United States Patent 8,461,315 (MICRORNAS AND USES THEREOF) - sequence listing, part 9

SEQ ID NO: 221462 - RNA, 64 nt, Homo Sapiens
auagcaacauugcauuuuggaugccauuugauuguaauaaaacuguggcaccuuaauuuugaau

SEQ ID NO: 221463 - RNA, 64 nt, Homo Sapiens
uaguguaaacugcaaauacuacagauaauucugauaauaaaaugauaugcacgcugaauccugc

SEQ ID NO: 221464 - RNA, 64 nt, Homo Sapiens
aaaaugcauaguaaaccacuaacguuagcuguuuuaauaaaaguuuucaguuauaaguuuagua

SEQ ID NO: 221465 - RNA, 64 nt, Homo Sapiens
uauuucaguuuuaagucaaaagguauucugaauauaauaaaagccucacaaauuauuuguaaaa

SEQ ID NO: 221466 - RNA, 64 nt, Homo Sapiens
auauuagaaaaaguccuuccaagaugauuuuggauaauaaaaguuguauuuguggaaauuggua

SEQ ID NO: 221467 - RNA, 64 nt, Homo Sapiens
aagauaaaucaggagauggcugauucauaauggguaauaaaauaaauagcacuuucgagcugau

SEQ ID NO: 221468 - RNA, 64 nt, Homo Sapiens
acuauuaagagcaauaaauucuguuguagaauaauaauaaaaaguucugaauuuugaguaucuu

SEQ ID NO: 221469 - RNA, 64 nt, Homo Sapiens
uucagaaaaaccuccauuuugcuucugcuaaauuuaauaaaaacguguuguucuugaugacauu

SEQ ID NO: 221470 - RNA, 64 nt, Homo Sapiens
ugaggacuccuuguaaaaaauuuauguccuauuauaauaaaagguugauauuacaaucauuuau

SEQ ID NO: 221471 - RNA, 64 nt, Homo Sapiens
cauaacacaaauaauuauucuaagguucaauauguaauaaaaaauucaaaccaacaaacucucu

SEQ ID NO: 221472 - RNA, 64 nt, Homo Sapiens
aucaacauugaaaacaguuucucuuccaaagccuuaauaaaaacuauuauguaaaauaauaaga

SEQ ID NO: 221473 - RNA, 64 nt, Homo Sapiens
auauugaaacuguuuuauaggauguaauaacugcuaauaaaauuauccucuaaaugugaauuuu

SEQ ID NO: 221474 - RNA, 64 nt, Homo Sapiens
ccacuuuauauaaaauugcuaugaaauguuucauuaauaaaaaauuauuucuacccuuaaugca

SEQ ID NO: 221475 - RNA, 64 nt, Homo Sapiens
gacaaugcuagugcauacuuguacuuauccauacuaauaaaauuggcaugucuuaauuaugcau

SEQ ID NO: 221476 - RNA, 64 nt, Homo Sapiens
agagaauuaaacuaccuaaacuuguauuagaacauaauaaaaguuucaguaaauacuaaaguua

SEQ ID NO: 221477 - RNA, 64 nt, Homo Sapiens
aaaagcccuuuaaacuuuguuuggaccuaaauaauaauaaaaaaugauuuuuaaaaacuuuuuu

SEQ ID NO: 221478 - RNA, 64 nt, Homo Sapiens
aacauguugaaacaagagaguaaauuuacauuuuuaauaaaagccccaaaugccaagguaauuu

SEQ ID NO: 221479 - RNA, 64 nt, Homo Sapiens
cuauaugacuuuuuauuauucuuuauuuccgaacuaauaaaaauaaaaagaccuuccugugaua

SEQ ID NO: 221480 - RNA, 64 nt, Homo Sapiens
uuggaaauugcuuuaaaccaccaguuucucuuauuaauaaaacuauucuuuaaucuguccaguc

SEQ ID NO: 221481 - RNA, 64 nt, Homo Sapiens
ucggcccuaaguaaagagcauuaaaauaggaacauaauaaaagaaaaaaaaaauaaaaagaauc

SEQ ID NO: 221482 - RNA, 64 nt, Homo Sapiens
aaaagcaauugcuauaugaaauaugcagaauguguaauaaaacaguaaaacaacugcuacauac

SEQ ID NO: 221483 - RNA, 64 nt, Homo Sapiens
acuacgccaagcucugaagggcacacuacacuauuaauaaaaauggaaucauuaaauacucucu

SEQ ID NO: 221484 - RNA, 64 nt, Homo Sapiens
uaauuauccuucuguucuuagaucuguaucuucauaauaaaaaauuuugcccaaguccuguuuc

SEQ ID NO: 221485 - RNA, 64 nt, Homo Sapiens
uauuauacuuuguacuuuugcccaaacguguaaauaauaaaaaaguuuuggcuuuuuucuuuag

SEQ ID NO: 221486 - RNA, 64 nt, Homo Sapiens
ucuuuuccguuccuuuuauuuaagucuuuuuauuuaauaaaaaaguuagcuauuucacuuaacg

SEQ ID NO: 221487 - RNA, 64 nt, Homo Sapiens
aaauuugcaccaaauuuaaguucauuguaagguuuaauaaaauugaaaaucauaugccacaaca

SEQ ID NO: 221488 - RNA, 64 nt, Homo Sapiens
cuuaaauuuguguuauuuuuuaugagauggauuauaauaaaauaucagaaaguauucucacaau

SEQ ID NO: 221489 - RNA, 64 nt, Homo Sapiens
ugaaagccaaaggauuuaagaguuuuguuguuguuaauaaaaggaauacuccuuuuccuuuugg

SEQ ID NO: 221490 - RNA, 64 nt, Homo Sapiens
ggccuccaggggcaauuccuaaaagcugaauggauaauaaaauuggacuggaaaguaaguaggu

SEQ ID NO: 221491 - RNA, 64 nt, Homo Sapiens
uaguuuauauuaauauaguuuuuuucucccuuuuuaauaaaauaauuacagucaucccucagug

SEQ ID NO: 221492 - RNA, 64 nt, Homo Sapiens
acuauuuuguuauauggaaugguuaauuuuuaccuaauaaaaacauagaugaaauacauuguau

SEQ ID NO: 221493 - RNA, 64 nt, Homo Sapiens
cuagagaagacaguauuggcaaucaugacaccuguaauaaaaacuugaauccaaagucaaaacu

SEQ ID NO: 221494 - RNA, 64 nt, Homo Sapiens
agcauuacugcaccucuuguuagacucugugcauuaauaaaacacaccuagagucuguugucau

SEQ ID NO: 221495 - RNA, 64 nt, Homo Sapiens
agacaaacccagauagauauaaggagguuaccuuuaauaaaagagaaggucuguucuugcucuc

SEQ ID NO: 221496 - RNA, 64 nt, Homo Sapiens
acaagcggugggacagaggguuucagggaaggucuaauaaaaaguuacguucguauuuaucuag

SEQ ID NO: 221497 - RNA, 64 nt, Homo Sapiens
ccuuaguuugagcauaauacguuguaaagccagcuaauaaaaugaaagccaagauauuauuuaa

SEQ ID NO: 221498 - RNA, 64 nt, Homo Sapiens
auuuuguggugaccauaagauuuggggaagguuauaauaaaagucaguuaaugcuaagaaaaga

SEQ ID NO: 221499 - RNA, 64 nt, Homo Sapiens
ucaaguaaugaauccaacugcuuaaaguugguauuaauaaaaagacaaccacauaguucguuua

SEQ ID NO: 221500 - RNA, 64 nt, Homo Sapiens
uaucuauauaaaauaacuaaaauguaucuaagaauaauaaaaucacguuaaaccaaauacacgu

SEQ ID NO: 221501 - RNA, 64 nt, Homo Sapiens
aguauuuauuguugacauuauucagaauuagugauaauaaaaagcagagugauuuuggucaauu

SEQ ID NO: 221502 - RNA, 64 nt, Homo Sapiens
uugaguuuguccauugcuagggagagacuuccaguaauaaaauuuacuauucuagaugcuucua

SEQ ID NO: 221503 - RNA, 64 nt, Homo Sapiens
cucagauuuuacucaacauuagagaguuaguacguaauaaaagcauuauaaaugcaauuuuugu

SEQ ID NO: 221504 - RNA, 64 nt, Homo Sapiens
aguaguauaucauuuuacuauuuguacuuuuauguaauaaaaugcaauguguuuaaaaauuuuu

SEQ ID NO: 221505 - RNA, 64 nt, Homo Sapiens
ucugcucauaucuuaacaucagcgaguugguauuuaauaaaagcauuaucaaugaaauuacugu

SEQ ID NO: 221506 - RNA, 64 nt, Homo Sapiens
auuguuauggacuacaggguuauuuuuauggucauaauaaaaauuacaaaaguaugaauaaaau

SEQ ID NO: 221507 - RNA, 64 nt, Homo Sapiens
uaucugcucacauguaaaaacaucaguucauacuuaauaaaaugcaauuaccgucaaaucuuuc

SEQ ID NO: 221508 - RNA, 64 nt, Homo Sapiens
aauuaauuaucauuuuguugauugugcuuuuauguaauaaaaugcaguacuuuaaaacauuuag

SEQ ID NO: 221509 - RNA, 64 nt, Homo Sapiens
auuugguuauguugauaaaccaaaaacauuugauuaauaaaauaucuauuugaauaaauuauga

SEQ ID NO: 221510 - RNA, 64 nt, Homo Sapiens
aguuuuaaacccaaaauauauacacauaguucuguaauaaaacuguuugacuucucaaguaaca

SEQ ID NO: 221511 - RNA, 64 nt, Homo Sapiens
aaaaagauggcuccaagcuaugucauguuaccuguaauaaaaucuuuucuucuagauucuuucu

SEQ ID NO: 221512 - RNA, 64 nt, Homo Sapiens
cccacugcauugaauuuuuugcuuauguuguuuauaauaaaacuuuucaauuaucucauauuug

SEQ ID NO: 221513 - RNA, 64 nt, Homo Sapiens
cucaaugcagcuucuccauggucauagguauuaauaauaaaagcccaaggcugguauuccuuga

SEQ ID NO: 221514 - RNA, 64 nt, Homo Sapiens
gaaagauugaauguucauguauauauaaacuauuuaauaaaaauacaccuugacauuucuuuuu

SEQ ID NO: 221515 - RNA, 64 nt, Homo Sapiens
cacuagcuuucguuccuuagauagauuuuaucguuaauaaaaaacuggaaaauuccugaacaau

SEQ ID NO: 221516 - RNA, 64 nt, Homo Sapiens
uguucguuuaucauuucagaauuuaaaaggaaaauaauaaaauaucuucauuuuuaaguaacug

SEQ ID NO: 221517 - RNA, 64 nt, Homo Sapiens
caaacaugacuguucuaugauuuugguuguauuauaauaaaauguaaaaauuguuaaauguaua

SEQ ID NO: 221518 - RNA, 64 nt, Homo Sapiens
gaaccagaacaaaucacucacuaaggaauaauuuuaauaaaaguuguuucacuauaaggaacag

SEQ ID NO: 221519 - RNA, 64 nt, Homo Sapiens
aggaaaacauaaugauguauaugggaaaauauuuuaauaaaacaaauaaauacuuuaauaagau

SEQ ID NO: 221520 - RNA, 64 nt, Homo Sapiens
aggacuuugguuuaaaguagugucagcuuuacaauaauaaaaaagugcuuaaaucagaguaaaa

SEQ ID NO: 221521 - RNA, 64 nt, Homo Sapiens
uauuuguauuuuuaaguuuuauuucaaaucuuuguaauaaaaauuaguucagacucauauaugg

SEQ ID NO: 221522 - RNA, 64 nt, Homo Sapiens
ugaagcacuucacuuuuuuuuauucaaagccauuuaauaaaacacaguuggucagcccagugca

SEQ ID NO: 221523 - RNA, 64 nt, Homo Sapiens
aucuucaccaguguucuaucuuguuccccuaaauuaauaaaauguuuuucuccaggauuuuggu

SEQ ID NO: 221524 - RNA, 64 nt, Homo Sapiens
cuguugcaauaacuuugcugaaauauuaacacauuaauaaaacuuuucuuaaacaaguugucuc

SEQ ID NO: 221525 - RNA, 64 nt, Homo Sapiens
uugaagcauaggauuuuucaaauauauuuauuauuaauaaaauaauaaaagaauucaugggcua

SEQ ID NO: 221526 - RNA, 64 nt, Homo Sapiens
uaggauuuuucaaauauauuuauuauuaauaaaauaauaaaagaauucaugggcuacaacuagc

SEQ ID NO: 221527 - RNA, 64 nt, Homo Sapiens
uaggauuuuuaaguauucccaaagaucugaaggguaauaaaauguacuggauuuuuuaaggugg

SEQ ID NO: 221528 - RNA, 64 nt, Homo Sapiens
ucucagaucacaagaaauacaaaucuauauaguauaauaaaaucagcaaaaagaucaacuaaug

SEQ ID NO: 221529 - RNA, 64 nt, Homo Sapiens
ucuagacccuucaucucuuacuugauagacuuacuaauaaaaugugaagacuagaccaauuguc

SEQ ID NO: 221530 - RNA, 64 nt, Homo Sapiens
aacuuaauaaauauuguauuuuagauauauucucuaauaaaauucagaauucuauucuggguua

SEQ ID NO: 221531 - RNA, 64 nt, Homo Sapiens
cugcucaacaagcucagaaauuaaauauuuuuaauaauaaaaaucuguucugguuauaaaccuu

SEQ ID NO: 221532 - RNA, 64 nt, Homo Sapiens
cuuugaaaaacucaggaaaaaaggaagauugaacuaauaaaauuuuauuucuuaaauauaaauu

SEQ ID NO: 221533 - RNA, 64 nt, Homo Sapiens
ugcaaagguaaucaugacuuaauacuuauauuuuuaauaaaagugguuguguaagagaauguug

SEQ ID NO: 221534 - RNA, 64 nt, Homo Sapiens
ucuuuccaguccuuggucaguguaaacguuucaguaauaaaacaucuuugaaacaacuuucucu

SEQ ID NO: 221535 - RNA, 64 nt, Homo Sapiens
uauuugugauguacuguaaguuuuguguuuaaguuaauaaaauuacagaauuuuucuucauuaa

SEQ ID NO: 221536 - RNA, 64 nt, Homo Sapiens
aucaccuuugucagaccauaucaaucuggggaaauaauaaaauuuauguacuacaugacaggca

SEQ ID NO: 221537 - RNA, 64 nt, Homo Sapiens
guucaugaaucggagacuaauagauauauuuuauuaauaaaaugacaaagaauauagaugauag

SEQ ID NO: 221538 - RNA, 64 nt, Homo Sapiens
aaguugguuauuaaugaaguaacuguaucugcucuaauaaaaaaguauaauguacaguuuucac

SEQ ID NO: 221539 - RNA, 64 nt, Homo Sapiens
ugacuuuguuuauuuaaaguucugccaauguacuuaauaaaacaauuuuggacagcacaugaag

SEQ ID NO: 221540 - RNA, 64 nt, Homo Sapiens
uuuaaucuuauuaaguguucuuuuaaaaaaauaauaauaaaauauuacgcugggaaagcugguu

SEQ ID NO: 221541 - RNA, 64 nt, Homo Sapiens
auuucagauguauuauaugauugugcccaaguaauaauaaaacuaggaacgggggaccauugca

SEQ ID NO: 221542 - RNA, 64 nt, Homo Sapiens
gauauaauuucuuaguaaaauauacuugaaaugauaauaaaaagcuaaucuauguugaacuuug

SEQ ID NO: 221543 - RNA, 64 nt, Homo Sapiens
aaagauuuuguaggcaacucuccauuccacucuauaauaaaacauaaaaccuaauuugucuuga

SEQ ID NO: 221544 - RNA, 64 nt, Homo Sapiens
uaauuugucuugauccauucaugaacuguuucauuaauaaaaccaagaaaugcgccggugggga

SEQ ID NO: 221545 - RNA, 64 nt, Homo Sapiens
caggaaccaaggcaaaaugauauugacaaucccauaauaaaacuaucaggaacaacuuucuccu

SEQ ID NO: 221546 - RNA, 64 nt, Homo Sapiens
auuaacuaggaaaaaacaguuacguagacagaaauaauaaaaauucagaauauuugaaguuucu

SEQ ID NO: 221547 - RNA, 64 nt, Homo Sapiens
accuaaaauaucuuuuuuguuggaaaaaaguuuauaauaaaaaaguuugucaucucuagugacu

SEQ ID NO: 221548 - RNA, 64 nt, Homo Sapiens
ggacuccucaucauauacuugguauauaauacucuaauaaaagcugccugaguugaauuguaua

SEQ ID NO: 221549 - RNA, 64 nt, Homo Sapiens
uugagaagguuacugagugaguuauugggagucuuaauaaaauaaacuagauauuagguccauu

SEQ ID NO: 221550 - RNA, 64 nt, Homo Sapiens
gcuaauuguacuaaucugagauuguguuuguucauaauaaaagugaagugaaucugauugcacu

SEQ ID NO: 221551 - RNA, 64 nt, Homo Sapiens
ugauugcauuuccucucauuaacaauuggguguguaauaaaaagcauuguacuucaucuuaaau

SEQ ID NO: 221552 - RNA, 64 nt, Homo Sapiens
agacagggacucuuuuuggaucucuauugacaaguaauaaaagucuggcccucauaacuuguuu

SEQ ID NO: 221553 - RNA, 64 nt, Homo Sapiens
caagauuucauuuacuuaagugccauguugaugauaauaaaacaauucguacuccccaauggug

SEQ ID NO: 221554 - RNA, 64 nt, Homo Sapiens
uuccacuguggaaauaaauguuuguaaauaaguguaauaaaaaucccuuugcauucuuucugga

SEQ ID NO: 221555 - RNA, 64 nt, Homo Sapiens
auaagagguuuagagauuuuguacaugaaaugucuaauaaaacuauuuuucuagauuaacuucu

SEQ ID NO: 221556 - RNA, 64 nt, Homo Sapiens
caggguuuggaagguuuuguuagauugcuuuguauaauaaaacauuucuuuuuaccuacuaaug

SEQ ID NO: 221557 - RNA, 64 nt, Homo Sapiens
uuaaaacaaauacgcuauuuuauccuaagcauuuuaauaaaaaguacgaaagaaagucaaucug

SEQ ID NO: 221558 - RNA, 64 nt, Homo Sapiens
ucaaaagauauaucuccuauauauucuacccuuauaauaaaagagauuuugaugaucuuaaucu

SEQ ID NO: 221559 - RNA, 64 nt, Homo Sapiens
guauuuuaaccuauuugggauuuauucuaacauuuaauaaaaauauuugugaauuguguauaaa

SEQ ID NO: 221560 - RNA, 64 nt, Homo Sapiens
uuuuaggagaauuugagaagauugcuucugaaaguaauaaaaaauguugauaccuugcaauagu

SEQ ID NO: 221561 - RNA, 64 nt, Homo Sapiens
agaaucuuuguauaucaaaaguacauugucaguguaauaaaaaccauuguaaauagucuuuguu

SEQ ID NO: 221562 - RNA, 64 nt, Homo Sapiens
agaagaagaaagaauaaagcagauaauauguuauuaauaaaaaugguugaacucugguuaaaca

SEQ ID NO: 221563 - RNA, 64 nt, Homo Sapiens
agacauuuuaugaaaucuucauugucaaaaccuuuaauaaaaguggaaauauuuugaaaugccc

SEQ ID NO: 221564 - RNA, 64 nt, Homo Sapiens
cauugagaauuucaacuagcuucugaucaauuuuuaauaaaaaauuuucaaaucauguuagcug

SEQ ID NO: 221565 - RNA, 64 nt, Homo Sapiens
uauuguacuucacuagugcugccagaggaauuguuaauaaaagcaccuucuuuaacaauaaaug

SEQ ID NO: 221566 - RNA, 64 nt, Homo Sapiens
ccaaugauuguagaccuugcuugaguauuuuuucuaauaaaacaaagcaaaucacauuuagcuu

SEQ ID NO: 221567 - RNA, 64 nt, Homo Sapiens
uuaugguggaaguauaaauaagccuaugaacuuauaauaaaacaaacuguagguagaaaaaaug

SEQ ID NO: 221568 - RNA, 64 nt, Homo Sapiens
cauacaaauuaaagugagagacaugguuacuguguaauaaaagaaaaaauacuuguucagguaa

SEQ ID NO: 221569 - RNA, 64 nt, Homo Sapiens
aagaaaaaauacuuguucagguaauucuaauucuuaauaaaacaaaugaguaucauacagguag

SEQ ID NO: 221570 - RNA, 64 nt, Homo Sapiens
uaaucucacuaauuuucaugauaaaugaaguuuuuaauaaaauauacuuguuauuaguaauuuu

SEQ ID NO: 221571 - RNA, 64 nt, Homo Sapiens
auguagggauaucagcguuucucugugugcuuguuaauaaaacuauauaaaaauuaaaauuuuc

SEQ ID NO: 221572 - RNA, 64 nt, Homo Sapiens
aaaaaacgggcuagucccuaucaggucacauuguuaauaaaaaauagacuuuaaagaauuguga

SEQ ID NO: 221573 - RNA, 64 nt, Homo Sapiens
uugugcaauauauucaaagaaaaccuuuuuuuaauaauaaaauaaacuuuuugccugagacaua

SEQ ID NO: 221574 - RNA, 64 nt, Homo Sapiens
auaaaggagaauuauucaauauauuucagucacuuaauaaaagauguagcuaaauaaaguacau

SEQ ID NO: 221575 - RNA, 64 nt, Homo Sapiens
aagaaaaauuaauacuaucaugaagagcuaauuuuaauaaaaauagauuuguuaguaacaaucu

SEQ ID NO: 221576 - RNA, 64 nt, Homo Sapiens
caagauuuguuaguaacaauuugccccagcacaguaauaaaaauagaacuuagugauuaaaauc

SEQ ID NO: 221577 - RNA, 64 nt, Homo Sapiens
uggauuuaauuuuauaaaauuaaccugaaauccuuaauaaaauuuucuagaaauuugaaguaug

SEQ ID NO: 221578 - RNA, 64 nt, Homo Sapiens
acauugaauugauuuuuagaagauuuccugcucuuaauaaaauuuugucauuagaggaaggucu

SEQ ID NO: 221579 - RNA, 64 nt, Homo Sapiens
cuugguuuuuauuugcuugugucucaauuuuaauuaauaaaauaauagucuuaguugguuuagg

SEQ ID NO: 221580 - RNA, 64 nt, Homo Sapiens
agugagcugaacucaccugaaaaaaaaaaaauaauaauaaaauacagagcaagacucugucuca

SEQ ID NO: 221581 - RNA, 64 nt, Homo Sapiens
auugcagauugcuaaguagccuuaauuguaaucauaauaaaacaaaugagaaaauaaaauauuu

SEQ ID NO: 221582 - RNA, 64 nt, Homo Sapiens
gacacagaguuaagauaguugcuuuucuuuuaauuaauaaaacaaucacagccugcauuaauuu

SEQ ID NO: 221583 - RNA, 64 nt, Homo Sapiens
uuucuugagacaaacaaaaaaagaaauuccaaaguaauaaaacuuaaauacaaaaaaaaaaaag

SEQ ID NO: 221584 - RNA, 64 nt, Homo Sapiens
cuauugcaaaaauuucuuuuuuugagaaagguguuaauaaaauuuuucugucauggaaaccuug

SEQ ID NO: 221585 - RNA, 64 nt, Homo Sapiens
gcauuaggucuaucuagccaauagauagauggcuuaauaaaauaaguauaaaaacaacaauucu

SEQ ID NO: 221586 - RNA, 64 nt, Homo Sapiens
ucacaaaguuaucuucuuuaauuaaaauaauaucuaauaaaaagagugauccaaaauuugaaau

SEQ ID NO: 221587 - RNA, 64 nt, Homo Sapiens
uuaguaguuuaaacaauuucuuuauuuguauuaguaauaaaacaaucuguauaaaugugaaauu

SEQ ID NO: 221588 - RNA, 64 nt, Homo Sapiens
cugcaccuaauccccauaacacugcuguauaagguaauaaaacuguuuuauuguaaucauaaau

SEQ ID NO: 221589 - RNA, 64 nt, Homo Sapiens
uuacaggucacuuuaaaagcuguauuaaugauuauaauaaaaaggcacugcuaccuucuuugau

SEQ ID NO: 221590 - RNA, 64 nt, Homo Sapiens
uuuuaaggggcuauuaauauauuuaaguaaaugguaauaaaauaauguacauuaucuaucguuc

SEQ ID NO: 221591 - RNA, 64 nt, Homo Sapiens
uuugucauguguuugaagaaacuuauaagcacaguaauaaaagagguuuuccguaaaccguguc

SEQ ID NO: 221592 - RNA, 64 nt, Homo Sapiens
uaaaguggaaguuauugccaguuauauuuuuauauaauaaaagcuuuguauauaaugaaauuuu

SEQ ID NO: 221593 - RNA, 64 nt, Homo Sapiens
acugcaagaaaauaggguagcaauaguuuuuaucuaauaaaagccuaaaaagucaaaacguuaa

SEQ ID NO: 221594 - RNA, 64 nt, Homo Sapiens
cauuuagaaacuuuuaaaguuuuuacuuagauacuaauaaaauauccauauagaaaucuagaau

SEQ ID NO: 221595 - RNA, 64 nt, Homo Sapiens
aggcuuuuuuagaggaagacauagaauaaugcauuaauaaaauguauaauagauaucuaucgcu

SEQ ID NO: 221596 - RNA, 64 nt, Homo Sapiens
uuauuaugucaaccagugagaaacguauuaucuuuaauaaaauguggcagauuugauuuuuaaa

SEQ ID NO: 221597 - RNA, 64 nt, Homo Sapiens
uggugcagauaaaaugucaauuuuuugauuuuuguaauaaaaauauauuguaaugaauuuuuac

SEQ ID NO: 221598 - RNA, 64 nt, Homo Sapiens
gcauuaaguuuuugauuuugaauuuugacucucuuaauaaaacuuauauccaguuaacugagag

SEQ ID NO: 221599 - RNA, 64 nt, Homo Sapiens
uaaauacuaauguauuaaguauuuaaguacuuucuaauaaaaucuuuaacaauaauaauguaaa

SEQ ID NO: 221600 - RNA, 64 nt, Homo Sapiens
gaccaucgugacuaacacagugaaaccccgucucuaauaaaaauacgaaaaauuagccaggcgu

SEQ ID NO: 221601 - RNA, 64 nt, Homo Sapiens
uaaacauuguugcccuucaacaaggcucuugaauuaauaaaauuauagucucuaagaauuccac

SEQ ID NO: 221602 - RNA, 64 nt, Homo Sapiens
uacauacauuguaucuuuguuuuaugguaauaaguaauaaaaauguagacuucauauuuuguac

SEQ ID NO: 221603 - RNA, 64 nt, Homo Sapiens
ugaaauuauuuagaacgggguaucaccauaaaaguaauaaaaaacuccuuuacugccaauuaac

SEQ ID NO: 221604 - RNA, 64 nt, Homo Sapiens
uuaggguuugguuuuuacuagaauuuguauuauuuaauaaaauugacuuacauguagugaaaua

SEQ ID NO: 221605 - RNA, 64 nt, Homo Sapiens
ggacuuuaguugaacuucauauuguaagaacuguuaauaaaaguugucaaguaaaaagcgcuau

SEQ ID NO: 221606 - RNA, 64 nt, Homo Sapiens
aagcuuguuauuugucaugcaccagcauuggagauaauaaaauuucuuguucuguguauuuugu

SEQ ID NO: 221607 - RNA, 64 nt, Homo Sapiens
gccuuaaucucuacaacaguauaucaggaauuuauaauaaaauuagaacaggcagggguggaau

SEQ ID NO: 221608 - RNA, 64 nt, Homo Sapiens
ugagccaucugagugaguccaaccuucaagucccuaauaaaacaggauugacuacauauuuuua

SEQ ID NO: 221609 - RNA, 64 nt, Homo Sapiens
auauggcacaccuuuuguuuuguuuucuaugauuuaauaaaaauugaaaagauuuguauacaaa

SEQ ID NO: 221610 - RNA, 64 nt, Homo Sapiens
cauucuuaaaguugaggguugugguugauguaaguaauaaaaaaguuaacuaucuuuuaaauuc

SEQ ID NO: 221611 - RNA, 64 nt, Homo Sapiens
ugacuuuuauauuaugggagggaaaaaauaacauuaauaaaaaggugauaaaaaagcacuguuu

SEQ ID NO: 221612 - RNA, 64 nt, Homo Sapiens
uucuauuuuuuucuuuuuuuccaaaaaaagaaaguaauaaaaacuuaaauucuuuguaccaguu

SEQ ID NO: 221613 - RNA, 64 nt, Homo Sapiens
uagucaagguguuuugauaugguauuaaaaugucuaauaaaagauggcacugcgugauuuuauu

SEQ ID NO: 221614 - RNA, 64 nt, Homo Sapiens
ucuuucaacuuuucuguauguuuggaauuuuucuuaauaaaagauugugggaaauggucauuug

SEQ ID NO: 221615 - RNA, 64 nt, Homo Sapiens
uaaaacaagaauaguuauacgagcuguuccaguauaauaaaauaaggcaagagacagaggacac

SEQ ID NO: 221616 - RNA, 64 nt, Homo Sapiens
gggggagaugugggcggcaaauggcgauucuaguuaauaaaaagaacaacaagcaaugauggcg

SEQ ID NO: 221617 - RNA, 64 nt, Homo Sapiens
gugaucaaacuuaaaagucauugccauucaucauuaauaaaaguugccauuucaacuacguccc

SEQ ID NO: 221618 - RNA, 64 nt, Homo Sapiens
aagacccugucuccgaaacaaauaaaaaauacuguaauaaaaguacuuauaaacauacuaaucc

SEQ ID NO: 221619 - RNA, 64 nt, Homo Sapiens
ucaugugacuuuucuguacuguuaaacuucauuguaauaaaaugagagaaaaauuuaugccuuu

SEQ ID NO: 221620 - RNA, 64 nt, Homo Sapiens
uuuguacagaugcaugccacaguagauguccacauaauaaaauucauaguuaccaaugcaguuu

SEQ ID NO: 221621 - RNA, 64 nt, Homo Sapiens
aaauaaauaaaaaauaaaaauguaaauaugauaguaauaaaauagagcauaacgaaacugugaa

SEQ ID NO: 221622 - RNA, 64 nt, Homo Sapiens
uguuuuaaaaaaauaauuaaaaaacaguuggcguuaauaaaaaugucaaugugaaacugauguc

SEQ ID NO: 221623 - RNA, 64 nt, Homo Sapiens
uaucucacaauaaguuaacuaaucuugaagaaaauaauaaaauugauuuauuggguuucuuaaa

SEQ ID NO: 221624 - RNA, 64 nt, Homo Sapiens
gggacaucccgacuuacguuguuaacacaaguacuaauaaaagauuuauaugcaguauagaaaa

SEQ ID NO: 221625 - RNA, 64 nt, Homo Sapiens
uucuuucaauaaagauacuaugugcccuucauaguaauaaaaucucaaucuuaaagcaugaauc

SEQ ID NO: 221626 - RNA, 64 nt, Homo Sapiens
auugaaguuuugguaaaaauucuuuuuucuuuuuuaauaaaaaauuagguuauuacuuuuuuua

SEQ ID NO: 221627 - RNA, 64 nt, Homo Sapiens
uucuuugguugucccuauuaacaaaaaaguauuuuaauaaaaaauugaaaugagugagucauau

SEQ ID NO: 221628 - RNA, 64 nt, Homo Sapiens
ugaagucaccguuacaguaacuugauguguauauuaauaaaaguaauucagucauuuuaguuuu

SEQ ID NO: 221629 - RNA, 64 nt, Homo Sapiens
cuuuucuacacugaacauuuuuuuuaacuugauuuaauaaaaauguuaauuuuggaagugcagu

SEQ ID NO: 221630 - RNA, 64 nt, Homo Sapiens
ggggccaguaaaucaguagacugaacauucaauauaauaaaagaacauggggauuuuguauaac

SEQ ID NO: 221631 - RNA, 64 nt, Homo Sapiens
auaaaagaacauggggauuuuguauaaccagggauaauaaaaagaaaaaagaaguuaauuuuua

SEQ ID NO: 221632 - RNA, 64 nt, Homo Sapiens
uuccauuuaaaaugucuugggauaucuggaucaguaauaaaauauuucaaaggcacagauguug

SEQ ID NO: 221633 - RNA, 64 nt, Homo Sapiens
gccuuugcuuuaccacucuuuccuuuuaucuuauuaauaaaaauguuggucuccaccacugacu

SEQ ID NO: 221634 - RNA, 64 nt, Homo Sapiens
gguuaaaaauugagucuuucgagcuuccaggguuuaauaaaacucgauguuuucccguguugua

SEQ ID NO: 221635 - RNA, 64 nt, Homo Sapiens
gggaaggugggucuuaaaacauauuugaugucuguaauaaaaguagaacaggucucacaaguau

SEQ ID NO: 221636 - RNA, 64 nt, Homo Sapiens
aucuaaucaaagaauauuauuggaaaaaauguuguaauaaaauagcacaggaaaugacugguaa

SEQ ID NO: 221637 - RNA, 64 nt, Homo Sapiens
ucccuccauggcuaagagggaaaaaaaaaugugcuaauaaaacucuccucuucccuugggggaa

SEQ ID NO: 221638 - RNA, 64 nt, Homo Sapiens
gcucacauuuuacucaacacagagaguuccugcuuaauaaaagcauuauaagugcaauuacugu

SEQ ID NO: 221639 - RNA, 64 nt, Homo Sapiens
auuuuuauuuaccacaguguuauuuuuaucgucauaauaaaaauuauauacgaguauaaaugaa

SEQ ID NO: 221640 - RNA, 64 nt, Homo Sapiens
ggaaaugacagaugugacuuuggaaccaaacuuguaauaaaaggaauuccaaauggacaagcag

SEQ ID NO: 221641 - RNA, 64 nt, Homo Sapiens
ucugucaccccuucuuagugucgaguguauuuauuaauaaaagcuuauuagaguguagaaaugc

SEQ ID NO: 221642 - RNA, 64 nt, Homo Sapiens
aaaaauuaaagcugcaaaagaaauaaaaugguguuaauaaaaauuuggcaucuaauaaaaucau

SEQ ID NO: 221643 - RNA, 64 nt, Homo Sapiens
agaaauaaaaugguguuaauaaaaauuuggcaucuaauaaaaucauuuuguauaucaugaacuc

SEQ ID NO: 221644 - RNA, 64 nt, Homo Sapiens
aauauuuaugaacuauauuucucauugcacucuguaauaaaaagcaguuaguuguuacuuaccu

SEQ ID NO: 221645 - RNA, 64 nt, Homo Sapiens
gauggauauuuguauuuuuuauacuuuuguguaauaauaaaaauacugcuguaaauauucuugu

SEQ ID NO: 221646 - RNA, 64 nt, Homo Sapiens
uuauggacacugagcuugaaucauggcuauguuuuaauaaaacuagacaaucauaaaugaauga

SEQ ID NO: 221647 - RNA, 64 nt, Homo Sapiens
uuacagacacugaacuugaaucauggcuauguuuuaauaaaacuagacaaucauaaaugaauga

SEQ ID NO: 221648 - RNA, 64 nt, Homo Sapiens
auaacauaauuuuuuuuuuuaauauauacuuauauaauaaaaguauguaacauacuuuuauuaa

SEQ ID NO: 221649 - RNA, 64 nt, Homo Sapiens
ccuacauuucugaggccugaguuauguagaaguauaauaaaaucuuuuuauggucauaauaaaa

SEQ ID NO: 221650 - RNA, 64 nt, Homo Sapiens
uauguagaaguauaauaaaauauuuuuauggucauaauaaaaguauuguuauugauuacagugu

SEQ ID NO: 221651 - RNA, 64 nt, Homo Sapiens
uuuaaaaucaaaaccaaaauguuugaaauuucaauaauaaaaugauauuucuacuuuuguaugu

SEQ ID NO: 221652 - RNA, 64 nt, Homo Sapiens
gggucuaucagacaacacacaucuguuuuaaccuuaauaaaaauggccaccucugaacccuuug

SEQ ID NO: 221653 - RNA, 64 nt, Homo Sapiens
aauauaucagacaucgacauauucuauguuuuuauaauaaaaaucugaauuauguaugaaaauu

SEQ ID NO: 221654 - RNA, 64 nt, Homo Sapiens
gaaggacaggaggaagacagauaaauguaucuuauaauaaaaagucuuuucuucuauggggucu

SEQ ID NO: 221655 - RNA, 64 nt, Homo Sapiens
auuucaaguaaauauuugaaccugcaaguaaucuuaauaaaaucaauguauuuggaggagaaau

SEQ ID NO: 221656 - RNA, 64 nt, Homo Sapiens
acagugaugagcaugccuaauauggucaggaauuuaauaaaaguuaaggcuuauaaaauaugag

SEQ ID NO: 221657 - RNA, 64 nt, Homo Sapiens
aagaaauaaaauuacaggagagagcaaaaauuaguaauaaaaauuagcuacagugacagauuuu

SEQ ID NO: 221658 - RNA, 64 nt, Homo Sapiens
aagaaauagcuacagugacagucuaaauguuuguuaauaaaaauuacguacuaccuaaaaggau

SEQ ID NO: 221659 - RNA, 64 nt, Homo Sapiens
accaucaauauugaaauuaaacuuccaacuucucuaauaaaaaauuaaaacacgcauaacacuc

SEQ ID NO: 221660 - RNA, 64 nt, Homo Sapiens
cuuuuggcacuaacaucucaugaaaaauuaugguuaauaaaauaucaccacauuuggauugcca

SEQ ID NO: 221661 - RNA, 64 nt, Homo Sapiens
gcaaacauccugugucugcuuugauggagaucuguaauaaaagaagguggcaaccaccugaauu

SEQ ID NO: 221662 - RNA, 64 nt, Homo Sapiens
aaaaugauaauuaaaaugcuguaaccaacuuaucuaauaaaauuggcaaccagccacuauuuug

SEQ ID NO: 221663 - RNA, 64 nt, Homo Sapiens
augauggauuuuauuucacucacacuccaguuuguaauaaaaugccaaauucugucagcuaucc

SEQ ID NO: 221664 - RNA, 64 nt, Homo Sapiens
uuucuaagaugcugcgaucccguucugcugcccguaauaaaaaugcucucagacacugguuagu

SEQ ID NO: 221665 - RNA, 64 nt, Homo Sapiens
uguauuuugaaccaaucuacaagucucugucuuuuaauaaaagaacuuuacacauuuguaaaaa

SEQ ID NO: 221666 - RNA, 64 nt, Homo Sapiens
uuccuaaaauuaacacacauuauuauugcuagaauaauaaaaguuuuauaaaaaagaagcaaca

SEQ ID NO: 221667 - RNA, 64 nt, Homo Sapiens
uuugaggcucaccagaauuauuuuuaagugguuuuaauaaaauaauaaaauuuccccuaaucuu

SEQ ID NO: 221668 - RNA, 64 nt, Homo Sapiens
ucaccagaauuauuuuuaagugguuuuaauaaaauaauaaaauuuccccuaaucuuuucugaau

SEQ ID NO: 221669 - RNA, 64 nt, Homo Sapiens
cuauaaguuuuuuaauuaacaucacuagugacacuaauaaaauuaacuucuuagaaugcaugau

SEQ ID NO: 221670 - RNA, 64 nt, Homo Sapiens
aaaucagaaaacaaaaugaugugcuuuggucaguuaauaaaaaugguuuuacccacuauagugu

SEQ ID NO: 221671 - RNA, 64 nt, Homo Sapiens
aguuggauuuuuguguauguuuuauuuauguauguaauaaaaaaguggucauuuaaagucaaua

SEQ ID NO: 221672 - RNA, 64 nt, Homo Sapiens
cauguguuucucuuauggauugcuauuaaugggcuaauaaaaaaugguguuauuggaagaaaaa

SEQ ID NO: 221673 - RNA, 64 nt, Homo Sapiens
aaaguauauaauucaauggucaccauuuuaauuauaauaaaaauaauuaauauaaaguaaaauu

SEQ ID NO: 221674 - RNA, 64 nt, Homo Sapiens
acucugacgaugauuguguuuacuggauuuaucuuaauaaaaagauaugugaauacacaaauuu

SEQ ID NO: 221675 - RNA, 64 nt, Homo Sapiens
auauucugugucaagcacugguucagccacaauuuauugagaaauguggaugcuucguuaauuu

SEQ ID NO: 221676 - RNA, 64 nt, Homo Sapiens
uuuaagguugaauguuugucaaaucugauuggcauauugagauaauuugugaauaaauuuuuag

SEQ ID NO: 221677 - RNA, 64 nt, Homo Sapiens
gaaucugggggcauuggagggaggggguuuuauuuauugagaaauggacuucgccugaggcugu

SEQ ID NO: 221678 - RNA, 64 nt, Homo Sapiens
uguuuuguguucucuaugucaaaguuuaguuuuauauugagaauguuaacuuauugcuuuguau

SEQ ID NO: 221679 - RNA, 64 nt, Homo Sapiens
aguuuggacaucuggccuuaaaauaucaccuccuuauugagacagcacgugggaaacuuuagua

SEQ ID NO: 221680 - RNA, 64 nt, Homo Sapiens
aaaugaauaugauacaaauguuaaaugucccagguauugagaauuuaauucauuauugaaugcc

SEQ ID NO: 221681 - RNA, 64 nt, Homo Sapiens
aauauccuuucuccacggaagucccacugcugauuauugagaaauugcuuguggaucuccacuu

SEQ ID NO: 221682 - RNA, 64 nt, Homo Sapiens
ucauucacaugccauucaguuuaacuaacagcuuuauugagauggaggagaagcggggaguggg

SEQ ID NO: 221683 - RNA, 64 nt, Homo Sapiens
gacuuugccccauggcagaacucugcuggaauccuauugagaagguagacauugugcuuuauua

SEQ ID NO: 221684 - RNA, 64 nt, Homo Sapiens
ccauucccaugccaugaagacaccaaggcagcccuauugagaaaucuaccugucguggccgggc

SEQ ID NO: 221685 - RNA, 64 nt, Homo Sapiens
uuuauauuuauagagcaucaaucaauauaagcauuauugagaaaaaugugacccguaacacugu

SEQ ID NO: 221686 - RNA, 64 nt, Homo Sapiens
acuguucggcugaauuugaagauuggaagacuuauauugagaccaguaacuuuacuguaaauuu

SEQ ID NO: 221687 - RNA, 64 nt, Homo Sapiens
cugucucuacaaaaaaauuugucucuaaaaagcauauugagacugggcaacauauugagacucu

SEQ ID NO: 221688 - RNA, 64 nt, Homo Sapiens
cugucucuaaaaagcauauuagaucugggcaacauauugagacuugcuugaguucagaaguuug

SEQ ID NO: 221689 - RNA, 64 nt, Homo Sapiens
ugcuuuuuuccuguguuaguuuuaucuaaauaaauauugagaugagcagugacaaucuacaccc

SEQ ID NO: 221690 - RNA, 64 nt, Homo Sapiens
cuacaguagugugagcguauuuaaauucaaucauuauugagaacaguggauuuuauuucauggu

SEQ ID NO: 221691 - RNA, 64 nt, Homo Sapiens
aaugaauauaauaguucaguaguauuuuaagagguauugagacugucuauuuucuaaaguuuua

SEQ ID NO: 221692 - RNA, 64 nt, Homo Sapiens
cuuuguggcuauugguguguucugggaacauuuauauugagauuaaacaaacaaauacacuauu

SEQ ID NO: 221693 - RNA, 64 nt, Homo Sapiens
cuuaugaugguggcauugccaaagugauaggaauuauugagaaauuaauacaugaaaaugcuua

SEQ ID NO: 221694 - RNA, 64 nt, Homo Sapiens
aauacaugaaaaugcuuaaaaugcuauuaaaauauauugagauugguuuuuugagaccauaugu

SEQ ID NO: 221695 - RNA, 64 nt, Homo Sapiens
acugcucauggcauuuguugggcaaagaggaauuuauugagaucgacuggcuuuuauagugaca

SEQ ID NO: 221696 - RNA, 64 nt, Homo Sapiens
uggcuauguuaauaaauauuucauaaaucuucuauauugagaauaaguggaaguauuaggagau

SEQ ID NO: 221697 - RNA, 64 nt, Homo Sapiens
aaauuuucuaaaauuacaugagaauaaauuuuuuuauugagaauuauuguauuaaccauuauug

SEQ ID NO: 221698 - RNA, 64 nt, Homo Sapiens
aaauuuuuuuauugagaauaauuguauuaaccauuauugagaauuuuaaugcuguuucugaguu

SEQ ID NO: 221699 - RNA, 64 nt, Homo Sapiens
guauuuuuuuucucuggaucaguuggacauguuuuauugagaauaaugucaccacuaucuggag

SEQ ID NO: 221700 - RNA, 64 nt, Homo Sapiens
augugguuuucaucuuucaugcuuuuucuccauguauugagauggauguugaauuuugugaaau

SEQ ID NO: 221701 - RNA, 64 nt, Homo Sapiens
ugauugcuauuuuggggggcuggaguggguagaguauugagaccuuuuuuauuagggugcuguu

SEQ ID NO: 221702 - RNA, 64 nt, Homo Sapiens
guauugagaccuuuuuuauuagggugcuguuuguuauugagagcccaaucucugcaugaauaac

SEQ ID NO: 221703 - RNA, 63 nt, Homo Sapiens
guuuggcccauggggcccccccaggccccugccccaacugauucugcccagauaaucgugucu

SEQ ID NO: 221704 - RNA, 63 nt, Homo Sapiens
cacaacaggacugagcagaaccaaacacuucuuccaacugacucugcucccugcccucaccau

SEQ ID NO: 221705 - RNA, 63 nt, Homo Sapiens
ucuauugcuaggguaaaauaaauacauuuguguccaacugaaauauaauugucauuaaaauaa

SEQ ID NO: 221706 - RNA, 63 nt, Homo Sapiens
gagagguuaguuuuuuuccuacacuuuuuuuugccaacugacuuaacaacauugcugucaggu

SEQ ID NO: 221707 - RNA, 62 nt, Homo Sapiens
acacaccaaccugcuggcuuuagaauaaaagcaccaacugaacugagaugugugguguggua

SEQ ID NO: 221708 - RNA, 63 nt, Homo Sapiens
uggacuuuccacuguaggaguggacauuucaagccaacugagccuuuuccucaagugccgaca

SEQ ID NO: 221709 - RNA, 63 nt, Homo Sapiens
auuucauauucuacagaaguaaaucagguuucaccaacugaaaugucucccuuugaaaguagc

SEQ ID NO: 221710 - RNA, 63 nt, Homo Sapiens
ugaaaauacaucuaucccucauuuugagagccuccaacugauccaagugucauccggaggagg

SEQ ID NO: 221711 - RNA, 63 nt, Homo Sapiens
aagaugagccucgauuuuaaaaucuauccacauccaacugauggcaccauugaugugcaaaua

SEQ ID NO: 221712 - RNA, 63 nt, Homo Sapiens
gguauacuguuuuagucuugaauugccaacuuuccaacugaucuauccauauuccuuaaguac

SEQ ID NO: 221713 - RNA, 63 nt, Homo Sapiens
aaacccuaucuuucacuuuacauuccuuucaauccaacugaucaaaacugguacccacacuug

SEQ ID NO: 221714 - RNA, 63 nt, Homo Sapiens
cagaagguuuggguacauuacagcuuggguuuuccaacugacuuaggauuucugacuuuuuau

SEQ ID NO: 221715 - RNA, 63 nt, Homo Sapiens
auccacauuugguguugcagaugaguuguaaagccaacugaaagaguuccuucaagaaguucc

SEQ ID NO: 221716 - RNA, 63 nt, Homo Sapiens
uggggcgcugcuccccacaguccccagcggccaccaacugacccucaccccacuccagggccu

SEQ ID NO: 221717 - RNA, 63 nt, Homo Sapiens
ucaagggcuguagguucaugauuucccuacuccccaacugaguugaaucgcugcgauacuggc

SEQ ID NO: 221718 - RNA, 63 nt, Homo Sapiens
cauugaauuuaaaauagagcggugccaguuuuuccaacugauuuuccuuccauaucuuuagca

SEQ ID NO: 221719 - RNA, 63 nt, Homo Sapiens
ucuuguauauucuguuagaugucauaaauuuucccaacugaagcuuuuuugcccuuucaugga

SEQ ID NO: 221720 - RNA, 63 nt, Homo Sapiens
uaggagacugacugugaguguauccagucugugccaacugaaguucccaucccaggagcucau

SEQ ID NO: 221721 - RNA, 63 nt, Homo Sapiens
accugagauggagauauguuaaguaagagccaaccaacugaaauuaaaguacuugggcuucag

SEQ ID NO: 221722 - RNA, 63 nt, Homo Sapiens
cauauaacguuuucaucuccuagagcauuuugaccaacugaaaugcaauauucaguaucaaau

SEQ ID NO: 221723 - RNA, 63 nt, Homo Sapiens
uuaguaaaauccuuuuuagaagguauuuuuuuuccaacugaguagugaaaaucaacaaggugc

SEQ ID NO: 221724 - RNA, 63 nt, Homo Sapiens
uaguauuugaaaaucagugugauuccuuaauggccaacugaagauugaauugccgcuaacaac

SEQ ID NO: 221725 - RNA, 63 nt, Homo Sapiens
uucuucauagggaccuuuaaaaagcaggaaauaccaacugaagucaauuugggggacaugcua

SEQ ID NO: 221726 - RNA, 63 nt, Homo Sapiens
ugucgaaagagcuggcugggggccuugcccaaaccaacugaggucuuaaaguccagggaaaaa

SEQ ID NO: 221727 - RNA, 63 nt, Homo Sapiens
agauggaaauuucuuuuuaggcuaauuugaaauccaacugaagcuuuuuaaccaauauuuuaa

SEQ ID NO: 221728 - RNA, 63 nt, Homo Sapiens
acucaaaauugcaaauauaaacaaaagaaaaauccaacugaaaauaacacuaaguauuuuuga

SEQ ID NO: 221729 - RNA, 63 nt, Homo Sapiens
guucaacauuuuugaauacauuaaaagaaguaaccaacugaacgacaaagcaugguauuugaa

SEQ ID NO: 221730 - RNA, 63 nt, Homo Sapiens
acguuccauacccccacaugccaauuucagcacccaacugagauccgaggagcuccugggaag

SEQ ID NO: 221731 - RNA, 63 nt, Homo Sapiens
gaaugagacaauuccuugggcuguaguuuggacccaacugaauccugagugcucuguggcuga

SEQ ID NO: 221732 - RNA, 63 nt, Homo Sapiens
cuucaaaaagccacuuuuccccuauccugauccccaacugaagcuccuacccuuccagggacc

SEQ ID NO: 221733 - RNA, 63 nt, Homo Sapiens
gugaacuuguucauucaccuauccuuaaucuggccaacugaaaucucaauuaaaaagaagugu

SEQ ID NO: 221734 - RNA, 63 nt, Homo Sapiens
gggcagcugaagcucacggugacucagcagugcccaacugaccaaucucccgcagcucuccug

SEQ ID NO: 221735 - RNA, 63 nt, Homo Sapiens
ugcuucucccauguaccagggcaccaggcccacccaacugaaggcauggcggcggggugcagg

SEQ ID NO: 221736 - RNA, 63 nt, Homo Sapiens
caauucauuuuucucuucuaaagguagucuuucccaacugacuguaggguugugucuuuuccc

SEQ ID NO: 221737 - RNA, 63 nt, Homo Sapiens
uggucagccuuuuuggguaacacaguuaauuuaccaacugauacagauaauagaauauauuca

SEQ ID NO: 221738 - RNA, 63 nt, Homo Sapiens
aaugggaaauaaaaugugguacccaaaugucuaccaacugaugauagccaaaaaguggaaaca

SEQ ID NO: 221739 - RNA, 63 nt, Homo Sapiens
gaagucuugaccuugauaccuucaguuccccacccaacugacugcccucccaugucugcuggu

SEQ ID NO: 221740 - RNA, 63 nt, Homo Sapiens
ugcuuagguaccuggcagcuuguccugcuguacccaacugacugcuacccuggaaugguggcg

SEQ ID NO: 221741 - RNA, 63 nt, Homo Sapiens
uaccagaaaaugacauucugccucuccugcaggccaacugaaaguguugucauucaaggacuu

SEQ ID NO: 221742 - RNA, 63 nt, Homo Sapiens
aaaaaauucucaggcuuuacccuugcagaagaaccaacugaaauaucuuugcagguaucacag

SEQ ID NO: 221743 - RNA, 63 nt, Homo Sapiens
caauguaacaguguaaucuacaucaggaagcucccaacugaagcucaugagcacuauaauaac

SEQ ID NO: 221744 - RNA, 63 nt, Homo Sapiens
gccguaaaaccuuuguugcucucauuuguucuuccaacugaaaaguucagcugcugucacagu

SEQ ID NO: 221745 - RNA, 63 nt, Homo Sapiens
ggguccacuuucugagaugcuuucuaaaaccaaccaacugauaaaaaguagaugagacuucuc

SEQ ID NO: 221746 - RNA, 63 nt, Homo Sapiens
cacauucaauauuuugauucuugcacaauaaagccaacugauugcaacugauucuuugagagg

SEQ ID NO: 221747 - RNA, 63 nt, Homo Sapiens
ccaccuggaccuccauuuuucccuguaaauucuccaacugauccuacccucccuacuccugca

SEQ ID NO: 221748 - RNA, 63 nt, Homo Sapiens
gaacccugaaacaaagauaaugauuuggaccacccaacugaaguggcauguuauguuuuuggc

SEQ ID NO: 221749 - RNA, 63 nt, Homo Sapiens
gugauugauguagggaaaugggagaggcacuuuccaacugaaggaguuuugaucucuuuuuaa

SEQ ID NO: 221750 - RNA, 63 nt, Homo Sapiens
ugccaacaaaauaaaaauaaauaaauguugaaaccaacugaacugguauauaguaggugcuca

SEQ ID NO: 221751 - RNA, 63 nt, Homo Sapiens
gucacuuaaaugaaaauuuaauuuaauuugcucccaacugauuuuuuuucaccuuaagggagg

SEQ ID NO: 221752 - RNA, 63 nt, Homo Sapiens
ugcaugcccaggacacaaguuucacauuuuaccccaacugaccgaauggcuaugaagcgucau

SEQ ID NO: 221753 - RNA, 63 nt, Homo Sapiens
aauggauguaaaaaagccuauuucuacauuauaccaacugagaaaaaaauggucgguaaagug

SEQ ID NO: 221754 - RNA, 63 nt, Homo Sapiens
ugcaauuagccucauaguuauuauccagaggacccaacugaacugaacuaauccuucuggcag

SEQ ID NO: 221755 - RNA, 63 nt, Homo Sapiens
ugcugaacauuuggaaaccaugcacuagccaacccaacugacuucugcuagguagaggcauuu

SEQ ID NO: 221756 - RNA, 63 nt, Homo Sapiens
guuagggcuucaaggcccucagagaugaucaguccaacugaacgaccuuacaaaugaggaaac

SEQ ID NO: 221757 - RNA, 63 nt, Homo Sapiens
uuuuuuauccagaaauauuuucagcaaaacuuuccaacugaguggagucugauuaaggauuua

SEQ ID NO: 221758 - RNA, 63 nt, Homo Sapiens
ggauuagcuagcaccuuuaagcccugcauuucuccaacugacaagugggugggggugauggca

SEQ ID NO: 221759 - RNA, 63 nt, Homo Sapiens
aaggacagaacuugacuggcuccauuucauggaccaacugaucaauugccaguacuaagccac

SEQ ID NO: 221760 - RNA, 63 nt, Homo Sapiens
cuacaagccauacugaggcggcagcaggagcgaccaacugaucgcacacaugcuuuguuugga

SEQ ID NO: 221761 - RNA, 63 nt, Homo Sapiens
ugauuugauuuauccuuguacucaucugagggcccaacugauacaagcauugcuaccaaccgc

SEQ ID NO: 221762 - RNA, 63 nt, Homo Sapiens
ccccagcaccugcuacagugcuucuccaagaccccaacugaguauucuugcuauaacuaagug

SEQ ID NO: 221763 - RNA, 63 nt, Homo Sapiens
gaauccuggcaggaacagacuuaccuucagaggccaacugacacauagggacagcuuguauaa

SEQ ID NO: 221764 - RNA, 63 nt, Homo Sapiens
cugagccaggguucccccaggccuccagggaggccaacugacuggggccgugaccagcccucu

SEQ ID NO: 221765 - RNA, 63 nt, Homo Sapiens
gccuucacuugucaguaucauaaagaguauugcccaacugaacuuugcucccacugguuuaau

SEQ ID NO: 221766 - RNA, 63 nt, Homo Sapiens
cccaaagcuguagucccaaucaaucaaaggcuaccaacugaguccucagguucauuucuuuuu

SEQ ID NO: 221767 - RNA, 63 nt, Homo Sapiens
auugccccuccgaugcugaggccacccacugacccaacugauccugcuccagcagcacaccuc

SEQ ID NO: 221768 - RNA, 63 nt, Homo Sapiens
ucucaccucacauugucccuacaaggacaggccccaacugauaaccguugcuuuuuuuuuuuu

SEQ ID NO: 221769 - RNA, 63 nt, Homo Sapiens
cugcccuugggauuccaaaccucccuagggcucccaacugaccucaggccucugagucacuga

SEQ ID NO: 221770 - RNA, 63 nt, Homo Sapiens
auggcugguguuauuggccaguuuuuagccaauccaacugaccuagugaagguucagaugcaa

SEQ ID NO: 221771 - RNA, 63 nt, Homo Sapiens
gaaucccuuaggacuggaacacuucaagcucaaccaacugacucaguugucauucuucacaaa

SEQ ID NO: 221772 - RNA, 63 nt, Homo Sapiens
gauguuccacuccacuuuguauagacaucugccccaacugaauguguucugucacucagcuuu

SEQ ID NO: 221773 - RNA, 63 nt, Homo Sapiens
aagaauaauucauggauuuguucauuguucuuuccaacugaaggcaguaaccauuacuucuaa

SEQ ID NO: 221774 - RNA, 63 nt, Homo Sapiens
uaugcccuaggaaaguacaaccagaauugaaaaccaacugaucuauaccaguucuuucaauua

SEQ ID NO: 221775 - RNA, 63 nt, Homo Sapiens
cauuugugcacguguauagcgggaagauuuccaccaacugaaucuuuaacaaugaaggggaag

SEQ ID NO: 221776 - RNA, 63 nt, Homo Sapiens
uacccgguagacugaauaucucagacacgaaauccaacugaauauauucuucuacugauucag

SEQ ID NO: 221777 - RNA, 63 nt, Homo Sapiens
gauagacucugagcacuaaugccaaaauaucucccaacugacuagugaaacaacaucauuuaa

SEQ ID NO: 221778 - RNA, 63 nt, Homo Sapiens
aaaccccugugguccggcaguucugaagcagcaccaacugagcguuccaagcauggaggcuca

SEQ ID NO: 221779 - RNA, 63 nt, Homo Sapiens
cuuuccucuccuggguacugaggugcuaugaagccaacugacaaagaugcaucacgugucuua

SEQ ID NO: 221780 - RNA, 63 nt, Homo Sapiens
cuguugucuucaaauacuaaugaacaauaucugccaacugaacaaaacaaccucaagggucca

SEQ ID NO: 221781 - RNA, 63 nt, Homo Sapiens
accaacaguuccaagccagaagggaguccuuugccaacugauguuuuacaguuaauccaggag

SEQ ID NO: 221782 - RNA, 63 nt, Homo Sapiens
cacaugaugauuuuguggucaaaaucuuuguugccaacugaaguuccucauaagcauaaaaag

SEQ ID NO: 221783 - RNA, 63 nt, Homo Sapiens
ggcuuugacuaugucauuagguggguacaaaacccaacugauguggagaaaaauugauguuug

SEQ ID NO: 221784 - RNA, 63 nt, Homo Sapiens
ggggggaugucuugagauguauuaugcaaaguaccaacugagccaaaaacaauaaacgaaaca

SEQ ID NO: 221785 - RNA, 63 nt, Homo Sapiens
ucaaucaugggaauuacauaaggauaaugaggcccaacugaaaccaaguuucagucugccuua

SEQ ID NO: 221786 - RNA, 63 nt, Homo Sapiens
agcaguauuuuaaguggggaaugcaacgugaggccaacugaacaauuccccccguggcugccc

SEQ ID NO: 221787 - RNA, 63 nt, Homo Sapiens
gaaugaaauuaucacagguugucucaagcacaaccaacugaaugucucuuaacuguggggacc

SEQ ID NO: 221788 - RNA, 63 nt, Homo Sapiens
guguucugcccuagauugguucaaggaggucauccaacugacuuuaucaaguggaauugggau

SEQ ID NO: 221789 - RNA, 63 nt, Homo Sapiens
uuuuaaugauuguguguucuaauucaugugcugccaacugaguuaucuagugauaugaccuca

SEQ ID NO: 221790 - RNA, 63 nt, Homo Sapiens
uaaacuuaaguccagaagccgaugaggaugucaccaacugaauacaggagaaaggacaaccag

SEQ ID NO: 221791 - RNA, 63 nt, Homo Sapiens
gaucgcccaacguuuuuggaacgcccucuuccuccaacugaagcugugugagcuacuuaacug

SEQ ID NO: 221792 - RNA, 63 nt, Homo Sapiens
ugccagccgguucugcuagauauuuguuucaacccaacugaccccagucuggagagcuguguc

SEQ ID NO: 221793 - RNA, 63 nt, Homo Sapiens
guaguauguggagcauaaaacaucuucauucucccaacugagucaaagacuucaacaauugca

SEQ ID NO: 221794 - RNA, 63 nt, Homo Sapiens
uuaugucuuaguuauaauuagauugugaaucagccaacugaaaauccuuuuugcauauuucaa

SEQ ID NO: 221795 - RNA, 63 nt, Homo Sapiens
cucucucucuaguauucuaaacugaccccaugaccaacugagaauuuauuuuuguuucauugg

SEQ ID NO: 221796 - RNA, 63 nt, Homo Sapiens
cagugcauguguggcagagacaggcaagggcuuccaacugaggaggacauacuaguucccugg

SEQ ID NO: 221797 - RNA, 55 nt, Homo Sapiens
aaaggacaccagacucuggaaccugccaacugauuuccaguggccuccagguuga

SEQ ID NO: 221798 - RNA, 63 nt, Homo Sapiens
cuacuaggauccugugugugacugaugcuuucgccaacugaaaacuguaauugggccuggcuc

SEQ ID NO: 221799 - RNA, 63 nt, Homo Sapiens
auaugaggacugcauguaauuuuaguuugcuaaccaacugaauaucccauaaauaaaaaauac

SEQ ID NO: 221800 - RNA, 63 nt, Homo Sapiens
caucuugugaguggauaauccauggucaaguucccaacugagucagccagaaagcacuacaau

SEQ ID NO: 221801 - RNA, 63 nt, Homo Sapiens
uuauaacccucugcaccuucagcugcauuacugccaacugaccuuucauucauaccagauaau

SEQ ID NO: 221802 - RNA, 63 nt, Homo Sapiens
aggaaaaacuucuguauggacaauggacuugacccaacugagaucaagcuguaacagaaaggu

SEQ ID NO: 221803 - RNA, 63 nt, Homo Sapiens
gugagggagucucacccaccuccaucaucagggccaacugagaucucaggcugcaccaaagau

SEQ ID NO: 221804 - RNA, 63 nt, Homo Sapiens
uggccuucaggagccuaggucgccugccccuguccaacugagaggcugaggccagaggcccau

SEQ ID NO: 221805 - RNA, 63 nt, Homo Sapiens
ucacaagccaaguagggcauauaucagauuuggccaacugaauggcgucuguccugucaucca

SEQ ID NO: 221806 - RNA, 63 nt, Homo Sapiens
uacguaggaauuuuuuccuuuuguguucugucaccaacugaaguggcuaaagagcuuugugau

SEQ ID NO: 221807 - RNA, 63 nt, Homo Sapiens
gcccacacaacaggcuuauuuucugugaaggaaccaacugaucucccccacccuuggauuaga

SEQ ID NO: 221808 - RNA, 63 nt, Homo Sapiens
uguuaagaggaaauaaucaagaucacucauaucccaacugaaucugagguuuuauaaaucccu

SEQ ID NO: 221809 - RNA, 63 nt, Homo Sapiens
accacuguccuacagagucaacagagucaacccccaacugagguugccagaugccccuagggg

SEQ ID NO: 221810 - RNA, 63 nt, Homo Sapiens
gaugaugugguugcuauggaaaguguugucaggccaacugaaugguuuuuuuuuuuuuaacca

SEQ ID NO: 221811 - RNA, 63 nt, Homo Sapiens
uauagacuuacugcuggacagccucuuuacugaccaacugaaggaagagguguccuuacagag

SEQ ID NO: 221812 - RNA, 63 nt, Homo Sapiens
aagacuagagggauuaguacuggucacacacaaccaacugaaaggguauuuaagugcuagggc

SEQ ID NO: 221813 - RNA, 63 nt, Homo Sapiens
auugaaaucucucauuugccguuuuccaggaauccaacugagcgugcuuggcagcuguucugu

SEQ ID NO: 221814 - RNA, 63 nt, Homo Sapiens
cugaucaacgaagagggauuacagcuacauccuccaacugacccccaccuggcuaccaggccg

SEQ ID NO: 221815 - RNA, 52 nt, Homo Sapiens
cauagccucuucagauuccuugccaacugaucauaagcucuucccacuguaa

SEQ ID NO: 221816 - RNA, 63 nt, Homo Sapiens
uuuaaacuuuguucuuguccauuaaaagaaauuccaacugacucuuguccccuuggucuuuua

SEQ ID NO: 221817 - RNA, 63 nt, Homo Sapiens
gaaacugaggguccugcccuggaaacugagguuccaacugacaaagucacucacuuaaaaugg

SEQ ID NO: 221818 - RNA, 63 nt, Homo Sapiens
ccccaacccacucccuuccaacaacaaccagcuccaacugacucuggucuugggaggugaggc

SEQ ID NO: 221819 - RNA, 63 nt, Homo Sapiens
ugacgucugaccucuaccaucgccauuuuugcuccaacugaggaaacuacaggggaagugggg

SEQ ID NO: 221820 - RNA, 63 nt, Homo Sapiens
gugcuaauugcuuggaucuccuuaggagcagcaccaacugaaguaguaguuagaggcuuacaa

SEQ ID NO: 221821 - RNA, 63 nt, Homo Sapiens
cuaaaggaaacaaacaaaaaagcgguaacacugccaacugagaaacagagaagagauuacacc

SEQ ID NO: 221822 - RNA, 63 nt, Homo Sapiens
ugaggagcuuccucucuuccaaccucuguaaccccaacugaaaaacuuacgauaucugcccca

SEQ ID NO: 221823 - RNA, 63 nt, Homo Sapiens
uaccgugaugguguugauuuuuacacguguaagccaacugagaugcucuuugaaaauuucuuu

SEQ ID NO: 221824 - RNA, 63 nt, Homo Sapiens
cacguaaagcucgaaccacggauggaaugaaagccaacugaaccugggauuuaagacaccccu

SEQ ID NO: 221825 - RNA, 63 nt, Homo Sapiens
uugggaaguuugguugagguaucuuuuugacuuccaacugauaaguccagaaagaaaggguuc

SEQ ID NO: 221826 - RNA, 63 nt, Homo Sapiens
ugaaccucuuagccacauuuccagcagggcaaaccaacugaugcccuggaagagucuuccgca

SEQ ID NO: 221827 - RNA, 63 nt, Homo Sapiens
auuggaaagcuaauccuaccuugucaguuucaaccaacugaguuuuuucuuuaagaaagguaa

SEQ ID NO: 221828 - RNA, 63 nt, Homo Sapiens
gcuaaaaagcaacaggccauauuucccccuaaaccaacugaagcaggucucauagguugagca

SEQ ID NO: 221829 - RNA, 63 nt, Homo Sapiens
uccaaauauaagaguacucauguuuauuuauuuccaacugagcagcaaccuccuuuguuucac

SEQ ID NO: 221830 - RNA, 63 nt, Homo Sapiens
uugccagacaagucuccaggggaucccuguuucccaacugaaaggugugaacggacacacaca

SEQ ID NO: 221831 - RNA, 63 nt, Homo Sapiens
ucauuuuaguauuaacucuuagcaucucaaauuccaacugaaaacucaaaauaaauggucuuu

SEQ ID NO: 221832 - RNA, 63 nt, Homo Sapiens
uuguauguaaauaccaagagcuaagaaauagagccaacugauucuuucuucccguguguauuu

SEQ ID NO: 221833 - RNA, 63 nt, Homo Sapiens
ccugacuuucccccuguaccagguaggacucaaccaacugaaaaaaagccuaacaaacagaua

SEQ ID NO: 221834 - RNA, 63 nt, Homo Sapiens
ugaugcuuaauaaaacugcucgccacccacaugccaacugacuuauuccauuaccaggcacuc

SEQ ID NO: 221835 - RNA, 63 nt, Homo Sapiens
uaaacccuuaccaaggaaaaaaaagggauguuaccaacugagaucgaucaguucauccaauca

SEQ ID NO: 221836 - RNA, 63 nt, Homo Sapiens
ggacacgaagucuagcuccgagaaaaccauuuaccaacugaaaagaaauauuauugauucuau

SEQ ID NO: 221837 - RNA, 63 nt, Homo Sapiens
cguggggugagcuuuauagcuccaaggugaggcccaacugaauaaggagguugugggugggau

SEQ ID NO: 221838 - RNA, 63 nt, Homo Sapiens
accaaauugagauggcaaauaauauauccaaauccaacugaauugugacugacagguaauccu

SEQ ID NO: 221839 - RNA, 63 nt, Homo Sapiens
cguuuaaauuugcccuaggauggcuuuuuccuaccaacugauaggaaaauuaaaggccacuug

SEQ ID NO: 221840 - RNA, 63 nt, Homo Sapiens
uuuuguauuuuaaaggaaaaaugacuuucauucccaacugauuaugaccuuucaggaugucgu

SEQ ID NO: 221841 - RNA, 63 nt, Homo Sapiens
uguuuuuuuuuuaugaggcuccugagaaucaacccaacugaagcauuucaauucacuugaaug

SEQ ID NO: 221842 - RNA, 63 nt, Homo Sapiens
uugugauuccuaccccucuuccagcuucuuuugccaacugaagccuucuucugccacuucugc

SEQ ID NO: 221843 - RNA, 63 nt, Homo Sapiens
uugcuccaccccacucacagagacacagggcauccaacugagaaaacgaaacugcucuaagca

SEQ ID NO: 221844 - RNA, 63 nt, Homo Sapiens
cccuuggccugcucccuguaggaagucauccugccaacugauuuaaaagggcucuuuagccag

SEQ ID NO: 221845 - RNA, 63 nt, Homo Sapiens
aagaggugacugucaguggaggggucucugcagccaacugagacuaucuugcugugcccugag

SEQ ID NO: 221846 - RNA, 63 nt, Homo Sapiens
acccccuugggguggggcagaaggugaagcaucccaacugacuagagacucaggcccugcagg

SEQ ID NO: 221847 - RNA, 63 nt, Homo Sapiens
agccaguuagacuaguccccggucucccgauucccaacugaguguuauuugcacacugcacug

SEQ ID NO: 221848 - RNA, 63 nt, Homo Sapiens
guaauauugguuagggaaacaaacuucaggucaccaacugaagucauuacaaacuccuuguac

SEQ ID NO: 221849 - RNA, 63 nt, Homo Sapiens
augccagccaggcccaggagugcccagcaucccccaacugaugacacaguagcacugauucug

SEQ ID NO: 221850 - RNA, 63 nt, Homo Sapiens
ugcgcuggagcugcucuuauggcccucacaggcccaacugacccgcuugcugcccaacaccau

SEQ ID NO: 221851 - RNA, 63 nt, Homo Sapiens
uaaaugcuauuuaaauaaagaacuggcauagagccaacugagacuuaccccaauaccaagacc

SEQ ID NO: 221852 - RNA, 63 nt, Homo Sapiens
acaacagugacauguuugaacugcaguguccucccaacugaaacccugccagaaaaaugugcu

SEQ ID NO: 221853 - RNA, 63 nt, Homo Sapiens
acaaaauccuggcccgugcugacacacggaaacccaacugagaggaaacccaagagcugccug

SEQ ID NO: 221854 - RNA, 63 nt, Homo Sapiens
agccccaagcucuccauggccaaccugcuguuaccaacugaaguggagggcugagcccuguga

SEQ ID NO: 221855 - RNA, 63 nt, Homo Sapiens
accuuuguuucucccccaugggagcuccccuccccaacugaccgggcagccagggagagccca

SEQ ID NO: 221856 - RNA, 63 nt, Homo Sapiens
uccauuagccggacucgaaauuggccuuaagucccaacugauggucucagguuggauuauuug

SEQ ID NO: 221857 - RNA, 63 nt, Homo Sapiens
uuuacaaaccagacuuuuauugaauagacuuggccaacugauguccacuaucaugaaggacuc

SEQ ID NO: 221858 - RNA, 63 nt, Homo Sapiens
aacugaacucacaccugguaccacucagaaccuccaacugacugaaugccaggagcugaacau

SEQ ID NO: 221859 - RNA, 63 nt, Homo Sapiens
uguaucuguccguggaaaauucccucuucuaacccaacugacuaaccagagccuauauggagu

SEQ ID NO: 221860 - RNA, 63 nt, Homo Sapiens
auaucuuuuuguucaucaguaauaacuaguuggccaacugacugugguccauggacuacacag

SEQ ID NO: 221861 - RNA, 63 nt, Homo Sapiens
cuggacagggggcagccguggaggccaccguuaccaacugaagcugggggccuggguccuacc

SEQ ID NO: 221862 - RNA, 63 nt, Homo Sapiens
gcauugagccaguggugcuaaaugcuacauacuccaacugaaauguuaaggaagaagauagau

SEQ ID NO: 221863 - RNA, 63 nt, Homo Sapiens
uaagauucaagggaguguugcuucucaacucagccaacugaguagcaaaucauuuguucuaga

SEQ ID NO: 221864 - RNA, 63 nt, Homo Sapiens
gcaaggauguaugauaauauguacaaaguaauuccaacugaggaagcucaccugauccuuagu

SEQ ID NO: 221865 - RNA, 63 nt, Homo Sapiens
uccugacauaagugcacagagcuucaguguccaccaacugaccaugaaauagaguaugcugua

SEQ ID NO: 221866 - RNA, 63 nt, Homo Sapiens
uuagaaaugcaaauucuugggucacucucuagaccaacugaugcagaaacaggaggugugagc

SEQ ID NO: 221867 - RNA, 63 nt, Homo Sapiens
acccgcucugauuccccacaucuccuucaagacccaacugagcaccucccacccuccuccucu

SEQ ID NO: 221868 - RNA, 63 nt, Homo Sapiens
guagucggcucaacacccuccaggccacccauuccaacugaguagcuggagcacuacgacuug

SEQ ID NO: 221869 - RNA, 63 nt, Homo Sapiens
gugcgaaccagcauuaacggauggggcacgugcccaacugaggaacaggagaagaaaucacca

SEQ ID NO: 221870 - RNA, 63 nt, Homo Sapiens
ggaaaguuucagcucacugugaagccagacuccccaacugaaacaccagaagguuuggaguga

SEQ ID NO: 221871 - RNA, 63 nt, Homo Sapiens
uaaguuucuuuuagcuuguacagcauccucagaccaacugaggagcuuuccuuguuaacaauu

SEQ ID NO: 221872 - RNA, 63 nt, Homo Sapiens
gccuggaguugccgaggaagucacagaaaaugaccaacugauggggccuggagugcaggaggg

SEQ ID NO: 221873 - RNA, 63 nt, Homo Sapiens
ccaaacuuuucuaaugucuguggauuuguuuuuccaacugaguuaaaggacuuuuuuaacugc

SEQ ID NO: 221874 - RNA, 63 nt, Homo Sapiens
uuuguauuuuuaguagagaccacaccaccacgcccaacugauuaguagcugagauuacaggcg

SEQ ID NO: 221875 - RNA, 63 nt, Homo Sapiens
ccccagagguuuguauaucagaacuugauugugccaacugaaaauuuucuguuaguacaaguu

SEQ ID NO: 221876 - RNA, 63 nt, Homo Sapiens
cuggacguccaggugggccccccagcaccucccccaacugaccguggccagguggggcgggac

SEQ ID NO: 221877 - RNA, 63 nt, Homo Sapiens
cucacuuuuuguauuuaaauauuaaaaaugauuccaacugaaagugucauccuaaguaccuug

SEQ ID NO: 221878 - RNA, 63 nt, Homo Sapiens
acuuaccugccuaguuaauagagaaagaauuaaccaacugauguucuaacuucucaaguucua

SEQ ID NO: 221879 - RNA, 63 nt, Homo Sapiens
ugauggggugggggugcuccgagaccagaggagccaacugagaagugccugaugcccgcguca

SEQ ID NO: 221880 - RNA, 63 nt, Homo Sapiens
aaaauuauauugagcaaucgccaaggccuaaagccaacugacuuaaagguaaucauuucagcu

SEQ ID NO: 221881 - RNA, 63 nt, Homo Sapiens
cccugccaugcucuggucuguucugaaacugugccaacugaaagaugauaguccacacagcac

SEQ ID NO: 221882 - RNA, 63 nt, Homo Sapiens
aauuacaucccauaacuugucaggauaguugcuccaacugaauugcuaucauuuggcuggaug

SEQ ID NO: 221883 - RNA, 63 nt, Homo Sapiens
uauuaugagaaaguggacuuaaccgaaauggaaccaacugacauucuaucguguuguacauag

SEQ ID NO: 221884 - RNA, 63 nt, Homo Sapiens
agaagggugcuaagucaccuacugaagagagaaccaacugacuuuccuauugacucaucagga

SEQ ID NO: 221885 - RNA, 63 nt, Homo Sapiens
ccuucuaucuugaaucuucuagagaguugcugaccaacugacguauguuucccuuugugaauu

SEQ ID NO: 221886 - RNA, 63 nt, Homo Sapiens
ucagggacauugccagcuccaaaaggcuauuuuccaacugaagaucuuugugugaaggauugg

SEQ ID NO: 221887 - RNA, 63 nt, Homo Sapiens
uguuauagguccuuuagaaaagcuagaacacugccaacugaucaucugcccccaacucccaaa

SEQ ID NO: 221888 - RNA, 63 nt, Homo Sapiens
ucucaauguucucaguacgauucagggugucuuccaacugaaaggguaugcuacucauaagau

SEQ ID NO: 221889 - RNA, 63 nt, Homo Sapiens
aguaccuuaucaaaguagcauaucuaaaucuguccaacugagaguuuacagagaugucucuua

SEQ ID NO: 221890 - RNA, 64 nt, Homo Sapiens
uacacagggaaauggaucauacucacuucuggccauauaacauuaaagcacaaagugcaugugu

SEQ ID NO: 221891 - RNA, 64 nt, Homo Sapiens
acccaggaaacagacccagcuuguuuuuuacaagauauaacauauuuuuugguuuuguuuuguu

SEQ ID NO: 221892 - RNA, 64 nt, Homo Sapiens
aucuauucaucuauuuauaucuauuacaauaaaaauauaacauauuguauauauauaaagaaau

SEQ ID NO: 221893 - RNA, 64 nt, Homo Sapiens
uuauguagguuucuuaucacccuuuucugaccucauauaacacaagcuucuaaauuaaucucug

SEQ ID NO: 221894 - RNA, 64 nt, Homo Sapiens
agacuuaaaauauuuuauuauugaugcaauuuaaauauaacaggauaauuaacauaauuuaaau

SEQ ID NO: 221895 - RNA, 64 nt, Homo Sapiens
ggaaccaauguuaucuuuaauauuaguaaugaauauauaacauggguuuagcuuugauaagugc

SEQ ID NO: 221896 - RNA, 64 nt, Homo Sapiens
uuacuaaguucaguauucaucauaauuagauacaauauaacauucacucucaucagauaucuga

SEQ ID NO: 221897 - RNA, 64 nt, Homo Sapiens
aacugaaauagucaauuagcaguacaguugauaaauauaacaucuuuaggaaacauacccagga

SEQ ID NO: 221898 - RNA, 64 nt, Homo Sapiens
uguuugccuuuacauuguaucuauuuauauucuuauauaacaaauacauuuuaucauauuuaua

SEQ ID NO: 221899 - RNA, 64 nt, Homo Sapiens
ugcacaugugacucuggucauugauuaauuugccauauaacacuucaucuugaaaugauucuca

SEQ ID NO: 221900 - RNA, 64 nt, Homo Sapiens
caugcuucgucagagguguuugauccuugccuucauauaacaaauaacaugcuucgugccauca

SEQ ID NO: 221901 - RNA, 64 nt, Homo Sapiens
cuucgugccaucaugauccuuggucauugccuucauauaacauguauaacaugcuucgugcuca

SEQ ID NO: 221902 - RNA, 64 nt, Homo Sapiens
cuucgugcucauggucauuguggucauugccuucauauaacauguuugguggcagcugccauca

SEQ ID NO: 221903 - RNA, 64 nt, Homo Sapiens
uaauauauauauauuauagggguaagucuacuguauauaacaucauugcuuaaacuauugacuu

SEQ ID NO: 221904 - RNA, 64 nt, Homo Sapiens
uaauauauauauuacaggccgguaagucuacuguauauaacaucauugcuuaaacuauugacuu

SEQ ID NO: 221905 - RNA, 64 nt, Homo Sapiens
caaaugaaguauggagguguguauguuuauauguauauaacaaaauauuuucauugugaccacu

SEQ ID NO: 221906 - RNA, 64 nt, Homo Sapiens
uuaggaauaaaaggaaucuuccuagauaugauaaauauaacaucuaugaaaagcccacaccuaa

SEQ ID NO: 221907 - RNA, 64 nt, Homo Sapiens
aauuuccucuuacaguucgaugcccauuaguuuuauauaacauuuauuugacacguacugacuu

SEQ ID NO: 221908 - RNA, 64 nt, Homo Sapiens
aauauucaauuuaagagcaaggaaauucuuauaaauauaacaauagaggcagaacucauguaag

SEQ ID NO: 221909 - RNA, 64 nt, Homo Sapiens
uugauuucugucauacccaugaccaagaaagaaaauauaacaguccuuuaagaaaaaccacagg

SEQ ID NO: 221910 - RNA, 64 nt, Homo Sapiens
uuuacauucacaaauucaguguaacugccauauuauauaacaaaagcugcauacguaauauuca

SEQ ID NO: 221911 - RNA, 64 nt, Homo Sapiens; identical to SEQ ID NO: 52875

SEQ ID NO: 221912 - RNA, 64 nt, Homo Sapiens; identical to SEQ ID NO: 52876

SEQ ID NO: 221913 - RNA, 64 nt, Homo Sapiens; identical to SEQ ID NO: 52877

SEQ ID NO: 221914 - RNA, 64 nt, Homo Sapiens; identical to SEQ ID NO: 52878

SEQ ID NO: 221915 - RNA, 64 nt, Homo Sapiens; identical to SEQ ID NO: 52879

SEQ ID NO: 221916 - RNA, 64 nt, Homo Sapiens; identical to SEQ ID NO: 52880

SEQ ID NO: 221917 - RNA, 64 nt, Homo Sapiens; identical to SEQ ID NO: 52881

SEQ ID NO: 221918 - RNA, 64 nt, Homo Sapiens; identical to SEQ ID NO: 52882

SEQ ID NO: 221919 - RNA, 64 nt, Homo Sapiens; identical to SEQ ID NO: 52883

SEQ ID NO: 221920 - RNA, 64 nt, Homo Sapiens; identical to SEQ ID NO: 52884

SEQ ID NO: 221921 - RNA, 64 nt, Homo Sapiens; identical to SEQ ID NO: 52885

SEQ ID NO: 221922 - RNA, 64 nt, Homo Sapiens; identical to SEQ ID NO: 52886

SEQ ID NO: 221923 - RNA, 64 nt, Homo Sapiens; identical to SEQ ID NO: 52887

SEQ ID NO: 221924 - RNA, 64 nt, Homo Sapiens; identical to SEQ ID NO: 52888

SEQ ID NO: 221925 - RNA, 64 nt, Homo Sapiens; identical to SEQ ID NO: 52889

SEQ ID NO: 221926 - RNA, 64 nt, Homo Sapiens; identical to SEQ ID NO: 52890

SEQ ID NO: 221927 - RNA, 64 nt, Homo Sapiens; identical to SEQ ID NO: 52891

SEQ ID NO: 221928 - RNA, 64 nt, Homo Sapiens; identical to SEQ ID NO: 52892

SEQ ID NO: 221929 - RNA, 64 nt, Homo Sapiens; identical to SEQ ID NO: 52893

SEQ ID NO: 221930 - RNA, 64 nt, Homo Sapiens; identical to SEQ ID NO: 52894

SEQ ID NO: 221931 - RNA, 64 nt, Homo Sapiens; identical to SEQ ID NO: 52895

SEQ ID NO: 221932 - RNA, 64 nt, Homo Sapiens; identical to SEQ ID NO: 52896

SEQ ID NO: 221933 - RNA, 64 nt, Homo Sapiens; identical to SEQ ID NO: 52897

SEQ ID NO: 221934 - RNA, 64 nt, Homo Sapiens; identical to SEQ ID NO: 52898

SEQ ID NO: 221935 - RNA, 64 nt, Homo Sapiens; identical to SEQ ID NO: 52899

SEQ ID NO: 221936 - RNA, 64 nt, Homo Sapiens; identical to SEQ ID NO: 52900

SEQ ID NO: 221937 - RNA, 64 nt, Homo Sapiens; identical to SEQ ID NO: 52901

SEQ ID NO: 221938 - RNA, 64 nt, Homo Sapiens; identical to SEQ ID NO: 52902

SEQ ID NO: 221939 - RNA, 64 nt, Homo Sapiens; identical to SEQ ID NO: 52903

SEQ ID NO: 221940 - RNA, 64 nt, Homo Sapiens; identical to SEQ ID NO: 52904

SEQ ID NO: 221941 - RNA, 64 nt, Homo Sapiens; identical to SEQ ID NO: 52905

SEQ ID NO: 221942 - RNA, 64 nt, Homo Sapiens; identical to SEQ ID NO: 52906

SEQ ID NO: 221943 - RNA, 64 nt, Homo Sapiens; identical to SEQ ID NO: 52907

SEQ ID NO: 221944 - RNA, 64 nt, Homo Sapiens; identical to SEQ ID NO: 52908

SEQ ID NO: 221945 - RNA, 64 nt, Homo Sapiens; identical to SEQ ID NO: 52909

SEQ ID NO: 221946 - RNA, 64 nt, Homo Sapiens; identical to SEQ ID NO: 52910

SEQ ID NO: 221947 - RNA, 64 nt, Homo Sapiens; identical to SEQ ID NO: 52911

SEQ ID NO: 221948 - RNA, 64 nt, Homo Sapiens; identical to SEQ ID NO: 52912

SEQ ID NO: 221949 - RNA, 64 nt, Homo Sapiens; identical to SEQ ID NO: 52913

SEQ ID NO: 221950 - RNA, 64 nt, Homo Sapiens; identical to SEQ ID NO: 52914

SEQ ID NO: 221951 - RNA, 64 nt, Homo Sapiens
uuuaccucaaguugcuuggcagcacaacuaucuuugcaaaaaaaaguaaagaaaaaguaaauga

SEQ ID NO: 221952 - RNA, 64 nt, Homo Sapiens
augaauaaucaaagugauuuuucagaauuaugugugcaaaaaauuaaugugcauucauauauuc

SEQ ID NO: 221953 - RNA, 64 nt, Homo Sapiens
uauuaagacuuauauaauaagugcauguaggaauugcaaaaaauauuuuaaaaauuuauuacug

SEQ ID NO: 221954 - RNA, 64 nt, Homo Sapiens
agcacaguaauguguguuuuguucagcauuauuaugcaaaaauucacuaguugagaugguuugu

SEQ ID NO: 221955 - RNA, 64 nt, Homo Sapiens
ccacugcaaauuuuuucaguauaaaauuuuucacugcaaaaaaauuucaguagaaaauaaggau

SEQ ID NO: 221956 - RNA, 64 nt, Homo Sapiens
cagguuaaauauucauugcauuuauaagaucuucugcaaaaagcccagaaaugguccuuuucag

SEQ ID NO: 221957 - RNA, 64 nt, Homo Sapiens
aaaaaaaaaaaaaaucucaguaaaaauagaaaauugcaaaaaaaaguugaugagcuuaaaaaaa

SEQ ID NO: 221958 - RNA, 64 nt, Homo Sapiens
auuuagaaaaaaacaacaaauguuaugcccuguuugcaaaaacauuacaaaguauuuuuuuacc

SEQ ID NO: 221959 - RNA, 64 nt, Homo Sapiens
aaaaaaaaaaaaaaaagcuuuuaucagaaacgaaugcaaaaaaauuaguuggaaguacccagaa

SEQ ID NO: 221960 - RNA, 64 nt, Homo Sapiens
aauauagacaaauauuuugaauauguaagaaaacugcaaaaacaaagggcugccagagguucug

SEQ ID NO: 221961 - RNA, 64 nt, Homo Sapiens
gcuuuaaaauuauacaugagccucgagugagccaugcaaaaauaaguuuuagggucuaaguuga

SEQ ID NO: 221962 - RNA, 64 nt, Homo Sapiens
augucaucucuucaguaacucauaguuuuucaacugcaaaaaucacuuuuaaggaggguggaua

SEQ ID NO: 221963 - RNA, 64 nt, Homo Sapiens
agauguacagauuucgguucccugccuacuuuucugcaaaaauguuuauguauaauucuuucug

SEQ ID NO: 221964 - RNA, 64 nt, Homo Sapiens
uggauucacaaaugucccugcaggcuccagcuucugcaaaaacuaaaugaaggccaaacagaag

SEQ ID NO: 221965 - RNA, 64 nt, Homo Sapiens
caugauauguacuauagugauucuguuuuugaggugcaaaaaacauacauauauaccaguuggu

SEQ ID NO: 221966 - RNA, 64 nt, Homo Sapiens
aaggagaugcuuauagaugauaguuguacauaugugcaaaaaaaaauccacuugcaaugguaag

SEQ ID NO: 221967 - RNA, 64 nt, Homo Sapiens
uugacuggggcaaaggauuuaccacaauggaugcugcaaaaacguaacuccaaguacaaggccg

SEQ ID NO: 221968 - RNA, 64 nt, Homo Sapiens
cuaauucauguuaaaguccucuggccuauaaacaugcaaaaaaauucauugccuggucaggucu

SEQ ID NO: 221969 - RNA, 64 nt, Homo Sapiens
uuaugcuuugaugauauagugagaaugcaucacuugcaaaaacgaucucaaaagugucagccuu

SEQ ID NO: 221970 - RNA, 64 nt, Homo Sapiens
agucagccuggccaacauggcaaaacuccgucucugcaaaaaauacaaaaaugagcccgguaug

SEQ ID NO: 221971 - RNA, 64 nt, Homo Sapiens
aaaggaaaaccagugaagugaaaagaccaauaggugcaaaaauaucaaaccaauucacccagaa

SEQ ID NO: 221972 - RNA, 64 nt, Homo Sapiens
aguuuucaccugguauccaugguucuggauauggugcaaaaaugcaggcauaaauuagagaaau

SEQ ID NO: 221973 - RNA, 64 nt, Homo Sapiens
agugcugaaagguuuugaauccuuuacccaacaaugcaaaaauagagccaaugguuauaacuug

SEQ ID NO: 221974 - RNA, 64 nt, Homo Sapiens
gguuuuaaaugacccgucuagguuacugcuuccuugcaaaaaaagucgaauccugcauugaauu

SEQ ID NO: 221975 - RNA, 64 nt, Homo Sapiens
ucugucguuaaaacugaggaacuugcaauauuuuugcaaaaaaaaaccuacaaaaauaaacuga

SEQ ID NO: 221976 - RNA, 64 nt, Homo Sapiens
uacuaagauguacgggucuucgaaaaagcaaaacugcaaaaaagcuucacagcuaugacaaaac

SEQ ID NO: 221977 - RNA, 64 nt, Homo Sapiens
cuccucuucuccccucacuuuucccuacuuccucugcaaaaagauuuaacaaauacauucauaa

SEQ ID NO: 221978 - RNA, 64 nt, Homo Sapiens
auucauaaggaaauguguguuguaacaaauauauugcaaaaacauaguuuguaaaggcauucua

SEQ ID NO: 221979 - RNA, 64 nt, Homo Sapiens
acuuugguauauuacaaauuacauaauauaguauugcaaaaaugguaauuauauacuugaaagu

SEQ ID NO: 221980 - RNA, 64 nt, Homo Sapiens
agaucauuuuguauacagagagcaaaaaaaugccugcaaaaagauaagaaguuaaaacuugaga

SEQ ID NO: 221981 - RNA, 64 nt, Homo Sapiens
aggccccauuuaguggagccgaucucugaauauaugcaaaaagaaaaaaaaaaaagacucccug

SEQ ID NO: 221982 - RNA, 64 nt, Homo Sapiens
guccuggaguugguagauugagugauuugcaccuugcaaaaaugauuccaacauugucuuuagg

SEQ ID NO: 221983 - RNA, 64 nt, Homo Sapiens
aaauucuuuugaauuguuacaucaugcuggaaccugcaaaaaauacuuuuucuaaugaggagag

SEQ ID NO: 221984 - RNA, 64 nt, Homo Sapiens
aaguuaauagauuuuuucagacuugucaagccugugcaaaaaaauuaaaauggaugccuugaau

SEQ ID NO: 221985 - RNA, 64 nt, Homo Sapiens
aguugucacagaaauuaugacuccagugaguaccugcaaaaauggcauuuuaagguucucagac

SEQ ID NO: 221986 - RNA, 64 nt, Homo Sapiens
accaaguccuccgaaggcauauaaugagagcaaaugcaaaaauaacaucauuccaaaaagaaca

SEQ ID NO: 221987 - RNA, 64 nt, Homo Sapiens
aaauggacagaauugcagccacuaguuuuuccugugcaaaaauagacuguuugaaucuugucuc

SEQ ID NO: 221988 - RNA, 64 nt, Homo Sapiens
aaaaugucaagaguauuuauuuaucuuggaaucaugcaaaaaaagagguuuacuuauuuuccac

SEQ ID NO: 221989 - RNA, 64 nt, Homo Sapiens
uuaaaaaaaaaaaaaaacaccaaagacccauuuaugcaaaaaugacaaaacugguuaccuguau

SEQ ID NO: 221990 - RNA, 64 nt, Homo Sapiens
guuuugugucauuaacugaagauaugucauaugaugcaaaaaagcaauaaguugauuuacugau

SEQ ID NO: 221991 - RNA, 64 nt, Homo Sapiens
uggaucauguagguuagaaguuuguuguaaacauugcaaaaaugcucagcugucugccugccac

SEQ ID NO: 221992 - RNA, 64 nt, Homo Sapiens
ucacagaaaacuuuugacuguauuuauuuauuguugcaaaaaagacgcuuuuuuauugcugccc

SEQ ID NO: 221993 - RNA, 64 nt, Homo Sapiens
cuauaaaaucugccauaguuggauuaugcagcuuugcaaaaauuuuuacuagauuuugcacuaa

SEQ ID NO: 221994 - RNA, 64 nt, Homo Sapiens
gguaauggcaaaguuugccaaucaguuuggauucugcaaaaaagcucaaggaaccagggaugaa

SEQ ID NO: 221995 - RNA, 64 nt, Homo Sapiens
gaaaauaacucuccugaacaaacagcuauaauuuugcaaaaaagccuuguauuuuacagaugca

SEQ ID NO: 221996 - RNA, 64 nt, Homo Sapiens
gucacaaagaggcaacguagccacugccucccuaugcaaaaaauuaaccagaugaugcagauaa

SEQ ID NO: 221997 - RNA, 64 nt, Homo Sapiens
caaucuagcugaggagacaagacacauccaaugcugcaaaaauggugaauaaccugauucaggg

SEQ ID NO: 221998 - RNA, 64 nt, Homo Sapiens
aaaaaaaaaaaaggugacagcaaaagguaggaaaugcaaaaaagauaaauauauauauauaugu

SEQ ID NO: 221999 - RNA, 64 nt, Homo Sapiens
aaaacacacacaaccaauaaggacauauuucuuaugcaaaaaggcaagagccucuggacuaaau

SEQ ID NO: 222000 - RNA, 64 nt, Homo Sapiens
gaaaaagaacuguugguuauaggggaaaugaaugugcaaaaaaaaaguucacuuuuuuuguucu

SEQ ID NO: 222001 - RNA, 64 nt, Homo Sapiens
cuggagaaaaaugaaggaaauaccaugucugaccugcaaaaauguguuuuuuuucagcacaugu

SEQ ID NO: 222002 - RNA, 64 nt, Homo Sapiens
caugucuaggcuacagggaaagagaauuauuugaugcaaaaauaauauaugaaaagagacgaaa

SEQ ID NO: 222003 - RNA, 64 nt, Homo Sapiens
uugaaguauuuuucuugccaugccuauuuauuuuugcaaaaaaauuaucugcuauauagaacca

SEQ ID NO: 222004 - RNA, 64 nt, Homo Sapiens
cacccaugcaggggcaaucagaucagcaucuucaugcaaaaaaaaaaaaaaaguugagugcucu

SEQ ID NO: 222005 - RNA, 64 nt, Homo Sapiens
aagcggcccugcagccacaaagcaacccgcccucugcaaaaacuaggcacauccgcagugcgca

SEQ ID NO: 222006 - RNA, 64 nt, Homo Sapiens
caaauauuguuaagggaccaugcugcuaauucuuugcaaaaaucaauuaacacuuaagguuggg

SEQ ID NO: 222007 - RNA, 64 nt, Homo Sapiens
cuuaauacuguuauucuuuguaguuacuguaaaaugcaaaaaauaaauauucacacuugaacca

SEQ ID NO: 222008 - RNA, 75 nt, Homo Sapiens
ugcagaggaaucuggaaauauuuauauccacggaguccuuggauccagugcuacgucaguaaauagcaccagcau

SEQ ID NO: 222009 - RNA, 75 nt, Homo Sapiens
gcagcacuggugcccaccauacacacaggugucucaugugacucacagugcuaaagacucaugcuugacagcuug

SEQ ID NO: 222010 - RNA, 75 nt, Homo Sapiens
aguuuagaagggaaguaggcauuaccauagacgacuccuagaggacagugcuauguaaaaaugugugucuauaaa

SEQ ID NO: 222011 - RNA, 75 nt, Homo Sapiens
acagucuguuuuccaaccaguguggaagcaauuaaauaugcguaacagugcuacggccacaccagcaccuccugg

SEQ ID NO: 222012 - RNA, 75 nt, Homo Sapiens
uuuauaagggaguacauuuugacugagcacuuagggcaucaggaacagugcuacuuacugauggguagacuggga

SEQ ID NO: 222013 - RNA, 75 nt, Homo Sapiens
cugcgugauucaagcuuuccccuccaggcccaugcagaaagaguucagugcuacuugccuagggacacuguccag

SEQ ID NO: 222014 - RNA, 75 nt, Homo Sapiens
acccaagcccccuccuucuucucccaggcacaugggauggauguccagugcuacccuguggcuccaaccccaaga

SEQ ID NO: 222015 - RNA, 75 nt, Homo Sapiens
uaaacaguuuucacaguuucacucuucucuccuggucuccuugagcagugcuacuuacugcuacgucucuaacag

SEQ ID NO: 222016 - RNA, 75 nt, Homo Sapiens
ggcagcuucugcuccugaccgaagcccaggacaguucgcugggaccagugcuaauaggugggugaccaagcugcg

SEQ ID NO: 222017 - RNA, 75 nt, Homo Sapiens
acugaggaugauuucccuaacaggacuucucuccugaagaacacgcagugcuaaaaacagcugggccuccucacu

SEQ ID NO: 222018 - RNA, 75 nt, Homo Sapiens
aauacuguguaucuaucauuaccuuggguugaugaaacaucaacccagugcuagguugugugcuuuaaacaaaau

SEQ ID NO: 222019 - RNA, 75 nt, Homo Sapiens
gugugcaagcaguuuuuuuauuuagugaaauugucauuguuuuaucagugcuaaucgguagucuuuaaacauucu

SEQ ID NO: 222020 - RNA, 75 nt, Homo Sapiens
guagguuuguguggauggccuggagggcaggugcccucugcuccccagugcuaccucucucuucccuagggccuu

SEQ ID NO: 222021 - RNA, 75 nt, Homo Sapiens
uacugcagggacagccccagagaggcccaacucuggccccuuucucagugcuaucugaugacggggaaacaaaau

SEQ ID NO: 222022 - RNA, 75 nt, Homo Sapiens
aagcugcaaagcagacugguggcaaguacacagcccuuuuuuuugcagugcuaacuugucuacuguguauuauga

SEQ ID NO: 222023 - RNA, 75 nt, Homo Sapiens
gugcacagaggagaugucagaagaccaaaacuuggugaauagucccagugcuaggucauauaggaaacagaaagc

SEQ ID NO: 222024 - RNA, 75 nt, Homo Sapiens
aaaaaaaauucuguauaaaacuguaauccuuuguauucauguuuacagugcuauuacuauaauucaaaauuaugu

SEQ ID NO: 222025 - RNA, 75 nt, Homo Sapiens
auuggagucagauacuucuuaauuaaaguauuuuaauaugguuuucagugcuaaaacauuuauguuuguggauuu

SEQ ID NO: 222026 - RNA, 75 nt, Homo Sapiens
gcugaagaguaauaggcuagaguaugauuacaguaacauucuguacagugcuauaauuguguuacaguugccuac

SEQ ID NO: 222027 - RNA, 75 nt, Homo Sapiens
auaaaccaaucaucuuaacuuucaucuguugacaauuugccauagcagugcuagggucuaaugaaacaaaaaaua

SEQ ID NO: 222028 - RNA, 75 nt, Homo Sapiens
ucuuggaccuuuaauacaguaggauuaacuggaaaaaaugugucucagugcuaauuggauuuaauauuuguauua

SEQ ID NO: 222029 - RNA, 75 nt, Homo Sapiens
caguuauaaauggaaucuugaaggcacuugccauuaauccuaauucagugcuaucccuaaauccuccucuaaaag

SEQ ID NO: 222030 - RNA, 75 nt, Homo Sapiens
ucacucugagaggagugauaccaaugaaaaaaggucaguugauuccagugcuaaaagggaaaaaccugugguccg

SEQ ID NO: 222031 - RNA, 75 nt, Homo Sapiens
uggggggaaaucacaagucacugagguguuuguuuguuuguuaggcagugcuagagcuugaagccacucaagcca

SEQ ID NO: 222032 - RNA, 75 nt, Homo Sapiens
aucauuaugguauauaaucuacccuuaacagagcuuuucuuauuacagugcuaaaaugauuucugauaaaauggu

SEQ ID NO: 222033 - RNA, 75 nt, Homo Sapiens
uaauacucuaaaaauagaaagaccaguaauauauaagucacuuuacagugcuacuucacacuuaaaagugcaugg

SEQ ID NO: 222034 - RNA, 75 nt, Homo Sapiens
ugagacugguccugguuuuguucccuuuggguacagaccucuugucagugcuauaaauuguuuaaugaggccauu

SEQ ID NO: 222035 - RNA, 75 nt, Homo Sapiens
uuacacauaaagcacuaccuaaguaauucucucucuguuuugugccagugcuaaacuacugauuacuuguaauua

SEQ ID NO: 222036 - RNA, 75 nt, Homo Sapiens
accgccacagcccggcagaggggcacacucuggagaccuugcuggcagugcuagccaggaaacagagugaccaag

SEQ ID NO: 222037 - RNA, 75 nt, Homo Sapiens
ugcuucugauacuaaggacguauccaggaguaccacaaccaccaccagugcuaccaccguugccacugagcccac

SEQ ID NO: 222038 - RNA, 75 nt, Homo Sapiens
accuagaucacaguauuuaaguguuuugcguuuuauacaugaggucagugcuacagccaccuagcaugaacuaac

SEQ ID NO: 222039 - RNA, 75 nt, Homo Sapiens
gcuucacaaacaugaccagauaacugacuagaaagaaguaguugacagugcuauuuugugcccacugucucuccu

SEQ ID NO: 222040 - RNA, 75 nt, Homo Sapiens
cugagagaguuaagugaaugucuaaggucacacaguauuaagugacagugcuagaaaucaaacccagagcugugg

SEQ ID NO: 222041 - RNA, 75 nt, Homo Sapiens
gauuucucaccucgaagcgcgaaaaauucuugccuuuccuuguuucagugcuaacucugagcugugggauucuau

SEQ ID NO: 222042 - RNA, 75 nt, Homo Sapiens
aaagaauaugugcuccuuuuguauuauuugcaauuuuauuaguuacagugcuauuuuuaaauucuucauaguuga

SEQ ID NO: 222043 - RNA, 75 nt, Homo Sapiens
agaugaguuaaaaccuuugaaagcaggcugugaacauugggugcccagugcuaucgagacacuaacccuucaaag

SEQ ID NO: 222044 - RNA, 75 nt, Homo Sapiens
caugaagguggguucaccauucagccacaucaggcacauggaacacagugcuauuucacaggccagcaguccaug

SEQ ID NO: 222045 - RNA, 75 nt, Homo Sapiens
agcacagcuaccucuggugguggcccagagcuacccugggagugucagugcuagcccugggccugggccugccua

SEQ ID NO: 222046 - RNA, 75 nt, Homo Sapiens
cagucaccagcagguuccucaagcgcaugcacacugaacucugcucagugcuaaagcuuuagcuuuuaacucugg

SEQ ID NO: 222047 - RNA, 75 nt, Homo Sapiens
aguauacaucuagagaggaaugucccugcaucugaacaucuuucccagugcuaucaguuugguaaacauugggau

SEQ ID NO: 222048 - RNA, 75 nt, Homo Sapiens
auucuagauuccugccuuuuacgugugauacugacagguaagcaacagugcuagcuucaguaggguuugagacuu

SEQ ID NO: 222049 - RNA, 75 nt, Homo Sapiens
cauggcuuaaucuuauuuuacaaaaaacccauguguuaaaauacucagugcuaaauuacaaaacaaacaaacaaa

SEQ ID NO: 222050 - RNA, 75 nt, Homo Sapiens
ggugggaaauacaguuuagcgugaagaaaauaguuugaguagcagcagugcuauaccuaugaauucuucuaauac

SEQ ID NO: 222051 - RNA, 75 nt, Homo Sapiens
guuagaaugcuuuuucagcauuauggcuaaaauauaugucuaacccagugcuauuuaggugaaaaugcuaauuga

SEQ ID NO: 222052 - RNA, 75 nt, Homo Sapiens
ccgaaguaauaagugaggacgaaugcacugcucuggaacauaacccagugcuaacuggggguuucauuuauucag

SEQ ID NO: 222053 - RNA, 75 nt, Homo Sapiens
aggcacagugaaaaagaagucaaaaaaaaaaguucuacuuuucaucagugcuauuaaagguggcagcaaauguaa

SEQ ID NO: 222054 - RNA, 75 nt, Homo Sapiens
uugagucaucccaguuuccuaguuuaaaaaucuuguaacacucagcagugcuauugaaaagauuugcugauuauu

SEQ ID NO: 222055 - RNA, 75 nt, Homo Sapiens
uuuagcacaguauuuugaucugcuugagagacacugggacacugucagugcuagacuugcaaagcaacuaguggg

SEQ ID NO: 222056 - RNA, 75 nt, Homo Sapiens
aauuguagccaggaaauaagguuuguggaaaugcuggacuuggcucagugcuauauguuuuaugacucugcugca

SEQ ID NO: 222057 - RNA, 75 nt, Homo Sapiens
acuaaaauacaugggcaugcaucuuacacugaucuuauuagaggucagugcuaaguacccaucuugauugaaguu

SEQ ID NO: 222058 - RNA, 75 nt, Homo Sapiens
acagggccaaagccauaguguccggucccaaggacaaggcucuuccagugcuaggagagguaugagcagccucuc

SEQ ID NO: 222059 - RNA, 75 nt, Homo Sapiens
caggguccuuucuugaggccauuuaaauucuuugaaaguggcucccagugcuauuuggcuuggcuuuagucuuac

SEQ ID NO: 222060 - RNA, 75 nt, Homo Sapiens
ugugugugugugugucuaagaaaacuugugugcuuuucaaaaaggcagugcuaagcacaagauuucaagaaagcc

SEQ ID NO: 222061 - RNA, 75 nt, Homo Sapiens
auuucacuguagacuguuuuaaauugccaagacugcacaaaauuacagugcuaauguauaugguugcaguucaca

SEQ ID NO: 222062 - RNA, 75 nt, Homo Sapiens
gagaggcauguuagguuucagagauuuucuccauggagcaaggugcagugcuagaauauggugguugauucccaa

SEQ ID NO: 222063 - RNA, 75 nt, Homo Sapiens
cucaguuugccuugcggggagggggcuccugggccaugggacuuccagugcuaaaacugggaaagccccagguaa

SEQ ID NO: 222064 - RNA, 75 nt, Homo Sapiens
aaauuauuagaaauuaugcuuuuuccauuuuaauuguauugcugccagugcuauuuuuuucuuuaaaaaauuuua

SEQ ID NO: 222065 - RNA, 75 nt, Homo Sapiens
ucggggcuuggaagagcucuucaguuuuucuguuuccucaagucucagugcuauccuauuacaacauggcugauc

SEQ ID NO: 222066 - RNA, 75 nt, Homo Sapiens
cagagcuuggcaggaggcucccggcggaccaaggaggaggagcugcagugcuaaguccagccagcgugcagcugc

SEQ ID NO: 222067 - RNA, 75 nt, Homo Sapiens
agaaaugugugacccuucauuuauggauauugacuauauguaaugcagugcuaucccaauauuuucaauaaagga

SEQ ID NO: 222068 - RNA, 75 nt, Homo Sapiens
agaauucauuuuaucaaaaagacaccugcaccaauauguucauuacagugcuauucucaccagcaaggacagaga

SEQ ID NO: 222069 - RNA, 75 nt, Homo Sapiens
ugcacugauuguuauacuuuaaauaacuaaaaaucugagaauccacagugcuacagacaauaagugauaaaaugg

SEQ ID NO: 222070 - RNA, 75 nt, Homo Sapiens
ucugacccaaccacagaggaauauggacucagccuugcaaauagccagugcuagucacucaggugcugaagggua

SEQ ID NO: 222071 - RNA, 75 nt, Homo Sapiens
ucucucccucccuucgucucacaggggcucaggucgugugggccccagugcuagagccccucccggccccaaacc

SEQ ID NO: 222072 - RNA, 75 nt, Homo Sapiens
ggaguacaucugcccugccauggcauguuugaggacucugcggaucagugcuacaauucaggugaaaaguuggcg

SEQ ID NO: 222073 - RNA, 75 nt, Homo Sapiens
auaauaaaguauuaauaauuauguuaggagaaaaauuaauauauucagugcuaaucuuuauauuugauaucuaaa

SEQ ID NO: 222074 - RNA, 75 nt, Homo Sapiens
uaauguguuuucccacauuuagcaucacaaaagaacagguauuuucagugcuacauuuuucuauuuuacuugcag

SEQ ID NO: 222075 - RNA, 75 nt, Homo Sapiens
augguaauggacagaguuauaacugagcaaaccccugugguccggcagugcuaccuuuugacuauuuucagcacc

SEQ ID NO: 222076 - RNA, 75 nt, Homo Sapiens
acgguaauggacagaguuauaacagagccaaggccuugggagcagcagugcuaccucucuuuuaauuucagcacc

SEQ ID NO: 222077 - RNA, 65 nt, Homo Sapiens
ccaagccagaauucaucuagacccuagggcagugccagugcuaggcugagcaccaucagcucucc

SEQ ID NO: 222078 - RNA, 75 nt, Homo Sapiens
ggagaaaagauguuggcauugcugauuguuugguuaagcaauguccagugcuaggauuauuugcagguuugguuu

SEQ ID NO: 222079 - RNA, 75 nt, Homo Sapiens
uggaggcauguauagguaugaucuguguaaaaucugacauaaaaacagugcuauucugagugaaaauuuuuuuga

SEQ ID NO: 222080 - RNA, 75 nt, Homo Sapiens
cuuuuugggaugagaacauuuuaguuguuuaguuuguuucuuaagcagugcuauuuuuuguaaacacagauaaau

SEQ ID NO: 222081 - RNA, 75 nt, Homo Sapiens
aaagccagaaauucuugcuucccauuucuagaauaguuucuagaacagugcuaugcacauauuagaucuuaauaa

SEQ ID NO: 222082 - RNA, 75 nt, Homo Sapiens
ccauuugaugauucuguauuucagagucaguuucuugaguaacuccagugcuacaaaaagaauuaguaauguggu

SEQ ID NO: 222083 - RNA, 75 nt, Homo Sapiens
uuaaaggaaguaugaguugaaagcucauguuaacuuucuuuuggucagugcuauuaagauuaaaaauuguacaug

SEQ ID NO: 222084 - RNA, 75 nt, Homo Sapiens
ugcucuguaugucacuacauaaugaaaguagcaggugcuaaguaucagugcuaaauauguggucaaaaacuagau

SEQ ID NO: 222085 - RNA, 75 nt, Homo Sapiens
gaggaagaccaugaaagcugaaacgcugcaguauuuugauuuggucagugcuacgccauccuguuaaccacagug

SEQ ID NO: 222086 - RNA, 75 nt, Homo Sapiens
ucugucuauauaaauagagaaguauauugguaguugucaauauagcagugcuagcuagaucuuaaagggcaaagc

SEQ ID NO: 222087 - RNA, 75 nt, Homo Sapiens
ggggccuccccacaggccaccuugggaaggcucuucuccggggcacagugcuagugcccugcaagcaaccccgcg

SEQ ID NO: 222088 - RNA, 75 nt, Homo Sapiens
uuuaaacugcuaacagaccuuaaaauaucccccuaccuggguccucagugcuauguuuaaagugcugcagggaug

SEQ ID NO: 222089 - RNA, 75 nt, Homo Sapiens
gaaaugcuuaggacuuuguggcuuguuacauuugucauuuaacugcagugcuauucuuugaaagcugcuaugugu

SEQ ID NO: 222090 - RNA, 75 nt, Homo Sapiens
uagguccuacugucugccaguacucaugugaguuguaugugcccccagugcuacauacgcagguaugcguaagug

SEQ ID NO: 222091 - RNA, 75 nt, Homo Sapiens
agcagaaaugcaauucuuugggacaaaagaugucauugacguagucagugcuaagaacugacccucuugggacaa

SEQ ID NO: 222092 - RNA, 75 nt, Homo Sapiens
uggaaaacggaaaauuuacaaagauuaugauaagaaagucugucacagugcuauuaagaaguagauagaaauacg

SEQ ID NO: 222093 - RNA, 75 nt, Homo Sapiens
gggauuaaaugagauaauaugaguggcagcucuucaugaguccugcagugcuaagcaaaugucagaaauuggugu

SEQ ID NO: 222094 - RNA, 75 nt, Homo Sapiens
caugucuaguauauuaagucuccauagcccuccugaugcaguagacagugcuaugcuguggauauaauaccaacc

SEQ ID NO: 222095 - RNA, 75 nt, Homo Sapiens
gcuuucucugcggugggguagagaauggagcucccgccuugcgggcagugcuaaagguggagcugggggauuuuc

SEQ ID NO: 222096 - RNA, 75 nt, Homo Sapiens
aauucuccuucucugaaugaccuaacaggagcuucaucaccaacucagugcuauucuuuuugugaagccauaugu

SEQ ID NO: 222097 - RNA, 75 nt, Homo Sapiens
caaaagaggaccacacaucuguuggucacagaguucaugucacaccagugcuagaaguuucaugauuuuauuucc

SEQ ID NO: 222098 - RNA, 75 nt, Homo Sapiens
uuuucucaauuguaacgacuucuccaucuccuguguaaucaaggccagugcuaaaauucagaugcuguuaguacc

SEQ ID NO: 222099 - RNA, 75 nt, Homo Sapiens
cauucuuaaaaaguuauuucaagggauggcauaacuguaagaggucagugcuagaauaaaguccuguagguuuau

SEQ ID NO: 222100 - RNA, 75 nt, Homo Sapiens
cucccauucuccccucccguucugccacagcggccugggcugguccagugcuaugccuggaggcucaacacaaaa

SEQ ID NO: 222101 - RNA, 75 nt, Homo Sapiens
acgggaggcagagccggcuccaggaggugaucaauuacaugugcacagugcuaggcuuuuuuccuuguggucauc

SEQ ID NO: 222102 - RNA, 75 nt, Homo Sapiens
aaauugccuauuaagguaaaaaaaauccguuuuauccaucagagucagugcuauaaggaacaagggaugagggag

SEQ ID NO: 222103 - RNA, 75 nt, Homo Sapiens
uacugaaguuauuuauuaaauuuaguuuuaacaguucacuuuuuacagugcuauuacauucuuguuuuaagugcc

SEQ ID NO: 222104 - RNA, 75 nt, Homo Sapiens
auccccaccccuacaccacugggccaagauagaaucuguaccacucagugcuaccggagaguucccccaugauga

SEQ ID NO: 222105 - RNA, 75 nt, Homo Sapiens
gcuggggaggaacagucaaggcucuguggcuuuucccaacacaaucagugcuaguuuaucuggcugugcagccuu

SEQ ID NO: 222106 - RNA, 75 nt, Homo Sapiens
guguguucucaguuuaagaugugacuucuccuuuuuucuguggaucagugcuauuacuaucuuaugagggagaug

SEQ ID NO: 222107 - RNA, 75 nt, Homo Sapiens
aguguugccuuucugagggauuucugcucaaugcaauacacuguucagugcuauucucccagcuagguuuaucca

SEQ ID NO: 222108 - RNA, 75 nt, Homo Sapiens
cuuacugauaagaagcugaaacaagaaauucucuucauuuuaucccagugcuauuuuauugauuaauuacuaaaa

SEQ ID NO: 222109 - RNA, 75 nt, Homo Sapiens
auaugcugauuugcucuuucucauuguaugucuaugcuuugucaucagugcuauaguaaauuacaaagaaauagg

SEQ ID NO: 222110 - RNA, 75 nt, Homo Sapiens
aauuuaauuucaagaugaguuuuggaggggacauucaaaccauagcagugcuauaauuuuaaaguacuucaaagc

SEQ ID NO: 222111 - RNA, 75 nt, Homo Sapiens
gggccagucuuucccguggcguccccuggaggggagguggaaaaucagugcuacggucacugcuccugggaccca

SEQ ID NO: 222112 - RNA, 75 nt, Homo Sapiens
aaguuaaagaaaaaaaaacucuacuaggcagccuuugugccacuucagugcuagaaagaaaaaaaaguggcuggu

SEQ ID NO: 222113 - RNA, 75 nt, Homo Sapiens
gagcugggcaugguaccagccccgcacacccucacucugccagggcagugcuaguuggcuccaugcuccucacug

SEQ ID NO: 222114 - RNA, 75 nt, Homo Sapiens
caugacaggggcgcuugggaggggccggaggaaccgagguguugccagugcuaagcugcccugaggguuuccuuc

SEQ ID NO: 222115 - RNA, 75 nt, Homo Sapiens
aguggguggauuuguugccaugugcaccuugggguuuuguaaugacagugcuaaaaaaaaaaagcauuuuuuuuu

SEQ ID NO: 222116 - RNA, 75 nt, Homo Sapiens
auuauaauuacuugccacuugaauguguuuuguguaauguuuuaacagugcuaguaaauaaauacggguuuaccc

SEQ ID NO: 222117 - RNA, 75 nt, Homo Sapiens
uguuuguccuguauuuacaguuguuuuugacuaugcaggagcuaucagugcuagagugagcaugcuucaaaacug

SEQ ID NO: 222118 - RNA, 75 nt, Homo Sapiens
ucguuugagaauuguagccuguuguuuucgcugugacuugggucucagugcuaggguauugagucaggcagcugg

SEQ ID NO: 222119 - RNA, 75 nt, Homo Sapiens
auguguaaucaguuuacauuguuuuguauagugaagguguauuuucagugcuacccgcuagcugauuuuaacuuu

SEQ ID NO: 222120 - RNA, 75 nt, Homo Sapiens
aucuccuaacaaaagaacuaagaggcccagcccucagaaacccuucagugcuacauuuuguggcuuuuuaaugga

SEQ ID NO: 222121 - RNA, 75 nt, Homo Sapiens
aaugcuuauaauguaguacaauuaaaaacaacacaucuccacuaccagugcuaacccauuuuuaaguacauuugc

SEQ ID NO: 222122 - RNA, 75 nt, Homo Sapiens
uaaauuaaucacuacugauagcuuuuuauuacuguggggagagggcagugcuaaacccagggcauuauguacagu

SEQ ID NO: 222123 - RNA, 75 nt, Homo Sapiens
aauuucuuccuuuccugcuuaguuuuagcguguuuuaugcaauuucagugcuaacuggccucuaauagguuggga

SEQ ID NO: 222124 - RNA, 75 nt, Homo Sapiens
cugaaugugaccugguuaccgguaguuguaugauuuuguuaccagcagugcuaacuaucuuguuuuugaagccag

SEQ ID NO: 222125 - RNA, 75 nt, Homo Sapiens
cuagccaaauuacauauguauuauaauuauuaguggcaacagagucagugcuaauuccuuuuuuccuaagaccau

SEQ ID NO: 222126 - RNA, 75 nt, Homo Sapiens
agauaccaggcaucuaguuugccacugcagcuaaguauuaauccccagugcuaaagcccuuaugccccaguucaa

SEQ ID NO: 222127 - RNA, 75 nt, Homo Sapiens
gaucuuccucagaagaacauucgcuuauugauauuccuuguuccacagugcuaugauuugcaggcucuuguguca

SEQ ID NO: 222128 - RNA, 75 nt, Homo Sapiens
aaagugcauuagaauggaauggagaugagaaaaaaauucaccuuacagugcuaagccaacaaacaauaguucuag

SEQ ID NO: 222129 - RNA, 75 nt, Homo Sapiens
cgucugaccugcacugcucauauccaccacccuuagacacaaucccagugcuaccuucuggaacuuucuaccgag

SEQ ID NO: 222130 - RNA, 75 nt, Homo Sapiens
uuuucuuaaucagaaaggaauguaaaauugacuuuaaaaauauugcagugcuauuuuuguaucuaauguguacag

SEQ ID NO: 222131 - RNA, 75 nt, Homo Sapiens
gugcuuuaaaaagaacccucacaaguuaaaaauuaagaguuguuucagugcuagaucuuaccagcuaaagacuug

SEQ ID NO: 222132 - RNA, 75 nt, Homo Sapiens
uaccaagguucagaaauacguaauuuagcaggaaacuauaaauaccagugcuaucacagccacacauacacacac

SEQ ID NO: 222133 - RNA, 75 nt, Homo Sapiens
aaugccagagccaaccuggagagcuucucugggcugaauguaugucagugcuauaguuuagagagccugucacca

SEQ ID NO: 222134 - RNA, 75 nt, Homo Sapiens
uauuuguguaucuaaacauacugauuacuguaggcgguuguaacacagugcuaagcuguauggcauauuacugua

SEQ ID NO: 222135 - RNA, 66 nt, Homo Sapiens
augggccaccccccacauagagggcauagcuggccacagugcuacaccaccugccugauugccaag

SEQ ID NO: 222136 - RNA, 75 nt, Homo Sapiens
ugauucuagacauagacagggaugauccacuguuacugagggcaucagugcuauaaguuaaggcuuucugcacug

SEQ ID NO: 222137 - RNA, 75 nt, Homo Sapiens
ucagaaugugaagauuuuacucuuggcuuaauuuuucccuccacucagugcuaaggcugagccuccagaugcugu

SEQ ID NO: 222138 - RNA, 75 nt, Homo Sapiens
aggacaauucaugaacuucgcaucaaaagacaauucuuuauacaacagugcuaaaaaugggacuucuuuucacau

SEQ ID NO: 222139 - RNA, 75 nt, Homo Sapiens
cuuccuauagccuggagaaccugaggcuuccccagaagcagaugccagugcuaugcuaccaugaguaaaagcuuc

SEQ ID NO: 222140 - RNA, 75 nt, Homo Sapiens
uagugaauaaaaaaauuaguuuuucagaaucuuuaaaauauaagacagugcuaucauaagcguuaaaaauugugu

SEQ ID NO: 222141 - RNA, 75 nt, Homo Sapiens
caacuggggaaaaggaugauguggggggaugagauuaggcugaggcagugcuaguacaguaugucagauaagccg

SEQ ID NO: 222142 - RNA, 75 nt, Homo Sapiens
ugggcacacacguagacaagucaguggcagugcuguaccccugggcagugcuaccccguacauguuaagggcauu

SEQ ID NO: 222143 - RNA, 75 nt, Homo Sapiens
cauuauugauuaggucuuggcauuuagaagacuuuaccauuauuucagugcuagggucucuguuaguacuauugg

SEQ ID NO: 222144 - RNA, 75 nt, Homo Sapiens
gcauuguaguaugcauuaaucuuucaauguagugguguaaaaaugcagugcuaaacuaaugaagcaggugacugc

SEQ ID NO: 222145 - RNA, 75 nt, Homo Sapiens
ugauugucagguauguuguagcaaggggucucaguucuaggaauacagugcuaguuaagcaagguaagaugagaa

SEQ ID NO: 222146 - RNA, 75 nt, Homo Sapiens
cucuguuuaaugguaaaaggcucucaaacaguugccccagccugacagugcuaguuguccguaucaagcaucagu

SEQ ID NO: 222147 - RNA, 75 nt, Homo Sapiens
cugucaccaaccuaagaaucacuccuagucucuggccuguggauccagugcuauuuaaaaccucauuugauaagc

SEQ ID NO: 222148 - RNA, 75 nt, Homo Sapiens
gucaaguguuguccuaggaucuugggagaaugaauuuuaaaaugucagugcuaguuauauauauauuuuuuauua

SEQ ID NO: 222149 - RNA, 75 nt, Homo Sapiens
ugagaagcagcaaugaacaguuuccaagauuuuccaagaugaagccagugcuagcggcuagaaccaucuuccaua

SEQ ID NO: 222150 - RNA, 75 nt, Homo Sapiens
uuacauuuagauuaagaacauaaauuuauuuucauaaaugguuugcagugcuaaaaacuuuuaugccuuuuaaaa

SEQ ID NO: 222151 - RNA, 75 nt, Homo Sapiens
acuuacacuguugacaucuauuuucugaaguguguuuaaauuauucagugcuaaucauuguuuuuuccuuuguaa

SEQ ID NO: 222152 - RNA, 75 nt, Homo Sapiens
cauauacaaauucgugaauucuuguucauuuugcauuccugcagucagugcuaauccgucguucuuaaucaggag

SEQ ID NO: 222153 - RNA, 75 nt, Homo Sapiens
aauauagccugaagacagaggauaaauaguugucaaugucagagacagugcuauuaauguauaugugagcgacaa

SEQ ID NO: 222154 - RNA, 75 nt, Homo Sapiens
uccugguugccauggaaauagcagccaacggacaccucccgaugccagugcuaaggcuggaaauggcccccucuu

SEQ ID NO: 222155 - RNA, 75 nt, Homo Sapiens
cuuacugucaaauugcaacuuuuuuuuuagauacagaguggaaaacagugcuaagucauuuggcaccuccuuaca

SEQ ID NO: 222156 - RNA, 75 nt, Homo Sapiens
gccucaacuuccccuaacagauaugcauauuccuuccagaugccucagugcuacaccacagugggccugguccca

SEQ ID NO: 222157 - RNA, 75 nt, Homo Sapiens
gccuguggguuugguccuugucauucauuggugaaguaaauuaggcagugcuaaacaagcuuugguuuaugguuu

SEQ ID NO: 222158 - RNA, 75 nt, Homo Sapiens
agauggacagauaagugugaucuuuuccuagcuuccuggucugaucagugcuaugguuccacugaugcaaaaggg

SEQ ID NO: 222159 - RNA, 75 nt, Homo Sapiens
uaacaucacacaauaggaaacaccacuuccacaagucucaagccucagugcuaaaguacuacugaaaaggaacua

SEQ ID NO: 222160 - RNA, 75 nt, Homo Sapiens
cugagauugaggucagggugagauggaggucauguguuugccggccagugcuauguuaauccaguacauuguaga

SEQ ID NO: 222161 - RNA, 75 nt, Homo Sapiens
gaaagcagcagagagagacgggaacagucuguggauggacaugaucagugcuaaggaugcaggauaugccugaca

SEQ ID NO: 222162 - RNA, 75 nt, Homo Sapiens
gaauaucggaauaugugcacuaaauucacaaaauuagcauaauugcagugcuaaugccaaaaagaauacauuguu

SEQ ID NO: 222163 - RNA, 75 nt, Homo Sapiens
uguaacugugucccagugacacuaggcucuuuguguauuaugauucagugcuauuuucgucuuucuuuaacacac

SEQ ID NO: 222164 - RNA, 75 nt, Homo Sapiens
aucuaauuuugaauucugaccauggauacccaucacuuuggcauucagugcuacauguguauuuuauauaaaaau

SEQ ID NO: 222165 - RNA, 75 nt, Homo Sapiens
guuuaaaauuuuguauaucaccaaauuuuuaaaaagugauagucacagugcuaaguuaucuaguuggcuacuauu

SEQ ID NO: 222166 - RNA, 75 nt, Homo Sapiens
uuaauggaauucuuuucuuugauuaucaaggacuuucacugcaggcagugcuauuucuugugccuaagaauguuu

SEQ ID NO: 222167 - RNA, 75 nt, Homo Sapiens
acauucuuauuaauucuucaccuguuauguaugaaggaaucauuccagugcuagaaaauuuagcccuuuaaaacg

SEQ ID NO: 222168 - RNA, 75 nt, Homo Sapiens
uuaaucauagggguuugucuagcaagcuucugcacuaguaacugacagugcuacaauaaacaauuaauuuugccc

SEQ ID NO: 222169 - RNA, 75 nt, Homo Sapiens
auuaggucuuugucagacauaagcaugcacaaagagauaaugucacagugcuacacaaauuuauuacauuagcag

SEQ ID NO: 222170 - RNA, 75 nt, Homo Sapiens
uaccaaagccuggaaguucucaucaccuccagguggacugcuuggcagugcuaggagguggacucaggacuucag

SEQ ID NO: 222171 - RNA, 75 nt, Homo Sapiens
agcagggauucaugugacaggaauggaacagcuguagaaagccuucagugcuaucuguacugagagaauccugaa

SEQ ID NO: 222172 - RNA, 75 nt, Homo Sapiens
cugaauacaauacugcugaccgaccuccugccugggucuucagcucagugcuacugaccuuccugucccugccuu

SEQ ID NO: 222173 - RNA, 75 nt, Homo Sapiens
guuccucuuuuggguauagucucccuuuuuauccugaguuaccaucagugcuaauauuuacucuuggaucucauu

SEQ ID NO: 222174 - RNA, 75 nt, Homo Sapiens
gaaaucacuggggaaugaaugaagauacaggaauucuguguaugacagugcuauugcauucauacaaaaauccaa

SEQ ID NO: 222175 - RNA, 75 nt, Homo Sapiens
ucugcccuggcucuccuagagcuaguccacguugacagcuuaagacagugcuagcuucucgagcagaugacacga

SEQ ID NO: 222176 - RNA, 75 nt, Homo Sapiens
gggagacuccggcaaccuucagcaacauauauccucgaccagaugcagugcuauaagaacagaacgcauuuugga

SEQ ID NO: 222177 - RNA, 75 nt, Homo Sapiens
aaaggaauuuuauacauugacucagucggauucaauggacggucacagugcuauuacuuugaaaacccugcugau

SEQ ID NO: 222178 - RNA, 75 nt, Homo Sapiens
uccaguucugugggggaugaguuuuuuuguggguugcuuuuucuucagugcuaagaaaguucccuccaacaggaa

SEQ ID NO: 222179 - RNA, 75 nt, Homo Sapiens
acuuuucuaaacugcaucuggauugaaagguguaaauaucaauaacagugcuacuuaguuaucaguauuuaauau

SEQ ID NO: 222180 - RNA, 75 nt, Homo Sapiens
uggauucauugcagcggaccaccgggcacuguugaccccacugagcagugcuaaguguugguuuaguggauguuc

SEQ ID NO: 222181 - RNA, 75 nt, Homo Sapiens
ccugagguucuggagcucagguuccugagcccccacccccaaucccagugcuacaccugucuucuccccuaggug

SEQ ID NO: 222182 - RNA, 75 nt, Homo Sapiens
aucauuggauucaguucccaaaauuucccucccagggagcaauuucagugcuagguacaauguucccuuguggcc

SEQ ID NO: 222183 - RNA, 75 nt, Homo Sapiens
acuuuguauuuuuugauacuacaacccaacccuucucacucuccucagugcuagccccagaggucccucugggcc

SEQ ID NO: 222184 - RNA, 75 nt, Homo Sapiens
ugcuaaggauacuguuuaucuuuuuguguaucugagauuuauuaacagugcuaaccuuugcccucuggaacuuga

SEQ ID NO: 222185 - RNA, 75 nt, Homo Sapiens
cucauccuugcuuuccagccuauaaacagauuuguaccugagccccagugcuacaccuuuucucuccuugagcuu

SEQ ID NO: 222186 - RNA, 75 nt, Homo Sapiens
agaccccagagagagggcaaacaccuccugggcugggcagagugacagugcuagaaccaggcuucgugggcacag

SEQ ID NO: 222187 - RNA, 75 nt, Homo Sapiens
cuagauucugugagauucugcuuccuccaaaggcccaggacaggacagugcuaccgagauucaaaagcugcauuc

SEQ ID NO: 222188 - RNA, 75 nt, Homo Sapiens
cuugcugaguauucugucacagacaagccuccauuaaagccacagcagugcuacccaccacacacaccuugcugg

SEQ ID NO: 222189 - RNA, 75 nt, Homo Sapiens
gagccaggaguauggagaucugagaccgugagcagggaagaaagccagugcuaacaugcaaccauuccucacgcc

SEQ ID NO: 222190 - RNA, 75 nt, Homo Sapiens
gggggugggagugaaugcuaaaagcagaucguccagugcccuuuucagugcuaccggccucucaccaagcagucc

SEQ ID NO: 222191 - RNA, 75 nt, Homo Sapiens
auuaaucucucugggucucaguuuucucaucuguauuggagguagcagugcuagcucugccuucaggcaugcaau

SEQ ID NO: 222192 - RNA, 75 nt, Homo Sapiens
uggcuucucuuugaggauuugacucgaggcagugguaacacugcacagugcuaugggucaccugugcccugucca

SEQ ID NO: 222193 - RNA, 75 nt, Homo Sapiens
uccugaccacuuguagucccuccgacuucucuagacaucuagucucagugcuagcuuauuuguauuuuuccucuu

SEQ ID NO: 222194 - RNA, 75 nt, Homo Sapiens
ugauugugaacuuggugccuaauguuccaugucugaaguuugccccagugcuacacguuggaguauaccuaugug

SEQ ID NO: 222195 - RNA, 75 nt, Homo Sapiens
auaccucaauauaauuccucuaguucugcuucuaaaaucugaggacagugcuagugggaaaauaauuuucaaacu

SEQ ID NO: 222196 - RNA, 75 nt, Homo Sapiens
uaagugcuuauucaaagacuagguuauuuucaacugggaaaaaagcagugcuaacaggauauuguucugggauag

SEQ ID NO: 222197 - RNA, 75 nt, Homo Sapiens
ccauauggcugugcagccuugcucuguggcuuuucccagcacaaucagugcuagugcuggggaagggacagucaa

SEQ ID NO: 222198 - RNA, 75 nt, Homo Sapiens
cgaguuucuacgugguggagggccugguugaggcuggagagaacacagugcuauuugcauuucuguuccauaugg

SEQ ID NO: 222199 - RNA, 75 nt, Homo Sapiens
uacuuuaagucaucucucgauuauuuguaacaccuaauacaaugucagugcuauguaaauagcuguuauauugua

SEQ ID NO: 222200 - RNA, 75 nt, Homo Sapiens
ugucacaugucugcuuccacucaagaagccaaagaaacacuugugcagugcuaagggcaguauacacagcacuac

SEQ ID NO: 222201 - RNA, 75 nt, Homo Sapiens
agcuaugcacagaaaauaaacuuauacacucugauuccuauaauacagugcuauauuuuauuuuucauuuuuuug

SEQ ID NO: 222202 - RNA, 75 nt, Homo Sapiens
cucgucuccacuguuuguuuaccuggggguuggugauuugggggacagugcuacaggcccagcccaggccuuggg

SEQ ID NO: 222203 - RNA, 75 nt, Homo Sapiens
ccuccccccucccccgacccgucaucuagcauuagguauaucucccagugcuaucugcgcugcacccacuaaugu

SEQ ID NO: 222204 - RNA, 75 nt, Homo Sapiens
gaaaggcaguagucauuuucaacccacucagagaugcauuuggaacagugcuacuuacaugcacacucaugugca

SEQ ID NO: 222205 - RNA, 75 nt, Homo Sapiens
gcuucauccuguugcuggcaagcacaucucuuaacugcauggugccagugcuaaucucuccuggcacgaauauaa

SEQ ID NO: 222206 - RNA, 75 nt, Homo Sapiens
cgcugcccaugcugggucaauacccugcccaucuuuguugccauucagugcuacgagcuaucagauaaggcaaac

SEQ ID NO: 222207 - RNA, 75 nt, Homo Sapiens
gugccuucuauuuaauucuuauuauuauguucugagaaagcuuuacagugcuacuccacacauacauagaaaaag

SEQ ID NO: 222208 - RNA, 71 nt, Homo Sapiens
ugccuaagugcuacgugauccucugccgcccagaccucaacagcacagagcacuuccaggccuccauucag

SEQ ID NO: 222209 - RNA, 71 nt, Homo Sapiens
aucggaagcgaccgcgggcuuuuuugcccuucucuuaguugagcacagaacccucagcucuggugcgggca

SEQ ID NO: 222210 - RNA, 71 nt, Homo Sapiens
cuuggaaacuaaaaccuaggucuuagguacauccuaaagggagcacagaacccaucauuucacacauaggc

SEQ ID NO: 222211 - RNA, 71 nt, Homo Sapiens
aggagcuggugacauucugaugcuggaggcaggugacggggagcacagacuuuguguccugcacacugagc

SEQ ID NO: 222212 - RNA, 71 nt, Homo Sapiens
gccaucaaggagagcagcaaguuuccauuuggcauuagcccagcacagagccaccggaacaucaagauccu

SEQ ID NO: 222213 - RNA, 71 nt, Homo Sapiens
gaaggauugaaauuaaacccugagccaccguguccuuguagagcacagaguagagaacaacuggcagcuuu

SEQ ID NO: 222214 - RNA, 71 nt, Homo Sapiens
gcugauucuccagcugcugccccagccuuuccgccuugcacagcacagagguggucaccccagggacagcc

SEQ ID NO: 222215 - RNA, 71 nt, Homo Sapiens
acaucugauucuuccagccauguuucccagucugaagaacaagcacagauugaugcugaaauggacucuac

SEQ ID NO: 222216 - RNA, 71 nt, Homo Sapiens
ggugagagaggaguuggccuagagcaggccacugugagcucagcacagaguaggaagaacagugacaucau

SEQ ID NO: 222217 - RNA, 71 nt, Homo Sapiens
uguaagagaggugagaagugcucccaagcagacacaacagcagcacagaggucuggaggccacacaaaaag

SEQ ID NO: 222218 - RNA, 71 nt, Homo Sapiens
ccaggcacuacggcuuccucuccagaauguggcuuugccugagcacagacagagucagcauggaaugcucu

SEQ ID NO: 222219 - RNA, 71 nt, Homo Sapiens
caguggccuuugugaguugucugcaacucagcucuucccccagcacagaucuguuccccuuauccugcaga

SEQ ID NO: 222220 - RNA, 71 nt, Homo Sapiens
ccccuuccacuuccaucagggcuauuccgcagcuugcagcaagcacagagugugaccucccaggauuugcu

SEQ ID NO: 222221 - RNA, 71 nt, Homo Sapiens
gggcugggugcagccagcuguccugcagcucuggggagaccagcacagaacugaggaacaucugcaggagg

SEQ ID NO: 222222 - RNA, 71 nt, Homo Sapiens
ucuuaaauguuguaguauuaauuucaaaacuaaaaaucgucagcacagaguauguguaaaaaucuguaaua

SEQ ID NO: 222223 - RNA, 71 nt, Homo Sapiens
aaugauagaaguuuccaucuacaauauauguuccuaaauggagcacagauguucaaacuaugcuuucauuu

SEQ ID NO: 222224 - RNA, 71 nt, Homo Sapiens
agaagcaauauaagugugauugcaagaaugguagaggaccgagcacagaaaucuuagagauuucuuguccc

SEQ ID NO: 222225 - RNA, 71 nt, Homo Sapiens
uuuuuuuuuucaacuuuuuccuuuaaaggacuccuaaacuaagcacagaagaguuggcgucaucuuaaaaa

SEQ ID NO: 222226 - RNA, 71 nt, Homo Sapiens
gaccucaguuugcguaugugugguugcucugggaagcccaaagcacagaccuauaucccuuugcagcuugu

SEQ ID NO: 222227 - RNA, 71 nt, Homo Sapiens
gaggcuagaaucaucuuuccuagugauccugacauuuagacagcacagaaauaaagagcaauaaaaagaac

SEQ ID NO: 222228 - RNA, 71 nt, Homo Sapiens
uaguaaaaggcagucuauaauuaacugacagaccuaacugaagcacagagaauacaucagacuuaugcauc

SEQ ID NO: 222229 - RNA, 71 nt, Homo Sapiens
gaccaauccccauggcagacagcgggcuggugaacaggaagagcacagaaucucuguggggcgaugcugca

SEQ ID NO: 222230 - RNA, 71 nt, Homo Sapiens
uuccgcacaggauuuccuaagacgagagggauuuagccaagagcacagacuuggauuccuucugucccucc

SEQ ID NO: 222231 - RNA, 71 nt, Homo Sapiens
ugugugugaagugaaccucuaccugaccaugaagaggcaagagcacagacuuacaaggauuucaacuuaag

SEQ ID NO: 222232 - RNA, 71 nt, Homo Sapiens
acaacucagcuucggggccggugaggggaggggccucccccagcacagaugaggagcagcugggguaggcu

SEQ ID NO: 222233 - RNA, 71 nt, Homo Sapiens
aagauaaaaguuugaggagaacaaacaggaauucugaauuaagcacagaguugaaguuuauacccguuuca

SEQ ID NO: 222234 - RNA, 71 nt, Homo Sapiens
uuauggaguaccuacuauaauacaguagcuaacauguauugagcacagauuuuuuuugguaaaacugugaa

SEQ ID NO: 222235 - RNA, 71 nt, Homo Sapiens
uauuagcugcaagcuuuaccaaguaauuggcaugacaucugagcacagaaauuaaggcaaaaaaccaaagc

SEQ ID NO: 222236 - RNA, 71 nt, Homo Sapiens
agaaggugcucacuaacagauguauuuaucuugaagagauaagcacagaagccgauuuucacauccuucca

SEQ ID NO: 222237 - RNA, 71 nt, Homo Sapiens
ucugcuccaucagaccucuuccuagccugugcucugccagcagcacagacagcguuucacuugugucugcu

SEQ ID NO: 222238 - RNA, 71 nt, Homo Sapiens
gaccaaagguuaugcacaggucucuugcagauaugagagauagcacagaugaaauauuaacauuuuagguu

SEQ ID NO: 222239 - RNA, 71 nt, Homo Sapiens
ccccugggacaccuacaggccuggcuguuuagcuugagggcagcacagaggccgggcugcccccgccagcu

SEQ ID NO: 222240 - RNA, 71 nt, Homo Sapiens
ccaucauuucccuuuccccuuggcccaggaugacaaugcacagcacagaugaagcaugugguugcauuggg

SEQ ID NO: 222241 - RNA, 71 nt, Homo Sapiens
ccacauuuuuauacaugaggaaagguucuauuauuaaaagcagcacagauuuuuuuuuuucuuugaaccuu

SEQ ID NO: 222242 - RNA, 71 nt, Homo Sapiens
uauuauuauuuuuuucuuuuuuaaggagaaaugugucugaaagcacagaaccuuagcuccugucggguuca

SEQ ID NO: 222243 - RNA, 71 nt, Homo Sapiens
ccggggugugugugugugugugagcagucugccugugagugagcacagauggcaagaaaggugcaagaaag

SEQ ID NO: 222244 - RNA, 71 nt, Homo Sapiens
aauauauguaaaggguuugggaggaguagguacauacaaucagcacagauuauguccaugcuguguccaag

SEQ ID NO: 222245 - RNA, 71 nt, Homo Sapiens
cugacuucuuuagacaaaguaguuuugugaaaauaguuuucagcacagaaaaaaacaguuuaguagccuuc

SEQ ID NO: 222246 - RNA, 71 nt, Homo Sapiens
uguaaaccuucccuuuugacuggagggaauucugagaagacagcacagaaugcugggucuguucuuacucu

SEQ ID NO: 222247 - RNA, 71 nt, Homo Sapiens
cuuaagacuacugaguugugcaugucagucuaugcagcaaaagcacagagaacaauggguagagcacaccg

SEQ ID NO: 222248 - RNA, 71 nt, Homo Sapiens
gccagaacucuaucgggcacugucucuuuggcugcugccucagcacagagaucauuggcaaauaagcauuc

SEQ ID NO: 222249 - RNA, 71 nt, Homo Sapiens
gccgcuaaauaaaaucuuuggaacucuguuucuaagugccaagcacagaaaaaaauuugcccuuaugcacg

SEQ ID NO: 222250 - RNA, 71 nt, Homo Sapiens
aggcucauaucaccucuuccaauuggacauuucucugucagagcacagaggcaaugaugccuuugaucugg

SEQ ID NO: 222251 - RNA, 71 nt, Homo Sapiens
uccagccccgcuacuuacauaagugcuuucucugcccagacagcacagaaccugugcccaucauucagucc

SEQ ID NO: 222252 - RNA, 71 nt, Homo Sapiens
cuacaguuaacgcugaacuguguagcucaggagacaauuccagcacagacagugcauaaugucugcucuug

SEQ ID NO: 222253 - RNA, 71 nt, Homo Sapiens
ggucacuagcaccuugugugacccuuguccccacaagcagaagcacagaggugucaucuuugccuacugac

SEQ ID NO: 222254 - RNA, 71 nt, Homo Sapiens
cauacaaguuccuuggacuucugggccaucccuggcccuguagcacagacaaggaggcggcuugggauccu

SEQ ID NO: 222255 - RNA, 71 nt, Homo Sapiens
gcgguggacagauggguagauguggcaggcaugucaucgacagcacagaagggcuguccugugucccccca

SEQ ID NO: 222256 - RNA, 71 nt, Homo Sapiens
ggccacuccccagauaccagaccugaggcaauucacuugccagcacagauggccaacccaccuccagauuc

SEQ ID NO: 222257 - RNA, 71 nt, Homo Sapiens
uugacauucuggagagagacuaucuucuggaguugaguacaagcacagaaacaucuuuacgguggcaucau

SEQ ID NO: 222258 - RNA, 71 nt, Homo Sapiens
uauugcauauugugaauucauuuuuauuuugaauauaguccagcacagagcuguucaaauuuuuaguucac

SEQ ID NO: 222259 - RNA, 71 nt, Homo Sapiens
uuaaaauagaguuuucugcaguaugcuuuuagucuaagaaaagcacagauggagcaauacuuuccuucuuu

SEQ ID NO: 222260 - RNA, 71 nt, Homo Sapiens
caguucucuuaguaagaacuuuagaaguaaucuugauaauaagcacagacagccuaacagcagaggcaacu

SEQ ID NO: 222261 - RNA, 71 nt, Homo Sapiens
uucugaaucugaaagcccgccucuguccuaaaauacaaacaagcacagacauuaaaccuggauacuauaug

SEQ ID NO: 222262 - RNA, 71 nt, Homo Sapiens
guuggguguaauuaggugaaaacagcccagguccucccgggagcacagaggggcuaggggcugguccuucu

SEQ ID NO: 222263 - RNA, 71 nt, Homo Sapiens
uacuuggccagggugucaaagggacaggccuccuuguugggagcacagaagugcuaugggccagaagcccc

SEQ ID NO: 222264 - RNA, 71 nt, Homo Sapiens
guucagugggaaugcaguggguggggcuguacacacccuccagcacagacuguucccuccaagguccucuu

SEQ ID NO: 222265 - RNA, 71 nt, Homo Sapiens
cugacccagcaccacuucccagccaggagccccccaggaacagcacagaacagcagggccuggccucuggg

SEQ ID NO: 222266 - RNA, 71 nt, Homo Sapiens
uacaaguucauaggagcacaauuccuugauucagggaaaguagcacagaaugcaauuugaaaacuacaggc

SEQ ID NO: 222267 - RNA, 71 nt, Homo Sapiens
uuugagaaacaguauuuugacuaggaccucucuuauuugucagcacagaacugauuaauauguaaugcuac

SEQ ID NO: 222268 - RNA, 71 nt, Homo Sapiens
augcuucagagcucaugcgcguuacccacgauggcaugacuagcacagagcugaucucuguuucuguuuug

SEQ ID NO: 222269 - RNA, 71 nt, Homo Sapiens
acuugucaggauuucuccucuucagagagauuuuuuuuuauagcacagauuccuuugccccuuuuaucucc

SEQ ID NO: 222270 - RNA, 71 nt, Homo Sapiens
cuaacucuugaggucucuaacauaccuugucauagaggaaaagcacagauuauaccuggaugauucaggag

SEQ ID NO: 222271 - RNA, 71 nt, Homo Sapiens
cuccuggccuugcugaccucagcgguugccaggaaggggugagcacagagugccucuuacgguaguuagga

SEQ ID NO: 222272 - RNA, 71 nt, Homo Sapiens
guugaaaaauguugcucugggagacuuacugcauugccgacagcacagaugugaaggacaugagacuaaga

SEQ ID NO: 222273 - RNA, 71 nt, Homo Sapiens
uuagagauccauguguucagguuuagaucauaugacacucgagcacagaagaauaauuucaaggaggucau

SEQ ID NO: 222274 - RNA, 71 nt, Homo Sapiens
aguucuuuucaacuuauaacacuguauacaguuauuucuaaagcacagaugaaauaaguucugcauauuuu

SEQ ID NO: 222275 - RNA, 71 nt, Homo Sapiens
uguaaauaggauuuugugcuuucuguaacagugcaugcuucagcacagaaaacucagcauugauuauugua

SEQ ID NO: 222276 - RNA, 71 nt, Homo Sapiens
uuugagaaauaagguucaaaaaauaagaaugcuaacacuuaagcacagacuagagcuugcuuggguuucuu

SEQ ID NO: 222277 - RNA, 71 nt, Homo Sapiens
aucucaauugcuuuguaagugaaaaacaugacccagaggacagcacagacuauggccauggcucacauggu

SEQ ID NO: 222278 - RNA, 71 nt, Homo Sapiens
gaggaacugagaucacagggaaggagauuggaggugauaccagcacagacagacucucaccucuucuccug

SEQ ID NO: 222279 - RNA, 71 nt, Homo Sapiens
aauuaguugagagcgcuggguugacuaaccucugguaucugagcacagacagagggugcugugggucugcu

SEQ ID NO: 222280 - RNA, 71 nt, Homo Sapiens
caucucuucucugaggagcucgacggcauaaaucagaagcaagcacagaguuugucagguuugaagccccu

SEQ ID NO: 222281 - RNA, 71 nt, Homo Sapiens
cacauauggacgaggauggggacaccauccaggaagaccccagcacagacuaacuggaccaccagagaaug

SEQ ID NO: 222282 - RNA, 71 nt, Homo Sapiens
cuggugcguaguagaugcucuugccugagacuaaagugcuuagcacagaacacagcacccaucucuuagug

SEQ ID NO: 222283 - RNA, 71 nt, Homo Sapiens
gccuguauaugauguaacugaucagauuggauugcuggcaaagcacagaauucagcccugaguggagaccu

SEQ ID NO: 222284 - RNA, 71 nt, Homo Sapiens
caaacuggggcugggccucucccacggguucugccagccccagcacagaccuggggcagggaagcuucaug

SEQ ID NO: 222285 - RNA, 71 nt, Homo Sapiens
aaauucaaacugccuauauuuuuccaauugaacuuucacauagcacagaaaaaaucuucauuuauucuucu

SEQ ID NO: 222286 - RNA, 71 nt, Homo Sapiens
cucacuauauaagucacauaaaaugagcaccagugguacuaagcacagaaaauuuagcaaacuguuuugac

SEQ ID NO: 222287 - RNA, 71 nt, Homo Sapiens
acauuuguugaaguauaguugcccuuuuguucugcugaaggagcacagagaggcaagaaucaucucguccu

SEQ ID NO: 222288 - RNA, 71 nt, Homo Sapiens
cagaauauuuucaucaccaccuagugcuuaccauacuggacagcacagacauucucaauggcuacguguga

SEQ ID NO: 222289 - RNA, 60 nt, Homo Sapiens
cccucaggguacuccuucucgagcaaccugagcacagacaccuggauccucaguaacuaa

SEQ ID NO: 222290 - RNA, 71 nt, Homo Sapiens
cuuuccuaccuuuuuguggauuccuuuauauauuuaaguucagcacagaaaaacuaaauauguuggacgug

SEQ ID NO: 222291 - RNA, 64 nt, Homo Sapiens
gucaucaucacaagcaaacuaacagaaguuccagagcacagaagccagcuccaauuuuuuguaa

SEQ ID NO: 222292 - RNA, 71 nt, Homo Sapiens
auaaagaagaagucuuucaugccugagauggcaguucaugaagcacagaagguauggcaucauuuagggau

SEQ ID NO: 222293 - RNA, 71 nt, Homo Sapiens
uguuuauguguucagauuuuugagaaggcaguuccaguuuuagcacagauuaaguuuaauuauauguagag

SEQ ID NO: 222294 - RNA, 71 nt, Homo Sapiens
acuuaugcuucuuaauuuuuaauugcauauuccuugaccagagcacagauuaggaagguaaaauacuaaua

SEQ ID NO: 222295 - RNA, 71 nt, Homo Sapiens
uucgaauguuuccaauauuucauuaagucagaauacaaaucagcacagauaauguuauuuucuucuuguuc

SEQ ID NO: 222296 - RNA, 71 nt, Homo Sapiens
ucagaguuccgucauuuugcaggcaauuaaaucacugugacagcacagagggucuuagauaauaccaugca

SEQ ID NO: 222297 - RNA, 71 nt, Homo Sapiens
aaaucaccuuggaguggucacgucucugacccaacagaggaagcacagaucgaccuaauaauagcccguuu

SEQ ID NO: 222298 - RNA, 71 nt, Homo Sapiens
uugccaagcuucagguucacgcucuccgugggaccgggugaagcacagaccugggaguucccuucccacuu

SEQ ID NO: 222299 - RNA, 71 nt, Homo Sapiens
cauacaaaaauagaaaugugaaagcauuuggugaaagccaaagcacagagucagaagcugccaccuuagag

SEQ ID NO: 222300 - RNA, 71 nt, Homo Sapiens
gaauuccuggucuuggcagauggcucugggaacagcgagggagcacagaagucguggccugaggcuguucu

SEQ ID NO: 222301 - RNA, 71 nt, Homo Sapiens
ugcaaguggccauuaccaucucuaaggagagcucugauugcagcacagagcaguggccaggccacccaaag

SEQ ID NO: 222302 - RNA, 71 nt, Homo Sapiens
cuggaaaggacccaauguaccaguauuuauaccucuaaugaagcacagagagaggaagagagcugcuuaaa

SEQ ID NO: 222303 - RNA, 71 nt, Homo Sapiens
agcagccacagccaggcuucugucauacagguagaucccgaagcacagagacauaaaaaaggucucccaga

SEQ ID NO: 222304 - RNA, 71 nt, Homo Sapiens
aggccauguuuugacucauuugguaaccauugccuguaagcagcacagaauuggugccauggauuaucuuu

SEQ ID NO: 222305 - RNA, 71 nt, Homo Sapiens
uagucuucaagcagauuggagaaacccuugaaaagacaucaagcacagaaggaggaggaggagguuuaggu

SEQ ID NO: 222306 - RNA, 51 nt, Homo Sapiens
augugguugucuccguuuaauagcacagacuugaaggaguuuaaaaggagg

SEQ ID NO: 222307 - RNA, 67 nt, Homo Sapiens
cagaaagcugcaguugcugagggggcagugagaguugagcacagaguccuucacaaaccaagaacac

SEQ ID NO: 222308 - RNA, 71 nt, Homo Sapiens
uugcuuucuggaaaagugucccagcuuagggauaagugucuagcacagaauggggcacacaguaggugcuu

SEQ ID NO: 222309 - RNA, 71 nt, Homo Sapiens
gacccugggauggcuggauugagcaaugagcagagccaagcagcacagaguccccuggggcuagaggugga

SEQ ID NO: 222310 - RNA, 66 nt, Homo Sapiens
acuaucugcaguaccagugagccaagccugaugggcagcacagacacagacacacaccgcagggcc

SEQ ID NO: 222311 - RNA, 71 nt, Homo Sapiens
ugauauuccugucuaaaagaacaacauugucuuucuuuucuagcacagaguuaugcauucaaagaugcaua

SEQ ID NO: 222312 - RNA, 71 nt, Homo Sapiens
cagaaagacucuuuuagggcauuuuucugacucaugaaaagagcacagaaaaggauguuuggcaauuuguc

SEQ ID NO: 222313 - RNA, 71 nt, Homo Sapiens
uuuuauacuguuugauaagaaaaguagguccagccuuaagcagcacagaugcgcugguagaugcauaguca

SEQ ID NO: 222314 - RNA, 71 nt, Homo Sapiens
gauauugccauuuuacagcuuaugaaaggccaucugcuuggagcacagaaaccuucucuuuagcuccugga

SEQ ID NO: 222315 - RNA, 71 nt, Homo Sapiens
agagacucucccccuugucaugccagugccuuccugggcugagcacagauuugccgggaccgggucugaca

SEQ ID NO: 222316 - RNA, 71 nt, Homo Sapiens
cuuagguuugccacaugcaggagaagcauauauggccacaaagcacagagggcccuuugaaaccccuuaga

SEQ ID NO: 222317 - RNA, 71 nt, Homo Sapiens
uuaauugucaugguuacaaauguuauagacugccgugcauuagcacagauugucugauuggcuuguagaau

SEQ ID NO: 222318 - RNA, 71 nt, Homo Sapiens
ggaggaggaggacuaaaugacaccaguuucucaggcuggggagcacagaggaggggagguguuuuugccau

SEQ ID NO: 222319 - RNA, 71 nt, Homo Sapiens
ccagagucuugugguucucuuaccauggcaaccuuugccagagcacagaccgaacaaggcauguccccaau

SEQ ID NO: 222320 - RNA, 71 nt, Homo Sapiens
agcaccaacguugaacagcugcagcacagagaagcucugauagcacagaucgcccuagaagagcgagccca

SEQ ID NO: 222321 - RNA, 71 nt, Homo Sapiens
agcucugauagcacagaucacccuagaagagcgagcccagcagcacagagaacacuacuuuaugggcaggg

SEQ ID NO: 222322 - RNA, 71 nt, Homo Sapiens
gcuaaucuacaucuugcugcguccgcaguagugcuuuugucagcacagacucugacagagaauucuuugag

SEQ ID NO: 222323 - RNA, 71 nt, Homo Sapiens
acgggaggggcuggcucccuuucacaccuggguuuggcaucagcacagacuggagacuggcuguaaccccc

SEQ ID NO: 222324 - RNA, 71 nt, Homo Sapiens
aucauuggucucuuuguuuuucaauaugagauauuaaaauaagcacagaaaauuaaaauaagaauugaaug

SEQ ID NO: 222325 - RNA, 71 nt, Homo Sapiens
uaacugaccuucaguuuacccuucugaaggagcagggacucagcacagaauucacuuuagacggggcugaa

SEQ ID NO: 222326 - RNA, 71 nt, Homo Sapiens
gucagugacacuaggaauauaauaaagguaacacagcaagaagcacagaacuacucccucuucaucuccau

SEQ ID NO: 222327 - RNA, 71 nt, Homo Sapiens
uuugugaggugauuuugaaucuuguccauauaggaaaaugaagcacagaauuacucagucuuccauauugu

SEQ ID NO: 222328 - RNA, 71 nt, Homo Sapiens
cuaaaaugaaguaacacaaucagaaaucccaugugcccauaagcacagauuuuucuuuuucauugaaacuu

SEQ ID NO: 222329 - RNA, 71 nt, Homo Sapiens
aaugaaacagcuaauuuccauuuugaaaauuaaaagaaaacagcacagagaaguuaaaugcgguguagcaa

SEQ ID NO: 222330 - RNA, 71 nt, Homo Sapiens
auggguguggauuuagguuauacugggggagaacuuuucucagcacagauucuaugccagcuucuuugggc

SEQ ID NO: 222331 - RNA, 71 nt, Homo Sapiens
gcacaaccccgaggcagcccgggcgcugaccuuccagguagagcacagaugcuucacuugccugugcagcu

SEQ ID NO: 222332 - RNA, 71 nt, Homo Sapiens
ugacaagcaguagccauggguguaugcucaucccugcacugagcacagauacugacuucgccucuuccugc

SEQ ID NO: 222333 - RNA, 71 nt, Homo Sapiens
ccuuugcccauaauaucaacuguaugcuauauaauacauagagcacagagcggcauauuagcaauuagagu

SEQ ID NO: 222334 - RNA, 71 nt, Homo Sapiens
gugcaagaacuuuugcauuuguagaugaauuaaccucucaaagcacagaauuauauuauacaaacuaaaau

SEQ ID NO: 222335 - RNA, 56 nt, Homo Sapiens
ccuaugccaucagaauaucaugaaguagcacagacuuauuggagacagcuggauga

SEQ ID NO: 222336 - RNA, 71 nt, Homo Sapiens
ccugcgaggaagccuauggaaaagucagugggacaaacuccagcacagaaguuguagagagauggacaacc

SEQ ID NO: 222337 - RNA, 71 nt, Homo Sapiens
augauuuaaaagggaagucuagaguuccuagucucccucacagcacagagaagacaaaauuagcaaaaccc

SEQ ID NO: 222338 - RNA, 71 nt, Homo Sapiens
uuaacugcauuaagauaaucacguuaaaauuguuacuaugcagcacagaacuucauucuuauaguauucuu

SEQ ID NO: 222339 - RNA, 71 nt, Homo Sapiens
aaaaagaaaagaaauagaauuaucaagcuuuuaaaaacuagagcacagaaggaauaaggucaugaaauuua

SEQ ID NO: 222340 - RNA, 71 nt, Homo Sapiens
ucaguaaaaguaaauucauguaauagcaaugcaagcagccuagcacagacuaagcauugagcauaauaggc

SEQ ID NO: 222341 - RNA, 71 nt, Homo Sapiens
augguaaucuuuaccuguauacagugcagagccuucucagaagcacagaauauuuuuauauuuccuuuaug

SEQ ID NO: 222342 - RNA, 71 nt, Homo Sapiens
auaaugggaaacaguaauacguacucugagaaaaauugcaaagcacagauaaauggaaauaaacaggaaaa

SEQ ID NO: 222343 - RNA, 71 nt, Homo Sapiens
ucacucuaccaguguaaacaaacucuaagcuagggcaagacagcacagacacaaguauauacuaaccaggg

SEQ ID NO: 222344 - RNA, 71 nt, Homo Sapiens
gaggagagcugcugcgcugaccugcagagguugguggucccagcacagagcugugcccaugggcuuguuag

SEQ ID NO: 222345 - RNA, 71 nt, Homo Sapiens
aucaggagcaucuugggauuuauuaaauuauguaagaagauagcacagauaucgggauauuauugugugaa

SEQ ID NO: 222346 - RNA, 71 nt, Homo Sapiens
agcgccaccuucuguugggucaguggagaugggugaggaacagcacagagcagcagggaucaucacaugca

SEQ ID NO: 222347 - RNA, 71 nt, Homo Sapiens
auuaaacuggcuccaucagaagacguugaagggcagugaagagcacagacucugugggcuucuuagauaag

SEQ ID NO: 222348 - RNA, 71 nt, Homo Sapiens
ggacuugcuucuccugccucuggggaagagagggaagagaaagcacagagcagagaagcagagauguuccu

SEQ ID NO: 222349 - RNA, 71 nt, Homo Sapiens
gcggcuuccccaucgccuuccgccuucuggcugcugcagucagcacagagaacagaggacagcuuccccau

SEQ ID NO: 222350 - RNA, 71 nt, Homo Sapiens
gcggcuuccccauugccuuccgccuucuggccgcugcagucagcacagagaacagaggacggcuuccccau

SEQ ID NO: 222351 - RNA, 71 nt, Homo Sapiens
auggcuuccccauugccuucaacugccaggcagcugcaguuagcacagagggugggagccgucagccugug

SEQ ID NO: 222352 - RNA, 71 nt, Homo Sapiens
uuaaaacuucuaagauuauucuccuuucuagaugaaaaccaagcacagauuguuuauuugccugacguuua

SEQ ID NO: 222353 - RNA, 71 nt, Homo Sapiens
caagcuacucugacauuaugguaucucagaaugaccagagcagcacagaaaaucacugauucaggaagaua

SEQ ID NO: 222354 - RNA, 71 nt, Homo Sapiens
acaaaguuaauucaaaaagaccaagaccuuaauuccaggaaagcacagaggcugcaacugaagaacugcag

SEQ ID NO: 222355 - RNA, 71 nt, Homo Sapiens
auuuuuucagacugaacagaacauuuugucaaucugaacagagcacagaacacugcgcccggccaaaaaga

SEQ ID NO: 222356 - RNA, 71 nt, Homo Sapiens
ggagacaucucauuagucagaaguucugugugccuccuuucagcacagaagggaccccaaaaaaccagaac

SEQ ID NO: 222357 - RNA, 71 nt, Homo Sapiens
ccaaaccuuacggccaaguuccucauugcauguguaguuugagcacagaucuuguauuagcagaauauugu

SEQ ID NO: 222358 - RNA, 71 nt, Homo Sapiens
cucuggcuggggcagcgcagccuguaggccucagcagggacagcacagaccggaggugaaugucucugccu

SEQ ID NO: 222359 - RNA, 71 nt, Homo Sapiens
ugagggauuaaaaggaaaggacacagugguaacuugaaggcagcacagaggcucgacaugccuaugcagcc

SEQ ID NO: 222360 - RNA, 67 nt, Homo Sapiens
agcucguggggauggagugacagccucagucccccucagcacagacaaaagccagcagagcaaagcg

SEQ ID NO: 222361 - RNA, 71 nt, Homo Sapiens
acaggaaaguuuccagauagguauuguaucauugagaaugcagcacagauagugugggcuucacacuauag

SEQ ID NO: 222362 - RNA, 71 nt, Homo Sapiens
cuuuaaaugcuguuuuuauagaugugauaugaggcaacacaagcacagacaguugcauagauuuuaauuua

SEQ ID NO: 222363 - RNA, 71 nt, Homo Sapiens
aggugaggggcacagcaccccuccccggcaucugccagcucagcacagaagacaccgaaugugcaucugga

SEQ ID NO: 222364 - RNA, 71 nt, Homo Sapiens
cggcagagguuugagugaacccucuuucaaagacaauaaauagcacagaauuguccgugcuucugugaggc

SEQ ID NO: 222365 - RNA, 71 nt, Homo Sapiens
caggugacuaaggaaaagagcagaagcuccuugguuuaaccagcacagagaaaauaauauaaaucccauaa

SEQ ID NO: 222366 - RNA, 71 nt, Homo Sapiens
ccuccaggccugcaggggcaaggggcuggcuggagucucagagcacagagguaggagaacugggguucaag

SEQ ID NO: 222367 - RNA, 71 nt, Homo Sapiens
uuuauaaugugcaucaacaugugaaagcaaucuaggucacuagcacagaggaaguugccaggaagguggcu

SEQ ID NO: 222368 - RNA, 71 nt, Homo Sapiens
gcccccuccccauguauuccccaccuguguuccguuugaccagcacagaaauauuaaacguccucuauuca

SEQ ID NO: 222369 - RNA, 71 nt, Homo Sapiens
guauuugauguauucugugauaagagguacuaauaguauccagcacagauuugcuuuucuuugcuagcaca

SEQ ID NO: 222370 - RNA, 71 nt, Homo Sapiens
uccucauacuugcuggcaucccucaucugguggucuguuaaagcacagauugcugggccgcacccucaggg

SEQ ID NO: 222371 - RNA, 71 nt, Homo Sapiens
uuucuuaccuugcaacugucagugccuccagccaaaugccuagcacagagcucaguggauuugauucuucc

SEQ ID NO: 222372 - RNA, 71 nt, Homo Sapiens
uggggcuucgggcagggagcccugcuugcagucacucgcauagcacagaggcugccuuccugggccagcuu

SEQ ID NO: 222373 - RNA, 71 nt, Homo Sapiens
ccacaagccaucagguucuucacaucuguuaguauugacacagcacagacacauuccauagucugucuccu

SEQ ID NO: 222374 - RNA, 71 nt, Homo Sapiens
ccuuucuggugccucucgaaggccugaaguggaggcugcucagcacagagcggaccguaggccaugugaug

SEQ ID NO: 222375 - RNA, 71 nt, Homo Sapiens
ggcuccuagggugcugagugcugggcuauccugcccuugggagcacagacagcagcuuauggaagucucag

SEQ ID NO: 222376 - RNA, 71 nt, Homo Sapiens
aaggcagcgccccucacuuggaauuaugccagcaagaaugaagcacagauguccaggaaauauccauccau

SEQ ID NO: 222377 - RNA, 71 nt, Homo Sapiens
ucugaaaaauggccauguugcaaagugucacuuggugcauaagcacagaaaccauguugcuucacucuauc

SEQ ID NO: 222378 - RNA, 71 nt, Homo Sapiens
cagacgaggggaugcagcccuauguuaugaagugcaggaacagcacagaccuuaaggaauaagaggaaaau

SEQ ID NO: 222379 - RNA, 71 nt, Homo Sapiens
aauauuggcuggcaugcaacauccucaaacuuucccuucccagcacagaggcacugcuauggucuugauac

SEQ ID NO: 222380 - RNA, 71 nt, Homo Sapiens
aaccaaaaauguauuuauauacgggauuucuauauggacauagcacagaugcccgguagacugaauaucug

SEQ ID NO: 222381 - RNA, 71 nt, Homo Sapiens
acaccacugcacuccagccuugggagguugagguugcagugagcacagaucgugggagguucacuugaacc

SEQ ID NO: 222382 - RNA, 71 nt, Homo Sapiens
agguucaaauaacuuuuccagacugagagacuguugaucaaagcacagaacacauaaaaugacagcaaaga

SEQ ID NO: 222383 - RNA, 71 nt, Homo Sapiens
caagugcaauccauguaucuuccggaugacacaaauaccagagcacagauuaccaacaggcguucucagcc

SEQ ID NO: 222384 - RNA, 71 nt, Homo Sapiens
cagagcagaaaguaguacaauuucaugagcuuucuguccauagcacagaaaccacguacugcacggucgua

SEQ ID NO: 222385 - RNA, 71 nt, Homo Sapiens
uuuuuuuaaguaaaguuuguagcuccucccaugcccaggaaagcacagaacucaagugugguggccgucug

SEQ ID NO: 222386 - RNA, 71 nt, Homo Sapiens
aauucagucaguaauaauuuacguguauucuuuuucucuauagcacagaaaacagauaguuaacugaugau

SEQ ID NO: 222387 - RNA, 71 nt, Homo Sapiens
cauccccaucucaaggccgaaccugugugaaccucaugccaagcacagauauagggcuggcgcaggugcuu

SEQ ID NO: 222388 - RNA, 71 nt, Homo Sapiens
ugggccggagccucugcccgcagguuucuaugcuguuucuuagcacagaauccagccuagccuuagccgca

SEQ ID NO: 222389 - RNA, 71 nt, Homo Sapiens
ccagccuugcccucacgcuuacccgagcucccagugugguuagcacagagcucacccaccuugccuggcuc

SEQ ID NO: 222390 - RNA, 71 nt, Homo Sapiens
uuugugcugccaaccugagauugaaggcagugccucagagcagcacagagaguuggggcccccugagcccu

SEQ ID NO: 222391 - RNA, 71 nt, Homo Sapiens
caagcaacaugaacaacugaauacagaaaguaacugaaagcagcacagagacugugucgucccuacagacu

SEQ ID NO: 222392 - RNA, 71 nt, Homo Sapiens
acgaggugguccccauguccgaaagggacaugcaaggaaacagcacagaacacccccuaggguccccaugg

SEQ ID NO: 222393 - RNA, 71 nt, Homo Sapiens
uuacaucugauugacauaguaaguucuguacuucaaauaauagcacagauuuauuuuuaagaauauauucu

SEQ ID NO: 222394 - RNA, 71 nt, Homo Sapiens
gcaguggaaaggacgcucuguuaguuggaguccgcguagucagcacagacaacagaauucgauggauuccu

SEQ ID NO: 222395 - RNA, 71 nt, Homo Sapiens
uccacacaccccagcccugcucuccacggagcccagaccccagcacagauaucucauuaccccuacacauc

SEQ ID NO: 222396 - RNA, 71 nt, Homo Sapiens
cgggacucagagaccccauucucuagggugucccugaggacagcacagaggagcccccaagcaagucccuu

SEQ ID NO: 222397 - RNA, 71 nt, Homo Sapiens
uucaagaaaauacuugaaaacaacuuuucaugauuuuuaugagcacagacucagugauuuaacagucuuuc

SEQ ID NO: 222398 - RNA, 71 nt, Homo Sapiens
auauucuugguuacagaauuggugcuucaaccagcuugcauagcacagagauggagaauccugaaaaagac

SEQ ID NO: 222399 - RNA, 71 nt, Homo Sapiens
cagaacaaagaacaauauccgaugaaauuuguuuccuggugagcacagaauaaggacgggcccccuacgga

SEQ ID NO: 222400 - RNA, 71 nt, Homo Sapiens
uaucgaccaacaccucccugcuugguuaccaaagaugccacagcacagaaagccgcugccagcucugguaa

SEQ ID NO: 222401 - RNA, 71 nt, Homo Sapiens
uauuugguguuugcugaagacagaaaagugucucaaagcagagcacagaguauuucucuugcuaacagauu

SEQ ID NO: 222402 - RNA, 71 nt, Homo Sapiens
cuguauccugccagugucccuccgucccagggggcugugcuagcacagaccugagaauggggacacagguc

SEQ ID NO: 222403 - RNA, 71 nt, Homo Sapiens
ggccucuccgguacuaacauccugcgauagcuugucccaugagcacagaagagccucaguagagucaaguc

SEQ ID NO: 222404 - RNA, 71 nt, Homo Sapiens
aaguuuaugaaaacauucauuugaaaguuccaugcagcuuuagcacagaguugaccaaacacuggcguaag

SEQ ID NO: 222405 - RNA, 71 nt, Homo Sapiens
uguauccaaauaaugaaucuucggguguuucccuuuagcuaagcacagaucuaccuuggugauuuggaccc

SEQ ID NO: 222406 - RNA, 71 nt, Homo Sapiens
acuacguuguuguuuucauuucuguuauaaguaaaacuaaaagcacagaauggugggaaaggggcuauaau

SEQ ID NO: 222407 - RNA, 71 nt, Homo Sapiens
cuugaaaauaaacagucucuuuuuuacaaagccuguguuagagcacagauuuaccuaggcuugaagauuug

SEQ ID NO: 222408 - RNA, 71 nt, Homo Sapiens
gaguauauguaacaguuuaaaaaaaaaguugguauuuuauaagcacagacaauucuaaugguaacuuuugu

SEQ ID NO: 222409 - RNA, 71 nt, Homo Sapiens
acaggugcgugcuaccacgccuggccaauuuuuuaaauuuuagcacagaugaggucucacuauguugcccg

SEQ ID NO: 222410 - RNA, 71 nt, Homo Sapiens
uuuaaaaucauauccagcacaaaaacuauuucuggcugaauagcacagaaaaguauuuuaaccuaccugua

SEQ ID NO: 222411 - RNA, 71 nt, Homo Sapiens
guccuucccccuguagacuagccaugugagccaccgcugccagcacagagcugugguuacagugcagacag

SEQ ID NO: 222412 - RNA, 71 nt, Homo Sapiens
cuggccccaggccccagacaucuggacagcagaagccuccaagcacagagccugccucucuggaaagaggc

SEQ ID NO: 222413 - RNA, 71 nt, Homo Sapiens
cccccuccacgucagaggccacacacuuaaaccuuccaaguagcacagaagucugcgggaguguccucggg

SEQ ID NO: 222414 - RNA, 71 nt, Homo Sapiens
ucuaugcaccuuuacucuuuucuauagcuacuuuauuuaacagcacagauuagugaucaguuauacuguuu

SEQ ID NO: 222415 - RNA, 71 nt, Homo Sapiens
uuuaaaauucauaaucaggcugaaauauccuaaaauauaggagcacagacauuaaagaguagaaaauaaga

SEQ ID NO: 222416 - RNA, 71 nt, Homo Sapiens
uggacugagugcuuugucacaguucacacaauucccugguuagcacagaugcuuuucaauggagaagagac

SEQ ID NO: 222417 - RNA, 71 nt, Homo Sapiens
uucucaaacuuucucagcucuuuuguauuuuucuugccuauagcacagauaaggugaaaaacuaaaugaug

SEQ ID NO: 222418 - RNA, 71 nt, Homo Sapiens
uugaaucugugugcauauuuucagaugaggucaacacagguagcacagauuuugaauauuuuuugaagguu

SEQ ID NO: 222419 - RNA, 71 nt, Homo Sapiens
auuucuuuagugucauugccaaauauauuugcauauugaaaagcacagaggaccagggcaacucuuggaag

SEQ ID NO: 222420 - RNA, 71 nt, Homo Sapiens
acuaauauuuuuaagcagaguuaaauugcuauuuuggcaacagcacagaaacauucuggcacuacauuugc

SEQ ID NO: 222421 - RNA, 71 nt, Homo Sapiens
cgugccaggcgguguuggcgacuugaguggcgauuaccuccagcacagagaucccaggaagaugggcagag

SEQ ID NO: 222422 - RNA, 71 nt, Homo Sapiens
uacuuggccuuuuaaaguuacuguuauguuuaucuauauugagcacagauaauggcauuauucuuauaauu

SEQ ID NO: 222423 - RNA, 71 nt, Homo Sapiens
gcaaguugcgauuaauuauuucuggagucaugggaacacacagcacagaggguaggggggcccucuaggug

SEQ ID NO: 222424 - RNA, 71 nt, Homo Sapiens
uaauguugcacauaaguuuauacagaguggaugaccacacuagcacagaagagaacaacauguauuaaagc

SEQ ID NO: 222425 - RNA, 71 nt, Homo Sapiens
gagacucagccucugcuggagaaagccacgcccucccugcuagcacagaggccugacugacuuuuuugcuu

SEQ ID NO: 222426 - RNA, 71 nt, Homo Sapiens
agggacgcuaauucggguacccauuccccaaguaaccagagagcacagagaaaugcuggugaaacuggcca

SEQ ID NO: 222427 - RNA, 71 nt, Homo Sapiens
gaaguuguuuccaggugugcucaagugccuuccucuagcagagcacagaaagcuagaauacccccagggag

SEQ ID NO: 222428 - RNA, 71 nt, Homo Sapiens
cggaccaacguugccaugugcguuugcucuguggggaacagagcacagagggugagcgacaugugcagaac

SEQ ID NO: 222429 - RNA, 71 nt, Homo Sapiens
ugauuuuuuaaaauguccugagaggugcuggcaugcuuuacagcacagaucccuguuagauauagugcuaa

SEQ ID NO: 222430 - RNA, 71 nt, Homo Sapiens
gccuaagacugcacaggccucaccgugugaagaaaaaugaaagcacagauagcugggcaguguagaccugc

SEQ ID NO: 222431 - RNA, 71 nt, Homo Sapiens
ugcacuaggauuaauuuguuuacucauugcuaaaaauguguagcacagaacgcaccagaagaugucugcau

SEQ ID NO: 222432 - RNA, 71 nt, Homo Sapiens
auucucaaaagcgagcagggaucaguuaagggaggugucccagcacagaucucauugccaguagugccuuc

SEQ ID NO: 222433 - RNA, 71 nt, Homo Sapiens
cugggaccaagguucagauucaguguggcaaagugggaaaaagcacagauccaguucaaagccaccuuaga

SEQ ID NO: 222434 - RNA, 71 nt, Homo Sapiens
gccacaggccucucuauacaauuuccacagacaaggccuccagcacagaugagcaagugcugagccucggc

SEQ ID NO: 222435 - RNA, 71 nt, Homo Sapiens
cucuccaugggagggggagcgggaggguauugcccuccgugagcacagagagggaguccaagggccgguga

SEQ ID NO: 222436 - RNA, 71 nt, Homo Sapiens
cccagauccagcuggugaaggaguaggagaagcuuagagaaagcacagaauaaguagaucauuaugauuga

SEQ ID NO: 222437 - RNA, 71 nt, Homo Sapiens
uuccugaggccaacgucaccaccugcccagagcuccaggccagcacagaaacuagaagccagucccucccc

SEQ ID NO: 222438 - RNA, 71 nt, Homo Sapiens
gaggaagccgcuuauccugucgccuccacccugcccugcugagcacagacguccuccuggccugagcgcag

SEQ ID NO: 222439 - RNA, 71 nt, Homo Sapiens
aaaaauaaggacaccggcagcccuuaguuucacuguuugccagcacagaccuuugaugggugcaggcuuuu

SEQ ID NO: 222440 - RNA, 71 nt, Homo Sapiens
guuuuaagaaauguaguugauguauccaacaagccagaaucagcacagauaaaaaguggaauuucuuguuu

SEQ ID NO: 222441 - RNA, 71 nt, Homo Sapiens
acccuaucccuugcauccacuugacuaugaaguuuuuuuaaagcacagauaaauugaauaaucagggcaau

SEQ ID NO: 222442 - RNA, 71 nt, Homo Sapiens
gcauuuugauacuucagcuguuuguuccugggagaauucugagcacagauuccagaggucacaguaagccu

SEQ ID NO: 222443 - RNA, 71 nt, Homo Sapiens
ugaccaggucagcugcccuggccuugcaccccucugcaugcagcacagaagggugugaccaugcccucagc

SEQ ID NO: 222444 - RNA, 71 nt, Homo Sapiens
guucuuuugauaugcaguuuccagcccuccaaugaguccccagcacagaucucaggcuuguggcugggaau

SEQ ID NO: 222445 - RNA, 71 nt, Homo Sapiens
ccccucucauggggaggaaagagcuuccagggggcgaacgcagcacagaggaagaggccugcuccacuugu

SEQ ID NO: 222446 - RNA, 71 nt, Homo Sapiens
aaggccagccccgcaucucccacugccaacagcugaagccgagcacagaccucccuuugcacgcuggaaca

SEQ ID NO: 222447 - RNA, 71 nt, Homo Sapiens
ucuuucagugaagagaaaggaaguacagaaaacaugcagaaagcacagaaaggaaaaccaagguucucaug

SEQ ID NO: 222448 - RNA, 71 nt, Homo Sapiens
ugcuaucccugcacucaaaaguuuugaaagaaacuaaucacagcacagaaguaccuugauuuaauuuuuua

SEQ ID NO: 222449 - RNA, 71 nt, Homo Sapiens
agaagugggacucagccauguuggcgcgugauugacauuacagcacagaaaacuguuagugacugguuucc

SEQ ID NO: 222450 - RNA, 71 nt, Homo Sapiens
uugaguggcagccauucucuccacgugaaccacacgucuggagcacagacaggccucucaaggucauugau

SEQ ID NO: 222451 - RNA, 71 nt, Homo Sapiens
gcaagagugaucugcauguuuuuuaaccugcuuuuccccauagcacagaccauaagaaacaacaaaugggg

SEQ ID NO: 222452 - RNA, 71 nt, Homo Sapiens
aguuuucaguuuuuaaugauugccaguggaggggcuucuucagcacagagaccccccacuguguccaggga

SEQ ID NO: 222453 - RNA, 71 nt, Homo Sapiens
uguucauaaaaugggaauuguguguuuucagaauuacagugagcacagaggauuuaccaguuagcaaaguc

SEQ ID NO: 222454 - RNA, 71 nt, Homo Sapiens
aggcuggcagagcuggggaccucaggacagacggcguggggagcacagaggggaccauccucaaaggcacu

SEQ ID NO: 222455 - RNA, 71 nt, Homo Sapiens
agaugugguggugguauggauuagcuuuuucguaaaauaaaagcacagaacaguuuaauguagauuugcca

SEQ ID NO: 222456 - RNA, 71 nt, Homo Sapiens
gcaugcaccugacuuucuaaagaugacuguguaaauguccaagcacagagagauuuuaaaaauugaguuaa

SEQ ID NO: 222457 - RNA, 71 nt, Homo Sapiens
cugcugucaggaagagggaggggcucaguggagucuggccaagcacagaggcugcccacucuguaaaugaa

SEQ ID NO: 222458 - RNA, 71 nt, Homo Sapiens
gccagccccuuagacagagggcagaagcagcaacuuguccuagcacagauguccuaucugggcuuccugga

SEQ ID NO: 222459 - RNA, 71 nt, Homo Sapiens
gucuggauaacuuccacagguuuauagaugggggaaagcaaagcacagagaguaguaccuuuuauauccca

SEQ ID NO: 222460 - RNA, 71 nt, Homo Sapiens
gaguuucgaguauaagaaucaaggcaucacagugagcagugagcacagaggauggaugucaggacuaaaaa

SEQ ID NO: 222461 - RNA, 71 nt, Homo Sapiens
ucgggcauccccuuauugccgguguuucuauuauccuuggaagcacagaccuuuaucuuaccacacacaug

SEQ ID NO: 222462 - RNA, 71 nt, Homo Sapiens
aucucaguuggacuggaccagagugcagagcaugucugccaagcacagagcgcgccagccaggccaggagg

SEQ ID NO: 222463 - RNA, 71 nt, Homo Sapiens
auuauaauguaggugaucgguuuccuccccugcagaaaauaagcacagaaauggcguugaauagaugugua

SEQ ID NO: 222464 - RNA, 71 nt, Homo Sapiens
ugcuuuggugaaggacacguauugaaauguuuggaaccuuuagcacagauuugaaaauauuuauuuuaaaa

SEQ ID NO: 222465 - RNA, 71 nt, Homo Sapiens
uggggcauccccagaaagacccugggcacccgguuccaggcagcacagacggggccugcugagccggcugc

SEQ ID NO: 222466 - RNA, 54 nt, Homo Sapiens
guucaucugacauaccuuaauguuagcacagaggacuuauucaaccuguccuuu

SEQ ID NO: 222467 - RNA, 71 nt, Homo Sapiens
cucaggauucguauuuuuaaagauuuaguuaauaugaacacagcacagauuuguuagaagaaaaaaaauuu

SEQ ID NO: 222468 - RNA, 71 nt, Homo Sapiens
aagccuuauuguuacaaugcacaguggaggacugcuuauagagcacagaccuuuguauuauaauuuuuaaa

SEQ ID NO: 222469 - RNA, 71 nt, Homo Sapiens
uggagcaaagucggaaacacagagaagcacggcuuccccucagcacagacccuccagacugggucucagag

SEQ ID NO: 222470 - RNA, 71 nt, Homo Sapiens
aggacacccuggcccugcugaggcauacagagcuucagcccagcacagaagcaagacaaaaucaguggcuc

SEQ ID NO: 222471 - RNA, 71 nt, Homo Sapiens
ugagcuccugcgggaguaguuggaaaguuggaaccguguccagcacagaaggaaucugugcagaugagcag

SEQ ID NO: 222472 - RNA, 71 nt, Homo Sapiens
cacuguaaagccaguuggcuucugugccugacucugugcugagcacagagaaaagucaggugcagucccag

SEQ ID NO: 222473 - RNA, 71 nt, Homo Sapiens
ggaguaacugguuuuucuuggguggcugaugacauggaugcagcacagacucagccuuggccuggagcaca

SEQ ID NO: 222474 - RNA, 71 nt, Homo Sapiens
ugcucuaugggaaaaaaacgauuuaccaauuaauauuacucagcacagagaugggggcccgguuuccauau

SEQ ID NO: 222475 - RNA, 71 nt, Homo Sapiens
aauaaaaaggcaccuauaaaacaggucaauacaguacaggcagcacagagacccccggaacaagccuaaaa

SEQ ID NO: 222476 - RNA, 71 nt, Homo Sapiens
agaacaggccaucucagcccuacacacuugccauccccuacagcacagaggaagagugaugguggcaugcu

SEQ ID NO: 222477 - RNA, 67 nt, Homo Sapiens
aggaggcucagcaaagcugaauuaacucaggcagaagagcacagaugugugggauugggggaggagu

SEQ ID NO: 222478 - RNA, 71 nt, Homo Sapiens
ccagagccaggaaccucucaaaccacacccggugggggcacagcacagaccaccagcaccucccaccaacc

SEQ ID NO: 222479 - RNA, 71 nt, Homo Sapiens
ccagaggcaggaaccucucaagccacacccggugggggcacagcacagaccaccagcaccucccaccaacc

SEQ ID NO: 222480 - RNA, 71 nt, Homo Sapiens
ccagagccaggaaccucucaagccacacccagugggggcacagcacagaccaccagcaccucccaccaacc

SEQ ID NO: 222481 - RNA, 71 nt, Homo Sapiens
ccaaagccaggaaccucucaagccacucccgguggggacacagcacagaccaacagcaccucccaccaacc

SEQ ID NO: 222482 - RNA, 71 nt, Homo Sapiens
uguuucgugcauuggaagacguggggguagagcugauccagagcacagaucucugucucuccaucuguuug

SEQ ID NO: 222483 - RNA, 71 nt, Homo Sapiens
cagaggagagucccagagcauucccaaggcguccgcgcgccagcacagaaaccgaggcugcccgccucuag

SEQ ID NO: 222484 - RNA, 71 nt, Homo Sapiens
uaccucauuuuaaccaauagucucauggcacacuucauggcagcacagauauaucagaaacugaagugugu

SEQ ID NO: 222485 - RNA, 71 nt, Homo Sapiens
ugccccaaagccuuguuaagaggggcuggcagggccuccauagcacagaaucucccuauuggacuacuagg

SEQ ID NO: 222486 - RNA, 71 nt, Homo Sapiens
ggcaaacaaaacccgagcugaccagacccaggagucuccaaagcacagagucaggggcagggacagaccag

SEQ ID NO: 222487 - RNA, 71 nt, Homo Sapiens
ucccuucugccaccuaccauggguccugaggcacagcucugagcacagaggagucuucccaucugaacgau

SEQ ID NO: 222488 - RNA, 71 nt, Homo Sapiens
gauuuucucuaaucagugucguccagcacugccguauugccagcacagacgccuucaagggaauuccgagu

SEQ ID NO: 222489 - RNA, 71 nt, Homo Sapiens
uuggaaggaaccuuuuuuuuaguuagggaagggagccauugagcacagacuggugaggugaccacagcugc

SEQ ID NO: 222490 - RNA, 71 nt, Homo Sapiens
cccagcacugaaagaguuacauuugagcagccagaugauaaagcacagaugcucuuucagguucaacuuuc

SEQ ID NO: 222491 - RNA, 71 nt, Homo Sapiens
ggauauaaucagucuggccugccagcacugacuuguguucgagcacagaacgaggcgcagaugcccacaca

SEQ ID NO: 222492 - RNA, 71 nt, Homo Sapiens
ugcauuucagaauauuagcccauugagcaguauauauauaaagcacagauuauucuauugaguggcagugu

SEQ ID NO: 222493 - RNA, 71 nt, Homo Sapiens
agucugucaauaaauggccacgugauguaagucaagcaccuagcacagaucgggcuguugucagaauucua

SEQ ID NO: 222494 - RNA, 71 nt, Homo Sapiens
ccugagucaugggaaagagucuuccuauaagggucaccucuagcacagagguaaaggauuuggggucucuc

SEQ ID NO: 222495 - RNA, 71 nt, Homo Sapiens
ucccagaccuguuguucucugaacaaaggacagagaauuuaagcacagaaagagagcccagccugaugcca

SEQ ID NO: 222496 - RNA, 71 nt, Homo Sapiens
caccuaaacagaaucagugacccgggugcuuuguggccagcagcacagaaucaaacccgcaucccagcauu

SEQ ID NO: 222497 - RNA, 71 nt, Homo Sapiens
ccaucguuuuggaagacgagagaaaguugagaagaacacgaagcacagacccugaugugauaaaacauuuu

SEQ ID NO: 222498 - RNA, 71 nt, Homo Sapiens
uuaaugggcuguguauuaaaugguuuuauuuucaguuuugcagcacagaacacuguugaaauauccauauc

SEQ ID NO: 222499 - RNA, 71 nt, Homo Sapiens
cuugggagacaggaacuggcgaguucaggugggguggggacagcacagacuguuccaccguugugcauauu

SEQ ID NO: 222500 - RNA, 71 nt, Homo Sapiens
accccuccaacaccccucugccucuggcucagguugcucaaagcacagauccucucuuaccccguccccag

SEQ ID NO: 222501 - RNA, 71 nt, Homo Sapiens
gauuuucuccuaggguuauguccaguugggguuuuuaaggcagcacagacugccaaguacuguuuuuuuua

SEQ ID NO: 222502 - RNA, 71 nt, Homo Sapiens
cccccagccugcgcaugcacccuccucuugcccaaguggggagcacagaggcggagaggaaucccuuacca

SEQ ID NO: 222503 - RNA, 71 nt, Homo Sapiens
uguaaagccacuggcaucugauuaucuccauuugaacacacagcacagaacaaucauuuaaauguuauuuu

SEQ ID NO: 222504 - RNA, 69 nt, Homo Sapiens
agcagaaaaguuucagaugagaaaaccugccaaaacuucagcacagaaauagguauuuaaaugcaagug

SEQ ID NO: 222505 - RNA, 71 nt, Homo Sapiens
aaaaacaaacuauaaacucucuagacugggcugacaguaaaagcacagaauacaaaacccaggggaugggg

SEQ ID NO: 222506 - RNA, 71 nt, Homo Sapiens
ucugcuccuccucuugaacucuggccacacugcucuccaguagcacagauguaagccagcccccgacuggc

SEQ ID NO: 222507 - RNA, 71 nt, Homo Sapiens
agagagcagacucugugcgggaggggacugugggacugaggagcacagagcccuccagcucccgugacuug

SEQ ID NO: 222508 - RNA, 71 nt, Homo Sapiens
uccuccacacugccugggacccccugagugcuuugucauauagcacagaagcagaugggaagacagaagcg

SEQ ID NO: 222509 - RNA, 71 nt, Homo Sapiens
uuugaaccuaggaggcagucaauuuugauaugucugcaugcagcacagaaccaugauccaaagauauaaga

SEQ ID NO: 222510 - RNA, 71 nt, Homo Sapiens
aaaaaaggcagcaagacaugugcaugaaguauguuaagcuaagcacagagaucaaagacauucuguuauac

SEQ ID NO: 222511 - RNA, 71 nt, Homo Sapiens
ucaccucugucuugaauaaacuucgauggcacuuucacuacagcacagauuucuagacccuuacucagugc

SEQ ID NO: 222512 - RNA, 71 nt, Homo Sapiens
uaugaaugacaauuccccuaucuuagccccucaaguaauauagcacagaguuuucacugaccauacauuuu

SEQ ID NO: 222513 - RNA, 71 nt, Homo Sapiens
aucaagagguggccuuugggaggaccugccaauguccucucagcacagagaccacgauuucaggaucaguc

SEQ ID NO: 222514 - RNA, 71 nt, Homo Sapiens
caggauaggacuccauuucuuggcauuggcccuugguggggagcacagacauaggcuaaacuggugcauac

SEQ ID NO: 222515 - RNA, 71 nt, Homo Sapiens
uagcauagggcaguggguuuacacuuauuuuaauuaacaauagcacagauaagaauuuccacagcaagaau

SEQ ID NO: 222516 - RNA, 71 nt, Homo Sapiens
cuccccggacucggagggggcucucaccaaggcugcgucaaagcacagaggaaccugcccugccucuccau

SEQ ID NO: 222517 - RNA, 71 nt, Homo Sapiens
ucugcuguagcuuuaaugcaagagagugaagcagaaacaggagcacagaccuugagacugaggagaaugau

SEQ ID NO: 222518 - RNA, 71 nt, Homo Sapiens
gacuuuauaccuucauuucaaucuccuuggaauuucacgacagcacagacuaauaaugaucuuacuuccaa

SEQ ID NO: 222519 - RNA, 71 nt, Homo Sapiens
uccaugaggaaaacucccagcacugugugcgcagcggcagcagcacagacggugaguccauguggagagag

SEQ ID NO: 222520 - RNA, 71 nt, Homo Sapiens
acuagaauuucauuuauuuucuacugcuucuaccaacuggaagcacagaaagccaaauucccuccucccuu

SEQ ID NO: 222521 - RNA, 71 nt, Homo Sapiens
agcugggugguaaugauaauuggccauuugguacauaauccagcacagauauagauguucuuuagaagauc

SEQ ID NO: 222522 - RNA, 71 nt, Homo Sapiens
caggggagaagggcgcccagauggaacuccaggacggcuacagcacagagaccaaugcccacggcuucauc

SEQ ID NO: 222523 - RNA, 71 nt, Homo Sapiens
aggauauaaacuuuccacaccuuccugucgugacagauaaaagcacagaaaggacaacccuugaaaucaug

SEQ ID NO: 222524 - RNA, 71 nt, Homo Sapiens
cuguuacucauuaacuuugcuuauaaugcuuuuuauagcccagcacagaauuuaaagccauaccaccaaaa

SEQ ID NO: 222525 - RNA, 71 nt, Homo Sapiens
augaaaauggggacaggauaaaagguggcaacuaaauuuaaagcacagaagaaaugauuuccuucuagcua

SEQ ID NO: 222526 - RNA, 71 nt, Homo Sapiens
uauaugauuauggugggugauuucagauauauaagcagauaagcacagauuauuguccuuucaaguuaaga

SEQ ID NO: 222527 - RNA, 71 nt, Homo Sapiens
uagguauuuucauauuacucagguaaagauggaaaugacagagcacagacauuuauuuuuuaaauugauag

SEQ ID NO: 222528 - RNA, 71 nt, Homo Sapiens
uagaugaguugcacuuuucugugacagcuugguuuaaauuuagcacagaacaggcaggggaaucuuccuga

SEQ ID NO: 222529 - RNA, 71 nt, Homo Sapiens
uguuucaacagaugucucucuuagcaaaacugaagaaaaaaagcacagaaugguaauuauauauuuauuau

SEQ ID NO: 222530 - RNA, 71 nt, Homo Sapiens
agagucgccgcagaugaccugaccagcuggagcugcugcccagcacagagggcagcacugugcaggacgug

SEQ ID NO: 222531 - RNA, 71 nt, Homo Sapiens
ugcuuauuuuuaugacuauuuauuccaauguuuuaacaagaagcacagagauuuauaguauucuuaauagu

SEQ ID NO: 222532 - RNA, 71 nt, Homo Sapiens
ucuuggacuccccucuuccucaaggguagaugagaggaacgagcacagagguuggcuguggguccugggua

SEQ ID NO: 222533 - RNA, 71 nt, Homo Sapiens
acuguguuacuuuacaagggcuacccagccagcaaguauauagcacagaacugacaaaacaaauccuguaa

SEQ ID NO: 222534 - RNA, 71 nt, Homo Sapiens
gcacugccucaauaacuugggaagcuucuacuccugcaguaagcacagaucuggaauuugcuagaacugug

SEQ ID NO: 222535 - RNA, 71 nt, Homo Sapiens
gaacugacgguggaagacauuagcuuccacgcaccugaacgagcacagaauuuuucaggucugcagaacca

SEQ ID NO: 222536 - RNA, 71 nt, Homo Sapiens
ccaaagccagauuaccuaggcauuauagcacagugguuaugagcacagauuuuaguagcugcuaucagaga

SEQ ID NO: 222537 - RNA, 71 nt, Homo Sapiens
cagcuggauucuucuacguuuuugaauauguccauaagcccagcacagaaaagcaucucacauuauucugg

SEQ ID NO: 222538 - RNA, 71 nt, Homo Sapiens
cgcuggcauguuucacuccuaggaaguggggacagauucgcagcacagagugagaaguuugugguauaaaa

SEQ ID NO: 222539 - RNA, 71 nt, Homo Sapiens
ugccuguugugaaugucccuuggggggagcgggugcucacaagcacagagcggggaggcgguggggggugg

SEQ ID NO: 222540 - RNA, 71 nt, Homo Sapiens
gccggccaccaguccucgaucacuggaauugucacacggcgagcacagaggucugauggugccaggaaagc

SEQ ID NO: 222541 - RNA, 71 nt, Homo Sapiens
auuuuuaucagagcuguaaaucaaaguuaaaauucaguggcagcacagauugcaaauguagaagaauauau

SEQ ID NO: 222542 - RNA, 71 nt, Homo Sapiens
agcauugcacuugguaccauucccuucuguucuguucauguagcacagauaugcguuuuauaauagcuuuu

SEQ ID NO: 222543 - RNA, 71 nt, Homo Sapiens
agugcccuggcugugucccucccuuggcugcaguggaagucagcacagagcccgcagaugcuucauuuuga

SEQ ID NO: 222544 - RNA, 71 nt, Homo Sapiens
cgggcagacgcagcaccugcgggcacaucgcaugcacucagagcacagagcccucccugccccgacaccuc

SEQ ID NO: 222545 - RNA, 71 nt, Homo Sapiens
ccaccccaaaucuuuguauuguccacauucuccaacaauaaagcacagaguggauuuaauuaagcacacaa

SEQ ID NO: 222546 - RNA, 71 nt, Homo Sapiens
aaaauacucuaauagccuugagugaccaacuuuuuuuuuaaagcacagauguaauugucuaauguucugau

SEQ ID NO: 222547 - RNA, 71 nt, Homo Sapiens
ggagccugcaggggagcagacuuggugcccagcugccagaaagcacagauuugacccaagcuauuuauaug

SEQ ID NO: 222548 - RNA, 71 nt, Homo Sapiens
agcagagugcacagcccucguucugccagcuggagccaagaagcacagagacacagaggcgccugccccuc

SEQ ID NO: 222549 - RNA, 71 nt, Homo Sapiens
gaaguguggucagaggggagcaaugggcuuugcugcuuaugagcacagaggaauucaguccccaggcagcc

SEQ ID NO: 222550 - RNA, 71 nt, Homo Sapiens
ugcauccucacgugcugccucuuuccugugauauguagacuagcacagagugguacauccuaaaaacuugg

SEQ ID NO: 222551 - RNA, 71 nt, Homo Sapiens
ucauucagaagaggaacacaaaggaagccacccaggaaggaagcacagagcugggggcucuggaaacgccc

SEQ ID NO: 222552 - RNA, 71 nt, Homo Sapiens
caagaauguugaugaugaugauauagaauuguggcuuuaguagcacagaggaugccccaacaaacucaugg

SEQ ID NO: 222553 - RNA, 71 nt, Homo Sapiens
ggcaaaggagcacaaggaaaccaagcagcagaggccccaucagcacagagggccucguuccacgaacguag

SEQ ID NO: 222554 - RNA, 71 nt, Homo Sapiens
cccacaauguuaaauucuguccacccuggaaugacuaugucagcacagagcaugcacggaggacccccuac

SEQ ID NO: 222555 - RNA, 71 nt, Homo Sapiens
uuuaaugacauaucuaaagagguaauucggguaacccagguagcacagauucaacauauuugaaucaggcu

SEQ ID NO: 222556 - RNA, 71 nt, Homo Sapiens
uguccagguguauugcacauggcauuguaacuaugucuucaagcacagaggguccuggggcaaaaugcuau

SEQ ID NO: 222557 - RNA, 71 nt, Homo Sapiens
cgcuugagcagcccuucccggugagaagaaaggagaggaaaagcacagaaaacaacaacagaaacagaaga

SEQ ID NO: 222558 - RNA, 71 nt, Homo Sapiens
uggcaggguucuugccgugguaugugguggugguugugcccagcacagaccugcacuuuccgugggugccu

SEQ ID NO: 222559 - RNA, 71 nt, Homo Sapiens
ugggcagugugggucagaagacucuugaaagcuccaugauaagcacagagacaauacagccuccgauccuc

SEQ ID NO: 222560 - RNA, 71 nt, Homo Sapiens
augagggcagcccagcccccgcacccacccccaaccagagaagcacagaucuuggggagcugccccacaag

SEQ ID NO: 222561 - RNA, 71 nt, Homo Sapiens
ccauuucccuuugaugcuuugguggccuugccccgcucugcagcacagacaggccagaugcauuuguccuu

SEQ ID NO: 222562 - RNA, 71 nt, Homo Sapiens
cagagguggcuuuggcccuggcaagauggauuccaggggugagcacagacaggaucgcagggagaggccgu

SEQ ID NO: 222563 - RNA, 71 nt, Homo Sapiens
aagucuaaaugugucagagaauuuaugugagaaaggacuaaagcacagacacuuucagccuuuauacuaaa

SEQ ID NO: 222564 - RNA, 71 nt, Homo Sapiens
ggacccugaggcccagagggccugcaagggagugaguugauagcacagacccugcccugugggcccccaaa

SEQ ID NO: 222565 - RNA, 71 nt, Homo Sapiens
acugcuaaugaaaugggaaccucccccucccuugugguuucagcacagaaccugaaugccaggaaaaauuc

SEQ ID NO: 222566 - RNA, 71 nt, Homo Sapiens
ugaguuccagagagcugccggaauuccagguuugacucuccagcacagagcagagcuacacagaggugacc

SEQ ID NO: 222567 - RNA, 71 nt, Homo Sapiens
ugcccaucgggacgcccggcgcagcgcacaggcccgggcccagcacagaacgccccgggaccagggauggg

SEQ ID NO: 222568 - RNA, 71 nt, Homo Sapiens
gauuuggaacuccauuccacaaagaaaucgggaugccgcggagcacagaguugucgggagguuagcugcgg

SEQ ID NO: 222569 - RNA, 71 nt, Homo Sapiens
gaauuguacaguuugcagaucagggagacccagugaggauaagcacagauuccugcccuagcugaggcaca

SEQ ID NO: 222570 - RNA, 71 nt, Homo Sapiens
ugcucagaaacucugcccaagcugcuguuucgcgacucaccagcacagauuggaccaccaagagagccagg

SEQ ID NO: 222571 - RNA, 71 nt, Homo Sapiens
gggugcugacugucaagcauccccuguccccaaguuccaaaagcacagacucaaagggaaaccccccaguc

SEQ ID NO: 222572 - RNA, 71 nt, Homo Sapiens
cagaggcccccgagguguguguaggaggcggaggcccgcagagcacagagcaggagaagggcuugggcccu

SEQ ID NO: 222573 - RNA, 71 nt, Homo Sapiens
cucugagcuggugggcaggauggcuggguggcccccagagaagcacagaccugagauggggucuccaugcc

SEQ ID NO: 222574 - RNA, 71 nt, Homo Sapiens
gccucaggcccagcacccaguuccuccucacauggcaggugagcacagacuucuaguuggcaggagcugag

SEQ ID NO: 222575 - RNA, 71 nt, Homo Sapiens
cugggcgucuguucuuuaccaaaaccauccaucccuagaagagcacagagcccugaggggcugggcugggc

SEQ ID NO: 222576 - RNA, 71 nt, Homo Sapiens
agccagccauagguuguuucuuugucuuccggguccuaaagagcacagagaaaauggagguccccagucua

SEQ ID NO: 222577 - RNA, 71 nt, Homo Sapiens
cuugaagccaaugaauuuuaaucuauagauucuuuaauauuagcacagaauaauaucuuugggucuuacua

SEQ ID NO: 222578 - RNA, 71 nt, Homo Sapiens
cccugcugugggagagcgaagggggucaaaggaagacuugaagcacagagggcuagggaggugggguacau

SEQ ID NO: 222579 - RNA, 71 nt, Homo Sapiens
agacaucucugguguucccaccacccuagaugaaaauccacagcacagaccucuaccguguuucucuucca

SEQ ID NO: 222580 - RNA, 71 nt, Homo Sapiens
acugguuggcccaagcccugccugacugaccacccccucagagcacagaucagggaccucacgcaucucuu

SEQ ID NO: 222581 - RNA, 71 nt, Homo Sapiens
gucgccuggcuuauucccaugugugacuccagccugcccucagcacagacucuuucagauggaggugccau

SEQ ID NO: 222582 - RNA, 71 nt, Homo Sapiens
ugucagugucuucugagggcaauugcguugcucaaaucacuagcacagagguuccuuaauuuggggccuua

SEQ ID NO: 222583 - RNA, 71 nt, Homo Sapiens
cccaauauuuccuuuuggugugagucuggguuguugggaacagcacagaauuuggagucuuaagcucuaaa

SEQ ID NO: 222584 - RNA, 71 nt, Homo Sapiens
ggccacccgggcugccugccccugcugcuugggacguguacagcacagaaugaguauuuauuuaaauaaag

SEQ ID NO: 222585 - RNA, 71 nt, Homo Sapiens
uuuuacauuuugaugugucaaaggcuuuuggagugaccaaaagcacagaggcagcggguggggcgccuggg

SEQ ID NO: 222586 - RNA, 71 nt, Homo Sapiens
uggagcgcccauuucuggaaacucacacucguccccagcuuagcacagagcaauguuggacaagcagacac

SEQ ID NO: 222587 - RNA, 71 nt, Homo Sapiens
aaacuuuuugucacucucugccccugccuaaugcugcgagaagcacagaauggcccucucuccaguuuuau

SEQ ID NO: 222588 - RNA, 71 nt, Homo Sapiens
augucuuuuaauccaaagguuagcuccgcucauguucccugagcacagauacgagccacuuguaggcacau

SEQ ID NO: 222589 - RNA, 71 nt, Homo Sapiens
ccagacuuugccagaggcaagggguggguuaaccucacacaagcacagaucuggggccuagaguggaagug

SEQ ID NO: 222590 - RNA, 71 nt, Homo Sapiens
aaggggcaagacguggccugcuguaggaucccugcucaagcagcacagagguggggucuguggugagaguc

SEQ ID NO: 222591 - RNA, 71 nt, Homo Sapiens
gaacucagagguagacagguuuagaggcgagccuggcaggcagcacagacugagccuacaaguggucuggg

SEQ ID NO: 222592 - RNA, 71 nt, Homo Sapiens
aaaagguagaucugaaugcuuguaaugauaggcggacucccagcacagaaagggcuggaaguaaggaaaca

SEQ ID NO: 222593 - RNA, 71 nt, Homo Sapiens
cgugcacugccagggagguggcaggcccuaagucuggcuucagcacagagguccuuggguaacagcuccca

SEQ ID NO: 222594 - RNA, 71 nt, Homo Sapiens
agugcuuaaaaaaaaaaaagaugucuugauucuguucgcaaagcacagacuagagaagcugaucuuuguua

SEQ ID NO: 222595 - RNA, 71 nt, Homo Sapiens
uuuaaagaagcgagagaggagguguucgguccuggucgcagagcacagaucaggcuuuggguaggacuucg

SEQ ID NO: 222596 - RNA, 71 nt, Homo Sapiens
aaggcuggaacaguccauccaagggcauuucugucuuuuuaagcacagacuucucccucauaauuccagag

SEQ ID NO: 222597 - RNA, 71 nt, Homo Sapiens
uucuucaacuguuuuugucuacagaaaaugaagguggaacaagcacagaugucauucaggcaacgcacaaa

SEQ ID NO: 222598 - RNA, 71 nt, Homo Sapiens
aggccccugccacccuaggggaaguccacugccuuugccccagcacagaagagugcccacugugaccugcc

SEQ ID NO: 222599 - RNA, 71 nt, Homo Sapiens
aacccuuugacacaaaccauuaggucagcacucccagacguagcacagaaacauuaaaaaaaaaugucacu

SEQ ID NO: 222600 - RNA, 71 nt, Homo Sapiens
uugaugacuucccuuucuagcaugcccaccgggaccuggucagcacagauccccaaguggcaugcagcccc

SEQ ID NO: 222601 - RNA, 71 nt, Homo Sapiens
gaaguuaggaggcaacuuugggauggugcuagagcauggaaagcacagagaauuggacaaacaggucuuuu

SEQ ID NO: 222602 - RNA, 71 nt, Homo Sapiens
aaggcagcauucaaauuauauagaaucuaguuuuuaaaaucagcacagaucuucuuaaaaacugugaacua

SEQ ID NO: 222603 - RNA, 71 nt, Homo Sapiens
agaaucaugguucugcagucugguguagacacuggaauaacagcacagaaaaaucuaugacucccaauauc

SEQ ID NO: 222604 - RNA, 71 nt, Homo Sapiens
aaaauauccagauguaaaccccaaacuuguacacaaaagaaagcacagauuguuuaccuguuguggauuuu

SEQ ID NO: 222605 - RNA, 71 nt, Homo Sapiens
uucugccuucuuucuugaguuugcuccuguugacuucccacagcacagauaauugacaugucccuuugugu

SEQ ID NO: 222606 - RNA, 71 nt, Homo Sapiens
uccuaggggucaggggguggggguuucauuuuccauuccucagcacagagcagaaaugauagauuuuuauu

SEQ ID NO: 222607 - RNA, 71 nt, Homo Sapiens
gaguuuaagcaggacagugugcgugcacgagcuccgagcccagcacagacaugccuggaacccccgccgcc

SEQ ID NO: 222608 - RNA, 71 nt, Homo Sapiens
uucucaaucacugaaaugaguuacaggccgucucucugcacagcacagaaacaaguggaugaugagaccaa

SEQ ID NO: 222609 - RNA, 71 nt, Homo Sapiens
auacauucuucaacagcauuauuacgaucaccucuuaccacagcacagaacguguauuggaugauuugggc

SEQ ID NO: 222610 - RNA, 71 nt, Homo Sapiens
cuagaagcaccugcugacaccuccacgaccugggggcucacagcacagaacgagagauccagagcccuaca

SEQ ID NO: 222611 - RNA, 71 nt, Homo Sapiens
acuguucucagaccaugaaaaucagagaucugauuccaaagagcacagaaugaaauugagcuauaugauuu

SEQ ID NO: 222612 - RNA, 71 nt, Homo Sapiens
uggugaacaaugacgaauuggcuucucagccaaguggcgguagcacagaugggauccuuugguccuuggau

SEQ ID NO: 222613 - RNA, 71 nt, Homo Sapiens
gggggccaccuccccaggccuguuagaguccaacguggggcagcacagagaugacaugcgggcugggcagc

SEQ ID NO: 222614 - RNA, 71 nt, Homo Sapiens
cccgguccugccugucagcuccagguccuggagccacguccagcacagaguggacggauucaccguggccg

SEQ ID NO: 222615 - RNA, 71 nt, Homo Sapiens
aacucagccgaggugggaaauggugucccugucccucccaaagcacagagcacagaaaugaggccguuuac

SEQ ID NO: 222616 - RNA, 71 nt, Homo Sapiens
ccgaggugggaaauggugucccugucccucccaaagcacagagcacagaaaugaggccguuuacauggcga

SEQ ID NO: 222617 - RNA, 71 nt, Homo Sapiens
ccuuuauuuucaggcauagacuccucuguggucacagcuggagcacagagagggacccugggaacuuggcc

SEQ ID NO: 222618 - RNA, 71 nt, Homo Sapiens
cuguucacugggaucagccagggcgccgggccccacuucugagcacagagcagagacagacgcaggcgggg

SEQ ID NO: 222619 - RNA, 71 nt, Homo Sapiens
cccugacccgcccucaugggcaccgggcaggcgccucacagagcacagacgugcccucggccuuggucgug

SEQ ID NO: 222620 - RNA, 71 nt, Homo Sapiens
ugaauuuggagggaagaaguaauggcgcuagugugggacgaagcacagaucccagcacuuuucccagcuuu

SEQ ID NO: 222621 - RNA, 71 nt, Homo Sapiens
gccgcccacgccggccucugcugcccccuuccccagcccuuagcacagagagggacacaugccccuccccc

SEQ ID NO: 222622 - RNA, 71 nt, Homo Sapiens
uucaagacuuagacuucccauuuuccucagaaaauccacacagcacagaauauuuauaaaaugucauguuu

SEQ ID NO: 222623 - RNA, 71 nt, Homo Sapiens
gcacagaagcacaugcaccuacccauacacccccucuucugagcacagauguucccccaucucgcucccuc

SEQ ID NO: 222624 - RNA, 71 nt, Homo Sapiens
ggggcaaagauuguccccucugcuguucucuggggccgcucagcacagaagaaggaugagggggcucagcg

SEQ ID NO: 222625 - RNA, 71 nt, Homo Sapiens
agaaauaucuucagaggaagacugccgccauacugaggcugagcacagauuugucuuuuucauugcaucug

SEQ ID NO: 222626 - RNA, 71 nt, Homo Sapiens
gggggguuagggggagucccccucccucccuuucccccccaagcacagaggggagaggggccagggaagug

SEQ ID NO: 222627 - RNA, 71 nt, Homo Sapiens
cagaaagaaauaugcauggauucaauaaguauauacaucugagcacagauuauuuuuauagugauuuuugc

SEQ ID NO: 222628 - RNA, 71 nt, Homo Sapiens
gcucagcugcgaccucuggccccagggguaaccccaggccaagcacagauacucaccccucucccacccuc

SEQ ID NO: 222629 - RNA, 71 nt, Homo Sapiens
agcagcgaccucccuuccaggaaacgagagccagcaagcugagcacagaccacagcccccagacccuucuu

SEQ ID NO: 222630 - RNA, 71 nt, Homo Sapiens
ucgcaggcagccucucagaagguggcugagauaagaaaggaagcacagaaguuccucuacuacaggaagaa

SEQ ID NO: 222631 - RNA, 71 nt, Homo Sapiens
ccguaacacacucugugcccauaaaauauuggcauguaaacagcacagacacaccauaugagaaccuuugu

SEQ ID NO: 222632 - RNA, 71 nt, Homo Sapiens
ccuggagguccaggggggcccuccacuugcagcgagacggcagcacagaccucauccucauccuccuccuc

SEQ ID NO: 222633 - RNA, 71 nt, Homo Sapiens
ccuuaaaccggcauuguauuaccggaggcacagagggcaggagcacagaccugucaccaucacuacucaag

SEQ ID NO: 222634 - RNA, 71 nt, Homo Sapiens
gucaaauuggcauaauccucuugggaagcuguguggaaauaagcacagagaagcagaacucuaauugcuua

SEQ ID NO: 222635 - RNA, 71 nt, Homo Sapiens
gccuuucauccaucuccacucucucaacugccuaaagucacagcacagauacugcccagugccuuaagagg

SEQ ID NO: 222636 - RNA, 71 nt, Homo Sapiens
ugcucaauaagcaaaaguggucgguggcugcuguauuggacagcacagaaaaagauuuccaucaccacaga

SEQ ID NO: 222637 - RNA, 71 nt, Homo Sapiens
ucccagugcccaagggccaccaaccccagggaaacagggccagcacagaggggccuuccucccccacagag

SEQ ID NO: 222638 - RNA, 71 nt, Homo Sapiens
caaggccggggcucugcguggcuugcugggaggugggcugcagcacagaggccugugacugcguuccagcg

SEQ ID NO: 222639 - RNA, 71 nt, Homo Sapiens
auguggugucacagauacauuguuuuaugucaaagcucuguagcacagagaaacaaaacaaccaaaaacca

SEQ ID NO: 222640 - RNA, 71 nt, Homo Sapiens
caauaaaggcaguggucccuugaaccccaggcugggaccccagcacagaggcuauugcccccagaggccuc

SEQ ID NO: 222641 - RNA, 71 nt, Homo Sapiens
ugucagugguggagagugucuucuguggccuggacacaaccagcacagagcuggugaaugacuggugugcc

SEQ ID NO: 222642 - RNA, 71 nt, Homo Sapiens
aaggaagugcuggugcauaugaaugucacagggaaccaaaaagcacagaaaugagcuggguugcacaggaa

SEQ ID NO: 222643 - RNA, 71 nt, Homo Sapiens
cccauggaagcccagggagaggcccaccgaaagcucaggggagcacagaagcuugucuccucccccaucag

SEQ ID NO: 222644 - RNA, 71 nt, Homo Sapiens
ccuguccuugugcagucugcguguugagacccccucagaccagcacagagaagggaagcuggguggggugg

SEQ ID NO: 222645 - RNA, 71 nt, Homo Sapiens
ugcaugugugugugugucugaaauuguguaugugcauaugaagcacagacaaagaugaagcaauaauuuuu

SEQ ID NO: 222646 - RNA, 62 nt, Homo Sapiens
ccgccgccuccuacggccgagccgcccccagcagcacagaccaguccuccuccgaggccuag

SEQ ID NO: 222647 - RNA, 71 nt, Homo Sapiens
acacuaguuggaagcucucaauaaaaaugccugcugcucacagcacagaaaauggggcagggggagccuca

SEQ ID NO: 222648 - RNA, 71 nt, Homo Sapiens
ggcucuugggguccccugagcgucuuccaggguggcuggagagcacagacgcgccagggagcccccucugu

SEQ ID NO: 222649 - RNA, 71 nt, Homo Sapiens
uguugauacagacucaaggauuucacaggugaagaaacagaagcacagagaaaguacuguuaucaucccca

SEQ ID NO: 222650 - RNA, 71 nt, Homo Sapiens
uucugaauaucuauuuugacggaagggcugccuuauuuuagagcacagauuaggaauaagugugcugugag

SEQ ID NO: 222651 - RNA, 71 nt, Homo Sapiens
gagcagccccagccacagcccacccagccucagcacagcucagcacagaagaguccuuggaccucccagcc

SEQ ID NO: 222652 - RNA, 71 nt, Homo Sapiens
agugccuuauccccacacuucucuaccauaucuuagcucagagcacagaggaacucaaaauucagaaggga

SEQ ID NO: 222653 - RNA, 71 nt, Homo Sapiens
ccuccuccccaggccuucccgcucccucagcagccacucauagcacagauuccugccaccaucauucagca

SEQ ID NO: 222654 - RNA, 71 nt, Homo Sapiens
cacucaagccuuucuccaccaggccccucaucugaauaccaagcacagaaaugaguggugugacuaauucc

SEQ ID NO: 222655 - RNA, 71 nt, Homo Sapiens
uguccccaguguuccuagcagagguaugcuuaccagcugucagcacagacccuccugcugccuggguccug

SEQ ID NO: 222656 - RNA, 71 nt, Homo Sapiens
uggcaauuccaucugguuuugagaaacuuagcagcucacagagcacagagauccugccuucuuccuacuau

SEQ ID NO: 222657 - RNA, 71 nt, Homo Sapiens
cacagagcccaaaacagaagggggcugccccagcccagcagagcacagaguuucuggagcucccauccaca

SEQ ID NO: 222658 - RNA, 71 nt, Homo Sapiens
gcagagucugggguagggagacagcgacuuguccaaggucaagcacagagggagagguucaggagucaggu

SEQ ID NO: 222659 - RNA, 71 nt, Homo Sapiens
acauuuuagauacacucuaagcuuguucaaaaacagaggccagcacagaugaagggcauuuuugguuuuua

SEQ ID NO: 222660 - RNA, 71 nt, Homo Sapiens
agguugagaccaugcagucaagccuuaccccucauucucacagcacagaugggggcccuaccugcaugccc

SEQ ID NO: 222661 - RNA, 71 nt, Homo Sapiens
cagcccgugggucucugucucuuaauuaagaggcucaggcaagcacagagguggucucauugggaaagacu

SEQ ID NO: 222662 - RNA, 71 nt, Homo Sapiens
acucugggggcagaggugggugcccccgcccauugcuuuggagcacagauggcauggcaugguggcagcug

SEQ ID NO: 222663 - RNA, 71 nt, Homo Sapiens
ucuagagcuguccugucgcuagcaguuuagcauugggaggaagcacagaucagucagaagauuagcaugaa

SEQ ID NO: 222664 - RNA, 71 nt, Homo Sapiens
cuacagaccacagcauucagggaccaggcuaacucugcagaagcacagacaaugcacaugcccucuuucug

SEQ ID NO: 222665 - RNA, 71 nt, Homo Sapiens
caggucaugucaugccccaaccuaaacccaugucuuagggcagcacagagcgcucugcacgauuucauguu

SEQ ID NO: 222666 - RNA, 71 nt, Homo Sapiens
augagcuucucucuacaacauuucuagaaaauagaaaaaaaagcacagagaaauguuuaacuguuugacuc

SEQ ID NO: 222667 - RNA, 71 nt, Homo Sapiens
cucccccgccauucaaggacuccucucuuucuucaccaagaagcacagaauucugcugggccuuugcuugu

SEQ ID NO: 222668 - RNA, 71 nt, Homo Sapiens
aagaaucaaguaugugaauggauggaugaauggaauugugaagcacagaugagcucuuucacacuccaagg

SEQ ID NO: 222669 - RNA, 71 nt, Homo Sapiens
auaucugaagcauguacucauugucagauguucccucugagagcacagaggaggcaaaagcuucuguggga

SEQ ID NO: 222670 - RNA, 71 nt, Homo Sapiens
auuuuuaguaaagauuaaauccaaaacuuuacuuuuaauguagcacagaauaguuuuaaugagaaaugcag

SEQ ID NO: 222671 - RNA, 71 nt, Homo Sapiens
aguaguuaaaaguuuuugucacuaucuucacaaguguguaaagcacagauuucaacagagugcuuggcaua

SEQ ID NO: 222672 - RNA, 71 nt, Homo Sapiens
auuuacugugucuuugguuugugcuaggcccccgggugugaagcacagaccccuuccagggguuuacaguc

SEQ ID NO: 222673 - RNA, 71 nt, Homo Sapiens
cucuucucuucugugaucucaguaggccuaaccuauaaccuagcacagacugcuacagcugcuccccuccc

SEQ ID NO: 222674 - RNA, 71 nt, Homo Sapiens
ggagugaagugugaggacccuuuucccccgcuugcugugaaagcacagauucauugacuacaguacacugu

SEQ ID NO: 222675 - RNA, 71 nt, Homo Sapiens
uaagcugccaugcauuuuuuuuuuuacaguucucaaggaagagcacagaacaauuucucauuucauauuug

SEQ ID NO: 222676 - RNA, 71 nt, Homo Sapiens
uggagugcugugaucucgacaacuuacuuucaaagacauaaagcacagaucuccgcacaggggaugugugu

SEQ ID NO: 222677 - RNA, 71 nt, Homo Sapiens
aaacuuugugccauaauccuugauaaauucaugauguuuacagcacagauauuuuuuuccuuccaauuuug

SEQ ID NO: 222678 - RNA, 64 nt, Homo Sapiens
cugacagagaccccccucggcaguggcugagccuagcacagacccgccucagcaacaguuguga

SEQ ID NO: 222679 - RNA, 71 nt, Homo Sapiens
cacuggcugggucuccaguccuuaguguuuauuucuucuacagcacagauucauuuaguaagaccaaucag

SEQ ID NO: 222680 - RNA, 71 nt, Homo Sapiens
agugguaaauggucuuuuucaucugguuuuuuuuuguagaaagcacagauagucuuggcccucauccaggu

SEQ ID NO: 222681 - RNA, 71 nt, Homo Sapiens
ccuccuguggccugccaguccccgauuugguaguugaggaaagcacagaggaguggacuggaggagcuggg

SEQ ID NO: 222682 - RNA, 71 nt, Homo Sapiens
agguaucauuccaaccucuauuuuacagaugagaaaacugaagcacagagaaguuaagugacuugccaaaa

SEQ ID NO: 222683 - RNA, 71 nt, Homo Sapiens
guuauccuuacguccugagcugacuucucagggcugcaagcagcacagaauuaccugccuuucacggcugc

SEQ ID NO: 222684 - RNA, 73 nt, Homo Sapiens
cgugccacggggaggcuccugcaggaggcucaacccgacggaucacagugaaagggauuccucccacgccaga

SEQ ID NO: 222685 - RNA, 73 nt, Homo Sapiens
uuguuguuuuuauguucauuugcuggagcgcaagacgugcugacacagugaguuuucucugauguauuuaagg

SEQ ID NO: 222686 - RNA, 73 nt, Homo Sapiens
gagcugaagagucuugagaggggcugucaucuguagcugccaucacagugaguuggcagaagugacuugagca

SEQ ID NO: 222687 - RNA, 73 nt, Homo Sapiens
agggacuggagcugcuggaucccaguguggugguguaggaggccacagugagcagguggccccagcuggguuu

SEQ ID NO: 222688 - RNA, 73 nt, Homo Sapiens
ucgacuuuugugaaugugugacauaaacagauguaaugcaugucacagugacggagauaacacugccaugaua

SEQ ID NO: 222689 - RNA, 73 nt, Homo Sapiens
cuauucuaccaaauuuuuaauuucuuucuucccuuucuugcuacacagugaucaagaguuucucauagugcuu

SEQ ID NO: 222690 - RNA, 73 nt, Homo Sapiens
ggcaucuugugacccaguuaaguggauacauaagauuaacuaucacagugacucaguggaauuuuuuguuugc

SEQ ID NO: 222691 - RNA, 73 nt, Homo Sapiens
aauggaaggcaacacugaauaggaguuaagggaauggcacgaucacagugagagagcugcacucaccugcaga

SEQ ID NO: 222692 - RNA, 66 nt, Homo Sapiens
ccuuugcaaaugggauuuaaacuaagauaauauaugcacagugaugugcaggaacaacuuccuaga

SEQ ID NO: 222693 - RNA, 73 nt, Homo Sapiens
aagggaggaagccuggugaauuuagugagcagcuggccugggucacagugaccugaccucaaaccagcuuaag

SEQ ID NO: 222694 - RNA, 73 nt, Homo Sapiens
uugcagugagccaagaucgugccacugcacuccagccuggcgacacagugagacucugucucaaaaaaacaaa

SEQ ID NO: 222695 - RNA, 73 nt, Homo Sapiens
uuacugagagucaggcuagaccuguguuuagagaagcaguuuucacagugacuaccauuuccacccaaugaga

SEQ ID NO: 222696 - RNA, 73 nt, Homo Sapiens
cccaguaagauuguggcaagaccuggcacuccuccaagcuuggcacagugagcccaccagcucagaugguuga

SEQ ID NO: 222697 - RNA, 73 nt, Homo Sapiens
uuaacuuauugucuaggccagagcgggggugggaggggaaugccacagugaagggaguggcagaaucaaauug

SEQ ID NO: 222698 - RNA, 67 nt, Homo Sapiens
agucauauaugcacaguuagaccacuccggcggacaucacagugacaagauuaacaagucagagucu

SEQ ID NO: 222699 - RNA, 73 nt, Homo Sapiens
cuguauuauagcaaguucuuuauuaaagauuuuugaggccgggcacagugacucacgccuguaaccccagcac

SEQ ID NO: 222700 - RNA, 73 nt, Homo Sapiens
gaagugacuucugagaauuaugcagagucaacauggaucauuucacagugagaugcuuuauggauugaaggau

SEQ ID NO: 222701 - RNA, 73 nt, Homo Sapiens
uucucaccuuugacagcugaauguuccuaaagaacugcugccccacagugagggugggagcagcggaacaggg

SEQ ID NO: 222702 - RNA, 73 nt, Homo Sapiens
ucccugagagucucuguuucaucaggacauucugaaauuuacccacagugaggcuguggauggaucaggggac

SEQ ID NO: 222703 - RNA, 73 nt, Homo Sapiens
aguaucuuguaucgcuguuuacaaaucuugcauggacuccugccacagugaaagaagaaaaucuucaugucuu

SEQ ID NO: 222704 - RNA, 73 nt, Homo Sapiens
gguauuuaaugcugaucuaccagcacaaauuaaguuauauaaacacagugacucauguacagaacuuugucua

SEQ ID NO: 222705 - RNA, 73 nt, Homo Sapiens
cguguuuuuacuaaaaguacgagaucgagaccauccuggcuaacacagugaaacggguggaucacgaggucag

SEQ ID NO: 222706 - RNA, 73 nt, Homo Sapiens
cucugugcacgacucaacuggguaaaguuguuugugucuggcccacagugacuuccaggugggaacaaggccu

SEQ ID NO: 222707 - RNA, 73 nt, Homo Sapiens
ccccaucuguacuaaaaauagaguucaagaccauccuggccaacacagugaaaggcagaucaccugaagucag

SEQ ID NO: 222708 - RNA, 73 nt, Homo Sapiens
ucuauuuucucccuuugccaagguauagcugagcgguugaaaccacagugaucggcaaaacuucuuuucuaaa

SEQ ID NO: 222709 - RNA, 73 nt, Homo Sapiens
aaggguucacaugcauucuuaacaagugauuaaauuuagucugcacagugagcuguauuuuuauuacuauuua

SEQ ID NO: 222710 - RNA, 73 nt, Homo Sapiens
uauuucuauguguaugcaaguuauaaagucaaggacgaauuugcacagugauauaauuugaggugaaauucag

SEQ ID NO: 222711 - RNA, 73 nt, Homo Sapiens
uuucuuuucccuuguuuaauuuuuuuuuucagagaccacagaccacagugauucagaucccacuuacucuuuu

SEQ ID NO: 222712 - RNA, 73 nt, Homo Sapiens
ugccuuuuuccuagaagugguugacguaauuaaauccaacuuucacagugaagcuauccuagucuucacaacu

SEQ ID NO: 222713 - RNA, 73 nt, Homo Sapiens
aaauccagggagcugauaaugcaucaguguggaggaagugugucacagugaaccagcaucucuugaguugccu

SEQ ID NO: 222714 - RNA, 73 nt, Homo Sapiens
auggaaauguucuuggagcuuuuccauuagauguaugugaaggcacagugaaauggaugaagggugcuguuca

SEQ ID NO: 222715 - RNA, 73 nt, Homo Sapiens
auacuaauuauacccccugcaaggagccaaacauccuacaagacacagugaccuuuuggcaagcucuaucacc

SEQ ID NO: 222716 - RNA, 73 nt, Homo Sapiens
ccccgucuccacuaaaaaaugagaucaagaccauccuggcuaacacagugaaaugaggugggcggcucacgag

SEQ ID NO: 222717 - RNA, 73 nt, Homo Sapiens
cugaggcuggaggauugcuugaguucaagaccagccugagcaacacagugaaaacccaucucaaaaaaaaaaa

SEQ ID NO: 222718 - RNA, 73 nt, Homo Sapiens
ugguggggguaugugaagcaaaaggggcaggugcacacaccuccacagugaccucugugcacacgguuaccac

SEQ ID NO: 222719 - RNA, 73 nt, Homo Sapiens
aucuuaauguuuuugaucguugcguuaaaguggaagugccacccacagugaaaccagaucccauuaauaaaua

SEQ ID NO: 222720 - RNA, 73 nt, Homo Sapiens
uaauuuauauccauguuuaggcuuuucauaagaugaaacaugccacagugaacacacucguguacauaucaag

SEQ ID NO: 222721 - RNA, 73 nt, Homo Sapiens
uuggcauauucgggagcuucuuagagggaugagguucuuugaacacagugaaaauuuaaauuaguaacuuuuu

SEQ ID NO: 222722 - RNA, 73 nt, Homo Sapiens
accugaaagccagcaauuuccugacacugagaaugaagaguaucacagugacgaacaaaaugauacucagaag

SEQ ID NO: 222723 - RNA, 73 nt, Homo Sapiens
uacuguuccccaacccacaacuaucuuuuaagaagucuuaguucacagugaaaggaaugaugacuuugaaauu

SEQ ID NO: 222724 - RNA, 73 nt, Homo Sapiens
ccauaauaacccugccagugccagggugggcuggggacucuggcacagugaugccgggcgccaggacagcagc

SEQ ID NO: 222725 - RNA, 73 nt, Homo Sapiens
agguugugcccuccaccuaccugccggacacagagggggccuucacagugaccaucgcaaccaggauugacag

SEQ ID NO: 222726 - RNA, 73 nt, Homo Sapiens
uaacucucaaugaagucaucguuuauuaaaauguguccuauuacacagugaguguguaaaaugcugaucauuu

SEQ ID NO: 222727 - RNA, 73 nt, Homo Sapiens
ugguuauuuucacauguuaccauuaaauauaucauauguuaggcacagugaccuucaacaaaaauugguuggu

SEQ ID NO: 222728 - RNA, 73 nt, Homo Sapiens
aacaaggagaaagcaaugauguuuauugaaccaauuugcaauacacagugaggaaaauucucaaaauacauug

SEQ ID NO: 222729 - RNA, 73 nt, Homo Sapiens
cccuauuauuacuuucagauauuucaguaccaguucugccagccacagugagccugcuuccccuguagucccc

SEQ ID NO: 222730 - RNA, 73 nt, Homo Sapiens
cuuaaggaaauguuugguuggguuugaauccuaaggagauugccacagugagagcagaccagccuuaacucug

SEQ ID NO: 222731 - RNA, 73 nt, Homo Sapiens
uuggcucgccucggccggccgaaaauggcaucuucgugaucaccacagugagcucccuguguugcuaagagcu

SEQ ID NO: 222732 - RNA, 73 nt, Homo Sapiens
uucacagcaguuguuggagugccuccccuacccagggucucugcacagugaccgucacacucaccuggcucca

SEQ ID NO: 222733 - RNA, 73 nt, Homo Sapiens
cccugucucuccuaaaaauagaguucgagaccauccuggcuaacacagugaaacggacagaucacgaggucag

SEQ ID NO: 222734 - RNA, 73 nt, Homo Sapiens
ccaacuaucccauaaaaugaguaauucggacaaacaugacaaacacagugaagaaguugcaagauaaacagcu

SEQ ID NO: 222735 - RNA, 73 nt, Homo Sapiens
gagugaguacagaagaaugcaaauagauauuccucuacccuuucacagugagucagacgguaucagaaacagc

SEQ ID NO: 222736 - RNA, 73 nt, Homo Sapiens
guguaguagauaaauucaagccagcuuauaaguuaaagggcaucacagugagguauaagcaggcugggcaggc

SEQ ID NO: 222737 - RNA, 73 nt, Homo Sapiens
ucuguuuauuuuuuguagguucacagcauaucaggaaaaaguacacagugaguuuaaaauaacuagcaauuaa

SEQ ID NO: 222738 - RNA, 73 nt, Homo Sapiens
auauacacuauacuggaggguaaaugccaguagugaccaagaacacagugauuuuguuuuugauguuaaacag

SEQ ID NO: 222739 - RNA, 73 nt, Homo Sapiens
cgcuuuggcuuuuugauaaauuuauguauuaaaaaaaccacuucacagugaguguucuuaaagaaaagacuug

SEQ ID NO: 222740 - RNA, 73 nt, Homo Sapiens
ugaugugcccaccaccguguucaaccuuaaggacuuagcuggccacagugagcagucugcauaaacuucaucu

SEQ ID NO: 222741 - RNA, 73 nt, Homo Sapiens
ccugacucuacuaaaaaauuagguucaagaccagccugggcaacacagugacaggaguuuugcuugaggccag

SEQ ID NO: 222742 - RNA, 73 nt, Homo Sapiens
gccaagcugcaucagccgcagccgccuucugcuccagcugcaucacagugauggaucuggcugaagugaacgg

SEQ ID NO: 222743 - RNA, 73 nt, Homo Sapiens
aggaaaauguuucagauguuuauuuguauaauuacuugauucacacagugagaaaaaaugaauguauuccugu

SEQ ID NO: 222744 - RNA, 73 nt, Homo Sapiens
cuggccacugcugugaccacgacacugcuggggcagcuucuuccacagugaugccuacugaugcuucagugcc

SEQ ID NO: 222745 - RNA, 73 nt, Homo Sapiens
ggcucucuugaucuccucaaucuggaguccccugcccucaaaacacagugauguucagaacagaacacaaggu

SEQ ID NO: 222746 - RNA, 73 nt, Homo Sapiens
ugccuccucucucugcucacuucagggcccagugcacucacuucacagugacagcccuccccuacaauccuug

SEQ ID NO: 222747 - RNA, 73 nt, Homo Sapiens
cccuccccuacaauccuugggcagagcauguggucugagggcccacagugaaagaacagcagugguggcaacu

SEQ ID NO: 222748 - RNA, 73 nt, Homo Sapiens
gccauggcccuaauugugccugagcuugacuuucagucagggccacagugagcauuaaauuauuauuccauac

SEQ ID NO: 222749 - RNA, 73 nt, Homo Sapiens
cuuaaugguauccuacugagcauuugcaccucuguucauuucacacagugaaacgcaauuuuaccuaguuugc

SEQ ID NO: 222750 - RNA, 73 nt, Homo Sapiens
uugcauuuuaaauucucagccaaccuacagccaugaucuuuagcacagugauaucaccaugacuucacagaca

SEQ ID NO: 222751 - RNA, 73 nt, Homo Sapiens
aaauucugaaaauaauuguaguaguagugauauagucaauggacacagugaaauagagcaaacaccuuuaguu

SEQ ID NO: 222752 - RNA, 73 nt, Homo Sapiens
uggguggaucacgaggucaggagaucgagaccauccuggcuaacacagugaaaccccgucucuacuaaaaaua

SEQ ID NO: 222753 - RNA, 73 nt, Homo Sapiens
ugcagugagcugugacugugccacugcacuccagcuugagcaacacagugauacugucucaauaaauaaauaa

SEQ ID NO: 222754 - RNA, 68 nt, Homo Sapiens
ugcaaugugugaucuugugacaggccugaggcccugggcacagugacgguggccuggccagcccucgg

SEQ ID NO: 222755 - RNA, 73 nt, Homo Sapiens
guuauacuaacuaauaaugaauauuaaaugauuuuucuucagucacagugagagcaucuugcuuugugguuga

SEQ ID NO: 222756 - RNA, 73 nt, Homo Sapiens
ugcagacauuugauuucuuuuauggcugagaguuuaguguuuucacagugaaggauaauguguggagucucau

SEQ ID NO: 222757 - RNA, 73 nt, Homo Sapiens
ccacucugagucccagagccaagaacuuggaaauagugauuuccacagugacuccgccacccucccacugcca

SEQ ID NO: 222758 - RNA, 73 nt, Homo Sapiens
ccacuucaagacagggcagggggugccccuucaggccugcucucacagugaaauuaggggagcugguggccag

SEQ ID NO: 222759 - RNA, 66 nt, Homo Sapiens
gggccacccuggaugggaaggccugagagagggggucacagugauacccgugucggccacugcuga

SEQ ID NO: 222760 - RNA, 73 nt, Homo Sapiens
cuuagggaaagacccugcuccacauuacagcugucuccaaacccacagugaugacuuucugcugacagcugca

SEQ ID NO: 222761 - RNA, 73 nt, Homo Sapiens
acagucccagucugcugggacagguggagaacuuucccuccuacacagugaggguagccuaauuuucugggag

SEQ ID NO: 222762 - RNA, 73 nt, Homo Sapiens
ccaguucagacacuaccccaagcccaccaggugucaggauagucacagugauaggccuacagccacaucccca

SEQ ID NO: 222763 - RNA, 73 nt, Homo Sapiens
aagcaaaaacugugcacagaugcacuuucggggaaggaggacucacagugaggagguaucagcuugcucucuu

SEQ ID NO: 222764 - RNA, 73 nt, Homo Sapiens
ggcaaaauuauucacucagaaaacaugacccacuuauauuuaucacagugaaaggcuucuaagggaauacugu

SEQ ID NO: 222765 - RNA, 73 nt, Homo Sapiens
ccauuuguccuuuucugcaacaguuuuauuuauuguguguucucacagugacacugcuguugacucuuccauu

SEQ ID NO: 222766 - RNA, 73 nt, Homo Sapiens
augguugacuagugacacagcaaaaucauagugacuaggacuccacagugaagaauccucaugaucuacaaaa

SEQ ID NO: 222767 - RNA, 73 nt, Homo Sapiens
uugggaaugaagagguagcaggagaaaaggcgacgaaucaggacacagugaacgaaggcguccacaaaagagg

SEQ ID NO: 222768 - RNA, 73 nt, Homo Sapiens
ccuuggauuaccugguggcuagaguacuuuucaugaguucuuccacagugaacagaccuguuguguauacuuc

SEQ ID NO: 222769 - RNA, 73 nt, Homo Sapiens
aaagagccagggcuagggcucugggcauguggcucagagguaucacagugacagugggaagcagcauuguccu

SEQ ID NO: 222770 - RNA, 73 nt, Homo Sapiens
acccaaggaaggccuaugaaguuucaaacugaggaagcuacaacacagugaagucccugucuuucugggguac

SEQ ID NO: 222771 - RNA, 73 nt, Homo Sapiens
gaaaaugcauguaaaugcccaguuuagaagguuuggucuacaacacagugaucuucagaaucuuggcaauuga

SEQ ID NO: 222772 - RNA, 73 nt, Homo Sapiens
aaaaaaaucaaacaguggagccagugaauaggggaaaaauaaacacagugaaaguuuauuuuauccaaguacc

SEQ ID NO: 222773 - RNA, 73 nt, Homo Sapiens
gucagcagauuccuuuacuuuggucccuugacauugacaaaagcacagugacuuccugccugccuucccauau

SEQ ID NO: 222774 - RNA, 73 nt, Homo Sapiens
uccuggggaugucauagccauccacccuggagaccacacugcacacagugacuucauuggcagcucaaagacu

SEQ ID NO: 222775 - RNA, 73 nt, Homo Sapiens
ccccaucucuacuaaaaauagaggucgagaucauccuggcuaacacagugaaacaggcggaucacgaggucag

SEQ ID NO: 222776 - RNA, 73 nt, Homo Sapiens
uagguccacguuccugauacgaugguacacuuucuaguuuuuacacagugauuaggagcgacagauucuccuu

SEQ ID NO: 222777 - RNA, 73 nt, Homo Sapiens
uuguggggauccagugagauuguaauuccugaucuucccaccucacagugauguucaucuguaagcggugguu

SEQ ID NO: 222778 - RNA, 73 nt, Homo Sapiens
ugauggucucuacagggagguuaccuacugaggcucaagccuucacagugagccucauuuuuuuccucaaauu

SEQ ID NO: 222779 - RNA, 73 nt, Homo Sapiens
ugcagucagauuuaugacagcugacaguuuuucagaggucgcacacagugacucuccucucucaggaugacga

SEQ ID NO: 222780 - RNA, 73 nt, Homo Sapiens
cuaguagagcuuuauguucgcuguccaugaaaccuucuguaaccacagugacuacaaguaguucuuucucuau

SEQ ID NO: 222781 - RNA, 73 nt, Homo Sapiens
ccaccagccacaccauuauaccagaaggcggaucccccaagaccacagugagagcuuuuucccuuugcuaacc

SEQ ID NO: 222782 - RNA, 73 nt, Homo Sapiens
ccuuuauuucuaaguggaaaaaguauuagccaccaucuuaccucacagugauguugugaggacauguggaagc

SEQ ID NO: 222783 - RNA, 73 nt, Homo Sapiens
gcugcauuccauaccucagugaagaagccgaaggaugcugacacacagugauguggagggcauuccggagaaa

SEQ ID NO: 222784 - RNA, 73 nt, Homo Sapiens
uaggauucaauacuuaguuugcaaaagcacuuugaaauuauggcacagugaguuguuuuggauaagaaaaucu

SEQ ID NO: 222785 - RNA, 73 nt, Homo Sapiens
aacugaauuggaaaaauagcuccauuuuuuggugcuugggaagcacagugaccaaaaaaguuguauggcugcu

SEQ ID NO: 222786 - RNA, 73 nt, Homo Sapiens
accccaacaucucccucccacauugucaccauuucaaagggcccacagugacuuuugcugggcauuuucccag

SEQ ID NO: 222787 - RNA, 73 nt, Homo Sapiens
uuaaaaacccuuaauauuuuaacaaaaauuucuugauuagaggcacagugaaaaagaagucaaaaaaaaaagu

SEQ ID NO: 222788 - RNA, 73 nt, Homo Sapiens
uuuuaaagugugcuuguguugucaaaaauaucagauaguaauacacagugagcauuuuuaaacaaagggaaac

SEQ ID NO: 222789 - RNA, 73 nt, Homo Sapiens
aacagaaagagaauguagccauucuagccaccguuaaaagauacacagugagguguuguguuuuguuuuuuua

SEQ ID NO: 222790 - RNA, 73 nt, Homo Sapiens
uuugaaugauugaauaucuugaaauguugaaauguaaggugugcacagugaucuucaacuuaacaaacacuua

SEQ ID NO: 222791 - RNA, 73 nt, Homo Sapiens
cugguuacgaagaaaacucaaaggaaggcaggcccuuccuauccacagugaacuuuaggaucuccaugguggg

SEQ ID NO: 222792 - RNA, 73 nt, Homo Sapiens
gaugauccuaugugccuagacaauucugauuagccugcguccacacagugaucugcacaagugauuucaggug

SEQ ID NO: 222793 - RNA, 73 nt, Homo Sapiens
ugguaaugauaaaauugcgagauuuuguaacaagggcuuguuacacagugauauuuugcagacaguagaggga

SEQ ID NO: 222794 - RNA, 73 nt, Homo Sapiens
caugucuuagcacugauuauguccugauugaauuucauuaugucacagugauggcagagucucagcaugauca

SEQ ID NO: 222795 - RNA, 73 nt, Homo Sapiens
uauuaaacccaaaaggaaucauugcuacuuugagauuuauuuccacagugauaucugaucaguguugcaaaaa

SEQ ID NO: 222796 - RNA, 73 nt, Homo Sapiens
acaaccuuuaaagcaagaggcugcacauacauguuguaauaugcacagugauuguacuuuagcuauuguuugc

SEQ ID NO: 222797 - RNA, 73 nt, Homo Sapiens
gcuuagggcaguucagaacccacuuguuucccuaucagagggacacagugaaguggagguuaaaguaaauuac

SEQ ID NO: 222798 - RNA, 73 nt, Homo Sapiens
ggagguggaagcaaauuaguuuacauggcauguccucccuaggcacagugacagcuguaaaguaugacggaac

SEQ ID NO: 222799 - RNA, 73 nt, Homo Sapiens
ucuuuuauacugaaaaaacacuuaaaguaguuuuguguggcaucacagugauuugucaugaaaagccauauau

SEQ ID NO: 222800 - RNA, 73 nt, Homo Sapiens
uacacuuggagcuaggaaaccaaagcaagcuuugugaaacuggcacagugauagagaauugcuguggagaguu

SEQ ID NO: 222801 - RNA, 73 nt, Homo Sapiens
agucagcagccgcuauuaccguaucuuacaauuuaauuacauacacagugaauugaaaccauugugcaaaaug

SEQ ID NO: 222802 - RNA, 73 nt, Homo Sapiens
ccguuaagaagaccuuggauguuguuccaguuaugcuggauuccacagugaaaucauuuaaaaccaucuaaau

SEQ ID NO: 222803 - RNA, 73 nt, Homo Sapiens
uuucucacccgcaacuugagccaggacagcugguccaaguggccacagugauggguuuaaguaccuugguagg

SEQ ID NO: 222804 - RNA, 73 nt, Homo Sapiens
uaaaauuaagcaaguggaacauaugcccuuugccucugcucugcacagugaaaugaaaagucaaccuuugaac

SEQ ID NO: 222805 - RNA, 73 nt, Homo Sapiens
ugagguguaugaggagagaugguuuucuccugcucagcucuuacacagugauagguuuguuccaugggacuua

SEQ ID NO: 222806 - RNA, 73 nt, Homo Sapiens
caguuggcgguagcagcuacuccgagcgccguuuacaguuuugcacagugaucuuccccauuguccacucaag

SEQ ID NO: 222807 - RNA, 73 nt, Homo Sapiens
cugggccaggacacguggggugccugggacgcugcuugccaugcacagugaucagagagaggcuggggugugu

SEQ ID NO: 222808 - RNA, 73 nt, Homo Sapiens
uugcuguucagugcuuuuuccuuuucaucuguuguucuguggucacagugaccuuagcuacauagcagacuuu

SEQ ID NO: 222809 - RNA, 73 nt, Homo Sapiens
agugucaagauaacaaaaaauguacccuagaauuuccucuauacacagugaaaucagucuugaugaacaucug

SEQ ID NO: 222810 - RNA, 73 nt, Homo Sapiens
uauaggucucaggcuuacuucaguauguauauagcauaauauacacagugaauucauuuuguuguucauugug

SEQ ID NO: 222811 - RNA, 73 nt, Homo Sapiens
cuccaccucaaaaaaaaaaagccacugugcuccagccugguggcacagugagauugcagugagcugagaucau

SEQ ID NO: 222812 - RNA, 73 nt, Homo Sapiens
auuaucugcuuuuuaaauuaucacauccccuuuuuguguucaacacagugaaggagaauuaacaaugucuagg

SEQ ID NO: 222813 - RNA, 73 nt, Homo Sapiens
cagcccuucacagaacuacuuuaccaagucuccucaugaaaaccacagugagugacaaugagcgugugaucca

SEQ ID NO: 222814 - RNA, 73 nt, Homo Sapiens
uguuuauuuaaauaucauuaaagggaaaaagggcgugagcucacacagugagcauuuaauuauucaguuuuua

SEQ ID NO: 222815 - RNA, 73 nt, Homo Sapiens
cccugucucuacuaaaaaaagagauugagaccauccuggcuaacacagugaaauggguggaucacaagguugg

SEQ ID NO: 222816 - RNA, 73 nt, Homo Sapiens
auucucggaguugugagaacgagacuacucaagugaaugcacacacagugaaaaaauagagacuauucuuuua

SEQ ID NO: 222817 - RNA, 73 nt, Homo Sapiens
ggcacauuuuuuaccuggugguuaugagcauggacuugggggccacagugacugaguuugauucccgacacag

SEQ ID NO: 222818 - RNA, 73 nt, Homo Sapiens
aucauucaguugcacccauggggaagauuguguuacugcccuucacagugaaaaaaagaaaaaucuuucauuu

SEQ ID NO: 222819 - RNA, 73 nt, Homo Sapiens
cucuguguucauacgccccagauaugugaguuacaugagauggcacagugauaaagccccauuuagugaccuu

SEQ ID NO: 222820 - RNA, 73 nt, Homo Sapiens
agaccaccacuucgaaaccugggauucaggaauguguggccugcacagugaagugcuggcaaccacuaagaau

SEQ ID NO: 222821 - RNA, 73 nt, Homo Sapiens
ucugucuuugugggaggguaagacaauaugaacaaacuaugaucacagugacuuuacaggagguuguggaugc

SEQ ID NO: 222822 - RNA, 73 nt, Homo Sapiens
ugcagugagccaagaucgugccauuccacuccagccugagcaacacagugagacccuaucucaaaaaaauaau

SEQ ID NO: 222823 - RNA, 73 nt, Homo Sapiens
cauggguuucaacacguuuuguauuaaauauauuuucaaaguccacagugauuuuucuaaacgcuuacagauu

SEQ ID NO: 222824 - RNA, 73 nt, Homo Sapiens
gcccucaugaguuccaauguugugugaagacaggcagaugcugcacagugaauugcagaugauauuacagaag

SEQ ID NO: 222825 - RNA, 73 nt, Homo Sapiens
auccgaguggcacuggcagagaaggauaggaguggaaugcccacacagugaccaacagaacuggucugcgugc

SEQ ID NO: 222826 - RNA, 73 nt, Homo Sapiens
agggccauggccggucccucacgcaguugcucugggaagaugccacagugaccucaccucccugggcagcgag

SEQ ID NO: 222827 - RNA, 73 nt, Homo Sapiens
auuguguucuuggcaugugaguuguggaccgucugccaggcaccacagugagccaagcugaacgcacccgcug

SEQ ID NO: 222828 - RNA, 73 nt, Homo Sapiens
cuugcuucucugagaccugcuuaauuugaagcaacuccuugcucacagugauucuaauagauuuguaaggcua

SEQ ID NO: 222829 - RNA, 73 nt, Homo Sapiens
ccccauguacuccauguagccaaacauacauaaaagagaagagcacagugaacucuuuucuuguagaacauuu

SEQ ID NO: 222830 - RNA, 73 nt, Homo Sapiens
aaggaaaaguggugccguuaaaucuacuuugucauuuauccaccacagugacacuuucuauacaggagauugg

SEQ ID NO: 222831 - RNA, 73 nt, Homo Sapiens
acaguaacuuggaacugaccagagagagaagacacacuugggacacagugaagcuccuccuaccccucaggau

SEQ ID NO: 222832 - RNA, 73 nt, Homo Sapiens
ggccugcuuuugugucccaugggauuuuaucccccaccaaaaacacagugaaagcaagagaauuucaaggcag

SEQ ID NO: 222833 - RNA, 51 nt, Homo Sapiens
gcugccuuauauuccuacauccacagugagacauccccugccuggaaguga

SEQ ID NO: 222834 - RNA, 73 nt, Homo Sapiens
gguucaggacgggucaaagggcuggaaagagagagaagggccucacagugauguugaguuuuuaguuugagaa

SEQ ID NO: 222835 - RNA, 73 nt, Homo Sapiens
uuguuuuuaucugugcucagagagguuggcuguuuaugguuugcacagugacucacccauguuagccacaaga

SEQ ID NO: 222836 - RNA, 73 nt, Homo Sapiens
accagcgugagugguggaggcacuccacgcagcuggcagagagcacagugauccagugauucccuccucccgu

SEQ ID NO: 222837 - RNA, 73 nt, Homo Sapiens
cccuccucccgucacuccacugagucugaagcacucucgcacacacagugauugugaaaauuauuuuggaaau

SEQ ID NO: 222838 - RNA, 73 nt, Homo Sapiens
uuuuauuugauuaggauugaacaguucaguuguaucuaugccccacagugaccaguaaaguccaauuaaaaua

SEQ ID NO: 222839 - RNA, 73 nt, Homo Sapiens
ggggacuccgcacaugccugugaugucacaguuacugucaguucacagugaaccuucccuccuuuuccuguug

SEQ ID NO: 222840 - RNA, 73 nt, Homo Sapiens
agcaguguacugagauguggcuggcugugccaucgucauagugcacagugacuuuucuguuucuuaucacuaa

SEQ ID NO: 222841 - RNA, 73 nt, Homo Sapiens
caacagggacacuuuuuaaaaacacucuuaucagccugggcaacacagugagacuccaucucuuaaaaaaaaa

SEQ ID NO: 222842 - RNA, 73 nt, Homo Sapiens
uugacuagacuucccaaauaauuuuaauauauacuuuuagacccacagugaaaccacagaaggucauauuuug

SEQ ID NO: 222843 - RNA, 73 nt, Homo Sapiens
uggcuggagcuagaauuugauaugugaacaguuguguuugaagcacagugaucaaguuauuuuuaauuugguu

SEQ ID NO: 222844 - RNA, 73 nt, Homo Sapiens
uugacacgugguguaauaaaauggacaaauucuguagaguagacacagugaguauguggaccucuuuuauaag

SEQ ID NO: 222845 - RNA, 73 nt, Homo Sapiens
uacguuuauugccucgucuuauucacugaccuuuguaaugauacacagugaauucuuuuugacaaagagaaau

SEQ ID NO: 222846 - RNA, 73 nt, Homo Sapiens
acucguggaaagggaaaggggaggagaugggacuuugaccacacacagugaugccucacacccugaagguggg

SEQ ID NO: 222847 - RNA, 73 nt, Homo Sapiens
cuaccuccacucaugucccauuuuagccaagcuuauuuaagaucacagugaacuuaguccuguuauagacgag

SEQ ID NO: 222848 - RNA, 73 nt, Homo Sapiens
gacaugagucuuggagguucugaaugauuuuauugcuaauuaucacagugacauagacuagaacagaaauuag

SEQ ID NO: 222849 - RNA, 73 nt, Homo Sapiens
uauaaugagccguugugcucucaggaggcugaggcaggaggaucacagugaccgcaugugcagucccagcuac

SEQ ID NO: 222850 - RNA, 73 nt, Homo Sapiens
auggagaaggugaacuugcuagugccacuuauuaaagagcuuccacagugaaguuuauagaggguuuacacaa

SEQ ID NO: 222851 - RNA, 73 nt, Homo Sapiens
agacaacuuugugaagaucuaauuuaauuucacguugacaaaacacagugaaacaacuuuugcuuauaacuac

SEQ ID NO: 222852 - RNA, 73 nt, Homo Sapiens
cuucauuucuacaaaaauuagaguugaagaccagccugggcaacacagugagaggaggaucguuugagcccag

SEQ ID NO: 222853 - RNA, 73 nt, Homo Sapiens
uggaucaggguggggacaagcaggcucagcucccagcugcguccacagugacccauugugucacaugggcugc

SEQ ID NO: 222854 - RNA, 73 nt, Homo Sapiens
agaugaaaaaauuauuuguacauuuaaauaacacaaaauugaccacagugauuccauuucuccacagagaccc

SEQ ID NO: 222855 - RNA, 73 nt, Homo Sapiens
cgcugcaguauuuugauuuguuccuccuuuccauccuguuaaccacagugaaaaauacuuuguuuuuaguuuu

SEQ ID NO: 222856 - RNA, 73 nt, Homo Sapiens
accacugauuuuuuccacuggaaaccaccaauaacccacugaccacagugagagaguaguccccaguuauuau

SEQ ID NO: 222857 - RNA, 73 nt, Homo Sapiens
ugcagugagccgagaucacgccauugcacuccagccugggugacacagugagacuccaucucaaaaaaaaaaa

SEQ ID NO: 222858 - RNA, 73 nt, Homo Sapiens
ccacgacagcugugccuacgacuaucuggaggugcgcgacgggcacagugagagcagcacccucaucgggcgc

SEQ ID NO: 222859 - RNA, 73 nt, Homo Sapiens
uuccaggucccccagggcuuccucccacagcagcugugaauggcacagugaccuuccugcagcguggagaugg

SEQ ID NO: 222860 - RNA, 73 nt, Homo Sapiens
gauuuacuccacuuuuuaugccuuccauugugaugacgucaaacacagugaaagccuucagucaugcuauggg

SEQ ID NO: 222861 - RNA, 73 nt, Homo Sapiens
uugacuuuuaagaaaaacaugucacuaaccugaagcucagccacacagugacuuuuaagguuuuauuuagacu

SEQ ID NO: 222862 - RNA, 73 nt, Homo Sapiens
ugagcacuuacagcaacaaugcacccccucaauagccagcacccacagugagcugcgcugcggaggacaggaa

SEQ ID NO: 222863 - RNA, 73 nt, Homo Sapiens
uucucagaggugacagagauucaggcagaggagagugcagccucacagugacugggggaugauggaggugaca

SEQ ID NO: 222864 - RNA, 73 nt, Homo Sapiens
cuccaucucaauuuaaaaaggaguuugagaccagccucaucaacacagugaaagguggauugcuugagcucgg

SEQ ID NO: 222865 - RNA, 73 nt, Homo Sapiens
cugagagagacggcgauuuuccuuugugucagaaaaaggaaaccacagugagcggaggggcagccugugccug

SEQ ID NO: 222866 - RNA, 73 nt, Homo Sapiens
uaugugcccaaaguucagaagggccuuugagaaucagacugaacacagugaaauugguagcugguguugaaua

SEQ ID NO: 222867 - RNA, 73 nt, Homo Sapiens
uggucaaaugcuccugacagaggcugcguaagggacccugagccacagugaguuacccacugguuuccccaac

SEQ ID NO: 222868 - RNA, 73 nt, Homo Sapiens
uugaaauacccauucccagauucugggaggaagcuggagagagcacagugaaaagacagggguggaauucguc

SEQ ID NO: 222869 - RNA, 73 nt, Homo Sapiens
agccucgucuuucagcgagcgagauuccagaacgcccuguguccacagugauuaacacucacugccugcagcu

SEQ ID NO: 222870 - RNA, 73 nt, Homo Sapiens
ggguuguuggccugaagaugccccguuauugucuuuuuggagacacagugaacacugcuucucgaauggaguc

SEQ ID NO: 222871 - RNA, 73 nt, Homo Sapiens
uaaucagcacugaauucagaggguuugacuuuuucaucuauaacacagugacuaaaagaguuaaggguauaua

SEQ ID NO: 222872 - RNA, 73 nt, Homo Sapiens
ccugagucugacccauggacaccuguuucauucacuuuagcaucacagugaccuuuguaugcucuguucaguc

SEQ ID NO: 222873 - RNA, 73 nt, Homo Sapiens
cagcuccuggaagcugaguuacagaguaauuaaaugggguguucacagugacuuggauacaccaauuagaaau

SEQ ID NO: 222874 - RNA, 73 nt, Homo Sapiens
gagauaccagcaaugugugcacagaacaaagaccaggagaggacacagugagaaggcaguuaucugcaagcaa

SEQ ID NO: 222875 - RNA, 73 nt, Homo Sapiens
ccugaaccugcccauggagacaguuguggugaggguugccacacacagugagggcggagcaggguggcugagg

SEQ ID NO: 222876 - RNA, 73 nt, Homo Sapiens
augagguguacggaugagugaccugcacuaagaagugaguugccacagugaaaauggguugguuuuugucuuc

SEQ ID NO: 222877 - RNA, 73 nt, Homo Sapiens
aaagaggcuagaugauggugggaauucugucucaucaguucuucacagugagaaccuaaauguucccuucuca

SEQ ID NO: 222878 - RNA, 73 nt, Homo Sapiens
cugcagagccugagcugcugagaacaucucaggaagcacuggacacagugauuccuuccauuccucagcugaa

SEQ ID NO: 222879 - RNA, 73 nt, Homo Sapiens
uuuuuaggaaauacacacuaaaugccauuguuuuaaggaaauacacagugaagcaaagcuauguaagagaaua

SEQ ID NO: 222880 - RNA, 73 nt, Homo Sapiens
uaugggcaaagcuuuuuuccaaguuggugucguaacuccaggccacagugaguuuucuuaauuggccaaauau

SEQ ID NO: 222881 - RNA, 73 nt, Homo Sapiens
cugggcccuuuaugcuugcugggugaguugaccuguggccucgcacagugauucugguguacauauguccgcu

SEQ ID NO: 222882 - RNA, 73 nt, Homo Sapiens
cagaaagucuccacuuucuggagcgcauagauacagcagagcucacagugagucaaguugcucccucuccagg

SEQ ID NO: 222883 - RNA, 73 nt, Homo Sapiens
cagggacucagcuccuuucacuucugcuuggcagguugguucacacagugaugguaacaguccagugggggug

SEQ ID NO: 222884 - RNA, 73 nt, Homo Sapiens
ugcagugagccaagaucacggcacugcgcugcagccugggcaacacagugagacccugucaaaaaaaaaaaaa

SEQ ID NO: 222885 - RNA, 73 nt, Homo Sapiens
auaugccccuuuucuuauaaaaacaaaaaaaaaaauaaugaaacacagugaauuuguagaguggggguauuug

SEQ ID NO: 222886 - RNA, 73 nt, Homo Sapiens
acuuuaugccggaugugcuuuucuccaauaucagugcucgagacacagugaagcaaauuaaaaaaaaaaaaaa

SEQ ID NO: 222887 - RNA, 73 nt, Homo Sapiens
uucauuuauguuugcugaccuguggagaccagucuuucugacacacagugaagcucaacuugccuccuggcug

SEQ ID NO: 222888 - RNA, 73 nt, Homo Sapiens
ugggcggaucacgaggucuggaguuugagaccauccuggcuaacacagugaaaucccgucucuacuaaaaaua

SEQ ID NO: 222889 - RNA, 73 nt, Homo Sapiens
guaaucaagccaauggccuuugucaggaagggaaggggcucaacacagugauggacugauccagauggcuccc

SEQ ID NO: 222890 - RNA, 73 nt, Homo Sapiens
gacaguuccucugugucacugacacaggaaaucauuucuaggacacagugaucagggaagggugccugggacu

SEQ ID NO: 222891 - RNA, 73 nt, Homo Sapiens
uuccacaaaaccaaaauccauguugaacaaaguuaaguccguacacagugacuuuuugggugagccgugugug

SEQ ID NO: 222892 - RNA, 73 nt, Homo Sapiens
gaguuaucuaagaauacagcuuucugaccuucagcucacgcuucacagugaucgaugauucaggugcagagga

SEQ ID NO: 222893 - RNA, 73 nt, Homo Sapiens
aauucucggauauagggauucaaaagacaggacacagaacuaacacagugaaaaaaaucaguaccacauuugg

SEQ ID NO: 222894 - RNA, 73 nt, Homo Sapiens
accaggggcagcucccgagggcacugugaaggcucccaugccacacagugagaacuguagccucugcguccaa

SEQ ID NO: 222895 - RNA, 73 nt, Homo Sapiens
ugugucucuacuuacaaaaagaguucgacaccagccuggccaacacagugaaagggcaauggcuugagcccag

SEQ ID NO: 222896 - RNA, 73 nt, Homo Sapiens
ugaggugagguagcaagaagaaguuuguuagguuacaugguuacacagugagguguaacuguuaauucaguga

SEQ ID NO: 222897 - RNA, 73 nt, Homo Sapiens
acacuggggagacgugcuuuaauguggaucuuuuacaccacaucacagugaacuaaguaguuuaaguauguua

SEQ ID NO: 222898 - RNA, 73 nt, Homo Sapiens
ccgacccccucugaauaugacagaggccccugcuugggcaguucacagugagagaaagggaaaugcuuuucug

SEQ ID NO: 222899 - RNA, 73 nt, Homo Sapiens
gggccaagagccagcacugcguggggccccaggauaaaacagacacagugacauccugcccaggagaggggcu

SEQ ID NO: 222900 - RNA, 73 nt, Homo Sapiens
gagccccuaagcuucagucuacagaugcccccaaaucagagcucacagugagucuuggaaagugugggcagcc

SEQ ID NO: 222901 - RNA, 73 nt, Homo Sapiens
agugagcacagagggaguuuaugucaggacuaaaaaaaggcaucacagugagcaaaccugaaaauauggaugg

SEQ ID NO: 222902 - RNA, 73 nt, Homo Sapiens
ggccaugcaaccaggugauucuguggucacugggaacgugccccacagugacuauacugccgucuaggagaac

SEQ ID NO: 222903 - RNA, 73 nt, Homo Sapiens
cgggacucuaaaaaaaaauuauaugguauggcaaguuaccaaacacagugagcccuccuccuaaccaagccgg

SEQ ID NO: 222904 - RNA, 73 nt, Homo Sapiens
ccaaaagugucagguguuuuaucgugccucuuagugccaaacccacagugagauggaaugaccuccuucagau

SEQ ID NO: 222905 - RNA, 73 nt, Homo Sapiens
agccuggcacaggacugauucugggaugcuccuaguuugaccucacagugacccuucccaaucagcacugaaa

SEQ ID NO: 222906 - RNA, 73 nt, Homo Sapiens
agucuuggcugagaucaaagggaugagcaacagggacuucugccacagugacaauggaauuguguugugccuu

SEQ ID NO: 222907 - RNA, 73 nt, Homo Sapiens
agccaaggagucagauggcaauggguacuccagcagguaggggcacagugaauguguguauguaugaaggcca

SEQ ID NO: 222908 - RNA, 73 nt, Homo Sapiens
uaauuucaugacauuuacaaucaggacugaaguaaguucuucacacagugaccucugaaucaguuucagagaa

SEQ ID NO: 222909 - RNA, 73 nt, Homo Sapiens
gaccuacuuuuguaacagaccaugguuguguccaagguaaaaccacagugauauuuuuggaugcuuugucugc

SEQ ID NO: 222910 - RNA, 73 nt, Homo Sapiens
uccaucagagacaguaucucuaggcuugggcaagagaaaaguccacagugauaagcaacuccaccuaaggcau

SEQ ID NO: 222911 - RNA, 73 nt, Homo Sapiens
gcgagaggaggggcccguugucucccuggcccucaaggccucccacagugacucgggcuccugugcccuuauu

SEQ ID NO: 222912 - RNA, 73 nt, Homo Sapiens
ggcggugagcucaguggauugcaguggugugcuggugauuuugcacagugagcucugcggaaggggucaggcu

SEQ ID NO: 222913 - RNA, 73 nt, Homo Sapiens
cugacugaaaacugaguuaacaagaugaaaucuaaaggauauucacagugacuucaauucaggaagaaugcuu

SEQ ID NO: 222914 - RNA, 73 nt, Homo Sapiens
uuguuagaucucugcuuaggucgcagcucacgcauugaaugcacacagugauuguaugcaugccuuuugguac

SEQ ID NO: 222915 - RNA, 73 nt, Homo Sapiens
gaaagggcaguguggggacugucauuuuugugauuuaauaacacacagugaaaauccaggaagaaugaauuaa

SEQ ID NO: 222916 - RNA, 73 nt, Homo Sapiens
auuuauuuauuuuguucauuuauuuauuggagaggcagcauugcacagugaaagaauucuggauaucucagga

SEQ ID NO: 222917 - RNA, 73 nt, Homo Sapiens
uggggcuaggcuggagcccagggagcggaaagcagcucaaaggcacagugaaggcuguccuuacccaucugca

SEQ ID NO: 222918 - RNA, 73 nt, Homo Sapiens
acucaaguggcaccuagaagggcaggaguuccuuuggugacuucacagugaagucuugcccucucugugggau

SEQ ID NO: 222919 - RNA, 73 nt, Homo Sapiens
cgacgagcugcagacgacaaaugucagcgaccugggcuuggaacacagugacucccuggaguagucgggcagc

SEQ ID NO: 222920 - RNA, 73 nt, Homo Sapiens
ugauguucuuggaggaucaacacuucugugggagcuauucauacacagugacuaggguucuuuuaacacucgg

SEQ ID NO: 222921 - RNA, 73 nt, Homo Sapiens
uuguacucuccucauucugcugaaaccauagcaugcuacucuucacagugacggcugugaugcugaucuuccu

SEQ ID NO: 222922 - RNA, 73 nt, Homo Sapiens
ugaaaauuuuauacucuaugauucuuauaauuuuaaaugagggcacagugaaaauuggauguuauuugcuuau

SEQ ID NO: 222923 - RNA, 73 nt, Homo Sapiens
ccuccuuuccuugggucucuucugcugcccuguucuucacccucacagugauagucuggggagagacagggcc

SEQ ID NO: 222924 - RNA, 73 nt, Homo Sapiens
caaaggacacaacuuuuuaugacagaaugaucauucaauggaucacagugaagaaauguuucccagaaaacua

SEQ ID NO: 222925 - RNA, 73 nt, Homo Sapiens
aaaggcucggaauguuacaaucuuacauggccacaaagggacacacagugacacagccuacagcagugugguc

SEQ ID NO: 222926 - RNA, 73 nt, Homo Sapiens
cgggaucccagaacucuggugagugaggacugacucaaggucacacagugaucggagccugagguacagagaa

SEQ ID NO: 222927 - RNA, 73 nt, Homo Sapiens
agccuauaugugcauuuacuaaauuauuugagaaagaccauaacacagugaguguguguguggcuuugaaaac

SEQ ID NO: 222928 - RNA, 73 nt, Homo Sapiens
gacugccucugcuucauagggugggggcugaugggggcaggcccacagugagagccucuggagaagaccuggg

SEQ ID NO: 222929 - RNA, 73 nt, Homo Sapiens
aagggagcccaccaccucuccuaguggccagaggagggaggggcacagugaagcucacucguauuucccaccc

SEQ ID NO: 222930 - RNA, 73 nt, Homo Sapiens
acccugagagcauccuggcagggagcacccuggcaccugggagcacagugaaggggagcacagugaagaccau

SEQ ID NO: 222931 - RNA, 64 nt, Homo Sapiens
aauggauuugucaguauuagaguuugacaaaauucacagugaaauaaucaaugaucacuauuuu

SEQ ID NO: 222932 - RNA, 73 nt, Homo Sapiens
agaaacugagccauugccaaaugguaaagaaaugaaaaguuuucacagugacuacugaauauaccaagagcuu

SEQ ID NO: 222933 - RNA, 73 nt, Homo Sapiens
ccaaggagcugguggugcagaaaggcuggcgguugccggaguacacagugacccaggagucugggccagccca

SEQ ID NO: 222934 - RNA, 73 nt, Homo Sapiens
cuuguuccagcccggaguuuugggaaagaaagaaaggaaaggucacagugaccuaggauuggaaccuuccugc

SEQ ID NO: 222935 - RNA, 73 nt, Homo Sapiens
guuugguaaaagaauauuuucuucucugaauaauaauuauuuucacagugaaaauuucaguauuuuaucacua

SEQ ID NO: 222936 - RNA, 73 nt, Homo Sapiens
ggaaacgugacucuuucuuaaugccacuggguuuuagucaggccacagugagaaggaacagcccuaacaggcc

SEQ ID NO: 222937 - RNA, 73 nt, Homo Sapiens
caauccaagcaggaagaaggaaaagauacccaaaggucaagaacacagugauuuuauuagaaguuucauccgc

SEQ ID NO: 222938 - RNA, 73 nt, Homo Sapiens
cuuuggagaucagaaaauucauauuuaagcaaagugauacaaacacagugauuugggaaugccuucauuuaca

SEQ ID NO: 222939 - RNA, 73 nt, Homo Sapiens
caugcuuuucggggaaaacuccagucguacuaucuuacugagccacagugauggaagaagaugacgaugauga

SEQ ID NO: 222940 - RNA, 73 nt, Homo Sapiens
gcaacauuaagggcaaagccggaucccaggagacaacagucuccacagugagaccgaccaaaccccaagaccu

SEQ ID NO: 222941 - RNA, 73 nt, Homo Sapiens
agaugaugacuauauggcuuuugcugcuucucaauaucauagacacagugaaugucuauauuauugcauaauu

SEQ ID NO: 222942 - RNA, 73 nt, Homo Sapiens
gucacuuccuucagcaucucgucucauuuaggacuggguuccccacagugacauugaaggaaagcuaagucuu

SEQ ID NO: 222943 - RNA, 73 nt, Homo Sapiens
ugcgcaauguuuauaugcuuaaaaaagaacagccuuuuuaggccacagugaccgacucuguuccaaaaaaaau

SEQ ID NO: 222944 - RNA, 73 nt, Homo Sapiens
uagccaaauaagucuuaacccuuucaucagaaguuacacagaccacagugauucgucauccaacacaacaugg

SEQ ID NO: 222945 - RNA, 73 nt, Homo Sapiens
ugaauaaaacgggauuuucaugacucaguauaguuacugguaccacagugagguaguuaacuguaaaguaacc

SEQ ID NO: 222946 - RNA, 73 nt, Homo Sapiens
gcgccgacugacuuaugguuagaguuccgacucugcauggugucacagugaaauugugcauuuaauaccaguu

SEQ ID NO: 222947 - RNA, 73 nt, Homo Sapiens
cuaaaacgugaaacacuguaacacuuuuaaccacugagcauuccacagugaaauguuauuucuaugcucuuau

SEQ ID NO: 222948 - RNA, 73 nt, Homo Sapiens
uuaucuagagaauaaucauauauaugcauacguaaaaauggaccacagugacuuauuuguaguuguuaguugc

SEQ ID NO: 222949 - RNA, 73 nt, Homo Sapiens
augaaguuuauuucaacagauauuuuaugaaaugcaguuuaaccacagugaaugaauuuuagcuuugcuuuug

SEQ ID NO: 222950 - RNA, 73 nt, Homo Sapiens
acuguugguuaaaugacaauuuauguggauuuugcauguaauacacagugagacacaguaauuuuaucuaaau

SEQ ID NO: 222951 - RNA, 73 nt, Homo Sapiens
ucuuggagcuuuugcauuuaaaacaaacaagcaagcagacacacacagugaacacauuugauuaauuguguug

SEQ ID NO: 222952 - RNA, 73 nt, Homo Sapiens
gguagaggacucuggcacagcacucauugcaguacuuucacagcacagugacaacagcaggcauaugaaacuc

SEQ ID NO: 222953 - RNA, 73 nt, Homo Sapiens
aggagcucuguggaccaagagacguguauugguugguccaagacacagugagugauagucccuucauucugua

SEQ ID NO: 222954 - RNA, 73 nt, Homo Sapiens
auguauuauagaguagaauauucuucaaagggaguuuguuauacacagugaaaauggauuaucugggguaauu

SEQ ID NO: 222955 - RNA, 73 nt, Homo Sapiens
aaucauaauacuagacaaaaaauguuguuuuuuugauugauagcacagugauauuuaaaaauuuuucccuuuc

SEQ ID NO: 222956 - RNA, 73 nt, Homo Sapiens
ugggcggaucacgaggucaggagaucgagaccaucgugacuaacacagugaaaccccgucucuaauaaaaaua

SEQ ID NO: 222957 - RNA, 73 nt, Homo Sapiens
cuuucaaaagaagaguuuuagagaaaauaaauuuaacuuuaaccacagugaaaguugacccuuagcgggacaa

SEQ ID NO: 222958 - RNA, 73 nt, Homo Sapiens
gaucagcagcuguggaaauaaagcuugugagcccucugcuggccacagugaggaaaguagcacaaauaggaua

SEQ ID NO: 222959 - RNA, 73 nt, Homo Sapiens
gauugcagggcuggcagcccccacgugguggcauccugacaggcacagugagacccuugcugggucaggucuc

SEQ ID NO: 222960 - RNA, 73 nt, Homo Sapiens
agcuagaggguuuuggcuguugcuuuuuuuaaaguuagguccacacagugaagggaaaagagucugugaaggu

SEQ ID NO: 222961 - RNA, 73 nt, Homo Sapiens
gaggaagcuaaggccuagaagguuaaggauguccccagggucacacagugagcggggcucagagcuugagugu

SEQ ID NO: 222962 - RNA, 73 nt, Homo Sapiens
guacauagauuugauuucuccaaaauacagaaaugcugcugggcacagugaugugcaguuauagucccagcua

SEQ ID NO: 222963 - RNA, 73 nt, Homo Sapiens
aacaaaaugauacucagaagcugacacugagaaugaacaguaucacagugaugaccugaaagccagcaauuuc

SEQ ID NO: 222964 - RNA, 73 nt, Homo Sapiens
cauccuccauccuauuuauagugacugucauugguaauacggacacagugaccagcugcuuguguuucuuggg

SEQ ID NO: 222965 - RNA, 73 nt, Homo Sapiens
gggagguggaggaggguugcacugggggguggaaguguggugacacagugaauugcagggaccagugccaggc

SEQ ID NO: 222966 - RNA, 73 nt, Homo Sapiens
uaggaaacaauauuuugaaauaagucuuacuuccugcuuagggcacagugaaggaggccaaagcacuguccug

SEQ ID NO: 222967 - RNA, 73 nt, Homo Sapiens
uaauuuaauuaucaaucaguuucuaaauacuagccuucugguucacagugaaaucacuucuaaauauuuugcu

SEQ ID NO: 222968 - RNA, 73 nt, Homo Sapiens
uggccccagacgcauagacuucggggaagcugcacaugugccacacagugacuugcuacaacaugugaggcau

SEQ ID NO: 222969 - RNA, 73 nt, Homo Sapiens
uccaggagguggcugauuuuggcucuuagcaaagcagguggcccacagugaccgaaugcaggggucugugcuu

SEQ ID NO: 222970 - RNA, 73 nt, Homo Sapiens
aggaagauguucacauacugcauaugaguaaaguuaccccaaccacagugaggguuuuguguaagaacagcug

SEQ ID NO: 222971 - RNA, 73 nt, Homo Sapiens
caaccaaaccaaccccgaauccagggacgaguguucagugggccacagugaacaugaaucugccacacugagg

SEQ ID NO: 222972 - RNA, 73 nt, Homo Sapiens
uaaaauuugccuauguucugcuauuguuugaucuaaucuuaaucacagugagcucuucauuagcacaauaugu

SEQ ID NO: 222973 - RNA, 73 nt, Homo Sapiens
ggcagagacugcccucagaaguuccuuguccagggugggcacccacagugacucagaggacagggcuaggcag

SEQ ID NO: 222974 - RNA, 73 nt, Homo Sapiens
cgggcggaucacaaggucaggagaucgagaccauccuggcuaacacagugaaaccccgucucuacuaaaaaua

SEQ ID NO: 222975 - RNA, 73 nt, Homo Sapiens
cauugaucuguuuuacaggaaacaaaccuugccuugaaauuuacacagugagacuguacauaauugcaugaaa

SEQ ID NO: 222976 - RNA, 73 nt, Homo Sapiens
aaaugugcuuauguucugcuaugacguuugaucgaauccuaaccacagugagcucuucauuagcucaauaugu

SEQ ID NO: 222977 - RNA, 73 nt, Homo Sapiens
gaauuccguagggucuuguucccacgaccggagugcuggcucucacagugaauuuugaugcauuuaaaauaag

SEQ ID NO: 222978 - RNA, 73 nt, Homo Sapiens
gucaguaaugauuggucccuggggaaggucuggcuggcuccagcacagugaggcauuuagguaucucucggug

SEQ ID NO: 222979 - RNA, 73 nt, Homo Sapiens
gacucugagagaccuugcacuccauacugaaaggagguggggucacagugaauuucacauccccucucaacca

SEQ ID NO: 222980 - RNA, 73 nt, Homo Sapiens
cucguggccagcccggcugguuuuguaagaugcuggguuggugcacagugauuuuuuucuuguaauuuaaaca

SEQ ID NO: 222981 - RNA, 73 nt, Homo Sapiens
ccucugugcacacugacacguggucccguccauccugaacaugcacagugauuuuccucucccguugcacaca

SEQ ID NO: 222982 - RNA, 73 nt, Homo Sapiens
uugguuuuuguuuuuuguuuucuuguuuuuaaaaaaaggauuucacagugagaaaguuuugguuagugcauac

SEQ ID NO: 222983 - RNA, 73 nt, Homo Sapiens
cguuuggccagugacauuucccagcuucacugucaugugcgaacacagugacaguuguucacuuggaguggau

SEQ ID NO: 222984 - RNA, 73 nt, Homo Sapiens
ucuucauuagcacaauaugucuguuguuugaucuaaucuuaaucacagugagcuaaaaugugccuauguucug

SEQ ID NO: 222985 - RNA, 73 nt, Homo Sapiens
ucuucuauagcucaauaugcaugauguuugaucucaucuuaaucacagugagcaaauuugcuaauguucugcu

SEQ ID NO: 222986 - RNA, 73 nt, Homo Sapiens
acucaguggcccauggcauuauccuugccaauagugucauccucacagugaacaguucacauacaaaucaucc

SEQ ID NO: 222987 - RNA, 73 nt, Homo Sapiens
augcugcuccuguaauuuugaauggaccacaucaucucucacucacagugacaaagaaaacagacuuuucuca

SEQ ID NO: 222988 - RNA, 73 nt, Homo Sapiens
ccccaucucuacuaaaaaaagagaucgagaccauccuggcuaacacagugaaaagggcggaucacgaggucag

SEQ ID NO: 222989 - RNA, 73 nt, Homo Sapiens
gauuaaugggcauuguguacucuucucuaugauugauacauggcacagugagacagguggcccaugccuggga

SEQ ID NO: 222990 - RNA, 73 nt, Homo Sapiens
gugccuagcacaaugucuggaugauugugcugugggaacagcacacagugaggugguuuuaauuucugagcag

SEQ ID NO: 222991 - RNA, 73 nt, Homo Sapiens
uauguggcuguucucgugguuaaagcaaggggcgugaagaaggcacagugaggccagcuggccacguagguuu

SEQ ID NO: 222992 - RNA, 73 nt, Homo Sapiens
gcagggauggccgccugcuggccuuugugggacccuccaggugcacagugacagucaugggcucggccucccu

SEQ ID NO: 222993 - RNA, 73 nt, Homo Sapiens
gccaccaggcuccgaggggccguggugacucuugaucaaagagcacagugaacugucccuucugagucucccu

SEQ ID NO: 222994 - RNA, 73 nt, Homo Sapiens
uugccuaauucauguuuucacuuaaaaguaucagaggugaaugcacagugaagggugauuuguggggagggag

SEQ ID NO: 222995 - RNA, 73 nt, Homo Sapiens
aaugaaagggcccagagaggguggugaccucugccugaagucacacagugagucgaggacagggaggugaccc

SEQ ID NO: 222996 - RNA, 73 nt, Homo Sapiens
aaaaguaccuuuagauaaaaacaaagaagaguaauauaugcagcacagugacguuaggauucugguaauuaac

SEQ ID NO: 222997 - RNA, 73 nt, Homo Sapiens
agagacacuuagguggaaggcacacagagaggccacgugaggacacagugagaagguggccgucugcaagccg

SEQ ID NO: 222998 - RNA, 73 nt, Homo Sapiens
auaaauugaggcacagaaagauuaaguuaccggcccaaggugacacagugaggagguggcagagcuaggauuu

SEQ ID NO: 222999 - RNA, 73 nt, Homo Sapiens
gggugggucuagacauacuauauucagagaacuauacuacccucacagugaggcccucagaccugccacaggg

SEQ ID NO: 223000 - RNA, 73 nt, Homo Sapiens
aagguuuuaacugcuuuguuauguaagcuuacccagcccggcgcacagugacucacgccuguaaucccagcac

SEQ ID NO: 223001 - RNA, 73 nt, Homo Sapiens
auuggaggaggccauuucacucccugaacccagccugacaaaucacagugagaauguucaccuuauaggcuug

SEQ ID NO: 223002 - RNA, 73 nt, Homo Sapiens
agcgccuggguccaggggaggccuuccagggacgaagaagagccacagugagggagaucccauccccuugucu

SEQ ID NO: 223003 - RNA, 73 nt, Homo Sapiens
gccaaggccuccccgaggcagaaguugccugguccucuguccccacagugaccugacugggggugagggagaa

SEQ ID NO: 223004 - RNA, 73 nt, Homo Sapiens
auagacugacugguccagaagacagaggguacaacaguggcaucacagugacagugucauggggagcugggcg

SEQ ID NO: 223005 - RNA, 73 nt, Homo Sapiens
gauggcuugaggccagagguuugagaccgaccagccagggcaacacagugagaccccuucucaaaaaaaaaaa

SEQ ID NO: 223006 - RNA, 73 nt, Homo Sapiens
gcaccuuguaugauggcaggacaggcuccagcagagagaacugcacagugaccacuguauuuuucacgcucuu

SEQ ID NO: 223007 - RNA, 73 nt, Homo Sapiens
ccaucacucuauaaaagugcuucaugagcccagaccaaaagcccacagugaaaugaaguacccuuuuguaaau

SEQ ID NO: 223008 - RNA, 73 nt, Homo Sapiens
ccucagacacugcccugccaccugucagacuugggugagcagacacagugaggcuguuagguccugcaguucc

SEQ ID NO: 223009 - RNA, 73 nt, Homo Sapiens
accugacucuuaaaaaaaaaccacggcacuacaaccuugguggcacagugagaugcaaugagccaugauuaca

SEQ ID NO: 223010 - RNA, 73 nt, Homo Sapiens
ucacagagaggcccuccugcgcuggcuggcuucuccgucuacccacagugaccgggugcuuuuccuccaguuu

SEQ ID NO: 223011 - RNA, 73 nt, Homo Sapiens
agccagcaagucucugguagaggagguucucaugcccaggguccacagugaccuacugugaacccaaucuuaa

SEQ ID NO: 223012 - RNA, 73 nt, Homo Sapiens
uuuguaacuucucuuucuaaaagucauugguguucauuuuccccacagugauucugcaagccucagagcagcc

SEQ ID NO: 223013 - RNA, 73 nt, Homo Sapiens
ggcagagcaagagggggaaaggagggcugggcagcaagccaggcacagugaguguaggaggagagaaggcugg

SEQ ID NO: 223014 - RNA, 73 nt, Homo Sapiens
cuuuggcaucugcucagguuauugccuuccugguacuccuguccacagugaagaugccgcccuuggcuacauc

SEQ ID NO: 223015 - RNA, 73 nt, Homo Sapiens
caauggcuguggcgauggcuacagcaauggucagcuuggaaaccacagugaagaagacagcacugaugaccaa

SEQ ID NO: 223016 - RNA, 73 nt, Homo Sapiens
cuacuggaaugguguuuugucagacuuccaaauccuggaaggacacagugaugaauguacuaugucugaacau

SEQ ID NO: 223017 - RNA, 73 nt, Homo Sapiens
ggaggauugcuugaguccaggaauuugagaccagccuggacaacacagugagaccucaucucuaucaaaaaau

SEQ ID NO: 223018 - RNA, 73 nt, Homo Sapiens
cuguuuacaaguagaauagccaauuauuuaaauguuuaguugccacagugaaccaggagucacugagccaaug

SEQ ID NO: 223019 - RNA, 73 nt, Homo Sapiens
aggguaugaagagcugucuuccccugagaguuuccucagaacccacagugagaggggagggcuccuggggcag

SEQ ID NO: 223020 - RNA, 73 nt, Homo Sapiens
cugugagggccgugugccccaugcuacccuccccgccucccuccacagugaucagcugugccucucugccugu

SEQ ID NO: 223021 - RNA, 73 nt, Homo Sapiens
ggaggaucgcucaagccccggaguuggagaccagccagagcaacacagugagacccccaucucuacaaaaaua

SEQ ID NO: 223022 - RNA, 69 nt, Homo Sapiens
gcccccuugauuuugauugaaaaugaacuauuugaaacacacagugaccaagggaagugaccaagguga

SEQ ID NO: 223023 - RNA, 73 nt, Homo Sapiens
guggcuuuguucacauagcugaugcgugcccugggaagguguccacagugagcccugugugcaggacugucca

SEQ ID NO: 223024 - RNA, 73 nt, Homo Sapiens
uugaacacuaaaauguuuuaaguuuucuuauugcuaacaaugucacagugaacauuuauauauucauuaaauc

SEQ ID NO: 223025 - RNA, 73 nt, Homo Sapiens
uuuugcuagagcugacagcuuuguucgcgugggcagagccuuccacagugaaugugucuggaccucauguugu

SEQ ID NO: 223026 - RNA, 73 nt, Homo Sapiens
uggcuggggucuaaccuugaacccucaccacgugcaggucacacacagugaagccacuuguaacugcacacuu

SEQ ID NO: 223027 - RNA, 73 nt, Homo Sapiens
gagugccuuaagaucaaacuaacaagaucugacccucuccccucacagugagccacugccccacuucagaggg

SEQ ID NO: 223028 - RNA, 73 nt, Homo Sapiens
uuucauucauguucuuucaguauuuuauauaauauuuuuuauucacagugaaaauuuguuauuagugauacuu

SEQ ID NO: 223029 - RNA, 73 nt, Homo Sapiens
gucuuaaagauacaaaauggauaauugaugcacaugauguucacacagugagauaaugcaguuaccuguaggc

SEQ ID NO: 223030 - RNA, 73 nt, Homo Sapiens
ccauuuaggaugcugucguuggccucagccaggggcaagugcccacagugacuaggcugaaggccacagggga

SEQ ID NO: 223031 - RNA, 73 nt, Homo Sapiens
gguggacaaaacucgacugcccucuaaccagcaacgugggcagcacagugaagaagaggaagccaguccuguu

SEQ ID NO: 223032 - RNA, 73 nt, Homo Sapiens
uaacuugccuaagaccacacuuugacagacgaaaaaauagaggcacagugaagaauaguuaauauuaucccca

SEQ ID NO: 223033 - RNA, 73 nt, Homo Sapiens
auguaacuugaccaaggucaccuacaggaggggaaacugagcccacagugagucucuagagaagcaccuuccu

SEQ ID NO: 223034 - RNA, 73 nt, Homo Sapiens
ccccgucucuacuaaaaauaucaagaccauccugacuaacaaacacagugaaaucgugugcgaggccaggaga

SEQ ID NO: 223035 - RNA, 73 nt, Homo Sapiens
ccuguggaaagaagagacagggggaugaggacaacugugaacucacagugagcauugacauuauugaaggaaa

SEQ ID NO: 223036 - RNA, 73 nt, Homo Sapiens
aggagcaggaaguugcuguucguggucuauggugagccaacgacacagugagagaaucagagggaaugcagga

SEQ ID NO: 223037 - RNA, 73 nt, Homo Sapiens
guacucacuuuucacuugucuucacuauuccuaugcugggguacacagugagaagccuccaguuguagcaggu

SEQ ID NO: 223038 - RNA, 73 nt, Homo Sapiens
ccaccuugagucaagccgacgaagauuuuuuuauacaaaaggccacagugaggucagggaacaaugagcacuu

SEQ ID NO: 223039 - RNA, 73 nt, Homo Sapiens
uauguuaaugcaaucuugaaaugacugaaagguagauugccagcacagugaguuucccagccugcucccccau

SEQ ID NO: 223040 - RNA, 73 nt, Homo Sapiens
uauaucaaaguuuuaguaguuuccuccacauucacgaaauuaccacagugagagcuaagcauuucuacugggc

SEQ ID NO: 223041 - RNA, 73 nt, Homo Sapiens
cuccucuagaagcagguuugaaauuauggguauguuuucuugucacagugacugaguacgguggugguagugg

SEQ ID NO: 223042 - RNA, 73 nt, Homo Sapiens
augauacagaacacuuucuucauauauacaguugucugucugccacagugaucaauucagugaauuuugaaaa

SEQ ID NO: 223043 - RNA, 73 nt, Homo Sapiens
cuugcuuaaaggcacuggccgugauucagauuugucagggaagcacagugaaggacaggauuucuaaaauucu

SEQ ID NO: 223044 - RNA, 73 nt, Homo Sapiens
uguuccaguuuccacugggcaaagaguggaccaaaacacugcacacagugaagggaagaaaaaagcagcuaaa

SEQ ID NO: 223045 - RNA, 73 nt, Homo Sapiens
aggugcuucaaagccaacaguuggauccaccucugagugagcgcacagugauccugugggugauuuaauuuau

SEQ ID NO: 223046 - RNA, 73 nt, Homo Sapiens
cggguggaucaugaggucaggagaucgagaccauccuggcuaacacagugaaacccugucucuacuaaaaaua

SEQ ID NO: 223047 - RNA, 73 nt, Homo Sapiens
gggucuggccccgggcugcugggcucacaaagucacacuagaccacagugacgaucucuguaagcacaaaggg

SEQ ID NO: 223048 - RNA, 73 nt, Homo Sapiens
gaccacaggaaggacgguguuugugucugagggagcugcuggccacagugaacacccacguuuauuccugccu

SEQ ID NO: 223049 - RNA, 73 nt, Homo Sapiens
aauaggcuuuuucugcuccccgauucugguguaguucuaaguacacagugauguccucuguaggggcgugccu

SEQ ID NO: 223050 - RNA, 73 nt, Homo Sapiens
cgggcggaucacuaggucaggaaauggagaccauccuggccaacacagugaaacccagucucuacuaaaaaau

SEQ ID NO: 223051 - RNA, 73 nt, Homo Sapiens
cccaguugcagggaggguagauggccccacccagaccgagagacacagugaugaccucagccuagggacacca

SEQ ID NO: 223052 - RNA, 73 nt, Homo Sapiens
ucaccacacugaccacccucaacccauugcgcccaguccccaccacagugaccacacccucacuggcucggcc

SEQ ID NO: 223053 - RNA, 73 nt, Homo Sapiens
agaacuggggguucagagggcaggugccucagaguugaggccacacagugaggucuggugggugaaaggaccc

SEQ ID NO: 223054 - RNA, 73 nt, Homo Sapiens
caauagcccauugacuuagaaacuguuacuuucccauuuuacacacagugaaacugaggcucagauauaaagg

SEQ ID NO: 223055 - RNA, 73 nt, Homo Sapiens
cuaacgucugcaggagcuuuauucccuauuaauagaaaaccgucacagugacccuagaucccuccgaguuaau

SEQ ID NO: 223056 - RNA, 73 nt, Homo Sapiens
ucaguaauaacuaguuggccaacugacugugguccauggacuacacagugaguagagguucuuuaaaagaagg

SEQ ID NO: 223057 - RNA, 73 nt, Homo Sapiens
ggaggaucgcuugaggccaggaguuugagacuagccuaggcaacacagugaggccuuaucucaacaacaacca

SEQ ID NO: 223058 - RNA, 73 nt, Homo Sapiens
augagccccaccacuacacuccagccuggaagacaccaugacacacagugaggccuggauggggaaagagucc

SEQ ID NO: 223059 - RNA, 73 nt, Homo Sapiens
aaaacuucauccucuuuugucccuuucgaguuaacauuacagccacagugaccuuucaaaaaugcaaauuaag

SEQ ID NO: 223060 - RNA, 73 nt, Homo Sapiens
uaaguuuuggugucuguaaauaaaguuuuguuggcuucagccacacagugauuuacaccuugauugugcugcu

SEQ ID NO: 223061 - RNA, 73 nt, Homo Sapiens
cuugcuggaguuccucaaugacuacccaccuuuacgaugcacccacagugaaguuccucacacccugcuacca

SEQ ID NO: 223062 - RNA, 73 nt, Homo Sapiens
gcccucuuuagcgacauauuuugugacauuccuuccauuacaccacagugaguucacagguaauauaaccuac

SEQ ID NO: 223063 - RNA, 73 nt, Homo Sapiens
ugccacauuugccccccauuggguguacagggggcccagacuccacagugacugcuuauuccucggaguagaa

SEQ ID NO: 223064 - RNA, 73 nt, Homo Sapiens
uaugauuacgccaaccuggggauugaaccagggagaucauggucacagugaacgccacugaagccagaggauc

SEQ ID NO: 223065 - RNA, 73 nt, Homo Sapiens
acacacaccaugacaacgacacggugaugaugucacacacagacacagugacagcggcgauggcaucacacag

SEQ ID NO: 223066 - RNA, 73 nt, Homo Sapiens
uaaagcaucccacccugcagcccuguccagguucccuccccgccacagugaaacccccaccccgccugccgcc

SEQ ID NO: 223067 - RNA, 73 nt, Homo Sapiens
ccucaucuccacuaaaaauagaguucaagaucagccugggcaacacagugagaggaagaucucuugagcucag

SEQ ID NO: 223068 - RNA, 73 nt, Homo Sapiens
agaucuuacaaguguaauaaccauugcacaucauuggagaauccacagugaagaguuuucaguaaugcuacaa

SEQ ID NO: 223069 - RNA, 73 nt, Homo Sapiens
cacaauugcuacaaaaagaugaguucgagacuagccuuagcaacacagugagaggaggaucgcuugagcucag

SEQ ID NO: 223070 - RNA, 73 nt, Homo Sapiens
gucagaaagcuucagcugaaacccuggagaaaguccuugaguacacagugaauaauguggaaaaucuguuagc

SEQ ID NO: 223071 - RNA, 73 nt, Homo Sapiens
ggcaaagauggggcggggccucccccugagagagcucacccuccacagugacccuuuuccuuccugccuaaua

SEQ ID NO: 223072 - RNA, 73 nt, Homo Sapiens
uguggacagcuuuggccagagcucccguguggcaucugggagccacagugacccagccaccuggcucaggcua

SEQ ID NO: 223073 - RNA, 73 nt, Homo Sapiens
augauaacaggguguccugaacuggcugccguugucguguucucacagugaagggcgugcccugugugccggg

SEQ ID NO: 223074 - RNA, 73 nt, Homo Sapiens
uucuuccuugugagcagaagguuggcugcuguuagcaggaucccacagugauaaccaggcccuucccuuccua

SEQ ID NO: 223075 - RNA, 73 nt, Homo Sapiens
uaaauauugucacaacacugaaccucuggcuagaggacauauucacagugaacauaacuguaacauauaugaa

SEQ ID NO: 223076 - RNA, 73 nt, Homo Sapiens
aagaagugauaaagucuccagaugcaguagcucacacuguaaucacagugacucaggaggcugaggugagagg

SEQ ID NO: 223077 - RNA, 73 nt, Homo Sapiens
gagugauaaacuaagucacauacagauaaagcacugaaaacaccacagugacccucccaccccccaccaauau

SEQ ID NO: 223078 - RNA, 73 nt, Homo Sapiens
accagccucacccaucaaaccagugaauuucucaaucuugccucacagugacugcagcgccaagcggcaucca

SEQ ID NO: 223079 - RNA, 73 nt, Homo Sapiens
cccauucucagggcccccacaucagugucucguuuacaucucacacagugacccugcgaggcaaggguuugcc

SEQ ID NO: 223080 - RNA, 73 nt, Homo Sapiens
cccaccccacuguccuccaaggcuacaggaccccugcuucugacacagugagcaacaagccuggguuucccug

SEQ ID NO: 223081 - RNA, 73 nt, Homo Sapiens
aacaggccaggagaagugcgugccgagcugaggcagauguucccacagugaccccagagcccugggcuauagu

SEQ ID NO: 223082 - RNA, 73 nt, Homo Sapiens
aguguuucuccugcagcacuccaaaacccacucugcacugcagcacagugaaugauaugcacucaccauuagc

SEQ ID NO: 223083 - RNA, 73 nt, Homo Sapiens
cugguggaucacaaggucaggagauugagaccauccuggcuaacacagugaaaccccgucucuacuaaaaaua

SEQ ID NO: 223084 - RNA, 73 nt, Homo Sapiens
gucgcugaggggguuggcugggucugagugccaccccccaggccacagugauaccaucccagugccaugagcc

SEQ ID NO: 223085 - RNA, 73 nt, Homo Sapiens
uuuaccucccucgcccugccccgcaccguggggaugcccaacucacagugacuucccguuuggggcccggugu

SEQ ID NO: 223086 - RNA, 73 nt, Homo Sapiens
cuuuggaaaagucaaaucauuccucuggcuuucauuuuucagccacagugauuaucaucucuuuggggaccac

SEQ ID NO: 223087 - RNA, 73 nt, Homo Sapiens
ccugccaagaugaccacugaaguggcccucagugucaucuguccacagugauaugacaacccaaggucagagg

SEQ ID NO: 223088 - RNA, 73 nt, Homo Sapiens
cgguagcuuccuuuuagucuaccgugacauuuucucaccugugcacagugagcucaacacauggugcuccuuu

SEQ ID NO: 223089 - RNA, 73 nt, Homo Sapiens
aaccucuuggaguauuuuuggaaaucuucuagcacuuuguaaacacagugaauaaagagaaaaguacaagaca

SEQ ID NO: 223090 - RNA, 72 nt, Homo Sapiens
cucuuuuuucaaaguaaauuaagaauguguaugacaaccacacacagugaagagagguccaugguuggguag

SEQ ID NO: 223091 - RNA, 73 nt, Homo Sapiens
ucucuagaaucugcuuuguuuugcguggaaggagcaaugcagacacagugaaagcggucagcuaagggagaac

SEQ ID NO: 223092 - RNA, 73 nt, Homo Sapiens
ggccccaaagcuaggcucugagaaggaaacacacucggcugggcacagugacguacuccaucucacaucugcc

SEQ ID NO: 223093 - RNA, 73 nt, Homo Sapiens
ccuuguacgaugcucuaaucauauugcauuuaauuuuauuuugcacagugaccuuguagccacaugagaaagc

SEQ ID NO: 223094 - RNA, 73 nt, Homo Sapiens
augcuugcaccugugaauagccacugcacuccaucuugggcaacacagugagacccccaucuauaaaaagaga

SEQ ID NO: 223095 - RNA, 73 nt, Homo Sapiens
auuuuuaaagcuuuugugauauuuuagcauuuugaaagacuuucacagugagaguagaagguagauuuggaau

SEQ ID NO: 223096 - RNA, 73 nt, Homo Sapiens
cucagacaccaagcugggccugcagaggaggggcacaguaggacacagugacugcccagguguccacacaccu

SEQ ID NO: 223097 - RNA, 73 nt, Homo Sapiens
ugaagccaccaugggugaccguccagccucacccgguggccugcacagugagggaagggcuucagggccaucu

SEQ ID NO: 223098 - RNA, 73 nt, Homo Sapiens
cgggcggaucacgaggucaggagaucgagaccauccuggcuaacacagugaaaccccgucucuacuaaaaaua

SEQ ID NO: 223099 - RNA, 52 nt, Homo Sapiens
accagucgcagggcuacugagccacagugaccgccugcccccgccccucccc

SEQ ID NO: 223100 - RNA, 73 nt, Homo Sapiens
accaccccauucuucucaagcaaggauugccagcgcgcgcugacacagugaugggcugcccagggcuggaggg

SEQ ID NO: 223101 - RNA, 73 nt, Homo Sapiens
gaacaggcccugagcucacaggcagccaauguaaagagggaaacacagugaguuaugcaguucccagugucca

SEQ ID NO: 223102 - RNA, 73 nt, Homo Sapiens
uugacccucuugguuuucuccucuggaaauauucucucucagccacagugacagcuggcugagcaaauucauc

SEQ ID NO: 223103 - RNA, 73 nt, Homo Sapiens
ucucaucagcucccuauuguucaucaacugucagguuguuuuucacagugacaguagaugcuagcaagcaaug

SEQ ID NO: 223104 - RNA, 73 nt, Homo Sapiens
cugcugcuaagggcuuccaauggauggagacaguggcagcucccacagugaugcuuggagcagauuuugucug

SEQ ID NO: 223105 - RNA, 73 nt, Homo Sapiens
augagaccucugacguccaaaccccaaguccuuuaugcuuugucacagugaagugagcccacacacacgcuca

SEQ ID NO: 223106 - RNA, 73 nt, Homo Sapiens
ugugaaagggcucgcuggucacagggugaccaugaggaccagucacagugauggcaaaaaugcugccccccuc

SEQ ID NO: 223107 - RNA, 73 nt, Homo Sapiens
uggggcgacugugaaacuggcucccagcugacggcaguaaauccacagugagugucccgagggcgccuggguc

SEQ ID NO: 223108 - RNA, 73 nt, Homo Sapiens
auuuuauucguguucuguuuccgaaacacuuagcaaagaaggucacagugauguggagucgccgcacccaucu

SEQ ID NO: 223109 - RNA, 73 nt, Homo Sapiens
cagacauagcaugacagaccuuccuagaguguuuggucggguucacagugaccgagagucagguccagcacac

SEQ ID NO: 223110 - RNA, 73 nt, Homo Sapiens
uugcgcuuacuuuguugaaaaagaaaaagaaauuaaauuugaacacagugaaagcugcaaguaugccaguggg

SEQ ID NO: 223111 - RNA, 73 nt, Homo Sapiens
cagacccugggaccuucuugccucaguguugugcuuguaaauacacagugaaauugucuuuauaucacuuuga

SEQ ID NO: 223112 - RNA, 73 nt, Homo Sapiens
cucuucagaauacacucuagacccaaaggugugcuaaucacuucacagugaccacuacagaguacuaagaaga

SEQ ID NO: 223113 - RNA, 73 nt, Homo Sapiens
agaauuuuccccucuguuuuccuaaauuguaugagagcuuucacacagugagaaauagagcaggcugccccau

SEQ ID NO: 223114 - RNA, 73 nt, Homo Sapiens
uuaucauggguggaauuuuuuuuuccauuucccucacucuagucacagugaaucuuuaacuguguccugaggg

SEQ ID NO: 223115 - RNA, 73 nt, Homo Sapiens
aaggaaaguuuuaaaaauguuuuuaaaacuucaaauaucucaccacagugaauuauggguaaggugauaauau

SEQ ID NO: 223116 - RNA, 73 nt, Homo Sapiens
auuuuuuuucaugaaaaugucaacaugguucuucugaaucuaucacagugaaaaguucuaacuuguuuuugag

SEQ ID NO: 223117 - RNA, 73 nt, Homo Sapiens
acacuguguuggcaccauauuuuacaaguuuuuuuccucuucucacagugaucuugugaguuaguuacuuaua

SEQ ID NO: 223118 - RNA, 73 nt, Homo Sapiens
ugguugcacucuguagacuggaucuguuuuaggaaguuacuuucacagugauguuguguguucuguuaguuuu

SEQ ID NO: 223119 - RNA, 73 nt, Homo Sapiens
uccgucuuuucucccauuuuacaguauuacucaaauaagggcacacagugaucauauuagcauuuagcaaaaa

SEQ ID NO: 223120 - RNA, 73 nt, Homo Sapiens
ucaucucuggugacugaguguaaaauaugugccaagucugcagcacagugaccaaaucugacaaucgagcucu

SEQ ID NO: 223121 - RNA, 73 nt, Homo Sapiens
gggcccgacuuuugccacccuccugaggaagccccuagguccacacagugaugccaugggggacccuugccuu

SEQ ID NO: 223122 - RNA, 73 nt, Homo Sapiens
guaacccucgcccugucccucccacucccugggggcgcuguuccacagugacugggcccuguccagggcagug

SEQ ID NO: 223123 - RNA, 73 nt, Homo Sapiens
uguguugcuucugucacuuuggacgcugggagcaguugcaggccacagugaagcaaaucauguuuauaaaaua

SEQ ID NO: 223124 - RNA, 73 nt, Homo Sapiens
ccagaccaaccuuccauucaaaaaaauccauuuuacacagcaccacagugaauuuuuuucccagguguuaaaa

SEQ ID NO: 223125 - RNA, 73 nt, Homo Sapiens
aggggaguagcuauugggaauuuuaaaugugucuugaagaaugcacagugacacagccagagcuauaauuguu

SEQ ID NO: 223126 - RNA, 73 nt, Homo Sapiens
ugguaucugaugaagaccuguuguugaaaacuagcacucuacccacagugacggagcccuaagaacaccacau

SEQ ID NO: 223127 - RNA, 73 nt, Homo Sapiens
guaugccaaaugcaaguccaguaaaacugcgcuuugccaguagcacagugaauauuuuauaaaugauauucuc

SEQ ID NO: 223128 - RNA, 73 nt, Homo Sapiens
ucagugagccagaccaacucugcaaauucuaguagaagauuuccacagugaaauuuccccaauaucuagucuu

SEQ ID NO: 223129 - RNA, 73 nt, Homo Sapiens
uccuggucaaucucuccacuacauuuccgaagaguuuauaaagcacagugaauagaauuggaaaauacugcag

SEQ ID NO: 223130 - RNA, 73 nt, Homo Sapiens
uuuuggcuuacuauauacauaauaaccaugcuaaguguauuuccacagugagcauuacucuuugugauuuucu

SEQ ID NO: 223131 - RNA, 73 nt, Homo Sapiens
augccagucagagccaggccagagaaaaguaaggcauauggcucacagugaugagggaacauccugaaguguc

SEQ ID NO: 223132 - RNA, 73 nt, Homo Sapiens
ggaagggaacacauuguauaucaguguucucaguaguagaaggcacagugaauucuguguuugaugagagaag

SEQ ID NO: 223133 - RNA, 73 nt, Homo Sapiens
uuguguucagccgugagucagcccagggcuguagcacaggcuucacagugauucucuugcguguccaaaagua

SEQ ID NO: 223134 - RNA, 73 nt, Homo Sapiens
gccucugaaaagagcccugacuucaggcacgugacagugacaacacagugacuaguaaacagucugcuugcuu

SEQ ID NO: 223135 - RNA, 73 nt, Homo Sapiens
aggcugagaugagaggaucacuugagccugaggagguccaggccacagugaucugagaucacaccauugcccu

SEQ ID NO: 223136 - RNA, 73 nt, Homo Sapiens
acucaucucuguaaaaaauauguucaagggccaaccuaggcaacacagugagagaggacugauugaguccggg

SEQ ID NO: 223137 - RNA, 64 nt, Homo Sapiens
aacuccucacuguuuaaauagggaaccucuuggagccugucaggacucuaccucugaaugugcu

SEQ ID NO: 223138 - RNA, 64 nt, Homo Sapiens
ucagggcaucacugaacaaagauaaucagaaccugccugucacccuucgaagggcaggacuggg

SEQ ID NO: 223139 - RNA, 64 nt, Homo Sapiens
ccuguuggggaucaggcagccauugcucccuggagccugucauggauccuuugggcagaugucc

SEQ ID NO: 223140 - RNA, 64 nt, Homo Sapiens
ccaggguggcgcagcuuucuggugaccaaguagggccugucacaucuucuccagcuuacccuag

SEQ ID NO: 223141 - RNA, 64 nt, Homo Sapiens
guacauauuuagcaaauuuugguuucuuacaugugccugucaugacuguaauucauuaugacug

SEQ ID NO: 223142 - RNA, 64 nt, Homo Sapiens
cuccaggaagggcuaauggggccaauauauuauugccugucauguggcacauccauguuaaggg

SEQ ID NO: 223143 - RNA, 64 nt, Homo Sapiens
ugaagucaggagccauacgucaagagcacagcgggccugucagaugccugucauacuugcuaaa

SEQ ID NO: 223144 - RNA, 64 nt, Homo Sapiens
cuugcuaaacaagagcacagggguuuuuuuuccugccugucauaaguggagcaguugacaucca

SEQ ID NO: 223145 - RNA, 64 nt, Homo Sapiens
ugaggcccuucagaaauuugugcugauuuggucccugugccagggcacagggggucaggcacug

SEQ ID NO: 223146 - RNA, 64 nt, Homo Sapiens
ggcaggcgugcugacagccggcaguuugcgugggcugugccaucugaugucuauucccagcccu

SEQ ID NO: 223147 - RNA, 64 nt, Homo Sapiens
auucucucccauccuggggcagcacuccccagagcugugccagcaggggggcugugccaaccug

SEQ ID NO: 223148 - RNA, 64 nt, Homo Sapiens
ggcagcacuccccagagcugugccagcaggggggcugugccaaccuguucuuagaguguagcug

SEQ ID NO: 223149 - RNA, 64 nt, Homo Sapiens
ccacacucugguccaugaggcagcaaggccagugcugugccaagcccgguaaggccaagugccg

SEQ ID NO: 223150 - RNA, 64 nt, Homo Sapiens
uugccugcaaauaguauaaacaacacuaaauuuacugugccaggaaaucuuccugaacuccuug

SEQ ID NO: 223151 - RNA, 64 nt, Homo Sapiens
gcuauucaaucuuagggugucuauccacgucuggcugugccaaauggucuggcagcugguuuug

SEQ ID NO: 223152 - RNA, 64 nt, Homo Sapiens
uccugccacuguuggccaugucguaaggcagcagcugugccaggauagcuggguccauucagag

SEQ ID NO: 223153 - RNA, 64 nt, Homo Sapiens
gagaggugaaaaauaccacauaaugaucaguaugcugugccagcuucauuuggggagaaauaac

SEQ ID NO: 223154 - RNA, 64 nt, Homo Sapiens
cauucauucaacacauauucauagagcuccuucucugugccagacacuguucuggaagauagcu

SEQ ID NO: 223155 - RNA, 64 nt, Homo Sapiens
gcucugggaagggguucccagaaucccuccugagcugugccauuuacucaggggacucccaaac

SEQ ID NO: 223156 - RNA, 64 nt, Homo Sapiens
ccaugcuuugggucaccucgggcugcaacccugucugugccagauugcccggucugacccugca

SEQ ID NO: 223157 - RNA, 64 nt, Homo Sapiens
cgagcaugccauggguccgcucugcaugcccugucugugccaugagugucccuggccccuuccu

SEQ ID NO: 223158 - RNA, 64 nt, Homo Sapiens
gagggauggcguuggcagugccagccuccccagccugugccaagcuucaacaggggcaagagga

SEQ ID NO: 223159 - RNA, 64 nt, Homo Sapiens
uggggagugggugggaggcaccaaaacuuggcagcugugccagaaaccaaagccaggcccagau

SEQ ID NO: 223160 - RNA, 64 nt, Homo Sapiens
cugaauguucguucaccauccgugggcaccaggucugugccaagcacagggacuccaggggcag

SEQ ID NO: 223161 - RNA, 64 nt, Homo Sapiens
gagcauguuagguggagcaguuugcugccugagccugugccacucccagguggguuggaacacg

SEQ ID NO: 223162 - RNA, 64 nt, Homo Sapiens
ccaacugugccugauagaccuccagccccucgcccugugccaccugcgucugugccagcucaaa

SEQ ID NO: 223163 - RNA, 64 nt, Homo Sapiens
ucaaauccagccccucgcccuuucccucuugcgucugugccagcacauguaacucaggaccccu

SEQ ID NO: 223164 - RNA, 64 nt, Homo Sapiens
cacugacuagagugaugacugcuuguagguaugucugugccauuucucagggaaguaagaugua

SEQ ID NO: 223165 - RNA, 64 nt, Homo Sapiens
ucuguccaaguacuuaacuaucuguucccuuccucugugccacgcuccucuguuuguuuggcug

SEQ ID NO: 223166 - RNA, 64 nt, Homo Sapiens
ccagcuagacuauuggguaugaacuaaaaagagacugugccauggugagaaaaauguaaaaucc

SEQ ID NO: 223167 - RNA, 64 nt, Homo Sapiens
ggugaaugaagggcaugcaggcccucagcccgggcugugccagcccucccagccccaggcccau

SEQ ID NO: 223168 - RNA, 64 nt, Homo Sapiens
gcaaucugcaccuuggggccugggcucccccucucugugccagcggcuucccagcaccugggag

SEQ ID NO: 223169 - RNA, 64 nt, Homo Sapiens
ggaagaggccugguaccgccucacccacagaggucugugccaggugcgcuucugcagguggagc

SEQ ID NO: 223170 - RNA, 64 nt, Homo Sapiens
gauggagaggaccaccgccgcaggguucuuuuaccugugccaccagcucuggagacauccacac

SEQ ID NO: 223171 - RNA, 64 nt, Homo Sapiens
ugccucagcgcugcccacaccaccgcccuccucgcugugccaccaccccucccucugcucucau

SEQ ID NO: 223172 - RNA, 64 nt, Homo Sapiens
ccaauggagacuuucugaugcaucguuuucuuugcugugccaaagcaggucagaagagggagag

SEQ ID NO: 223173 - RNA, 64 nt, Homo Sapiens
ggcugagugccacgacaggcugagccacauaugucugugccaugccauccacugguucuugccc

SEQ ID NO: 223174 - RNA, 64 nt, Homo Sapiens
cuucccaugcccucccccaacaaacccaggacaucugugccaggcccugcagcagagcagggcg

SEQ ID NO: 223175 - RNA, 64 nt, Homo Sapiens
ccagaguuuccugaggggcccaucccugcugcugcugugccagaauuccacaaagggagagugg

SEQ ID NO: 223176 - RNA, 64 nt, Homo Sapiens
cuccuuguccccagccucuggcugugauggcauucugugccaucagcccugccagacuccccug

SEQ ID NO: 223177 - RNA, 64 nt, Homo Sapiens
aggcaccugaguucucugcuaucuguccuccugucugugccagguguggaugcucaccugugcc

SEQ ID NO: 223178 - RNA, 64 nt, Homo Sapiens
uguccuccugucugugccagguguggaugcucaccugugccaucacccccuguggcaauggagu

SEQ ID NO: 223179 - RNA, 64 nt, Homo Sapiens
uuuuccuagaccaggaauggggaauauauaacaccugugccaccgcucuuuuaaggaggcauua

SEQ ID NO: 223180 - RNA, 64 nt, Homo Sapiens
gaggcauuaugaaugagugcagcauuccuguccucugugccaggauuuggucuuagaauccaug

SEQ ID NO: 223181 - RNA, 64 nt, Homo Sapiens
uuuuauggcuccccucacugauggacaaggaggucugugccaaagaagaauccaauaagcacau

SEQ ID NO: 223182 - RNA, 64 nt, Homo Sapiens
aaccauuuaguauuaguauuagaaugaagucaaacugugccacacauggugaaugaaaaaaaaa

SEQ ID NO: 223183 - RNA, 64 nt, Homo Sapiens
gguuugggaagcaggacuccgucccuguccccgacugugccacgugguaggacacauaggacac

SEQ ID NO: 223184 - RNA, 64 nt, Homo Sapiens
uaggacacaggaauuccuggguccuugcccaugacugugccaugugguaggacacaggacacag

SEQ ID NO: 223185 - RNA, 64 nt, Homo Sapiens
gaaccugggaggcagagguugcagugagcugagacugugccauugcacuccagucggguuaaca

SEQ ID NO: 223186 - RNA, 64 nt, Homo Sapiens
gaauauggagaugaagauuguuuucuccaauuuucugugccauuuuaaauuuaacuuugacauc

SEQ ID NO: 223187 - RNA, 64 nt, Homo Sapiens
gucccacccuccaccuggggugucucgccaccuccugugccaauagggaugggcaccucaugcc

SEQ ID NO: 223188 - RNA, 64 nt, Homo Sapiens
uggguguggagcccauggaaugagccccccaucccugugccaccagagggggccccucugcauc

SEQ ID NO: 223189 - RNA, 64 nt, Homo Sapiens
ugcugugcucugggcagggguauugucugcuccucugugccagguguuucucacagccgguauu

SEQ ID NO: 223190 - RNA, 64 nt, Homo Sapiens
caugaggcagcucugaucacgcccugugcuggcacugugccagucagagacccugugggcccug

SEQ ID NO: 223191 - RNA, 64 nt, Homo Sapiens
cccggccccacuggugugucaggagggggcacagcugugccaagcccgcugccagggcagaggg

SEQ ID NO: 223192 - RNA, 64 nt, Homo Sapiens
aauggguuuucgggacuugccugcaggguccccucugugccagaauguuagccauggguccuuu

SEQ ID NO: 223193 - RNA, 64 nt, Homo Sapiens
gguucgacuccccgaggugcaaugccugagauggcugugccagaccagagaugaaacucccuaa

SEQ ID NO: 223194 - RNA, 64 nt, Homo Sapiens
ggugcggcuuccagaggugcggugucagagguggcugugccagaucagagaugaaacucccaga

SEQ ID NO: 223195 - RNA, 64 nt, Homo Sapiens
gccuucccugacacccugggccagaugcaagacacugugccacccacuccuggacaaccuggac

SEQ ID NO: 223196 - RNA, 57 nt, Homo Sapiens
ggcuggaccacacaggagaacgagcagcugugccagauacggccuuuggacaucuaa

SEQ ID NO: 223197 - RNA, 64 nt, Homo Sapiens
agacagacagagaaggcugcgccuccccaugugccugugccaaguggcccccacccugcgggag

SEQ ID NO: 223198 - RNA, 54 nt, Homo Sapiens
ccagucacaccgaccaccacgggucugugccaggccaggugucaagaagccuag

SEQ ID NO: 223199 - RNA, 64 nt, Homo Sapiens
ucuacaaaaugaauauuaucaagccaaaguguacgguagaaauuuaauuuugaagcauuugaaa

SEQ ID NO: 223200 - RNA, 64 nt, Homo Sapiens
aaggaagcagacacaacauguuggugggaaaauagguagaaaccuaccuaaaaauuguuagaaa

SEQ ID NO: 223201 - RNA, 64 nt, Homo Sapiens
guugcagacugcugacuucuuauuguguccucgugguagaaagaggguuagagccucuggcaug

SEQ ID NO: 223202 - RNA, 64 nt, Homo Sapiens
guuaacauucauaaauggugggggcccuuacugugguagaaaccauugucacugcaaggcagcc

SEQ ID NO: 223203 - RNA, 64 nt, Homo Sapiens
uuucccaauucuacacauggcaucagcccuagaggguagaaagucuaaacucaucugauccuuu

SEQ ID NO: 223204 - RNA, 64 nt, Homo Sapiens
aguaggcccucacaggaggcaaugaagugacagagguagaaaaccagagugcccagcugucugg

SEQ ID NO: 223205 - RNA, 64 nt, Homo Sapiens
caaauuuauagcaaggcacugaauuuuaucuuuugguagaaauguguuuauuuaacacacacac

SEQ ID NO: 223206 - RNA, 64 nt, Homo Sapiens
cccuugaagaaagcaguuauauucccauuuuauagguagaaauauuauaauagagagauuaagu

SEQ ID NO: 223207 - RNA, 64 nt, Homo Sapiens
guugaggggugcaguuucugguguaggccagguagguagaaagugaggaacaggguugccucuu

SEQ ID NO: 223208 - RNA, 64 nt, Homo Sapiens
uguugcccuggggcuuaucugauuaugggacgaggguagaaaguaagaagcacuuuugaauuug

SEQ ID NO: 223209 - RNA, 64 nt, Homo Sapiens
agcagauuggaugggcagguggagaaugccuggggguagaaauguuagaucuugcaacaucaga

SEQ ID NO: 223210 - RNA, 64 nt, Homo Sapiens
auaauuaagucuaugcaaauaucagagaauuuaugguagaaauauauaagguacugacacuuca

SEQ ID NO: 223211 - RNA, 64 nt, Homo Sapiens
gagugcuaaguauagaaaaucugaaacuaaaguugguagaaaaguuauuuguauagaacuuuaa

SEQ ID NO: 223212 - RNA, 63 nt, Homo Sapiens
ucugcaaacauuaaaggaaucuagguccuauuacuaaucuaugugucugcaaacauuacuaau

SEQ ID NO: 223213 - RNA, 63 nt, Homo Sapiens
uccuauuacuaaucuaugucucugcaaacauuacuaaucuagggaccauuacuaaggucuaug

SEQ ID NO: 223214 - RNA, 63 nt, Homo Sapiens
gucgggagacagcaucagggccaucuugcuucccuaaucuauguaaguugauucgguaucccc

SEQ ID NO: 223215 - RNA, 63 nt, Homo Sapiens
uaucgacuuguuuuugcacauucguggggaggucuaaucuagagggacaggaguccacuuugu

SEQ ID NO: 223216 - RNA, 63 nt, Homo Sapiens
ugccacagaagagcaaaauugugagaaaucuugcuaaucuauacauauauuugugguuuaagu

SEQ ID NO: 223217 - RNA, 63 nt, Homo Sapiens
aaacuggugauauuuaauauaaaagacuugcagcuaaucuaaaaucaugaauucccuuguuuc

SEQ ID NO: 223218 - RNA, 63 nt, Homo Sapiens
auuccuaaccuauuauaacuauguaguacauuucuaaucuauuuuauaggccacuguuuugua

SEQ ID NO: 223219 - RNA, 63 nt, Homo Sapiens
aguccucuuauuaugcuuuuuaaaagcaugcaucuaaucuaaucaugacuguucuuuauacac

SEQ ID NO: 223220 - RNA, 64 nt, Homo Sapiens
gaagacacugucucaaauguugagccuuuccuuucauauccacaaugaaacuagucuuaacugu

SEQ ID NO: 223221 - RNA, 64 nt, Homo Sapiens
agaagauucuacacuagcgucugcaggcuucugccauauccaugcuuggacugcauuuuaagcc

SEQ ID NO: 223222 - RNA, 64 nt, Homo Sapiens
cuugagaaguaugucaaaagucugcauuccaccacauauccaccaaccacacauauugauggag

SEQ ID NO: 223223 - RNA, 64 nt, Homo Sapiens
aaugccuuccaucugaauguucuuuuuuuuaauacauauccaauauuuuauuuuuuucaggggg

SEQ ID NO: 223224 - RNA, 64 nt, Homo Sapiens
aaggguuuagagacuccccuuggcucccagucaccauauccaguguuguguaaagagacuggcc

SEQ ID NO: 223225 - RNA, 64 nt, Homo Sapiens
acaauccugggcauugacucugugacauuucuagcauauccaaggcaccaccagugauuucucc

SEQ ID NO: 223226 - RNA, 64 nt, Homo Sapiens
uuccacacaggauuccguuggugaaccuguaaaaacaaaacaaacaaaacaaaacaaaaaagac

SEQ ID NO: 223227 - RNA, 64 nt, Homo Sapiens
ggauuccguuggugaaccuguaaaaacaaaacaaacaaaacaaaacaaaaaagacaaaaccuaa

SEQ ID NO: 223228 - RNA, 64 nt, Homo Sapiens
ccguuggugaaccuguaaaaacaaaacaaacaaaacaaaacaaaaaagacaaaaccuaaaacug

SEQ ID NO: 223229 - RNA, 64 nt, Homo Sapiens
uccagccugguuacagagcaagacucugucucaaacaaaacaaaacaaaacaaaaacacacuac

SEQ ID NO: 223230 - RNA, 64 nt, Homo Sapiens
ccugguuacagagcaagacucugucucaaacaaaacaaaacaaaacaaaaacacacuacuguau

SEQ ID NO: 223231 - RNA, 64 nt, Homo Sapiens
uuacagagcaagacucugucucaaacaaaacaaaacaaaacaaaaacacacuacuguauuuugg

SEQ ID NO: 223232 - RNA, 64 nt, Homo Sapiens
cucauuacuguagugcugagguuauugaaguuauacaaaacacaucucagucucuguuucuugg

SEQ ID NO: 223233 - RNA, 64 nt, Homo Sapiens
gaguugaauauugaacucuaacaguuuucuacauacaaaacacagugucaugaagguuauucau

SEQ ID NO: 223234 - RNA, 64 nt, Homo Sapiens
ucuuuaaacagaacaagaauuuuuuaaaauacagacaaaacacuggccauuauuuucuaaucca

SEQ ID NO: 223235 - RNA, 64 nt, Homo Sapiens
guauagaugccaagaugucuuuaaaguuuauuagacaaaacagaguauaaggagagaaauaacu

SEQ ID NO: 223236 - RNA, 64 nt, Homo Sapiens
auuagagauugggucuuuccaaaaacaaaacaaaacaaaacaaacagagcgacacucggucuca

SEQ ID NO: 223237 - RNA, 64 nt, Homo Sapiens
acaaaauuagagauugggucucucaaaaaacaaaacaaaacaaaggugacagagcgacacucgg

SEQ ID NO: 223238 - RNA, 64 nt, Homo Sapiens
acaaaacaaaauuagagauucucggucucaaaaaacaaaacaaagccugggugacagagcgaca

SEQ ID NO: 223239 - RNA, 64 nt, Homo Sapiens
auuaaacucaucaguugcaaauuuuauauagaggacaaaacagcagucucagaaaaggcuaaca

SEQ ID NO: 223240 - RNA, 64 nt, Homo Sapiens
auuuugagaacaaagaugacaaagguaaaacaaaacaaaacaacguacaaaggggaaagaacau

SEQ ID NO: 223241 - RNA, 64 nt, Homo Sapiens
acaacauuuugagaacaaagaacauaaagguaaaacaaaacaaacaucuguacaaaggggaaag

SEQ ID NO: 223242 - RNA, 64 nt, Homo Sapiens
aaaacacuaggaguccacuccauaaaaaaacaaaacaaaacaaauccacaucgugcagucgugu

SEQ ID NO: 223243 - RNA, 64 nt, Homo Sapiens
acaaaaaaacacuaggaguccgugucauaaaaaaacaaaacaaaccagauccacaucgugcagu

SEQ ID NO: 223244 - RNA, 64 nt, Homo Sapiens
cuuccaaacaguguguugguggaauuaaaacaaaacaaaacaaacuauguugguuucaguggcu

SEQ ID NO: 223245 - RNA, 64 nt, Homo Sapiens
acaaacuuccaaacaguguguggcuggaauuaaaacaaaacaaaaacuucuauguugguuucag

SEQ ID NO: 223246 - RNA, 64 nt, Homo Sapiens
uaaccaguagcugaucuuaaggcuuuuuuaaaaaacaaaacaaaacaacaaaaaaaaaucuuua

SEQ ID NO: 223247 - RNA, 64 nt, Homo Sapiens
aguagcugaucuuaaggcuuuuuuaaaaaacaaaacaaaacaacaaaaaaaaaucuuuauaaga

SEQ ID NO: 223248 - RNA, 64 nt, Homo Sapiens
caguuuggacuacagagugagacuccaucucaaaacaaaacaaaacaacaacagcaaaaaacaa

SEQ ID NO: 223249 - RNA, 64 nt, Homo Sapiens
uggacuacagagugagacuccaucucaaaacaaaacaaaacaacaacagcaaaaaacaacaaaa

SEQ ID NO: 223250 - RNA, 64 nt, Homo Sapiens
ucaaaacaaaacaaaacaacaacagcaaaaaacaacaaaacaaaacacaaauacucucacaggg

SEQ ID NO: 223251 - RNA, 64 nt, Homo Sapiens
acaaaacaaaacaacaacagcaaaaaacaacaaaacaaaacacaaauacucucacagggcaugg

SEQ ID NO: 223252 - RNA, 64 nt, Homo Sapiens
aauuuagagcuuucaaacuggaaaaaaaaaugaaacaaaacaaauacaccaagaccaaaauagg

SEQ ID NO: 223253 - RNA, 64 nt, Homo Sapiens
ccagggagcuguagugauuggaacccacguuugcacaaaacauuuuugcagaaggaaagucaac

SEQ ID NO: 223254 - RNA, 64 nt, Homo Sapiens
gaugacuuaguacaaaguuucaauuuguuuccccacaaaacaaagcaauucuuucaagucaguu

SEQ ID NO: 223255 - RNA, 64 nt, Homo Sapiens
uaaggucugaauaauagcagaaaaaccaacaucuacaaaacauuaaacuaguguuauacuugau

SEQ ID NO: 223256 - RNA, 64 nt, Homo Sapiens
aaccaaaagauuuucuguccuuguaucugugguaacaaaacauuaaauuauucagauuuuauuu

SEQ ID NO: 223257 - RNA, 64 nt, Homo Sapiens
aucgcuuuaacuuuucuaaaaacaaacuuguaccacaaaacaauguauaggaggugagcuaguu

SEQ ID NO: 223258 - RNA, 64 nt, Homo Sapiens
guuuucuccuucccaaggcagcuggauugaaaaaacaaaacaaaacaaaaaaacccaggggcgu

SEQ ID NO: 223259 - RNA, 64 nt, Homo Sapiens
cuccuucccaaggcagcuggauugaaaaaacaaaacaaaacaaaaaaacccaggggcgucaguc

SEQ ID NO: 223260 - RNA, 64 nt, Homo Sapiens
aacuuugaagauuguuuguaucuuuuuuuaaaaaacaaaacaaaacaaaaauccccaaaauaua

SEQ ID NO: 223261 - RNA, 64 nt, Homo Sapiens
ugaagauuguuuguaucuuuuuuuaaaaaacaaaacaaaacaaaaauccccaaaauauauagaa

SEQ ID NO: 223262 - RNA, 64 nt, Homo Sapiens
ugccacacaucacccuuaccacuauucugauuacacaaaacaaaaagaaguuggaugggugggu

SEQ ID NO: 223263 - RNA, 64 nt, Homo Sapiens
ccuagaguguuguugagaauuggacccaaugcacacaaaacaacuucuuacaggcacaaaauga

SEQ ID NO: 223264 - RNA, 64 nt, Homo Sapiens
uaccaagaaagcacuuuguaggccauucuuguuuacaaaacacuuacacaaagaccaucgagac

SEQ ID NO: 223265 - RNA, 64 nt, Homo Sapiens
uuggcauauuuaagaguggcugcucucugcagcuacaaaacaucguuuaagcucaaguuugcug

SEQ ID NO: 223266 - RNA, 64 nt, Homo Sapiens
auucaagccacuagaauuauuucaauuuguuuuuacaaaacauucaauuuugccaauaccaagu

SEQ ID NO: 223267 - RNA, 64 nt, Homo Sapiens
ccucccuuccccagcagggcgaaaacaaaacaaaacaaaacaaaugcaagauaaaaggucuugg

SEQ ID NO: 223268 - RNA, 64 nt, Homo Sapiens
acaaaccucccuuccccagccuugggaaaacaaaacaaaacaaaucuggugcaagauaaaaggu

SEQ ID NO: 223269 - RNA, 64 nt, Homo Sapiens
acaaaacaaaccucccuuccaaggucuugggaaaacaaaacaaaaauucucuggugcaagauaa

SEQ ID NO: 223270 - RNA, 64 nt, Homo Sapiens
caauaaagucaccagcaguauaacggggcacuaaacaaaacaacaaccgaacucaaggcuuaau

SEQ ID NO: 223271 - RNA, 64 nt, Homo Sapiens
gccacucuugaaaucacaagacuccagaccauguacaaaacacaagccacuucauauaaagguu

SEQ ID NO: 223272 - RNA, 64 nt, Homo Sapiens
gcuuaucuaaucuaaugagacuaagacaaacaaaacaaaacacauucuagaaguuaaacaagag

SEQ ID NO: 223273 - RNA, 64 nt, Homo Sapiens
acacagcuuaucuaaucuaaaagagcuaagacaaacaaaacaaauaguuuucuagaaguuaaac

SEQ ID NO: 223274 - RNA, 64 nt, Homo Sapiens
aacaaaaaacaaacaaacaauucuuaugaacaaaacaaaacaacuaaguaguaucuuucucucu

SEQ ID NO: 223275 - RNA, 64 nt, Homo Sapiens
acaacaacaaaaaacaaacaucucuuucuuaugaacaaaacaaaacggauaaguaguaucuuuc

SEQ ID NO: 223276 - RNA, 64 nt, Homo Sapiens
cuggauauuauucuuguaguuuaccucuuuaaaaacaaaacaaaacaaaacaaaaaacuccccu

SEQ ID NO: 223277 - RNA, 64 nt, Homo Sapiens
uauuauucuuguaguuuaccucuuuaaaaacaaaacaaaacaaaacaaaaaacuccccuuccuc

SEQ ID NO: 223278 - RNA, 64 nt, Homo Sapiens
uucuuguaguuuaccucuuuaaaaacaaaacaaaacaaaacaaaaaacuccccuuccucacugc

SEQ ID NO: 223279 - RNA, 64 nt, Homo Sapiens
ugucuguuggauaauggcuguaaaauguuuaaaaacaaaacaaaacaaaaaagaggcacuaguc

SEQ ID NO: 223280 - RNA, 64 nt, Homo Sapiens
guuggauaauggcuguaaaauguuuaaaaacaaaacaaaacaaaaaagaggcacuagucuaucu

SEQ ID NO: 223281 - RNA, 64 nt, Homo Sapiens
acagagucagacuccgucccaaaaaaacaaacaaacaaaacaaaacaaaaaaaaacagaaguua

SEQ ID NO: 223282 - RNA, 64 nt, Homo Sapiens
gucagacuccgucccaaaaaaacaaacaaacaaaacaaaacaaaaaaaaacagaaguuacaaau

SEQ ID NO: 223283 - RNA, 64 nt, Homo Sapiens
ccagccuggaugacagagugagaccuugucucaaacaaaacaaaacaaaaaugaaauguucuag

SEQ ID NO: 223284 - RNA, 64 nt, Homo Sapiens
cuggaugacagagugagaccuugucucaaacaaaacaaaacaaaaaugaaauguucuaguuuug

SEQ ID NO: 223285 - RNA, 64 nt, Homo Sapiens
agaagccuaagaaguuauauauuuaaucagguagacaaaacaguucaaagcauaagguccaugg

SEQ ID NO: 223286 - RNA, 64 nt, Homo Sapiens
aacaauacaacaagaacaacuguacaaaaacaaaacaaaacaacuucuccuacuuuacacucuc

SEQ ID NO: 223287 - RNA, 64 nt, Homo Sapiens
acaacaacaauacaacaagacucucuguacaaaaacaaaacaaaggaauuucuccuacuuuaca

SEQ ID NO: 223288 - RNA, 64 nt, Homo Sapiens
auuuugugcaauuaacaaaguuuaaauggcaaaaacaaaacauaaauaggauucugugauaaua

SEQ ID NO: 223289 - RNA, 64 nt, Homo Sapiens
aaaaaacaaggagaaguuguauguuaaaaacaaaacaaaacaaagggaccagagagagcuugga

SEQ ID NO: 223290 - RNA, 64 nt, Homo Sapiens
acaaaaaaaaacaaggagaauuggaauguuaaaaacaaaacaaagauaggggaccagagagagc

SEQ ID NO: 223291 - RNA, 64 nt, Homo Sapiens
acaauguuacaagaguaagaucuuauaagacaaaacaaaacaggugaggauaggaguuauauau

SEQ ID NO: 223292 - RNA, 64 nt, Homo Sapiens
acaggacaauguuacaagaguauauucuuauaagacaaaacaaacucugugaggauaggaguua

SEQ ID NO: 223293 - RNA, 64 nt, Homo Sapiens
gacgauguauguauuauaauggagggucgcuaucacaaaacauuauuuacaaauuaaaucuucu

SEQ ID NO: 223294 - RNA, 64 nt, Homo Sapiens
uagccaugaugggagacaggccaaaacaaggaccacaaaacaacgcaacaacacgaagaugaua

SEQ ID NO: 223295 - RNA, 64 nt, Homo Sapiens
acuguuguuucucuuucuuggcuagcagaaaaaaacaaaacaaagaauagaaacacauuuucug

SEQ ID NO: 223296 - RNA, 64 nt, Homo Sapiens
agcaaacacaaaacccaagggcagcuaaaacaaaacaaaacaugcacaaggaaucacacguggu

SEQ ID NO: 223297 - RNA, 64 nt, Homo Sapiens
acaugagcaaacacaaaaccguggugcagcuaaaacaaaacaaaaauggcacaaggaaucacac

SEQ ID NO: 223298 - RNA, 64 nt, Homo Sapiens
gccugggcgacagagcgagacucugccucaaaaaacaaaacaaaacaaaacacucacccaucaa

SEQ ID NO: 223299 - RNA, 64 nt, Homo Sapiens
ggcgacagagcgagacucugccucaaaaaacaaaacaaaacaaaacacucacccaucaacgaau

SEQ ID NO: 223300 - RNA, 64 nt, Homo Sapiens
cagagcgagacucugccucaaaaaacaaaacaaaacaaaacacucacccaucaacgaauauaga

SEQ ID NO: 223301 - RNA, 64 nt, Homo Sapiens
caaacaaauacaaucuaacuaaaaacaaaacaaaacaaaacaacucacaaguccugugaggcaa

SEQ ID NO: 223302 - RNA, 64 nt, Homo Sapiens
acaaccaaacaaauacaaucggcaaaaaaacaaaacaaaacaaacuauuucacaaguccuguga

SEQ ID NO: 223303 - RNA, 64 nt, Homo Sapiens
acaaaacaaccaaacaaauaugugaggcaaaaaaacaaaacaaauaagacuauuucacaagucc

SEQ ID NO: 223304 - RNA, 64 nt, Homo Sapiens
guccugcauacucaccaccaaaaaacaaaacaaaacaaaacacaaaaauguguaaggcuugcua

SEQ ID NO: 223305 - RNA, 64 nt, Homo Sapiens
acacaguccugcauacucacugcuaaaaaacaaaacaaaacaaaaaaagaaaauguguaaggcu

SEQ ID NO: 223306 - RNA, 64 nt, Homo Sapiens
acaaaacacaguccugcauaaggcuugcuaaaaaacaaaacaaacauacaaaagaaaaugugua

SEQ ID NO: 223307 - RNA, 64 nt, Homo Sapiens
uaggcuuuuccauaaguggcgucuuaaagcucauacaaaacaaagcuugaccugguuaaauacu

SEQ ID NO: 223308 - RNA, 64 nt, Homo Sapiens
gcuuugaaaaaacuuuaacacagcacaacaaggaacaaaacaaaucuuaaaacuuguuuguggu

SEQ ID NO: 223309 - RNA, 64 nt, Homo Sapiens
aacaggaaaaaaacaaaaaaaaaaacaaaacaaaacaaaacaaaagaagccucggguaacacug

SEQ ID NO: 223310 - RNA, 64 nt, Homo Sapiens
acaaaaacaggaaaaaaacacacugaaaaacaaaacaaaacaaauucagagaagccucggguaa

SEQ ID NO: 223311 - RNA, 64 nt, Homo Sapiens
acaaaacaaaaacaggaaaagguaacacugaaaaacaaaacaaaagcucuucagagaagccucg

SEQ ID NO: 223312 - RNA, 64 nt, Homo Sapiens
agaaagcugcaauuauccgccaacugcauuuaaaacaaaacaaaacagaaaaaucaaaauaaca

SEQ ID NO: 223313 - RNA, 64 nt, Homo Sapiens
gcugcaauuauccgccaacugcauuuaaaacaaaacaaaacagaaaaaucaaaauaacauugac

SEQ ID NO: 223314 - RNA, 64 nt, Homo Sapiens
uaauuguuuuaaauuuuucauaggggaguuuuggacaaaacagucacuggggagaucacugcca

SEQ ID NO: 223315 - RNA, 64 nt, Homo Sapiens
uuugggacaugagccagaguuuaaaagggaaccaacaaaacacuauaacuuaaaaggauggggu

SEQ ID NO: 223316 - RNA, 64 nt, Homo Sapiens
ugaacauaagguauagcauuugguuuuuaagaaaacaaaacauuaagacgcaacucauuuuaua

SEQ ID NO: 223317 - RNA, 64 nt, Homo Sapiens
agaucaccacagaauccauuuuuuucccaguuccacaaaacacucuguuugccuucaguuuuua

SEQ ID NO: 223318 - RNA, 64 nt, Homo Sapiens
aucuggagaugcugaauuuuggcuccaaaacaaaacaaaacaaagagaaggaaacuaaggacuu

SEQ ID NO: 223319 - RNA, 64 nt, Homo Sapiens
acaaaaucuggagaugcugagacuuggcuccaaaacaaaacaaauuacugagaaggaaacuaag

SEQ ID NO: 223320 - RNA, 64 nt, Homo Sapiens
aagucuuuuguuugugaacacaguucaaaacaaaacaaaacaaaugcacagaauaucaccauug

SEQ ID NO: 223321 - RNA, 64 nt, Homo Sapiens
acaaaaagucuuuuguuugucauugcaguucaaaacaaaacaaauuugcugcacagaauaucac

SEQ ID NO: 223322 - RNA, 64 nt, Homo Sapiens
gcaaaauauugaugaucaggauuaauaaaacaaaacaaaacaaagggacugggacuccagaacc

SEQ ID NO: 223323 - RNA, 64 nt, Homo Sapiens
acaaagcaaaauauugaugagaaccauuaauaaaacaaaacaaaggguagggacugggacucca

SEQ ID NO: 223324 - RNA, 64 nt, Homo Sapiens
aaaaccaauggauuuuaaccuuuaggccagaaguacaaaacaaauucugccaugaggauuucuc

SEQ ID NO: 223325 - RNA, 64 nt, Homo Sapiens
cagauagcaaauuuauauucuuucccaaagggcaacaaaacauaacacugguugacaguauaau

SEQ ID NO: 223326 - RNA, 64 nt, Homo Sapiens
agccagaaguaaggacugaaaagggccucacaagacaaaacagguuccguuaggccaauaaaag

SEQ ID NO: 223327 - RNA, 64 nt, Homo Sapiens
aaggagaaaaaguaauaaugagaaaucuacuuuaacaaaacaaauuaagagaaaucaucaguua

SEQ ID NO: 223328 - RNA, 64 nt, Homo Sapiens
aaaaaaaaagcgaaagacugcaguugugcuaaaaacaaaacaaaacaaacaaacaaacaaaaaa

SEQ ID NO: 223329 - RNA, 64 nt, Homo Sapiens
aaaagcgaaagacugcaguugugcuaaaaacaaaacaaaacaaacaaacaaacaaaaaaguaaa

SEQ ID NO: 223330 - RNA, 64 nt, Homo Sapiens
uuuuaaaagauuugaaauaagcauuuuuaauaugacaaaacaaacuuaccaaaucuucuccuau

SEQ ID NO: 223331 - RNA, 64 nt, Homo Sapiens
aaugaaacacuuauacugacgcauuuaugggaagacaaaacaagcccauauaacuaagacauau

SEQ ID NO: 223332 - RNA, 64 nt, Homo Sapiens
uucugugaagaaugaaguggaggaaguaacuuuuacaaaacauacccaguguuugggguguuuc

SEQ ID NO: 223333 - RNA, 64 nt, Homo Sapiens
acagagccaacucacucuuaugaaaugggcuuuaacaaaacaagaaagaaacguacuuaacugu

SEQ ID NO: 223334 - RNA, 64 nt, Homo Sapiens
uugaaaagccuuucuguugcaacuaugaaugaaaacaaaacaccacaaaacagacuucacuaac

SEQ ID NO: 223335 - RNA, 64 nt, Homo Sapiens
uuucuguugcaacuaugaaugaaaacaaaacaccacaaaacagacuucacuaacacagaaaaac

SEQ ID NO: 223336 - RNA, 64 nt, Homo Sapiens
agcaugugacuaguuacaaaagcaauaaauugaaacaaaacaaaacaaaacaaaacuuguuucu

SEQ ID NO: 223337 - RNA, 64 nt, Homo Sapiens
gugacuaguuacaaaagcaauaaauugaaacaaaacaaaacaaaacaaaacuuguuucuuaaaa

SEQ ID NO: 223338 - RNA, 64 nt, Homo Sapiens
uaguuacaaaagcaauaaauugaaacaaaacaaaacaaaacaaaacuuguuucuuaaaaaugcg

SEQ ID NO: 223339 - RNA, 64 nt, Homo Sapiens
aaugaacucccccaaacauggcuguggagagacaacaaaacaaaacaaagcacaaaagucucug

SEQ ID NO: 223340 - RNA, 64 nt, Homo Sapiens
acucccccaaacauggcuguggagagacaacaaaacaaaacaaagcacaaaagucucugccaac

SEQ ID NO: 223341 - RNA, 64 nt, Homo Sapiens
aagccaccgcaauaauucggaaaagcaaaccagaacaaaacaaaaucacauucguuucccagug

SEQ ID NO: 223342 - RNA, 64 nt, Homo Sapiens
cacaaacaaacaaaaaaccuaagaacaaaacaaaacaaaacaaaaugggauuggugcugauuga

SEQ ID NO: 223343 - RNA, 64 nt, Homo Sapiens
acaaacacaaacaaacaaaaauugaaagaacaaaacaaaacaaacauuuaugggauuggugcug

SEQ ID NO: 223344 - RNA, 64 nt, Homo Sapiens
acaaaacaaacacaaacaaaugcugauugaaagaacaaaacaaauagaucauuuaugggauugg

SEQ ID NO: 223345 - RNA, 64 nt, Homo Sapiens
acagaaucucucccugaguucaaaacagaacaaaacaaaacaauauucaauacaugguuuuuaa

SEQ ID NO: 223346 - RNA, 64 nt, Homo Sapiens
acaauacagaaucucucccuuuuaacaaaacagaacaaaacaaauuuaaauucaauacaugguu

SEQ ID NO: 223347 - RNA, 64 nt, Homo Sapiens
acaaaacaaaacaauacagaauacaugguuuuuaacaaaacagauuuacuaaaauuuaaauuca

SEQ ID NO: 223348 - RNA, 64 nt, Homo Sapiens
auuugcaaaacagaggguaugugguccuuuuuaaacaaaacauuuauuacagugcuguaacugg

SEQ ID NO: 223349 - RNA, 64 nt, Homo Sapiens
aaaauauauauauauucucauggagagauuugguacaaaacaacguugcuacaaagguaaauaa

SEQ ID NO: 223350 - RNA, 64 nt, Homo Sapiens
uuaaggauugucuuaaaguuccuuagccagcaaaacaaaacaaaacaaaacaaacaaaugaaaa

SEQ ID NO: 223351 - RNA, 64 nt, Homo Sapiens
gauugucuuaaaguuccuuagccagcaaaacaaaacaaaacaaaacaaacaaaugaaaaacguu

SEQ ID NO: 223352 - RNA, 64 nt, Homo Sapiens
ucuuaaaguuccuuagccagcaaaacaaaacaaaacaaaacaaacaaaugaaaaacguuuaaaa

SEQ ID NO: 223353 - RNA, 64 nt, Homo Sapiens
aaugaggaagauguguucauuguggacucuaaaaacaaaacaaaacacaaaauccccuguucaa

SEQ ID NO: 223354 - RNA, 64 nt, Homo Sapiens
ggaagauguguucauuguggacucuaaaaacaaaacaaaacacaaaauccccuguucaaauaaa

SEQ ID NO: 223355 - RNA, 64 nt, Homo Sapiens
aguaaccauuguuaaggguugggggaaagcauggacaaaacaucacuggaaacaaaggcuguaa

SEQ ID NO: 223356 - RNA, 64 nt, Homo Sapiens
ucucuuggaauguguauuguuuuuauuuugcgaaacaaaacaaaacaaaaaaaaaagcuuggaa

SEQ ID NO: 223357 - RNA, 64 nt, Homo Sapiens
uggaauguguauuguuuuuauuuugcgaaacaaaacaaaacaaaaaaaaaagcuuggaacucca

SEQ ID NO: 223358 - RNA, 64 nt, Homo Sapiens
uaaauuggguucaugaugcagucuccucuuuaaaacaaaacaaaacaaaacaaaacuauacuug

SEQ ID NO: 223359 - RNA, 64 nt, Homo Sapiens
uggguucaugaugcagucuccucuuuaaaacaaaacaaaacaaaacaaaacuauacuugaacaa

SEQ ID NO: 223360 - RNA, 64 nt, Homo Sapiens
ucaugaugcagucuccucuuuaaaacaaaacaaaacaaaacaaaacuauacuugaacaaaaggg

SEQ ID NO: 223361 - RNA, 64 nt, Homo Sapiens
cguuucaggugcuagggacuuaaugaaaaacaggacaaaacaauuccuuuuuguggcccaggua

SEQ ID NO: 223362 - RNA, 64 nt, Homo Sapiens
aaaaagacaugggagagaugcaaaaaaaaacaaaacaaaacaaagugacagagccaaacuccgu

SEQ ID NO: 223363 - RNA, 64 nt, Homo Sapiens
acaaaaaaaagacaugggaguccgucaaaaaaaaacaaaacaaacuggagugacagagccaaac

SEQ ID NO: 223364 - RNA, 64 nt, Homo Sapiens
aaauauaaacaaucaaaaucaaaacaaaaacaaaacaaaacauaaggacgccaguaaaaaaaca

SEQ ID NO: 223365 - RNA, 64 nt, Homo Sapiens
acauaaaauauaaacaaucaaaacaaaaacaaaaacaaaacaaaaauggaggacgccaguaaaa

SEQ ID NO: 223366 - RNA, 64 nt, Homo Sapiens
cagcuugggcaacagagugagacuccaucucaaaacaaaacaaaacaaaacaaaacaaaaaaac

SEQ ID NO: 223367 - RNA, 64 nt, Homo Sapiens
ugggcaacagagugagacuccaucucaaaacaaaacaaaacaaaacaaaacaaaaaaacccggc

SEQ ID NO: 223368 - RNA, 64 nt, Homo Sapiens
aacagagugagacuccaucucaaaacaaaacaaaacaaaacaaaacaaaaaaacccggcuuugc

SEQ ID NO: 223369 - RNA, 64 nt, Homo Sapiens
agugagacuccaucucaaaacaaaacaaaacaaaacaaaacaaaaaaacccggcuuugcugcuu

SEQ ID NO: 223370 - RNA, 64 nt, Homo Sapiens
agugcuuuuuucaaaccugaaagaaaaaaacaaaacaaaacaacgggagaagauauucucguga

SEQ ID NO: 223371 - RNA, 64 nt, Homo Sapiens
acaacagugcuuuuuucaaacgugaaagaaaaaaacaaaacaaauccaagggagaagauauucu

SEQ ID NO: 223372 - RNA, 64 nt, Homo Sapiens
cugcuuaaauauaccagucacauaaacaaggguaacaaaacaaggaaaugacaacuuuauucca

SEQ ID NO: 223373 - RNA, 64 nt, Homo Sapiens
ccuuucaaacaaucauuguccuccuggcuuccuuacaaaacaagcucaucaaacucauauauuc

SEQ ID NO: 223374 - RNA, 64 nt, Homo Sapiens
ugagauuaaaagaagacaauuauucaaagccaucacaaaacacuauaagacugaccaaaauuua

SEQ ID NO: 223375 - RNA, 64 nt, Homo Sapiens
cagcccaggcugcagucuccacaccaaacagucaacaaaacacaaacccugaaggaaaaccuuu

SEQ ID NO: 223376 - RNA, 64 nt, Homo Sapiens
cugggaacacagcgagacccucucauuaaaaacaacaaaacaaaacaauuccagucuuggagua

SEQ ID NO: 223377 - RNA, 64 nt, Homo Sapiens
aacacagcgagacccucucauuaaaaacaacaaaacaaaacaauuccagucuuggaguagucua

SEQ ID NO: 223378 - RNA, 64 nt, Homo Sapiens
aaacaacaacaacaaaaaaccacugaacuucaaaacaaaacaaaucuuacuguaaaaaaaagug

SEQ ID NO: 223379 - RNA, 64 nt, Homo Sapiens
uguuauguguacauucggagcauaaacaagaacaacaaaacagguguaauagaugcacgacagg

SEQ ID NO: 223380 - RNA, 64 nt, Homo Sapiens
aaaacaugagcagugguguuacgaaaaaaacaaaacaaaacaaacuaaugcuuuguuuaaaaaa

SEQ ID NO: 223381 - RNA, 64 nt, Homo Sapiens
acaaaaaaacaugagcagugaaaaaacgaaaaaaacaaaacaaauaacacuaaugcuuuguuua

SEQ ID NO: 223382 - RNA, 64 nt, Homo Sapiens
aacacagugccauaugaauauuguacuugaauauacaaaacaugaccacuauacauaguuucuu

SEQ ID NO: 223383 - RNA, 64 nt, Homo Sapiens
aacuuuagagcaagaagaccgcacuugucuauguacaaaacacaaagauggauagcacauaaug

SEQ ID NO: 223384 - RNA, 64 nt, Homo Sapiens
aaacuagauauguaauuucucaaaacaaaacaaaacaaaacaaacucuuaucuuaaaaaguaaa

SEQ ID NO: 223385 - RNA, 64 nt, Homo Sapiens
acaaaaaacuagauauguaaguaaacaaaacaaaacaaaacaaacaggacucuuaucuuaaaaa

SEQ ID NO: 223386 - RNA, 64 nt, Homo Sapiens
acaaaacaaaaaacuagauaaaaaaguaaacaaaacaaaacaaaugcggcaggacucuuaucuu

SEQ ID NO: 223387 - RNA, 64 nt, Homo Sapiens
acaaaacaaaacaaaaaacuaucuuaaaaaguaaacaaaacaaaagaggugcggcaggacucuu

SEQ ID NO: 223388 - RNA, 64 nt, Homo Sapiens
uuucagguuccaaggaagagacuuuaaaaacaaaacaaaacauugcuuuacuucuuuugcaugc

SEQ ID NO: 223389 - RNA, 64 nt, Homo Sapiens
acauuuuucagguuccaaggcaugcacuuuaaaaacaaaacaaaaaaaggcuuuacuucuuuug

SEQ ID NO: 223390 - RNA, 64 nt, Homo Sapiens
ggagacagagcaagacuccaucucaaaaacaaaaacaaaacaaaacaacaacaaaaaaagaagu

SEQ ID NO: 223391 - RNA, 64 nt, Homo Sapiens
cagagcaagacuccaucucaaaaacaaaaacaaaacaaaacaacaacaaaaaaagaaguuaaau

SEQ ID NO: 223392 - RNA, 64 nt, Homo Sapiens
agugccccaaauggaaaaaagauacucacacagaacaaaacaguucuuggucuuguucuugguc

SEQ ID NO: 223393 - RNA, 64 nt, Homo Sapiens
aagaguuuuguauaugucugauaccguuguuauaacaaaacaaauuuuuuuacuauaguuuuuu

SEQ ID NO: 223394 - RNA, 64 nt, Homo Sapiens
uuguguuuauauuuccuguaagugaauaaauaaaacaaaacaaaacaaaaaaaacuugugccug

SEQ ID NO: 223395 - RNA, 64 nt, Homo Sapiens
uuuauauuuccuguaagugaauaaauaaaacaaaacaaaacaaaaaaaacuugugccugauaag

SEQ ID NO: 223396 - RNA, 64 nt, Homo Sapiens
ccagccugggugacagagcgagacuaucucagaaacaaaacaaaacaaaacaacaaaaaaagaa

SEQ ID NO: 223397 - RNA, 64 nt, Homo Sapiens
cugggugacagagcgagacuaucucagaaacaaaacaaaacaaaacaacaaaaaaagaaaaggc

SEQ ID NO: 223398 - RNA, 64 nt, Homo Sapiens
ugacagagcgagacuaucucagaaacaaaacaaaacaaaacaacaaaaaaagaaaaggcagagu

SEQ ID NO: 223399 - RNA, 64 nt, Homo Sapiens
ggcacugcaauuuuauuuuugaguugggacuuuuacaaaacacuuuuuucccuggagucuucuc

SEQ ID NO: 223400 - RNA, 64 nt, Homo Sapiens
cacaaccagucuuuuuguauuuauuguuacugagacaaaacaguacucacugaguguuuuucag

SEQ ID NO: 223401 - RNA, 64 nt, Homo Sapiens
aagauugucuguaaucacaugaaaaguauacaaaacaaaacagucaaaaacauucacaaauaua

SEQ ID NO: 223402 - RNA, 64 nt, Homo Sapiens
acaguaagauugucuguaauauauagaaaaguauacaaaacaaauauuucaaaaacauucacaa

SEQ ID NO: 223403 - RNA, 56 nt, Homo Sapiens
auaaaacaaaaaaaaggaagaacaaaacaaaacaaaaaggauuuggcaugcuguaa

SEQ ID NO: 223404 - RNA, 51 nt, Homo Sapiens
acaaaauaaaacaaaaaaaaaacaaaacaaaaaggauuuggcaugcuguaa

SEQ ID NO: 223405 - RNA, 64 nt, Homo Sapiens
auuagcugagcaugguggugcaucucaaaacaaaacaaaacaaaugggcgacacagcgagacuc

SEQ ID NO: 223406 - RNA, 64 nt, Homo Sapiens
acaaaauuagcugagcaugggacuccaucucaaaacaaaacaaagagccugggcgacacagcga

SEQ ID NO: 223407 - RNA, 64 nt, Homo Sapiens
aacaacaacaaaaaacaaaaucucaaaaaacaaaacaaaacaaaucaacaagaguaaaacuuca

SEQ ID NO: 223408 - RNA, 64 nt, Homo Sapiens
acaaaaacaacaacaaaaaacuucaucucaaaaaacaaaacaaaccuggucaacaagaguaaaa

SEQ ID NO: 223409 - RNA, 64 nt, Homo Sapiens
caagcaaaaaacacaaaaaccuauuuucaacaaaacaaaacaaaucuccccauucugugcccua

SEQ ID NO: 223410 - RNA, 64 nt, Homo Sapiens
acaaacaagcaaaaaacacacccuacuauuuucaacaaaacaaaucuccucuccccauucugug

SEQ ID NO: 223411 - RNA, 64 nt, Homo Sapiens
aaaagccucgguauaauuuugauaaaaguauaaaacaaaacaaagcaaguuugcuggggaguuu

SEQ ID NO: 223412 - RNA, 64 nt, Homo Sapiens
uagcucaucuuauucucucuggcgguggcuuuucacaaaacauuaagucacaagcuuucggaug

SEQ ID NO: 223413 - RNA, 64 nt, Homo Sapiens
uugaaucaaguuuguuuguaaaaaaacaaaacaaacaaaacaccuucuuuuuccuuuuuuuuua

SEQ ID NO: 223414 - RNA, 64 nt, Homo Sapiens
caaaacaccuugaaucaaguuuuuuuuuaaaaaaacaaaacaaaccuuugucuuucuuuuuccu

SEQ ID NO: 223415 - RNA, 64 nt, Homo Sapiens
auacuaguggguuuuucuaccuggcauugaaaggacaaaacauuaguauguucccaaaucugug

SEQ ID NO: 223416 - RNA, 64 nt, Homo Sapiens
uuuguuuuuuauuuuacaaccacugccaguuuugacaaaacagguuccagugcugccuucuuua

SEQ ID NO: 223417 - RNA, 64 nt, Homo Sapiens
aaaauaccuguauguuuuguuaagaccaaacaaaacaaaacauugaaaauauagaauuccugga

SEQ ID NO: 223418 - RNA, 64 nt, Homo Sapiens
acauuaaaauaccuguaugucuggauaagaccaaacaaaacaaaggagagaaaauauagaauuc

SEQ ID NO: 223419 - RNA, 64 nt, Homo Sapiens
aaaguuguuuucuagauuuguggcuuuaagaaaaacaaaacaaaacaaacacauuguuuuucuc

SEQ ID NO: 223420 - RNA, 64 nt, Homo Sapiens
uguuuucuagauuuguggcuuuaagaaaaacaaaacaaaacaaacacauuguuuuucucagaac

SEQ ID NO: 223421 - RNA, 64 nt, Homo Sapiens
ggggagggggacauagcgagacucggucucaaaaacaaaacaaaacaaaacaaaacaaaacaaa

SEQ ID NO: 223422 - RNA, 64 nt, Homo Sapiens
gggggacauagcgagacucggucucaaaaacaaaacaaaacaaaacaaaacaaaacaaaaacaa

SEQ ID NO: 223423 - RNA, 64 nt, Homo Sapiens
acauagcgagacucggucucaaaaacaaaacaaaacaaaacaaaacaaaacaaaaacaaaacaa

SEQ ID NO: 223424 - RNA, 64 nt, Homo Sapiens
gcgagacucggucucaaaaacaaaacaaaacaaaacaaaacaaaacaaaacaaaacaaaacaaa

SEQ ID NO: 223425 - RNA, 64 nt, Homo Sapiens
acucggucucaaaaacaaaacaaaacaaaacaaaacaaaacaaaacaaaacaaaacaaaacacu

SEQ ID NO: 223426 - RNA, 64 nt, Homo Sapiens
gucucaaaaacaaaacaaaacaaaacaaaacaaaacaaaacaaaacaaaacaaaacacugccaa

SEQ ID NO: 223427 - RNA, 64 nt, Homo Sapiens
aaaaacaaaacaaaacaaaacaaaacaaaacaaaacaaaacaaaacaaaacacugccaaacugu

SEQ ID NO: 223428 - RNA, 64 nt, Homo Sapiens
caaaacaaaacaaaacaaaacaaaacaaaacaaaacaaaacaaaacacugccaaacuguuucca

SEQ ID NO: 223429 - RNA, 64 nt, Homo Sapiens
aaaacaaaacaaaacaaaaacaaaacaaaacaaaacaaaacacugccaaacuguuuccaaagca

SEQ ID NO: 223430 - RNA, 64 nt, Homo Sapiens
uucuuuccugaguucaggugacugaggaagagccacaaaacaaaacacaacaaaaccaaaccac

SEQ ID NO: 223431 - RNA, 64 nt, Homo Sapiens
uccugaguucaggugacugaggaagagccacaaaacaaaacacaacaaaaccaaaccacagaau

SEQ ID NO: 223432 - RNA, 64 nt, Homo Sapiens
gagagaaaaagcaaaccgcgccuuagguuacaaaacaaaacagguggucucagaggcucugcuu

SEQ ID NO: 223433 - RNA, 64 nt, Homo Sapiens
acagggagagaaaaagcaaaugcuuccuuagguuacaaaacaaaguguguggucucagaggcuc

SEQ ID NO: 223434 - RNA, 64 nt, Homo Sapiens
aaaagccauuuuggagacaguggaccugguuugaacaaaacauauucaguauguuggcauuacu

SEQ ID NO: 223435 - RNA, 64 nt, Homo Sapiens
auucuauaagucaguauacuccugugggaaagaaacaaaacaucuuauguguguguauaaaacu

SEQ ID NO: 223436 - RNA, 64 nt, Homo Sapiens
aaaaaaaccggauagaauaacaaacaacaacaaaacaaaacaaaacacagcaaguucuuguuuc

SEQ ID NO: 223437 - RNA, 64 nt, Homo Sapiens
acaaaaaaaaaaccggauagguuuccaaacaacaacaaaacaaagggcgacacagcaaguucuu

SEQ ID NO: 223438 - RNA, 64 nt, Homo Sapiens
gucuggucggcaagagugagacuccgucucaaaaacaaaacaaaacaaaaaaaccacauaacau

SEQ ID NO: 223439 - RNA, 64 nt, Homo Sapiens
gucggcaagagugagacuccgucucaaaaacaaaacaaaacaaaaaaaccacauaacauaaauu

SEQ ID NO: 223440 - RNA, 64 nt, Homo Sapiens
cugaaaauucgugcgugggcuauuggguuuggucacaaaacaucgggucuauuuguguggcagu

SEQ ID NO: 223441 - RNA, 64 nt, Homo Sapiens
uuuuacaucugaacaaaauguugacaauaaucucacaaaacauauuuuauacaugaaaauuugu

SEQ ID NO: 223442 - RNA, 64 nt, Homo Sapiens
cauauauauauaaauauaaauauauauaaaaacaacaaaacaaaacaaaaaaagaaaaaaaaac

SEQ ID NO: 223443 - RNA, 64 nt, Homo Sapiens
auauauaaauauaaauauauauaaaaacaacaaaacaaaacaaaaaaagaaaaaaaaacaaaaa

SEQ ID NO: 223444 - RNA, 64 nt, Homo Sapiens
aucaugacugagccaaucacuguuucucagaaaaacaaaacaaaacaaaacaaaugacaguaac

SEQ ID NO: 223445 - RNA, 64 nt, Homo Sapiens
gacugagccaaucacuguuucucagaaaaacaaaacaaaacaaaacaaaugacaguaacccuuc

SEQ ID NO: 223446 - RNA, 64 nt, Homo Sapiens
agccaaucacuguuucucagaaaaacaaaacaaaacaaaacaaaugacaguaacccuuccccgg

SEQ ID NO: 223447 - RNA, 64 nt, Homo Sapiens
agccugggugacagagcaagacucugucuaaaaaacaaaacaaaacaaaacaaaacaaaaaaac

SEQ ID NO: 223448 - RNA, 64 nt, Homo Sapiens
gggugacagagcaagacucugucuaaaaaacaaaacaaaacaaaacaaaacaaaaaaaccucuu

SEQ ID NO: 223449 - RNA, 64 nt, Homo Sapiens
acagagcaagacucugucuaaaaaacaaaacaaaacaaaacaaaacaaaaaaaccucuuaauau

SEQ ID NO: 223450 - RNA, 64 nt, Homo Sapiens
gcaagacucugucuaaaaaacaaaacaaaacaaaacaaaacaaaaaaaccucuuaauauucugg

SEQ ID NO: 223451 - RNA, 64 nt, Homo Sapiens
gacacucacuuguguguauaaggucaaaaacaaaacaaaacaguaagcaauauuuaauaaaacu

SEQ ID NO: 223452 - RNA, 64 nt, Homo Sapiens
acagugacacucacuuguguaaacuaggucaaaaacaaaacaaacaaggaagcaauauuuaaua

SEQ ID NO: 223453 - RNA, 64 nt, Homo Sapiens
caaacaaacaaaacuugcaucaaaacaaaacaaaacaaaacaaaacaaaaacgaaacuccaucu

SEQ ID NO: 223454 - RNA, 64 nt, Homo Sapiens
acaaacaaacaaacaaaacucaucucaaaacaaaacaaaacaaagggcgacaaaaacgaaacuc

SEQ ID NO: 223455 - RNA, 64 nt, Homo Sapiens
acaaaacaaacaaacaaacaaacuccaucucaaaacaaaacaaaagccugggcgacaaaaacga

SEQ ID NO: 223456 - RNA, 64 nt, Homo Sapiens
auuaacugcuuaaauguuuuacaaacaaaacaaaacaaaacaaaaccacaauuguucuucaaaa

SEQ ID NO: 223457 - RNA, 64 nt, Homo Sapiens
acaaaauuaacugcuuaaaucaaaaacaaacaaaacaaaacaaaaaaagaccacaauuguucuu

SEQ ID NO: 223458 - RNA, 64 nt, Homo Sapiens
acaaaacaaaauuaacugcuuucuucaaaaacaaacaaaacaaaaauguaaaagaccacaauug

SEQ ID NO: 223459 - RNA, 64 nt, Homo Sapiens; identical to SEQ ID NO: 172363

SEQ ID NO: 223460 - RNA, 64 nt, Homo Sapiens; identical to SEQ ID NO: 172364

SEQ ID NO: 223461 - RNA, 64 nt, Homo Sapiens; identical to SEQ ID NO: 172365

SEQ ID NO: 223462 - RNA, 64 nt, Homo Sapiens; identical to SEQ ID NO: 172366

SEQ ID NO: 223463 - RNA, 64 nt, Homo Sapiens; identical to SEQ ID NO: 172367

SEQ ID NO: 223464 - RNA, 64 nt, Homo Sapiens; identical to SEQ ID NO: 172368

SEQ ID NO: 223465 - RNA, 64 nt, Homo Sapiens
cugugccaaauggucuggcagcugguuuuggcauccccagcaucaccacucucccaacccauca

SEQ ID NO: 223466 - RNA, 64 nt, Homo Sapiens
agauccgcccagcugccaccauuuucauugcuuuccccagcagcaugaugggaacccaagcuga

SEQ ID NO: 223467 - RNA, 64 nt, Homo Sapiens
cagguguuguguggcuuagcaaaggguuugggugccccagcauccaguguucagaguuuuaggg

SEQ ID NO: 223468 - RNA, 64 nt, Homo Sapiens
cugcccccgacucuaccuccguggcccugccugcccccagcagcgggaccuguugauuaauuga

SEQ ID NO: 223469 - RNA, 64 nt, Homo Sapiens
ccgguauccucagcacuacccacccccgccagcuccccagcacaaaggacccuuucgacaagac

SEQ ID NO: 223470 - RNA, 64 nt, Homo Sapiens
aggacccuuucgacaagacguuccgccuuccccuccccagcaccaaagaaugccagccuaucag

SEQ ID NO: 223471 - RNA, 64 nt, Homo Sapiens
gcuugaccugaggcugugguaggaagguggauggccccagcacaccccaucuucuaaauggcaa

SEQ ID NO: 223472 - RNA, 64 nt, Homo Sapiens
ccagccccucuggucgcuccccaccaggccaccuccccagcauugcaggcccuggccuccccug

SEQ ID NO: 223473 - RNA, 64 nt, Homo Sapiens
uacuccccucugcaacccccauuuugggaguugaccccagcaaugaccuugguggcacgcucac

SEQ ID NO: 223474 - RNA, 64 nt, Homo Sapiens
ccuuccugguagaccuuaaaccucgcacacauguccccagcauuuucucaccuggauaaagccc

SEQ ID NO: 223475 - RNA, 64 nt, Homo Sapiens
agucauagacuagguaggaaggcccuauauugguccccagcaucuacugaggcagaccugcaac

SEQ ID NO: 223476 - RNA, 64 nt, Homo Sapiens
cugaggcagaccugcaacagaaguggcauucaguccccagcagacaugggugagcucaccccag

SEQ ID NO: 223477 - RNA, 64 nt, Homo Sapiens
ggcauucaguccccagcagacaugggugagcucaccccagcacugcuguugggaaggugacugc

SEQ ID NO: 223478 - RNA, 64 nt, Homo Sapiens
guaccaucuuggauccuucaaaaccaaagacuugccccagcacugcuguggaaccaccuggcuu

SEQ ID NO: 223479 - RNA, 64 nt, Homo Sapiens
cagagaagagaaagcauguugcuuaaacauccuuccccagcaccagcuauugguguaccuauaa

SEQ ID NO: 223480 - RNA, 64 nt, Homo Sapiens
cuuugucuguguauuagcucuuuccauucuuugcccccagcaugaguuaacucgcguggacucu

SEQ ID NO: 223481 - RNA, 64 nt, Homo Sapiens
uuaacucgcguggacucugcagugcgaguagugaccccagcauaccuuguccucuggaccuccu

SEQ ID NO: 223482 - RNA, 64 nt, Homo Sapiens
ugccccagggacaugggaagguguccuggaaagcccccagcagcuugacuuagagugacagccg

SEQ ID NO: 223483 - RNA, 64 nt, Homo Sapiens
ucucaagaacacagcugcacccccuuccccaggcccccagcaagcuggggacucaggaaccaug

SEQ ID NO: 223484 - RNA, 64 nt, Homo Sapiens
caaaacuuuuuguuggcuuuuuccuuugucgccuccccagcaccugcccucccagucucccacc

SEQ ID NO: 223485 - RNA, 64 nt, Homo Sapiens
cuaagccaaagauggccccugacaccucccccagccccagcacaccagccugcaccucuuaucc

SEQ ID NO: 223486 - RNA, 64 nt, Homo Sapiens
uucgcccaccaggccuaggcuacgcuccaugcucccccagcaaucucugccuacaccuccugcg

SEQ ID NO: 223487 - RNA, 64 nt, Homo Sapiens
cauccagggaaagaggaagaaaggccuuagugugccccagcagucuggcugcguccagccacca

SEQ ID NO: 223488 - RNA, 64 nt, Homo Sapiens
cuccagauugagagcaaggugaagauggggcaccccccagcaccaagccagccaggggccccag

SEQ ID NO: 223489 - RNA, 64 nt, Homo Sapiens
cacacucccugccacuguucggccuccccaccuaccccagcacacucaggcccaggacccagga

SEQ ID NO: 223490 - RNA, 64 nt, Homo Sapiens
caaggcugggcccugcaguggggcgggccgccagccccagcaguuuacagacgcauggcucuuc

SEQ ID NO: 223491 - RNA, 64 nt, Homo Sapiens
gaggagcccaggggcuuaccucacugagagugcuccccagcaggcauccacuaccccagggccc

SEQ ID NO: 223492 - RNA, 64 nt, Homo Sapiens
ucucagggugcugaccucucagccccugugguagccccagcaguaccauaccucugacccaccc

SEQ ID NO: 223493 - RNA, 64 nt, Homo Sapiens
ugaugggcucccugaaacugaccuguccaaggccccccagcagaggggcagcguguuccccugu

SEQ ID NO: 223494 - RNA, 64 nt, Homo Sapiens
ggagagcuggcaggcccagggcuuguccugcugaccccagcagacccuccuguugguuccagcg

SEQ ID NO: 223495 - RNA, 64 nt, Homo Sapiens
agucuguucugacgcccuggggguuccuguccaaccccagcaggggcgcagcgggaccagcccc

SEQ ID NO: 223496 - RNA, 64 nt, Homo Sapiens
uggauucugggcaagccugucccacccuccaggaccccagcaagcaccugccauggacacuuca

SEQ ID NO: 223497 - RNA, 64 nt, Homo Sapiens
ccccacuugccugaagcucccccaugagaccgucccccagcaucuccugaagauagccagagag

SEQ ID NO: 223498 - RNA, 64 nt, Homo Sapiens
acucgcagugggauggcugccccagaucccccugccccagcaagcccugcguguucauccuggg

SEQ ID NO: 223499 - RNA, 64 nt, Homo Sapiens
caauuauccggccuuccauauguacuuggggugaccccagcagcuagugcagagcccguccuuu

SEQ ID NO: 223500 - RNA, 64 nt, Homo Sapiens
cuuuugauaugcaguuuccagcccuccaaugaguccccagcacagaucucaggcuuguggcugg

SEQ ID NO: 223501 - RNA, 64 nt, Homo Sapiens
acccuguggcugcccuucacacuuacaggccuaaccccagcaggaccugccagcugcuucauga

SEQ ID NO: 223502 - RNA, 64 nt, Homo Sapiens
ugcaggaccaagugcagagggaggcccacaccugccccagcaccgaccacagcccccagcaggg

SEQ ID NO: 223503 - RNA, 64 nt, Homo Sapiens
ggaggcccacaccugccccauuucugaccacagcccccagcagggcgccaucuaccggcugaac

SEQ ID NO: 223504 - RNA, 64 nt, Homo Sapiens
aauuacugcuccaguuaugaagagacauuuaugcccccagcacccuucugucucuuuagcugcc

SEQ ID NO: 223505 - RNA, 64 nt, Homo Sapiens
ccugcccaucuggugccacaguuacuuuuggccuccccagcaccaccaguuuggagggaagcug

SEQ ID NO: 223506 - RNA, 64 nt, Homo Sapiens
cucucgaaaauugcacuucuucacaaggggguacccccagcagcaaaauuuaugcauacguucu

SEQ ID NO: 223507 - RNA, 64 nt, Homo Sapiens
aaaaaaccaaugauuuugcugccucccaccccgaccccagcaucgugacccccgucaacccacu

SEQ ID NO: 223508 - RNA, 64 nt, Homo Sapiens
uggggcugggucaggaaccacacgggccucagggccccagcagacaggaaaagcaaugucucuu

SEQ ID NO: 223509 - RNA, 64 nt, Homo Sapiens
ucccagccuuuccaggagcuugccccauucccugccccagcacuagggcacagcugcuggcaaa

SEQ ID NO: 223510 - RNA, 64 nt, Homo Sapiens
cacuugccuguucauuccugugggaagaauggucccccagcaagagcagcccccuccuccuggc

SEQ ID NO: 223511 - RNA, 64 nt, Homo Sapiens
ccccuccuccuggcugggaagggagaaagucccuccccagcagccacccacaacccgagaauca

SEQ ID NO: 223512 - RNA, 64 nt, Homo Sapiens
agagacccuggagcacaggaccccaggaccccuuccccagcagcuuuucuucauuuacuucaua

SEQ ID NO: 223513 - RNA, 64 nt, Homo Sapiens
cugggguuauuuaacaauagcuccccuguacgugccccagcauuccuccucccugcuuccucuc

SEQ ID NO: 223514 - RNA, 64 nt, Homo Sapiens
acaaagaccagggcaggucacggguuucccaauuccccagcaauuaagauuucgagcagaauuu

SEQ ID NO: 223515 - RNA, 64 nt, Homo Sapiens
ucucaggauugagauucuauccccccuuccccgcccccagcagugucgcuccaauucaaauuag

SEQ ID NO: 223516 - RNA, 64 nt, Homo Sapiens
acgggugagaacugcuaagugaugacagguggagccccagcaggggccacucuauugaauggca

SEQ ID NO: 223517 - RNA, 64 nt, Homo Sapiens
ccuucacaaaagcagaaggaacacuggcccaaacccccagcaccccggaagcagaggugagaug

SEQ ID NO: 223518 - RNA, 64 nt, Homo Sapiens
gcccuccgagguggagcagcccuacucccggagcccccagcaggcuuccuuucucagcugaacc

SEQ ID NO: 223519 - RNA, 64 nt, Homo Sapiens
gcccuccgagguggaacagcccccuacccggagcccccagcaggcgcuuccuuucucagcugaa

SEQ ID NO: 223520 - RNA, 64 nt, Homo Sapiens
gcaucaguuuucuccacuucuuucucccacucacccccagcaaggugccuggggagacuugagc

SEQ ID NO: 223521 - RNA, 64 nt, Homo Sapiens
agccaggccuccaaugcacugugaccucuggcuuccccagcagcuuucccagagaggcagaggg

SEQ ID NO: 223522 - RNA, 64 nt, Homo Sapiens
cacaccgggccuggcgcuacacacugaugauucuccccagcauccucgggggcuuucggcuccc

SEQ ID NO: 223523 - RNA, 64 nt, Homo Sapiens
ucugucugccaugcgcuucucccuguggcccccuccccagcaccagccuucuauuugugaagug

SEQ ID NO: 223524 - RNA, 64 nt, Homo Sapiens
cuuuucccauuguuccugcgcugcaaauugcaggccccagcaaucgugacugacguuugcuccu

SEQ ID NO: 223525 - RNA, 64 nt, Homo Sapiens
gcuguucuggaagaaacagaucuccuggcaaaggccccagcaucucccucacugaaaccaggug

SEQ ID NO: 223526 - RNA, 64 nt, Homo Sapiens
gagugggacagagucuggguguauuuauuuuccuccccagcagguggggaggggguuugggggc

SEQ ID NO: 223527 - RNA, 64 nt, Homo Sapiens
uuggcccccgagcugggggccaugagcuccagacccccagcaacccuccuaucaccuccccucc

SEQ ID NO: 223528 - RNA, 64 nt, Homo Sapiens
gggggccugcaaaucuaguguccccgucccugucccccagcauccaucauccacccgcugcccc

SEQ ID NO: 223529 - RNA, 64 nt, Homo Sapiens
gccaccuccgccagaccccggagcccuguacccaccccagcacaggucaccauccucagaggcu

SEQ ID NO: 223530 - RNA, 64 nt, Homo Sapiens
ccucccagccccggugcccgcagaagacgcuuuuccccagcaggucacccacggccccggaacc

SEQ ID NO: 223531 - RNA, 64 nt, Homo Sapiens
gaauccagccgggcgugguggcucacaccuguaaccccagcacuuugggaggcuaaggcggcgg

SEQ ID NO: 223532 - RNA, 64 nt, Homo Sapiens
gcccuaccccuccacuccgagccggugcccugccccccagcacuuagggguggggagguggucu

SEQ ID NO: 223533 - RNA, 64 nt, Homo Sapiens
cuuugaacccacccuuaggggggacagcuguucaccccagcaccuccagggugggucuggggag

SEQ ID NO: 223534 - RNA, 64 nt, Homo Sapiens
ugcaauaaugcccucaccccaggguuguccuuccccccagcaaaacgcagggaauacaggggag

SEQ ID NO: 223535 - RNA, 64 nt, Homo Sapiens
gacacugacgucaggacccgaaccuggugggggcccccagcaggugcgaugaugacccgggcgc

SEQ ID NO: 223536 - RNA, 64 nt, Homo Sapiens
uagcaaaagcauuucuugguaaaaaagaaaaaagccccagcaugcggagugagacucccucuca

SEQ ID NO: 223537 - RNA, 64 nt, Homo Sapiens
gccgggcaugguggcucauguguucuuagaaaagccccagcaugcuuacccuccggugugcuug

SEQ ID NO: 223538 - RNA, 64 nt, Homo Sapiens
ggugcaggacagcugccagcgcaacuccacccgaccccagcagugcuaucacagaacuccacca

SEQ ID NO: 223539 - RNA, 64 nt, Homo Sapiens
aucucccgacaccaacugugugguuuuucggguuccccagcagcaggcauucaucuuggagaug

SEQ ID NO: 223540 - RNA, 64 nt, Homo Sapiens
ugcuagcaggaggcaccuggccuccugccagcacccccagcacccccacugaagccccgcgccu

SEQ ID NO: 223541 - RNA, 64 nt, Homo Sapiens
uggugcgggugugugagugggcacgguccuaaguccccagcagguggguuugagugaagggaga

SEQ ID NO: 223542 - RNA, 64 nt, Homo Sapiens
aggggugcucugggaccagacuaagcaggugcgaccccagcaagacggaaaccagcccugcggg

SEQ ID NO: 223543 - RNA, 64 nt, Homo Sapiens
uccagguuggcccacacaggaguucuaggucguuccccagcaccucuguccacccacccagccc

SEQ ID NO: 223544 - RNA, 64 nt, Homo Sapiens
gugaugggaguccacggcuaggcuugaacccagaccccagcacuaauguccuagcugcugcuga

SEQ ID NO: 223545 - RNA, 64 nt, Homo Sapiens
agucccuucccaccaggggcugaccucccagcugccccagcaagcucugcccucucuggcuuug

SEQ ID NO: 223546 - RNA, 64 nt, Homo Sapiens
cuacucccccagacccaaguucugcagaacuaacccccagcaggccugguuccacccugggcag

SEQ ID NO: 223547 - RNA, 64 nt, Homo Sapiens
ggcggggcccugccuggggaucucaaggaugaggccccagcauggaggauuggggguagaauuc

SEQ ID NO: 223548 - RNA, 64 nt, Homo Sapiens
cauggaggauuggggguagaauuccacccuugaaccccagcagacagucccuccccugacuccc

SEQ ID NO: 223549 - RNA, 64 nt, Homo Sapiens
guggucccaggacuggcaccuacucuuuagagagccccagcaucuuugauguggauuggagaca

SEQ ID NO: 223550 - RNA, 64 nt, Homo Sapiens
agggucccaccacagccagcgggcuggccucccaccccagcauccauacacguaggccuguugc

SEQ ID NO: 223551 - RNA, 64 nt, Homo Sapiens
auagcagaggagagagggguguacugucuguggcccccagcaugggccacauaccaacccacca

SEQ ID NO: 223552 - RNA, 64 nt, Homo Sapiens
agccugcgugccccuaaccuggcuuuucccaucuccccagcauaaccaaaucuuacuaaacuca

SEQ ID NO: 223553 - RNA, 64 nt, Homo Sapiens
ccuaggcugggcauggugacucacgccuguaaucccccagcaauuugggaggcaaaggugggag

SEQ ID NO: 223554 - RNA, 64 nt, Homo Sapiens
agccugcaugccccuaaccugccuuuucccaucuccccagcauaaccuaauauuuuuuuuuuuu

SEQ ID NO: 223555 - RNA, 64 nt, Homo Sapiens
ccuaggcuggccgcggugacucaugccuauaaucccccagcaauuugggaggcagaggugagag

SEQ ID NO: 223556 - RNA, 64 nt, Homo Sapiens
guguugugaggcgcacuguuacuguucuugggcgccccagcauuauuccagggggcugguucac

SEQ ID NO: 223557 - RNA, 64 nt, Homo Sapiens
uuaucaccaucugugccuuugggaguggaccagcccccagcaaaggugagacagcagggcccag

SEQ ID NO: 223558 - RNA, 64 nt, Homo Sapiens
gaguccccccuccuuuguguacgcagcagccucuccccagcacuugcauucagcccucucuagg

SEQ ID NO: 223559 - RNA, 64 nt, Homo Sapiens
acuguuugggucccgcuuuuacaggaacaaauuuccccagcacccacucagccuuccaaaggga

SEQ ID NO: 223560 - RNA, 64 nt, Homo Sapiens
gucugcucaggccugacagcgaacuuucucucucccccagcagucgugcuugguggggggaugu

SEQ ID NO: 223561 - RNA, 64 nt, Homo Sapiens
aggcggaaccacccagccagcuauguucacguccccccagcagcgcggggccagagcggcgggu

SEQ ID NO: 223562 - RNA, 64 nt, Homo Sapiens
ugcaggcaaggagaccaaagauugaugagaagacccccagcagggguacuggguacccggcagg

SEQ ID NO: 223563 - RNA, 64 nt, Homo Sapiens
uguguucuucucugagcagcuccuccccggagucccccagcacagucccaggagaugacaggaa

SEQ ID NO: 223564 - RNA, 64 nt, Homo Sapiens
guccccauggagcugguggccucagguucccuguccccagcacuaggcugaaaucuggcaucau

SEQ ID NO: 223565 - RNA, 64 nt, Homo Sapiens
cucuagcaauagcagcugcuguccucugcugggcccccagcaaagaaauggaccccgcaacccu

SEQ ID NO: 223566 - RNA, 64 nt, Homo Sapiens
ugccaugggguuuccuuccaacccguccucucacccccagcagucauguccucccugccuuggg

SEQ ID NO: 223567 - RNA, 64 nt, Homo Sapiens
cuccagcccacaaacagggcuguacaguccugccccccagcaccgcccacauccccacugcccc

SEQ ID NO: 223568 - RNA, 64 nt, Homo Sapiens
ccccacccuugccccagcugcucuucccccaccuccccagcagcccucccaccccagcagcccu

SEQ ID NO: 223569 - RNA, 64 nt, Homo Sapiens
ccucucuucccccaccuccccacccuaccucccaccccagcagcaggaccgggcccugccccgc

SEQ ID NO: 223570 - RNA, 64 nt, Homo Sapiens
uaaacacucuucucguuggugcugucucagaugcccccagcaaacuucucuguguaccaccucu

SEQ ID NO: 223571 - RNA, 64 nt, Homo Sapiens
ggccucccuguggaagaugagccuuuguccucauccccagcacuagagcugggacugggcguag

SEQ ID NO: 223572 - RNA, 64 nt, Homo Sapiens; identical to SEQ ID NO: 148065

SEQ ID NO: 223573 - RNA, 64 nt, Homo Sapiens; identical to SEQ ID NO: 148066

SEQ ID NO: 223574 - RNA, 64 nt, Homo Sapiens; identical to SEQ ID NO: 148067

SEQ ID NO: 223575 - RNA, 64 nt, Homo Sapiens; identical to SEQ ID NO: 148068

SEQ ID NO: 223576 - RNA, 64 nt, Homo Sapiens; identical to SEQ ID NO: 148069

SEQ ID NO: 223577 - RNA, 64 nt, Homo Sapiens; identical to SEQ ID NO: 148070

SEQ ID NO: 223578 - RNA, 64 nt, Homo Sapiens; identical to SEQ ID NO: 148071

SEQ ID NO: 223579 - RNA, 64 nt, Homo Sapiens; identical to SEQ ID NO: 148072

SEQ ID NO: 223580 - RNA, 64 nt, Homo Sapiens; identical to SEQ ID NO: 148073

SEQ ID NO: 223581 - RNA, 64 nt, Homo Sapiens; identical to SEQ ID NO: 148074

SEQ ID NO: 223582 - RNA, 64 nt, Homo Sapiens; identical to SEQ ID NO: 148075

SEQ ID NO: 223583 - RNA, 64 nt, Homo Sapiens; identical to SEQ ID NO: 148076

SEQ ID NO: 223584 - RNA, 64 nt, Homo Sapiens; identical to SEQ ID NO: 148077

SEQ ID NO: 223585 - RNA, 64 nt, Homo Sapiens; identical to SEQ ID NO: 148078

SEQ ID NO: 223586 - RNA, 64 nt, Homo Sapiens; identical to SEQ ID NO: 148079

SEQ ID NO: 223587 - RNA, 64 nt, Homo Sapiens; identical to SEQ ID NO: 148080

SEQ ID NO: 223588 - RNA, 64 nt, Homo Sapiens; identical to SEQ ID NO: 148081

SEQ ID NO: 223589 - RNA, 64 nt, Homo Sapiens; identical to SEQ ID NO: 148082

SEQ ID NO: 223590 - RNA, 64 nt, Homo Sapiens; identical to SEQ ID NO: 148083

SEQ ID NO: 223591 - RNA, 64 nt, Homo Sapiens; identical to SEQ ID NO: 148084

SEQ ID NO: 223592 - RNA, 64 nt, Homo Sapiens; identical to SEQ ID NO: 148085

SEQ ID NO: 223593 - RNA, 64 nt, Homo Sapiens; identical to SEQ ID NO: 148086

SEQ ID NO: 223594 - RNA, 64 nt, Homo Sapiens; identical to SEQ ID NO: 148087

SEQ ID NO: 223595 - RNA, 64 nt, Homo Sapiens; identical to SEQ ID NO: 148088

SEQ ID NO: 223596 - RNA, 64 nt, Homo Sapiens; identical to SEQ ID NO: 148089

SEQ ID NO: 223597 - RNA, 64 nt, Homo Sapiens; identical to SEQ ID NO: 148090

SEQ ID NO: 223598 - RNA, 64 nt, Homo Sapiens; identical to SEQ ID NO: 148091

SEQ ID NO: 223599 - RNA, 64 nt, Homo Sapiens; identical to SEQ ID NO: 148092

SEQ ID NO: 223600 - RNA, 64 nt, Homo Sapiens; identical to SEQ ID NO: 148093

SEQ ID NO: 223601 - RNA, 64 nt, Homo Sapiens; identical to SEQ ID NO: 148094

SEQ ID NO: 223602 - RNA, 64 nt, Homo Sapiens; identical to SEQ ID NO: 148095

SEQ ID NO: 223603 - RNA, 64 nt, Homo Sapiens; identical to SEQ ID NO: 148096

SEQ ID NO: 223604 - RNA, 64 nt, Homo Sapiens; identical to SEQ ID NO: 148097

SEQ ID NO: 223605 - RNA, 64 nt, Homo Sapiens; identical to SEQ ID NO: 148098

SEQ ID NO: 223606 - RNA, 64 nt, Homo Sapiens; identical to SEQ ID NO: 148099

SEQ ID NO: 223607 - RNA, 64 nt, Homo Sapiens; identical to SEQ ID NO: 148100

SEQ ID NO: 223608 - RNA, 64 nt, Homo Sapiens; identical to SEQ ID NO: 148101

SEQ ID NO: 223609 - RNA, 64 nt, Homo Sapiens; identical to SEQ ID NO: 148102

SEQ ID NO: 223610 - RNA, 64 nt, Homo Sapiens
cuuuagguuuuaggaggcuuggucacuagagauugggacuuaccgucaguuuaccucuguguau

SEQ ID NO: 223611 - RNA, 64 nt, Homo Sapiens
agugaacaagaguaauggugcugaaugcaauaaagggacuuaaguuuaaauaccuauauauucu

SEQ ID NO: 223612 - RNA, 57 nt, Homo Sapiens
ucaauguggaugagaacuaaucgcugaucgucagaucaaauaaaguuauaaaauugc

SEQ ID NO: 223613 - RNA, 64 nt, Homo Sapiens
ggugaugggugauggaggguucagagaggagugaucgucagaugugugaauggacgguuuaggu

SEQ ID NO: 223614 - RNA, 64 nt, Homo Sapiens
cuucugugggagccauugaggaaugaaaagcacuucgucagaaccacaggagaggaagaauuug

SEQ ID NO: 223615 - RNA, 64 nt, Homo Sapiens
agaccaacaugaagggguauugguuuucacuucuucgucagauaagcauucagcccagggaaug

SEQ ID NO: 223616 - RNA, 64 nt, Homo Sapiens
agcgagcaacacacgucuaacagccuagacaaucucgucagaugcucauacuggaccaucagcc

SEQ ID NO: 223617 - RNA, 64 nt, Homo Sapiens
aauguggaggcuccauauuaccuuuagaggaauuucgucagaaacuguuucacagcugccacca

SEQ ID NO: 223618 - RNA, 64 nt, Homo Sapiens
cagauuaucaaagcuaauuugacuaguuugaaccucgucagacauucauuccuuuggccauugc

SEQ ID NO: 223619 - RNA, 64 nt, Homo Sapiens
aaagggaacaggugccucagccaucccaacagugucgucagaggguccccagggcauuuucaug

SEQ ID NO: 223620 - RNA, 64 nt, Homo Sapiens
ugagaauaauaaaaacggagagaacacagauguaucgucagacaccagaaaagucacuggacaa

SEQ ID NO: 223621 - RNA, 64 nt, Homo Sapiens
acuuuggaguauuagaaaccauucugcguucccaucgucagacaggucuucccuccuuguuccg

SEQ ID NO: 223622 - RNA, 64 nt, Homo Sapiens
aaggcuuugaaaucuccccuugcacugagauuagucgucagaucucuccccgucucccucccaa

SEQ ID NO: 223623 - RNA, 64 nt, Homo Sapiens
uguugggguugaaaaaggagauaacaaacaugcuucgucagaggaucaugauccuugccuucau

SEQ ID NO: 223624 - RNA, 64 nt, Homo Sapiens
ggucuuguguuuugguuuugcccuguguuuacugucgucagaaagcggggaggaagccagcagc

SEQ ID NO: 223625 - RNA, 64 nt, Homo Sapiens
uauuuauauauuuuaaaaauaaacauuuuuuaaaucgucagaaggcaacauuuaccauguuccu

SEQ ID NO: 223626 - RNA, 64 nt, Homo Sapiens
aaaaggaggccuagaaagguaacucccuuguuuuucgucagaggcuuuaaaacuuauccagugc

SEQ ID NO: 223627 - RNA, 64 nt, Homo Sapiens
uaagucagggaaggagauggacggagcugggccaucgucagaaccuugcacucguuaaagaaac

SEQ ID NO: 223628 - RNA, 64 nt, Homo Sapiens
uggcagcaaagacauuuuuccuccuuuuuuccuuucgucagacuaaaaaacaaaaaaaaaaacc

SEQ ID NO: 223629 - RNA, 64 nt, Homo Sapiens
aacggcugugcaguaggcccagcgcugcugugucucgucagaggaauagcuuaccacgaacccc

SEQ ID NO: 223630 - RNA, 64 nt, Homo Sapiens
agguucggauacaaucaucuuuggggucaggaccucgucagaccgaggguacccaucuagcuac

SEQ ID NO: 223631 - RNA, 64 nt, Homo Sapiens
cuugugauuaacuguggcggucuguggcccugugucgucagaggccagauguugagugaccagc

SEQ ID NO: 223632 - RNA, 64 nt, Homo Sapiens
gguggggauaaaguagaguggaaauaauguagagucgucagacugaaaggccagguuguagucc

SEQ ID NO: 223633 - RNA, 64 nt, Homo Sapiens
ccagcagcuucacaaaugucugcugcaaggggaaucgucagaguccaaugugugccucuacagu

SEQ ID NO: 223634 - RNA, 64 nt, Homo Sapiens
ccagccuggcugcaggugcuuggcccaggcagggucgucagaggucugccagggauggucccug

SEQ ID NO: 223635 - RNA, 64 nt, Homo Sapiens
gcccguccugguaucacaguggucagucacuuagucgucagaucggccguagaugcuccccgcc

SEQ ID NO: 223636 - RNA, 64 nt, Homo Sapiens
uacaugaggggcgcagagaugcccugcaccccccucgucagaagcccaggcucugcucugcccu

SEQ ID NO: 223637 - RNA, 64 nt, Homo Sapiens
uaguaaaaucaucuuuuaguguaugcaguuggacucgucagagauaaucuuaucccuuuucucu

SEQ ID NO: 223638 - RNA, 64 nt, Homo Sapiens
aaccaugaggugguguccugagagaccagcucagucgucagagaugugugcugggacgcuguac

SEQ ID NO: 223639 - RNA, 64 nt, Homo Sapiens
uuuuuguagaaauaaaaauugaccuuagaauuuaucgucagauaaacuuguaaagauuugaaua

SEQ ID NO: 223640 - RNA, 64 nt, Homo Sapiens
uugauuauguacuuuaucuguauagcaggcuuugucgucagaaguuuuuauaucgauuuaaauu

SEQ ID NO: 223641 - RNA, 64 nt, Homo Sapiens
agggugaggaagacuaauuaacucaucugaaggaucgucagagggauggaggaagaagacccag

SEQ ID NO: 223642 - RNA, 63 nt, Homo Sapiens
uaugccaaauaucaagaugugaaggacuaauucaggaugcaaaaacguuauugggggguugua

SEQ ID NO: 223643 - RNA, 63 nt, Homo Sapiens
gggggguuguaaauaucaacuauucaacaguuuaggaugcaauuacgaguguaaacugugugc

SEQ ID NO: 223644 - RNA, 63 nt, Homo Sapiens
cuagucagggccuugggcaagacauugggcucuaggaugcaauuggcaaauacguccccguua

SEQ ID NO: 223645 - RNA, 63 nt, Homo Sapiens
uguaggaaagcaaauguagguaaggggagagcaaggaugcacagaaaacacacugacuguggg

SEQ ID NO: 223646 - RNA, 63 nt, Homo Sapiens
gcacagaaaacacacugacugugggacugugccaggaugcauuuggaaagauagagcauucug

SEQ ID NO: 223647 - RNA, 63 nt, Homo Sapiens
ccugggggaugacacucaguucugucacugucaaggaugcagagagcuggugguaggugggaa

SEQ ID NO: 223648 - RNA, 63 nt, Homo Sapiens
ccagugggauugaaaaccagcagaagccaagacaggaugcacagcugaauuggaggagaguag

SEQ ID NO: 223649 - RNA, 63 nt, Homo Sapiens
agaccuguuccacaucaugcucauuuuagugaaaggaugcaucccucaaucccauuuugauau

SEQ ID NO: 223650 - RNA, 63 nt, Homo Sapiens
aagaugaugcugagcgugaacugcuaggaagcaaggaugcaacaugaggaguuguugaaccca

SEQ ID NO: 223651 - RNA, 63 nt, Homo Sapiens
auagccaaguaaguuuuaaaaaccaaagcauccaggaugcacaccccugcaccauuugcugug

SEQ ID NO: 223652 - RNA, 63 nt, Homo Sapiens
gaugaauguuugacggggaagaggaaggguaggaggaugcauggaugaguggaugaguggauc

SEQ ID NO: 223653 - RNA, 63 nt, Homo Sapiens
aagugggaggaucaccugagcccagggaggucaaggaugcagugagccauggucucaccacug

SEQ ID NO: 223654 - RNA, 64 nt, Homo Sapiens
gggucucuaccauccccuguagagugggagcugagugggggaucacagccucugaaaaccaaug

SEQ ID NO: 223655 - RNA, 64 nt, Homo Sapiens
ucgcugugucagcauagaaguaacuuacuuaggugugggggaagcaccauaacuuuguuuagcc

SEQ ID NO: 223656 - RNA, 64 nt, Homo Sapiens
cagcaggcagaggagaguaccccccugagagcaugugggggaaggccuugcugucaugugaauc

SEQ ID NO: 223657 - RNA, 64 nt, Homo Sapiens
ugccaagccuggagccccuguguuggggggcaaggugggggagccuggagccccugugugggag

SEQ ID NO: 223658 - RNA, 64 nt, Homo Sapiens
ggugucgugcacuccuagaguaaaacaaggaguugugggggaaguccuaauggguuaaauccuu

SEQ ID NO: 223659 - RNA, 64 nt, Homo Sapiens
ggggaucuguguuuagccauccguguccccccuggugggggauucugcgacauuauagaaucgg

SEQ ID NO: 223660 - RNA, 64 nt, Homo Sapiens
aggguagggaaaucuccauagcagcugugccugugugggggaacagguagggauacccaugggg

SEQ ID NO: 223661 - RNA, 64 nt, Homo Sapiens
ggucugccgcugucccccacaccaaagcaucggggugggggaggcccucagaggugguguuugg

SEQ ID NO: 223662 - RNA, 64 nt, Homo Sapiens
aucugcuguuugaggacggggguuguuugcuggggugggggagcaaugcacaaguguaacuccu

SEQ ID NO: 223663 - RNA, 64 nt, Homo Sapiens
aagaaggaaacuccguugcaccuccucgacccuagugggggaucaaauggacaaagggcucugu

SEQ ID NO: 223664 - RNA, 64 nt, Homo Sapiens
agucuuuugucaucaaggagcuugggucuccccagugggggauaaccaagaggguuuuuagugg

SEQ ID NO: 223665 - RNA, 64 nt, Homo Sapiens
acacuagagaaccaaaaaugaagcuuugagcucugugggggaacgagaugaaaggcuuugcaga

SEQ ID NO: 223666 - RNA, 64 nt, Homo Sapiens
ccuucuccacccucucccuguugccggcuuagcugugggggaccggucccagugaagcuucccc

SEQ ID NO: 223667 - RNA, 64 nt, Homo Sapiens
agagccugguguaagugcgccugccagccaucaggugggggauuccccuugcguuggcucuuug

SEQ ID NO: 223668 - RNA, 64 nt, Homo Sapiens
auaggcugaaaaaaaaaagugcgcagcagccucugugggggagguuuaauucaauuuguaagua

SEQ ID NO: 223669 - RNA, 64 nt, Homo Sapiens
ugagacagaucuggaaagcccugcuuccugcuaagugggggaggagccaggcccaggguggcug

SEQ ID NO: 223670 - RNA, 64 nt, Homo Sapiens
acgggccuucuacaccacauacagcggcucaggagugggggagcaucccaugccugggggagag

SEQ ID NO: 223671 - RNA, 64 nt, Homo Sapiens
cgcagcaccccacugguucuuccugccuccuggagugggggaaaggcccagcacuuucaucaga

SEQ ID NO: 223672 - RNA, 64 nt, Homo Sapiens
cuaaaaggaauaucacgguuuuuugaaacacucagugggggacauuuuggugaagaugcaauau

SEQ ID NO: 223673 - RNA, 64 nt, Homo Sapiens
ccccaggggguacucuggagugagcagugccccugugggggagccuguaaaugcgggcucagug

SEQ ID NO: 223674 - RNA, 64 nt, Homo Sapiens
uucccauggaaucuagacagcauuuaucccucuggugggggaaucucacacugacuaacugaau

SEQ ID NO: 223675 - RNA, 64 nt, Homo Sapiens
aaaagauucauguguuucagccuagugggagagagugggggagaggaagagagagagagagcau

SEQ ID NO: 223676 - RNA, 64 nt, Homo Sapiens
agcacacgcggcgccccgccaggccuuagggcccgugggggacgcggccccgcgccgcggggag

SEQ ID NO: 223677 - RNA, 64 nt, Homo Sapiens
caggccucugagucacugaaugucaccaggagaggugggggagggaaagugggccaguggggag

SEQ ID NO: 223678 - RNA, 64 nt, Homo Sapiens
gggagagagcgaacacccacaagggggguugggggugggggagagucauggccccacauggggu

SEQ ID NO: 223679 - RNA, 57 nt, Homo Sapiens
ggaaacguggcucucccuuaaggcagcgugggggaaaggucuaauguaggcaaguag

SEQ ID NO: 223680 - RNA, 64 nt, Homo Sapiens
ucuccccaccccagcuucaagcagaggccucggggugggggagcuacaaagcacaacaauguac

SEQ ID NO: 223681 - RNA, 64 nt, Homo Sapiens
augugcagacagaucagggaggaaccuccaaugggugggggacagugagcuucggccuggccga

SEQ ID NO: 223682 - RNA, 64 nt, Homo Sapiens
ccucucugucuccaccccaugggcccacacccaggugggggaggaggaagccacugcaucuguu

SEQ ID NO: 223683 - RNA, 64 nt, Homo Sapiens
agggaagguggauucuaggaugucagaggcaggagugggggaucgaaguacuuagggagguugg

SEQ ID NO: 223684 - RNA, 64 nt, Homo Sapiens
ugaauguuuuuauguugacucucuuaaacuaagggugggggaucggcaucacccaagguuccuu

SEQ ID NO: 223685 - RNA, 64 nt, Homo Sapiens
cgcacagugugagcccgcccccagugggaagagugugggggaggagguguccugagcaccacac

SEQ ID NO: 223686 - RNA, 64 nt, Homo Sapiens
aucaggaggaagugagcagucuggacugcuuggggugggggacgaugaucucuucugguguuga

SEQ ID NO: 223687 - RNA, 64 nt, Homo Sapiens
ugguggauggaguugaccaagguuaaggaagccugugggggaccgggagcagaaagagcaagug

SEQ ID NO: 223688 - RNA, 64 nt, Homo Sapiens
aggccagcuuuaagacguaggcaucaguugccgugugggggagaagaggugggcuagguguaag

SEQ ID NO: 223689 - RNA, 64 nt, Homo Sapiens
ccccagagcccauggccugaucuuaaugggaccagugggggauaucgguggagccaggggcaaa

SEQ ID NO: 223690 - RNA, 64 nt, Homo Sapiens
ugcuccucacagagccccucgccacggccaugcugugggggaccaccauccucuuccaacccac

SEQ ID NO: 223691 - RNA, 64 nt, Homo Sapiens
guccguguugccuucuuuaacacacacucgugcagugggggaguucuggcuccccaaccuaacc

SEQ ID NO: 223692 - RNA, 64 nt, Homo Sapiens
cggggccugaaaccuuagcccccagccggccugagugggggauauugacacccccagcuaaagc

SEQ ID NO: 223693 - RNA, 64 nt, Homo Sapiens
gcuugcuccguccucggacaggaagccacccugcgugggggacugcaggcacgcaaaauaaaau

SEQ ID NO: 223694 - RNA, 64 nt, Homo Sapiens
aaucuugcguuuuucgucaucuuauuccaguucugugggggaugaguuuuuuuguggguugcuu

SEQ ID NO: 223695 - RNA, 64 nt, Homo Sapiens
ggacaagauggaggauguccacagaggcugaccugugggggaaaagaagugcucagguaagguu

SEQ ID NO: 223696 - RNA, 64 nt, Homo Sapiens
uuggccugaggcagggcgggaggcaugcaagccagugggggaaaaccccucugaagcugggcag

SEQ ID NO: 223697 - RNA, 63 nt, Homo Sapiens
cagaacaagaggcgcggggccacacccgugaaccaugcagacggccgaagaagucuuaggcag

SEQ ID NO: 223698 - RNA, 63 nt, Homo Sapiens
uggggaagucgagggccuguggcuuggauccgccaugcagagauguggccgggcacccaucuu

SEQ ID NO: 223699 - RNA, 63 nt, Homo Sapiens
auauguugucaugcaggguuugggccaagaaagcaugcagaaaaaaaugccaugugauuguaa

SEQ ID NO: 223700 - RNA, 63 nt, Homo Sapiens
ugauucucucacaggcuugggaaauccuguuagcaugcagaauaaugugguaacuuugucaau

SEQ ID NO: 223701 - RNA, 63 nt, Homo Sapiens
aggaagaaaacuuaggggcucucaguagagggucaugcagacaaagagaccccaaauagccug

SEQ ID NO: 223702 - RNA, 63 nt, Homo Sapiens
gaguucagugcuacucugcgcagccuccaggcccaugcagaaagccugccuagggacacuguc

SEQ ID NO: 223703 - RNA, 63 nt, Homo Sapiens
ugugcacagauaugcugucuggacacgcacacacaugcagauaugcugccuggacacacacuu

SEQ ID NO: 223704 - RNA, 63 nt, Homo Sapiens
cagauaugcuguccggauacacacgcacgcacacaugcagauaugcugccugggcacacacuu

SEQ ID NO: 223705 - RNA, 63 nt, Homo Sapiens
uaguaguagcugccaccacaucucuaggguagccaugcagaggagggcuucauauucccaaua

SEQ ID NO: 223706 - RNA, 63 nt, Homo Sapiens
gaauccaugcaagccccauaaaacaguuccuagcaugcagaaaaugcccacguaaauagcugu

SEQ ID NO: 223707 - RNA, 63 nt, Homo Sapiens
agggacauucugcuggcccacccugcgcgcugucaugcagaggccauucccccaggccugugu

SEQ ID NO: 223708 - RNA, 63 nt, Homo Sapiens
uguacaugcaccaaagcaugugugaccuacagacaugcagaacaugcacguguacacauacca

SEQ ID NO: 223709 - RNA, 63 nt, Homo Sapiens
acucuugcucacaaugggcauggaucagaagaccaugcagaaguuacuguaucucuugugacc

SEQ ID NO: 223710 - RNA, 63 nt, Homo Sapiens
accccuggagggguggaguuucuaccccugacucaugcagacaucuauuacauggaggcagua

SEQ ID NO: 223711 - RNA, 63 nt, Homo Sapiens
agaagacucuccgccccacgccaaucccaaaggcaugcagauggcugugcauguuggcuucuu

SEQ ID NO: 223712 - RNA, 63 nt, Homo Sapiens
uucaaaacuagaaggaucuacuccgcaugggugcaugcagaggcuccuggaucugggaagccc

SEQ ID NO: 223713 - RNA, 63 nt, Homo Sapiens
caaaacuggguucuggcucuucacauuuccuggcaugcagaccuggccacauuuggaggaagu

SEQ ID NO: 223714 - RNA, 63 nt, Homo Sapiens
guaucuuuuuuuaaauuucuugccccuucagaacaugcagaguaccacuaacuagguagugua

SEQ ID NO: 223715 - RNA, 64 nt, Homo Sapiens
aagauaccaacuucaacacuguaauaacauauacugugaaaacauuccuaaaaaguaaccaaag

SEQ ID NO: 223716 - RNA, 64 nt, Homo Sapiens
acaaaggauggucuuggccauaugcuagggccccugugaaaauaaguaguuuugagaaguuuuu

SEQ ID NO: 223717 - RNA, 64 nt, Homo Sapiens
uaaauaacuagaaauaacaugauuuagucauaauugugaaaaauaauaauaauuuuucuuggau

SEQ ID NO: 223718 - RNA, 64 nt, Homo Sapiens
aauaauaauuuuucuuggauuuauguucuguaucugugaaaaaauaaauuucuuauaaaacucg

SEQ ID NO: 223719 - RNA, 64 nt, Homo Sapiens
guauguaguggcuucuuuugugugaaaacauauuugugaaaagaggcuaguacuguauuggcuc

SEQ ID NO: 223720 - RNA, 64 nt, Homo Sapiens
uauuugugaaaagaguauguuacuguauuggcucugugaaaacauguacuggguuaauggcuag

SEQ ID NO: 223721 - RNA, 64 nt, Homo Sapiens
auuuuaugagguugucuaaagaaguugggggggaugugaaaauaaagaugaggauuaagagcaa

SEQ ID NO: 223722 - RNA, 64 nt, Homo Sapiens
uaacgcuuuuuggaagacaucauaguccccacucugugaaaacucacuauuugagcauggaaau

SEQ ID NO: 223723 - RNA, 64 nt, Homo Sapiens
acggcacugcccuuagccuucuuuucuaaggccaugugaaaaucagccuuaugaaugccccucg

SEQ ID NO: 223724 - RNA, 64 nt, Homo Sapiens
agcugcucuccuugucccaggaggagcaggaaugugugaaaaacgaacaugagcccagcugaga

SEQ ID NO: 223725 - RNA, 64 nt, Homo Sapiens
uaaauuacuugcagcauaguuauaugauugaugaugugaaaaccgcuggcuucuuuggacuccc

SEQ ID NO: 223726 - RNA, 64 nt, Homo Sapiens
auuuaguugccaguauauucgucuguauuuuuggugugaaaauuuaaggaaacacucauuuagu

SEQ ID NO: 223727 - RNA, 64 nt, Homo Sapiens
caagucuuugagugugcacuugaacuucuauacaugugaaaacaaggcuuuggaaacccccaga

SEQ ID NO: 223728 - RNA, 64 nt, Homo Sapiens
aaauuuucaauguuuuuuuguuaugcaaauccccugugaaaauagaacaaaaauaauguucuuu

SEQ ID NO: 223729 - RNA, 64 nt, Homo Sapiens
ucauggauuugggcaaacugagaaauuuuacaauugugaaaacccucuaauuuccaaaaaugua

SEQ ID NO: 223730 - RNA, 64 nt, Homo Sapiens
aaaaucacaaauaaaacaguucuagcccagcccuugugaaaaaauguguguguaaacuguaaag

SEQ ID NO: 223731 - RNA, 64 nt, Homo Sapiens
gcaaacuguaaugaaacuacauuguauuucuaagugugaaaacgacaggcugccccguuuuuac

SEQ ID NO: 223732 - RNA, 64 nt, Homo Sapiens
auuugggagauuguaaaaucuguaaaguuuguuuugugaaaauaaaauguucacaguagaauuu

SEQ ID NO: 223733 - RNA, 64 nt, Homo Sapiens
augccucauucaucuagagguaaucuggcagucuugugaaaaccgaacacaacucagaaacuug

SEQ ID NO: 223734 - RNA, 64 nt, Homo Sapiens
ccauuuuuugaaauagagaauauuuuauuauuuuugugaaaauagaguuuugguaaucacuuuc

SEQ ID NO: 223735 - RNA, 64 nt, Homo Sapiens
uuaugcccuauguaacagcaucccaaaaaagccuugugaaaauguugcuaaucauugacuguag

SEQ ID NO: 223736 - RNA, 64 nt, Homo Sapiens
agaaaauguaguuaauuacaguguuuuguauuacugugaaaauaaaccaguucugcaagugacu

SEQ ID NO: 223737 - RNA, 64 nt, Homo Sapiens
agcuuguauuuacacaaaccguuagggaaucuugugugaaaaucuacguucuaagaaaugcaua

SEQ ID NO: 223738 - RNA, 64 nt, Homo Sapiens
cuuuagguucauuaaaaaaaauguacucaucugcugugaaaagucuuauuccaguaacauuuuu

SEQ ID NO: 223739 - RNA, 64 nt, Homo Sapiens
uuaaauaagaaaaacauuccuagaagaugauaauugugaaaaccuccuuuggcuuauuugcuuu

SEQ ID NO: 223740 - RNA, 64 nt, Homo Sapiens
uuauauuuugcaagggucauucuagcugccauauugugaaaaacuuuaguggacaagggcagaa

SEQ ID NO: 223741 - RNA, 64 nt, Homo Sapiens
ggggagaaugguaguauuuuuuuuuuuuaucagcugugaaaaaaauguuacagaucugcacauu

SEQ ID NO: 223742 - RNA, 64 nt, Homo Sapiens
uauuuggggaaaguuugcuaauauacauuuugucugugaaaauauaguaaauuuuaaaauacua

SEQ ID NO: 223743 - RNA, 64 nt, Homo Sapiens
uggagauuugaaaauuugacgagaauauauaucuugugaaaauaugugcagaaagauuccaaag

SEQ ID NO: 223744 - RNA, 64 nt, Homo Sapiens
gcauuuauauuggacuaaucaaagauaaagggauugugaaaagaaaaaaaaaaaaagaaaagaa

SEQ ID NO: 223745 - RNA, 64 nt, Homo Sapiens
ggauacuauagacuacugagcauuuuaagaagcaugugaaaaugcaccguuugucuucuuaccu

SEQ ID NO: 223746 - RNA, 64 nt, Homo Sapiens
aagaccaagaaaaaacaaacagagaauuuuucccugugaaaaguacuucaaauuagccucauga

SEQ ID NO: 223747 - RNA, 64 nt, Homo Sapiens
acacacuuugaauaacugcaaaggauuuacgguuugugaaaaauguguacuguggaaaagauaa

SEQ ID NO: 223748 - RNA, 64 nt, Homo Sapiens
aagcuacaguaauuucuguauuacaucauuuauaugugaaaaguuggacauuucuguaaguuuu

SEQ ID NO: 223749 - RNA, 61 nt, Homo Sapiens
cagaggcuaccaaugucuaaggaagcuguggugugaaaauguauggaugaauucugaccag

SEQ ID NO: 223750 - RNA, 64 nt, Homo Sapiens
uuuaauuccuggaaaacuggcugggcagagccugugugaaaauacuggaauucaaagauaaggc

SEQ ID NO: 223751 - RNA, 64 nt, Homo Sapiens
uauaugaauccuuuuaaaauacaccugcucuuuaugugaaaauguuauuaucuuucugucuuuu

SEQ ID NO: 223752 - RNA, 64 nt, Homo Sapiens
aguaauaaaaccuuugaaagaacccuuaauauugugugaaaaaguaauuuaauuuuaagacuga

SEQ ID NO: 223753 - RNA, 64 nt, Homo Sapiens
gauuuagaagauauuuuggauguuuacauuaauaugugaaaaaaaauuaauguacuaaauccua

SEQ ID NO: 223754 - RNA, 64 nt, Homo Sapiens
ucucauuacaaugaaaccaaugaauccaagugacugugaaaaggucuuuaauauauuuacacaa

SEQ ID NO: 223755 - RNA, 64 nt, Homo Sapiens
aaaucaguuauagguuaauguagauaggauguuuugugaaaaagcaaucuauuguguccaaaua

SEQ ID NO: 223756 - RNA, 64 nt, Homo Sapiens
agaugaaaaacgauuaauguuucauuauuauuauugugaaaauauuauuaacacuggggacucc

SEQ ID NO: 223757 - RNA, 64 nt, Homo Sapiens
auaugaguugaaugcaauuuuuauuuuugguaacugugaaaaauaagauacuguggauauauac

SEQ ID NO: 223758 - RNA, 64 nt, Homo Sapiens
guacauuuuuaguuacuuaccuugaacauauucgugugaaaaagaauacaucauuucucacagu

SEQ ID NO: 223759 - RNA, 64 nt, Homo Sapiens
auuaugggauugcuaccuguauaaacaauggcacugugaaaauacuguuaguuuuaauacaaga

SEQ ID NO: 223760 - RNA, 64 nt, Homo Sapiens
ugaguuccucauuuguugguaaaaagaaaaagaaugugaaaaugucucuuuuuuucuuggcuau

SEQ ID NO: 223761 - RNA, 64 nt, Homo Sapiens
uuaauuuggggguuuucccuaauggcuuguaauuugugaaaacaccaggcauauggucuuuagu

SEQ ID NO: 223762 - RNA, 64 nt, Homo Sapiens
cauuauuuuuucaaagcaagaaaauguuuuaaaaugugaaaaaauccuuuugcaaaagcagacu

SEQ ID NO: 223763 - RNA, 64 nt, Homo Sapiens
uugagaaaauucguacuggagagaauccuacaaaugugaaaaauguggcaaauccuuuaacuga

SEQ ID NO: 223764 - RNA, 64 nt, Homo Sapiens
uaacauaaaucauacuggugaaaaauccuagaaaugugaaaaauaucacaaagccuuuaaaugg

SEQ ID NO: 223765 - RNA, 64 nt, Homo Sapiens
auauuggagaaaagcacuguaaauguaaugcauuugugaaaacauuuuuuaaaaaacuacagcu

SEQ ID NO: 223766 - RNA, 64 nt, Homo Sapiens
uaauuggucauaaauaauuggcaaaauaacaaauugugaaaauagaagccauugcucagcaccg

SEQ ID NO: 223767 - RNA, 64 nt, Homo Sapiens
auacuggagcuuuaagaacauacuuaguuucucaugugaaaacuuaggcuuugucugauguuuu

SEQ ID NO: 223768 - RNA, 64 nt, Homo Sapiens
ccauacuagagagaagcccuacaaauguaaagaaugugaaaagucuuucagucagagcucaagu

SEQ ID NO: 223769 - RNA, 64 nt, Homo Sapiens
ucacaugggaauaaaauuccauugcugcaaugaaugugaaaaagccaucagucaaagaaacuac

SEQ ID NO: 223770 - RNA, 64 nt, Homo Sapiens
auauuaaagugauuugcucuaaccguguuuuauuugugaaaaaaaaucuaaaauauacuauaac

SEQ ID NO: 223771 - RNA, 64 nt, Homo Sapiens
auuauuuuacuuuuggaagacuuggcugcuuuucugugaaaauuuguagcuguuauuuucagua

SEQ ID NO: 223772 - RNA, 64 nt, Homo Sapiens
acaacaaaauucuuaauguaacauacaucggauaugugaaaagcgaggaauguuuaauaugaaa

SEQ ID NO: 223773 - RNA, 64 nt, Homo Sapiens
auauugauauauauacuaguguaacugaaugguuugugaaaaauucuaaaagcauacacaaugu

SEQ ID NO: 223774 - RNA, 64 nt, Homo Sapiens
aaucacaucacgaaaauucugugccugucgucagugugaaaaugccuuugcugauaauuuaucc

SEQ ID NO: 223775 - RNA, 64 nt, Homo Sapiens
uucauuauaagguaacugauaaaaacaggaaauaugugaaaauauuuuuuauuagguggaugag

SEQ ID NO: 223776 - RNA, 64 nt, Homo Sapiens
acaugacacaguaguugcuuuaauuaaaagaaugugugaaaaguaaggguuaguggagaguuuu

SEQ ID NO: 223777 - RNA, 64 nt, Homo Sapiens
uauuuuuuaaaaauaucuuuaucgcuuguaccccugugaaaauacauaguggguauaaucaugg

SEQ ID NO: 223778 - RNA, 64 nt, Homo Sapiens
uuuucuuuucagaaauaguuuggccauuuguuggugugaaaauagcuuccauuugaccuaagau

SEQ ID NO: 223779 - RNA, 64 nt, Homo Sapiens
gagaaauucuaccuuuaccacauuggcaugaagcugugaaaaauuguggccaguaaaauuauac

SEQ ID NO: 223780 - RNA, 64 nt, Homo Sapiens
guuguguugugaaauguuuuaggauuuuuuguauugugaaaauaugaauaugauuggauucaga

SEQ ID NO: 223781 - RNA, 64 nt, Homo Sapiens
aauuaacuuucugaauuugaucugucuucagucuugugaaaaaguugaacaaauuuccuaauca

SEQ ID NO: 223782 - RNA, 64 nt, Homo Sapiens
ccugcuguaguagugaaagaaccaaugaaucuggugugaaaaacugauagacuuuugcauuggg

SEQ ID NO: 223783 - RNA, 64 nt, Homo Sapiens
auuguguuuugcugaacuugccuuuccucagugaugugaaaauauccaucucucucucucuuuc

SEQ ID NO: 223784 - RNA, 64 nt, Homo Sapiens
uugccuuguauuuaaaaggguguaauuuuccagcugugaaaauggugguaaaucaagauuuagu

SEQ ID NO: 223785 - RNA, 64 nt, Homo Sapiens
uauguuuucaguauuaugacuacacuucuuaaaaugugaaaaucaguauuauugagucuuuuca

SEQ ID NO: 223786 - RNA, 64 nt, Homo Sapiens
uuguggacagucccuaaaaguccaguucuacauuugugaaaauuguggugccaugaauuaagau

SEQ ID NO: 223787 - RNA, 64 nt, Homo Sapiens
uccuauuuauauuauuuuucaguccugugaaugcugugaaaagauuuauuccuuugaggccagg

SEQ ID NO: 223788 - RNA, 64 nt, Homo Sapiens
cauguacuucccuaggacuagaugcauaccguuuugugaaaaccagccauaggaaaacauguga

SEQ ID NO: 223789 - RNA, 64 nt, Homo Sapiens
uaugucuguguuucuuaggaauguugaagcuuuuugugaaaacuguacuguauacauauauaaa

SEQ ID NO: 223790 - RNA, 64 nt, Homo Sapiens
ucaaggcggcagcauaauuugaagggcaauugcgugugaaaauugaugugacuugauuuacaca

SEQ ID NO: 223791 - RNA, 64 nt, Homo Sapiens
acuucuugaaaauccaauaaaauuggcaaaagauugugaaaauucuggaagaauaagggaaaca

SEQ ID NO: 223792 - RNA, 64 nt, Homo Sapiens
aaagaagaaauuggcagauauuggaaaaauauuuugugaaaagcuguauuuauuauaaauacua

SEQ ID NO: 223793 - RNA, 64 nt, Homo Sapiens
uuuaaauucucaguuuaugucucagaugcuaacgugugaaaauauaaauauauauaauauauaa

SEQ ID NO: 223794 - RNA, 64 nt, Homo Sapiens
uucucauuugauauaauuuuucucuguuucacugugugaaaaaaagaagauauuucccauaaau

SEQ ID NO: 223795 - RNA, 64 nt, Homo Sapiens
gaugugaaggugaacauuccugauuuuugucugaugugaaaaagccuugguauuuuacauuuug

SEQ ID NO: 223796 - RNA, 64 nt, Homo Sapiens
ugguuuugguuuuguuuggguaaauuuuaaauggugugaaaaucgaugacaacaguccucuuac

SEQ ID NO: 223797 - RNA, 64 nt, Homo Sapiens
uaaggagauuuuuuuuuucacaguugaguuaguuugugaaaauaaagaacucuguagcucacca

SEQ ID NO: 223798 - RNA, 64 nt, Homo Sapiens
auuuuuguuaaaacaggauuuauguagaauggaaugugaaaauucauuuuggaaauguccucau

SEQ ID NO: 223799 - RNA, 64 nt, Homo Sapiens
uugaugcauuuugagauggaugauacgugucaugugugaaaaguugauaacugugaaauauuug

SEQ ID NO: 223800 - RNA, 64 nt, Homo Sapiens
aauccauacuagagaaacacuauagauguaaaaaugugaaaaguuuuauucaaaauaucaaacu

SEQ ID NO: 223801 - RNA, 64 nt, Homo Sapiens
ucuguugcugcuuuuccuuaauccgugguguucaugugaaaauauguguucuguuuuuuuuucu

SEQ ID NO: 223802 - RNA, 64 nt, Homo Sapiens
aauccauggugaaaaugaaaauuucaaaggaguuugugaaaaaauuuacauauaagucuguuua

SEQ ID NO: 223803 - RNA, 64 nt, Homo Sapiens
gccaucuuuaagcauauuuacuuuuuuguuuacuugugaaaaugcuuuguuucuuacaugugua

SEQ ID NO: 223804 - RNA, 64 nt, Homo Sapiens
uggucagguaguuauauguacagcagcaacuucaugugaaaauagaacuuugauguauaauaag

SEQ ID NO: 223805 - RNA, 64 nt, Homo Sapiens
uacacacugggagaugcugucuucagaacuuagaugugaaaauccuuccacgcuuagaucaugu

SEQ ID NO: 223806 - RNA, 64 nt, Homo Sapiens
cuuaaggguguguggauggcuaccgucagagugcugugaaaaaccauuugcaaaacacacauaa

SEQ ID NO: 223807 - RNA, 64 nt, Homo Sapiens
cauuucaaaaaauguuaugugacuaccuauagccugugaaaauauuguggccaucuuugcaaau

SEQ ID NO: 223808 - RNA, 64 nt, Homo Sapiens
auaaaauacauuuuuugcaugaaggcaauauacaugugaaaaccgauuucaaggacuacuaaag

SEQ ID NO: 223809 - RNA, 64 nt, Homo Sapiens
ugaguaaaacuauuugcaacaaaguguuuuugagugugaaaaguguuuuuagcuuuuaaaauuu

SEQ ID NO: 223810 - RNA, 64 nt, Homo Sapiens
uauccauuuaucuucagguuaguaugccuugccuugugaaaauuauuaagauuuaaaaacgaaa

SEQ ID NO: 223811 - RNA, 64 nt, Homo Sapiens
aaaagaaacaaagucuccaagaaauaugggacuaugugaaaagaccaaaucuaccucugauugg

SEQ ID NO: 223812 - RNA, 64 nt, Homo Sapiens
agaauuuuagaccaauauccuugaugaacauugaugugaaaauccucaauaaaauacuggcaaa

SEQ ID NO: 223813 - RNA, 64 nt, Homo Sapiens
aaaaaaaauuuauacuguacaaaaaccccacaagugugaaaaacauggcaaagccuuuaagaag

SEQ ID NO: 223814 - RNA, 64 nt, Homo Sapiens
uuauacuugagauaaauuauacaaauauaaagacugugaaaaagccaucauuaucugcucacau

SEQ ID NO: 223815 - RNA, 64 nt, Homo Sapiens
uaagauaauuuauacuggagagaagcccuacaaaugugaaaaauguggcaaaccuuuuaaccaa

SEQ ID NO: 223816 - RNA, 64 nt, Homo Sapiens
uuagauaauucaugcuggagagaaacccuacaaaugugaaaaauguggcaaagcuuuuaaccaa

SEQ ID NO: 223817 - RNA, 64 nt, Homo Sapiens
uaagaaaauucauacuggagagaaacccuaugauugugaaaaauauggcaaaggcuuuaacuag

SEQ ID NO: 223818 - RNA, 64 nt, Homo Sapiens
auuuauauuugagaaaaauuguagaaauauagacugugaaaaagacgucaauaucugcucacau

SEQ ID NO: 223819 - RNA, 64 nt, Homo Sapiens
gaacaguuauacaaacgagggcuugaaaacauuuugugaaaacuugcuuaguccugcaacguuc

SEQ ID NO: 223820 - RNA, 64 nt, Homo Sapiens
gaaggaaugucauuuuuaaucuuuuuaaagagugugugaaaauucacuuuaacuggaauuuuaa

SEQ ID NO: 223821 - RNA, 64 nt, Homo Sapiens
uucccuuaagcgugcacuuucuuucaucagacacugugaaaacacaauggggcugccucuuuuc

SEQ ID NO: 223822 - RNA, 64 nt, Homo Sapiens
cauugggagaagcagucuggcaauggcaaagaaaugugaaaaggggcaaagggauccauaugug

SEQ ID NO: 223823 - RNA, 64 nt, Homo Sapiens
aacuuucuuuuggaggguguuuuuccaaaguguaugugaaaagaaacaagauaagauuugauua

SEQ ID NO: 223824 - RNA, 64 nt, Homo Sapiens
aaugauuuugccuccuggauaucagaaaaauccaugugaaaauguaguaaaccuuuaaaacuca

SEQ ID NO: 223825 - RNA, 64 nt, Homo Sapiens
gucagcuacugggaauauuuuuguagagcugcauugugaaaaaaagauggucuuaccugaaucu

SEQ ID NO: 223826 - RNA, 64 nt, Homo Sapiens
acacgcagcgcguuggugucuccguguuugucccugugaaaacauguaacgucugccuuagagc

SEQ ID NO: 223827 - RNA, 64 nt, Homo Sapiens
cuggucuucauugugaaacgugccagucgugcuuugugaaaaauaacaaaguggucacagaaau

SEQ ID NO: 223828 - RNA, 64 nt, Homo Sapiens
uugaauuagcuuucauaugaaauagugugacuuuugugaaaauuguaauuuacuacacuuauaa

SEQ ID NO: 223829 - RNA, 64 nt, Homo Sapiens
uaauuuuaaggaaaucuuacaggauaauuguaauugugaaaaaaaaugccacuauuguggaaau

SEQ ID NO: 223830 - RNA, 64 nt, Homo Sapiens
gcuuuauuuagcuguauguggcacuguaaugaaaugugaaaaauacuuuuccucacuuuguugu

SEQ ID NO: 223831 - RNA, 64 nt, Homo Sapiens
aucagguguuaauauaauacuuuuagaaaauaagugugaaaagauugucacugcaauaaguggg

SEQ ID NO: 223832 - RNA, 64 nt, Homo Sapiens
auucucuguucugagaucucggauagggauuucagcaacuaaacgcaugagaaauaugauauuu

SEQ ID NO: 223833 - RNA, 64 nt, Homo Sapiens
ucaugcugcaaacuuguguuuagggaauaaguuugcaacuaaucauggaaggaaguauuaauaa

SEQ ID NO: 223834 - RNA, 64 nt, Homo Sapiens
uagaaaucagaauaaguaaaaggaacguucacucacaggguacgcucauggagagagggcgcag

SEQ ID NO: 223835 - RNA, 64 nt, Homo Sapiens
ugcaauucgauccucaaucaguggguggaggauaacaggguagauucacuugugugcacuugua

SEQ ID NO: 223836 - RNA, 64 nt, Homo Sapiens
gcugucaagaggcaggggcuguggccaggaccucacaggguaugcaaguccuucccauacucaa

SEQ ID NO: 223837 - RNA, 64 nt, Homo Sapiens
ccuuccccucugccccaguggucaugcagaggugacaggguaucgacagagggcacagucccau

SEQ ID NO: 223838 - RNA, 64 nt, Homo Sapiens
uucauuuuuaaguuguguuggcaacuuuagggaauggaaguaagggauucuguucauucaacau

SEQ ID NO: 223839 - RNA, 64 nt, Homo Sapiens
uacaacucaaggauuuugguugguuuaagagcauuggaaguaguuguaaaacugguaggagcua

SEQ ID NO: 223840 - RNA, 64 nt, Homo Sapiens
auguaaauccacaggguagauuucuuucuagauguggaaguacaagaaaaucuuuuuuaguuau

SEQ ID NO: 223841 - RNA, 64 nt, Homo Sapiens
acucacuuuggucaaaugauuauuguguugucacuggaaguacugucaaagacuuugggggucu

SEQ ID NO: 223842 - RNA, 64 nt, Homo Sapiens
aaaaugccaucucuuuuuaguugaaggaaaacucuggaaguaggugccauuggucauucugcag

SEQ ID NO: 223843 - RNA, 64 nt, Homo Sapiens
aggaaauauaauuugagaauacuuuaaagggaaguggaaguauaagugaaugauauuuuucuuu

SEQ ID NO: 223844 - RNA, 64 nt, Homo Sapiens
aaaagacuauuuuauacuugagaaaauguaaguuuggaaguacuaaguuucauuguacauucaa

SEQ ID NO: 223845 - RNA, 64 nt, Homo Sapiens
aucagggcugauauucaccuauguaucucaucauuggaaguaaggcuacuacauaagccaaaac

SEQ ID NO: 223846 - RNA, 64 nt, Homo Sapiens
agaaaagcaaccacagccagccuuagggaaaacuuggaaguaagugaaauuugucuucagaaua

SEQ ID NO: 223847 - RNA, 64 nt, Homo Sapiens
gagcagguguugcagacaggagggccacagcguguggaaguaaagacuuuggagcuagagaagc

SEQ ID NO: 223848 - RNA, 64 nt, Homo Sapiens
cauuuagcuuuggaaguuuucuuugccuuaguuuuggaaguaaauucuaguuuguaguucucau

SEQ ID NO: 223849 - RNA, 64 nt, Homo Sapiens
auuuuggcccuucaauuuggaggagggcaaaaguuggaaguaagaaguuuuauuuuaaguacuu

SEQ ID NO: 223850 - RNA, 64 nt, Homo Sapiens
gaaaacucccauuaacauaauaaugauuggcuccuggaaguauauguuuuuauuagccaaauuc

SEQ ID NO: 223851 - RNA, 64 nt, Homo Sapiens
cauaacucuuuaccaguagucgauauuaauauuuuggaaguaauaaacucuguuuucuuuggca

SEQ ID NO: 223852 - RNA, 64 nt, Homo Sapiens
ucuucugcacccacuucuaaauuuaauguuuuucuggaaguaguaauugcaagaguucgaauag

SEQ ID NO: 223853 - RNA, 64 nt, Homo Sapiens
ugaggucuauuuuauguuuuugcugcuacuucuguggaaguagcuuugaacuaguuuuacuuug

SEQ ID NO: 223854 - RNA, 64 nt, Homo Sapiens
uguaagcauccugaaauaaaaaacaaagucuuccuggaaguaauuuuugcaaccugaggucuau

SEQ ID NO: 223855 - RNA, 64 nt, Homo Sapiens
gaaacauguaaugauaggcgcauaacagaugggcuggaaguaagcuggcuuagcaaggagccaa

SEQ ID NO: 223856 - RNA, 61 nt, Homo Sapiens
gaaauauuuuuaagcuccucugaugcagcagcaaugcaaauuaugacauagugaauauaga

SEQ ID NO: 223857 - RNA, 61 nt, Homo Sapiens
agccucaacaauccaaaucuacaaacuuuaacaaugcaagucuuacucuaauuuuuaagua

SEQ ID NO: 223858 - RNA, 61 nt, Homo Sapiens
gccaagaaaguauaagggucuuuaauugcaacaaugcaaaagcagccuuuuuuuuuuuuuu

SEQ ID NO: 223859 - RNA, 61 nt, Homo Sapiens
aaaacaaaauuccauuacaggcaaugcaauucaaugcaaugcuguacugauacuauucaau

SEQ ID NO: 223860 - RNA, 61 nt, Homo Sapiens
caaugcaaugaaaacaaaauacuauucaaugcaaugcaauuaaacuggauacuguacugau

SEQ ID NO: 223861 - RNA, 61 nt, Homo Sapiens
caauucaaugcaaugaaaaccugauacuauucaaugcaauggaaguaaacuggauacugua

SEQ ID NO: 223862 - RNA, 61 nt, Homo Sapiens
uuguuaugcaugaaaccagugguagaagaaacaaugcaagacauacauuuccacuaugguc

SEQ ID NO: 223863 - RNA, 61 nt, Homo Sapiens
gguuucaggaauuucaaaagaaaucugacgucaaugcaauuauccauuauuuaaaagcuau

SEQ ID NO: 223864 - RNA, 61 nt, Homo Sapiens
aacugcuguaaacacaggggacacagcuuaacaaugcaacuuuuaauuacuguuuucuuuu

SEQ ID NO: 223865 - RNA, 61 nt, Homo Sapiens
cuaguacuuauuacaugcugcuauacacaagcaaugcaagaaaaaaacuuacuggguaggu

SEQ ID NO: 223866 - RNA, 61 nt, Homo Sapiens
aucuuauuucucaucuuuaaacucaacuuuacaaugcaaacgugugcauuuauuagcuauu

SEQ ID NO: 223867 - RNA, 61 nt, Homo Sapiens
gggucuugcuggcuaaaauggugaacgacugcaaugcaagcaaauugugccagcgagcacc

SEQ ID NO: 223868 - RNA, 64 nt, Homo Sapiens
uauguauauguuuucucuguccuaauuuaaaaguacauugcaaacaucaugaaacuugaucccu

SEQ ID NO: 223869 - RNA, 64 nt, Homo Sapiens
cugguuuuggaaucagcauccagucacggugcacacauugcauuuucuaacuauguuuuuaaaa

SEQ ID NO: 223870 - RNA, 64 nt, Homo Sapiens
ugggcauagcaguuuuugacugaaaacacauccuacauugcauaaaauauguagcugugguucu

SEQ ID NO: 223871 - RNA, 64 nt, Homo Sapiens
uaaucgagaugcguccuauuugcccacguguuaaacauugcauucgucaggguagcauguauaa

SEQ ID NO: 223872 - RNA, 64 nt, Homo Sapiens
agaaggguaagugcuugcuguucccaucccugaaacauugcauguauuuaagaaaaacaaaaug

SEQ ID NO: 223873 - RNA, 64 nt, Homo Sapiens
auuuauucaucugcaauuuggcuucccuaacuuaacauugcaucaugaaacucuuuggaacaac

SEQ ID NO: 223874 - RNA, 64 nt, Homo Sapiens
uguugauuacuacuuuaagugauauucauuuaaaacauugcaaauuuauuuuauuuauuuaauu

SEQ ID NO: 223875 - RNA, 64 nt, Homo Sapiens
ggauuacaggcuugagccaccacgcccggcuaaaacauugcaaauuuaaaugagaguuuuaaaa

SEQ ID NO: 223876 - RNA, 64 nt, Homo Sapiens; identical to SEQ ID NO: 45363

SEQ ID NO: 223877 - RNA, 64 nt, Homo Sapiens; identical to SEQ ID NO: 45364

SEQ ID NO: 223878 - RNA, 64 nt, Homo Sapiens; identical to SEQ ID NO: 45365

SEQ ID NO: 223879 - RNA, 64 nt, Homo Sapiens; identical to SEQ ID NO: 45366

SEQ ID NO: 223880 - RNA, 64 nt, Homo Sapiens; identical to SEQ ID NO: 45367

SEQ ID NO: 223881 - RNA, 64 nt, Homo Sapiens; identical to SEQ ID NO: 45368

SEQ ID NO: 223882 - RNA, 64 nt, Homo Sapiens; identical to SEQ ID NO: 45369

SEQ ID NO: 223883 - RNA, 64 nt, Homo Sapiens; identical to SEQ ID NO: 45370

SEQ ID NO: 223884 - RNA, 64 nt, Homo Sapiens; identical to SEQ ID NO: 45371

SEQ ID NO: 223885 - RNA, 64 nt, Homo Sapiens; identical to SEQ ID NO: 45372

SEQ ID NO: 223886 - RNA, 64 nt, Homo Sapiens; identical to SEQ ID NO: 45373

SEQ ID NO: 223887 - RNA, 64 nt, Homo Sapiens; identical to SEQ ID NO: 45374

SEQ ID NO: 223888 - RNA, 64 nt, Homo Sapiens; identical to SEQ ID NO: 45375

SEQ ID NO: 223889 - RNA, 64 nt, Homo Sapiens; identical to SEQ ID NO: 45376

SEQ ID NO: 223890 - RNA, 64 nt, Homo Sapiens; identical to SEQ ID NO: 45377

SEQ ID NO: 223891 - RNA, 64 nt, Homo Sapiens; identical to SEQ ID NO: 45378

SEQ ID NO: 223892 - RNA, 64 nt, Homo Sapiens; identical to SEQ ID NO: 45379

SEQ ID NO: 223893 - RNA, 64 nt, Homo Sapiens; identical to SEQ ID NO: 45380

SEQ ID NO: 223894 - RNA, 64 nt, Homo Sapiens; identical to SEQ ID NO: 45381

SEQ ID NO: 223895 - RNA, 64 nt, Homo Sapiens; identical to SEQ ID NO: 45382

SEQ ID NO: 223896 - RNA, 64 nt, Homo Sapiens; identical to SEQ ID NO: 45383

SEQ ID NO: 223897 - RNA, 64 nt, Homo Sapiens; identical to SEQ ID NO: 45384

SEQ ID NO: 223898 - RNA, 64 nt, Homo Sapiens; identical to SEQ ID NO: 45385

SEQ ID NO: 223899 - RNA, 64 nt, Homo Sapiens; identical to SEQ ID NO: 45386

SEQ ID NO: 223900 - RNA, 64 nt, Homo Sapiens; identical to SEQ ID NO: 45387

SEQ ID NO: 223901 - RNA, 64 nt, Homo Sapiens; identical to SEQ ID NO: 45388

SEQ ID NO: 223902 - RNA, 64 nt, Homo Sapiens; identical to SEQ ID NO: 45389

SEQ ID NO: 223903 - RNA, 64 nt, Homo Sapiens; identical to SEQ ID NO: 45390

SEQ ID NO: 223904 - RNA, 64 nt, Homo Sapiens; identical to SEQ ID NO: 45391

SEQ ID NO: 223905 - RNA, 64 nt, Homo Sapiens; identical to SEQ ID NO: 45392

SEQ ID NO: 223906 - RNA, 64 nt, Homo Sapiens; identical to SEQ ID NO: 45393

SEQ ID NO: 223907 - RNA, 64 nt, Homo Sapiens; identical to SEQ ID NO: 45394

SEQ ID NO: 223908 - RNA, 64 nt, Homo Sapiens; identical to SEQ ID NO: 45395

SEQ ID NO: 223909 - RNA, 64 nt, Homo Sapiens; identical to SEQ ID NO: 45396

SEQ ID NO: 223910 - RNA, 64 nt, Homo Sapiens; identical to SEQ ID NO: 45397

SEQ ID NO: 223911 - RNA, 64 nt, Homo Sapiens; identical to SEQ ID NO: 45398

SEQ ID NO: 223912 - RNA, 58 nt, Homo Sapiens
aggcacugccccaggacaacacaacaaggacagucacaacaaggacaacaaggacaca

SEQ ID NO: 223913 - RNA, 58 nt, Homo Sapiens
acaaggacacaacacaacacacaacaaggacagucacaacaagccuagagccagaaag

SEQ ID NO: 223914 - RNA, 58 nt, Homo Sapiens
ggaaggaaggagccugugucccugggacgacagucaacuggagcuagguguugaccuc

SEQ ID NO: 223915 - RNA, 58 nt, Homo Sapiens
ucuaggugcuguuuucaaaaccccagaugacagucauagaaaauuuggaacuuaggaa

SEQ ID NO: 223916 - RNA, 58 nt, Homo Sapiens
aucagauaggccccaaaccuacuuccgggacagucauuaacugucucaaaaaagagag

SEQ ID NO: 223917 - RNA, 58 nt, Homo Sapiens
aguggggacacuuucagcuucaaggcaggacagucaagcacagauugcaggguucuga

SEQ ID NO: 223918 - RNA, 58 nt, Homo Sapiens
ggugcugagcccugcccugggccccacggacagucagccugccggccucccugcagcu

SEQ ID NO: 223919 - RNA, 58 nt, Homo Sapiens
caugugcaaaagcuccccguccagcuuugacagucaguuuugaugucagcuccucggc

SEQ ID NO: 223920 - RNA, 64 nt, Homo Sapiens; identical to SEQ ID NO: 70908

SEQ ID NO: 223921 - RNA, 64 nt, Homo Sapiens; identical to SEQ ID NO: 70909

SEQ ID NO: 223922 - RNA, 63 nt, Homo Sapiens; identical to SEQ ID NO: 70910

SEQ ID NO: 223923 - RNA, 64 nt, Homo Sapiens; identical to SEQ ID NO: 70911

SEQ ID NO: 223924 - RNA, 64 nt, Homo Sapiens; identical to SEQ ID NO: 70912

SEQ ID NO: 223925 - RNA, 64 nt, Homo Sapiens; identical to SEQ ID NO: 70913

SEQ ID NO: 223926 - RNA, 64 nt, Homo Sapiens; identical to SEQ ID NO: 70914

SEQ ID NO: 223927 - RNA, 64 nt, Homo Sapiens; identical to SEQ ID NO: 70915

SEQ ID NO: 223928 - RNA, 63 nt, Homo Sapiens; identical to SEQ ID NO: 70916

SEQ ID NO: 223929 - RNA, 64 nt, Homo Sapiens; identical to SEQ ID NO: 70917

SEQ ID NO: 223930 - RNA, 64 nt, Homo Sapiens; identical to SEQ ID NO: 70918

SEQ ID NO: 223931 - RNA, 64 nt, Homo Sapiens; identical to SEQ ID NO: 70919

SEQ ID NO: 223932 - RNA, 64 nt, Homo Sapiens; identical to SEQ ID NO: 70920

SEQ ID NO: 223933 - RNA, 64 nt, Homo Sapiens; identical to SEQ ID NO: 70921

SEQ ID NO: 223934 - RNA, 64 nt, Homo Sapiens; identical to SEQ ID NO: 70922

SEQ ID NO: 223935 - RNA, 64 nt, Homo Sapiens; identical to SEQ ID NO: 70923

SEQ ID NO: 223936 - RNA, 64 nt, Homo Sapiens; identical to SEQ ID NO: 70924

SEQ ID NO: 223937 - RNA, 64 nt, Homo Sapiens; identical to SEQ ID NO: 70925

SEQ ID NO: 223938 - RNA, 64 nt, Homo Sapiens; identical to SEQ ID NO: 70926

SEQ ID NO: 223939 - RNA, 64 nt, Homo Sapiens; identical to SEQ ID NO: 70927

SEQ ID NO: 223940 - RNA, 64 nt, Homo Sapiens; identical to SEQ ID NO: 70928

SEQ ID NO: 223941 - RNA, 64 nt, Homo Sapiens; identical to SEQ ID NO: 70929

SEQ ID NO: 223942 - RNA, 64 nt, Homo Sapiens; identical to SEQ ID NO: 70930

SEQ ID NO: 223943 - RNA, 64 nt, Homo Sapiens; identical to SEQ ID NO: 70931

SEQ ID NO: 223944 - RNA, 64 nt, Homo Sapiens; identical to SEQ ID NO: 70932

SEQ ID NO: 223945 - RNA, 64 nt, Homo Sapiens; identical to SEQ ID NO: 70933

SEQ ID NO: 223946 - RNA, 64 nt, Homo Sapiens; identical to SEQ ID NO: 70934

SEQ ID NO: 223947 - RNA, 64 nt, Homo Sapiens; identical to SEQ ID NO: 70935

SEQ ID NO: 223948 - RNA, 64 nt, Homo Sapiens; identical to SEQ ID NO: 70936

SEQ ID NO: 223949 - RNA, 64 nt, Homo Sapiens; identical to SEQ ID NO: 70937

SEQ ID NO: 223950 - RNA, 64 nt, Homo Sapiens; identical to SEQ ID NO: 70938

SEQ ID NO: 223951 - RNA, 64 nt, Homo Sapiens; identical to SEQ ID NO: 70939

SEQ ID NO: 223952 - RNA, 64 nt, Homo Sapiens; identical to SEQ ID NO: 70940

SEQ ID NO: 223953 - RNA, 64 nt, Homo Sapiens; identical to SEQ ID NO: 70941

SEQ ID NO: 223954 - RNA, 64 nt, Homo Sapiens; identical to SEQ ID NO: 70942

SEQ ID NO: 223955 - RNA, 64 nt, Homo Sapiens; identical to SEQ ID NO: 70943

SEQ ID NO: 223956 - RNA, 64 nt, Homo Sapiens; identical to SEQ ID NO: 70944

SEQ ID NO: 223957 - RNA, 64 nt, Homo Sapiens; identical to SEQ ID NO: 70945

SEQ ID NO: 223958 - RNA, 64 nt, Homo Sapiens; identical to SEQ ID NO: 70946

SEQ ID NO: 223959 - RNA, 64 nt, Homo Sapiens; identical to SEQ ID NO: 70947

SEQ ID NO: 223960 - RNA, 64 nt, Homo Sapiens; identical to SEQ ID NO: 70948

SEQ ID NO: 223961 - RNA, 64 nt, Homo Sapiens; identical to SEQ ID NO: 70949

SEQ ID NO: 223962 - RNA, 64 nt, Homo Sapiens; identical to SEQ ID NO: 70950

SEQ ID NO: 223963 - RNA, 64 nt, Homo Sapiens; identical to SEQ ID NO: 70951

SEQ ID NO: 223964 - RNA, 64 nt, Homo Sapiens; identical to SEQ ID NO: 70952

SEQ ID NO: 223965 - RNA, 64 nt, Homo Sapiens; identical to SEQ ID NO: 70953

SEQ ID NO: 223966 - RNA, 64 nt, Homo Sapiens; identical to SEQ ID NO: 70954

SEQ ID NO: 223967 - RNA, 64 nt, Homo Sapiens; identical to SEQ ID NO: 70955

SEQ ID NO: 223968 - RNA, 64 nt, Homo Sapiens; identical to SEQ ID NO: 70956

SEQ ID NO: 223969 - RNA, 64 nt, Homo Sapiens; identical to SEQ ID NO: 70957

SEQ ID NO: 223970 - RNA, 64 nt, Homo Sapiens; identical to SEQ ID NO: 70958

SEQ ID NO: 223971 - RNA, 64 nt, Homo Sapiens; identical to SEQ ID NO: 70959

SEQ ID NO: 223972 - RNA, 64 nt, Homo Sapiens; identical to SEQ ID NO: 70960

SEQ ID NO: 223973 - RNA, 64 nt, Homo Sapiens; identical to SEQ ID NO: 70961

SEQ ID NO: 223974 - RNA, 64 nt, Homo Sapiens; identical to SEQ ID NO: 70962

SEQ ID NO: 223975 - RNA, 64 nt, Homo Sapiens; identical to SEQ ID NO: 70963

SEQ ID NO: 223976 - RNA, 64 nt, Homo Sapiens; identical to SEQ ID NO: 70964

SEQ ID NO: 223977 - RNA, 62 nt, Homo Sapiens; identical to SEQ ID NO: 70965

SEQ ID NO: 223978 - RNA, 64 nt, Homo Sapiens; identical to SEQ ID NO: 70966

SEQ ID NO: 223979 - RNA, 64 nt, Homo Sapiens; identical to SEQ ID NO: 70967

SEQ ID NO: 223980 - RNA, 64 nt, Homo Sapiens; identical to SEQ ID NO: 70968

SEQ ID NO: 223981 - RNA, 64 nt, Homo Sapiens; identical to SEQ ID NO: 70969

SEQ ID NO: 223982 - RNA, 64 nt, Homo Sapiens; identical to SEQ ID NO: 70970

SEQ ID NO: 223983 - RNA, 64 nt, Homo Sapiens; identical to SEQ ID NO: 70971

SEQ ID NO: 223984 - RNA, 64 nt, Homo Sapiens; identical to SEQ ID NO: 70972

SEQ ID NO: 223985 - RNA, 64 nt, Homo Sapiens; identical to SEQ ID NO: 70973

SEQ ID NO: 223986 - RNA, 64 nt, Homo Sapiens; identical to SEQ ID NO: 70974

SEQ ID NO: 223987 - RNA, 64 nt, Homo Sapiens; identical to SEQ ID NO: 70975

SEQ ID NO: 223988 - RNA, 64 nt, Homo Sapiens; identical to SEQ ID NO: 70976

SEQ ID NO: 223989 - RNA, 64 nt, Homo Sapiens; identical to SEQ ID NO: 70977

SEQ ID NO: 223990 - RNA, 64 nt, Homo Sapiens; identical to SEQ ID NO: 70978

SEQ ID NO: 223991 - RNA, 64 nt, Homo Sapiens; identical to SEQ ID NO: 70979

SEQ ID NO: 223992 - RNA, 64 nt, Homo Sapiens; identical to SEQ ID NO: 70980

SEQ ID NO: 223993 - RNA, 64 nt, Homo Sapiens; identical to SEQ ID NO: 70981

SEQ ID NO: 223994 - RNA, 64 nt, Homo Sapiens; identical to SEQ ID NO: 70982

SEQ ID NO: 223995 - RNA, 64 nt, Homo Sapiens; identical to SEQ ID NO: 70983

SEQ ID NO: 223996 - RNA, 64 nt, Homo Sapiens; identical to SEQ ID NO: 70984

SEQ ID NO: 223997 - RNA, 64 nt, Homo Sapiens; identical to SEQ ID NO: 70985

SEQ ID NO: 223998 - RNA, 64 nt, Homo Sapiens; identical to SEQ ID NO: 70986

SEQ ID NO: 223999 - RNA, 64 nt, Homo Sapiens; identical to SEQ ID NO: 70987

SEQ ID NO: 224000 - RNA, 64 nt, Homo Sapiens; identical to SEQ ID NO: 70988

SEQ ID NO: 224001 - RNA, 64 nt, Homo Sapiens; identical to SEQ ID NO: 70989

SEQ ID NO: 224002 - RNA, 64 nt, Homo Sapiens; identical to SEQ ID NO: 70990

SEQ ID NO: 224003 - RNA, 64 nt, Homo Sapiens; identical to SEQ ID NO: 70991

SEQ ID NO: 224004 - RNA, 64 nt, Homo Sapiens; identical to SEQ ID NO: 70992

SEQ ID NO: 224005 - RNA, 64 nt, Homo Sapiens; identical to SEQ ID NO: 70993

SEQ ID NO: 224006 - RNA, 64 nt, Homo Sapiens; identical to SEQ ID NO: 70994

SEQ ID NO: 224007 - RNA, 64 nt, Homo Sapiens; identical to SEQ ID NO: 70995

SEQ ID NO: 224008 - RNA, 64 nt, Homo Sapiens; identical to SEQ ID NO: 70996

SEQ ID NO: 224009 - RNA, 64 nt, Homo Sapiens; identical to SEQ ID NO: 70997

SEQ ID NO: 224010 - RNA, 64 nt, Homo Sapiens; identical to SEQ ID NO: 70998

SEQ ID NO: 224011 - RNA, 64 nt, Homo Sapiens; identical to SEQ ID NO: 70999

SEQ ID NO: 224012 - RNA, 64 nt, Homo Sapiens; identical to SEQ ID NO: 71000

SEQ ID NO: 224013 - RNA, 64 nt, Homo Sapiens; identical to SEQ ID NO: 71001

SEQ ID NO: 224014 - RNA, 64 nt, Homo Sapiens; identical to SEQ ID NO: 71002

SEQ ID NO: 224015 - RNA, 64 nt, Homo Sapiens; identical to SEQ ID NO: 71003

SEQ ID NO: 224016 - RNA, 64 nt, Homo Sapiens; identical to SEQ ID NO: 71004

SEQ ID NO: 224017 - RNA, 64 nt, Homo Sapiens; identical to SEQ ID NO: 71005

SEQ ID NO: 224018 - RNA, 64 nt, Homo Sapiens; identical to SEQ ID NO: 71006

SEQ ID NO: 224019 - RNA, 64 nt, Homo Sapiens; identical to SEQ ID NO: 71007

SEQ ID NO: 224020 - RNA, 64 nt, Homo Sapiens; identical to SEQ ID NO: 71008

SEQ ID NO: 224021 - RNA, 64 nt, Homo Sapiens; identical to SEQ ID NO: 71009

SEQ ID NO: 224022 - RNA, 64 nt, Homo Sapiens; identical to SEQ ID NO: 71010

SEQ ID NO: 224023 - RNA, 64 nt, Homo Sapiens; identical to SEQ ID NO: 71011

SEQ ID NO: 224024 - RNA, 64 nt, Homo Sapiens; identical to SEQ ID NO: 71012

SEQ ID NO: 224025 - RNA, 64 nt, Homo Sapiens; identical to SEQ ID NO: 71013

SEQ ID NO: 224026 - RNA, 64 nt, Homo Sapiens; identical to SEQ ID NO: 71014

SEQ ID NO: 224027 - RNA, 64 nt, Homo Sapiens; identical to SEQ ID NO: 71015

SEQ ID NO: 224028 - RNA, 64 nt, Homo Sapiens; identical to SEQ ID NO: 71016

SEQ ID NO: 224029 - RNA, 64 nt, Homo Sapiens; identical to SEQ ID NO: 71017

SEQ ID NO: 224030 - RNA, 64 nt, Homo Sapiens; identical to SEQ ID NO: 71018

SEQ ID NO: 224031 - RNA, 64 nt, Homo Sapiens; identical to SEQ ID NO: 71019

SEQ ID NO: 224032 - RNA, 64 nt, Homo Sapiens; identical to SEQ ID NO: 71020

SEQ ID NO: 224033 - RNA, 64 nt, Homo Sapiens; identical to SEQ ID NO: 71021

SEQ ID NO: 224034 - RNA, 64 nt, Homo Sapiens; identical to SEQ ID NO: 71022

SEQ ID NO: 224035 - RNA, 64 nt, Homo Sapiens; identical to SEQ ID NO: 71023

SEQ ID NO: 224036 - RNA, 64 nt, Homo Sapiens; identical to SEQ ID NO: 71024

SEQ ID NO: 224037 - RNA, 64 nt, Homo Sapiens; identical to SEQ ID NO: 71025

SEQ ID NO: 224038 - RNA, 64 nt, Homo Sapiens; identical to SEQ ID NO: 71026

SEQ ID NO: 224039 - RNA, 64 nt, Homo Sapiens; identical to SEQ ID NO: 71027

SEQ ID NO: 224040 - RNA, 64 nt, Homo Sapiens; identical to SEQ ID NO: 71028

SEQ ID NO: 224041 - RNA, 64 nt, Homo Sapiens; identical to SEQ ID NO: 71029

SEQ ID NO: 224042 - RNA, 64 nt, Homo Sapiens; identical to SEQ ID NO: 71030

SEQ ID NO: 224043 - RNA, 64 nt, Homo Sapiens; identical to SEQ ID NO: 71031

SEQ ID NO: 224044 - RNA, 64 nt, Homo Sapiens; identical to SEQ ID NO: 71032

SEQ ID NO: 224045 - RNA, 64 nt, Homo Sapiens; identical to SEQ ID NO: 71033

SEQ ID NO: 224046 - RNA, 64 nt, Homo Sapiens; identical to SEQ ID NO: 71034

SEQ ID NO: 224047 - RNA, 64 nt, Homo Sapiens; identical to SEQ ID NO: 71035

SEQ ID NO: 224048 - RNA, 64 nt, Homo Sapiens; identical to SEQ ID NO: 71036

SEQ ID NO: 224049 - RNA, 64 nt, Homo Sapiens; identical to SEQ ID NO: 71037

SEQ ID NO: 224050 - RNA, 64 nt, Homo Sapiens; identical to SEQ ID NO: 71038

SEQ ID NO: 224051 - RNA, 64 nt, Homo Sapiens; identical to SEQ ID NO: 71039

SEQ ID NO: 224052 - RNA, 64 nt, Homo Sapiens; identical to SEQ ID NO: 71040

SEQ ID NO: 224053 - RNA, 64 nt, Homo Sapiens; identical to SEQ ID NO: 71041

SEQ ID NO: 224054 - RNA, 64 nt, Homo Sapiens; identical to SEQ ID NO: 71042

SEQ ID NO: 224055 - RNA, 64 nt, Homo Sapiens; identical to SEQ ID NO: 71043

SEQ ID NO: 224056 - RNA, 64 nt, Homo Sapiens; identical to SEQ ID NO: 71044

SEQ ID NO: 224057 - RNA, 64 nt, Homo Sapiens; identical to SEQ ID NO: 71045

SEQ ID NO: 224058 - RNA, 64 nt, Homo Sapiens; identical to SEQ ID NO: 71046

SEQ ID NO: 224059 - RNA, 64 nt, Homo Sapiens; identical to SEQ ID NO: 71047

SEQ ID NO: 224060 - RNA, 64 nt, Homo Sapiens; identical to SEQ ID NO: 71048

SEQ ID NO: 224061 - RNA, 64 nt, Homo Sapiens; identical to SEQ ID NO: 71049

SEQ ID NO: 224062 - RNA, 64 nt, Homo Sapiens; identical to SEQ ID NO: 71050

SEQ ID NO: 224063 - RNA, 64 nt, Homo Sapiens; identical to SEQ ID NO: 71051

SEQ ID NO: 224064 - RNA, 64 nt, Homo Sapiens; identical to SEQ ID NO: 71052

SEQ ID NO: 224065 - RNA, 64 nt, Homo Sapiens; identical to SEQ ID NO: 71053

SEQ ID NO: 224066 - RNA, 64 nt, Homo Sapiens; identical to SEQ ID NO: 71054

SEQ ID NO: 224067 - RNA, 64 nt, Homo Sapiens; identical to SEQ ID NO: 71055

SEQ ID NO: 224068 - RNA, 50 nt, Homo Sapiens; identical to SEQ ID NO: 71056

SEQ ID NO: 224069 - RNA, 64 nt, Homo Sapiens; identical to SEQ ID NO: 71057

SEQ ID NO: 224070 - RNA, 64 nt, Homo Sapiens; identical to SEQ ID NO: 71058

SEQ ID NO: 224071 - RNA, 64 nt, Homo Sapiens; identical to SEQ ID NO: 71059

SEQ ID NO: 224072 - RNA, 64 nt, Homo Sapiens; identical to SEQ ID NO: 71060

SEQ ID NO: 224073 - RNA, 64 nt, Homo Sapiens; identical to SEQ ID NO: 71061

SEQ ID NO: 224074 - RNA, 64 nt, Homo Sapiens; identical to SEQ ID NO: 71062

SEQ ID NO: 224075 - RNA, 64 nt, Homo Sapiens; identical to SEQ ID NO: 71063

SEQ ID NO: 224076 - RNA, 64 nt, Homo Sapiens; identical to SEQ ID NO: 71064

SEQ ID NO: 224077 - RNA, 64 nt, Homo Sapiens; identical to SEQ ID NO: 71065

SEQ ID NO: 224078 - RNA, 64 nt, Homo Sapiens; identical to SEQ ID NO: 71066

SEQ ID NO: 224079 - RNA, 64 nt, Homo Sapiens; identical to SEQ ID NO: 71067

SEQ ID NO: 224080 - RNA, 64 nt, Homo Sapiens; identical to SEQ ID NO: 71068

SEQ ID NO: 224081 - RNA, 64 nt, Homo Sapiens; identical to SEQ ID NO: 71069

SEQ ID NO: 224082 - RNA, 64 nt, Homo Sapiens; identical to SEQ ID NO: 71070

SEQ ID NO: 224083 - RNA, 64 nt, Homo Sapiens; identical to SEQ ID NO: 71071

SEQ ID NO: 224084 - RNA, 64 nt, Homo Sapiens; identical to SEQ ID NO: 71072

SEQ ID NO: 224085 - RNA, 64 nt, Homo Sapiens; identical to SEQ ID NO: 71073

SEQ ID NO: 224086 - RNA, 64 nt, Homo Sapiens; identical to SEQ ID NO: 71074

SEQ ID NO: 224087 - RNA, 64 nt, Homo Sapiens; identical to SEQ ID NO: 71075

SEQ ID NO: 224088 - RNA, 64 nt, Homo Sapiens; identical to SEQ ID NO: 71076

SEQ ID NO: 224089 - RNA, 64 nt, Homo Sapiens; identical to SEQ ID NO: 71077

SEQ ID NO: 224090 - RNA, 64 nt, Homo Sapiens; identical to SEQ ID NO: 71078

SEQ ID NO: 224091 - RNA, 64 nt, Homo Sapiens; identical to SEQ ID NO: 71079

SEQ ID NO: 224092 - RNA, 64 nt, Homo Sapiens; identical to SEQ ID NO: 71080

SEQ ID NO: 224093 - RNA, 64 nt, Homo Sapiens; identical to SEQ ID NO: 71081

SEQ ID NO: 224094 - RNA, 64 nt, Homo Sapiens; identical to SEQ ID NO: 71082

SEQ ID NO: 224095 - RNA, 64 nt, Homo Sapiens; identical to SEQ ID NO: 71083

SEQ ID NO: 224096 - RNA, 64 nt, Homo Sapiens; identical to SEQ ID NO: 71084

SEQ ID NO: 224097 - RNA, 64 nt, Homo Sapiens; identical to SEQ ID NO: 71085

SEQ ID NO: 224098 - RNA, 64 nt, Homo Sapiens; identical to SEQ ID NO: 71086

SEQ ID NO: 224099 - RNA, 64 nt, Homo Sapiens; identical to SEQ ID NO: 71087

SEQ ID NO: 224100 - RNA, 64 nt, Homo Sapiens; identical to SEQ ID NO: 71088

SEQ ID NO: 224101 - RNA, 64 nt, Homo Sapiens; identical to SEQ ID NO: 71089

SEQ ID NO: 224102 - RNA, 64 nt, Homo Sapiens
aaucgagugauaauacaguuuuacugcaaaagaagcacuucaaaccuauuauguccuuagaacu

SEQ ID NO: 224103 - RNA, 64 nt, Homo Sapiens
cuccgaaugucaaaaacaaaugcgacaaacaauggcacuucaucauuuaaaguaauguugccaa

SEQ ID NO: 224104 - RNA, 64 nt, Homo Sapiens
ggccucguggccuagcacugguguugagcaaugugcacuucacuggagagaaagaacuggaauu

SEQ ID NO: 224105 - RNA, 64 nt, Homo Sapiens
ucccuuacuauucccacuuucauucaaucaaccugcacuucauaucuagauuucuagaaaagcu

SEQ ID NO: 224106 - RNA, 63 nt, Homo Sapiens
agccugggaaccuggucugauuccuuccaacgugcacuucagcuggagaaagaaaccaagaag

SEQ ID NO: 224107 - RNA, 64 nt, Homo Sapiens
gcggcucuucuuuuuaggaaggcucuggugcagagcacuucaaauauguccucaggccagauac

SEQ ID NO: 224108 - RNA, 64 nt, Homo Sapiens
cuauaggcucgguguguguacaucccccucuuuaaucuaugaaucgggcagucagcucuccauc

SEQ ID NO: 224109 - RNA, 64 nt, Homo Sapiens
ucucugcagggcaaggggacagacaaacccucugaucuaugaaggcucugcaggacagacagac

SEQ ID NO: 224110 - RNA, 64 nt, Homo Sapiens
gaucaagccccacgaugacugcacaguagagcaaaucuaugagauuuugaaaaucuaccaacuc

SEQ ID NO: 224111 - RNA, 64 nt, Homo Sapiens
caucaucuauggcacugauggacaggaggcccccaucuaugagcugacaucucaguucacuggu

SEQ ID NO: 224112 - RNA, 64 nt, Homo Sapiens
uggcauugccccaggucgucagcagugugguauuaucuaugagaacuugagcgacagaguauuu

SEQ ID NO: 224113 - RNA, 64 nt, Homo Sapiens
gcagguuuuauuuccauuauuuuauuuccacuauaucuaugauaagaugcaauuauaaggagag

SEQ ID NO: 224114 - RNA, 64 nt, Homo Sapiens
auugaaggaaauuuagaaaauuauuaccaauguaaucuaugauuuaagaaauguuuauguuucu

SEQ ID NO: 224115 - RNA, 64 nt, Homo Sapiens
uguuugauaaaugugaauaucccauaggugccacaucuaugagauaugaaggguuuuuugaaau

SEQ ID NO: 224116 - RNA, 64 nt, Homo Sapiens
gguuuuuugaaaucccauaguuugggaggcaaaaaucuaugaagucauggggcugcuguguggg

SEQ ID NO: 224117 - RNA, 64 nt, Homo Sapiens
ccacaucagcacaguaggacugccaagcuuggucaucuaugacgccacugucacaggaagaacc

SEQ ID NO: 224118 - RNA, 64 nt, Homo Sapiens
ccacaccagcacaguaggacugccaagcuuggucaucuaugacaccaccgucacaggaagcacu

SEQ ID NO: 224119 - RNA, 64 nt, Homo Sapiens
uauuauaugugcuccugaagcgagcacucuuuuuaucuaugauacuuccauaauaaucucuucu

SEQ ID NO: 224120 - RNA, 64 nt, Homo Sapiens
uauuacacgugcugcugaagggagcaugguuuuuaucuaugauacuuaguuaacauauauauua

SEQ ID NO: 224121 - RNA, 64 nt, Homo Sapiens
uaaacaaaagaaacauuuauaaacuaaagaaaaacuaaaagaaugacagaacaaucaucuuagc

SEQ ID NO: 224122 - RNA, 64 nt, Homo Sapiens
ggagaaauccucuuugugucucuacucuagaugccuaaaagaguuuauauacuucuaaaagcuc

SEQ ID NO: 224123 - RNA, 64 nt, Homo Sapiens
augugaaauauauauacauauauauauauauuuccuaaaagaagaaaagauaccuuucuguuca

SEQ ID NO: 224124 - RNA, 64 nt, Homo Sapiens
aauuugauaauuucauguaugaugugcauauaugcuaaaagaaugcagaaaaucauuuuaugaa

SEQ ID NO: 224125 - RNA, 64 nt, Homo Sapiens
uagaaagucauugaacugacaguguuugaugcaacuaaaagaggauuguaagacauagcuuucu

SEQ ID NO: 224126 - RNA, 64 nt, Homo Sapiens
auaauaagcaaauuauuggcuucuuucuucuagacuaaaagaaauuaaagagaugaaacaauca

SEQ ID NO: 224127 - RNA, 64 nt, Homo Sapiens
aagaagaaagagagaaagaaagaaacagaaaaaccuaaaagaaagcgaaugaauuugacaccug

SEQ ID NO: 224128 - RNA, 64 nt, Homo Sapiens
ccuuccaacuuccuauagggcccauuccugcccucuaaaagaaugggauccuuuuuacuuguag

SEQ ID NO: 224129 - RNA, 64 nt, Homo Sapiens
uguuggguuuuagaucucuuaaguaaccuuuuaacuaaaagauuuuauacuauauucuguuucc

SEQ ID NO: 224130 - RNA, 64 nt, Homo Sapiens
caguagucacuuuuguaagccagucucuucaugccuaaaagacacuaccagucaccuuugauuc

SEQ ID NO: 224131 - RNA, 64 nt, Homo Sapiens
gcuggguggacucuuagugguccugcagcguauccuaaaagacuaccuuugaaacaggauucuu

SEQ ID NO: 224132 - RNA, 64 nt, Homo Sapiens
cuugucuccccucauacacaaaaguacaauaugaagccuucauuuaaucucugcaguucaucuc

SEQ ID NO: 224133 - RNA, 64 nt, Homo Sapiens
ugguacucggggaccuccaaagacuaaacugacaagccuucaaggagcccagggguaaguuaac

SEQ ID NO: 224134 - RNA, 64 nt, Homo Sapiens
caauuuuguagauuaaaacaaaguuucucgaguuagccuucaugagaaauuuuagaaugauagg

SEQ ID NO: 224135 - RNA, 64 nt, Homo Sapiens
cauuaugacucuggugauaacaaccuacucugaaagccuucagaaaacagaaggagggaaaaac

SEQ ID NO: 224136 - RNA, 64 nt, Homo Sapiens
gacccuggacagugacgaggacggaaaagacaagagccuucaacgaauggauucaacacugugc

SEQ ID NO: 224137 - RNA, 64 nt, Homo Sapiens
guaagagucagcuuuuucuccuccucugcccuucagccuucaaagcugaaauacacgcuaguaa

SEQ ID NO: 224138 - RNA, 64 nt, Homo Sapiens
cuuuagauugauugccgagcggggcaguuuugugagccuucaucugaagccuucaguucacccc

SEQ ID NO: 224139 - RNA, 64 nt, Homo Sapiens
gccgagcggggcaguuuugugagccuucaucugaagccuucaguucaccccucugcacaggccu

SEQ ID NO: 224140 - RNA, 64 nt, Homo Sapiens
caaaccucauugcuuuauaaggguaaugugggagagccuucagcugagaaaaaccugugaaugu

SEQ ID NO: 224141 - RNA, 64 nt, Homo Sapiens
uacauacugauucuuuaagacagugaguguggcaagccuucaguggggaggagccuuaucaaug

SEQ ID NO: 224142 - RNA, 64 nt, Homo Sapiens
uccugggagucccagcuguucuaccuauggcuucagccuucagcuggauuccucgguuucuggg

SEQ ID NO: 224143 - RNA, 64 nt, Homo Sapiens
uucccccacccccauuugcugaacuggagaacucagccuucauccaccuggaagccaaugaagg

SEQ ID NO: 224144 - RNA, 64 nt, Homo Sapiens
gagagaaacccuacacauguaaagaauguggcaaagccuucaauagguucucaacccuuacugu

SEQ ID NO: 224145 - RNA, 64 nt, Homo Sapiens
gaaaaaaaugcuacaaaugugaaaaacguggcagagccuucagaccauccacaaaccuuuauga

SEQ ID NO: 224146 - RNA, 64 nt, Homo Sapiens
gugagaagccacaaaaauaugaaaaauguggcaaagccuucaaaugcuugucacaucuuacugu

SEQ ID NO: 224147 - RNA, 64 nt, Homo Sapiens
gccugguacugauaguaguggcucgauuuuuaagagccuucaauuguagaugaacaucucuguu

SEQ ID NO: 224148 - RNA, 64 nt, Homo Sapiens
uuuaucccucauucauccauccguucauucauucagccuucaaucaacaucucuugagugucua

SEQ ID NO: 224149 - RNA, 64 nt, Homo Sapiens
ggccgcuuucugcccaguggcguugggggaauucagccuucauuuauaaucagugagauucccc

SEQ ID NO: 224150 - RNA, 64 nt, Homo Sapiens
acagugucccugaaaccacaugcaucauucaggaagccuucacccugugacuauucagccuccc

SEQ ID NO: 224151 - RNA, 64 nt, Homo Sapiens
guccagggguaggggccccaccagcccuucuuggagccuucaugagagagaaaacuuagugcuu

SEQ ID NO: 224152 - RNA, 64 nt, Homo Sapiens
cucccuuuguaaugcugcucuucccugagggaugagccuucagccacaggcuggggggcuccgg

SEQ ID NO: 224153 - RNA, 64 nt, Homo Sapiens
gagagaaccccuaugaguguaagcaauuugggaaagccuucagaucugucaaaaaucuucgauu

SEQ ID NO: 224154 - RNA, 64 nt, Homo Sapiens
gagagaaacccuaugaguguaugccaagugggaaagccuucauuucuucuaguucccuucaaua

SEQ ID NO: 224155 - RNA, 64 nt, Homo Sapiens
gagagaagcccuaugaauauaagcaaugugggaaagccuucagaucagccucgcaccuucaaau

SEQ ID NO: 224156 - RNA, 64 nt, Homo Sapiens
gagagaaacccuauaaaugcaugccaugugguaaagccuucaaucuuuccaguuccuuucagua

SEQ ID NO: 224157 - RNA, 64 nt, Homo Sapiens
gagagaaacccuaugaguguaagcaaugugggaaagccuucagaugugccccacaccuucgaag

SEQ ID NO: 224158 - RNA, 64 nt, Homo Sapiens
gagagaaacccuaugaguguaaggaaugugggaaagccuucagaucugccucacaccuucaaau

SEQ ID NO: 224159 - RNA, 64 nt, Homo Sapiens
cagagaaacccuaugaaugcaagcaaugugguaaagccuucaguaguuccaguuccuuuuggua

SEQ ID NO: 224160 - RNA, 64 nt, Homo Sapiens
gagagaaacccuaugaguguaagcaaugugggaaagccuucagaucugccucaauccuucaaau

SEQ ID NO: 224161 - RNA, 64 nt, Homo Sapiens
aagagaagcccuacgaguguaagcaaugugggaaagccuucagaucugccccacaccuucgaau

SEQ ID NO: 224162 - RNA, 64 nt, Homo Sapiens
gagagaaacccuaugaguguaaggaaugugggaaagccuucagaucugccaagaaccuucgaau

SEQ ID NO: 224163 - RNA, 64 nt, Homo Sapiens
gaugccucuguguuagggaaaaagaagaagagaaagccuucaguuacagagaaacuugaaauau

SEQ ID NO: 224164 - RNA, 64 nt, Homo Sapiens
gcuaucagcagggauucauggaacagcuguagaaagccuucaguugagagaauccugaagaaug

SEQ ID NO: 224165 - RNA, 64 nt, Homo Sapiens
aguuccaguuauauucauauaaacagugugguaaagccuucagugagagaaaccuuaugaaugu

SEQ ID NO: 224166 - RNA, 64 nt, Homo Sapiens
uaccacuguacugcucaaaaaaggaaugugggaaagccuucagugagagaaacccuacaaaugc

SEQ ID NO: 224167 - RNA, 64 nt, Homo Sapiens
ugucaacguucuuuccaaauaaggccugugggaaagccuucagucagggauagucuacaaaugu

SEQ ID NO: 224168 - RNA, 64 nt, Homo Sapiens
cauucccguuuccuucaaggaaacaaugugguaaagccuucacugagagaaaccuuaugaaggu

SEQ ID NO: 224169 - RNA, 64 nt, Homo Sapiens
cauuuuggucacuuaaagcacaaacauguagaaaagccuucagucagaaaaaccuuaugagugu

SEQ ID NO: 224170 - RNA, 64 nt, Homo Sapiens
gcuuccacuucccuucaaagaaacaaugugggaaagccuucagugagagaaacucuguacaugu

SEQ ID NO: 224171 - RNA, 64 nt, Homo Sapiens
ucacguaaucuuuuaaagacauggaguguaggaaagccuucacugacagaaaagcuacgaaugu

SEQ ID NO: 224172 - RNA, 64 nt, Homo Sapiens
uguccuaauucccuuugaagaaacggugugauuaagccuucagugagagaaauucaaggaaugu

SEQ ID NO: 224173 - RNA, 64 nt, Homo Sapiens
cagccuuuugagcacacaugaagacauuugggaaagccuucacagggugaaagucuauaaaugu

SEQ ID NO: 224174 - RNA, 64 nt, Homo Sapiens
ugaccuaauucauuucaaagaaacauugugauuaagccuucagugugagaaacaguaugaaugu

SEQ ID NO: 224175 - RNA, 64 nt, Homo Sapiens
uacauucuuuucaccccucccagucuacccauccagccuucaugauucauuccugugucaaggu

SEQ ID NO: 224176 - RNA, 64 nt, Homo Sapiens
uguauaugugauuaaaaugaagauuauuuucuaaagccuucaaauuagaaguggauuucuguuu

SEQ ID NO: 224177 - RNA, 64 nt, Homo Sapiens; identical to SEQ ID NO: 87137

SEQ ID NO: 224178 - RNA, 64 nt, Homo Sapiens; identical to SEQ ID NO: 87138

SEQ ID NO: 224179 - RNA, 64 nt, Homo Sapiens; identical to SEQ ID NO: 87139

SEQ ID NO: 224180 - RNA, 64 nt, Homo Sapiens; identical to SEQ ID NO: 87140

SEQ ID NO: 224181 - RNA, 64 nt, Homo Sapiens; identical to SEQ ID NO: 87141

SEQ ID NO: 224182 - RNA, 64 nt, Homo Sapiens; identical to SEQ ID NO: 87142

SEQ ID NO: 224183 - RNA, 64 nt, Homo Sapiens; identical to SEQ ID NO: 87143

SEQ ID NO: 224184 - RNA, 64 nt, Homo Sapiens; identical to SEQ ID NO: 87144

SEQ ID NO: 224185 - RNA, 64 nt, Homo Sapiens; identical to SEQ ID NO: 87145

SEQ ID NO: 224186 - RNA, 64 nt, Homo Sapiens; identical to SEQ ID NO: 87146

SEQ ID NO: 224187 - RNA, 64 nt, Homo Sapiens; identical to SEQ ID NO: 87147

SEQ ID NO: 224188 - RNA, 64 nt, Homo Sapiens; identical to SEQ ID NO: 87148

SEQ ID NO: 224189 - RNA, 64 nt, Homo Sapiens; identical to SEQ ID NO: 87149

SEQ ID NO: 224190 - RNA, 64 nt, Homo Sapiens; identical to SEQ ID NO: 87150

SEQ ID NO: 224191 - RNA, 64 nt, Homo Sapiens; identical to SEQ ID NO: 87151

SEQ ID NO: 224192 - RNA, 64 nt, Homo Sapiens; identical to SEQ ID NO: 87152

SEQ ID NO: 224193 - RNA, 64 nt, Homo Sapiens; identical to SEQ ID NO: 87153

SEQ ID NO: 224194 - RNA, 64 nt, Homo Sapiens; identical to SEQ ID NO: 87154

SEQ ID NO: 224195 - RNA, 64 nt, Homo Sapiens; identical to SEQ ID NO: 87155

SEQ ID NO: 224196 - RNA, 64 nt, Homo Sapiens; identical to SEQ ID NO: 87156

SEQ ID NO: 224197 - RNA, 64 nt, Homo Sapiens; identical to SEQ ID NO: 87157

SEQ ID NO: 224198 - RNA, 64 nt, Homo Sapiens; identical to SEQ ID NO: 87158

SEQ ID NO: 224199 - RNA, 64 nt, Homo Sapiens; identical to SEQ ID NO: 87159

SEQ ID NO: 224200 - RNA, 64 nt, Homo Sapiens; identical to SEQ ID NO: 87160

SEQ ID NO: 224201 - RNA, 64 nt, Homo Sapiens; identical to SEQ ID NO: 87161

SEQ ID NO: 224202 - RNA, 64 nt, Homo Sapiens; identical to SEQ ID NO: 87162

SEQ ID NO: 224203 - RNA, 64 nt, Homo Sapiens; identical to SEQ ID NO: 87163

SEQ ID NO: 224204 - RNA, 64 nt, Homo Sapiens; identical to SEQ ID NO: 87164

SEQ ID NO: 224205 - RNA, 64 nt, Homo Sapiens; identical to SEQ ID NO: 87165

SEQ ID NO: 224206 - RNA, 64 nt, Homo Sapiens; identical to SEQ ID NO: 87166

SEQ ID NO: 224207 - RNA, 64 nt, Homo Sapiens; identical to SEQ ID NO: 87167

SEQ ID NO: 224208 - RNA, 64 nt, Homo Sapiens; identical to SEQ ID NO: 87168

SEQ ID NO: 224209 - RNA, 64 nt, Homo Sapiens; identical to SEQ ID NO: 87169

SEQ ID NO: 224210 - RNA, 64 nt, Homo Sapiens; identical to SEQ ID NO: 87170

SEQ ID NO: 224211 - RNA, 64 nt, Homo Sapiens; identical to SEQ ID NO: 87171

SEQ ID NO: 224212 - RNA, 64 nt, Homo Sapiens; identical to SEQ ID NO: 87172

SEQ ID NO: 224213 - RNA, 64 nt, Homo Sapiens; identical to SEQ ID NO: 87173

SEQ ID NO: 224214 - RNA, 64 nt, Homo Sapiens; identical to SEQ ID NO: 87174

SEQ ID NO: 224215 - RNA, 64 nt, Homo Sapiens; identical to SEQ ID NO: 87175

SEQ ID NO: 224216 - RNA, 64 nt, Homo Sapiens; identical to SEQ ID NO: 87176

SEQ ID NO: 224217 - RNA, 64 nt, Homo Sapiens; identical to SEQ ID NO: 55231

SEQ ID NO: 224218 - RNA, 64 nt, Homo Sapiens; identical to SEQ ID NO: 55232

SEQ ID NO: 224219 - RNA, 64 nt, Homo Sapiens; identical to SEQ ID NO: 55233

SEQ ID NO: 224220 - RNA, 64 nt, Homo Sapiens; identical to SEQ ID NO: 55234

SEQ ID NO: 224221 - RNA, 64 nt, Homo Sapiens; identical to SEQ ID NO: 55235

SEQ ID NO: 224222 - RNA, 64 nt, Homo Sapiens; identical to SEQ ID NO: 55236

SEQ ID NO: 224223 - RNA, 64 nt, Homo Sapiens; identical to SEQ ID NO: 55237

SEQ ID NO: 224224 - RNA, 64 nt, Homo Sapiens; identical to SEQ ID NO: 55238

SEQ ID NO: 224225 - RNA, 64 nt, Homo Sapiens; identical to SEQ ID NO: 55239

SEQ ID NO: 224226 - RNA, 64 nt, Homo Sapiens; identical to SEQ ID NO: 55240

SEQ ID NO: 224227 - RNA, 64 nt, Homo Sapiens; identical to SEQ ID NO: 55241

SEQ ID NO: 224228 - RNA, 64 nt, Homo Sapiens; identical to SEQ ID NO: 55242

SEQ ID NO: 224229 - RNA, 64 nt, Homo Sapiens; identical to SEQ ID NO: 55243

SEQ ID NO: 224230 - RNA, 64 nt, Homo Sapiens; identical to SEQ ID NO: 55244

SEQ ID NO: 224231 - RNA, 64 nt, Homo Sapiens; identical to SEQ ID NO: 55245

SEQ ID NO: 224232 - RNA, 64 nt, Homo Sapiens; identical to SEQ ID NO: 55246

SEQ ID NO: 224233 - RNA, 64 nt, Homo Sapiens; identical to SEQ ID NO: 55247

SEQ ID NO: 224234 - RNA, 64 nt, Homo Sapiens; identical to SEQ ID NO: 55248

SEQ ID NO: 224235 - RNA, 64 nt, Homo Sapiens; identical to SEQ ID NO: 55249

SEQ ID NO: 224236 - RNA, 64 nt, Homo Sapiens; identical to SEQ ID NO: 55250

SEQ ID NO: 224237 - RNA, 64 nt, Homo Sapiens; identical to SEQ ID NO: 55251

SEQ ID NO: 224238 - RNA, 64 nt, Homo Sapiens; identical to SEQ ID NO: 55252

SEQ ID NO: 224239 - RNA, 64 nt, Homo Sapiens; identical to SEQ ID NO: 55253

SEQ ID NO: 224240 - RNA, 64 nt, Homo Sapiens; identical to SEQ ID NO: 55254

SEQ ID NO: 224241 - RNA, 64 nt, Homo Sapiens; identical to SEQ ID NO: 55255

SEQ ID NO: 224242 - RNA, 64 nt, Homo Sapiens; identical to SEQ ID NO: 55256

SEQ ID NO: 224243 - RNA, 64 nt, Homo Sapiens; identical to SEQ ID NO: 55257

SEQ ID NO: 224244 - RNA, 64 nt, Homo Sapiens; identical to SEQ ID NO: 55258

SEQ ID NO: 224245 - RNA, 64 nt, Homo Sapiens; identical to SEQ ID NO: 55259

SEQ ID NO: 224246 - RNA, 64 nt, Homo Sapiens; identical to SEQ ID NO: 55260

SEQ ID NO: 224247 - RNA, 64 nt, Homo Sapiens; identical to SEQ ID NO: 55261

SEQ ID NO: 224248 - RNA, 64 nt, Homo Sapiens; identical to SEQ ID NO: 55262

SEQ ID NO: 224249 - RNA, 64 nt, Homo Sapiens; identical to SEQ ID NO: 55263

SEQ ID NO: 224250 - RNA, 64 nt, Homo Sapiens; identical to SEQ ID NO: 55264

SEQ ID NO: 224251 - RNA, 64 nt, Homo Sapiens; identical to SEQ ID NO: 55265

SEQ ID NO: 224252 - RNA, 64 nt, Homo Sapiens; identical to SEQ ID NO: 55266

SEQ ID NO: 224253 - RNA, 64 nt, Homo Sapiens; identical to SEQ ID NO: 55267

SEQ ID NO: 224254 - RNA, 64 nt, Homo Sapiens; identical to SEQ ID NO: 55268

SEQ ID NO: 224255 - RNA, 64 nt, Homo Sapiens; identical to SEQ ID NO: 55269

SEQ ID NO: 224256 - RNA, 64 nt, Homo Sapiens; identical to SEQ ID NO: 55270

SEQ ID NO: 224257 - RNA, 64 nt, Homo Sapiens; identical to SEQ ID NO: 55271

SEQ ID NO: 224258 - RNA, 64 nt, Homo Sapiens; identical to SEQ ID NO: 55272

SEQ ID NO: 224259 - RNA, 64 nt, Homo Sapiens; identical to SEQ ID NO: 55273

SEQ ID NO: 224260 - RNA, 64 nt, Homo Sapiens; identical to SEQ ID NO: 55274

SEQ ID NO: 224261 - RNA, 64 nt, Homo Sapiens; identical to SEQ ID NO: 55275

SEQ ID NO: 224262 - RNA, 64 nt, Homo Sapiens; identical to SEQ ID NO: 55276

SEQ ID NO: 224263 - RNA, 64 nt, Homo Sapiens; identical to SEQ ID NO: 55277

SEQ ID NO: 224264 - RNA, 64 nt, Homo Sapiens; identical to SEQ ID NO: 55278

SEQ ID NO: 224265 - RNA, 64 nt, Homo Sapiens; identical to SEQ ID NO: 55279

SEQ ID NO: 224266 - RNA, 64 nt, Homo Sapiens
cagccauguggagggagucagguugggccugugucacauccagggggguuuuguccauagcuuu

SEQ ID NO: 224267 - RNA, 64 nt, Homo Sapiens
uugugauuggauccauaaguccucccgccccuuccacauccaugcagaagcccacugguauggg

SEQ ID NO: 224268 - RNA, 64 nt, Homo Sapiens
ggggcacaacagggacuuguccuggccggugcugcacauccaccacugaccccucggcgccugg

SEQ ID NO: 224269 - RNA, 64 nt, Homo Sapiens
gcuaagcaagaaauaauucagguggguuacauagcacauccaggaugaggagacagagguccag

SEQ ID NO: 224270 - RNA, 64 nt, Homo Sapiens
agccugugccucauuccugguuugcucauacacgcacauccaaauguggcgguuucuguguacg

SEQ ID NO: 224271 - RNA, 64 nt, Homo Sapiens
aaaugcagggucacaugaaaacuugaaaaaaagucacauccagcagacaauggacgugucaaug

SEQ ID NO: 224272 - RNA, 64 nt, Homo Sapiens
ugauguaaaugguauuuuaggccaagugugcacccacauccaauggugcuacaagugacugaaa

SEQ ID NO: 224273 - RNA, 64 nt, Homo Sapiens
cacuaugcauaucuuaucauuuuauuauuauacacacauccauccuaaacuauacuaaagcccu

SEQ ID NO: 224274 - RNA, 64 nt, Homo Sapiens
ggagcggugguagauccugagauggacaaaguggcacauccaguacauccauggugagcauuuu

SEQ ID NO: 224275 - RNA, 64 nt, Homo Sapiens
gugagcauuuugauggacaacucucaugcugaaucacauccauguuuccccacucugcccaccu

SEQ ID NO: 224276 - RNA, 64 nt, Homo Sapiens
augugucuguagacuuagauacauccucuugaagcacauccauuucuuuagcgucucucaguaa

SEQ ID NO: 224277 - RNA, 64 nt, Homo Sapiens
ccaccaagcuagaaaauaaaaaacuuaguucuaccacauccaauuaacuuacacacccccuucc

SEQ ID NO: 224278 - RNA, 64 nt, Homo Sapiens
uugaggagcucacaaucuagcugaggagacaagacacauccaaugcugcaaaaauggugaauaa

SEQ ID NO: 224279 - RNA, 64 nt, Homo Sapiens
aguggagaagaggcagggucaggccucagcaucucacauccaccaccuccaggaggggagacca

SEQ ID NO: 224280 - RNA, 64 nt, Homo Sapiens
uagauaagaaaagguggggcuauacuagcaacaaaaaaagaaugcuguuccugcaccugccggu

SEQ ID NO: 224281 - RNA, 64 nt, Homo Sapiens
auauuaaaacagagauaugugcaugaaaucaagaaaaaagaaaugaacaaaagcaaagcauuag

SEQ ID NO: 224282 - RNA, 64 nt, Homo Sapiens
cagcucgcuguagccuuggagagggaagugauggaaaaagaauauagcagcuuauuagggacuc

SEQ ID NO: 224283 - RNA, 64 nt, Homo Sapiens
cccgguuauuuaugauuaaauuacugaagugucuaaaaagaacagaaggacccaccccagccau

SEQ ID NO: 224284 - RNA, 64 nt, Homo Sapiens
caaaagacauaggacuuaacuggaaaaugaaaaaaaaaagaaaaagaaaaaacuaaacaaaaaa

SEQ ID NO: 224285 - RNA, 64 nt, Homo Sapiens
acauaggacuuaacuggaaaaugaaaaaaaaaagaaaaagaaaaaacuaaacaaaaaaucccuc

SEQ ID NO: 224286 - RNA, 64 nt, Homo Sapiens
agcccagagaagcccccuacauccccccgggaaaaaaaagaaaacuagacagaaacucaucuau

SEQ ID NO: 224287 - RNA, 64 nt, Homo Sapiens
caggccaccauauuuagaacuaguuaccuuauuaaaaaagaaaaaacagucuguuggcuucuca

SEQ ID NO: 224288 - RNA, 64 nt, Homo Sapiens
caucauaaacuuuuuaaaggaaaauaagcaaacuaaaaagaacauugguuuagauaaauacuua

SEQ ID NO: 224289 - RNA, 64 nt, Homo Sapiens
ugaggguuuacauuuguuuuguuuuguaaccguuaaaaagaaguuguuuccagcuaauuauugu

SEQ ID NO: 224290 - RNA, 64 nt, Homo Sapiens
guccuaauguugcuacucccauggcaaagaaaaaaaaaagaaugaaaaaaagaaaaaaauuugg

SEQ ID NO: 224291 - RNA, 64 nt, Homo Sapiens
cuacucccauggcaaagaaaaaaaaaagaaugaaaaaaagaaaaaaauuuggaaaaaaaaauca

SEQ ID NO: 224292 - RNA, 64 nt, Homo Sapiens
aauaguauaauuauaucaguaacaagaagacucaaaaaagaaacaggaguaccuaucccuaucu

SEQ ID NO: 224293 - RNA, 64 nt, Homo Sapiens
uuuuaaauaaacuacuaguucuuuauauuuugacaaaaagaacuuaaauuuuaucaggaacugu

SEQ ID NO: 224294 - RNA, 64 nt, Homo Sapiens
ccugggugacagagcaagugagacccugucucaaaaaaagaaaaagaaaaagaaaaaauauuuu

SEQ ID NO: 224295 - RNA, 64 nt, Homo Sapiens
ugacagagcaagugagacccugucucaaaaaaagaaaaagaaaaagaaaaaauauuuucccuau

SEQ ID NO: 224296 - RNA, 64 nt, Homo Sapiens
agcaagugagacccugucucaaaaaaagaaaaagaaaaagaaaaaauauuuucccuauuagaga

SEQ ID NO: 224297 - RNA, 64 nt, Homo Sapiens
caggaugggguguaagccauagaguaagguuaacaaaaagaauaaagcuaaucauguauuacaa

SEQ ID NO: 224298 - RNA, 64 nt, Homo Sapiens
ugggugguagaucaaggcuuuguuucauuugaaaaaaaagaaagaaagaaagaaagaaagaaau

SEQ ID NO: 224299 - RNA, 64 nt, Homo Sapiens
ugacaggauuccaauaauuaagaauacuucauacaaaaagaaauguaaaugaccuuuaacaugu

SEQ ID NO: 224300 - RNA, 64 nt, Homo Sapiens
aagagaauaaaccaguguuuuuaccuuucacuugaaaaagaaguauaaaaacaacuguauugag

SEQ ID NO: 224301 - RNA, 64 nt, Homo Sapiens
cauugucucuaaaauacauaaguaaauuuaaaaaaaaaagaauaauaauuugaacagugaaugu

SEQ ID NO: 224302 - RNA, 64 nt, Homo Sapiens
auaaggaaugaaguuggaaccacaggcagaucugaaaaagaaccaaauagagcuccuaaaaaug

SEQ ID NO: 224303 - RNA, 64 nt, Homo Sapiens
ccagccuggguaacagagcaagacuccaucucaaaaaaagaaagaaagaaaaaagaaaguacaa

SEQ ID NO: 224304 - RNA, 64 nt, Homo Sapiens
gagcaagacuccaucucaaaaaaagaaagaaagaaaaaagaaaguacaaguuuauaaaguauua

SEQ ID NO: 224305 - RNA, 64 nt, Homo Sapiens
aguaaucccagaacaauggcuauucaugugggaaaaaaagaaauuuuacuuucucucaccuuac

SEQ ID NO: 224306 - RNA, 64 nt, Homo Sapiens
agcauacguauacaauaaaacuaugcuauuaaaaaaaaagaagguaacugauaaaccaaaauug

SEQ ID NO: 224307 - RNA, 64 nt, Homo Sapiens
aaauagcuugguuuuauuugccuaguuaauguuuaaaaagaaaaaauaaauguucuuuauacag

SEQ ID NO: 224308 - RNA, 64 nt, Homo Sapiens
aaaggaaaagguuuuuagcuaaaagcuuuaaaaaaaaaagaaaaugguugguuuaacaaaaaaa

SEQ ID NO: 224309 - RNA, 64 nt, Homo Sapiens
uaaaaguccccuagugauaggucaaaaaagaaauaaaaagaaagggagacaggggagacccuau

SEQ ID NO: 224310 - RNA, 64 nt, Homo Sapiens
aaaaagaaaguaaaagucccgagacccuaugucaaaaaagaaaucuucagccuuggagacaggg

SEQ ID NO: 224311 - RNA, 64 nt, Homo Sapiens
ucuuaagaguuuaucuuuuccauaauuuggggcaaaaaagaaagauauauuuuccuuucugaca

SEQ ID NO: 224312 - RNA, 64 nt, Homo Sapiens
aauguauuaaaauuuacauccccguucaaguucaaaaaagaaauuggaucaucccauucugguu

SEQ ID NO: 224313 - RNA, 64 nt, Homo Sapiens
gucuauaaccugaaaauguuuccucugugacaccaaaaagaaaaaaaagaauucagaacuacuu

SEQ ID NO: 224314 - RNA, 64 nt, Homo Sapiens
cagaacuacuuuccucuguguaaaaaaaaaagaaaaaaagaauuagcaaauuaaguuauuuucc

SEQ ID NO: 224315 - RNA, 64 nt, Homo Sapiens
aaagaauucagaacuacuuuuauuuuccuaaaaaaaaaagaaaaaugaauuuagcaaauuaagu

SEQ ID NO: 224316 - RNA, 64 nt, Homo Sapiens
cgaagccaguauuuuaauaaaaauuugaaaggaaaaaaagaaacauauguaaagcaauuguagg

SEQ ID NO: 224317 - RNA, 64 nt, Homo Sapiens
ucuuuugccccauuucuuuacggcucagucaugaaaaaagaaggacacauuagagguacaggag

SEQ ID NO: 224318 - RNA, 64 nt, Homo Sapiens
acauagaguucagucccuagucaaaaaaaagaaaaaaaagaaauuaacacagcaagacucuauc

SEQ ID NO: 224319 - RNA, 64 nt, Homo Sapiens
aaaagaaauacauagaguucgacucuaucucaaaaaaaagaaaacacccuggguaacacagcaa

SEQ ID NO: 224320 - RNA, 64 nt, Homo Sapiens
acugaccagugucucuacuuccuaguuccccccaaaaaagaaaucucacuucuacuccugcucu

SEQ ID NO: 224321 - RNA, 64 nt, Homo Sapiens
gaccuagcucugaauuuguucauuuggcuuuaucaaaaagaacacaccucccucucucuugcuu

SEQ ID NO: 224322 - RNA, 64 nt, Homo Sapiens
ugaggcucaagaggcugcuuuucaaauuucuaagaaaaagaaaacuuuucuagucacagauguu

SEQ ID NO: 224323 - RNA, 64 nt, Homo Sapiens
agaagaagagagacuaaaggcuguccagaaagccaaaaagaaacggaaagagcuggagucagca

SEQ ID NO: 224324 - RNA, 64 nt, Homo Sapiens
gguggcaccaugaagaggagucaggaaagggaagaaaaagaagaagagcaaaccaaucaguccc

SEQ ID NO: 224325 - RNA, 64 nt, Homo Sapiens
ggaggcagaaagaggaggaacccccaaaaaaaagaaaaagaaaaacugcagucagagagcaagc

SEQ ID NO: 224326 - RNA, 64 nt, Homo Sapiens
agaaaaggaggcagaaagaggcaagccccccaaaaaaaagaaaacccucaacugcagucagaga

SEQ ID NO: 224327 - RNA, 64 nt, Homo Sapiens
auagaagacauauaaauuaaccccaaaaaaagagaaaaagaaaagaauuugucacauguaucac

SEQ ID NO: 224328 - RNA, 64 nt, Homo Sapiens
gagggaggaagaaagggagagaaaaaaaugaaauaaaaagaagacuucuauaacaaauaaaugg

SEQ ID NO: 224329 - RNA, 64 nt, Homo Sapiens
acaaaaugcuaaugaagccaucuauuaaggauccaaaaagaaaaucccuaacagaauugaguuu

SEQ ID NO: 224330 - RNA, 64 nt, Homo Sapiens
aaaagaaagcuggagcugguuccagcucaaaaaaaaaaagaaagccuggcaacaagagcaaaac

SEQ ID NO: 224331 - RNA, 64 nt, Homo Sapiens
caaauauuccagccccaaaugaaguaaaaaaauuaaaaagaauauagaaacucuucuaauaaau

SEQ ID NO: 224332 - RNA, 64 nt, Homo Sapiens
gaagaaggaaugccuuauaguucuguggagauauaaaaagaaugacagggucccaugagagcag

SEQ ID NO: 224333 - RNA, 64 nt, Homo Sapiens
uuaaguguggacagaccuaugcuaaauuggucuaaaaaagaauagguuaaguaauagauuucca

SEQ ID NO: 224334 - RNA, 64 nt, Homo Sapiens
uacuuaagauagaacaugguaaagagggaggaaaaaaaagaaccaaaaaagaaaaaaaaagaaa

SEQ ID NO: 224335 - RNA, 64 nt, Homo Sapiens
aagagggaggaaaaaaaagaauuuuauuaaaaaaaaaaagaaaaugaugauggucuggggagag

SEQ ID NO: 224336 - RNA, 64 nt, Homo Sapiens
gucauuuuuaaacuaccuauucaaaaaaaaaagaaaaaagaauaugacagagaaggacuccguc

SEQ ID NO: 224337 - RNA, 64 nt, Homo Sapiens
aagaauagucauuuuuaaaccuccgucucaaaaaaaaaagaaaagccugggugacagagaagga

SEQ ID NO: 224338 - RNA, 64 nt, Homo Sapiens
uuaaauacaccaacaugagagaaauucaagauucaaaaagaauucaucaguacccgaucuugaa

SEQ ID NO: 224339 - RNA, 64 nt, Homo Sapiens
auuucugaagcccgauugggcaugcucgucaugaaaaaagaaccaugauugauagcuggacaga

SEQ ID NO: 224340 - RNA, 64 nt, Homo Sapiens
guaauuaccuuuguguuuccauuuggauaauuuuaaaaagaaaaucucuuuccaguaaguucac

SEQ ID NO: 224341 - RNA, 64 nt, Homo Sapiens
ucccuugaaaugaucaugagauaugugacaguugaaaaagaaaugguccuguguuaccaaguuu

SEQ ID NO: 224342 - RNA, 64 nt, Homo Sapiens
cugaagauuaaccauuuuuuugucuuagaauaucaaaaagaaaaagaaaaagguguucuagcug

SEQ ID NO: 224343 - RNA, 64 nt, Homo Sapiens
auuaaccauuuuuuugucuuagaauaucaaaaagaaaaagaaaaagguguucuagcuguuugca

SEQ ID NO: 224344 - RNA, 64 nt, Homo Sapiens
aagcaacuucaguucuuuuacugcaaagaacagaaaaaagaaagaaagcaaacaagaagacucc

SEQ ID NO: 224345 - RNA, 64 nt, Homo Sapiens
aguuugugucuuguggaagaaauccucuuuguggaaaaagaaacaggguuuugaacucuguuaa

SEQ ID NO: 224346 - RNA, 64 nt, Homo Sapiens
ggugaaaaaacaaugcauucuugcuuuaaaaaaaaaaaagaaggcuaaaaaauuaccucuuuuu

SEQ ID NO: 224347 - RNA, 64 nt, Homo Sapiens
uuuguaguuacuauaaaucaagcuuuggaaguccaaaaagaauaaaagacugccuuccuuuuag

SEQ ID NO: 224348 - RNA, 64 nt, Homo Sapiens
gcuuauaauguaccuggaaaauaaaccucuugagaaaaagaaaaguucauacugauuauuggaa

SEQ ID NO: 224349 - RNA, 64 nt, Homo Sapiens
uuuuugucuuaaaauauuaguggcuuacauuuuaaaaaagaaaaaucaccagcaugaacuugca

SEQ ID NO: 224350 - RNA, 64 nt, Homo Sapiens
aaaaguguugcuagagaaaauuagggaaaaggugaaaaagaaaaaaugguaguaauugagcaga

SEQ ID NO: 224351 - RNA, 64 nt, Homo Sapiens
cagauuuaucuaaguagaacugaauuggcuaggaaaaaagaaaaacugcauguuaaucauuuuc

SEQ ID NO: 224352 - RNA, 64 nt, Homo Sapiens
uccagcccaggcaacaagagugaaacccugucucaaaaagaaaaaaaaaguugaccuugagaau

SEQ ID NO: 224353 - RNA, 64 nt, Homo Sapiens
accuccagaacugugaaaaauaaauuuguuauuuaaaaagaaaaaaaaaaaaacaaaaaccuga

SEQ ID NO: 224354 - RNA, 64 nt, Homo Sapiens
aaaaaaaaaaaaaaaaaaaaaaaaaaggaaaaaaaaaaagaaaaagaaaacgugugcauuuugu

SEQ ID NO: 224355 - RNA, 64 nt, Homo Sapiens
aaaaaaaaaaaaaaaaaaaaggaaaaaaaaaaagaaaaagaaaacgugugcauuuuguauaaug

SEQ ID NO: 224356 - RNA, 64 nt, Homo Sapiens
guuuucuuuuuucuagaaaacacuuuccuggauaaaaaagaaaacauuccagaugcaugaucca

SEQ ID NO: 224357 - RNA, 64 nt, Homo Sapiens
uuugacauuuaauaacuuugcuggaaaaucuguaaaaaagaaaaacaaguuugcuagugacuaa

SEQ ID NO: 224358 - RNA, 64 nt, Homo Sapiens
aaaaaaaaaaggagcugugcaucaguuuuuuaaaaaaaagaaaagcagccacugcaagcucuga

SEQ ID NO: 224359 - RNA, 64 nt, Homo Sapiens
aaaaguuugaauagcuauuaaaucuuguuuuucaaaaaagaauagcuaaaacguuuuuauagag

SEQ ID NO: 224360 - RNA, 64 nt, Homo Sapiens
uaccuaugauccuggauuuacaaaacauaacacaaaaaagaagcgcacaacacaaaaaccaaca

SEQ ID NO: 224361 - RNA, 64 nt, Homo Sapiens
acaaaaaacaaaaaacaggggcucuuguuucucaaaaaagaaaaaauaaaaacaaguaucucau

SEQ ID NO: 224362 - RNA, 64 nt, Homo Sapiens
agaaaguggaguccugauucuccugaaaaagagcaaaaagaagggaaauuccgaacccccuccu

SEQ ID NO: 224363 - RNA, 64 nt, Homo Sapiens
uccgaacccccuccuuccugcucccucaaagaagaaaaagaaauagagggcucaccuuccaagu

SEQ ID NO: 224364 - RNA, 64 nt, Homo Sapiens
aaaacuuuugaggaacucucaguuuaaaaagaugaaaaagaauauguauaccaggcagugugcc

SEQ ID NO: 224365 - RNA, 64 nt, Homo Sapiens
uuuucugaaugccuaccuggauuguguauuuaaaaaaaagaaacaaaucuucccaguauuauaa

SEQ ID NO: 224366 - RNA, 64 nt, Homo Sapiens
cuguaguuugagguaugaccaacacuugaauuggaaaaagaacuaaaucgcaguuaaagcauga

SEQ ID NO: 224367 - RNA, 64 nt, Homo Sapiens
aauaaaaucgcaguuaaagcaaagagacuaucugaaaaagaagaaauaaggcuaguguacuaca

SEQ ID NO: 224368 - RNA, 64 nt, Homo Sapiens
aaaaaaaacccuuuugaguugcuaggauuugcuaaaaaagaaaagauuuuuuuguuaauaaugu

SEQ ID NO: 224369 - RNA, 64 nt, Homo Sapiens
cacauuuagagucucucuucuuagaaacacacuuaaaaagaacacagauugcagaaaaacagga

SEQ ID NO: 224370 - RNA, 64 nt, Homo Sapiens
uuuauaucuugauuauuuugccguugauguugauaaaaagaaagguuuguaaguguuguaugua

SEQ ID NO: 224371 - RNA, 64 nt, Homo Sapiens
uaaauacauaaaaaagggacguguguuugcaaaaaaaaagaaaauuacaaauucuaaaagauaa

SEQ ID NO: 224372 - RNA, 64 nt, Homo Sapiens
gaaaacuucaauuuucugggagaaaaagaaaaaaaaaaagaaaaaaauguuaugaugcaaaaaa

SEQ ID NO: 224373 - RNA, 64 nt, Homo Sapiens
aaaaaaagaaaagaaaacuuugaugcaaaaaaagaaaaagaaaaaagauuuuuaucaaauguua

SEQ ID NO: 224374 - RNA, 64 nt, Homo Sapiens
agaaaaaaaaaaagaaaagaauguuaugaugcaaaaaaagaaaaaaacaaaagauuuuuaucaa

SEQ ID NO: 224375 - RNA, 64 nt, Homo Sapiens
gugagcuacgucauuauugagaauugcuauugcuaaaaagaaugauugaagaacugcaugcagg

SEQ ID NO: 224376 - RNA, 64 nt, Homo Sapiens
guaauggcuacaguuucaguuugcucaaaaccagaaaaagaauuuugccagagagauaaaauuu

SEQ ID NO: 224377 - RNA, 64 nt, Homo Sapiens
aguuucagaagagcagaaguagaaaaaagauagaaaaaagaaaaucgacuggagaagaaaaaaa

SEQ ID NO: 224378 - RNA, 64 nt, Homo Sapiens
aagauagaaaaaagaaaaaggacuggagaagaaaaaaaagaaaacaauuacaggaaauuagauc

SEQ ID NO: 224379 - RNA, 64 nt, Homo Sapiens
cccaggugugguagugcauggaaaaagaaaaagaaaaaagaauaguacuaaaaaaaaaaaaaaa

SEQ ID NO: 224380 - RNA, 64 nt, Homo Sapiens
aagaauacccaggugugguaaaaaaaagaaaaagaaaaagaaaaccggucuguacuaaaaaaaa

SEQ ID NO: 224381 - RNA, 64 nt, Homo Sapiens
agaaaaaagaauacccagguaaaaaaaaaaaaagaaaaagaaaaugaaacccggucuguacuaa

SEQ ID NO: 224382 - RNA, 64 nt, Homo Sapiens
agaaaaagaaaaaagaauacuacuaaaaaaaaaaaaaaagaaaaacguggugaaacccggucug

SEQ ID NO: 224383 - RNA, 64 nt, Homo Sapiens
uuaaugauucuaauaagagggauagcaucucuugaaaaagaauuaugacaacuuuauauuuuuu

SEQ ID NO: 224384 - RNA, 64 nt, Homo Sapiens
ugugaaaaaugagcuuguaaucuuggaauuuuguaaaaagaaaucaaugaaggauuucuuauuu

SEQ ID NO: 224385 - RNA, 64 nt, Homo Sapiens
ccugguuuguaauguuugucagcucuaugugggaaaaaagaaauuugauaagaguguaacaucc

SEQ ID NO: 224386 - RNA, 64 nt, Homo Sapiens
ggauaucccuuccuacaguauaucuacuauuugaaaaaagaagauaaguuccaaaaauaccauu

SEQ ID NO: 224387 - RNA, 64 nt, Homo Sapiens
guguugaaauuggaaaggacuuccuguaguggcaaaaaagaacauuauaacaccaucuggaguc

SEQ ID NO: 224388 - RNA, 64 nt, Homo Sapiens
uagugacccagagcuauaauauucauguuuucauaaaaagaaguuuugaguuauaacuaguauu

SEQ ID NO: 224389 - RNA, 64 nt, Homo Sapiens
uguaaagguguguuuuggggaaaucaacauuuuuaaaaagaaaagacaguagccacuuacaaac

SEQ ID NO: 224390 - RNA, 64 nt, Homo Sapiens
gcaaaaucucuacugcuuuggauccugggucaaaaaaaagaaaaaaaaaagaaaugcaaaacuu

SEQ ID NO: 224391 - RNA, 64 nt, Homo Sapiens
acugcuuuggauccugggucaaaaaaaagaaaaaaaaaagaaaugcaaaacuuuaggcccugcc

SEQ ID NO: 224392 - RNA, 64 nt, Homo Sapiens
ugcuaagaggauaaaggaacugagaccagaugagaaaaagaaaggauauagauuccuugagugg

SEQ ID NO: 224393 - RNA, 64 nt, Homo Sapiens
guggacaaauuuaacaaguuuucuguuacuuuuuaaaaagaaaaaauccagaacauaagaacua

SEQ ID NO: 224394 - RNA, 64 nt, Homo Sapiens
auuuuacuggguuugcuuuucuuaaaacauaccaaaaaagaaaaaaauagaaaaaaaaaaaaaa

SEQ ID NO: 224395 - RNA, 64 nt, Homo Sapiens
gacagucuguaaaguauugcucuuaaaaacaauuaaaaagaacccuuucauauuggcaccauug

SEQ ID NO: 224396 - RNA, 64 nt, Homo Sapiens
aacuauucagaggacugugugaaguaguuacuggaaaaagaacuugaauuaugcauuuauuggc

SEQ ID NO: 224397 - RNA, 64 nt, Homo Sapiens
uuuaccaugugucugaauuacauagugugcuuguaaaaagaagaguuuucucucuugcacaaau

SEQ ID NO: 224398 - RNA, 64 nt, Homo Sapiens
uaaaaaacgcagaaaagaaaaaaagguuaagcauaaaaagaaagggaaaaagcagaaacacugc

SEQ ID NO: 224399 - RNA, 64 nt, Homo Sapiens
aauccaagucugaacgggaaugcccucauucaaaaaaaagaacuuugaaagagaaucuuucuga

SEQ ID NO: 224400 - RNA, 64 nt, Homo Sapiens
acucagggcuggggccaagaggaaaaacagggaaaaaaagaaaaaaaaaagaaaaaggaaaagg

SEQ ID NO: 224401 - RNA, 64 nt, Homo Sapiens
gggccaagaggaaaaacagggaaaaaaagaaaaaaaaaagaaaaaggaaaaggaagcggugugu

SEQ ID NO: 224402 - RNA, 64 nt, Homo Sapiens
auguaaaguuuaauugaaagaauguaaagcaaccaaaaagaaaaaaaaaaagaaagaaagagga

SEQ ID NO: 224403 - RNA, 64 nt, Homo Sapiens
auugaaagaauguaaagcaaccaaaaagaaaaaaaaaaagaaagaaagaggaaaagaaauccau

SEQ ID NO: 224404 - RNA, 64 nt, Homo Sapiens
acccaccuuaacucuuucuugucaggaguauauaaaaaagaaagaaaacaaaacucgcccuaca

SEQ ID NO: 224405 - RNA, 64 nt, Homo Sapiens
augcagguagcaaagauguaauaaauuugcuuaaaaaaagaaauuaaaguuuuauuuagaauca

SEQ ID NO: 224406 - RNA, 64 nt, Homo Sapiens
ggggcuuugcugcauucccuaagauaauuacaggaaaaagaaaauguaaaagugcuaacaaggc

SEQ ID NO: 224407 - RNA, 64 nt, Homo Sapiens
gugaaagaccgagacuccgccucaaaaaaaaaaaaaaaagaaagaaagaaagaaagaaagaaau

SEQ ID NO: 224408 - RNA, 64 nt, Homo Sapiens
ggauucuuccugauucaaagacugucaaauaggaaaaaagaaaacaguaaaugaacaaaaacau

SEQ ID NO: 224409 - RNA, 64 nt, Homo Sapiens
cagaaacauuugcugaguguuuuuaauaggagucaaaaagaaagggucuuuucagaaacugaag

SEQ ID NO: 224410 - RNA, 64 nt, Homo Sapiens
cguuuuucuuuuguuugcauuuucugcaaaaaggaaaaagaaaccacaaauuggggaaaaaaaa

SEQ ID NO: 224411 - RNA, 64 nt, Homo Sapiens
caaaaaggaaaaagaaaccacaaauuggggaaaaaaaaagaagaaaaaccuguuuccgugugca

SEQ ID NO: 224412 - RNA, 64 nt, Homo Sapiens
uaggaaaagguuaaacuggauuuuuuuuuuuaaaaaaaagaaaaaaaaagaagaaaaguauacc

SEQ ID NO: 224413 - RNA, 64 nt, Homo Sapiens
uuaaacuggauuuuuuuuuuuaaaaaaaagaaaaaaaaagaagaaaaguauaccagauaccaaa

SEQ ID NO: 224414 - RNA, 64 nt, Homo Sapiens
agcaaacugcccuuuguccucaaagaaauuguugaaaaagaaaacuuuuuaaagagauuuuuug

SEQ ID NO: 224415 - RNA, 64 nt, Homo Sapiens
uggacauacauuccaagcuuuucaacucuaggagaaaaagaaaaucauguuuuccuguauugua

SEQ ID NO: 224416 - RNA, 64 nt, Homo Sapiens
auguuuauugcuguuuugucuuucuuuuuucuaaaaaaagaaaaaaaagaaaaaaaggaaaaga

SEQ ID NO: 224417 - RNA, 64 nt, Homo Sapiens
gcuguuuugucuuucuuuuuucuaaaaaaagaaaaaaaagaaaaaaaggaaaagaagaacaaag

SEQ ID NO: 224418 - RNA, 64 nt, Homo Sapiens
aaguuauugaaauaggacuuaagaauuaccuauuaaaaagaaaucugauauauaaaaauaugua

SEQ ID NO: 224419 - RNA, 64 nt, Homo Sapiens
ucuaaagaaucaaauuucuauuucugccucugacaaaaagaacuuacuaugaaagaaauaguug

SEQ ID NO: 224420 - RNA, 64 nt, Homo Sapiens
gaaguacucacacaugccaccauuauuagacucuaaaaagaaauggucuguccacgcaauggaa

SEQ ID NO: 224421 - RNA, 64 nt, Homo Sapiens
aaguugguggauucacacuuccaaauaagccuugaaaaagaacaaugcaagggacccagaauau

SEQ ID NO: 224422 - RNA, 64 nt, Homo Sapiens
aaauguauccagauaggaaaagcauuugggaaagaaaaagaaauuaagaagcuaauguuuaaga

SEQ ID NO: 224423 - RNA, 64 nt, Homo Sapiens
aaguguauuuuacuguuuucaaaaaaaaaaaaagaaaaagaaaacuagucuuguuuguaaaaaa

SEQ ID NO: 224424 - RNA, 64 nt, Homo Sapiens
agaaaaaaguguauuuuacuaaaaaaaaaaaaaaaaaaagaaaauauaagcuagucuuguuugu

SEQ ID NO: 224425 - RNA, 64 nt, Homo Sapiens
agaaacaaaaaacacauuaaauuauaucuaaacaaaaaagaauaagaaaagaaacaugguucaa

SEQ ID NO: 224426 - RNA, 64 nt, Homo Sapiens
gaaaagaaacaugguucaaagagacucuguuucaaaaaagaaaacuccagccuggugacagagu

SEQ ID NO: 224427 - RNA, 64 nt, Homo Sapiens
auuucugaguaaucuggaagaaaaauguucuacaaaaaagaagugaaacagagcaugagcccac

SEQ ID NO: 224428 - RNA, 64 nt, Homo Sapiens
ugucccuguggaaauguccauaacuuggaaaaggaaaaagaagaagucgagcugaagacaauuu

SEQ ID NO: 224429 - RNA, 64 nt, Homo Sapiens
uuuuaagagugacuauuacaacgaaaauuucuagaaaaagaagugaaacauuccaccuggcuac

SEQ ID NO: 224430 - RNA, 64 nt, Homo Sapiens
cccgggucugcagagaaugaaaagcaguuuuuauaaaaagaaaguggugucucuaugcccuuug

SEQ ID NO: 224431 - RNA, 64 nt, Homo Sapiens
caagcagauggcuuaaagcuuacaaaaaaaaaaaaaaaagaaaucuuuuccuauauauguuccu

SEQ ID NO: 224432 - RNA, 64 nt, Homo Sapiens
gcuacacccaaacaauacaaucugacaacuugauaaaaagaaaacauaaauauguaugcauacu

SEQ ID NO: 224433 - RNA, 64 nt, Homo Sapiens
uaaguuacuugucugcagucuaguggaaaagacaaaaaagaaacgacuuuguucuuccaagucc

SEQ ID NO: 224434 - RNA, 64 nt, Homo Sapiens
ccagaagccuuauuugugauguuuaccucacacuaaaaagaaaagccuuaauauugaauauacu

SEQ ID NO: 224435 - RNA, 64 nt, Homo Sapiens
acagaccauuuaaaaacucaaauccuacauaaugaaaaagaaaaaagaauuuuggugggcaucu

SEQ ID NO: 224436 - RNA, 64 nt, Homo Sapiens
ucuggaauguagccccacuccagugucauugauuaaaaagaauagugaaaaagaagcucuaaaa

SEQ ID NO: 224437 - RNA, 64 nt, Homo Sapiens
ucuaaaacagugucauugauauucaaugaaagugaaaaagaagcaaacuaaagacaugugacuu

SEQ ID NO: 224438 - RNA, 64 nt, Homo Sapiens
uucuaauauaaagcauuucaccuguuuauggauuaaaaagaaaaagauucugugauuuauuugc

SEQ ID NO: 224439 - RNA, 64 nt, Homo Sapiens
gacaucucuuguacacugaaauguuaaugaagauaaaaagaaguauuucaggaggagaaugagu

SEQ ID NO: 224440 - RNA, 64 nt, Homo Sapiens
caguugaugaaugaguuuaucaagaauaauacagaaaaagaagaacuucaacaaucuugagugc

SEQ ID NO: 224441 - RNA, 64 nt, Homo Sapiens
agcagcaguaucuuguucucauauuucaaaagacaaaaagaagccagagccuacaaaacauugu

SEQ ID NO: 224442 - RNA, 64 nt, Homo Sapiens
cacagcuuuuggcauucauguugccaauaaaaagaaaaagaacuuucauaaaaauauauuuacu

SEQ ID NO: 224443 - RNA, 64 nt, Homo Sapiens
agaacucacagcuuuuggcauuuacuuugccaauaaaaagaaaaugguccuucauaaaaauaua

SEQ ID NO: 224444 - RNA, 64 nt, Homo Sapiens
aaucagcuuauauuuuuuauuauguaaaaccaacaaaaagaacaucagguugucuaaguguuuu

SEQ ID NO: 224445 - RNA, 64 nt, Homo Sapiens
acauaucucagguugucuaauuuuuuuaaucaucaaaaagaacauugcgcccggccuuaaaugu

SEQ ID NO: 224446 - RNA, 64 nt, Homo Sapiens
aacagaaauauauccagcuaaaaaaaaaagaaaaaaaaagaaaauucugugacaaaaaaaaaaa

SEQ ID NO: 224447 - RNA, 64 nt, Homo Sapiens
aaaaagaaaaaacagaaauaaaaaaaaaaaaaaaaaaaagaaaagcaaacaguguucugugaca

SEQ ID NO: 224448 - RNA, 64 nt, Homo Sapiens
aaaguacacauucagaaucuaugagugcauuuugaaaaagaaaaaauaugaacuuugguucuuc

SEQ ID NO: 224449 - RNA, 64 nt, Homo Sapiens
aaccucacuuuuccuuuauagaaguacguuaaagaaaaagaaaaaccaagaagcucaaagaaaa

SEQ ID NO: 224450 - RNA, 64 nt, Homo Sapiens
ccacuuauucuuaguuaauaucuguacaaaggagaaaaagaacccuccuagugaaagaaaaauc

SEQ ID NO: 224451 - RNA, 64 nt, Homo Sapiens
ucuuuuuuuuuuuuaaucacuuauuuuaugcagcaaaaagaagccauaauucaguccuuuagau

SEQ ID NO: 224452 - RNA, 64 nt, Homo Sapiens
ggugacagaguaacacucugucucagaaaaaaaaaaaaagaaaaauauaugggguaaauacagu

SEQ ID NO: 224453 - RNA, 64 nt, Homo Sapiens
uguauaccuauguuaaugaaacaacagaaguacaaaaaagaauaucagauacaaaaaucaaucg

SEQ ID NO: 224454 - RNA, 64 nt, Homo Sapiens
uugcuguauuaacugaugauaaaacuaauggcagaaaaagaaguugagcaauuucuauguaaug

SEQ ID NO: 224455 - RNA, 64 nt, Homo Sapiens
agaauuugaguccuguuaauguaguagaaaaaaaaaaaagaaauuuucuuuuucuuuugugcug

SEQ ID NO: 224456 - RNA, 64 nt, Homo Sapiens
ccauuugcuauaaaguugaacuuuguauggcuugaaaaagaaaugacaauauggaacaucccaa

SEQ ID NO: 224457 - RNA, 64 nt, Homo Sapiens
uaacauuuauaauugcaaaauaaaccaacuauaaaaaaagaaacuaagagagaauugguacuuu

SEQ ID NO: 224458 - RNA, 64 nt, Homo Sapiens
uaaugcucuuaagauauauaacugucuuucauuuaaaaagaaauuucuaacacagacuuucuuc

SEQ ID NO: 224459 - RNA, 64 nt, Homo Sapiens
aaaggacuaacaagcuucacuugauuuggucacuaaaaagaagaaugguuagauacacagcaug

SEQ ID NO: 224460 - RNA, 64 nt, Homo Sapiens
gaaaagaucuucuuugaagaaaccaaaaagaagaaaaaagaaagguuuuaaacuuuggguacca

SEQ ID NO: 224461 - RNA, 64 nt, Homo Sapiens
aaaaagaaaggaaaagaucuuuggguaccaaaccaaaaagaagaccuuacuucuguuuuaaacu

SEQ ID NO: 224462 - RNA, 64 nt, Homo Sapiens
caaccaaagaaaauugguacgaacauuaauguugaaaaagaaaauaccuggcuacaauuacuuu

SEQ ID NO: 224463 - RNA, 64 nt, Homo Sapiens
gguagggauuuggcuaugccuauuccuacaaagaaaaaagaagguuugcucaauaugaucuuga

SEQ ID NO: 224464 - RNA, 64 nt, Homo Sapiens
uauugccaaauauuaagaagauauuuuuugauggaaaaagaauaacaguguuuuaggugccugg

SEQ ID NO: 224465 - RNA, 64 nt, Homo Sapiens
gauaaauauuugaaaccaugauuuuguccccaacaaaaagaaauuuucaaauagcuaaaaggag

SEQ ID NO: 224466 - RNA, 64 nt, Homo Sapiens
cuuagacacugcuggugggaagaugcgggaaaaaaaaaagaacuuaaaaauaacauauugguga

SEQ ID NO: 224467 - RNA, 50 nt, Homo Sapiens
uuaucuccuauagaaaacagaaaaagaaucugauuccauucauauuguaa

SEQ ID NO: 224468 - RNA, 64 nt, Homo Sapiens
guaugaggcaagagaaauaaauaauauucaagacaaaaagaacagcaaaggaaaaagugauaga

SEQ ID NO: 224469 - RNA, 64 nt, Homo Sapiens
uagaaauguccuaauuuaacuuacauuucaacugaaaaagaaaccugucuuaaauuccaaagcu

SEQ ID NO: 224470 - RNA, 64 nt, Homo Sapiens
acagucuuacaccaucaaggcaguucuuggaaugaaaaagaaauacucagaaaaaagaagcugc

SEQ ID NO: 224471 - RNA, 64 nt, Homo Sapiens
ugccaguucuuggaaugaaaagaaaugacucagaaaaaagaagcgaaacauaaucaauggauuc

SEQ ID NO: 224472 - RNA, 64 nt, Homo Sapiens
agcauuuuauauuacuacuccacuuguaacaaugaaaaagaaaaauguuggcaaucaaagcaug

SEQ ID NO: 224473 - RNA, 64 nt, Homo Sapiens
uugcaaauuuguuaaaaugcaacagaaaaagaaaaaaaagaacgcagucuuaaaaaaaaaaaaa

SEQ ID NO: 224474 - RNA, 64 nt, Homo Sapiens
aaaagaacguugcaaauuugaaaaaaaaaaacagaaaaagaaaaugaauuaggcagucuuaaaa

SEQ ID NO: 224475 - RNA, 64 nt, Homo Sapiens
cuaaugcuaguauauacugcagaaaaaaaauuuuaaaaagaaagccuuuuaaaaaugcuuauag

SEQ ID NO: 224476 - RNA, 64 nt, Homo Sapiens
agaaacagcagaaagcagucaaaagaaaagcaaaaaaaagaagaaaaucaggcugagaaaaagc

SEQ ID NO: 224477 - RNA, 64 nt, Homo Sapiens
caagcaaaaaucaggcugagaagaggaaaccaagaaaaagaagcggucuggggaccaugguaua

SEQ ID NO: 224478 - RNA, 64 nt, Homo Sapiens
aaaucccuuguucucagugggaaaaaaagaaaagaaaaagaaaaugcccuucccccugcaaaaa

SEQ ID NO: 224479 - RNA, 64 nt, Homo Sapiens
gaaaaagaaaaaaaucccuucccugcaaaaagaaaaaaagaaaagauauacucccugcccuucc

SEQ ID NO: 224480 - RNA, 64 nt, Homo Sapiens
aaagaaaagaaaaagaaaaagcccuucccccugcaaaaagaaaaguguagacgauauacucccu

SEQ ID NO: 224481 - RNA, 64 nt, Homo Sapiens
aucaacuuaccaggcaccaaaagaaguaaaagcaaaaaagaaaaccuuucuucaccaaaucuug

SEQ ID NO: 224482 - RNA, 64 nt, Homo Sapiens
ugaguggacuggccucaaagcaagcauucagaagaaaaagaagcaaccucaguaauuuagaaau

SEQ ID NO: 224483 - RNA, 64 nt, Homo Sapiens
gagagcauugggauaucuccugaaaagguuuaugaaaaagaagaaucucaucucagugaagaau

SEQ ID NO: 224484 - RNA, 64 nt, Homo Sapiens
cuuucuuuggaugggacuagagcuuucuuucacaaaaaagaaguaggggaagacaugcagccua

SEQ ID NO: 224485 - RNA, 64 nt, Homo Sapiens
aauuuaaagccacaaccacauacaacacaaagagaaaaagaaaugcaaaaaucucugcgugcag

SEQ ID NO: 224486 - RNA, 64 nt, Homo Sapiens
ccugauaagcuucaaagcugcuuuauucaauaaaaaaaagaaaugaaaaagauauaugaauaug

SEQ ID NO: 224487 - RNA, 64 nt, Homo Sapiens
uccagcuugggcaacagagcaagacuccaucucaaaaaagaaaaaagaaaagaaauagaauuau

SEQ ID NO: 224488 - RNA, 64 nt, Homo Sapiens
ugggcaacagagcaagacuccaucucaaaaaagaaaaaagaaaagaaauagaauuaucaagcuu

SEQ ID NO: 224489 - RNA, 64 nt, Homo Sapiens
auuugaagauggagcacugcugauuuaugaaggaaaaaagaagaauuuucuaaagauuacacau

SEQ ID NO: 224490 - RNA, 64 nt, Homo Sapiens
auaaauaauaaaguaggcauuuguuuauuuuguaaaaaagaaaugaaaaucugcuggccagcua

SEQ ID NO: 224491 - RNA, 64 nt, Homo Sapiens
cuaggcaauguagugagacccugucucuaauuuaaaaaagaaaaagaaaaaaacauucccagug

SEQ ID NO: 224492 - RNA, 64 nt, Homo Sapiens
aauguagugagacccugucucuaauuuaaaaaagaaaaagaaaaaaacauucccaguggcagcc

SEQ ID NO: 224493 - RNA, 64 nt, Homo Sapiens
ugaaagcuugcuguacaaaggcaacagcaacuuaaaaaagaaaaucuggacaauagauguggac

SEQ ID NO: 224494 - RNA, 64 nt, Homo Sapiens
auuuugauaugacugaauugcaaucuauauuuuuaaaaagaaaaaucaaaauacauuaggguuu

SEQ ID NO: 224495 - RNA, 64 nt, Homo Sapiens
cuuucuugauacuuagucaugggaggauauuacaaaaaagaaauuuaaauuguguucauagucu

SEQ ID NO: 224496 - RNA, 64 nt, Homo Sapiens
augguacuccuaaagcauaugccucaccugguuaaaaaagaacaaacauguuuuugugaaagcu

SEQ ID NO: 224497 - RNA, 64 nt, Homo Sapiens
aaaccaaccacagaucaaaaauagaaaaaaaaaaaaaaagaaaaaaagaauguaaaauuuuaaa

SEQ ID NO: 224498 - RNA, 64 nt, Homo Sapiens
cacagaucaaaaauagaaaaaaaaaaaaaaagaaaaaaagaauguaaaauuuuaaaaauacagu

SEQ ID NO: 224499 - RNA, 64 nt, Homo Sapiens
auuguucuuaaggcaucauaucuagaagcaaagaaaaaagaaaaauaacaauuuaaguugugua

SEQ ID NO: 224500 - RNA, 64 nt, Homo Sapiens
caguuacuuauauuaauaauauucagaaaaaaaaaaaaagaaaaggaaaaagaaaaauauauau

SEQ ID NO: 224501 - RNA, 64 nt, Homo Sapiens
agacucugucucagaaaaaaaaaaaaagaaaaggaaaaagaaaaauauauauucuauauuuuuu

SEQ ID NO: 224502 - RNA, 64 nt, Homo Sapiens
aauugcaaagcacagauaaauggaaauaaacaggaaaaagaaucaccuauaaccucaccaucca

SEQ ID NO: 224503 - RNA, 64 nt, Homo Sapiens
cuaaagggaaaggggaaagaaagggaaaagggagaaaaagaaacacaagagacuuaaaggacag

SEQ ID NO: 224504 - RNA, 64 nt, Homo Sapiens
auuuggaguuagguccucacuugggggaaaaaaaaaaaagaaaagccaagcaaaccaaugguga

SEQ ID NO: 224505 - RNA, 64 nt, Homo Sapiens
uguugucguuuuaacaucuccacgucccuagcauaaaaagaaaaagaaaaaaauuuaaacugcu

SEQ ID NO: 224506 - RNA, 64 nt, Homo Sapiens
cguuuuaacaucuccacgucccuagcauaaaaagaaaaagaaaaaaauuuaaacugcuuuuucg

SEQ ID NO: 224507 - RNA, 64 nt, Homo Sapiens
uuucaauuacauccugacuuguauagacacagccaaaaagaaacuguuaauagccauccgucca

SEQ ID NO: 224508 - RNA, 64 nt, Homo Sapiens
agguuugaauggaguugaaaguuuuacauaagugaaaaagaaaguuuaucuugggaguugaguu

SEQ ID NO: 224509 - RNA, 64 nt, Homo Sapiens
cacacugcagcagagcuuguagcuggacagagucaaaaagaagaaaauacgguuucaggcuuuc

SEQ ID NO: 224510 - RNA, 64 nt, Homo Sapiens
agugaugccuuauuugaaacugggcuuaaacugcaaaaagaaugaaguuggauuuaggaagcug

SEQ ID NO: 224511 - RNA, 64 nt, Homo Sapiens
uucacuagcagggaaguuuccuugagccuaaaauaaaaagaaaaaauuaaaaagaaucaguuuu

SEQ ID NO: 224512 - RNA, 64 nt, Homo Sapiens
aguuuccuugagccuaaaauaaaaagaaaaaauuaaaaagaaucaguuuuuuuaauuaaaaaaa

SEQ ID NO: 224513 - RNA, 64 nt, Homo Sapiens
uucuucugagaaugugacuuuuucugguguuguaaaaaagaaaaaaaaaagaaugcucauugua

SEQ ID NO: 224514 - RNA, 64 nt, Homo Sapiens
augugacuuuuucugguguuguaaaaaagaaaaaaaaaagaaugcucauuguaaaaauaaaaaa

SEQ ID NO: 224515 - RNA, 64 nt, Homo Sapiens
ccccuccuaccccagucccuaaaagaaauggggaaaaaagaaaacaacagcaagucagaaaaaa

SEQ ID NO: 224516 - RNA, 64 nt, Homo Sapiens
cagaggauaacacuugucucuuaaaaacuaagcuaaaaagaaccuagaaccuucaauugagcag

SEQ ID NO: 224517 - RNA, 64 nt, Homo Sapiens
cgacugaaaaaguucaucuggaauaauuauugaaaaaaagaacaauaaccuauggcaguugguu

SEQ ID NO: 224518 - RNA, 64 nt, Homo Sapiens
uggccaaacaauuauucaccuucauaaaaugaagaaaaagaaugagugcauagguccauaauau

SEQ ID NO: 224519 - RNA, 64 nt, Homo Sapiens
acaaauauuaauagaaaucugauuuuuaaaaaagaaaaagaaacaaaauacaaccgagagggga

SEQ ID NO: 224520 - RNA, 64 nt, Homo Sapiens
agaaacacaaauauuaauagaggggagauuuuuaaaaaagaaaagaggcuaaaauacaaccgag

SEQ ID NO: 224521 - RNA, 64 nt, Homo Sapiens
aaauaccacuaugaauaaggcuacaccuguuuacaaaaagaaucgaucaaggucacagcacugc

SEQ ID NO: 224522 - RNA, 64 nt, Homo Sapiens
uaguuaugggaguuaaguuuuggcauucuacaacaaaaagaagccaaucccgacaguagcagaa

SEQ ID NO: 224523 - RNA, 64 nt, Homo Sapiens
acugaugauuagauuagguugcuugccuucuuuuaaaaagaaaaaucauggauaaaaacuaagc

SEQ ID NO: 224524 - RNA, 64 nt, Homo Sapiens
aaaaaaaaaaaauucaucauuauucuugucuuucaaaaagaaccccucuuuacuuauaucaaau

SEQ ID NO: 224525 - RNA, 64 nt, Homo Sapiens
uugagguuuuaggauuuucaaaauuuuaaaaaagaaaaagaaaaaguugaauaagaguuggcuu

SEQ ID NO: 224526 - RNA, 64 nt, Homo Sapiens
agaaaauugagguuuuaggauggcuuaaauuuuaaaaaagaaaaaagaaaaguugaauaagagu

SEQ ID NO: 224527 - RNA, 64 nt, Homo Sapiens
gcaaggaaaaggcucuuuauaagaaaaaaagggaaaaaagaaaauguaagaaaagaaaaaagaa

SEQ ID NO: 224528 - RNA, 64 nt, Homo Sapiens
gaaaaaaagggaaaaaagaaguuguaagaaaagaaaaaagaaaaugauucacgacuuaauguau

SEQ ID NO: 224529 - RNA, 64 nt, Homo Sapiens
caaaaaaagacugacaaugauuaguuuugucuuuaaaaagaauuuccaguucgaucuucugggu

SEQ ID NO: 224530 - RNA, 64 nt, Homo Sapiens
cauugauaauucuaacucaguaaaaagacaaaaaaaaaagaauuuuuuuaaaaucaagaaaauu

SEQ ID NO: 224531 - RNA, 64 nt, Homo Sapiens
aaaaaagccucucuguccuacaaaugccaaaaagaaaaagaaaaagaagauugaccaaaccauc

SEQ ID NO: 224532 - RNA, 64 nt, Homo Sapiens
agaaaaaaaaaagccucucuaccauccaaaugccaaaaagaaaaaggaagagaagauugaccaa

SEQ ID NO: 224533 - RNA, 64 nt, Homo Sapiens
ugcggcaccuuauuuauguggauguauggaaacuaaaaagaacacuccucacucugggacagac

SEQ ID NO: 224534 - RNA, 64 nt, Homo Sapiens
cauuguuuuaauugagagggaaaaaaagaaaagaaaaaagaaagcagagcaagacuccgucuca

SEQ ID NO: 224535 - RNA, 64 nt, Homo Sapiens
gaaaaaagaaagcauuguuugacuccgucucaaaaaaaagaaaacagcccgggugacagagcaa

SEQ ID NO: 224536 - RNA, 64 nt, Homo Sapiens
uaaaauugcaguauuuaaagcuuaagcuuucaggaaaaagaaaauaagaauucagugugugcau

SEQ ID NO: 224537 - RNA, 64 nt, Homo Sapiens
uaaucaguuuagcuuuguguuguaugcuaguuuaaaaaagaaaauauguaauauaauguaaaaa

SEQ ID NO: 224538 - RNA, 64 nt, Homo Sapiens
cgggggggguaggagaggagaaaaaaaaagugaaaaaaagaaacgaaaaggacagacgaagagu

SEQ ID NO: 224539 - RNA, 64 nt, Homo Sapiens
aaaggacagacgaagaguuuaaagagaaaagggaaaaaagaaagaaaaaguaagcagggcuggc

SEQ ID NO: 224540 - RNA, 64 nt, Homo Sapiens
gcagucaguggagggcgagugguuucggaaaaaaaaaaagaaaaaaagaaaaaaaaagaaaaaa

SEQ ID NO: 224541 - RNA, 64 nt, Homo Sapiens
uggagggcgagugguuucggaaaaaaaaaaagaaaaaaagaaaaaaaaagaaaaaaaaaagauu

SEQ ID NO: 224542 - RNA, 64 nt, Homo Sapiens
gugguuucggaaaaaaaaaaagaaaaaaagaaaaaaaaagaaaaaaaaaagauuuuuuucuucu

SEQ ID NO: 224543 - RNA, 64 nt, Homo Sapiens
aauucaaggccacaaaaacaauguuugggggaaaaaaaagaaaaaaucaugccagcuaaucaug

SEQ ID NO: 224544 - RNA, 64 nt, Homo Sapiens
uuguggaguaucccauucugaugaguacagaaaaaaaaagaaaaagaaaagaagagaaaaaauu

SEQ ID NO: 224545 - RNA, 64 nt, Homo Sapiens
aguaucccauucugaugaguacagaaaaaaaaagaaaaagaaaagaagagaaaaaauuaagaaa

SEQ ID NO: 224546 - RNA, 64 nt, Homo Sapiens
cagauaauguugaugacauugacccuuuguuuaaaaaaagaaacuguaaauuugacauaauuuc

SEQ ID NO: 224547 - RNA, 64 nt, Homo Sapiens
aggcccuauagccacauaaauauaaauuucauagaaaaagaauaaaagcggagauauauuuuuu

SEQ ID NO: 224548 - RNA, 64 nt, Homo Sapiens
uuaacaaaugugaauuauugaaaugugaagggacaaaaagaaucauacauuuaaacugucuugu

SEQ ID NO: 224549 - RNA, 64 nt, Homo Sapiens
acuggguucgaucagcccuccuaaagcuggcuggaaaaagaagccccagcccagccugccucau

SEQ ID NO: 224550 - RNA, 64 nt, Homo Sapiens
auuuuuaguuacuuaccuugaacauauucgugugaaaaagaauacaucauuucucacagucuua

SEQ ID NO: 224551 - RNA, 64 nt, Homo Sapiens
aacuggggaguucuugaguuccucauuuguugguaaaaagaaaaagaaugugaaaaugucucuu

SEQ ID NO: 224552 - RNA, 64 nt, Homo Sapiens
ggaguucuugaguuccucauuuguugguaaaaagaaaaagaaugugaaaaugucucuuuuuuuc

SEQ ID NO: 224553 - RNA, 64 nt, Homo Sapiens
uacacaugugagguuugaaaaaaaaaaaaaaaaaaaaaagaacuaccuugugaguuuugcucaa

SEQ ID NO: 224554 - RNA, 60 nt, Homo Sapiens
gccacagcacaaaguuuuaaugucuuuaagaaaaagaaaucaaucugcagaaaugugaag

SEQ ID NO: 224555 - RNA, 64 nt, Homo Sapiens
gcuuggcuuucacgggggaggguuguauucaguaaaaaagaauaguaaauauaaggucacugag

SEQ ID NO: 224556 - RNA, 64 nt, Homo Sapiens
uccuuaagggacuaaauuaaugcuugggugcauuaaaaagaacaaaacauucccacauguuggg

SEQ ID NO: 224557 - RNA, 64 nt, Homo Sapiens
cugugugcuccugagaacucuuacuugagacaucaaaaagaagcagcaagagcuucugggacag

SEQ ID NO: 224558 - RNA, 64 nt, Homo Sapiens
ucauuuccuucaauuuccuuugaccuauaggcuaaaaaagaaaggcucauuccagccacagggc

SEQ ID NO: 224559 - RNA, 64 nt, Homo Sapiens
agcacaauuauggguuacuuccuuuuucuuaacaaaaaagaauguuugauuuccucugggugac

SEQ ID NO: 224560 - RNA, 64 nt, Homo Sapiens
uuuauauauuuuuucauuagggccauaucuccaaaaaaagaaagaaaaaauacaaaaaacaaaa

SEQ ID NO: 224561 - RNA, 64 nt, Homo Sapiens
uuuguauuucaagauaauguaguuuaaaaaaaaaaaaaagaaaaaaacuugauguaaauuccuc

SEQ ID NO: 224562 - RNA, 64 nt, Homo Sapiens
caagauaauauagguaaauaacaaaacuuccuuaaaaaagaauauuaaaccucucuucucuuug

SEQ ID NO: 224563 - RNA, 64 nt, Homo Sapiens
auauaauuuucacaugaaccagaacaaaauguacaaaaagaacaaaagugaaaauuauguuccu

SEQ ID NO: 224564 - RNA, 64 nt, Homo Sapiens
aaaaucuauaacaacaacuuucauacaaaugguuaaaaagaaacuuauuuuacaaaaauauuuu

SEQ ID NO: 224565 - RNA, 64 nt, Homo Sapiens
aacagacaaagguuugaaaacaucaaagaagaagaaaaagaagguuuuaauauuuuaugauugc

SEQ ID NO: 224566 - RNA, 64 nt, Homo Sapiens
gugagugaacagcaaggaagccacgccuuuuaggaaaaagaaaacugggaucccucugucaacc

SEQ ID NO: 224567 - RNA, 64 nt, Homo Sapiens
cuuucugcucauaucauaacuccucuucuuuuaaaaaaagaacauugccuuuccaagugaccuc

SEQ ID NO: 224568 - RNA, 64 nt, Homo Sapiens
uacugucugucuuaaauuuuaaaaaaaaaaaagaaaaaagaaagcagaccuugucucaaaaaaa

SEQ ID NO: 224569 - RNA, 64 nt, Homo Sapiens
aagaaaguacugucugucuuaaaaaaaaaaaaaaaaaaagaaaaacagagccagaccuugucuc

SEQ ID NO: 224570 - RNA, 64 nt, Homo Sapiens
guacuuguuaggaaguagcucaguaaagacuuugaaaaagaaauauuuaaaaauuaaucaguua

SEQ ID NO: 224571 - RNA, 64 nt, Homo Sapiens
ugaaugauguugaauuuuagccuaaaugggaugcaaaaagaaacagccucagcaacaaacauuu

SEQ ID NO: 224572 - RNA, 64 nt, Homo Sapiens
auuaugcacacaucuaacauccccagcuacaaugaaaaagaagauaauugaccacuuccuuggc

SEQ ID NO: 224573 - RNA, 64 nt, Homo Sapiens
ugguuuugcucguuuaagagauuucuuuaaauagaaaaagaauuggggaaaauaaagauuuaau

SEQ ID NO: 224574 - RNA, 64 nt, Homo Sapiens
acgucucauucuucaauacuuuucaucaauaggaaaaaagaaauuggauagcuuuucuaauaau

SEQ ID NO: 224575 - RNA, 64 nt, Homo Sapiens
cucucacuauaguauaagaaucuauuuuggagaaaaaaagaaaauaugagggucucgaagcaug

SEQ ID NO: 224576 - RNA, 64 nt, Homo Sapiens
gaagaaucaaaacaaaagcaaaaaaaaaaagcaaaaaaagaaaagagaaaaaaagaaaaaaugc

SEQ ID NO: 224577 - RNA, 64 nt, Homo Sapiens
aagcaaaaaaaaaaagcaaaaaaagaaaagagaaaaaaagaaaaaaugcaaauggaauaauuuu

SEQ ID NO: 224578 - RNA, 64 nt, Homo Sapiens
cuggcuuccuaagaaauguuuaagacucagcuuuaaaaagaaguuaacauucauaucucuguuu

SEQ ID NO: 224579 - RNA, 64 nt, Homo Sapiens
acuccagccugggugauagagcaagacugucucaaaaaagaaaaaaaagaaaaaauuuuaauuu

SEQ ID NO: 224580 - RNA, 64 nt, Homo Sapiens
ugggugauagagcaagacugucucaaaaaagaaaaaaaagaaaaaauuuuaauuuaauccuucu

SEQ ID NO: 224581 - RNA, 64 nt, Homo Sapiens
gucuguuucaaauaaaugaacucaaucuaaauuaaaaaagaaagaaauuugaaaaaacuuucuc

SEQ ID NO: 224582 - RNA, 64 nt, Homo Sapiens
gcacaucuacuugcuuaaauugugggcaaaagagaaaaagaaggauugaucagagcauugugca

SEQ ID NO: 224583 - RNA, 64 nt, Homo Sapiens
uuuauuuuuacuuuuuuauuauaauuuugauauuaaaaagaacagagauggggucuugcuuugu

SEQ ID NO: 224584 - RNA, 64 nt, Homo Sapiens
ugucuuauuuccuaaagugaagcaucuuuuuuuaaaaaagaauuugauugacaauauauccagu

SEQ ID NO: 224585 - RNA, 64 nt, Homo Sapiens
uaaaauuauuucagagaugugugcuccuggagggaaaaagaaauacagccucaacagauuaaaa

SEQ ID NO: 224586 - RNA, 64 nt, Homo Sapiens
ugggugacuagcaaaacuccaucucaaaaaaaaaaaaaagaaagaaagaaacugaaaagugagg

SEQ ID NO: 224587 - RNA, 64 nt, Homo Sapiens
gccuggcaacagagcaagagucugucucaaaaaaaaaaagaaaaaaagaaaaaaagaaaaaaga

SEQ ID NO: 224588 - RNA, 64 nt, Homo Sapiens
acagagcaagagucugucucaaaaaaaaaaagaaaaaaagaaaaaaagaaaaaagaaaaaucuc

SEQ ID NO: 224589 - RNA, 64 nt, Homo Sapiens
agagucugucucaaaaaaaaaaagaaaaaaagaaaaaaagaaaaaagaaaaaucucauuauuuc

SEQ ID NO: 224590 - RNA, 64 nt, Homo Sapiens
gucucaaaaaaaaaaagaaaaaaagaaaaaaagaaaaaagaaaaaucucauuauuucaaaauga

SEQ ID NO: 224591 - RNA, 64 nt, Homo Sapiens
auaaacuucagcugaagauuuuauauaggacuuuaaaaagaagagaagagaaagaagaaacaau

SEQ ID NO: 224592 - RNA, 64 nt, Homo Sapiens
augguugcaaaaaaaaaaaaaagucagugcuucuaaaaagaauuuaagauaaugguuuuuaaaa

SEQ ID NO: 224593 - RNA, 64 nt, Homo Sapiens
uuacccuuucauguacuuccaaagaaagguaaucaaaaagaaucuucuuaagugauauaauauc

SEQ ID NO: 224594 - RNA, 64 nt, Homo Sapiens
auaauaaauuauauuaguaaaagucuuaacuggaaaaaagaaucuaaaucagaauagugaucaa

SEQ ID NO: 224595 - RNA, 64 nt, Homo Sapiens
auaauauuuuuaaaaauaugaaaauaaaugaugaaaaaagaacuuaugacaguguacauauaug

SEQ ID NO: 224596 - RNA, 64 nt, Homo Sapiens
augugguggcucucauuuaaggcauucuuugugcaaaaagaagcucaauuuuauguuuccuuuu

SEQ ID NO: 224597 - RNA, 64 nt, Homo Sapiens
aagcaacgaaaacaaaaugccagagacuggcucaaaaaagaaaggcuguuaaauuggccugcuc

SEQ ID NO: 224598 - RNA, 64 nt, Homo Sapiens
uuuaacacuaauuuuccaaacauguguggguuaaaaaaagaagcaaaaugaaagauugaauguu

SEQ ID NO: 224599 - RNA, 64 nt, Homo Sapiens
aaacuauaaauacaaaucugaccuguagaugcagaaaaagaaaauacaugcauaaaagggucaa

SEQ ID NO: 224600 - RNA, 64 nt, Homo Sapiens
accaagagaaggggacuucucuuuaaaaagaaaaaaaaagaauuuccucuguaagauaucccag

SEQ ID NO: 224601 - RNA, 64 nt, Homo Sapiens
aaaaagaauuaccaagagaagauaucccagcuuuaaaaagaaaaaauuuuuccuuccucuguaa

SEQ ID NO: 224602 - RNA, 64 nt, Homo Sapiens
guauaguuaaugguuucaaagccuuaaaauaaugaaaaagaaaacugacuauuuuaucaaauuu

SEQ ID NO: 224603 - RNA, 64 nt, Homo Sapiens
aaacucacaauauuaacauaagccugcuacauguaaaaagaaccuuguaauuuaacaauaaaua

SEQ ID NO: 224604 - RNA, 64 nt, Homo Sapiens
uuguccauuuagcuuucauaacaaccuacauauaaaaaagaaacuugcacaggguggagucaaa

SEQ ID NO: 224605 - RNA, 64 nt, Homo Sapiens
gaaagccuuuauuuccugguagauagauuuuaaaaaaaagaauaagguuuagggaguguaccuc

SEQ ID NO: 224606 - RNA, 64 nt, Homo Sapiens
agccgggugagguggugugugaaaaaaaaaaagaaaaaagaaaagugaccucccgucucucucg

SEQ ID NO: 224607 - RNA, 64 nt, Homo Sapiens
aagaaaaagccgggugagguucucucggaaaaaaaaaaagaaaacaacauggugaccucccguc

SEQ ID NO: 224608 - RNA, 64 nt, Homo Sapiens
aguuuccaauuacccugauggaagugaggaugcgaaaaagaauggggauaagaauagucuucua

SEQ ID NO: 224609 - RNA, 64 nt, Homo Sapiens
aacuaaacauuuaaacaaaauuuaaaaucaaaucaaaaagaaaacaaaacagaaaaauaaauga

SEQ ID NO: 224610 - RNA, 64 nt, Homo Sapiens
agaaugaaaacugcugacgugaaaaaaagaaggaaaaaagaauauaacauugcaaugaaaaaau

SEQ ID NO: 224611 - RNA, 64 nt, Homo Sapiens
aaaaaagaauaagaaugaaaaaugaaaaaaugaaaaaaagaaggcucugguguguuaacauugc

SEQ ID NO: 224612 - RNA, 64 nt, Homo Sapiens
guuguuauggacuggacacccaaaaaaaaaaaaaaaaaagaaaggacagagugagacucuaucu

SEQ ID NO: 224613 - RNA, 64 nt, Homo Sapiens
guucuggacuauugaacagcagcccuaaaauagaaaaaagaacaagacuaaauagaaaccccuc

SEQ ID NO: 224614 - RNA, 64 nt, Homo Sapiens
caaagaaaaccuaaaguuguaaauuaaauuaaaaaaaaagaagagaaaaagaaaaagaaaauaa

SEQ ID NO: 224615 - RNA, 64 nt, Homo Sapiens
uaaaaauuaaauuaaaaaaagcucacagaaaaagaaaaagaaaaaguuucaauacaagccauag

SEQ ID NO: 224616 - RNA, 64 nt, Homo Sapiens
agaaaauaaaaauuaaauuaccauaggcucacagaaaaagaaaaaccuaaaguuucaauacaag

SEQ ID NO: 224617 - RNA, 64 nt, Homo Sapiens
gucuacguaugcaugcuaaauuguauuuauauauaaaaagaaacacugucuuuauuuuuguaua

SEQ ID NO: 224618 - RNA, 64 nt, Homo Sapiens
aaggguuuaugcuuacgucuugcagaguauuuggaaaaagaaaacgccucuggagccgccauuc

SEQ ID NO: 224619 - RNA, 64 nt, Homo Sapiens
ggcaaguuucccuaaguuugaguugauaguuauuaaaaagaaaacaaaacaaaaaaaaaaggca

SEQ ID NO: 224620 - RNA, 64 nt, Homo Sapiens
gaaacuggguauauuuaugauuucuuucagcguuaaaaagaaacauaguguugcccuuuuucuu

SEQ ID NO: 224621 - RNA, 64 nt, Homo Sapiens
gacuucuuuguugauuuuuuaagauagaaagauuaaaaagaaagaaagaugggaagaaaaugaa

SEQ ID NO: 224622 - RNA, 64 nt, Homo Sapiens
uuaaggaucugcucuaugaaggagaagaaagaggaaaaagaaguaaaggaguuaggaggagaca

SEQ ID NO: 224623 - RNA, 64 nt, Homo Sapiens
gaauaaagagagagaugaauuuauaaaguaggaaaaaaagaaucugaaagauacaaagugauua

SEQ ID NO: 224624 - RNA, 64 nt, Homo Sapiens
aucaaggaaagcaagagagcagauaauacaaaagaaaaagaagaagguucacauaaauagcuuc

SEQ ID NO: 224625 - RNA, 64 nt, Homo Sapiens
uauaguagaaaaggaaacuaguagggccaaaaaaaaaaagaaaaagaaaaagaaaaaagaaaaa

SEQ ID NO: 224626 - RNA, 64 nt, Homo Sapiens
agaaaaggaaacuaguagggccaaaaaaaaaaagaaaaagaaaaagaaaaaagaaaaaaaaaga

SEQ ID NO: 224627 - RNA, 64 nt, Homo Sapiens
ggaaacuaguagggccaaaaaaaaaaagaaaaagaaaaagaaaaaagaaaaaaaaagaaaaaac

SEQ ID NO: 224628 - RNA, 64 nt, Homo Sapiens
aguagggccaaaaaaaaaaagaaaaagaaaaagaaaaaagaaaaaaaaagaaaaaacugggacc

SEQ ID NO: 224629 - RNA, 64 nt, Homo Sapiens
aaaaaaaaaagaaaaagaaaaagaaaaaagaaaaaaaaagaaaaaacugggaccuaaguauaaa

SEQ ID NO: 224630 - RNA, 64 nt, Homo Sapiens
agaucacuacagaccaaaacagaagaagaagaaaaaaaagaaaaagaaaucuaagcaacauggu

SEQ ID NO: 224631 - RNA, 64 nt, Homo Sapiens
cuacagaccaaaacagaagaagaagaaaaaaaagaaaaagaaaucuaagcaacaugguaaguac

SEQ ID NO: 224632 - RNA, 64 nt, Homo Sapiens
cagaacgaaguuaccagcaggauggaccuaauagaaaaagaagucgaugguaauuuaagaaaga

SEQ ID NO: 224633 - RNA, 64 nt, Homo Sapiens
acaucaguuuaaaggcacaacucagcauaguagcaaaaagaacgcauagucaguaauaauaaaa

SEQ ID NO: 224634 - RNA, 64 nt, Homo Sapiens
ccuuucuuuuguuuuuuacauuguaaguaaaaacaaaaagaaaaacaaagauauucucuauguu

SEQ ID NO: 224635 - RNA, 64 nt, Homo Sapiens
aauaagucacaaccccuucacaccacuacaaaaaaaaaagaauucaacaccgccacaccaacac

SEQ ID NO: 224636 - RNA, 64 nt, Homo Sapiens
aaagagggaaaaagagcugggaaaaaaagaaaaaaaaaagaaaguguaggaucguaaaaaaaua

SEQ ID NO: 224637 - RNA, 64 nt, Homo Sapiens
aaaaaagaaagaaagagggaguaaaaaaauagaaaaaaagaaaauggaccaucucuguaggauc

SEQ ID NO: 224638 - RNA, 64 nt, Homo Sapiens
aaagaaaagguacauguauagacucugucucaaaaaaaagaaagccagccugggcaacgggcga

SEQ ID NO: 224639 - RNA, 64 nt, Homo Sapiens
cccuucacucuacaggggacaaaacuaaaaagaaaaaaagaagcuuuaagacucugucuuaaaa

SEQ ID NO: 224640 - RNA, 64 nt, Homo Sapiens
aaagaagccccuucacucuaucuuaaaaaaaacuaaaaagaaaagcaauuuuuuuaagacucug

SEQ ID NO: 224641 - RNA, 64 nt, Homo Sapiens
agcuagcagauuuacuccuuagcuuucacauuaaaaaaagaaaaaucugccugagggcuugcau

SEQ ID NO: 224642 - RNA, 64 nt, Homo Sapiens
uaguauuaagggaagcgcaacucauugaucagacaaaaagaaacuaaaaacaaauuggcuuugu

SEQ ID NO: 224643 - RNA, 64 nt, Homo Sapiens
cccuaccugugaguuccuuuaguuucuugcugugaaaaagaacuacaugacuuuguuuauuuaa

SEQ ID NO: 224644 - RNA, 64 nt, Homo Sapiens
caggggaagaaagauaucuaaaaaguaauuacuuaaaaagaaauagaaacuaaauggucuuuau

SEQ ID NO: 224645 - RNA, 64 nt, Homo Sapiens
aucauuuaaucaguaccauucuuacaaaaggcuuaaaaagaacaauuaaaauuauuauucuaga

SEQ ID NO: 224646 - RNA, 64 nt, Homo Sapiens
uaaaaagccauauauacugcuaggggcuuauacaaaaaagaaaaaaauauagauucuaaauaaa

SEQ ID NO: 224647 - RNA, 64 nt, Homo Sapiens
caugauauuuacuguuuuguaaauaaaauaauaaaaaaagaaagaaacucauauuacaaaaaca

SEQ ID NO: 224648 - RNA, 64 nt, Homo Sapiens
uuaaucauagucaccugacuagggaaauauauacaaaaagaaaauggcaaaacuauuauaugua

SEQ ID NO: 224649 - RNA, 64 nt, Homo Sapiens
gaacauaaucaaguaaggaugauacaguuuucagaaaaagaaauacuccauuacucugauuuuu

SEQ ID NO: 224650 - RNA, 64 nt, Homo Sapiens
aauguaaagaccguaaugcauguuaacuuuuuuaaaaaagaagcgguggcuuuuuucauacuac

SEQ ID NO: 224651 - RNA, 64 nt, Homo Sapiens
acguaguaaauguauacuuagcaccaaaaaugugaaaaagaaucgaagcuuugaaauaaauacu

SEQ ID NO: 224652 - RNA, 64 nt, Homo Sapiens
cuguauaaacuuaacagggaagggcuggggugugaaaaagaagauuguaugaaaaccauuggua

SEQ ID NO: 224653 - RNA, 64 nt, Homo Sapiens
auuuuaaauauucuaguagccacauuaauaaaguaaaaagaaacaggugagguuaauuugaaug

SEQ ID NO: 224654 - RNA, 64 nt, Homo Sapiens
caucucuguucaucccuuccuauaaccucuagguaaaaagaaaagaaaaaaagaaauuucgaga

SEQ ID NO: 224655 - RNA, 64 nt, Homo Sapiens
cccuuccuauaaccucuagguaaaaagaaaagaaaaaaagaaauuucgagauauuuucaacauu

SEQ ID NO: 224656 - RNA, 64 nt, Homo Sapiens
uaucucaaaccgcagaaaggcuuuaauacuggaaaaaaagaauucaagacuacaggcagcuccc

SEQ ID NO: 224657 - RNA, 64 nt, Homo Sapiens
gccugggugacaagagugaaacuccaucucaaaaaaaaagaaaagaagguccagcuuuuggauu

SEQ ID NO: 224658 - RNA, 64 nt, Homo Sapiens
agcccgggugacaaagcaagacccugucucagaaaaaaagaaaauucaaggccaguuaagacaa

SEQ ID NO: 224659 - RNA, 64 nt, Homo Sapiens
ugcuguaguaggaauguuuuaacagugucauaugaaaaagaacaaaauaaauauuuugauuuug

SEQ ID NO: 224660 - RNA, 64 nt, Homo Sapiens
augacucgcaaccccucaccccacaauuucuuuaaaaaagaaauuaucuuuaguugaauuccaa

SEQ ID NO: 224661 - RNA, 64 nt, Homo Sapiens
acauuuuaggaucucgccuggaaacagagguaaaaaaaagaagugugcgcccggcuaaugcagc

SEQ ID NO: 224662 - RNA, 64 nt, Homo Sapiens
cuguauggaaucaacaccaccgagcucugugggaaaaaagaaaaaccugcucccuucgcucugc

SEQ ID NO: 224663 - RNA, 64 nt, Homo Sapiens
accaacauguaucugucuacuuucucuuguuuaaaaaaagaaaaaaaaacuuaaaaaaaugggg

SEQ ID NO: 224664 - RNA, 64 nt, Homo Sapiens
aaggaaaaaaacaguuugaagaaaaaaaaaggaaaaaaagaaaaaucuuaaaaaaagaaaaaau

SEQ ID NO: 224665 - RNA, 64 nt, Homo Sapiens
aaugaaaaaaaaaggaaaaaguuugaaaucuuaaaaaaagaaaacuuuuccaguguguaaccca

SEQ ID NO: 224666 - RNA, 64 nt, Homo Sapiens
acaacaauaguuuaagaaaucaagcaacugagggaaaaagaaacaccuuuccuucaagcagaaa

SEQ ID NO: 224667 - RNA, 64 nt, Homo Sapiens
ccucugaacugggucggucuaacccuuauccuuuaaaaagaaauacacucauuuccaaggcccu

SEQ ID NO: 224668 - RNA, 64 nt, Homo Sapiens
aaacauggucuuguuuuuacaugcacauuuuuaaaaaaagaaaaauucauuuauguuagcauua

SEQ ID NO: 224669 - RNA, 64 nt, Homo Sapiens
aaaaaggaacuucuuauaguagggaaaaaaaagaaaaaagaaaccuguugccugcaaaaauaaa

SEQ ID NO: 224670 - RNA, 64 nt, Homo Sapiens
aagaaacaaaaaggaacuucaaauaaaagggaaaaaaaagaaaacccaugacuguugccugcaa

SEQ ID NO: 224671 - RNA, 64 nt, Homo Sapiens
aaaaguuguuuuaucuaauauauugcagguguuuaaaaagaaagaaacugaauuuuugaaagac

SEQ ID NO: 224672 - RNA, 64 nt, Homo Sapiens
gaaccaacagaauuuuaacuguguuuugcaaaagaaaaagaaaagcugaaggagaaggagggua

SEQ ID NO: 224673 - RNA, 64 nt, Homo Sapiens
aguauuagauuuuggucuccagguguuuaucauaaaaaagaaacgcacacugagauauaauaaa

SEQ ID NO: 224674 - RNA, 64 nt, Homo Sapiens
cuagaaucuaaugcagaagacaguuuugaaaccaaaaaagaaacauuuuuauggauuguagacc

SEQ ID NO: 224675 - RNA, 64 nt, Homo Sapiens
gggagcuggucacacagggcguuggggaagcuagaaaaagaaaucuuuuaguaaggcauuuggg

SEQ ID NO: 224676 - RNA, 64 nt, Homo Sapiens
ugaaaaguauuauuaagcuuccuuaugaaacaagaaaaagaaaagaacauuuggcaggaauugu

SEQ ID NO: 224677 - RNA, 64 nt, Homo Sapiens
aaaauuuuguaugucaauaauuucauuaaaaggaaaaaagaaaaagauuucuaaguuaaaucau

SEQ ID NO: 224678 - RNA, 64 nt, Homo Sapiens
aaaugauuguuuuagaaguuauaacccacugcugaaaaagaaaauuaaauuuacagaauauuau

SEQ ID NO: 224679 - RNA, 64 nt, Homo Sapiens
aaggcuggguuuacuauugcgccuuacuguauagaaaaagaaaagcauuacaggcugcauucuu

SEQ ID NO: 224680 - RNA, 64 nt, Homo Sapiens
aacucuguuguaaaaacaguggguuuaauuaaaaaaaaagaaaaugucuucuguacaucuuacu

SEQ ID NO: 224681 - RNA, 64 nt, Homo Sapiens
gccacaguuguuugaugcauuaaaagaaaauaaaaaaaagaaaaaagagaaaagaaaaaaaaag

SEQ ID NO: 224682 - RNA, 64 nt, Homo Sapiens
agaaaauaaaaaaaagaaaaaagagaaaagaaaaaaaaagaaaaaaguuguaggcgaaucauuu

SEQ ID NO: 224683 - RNA, 64 nt, Homo Sapiens
aaauaggaaaacaacaaaagaaaaacaauaacaaaaaaagaaagugugauggcugggugcagug

SEQ ID NO: 224684 - RNA, 64 nt, Homo Sapiens
aaaauaaauaaauagaaagagagagagaggaaaaaaaaagaaaagaacacuucuuuauuugagg

SEQ ID NO: 224685 - RNA, 64 nt, Homo Sapiens
aaguaccugaucaggaucugggagaauuugaaaaaaaaagaaaaacuagaaaaauaaacaaaau

SEQ ID NO: 224686 - RNA, 64 nt, Homo Sapiens
aaaaaaaagaaaaacuagaaaaauaaacaaaauuaaaaagaaaaaaaaauaccugagacugagu

SEQ ID NO: 224687 - RNA, 64 nt, Homo Sapiens
uuauaggauuccguuuuuucacaagacuuuuaauaaaaagaaauuguagaaauaaacacauuaa

SEQ ID NO: 224688 - RNA, 64 nt, Homo Sapiens
aguaauaaaggaagaauuaugacuucauuaugaaaaaaagaaguuuuaaaguuuucaauuacga

SEQ ID NO: 224689 - RNA, 64 nt, Homo Sapiens
ccgaacagccugaaaugugaacugaacaggagaaaaaaagaaaagcaaaaaacuccuguaaccc

SEQ ID NO: 224690 - RNA, 64 nt, Homo Sapiens
acacuaaauucaagucauuuguuuuaagucucuaaaaaagaagauugcagucauccauucauau

SEQ ID NO: 224691 - RNA, 64 nt, Homo Sapiens
uuucuaaccucuuauagacaugccaaaugcuggcaaaaagaagugcuuuuuggauauggcagca

SEQ ID NO: 224692 - RNA, 64 nt, Homo Sapiens
ccagccugagcaacaagagcgaaacugucucaaaaaaaagaagaaaauaaauaaauaaaaauca

SEQ ID NO: 224693 - RNA, 64 nt, Homo Sapiens
uuuuuucuuaaguuauauuuguuuuuacuuuuuaaaaaagaagaggaaacaaagcccccuuuua

SEQ ID NO: 224694 - RNA, 64 nt, Homo Sapiens
cuaguggucccuuuugaauuucaugagccucucaaaaaagaaaaacuuaaaaaaaaaaaaaaaa

SEQ ID NO: 224695 - RNA, 64 nt, Homo Sapiens
uuuuauuuccuaagaaauaauuuaauguuuaguaaaaaagaaaacagaaaaaagaaagaugcgu

SEQ ID NO: 224696 - RNA, 64 nt, Homo Sapiens
aaauaauuuaauguuuaguaaaaaagaaaacagaaaaaagaaagaugcguguguuggcuuacgc

SEQ ID NO: 224697 - RNA, 64 nt, Homo Sapiens
aacaugaggguuaaaaaucagguccuguucaaagaaaaagaaaggaccaaagaccucaaacacu

SEQ ID NO: 224698 - RNA, 58 nt, Homo Sapiens
ccaaagaccucaaacacuggcaagaaaaaaaaagaagaacaagaccccugaggcauga

SEQ ID NO: 224699 - RNA, 64 nt, Homo Sapiens
agacaucaagucauuaaaagucagguauaugauaaaaaagaauuaggguuguagaauguagucc

SEQ ID NO: 224700 - RNA, 64 nt, Homo Sapiens
gcaaauuaaauccaaaguaacuuuggaaaacuagaaaaagaagaacaaguaaucuaagcuucca

SEQ ID NO: 224701 - RNA, 64 nt, Homo Sapiens
uauucauacagaaauuaccuuuaagguguauaagaaaaagaaagcagauaacagcaggaaggac

SEQ ID NO: 224702 - RNA, 64 nt, Homo Sapiens
ugagagauucaaaaauaucauuuaauacuuauuuaaaaagaagagaucaacaccuuaaaauuca

SEQ ID NO: 224703 - RNA, 64 nt, Homo Sapiens
agaggaagaagcagcuuugcaaaaaaaaaaaaagaaaaagaaaagugggcuuuuuuuuccucuc

SEQ ID NO: 224704 - RNA, 64 nt, Homo Sapiens
agaaaaagaggaagaagcagccucucaaaaaaaaaaaaagaaaaauuccagugggcuuuuuuuu

SEQ ID NO: 224705 - RNA, 64 nt, Homo Sapiens
aauagagcuuuuuccuuuaugugcaucaaaucacaaaaagaauaguguguuaaguuuuucaucu

SEQ ID NO: 224706 - RNA, 64 nt, Homo Sapiens
ggauggucuuuguaacugauagaugaacuaagagaaaaagaaucaccaagagacagugaaaaau

SEQ ID NO: 224707 - RNA, 64 nt, Homo Sapiens
aauaaauaaaacaaacuuaaucuucaucuuuaaaaaaaagaaaaaagaaaccaaaaugagaauc

SEQ ID NO: 224708 - RNA, 64 nt, Homo Sapiens
aaaacaaacuuaaucuucaucuuuaaaaaaaagaaaaaagaaaccaaaaugagaaucaacacuu

SEQ ID NO: 224709 - RNA, 64 nt, Homo Sapiens
guuauaucuuggauauuguauuacccuggguauuaaaaagaacuccuuucacauuuuaaaauaa

SEQ ID NO: 224710 - RNA, 64 nt, Homo Sapiens
accuuuaguagucaaaccaaaaaucuaagauuccaaaaagaacagcauucauugaaauaauauu

SEQ ID NO: 224711 - RNA, 64 nt, Homo Sapiens
uaaugcaugaauauaaaucuauauuauuugcuaaaaaaagaaaaaacauuuguguuuuaguuuc

SEQ ID NO: 224712 - RNA, 64 nt, Homo Sapiens
ucucugauacuuuugaaacagaugugaaaaacagaaaaagaaaaaauugucugaaauguuuauu

SEQ ID NO: 224713 - RNA, 64 nt, Homo Sapiens
aaaauugauguugucuuuaccagaaagguagacaaaaaagaagcagcagcagcucuuaaaguga

SEQ ID NO: 224714 - RNA, 64 nt, Homo Sapiens
cucuuggaaagaaugacguuuugcuggaaaaaaaaaaaagaacaguuuguguuucacaaacaug

SEQ ID NO: 224715 - RNA, 64 nt, Homo Sapiens
guaguuaccugaauauagguugaaaagguuauguaaaaagaaauuauaauaaaagggauacuuu

SEQ ID NO: 224716 - RNA, 64 nt, Homo Sapiens
uuaacuguuugauuauaacugugcaaauacagaaaaaaagaaggcuggcugaaaguugaguuaa

SEQ ID NO: 224717 - RNA, 64 nt, Homo Sapiens
aacauuucacaaauguuuagugaaacauuugugaaaaaagaagacuaaauuaagaccugagcug

SEQ ID NO: 224718 - RNA, 64 nt, Homo Sapiens
ucauuuauuuuaaauaaaugaauaaaauaaaauaaaaaagaauauucagucguuggcacauaaa

SEQ ID NO: 224719 - RNA, 64 nt, Homo Sapiens
aauuguuaaauguucuuaaauguucucacuacaaaaaaagaaaaaagauaacuacgugagguga

SEQ ID NO: 224720 - RNA, 64 nt, Homo Sapiens
aggaccaaaccaugcacauaaagcuuguaguuuaaaaaagaaaagcaaaaaaauaauuaugccu

SEQ ID NO: 224721 - RNA, 64 nt, Homo Sapiens
agccugggcaacagagggagacucugucucaaaaaaaaagaaguuacuuccaagacagacuuuu

SEQ ID NO: 224722 - RNA, 64 nt, Homo Sapiens
auucagaaaaggaggaaaggguaguuuaauuucaaaaaagaaucccuuccucuuuccucugcug

SEQ ID NO: 224723 - RNA, 64 nt, Homo Sapiens
aacuguggccugaagggauggggaguagcaacauaaaaagaaguggcucaagucuucuuggagu

SEQ ID NO: 224724 - RNA, 64 nt, Homo Sapiens
uagaguagaggccuauugccagaaagagaagaagaaaaagaagguccugaacggaaaaggaaga

SEQ ID NO: 224725 - RNA, 64 nt, Homo Sapiens
ggauccugaacggaaaaggagaagaagaaaaagaaaaaagaagaccaucugauucagaucacaa

SEQ ID NO: 224726 - RNA, 64 nt, Homo Sapiens
aagaagaggauccugaacggaucacaagaagaagaaaaagaaaaagaaacaccaucugauucag

SEQ ID NO: 224727 - RNA, 64 nt, Homo Sapiens
caaaaacuuuccaaauuccacggaaaugugugggaaaaagaaaacuuggaaaacaccccaaccc

SEQ ID NO: 224728 - RNA, 64 nt, Homo Sapiens
ggaaaaaccccgugcucgccaagaggaaacgcaaaaaaagaaaaugccucaggcuucucuuacg

SEQ ID NO: 224729 - RNA, 64 nt, Homo Sapiens
gcuuguaugauuuucaaaagcaccuaacuuuaagaaaaagaaccuuuuuaauugaguguaaaca

SEQ ID NO: 224730 - RNA, 64 nt, Homo Sapiens
uuuucaaauaaaacccaaaacaaaauacuccaagaaaaagaaaauguaguaguuggucuagaaa

SEQ ID NO: 224731 - RNA, 64 nt, Homo Sapiens
aagcuauuuguuaaaauauuugccuuuuuaaguaaaaaagaaaaaucagaacagggcuauuuga

SEQ ID NO: 224732 - RNA, 64 nt, Homo Sapiens
uugcacuuagguaccaggugucaggaaacagacuaaaaagaauuccaccaggcuguuuggagau

SEQ ID NO: 224733 - RNA, 64 nt, Homo Sapiens
uccauuugaucuauagcaaugugauuuuauuuuuaaaaagaaaagcaguguguuuucuuuuuuu

SEQ ID NO: 224734 - RNA, 64 nt, Homo Sapiens
uuaucugauguugguuugauacuguuaacacaccaaaaagaauauggaauugaaaugagcuagc

SEQ ID NO: 224735 - RNA, 64 nt, Homo Sapiens
ugaagacaauuucuguaaugguuuuaagagauuuaaaaagaaauucacugguucuuuacaaaau

SEQ ID NO: 224736 - RNA, 64 nt, Homo Sapiens
aaaauaccguuaauucaaauugacagagauugauaaaaagaaacugauuuaccuaaguuuacuu

SEQ ID NO: 224737 - RNA, 64 nt, Homo Sapiens
gggcgacagugcaagacucugucuccaaaaaaaaaaaaagaaaaaagaaaaucccccuucaucc

SEQ ID NO: 224738 - RNA, 64 nt, Homo Sapiens
agugcaagacucugucuccaaaaaaaaaaaaagaaaaaagaaaaucccccuucaucccccagga

SEQ ID NO: 224739 - RNA, 64 nt, Homo Sapiens
gccaucaaauggcuacaguucauuuaaauuuaaaaaaaagaaaaaagaaacagaaaacgugucu

SEQ ID NO: 224740 - RNA, 64 nt, Homo Sapiens
aauggcuacaguucauuuaaauuuaaaaaaaagaaaaaagaaacagaaaacgugucucagaugg

SEQ ID NO: 224741 - RNA, 64 nt, Homo Sapiens
agugaaucccuuuguucucuguuuaaaaaaaucuaaaaagaaaaaggaaaaaaaaaaaagaacu

SEQ ID NO: 224742 - RNA, 64 nt, Homo Sapiens
guuuaaaaaaaucuaaaaagaaaaaggaaaaaaaaaaaagaacugcugugggauugucaaccag

SEQ ID NO: 224743 - RNA, 64 nt, Homo Sapiens
caauuuugaggguucagauuuagcuuggaagaaaaaaaagaaacauacauccuucaguauagga

SEQ ID NO: 224744 - RNA, 64 nt, Homo Sapiens
gaauguuagcaucuucacuaggguaaagaagaacaaaaagaauguugcuggaacguaaaauagu

SEQ ID NO: 224745 - RNA, 64 nt, Homo Sapiens
gaagcacaugaucaugggaaugauagcccagaacaaaaagaaaucuugucuuaccacaguguuu

SEQ ID NO: 224746 - RNA, 64 nt, Homo Sapiens
auuaugaauggaggauauucuacuguacuuuuuuaaaaagaaacuauuuuuguguuugaaagug

SEQ ID NO: 224747 - RNA, 64 nt, Homo Sapiens
cacaaaauaccccaacacaggcgggggagagacgaaaaagaaaaggaaagagcaagauagacaa

SEQ ID NO: 224748 - RNA, 64 nt, Homo Sapiens
ggaaagagcaagauagacaaaagccaaucagcuuaaaaagaaaaacaaggaaggggaaaagaaa

SEQ ID NO: 224749 - RNA, 53 nt, Homo Sapiens
aggaagaaaacaaggacuaagcaaaaaagaaagacccccccccccuuagcaac

SEQ ID NO: 224750 - RNA, 64 nt, Homo Sapiens
acauacuaccuaaagggaaccugcaauaaucuugaaaaagaaaaagagaaaaauuuuaaaaucc

SEQ ID NO: 224751 - RNA, 64 nt, Homo Sapiens
aaaaaaagagaaaaaaauaaaaaucaaaaaaaaaaaaaagaaagaaagaaaccuccagcguauu

SEQ ID NO: 224752 - RNA, 64 nt, Homo Sapiens
aguacuuuguauuguauacgugagucauaauaauaaaaagaagaagaaaaauaauagaagcugg

SEQ ID NO: 224753 - RNA, 64 nt, Homo Sapiens
ugugauuaugaccauuguuucauauuccaauuaaaaaaagaacagcagccuagcuacuuaaggu

SEQ ID NO: 224754 - RNA, 64 nt, Homo Sapiens
ucucucagccugggaaacuaucaacucuuucuuuaaaaagaaagaggguugaaaauccucugga

SEQ ID NO: 224755 - RNA, 64 nt, Homo Sapiens
uaaucuggcaucuucuccaggccuaaaucuuaagaaaaagaaaugggugcugggguuuggggga

SEQ ID NO: 224756 - RNA, 64 nt, Homo Sapiens
gauaaacugaaguggcacugugacuuuaaaaauaaaaaagaaaucuacuuggaaguccuuuuug

SEQ ID NO: 224757 - RNA, 64 nt, Homo Sapiens
caaagauccaccgagagaagaagagaaagaaaagaaaaagaaaaagcacaaaaaaagaucucga

SEQ ID NO: 224758 - RNA, 64 nt, Homo Sapiens
ucucucucucucugcauuaggggagucucucaggaaaaagaagcccagaucucuucagcaaucg

SEQ ID NO: 224759 - RNA, 64 nt, Homo Sapiens
ccuuuuauuuuucucucucuuuacauauaaauaaaaaaagaaucaccacccuaaaguuggauuu

SEQ ID NO: 224760 - RNA, 64 nt, Homo Sapiens
augaauuucucuuuacuucugcaccugacagaaaaaaaagaaaaucauuuuuuuucuuuguaau

SEQ ID NO: 224761 - RNA, 64 nt, Homo Sapiens
aaguuuuguuuuguuuuuuggugcuacaauuuuuaaaaagaaaaugaauguguuuuguuguuuu

SEQ ID NO: 224762 - RNA, 64 nt, Homo Sapiens
aaauggaaaaaaauuacaaguauauuuuuucuauaaaaagaaaaggucacucuccccaaaauau

SEQ ID NO: 224763 - RNA, 64 nt, Homo Sapiens
ugaauaccuaagauuucuguuagcaaugccugugaaaaagaaaccagaguuuugguuuuugaac

SEQ ID NO: 224764 - RNA, 64 nt, Homo Sapiens
caaagacaaaguguguaauuaugguaaaaagaagaaaaagaaguuaaagaaaagaugagcaaag

SEQ ID NO: 224765 - RNA, 64 nt, Homo Sapiens
aaaagaagucaaagacaaagugagcaaagaugguaaaaagaagaucgaaaacauaaagaaaaga

SEQ ID NO: 224766 - RNA, 64 nt, Homo Sapiens
uggauguuuuccagcauuuagccaaauuccauacaaaaagaauuuugagcacuggguucuuuua

SEQ ID NO: 224767 - RNA, 64 nt, Homo Sapiens
gccauaagaaaaccagguaaaggaaacaacuagcaaaaagaauaagaaaaagaaaaaagugaaa

SEQ ID NO: 224768 - RNA, 64 nt, Homo Sapiens
aagugaaaaggaaacaacuaaaaagauaaaguagaaaaagaaaaacacagucaaagaaagagaa

SEQ ID NO: 224769 - RNA, 56 nt, Homo Sapiens
ggagaaaaaaacuucuuuaaaaaaagaaaaagaagauuccaccccuuccuaaguaa

SEQ ID NO: 224770 - RNA, 50 nt, Homo Sapiens
agaagaggagaaaaaaacuuaaaaagaaaauuccaccccuuccuaaguaa

SEQ ID NO: 224771 - RNA, 64 nt, Homo Sapiens
aaaaagucuagcgaaaaaacuuuuuaauaagguuaaaaagaaaauauuuuuaggaccaaucuca

SEQ ID NO: 224772 - RNA, 64 nt, Homo Sapiens
aaaaaaauaauuuuucuuuuggacuaaaagccaaaaaaagaaagugcagagaugagguccuucu

SEQ ID NO: 224773 - RNA, 64 nt, Homo Sapiens
aaagaaaaaaggcagaagccaaaaaaaaaaaagaaaaaagaaagcagagcgaaccucugucuca

SEQ ID NO: 224774 - RNA, 64 nt, Homo Sapiens
aagaaagaaagaaaaaaggcugucucaaaaaaaaaaaaagaaaaggggugacagagcgaaccuc

SEQ ID NO: 224775 - RNA, 64 nt, Homo Sapiens
ucauuuuguauacagagaacaaaaaaaugccugcaaaaagaagagaaguuaaaacuugagaagc

SEQ ID NO: 224776 - RNA, 64 nt, Homo Sapiens
aauaaaaaaaccuucagcugugggcucacuuuaaaaaaagaaagcugggaaagacaccaaauca

SEQ ID NO: 224777 - RNA, 64 nt, Homo Sapiens
uugugcucuuuucuaauccaacagaacaaaacaaaaaaagaaaagcaguaugccacuucuuaaa

SEQ ID NO: 224778 - RNA, 64 nt, Homo Sapiens
cauagacauauuuuuuuaaaaagaaaaaaagaaaaaaaagaaagaaguacuugacuaaaaaaaa

SEQ ID NO: 224779 - RNA, 64 nt, Homo Sapiens
aaaagaaagcauagacauauuaaaaaaaaaagaaaaaaagaaaaucuuuaagaaaguacuugac

SEQ ID NO: 224780 - RNA, 64 nt, Homo Sapiens
aaagaaaaaaaagaaagcauuacuugacuaaaaaaaaaagaaaacuauuguuucuuuaagaaag

SEQ ID NO: 224781 - RNA, 64 nt, Homo Sapiens
ccccauuuaguggagccagccucugaauauaugcaaaaagaaggaaaaaaaagacucccuggau

SEQ ID NO: 224782 - RNA, 64 nt, Homo Sapiens
augcaaauaguugcaacuuuacaucaugcuuacaaaaaagaauaacacaaagcuuuauuuuucc

SEQ ID NO: 224783 - RNA, 64 nt, Homo Sapiens
aaaagcacgugaccuuaugaucucaaaaaagaaaaaaaagaaaagcaacaaaagcgaaacucug

SEQ ID NO: 224784 - RNA, 64 nt, Homo Sapiens
aaaagaaaaaaaagcacguggaaacucugucucaaaaaagaaaaccagccugggcaacaaaagc

SEQ ID NO: 224785 - RNA, 64 nt, Homo Sapiens
aaucagcgucauuuguucccagagaguucaguuaaaaaagaaaauuucauaaaacauuuucuug

SEQ ID NO: 224786 - RNA, 64 nt, Homo Sapiens
auuuaaugacgguuuaaaaccuucagauuucuacaaaaagaaacucaaauucagacgcagaacu

SEQ ID NO: 224787 - RNA, 64 nt, Homo Sapiens
cuguuucaacagaugaccguacuaagaucuguuaaaaaagaaauaguaccuaugacuuuuuuaa

SEQ ID NO: 224788 - RNA, 64 nt, Homo Sapiens
guguuuuguuuuuuaauucuagacucuucacuccaaaaagaaaaugguuauaacagcaaaugaa

SEQ ID NO: 224789 - RNA, 64 nt, Homo Sapiens
aauaauaaaaggccuccauuuaaaagacuuugauaaaaagaaacauagcgcugguacaguacac

SEQ ID NO: 224790 - RNA, 64 nt, Homo Sapiens
aaaacacaaaaaauaaaaaaccaauucuaagcagaaaaagaaaaggcuuuucuucccuagaaac

SEQ ID NO: 224791 - RNA, 64 nt, Homo Sapiens
ugaaggaccucaaagcaccuauuuucuuaucacaaaaaagaaaauucaacguuaauaauucugg

SEQ ID NO: 224792 - RNA, 64 nt, Homo Sapiens
cacuuaaaaugaucauuaggcauuuaccuuuuugaaaaagaaaaaaugugucuuucuuuuugga

SEQ ID NO: 224793 - RNA, 64 nt, Homo Sapiens
ucagcuuuucuaagaucaagggaaauaugcugccaaaaagaaaacuuucccaucaguucucacc

SEQ ID NO: 224794 - RNA, 64 nt, Homo Sapiens
aaaaaucaaugaacuugaaggagauuagauacagaaaaagaagauuguuaaaaucccgagugga

SEQ ID NO: 224795 - RNA, 64 nt, Homo Sapiens
gccgcugcacuccagccugggagacugcaucucaaaaaagaaaaauaaacgaaguaaaagauau

SEQ ID NO: 224796 - RNA, 64 nt, Homo Sapiens
agauugugucacugcacucuagccugggcgacagaaaaagaaaauuuagguggggaaaaaaauc

SEQ ID NO: 224797 - RNA, 64 nt, Homo Sapiens
ugaguccacguuugguagcaucaguuguugaguuaaaaagaaaauuauugcauuugaucuggau

SEQ ID NO: 224798 - RNA, 64 nt, Homo Sapiens
uucacauuugccaccauaauguucuuuuuuauguaaaaagaagaacuuggagacauuaacauga

SEQ ID NO: 224799 - RNA, 64 nt, Homo Sapiens
uuuuuugacaaaucauauuguauucuuuuguacaaaaaagaacuacuuguauucuagaagaaau

SEQ ID NO: 224800 - RNA, 64 nt, Homo Sapiens
uuagugauuauuaagcacuucugucagucuuugaaaaaagaacguauuuuuugugcuuugaaga

SEQ ID NO: 224801 - RNA, 64 nt, Homo Sapiens
aucugugcuguagaaaaacauuaacccuuguucaaaaaagaaauggauaaacuuggccuuucua

SEQ ID NO: 224802 - RNA, 64 nt, Homo Sapiens
agcacauugcauguaguugagccacauuuuuuaaaaaaagaaaauggaugaccauuaauugacu

SEQ ID NO: 224803 - RNA, 64 nt, Homo Sapiens
augacccuuuugaauauaccuaaugauuuccuuaaaaaagaaauuuuaaacagacuuguuuaau

SEQ ID NO: 224804 - RNA, 64 nt, Homo Sapiens
aucaugaggucagcaguugagaccagccaaaaggaaaaagaaaauuaugagaguuacuuaaagg

SEQ ID NO: 224805 - RNA, 64 nt, Homo Sapiens
ccagcuauugucuguuguguucagcugagaugcaaaaaagaaauuaagcaaaaaagaaaaagau

SEQ ID NO: 224806 - RNA, 64 nt, Homo Sapiens
guguucagcugagaugcaaaaaagaaauuaagcaaaaaagaaaaagaugaagacuuuucaugaa

SEQ ID NO: 224807 - RNA, 64 nt, Homo Sapiens
uucaaauuuagcaauaaacaauuagcauuaguuaaaaaagaaacauauuccaagggcagguucg

SEQ ID NO: 224808 - RNA, 64 nt, Homo Sapiens
aucaugugauucuagauuaacauuaaauagauugaaaaagaaacuuugcacgguaugagcuuca

SEQ ID NO: 224809 - RNA, 64 nt, Homo Sapiens
gaugcaccaaccguaucauuauuuguuugaggaaaaaaagaaaucugcauuuuaauucauguug

SEQ ID NO: 224810 - RNA, 64 nt, Homo Sapiens
uauguagaaugacuauucuaaauauuaauguauuaaaaagaaaauacaacaaaauguauauuua

SEQ ID NO: 224811 - RNA, 64 nt, Homo Sapiens
uuuuaaagggaaugauuggggggaaaaacuggugaaaaagaaauauaaaaaggacccuaaaaag

SEQ ID NO: 224812 - RNA, 64 nt, Homo Sapiens
aaaacuggugaaaaagaaauauaaaaaggacccuaaaaagaauucugcaaaauaagagaagaaa

SEQ ID NO: 224813 - RNA, 64 nt, Homo Sapiens
aaaaguagcaguaaaauuauuguacaauaugaaaaaaaagaauauuaauaccuaauaucauagu

SEQ ID NO: 224814 - RNA, 64 nt, Homo Sapiens
aagaacauuuuucacucugauuucucaugaaaguaaaaagaaccccacaugaacacugucaucu

SEQ ID NO: 224815 - RNA, 64 nt, Homo Sapiens
aacuugcuuuguagguuuguaucaaaaaaccuuaaaaaagaaguucuaguugugucaccaaauc

SEQ ID NO: 224816 - RNA, 64 nt, Homo Sapiens
aaaaccauauguguauuaggaaaaaggaaaaaaaaaaaagaaaacucaaaaaaaaaaaaaaaaa

SEQ ID NO: 224817 - RNA, 64 nt, Homo Sapiens
aaaacaacuuuuuuuaaagcuuuuuagcuguaacaaaaagaaagaagugaauggugauuggaaa

SEQ ID NO: 224818 - RNA, 64 nt, Homo Sapiens
uauggaugaagugaacccauaagaguauucugaaaaaaagaagauuugaaauaagacaggaaua

SEQ ID NO: 224819 - RNA, 64 nt, Homo Sapiens
gcaauuccuuuuuagcaaggaaagagaaggcauuaaaaagaaguauaagugcauauauagugug

SEQ ID NO: 224820 - RNA, 64 nt, Homo Sapiens
gcacuuguaaacagaauguuuaaacauaugauaaaaaaagaaauaaauuaaauuucacccuauu

SEQ ID NO: 224821 - RNA, 64 nt, Homo Sapiens
ucagggaucacugggagaagaaaaaaagaagaagaaaaagaaaccagcaguaaacuauggggaa

SEQ ID NO: 224822 - RNA, 64 nt, Homo Sapiens
agaaaaagaaacucagggauaacuauggggaaaaaaaaagaagaagaaccuaagcacagcagua

SEQ ID NO: 224823 - RNA, 64 nt, Homo Sapiens
auaaugagagcaaaugcaaaaacaacaucauuccaaaaagaacaggacagcuacuucugggaaa

SEQ ID NO: 224824 - RNA, 64 nt, Homo Sapiens
aagcaauuagguagcacagcaaaguuggaaaggaaaaaagaaaaugcugcugccucugaaacag

SEQ ID NO: 224825 - RNA, 64 nt, Homo Sapiens
aaagcaaucucgcaguacauauugauggaaaaagaaaaagaagaggcauuccagccccuauguu

SEQ ID NO: 224826 - RNA, 64 nt, Homo Sapiens
agaagaaaagcaaucucgcauauguuauugauggaaaaagaaaaaaaagaggcauuccagcccc

SEQ ID NO: 224827 - RNA, 64 nt, Homo Sapiens
aaaaaaaaggaaagaaagaaugaacaaaaaaaacaaaaagaaaagucaaccagugaggcugccc

SEQ ID NO: 224828 - RNA, 64 nt, Homo Sapiens
gagagagaggaaaaaaagaggaaagaaggaaaaaaaaaagaauuaaaaaaaaaaaaaagaaaaa

SEQ ID NO: 224829 - RNA, 64 nt, Homo Sapiens
ggaaagaaggaaaaaaaaaagaauuaaaaaaaaaaaaaagaaaaacagaagaugaccuugaugg

SEQ ID NO: 224830 - RNA, 64 nt, Homo Sapiens
uuuaaucuuuaucauuuucuugaaguaaauaaacaaaaagaaacauuuguuugcauaggaauuc

SEQ ID NO: 224831 - RNA, 64 nt, Homo Sapiens
uugcauaggaauucaugaaggcgacccaaccuggaaaaagaacuauucacuuuggccauggggg

SEQ ID NO: 224832 - RNA, 64 nt, Homo Sapiens
ucccaaaugggaaaggugcugacagaguuggagaaaaaagaauagacucauuuuuccccauuau

SEQ ID NO: 224833 - RNA, 64 nt, Homo Sapiens
ccucucucaccccguaaacugacaagcaugaugaaaaaagaagcacauccaaguuucugccucu

SEQ ID NO: 224834 - RNA, 64 nt, Homo Sapiens
uuuaauuauguaaaaaacaaaacuacaacaacaaaaaaagaaaaaaguuaaaaaagaaaaaaac

SEQ ID NO: 224835 - RNA, 64 nt, Homo Sapiens
acaaaacuacaacaacaaaaaaagaaaaaaguuaaaaaagaaaaaaacaccaaaaaacaaaaac

SEQ ID NO: 224836 - RNA, 64 nt, Homo Sapiens
cccaaggcaaagaagggggaaaaaagaagaaacgaaaaagaaagaaaauuuugaaaaagaagau

SEQ ID NO: 224837 - RNA, 64 nt, Homo Sapiens
aacgaaaaagaaagcccaaguugaaaaagaagauaaaaagaagaugagaaaacaccaaaaaauu

SEQ ID NO: 224838 - RNA, 64 nt, Homo Sapiens
uaaaaagaagaaacgaaaaaaccaaaaaauuuugaaaaagaagaugauguuccacugagaaaac

SEQ ID NO: 224839 - RNA, 64 nt, Homo Sapiens
uuuaacuuaaaauauuuuagaaaaaaaaaaaaagaaaaagaaaauuaaacuuauuuugcuuuaa

SEQ ID NO: 224840 - RNA, 64 nt, Homo Sapiens
agaaaauuuaacuuaaaauacuuuaaaaaaaaaaaaaaagaaaaucccuuuuaaacuuauuuug

SEQ ID NO: 224841 - RNA, 64 nt, Homo Sapiens
aaaaauuuaaaggguguacuuuucuaaaaaaagaaaaaagaagauacaaaaaaaaaguuuuauu

SEQ ID NO: 224842 - RNA, 64 nt, Homo Sapiens
aagaagaaaaaauuuaaagguuuuauuuuucuaaaaaaagaaaaauauuuguacaaaaaaaaag

SEQ ID NO: 224843 - RNA, 64 nt, Homo Sapiens
aggaacauaacccaggagucaugaguauuauuuaaaaaagaaaaauaaauauguuguucaaauu

SEQ ID NO: 224844 - RNA, 64 nt, Homo Sapiens
uggggaagaaaagaaggaaacuuuuuuaagcaccaaaaagaagagauccugguguuucuauguu

SEQ ID NO: 224845 - RNA, 64 nt, Homo Sapiens
accacucccaguccccagccguacauuuuguuguaaaaagaaaaugccuaguuuuuaguaaucu

SEQ ID NO: 224846 - RNA, 64 nt, Homo Sapiens
ugaaaaacaaccaagcgcauguuuuuuuuuuuaaaaaaagaaaaucccccccuaaaauuugugg

SEQ ID NO: 224847 - RNA, 64 nt, Homo Sapiens
aggagcucaacuaaaaguggauacacaaggccagaaaaagaagaagccacggaaacauagaaac

SEQ ID NO: 224848 - RNA, 64 nt, Homo Sapiens
gaaauugacaagcuaggaaauggagagagugguaaaaaagaaauaggguuaauuucuaggcagg

SEQ ID NO: 224849 - RNA, 64 nt, Homo Sapiens
cccuuacauuuaaaagagcuguaaauaaaacaauaaaaagaaaaucaguuucuuagaauccuag

SEQ ID NO: 224850 - RNA, 64 nt, Homo Sapiens
guuuuuuggagaggcagauguaagaacuguggccaaaaagaacaaauuucagcuuaauugacca

SEQ ID NO: 224851 - RNA, 64 nt, Homo Sapiens
aaaaggaaguaguuaaaugcugacaaccuuugagaaaaagaaacacaggagaaaaaggguuguu

SEQ ID NO: 224852 - RNA, 64 nt, Homo Sapiens
aaaaaacaaaaacaaacagggugaauuuggaaauaaaaagaaaauuuaauguaccuuuuuguua

SEQ ID NO: 224853 - RNA, 64 nt, Homo Sapiens
gaccaucgucaaagaccugcucaagaaauuuuuaaaaaagaaacaaaguuaugggguuaaucuc

SEQ ID NO: 224854 - RNA, 64 nt, Homo Sapiens
guguagauauuugucauauauuuaagaaaaagcuaaaaagaauggaaaucgcaugacuauaacu

SEQ ID NO: 224855 - RNA, 64 nt, Homo Sapiens
aaaacacaaagaaguuuuucuuuguguuuggaucaaaaagaaacuuuguuuuuccgcaauugaa

SEQ ID NO: 224856 - RNA, 64 nt, Homo Sapiens
uuuuaaucuuaagauucuuugugaugagggugagaaaaagaauccucaguuuauuuuuccacua

SEQ ID NO: 224857 - RNA, 64 nt, Homo Sapiens
ccacucuuccacccucuaccccuuaccuuauucuaaaaagaacuuagguagguuauggugccuc

SEQ ID NO: 224858 - RNA, 64 nt, Homo Sapiens
acuaucucagaaacaaaacaaaacaaaacaacaaaaaaagaaaaggcagaguacaaggagauac

SEQ ID NO: 224859 - RNA, 64 nt, Homo Sapiens
caaugcuuuccauauugugaauuuaauuuaguggaaaaagaagacuguggcacuuuucaccaua

SEQ ID NO: 224860 - RNA, 64 nt, Homo Sapiens
aauuuaaaaaauuuuaaaaaaaaaggaaggaaaaaaaaagaaaacaaaacaaaauaaaacaaaa

SEQ ID NO: 224861 - RNA, 64 nt, Homo Sapiens
gccuuaacauauauaaaaguaguauauugaaaagaaaaagaagauuuuuuaaaauucuaaguag

SEQ ID NO: 224862 - RNA, 64 nt, Homo Sapiens
uuuauuuuuuaaaauucuaaaacaagagguaccaaaaaagaaaguuucccaggcuaauacagga

SEQ ID NO: 224863 - RNA, 64 nt, Homo Sapiens
caaggauacuaagaaaauagugagaaaucugaaaaaaaagaaagaaagaagagaaaagaucguc

SEQ ID NO: 224864 - RNA, 64 nt, Homo Sapiens
gaaaagaucgucugagaaauacaagccucugucaaaaaagaagauggggcgguauggucaggac

SEQ ID NO: 224865 - RNA, 64 nt, Homo Sapiens
cuuaagcaaacagucccaaaccucuuaggggugaaaaaagaaacaugccacuugauuaggagag

SEQ ID NO: 224866 - RNA, 64 nt, Homo Sapiens
ugggcaagaagagcgaaacugggucucaaguuaaaaaaagaaagcaaggaaagaguaauuuaca

SEQ ID NO: 224867 - RNA, 64 nt, Homo Sapiens
aaagcacuguuucuauuuuuuucuuuuuuuccaaaaaaagaaaguaauaaaaacuuaaauucuu

SEQ ID NO: 224868 - RNA, 64 nt, Homo Sapiens
uccaaggcccaggacacuugucagaaggaugcaaaaaaagaaaaaaguacauccacccucuuaa

SEQ ID NO: 224869 - RNA, 64 nt, Homo Sapiens
ugggguuuuguuucuguuguuguucaaaugcaaaaaaaagaaaaaaaaagaaaaaaaaagguga

SEQ ID NO: 224870 - RNA, 64 nt, Homo Sapiens
uuucuguuguuguucaaaugcaaaaaaaagaaaaaaaaagaaaaaaaaaggugacucacauugu

SEQ ID NO: 224871 - RNA, 64 nt, Homo Sapiens
gaaaaagcacagcucucacuggccaguagcugccaaaaagaacacccaucguauaaggaaaucc

SEQ ID NO: 224872 - RNA, 64 nt, Homo Sapiens
cgcucucucauguggggauguuugugcugcagacaaaaagaacaaaaaaaaauuuuuaaauacc

SEQ ID NO: 224873 - RNA, 64 nt, Homo Sapiens
auuguuauuuuuuuaaaggaaacaaacagacaacaaaaagaagaaaaaaaaaaagaaccuccuu

SEQ ID NO: 224874 - RNA, 64 nt, Homo Sapiens
aaggaaacaaacagacaacaaaaagaagaaaaaaaaaaagaaccuccuuggaaaaauuaauugc

SEQ ID NO: 224875 - RNA, 64 nt, Homo Sapiens
ccacuaugcccucauuuuuuuaaaaaaggaaaaaaaaaagaaacuggguuccagucuuaauuca

SEQ ID NO: 224876 - RNA, 64 nt, Homo Sapiens
aaauaaaaauaaaaaaaauaaaaaaggaaaaaaaaaaaagaagaaacaagacaugccaccuuuc

SEQ ID NO: 224877 - RNA, 64 nt, Homo Sapiens
aaaaaauccaaaagagagaaaaaaaaaaaaaagaaaaaagaaaaagccaaaaaaaaaaaaaaaa

SEQ ID NO: 224878 - RNA, 64 nt, Homo Sapiens
aagaaaaaaaaaauccaaaaaaaaaaaaaaaaaaaaaaagaaaacuuuaaaagccaaaaaaaaa

SEQ ID NO: 224879 - RNA, 64 nt, Homo Sapiens
acaagaguauaauaccuucaaaaaaaaaaagaaaaaaaagaaguggagugaaacuccgucucaa

SEQ ID NO: 224880 - RNA, 64 nt, Homo Sapiens
aaaagaaguacaagaguauaccgucucaaaaaaaaaaaagaaaauggacaacaggagugaaacu

SEQ ID NO: 224881 - RNA, 64 nt, Homo Sapiens
gcaaucaggcaagagaaagaaauaaaaggcaaccaaaaagaaaggaagucgaaguaucucuguu

SEQ ID NO: 224882 - RNA, 64 nt, Homo Sapiens
aaaucaagaaugcaauccuauucacaauugccacaaaaagaauaaaauaccuaggaauacagcu

SEQ ID NO: 224883 - RNA, 64 nt, Homo Sapiens
aaaaagagcccaaaaagccaaagcaauccuaagcaaaaagaacaaagcuggaggcaucgcauua

SEQ ID NO: 224884 - RNA, 64 nt, Homo Sapiens
gggcaaccaagcgagacucugccuuaaaaaaaaaaaaaagaaaauguggcacauauacaccaug

SEQ ID NO: 224885 - RNA, 64 nt, Homo Sapiens
gcacauauacaccauggaauacuaugcagccauaaaaaagaaugggaucauguccugugcagca

SEQ ID NO: 224886 - RNA, 64 nt, Homo Sapiens
gguuugcccaaggacuacaaauaaaccaacgggaaaaaagaaagguuccaguuuugucugaaaa

SEQ ID NO: 224887 - RNA, 64 nt, Homo Sapiens
ucagaacagcaaccaaauaaaacugaacuuggcaaaaaagaacuuugccgagaaaauuguguac

SEQ ID NO: 224888 - RNA, 64 nt, Homo Sapiens
uuuucucauaaaauagucugauaagcuaauuuuuaaaaagaaaugccauuaacuguguuguauc

SEQ ID NO: 224889 - RNA, 64 nt, Homo Sapiens
uggcccaacuugggaguggggaaauugcuuaaaaaaaaagaaaaagaaaaaaaaaaagauuauu

SEQ ID NO: 224890 - RNA, 64 nt, Homo Sapiens
aacuugggaguggggaaauugcuuaaaaaaaaagaaaaagaaaaaaaaaaagauuauucuaaau

SEQ ID NO: 224891 - RNA, 64 nt, Homo Sapiens
aaaagagaaaaacaauggaguuacuuauuuaaaaaaaaagaaagaaaguuaucucuucccagga

SEQ ID NO: 224892 - RNA, 64 nt, Homo Sapiens
aacugugaauguagaagugggggggaggggggagaaaaagaaaacucuggcguuagaggauaua

SEQ ID NO: 224893 - RNA, 64 nt, Homo Sapiens
guggcagaagcgagaaaacuuuguuuauugaaaaaaaaagaaaaagaaagcaagaaaaaaagau

SEQ ID NO: 224894 - RNA, 64 nt, Homo Sapiens
gaagcgagaaaacuuuguuuauugaaaaaaaaagaaaaagaaagcaagaaaaaaagauacuaug

SEQ ID NO: 224895 - RNA, 64 nt, Homo Sapiens
cagaguauuuuuguacagauuugcuuucucuuacaaaaagaaaaaaaaaauccuguuguauuaa

SEQ ID NO: 224896 - RNA, 63 nt, Homo Sapiens
uauauuauuguuuacaauaaauauacauugcauuaaaaagaaaguggcccuguggauuuauuc

SEQ ID NO: 224897 - RNA, 64 nt, Homo Sapiens
aaggcucgccgugagccaggucuaaaguuugaagaaaaagaaaaaucuuaaaaaaaaaaaaaaa

SEQ ID NO: 224898 - RNA, 64 nt, Homo Sapiens
gaaaaagaaaaaucuuaaaaaaaaaaaaaaaaaaaaaaagaaaaaaagaaaaacaggaaaaagg

SEQ ID NO: 224899 - RNA, 64 nt, Homo Sapiens
aaaaucuuaaaaaaaaaaaaaaaaaaaaaaagaaaaaaagaaaaacaggaaaaaggacuuuuuu

SEQ ID NO: 224900 - RNA, 64 nt, Homo Sapiens
gcuuacauugucagggauccaaaaaaaagaacggaaaaagaaaucugucuccgaaaaaaaaaaa

SEQ ID NO: 224901 - RNA, 64 nt, Homo Sapiens
gaaaaagaaaugcuuacauuaaaaaaaaaaaaaaaaaaagaacgagagugagacccugucuccg

SEQ ID NO: 224902 - RNA, 64 nt, Homo Sapiens
cagauccucauggcuauagacgucucaaaaaaaaaaaaagaaagugggugacagagcgagacuc

SEQ ID NO: 224903 - RNA, 64 nt, Homo Sapiens
gaaacuagaaacaguuaaagccuuccaagagaagaaaaagaagaaaagaauuugucaauccuag

SEQ ID NO: 224904 - RNA, 64 nt, Homo Sapiens
ggcugaggaggaagucuucuauucaaaagcaccuaaaaagaauaacucgaauuaaauauccaca

SEQ ID NO: 224905 - RNA, 64 nt, Homo Sapiens
ugcuuucaaaacgaaagcugaauagaaucacucgaaaaagaaucaaugagaaaaauccuaaccc

SEQ ID NO: 224906 - RNA, 64 nt, Homo Sapiens
agcaagaagaaggaagaaaguucuuaaaaaaaagaaaaagaaaaauucaaaucucuugcuuucu

SEQ ID NO: 224907 - RNA, 64 nt, Homo Sapiens
agaaaaagcaagaagaaggacuuucuuucuuaaaaaaaagaaaaagcaagauucaaaucucuug

SEQ ID NO: 224908 - RNA, 64 nt, Homo Sapiens
aaaaauauauaucacucuaguggaagaaaaaaagaaaaagaacaagagcucuaauuguuuguuu

SEQ ID NO: 224909 - RNA, 64 nt, Homo Sapiens
agaacaaaaaauauauaucauuguuuuggaagaaaaaaagaaaagggccuagagcucuaauugu

SEQ ID NO: 224910 - RNA, 64 nt, Homo Sapiens
aaaaucccuuucuuguaaacaaaaaaaaagaaaaaaaaagaaaaaauagaaacuuugcuaguua

SEQ ID NO: 224911 - RNA, 64 nt, Homo Sapiens
aaaaagaaaaaaaaucccuuuugcuaguuaaaaaaaaaagaaaaaagaaaguauaauagaaacu

SEQ ID NO: 224912 - RNA, 64 nt, Homo Sapiens
aguuugaaaaucauucccuaaagcaugcaauaggaaaaagaaccuccuggcugggacugcccaa

SEQ ID NO: 224913 - RNA, 64 nt, Homo Sapiens
uuugccagccuggcaacagaacaagacucugucuaaaaagaaaaaaaaauuuuuuuguuuaaga

SEQ ID NO: 224914 - RNA, 64 nt, Homo Sapiens
uguuuugcuuuuccauauagcucgagcaaaauucaaaaagaacuaaauaugcaauauauguuca

SEQ ID NO: 224915 - RNA, 64 nt, Homo Sapiens
aaaugauuuacauaggccgagcuguggacaaaaaaaaaagaagcagcagcuuguaguaugcuua

SEQ ID NO: 224916 - RNA, 64 nt, Homo Sapiens
aagaacauggggauuuuguauaaccagggauaauaaaaagaaaaaagaaguuaauuuuuaauug

SEQ ID NO: 224917 - RNA, 64 nt, Homo Sapiens
uggggauuuuguauaaccagggauaauaaaaagaaaaaagaaguuaauuuuuaauugauguuuu

SEQ ID NO: 224918 - RNA, 64 nt, Homo Sapiens
acaacacuggugacagucauaugguuuugaaaaaaaaaagaaauuuugcuucuucccagcuuuu

SEQ ID NO: 224919 - RNA, 64 nt, Homo Sapiens
aacagauugcuagacaagagaaaaaacuugaagaaaaaagaagcuuaauuucaugcuucauaag

SEQ ID NO: 224920 - RNA, 64 nt, Homo Sapiens
ccaaacugcuuuguguauuguauauuuuuuuaagaaaaagaaaagccuuauuugacuuaugcuu

SEQ ID NO: 224921 - RNA, 64 nt, Homo Sapiens
gugaaucuagagccuacuuuuauuuugguuaaagaaaaagaaaauaucaauaauucaauuuugu

SEQ ID NO: 224922 - RNA, 64 nt, Homo Sapiens
ugaguuacacugagaaugaaaguuacagaaaaugaaaaagaaaauggaguaauagggaaagaag

SEQ ID NO: 224923 - RNA, 64 nt, Homo Sapiens
guaccuguuggcaggagaagaaaaaaaaaaagaaaaaaagaaaugcgagacuccgccucaaaaa

SEQ ID NO: 224924 - RNA, 64 nt, Homo Sapiens
aaagaaauguaccuguuggccucaaaaaaaaaaaaaaaagaaaagcgacagagcgagacuccgc

SEQ ID NO: 224925 - RNA, 64 nt, Homo Sapiens
uuucuuuuacuguguuuaauuaucuugcacaaagaaaaagaaaaaaaaggucuucugacacacu

SEQ ID NO: 224926 - RNA, 64 nt, Homo Sapiens
gcggguucuuguucgggaggcaaauuucccuaggaaaaagaagacagacuuuucuaaugugguc

SEQ ID NO: 224927 - RNA, 64 nt, Homo Sapiens
ccugggcaacaagagcaaaacuccgucucaaaauaaaaagaaaagaaaagaauggacaguguuu

SEQ ID NO: 224928 - RNA, 64 nt, Homo Sapiens
cucaaagacucuuguccucuugucccuccugagaaaaaagaaaacgaaaagugggguuuuuuuc

SEQ ID NO: 224929 - RNA, 64 nt, Homo Sapiens
uuauuuuuuugaauuuuaauuguaacauuuuuagaaaaagaacaaaaaaagaaaaaaaaaagaa

SEQ ID NO: 224930 - RNA, 64 nt, Homo Sapiens
aauuuuaauuguaacauuuuuagaaaaagaacaaaaaaagaaaaaaaaaagaaagaaacacagc

SEQ ID NO: 224931 - RNA, 64 nt, Homo Sapiens
uaacauuuuuagaaaaagaacaaaaaaagaaaaaaaaaagaaagaaacacagcaacuguagaug

SEQ ID NO: 224932 - RNA, 64 nt, Homo Sapiens
cgggaagggaccuugcagggaccucucccuccaaaaaaagaaaaaaagaaaaagaaagaaaaaa

SEQ ID NO: 224933 - RNA, 64 nt, Homo Sapiens
gaccuugcagggaccucucccuccaaaaaaagaaaaaaagaaaaagaaagaaaaaauaaaugag

SEQ ID NO: 224934 - RNA, 64 nt, Homo Sapiens
gcagggaccucucccuccaaaaaaagaaaaaaagaaaaagaaagaaaaaauaaaugaggaaacg

SEQ ID NO: 224935 - RNA, 64 nt, Homo Sapiens
aucaaaaucccccaaauguuaagguauaugguaaaaaaagaaauaucugggaucccgauguucu

SEQ ID NO: 224936 - RNA, 64 nt, Homo Sapiens
uauaccaguuauaugaauugacuuaaguaucuugaaaaagaaacuuuagagaaagcaucagggg

SEQ ID NO: 224937 - RNA, 64 nt, Homo Sapiens
aaagaaagaaagggaaagauggaaggaaggaaggaaaaagaaagagaaagagagagagagagaa

SEQ ID NO: 224938 - RNA, 64 nt, Homo Sapiens
ggaaaaagaaagagaaagagagagagagagaaagaaaaagaaagaaaaguaagaaagaaaaaag

SEQ ID NO: 224939 - RNA, 64 nt, Homo Sapiens
agagagaaagaaaaagaaagaaaaguaagaaagaaaaaagaaaaagaaagaaaaguaagaaaga

SEQ ID NO: 224940 - RNA, 64 nt, Homo Sapiens
aaagaaaaagaaagaaaaguaagaaagaaaaaagaaaaagaaagaaaaguaagaaagaaaaaaa

SEQ ID NO: 224941 - RNA, 64 nt, Homo Sapiens
ucggcaacaugccaagaccccgucucuauuuuuaaaaaagaaaaagaaccgacuucugaaucgc

SEQ ID NO: 224942 - RNA, 64 nt, Homo Sapiens
acaugccaagaccccgucucuauuuuuaaaaaagaaaaagaaccgacuucugaaucgcagcucc

SEQ ID NO: 224943 - RNA, 64 nt, Homo Sapiens
ugggugacacagcaagacuccaucucaaaaaaaaaaaaagaaaaagaaaugaauggguucaaag

SEQ ID NO: 224944 - RNA, 64 nt, Homo Sapiens
acacagcaagacuccaucucaaaaaaaaaaaaagaaaaagaaaugaauggguucaaagaccaua

SEQ ID NO: 224945 - RNA, 64 nt, Homo Sapiens
ucauucuaauaccaaaaccugacaggcacaaugaaaaaagaaaacuucaggcugguacuccuga

SEQ ID NO: 224946 - RNA, 64 nt, Homo Sapiens
guacauauacaccauggaauacuaugcagccauaaaaaagaacaagacuguguccuuuacagca

SEQ ID NO: 224947 - RNA, 64 nt, Homo Sapiens
cagccugggcaacauagccagaccuccucucuacaaaaagaaaaaagaaugacaugcuucuugu

SEQ ID NO: 224948 - RNA, 64 nt, Homo Sapiens
ggcaacauagccagaccuccucucuacaaaaagaaaaaagaaugacaugcuucuuguuuuuguc

SEQ ID NO: 224949 - RNA, 64 nt, Homo Sapiens
aaaccaccucuacauauuauaaaagaaaaaaaaaaaaaagaaacgcaaaaaaaaaaguaaaaag

SEQ ID NO: 224950 - RNA, 64 nt, Homo Sapiens
gaaaaaaaaaaaaaagaaacgcaaaaaaaaaaguaaaaagaaaaaagagcucugccaggggcgg

SEQ ID NO: 224951 - RNA, 64 nt, Homo Sapiens
cacacagaagagauuuaaaaaaaaaaagcaacaaaaaaagaaaaaaaacacaaacagaagagga

SEQ ID NO: 224952 - RNA, 64 nt, Homo Sapiens
aaaucaaaaaagcgacaaaaugcugcaaggaacaaaaaagaaaauuaaacgucuguggagcuuc

SEQ ID NO: 224953 - RNA, 64 nt, Homo Sapiens
uauuuuggcagguuauguuuaaagacaaaaaaaaaaaaagaaaaugaaaaaaaaaaacacaaaa

SEQ ID NO: 224954 - RNA, 64 nt, Homo Sapiens
cagagaugugcccccaccccuucuuuuuucggcuaaaaagaauguucauggugaagguuuuugu

SEQ ID NO: 224955 - RNA, 64 nt, Homo Sapiens
aaacucuaugaauguaaaccaaauaaaaaaaaagaaaaagaaaugugagacuccaucucaaaaa

SEQ ID NO: 224956 - RNA, 64 nt, Homo Sapiens
agaaauaaacucuaugaaugcaaaaaaaauaaaaaaaaagaaaaaacagagugagacuccaucu

SEQ ID NO: 224957 - RNA, 64 nt, Homo Sapiens
uguacuguauuuccuaaacaaagaacaaaaaaaaaaaaagaacuuauuugaaaagguuaaaaaa

SEQ ID NO: 224958 - RNA, 64 nt, Homo Sapiens
aaaaaaaaaaaagaacuuguuugaaaagguuaaaaaaaagaacagcucaaaggguuaagucuau

SEQ ID NO: 224959 - RNA, 64 nt, Homo Sapiens
auuaugauggucagaguaagguccuggacccagcaaaaagaaugugugccaugaguuagccaug

SEQ ID NO: 224960 - RNA, 64 nt, Homo Sapiens
auucuaaguaaacauaacgaaucuauuucuuauuaaaaagaaacaaaggauacuucaauuuugu

SEQ ID NO: 224961 - RNA, 64 nt, Homo Sapiens
uggagaugguucugcccacucugucucaaaaaaaaaaaagaauucugggugacagagcgagacc

SEQ ID NO: 224962 - RNA, 64 nt, Homo Sapiens
aguuuggaucaggcagggugcgagacuccgucucaaaaagaaaacuccagccugggcaacacag

SEQ ID NO: 224963 - RNA, 64 nt, Homo Sapiens
uauauaaaaauacuuuauugcuccauuauuuuuuaaaaagaaauccugaugcccuuauuugaag

SEQ ID NO: 224964 - RNA, 64 nt, Homo Sapiens
uauggccgggcgcgguggcucugucucuauuuaaaaaaagaagucugggcaauauagggagauc

SEQ ID NO: 224965 - RNA, 64 nt, Homo Sapiens
uaaaacugaucaaaagcauaauugaaaguucugaaaaaagaaaaauaauaauauguagaaaaau

SEQ ID NO: 224966 - RNA, 64 nt, Homo Sapiens
ucauuagacacuuaauaaaacuuaacuuccaaugaaaaagaaaucuuuuguaaaucauucuacu

SEQ ID NO: 224967 - RNA, 64 nt, Homo Sapiens
uuuucauuugagagggagagcugugguacuggcuaaaaagaaaggaagauaacauccaguaacc

SEQ ID NO: 224968 - RNA, 64 nt, Homo Sapiens
caagaauaagcagcagaacccuguuccauauggaaaaaagaaaaacaauuuuuugucccuaaug

SEQ ID NO: 224969 - RNA, 64 nt, Homo Sapiens
agcaagacacgcacagucaaccauuuuccgagaaaaaaagaaaauuccccacuuggaaagaaag

SEQ ID NO: 224970 - RNA, 64 nt, Homo Sapiens
agggccacugcagaugacucuccuuugaaaugagaaaaagaaaagaaagcaagaacagaaaacg

SEQ ID NO: 224971 - RNA, 64 nt, Homo Sapiens
ccagccugggcaacauagcgagaccucaucuccaaaaaagaaaacaaaaaacaaaaaaaggaau

SEQ ID NO: 224972 - RNA, 64 nt, Homo Sapiens
aaaaauuuaugcacugauuuaaaacaaaccaaaaaaaaagaaaaaaacaaaaaaaaaaaucccu

SEQ ID NO: 224973 - RNA, 64 nt, Homo Sapiens
caagcacacccgugguugugaaaauaguauagcaaaaaagaaaaauccccgguuauugauguac

SEQ ID NO: 224974 - RNA, 64 nt, Homo Sapiens
uaucaugggauuuaaauuuaucauaaccauguguaaaaagaaauuaauguaugaugacaucuca

SEQ ID NO: 224975 - RNA, 64 nt, Homo Sapiens
augggauuuggcuugugagucuguaacaguucuuaaaaagaauaucugagaaacuacucuguuu

SEQ ID NO: 224976 - RNA, 64 nt, Homo Sapiens
ucuuuuuuaaaccagaauaaaguagaaagaaaagaaaaagaaaauuuaaccaggacuauguaga

SEQ ID NO: 224977 - RNA, 64 nt, Homo Sapiens
aaaggaaaacaaaaagcacuggcaaaaaaaaaaaaaaaagaaaguauugaaagaauacuuuucu

SEQ ID NO: 224978 - RNA, 64 nt, Homo Sapiens
uuauacaauuuaguucacaagaaguccuuuccuaaaaaagaaacuucuuugccuuguucucugu

SEQ ID NO: 224979 - RNA, 64 nt, Homo Sapiens
uuuccauacuucguguucugagacaaguguuuuuaaaaagaaccaauuuggauuuuguuccaaa

SEQ ID NO: 224980 - RNA, 64 nt, Homo Sapiens
aguuccgggcauuuugcaucuuaaaaagaaaaaaaaaaagaaaaacgguauuuuuguuuguaag

SEQ ID NO: 224981 - RNA, 64 nt, Homo Sapiens
aaaaaaagaaaaaguuccgguuuguuuguaaguuaaaaagaaaaggguuuauuauuacgguauu

SEQ ID NO: 224982 - RNA, 64 nt, Homo Sapiens
uuuugguauuggagaagggacaaccccaacaacaaaaaagaaugaaaaaaaaaaaaaaagcaac

SEQ ID NO: 224983 - RNA, 64 nt, Homo Sapiens
acgauuuaaaaaaaaaaaaaaaaaaaaaaaaaagaaaaagaaaauguauuaacuuuaacuuauu

SEQ ID NO: 224984 - RNA, 64 nt, Homo Sapiens
agaaaaacgauuuaaaaaaacuuauuaaaaaaaaaaaaagaaaauauauuuguauuaacuuuaa

SEQ ID NO: 224985 - RNA, 64 nt, Homo Sapiens
aacacaguguuuccugaguaugauuuugaugauuaaaaagaauacaggucuugcccaaagucau

SEQ ID NO: 224986 - RNA, 64 nt, Homo Sapiens
ugccgauuucaugcauucuagacugaucaagccaaaaaagaagggagccagccaggacuccuua

SEQ ID NO: 224987 - RNA, 64 nt, Homo Sapiens
uugaauccggugcaugccuucugacaacuggaacaaaaagaaccauuggggucuaguuuggaau

SEQ ID NO: 224988 - RNA, 52 nt, Homo Sapiens
accacaggcccuuccccuucucaaaaagaaaagacaguguuacagcaauuaa

SEQ ID NO: 224989 - RNA, 64 nt, Homo Sapiens
aaaaaaaccacguuucuuugcaaaaaaaaaaagaaaaaagaaaagcacaagcuaagagagcuug

SEQ ID NO: 224990 - RNA, 64 nt, Homo Sapiens
aagaaaaaaaaaaaccacgugagcuugcaaaaaaaaaaagaaaaucugaaugcacaagcuaaga

SEQ ID NO: 224991 - RNA, 64 nt, Homo Sapiens
aaacgaaaagaagaaacaaaugaaauugaaaaagaaaaagaagagaaauugagaaguauguugc

SEQ ID NO: 224992 - RNA, 64 nt, Homo Sapiens
agaagaaaacgaaaagaagauguugcugaaauugaaaaagaaaaccugaagaaauugagaagua

SEQ ID NO: 224993 - RNA, 64 nt, Homo Sapiens
cacaaacuuaagaggaaauaaggaaaaggagagaaaaaagaaauugguuaugaauaaaagugac

SEQ ID NO: 224994 - RNA, 64 nt, Homo Sapiens
gggcggggacaaauaucaaauuaagcaaguaaagaaaaagaacagguaagagugugugugugug

SEQ ID NO: 224995 - RNA, 64 nt, Homo Sapiens
uugacagggugcagucauuggugagaagaaucagaaaaagaagacccaucagcacagguuggau

SEQ ID NO: 224996 - RNA, 64 nt, Homo Sapiens
cagcuuagguggcaaagugagacccugucuccaaaaaaagaaaauagagcuuuauaagcagaga

SEQ ID NO: 224997 - RNA, 64 nt, Homo Sapiens
gaauucccuguaucaucuggaucucaacaucggaaaaaagaagcggauaguguuuauggagaau

SEQ ID NO: 224998 - RNA, 64 nt, Homo Sapiens
ccaccaucuccccucaaaauuuuguagagguucuaaaaagaaagugguauguugugugaugauc

SEQ ID NO: 224999 - RNA, 64 nt, Homo Sapiens
ggguagauguaguugcuuaguagcauuuuggaaaaaaaagaaaaaaagguuugguuugguuuug

SEQ ID NO: 225000 - RNA, 64 nt, Homo Sapiens
agagcgaaacuccgucucaaaaaaaaaaaaaaaaaaaaagaaagaaaagaguaacagaaagaua

SEQ ID NO: 225001 - RNA, 64 nt, Homo Sapiens
guugguuauuuguguuauucaugugcaaaaaaagaaaaagaacuuuuuguucuaggggaaauga

SEQ ID NO: 225002 - RNA, 64 nt, Homo Sapiens
agaacuguugguuauuugugaaaugaaugugcaaaaaaagaaaacacuuuuuuuguucuagggg

SEQ ID NO: 225003 - RNA, 64 nt, Homo Sapiens
aguaaugugaucgcuugguugaagaaggcuagaaaaaaagaaugaaaguuaaauguaucacauu

SEQ ID NO: 225004 - RNA, 64 nt, Homo Sapiens
auuuuauacccuugacuuaagcaaugcugugaauaaaaagaaagcugugaaugcuucugauuua

SEQ ID NO: 225005 - RNA, 64 nt, Homo Sapiens
acacuuguauuuuguaugucuccaaacuaagaauaaaaagaaugguagaagaauggacuaucug

SEQ ID NO: 225006 - RNA, 64 nt, Homo Sapiens
agccaaaaaguacaauuguucaaaagaggggaguaaaaagaaauuuacaacaacagggacaggg

SEQ ID NO: 225007 - RNA, 64 nt, Homo Sapiens
uuauugcugaucacaaggaccagucucaaaaagaaaaaagaaaucugggcaacagagcgagacu

SEQ ID NO: 225008 - RNA, 64 nt, Homo Sapiens
aagaaauuuauugcugaucacgagacucagucucaaaaagaaaacuccagccugggcaacagag

SEQ ID NO: 225009 - RNA, 64 nt, Homo Sapiens
ggcaccaaugugagaaccugucuuggaaaaaaaaaaaaagaaacauguuuuaguagaaguuuua

SEQ ID NO: 225010 - RNA, 64 nt, Homo Sapiens
aaaaagaaacauguuuuaguagaaguuuuauuugaaaaagaaaaauaagcauaaauauauuccc

SEQ ID NO: 225011 - RNA, 64 nt, Homo Sapiens
gcugccgcgcaguguggaggagcuuacaaauacuaaaaagaagucucaauugaaagugggcaaa

SEQ ID NO: 225012 - RNA, 64 nt, Homo Sapiens
acuugugguucuaaaaggugccuuuguuggagucaaaaagaaccugacuuuuucaacuucguuu

SEQ ID NO: 225013 - RNA, 64 nt, Homo Sapiens
ccaaacuagugagaguaauauaaaaagaaaaagaaaaaagaagcucuuuccagcugcuguuuug

SEQ ID NO: 225014 - RNA, 64 nt, Homo Sapiens
aagaagcccaaacuagugaguguuuuguaaaaagaaaaagaaaaacauuucucuuuccagcugc

SEQ ID NO: 225015 - RNA, 64 nt, Homo Sapiens
agaaaaaagaagcccaaacuagcugcuguuuuguaaaaagaaaaccaccuacauuucucuuucc

SEQ ID NO: 225016 - RNA, 64 nt, Homo Sapiens
uggaucugcggaaguaaccacaaaauauuaucgaaaaaagaaaagaauucuaaugaccagccgu

SEQ ID NO: 225017 - RNA, 64 nt, Homo Sapiens
ucagacauagagagcuuugugugauucauguuuuaaaaagaaccgaagaagccacaggcagggc

SEQ ID NO: 225018 - RNA, 64 nt, Homo Sapiens
uuucuguuuuuuaaccuuuuguuccgccauuuaaaaaaagaaaaaaaaaaagcuuauguuucuu

SEQ ID NO: 225019 - RNA, 64 nt, Homo Sapiens
aauuauuuucagaaaaacacugacugugucauuuaaaaagaaauaaaugauauguuauuauccc

SEQ ID NO: 225020 - RNA, 64 nt, Homo Sapiens
aaucauacuaaagacauuugcgcuuacuuuguugaaaaagaaaaagaaauuaaauuugaacaca

SEQ ID NO: 225021 - RNA, 64 nt, Homo Sapiens
acuaaagacauuugcgcuuacuuuguugaaaaagaaaaagaaauuaaauuugaacacagugaaa

SEQ ID NO: 225022 - RNA, 64 nt, Homo Sapiens
guagaccuguggcuuaaaauaaagaaaaugcagcaaaaagaaugcuauagaaauauuugguggu

SEQ ID NO: 225023 - RNA, 64 nt, Homo Sapiens
ucccuuacauuuuuauuuaauugucuuagcuuaaaaaaagaagaaacuguggaauacuacagua

SEQ ID NO: 225024 - RNA, 64 nt, Homo Sapiens
uucuagaagacagagcugauaggguaaauguugaaaaaagaagcaugccuccuucucccuccca

SEQ ID NO: 225025 - RNA, 64 nt, Homo Sapiens
ucucugggugaggcaucugguuacugguuauuuuaaaaagaauaaagacauuccuggaaucacu

SEQ ID NO: 225026 - RNA, 64 nt, Homo Sapiens
aaauugcaauuuguuuaauucagaauguguauuuaaaaagaaaaggaauuuaacaauuugcauc

SEQ ID NO: 225027 - RNA, 64 nt, Homo Sapiens
cacacgugcacacacacacacauuuaaaugauauaaaaagaagagguugaaagauuauuaaaua

SEQ ID NO: 225028 - RNA, 64 nt, Homo Sapiens
guguaagucacccccaccaaaaacaaaagagaagaaaaagaauagaaagaauuauccaguguca

SEQ ID NO: 225029 - RNA, 64 nt, Homo Sapiens
aggcagggaauagacuucuagaaaaccugagaggaaaaagaauucuuuuuacaggaggcagcag

SEQ ID NO: 225030 - RNA, 64 nt, Homo Sapiens
cucuuuccaauuucacuuugguggucugaagaagaaaaagaaauuuuauguauguauguguaaa

SEQ ID NO: 225031 - RNA, 64 nt, Homo Sapiens
caucaauaaaauuguauguuaaugcuggaaagaaaaaaagaagaaagaaagaaaccaucccugu

SEQ ID NO: 225032 - RNA, 64 nt, Homo Sapiens
ucuaaaauggguauugauuuuuaggacgguuuugaaaaagaaaaguguugggaaugaagcaagu

SEQ ID NO: 225033 - RNA, 64 nt, Homo Sapiens
ucaaaagaauuggcacugggauaagauuuuucagaaaaagaaaaacaucggcaaacugugugug

SEQ ID NO: 225034 - RNA, 64 nt, Homo Sapiens
uagacuacacaaaagcuuccuuccaguauuaaacaaaaagaauuaaacauaacuaugaaaaaac

SEQ ID NO: 225035 - RNA, 64 nt, Homo Sapiens
aaaaugagaaaaaaguaagacuauaaaaaagagaaaaaagaaaaagaaaaaauauacuugcuau

SEQ ID NO: 225036 - RNA, 64 nt, Homo Sapiens
guguuuuuagaaaugcguacgagugaccucuagaaaaaagaaaaagugauauaucaguguuuga

SEQ ID NO: 225037 - RNA, 64 nt, Homo Sapiens
aagcuugccuuugguggggccagggcccugccaaaaaaagaagaggaagaguugcuucccauuu

SEQ ID NO: 225038 - RNA, 64 nt, Homo Sapiens
auguauauagcugugaguuuuaagagacuuuguaaaaaagaaaauugccagccugaacuauauu

SEQ ID NO: 225039 - RNA, 64 nt, Homo Sapiens
aaaauuauuaaauguuucucccuucauuuucuuaaaaaagaaaaccuuuuccucaaguuacuuu

SEQ ID NO: 225040 - RNA, 64 nt, Homo Sapiens
cuacucaagaaaagacagaacaagaacuuaagagaaaaagaaacacaacacuaacaugagaaca

SEQ ID NO: 225041 - RNA, 64 nt, Homo Sapiens
cuguugaagaaaggacagaaagcacaggaaagagaaaaagaaaucuccgagaaagaagaacgua

SEQ ID NO: 225042 - RNA, 64 nt, Homo Sapiens
aaagccaugauguacccuccagcuuaagcaucgaaaaaagaaaaagucaaggucaguucaggaa

SEQ ID NO: 225043 - RNA, 64 nt, Homo Sapiens
guaaaccucaaauuaccucugaugaaagaacuuuaaaaagaaauaugggggcaccuaaacucuu

SEQ ID NO: 225044 - RNA, 64 nt, Homo Sapiens
aaggauuuuuuuuacaaguacgugucucacacacaaaaagaauuuauguacuuuuuaaugaaca

SEQ ID NO: 225045 - RNA, 64 nt, Homo Sapiens
aaggggcaaggagccccgcgaaaagaaaagaaggaaaaagaaaaccucuucuuucccauuuuaa

SEQ ID NO: 225046 - RNA, 64 nt, Homo Sapiens
gaaggaaaaagaaaaaagggucuuucccauuuuaaaaaagaaaacucuucuacccucccccucu

SEQ ID NO: 225047 - RNA, 64 nt, Homo Sapiens
uguuauucaguuacuaaauuugaggugaauaauuaaaaagaaaaggacauuaggagagugaaaa

SEQ ID NO: 225048 - RNA, 64 nt, Homo Sapiens
guauggauauaauauaaaaugaauucauauaauuaaaaagaauuugguuaauaagaauuuggag

SEQ ID NO: 225049 - RNA, 64 nt, Homo Sapiens; identical to SEQ ID NO: 225026

SEQ ID NO: 225050 - RNA, 64 nt, Homo Sapiens
cacacacgugcacacacacacauuuaaaggauauaaaaagaagagguugaaagauuauuaaaua

SEQ ID NO: 225051 - RNA, 64 nt, Homo Sapiens
gggaagaguugcuuccuauuucaggacccugccaaaaaagaagaaagcuugccuuugguggggc

SEQ ID NO: 225052 - RNA, 64 nt, Homo Sapiens
agugauauaucaguguuugggagugaccucuagaaaaaagaaaacuguuuuuagaaauacauaa

SEQ ID NO: 225053 - RNA, 64 nt, Homo Sapiens
cacaagagagguggcuuugacucucucaaaaagaaaaaagaagaccugggcgacaagagcgaga

SEQ ID NO: 225054 - RNA, 64 nt, Homo Sapiens
aagaagacacaagagaggugagcgagacucucucaaaaagaaaaacuccagccugggcgacaag

SEQ ID NO: 225055 - RNA, 64 nt, Homo Sapiens
auugucaggacuaacugucuguacaguauuuugaaugugagauguggugacuucagauuuuuuu

SEQ ID NO: 225056 - RNA, 64 nt, Homo Sapiens
uugcauuuuaaugggaaauuaaauacaaguaaggaugugagaauacuuacaguuaacauaggaa

SEQ ID NO: 225057 - RNA, 64 nt, Homo Sapiens
augggguauacugcaucauuauacugccaauuuaaugugagaacgagaagagacuuagcuucug

SEQ ID NO: 225058 - RNA, 64 nt, Homo Sapiens
uagagcucauugaguauauucagaucacuagugaaugugagauuuauuuauucagcuucacuug

SEQ ID NO: 225059 - RNA, 64 nt, Homo Sapiens
aauguacaaagauacuugaugcacuuauuuuuuaaugugagacagcaaguuuauaaaacaucca

SEQ ID NO: 225060 - RNA, 64 nt, Homo Sapiens
gaacaaguguacagaagaauuuuuuuuuuaagauaugugagaacuuuucauagaugaacuuuuu

SEQ ID NO: 225061 - RNA, 64 nt, Homo Sapiens
uuuacaagacacccagaacaaaaauuaggaccacaugugagaugcuguguggagccuggaaaaa

SEQ ID NO: 225062 - RNA, 64 nt, Homo Sapiens
augucuccauuguucacugugcaaaggaauaaagaugugagaguggaccaaaauacuuacaccu

SEQ ID NO: 225063 - RNA, 64 nt, Homo Sapiens
uuccugcaaaccaucccauuuuaauaagguuuuaaugugagauacuuugccacugacuguagua

SEQ ID NO: 225064 - RNA, 64 nt, Homo Sapiens
guguuaaccuagaguuaccuugucaucuacgugcaugugagagccauguaccgagaggacuaaa

SEQ ID NO: 225065 - RNA, 64 nt, Homo Sapiens
uagggucacuagagacccuuagaugagacuuggcaugugagacaaacaugagacguggcaugug

SEQ ID NO: 225066 - RNA, 64 nt, Homo Sapiens
agacuuggcaugugagacauacaugagacguggcaugugagauguacagggcaucugacaccua

SEQ ID NO: 225067 - RNA, 64 nt, Homo Sapiens
cuuaccacuaagccauucugaauuuuuaccuuacaugugagaguacuuuuuugcauauuagguu

SEQ ID NO: 225068 - RNA, 64 nt, Homo Sapiens
cucagaguaaugucuacuguuuuucuggaaacauaugugagacauucaguggcuuuuuuuuuuc

SEQ ID NO: 225069 - RNA, 64 nt, Homo Sapiens
aacaggagagcagcaauacgugauccuuuuauaaaugugagauuuuuagcacuuggcagccuca

SEQ ID NO: 225070 - RNA, 64 nt, Homo Sapiens
acuuaguugaaacaaaaagguuauaaacuaauauaugugagagugaaaguaauaacaaacauua

SEQ ID NO: 225071 - RNA, 64 nt, Homo Sapiens
cauuugccucauaaagcacagcaucagauaauuuaugugagagaaaaugguagugucauucaua

SEQ ID NO: 225072 - RNA, 64 nt, Homo Sapiens
ugacuugguuggggggcacuguaugccauaaugaaugugagaaagcugucauuuaaaucucauc

SEQ ID NO: 225073 - RNA, 64 nt, Homo Sapiens
uauuuuuuucauuggggauacauuuaguacauucaugugagaggaaggcccuguggguguaaga

SEQ ID NO: 225074 - RNA, 64 nt, Homo Sapiens
cauuuauaaagucagaaccuaucucugaaaauuaaugugagaaagaaaucucuagauuugaugg

SEQ ID NO: 225075 - RNA, 64 nt, Homo Sapiens
uuucauuuaaaaaaagucaaguucaguaauaaauaugugagacuugaacaccuuuguuggcuug

SEQ ID NO: 225076 - RNA, 64 nt, Homo Sapiens
cuacaggaaaagcauuccauagcauucuugcaucaugugagaucgauugaauagaaggggugag

SEQ ID NO: 225077 - RNA, 64 nt, Homo Sapiens
aauauauccaguaauaguaugauucauuucucuaaugugagaaaaauauguuuuauugaaauua

SEQ ID NO: 225078 - RNA, 64 nt, Homo Sapiens
uuuuccugauauguuaucuuuauuugauccuauuaugugagagauucuuggggaugccuuuuaa

SEQ ID NO: 225079 - RNA, 64 nt, Homo Sapiens; identical to SEQ ID NO: 89905

SEQ ID NO: 225080 - RNA, 64 nt, Homo Sapiens; identical to SEQ ID NO: 89906

SEQ ID NO: 225081 - RNA, 64 nt, Homo Sapiens; identical to SEQ ID NO: 89907

SEQ ID NO: 225082 - RNA, 64 nt, Homo Sapiens; identical to SEQ ID NO: 89908

SEQ ID NO: 225083 - RNA, 64 nt, Homo Sapiens; identical to SEQ ID NO: 89909

SEQ ID NO: 225084 - RNA, 64 nt, Homo Sapiens; identical to SEQ ID NO: 89910

SEQ ID NO: 225085 - RNA, 64 nt, Homo Sapiens; identical to SEQ ID NO: 89911

SEQ ID NO: 225086 - RNA, 64 nt, Homo Sapiens; identical to SEQ ID NO: 89912

SEQ ID NO: 225087 - RNA, 64 nt, Homo Sapiens; identical to SEQ ID NO: 89913

SEQ ID NO: 225088 - RNA, 64 nt, Homo Sapiens; identical to SEQ ID NO: 89914

SEQ ID NO: 225089 - RNA, 64 nt, Homo Sapiens; identical to SEQ ID NO: 89915

SEQ ID NO: 225090 - RNA, 64 nt, Homo Sapiens; identical to SEQ ID NO: 89916

SEQ ID NO: 225091 - RNA, 64 nt, Homo Sapiens; identical to SEQ ID NO: 89917

SEQ ID NO: 225092 - RNA, 64 nt, Homo Sapiens; identical to SEQ ID NO: 89918

SEQ ID NO: 225093 - RNA, 64 nt, Homo Sapiens; identical to SEQ ID NO: 89919

SEQ ID NO: 225094 - RNA, 64 nt, Homo Sapiens; identical to SEQ ID NO: 89920

SEQ ID NO: 225095 - RNA, 64 nt, Homo Sapiens; identical to SEQ ID NO: 89921

SEQ ID NO: 225096 - RNA, 64 nt, Homo Sapiens; identical to SEQ ID NO: 89922

SEQ ID NO: 225097 - RNA, 64 nt, Homo Sapiens; identical to SEQ ID NO: 89923

SEQ ID NO: 225098 - RNA, 64 nt, Homo Sapiens; identical to SEQ ID NO: 89924

SEQ ID NO: 225099 - RNA, 64 nt, Homo Sapiens; identical to SEQ ID NO: 89925

SEQ ID NO: 225100 - RNA, 64 nt, Homo Sapiens; identical to SEQ ID NO: 89926

SEQ ID NO: 225101 - RNA, 64 nt, Homo Sapiens; identical to SEQ ID NO: 89927

SEQ ID NO: 225102 - RNA, 64 nt, Homo Sapiens; identical to SEQ ID NO: 89928

SEQ ID NO: 225103 - RNA, 50 nt, Homo Sapiens; identical to SEQ ID NO: 89929

SEQ ID NO: 225104 - RNA, 64 nt, Homo Sapiens; identical to SEQ ID NO: 89930

SEQ ID NO: 225105 - RNA, 64 nt, Homo Sapiens; identical to SEQ ID NO: 89931

SEQ ID NO: 225106 - RNA, 64 nt, Homo Sapiens; identical to SEQ ID NO: 89932

SEQ ID NO: 225107 - RNA, 64 nt, Homo Sapiens; identical to SEQ ID NO: 89933

SEQ ID NO: 225108 - RNA, 64 nt, Homo Sapiens; identical to SEQ ID NO: 89934

SEQ ID NO: 225109 - RNA, 64 nt, Homo Sapiens; identical to SEQ ID NO: 89935

SEQ ID NO: 225110 - RNA, 64 nt, Homo Sapiens; identical to SEQ ID NO: 89936

SEQ ID NO: 225111 - RNA, 64 nt, Homo Sapiens; identical to SEQ ID NO: 89937

SEQ ID NO: 225112 - RNA, 64 nt, Homo Sapiens; identical to SEQ ID NO: 89938

SEQ ID NO: 225113 - RNA, 64 nt, Homo Sapiens; identical to SEQ ID NO: 89939

SEQ ID NO: 225114 - RNA, 64 nt, Homo Sapiens; identical to SEQ ID NO: 89940

SEQ ID NO: 225115 - RNA, 64 nt, Homo Sapiens; identical to SEQ ID NO: 89941

SEQ ID NO: 225116 - RNA, 55 nt, Homo Sapiens; identical to SEQ ID NO: 89942

SEQ ID NO: 225117 - RNA, 64 nt, Homo Sapiens; identical to SEQ ID NO: 89943

SEQ ID NO: 225118 - RNA, 64 nt, Homo Sapiens; identical to SEQ ID NO: 89944

SEQ ID NO: 225119 - RNA, 64 nt, Homo Sapiens; identical to SEQ ID NO: 89945

SEQ ID NO: 225120 - RNA, 64 nt, Homo Sapiens; identical to SEQ ID NO: 89946

SEQ ID NO: 225121 - RNA, 64 nt, Homo Sapiens; identical to SEQ ID NO: 89947

SEQ ID NO: 225122 - RNA, 64 nt, Homo Sapiens; identical to SEQ ID NO: 89948

SEQ ID NO: 225123 - RNA, 64 nt, Homo Sapiens; identical to SEQ ID NO: 89949

SEQ ID NO: 225124 - RNA, 64 nt, Homo Sapiens; identical to SEQ ID NO: 89950

SEQ ID NO: 225125 - RNA, 64 nt, Homo Sapiens; identical to SEQ ID NO: 89951

SEQ ID NO: 225126 - RNA, 64 nt, Homo Sapiens; identical to SEQ ID NO: 89952

SEQ ID NO: 225127 - RNA, 64 nt, Homo Sapiens; identical to SEQ ID NO: 89953

SEQ ID NO: 225128 - RNA, 64 nt, Homo Sapiens; identical to SEQ ID NO: 89954

SEQ ID NO: 225129 - RNA, 64 nt, Homo Sapiens; identical to SEQ ID NO: 89955

SEQ ID NO: 225130 - RNA, 64 nt, Homo Sapiens; identical to SEQ ID NO: 89956

SEQ ID NO: 225131 - RNA, 64 nt, Homo Sapiens; identical to SEQ ID NO: 89957

SEQ ID NO: 225132 - RNA, 64 nt, Homo Sapiens; identical to SEQ ID NO: 89958

SEQ ID NO: 225133 - RNA, 64 nt, Homo Sapiens; identical to SEQ ID NO: 89959

SEQ ID NO: 225134 - RNA, 64 nt, Homo Sapiens; identical to SEQ ID NO: 89960

SEQ ID NO: 225135 - RNA, 64 nt, Homo Sapiens; identical to SEQ ID NO: 89961

SEQ ID NO: 225136 - RNA, 64 nt, Homo Sapiens; identical to SEQ ID NO: 89962

SEQ ID NO: 225137 - RNA, 64 nt, Homo Sapiens; identical to SEQ ID NO: 89963

SEQ ID NO: 225138 - RNA, 64 nt, Homo Sapiens; identical to SEQ ID NO: 89964

SEQ ID NO: 225139 - RNA, 64 nt, Homo Sapiens; identical to SEQ ID NO: 89965

SEQ ID NO: 225140 - RNA, 64 nt, Homo Sapiens; identical to SEQ ID NO: 89966

SEQ ID NO: 225141 - RNA, 64 nt, Homo Sapiens; identical to SEQ ID NO: 89967

SEQ ID NO: 225142 - RNA, 64 nt, Homo Sapiens; identical to SEQ ID NO: 89968

SEQ ID NO: 225143 - RNA, 64 nt, Homo Sapiens; identical to SEQ ID NO: 89969

SEQ ID NO: 225144 - RNA, 64 nt, Homo Sapiens; identical to SEQ ID NO: 89970

SEQ ID NO: 225145 - RNA, 64 nt, Homo Sapiens; identical to SEQ ID NO: 89971

SEQ ID NO: 225146 - RNA, 64 nt, Homo Sapiens; identical to SEQ ID NO: 89972

SEQ ID NO: 225147 - RNA, 64 nt, Homo Sapiens; identical to SEQ ID NO: 89973

SEQ ID NO: 225148 - RNA, 64 nt, Homo Sapiens; identical to SEQ ID NO: 89974

SEQ ID NO: 225149 - RNA, 64 nt, Homo Sapiens; identical to SEQ ID NO: 89975

SEQ ID NO: 225150 - RNA, 64 nt, Homo Sapiens; identical to SEQ ID NO: 89976

SEQ ID NO: 225151 - RNA, 64 nt, Homo Sapiens; identical to SEQ ID NO: 89977

SEQ ID NO: 225152 - RNA, 64 nt, Homo Sapiens; identical to SEQ ID NO: 89978

SEQ ID NO: 225153 - RNA, 64 nt, Homo Sapiens; identical to SEQ ID NO: 89979

SEQ ID NO: 225154 - RNA, 64 nt, Homo Sapiens; identical to SEQ ID NO: 89980

SEQ ID NO: 225155 - RNA, 64 nt, Homo Sapiens; identical to SEQ ID NO: 89981

SEQ ID NO: 225156 - RNA, 64 nt, Homo Sapiens; identical to SEQ ID NO: 89982

SEQ ID NO: 225157 - RNA, 64 nt, Homo Sapiens; identical to SEQ ID NO: 89983

SEQ ID NO: 225158 - RNA, 64 nt, Homo Sapiens; identical to SEQ ID NO: 89984

SEQ ID NO: 225159 - RNA, 64 nt, Homo Sapiens; identical to SEQ ID NO: 89985

SEQ ID NO: 225160 - RNA, 64 nt, Homo Sapiens; identical to SEQ ID NO: 89986

SEQ ID NO: 225161 - RNA, 64 nt, Homo Sapiens; identical to SEQ ID NO: 89987

SEQ ID NO: 225162 - RNA, 64 nt, Homo Sapiens; identical to SEQ ID NO: 89988

SEQ ID NO: 225163 - RNA, 59 nt, Homo Sapiens; identical to SEQ ID NO: 89989

SEQ ID NO: 225164 - RNA, 64 nt, Homo Sapiens; identical to SEQ ID NO: 89990

SEQ ID NO: 225165 - RNA, 64 nt, Homo Sapiens; identical to SEQ ID NO: 89991

SEQ ID NO: 225166 - RNA, 64 nt, Homo Sapiens; identical to SEQ ID NO: 89992

SEQ ID NO: 225167 - RNA, 64 nt, Homo Sapiens; identical to SEQ ID NO: 89993

SEQ ID NO: 225168 - RNA, 64 nt, Homo Sapiens; identical to SEQ ID NO: 89994

SEQ ID NO: 225169 - RNA, 64 nt, Homo Sapiens; identical to SEQ ID NO: 89995

SEQ ID NO: 225170 - RNA, 64 nt, Homo Sapiens; identical to SEQ ID NO: 89996

SEQ ID NO: 225171 - RNA, 64 nt, Homo Sapiens; identical to SEQ ID NO: 89997

SEQ ID NO: 225172 - RNA, 64 nt, Homo Sapiens; identical to SEQ ID NO: 89998

SEQ ID NO: 225173 - RNA, 64 nt, Homo Sapiens; identical to SEQ ID NO: 89999

SEQ ID NO: 225174 - RNA, 64 nt, Homo Sapiens; identical to SEQ ID NO: 90000

SEQ ID NO: 225175 - RNA, 64 nt, Homo Sapiens; identical to SEQ ID NO: 90001

SEQ ID NO: 225176 - RNA, 64 nt, Homo Sapiens; identical to SEQ ID NO: 90002

SEQ ID NO: 225177 - RNA, 64 nt, Homo Sapiens; identical to SEQ ID NO: 90003

SEQ ID NO: 225178 - RNA, 64 nt, Homo Sapiens; identical to SEQ ID NO: 90004

SEQ ID NO: 225179 - RNA, 64 nt, Homo Sapiens; identical to SEQ ID NO: 90005

SEQ ID NO: 225180 - RNA, 64 nt, Homo Sapiens; identical to SEQ ID NO: 90006

SEQ ID NO: 225181 - RNA, 64 nt, Homo Sapiens; identical to SEQ ID NO: 90007

SEQ ID NO: 225182 - RNA, 64 nt, Homo Sapiens; identical to SEQ ID NO: 90008

SEQ ID NO: 225183 - RNA, 64 nt, Homo Sapiens; identical to SEQ ID NO: 90009

SEQ ID NO: 225184 - RNA, 64 nt, Homo Sapiens; identical to SEQ ID NO: 90010

SEQ ID NO: 225185 - RNA, 64 nt, Homo Sapiens; identical to SEQ ID NO: 90011

SEQ ID NO: 225186 - RNA, 64 nt, Homo Sapiens; identical to SEQ ID NO: 90012

SEQ ID NO: 225187 - RNA, 64 nt, Homo Sapiens; identical to SEQ ID NO: 90013

SEQ ID NO: 225188 - RNA, 64 nt, Homo Sapiens; identical to SEQ ID NO: 90014

SEQ ID NO: 225189 - RNA, 64 nt, Homo Sapiens; identical to SEQ ID NO: 90015

SEQ ID NO: 225190 - RNA, 64 nt, Homo Sapiens; identical to SEQ ID NO: 90016

SEQ ID NO: 225191 - RNA, 64 nt, Homo Sapiens; identical to SEQ ID NO: 90017

SEQ ID NO: 225192 - RNA, 64 nt, Homo Sapiens; identical to SEQ ID NO: 90018

SEQ ID NO: 225193 - RNA, 64 nt, Homo Sapiens; identical to SEQ ID NO: 90019

SEQ ID NO: 225194 - RNA, 64 nt, Homo Sapiens; identical to SEQ ID NO: 90020

SEQ ID NO: 225195 - RNA, 64 nt, Homo Sapiens; identical to SEQ ID NO: 90021

SEQ ID NO: 225196 - RNA, 64 nt, Homo Sapiens; identical to SEQ ID NO: 90022

SEQ ID NO: 225197 - RNA, 64 nt, Homo Sapiens; identical to SEQ ID NO: 90023

SEQ ID NO: 225198 - RNA, 64 nt, Homo Sapiens; identical to SEQ ID NO: 90024

SEQ ID NO: 225199 - RNA, 64 nt, Homo Sapiens; identical to SEQ ID NO: 90025

SEQ ID NO: 225200 - RNA, 64 nt, Homo Sapiens; identical to SEQ ID NO: 90026

SEQ ID NO: 225201 - RNA, 64 nt, Homo Sapiens; identical to SEQ ID NO: 90027

SEQ ID NO: 225202 - RNA, 64 nt, Homo Sapiens; identical to SEQ ID NO: 90028

SEQ ID NO: 225203 - RNA, 64 nt, Homo Sapiens; identical to SEQ ID NO: 90029

SEQ ID NO: 225204 - RNA, 64 nt, Homo Sapiens; identical to SEQ ID NO: 90030

SEQ ID NO: 225205 - RNA, 64 nt, Homo Sapiens; identical to SEQ ID NO: 90031

SEQ ID NO: 225206 - RNA, 64 nt, Homo Sapiens; identical to SEQ ID NO: 90032

SEQ ID NO: 225207 - RNA, 64 nt, Homo Sapiens; identical to SEQ ID NO: 90033

SEQ ID NO: 225208 - RNA, 64 nt, Homo Sapiens; identical to SEQ ID NO: 90034

SEQ ID NO: 225209 - RNA, 64 nt, Homo Sapiens; identical to SEQ ID NO: 90035

SEQ ID NO: 225210 - RNA, 64 nt, Homo Sapiens; identical to SEQ ID NO: 90036

SEQ ID NO: 225211 - RNA, 64 nt, Homo Sapiens; identical to SEQ ID NO: 90037

SEQ ID NO: 225212 - RNA, 64 nt, Homo Sapiens; identical to SEQ ID NO: 90038

SEQ ID NO: 225213 - RNA, 64 nt, Homo Sapiens; identical to SEQ ID NO: 90039

SEQ ID NO: 225214 - RNA, 64 nt, Homo Sapiens; identical to SEQ ID NO: 90040

SEQ ID NO: 225215 - RNA, 64 nt, Homo Sapiens; identical to SEQ ID NO: 90041

SEQ ID NO: 225216 - RNA, 64 nt, Homo Sapiens; identical to SEQ ID NO: 90042

SEQ ID NO: 225217 - RNA, 64 nt, Homo Sapiens; identical to SEQ ID NO: 90043

SEQ ID NO: 225218 - RNA, 64 nt, Homo Sapiens; identical to SEQ ID NO: 90044

SEQ ID NO: 225219 - RNA, 64 nt, Homo Sapiens; identical to SEQ ID NO: 90045

SEQ ID NO: 225220 - RNA, 64 nt, Homo Sapiens; identical to SEQ ID NO: 90046

SEQ ID NO: 225221 - RNA, 64 nt, Homo Sapiens; identical to SEQ ID NO: 90047

SEQ ID NO: 225222 - RNA, 64 nt, Homo Sapiens; identical to SEQ ID NO: 90048

SEQ ID NO: 225223 - RNA, 64 nt, Homo Sapiens; identical to SEQ ID NO: 90049

SEQ ID NO: 225224 - RNA, 64 nt, Homo Sapiens; identical to SEQ ID NO: 90050

SEQ ID NO: 225225 - RNA, 64 nt, Homo Sapiens; identical to SEQ ID NO: 90051

SEQ ID NO: 225226 - RNA, 64 nt, Homo Sapiens; identical to SEQ ID NO: 90052

SEQ ID NO: 225227 - RNA, 64 nt, Homo Sapiens; identical to SEQ ID NO: 90053

SEQ ID NO: 225228 - RNA, 64 nt, Homo Sapiens; identical to SEQ ID NO: 90054

SEQ ID NO: 225229 - RNA, 64 nt, Homo Sapiens; identical to SEQ ID NO: 90055

SEQ ID NO: 225230 - RNA, 64 nt, Homo Sapiens; identical to SEQ ID NO: 90056

SEQ ID NO: 225231 - RNA, 64 nt, Homo Sapiens; identical to SEQ ID NO: 90057

SEQ ID NO: 225232 - RNA, 64 nt, Homo Sapiens; identical to SEQ ID NO: 90058

SEQ ID NO: 225233 - RNA, 64 nt, Homo Sapiens; identical to SEQ ID NO: 90059

SEQ ID NO: 225234 - RNA, 64 nt, Homo Sapiens; identical to SEQ ID NO: 90060

SEQ ID NO: 225235 - RNA, 64 nt, Homo Sapiens; identical to SEQ ID NO: 90061

SEQ ID NO: 225236 - RNA, 64 nt, Homo Sapiens; identical to SEQ ID NO: 90062

SEQ ID NO: 225237 - RNA, 64 nt, Homo Sapiens; identical to SEQ ID NO: 90063

SEQ ID NO: 225238 - RNA, 64 nt, Homo Sapiens; identical to SEQ ID NO: 90064

SEQ ID NO: 225239 - RNA, 64 nt, Homo Sapiens; identical to SEQ ID NO: 90065

SEQ ID NO: 225240 - RNA, 64 nt, Homo Sapiens; identical to SEQ ID NO: 90066

SEQ ID NO: 225241 - RNA, 64 nt, Homo Sapiens; identical to SEQ ID NO: 90067

SEQ ID NO: 225242 - RNA, 64 nt, Homo Sapiens; identical to SEQ ID NO: 90068

SEQ ID NO: 225243 - RNA, 64 nt, Homo Sapiens; identical to SEQ ID NO: 90069

SEQ ID NO: 225244 - RNA, 64 nt, Homo Sapiens; identical to SEQ ID NO: 90070

SEQ ID NO: 225245 - RNA, 64 nt, Homo Sapiens; identical to SEQ ID NO: 90071

SEQ ID NO: 225246 - RNA, 64 nt, Homo Sapiens; identical to SEQ ID NO: 90072

SEQ ID NO: 225247 - RNA, 64 nt, Homo Sapiens; identical to SEQ ID NO: 90073

SEQ ID NO: 225248 - RNA, 64 nt, Homo Sapiens; identical to SEQ ID NO: 90074

SEQ ID NO: 225249 - RNA, 64 nt, Homo Sapiens; identical to SEQ ID NO: 90075

SEQ ID NO: 225250 - RNA, 64 nt, Homo Sapiens; identical to SEQ ID NO: 90076

SEQ ID NO: 225251 - RNA, 64 nt, Homo Sapiens; identical to SEQ ID NO: 90077

SEQ ID NO: 225252 - RNA, 64 nt, Homo Sapiens; identical to SEQ ID NO: 90078

SEQ ID NO: 225253 - RNA, 64 nt, Homo Sapiens; identical to SEQ ID NO: 90079

SEQ ID NO: 225254 - RNA, 64 nt, Homo Sapiens; identical to SEQ ID NO: 90080

SEQ ID NO: 225255 - RNA, 64 nt, Homo Sapiens; identical to SEQ ID NO: 90081

SEQ ID NO: 225256 - RNA, 64 nt, Homo Sapiens; identical to SEQ ID NO: 90082

SEQ ID NO: 225257 - RNA, 64 nt, Homo Sapiens; identical to SEQ ID NO: 90083

SEQ ID NO: 225258 - RNA, 64 nt, Homo Sapiens; identical to SEQ ID NO: 90084

SEQ ID NO: 225259 - RNA, 62 nt, Homo Sapiens
caucuuagugccugagaguauuuaggcagauugaaaaggacaccuuuuaacucaccucucaa

SEQ ID NO: 225260 - RNA, 62 nt, Homo Sapiens
uacaugguugugaccugaggauuuaagggauggaaaaggaagacuagaggcuugcauaauaa

SEQ ID NO: 225261 - RNA, 62 nt, Homo Sapiens
aguuuuauugcuuauagaaaaggaugggaagagaaaaggagccagagagaacccagguuaga

SEQ ID NO: 225262 - RNA, 62 nt, Homo Sapiens
guugcacaaggguugugaauucugacuugagagaaaaggaaucacugaaacauguggucugg

SEQ ID NO: 225263 - RNA, 62 nt, Homo Sapiens
aaauagauguguguuuaauggaauugaagucugaaaaggaaguaguuauuuuagcagaaaau

SEQ ID NO: 225264 - RNA, 62 nt, Homo Sapiens
uugaauuauuuuucuccaaauugagacucucagaaaaggaagauugaauuagcguguuuuuu

SEQ ID NO: 225265 - RNA, 62 nt, Homo Sapiens
agaacucuuguuucuuggggaaggagaggagggaaaaggaccagggucaagggggaccagag

SEQ ID NO: 225266 - RNA, 62 nt, Homo Sapiens
ugacugauuaauuauuccugauaacaucucaagaaaaggagaaggaaaguguuucuggagaa

SEQ ID NO: 225267 - RNA, 62 nt, Homo Sapiens
acauaagaaacuccauuuugugugucuguguagaaaaggaagaagaaagaucagauuguuac

SEQ ID NO: 225268 - RNA, 62 nt, Homo Sapiens
caggagccacugugaggugacuuggugcauuggaaaaggagucaucccuccguggugugugu

SEQ ID NO: 225269 - RNA, 62 nt, Homo Sapiens
uaauacaauuccagaaaguguuuuacucucuggaaaaggagaacaauggugauuuuauuuau

SEQ ID NO: 225270 - RNA, 62 nt, Homo Sapiens
ucugcuuucguguuuuugggauuuuuuucagugaaaaggaauccuugcauggaaaacuguuu

SEQ ID NO: 225271 - RNA, 62 nt, Homo Sapiens
cuuaucacacugauguguucaacuguuuaugggaaaaggaaacuaggaugguuuuauuugug

SEQ ID NO: 225272 - RNA, 62 nt, Homo Sapiens
cuacaacgcuagaacuguugaacuucuugggagaaaaggagaaucuuuguuuuguugugcug

SEQ ID NO: 225273 - RNA, 62 nt, Homo Sapiens
agcgcagagcagagugcugaguaaagaugucagaaaaggaaagcaauggucugguacaaguc

SEQ ID NO: 225274 - RNA, 62 nt, Homo Sapiens
aaagaaagguuuuuugguuugacccaagagaagaaaaggaagcuauuacauaagaaacaaug

SEQ ID NO: 225275 - RNA, 62 nt, Homo Sapiens
uguacuggcuauuacauaagaagcuaacacaggaaaaggaacaauuuuaggcucaaaaauua

SEQ ID NO: 225276 - RNA, 62 nt, Homo Sapiens
uuuaggaggagaauuugugagagcguuccuaggaaaaggaauuuccauuacuccauuuacag

SEQ ID NO: 225277 - RNA, 62 nt, Homo Sapiens
aaguccugcagaaucaauccgcaccaagcguggaaaaggagagcuuaaucuucagcuucuau

SEQ ID NO: 225278 - RNA, 62 nt, Homo Sapiens
cagagaaaaaucacagcuuccuugucggaggggaaaaggacaggugaucuggggaaaacgca

SEQ ID NO: 225279 - RNA, 62 nt, Homo Sapiens
auuuucuucagccugugcaaaacaaagcaauggaaaaggaaacuaaaaaauauacauacuag

SEQ ID NO: 225280 - RNA, 62 nt, Homo Sapiens
caggaaaacuacagguguugcuccuguuuacugaaaaggaguuuccugcugacuacaacccu

SEQ ID NO: 225281 - RNA, 62 nt, Homo Sapiens
guagcucaacuugugauaaaaacucuauaaaggaaaaggaauaucaccccugccuuuuguuc

SEQ ID NO: 225282 - RNA, 62 nt, Homo Sapiens
uaggagaaagaagagcagcugcuucugaggaagaaaaggaguuuuuaucgagagaaccuucu

SEQ ID NO: 225283 - RNA, 62 nt, Homo Sapiens
agguuugaggggcuggggagugggaggggggagaaaaggaauguauuuaaacaauuuccgau

SEQ ID NO: 225284 - RNA, 62 nt, Homo Sapiens
acaagaaauuuaaagaaucaaaacgaugguuugaaaaggaaaccuaugauacaugcaggaga

SEQ ID NO: 225285 - RNA, 62 nt, Homo Sapiens
auccugcugcuggguauauacccgaaagaaaggaaaaggaagccaguauauugaagagguau

SEQ ID NO: 225286 - RNA, 62 nt, Homo Sapiens
augagauucugucauuugcaauaauauagauggaaaaggaggcccuuaugugaagugaaaua

SEQ ID NO: 225287 - RNA, 62 nt, Homo Sapiens
gagaggcugagaucauucagggaguguguucagaaaaggagauagucuccuuuuucaacaaa

SEQ ID NO: 225288 - RNA, 62 nt, Homo Sapiens
cuggugcuuccccuguuugcucuggcugcauagaaaaggauugagccuguccguucagagcc

SEQ ID NO: 225289 - RNA, 62 nt, Homo Sapiens
agugugacggagcaggcgggcugaggagaguggaaaaggaagcgacccagaaauggcaggga

SEQ ID NO: 225290 - RNA, 62 nt, Homo Sapiens
aaaaaaaaaaaugcuuuuaaaaaagauaaaaugaaaaggagagcucucuuuuucucucucuu

SEQ ID NO: 225291 - RNA, 62 nt, Homo Sapiens
aauaucuuuuuuggaacuaaucugggaggcaagaaaaggacaugaggggacauuuucuggau

SEQ ID NO: 225292 - RNA, 62 nt, Homo Sapiens
aaaagcaaaaagcaagggagacaugugaggaggaaaaggaaaaguccucuagcaggccuaag

SEQ ID NO: 225293 - RNA, 61 nt, Homo Sapiens; identical to SEQ ID NO: 123342

SEQ ID NO: 225294 - RNA, 62 nt, Homo Sapiens
cuaagucaagugcaaggacuuaacuugcguuugaaaaggaauuagagggucagaaacaccca

SEQ ID NO: 225295 - RNA, 62 nt, Homo Sapiens
uguaagagguggccuucaugaccaaggggcaggaaaaggauaugaggaaucaaggggccauu

SEQ ID NO: 225296 - RNA, 62 nt, Homo Sapiens
gcacaggaugcccuccaaggacucaggaaugggaaaaggacacuccaguauuuccuuuggau

SEQ ID NO: 225297 - RNA, 62 nt, Homo Sapiens
uuuuggcuuacucuuuggaugagaccagacaagaaaaggauuaaacggguggcuccuuuaau

SEQ ID NO: 225298 - RNA, 62 nt, Homo Sapiens
cuuagacaaaaaaagcagaacccacuggaguagaaaaggaagcauguagcauauacucagua

SEQ ID NO: 225299 - RNA, 62 nt, Homo Sapiens
auuucuucuucucacgucugugacaaaugguugaaaaggagucaacauggccccaacuauag

SEQ ID NO: 225300 - RNA, 62 nt, Homo Sapiens
gggaacuccagacugacacagcaguuguuuuugaaaaggaaauaaacuuugaugaauuagau

SEQ ID NO: 225301 - RNA, 62 nt, Homo Sapiens
aacucuggagugagaggaugccagaggaucaagaaaaggaucacaguuucuugaagaagcuu

SEQ ID NO: 225302 - RNA, 62 nt, Homo Sapiens
ugagagaaaaaccaaucaauguuuacaaaauggaaaaggacacagcauguccuuugaacucc

SEQ ID NO: 225303 - RNA, 62 nt, Homo Sapiens
acgacagccccaaucuucccgucuuuaugagagaaaaggaaaaaggaaucaaagguggaaga

SEQ ID NO: 225304 - RNA, 62 nt, Homo Sapiens
guguggaagggggucuaggagagggagagcuggaaaaggagcugauggggucuuauccuggc

SEQ ID NO: 225305 - RNA, 62 nt, Homo Sapiens
aggcggcagagcugugcgcccacccagcuauugaaaaggacuuucugugggcacacacucug

SEQ ID NO: 225306 - RNA, 62 nt, Homo Sapiens
uuucccauaagacaaugacauacgcuuuuaaugaaaaggaaucacguuagaggaaaaauauu

SEQ ID NO: 225307 - RNA, 62 nt, Homo Sapiens
ggaacuugucucuucaucuaauaugauagcgggaaaaggagaggaaacuacugccuuuagaa

SEQ ID NO: 225308 - RNA, 62 nt, Homo Sapiens
ucugugcguugggucaguuucuguuacguaacgaaaaggauaaacaucucccacgggagagg

SEQ ID NO: 225309 - RNA, 62 nt, Homo Sapiens
uuuaagugcuguauuaauaauacuuucugaaagaaaaggacacuuaccccaaaacuucaauc

SEQ ID NO: 225310 - RNA, 62 nt, Homo Sapiens
cuuccacugaaacauuuggaagcucauguuuggaaaaggaauaauuaaaaacccaaagaacc

SEQ ID NO: 225311 - RNA, 62 nt, Homo Sapiens
gcuccaucaaagaggaccccgcaagacuuggagaaaaggaaagcuuuuccucaggaaauucg

SEQ ID NO: 225312 - RNA, 62 nt, Homo Sapiens
uuauuaugagugggggacuggugacuuuauaugaaaaggaaggaagagugaccuaagcuagc

SEQ ID NO: 225313 - RNA, 62 nt, Homo Sapiens
uaacugugcuugucucagucaaacuuaauugggaaaaggaggaguaagagcaggcccuuucu

SEQ ID NO: 225314 - RNA, 62 nt, Homo Sapiens
cccuuagaaugggaaagaaaaaaaguaagaaagaaaaggacuuccaucucaaaaaaaaaaaa

SEQ ID NO: 225315 - RNA, 62 nt, Homo Sapiens
cccuggccaggcgcagugacuaggcucaguuagaaaaggacuauuuguaccuaagagaaaaa

SEQ ID NO: 225316 - RNA, 62 nt, Homo Sapiens
gguagauacagucagugucaggaucagaugaagaaaaggagagacuuuagacaaaagcaaga

SEQ ID NO: 225317 - RNA, 62 nt, Homo Sapiens
ccuguuacagaaaagacaaggagaacauaagagaaaaggaaaaaagaacauaagaacucaag

SEQ ID NO: 225318 - RNA, 62 nt, Homo Sapiens
gguagauacagucagugucaacaccugaugaagaaaaggagaauauggauuuagaaaaagga

SEQ ID NO: 225319 - RNA, 62 nt, Homo Sapiens
auaaaaacuguggcugaccaauucauagaaaugaaaaggaaacaaagucaacugaaucuuuu

SEQ ID NO: 225320 - RNA, 62 nt, Homo Sapiens
ucuguauuuucuauuagccacaacucucuuaugaaaaggaacaaaauacuguuucuucuauc

SEQ ID NO: 225321 - RNA, 64 nt, Homo Sapiens
caauuuccacaugaaaaagguggagcuuucuagaaaaaccaaccucuaaggcauuaggaauuua

SEQ ID NO: 225322 - RNA, 64 nt, Homo Sapiens
cacuucuuccuuuguuaggcugugcuuuacugauaaaaccaaguauugaauaaagagaguuaau

SEQ ID NO: 225323 - RNA, 64 nt, Homo Sapiens
agagugggagcugagugggggaucacagccucugaaaaccaauguucucucuucuccaccuccc

SEQ ID NO: 225324 - RNA, 64 nt, Homo Sapiens
ggugugggggaagcaccauaacuuuguuuagcccaaaaccaagucaagugaaaaaggaggaaga

SEQ ID NO: 225325 - RNA, 64 nt, Homo Sapiens
aaggagcugguagccuaccuacacagcugcuacaaaaaccaaaauacagaauggcuucugugau

SEQ ID NO: 225326 - RNA, 64 nt, Homo Sapiens
uuggcaugacaucugagcacagaaauuaaggcaaaaaaccaaagcaaaacaaauacauggugcu

SEQ ID NO: 225327 - RNA, 64 nt, Homo Sapiens
ccugaacccuuuuaaagaacgugcagccugauuuaaaaccaaacgucagauugauuugaaaggu

SEQ ID NO: 225328 - RNA, 64 nt, Homo Sapiens
augaugccuagugaguauguaaaaucccugguuuaaaaccaacauuuuuugagauuaaaaaaaa

SEQ ID NO: 225329 - RNA, 64 nt, Homo Sapiens
uguagcaagaugcaaaugcauaggcccuuucauaaaaaccaaacuaugucaacuuaaaaaaaaa

SEQ ID NO: 225330 - RNA, 64 nt, Homo Sapiens
cugaugaccuuaucagcuucuugugcccugggccaaaaccaaugguuaaggcaacauuccuuuc

SEQ ID NO: 225331 - RNA, 64 nt, Homo Sapiens
cuucuguuuauccugaggcugagaaaaggagcaaaaaaccaaguaaaacguacuguaccguaca

SEQ ID NO: 225332 - RNA, 64 nt, Homo Sapiens
guaaucacgucugagccaagguggauuaauuaggaaaaccaauauuacacuucccuguggauuu

SEQ ID NO: 225333 - RNA, 64 nt, Homo Sapiens
gauaucuaaguaguucucagucuuauuuaaaaacaaaaccaaauccauucuaauuaaugcccuu

SEQ ID NO: 225334 - RNA, 64 nt, Homo Sapiens
uauuguucaaauuuagguuucaauaacaaagaagaaaaccaaaugggucuaccuuuaaaauaag

SEQ ID NO: 225335 - RNA, 64 nt, Homo Sapiens
aggaguucugcaguuuucuuucauuagguaaaggaaaaccaaugagcaauuaaggucacagaaa

SEQ ID NO: 225336 - RNA, 64 nt, Homo Sapiens
acuuaaucuuuuacaucauggguaaauauguuacaaaaccaaguaauauuuugugacuuuaauu

SEQ ID NO: 225337 - RNA, 64 nt, Homo Sapiens
uacucugaaagccuucagacaacagaaggagggaaaaaccaaccguaagaagaaaauggagaca

SEQ ID NO: 225338 - RNA, 64 nt, Homo Sapiens
acuuuccgccucucuugcaacccaugcuucgaggaaaaccaaacaauaccaugaucgaugaugu

SEQ ID NO: 225339 - RNA, 64 nt, Homo Sapiens
uuuccacccacagacccuuucaaauacuggagagaaaaccaacgaacgagcaacaaucggaaac

SEQ ID NO: 225340 - RNA, 64 nt, Homo Sapiens
guuccucagaaggagccaucauuuacuacuucagaaaaccaauucuaaagugguagaugaugaa

SEQ ID NO: 225341 - RNA, 64 nt, Homo Sapiens
cuuuuaagaaaauuaaacugcacgguauucugccaaaaccaaauggauguuuuugucugugaau

SEQ ID NO: 225342 - RNA, 64 nt, Homo Sapiens
aaacagcuccaguguuuuuaagagaauguuucuuaaaaccaauaggaaacuuaagcgagguuuc

SEQ ID NO: 225343 - RNA, 64 nt, Homo Sapiens
agaaaacuaagauuauaaauuagcaucuaguuccaaaaccaaaaaaagugccuguggauguaua

SEQ ID NO: 225344 - RNA, 64 nt, Homo Sapiens
aauaguggcccugaaggaauaaauuccagcuuuaaaaaccaagucugaggaaauauuuggcuuc

SEQ ID NO: 225345 - RNA, 64 nt, Homo Sapiens
uccuguauuuuaugcccauaaaauaagcuuuauaaaaaccaauuuccugauggacuauuaaauu

SEQ ID NO: 225346 - RNA, 64 nt, Homo Sapiens
cucagauuuccacagagacuguuugaauguuuucaaaaccaaguaucacacuuuaauguacaug

SEQ ID NO: 225347 - RNA, 64 nt, Homo Sapiens
uauugugacagagccaugguguguuuguaauaauaaaaccaaagaaacauacguccugugugca

SEQ ID NO: 225348 - RNA, 64 nt, Homo Sapiens
uguuacaguacacuuguagccaaaacuggaagacaaaaccaauauauaauuuggcugcugauug

SEQ ID NO: 225349 - RNA, 64 nt, Homo Sapiens
uugcgcuaccuaacaguaccaucuuggauccuucaaaaccaaagacuugccccagcacugcugu

SEQ ID NO: 225350 - RNA, 64 nt, Homo Sapiens
guccuuaaccacugaccauucaauagcacaaaggaaaaccaaaauaaagccauuauuuuuauau

SEQ ID NO: 225351 - RNA, 64 nt, Homo Sapiens
ugaaaucgcuuuggaaaucauuauugacauaucuaaaaccaaacuuuuucccacugccuuuuua

SEQ ID NO: 225352 - RNA, 64 nt, Homo Sapiens
aguaugucauaaaauauaacauuacagcuuauuuaaaaccaaauauaguugaacauauuuaaaa

SEQ ID NO: 225353 - RNA, 64 nt, Homo Sapiens
cuuuuaccuuucuguccuugauaaaauaguaaagaaaaccaaacaaacccaggccugaugggaa

SEQ ID NO: 225354 - RNA, 64 nt, Homo Sapiens
uauuuucaaacgaaacguaagagaagucaacaauaaaaccaagaaaagugaguauuuuuauacc

SEQ ID NO: 225355 - RNA, 64 nt, Homo Sapiens
aaagaugucaagaagcuuuuaaaggucaacacaaaaaaccaaggccaggagugaggggcucuuu

SEQ ID NO: 225356 - RNA, 64 nt, Homo Sapiens
acuuuuucaguuaguccuaacuuuuaaaagaaggaaaaccaagagacauaucugguguacgugu

SEQ ID NO: 225357 - RNA, 64 nt, Homo Sapiens
acaccgcacaagucaaacgcuaggaaguuugaauaaaaccaauuuuucuaacuuguugcucauu

SEQ ID NO: 225358 - RNA, 64 nt, Homo Sapiens
ugcaucauuaauauucauuuacuucaaaaccaaaaaaaccaaggcaucacaagcauaggaagau

SEQ ID NO: 225359 - RNA, 64 nt, Homo Sapiens
aaaccaaggugcaucauuaauaggaagauacuucaaaaccaaaaucauacagucaucacaagca

SEQ ID NO: 225360 - RNA, 64 nt, Homo Sapiens
guugcuguguugaguucucuuuaaaaacaaggacaaaaccaaccagcguucaaaggaaccuccc

SEQ ID NO: 225361 - RNA, 64 nt, Homo Sapiens
uuuccaauguauguuuguuaaaaauaauaauaauaaaaccaaaagccuuuguggaaacccacuc

SEQ ID NO: 225362 - RNA, 64 nt, Homo Sapiens
uuccuuuugcuggauaugcagaaaugauaggaaaaaaaccaauggugaaauuucaaguuucaaa

SEQ ID NO: 225363 - RNA, 64 nt, Homo Sapiens
aggaaaaaaaccaauggugaaauuucaaguuucaaaaaccaaccuuucauuaccaaucccaggc

SEQ ID NO: 225364 - RNA, 64 nt, Homo Sapiens
auaguguguuuauuguaacuccucauacacuuuuaaaaccaacaucuuuuuucauaaauguugg

SEQ ID NO: 225365 - RNA, 64 nt, Homo Sapiens
gacaauuuacuuaacaaguaaccaguaguucaucaaaaccaacuuguacagacuaauaaaucuu

SEQ ID NO: 225366 - RNA, 64 nt, Homo Sapiens
auacauuuuauggugguuucaguaggucauuuuaaaaaccaaugugcauuaguuuucaaguaua

SEQ ID NO: 225367 - RNA, 64 nt, Homo Sapiens
ccuggcaccuccaaaucucauguccucacauuucaaaaccaaucaugccuucccaacagucccc

SEQ ID NO: 225368 - RNA, 64 nt, Homo Sapiens
gccaaucuguuagcaguccugacuugauuuaauaaaaaccaaggagagccaccccugcuuucug

SEQ ID NO: 225369 - RNA, 64 nt, Homo Sapiens
aaaagaugcuuuucauaauuuucacuauaccucuaaaaccaauuguaccgacaucacguagaca

SEQ ID NO: 225370 - RNA, 64 nt, Homo Sapiens
gaaaugucuaaggaaaauguuucaacagaaaaccaaaaccaaacuagccaucugcuauaacucu

SEQ ID NO: 225371 - RNA, 64 nt, Homo Sapiens
ccaaacgaaaugucuaaggaaacucuuucaacagaaaaccaaaauugaaauagccaucugcuau

SEQ ID NO: 225372 - RNA, 64 nt, Homo Sapiens
aagcaaguugcugccuauucaugcucuuggaaagaaaaccaagcauuacucuuguuugucuagu

SEQ ID NO: 225373 - RNA, 64 nt, Homo Sapiens
ugcuauuuuuaaaagcaucaaaaauuauauguauaaaaccaaagcaucucaggagaaauauugg

SEQ ID NO: 225374 - RNA, 64 nt, Homo Sapiens
ccucacuaucggaaauucauuuugauucagaauaaaaaccaaauguauagagcuuuggguguag

SEQ ID NO: 225375 - RNA, 64 nt, Homo Sapiens
uggaacuuucuguaucucuuaggaggaacaaguaaaaaccaaaugguuacauugugcugcuaga

SEQ ID NO: 225376 - RNA, 64 nt, Homo Sapiens
aaaauuuaaguuuuuuuaacuuuauuauguaagcaaaaccaauaguggcuauaguuacugauuu

SEQ ID NO: 225377 - RNA, 64 nt, Homo Sapiens
uagaaaaaggugcuaucguuuucuuuacauacucaaaaccaagaaaguaagaaacaauuauaau

SEQ ID NO: 225378 - RNA, 64 nt, Homo Sapiens
ccagguucaugaauauggugaauuauguguugccaaaaccaaacuuguucacuucuaaaccaaa

SEQ ID NO: 225379 - RNA, 64 nt, Homo Sapiens
ggugcuaggagguguggguggagaacuccaucagaaaaccaaagaaugcacugaugugugaagu

SEQ ID NO: 225380 - RNA, 64 nt, Homo Sapiens
agugcugaaaacuguauauuuagcaguagcacccaaaaccaagccuuuaaccccaacaaugugu

SEQ ID NO: 225381 - RNA, 64 nt, Homo Sapiens
uuuauucuuuguuaacaugagagucccaugucugaaaaccaaaguccaauuucugucuggccuu

SEQ ID NO: 225382 - RNA, 64 nt, Homo Sapiens
caaagccuaauuaaccaaaguacaaguaaugccaaaaaccaaguucauuggaaugauauaauua

SEQ ID NO: 225383 - RNA, 64 nt, Homo Sapiens
uuagguguucuuacauauuuauaaacuuuauuuuaaaaccaaauaucugaugagaaugguuguu

SEQ ID NO: 225384 - RNA, 64 nt, Homo Sapiens
acugacacaacuccuuaagcugucaucguuuaacaaaaccaacaugugaauuuuaacaguucuc

SEQ ID NO: 225385 - RNA, 64 nt, Homo Sapiens
cucccaagcugaauauucuucuucuagaccgcuuaaaaccaauguucuggaagaauguaguaau

SEQ ID NO: 225386 - RNA, 64 nt, Homo Sapiens
gugaugaacuugugauuuuguguuuuacuugaccaaaaccaaguguauauguuuacauguuuuu

SEQ ID NO: 225387 - RNA, 64 nt, Homo Sapiens
aagauuauaaaagggaaaauagaacaaaaauauuaaaaccaaugagaauaaaagaauggaaaga

SEQ ID NO: 225388 - RNA, 64 nt, Homo Sapiens
caaacaaacaaaaaaaaccccggcaagaaaaccaaaaaccaaaacuuucuacaguuuugcacca

SEQ ID NO: 225389 - RNA, 64 nt, Homo Sapiens
accaaaacaaacaaacaaaaugcaccacggcaagaaaaccaaaauaagcaacuuucuacaguuu

SEQ ID NO: 225390 - RNA, 64 nt, Homo Sapiens
cauccucuucuuucugccaagcuucucuucuaucaaaaccaacauugaaaauaaucuauuugua

SEQ ID NO: 225391 - RNA, 64 nt, Homo Sapiens
cucacuucacagggucuguaaaaagguuaaucacaaaaccaaccauuuuaaaaagaaaaacaga

SEQ ID NO: 225392 - RNA, 64 nt, Homo Sapiens
cugauuggaaacaauuaauuauugcagagaaaacaaaaccaaaguagaugguguuugcauguaa

SEQ ID NO: 225393 - RNA, 64 nt, Homo Sapiens
augggccagcugggcuuuuuacagggcuuugcugaaaaccaaaccccagcgcaaacuucaagag

SEQ ID NO: 225394 - RNA, 64 nt, Homo Sapiens
caaguaaagaacagccaaguggaaacaacaaaauaaaaccaaccaguauuuccgucaagaaaaa

SEQ ID NO: 225395 - RNA, 64 nt, Homo Sapiens
uuauagacuauguagaaaugaaauguuuaaaaucaaaaccaaaauguuugaaauuucaauaaua

SEQ ID NO: 225396 - RNA, 64 nt, Homo Sapiens
acaaaccaaaaaaaaaaaaaaaaacaaacaaaaaaaaaccaaaacccaaaggaaccagagguga

SEQ ID NO: 225397 - RNA, 64 nt, Homo Sapiens
auaaucacaacagaaaccagaaccaacaaaagagaaaaccaaaaaaaaaaaaaggaaagaaacu

SEQ ID NO: 225398 - RNA, 64 nt, Homo Sapiens
auugacaaugacccaaaucucuuccacaagacuuaaaaccaaauucagggacaaauggauagag

SEQ ID NO: 225399 - RNA, 64 nt, Homo Sapiens
cugacuguagcuuugugaaauaucuuaaaacgcaaaaaccaauuguguccugaaaauuguuuca

SEQ ID NO: 225400 - RNA, 64 nt, Homo Sapiens
acacgcggcccugacggugguauccaguuaacucaaaaccaacacacagagugcaggaaaagac

SEQ ID NO: 225401 - RNA, 64 nt, Homo Sapiens
agucacagcgcccucaucuuuuuagcaagguaaaaaaaccaaaauggguguuaucucugauauc

SEQ ID NO: 225402 - RNA, 64 nt, Homo Sapiens
uuauaggauuuuuuuuucuuuaaaaaccuguauaaaaaccaaaaaggauuuuuuucuuuuuuag

SEQ ID NO: 225403 - RNA, 64 nt, Homo Sapiens
uuauaggauuuuuuucuuuuuaaaaaccuauaugaaaaccaaaauaggauuuuuucuuuuuuag

SEQ ID NO: 225404 - RNA, 64 nt, Homo Sapiens
uuauaggauuuuuucuuuuuuaaaaaccuauauaaaaaccaaaaaggauuuuuuucuuuuuuag

SEQ ID NO: 225405 - RNA, 64 nt, Homo Sapiens
uuauaggauuuuuuucuuuuuaaaaaccgguaucaaaaccaaaauaggauuuuuucuuuuuuag

SEQ ID NO: 225406 - RNA, 64 nt, Homo Sapiens
uuauaggauuuuuucuuuuuuaaaaaccuauauaaaaaccaaaaguaauagagccacuggugag

SEQ ID NO: 225407 - RNA, 64 nt, Homo Sapiens
aacccuuucaagggaaauuuuaaucuaaaaggaaaaaaccaaaauauugaugagaaggaguccu

SEQ ID NO: 225408 - RNA, 64 nt, Homo Sapiens
agaaggcuugucucaccuccaccggcauccacacaaaaccaaacaggagcaggcgucaucccca

SEQ ID NO: 225409 - RNA, 64 nt, Homo Sapiens
acucauuuaaaaguagguuauuaauaccaaacuuaaaaccaaacacuuaauuuaaguuugcacu

SEQ ID NO: 225410 - RNA, 64 nt, Homo Sapiens
cuauacuuuugaucuauaauaaauaaaauaaaacaaaaccaaaaagucauuugaacaugcuucu

SEQ ID NO: 225411 - RNA, 64 nt, Homo Sapiens
uucucuucucucuucucaauuuugagguccucauucccaagauugaggaggcaguaguuaaucu

SEQ ID NO: 225412 - RNA, 64 nt, Homo Sapiens
caguagaauggccagcauuccugccuguaagucuucccaagacagaggcccggugacacaguuc

SEQ ID NO: 225413 - RNA, 64 nt, Homo Sapiens
uccaggugcuuuccagacucaauccaggcuccucucccaagaaaacagcccuccucucccaaga

SEQ ID NO: 225414 - RNA, 64 nt, Homo Sapiens
uccaggcuccucucccaagaccacagcccuccucucccaagaaaagaagaacugauuggggcuu

SEQ ID NO: 225415 - RNA, 64 nt, Homo Sapiens
ucacucacagcaaacuuggaaagaaggcuaugacucccaagaggcagugaaccauugccuuaaa

SEQ ID NO: 225416 - RNA, 64 nt, Homo Sapiens
ucauuauucugccucuuacuuacccuauuauggcucccaagaaaguuccugcuuuaguguuuug

SEQ ID NO: 225417 - RNA, 64 nt, Homo Sapiens
gggauguuagcauucauuagaguaugaggaugagucccaagaagguucuuuggaaggaggacga

SEQ ID NO: 225418 - RNA, 64 nt, Homo Sapiens
uuuaagugggcuuccauuccauggauuuaaucagucccaagaagaucaaacucagcaguacuug

SEQ ID NO: 225419 - RNA, 64 nt, Homo Sapiens
aaaaaauuguucaacaauaagagcaagauuccguucccaagaaagcacuccagccugggcgaca

SEQ ID NO: 225420 - RNA, 64 nt, Homo Sapiens
aggacccacuggggcauauacuucccaguugagcucccaagaccucucugcuguauccuuucgg

SEQ ID NO: 225421 - RNA, 64 nt, Homo Sapiens
aggacccacuggggcauauacuucccaguugagcucccaagaccucucugcuguguccuuucgg

SEQ ID NO: 225422 - RNA, 64 nt, Homo Sapiens
uuuuuucugguaaguuggagucuuuaagugguguucccaagagcugugaaacuguuuaggauuu

SEQ ID NO: 225423 - RNA, 64 nt, Homo Sapiens
cagaaauguggaugcucuuucagcuucccuuuucucccaagaugaauugaagacacguucuugc

SEQ ID NO: 225424 - RNA, 64 nt, Homo Sapiens
agagccuguccccagauguccuggugaccugcucucccaagaacggcaggcagcccuacaaauc

SEQ ID NO: 225425 - RNA, 64 nt, Homo Sapiens
uccugguggugcagccugugcagcaggaaggggcucccaagagccugcaugauggggagugaag

SEQ ID NO: 225426 - RNA, 64 nt, Homo Sapiens
aaauauauuaaaaagauauuuauuauuauugucaucccaagaaaaguuaauacuaucauaguaa

SEQ ID NO: 225427 - RNA, 64 nt, Homo Sapiens
aaagauauuuuaaaaauuuauacuauuauugucaucccaagaaaaauuaauacuaucauguuaa

SEQ ID NO: 225428 - RNA, 64 nt, Homo Sapiens
ggcugaaagaugaaaauggugcccucaucagagucaucagcaaacuguccaaguaggcuaggcu

SEQ ID NO: 225429 - RNA, 64 nt, Homo Sapiens
cuucuacuagccagcaguucucucuggauacuggcaucagcaggucuccuuuuucuugugcugc

SEQ ID NO: 225430 - RNA, 64 nt, Homo Sapiens
gcuggugcugcuguguguggacagacaaccgugacaucagcaguucuaacgugggaucuucugg

SEQ ID NO: 225431 - RNA, 64 nt, Homo Sapiens
uauguagucaaggcagccagucaccgagcugucacaucagcaaaucuuguucaagagaaaguga

SEQ ID NO: 225432 - RNA, 64 nt, Homo Sapiens
aucuggcagggcaccacagcgcccccuacugaaccaucagcaugucaguggcauuuaaagccau

SEQ ID NO: 225433 - RNA, 64 nt, Homo Sapiens
gccugcucuaagaugccuugcuuguccuuugacccaucagcauggagcucagugguugcuguuu

SEQ ID NO: 225434 - RNA, 64 nt, Homo Sapiens
gggaaagccaagcugagaauguuauaacccacaccaucagcaggacauuugcaggaagguaacu

SEQ ID NO: 225435 - RNA, 64 nt, Homo Sapiens
ucaacccuaugcugggaaaggcaaacuucgagcccaucagcagguccuuugauaagacccauag

SEQ ID NO: 225436 - RNA, 64 nt, Homo Sapiens
gaucucgguggguugcucagugagaauguggaggcaucagcaagggaaagggcuggcucacuga

SEQ ID NO: 225437 - RNA, 64 nt, Homo Sapiens
gugggccuccaaagccagauucagaaaaaaacaccaucagcaaaaacugaucauauugcuuguc

SEQ ID NO: 225438 - RNA, 64 nt, Homo Sapiens
aaacaaaagucacacuuaaggauccuucuagucacaucagcaguguucugccuuuauguaguag

SEQ ID NO: 225439 - RNA, 64 nt, Homo Sapiens
caacuacaacuucccuauagcuucuaagcaguuucaucagcauuacuugggaaaacguguugca

SEQ ID NO: 225440 - RNA, 64 nt, Homo Sapiens
cuccuggccagccacauaagauaagcucucagaccaucagcaucaccugcagacacuuucugca

SEQ ID NO: 225441 - RNA, 64 nt, Homo Sapiens
cuccuggccagcugcauaaaauucacucucagaccaucagcaucacaugcacacauuuucugca

SEQ ID NO: 225442 - RNA, 64 nt, Homo Sapiens
cucaacugauuuacucacuuagcuucccuucccucaucagcauaguauaauagaauguauguua

SEQ ID NO: 225443 - RNA, 64 nt, Homo Sapiens
gucagugaagucuaucaaucauucuccccuuccucaucagcaaugguagauagaaauguccuaa

SEQ ID NO: 225444 - RNA, 64 nt, Homo Sapiens
ucuguucccuucuccuuucaucccagaggggccucaucagcaaagacagaaacugauguuccau

SEQ ID NO: 225445 - RNA, 64 nt, Homo Sapiens
cagcacuacucagcauguaguccaggaccugcggcaucagcauccccugggagcuucuuagaaa

SEQ ID NO: 225446 - RNA, 64 nt, Homo Sapiens
aaaggagcacaaggaaaccaagcagcagaggccccaucagcacagagggccucguuccacgaac

SEQ ID NO: 225447 - RNA, 64 nt, Homo Sapiens
ucacccucucucguccaucucuguugccucugcacaucagcacacacugacuccaccugggcug

SEQ ID NO: 225448 - RNA, 64 nt, Homo Sapiens
acuggcguccucuccugagucccuccgcacucuccaucagcaaccucacaccugccuucagacc

SEQ ID NO: 225449 - RNA, 64 nt, Homo Sapiens
agguggggcugcaccagacucagcacuagcacuccaucagcacuagcaccucacuccaucagca

SEQ ID NO: 225450 - RNA, 64 nt, Homo Sapiens
gcacuagcacuccaucagcacuagcaccucacuccaucagcacuagcaccucacuccaucggcc

SEQ ID NO: 225451 - RNA, 64 nt, Homo Sapiens
caucggcacuaaugccccacucggcgccccacuccaucagcacuaaugcuccacuccauuggca

SEQ ID NO: 225452 - RNA, 64 nt, Homo Sapiens
aaugacccgcuccuuugacauuggugccccacuccaucagcacuaacgcccugcuccaucggca

SEQ ID NO: 225453 - RNA, 64 nt, Homo Sapiens
ucugauagcaccacacgcaaaccaaccuuucugacaucagcacuuuaccagaggcauaaacaca

SEQ ID NO: 225454 - RNA, 64 nt, Homo Sapiens
gaagucuuuaauauuuuaagcccuaucacugacacaucagcauguuuucugcuuuaaauuaaaa

SEQ ID NO: 225455 - RNA, 64 nt, Homo Sapiens
auccuuuaaugaucugguggucuccucgucaauccaucagcaaugcuucucucauagugucaua

SEQ ID NO: 225456 - RNA, 64 nt, Homo Sapiens
ucuggaaaugcacuauuucugaccugccaccucccaucagcaaucaaaugggucaaaaccaugg

SEQ ID NO: 225457 - RNA, 64 nt, Homo Sapiens
ccgcugacaagucuuucuaggucuccaggagucucaucagcaaaccugagggcaccccgacucu

SEQ ID NO: 225458 - RNA, 64 nt, Homo Sapiens
cccuccauucuccuggagcugccaccgcuguccccaucagcaaccauguucuugcaggcugggg

SEQ ID NO: 225459 - RNA, 64 nt, Homo Sapiens
guagaacccaaaagauuggagccuuaacaauaaacaucagcacuaagugaccuguuccuccuuu

SEQ ID NO: 225460 - RNA, 64 nt, Homo Sapiens
uuaagaaacuuugugugcuguguagaucauuaaacaucagcauuucuugagccuaaucauguag

SEQ ID NO: 225461 - RNA, 64 nt, Homo Sapiens
acucuccugaggacucuucaccacauuccguggacaucagcacuggcuuguccaugugcugcuc

SEQ ID NO: 225462 - RNA, 64 nt, Homo Sapiens
guaaggaagcuguuucuuuuaaaacacaaaccaccaccaaaaauuuaaauguacauauugcuua

SEQ ID NO: 225463 - RNA, 64 nt, Homo Sapiens
uauuuggcuguuuuuauuuuuuaaaagguauaaacaccaaaaaaaaaauuaacauuguaugaag

SEQ ID NO: 225464 - RNA, 64 nt, Homo Sapiens
ucgugucucuuauucaguaagaugguuacucagccaccaaaauauauuucacucaaggcuugua

SEQ ID NO: 225465 - RNA, 64 nt, Homo Sapiens
auucaaaugcucuuuucccuauaaccucuuuucucaccaaaaaggagauaaauuugaaaacaga

SEQ ID NO: 225466 - RNA, 64 nt, Homo Sapiens
acuguauauguuacugccuuguacuuuucucauacaccaaaaacacaccaaaaaaaucaauaaa

SEQ ID NO: 225467 - RNA, 64 nt, Homo Sapiens
uacugccuuguacuuuucucauacaccaaaaacacaccaaaaaaaucaauaaaauaagcaaucu

SEQ ID NO: 225468 - RNA, 64 nt, Homo Sapiens
uaauggccuaaugcacccccaaacauggaaauaucaccaaaaaauacuuaauaguccaccaaaa

SEQ ID NO: 225469 - RNA, 64 nt, Homo Sapiens
acauggaaauaucaccaaaaaauacuuaauaguccaccaaaaggcaagacugcccuuagaaauu

SEQ ID NO: 225470 - RNA, 56 nt, Homo Sapiens
agcaggaguguaaagauuagauaucacaccaaaagcucaggcaagaaaagcaaaaa

SEQ ID NO: 225471 - RNA, 64 nt, Homo Sapiens
aaacccaaaacuccugcacaacaaaggaaacgaucaccaaaaugaaaagguggacuguagauug

SEQ ID NO: 225472 - RNA, 64 nt, Homo Sapiens
ucccuccaacagcaauaucuuauaauauuuaacccaccaaaaagugaccagaaaacaaugauuu

SEQ ID NO: 225473 - RNA, 64 nt, Homo Sapiens
cuccuauccaacaauuauuugucugugcaaaacccaccaaaaugcauucugacacaagaugcaa

SEQ ID NO: 225474 - RNA, 64 nt, Homo Sapiens
acuuaauucuuguuuuuuucugccuugcuauauucaccaaaaggaggccaaaugaacuaaacau

SEQ ID NO: 225475 - RNA, 64 nt, Homo Sapiens
acuuacuucuuguuuuuuccugccuugcuauauucaccaaaagguauaaaaaugaacuaaacau

SEQ ID NO: 225476 - RNA, 64 nt, Homo Sapiens
gauacccauguugagggguucaacagaaaaacaccaccaaaacagaacaccacgcuguagucuc

SEQ ID NO: 225477 - RNA, 64 nt, Homo Sapiens
auugccucuuuuccuuccuugagaauuagagcaacaccaaaagguuaccuagagggcuuuuaca

SEQ ID NO: 225478 - RNA, 64 nt, Homo Sapiens
ccuacccuguauuugccauaaacuccacaauucacaccaaaaugucuguacuuagagcuaauuc

SEQ ID NO: 225479 - RNA, 64 nt, Homo Sapiens
aguuuguuauuuuuaaaauguuuauacauaaaaccaccaaaauacauagcuucgacaagaugga

SEQ ID NO: 225480 - RNA, 64 nt, Homo Sapiens
aaagcauuuaugagaauuauuauuuuuuauuucucaccaaaauacuuagacuuguucugcauuu

SEQ ID NO: 225481 - RNA, 64 nt, Homo Sapiens
cacugcauuacagaaauugcuuccaaauuugagccaccaaaauagauauuguguucaagaauga

SEQ ID NO: 225482 - RNA, 64 nt, Homo Sapiens
aaaaauuuaaaaucuuaaauguguaagucacccccaccaaaaacaaaagagaagaaaaagaaua

SEQ ID NO: 225483 - RNA, 64 nt, Homo Sapiens
uugcaguuuuguuuuagaugauuggaaaguauaucaccaaaaaaaguauauagugacauuuuua

SEQ ID NO: 225484 - RNA, 64 nt, Homo Sapiens
aauuccaaguguauacuugcucgggugaugggugcaccaaaaucucacaaaucaccacuaaaua

SEQ ID NO: 225485 - RNA, 64 nt, Homo Sapiens
auaauguacucauguaaccaaaugcuaccuguuccaccaaaaccuauggaaauuuaaaaaaaac

SEQ ID NO: 225486 - RNA, 64 nt, Homo Sapiens
ucuuuagaauuacacagcuaaaaaggaaaaaaaacaccaaaauaagauaaaauaaaacaaauuu

SEQ ID NO: 225487 - RNA, 64 nt, Homo Sapiens
acaccaaaauaagauaaaauaaaacaaauuuaaacaccaaaauaagauauaauaaaacauuugu

SEQ ID NO: 225488 - RNA, 64 nt, Homo Sapiens; identical to SEQ ID NO: 119840

SEQ ID NO: 225489 - RNA, 64 nt, Homo Sapiens; identical to SEQ ID NO: 119841

SEQ ID NO: 225490 - RNA, 64 nt, Homo Sapiens; identical to SEQ ID NO: 100156

SEQ ID NO: 225491 - RNA, 64 nt, Homo Sapiens; identical to SEQ ID NO: 100157

SEQ ID NO: 225492 - RNA, 64 nt, Homo Sapiens; identical to SEQ ID NO: 100158

SEQ ID NO: 225493 - RNA, 64 nt, Homo Sapiens; identical to SEQ ID NO: 100159

SEQ ID NO: 225494 - RNA, 64 nt, Homo Sapiens; identical to SEQ ID NO: 100160

SEQ ID NO: 225495 - RNA, 64 nt, Homo Sapiens; identical to SEQ ID NO: 100161

SEQ ID NO: 225496 - RNA, 64 nt, Homo Sapiens; identical to SEQ ID NO: 100162

SEQ ID NO: 225497 - RNA, 64 nt, Homo Sapiens; identical to SEQ ID NO: 100163

SEQ ID NO: 225498 - RNA, 64 nt, Homo Sapiens; identical to SEQ ID NO: 100164

SEQ ID NO: 225499 - RNA, 64 nt, Homo Sapiens; identical to SEQ ID NO: 100165

SEQ ID NO: 225500 - RNA, 64 nt, Homo Sapiens; identical to SEQ ID NO: 100166

SEQ ID NO: 225501 - RNA, 64 nt, Homo Sapiens; identical to SEQ ID NO: 100167

SEQ ID NO: 225502 - RNA, 64 nt, Homo Sapiens
ccucaggugggcuggcuggcugacagaccuucuggccagacagacuccuaaccaaccagaugga

SEQ ID NO: 225503 - RNA, 64 nt, Homo Sapiens
uggccagacagacuccuaaccaaccagauggacugccagacaggcagacaucagccacauggaa

SEQ ID NO: 225504 - RNA, 64 nt, Homo Sapiens
aggaccuaucuaggcagaccccagccagacccccgccagacagacucccaaccagacugacccc

SEQ ID NO: 225505 - RNA, 64 nt, Homo Sapiens
cggcaccguaucugcagugggcacgggggggccggccagacaggcagacugggaggauggagga

SEQ ID NO: 225506 - RNA, 64 nt, Homo Sapiens
cuuucagccaugcugaugaccacaccccguccaggccagacaccaccccccaccccacugucgu

SEQ ID NO: 225507 - RNA, 64 nt, Homo Sapiens
ggcccucccuguuccccagaggaaccucagccuggccagacacagccaugauggcaacagaucu

SEQ ID NO: 225508 - RNA, 64 nt, Homo Sapiens
ccacaaggacuuccuguccaucacaguucuuugggccagacaugaagauaacuaggaaauccau

SEQ ID NO: 225509 - RNA, 64 nt, Homo Sapiens
cuuccucuugagaccucguuggacaucuuugcaagccagacacagggguccuguccaggcccag

SEQ ID NO: 225510 - RNA, 64 nt, Homo Sapiens
gucgccaggcaaugaggaaacacccucgagggcagccagacagcacaugucccaggauuugcuc

SEQ ID NO: 225511 - RNA, 64 nt, Homo Sapiens
acacccugaaauugugacccccugggggacagcugccagacacagcuggcggcagcaccagaug

SEQ ID NO: 225512 - RNA, 64 nt, Homo Sapiens
accucaccugaagggggugagacccuuguuggcagccagacaaggguggggcuccacaggcagc

SEQ ID NO: 225513 - RNA, 64 nt, Homo Sapiens
ggaucacagccacuauggaugacauguugucuacucggucuagcaccuugaccgaggauggagc

SEQ ID NO: 225514 - RNA, 64 nt, Homo Sapiens
gcuuugggggagugggcgcauccccgauggggcaucggucuaaagacuuuaaaccaccuaguuc

SEQ ID NO: 225515 - RNA, 64 nt, Homo Sapiens
ccacuaccuccaggguuuugcugucuccuucucgucggucuaccggguccauugcccacauucu

SEQ ID NO: 225516 - RNA, 64 nt, Homo Sapiens
gacgaucaucacaccugugucguuaccucagccaucggucuagcauaucagucacugggcccaa

SEQ ID NO: 225517 - RNA, 64 nt, Homo Sapiens
cuuuuauuaaaauaaccaugcaacaauaacacuaucggucuaucugacaguuuuucccccaggg

SEQ ID NO: 225518 - RNA, 64 nt, Homo Sapiens
ugcaggguaucuccacagcauggcuuucucacauucggucuacugcgaggcccauguacuccug

SEQ ID NO: 225519 - RNA, 64 nt, Homo Sapiens
ggacugccaggcuggguuggggacccagggaacaucggucuacucaggugugagggggcagguc

SEQ ID NO: 225520 - RNA, 64 nt, Homo Sapiens
gaguugcgaaucuaaaccugcacaucucagcaggucggucuagaaauugaaugagagcagugga

SEQ ID NO: 225521 - RNA, 64 nt, Homo Sapiens
acucucucaggaugccuuuuccacaggaccugggucggucuagacuccugacccguauagugug

SEQ ID NO: 225522 - RNA, 64 nt, Homo Sapiens
guaagcaggccuuaguacggcugcugcacacuucucggucuaggugggagagagugcauaaagg

SEQ ID NO: 225523 - RNA, 64 nt, Homo Sapiens
ucaaagugugccccagcacaagaggcacugguguucggucuacauuuaguucuccccacucuga

SEQ ID NO: 225524 - RNA, 64 nt, Homo Sapiens
aauuguuucauguuagauauacuucguacagaguucggucuauugcaagagaauacuguaacaa

SEQ ID NO: 225525 - RNA, 64 nt, Homo Sapiens
accacuaaccccgcauugcuccacgucagugccaucggucuagaaaauuucugcccugagcccu

SEQ ID NO: 225526 - RNA, 64 nt, Homo Sapiens
cuacuuuaggacuggaucccgacagaauucuacaucggucuaauugaaggggagaacgucucca

SEQ ID NO: 225527 - RNA, 64 nt, Homo Sapiens
uuuucuugcagguaagugacacucccuguccuagucggucuaucuggacuugcccuugucuguu

SEQ ID NO: 225528 - RNA, 64 nt, Homo Sapiens
gcuggagugguggcuccauccucucugggccacuucggucuaggaacucaucuuugcaggaacc

SEQ ID NO: 225529 - RNA, 64 nt, Homo Sapiens
uccaguguucgggggccucuggcugcugaaggauucggucuaccacggagggcugugcuguuag

SEQ ID NO: 225530 - RNA, 64 nt, Homo Sapiens
gugcuaauuuacccauuugauuuauuaucuguuaucggucuaaauguucauucugauuugucau

SEQ ID NO: 225531 - RNA, 64 nt, Homo Sapiens
gccucaagaggccucagaacugcaaacuccugcgucggucuauacuacucggccauggcccaca

SEQ ID NO: 225532 - RNA, 64 nt, Homo Sapiens
caugagccaccaugcccagcugcuccuuuauuuuaaucccuaaauauaaucccuaaauauaguu

SEQ ID NO: 225533 - RNA, 64 nt, Homo Sapiens
gcccagcugcuccuuuauuuuaaucccuaaauauaaucccuaaauauaguuauauuucauacuu

SEQ ID NO: 225534 - RNA, 64 nt, Homo Sapiens
auggaugccggcacaaaacugccuuaaaauauucauaguuaauacagguauaucuauuuuuauu

SEQ ID NO: 225535 - RNA, 64 nt, Homo Sapiens
aggaaaugguugaaaacugaagguagaugguguuauaguuaauaauaaaugcuguaaauaagca

SEQ ID NO: 225536 - RNA, 64 nt, Homo Sapiens
ugguugucuacaauuuguuuuccuguaaaugcagauaguuaaaaucuaaaggauagaaugcuuu

SEQ ID NO: 225537 - RNA, 64 nt, Homo Sapiens
uaagcgcauaguuuuugguccugccucauguaaaauaguuaaugauuaucauuuacuuggaaag

SEQ ID NO: 225538 - RNA, 64 nt, Homo Sapiens
guaauauugcuauuuacauguugauauuaauaauauaguuaauagcucucagagaguauuaaua

SEQ ID NO: 225539 - RNA, 64 nt, Homo Sapiens
gaaauuucccuucaaagaaccccagccuccaaacauaguuaauauuucuuuaccauuuugcuuu

SEQ ID NO: 225540 - RNA, 64 nt, Homo Sapiens
uacguacauuaaaaaaaaaauuguagcagugaauauaguuaaaauauaguuguuacugguccug

SEQ ID NO: 225541 - RNA, 64 nt, Homo Sapiens
uuaaagagauuuaguauuaauugucuuuuaugauauaguuaauuuuaguuuagugacaaaguca

SEQ ID NO: 225542 - RNA, 64 nt, Homo Sapiens
acauuauauuccauuuaguuacuguaggacgacuauaguuaagaaauuucugguguucuauacc

SEQ ID NO: 225543 - RNA, 64 nt, Homo Sapiens
auuauacuccaacaauucauagacuuaguuaaggauaguuaacuacauauaaauucaauaaaua

SEQ ID NO: 225544 - RNA, 64 nt, Homo Sapiens
aucccaaguugcuuaccuagaagaacuugacaggauaguuaauaauaaaccuuaaaacccauga

SEQ ID NO: 225545 - RNA, 64 nt, Homo Sapiens
gugauaaaugagacuauauaguuauauuguuaauauaguuaacacauuacaugauuuggugagc

SEQ ID NO: 225546 - RNA, 64 nt, Homo Sapiens
ucuacugccuugaaaaaugacaauugugaacaugauaguuaaacuaccacuuuuuuuaaccauu

SEQ ID NO: 225547 - RNA, 64 nt, Homo Sapiens
uuuagaagaaaaguuauuggcaugguuguugcauauaguuaaacugagaguaauucaucuguga

SEQ ID NO: 225548 - RNA, 64 nt, Homo Sapiens
aaggcuugcuuuuucuccaugucucccaguuuguauaguuaaauuguccaguuguauaguuaaa

SEQ ID NO: 225549 - RNA, 64 nt, Homo Sapiens
ucucccaguuuguauaguuaaauuguccaguuguauaguuaaauauuugaucuuauuaaaaaca

SEQ ID NO: 225550 - RNA, 64 nt, Homo Sapiens
ugcugacauaacaccaaacuucgcuauagcaaaaauaguuaaaaugauaauauaugaggaggcc

SEQ ID NO: 225551 - RNA, 64 nt, Homo Sapiens
aucuaugaugaagguaauuauaaacauuuuauuuauaguuaauauaccuaauccaaauaucaua

SEQ ID NO: 225552 - RNA, 64 nt, Homo Sapiens
gguacagccauggcuaucguguuggaauagaaucauaguuaaguuugugauaugauucugaaca

SEQ ID NO: 225553 - RNA, 64 nt, Homo Sapiens
aaacucgggcuacaaacaaaauuaaguguaacaaauaguuaagccaaaaccacagcagccuccu

SEQ ID NO: 225554 - RNA, 64 nt, Homo Sapiens
auguacacgaggcacuacuuguuuucaucuguaaauaguuaaguuuaguguugugguaaugccu

SEQ ID NO: 225555 - RNA, 64 nt, Homo Sapiens
uucacccucuuuaauuucacagucuacuucuaccauaguuaaacuacaccagaaaaggacuggc

SEQ ID NO: 225556 - RNA, 64 nt, Homo Sapiens
gaaaucugcauauucuggaucuucauugcuauuaauaguuaaauuacauguuugugugcaacug

SEQ ID NO: 225557 - RNA, 64 nt, Homo Sapiens
acugugucaaagaguguuucaaaaaaaucuaaaaauaguuaagccccuuccuuuacaguuuaaa

SEQ ID NO: 225558 - RNA, 64 nt, Homo Sapiens
acuaaauuagagaacugcucuugcugaaauuaugauaguuaagauuccuaagaacuugacaaug

SEQ ID NO: 225559 - RNA, 64 nt, Homo Sapiens
auucuucacaaaauucugagauuauaaaauguauauaguuaauauuuguuugagcuugugaccu

SEQ ID NO: 225560 - RNA, 64 nt, Homo Sapiens
auuguaacuggggaguauagaguagaaaaaaaguauaguuaaaacauuuguucuacaaauuaac

SEQ ID NO: 225561 - RNA, 64 nt, Homo Sapiens
gaggaaaggcccuagggagauuuauuucuguuaaauaguuaacucugcugaguaugacaaauag

SEQ ID NO: 225562 - RNA, 64 nt, Homo Sapiens
aaaccagucuuguuagaugaaacuggaugccugaauaguuaacuaaaugucagaagauauucug

SEQ ID NO: 225563 - RNA, 64 nt, Homo Sapiens
acauuaacacuucaauagcauuaaaacuuuggccauaguuaauaugccauaggaaaaaauuauc

SEQ ID NO: 225564 - RNA, 64 nt, Homo Sapiens
cacuuuuuuuaaaaauuuuaaccagaaaauaaagauaguuaaauccuaagauagagauuaaguc

SEQ ID NO: 225565 - RNA, 64 nt, Homo Sapiens
agauucuguccucuucucugcauaccgugaauuuauaguuaaggaucccuuugcugugagggua

SEQ ID NO: 225566 - RNA, 64 nt, Homo Sapiens
ccuccaauuuuuaaugucgaaugguaaucuuucaacucauuauucuaaucuaucacuucaaaag

SEQ ID NO: 225567 - RNA, 64 nt, Homo Sapiens
ccaaauauuuguacaaaaaauuaggcuugcugcuacucauuaacaugcaagucaagcuuuauug

SEQ ID NO: 225568 - RNA, 64 nt, Homo Sapiens
uaaccccauaauuagauccacauuuguuaauaucacucauuaauaauauacucauuagaauuac

SEQ ID NO: 225569 - RNA, 64 nt, Homo Sapiens
auuaccauuuguuaauaucauccccaaugaauauacucauuagacccaagugacgaaaacauug

SEQ ID NO: 225570 - RNA, 64 nt, Homo Sapiens; identical to SEQ ID NO: 167914

SEQ ID NO: 225571 - RNA, 64 nt, Homo Sapiens; identical to SEQ ID NO: 167915

SEQ ID NO: 225572 - RNA, 64 nt, Homo Sapiens
uuccagagaagauuuuauuucaucucaaagaggagcaauguaucuuccggucccuuuucccugc

SEQ ID NO: 225573 - RNA, 64 nt, Homo Sapiens
uggagauacuugagcugagaucagggaauggacagcaauguauuagaaauaacacacggaaagg

SEQ ID NO: 225574 - RNA, 64 nt, Homo Sapiens
aaaugauuagauacacaggaauuuucuuauagaagcaauguauuacuaaaauuuaacaaauagu

SEQ ID NO: 225575 - RNA, 64 nt, Homo Sapiens
aauaauacagcugugcuaaucuuucuagguguuugcaauguacaugggauuuuguuucccaucu

SEQ ID NO: 225576 - RNA, 64 nt, Homo Sapiens
gaccguaaugcacuaagcuuuuuuuaaaaaagaagcaauguaaauuuucauacuacuguuaacu

SEQ ID NO: 225577 - RNA, 64 nt, Homo Sapiens
ugauuuccucacucagacagaauuccaaaaugcugcaauguagcuuaacuauagcuuuauuagu

SEQ ID NO: 225578 - RNA, 64 nt, Homo Sapiens
uagaacacuaauuaaaaaacuugguggaaguucugcaauguaaaccaaaguuaaacuacugcag

SEQ ID NO: 225579 - RNA, 64 nt, Homo Sapiens
guuacgcuuuuauaaguauuagcugaaaauaaaagcaauguagauaaguuuuucuguuacuuag

SEQ ID NO: 225580 - RNA, 64 nt, Homo Sapiens
aaauauuauguaucuuacugugaaaacaaauagugcaauguaagauuuauuacaaucuccacaa

SEQ ID NO: 225581 - RNA, 64 nt, Homo Sapiens
gcauccuuaggaaucugggauuugccaguugcuggcaauguagagcaggcauggaauuuuauau

SEQ ID NO: 225582 - RNA, 64 nt, Homo Sapiens
guaugugugaaguauauacugggacuucagaagugcaauguauuuuucuccugugaaaccugaa

SEQ ID NO: 225583 - RNA, 64 nt, Homo Sapiens
auuuccccuccuaucccucugccccuacugcucagcaauguaaaagagacaaauaaggagaaag

SEQ ID NO: 225584 - RNA, 64 nt, Homo Sapiens
uuuucauagaucuauaaucaggcaauuucugcaagcaauguaugaccccaccugagcaaccaca

SEQ ID NO: 225585 - RNA, 64 nt, Homo Sapiens; identical to SEQ ID NO: 172369

SEQ ID NO: 225586 - RNA, 64 nt, Homo Sapiens; identical to SEQ ID NO: 172370

SEQ ID NO: 225587 - RNA, 64 nt, Homo Sapiens; identical to SEQ ID NO: 172371

SEQ ID NO: 225588 - RNA, 64 nt, Homo Sapiens; identical to SEQ ID NO: 172372

SEQ ID NO: 225589 - RNA, 64 nt, Homo Sapiens; identical to SEQ ID NO: 172373

SEQ ID NO: 225590 - RNA, 64 nt, Homo Sapiens; identical to SEQ ID NO: 172374

SEQ ID NO: 225591 - RNA, 64 nt, Homo Sapiens; identical to SEQ ID NO: 172375

SEQ ID NO: 225592 - RNA, 64 nt, Homo Sapiens; identical to SEQ ID NO: 172376

SEQ ID NO: 225593 - RNA, 64 nt, Homo Sapiens; identical to SEQ ID NO: 172377

SEQ ID NO: 225594 - RNA, 64 nt, Homo Sapiens; identical to SEQ ID NO: 172378

SEQ ID NO: 225595 - RNA, 64 nt, Homo Sapiens; identical to SEQ ID NO: 172379

SEQ ID NO: 225596 - RNA, 64 nt, Homo Sapiens; identical to SEQ ID NO: 172380

SEQ ID NO: 225597 - RNA, 64 nt, Homo Sapiens
gauucuaagaagagacuguccaagcaaguuaggcuugcaggaagauaugacccagcugagaagc

SEQ ID NO: 225598 - RNA, 64 nt, Homo Sapiens
aggcccugcauucagaggucuuguaaucuacuuguugcaggagaaagaagguaaaaaaugauuu

SEQ ID NO: 225599 - RNA, 64 nt, Homo Sapiens
cacuggauguuauucaacucuagagccugaagucuugcaggacucagggagcugcuggagguag

SEQ ID NO: 225600 - RNA, 64 nt, Homo Sapiens
cacuggauagauguuauucgaagagccugaagucuugcaggacucagggagcugcuggcugaga

SEQ ID NO: 225601 - RNA, 64 nt, Homo Sapiens
cacuggauagauguuauucaaagagccugaagucuugcaggacucagggagcugcuggaugaga

SEQ ID NO: 225602 - RNA, 64 nt, Homo Sapiens
uuacuguuucuccauuuucuuaauuauagcuucauugcaggacucggaauguaugguucaaccu

SEQ ID NO: 225603 - RNA, 64 nt, Homo Sapiens
agcggaauguaugguucaacugauuguaggaaaguugcaggauuggauuguauaggcagaaaaa

SEQ ID NO: 225604 - RNA, 64 nt, Homo Sapiens
uggggguggggagggacaaggcuuuguaccucuuuugcaggaucgcccuguggcccucugggaa

SEQ ID NO: 225605 - RNA, 64 nt, Homo Sapiens
auuaauagcaacccacauuucauucacacgcccauugcaggagucccacucauuucugggaaca

SEQ ID NO: 225606 - RNA, 64 nt, Homo Sapiens
gggcaaccugagagcuguuaugauacauaaacuuuugcaggaauguguugcccucugcccgcuu

SEQ ID NO: 225607 - RNA, 64 nt, Homo Sapiens
cauaugacaagccuuugugcagagcagucuaucauugcaggagccaucaucgcucccaaaggaa

SEQ ID NO: 225608 - RNA, 64 nt, Homo Sapiens
gccagguauauucacuugugcuggccugcaaaguuugcaggagguuugccuucauucuuaccac

SEQ ID NO: 225609 - RNA, 64 nt, Homo Sapiens
ugacuuuggaagggcaggcucugcaggcugcuaauugcaggaaacagccccaagaaccuaaaga

SEQ ID NO: 225610 - RNA, 64 nt, Homo Sapiens
gacagguaaagugauugcugggaaugaauuggcauugcaggaaacugggucuuggagggaugug

SEQ ID NO: 225611 - RNA, 64 nt, Homo Sapiens
acuacuuagaauuaaauuaggaagucuuuuaucauugcaggauuguacauacuacuuuauaaaa

SEQ ID NO: 225612 - RNA, 64 nt, Homo Sapiens
agaaaaucuuacuuagaaaaaagccccuugaaacuugcaggauuuacuuaauaaaaauacacgc

SEQ ID NO: 225613 - RNA, 64 nt, Homo Sapiens
auacaauucauugagcagcuaccacuuaaaaaacuugcaggacaguuagagccugcauuucuag

SEQ ID NO: 225614 - RNA, 64 nt, Homo Sapiens
cuuuguaaagggugcagccaagcucugcagacuuuugcaggauugucuagccugaguaccgggc

SEQ ID NO: 225615 - RNA, 64 nt, Homo Sapiens
ugcuguuuacucauuggaggugacuuaggccagcccuacagaagucagguuaucuugaacugcc

SEQ ID NO: 225616 - RNA, 64 nt, Homo Sapiens
ugccuuuuacguauuggagcugacucaugccagcccuacagaagucaguuuaucuuggacugac

SEQ ID NO: 225617 - RNA, 64 nt, Homo Sapiens
acacuucucagagggcagaguggcagccgggcacccuacagaaacucagagggcagaguggcag

SEQ ID NO: 225618 - RNA, 64 nt, Homo Sapiens
guaucuggggcgaguguuggggguaaaagcccacccuacagaaaguggaacagcccggagccug

SEQ ID NO: 225619 - RNA, 64 nt, Homo Sapiens
gaaagacccucgggccgcucuacagagggaaagaccuacagaggcagaaucuucuggauguucc

SEQ ID NO: 225620 - RNA, 64 nt, Homo Sapiens
gaaagaccuacagagggaaaaucuucuggauguuccuacagaggaaugugugcuugcuuccaga

SEQ ID NO: 225621 - RNA, 64 nt, Homo Sapiens
uauuagaauuggaaggcaaauuuuuguccaaaaaccuacagacaaguacuuugagagaauuucc

SEQ ID NO: 225622 - RNA, 64 nt, Homo Sapiens
ugcugguguauaaaaaccuggauguaaagcugagccuacagaccuguccucaccaacuguuuug

SEQ ID NO: 225623 - RNA, 64 nt, Homo Sapiens
uagaaaauaggcuaggcacaguggcucacgccuguaaucucaacacuuugggaggccaaggugg

SEQ ID NO: 225624 - RNA, 64 nt, Homo Sapiens
uaaaaguacaaaagggcaugauggcaggugccuguaaucucagcuacucaguaggcuggagcgg

SEQ ID NO: 225625 - RNA, 64 nt, Homo Sapiens
uuuagccaugauagaugauguaauacagcugugcuaaucucacaagguguuugcaauguacaaa

SEQ ID NO: 225626 - RNA, 64 nt, Homo Sapiens
augcuggaaugaugucuguuauccccaaucacccuaaucucagaaacauuccaacuccagaaug

SEQ ID NO: 225627 - RNA, 64 nt, Homo Sapiens
aauuuauuuggccgggcacgguggcucacaccuguaaucucagcacuuuggcaggccaaggcag

SEQ ID NO: 225628 - RNA, 64 nt, Homo Sapiens
uuuauaauauagaugguuuuguuugacuaaagaauaaucucauauaacuagaauacuuguggcu

SEQ ID NO: 225629 - RNA, 64 nt, Homo Sapiens
ugaaaagaggcauuuguuugauccuugaacgaauuaaucucacguacuucccuguuugugguuu

SEQ ID NO: 225630 - RNA, 64 nt, Homo Sapiens
aaguauuugccacuuucgaguacagcuaauuggauaaucucaaacccuuuagugaaaauaucuu

SEQ ID NO: 225631 - RNA, 64 nt, Homo Sapiens
caugauguugauuuuuuuucaaugaccuuuguuuuaaucucauuccugagaaauauucucuuaa

SEQ ID NO: 225632 - RNA, 64 nt, Homo Sapiens
uacucaggaggcugaggcacguggcgcacaccuauaaucucagcuauaaaaucagccaggcaug

SEQ ID NO: 225633 - RNA, 64 nt, Homo Sapiens
aaucuauaccuggacuguccuucugcugaaucccuaaucucaacaugagaacauuugcuuugcu

SEQ ID NO: 225634 - RNA, 64 nt, Homo Sapiens
uuggcaguuaaagucaaaauauuucugaagaaacuaaucucagacaacguuuugcagcuuccaa

SEQ ID NO: 225635 - RNA, 64 nt, Homo Sapiens
aaaaauguuggcugugcacgguagcuuaugccuguaaucucagcacuuugggaggccaaggcag

SEQ ID NO: 225636 - RNA, 64 nt, Homo Sapiens
uggaaaaacuuaugaaacuucuuauaagagagaguaaucucaggccggacaugcuggcucauac

SEQ ID NO: 225637 - RNA, 64 nt, Homo Sapiens
gcuuugggaggggaggcaggguggcucacaccuguaaucucaacagggucgugggcugggcgcg

SEQ ID NO: 225638 - RNA, 64 nt, Homo Sapiens
cugacaggaggggucguugaugccucuucugcuuuaaucucaucucucugaaggcauuugaguu

SEQ ID NO: 225639 - RNA, 58 nt, Homo Sapiens
acaccagugaaggcaaaugaaaguggagauucaggagcagcaaugggucucaccauag

SEQ ID NO: 225640 - RNA, 64 nt, Homo Sapiens
aaccaaaaaaacuguccagcuguggacuuucaggauucaggacugcuggggaucaagcccaagg

SEQ ID NO: 225641 - RNA, 64 nt, Homo Sapiens
gccugcauaauguuucuggauuucauacuguaacauucaggaauucuuggagaaaauggguuua

SEQ ID NO: 225642 - RNA, 64 nt, Homo Sapiens
uagugcgguuuacucacugcugcaaauacuguauauucaggacuugaaagaaauggugaaugcc

SEQ ID NO: 225643 - RNA, 64 nt, Homo Sapiens
uccacuauguugaauguccaccaggaugaugcucauucaggaaaaacuaauauguuuucugaaa

SEQ ID NO: 225644 - RNA, 64 nt, Homo Sapiens
aaauaauaaagucacuaucuauacccuccuguuuauucaggaaacuauuuuuuguuauuucaau

SEQ ID NO: 225645 - RNA, 64 nt, Homo Sapiens
uacuaggucagaacauuuugagucaccuugggagauucaggauggggagagcaaauuugaacaa

SEQ ID NO: 225646 - RNA, 64 nt, Homo Sapiens
ggaggguuacugaaagaauuuuagcaauauauugauucaggaaaaggagcuguuuuauaaauga

SEQ ID NO: 225647 - RNA, 64 nt, Homo Sapiens
ucaucugaccuucaccuuggucagaaugcacuugauucaggagggaucuauucauuguuucaac

SEQ ID NO: 225648 - RNA, 64 nt, Homo Sapiens
uccuuccauaucccugcccauguagguucucgcgauucaggacgguacucggcuuccugugggg

SEQ ID NO: 225649 - RNA, 64 nt, Homo Sapiens
uauugcauuuugaaauaaucauuaacaugcugcaauucaggagcugguuagaacauuuuaagug

SEQ ID NO: 225650 - RNA, 64 nt, Homo Sapiens
ugacacaccuugucgucuaaauguucgguauucuauucaggacuuacgguaacuauuaugaggg

SEQ ID NO: 225651 - RNA, 64 nt, Homo Sapiens
cuuccccaaucuagcaaggcaggccaacauucagauucaggaaauacagagaacgccacaaaga

SEQ ID NO: 225652 - RNA, 64 nt, Homo Sapiens
uuggauaaauagucaagacccaucagggugcuguauucaggaaacccaucucacgugcagagac

SEQ ID NO: 225653 - RNA, 64 nt, Homo Sapiens
cauaaaaacccuagaagaaaaccuaggcaauaccauucaggacauaggcaugggcaaggacuuc

SEQ ID NO: 225654 - RNA, 64 nt, Homo Sapiens
guggauucauccugcugguuuuacuuuagucccuccaugucaaagugggccugagaaaagcuca

SEQ ID NO: 225655 - RNA, 64 nt, Homo Sapiens
gauuuguauugaauuuauagauuaaucugguaaaccaugucaucuuuacaauguugucuuccaa

SEQ ID NO: 225656 - RNA, 64 nt, Homo Sapiens
acccggagcuaagucacccagagcacaggagcugccaugucagaugggaaaucugccuauguca

SEQ ID NO: 225657 - RNA, 64 nt, Homo Sapiens
cugggccaccgggcagccuggggcggugugugugccaugucacagcauggccucucggccuugg

SEQ ID NO: 225658 - RNA, 64 nt, Homo Sapiens
gccacaucguggcccgcagccccagagucacuguccaugucaccauccuucuccuccuuuggaa

SEQ ID NO: 225659 - RNA, 64 nt, Homo Sapiens
cugaauuugacagagaacaccuucccuuuccuugccaugucacccuccagaggaagucacaccu

SEQ ID NO: 225660 - RNA, 64 nt, Homo Sapiens; identical to SEQ ID NO: 209315

SEQ ID NO: 225661 - RNA, 64 nt, Homo Sapiens; identical to SEQ ID NO: 209316

SEQ ID NO: 225662 - RNA, 64 nt, Homo Sapiens; identical to SEQ ID NO: 209317

SEQ ID NO: 225663 - RNA, 64 nt, Homo Sapiens; identical to SEQ ID NO: 209318

SEQ ID NO: 225664 - RNA, 64 nt, Homo Sapiens; identical to SEQ ID NO: 209319

SEQ ID NO: 225665 - RNA, 64 nt, Homo Sapiens; identical to SEQ ID NO: 209320

SEQ ID NO: 225666 - RNA, 64 nt, Homo Sapiens; identical to SEQ ID NO: 209321

SEQ ID NO: 225667 - RNA, 64 nt, Homo Sapiens; identical to SEQ ID NO: 209322

SEQ ID NO: 225668 - RNA, 64 nt, Homo Sapiens; identical to SEQ ID NO: 209323

SEQ ID NO: 225669 - RNA, 64 nt, Homo Sapiens; identical to SEQ ID NO: 209324

SEQ ID NO: 225670 - RNA, 64 nt, Homo Sapiens; identical to SEQ ID NO: 209325

SEQ ID NO: 225671 - RNA, 64 nt, Homo Sapiens; identical to SEQ ID NO: 209326

SEQ ID NO: 225672 - RNA, 64 nt, Homo Sapiens; identical to SEQ ID NO: 209327

SEQ ID NO: 225673 - RNA, 64 nt, Homo Sapiens; identical to SEQ ID NO: 209328

SEQ ID NO: 225674 - RNA, 64 nt, Homo Sapiens; identical to SEQ ID NO: 209329

SEQ ID NO: 225675 - RNA, 64 nt, Homo Sapiens; identical to SEQ ID NO: 209330

SEQ ID NO: 225676 - RNA, 64 nt, Homo Sapiens; identical to SEQ ID NO: 209331

SEQ ID NO: 225677 - RNA, 64 nt, Homo Sapiens; identical to SEQ ID NO: 209332

SEQ ID NO: 225678 - RNA, 64 nt, Homo Sapiens; identical to SEQ ID NO: 209333

SEQ ID NO: 225679 - RNA, 64 nt, Homo Sapiens; identical to SEQ ID NO: 209334

SEQ ID NO: 225680 - RNA, 64 nt, Homo Sapiens; identical to SEQ ID NO: 209335

SEQ ID NO: 225681 - RNA, 64 nt, Homo Sapiens; identical to SEQ ID NO: 209336

SEQ ID NO: 225682 - RNA, 64 nt, Homo Sapiens; identical to SEQ ID NO: 209337

SEQ ID NO: 225683 - RNA, 64 nt, Homo Sapiens; identical to SEQ ID NO: 209338

SEQ ID NO: 225684 - RNA, 64 nt, Homo Sapiens; identical to SEQ ID NO: 209339

SEQ ID NO: 225685 - RNA, 64 nt, Homo Sapiens; identical to SEQ ID NO: 209340

SEQ ID NO: 225686 - RNA, 64 nt, Homo Sapiens; identical to SEQ ID NO: 209341

SEQ ID NO: 225687 - RNA, 64 nt, Homo Sapiens; identical to SEQ ID NO: 209342

SEQ ID NO: 225688 - RNA, 64 nt, Homo Sapiens; identical to SEQ ID NO: 209343

SEQ ID NO: 225689 - RNA, 64 nt, Homo Sapiens; identical to SEQ ID NO: 209344

SEQ ID NO: 225690 - RNA, 64 nt, Homo Sapiens; identical to SEQ ID NO: 209345

SEQ ID NO: 225691 - RNA, 64 nt, Homo Sapiens; identical to SEQ ID NO: 209346

SEQ ID NO: 225692 - RNA, 64 nt, Homo Sapiens; identical to SEQ ID NO: 209347

SEQ ID NO: 225693 - RNA, 64 nt, Homo Sapiens; identical to SEQ ID NO: 209348

SEQ ID NO: 225694 - RNA, 64 nt, Homo Sapiens; identical to SEQ ID NO: 209349

SEQ ID NO: 225695 - RNA, 64 nt, Homo Sapiens; identical to SEQ ID NO: 209350

SEQ ID NO: 225696 - RNA, 64 nt, Homo Sapiens; identical to SEQ ID NO: 209351

SEQ ID NO: 225697 - RNA, 64 nt, Homo Sapiens; identical to SEQ ID NO: 209352

SEQ ID NO: 225698 - RNA, 64 nt, Homo Sapiens
aauuaaagaacuugcuguucuucaagcuccagcuucucagaaaguuucaacaauguucucuagu

SEQ ID NO: 225699 - RNA, 64 nt, Homo Sapiens
auuugaaucuguuuucuuagugaauagucgguuuucucagaauaaaaccugggacacgagucug

SEQ ID NO: 225700 - RNA, 64 nt, Homo Sapiens
aaggaaggauucaccaccuccaggaaaagugucuucucagaaacaaccagcugagaagguaauu

SEQ ID NO: 225701 - RNA, 64 nt, Homo Sapiens
aauaaaggagggaccaauaucugggacagugucuucucagaaacaaccagcugagaagguaauu

SEQ ID NO: 225702 - RNA, 64 nt, Homo Sapiens
aauaauggguggugggaaaucuggaacagugucuucucagaaacaaccagccucaaagguaauu

SEQ ID NO: 225703 - RNA, 64 nt, Homo Sapiens
aauaaaggauggacuacagugugggacagugucuucucagaaacaaccagccuugaagguaauu

SEQ ID NO: 225704 - RNA, 64 nt, Homo Sapiens
aauaaaggauggagaaaaaucugggacagugucuucucagaaacaaccagccuugaagguaauu

SEQ ID NO: 225705 - RNA, 64 nt, Homo Sapiens
aauaaaggauggagaaaaaucugggacagugucuucucagaaaccaccagccuugacgguaaug

SEQ ID NO: 225706 - RNA, 64 nt, Homo Sapiens
aaaaaaggauggagaaauaucuaggaaagugucuucucagaaaccaccaaccuugaagguaaug

SEQ ID NO: 225707 - RNA, 64 nt, Homo Sapiens
aaaaaaggauggagaaauaucuaggaaagugucuucucagaaaccaccagccuugaagguaaug

SEQ ID NO: 225708 - RNA, 64 nt, Homo Sapiens
auuuugcugaagaagcaguuucucagacacaacaucucagaauuuuaauuuuuagaaauucaug

SEQ ID NO: 225709 - RNA, 64 nt, Homo Sapiens
uaccauacuguaaauaugagcuuuauggugucauucucagaaacuuacacauuucugcucuccu

SEQ ID NO: 225710 - RNA, 64 nt, Homo Sapiens
ccucugaguaacguguuugcuuucacagcaccauucucagaacagcucaaaagugacaaguccu

SEQ ID NO: 225711 - RNA, 64 nt, Homo Sapiens
ggggagcucaauagcucaaaaacaaaaugacaggucucagaaagcucagccucaaucaugucuu

SEQ ID NO: 225712 - RNA, 64 nt, Homo Sapiens
uuagauuuuuaaaaaagaauuaaaaugugggaguucucagaaagaaauaaacacaugagaauaa

SEQ ID NO: 225713 - RNA, 64 nt, Homo Sapiens
aaauaacgccugauguauagauuaguuagcaaauucucagaaaucccccacauaaaagccuuac

SEQ ID NO: 225714 - RNA, 64 nt, Homo Sapiens
uuagaagcaaguagaaaauaaguacagcauacaaucucagaaaccuuaaucaaaaagaauagcc

SEQ ID NO: 225715 - RNA, 64 nt, Homo Sapiens
ugucauagaauuucuugcugcauaggauuacuugucucagaagcggcaugggguggauauaggg

SEQ ID NO: 225716 - RNA, 64 nt, Homo Sapiens
gaauugacugggacuaauaucacaggaucaaucaucucagaaucuuacuugaugcauuauuuau

SEQ ID NO: 225717 - RNA, 64 nt, Homo Sapiens
uuucuacgccauucaggaaggcagcacaaauuuaucucagaaagguuccuguguauugcaaggu

SEQ ID NO: 225718 - RNA, 64 nt, Homo Sapiens
aaugucaaaucagaugaaguagaaagauaucaaaucucagaaagaaaaacuaagguaacuucuc

SEQ ID NO: 225719 - RNA, 64 nt, Homo Sapiens
auaucaaaucucagaaagaaaaacuaagguaacuucucagaaaguucacucacuguggaaauaa

SEQ ID NO: 225720 - RNA, 64 nt, Homo Sapiens
cucuccuaauaagcagaugugcuuuaucuaagcuucucagaacacccagcauguuucuaccaaa

SEQ ID NO: 225721 - RNA, 64 nt, Homo Sapiens
uuaugugugguuuuaaagucuuauggcaaaaaucucucagaaauacaguaagguggaugguacc

SEQ ID NO: 225722 - RNA, 64 nt, Homo Sapiens
auaauccuagggcagacuaaauucagacgacccaucucagaaugguggaucaaagcagcaaguc

SEQ ID NO: 225723 - RNA, 64 nt, Homo Sapiens
aggacuaaagggcaaaauucuagagagugguaaaucucagaaagcacaagcauaaaaugcagcu

SEQ ID NO: 225724 - RNA, 64 nt, Homo Sapiens
augccucuuuuguacauguucauguuuaguguuuucucagaaucagcaacucaagguacuauga

SEQ ID NO: 225725 - RNA, 64 nt, Homo Sapiens
guuuucuuaaucuuugaaaugcaaauaauguuuaucucagaagacuauuucuaggauuaacuga

SEQ ID NO: 225726 - RNA, 64 nt, Homo Sapiens
ggauacauuauuuuuucuuucuuucauagcugugucucagaaaggacccauuuguggcucuuuu

SEQ ID NO: 225727 - RNA, 64 nt, Homo Sapiens
uucuagccaucuaaauugacucuuccaauauaggucucagaaauccaauauuuggaguacaauu

SEQ ID NO: 225728 - RNA, 64 nt, Homo Sapiens
aaaaaaaaaaaagagagagaagagcaagacucugucucagaaaagcacuccagccugggcgaca

SEQ ID NO: 225729 - RNA, 64 nt, Homo Sapiens
gccaaucaggucaagguuugcgugggucucuucaucucagaaaugaggaaaaucuauuggcucu

SEQ ID NO: 225730 - RNA, 64 nt, Homo Sapiens
aucuuggucacugcagaauuuuaaaaggcaaacuucucagaacagaugugcacaucuuaauuug

SEQ ID NO: 225731 - RNA, 64 nt, Homo Sapiens
cguuagcagcauuagcaccuucugaauuccacccucucagaagaauccacaguguuugaacaau

SEQ ID NO: 225732 - RNA, 64 nt, Homo Sapiens
gaaauaaacccacagcuccagagaaggugaccauucucagaacuccagcuauucacucuccagg

SEQ ID NO: 225733 - RNA, 64 nt, Homo Sapiens
ccagacgauuuccacuauucacagcauuuccuuuucucagaaggacucuuuauauuuccaugua

SEQ ID NO: 225734 - RNA, 64 nt, Homo Sapiens
agaagagaagggcacugagaaaaagcaaaaggcuucucagaaccugguggugcuggccagggag

SEQ ID NO: 225735 - RNA, 64 nt, Homo Sapiens
acugcacuccagccugggugacagagcgagacuaucucagaaacaaaacaaaacaaaacaacaa

SEQ ID NO: 225736 - RNA, 64 nt, Homo Sapiens
caggcuuccuccuccucaucagcuauuuuacccaucucagaacguccugugucuccauguagga

SEQ ID NO: 225737 - RNA, 64 nt, Homo Sapiens
uugauauuuuaagcauuuucccaugucaugaguuucucagaaacauguuuuuaacaauuguacu

SEQ ID NO: 225738 - RNA, 64 nt, Homo Sapiens
gguguggaggcuguugauguuucuggugucaaguucucagaaguugcugccaccaacucuuuaa

SEQ ID NO: 225739 - RNA, 64 nt, Homo Sapiens
uucuaaaguccaguacuuuguccagauuuuagauucucagaauaaauguuuuucacagauagac

SEQ ID NO: 225740 - RNA, 64 nt, Homo Sapiens
auuggccauugccuggcuaaugagaaccccugguucucagaauuuuaaccaaaaggaguuggcu

SEQ ID NO: 225741 - RNA, 64 nt, Homo Sapiens
gggagaugaggucauuguuugucauugagucuucucucagaaucagcgagcccagcuguagggu

SEQ ID NO: 225742 - RNA, 64 nt, Homo Sapiens
ucuggcuguuaaagaauguuauuauuauuuccugucucagaaagaaugcuaaauauauggagcc

SEQ ID NO: 225743 - RNA, 64 nt, Homo Sapiens
uuuuaguuccuuuuuccaccccacccuggcaggcucucagaaauaagggaaaggggugcagcuu

SEQ ID NO: 225744 - RNA, 64 nt, Homo Sapiens
aacaaugaccugauucugucuuuaaaaaaaaaaaucucagaauucuuuuuuuguuuguguuuuu

SEQ ID NO: 225745 - RNA, 64 nt, Homo Sapiens
auuacaggcgugagccaccuugccuggccaaaaaucucagaauucuuuaagacuguuuuaauug

SEQ ID NO: 225746 - RNA, 64 nt, Homo Sapiens
cccaguguuuuugcaaagaaagaaccguccguguucucagaaagagauuucacaaauugugcua

SEQ ID NO: 225747 - RNA, 64 nt, Homo Sapiens
ggcugauuggaaggggacaaaguuagauggggguucucagaaguggcccucuuuuccaguagga

SEQ ID NO: 225748 - RNA, 64 nt, Homo Sapiens
cuaaaaaguaguucuuuaguaucaacuuuaauucuacuucuaagaaucauacucuacuucuaag

SEQ ID NO: 225749 - RNA, 64 nt, Homo Sapiens
aucaacuuuaauucuacuucuaagaaucauacucuacuucuaagaaaauaauuagaaguagaca

SEQ ID NO: 225750 - RNA, 64 nt, Homo Sapiens
uacaaauguuauguuaaagaauacaaauguacuguacuucuacaucuguauacuguacuucuac

SEQ ID NO: 225751 - RNA, 64 nt, Homo Sapiens
uacaaauguacuguacuucuaucucuguauacuguacuucuacaacaguauauuguaaauucuu

SEQ ID NO: 225752 - RNA, 64 nt, Homo Sapiens
auuugcauuuacaucauaaauugaaaaaaguuuuuacuucuaaggagucugauaaaagucuucu

SEQ ID NO: 225753 - RNA, 64 nt, Homo Sapiens
uaggugauuuuaccagguuucauaaaauauuauuuacuucuauauuucauuuugcagauguggc

SEQ ID NO: 225754 - RNA, 64 nt, Homo Sapiens
augggccuguuguaaaccaucugggaauaauguuuacuucuagagaaucccuauuccaggauuu

SEQ ID NO: 225755 - RNA, 64 nt, Homo Sapiens
uggggggugcacggggcgccgggagguucgccccuacuucuacccaccuuccacgcccgcuuug

SEQ ID NO: 225756 - RNA, 57 nt, Homo Sapiens
uaaaagaucuuuuugggugaggugucuuacuucuauuuugaaggauuauuucaguuu

SEQ ID NO: 225757 - RNA, 64 nt, Homo Sapiens
gauuuacaucuuuauauaguuggcuuggaggaaguacuucuaugggaaagugaacaguucugug

SEQ ID NO: 225758 - RNA, 64 nt, Homo Sapiens
uuuucucuaaucauuuuuucuauuuuuuuuuuuguacuucuagauguuuugguuauacagcuuc

SEQ ID NO: 225759 - RNA, 64 nt, Homo Sapiens
gcccuuuuucuccaguaguacaggcuuugaaaacuacuucuauuaaguuauugaugcaauuuga

SEQ ID NO: 225760 - RNA, 64 nt, Homo Sapiens
gacgccucccauccaccuacaagacuggacacucuacuucuaagucuuccuguuugaggaaaca

SEQ ID NO: 225761 - RNA, 64 nt, Homo Sapiens
uuuucuuccuguuugaggaagcccacccucucuuuacuucuaacgcuuagaccccaaugggaag

SEQ ID NO: 225762 - RNA, 64 nt, Homo Sapiens
uauuacagaaacagucuguaauagucuuugugcauacuucuaggucagacuggaaggaguuuuu

SEQ ID NO: 225763 - RNA, 64 nt, Homo Sapiens
uguuuccuuuuagugccagaugaaaaacagugaauacuucuaauagauucuugaaggcaaaauu

SEQ ID NO: 225764 - RNA, 64 nt, Homo Sapiens
uuuauuucugacaucuauucauggacacuuggguuacuucuaccucuggcuauugugaauauug

SEQ ID NO: 225765 - RNA, 64 nt, Homo Sapiens
guaccccaaaaaguggaacugcuggaucacaugguacuucuaacuuuaauucuuugaugaacug

SEQ ID NO: 225766 - RNA, 53 nt, Homo Sapiens
aagaaguuggccugcccuaacaauacuucuacagaacguuuguagagauauug

SEQ ID NO: 225767 - RNA, 64 nt, Homo Sapiens
uauauugauuuaugcuguguacaaauagaauuauuacuucuaguugacuuuuuuuuaaauauac

SEQ ID NO: 225768 - RNA, 64 nt, Homo Sapiens; identical to SEQ ID NO: 156063

SEQ ID NO: 225769 - RNA, 64 nt, Homo Sapiens; identical to SEQ ID NO: 156064

SEQ ID NO: 225770 - RNA, 64 nt, Homo Sapiens; identical to SEQ ID NO: 156065

SEQ ID NO: 225771 - RNA, 64 nt, Homo Sapiens; identical to SEQ ID NO: 156066

SEQ ID NO: 225772 - RNA, 64 nt, Homo Sapiens; identical to SEQ ID NO: 156067

SEQ ID NO: 225773 - RNA, 64 nt, Homo Sapiens; identical to SEQ ID NO: 156068

SEQ ID NO: 225774 - RNA, 64 nt, Homo Sapiens; identical to SEQ ID NO: 156069

SEQ ID NO: 225775 - RNA, 64 nt, Homo Sapiens; identical to SEQ ID NO: 156070

SEQ ID NO: 225776 - RNA, 64 nt, Homo Sapiens; identical to SEQ ID NO: 156071

SEQ ID NO: 225777 - RNA, 64 nt, Homo Sapiens; identical to SEQ ID NO: 156072

SEQ ID NO: 225778 - RNA, 64 nt, Homo Sapiens; identical to SEQ ID NO: 156073

SEQ ID NO: 225779 - RNA, 64 nt, Homo Sapiens; identical to SEQ ID NO: 156074

SEQ ID NO: 225780 - RNA, 64 nt, Homo Sapiens; identical to SEQ ID NO: 156075

SEQ ID NO: 225781 - RNA, 64 nt, Homo Sapiens; identical to SEQ ID NO: 156076

SEQ ID NO: 225782 - RNA, 64 nt, Homo Sapiens; identical to SEQ ID NO: 156077

SEQ ID NO: 225783 - RNA, 64 nt, Homo Sapiens; identical to SEQ ID NO: 156078

SEQ ID NO: 225784 - RNA, 64 nt, Homo Sapiens; identical to SEQ ID NO: 156079

SEQ ID NO: 225785 - RNA, 64 nt, Homo Sapiens; identical to SEQ ID NO: 156080

SEQ ID NO: 225786 - RNA, 64 nt, Homo Sapiens; identical to SEQ ID NO: 156081

SEQ ID NO: 225787 - RNA, 64 nt, Homo Sapiens; identical to SEQ ID NO: 156082

SEQ ID NO: 225788 - RNA, 64 nt, Homo Sapiens; identical to SEQ ID NO: 156083

SEQ ID NO: 225789 - RNA, 64 nt, Homo Sapiens; identical to SEQ ID NO: 156084

SEQ ID NO: 225790 - RNA, 64 nt, Homo Sapiens; identical to SEQ ID NO: 156085

SEQ ID NO: 225791 - RNA, 64 nt, Homo Sapiens; identical to SEQ ID NO: 156086

SEQ ID NO: 225792 - RNA, 64 nt, Homo Sapiens; identical to SEQ ID NO: 156087

SEQ ID NO: 225793 - RNA, 64 nt, Homo Sapiens; identical to SEQ ID NO: 156088

SEQ ID NO: 225794 - RNA, 64 nt, Homo Sapiens; identical to SEQ ID NO: 156089

SEQ ID NO: 225795 - RNA, 64 nt, Homo Sapiens; identical to SEQ ID NO: 156090

SEQ ID NO: 225796 - RNA, 64 nt, Homo Sapiens; identical to SEQ ID NO: 156091

SEQ ID NO: 225797 - RNA, 64 nt, Homo Sapiens; identical to SEQ ID NO: 156092

SEQ ID NO: 225798 - RNA, 64 nt, Homo Sapiens; identical to SEQ ID NO: 156093

SEQ ID NO: 225799 - RNA, 64 nt, Homo Sapiens; identical to SEQ ID NO: 156094

SEQ ID NO: 225800 - RNA, 64 nt, Homo Sapiens; identical to SEQ ID NO: 156095

SEQ ID NO: 225801 - RNA, 64 nt, Homo Sapiens; identical to SEQ ID NO: 156096

SEQ ID NO: 225802 - RNA, 64 nt, Homo Sapiens; identical to SEQ ID NO: 156097

SEQ ID NO: 225803 - RNA, 64 nt, Homo Sapiens; identical to SEQ ID NO: 156098

SEQ ID NO: 225804 - RNA, 64 nt, Homo Sapiens; identical to SEQ ID NO: 156099

SEQ ID NO: 225805 - RNA, 64 nt, Homo Sapiens; identical to SEQ ID NO: 156100

SEQ ID NO: 225806 - RNA, 64 nt, Homo Sapiens; identical to SEQ ID NO: 156101

SEQ ID NO: 225807 - RNA, 64 nt, Homo Sapiens; identical to SEQ ID NO: 156102

SEQ ID NO: 225808 - RNA, 64 nt, Homo Sapiens; identical to SEQ ID NO: 156103

SEQ ID NO: 225809 - RNA, 64 nt, Homo Sapiens; identical to SEQ ID NO: 156104

SEQ ID NO: 225810 - RNA, 64 nt, Homo Sapiens; identical to SEQ ID NO: 156105

SEQ ID NO: 225811 - RNA, 64 nt, Homo Sapiens; identical to SEQ ID NO: 156106

SEQ ID NO: 225812 - RNA, 64 nt, Homo Sapiens; identical to SEQ ID NO: 156107

SEQ ID NO: 225813 - RNA, 64 nt, Homo Sapiens; identical to SEQ ID NO: 156108

SEQ ID NO: 225814 - RNA, 64 nt, Homo Sapiens; identical to SEQ ID NO: 156109

SEQ ID NO: 225815 - RNA, 64 nt, Homo Sapiens; identical to SEQ ID NO: 156110

SEQ ID NO: 225816 - RNA, 64 nt, Homo Sapiens; identical to SEQ ID NO: 156111

SEQ ID NO: 225817 - RNA, 64 nt, Homo Sapiens
ggucucccgucccugcaccaggcccugccuugagaagagacacagagcacugugguagagcacu

SEQ ID NO: 225818 - RNA, 64 nt, Homo Sapiens
uccuccaguacccugucuucaccucacccugcaaaagagacaggaucaagaucuuugagggacc

SEQ ID NO: 225819 - RNA, 64 nt, Homo Sapiens
uuuaucaguugcagauagccuccuuuguuuacuaaagagacauauauaaauacugauauuucau

SEQ ID NO: 225820 - RNA, 64 nt, Homo Sapiens
augauauccaguaagcacaugcugcugaagaggcaagagacagacaaugguuuacaugaacaca

SEQ ID NO: 225821 - RNA, 64 nt, Homo Sapiens
aauuuauuauaacacuaaacuugggcuuuuuugaaagagacaaaauauuuugguggagaagagg

SEQ ID NO: 225822 - RNA, 64 nt, Homo Sapiens
aaucaggacuaaguccucugagaaaagagaaagcaagagacagauguuugcauauuaaaaaaag

SEQ ID NO: 225823 - RNA, 64 nt, Homo Sapiens
auuacuaccagaacugugguaggggccaccuuguaagagacaucaagaacugcugucaugaagg

SEQ ID NO: 225824 - RNA, 64 nt, Homo Sapiens
gcccacaugauggccauuccuggucagcaguucuaagagacacuuuugcccccuuggaacacau

SEQ ID NO: 225825 - RNA, 64 nt, Homo Sapiens
gaagauguaugcaaagugaaaugccagcccuuuaaagagacauuaguuaguguaaaauggaucu

SEQ ID NO: 225826 - RNA, 64 nt, Homo Sapiens
uguaaaucauguggcaucuauguauaauaaaagaaagagacaacuauauuacucaauuucauau

SEQ ID NO: 225827 - RNA, 64 nt, Homo Sapiens
ggucaauugcucugacccuguaagccuagcaguaaagagacauucaucuguaauuuacuguugg

SEQ ID NO: 225828 - RNA, 64 nt, Homo Sapiens
cagugugugucuuauaaaugucaauauguaguuuaagagacaauaaaauaauguucauaaggag

SEQ ID NO: 225829 - RNA, 64 nt, Homo Sapiens
uguaaaaacacauacauggccaaaugcaauacugaagagacaaucauccuguaucuuuuauggu

SEQ ID NO: 225830 - RNA, 64 nt, Homo Sapiens
aggguaugguuuggucgcuuugguugucaugagaaagagacauucuccuugcagcuaccuccau

SEQ ID NO: 225831 - RNA, 64 nt, Homo Sapiens
gcuuugcugaaaaccaaacaccagcgcaaacuucaagagacaggguuggccguccccaggccuc

SEQ ID NO: 225832 - RNA, 64 nt, Homo Sapiens
uuacccagaaaccccucccuagaaagaaaagaaaaagagacaaacacagcgagacccugucuca

SEQ ID NO: 225833 - RNA, 64 nt, Homo Sapiens
aaagcauguauauaagagcacguuguaaacuugaaagagacaaaggcacaaauguggcuguuga

SEQ ID NO: 225834 - RNA, 64 nt, Homo Sapiens
ccccuagacuaggacuccagugcccuccucucccaagagacaaaggccauugcauugaaggagg

SEQ ID NO: 225835 - RNA, 64 nt, Homo Sapiens
uuuaagucaaccaugauuucuccuugauuucuacaagagacaaagaaaugauuuugccuccugg

SEQ ID NO: 225836 - RNA, 64 nt, Homo Sapiens
uauaguguugauuucaccaaaaucagagggcugaaagagacacuucuauagacugcauccugag

SEQ ID NO: 225837 - RNA, 64 nt, Homo Sapiens
gguuucaaugccuaaggacagugaagucuggagcccaaaguacaguuucagcaaagcuguuuga

SEQ ID NO: 225838 - RNA, 64 nt, Homo Sapiens
ugagcauggcagugccacucaagaaaaugaaucuccaaaguaucuucaaagaauaaauacuaau

SEQ ID NO: 225839 - RNA, 64 nt, Homo Sapiens
ucaguaacuauccacaaacucaccuuauguuacuccaaaguaauaguaggggauaaacccauag

SEQ ID NO: 225840 - RNA, 64 nt, Homo Sapiens
uuuaggaaacuagaaaaagaagagcaaauuaaauccaaaguaaccugaaaaaacauuagaguaa

SEQ ID NO: 225841 - RNA, 64 nt, Homo Sapiens
cuggaaaaaaauuagaguaaagagcaaauuaaauccaaaguaacuuuggaaaacuagaaaaaga

SEQ ID NO: 225842 - RNA, 64 nt, Homo Sapiens
aguaggggauaaacccauagcgccuuauguuacuccaaaguaacucaauaacuauccacaaacu

SEQ ID NO: 225843 - RNA, 64 nt, Homo Sapiens
gccaaugaaagugcucgugucauaugcacuuccaccaaaguaauccccuucccaaaacagaguu

SEQ ID NO: 225844 - RNA, 64 nt, Homo Sapiens
aagcuaaugaucagucacuccacuaacagauaggccaaaguagcuccuauccacccaagggaga

SEQ ID NO: 225845 - RNA, 64 nt, Homo Sapiens
ugauguauuggacguucuaagucugaaucaaaugccaaaguagcgaugacucacaugaugggga

SEQ ID NO: 225846 - RNA, 64 nt, Homo Sapiens
ggcuacagaaaccgugccaagaaguuucuaucauccaaaguaugcuccugaacaucuaaaagau

SEQ ID NO: 225847 - RNA, 64 nt, Homo Sapiens
uuguguguccaguuuggccuccugcccaaacuguccauuccagcagcuccugcccccuucucug

SEQ ID NO: 225848 - RNA, 64 nt, Homo Sapiens
ccugccccauccucucucugaagccagggcccuuccauuccauuuagccuuuggaucauccugg

SEQ ID NO: 225849 - RNA, 64 nt, Homo Sapiens
cagauugccuguuucugauuugcugcucuucaucccauuccaggcagccucugucaggccuuca

SEQ ID NO: 225850 - RNA, 64 nt, Homo Sapiens
uuccuggaauugccagcugacaucuugaauccuuccauuccacacagaaugcaaccaagucaca

SEQ ID NO: 225851 - RNA, 64 nt, Homo Sapiens
ccucaggucaaaccaagccaagagcacccuguccccauuccaaggggccagcagcacuuuggcc

SEQ ID NO: 225852 - RNA, 64 nt, Homo Sapiens
ggagggugauggguagagcuuuccagaaccuucuccauuccagaaucucugccccuguguaauc

SEQ ID NO: 225853 - RNA, 64 nt, Homo Sapiens
agaaccuuugauucugcacaacuuccgaagugaaccauuccaccucauccgcacugcccuuggg

SEQ ID NO: 225854 - RNA, 64 nt, Homo Sapiens
ccaccuguuuccccuuccaucugguuccaccuuuccauuccaaaagggagcacauuuuguggac

SEQ ID NO: 225855 - RNA, 64 nt, Homo Sapiens
caugugcaaucuuugcuucuuguaggcuaucgccccauuccagcggagacuuauguaggaggga

SEQ ID NO: 225856 - RNA, 64 nt, Homo Sapiens
aaacaccaggcacccucugccacuuagacauaauccauuccacucauuauuccagcaaacacuu

SEQ ID NO: 225857 - RNA, 64 nt, Homo Sapiens
ugguguacuguucugauuuucuuaaauuguuugaccauuccaguugcaccauuaaaacauuuga

SEQ ID NO: 225858 - RNA, 64 nt, Homo Sapiens
gugaggugucauucccugcacugccugccagugcccauuccacuuaaaggacugcuucugcccu

SEQ ID NO: 225859 - RNA, 64 nt, Homo Sapiens
gauugauucucaccagcguuauuacucguccccgccauuccaggcuuccagauugguuuaacca

SEQ ID NO: 225860 - RNA, 64 nt, Homo Sapiens
caucucuggccugagugacaaguuuccaggaccuccauuccacuugugccucccacugaauggc

SEQ ID NO: 225861 - RNA, 64 nt, Homo Sapiens
augggagccuugcucuccaaguuuuuuuaauuuagggggaaaaagaaagcaagcaaagauguaa

SEQ ID NO: 225862 - RNA, 64 nt, Homo Sapiens
acuccaugauucaguuaucucaugagaacaguaugggggaaacaucgugagacuuauuuacuac

SEQ ID NO: 225863 - RNA, 64 nt, Homo Sapiens
caggaaaugacauguuaaugcuuugcucccugaagggggaaaaaaucuguccuuuaacaagcua

SEQ ID NO: 225864 - RNA, 64 nt, Homo Sapiens
acguccagaugcauuacugcuaucuuaguuuaaagggggaaagaaaagggaagaagaaaggaaa

SEQ ID NO: 225865 - RNA, 64 nt, Homo Sapiens
auagcuuuugaagaaaggccagugauccagcaaagggggaaaaauaugcauuucaccccacaug

SEQ ID NO: 225866 - RNA, 64 nt, Homo Sapiens
ugcagccagcacaaugugacccaacuuaaaauuugggggaaaaagaaugcaggagugaaauaac

SEQ ID NO: 225867 - RNA, 64 nt, Homo Sapiens
caagcugagaauaaacccagccacaccaucagcagggggaaagcaggaagguaacuguuauaac

SEQ ID NO: 225868 - RNA, 64 nt, Homo Sapiens
uaagaauagucaucaggguuaguucaagucauuugggggaaacuuguagcucuucgagaaagaa

SEQ ID NO: 225869 - RNA, 64 nt, Homo Sapiens
ggaaauaauagggaaaauaccuauuuuauaugaugggggaaaaaaaguaaucuuuaaacuggcu

SEQ ID NO: 225870 - RNA, 64 nt, Homo Sapiens
uuuuaaagaaaaauaugauacucucagauuuuaagggggaaaacuguucucuuuaaaauauuug

SEQ ID NO: 225871 - RNA, 64 nt, Homo Sapiens
uccuucaggacagcugcugugcauuagauauuaggggggaaagucaucuguuuaauuuacacac

SEQ ID NO: 225872 - RNA, 64 nt, Homo Sapiens
aagccaucuuuuuaaacaaaaaaaaguuuaaaaugggggaaaaauaggucacucgggaaggggg

SEQ ID NO: 225873 - RNA, 64 nt, Homo Sapiens
guuuaaaaugggggaaaaaaaggucacucgggaagggggaaaaacaucagucuaacaagucauu

SEQ ID NO: 225874 - RNA, 64 nt, Homo Sapiens
uauucuuggaaccacucaugauaccuucuccauugggggaaagaugucggaauuuagccucuga

SEQ ID NO: 225875 - RNA, 64 nt, Homo Sapiens
accuuagaacuuuuuaagguaaaauuaacaaagggggggaaagguaaaaugugccuaguuuacc

SEQ ID NO: 225876 - RNA, 64 nt, Homo Sapiens
auuacauuuagaagcugcuaguugagagaaauuagggggaaauggguuuuagaaucacugcccu

SEQ ID NO: 225877 - RNA, 64 nt, Homo Sapiens
uaagguuugagguuuuagaaucccauuuuaagaugggggaaaauuagcuuuuccagaagcugau

SEQ ID NO: 225878 - RNA, 64 nt, Homo Sapiens
uacaaacuaauauauuuuuucugugagacuuccugggggaaauagcacagguguccugugcuuc

SEQ ID NO: 225879 - RNA, 64 nt, Homo Sapiens
acuucuuuucuccuucugucuaaaacuaucuugagggggaaauggcauccugauauuauaagcu

SEQ ID NO: 225880 - RNA, 64 nt, Homo Sapiens
ggcacuauccguguacgaaugaauugcaaaauuugggggaaaauuuggggggcaauaaucaacu

SEQ ID NO: 225881 - RNA, 64 nt, Homo Sapiens
auccaaaacacaaacugugguguauggaaauuuugggggaaaaaugaucuagaugucuguuugu

SEQ ID NO: 225882 - RNA, 64 nt, Homo Sapiens
aaaugauugaagagguggaacggaaaugaccuuagggggaaaaaaaaggaccaaagaagucuga

SEQ ID NO: 225883 - RNA, 64 nt, Homo Sapiens
gugccucugaggcagaaccaaaggagccugcacugggggaaaucccuuuuccugccugccuguc

SEQ ID NO: 225884 - RNA, 64 nt, Homo Sapiens
gaugguugugggucuuucugggagagacagaacugggggaaaggcaggagugggcagcagucag

SEQ ID NO: 225885 - RNA, 64 nt, Homo Sapiens
uggcuccaaccaaccccuccacugccccaccccugggggaaacccagucuauaccagcaugagu

SEQ ID NO: 225886 - RNA, 64 nt, Homo Sapiens
gugucaacucuuuguuauuugcugauuuauuuaagggggaaaaaacauuauguggaaaacuuau

SEQ ID NO: 225887 - RNA, 64 nt, Homo Sapiens
caguucugcucugguuguuuggggaaguagggaggggggaaauaaauuuugaguugccacagga

SEQ ID NO: 225888 - RNA, 64 nt, Homo Sapiens
guaauuaaaauuggcauaauaaacacagauuauugggggaaaaggaaaauuagugaucucuucu

SEQ ID NO: 225889 - RNA, 64 nt, Homo Sapiens
ccagacaucuaguugcaguguucaagaggauuaugggggaaagagauuagagauaauugucuag

SEQ ID NO: 225890 - RNA, 64 nt, Homo Sapiens
uauauaaugcuugcaccucaggguggggcgggaugggggaaaaggaaaagaaaucauuuggguu

SEQ ID NO: 225891 - RNA, 61 nt, Homo Sapiens
aggugagcauauguuucaauuucacuaauuagggggaaaaacaaaugacaaaaaaacuuga

SEQ ID NO: 225892 - RNA, 64 nt, Homo Sapiens
acaagauggaggauguccacagaggcugaccugugggggaaaagaagugcucagguaagguugu

SEQ ID NO: 225893 - RNA, 64 nt, Homo Sapiens
ggccugaggcagggcgggaggcaugcaagccagugggggaaaaccccucugaagcugggcagcc

SEQ ID NO: 225894 - RNA, 64 nt, Homo Sapiens
aaaagcaaaaugcugugauaaaccaaacagggaagggggaaaaacccuccuccuugggauuuuu

SEQ ID NO: 225895 - RNA, 64 nt, Homo Sapiens
uaacccgacacggacuuauuuuugucauuagcaagggggaaaaggccaaaggacaagggccucu

SEQ ID NO: 225896 - RNA, 64 nt, Homo Sapiens
gacuuuagggacucaauuucuccccaggguggaugggggaaauggugccuucaagaccuucacc

SEQ ID NO: 225897 - RNA, 64 nt, Homo Sapiens
gccuuaaagucaguaacuuacccuuagggaggcugggggaaaagguuagauuuuguauucaggg

SEQ ID NO: 225898 - RNA, 64 nt, Homo Sapiens
aacugguggugggaugcuguuuccguagacaugaccacuuuauuaaaccuaagguuuuuuuuuu

SEQ ID NO: 225899 - RNA, 64 nt, Homo Sapiens
aaaaaccuaagguuuuuuuuaugauugauaauaaccacuuuauuauugcucaacuuuaauuaaa

SEQ ID NO: 225900 - RNA, 64 nt, Homo Sapiens
auuuuguuaacauguauauauguacaacaguguguuuguaaauauauaggaacguuucugaaca

SEQ ID NO: 225901 - RNA, 64 nt, Homo Sapiens
ggcccugccccuggcuccuuaaaugccccgucucuuuguaaacugauauucagccagcaaugcc

SEQ ID NO: 225902 - RNA, 64 nt, Homo Sapiens
cucgcagggggcuguggggaggcauaagcugauguuuguaaagcgcuuuguaaauaaacgugcu

SEQ ID NO: 225903 - RNA, 64 nt, Homo Sapiens
uguggggaggcauaagcugauguuuguaaagcgcuuuguaaauaaacgugcucucugaaugcca

SEQ ID NO: 225904 - RNA, 64 nt, Homo Sapiens
aaccuuugucaucuguuagacucuguaugugugauuuguaaaaagcaggcugaaacuauggaca

SEQ ID NO: 225905 - RNA, 64 nt, Homo Sapiens
uuuuugaaccccuaggcuucaggaaaacugcucuuuuguaaaaagaauagcgaugacauuuucu

SEQ ID NO: 225906 - RNA, 64 nt, Homo Sapiens
guggcauguugauuucuauggccaacuuucucucuuuguaaaacaaagauugauugauuuucuu

SEQ ID NO: 225907 - RNA, 64 nt, Homo Sapiens
uuuaauacagcagagcauggcaugaccaagcaucuuuguaaaguguuagauggaaaaugcugug

SEQ ID NO: 225908 - RNA, 64 nt, Homo Sapiens
ggagcuuguggaguugaugacuuucuguuuucuguuuguaaauuauuugcuaagcauauuuucu

SEQ ID NO: 225909 - RNA, 64 nt, Homo Sapiens
uuggggagggaggggaaauguaauacuggaauaauuuguaaaugauuuuaauuuuauauucagu

SEQ ID NO: 225910 - RNA, 64 nt, Homo Sapiens
ucagaccucugcauguauauuugauaacaugucuuuuguaaaacaaaaauuacaaaaaaauuug

SEQ ID NO: 225911 - RNA, 64 nt, Homo Sapiens
aaaauguuaugcaauguuuuccaaacugauaaaguuuguaaagugcuauaaauguauuuuguua

SEQ ID NO: 225912 - RNA, 64 nt, Homo Sapiens
auuccuauauaguuuauugacaauaauuucagguuuuguaaagaugccggguuuuauauuuuua

SEQ ID NO: 225913 - RNA, 64 nt, Homo Sapiens
uguggccuaaaaaugcaacuucuuuuuauuuucuuuuguaaauguuuagguuuuuuuguauagu

SEQ ID NO: 225914 - RNA, 64 nt, Homo Sapiens
acauggugaaacccugucucuacugucucuaacauuuguaaaccugucucuaauuuguaauuug

SEQ ID NO: 225915 - RNA, 64 nt, Homo Sapiens
cucuaacauuuguaaaccugucucuaauuuguaauuuguaaacccugucucucauauuuguaaa

SEQ ID NO: 225916 - RNA, 64 nt, Homo Sapiens
ucuaauuuguaauuuguaaacccugucucucauauuuguaaaacuacaaaaauuagcuuggcau

SEQ ID NO: 225917 - RNA, 64 nt, Homo Sapiens
gaagaauccuuuuguagaauccacugcaaguccuuuuguaaaguuucaucuuuuaaagaaauaa

SEQ ID NO: 225918 - RNA, 64 nt, Homo Sapiens
acauccuuauccuucaucuuuuguacaugaaauuuuuguaaaucgaagugcuccccucugaaag

SEQ ID NO: 225919 - RNA, 64 nt, Homo Sapiens
aaaggaaaaacuccggguauauuugguuuacugcuuuguaaauaauauuuauguucacacagga

SEQ ID NO: 225920 - RNA, 64 nt, Homo Sapiens
agaugauuaugcuuuguggcuggggcauuuguuuuuuguaaauagggggggcuuuuuuagguuu

SEQ ID NO: 225921 - RNA, 64 nt, Homo Sapiens
gaauaauauucaaagacuuuuuguaagguuccauuuuguaaagaacauuaaauugucaguauuu

SEQ ID NO: 225922 - RNA, 64 nt, Homo Sapiens
gacugcugacagcaaguucuccuccugagcuguuuuuguaaaaucaugauguaggugccaccca

SEQ ID NO: 225923 - RNA, 64 nt, Homo Sapiens
ugcuucuugauauuuuacuuagcuauagaacugcuuuguaaagauuuccccuuuaaaaggaauu

SEQ ID NO: 225924 - RNA, 64 nt, Homo Sapiens
ucucccucaccccacccugcuucaucuuguauucuuuguaaaaugccaaccagcccaaaauuau

SEQ ID NO: 225925 - RNA, 64 nt, Homo Sapiens
caaaugacauucaguucaauuuuuuuuuuuuuuuuuuguaaacauucuuuuuccuuuucuuccu

SEQ ID NO: 225926 - RNA, 64 nt, Homo Sapiens
acuuuuuguuaaaauucauaguaaaaugacacauuuuguaaauaacauguuaaaauuagaggua

SEQ ID NO: 225927 - RNA, 64 nt, Homo Sapiens
ccuugcguuguuguucagcugacugucaucuuguuuuguaaacuuugcuauauauacacauguu

SEQ ID NO: 225928 - RNA, 59 nt, Homo Sapiens
uuggagauaccacuguuuaaggaaauaccuuuguaaaccugcagaacauuuuacuuaaa

SEQ ID NO: 225929 - RNA, 64 nt, Homo Sapiens
cauuagugugcucuucauguuaauauggcagaguuuuguaaacuaaauuaaaacuuacugauau

SEQ ID NO: 225930 - RNA, 64 nt, Homo Sapiens
uguucacauuucaugaaaccuaugaaacuauauuuuuguaaaauguauuugugacagugaaauc

SEQ ID NO: 225931 - RNA, 63 nt, Homo Sapiens
guuaaaguuucucuccuuuaaaaauuuuaguacauuuguaaauaguccaugguucucaguguu

SEQ ID NO: 225932 - RNA, 64 nt, Homo Sapiens
ucuguugccagccugcauugauauaccagucccauuuguaaauauuuacguaccuuuauaaauu

SEQ ID NO: 225933 - RNA, 64 nt, Homo Sapiens
guuuugugccuugacaaccucucccuaugugagguuuguaaaaaguguccugugacuuaacaca

SEQ ID NO: 225934 - RNA, 64 nt, Homo Sapiens
uguacugucuuagaauauuauuuauuuuuuuguauuuguaaaucuguggacaaaagaggguuuc

SEQ ID NO: 225935 - RNA, 64 nt, Homo Sapiens
ucccccuguaccaggccauagcuuugaaguguauuuuguaaauucaacuauagguuagucagaa

SEQ ID NO: 225936 - RNA, 64 nt, Homo Sapiens
ucuuuugugcuguaucuuuuaagugcaugugaaauuuguaaaauagagauaaguacaguaugua

SEQ ID NO: 225937 - RNA, 64 nt, Homo Sapiens
auuuguaaaauagagauaaguacaguauguauauuuuguaaaucucccauuuuuguaagaaaau

SEQ ID NO: 225938 - RNA, 64 nt, Homo Sapiens
uucaugcuguaaauggaauuuguacagguguacauuuguaaaccguagugaugcuuuccuuggu

SEQ ID NO: 225939 - RNA, 64 nt, Homo Sapiens
uuuaccuuguaaagucacaaaagcugucacauauuuuguaaauuguaacuguaucaaaaauaaa

SEQ ID NO: 225940 - RNA, 64 nt, Homo Sapiens
uuuuaagguucuuguguauaacuuuauucauccauuuguaaauuuaaagcaaaacuauuuauug

SEQ ID NO: 225941 - RNA, 64 nt, Homo Sapiens
uuuugaaaaugaacuuagcuucugaaucaaagguuuuguaaaaccuguaccccaucaagcuuac

SEQ ID NO: 225942 - RNA, 64 nt, Homo Sapiens
gaggugauacaguucugaaucagcccuuugggaguuuguaaaauucuauaaugaugacucuugg

SEQ ID NO: 225943 - RNA, 64 nt, Homo Sapiens
gaacuaaugcuauauuuaaauuuuggaaacaguauuuguaaaugagaccuugguaaaagaacua

SEQ ID NO: 225944 - RNA, 64 nt, Homo Sapiens
uacuggaagcuugauaauaaguuauauccaacuuuuuguaaauaacauuuuuaauauuuuuuug

SEQ ID NO: 225945 - RNA, 64 nt, Homo Sapiens
aaguaauugcuagaaacauugucuuuaagucguguuuguaaaaguauaaccugcauaacuuuuu

SEQ ID NO: 225946 - RNA, 64 nt, Homo Sapiens
cacugucagagaaucuggagaguuuucuaaaaauuuuguaaagguuguuguuaaaugccuaaga

SEQ ID NO: 225947 - RNA, 64 nt, Homo Sapiens
uucugcucguuuacacugcaagaaaguaauuuaauuuguaaaaccgauguuguauugauuuuua

SEQ ID NO: 225948 - RNA, 64 nt, Homo Sapiens
aaacuuaagaauugaauugguuuuugcacaccauuuuguaaauguuauuugaggucaguguuug

SEQ ID NO: 225949 - RNA, 64 nt, Homo Sapiens
ugagacuuuuucaguggaacguguaugaguugcauuuguaaaaagaaaggguccaugaaggaaa

SEQ ID NO: 225950 - RNA, 64 nt, Homo Sapiens
gaaucaacuagguauuuaagacaugacuguuucuuuuguaaagauuugcauuuucugauguauu

SEQ ID NO: 225951 - RNA, 64 nt, Homo Sapiens
cccaguugugaaaacugcagucuuuucagacuuuuuuguaaaccuauuuguauaaaaauacuca

SEQ ID NO: 225952 - RNA, 64 nt, Homo Sapiens
aaggugucugugcagauuuuacuuggacacagaguuuguaaauaauucaggauuauuagccugg

SEQ ID NO: 225953 - RNA, 64 nt, Homo Sapiens
gggauuuuguuaaucaaauuuuauuuacuucuguuuuguaaauuuaaugaauauauuucugcau

SEQ ID NO: 225954 - RNA, 64 nt, Homo Sapiens
agugucuccuuuuuuauuuaguauacaauauuguuuuguaaauaacaaugcauuuauauaauau

SEQ ID NO: 225955 - RNA, 64 nt, Homo Sapiens
cuauagaagcacuuggaaaaugcacuuguccuguuuuguaaaauaaaaagguauuaaaugugua

SEQ ID NO: 225956 - RNA, 64 nt, Homo Sapiens
cuauaguaauuucuuuuuauauaauaaaaauauauuuguaaagucgacagacaacuuguaauua

SEQ ID NO: 225957 - RNA, 64 nt, Homo Sapiens
uugauaugggcuuucucuuugguuucucaucacauuuguaaaugucuuuucaaaaggauuuacu

SEQ ID NO: 225958 - RNA, 64 nt, Homo Sapiens
acauuuguaaaugucuuuucaaaaggauuuacuuuuuguaaaaagcuucauucucacucugcuu

SEQ ID NO: 225959 - RNA, 64 nt, Homo Sapiens
acuaauuuuuaugaugcaaauuuauacacugauuuuuguaaaggacaaaguuuuaaaagcguau

SEQ ID NO: 225960 - RNA, 64 nt, Homo Sapiens
ugcaaaugcuuuaacagcugauaaaaauuuuacauuuguaaaauuaauauauuguacugguaca

SEQ ID NO: 225961 - RNA, 64 nt, Homo Sapiens
acacucagaacuccuuucauaucaagacaaguuauuuguaaaaaauaaagaagggguuuuaaua

SEQ ID NO: 225962 - RNA, 64 nt, Homo Sapiens
uuuuuaaaaaagguagcauuuuguugacaguuauuuuguaaacauaagcaaauaagggcuugga

SEQ ID NO: 225963 - RNA, 64 nt, Homo Sapiens
cuauauauguauauauauauguaguaaaccacuuuuuguaaaagaagaaagagcaaaaagcugu

SEQ ID NO: 225964 - RNA, 64 nt, Homo Sapiens
uaaaaguguguuugaaaaauauuaucuuggguucuuuguaaaauuuauuuuuuacaugcugaau

SEQ ID NO: 225965 - RNA, 64 nt, Homo Sapiens
ccucgaucuuuuugauuaagagcacaaacuuuuuuuuguaaaacauguaaaaaaaaaaacuggg

SEQ ID NO: 225966 - RNA, 64 nt, Homo Sapiens
gggcaguuauaaauggacacauugcccagaauguuuuguaaaaugaagaccagcaaauguaggc

SEQ ID NO: 225967 - RNA, 64 nt, Homo Sapiens
uuuuuuaucacauguagucacaaccuguuuuguuuuuguaaaacauaggaagucucuuuaaugc

SEQ ID NO: 225968 - RNA, 64 nt, Homo Sapiens
caaguugauucaguguauuacugauuuuuuucuauuuguaaaggauuaugaguuguauaaaaua

SEQ ID NO: 225969 - RNA, 64 nt, Homo Sapiens
ucaugaaacugguuucuguuuuaugcaguugucauuuguaaagucuaauaaaauauucucuaua

SEQ ID NO: 225970 - RNA, 64 nt, Homo Sapiens
accacaguuauuacccaaauacuaugaacauauuuuuguaaaccagucauucugaauuauagug

SEQ ID NO: 225971 - RNA, 64 nt, Homo Sapiens
agagacaccuagcuuagucauggcaaguugccauuuuguaaacuaaggauuuuggacugagauu

SEQ ID NO: 225972 - RNA, 64 nt, Homo Sapiens
aaauaguagaaaaaucagagucuauaacagaaaguuuguaaaaauauacugauuuugaaaagua

SEQ ID NO: 225973 - RNA, 64 nt, Homo Sapiens
uaggugacaaguuauuccauuucuuagccuugcuuuuguaaaguucccaagccacaaguaguca

SEQ ID NO: 225974 - RNA, 64 nt, Homo Sapiens
acacucaguccuugaacaggccauuuggaggggauuuguaaagguuaagccccuuuggaaucuc

SEQ ID NO: 225975 - RNA, 64 nt, Homo Sapiens
aaaauauguccagaagaguccuguuauauuuccuuuuguaaaguuugcuauaaauagauuuagu

SEQ ID NO: 225976 - RNA, 64 nt, Homo Sapiens
cuuuuuucuuugaaaugcuacaccauucuucuuuuuuguaaaaaacauaagcuucucaaugagu

SEQ ID NO: 225977 - RNA, 64 nt, Homo Sapiens
guuaauuguccuacaucaaacugaauuguaaauguuuguaaaggacgguagucagugacuuaac

SEQ ID NO: 225978 - RNA, 64 nt, Homo Sapiens
ucccagauaucaaaauagacaaugcagcagccuuuuuguaaacuaaggcauaaguaguuugaag

SEQ ID NO: 225979 - RNA, 64 nt, Homo Sapiens
ggauggaagaacuuuguauuagaguuuugcugguuuuguaaaauuuccuguaggauuuuauugu

SEQ ID NO: 225980 - RNA, 64 nt, Homo Sapiens
agauuggucuacuuuuuccucuguuaaaaugcuguuuguaaauguuuguaacauuuaauaauua

SEQ ID NO: 225981 - RNA, 64 nt, Homo Sapiens
gguucuucuuuuacccaaucugcuuauagcuuuuuuuguaaacagggaaauguugagugguacu

SEQ ID NO: 225982 - RNA, 64 nt, Homo Sapiens
auggauugauucaauuaagaccugagugacacuauuuguaaauauaacuaguugugaagcacac

SEQ ID NO: 225983 - RNA, 64 nt, Homo Sapiens
aggaagugaaauauuuaauucagaaccaaaugcuuuuguaaaacuuuuuggauuuuguaaaagc

SEQ ID NO: 225984 - RNA, 64 nt, Homo Sapiens
ucagaaccaaaugcuuuuguaaaacuuuuuggauuuuguaaaagcauuuucauucucuuagaaa

SEQ ID NO: 225985 - RNA, 64 nt, Homo Sapiens
gauuuccagccuuuacugcuuugaagaaacagaauuuguaaagguaugcauguagaacauaaaa

SEQ ID NO: 225986 - RNA, 64 nt, Homo Sapiens
uugcagucucuuucuaccuucccucuguuagucauuuguaaauucuaaauggucaccauaaaau

SEQ ID NO: 225987 - RNA, 64 nt, Homo Sapiens
aauugauuugaugaaaauuaguuuuaaguaaauguuuguaaauagauauugguugaauuuuugg

SEQ ID NO: 225988 - RNA, 64 nt, Homo Sapiens
gguauucugaauauaauaaaagccucacaaauuauuuguaaaauuuaguaguucauauuuagua

SEQ ID NO: 225989 - RNA, 64 nt, Homo Sapiens
ucucaccugguucuuuuauguucuuguaugauauuuuguaaagcccuuucuuuuuauaguauau

SEQ ID NO: 225990 - RNA, 64 nt, Homo Sapiens
ugcuguugauccaaauauuuuaagaauuuaugcauuuguaaaguaagaaagacaauuggacccu

SEQ ID NO: 225991 - RNA, 64 nt, Homo Sapiens
caaguaaguucuaaaaaaaacacuuaaauuaauuuuuguaaaccuccauggacaaaauuaggcu

SEQ ID NO: 225992 - RNA, 64 nt, Homo Sapiens
uguuuguuuauauagaccuaaaggaauaagaucauuuguaaaaagggaaggauaccuggagcac

SEQ ID NO: 225993 - RNA, 64 nt, Homo Sapiens
uaugaaagaugccuuuccuuaaguggaaauaaaauuuguaaauauaaauguugacaauauuuac

SEQ ID NO: 225994 - RNA, 64 nt, Homo Sapiens
aaauuacuuaagaaaauacaggugacuuucuuuuuuuguaaagcaccuagccaaaaccagaugc

SEQ ID NO: 225995 - RNA, 64 nt, Homo Sapiens
uaacuguagcuuauauucuuuucaucuguguuauuuuguaaaaacugaauuaacacaguauuca

SEQ ID NO: 225996 - RNA, 64 nt, Homo Sapiens
gcaauguccugcaugcauaacaagguaauuuuuuuuuguaaaguaaguacuaucuuugucuaaa

SEQ ID NO: 225997 - RNA, 64 nt, Homo Sapiens
agacacauacaaaaaaaaucagguauaaggaucuuuuguaaaugauuaugaaggaccugaaaua

SEQ ID NO: 225998 - RNA, 64 nt, Homo Sapiens
agugaucaagcauuuuuauaagauauuugcaauuuuuguaaauauuuuuggccugcaacuggga

SEQ ID NO: 225999 - RNA, 64 nt, Homo Sapiens
accaauuuguacauuuuaauuauucaauuucuacuuuguaaaaauagggaaauuauuugaagug

SEQ ID NO: 226000 - RNA, 64 nt, Homo Sapiens
ugauaaacuuuguagcugccucuuuaaccaagaauuuguaaacacaacucuaauaaaugugagu

SEQ ID NO: 226001 - RNA, 64 nt, Homo Sapiens
guaauuagaacaaugcacaucugucuuccaagauuuuguaaauauuuuugauuuuuuucauuaa

SEQ ID NO: 226002 - RNA, 64 nt, Homo Sapiens
cuucaagaaguaagagcuaaguucuaaguucauguuuguaaauuaauacuucauuuggugcugg

SEQ ID NO: 226003 - RNA, 64 nt, Homo Sapiens
agacauuuuuauuuaguugaaaaaucuaguuuuuuuuguaaacuguaucaaaucuguauauguu

SEQ ID NO: 226004 - RNA, 64 nt, Homo Sapiens
uuguuucaaaugaaacuuuaaaagacugaaaaauuuuguaaauagguuugauucuuguuagagg

SEQ ID NO: 226005 - RNA, 64 nt, Homo Sapiens
gacuccaaugccuguacugugucuacugcaccacuuuguaaacacuucaauuuacuaucuuuga

SEQ ID NO: 226006 - RNA, 64 nt, Homo Sapiens
cugcaugaauuucuuccacaguaaaaauacguuuuuuguaaaggcaauuguacauaauacucau

SEQ ID NO: 226007 - RNA, 64 nt, Homo Sapiens
gauacuuuuaucuuaaaaguauguuguuaaagauuuuguaaauuguauuucaacaauuuuaaau

SEQ ID NO: 226008 - RNA, 64 nt, Homo Sapiens
auuuuagacccagaagagaggaguuugcucugaauuuguaaauaagucuuccccauuccucaua

SEQ ID NO: 226009 - RNA, 64 nt, Homo Sapiens
uaagaugcuuguaaauacuauuuauguuuuuaauuuuguaaaauaaagauuucuuuuuaaccac

SEQ ID NO: 226010 - RNA, 64 nt, Homo Sapiens
cuuccauacuuuacucccuccuuuuucagacuuguuuguaaaguacagaaucugaauuuagccu

SEQ ID NO: 226011 - RNA, 64 nt, Homo Sapiens
auaacuuuuuaugggguuuuguuauugguuuuuuuuuguaaagugugaauaaaagguauguuua

SEQ ID NO: 226012 - RNA, 64 nt, Homo Sapiens
cucaaacaugacgauuccauacguuuguaaaauguuuguaaaaggaaaacaaugcuauuccaug

SEQ ID NO: 226013 - RNA, 64 nt, Homo Sapiens
guuuguaaaagcucaaacaugcuauuccaugacguuuguaaaauugaauugggaagaaaacaau

SEQ ID NO: 226014 - RNA, 64 nt, Homo Sapiens
uguaacauuuauaguuaaaucauuuuuguuucaguuuguaaaugauuuaaaucucuguacuaug

SEQ ID NO: 226015 - RNA, 64 nt, Homo Sapiens
uggaaaaacuuuggaacucagacaccuuuuuuuauuuguaaagguauucccaaacuguggaaag

SEQ ID NO: 226016 - RNA, 64 nt, Homo Sapiens
uuauuuagcaauuuuguacaaaaauagcaauuaauuuguaaacacugccagaauacuuucuagc

SEQ ID NO: 226017 - RNA, 64 nt, Homo Sapiens
gugugggaauuucuuuuccuacgggguacgugauuuuguaaaaaggaaguauuucucccaaaau

SEQ ID NO: 226018 - RNA, 64 nt, Homo Sapiens
uaaaaaaaaacaaaaaaaagcuuuuaugauggauuuuguaaauagauuuguuacagggugaccu

SEQ ID NO: 226019 - RNA, 64 nt, Homo Sapiens
uaguacgucucacuugaaauugcuuuguauacauuuuguaaaaauauuuauaaaauguuuugua

SEQ ID NO: 226020 - RNA, 64 nt, Homo Sapiens
uuguauacauuuuguaaaaauauuuauaaaauguuuuguaaaaaaaaaaaaacuauaacaaauu

SEQ ID NO: 226021 - RNA, 64 nt, Homo Sapiens
ugucagacugugccuacucugaugguaugugccauuuguaaaauaaaauagagcagaaaaacac

SEQ ID NO: 226022 - RNA, 64 nt, Homo Sapiens
uagaaauguugcuaucuuuauaagugcaauuuaauuuguaaauagaguuugaaucaaaguauca

SEQ ID NO: 226023 - RNA, 64 nt, Homo Sapiens
cacaugaaguuugcaacuuuccacccugcccauuuuuguaaaacugcagucaucuuggaccuuu

SEQ ID NO: 226024 - RNA, 64 nt, Homo Sapiens
gcaaugguuuuguguagcaucuugucuaucauguuuuguaaauacuggagaagcuuugaccaau

SEQ ID NO: 226025 - RNA, 64 nt, Homo Sapiens
aucuuuugguucuguucacugagcuaaauuuaucuuuguaaaucuuuuugagucuggggggugg

SEQ ID NO: 226026 - RNA, 64 nt, Homo Sapiens
ugguaauggggggcagaguaagaacuuuuggcauuuuguaaacauuguugaauucucuuucaug

SEQ ID NO: 226027 - RNA, 64 nt, Homo Sapiens
gacauaaucaucacucaguagguaaaagauaccuuuuguaaaguugucaucucucuguaauaga

SEQ ID NO: 226028 - RNA, 64 nt, Homo Sapiens
ugaggagcacaauacagagauuuuaaaaagugauuuuguaaaaucuacacuacggucucuguuu

SEQ ID NO: 226029 - RNA, 64 nt, Homo Sapiens
aggacccuaaauguuuaauugaaaggcacugaguuuuguaaaucaaaacucaucaauaaaucau

SEQ ID NO: 226030 - RNA, 64 nt, Homo Sapiens
uacugguaauuguacaauacacugucuaagcaguuuuguaaauguucuuacucuggagcaaccu

SEQ ID NO: 226031 - RNA, 64 nt, Homo Sapiens
uuaaauuuggaauuacuuguuaaagcugaaaacuuuuguaaaaauguuugccauaauuugucaa

SEQ ID NO: 226032 - RNA, 64 nt, Homo Sapiens
uaauuuuaaugcuguuuuaauguuugauauuaaguuuguaaauuaucuguuaguuagacaaaga

SEQ ID NO: 226033 - RNA, 64 nt, Homo Sapiens
uuguaaauuuuauuuauacuucuguaaauguuccuuuguaaaacaacaaauaacagaaacaaaa

SEQ ID NO: 226034 - RNA, 64 nt, Homo Sapiens
ucagacaacacacuaucuuuuuaaaaagaauuuuuuuguaaagagccaagagcucugauauuuu

SEQ ID NO: 226035 - RNA, 64 nt, Homo Sapiens
ccauuguuuuuggauauaaauucaguauuauguauuuguaaaaauggugacuuuuugagcaccu

SEQ ID NO: 226036 - RNA, 64 nt, Homo Sapiens
gauuuaugguaacugguuucacauuacauuuaucuuuguaaaaaauuuuuaaaaguaguaagcc

SEQ ID NO: 226037 - RNA, 64 nt, Homo Sapiens
aacggaggggauggaauucuuccuuagacuuacuuuuguaaaaauguccccacgguacuuacuc

SEQ ID NO: 226038 - RNA, 64 nt, Homo Sapiens
ugugcccuguaaccugacugguuaacagcaguccuuuguaaacaguguuuuaaacucuccuagu

SEQ ID NO: 226039 - RNA, 64 nt, Homo Sapiens
aauuucugcauggucuaaaucuuuguguacuuuauuuguaaauuauuugcccuggaguuuuaga

SEQ ID NO: 226040 - RNA, 64 nt, Homo Sapiens
cagguuaucagagaucaaagauuguaauaauaauuuuguaaauuguaagcaaaaaguuauuuuu

SEQ ID NO: 226041 - RNA, 64 nt, Homo Sapiens
agaaaagcacccuuuaaauguguaaagacaguguuuuguaaagaauuuuguuuaaaaaguuucu

SEQ ID NO: 226042 - RNA, 64 nt, Homo Sapiens
guuuuguaaagaauuuuguuuaaaaaguuucuauuuuguaaauacaguacuuaaguuauaugau

SEQ ID NO: 226043 - RNA, 64 nt, Homo Sapiens
gugggggcgcaaacccuuuuccucccagccuauuuuuguaaauaaaauguuuaaacuugaaaua

SEQ ID NO: 226044 - RNA, 64 nt, Homo Sapiens
uccuugcaccauuguaauaaaagcuguuagaauauuuguaaauaucuuucugcuguaguguggu

SEQ ID NO: 226045 - RNA, 64 nt, Homo Sapiens
auaucugaaccuaaugguuuaauaaaaaagaaccuuuguaaaauuuaaauaccaaaagagggaa

SEQ ID NO: 226046 - RNA, 64 nt, Homo Sapiens
ggauauggacaaguaaguaauucugugacuuaacuuuguaaaggcugccccucuuccuucuucc

SEQ ID NO: 226047 - RNA, 64 nt, Homo Sapiens
acuauaagucauuuugagugaaacauuuguaaaauuuguaaaauuaaaucuucauaguaauuau

SEQ ID NO: 226048 - RNA, 64 nt, Homo Sapiens
uuguaaaauacuauaagucaaguaauuauaaacauuuguaaaauaggguuuuguaaaucuucau

SEQ ID NO: 226049 - RNA, 64 nt, Homo Sapiens
uucauaguaauuauaaacauauagguuuuaggguuuuguaaaucaugaguguucgauauuugcu

SEQ ID NO: 226050 - RNA, 64 nt, Homo Sapiens
ucuguccccaguucuuccaucagccucucugaacuuuguaaaaacacagaaugaaagggcaucu

SEQ ID NO: 226051 - RNA, 64 nt, Homo Sapiens
acaagaauaauucaauuuuauuaaaguguuacuuuuuguaaacggugagagauucugugaucuu

SEQ ID NO: 226052 - RNA, 64 nt, Homo Sapiens
gagaaacaaucauaucuuucuguccugauucuauuuuguaaaugaaaauauaaaaaauuuaaau

SEQ ID NO: 226053 - RNA, 64 nt, Homo Sapiens
cuauaauuaugaagcgauugucuuucucgaccuuuuuguaaaccggcuauuucgccuucgcuuu

SEQ ID NO: 226054 - RNA, 64 nt, Homo Sapiens
guuugcagaaacuaacucuuuucucacaucaacauuuguaaaauugauguguuauaguggaaaa

SEQ ID NO: 226055 - RNA, 64 nt, Homo Sapiens
uuuucauauguuugaugaaaacuggcucaagauguuuguaaauagaaucaagagcaaaacugca

SEQ ID NO: 226056 - RNA, 64 nt, Homo Sapiens
acccuaaacacaguauuucuuuuuaacuuuuuuauuuguaaacuaauaaagguaaucacagcca

SEQ ID NO: 226057 - RNA, 64 nt, Homo Sapiens
agaacaaacauauuuaugaucaugaauaaugugcuuuguaaaaagauuucaaguuauuaggaag

SEQ ID NO: 226058 - RNA, 64 nt, Homo Sapiens
gaauuugcaaauauaguguuauauuuuauaaaguuuuguaaaaucccaaacaauauuucuauuu

SEQ ID NO: 226059 - RNA, 64 nt, Homo Sapiens
aaaguuuuguaaaaucccaaacaauauuucuauuuuuguaaaacaauuguauguauaaucugua

SEQ ID NO: 226060 - RNA, 64 nt, Homo Sapiens
cugaacucaacaagaucuuggcuguacauaaauauuuguaaaagagacccuuugcaccuuuuua

SEQ ID NO: 226061 - RNA, 64 nt, Homo Sapiens
ccacuuucuagcucuggagagguuggauuuugcuuuuguaaacacaugaauccuuaugauaaaa

SEQ ID NO: 226062 - RNA, 64 nt, Homo Sapiens
auacaaauaaucuaacacauaaaucauaugguccuuuguaaaauguaaaugugguaggaaauau

SEQ ID NO: 226063 - RNA, 64 nt, Homo Sapiens
ugguaggaaauauaaaucauagcgauuuuuaauguuuguaaauguuauauauuuuuuaacauuu

SEQ ID NO: 226064 - RNA, 64 nt, Homo Sapiens
aaaaggcaaugauguaugcauguaaauugggucuuuuguaaacaacuauguuaaugaucaauac

SEQ ID NO: 226065 - RNA, 64 nt, Homo Sapiens
auauguaaaauaaaugugacguacucuuuuuuuuuuuguaaaguuuuucuuuuauuucuucauu

SEQ ID NO: 226066 - RNA, 64 nt, Homo Sapiens
uuaaguguuuaaaugaaaaagagugguuuaauguuuuguaaauauugauacaauagucaaaauu

SEQ ID NO: 226067 - RNA, 64 nt, Homo Sapiens
caggaauauuaggcucuuuguugcauuaauugauuuuguaaaucgaaugaucugcaagaauuuu

SEQ ID NO: 226068 - RNA, 64 nt, Homo Sapiens
aaguucaaaggaaaauagaccccuuucaaaaguguuuguaaaccgccaggaaauguuucucuaa

SEQ ID NO: 226069 - RNA, 64 nt, Homo Sapiens
uaugauguaaauuuucaguguuaugaaaagaaacuuuguaaaaguuuuguaaagaaguauauuu

SEQ ID NO: 226070 - RNA, 64 nt, Homo Sapiens
aguauauuuuuaugaaaagauuaaugcauacacuuuuguaaagaaacuggcuacuccucuuaua

SEQ ID NO: 226071 - RNA, 64 nt, Homo Sapiens
gacauuguagauaauugaauaggaguuuuccccguuuguaaaaauaugaugugccuguaaacca

SEQ ID NO: 226072 - RNA, 64 nt, Homo Sapiens
auuccauuugagucuuucuguuaaaguguucuauuuuguaaaucaaagauaggacugaccuggu

SEQ ID NO: 226073 - RNA, 64 nt, Homo Sapiens
uuuaaaugcauaaagggggucuuuuuuacaagucuuuguaaaauaggugccaaauuccauuuaa

SEQ ID NO: 226074 - RNA, 64 nt, Homo Sapiens
uugacaauuuucuuucugcaucuugaucuuuuaauuuguaaauaaaccuauguaacugacauaa

SEQ ID NO: 226075 - RNA, 64 nt, Homo Sapiens
uugaaauagaaauuugauuguacuauaaaugauuuuuguaaauaauuuauauucugcucuaaua

SEQ ID NO: 226076 - RNA, 64 nt, Homo Sapiens
uauugagagauauguuuuuaaacuuuuaucaucauuuguaaauguggaaguugguggauugcug

SEQ ID NO: 226077 - RNA, 64 nt, Homo Sapiens
uugacaacuauucacccuaccucagaucauagaguuuguaaaguuugugucccuccccaguuuu

SEQ ID NO: 226078 - RNA, 64 nt, Homo Sapiens
uuagagaaaguaacuuacaaccacccauuccggauuuguaaagcaacaugaaaaccuuugauaa

SEQ ID NO: 226079 - RNA, 64 nt, Homo Sapiens
uuaaugcaaauguuucaaaacuggguuucugauauuuguaaauguguuucuuuauuagauaaga

SEQ ID NO: 226080 - RNA, 64 nt, Homo Sapiens
cucugugggaaaugugaggaagccuaaguuuguauuuguaaauuucuuaugccauccucuaguc

SEQ ID NO: 226081 - RNA, 64 nt, Homo Sapiens
gaugucaugaaaugguggguacaguguauuguguuuuguaaaauaguguuuugcaauuugugaa

SEQ ID NO: 226082 - RNA, 64 nt, Homo Sapiens
aaagcacccuuuuguaaugccagaagugaauucuuuuguaaagugcuggcuguuuaagggaacc

SEQ ID NO: 226083 - RNA, 64 nt, Homo Sapiens
aaguaccuguaucuagauuauauuaaucuaaauauuuguaaauacauuugauguaacaaaaugc

SEQ ID NO: 226084 - RNA, 64 nt, Homo Sapiens
ggaaaguguuucuaaagguguuggcauaaauuguuuuguaaaagaggggcuguuuuaugucaug

SEQ ID NO: 226085 - RNA, 64 nt, Homo Sapiens
uuuuugcauuacaggcugcaccugcuuuucucuuuuuguaaacgugcaaucgacaaugugcuaa

SEQ ID NO: 226086 - RNA, 64 nt, Homo Sapiens
ucuuauuuguguaauaaagucuuucaugucgugcuuuguaaaugaugucuguuuuguuacauac

SEQ ID NO: 226087 - RNA, 64 nt, Homo Sapiens
caaugucuguuuuguuacauuuguaagcacuuuuuuuguaaaacacacacacacggaaaaaaaa

SEQ ID NO: 226088 - RNA, 64 nt, Homo Sapiens
uugaaguguguaauaaagcccauuuaacuuuaacuuuguaaauauuaauacaauagagacuuuu

SEQ ID NO: 226089 - RNA, 64 nt, Homo Sapiens
acaucuuuccuacuuuuugacuugaucaaaauuauuuguaaagacugcuuucuuugaacacaua

SEQ ID NO: 226090 - RNA, 64 nt, Homo Sapiens
aaaacaaguauaauaaacucuagauguuuuuaauuuuguaaaagcugccacuugggccugguuu

SEQ ID NO: 226091 - RNA, 64 nt, Homo Sapiens
auaaaguacguggcauguguggacacaaaaguguuuuguaaacugugagggaaagucaguugag

SEQ ID NO: 226092 - RNA, 64 nt, Homo Sapiens
guauacucuguacgguucuguaaaccgaaaaacuuuuguaaauauauaaauauacauagacaua

SEQ ID NO: 226093 - RNA, 64 nt, Homo Sapiens
uuaaaaagcaacaaguuugcacagcuagaguguuuuuguaaauaaauguauuuguauaacacag

SEQ ID NO: 226094 - RNA, 64 nt, Homo Sapiens
uuucaaaugucagucaaguuuaaguuaaaauguuuuuguaaaauaauaacuaauccuucaaaaa

SEQ ID NO: 226095 - RNA, 64 nt, Homo Sapiens
gauauagacagugguaauaauauccuuuuuuguguuuguaaauguaaauuauaaggcaucuuuu

SEQ ID NO: 226096 - RNA, 64 nt, Homo Sapiens
uauuauuccagagaguauacguuuguuuuaaaucuuuguaaaguaaaaaggcuuuuaaaauuuu

SEQ ID NO: 226097 - RNA, 64 nt, Homo Sapiens
cagcaaaggcaguguuucaaugguaacuuuggguuuuguaaaauaugauagacacagaaagguu

SEQ ID NO: 226098 - RNA, 64 nt, Homo Sapiens
gaaguaaaaggucaacauuuuuauuauuuucauuuuuguaaaaguauuuuauacgaaaacaugu

SEQ ID NO: 226099 - RNA, 64 nt, Homo Sapiens
caaaacauuucccaugagcuuccaacaucuauacuuuguaaaguauauacauuuuucuuaaugu

SEQ ID NO: 226100 - RNA, 64 nt, Homo Sapiens
caguagccguccugcaggcagcucccagaaggccuuuguaaaaucccaggugagcccuggauug

SEQ ID NO: 226101 - RNA, 64 nt, Homo Sapiens
aaaaagggauaucuuuuuuauccuggcuuuuagguuuguaaaagcuuggcccagagcuucauuc

SEQ ID NO: 226102 - RNA, 64 nt, Homo Sapiens
agagugauucaucuagaugaucucagugacuucauuuguaaauguguuuuuaaaacucucugag

SEQ ID NO: 226103 - RNA, 64 nt, Homo Sapiens
aauugauugaagauuuuaaaaccuuaugauguacuuuguaaaaauuccucccaaggguucuggc

SEQ ID NO: 226104 - RNA, 64 nt, Homo Sapiens
ugauuaguaguuuuacuuuauuuuagccuggaaguuuguaaaaccacuccccaagucucagagc

SEQ ID NO: 226105 - RNA, 64 nt, Homo Sapiens
auuuuaacucaaauaaaauuuaugucuuuggguuuuuguaaauauuuguaccaguuucaugaag

SEQ ID NO: 226106 - RNA, 64 nt, Homo Sapiens
uugaagccauaaaaauauuaguuucuucauuggauuuguaaaaccuuucagguaguuacaucau

SEQ ID NO: 226107 - RNA, 64 nt, Homo Sapiens
uuuuuccucuauaaaugaaauuguguuuacuguuuuuguaaauuagcuguaaccugacuauccu

SEQ ID NO: 226108 - RNA, 64 nt, Homo Sapiens
cguggccaauugucuccugucaguuauucugcuuuuuguaaagcuaaauaauuucaauuugggg

SEQ ID NO: 226109 - RNA, 64 nt, Homo Sapiens
cacaaggcuaaauuaaugaaguguagauacuauuuuuguaaaaagauguauagcccuguauaca

SEQ ID NO: 226110 - RNA, 64 nt, Homo Sapiens
gcaaaguuuguuuugagguuuaaagauagguuaauuuguaaaugagcugucguucaguuaagcu

SEQ ID NO: 226111 - RNA, 64 nt, Homo Sapiens
aagcugaaacuuuuuugaugcaauuuaccuuggauuuguaaauccuguagcuuuucagaagaag

SEQ ID NO: 226112 - RNA, 64 nt, Homo Sapiens
aaaaccccuuguuauuuguauggccaagcucguauuuguaaacuauuuugaaucagagaauacu

SEQ ID NO: 226113 - RNA, 64 nt, Homo Sapiens
uucccccuauucaguuuuaaucuuggaauaugcauuuguaaauugugaugucauugagacuaua

SEQ ID NO: 226114 - RNA, 64 nt, Homo Sapiens
uuauaagaaauaaaagcauuauugggugccuuuguuuguaaaccaaaaaguaauaaaugaaucc

SEQ ID NO: 226115 - RNA, 64 nt, Homo Sapiens
uuuuuuguguuuuguucuuuaaagucagguccaauuuguaaaaacagcauugcuuucugaaauu

SEQ ID NO: 226116 - RNA, 64 nt, Homo Sapiens
cauguagauccuguuugacauuuuuauggcuguauuuguaaacuuaaacacaccagugucuguu

SEQ ID NO: 226117 - RNA, 64 nt, Homo Sapiens
ugcuuguauguauaaauccuaugaauagagggcuuuuguaaauuaugcauuuauuguaauuauc

SEQ ID NO: 226118 - RNA, 64 nt, Homo Sapiens
uauuuuucuuauguaaaucaucuuuuuacauuuguuuguaaacauguuuaaagaacgaaccuag

SEQ ID NO: 226119 - RNA, 64 nt, Homo Sapiens
aaauauuacuuauccaucagguuucucuuugguuuuuguaaacggagaggacaguucuuagucc

SEQ ID NO: 226120 - RNA, 64 nt, Homo Sapiens
ccaguaaaaauaugcagauuguauguaaugaauuuuuguaaacaaagguaauuucugucaaaug

SEQ ID NO: 226121 - RNA, 64 nt, Homo Sapiens
auuugauuuuuuuaaaaacauggaaacguacuguuuuguaaauucuuuuuaacugcacaucuac

SEQ ID NO: 226122 - RNA, 64 nt, Homo Sapiens
caagagcugcugcuauaacuuccaguuuuacaucuuuguaaaauuguaucucaaaggcagaaaa

SEQ ID NO: 226123 - RNA, 64 nt, Homo Sapiens
cuuuugauguuugaaguuacaaaccuguaauuuuuuuguaaaggaaauaauugccaaauaccua

SEQ ID NO: 226124 - RNA, 64 nt, Homo Sapiens
uguguguuguaacaaauauauugcaaaaacauaguuuguaaaggcauucuauaagcuauuuaug

SEQ ID NO: 226125 - RNA, 64 nt, Homo Sapiens
uuuccaggugguucuaaaggcccuuuuuuuuuuuuuuguaaagcuaacaacuaaaucaaaauca

SEQ ID NO: 226126 - RNA, 64 nt, Homo Sapiens
acaaauauaaauuaucacccugauagauguuugauuuguaaauucuagguacauaguaagugua

SEQ ID NO: 226127 - RNA, 64 nt, Homo Sapiens
uuaacaaaaucacuaaauuaaaaugagaaauaauuuuguaaaacgaagaguagaauuccaagaa

SEQ ID NO: 226128 - RNA, 64 nt, Homo Sapiens
gaagaguagaauuccaagaaucucaauuuaaggcuuuguaaaauuuugucaugugauuuuugag

SEQ ID NO: 226129 - RNA, 64 nt, Homo Sapiens
auuuauugaauguucugaucuuuaaagagagaauuuuguaaaccgaucacucuguucucuuugu

SEQ ID NO: 226130 - RNA, 64 nt, Homo Sapiens
gacuuacuugguauauuuuuaaacagcuuccuaguuuguaaauaucuaaaucaugcuguuucug

SEQ ID NO: 226131 - RNA, 64 nt, Homo Sapiens
gccaaagaucauuuuuuuauauagacuucagcccuuuguaaauauuguaacuggggaguauaga

SEQ ID NO: 226132 - RNA, 64 nt, Homo Sapiens
cagacaaaguagaaacugugcugcaugauguuauuuuguaaacagaugacauuuucugaccagg

SEQ ID NO: 226133 - RNA, 64 nt, Homo Sapiens
uaaauuuugugcccagcaagcuguuaguuuuauuuuuguaaagguauguaaguuauuaaauggu

SEQ ID NO: 226134 - RNA, 64 nt, Homo Sapiens
ggacucaccauaacauugucaguucuaaugaaauuuuguaaaagauggcaaguuuguuaccuca

SEQ ID NO: 226135 - RNA, 64 nt, Homo Sapiens
cagggugcuuuuauauauaagagcagcagccgccuuuguaaagugugaucuaugagaauuggag

SEQ ID NO: 226136 - RNA, 64 nt, Homo Sapiens
accucacugcacgcaucgaaggaucugauuugaauuuguaaaggcaauucuuuugagagcagga

SEQ ID NO: 226137 - RNA, 64 nt, Homo Sapiens
uggauaaaucuauuuuuuaacaaucuuuuuauuauuuguaaaagauauaaaaacaacucccauc

SEQ ID NO: 226138 - RNA, 64 nt, Homo Sapiens
uccaccuggccgccuccauggacccuugguggcuuuuguaaauuaauuuuugaugacauuuuga

SEQ ID NO: 226139 - RNA, 64 nt, Homo Sapiens
uaagauuucugaccagcagucucuuaccuguauauuuguaaauauaucauguuucugugaaaau

SEQ ID NO: 226140 - RNA, 64 nt, Homo Sapiens
gaugaaaauuuuauuuucuuuuaauuuaaccccauuuguaaacacauaugauagcuugugcuga

SEQ ID NO: 226141 - RNA, 64 nt, Homo Sapiens
uuaaaacaucuauauuuaaaauauucaauagauuuuuguaaauggacauugaguugugacuucu

SEQ ID NO: 226142 - RNA, 64 nt, Homo Sapiens
aguccugauuuggccuccaauaugcccagcacauuuuguaaaacaucaucuuauguaccacuaa

SEQ ID NO: 226143 - RNA, 64 nt, Homo Sapiens
auuuugagauaucaggcauuuagaacuaucuccuuuuguaaaggcauacccaaaacuccuugac

SEQ ID NO: 226144 - RNA, 64 nt, Homo Sapiens
ccuuucauucugguacaagauacacugaccaggguuuguaaaaccacagaggcugugugugccc

SEQ ID NO: 226145 - RNA, 64 nt, Homo Sapiens
aaaucaggaugguagaaaguucuaacaauugcuguuuguaaaaugccaucagauauggaugccu

SEQ ID NO: 226146 - RNA, 64 nt, Homo Sapiens
aaaauuuguuuacuuacccacucaaaauaacuuguuuguaaaagcaccaggaggaucccuauga

SEQ ID NO: 226147 - RNA, 64 nt, Homo Sapiens
ugagcuauuggacuucacuguuuacauuccguacuuuguaaacuuuaaaugaaauggggagaua

SEQ ID NO: 226148 - RNA, 64 nt, Homo Sapiens
uuauuugucuuaacucauuuuuauuauuugucuauuuguaaaguuauuuuagccacugagccuu

SEQ ID NO: 226149 - RNA, 64 nt, Homo Sapiens
uaaauaaauaugcccuuuuaguuuuugaaacuuguuuguaaacaagcauacauguuuuccuuuu

SEQ ID NO: 226150 - RNA, 64 nt, Homo Sapiens
uaguguuuuuuuauuucuacaacucaaugcuuuauuuguaaauuauauacacgaauagacauca

SEQ ID NO: 226151 - RNA, 64 nt, Homo Sapiens
uuuauuuuuuuuaaagaaaaucugagggaaauguuuuguaaacauacuuccaugaauuuuaaaa

SEQ ID NO: 226152 - RNA, 64 nt, Homo Sapiens
uucuaugaguuuuggguggguuauauggucaauauuuguaaauaaugguuucuacuuuauggaa

SEQ ID NO: 226153 - RNA, 64 nt, Homo Sapiens
auuaguuuguuauaguugaauaaaagggacuaaauuuguaaaaacuguccuuuugacauacagc

SEQ ID NO: 226154 - RNA, 64 nt, Homo Sapiens
gagaauaauguuuauuuccuuucacauacacuuuuuuguaaaauuaguguagauuuuuuuaaag

SEQ ID NO: 226155 - RNA, 64 nt, Homo Sapiens
aauuuguuuguacauuguauuuguaauuguaauuuuuguaaauaauugucucaauuuguacagu

SEQ ID NO: 226156 - RNA, 64 nt, Homo Sapiens
gcaguucacauuuuuccacaaaaaauaaaauuacuuuguaaauauaguuaauuuguucuuacca

SEQ ID NO: 226157 - RNA, 64 nt, Homo Sapiens
gaagcaagcuauuauuaacaucaguguuaaaguauuuguaaauaaguggacacuuguaagucaa

SEQ ID NO: 226158 - RNA, 64 nt, Homo Sapiens
ugucauuaucaggucacauagggggggauuguuuuuuguaaaaaacugaccaagauguuggggu

SEQ ID NO: 226159 - RNA, 64 nt, Homo Sapiens
ccuaagucaaguaggcuggccggagucgaaugcauuuguaaaucccacgucguguuucacaugu

SEQ ID NO: 226160 - RNA, 64 nt, Homo Sapiens
augucauugucuacugcauaguuuccugagucuguuuguaaagugcuuauggcuaacaguucag

SEQ ID NO: 226161 - RNA, 64 nt, Homo Sapiens
uuugagauacuagguuuuaucaccugcugcuguauuuguaaacaaagacaaauguugcuuuaag

SEQ ID NO: 226162 - RNA, 64 nt, Homo Sapiens
cagaaaauaaaauauucacucuccauuagaaaauuuuguaaaacaaugccaugaacaaauucuu

SEQ ID NO: 226163 - RNA, 64 nt, Homo Sapiens
cuuugauaacaaaaaauaaauuuuaaaaaggaauuuuguaaaguuucuagaauuuuauaucauu

SEQ ID NO: 226164 - RNA, 64 nt, Homo Sapiens
cuaggauaauuuuuuuuucauauuugccaaaauuuuuguaaacccugucuugucaaauaagugu

SEQ ID NO: 226165 - RNA, 64 nt, Homo Sapiens
aagacuaguuucuucagggcaguggacguaguaguuuguaaaaacguuuucuaugacgcauaag

SEQ ID NO: 226166 - RNA, 64 nt, Homo Sapiens
uuuauuaauuuaaaauagaacgcuugagaggcacuuuguaaagauuuguuaaacuggaaacguu

SEQ ID NO: 226167 - RNA, 64 nt, Homo Sapiens
cagaaaaugacaggacugggcaaauuaacaaauguuuguaaacaugaauguucaggaacuacug

SEQ ID NO: 226168 - RNA, 64 nt, Homo Sapiens
uaguuuauugcuuuaccauuauaucuaugaaaccuuuguaaauuauuuuaaacuugugauaggc

SEQ ID NO: 226169 - RNA, 64 nt, Homo Sapiens
agcuuccuaugaaaauguggguacauguauuuucuuuguaaaguuguuuguauuuucaacugga

SEQ ID NO: 226170 - RNA, 64 nt, Homo Sapiens
ucacaaacuuauaagcaaugauguaaacguaggguuuguaaaagacugcaguuacuauuuacua

SEQ ID NO: 226171 - RNA, 64 nt, Homo Sapiens
guaaaaaacugcuucuaaucacucuaaaugacauuuuguaaauauacugaagguggccaccucc

SEQ ID NO: 226172 - RNA, 64 nt, Homo Sapiens
caaguagcuuuaagauaaaguuuuauuuuuauuuuuuguaaagcguuccuccccuaauccucua

SEQ ID NO: 226173 - RNA, 64 nt, Homo Sapiens
ugucaguaacauuccacaucgaaaaaaaucaguuuuuguaaagagaaauuauuuguguugagug

SEQ ID NO: 226174 - RNA, 64 nt, Homo Sapiens
uaaaugucagcauucccuuuauuuuaaauuucauuuuguaaaguuuccccagaguacuacuuac

SEQ ID NO: 226175 - RNA, 64 nt, Homo Sapiens
cugagcuuauaguuuuccuuguaaguugcuuuuguuuguaaaauaggaccagcaauaauaccuu

SEQ ID NO: 226176 - RNA, 64 nt, Homo Sapiens
uuuuuaguuggaaaaacagcagacagucuguucuuuuguaaacaugggguuuuuuuguuuguuc

SEQ ID NO: 226177 - RNA, 64 nt, Homo Sapiens
uguacauauuaaaggaagcacgugaaagugcauuuuuguaaaugcggccccggccgccccuccu

SEQ ID NO: 226178 - RNA, 64 nt, Homo Sapiens
uuccgugcguggcacucgcuggauaguugcuauuuuuguaaagugaaaacaauggaguauucuc

SEQ ID NO: 226179 - RNA, 64 nt, Homo Sapiens
ucucuacuuuucccuguacuuuucccauuuguaauuuguaaaauguucucuuaugaucaccaug

SEQ ID NO: 226180 - RNA, 64 nt, Homo Sapiens
auuuguaaaauguucucuuaugaucaccauguauuuuguaaauaauaaaauaguaucuguuaaa

SEQ ID NO: 226181 - RNA, 64 nt, Homo Sapiens
acauaauuaauauuugaccucugcuugaguuuuguuuguaaaauugggacaaguaauaaaacaa

SEQ ID NO: 226182 - RNA, 64 nt, Homo Sapiens
caguaguuuugcacaaccucacuuuugugccauuuuuguaaauagugcauuaacuguugaauuc

SEQ ID NO: 226183 - RNA, 64 nt, Homo Sapiens
agaaguuuaagaccacaaguuuuaccuuuuggauuuuguaaaacuuguauugauuucuucugua

SEQ ID NO: 226184 - RNA, 64 nt, Homo Sapiens
guuauacaaucagaaggugcaaagcaaaaaguacuuuguaaaguagaaguuccagacagaugag

SEQ ID NO: 226185 - RNA, 64 nt, Homo Sapiens
aaucaaaaguaggcguaagcaaugugucuaugaauuuguaaaacugauccucaaggaacuugca

SEQ ID NO: 226186 - RNA, 64 nt, Homo Sapiens
auuuuaucaaaccaaauguuaaaaagacuuuccuuuuguaaaacuggauuagagaagacuuuuc

SEQ ID NO: 226187 - RNA, 64 nt, Homo Sapiens
aaauuuucuuagauuuggucaucaucaggaagcauuuguaaaaauaaaaaucuccacaaauuac

SEQ ID NO: 226188 - RNA, 64 nt, Homo Sapiens
uccuaauaaaggagaaaugcauguuuauggcuuuuuuguaaauauaaaugcagugaucuauggc

SEQ ID NO: 226189 - RNA, 64 nt, Homo Sapiens
ucuauggcuuaaaaaauuuguuucugugacaauguuuguaaaucuagccaauagagucauuuac

SEQ ID NO: 226190 - RNA, 64 nt, Homo Sapiens
aacuguuucccccucaaaaccugaaccugaauuauuuguaaaaacugaaauuuaaugauuaaag

SEQ ID NO: 226191 - RNA, 64 nt, Homo Sapiens
cacaaagcuuuggaaggagacuuucauccuuuuuuuuguaaauuggaacuaagcaguuuguaaa

SEQ ID NO: 226192 - RNA, 64 nt, Homo Sapiens
uucauccuuuuuuuuguaaauuggaacuaagcaguuuguaaacuuucucaccucuuaugcuuag

SEQ ID NO: 226193 - RNA, 64 nt, Homo Sapiens
cauuggauauaaaagagugauuuguaaaugauuuuuuguaaaguuuaucauaugcagucacuuc

SEQ ID NO: 226194 - RNA, 64 nt, Homo Sapiens
auuuuuuguaaagucauugguaugcagucacuucuuuguaaauguuggcacaaauauuuuauca

SEQ ID NO: 226195 - RNA, 64 nt, Homo Sapiens
uuuacuauguuuuucuauuaauguuaucaacguuuuuguaaauaauaugugugugacuugagua

SEQ ID NO: 226196 - RNA, 64 nt, Homo Sapiens
uuguuaagaccugucuacaucuccauaauuucaauuuguaaacuuuagauucauuuugggaaau

SEQ ID NO: 226197 - RNA, 64 nt, Homo Sapiens
auuggcuaaaagaaucaucuugaauuauucuaccuuuguaaacaaaaaaaaaauaaaauuauuu

SEQ ID NO: 226198 - RNA, 64 nt, Homo Sapiens
aaaauaaaauuauuuugaauuccuguacuugcucuuuguaaaaaaauacaugaucuugaacagc

SEQ ID NO: 226199 - RNA, 64 nt, Homo Sapiens
uccuuuucaaugucaaagcgacgagaggggucuuuuuguaaaccaauuuagagucacugauauu

SEQ ID NO: 226200 - RNA, 64 nt, Homo Sapiens
gaaaauuaguacucugcucgguuuucgauguguguuuguaaagguggaugugcaugaagcucuu

SEQ ID NO: 226201 - RNA, 64 nt, Homo Sapiens
ucauauuguguggcugaucugaagucagucggaauuuguaaacaggguagcaaacaagauauuu

SEQ ID NO: 226202 - RNA, 64 nt, Homo Sapiens
auugcaacaacacuuuacuaccuaacggauagcauuuguaaauacucuagguaucuguaaacac

SEQ ID NO: 226203 - RNA, 64 nt, Homo Sapiens
guuuuuagcuuuuaaaauuuauuaaaauggauaauuuguaaauacaacaacaaacauuuuuaaa

SEQ ID NO: 226204 - RNA, 64 nt, Homo Sapiens
cuaugaaaaaugcauuuuccuugauaucacaguguuuguaaauuagcaguuuuugagaaugugu

SEQ ID NO: 226205 - RNA, 64 nt, Homo Sapiens
auaaccucacauaagaaccaaugugagucaaaauuuuguaaaauuuucuccccccuaagguuac

SEQ ID NO: 226206 - RNA, 64 nt, Homo Sapiens
gagggucauaguucagcauccuuuugaaaaaugauuuguaaauuuguuuaaacuuuuuuuuauu

SEQ ID NO: 226207 - RNA, 64 nt, Homo Sapiens
cuuggggaguaaggacauuaauguacuuucucccuuuguaaagaugugugaaaucuaagcagua

SEQ ID NO: 226208 - RNA, 64 nt, Homo Sapiens
aaaugugacuaaaauauagcagaaauucagguuguuuguaaaaauuuuaauaacaaauagcauu

SEQ ID NO: 226209 - RNA, 64 nt, Homo Sapiens
acacuguaucuuauuaaaauaggaugauuugcauuuuguaaaauuauccugcacaucaagcugc

SEQ ID NO: 226210 - RNA, 64 nt, Homo Sapiens
uuucugaacuuuagugaaaccauaaauaagcaaauuuguaaacuagaaaucuacaaauguaugu

SEQ ID NO: 226211 - RNA, 64 nt, Homo Sapiens
cuaucaugauauuuucaauucaaaguugugugcauuuguaaacaaggauuuguaaagcuuugcu

SEQ ID NO: 226212 - RNA, 64 nt, Homo Sapiens
uuugcucaaaguugugugcauaugguaugaaggauuuguaaagcuuauuuucucauuugcuuug

SEQ ID NO: 226213 - RNA, 64 nt, Homo Sapiens
agcagaacuguuuuguuggugucuaauugacucauuuguaaaugcagaaguugcugcuuuguuu

SEQ ID NO: 226214 - RNA, 64 nt, Homo Sapiens
ucaaaugaccacauaaagcucauuagagaaaccauuuguaaaaccauaaaugauuuuggcauac

SEQ ID NO: 226215 - RNA, 64 nt, Homo Sapiens
gccauuucuugggaguuuuuagaaccuuugacauuuuguaaaagaugaccagcaguugguauga

SEQ ID NO: 226216 - RNA, 64 nt, Homo Sapiens
aaauuuuguaguuuaaguauuugaugaaacuguauuuguaaaaaguugauguaugucccaaguu

SEQ ID NO: 226217 - RNA, 64 nt, Homo Sapiens
ggacaauguuuugcaauauauaaaucauucuauuuuuguaaauuguauaucacuuuaauugaaa

SEQ ID NO: 226218 - RNA, 64 nt, Homo Sapiens
guaagaugaaauauuaugcuauuauaugaugcuguuuguaaagguauuaauguacuaguaaggu

SEQ ID NO: 226219 - RNA, 64 nt, Homo Sapiens
aaaguuuagaaacuucauaugugucaucacagcuuuuguaaagaaaguauccuuaauauuuuau

SEQ ID NO: 226220 - RNA, 64 nt, Homo Sapiens
uauuccuucuacauuuauuuuaaaauaaguuuauuuuguaaaaacaugcauaaacugucuuagc

SEQ ID NO: 226221 - RNA, 64 nt, Homo Sapiens
gcuggguuagagaugaggcaccuuuuauauuauauuuguaaaagaaccacagcagcuauuuugg

SEQ ID NO: 226222 - RNA, 64 nt, Homo Sapiens
guccuuuugauaccaucaucguuacuauucuuaguuuguaaauucacaggaugcugaaagcuau

SEQ ID NO: 226223 - RNA, 64 nt, Homo Sapiens
aaaaaaaaauauauauauaugucuggaauaacauuuuguaaaaacugcccaccaaaaugaucca

SEQ ID NO: 226224 - RNA, 64 nt, Homo Sapiens
uaaaauauuugugcaaagcuauuaauauacacauuuuguaaaaaaaaaaaaaaaacacguauau

SEQ ID NO: 226225 - RNA, 64 nt, Homo Sapiens
ccugcuuuccuuuuuacauuuauuaaaaguggauuuuguaaaagcauuucauugacacgcgacc

SEQ ID NO: 226226 - RNA, 64 nt, Homo Sapiens
cuuugcuaauaucuguguuuuucagauuucauuuuuuguaaaaucagaaauuaaucuaaacaua

SEQ ID NO: 226227 - RNA, 62 nt, Homo Sapiens
caaugaaucauuguucaaccuugaaaaauaaaauuuuguaaaacaucgguugaugucauuau

SEQ ID NO: 226228 - RNA, 64 nt, Homo Sapiens
acaggucuuucaaagucauucucaauauucagcuuuuguaaauuaucaagcuucaaaaagcuuu

SEQ ID NO: 226229 - RNA, 64 nt, Homo Sapiens
uuuugcaacucauguuauggguuaaaugaauauuuuuguaaaaguaaaagcaacaaauuuauaa

SEQ ID NO: 226230 - RNA, 64 nt, Homo Sapiens
gaaagcuauauacuugugcuaucuaaagcacuacuuuguaaagaugacuacccaagauuguaaa

SEQ ID NO: 226231 - RNA, 64 nt, Homo Sapiens
augauugugcaaaaagucacguguaaauugaacuuuuguaaaucaaauuguauuuuaaaugcau

SEQ ID NO: 226232 - RNA, 64 nt, Homo Sapiens
aaauaaaggcgauagcugacuuucauuuggggcauuuguaaaaaguagauuaaaauauuugccu

SEQ ID NO: 226233 - RNA, 64 nt, Homo Sapiens
uuugcuaucugaacuaauucauuuauuaaguauauuuguaaaagcuaaggcucgaguuaaaaca

SEQ ID NO: 226234 - RNA, 64 nt, Homo Sapiens
gcucgaguuaaaacaaugaaguguuuuacaaugauuuguaaaggacuauuuauaacuaauaugg

SEQ ID NO: 226235 - RNA, 64 nt, Homo Sapiens
uguuuucaaugaauuaagaaagauuaaauauaucuuuguaaauuauuuuaugucauaguuuaau

SEQ ID NO: 226236 - RNA, 64 nt, Homo Sapiens
aguauaagaaauuuuauuagacauucucuuacuuuuuguaaaugcuguaaauauuucauaaauu

SEQ ID NO: 226237 - RNA, 64 nt, Homo Sapiens
agccauuaaccauacaguguaguuggggaaaccauuuguaaaaccuuugaggagcucacuguuu

SEQ ID NO: 226238 - RNA, 64 nt, Homo Sapiens
uuuuucuuuuuccuuuuuaagcgcaucagaaucguuuguaaagcggugguuaucaaccuuggcu

SEQ ID NO: 226239 - RNA, 64 nt, Homo Sapiens
uuucuguucagcguuuugcacaagaaugaagguuuuuguaaagagaaaaaucaaguauuauaaa

SEQ ID NO: 226240 - RNA, 64 nt, Homo Sapiens
aaaauauuuaauguugaacaaagauauacuuguuuuuguaaagacuguuuuuaaaaauuagccu

SEQ ID NO: 226241 - RNA, 64 nt, Homo Sapiens
uaaaauuuuuccaauagauuauuaccuauaaagauuuguaaaagacaaguacaaacauugaaca

SEQ ID NO: 226242 - RNA, 64 nt, Homo Sapiens
cuuucuccuuuaaaauuauuagugcuucauccuauuuguaaaauucuguauauuaccucguacc

SEQ ID NO: 226243 - RNA, 64 nt, Homo Sapiens
auugggggcagauaucuuggaaggaaauauucagagacuuuagcaaauauauugaauguacaga

SEQ ID NO: 226244 - RNA, 64 nt, Homo Sapiens
agaucaaacucagccuauucacaaguuaaaaaguagacuuuaagugccaugaggccauuuucag

SEQ ID NO: 226245 - RNA, 64 nt, Homo Sapiens
auauuacacuacaguuuacuuuucagaauacuaaagacuuuauaacugcaugaacuuggauuuu

SEQ ID NO: 226246 - RNA, 64 nt, Homo Sapiens
auuuccauaaagaaaacucaaguauuaauaaaagagacuuuacuggcuuaagagggcugugaaa

SEQ ID NO: 226247 - RNA, 64 nt, Homo Sapiens
agcccuccuggaauggagcuguauaacugugcagagacuuuauccaugccaauaguugcugucc

SEQ ID NO: 226248 - RNA, 64 nt, Homo Sapiens
ccaaacuucuuguucaaaacggggggaguuuaggagacuuuaaucccgguuucagaagcugcag

SEQ ID NO: 226249 - RNA, 64 nt, Homo Sapiens
aauuugaaaaacgucuuuagaugaccaagcaaaaagacuuuaaaaaaugguaaugaaaauggaa

SEQ ID NO: 226250 - RNA, 64 nt, Homo Sapiens
ugaagaauaaaauugauuaaagguuuuuuuggugagacuuuauuuaaugcacaucugucuuaaa

SEQ ID NO: 226251 - RNA, 64 nt, Homo Sapiens
cuacacaguagacuguguuauguacgaacacggcagacuuuagccauuauuccuuuucagucac

SEQ ID NO: 226252 - RNA, 64 nt, Homo Sapiens
auuccuucugccuaacuuguuguaaacaucagcaagacuuuauaagucacauugauguaaggac

SEQ ID NO: 226253 - RNA, 64 nt, Homo Sapiens
uauuaacuuuacuuuuuuuaaaucaacuugcuauagacuuuauauacauuuuguuaaauauagu

SEQ ID NO: 226254 - RNA, 64 nt, Homo Sapiens
ucuggaaagcauagacauuuuuuacacucuggauagacuuuauucuugaagaucaucagaaaug

SEQ ID NO: 226255 - RNA, 64 nt, Homo Sapiens
ucuuagugauuuuaguuuuguuuuuaauugacaaagacuuuauacaaccugaagaaaauaucaa

SEQ ID NO: 226256 - RNA, 64 nt, Homo Sapiens
uugguguuagaaccacuaaaucauuuuuguggaaagacuuuaaauguacgaaaagguuuggagu

SEQ ID NO: 226257 - RNA, 64 nt, Homo Sapiens
aaaaaauaaaaaauaaaaaaauaaaaaaaaaauaagacuuuaacugcaguuccaaagcuucucu

SEQ ID NO: 226258 - RNA, 64 nt, Homo Sapiens
gaaagcauuuucuagguguguuuaguguacaaagagacuuuauaacccuuacuggacaacacac

SEQ ID NO: 226259 - RNA, 64 nt, Homo Sapiens
uuuaauuuuauugugaucucuuaaagcagagguuagacuuuaccuuucugacucugucguccag

SEQ ID NO: 226260 - RNA, 64 nt, Homo Sapiens
cugggauuacaggcaugagccaccacgcccggcuagacuuuaccuuucuaaagaaauuguuuac

SEQ ID NO: 226261 - RNA, 64 nt, Homo Sapiens
aguuuuguaaaaaccuuuuucagucaaacaguaaagacuuuauuuauggauuguaauaacaacc

SEQ ID NO: 226262 - RNA, 64 nt, Homo Sapiens
ccccucuuuuugucagugcauugggaauagggauagacuuuacagauuuauggaaauuaaauuu

SEQ ID NO: 226263 - RNA, 64 nt, Homo Sapiens
ucuuaucuuuugguguugucuugguuuuucucauagacuuuauaaguuugaacuggacuuauuu

SEQ ID NO: 226264 - RNA, 64 nt, Homo Sapiens
ucaguaucuuuaguucuuccuaccuaguaacuugagacuuuaaaagaagaaacauggagaagau

SEQ ID NO: 226265 - RNA, 64 nt, Homo Sapiens
uuugcugucuacagccaacuauucuauuaguuacaaaacucaaucauuuuauucagcaacugga

SEQ ID NO: 226266 - RNA, 64 nt, Homo Sapiens
ucaucaaaaaaauaaaguaaaauagaaaacugagaaaacucaauccaugaccagggagaacuua

SEQ ID NO: 226267 - RNA, 64 nt, Homo Sapiens
agcccauguucucuaaugccacugcucuguuuuaaaaacucagaggcaauuuuuacauaucagu

SEQ ID NO: 226268 - RNA, 64 nt, Homo Sapiens
gguaguagaggauuagguugucuauuauaaaaccaaaacucauucguuuaaugaacuugacugu

SEQ ID NO: 226269 - RNA, 64 nt, Homo Sapiens
cagcgucaaaauaguucaaauaauuuuacgaaaaaaaacucagcuucuguuguuuaucaggcag

SEQ ID NO: 226270 - RNA, 64 nt, Homo Sapiens
ugugguaccauguagagagaugggaugguaucuaaaaacucaaguauuuucgaugauagaggua

SEQ ID NO: 226271 - RNA, 64 nt, Homo Sapiens
cuuguucaagacuagcuaauugucaguuuucugcaaaacucacuucuguacuagaauucagaua

SEQ ID NO: 226272 - RNA, 64 nt, Homo Sapiens
uuaaauacggagacuauaauaaaauuggaaaagaaaaacucaguuuauguugaggcauggaaaa

SEQ ID NO: 226273 - RNA, 64 nt, Homo Sapiens
uggauauaaaagaacaccagagaucagaaauucaaaaacucagaauaaaaaugaaaaagcuaca

SEQ ID NO: 226274 - RNA, 64 nt, Homo Sapiens
guggcauagaguuaauauuuaaaauucaaauauuaaaacucaaauaaaccccaaagaacuuuug

SEQ ID NO: 226275 - RNA, 64 nt, Homo Sapiens
cauuuuuuuuguuccuuuucuuguuacuuuuaagaaaacucaugcucuguuucucugaaucaaa

SEQ ID NO: 226276 - RNA, 64 nt, Homo Sapiens
uaacguccuuaagaccaucuguucagggguucacaaaacucaaauuugugucauucuauuuuau

SEQ ID NO: 226277 - RNA, 64 nt, Homo Sapiens
cucuuaaagagauuuuauggccucuacagagaccaaaacucauuuuccuuuuucuuuuugugua

SEQ ID NO: 226278 - RNA, 64 nt, Homo Sapiens
gaagauaucauguaggcccuaacccaguaucacaaaaacucauauuaugcaauauuauaucacc

SEQ ID NO: 226279 - RNA, 64 nt, Homo Sapiens
auaguaaaagcaccuaguguucaaaaaaaaaaaaaaaacucaagaaggacuauuucucuaaaac

SEQ ID NO: 226280 - RNA, 64 nt, Homo Sapiens
aaaaaaaaaaaaacucaagaaggacuauuucucuaaaacucaaaaguuucuaagucauauuaaa

SEQ ID NO: 226281 - RNA, 64 nt, Homo Sapiens
uguuugguucugggugaagccuauaauauuuuuuaaaacucaccauuaaucauuugaaauuaug

SEQ ID NO: 226282 - RNA, 64 nt, Homo Sapiens
uuuguaacaaaugauaucuauuucauucuuaagaaaaacucauggaaguuaaauagaauuuuua

SEQ ID NO: 226283 - RNA, 64 nt, Homo Sapiens
gaagcaggaaauauugagggcuucuugaucacagaaaacucagaagagauaguaaugcucagga

SEQ ID NO: 226284 - RNA, 64 nt, Homo Sapiens
acauguagauguuuuguguguauuuuuuuaaaugaaaacucaaaauaagacaaguaauuuguug

SEQ ID NO: 226285 - RNA, 64 nt, Homo Sapiens
ucuuaaugaagauguaucuagcaguaacaagcauaaaacucacauaauucauaauugaaaauau

SEQ ID NO: 226286 - RNA, 64 nt, Homo Sapiens
uuuccuucuucauuuuguauucuaucugaaggacaaaacucauuuaucuacauuuuccucagcc

SEQ ID NO: 226287 - RNA, 64 nt, Homo Sapiens
auaaucugaauaucuugaucgaugauaaccaaaaaaaacucauauaauuugugcagcagcaaua

SEQ ID NO: 226288 - RNA, 64 nt, Homo Sapiens
ucagguagcagcuccacuaguuccuaccccucuuaaaacucaguugacccacuacauuuuuucu

SEQ ID NO: 226289 - RNA, 64 nt, Homo Sapiens
cagaaaucauggauuuuaaauauaaauaaagagaaaaacucauuuacucuaauucaacuaaagu

SEQ ID NO: 226290 - RNA, 64 nt, Homo Sapiens
gcugagauaguaaaccaugauucauaaaucauggaaaacucacuauguguucugaauauccuuc

SEQ ID NO: 226291 - RNA, 64 nt, Homo Sapiens
agugucagccacuguacaguuggaaaaaauguuuaaaacucagucaauuuuucucaaagggauc

SEQ ID NO: 226292 - RNA, 64 nt, Homo Sapiens
gccauguggcucacuuauuuaaaaaaaaaaaaaaaaaacucacccguuuuccugggauuuguug

SEQ ID NO: 226293 - RNA, 64 nt, Homo Sapiens
gaaaagccauuuuuaguaggugacuaccauuugaaaaacucaauuggauguauaucugaauguu

SEQ ID NO: 226294 - RNA, 64 nt, Homo Sapiens
aacuguuugguugauuaaaauacaucagcucuuaaaaacucauuaacugaggguaauuacagua

SEQ ID NO: 226295 - RNA, 64 nt, Homo Sapiens
aaagcuucaaugucuuuuuuuuuuuuuucauggaaaaacucaaaccucuguuauuugggagcuc

SEQ ID NO: 226296 - RNA, 64 nt, Homo Sapiens
auguugauauaaucaagauggaaaauaaacucauaaaacucauagacacuauucucuuugauua

SEQ ID NO: 226297 - RNA, 64 nt, Homo Sapiens
gaaucaaagauggauuaaacacuauuauaauacuaaaacucagaggguauggcuuacagugacu

SEQ ID NO: 226298 - RNA, 64 nt, Homo Sapiens
gggagugaauggcaucucguacgaccgucuuuugaaaacucaucgaucccacguugaugucuga

SEQ ID NO: 226299 - RNA, 64 nt, Homo Sapiens
cagugguauugcuaguuuaauuaguuaaucuuugaaaacucauauaaaaaucagaaagacauuc

SEQ ID NO: 226300 - RNA, 64 nt, Homo Sapiens
uucuucagagagauaaaauucaaaaaaaaaaaaaaaaacucagcgacagagugagacuccgucu

SEQ ID NO: 226301 - RNA, 64 nt, Homo Sapiens
acguggccgggcgugguggcguuucuggauccucaaaacucagagugucgcuuuccagccuuuu

SEQ ID NO: 226302 - RNA, 64 nt, Homo Sapiens
uucauucagaaauaucugucacugcucuguugccaaaacucagaauagaacuuagacguauguc

SEQ ID NO: 226303 - RNA, 64 nt, Homo Sapiens
acaaugguuaccauaaaaaaucuggcaggauuuuaaaacucaaucagucuuuccuuugagcuag

SEQ ID NO: 226304 - RNA, 64 nt, Homo Sapiens
cagggacagcagucagaaucgacauaaagcuuuaaaaacucaagguuuuuucaaccuacugagg

SEQ ID NO: 226305 - RNA, 64 nt, Homo Sapiens
ugaaugaagcugagagagagaucuagcaaaagcuaaaacucauguugucuaucuuugaacuugg

SEQ ID NO: 226306 - RNA, 64 nt, Homo Sapiens
agaaaaaaauaaguaucuguguguuuguguauugaaaacucaauauguaaucuuguguuuuuau

SEQ ID NO: 226307 - RNA, 64 nt, Homo Sapiens
ugugccacugcacucuagccugagcaacaagagcaaaacucagucucaaaaaaaaaaaaaaaaa

SEQ ID NO: 226308 - RNA, 64 nt, Homo Sapiens
ccuuuauucugccaagucauuucgaagacaugaaaaaacucacacuggagagaaacccuauaaa

SEQ ID NO: 226309 - RNA, 64 nt, Homo Sapiens
cuuuuauucucccacgucauuucaaagacaugaaaaaacucacacugcagagaaacccuaugaa

SEQ ID NO: 226310 - RNA, 64 nt, Homo Sapiens
uugugucccauaaauuauuucagaaaaugcugauaaaacucaggauauugacauuuuuguugag

SEQ ID NO: 226311 - RNA, 64 nt, Homo Sapiens
uucauacuaggacuugggaugauguagccagaauaaaacucaaguugcacccuccgguuggugg

SEQ ID NO: 226312 - RNA, 64 nt, Homo Sapiens
uaucugaucaauuuggaauauauaaaguguacuaaaaacucaacugaagucaggcaugguagcu

SEQ ID NO: 226313 - RNA, 64 nt, Homo Sapiens
gugaggccucaucucaaaaaaaaaaaaaggccacaaaacucaacaauaaaaacaaacaguccaa

SEQ ID NO: 226314 - RNA, 64 nt, Homo Sapiens
ggccuagaagcugccuguacauccaauaucaugccccacucaaugguuguuuccugagccaagc

SEQ ID NO: 226315 - RNA, 64 nt, Homo Sapiens
guaucugaccauguguguaagacagcucagcguccccacucaguaugaccacuguaggagugau

SEQ ID NO: 226316 - RNA, 64 nt, Homo Sapiens
agcaggcaugaucagggcaggcugugugucugagcccacucagcgcgcaaggaggccaagcuca

SEQ ID NO: 226317 - RNA, 64 nt, Homo Sapiens
acaccuaagccaguggcccuaggaggagguggggcccacucaacgggugcagaagacccauggg

SEQ ID NO: 226318 - RNA, 64 nt, Homo Sapiens
gccaaccacagaaugcccccuuagucccacucaccccacucagggagcuguggggcgaucuuuc

SEQ ID NO: 226319 - RNA, 64 nt, Homo Sapiens
ccacucagggccaaccacagcgaucuuucuuagucccacucaccagaugcagagagcugugggg

SEQ ID NO: 226320 - RNA, 64 nt, Homo Sapiens
cucuucuaagucuucaucucagagacccugaguucccacucagacccacucagccaaaucucau

SEQ ID NO: 226321 - RNA, 64 nt, Homo Sapiens
ucuucaucucagagacccugaguucccacucagacccacucagccaaaucucauggaagaccaa

SEQ ID NO: 226322 - RNA, 64 nt, Homo Sapiens
cauaccuuaggagguggaaagguggaugccaggucccacucaggggaacagggucacccaggag

SEQ ID NO: 226323 - RNA, 64 nt, Homo Sapiens
cuggccuggacaccgccaugugaucagacuaggccccacucagcuugaacgaggagagcacugc

SEQ ID NO: 226324 - RNA, 64 nt, Homo Sapiens
cagugacaaugugcccccugccagccggggcucgcccacucaucauucauucauccauucuaga

SEQ ID NO: 226325 - RNA, 64 nt, Homo Sapiens
caggcugacuuggggggcagacuugacacuaggccccacucacucagauguccugaaauuccac

SEQ ID NO: 226326 - RNA, 64 nt, Homo Sapiens
ccauccuaugagcccacgccgccccacuccuggccccacucacaccacucccaccauccuguga

SEQ ID NO: 226327 - RNA, 64 nt, Homo Sapiens
cuauccugugagaccacgccagaccacgcccggccccacucacucccauucacuccauccugug

SEQ ID NO: 226328 - RNA, 64 nt, Homo Sapiens
acaucuuguaagacugugccgccccacucccggccccacucacaccacucacaccaaccuguga

SEQ ID NO: 226329 - RNA, 64 nt, Homo Sapiens
ccaaccugugagccccacucgccccacucccagccccacucacaccacucacuccauccuguga

SEQ ID NO: 226330 - RNA, 64 nt, Homo Sapiens
ccauccugugagccccacucgccccacucccggccccacucacuccacucccaccauccuguga

SEQ ID NO: 226331 - RNA, 64 nt, Homo Sapiens
ccaucuuguaagacuaugccgccccacucccggccccacucacuccacucacaccaaccuguga

SEQ ID NO: 226332 - RNA, 64 nt, Homo Sapiens
ccaaccugugagccccacucagcccaugcccggccccacucacacccacucccaccauccugug

SEQ ID NO: 226333 - RNA, 64 nt, Homo Sapiens
ccauccugugagucccacucagacugugcccagccccacucacucccacucccaccaucuugua

SEQ ID NO: 226334 - RNA, 64 nt, Homo Sapiens
gguaccugcucaggaccccccgcacugucccaaucccacucaggcccaccuccagcuggccuca

SEQ ID NO: 226335 - RNA, 64 nt, Homo Sapiens
uucguaccugcucaggagcccccacugucccagucccacucaggcccaucucuggcuggccuca

SEQ ID NO: 226336 - RNA, 64 nt, Homo Sapiens
ccugaggguccccagggucccucagcagccccaccccacucaaccucccccggcccccaccacc

SEQ ID NO: 226337 - RNA, 64 nt, Homo Sapiens
ugugugcccacaaguguagucggaagccacaggacccacucaugcucccaaccugccucccgcc

SEQ ID NO: 226338 - RNA, 64 nt, Homo Sapiens
uguguagagugccaucugggccaggggcugaguucccacucacccaaaccaaaggggguuacgu

SEQ ID NO: 226339 - RNA, 64 nt, Homo Sapiens
cuuccaaagggaacaggaacccugugcugcaucacccacucagcucugacguccaagccuuguu

SEQ ID NO: 226340 - RNA, 64 nt, Homo Sapiens
cuugucccaguccacuccuaacacuagcaucagucccacucaucucaggcugagccacaucuca

SEQ ID NO: 226341 - RNA, 64 nt, Homo Sapiens
guuguccugaggggcuccaaagaagacaauaguucccacucaugauuuuccguuacaaacaggc

SEQ ID NO: 226342 - RNA, 64 nt, Homo Sapiens
auucugaauaauuaguuacuuauucucaaagaaaaucuuugaaagaaucaggaggucaagucaa

SEQ ID NO: 226343 - RNA, 64 nt, Homo Sapiens
agcaccaagucaggcucagaugcaacuaaaacacaucuuugagccuuuucuuuuucccuucucc

SEQ ID NO: 226344 - RNA, 64 nt, Homo Sapiens
aaugaaagauaccuaugcaauaacauuuaggauaaucuuugacauuuuggaaaaauaagaauug

SEQ ID NO: 226345 - RNA, 64 nt, Homo Sapiens
agaaaucucucaaaaucuuuccaaauguucugguaucuuugaaaaauguaaauaguuuauuuau

SEQ ID NO: 226346 - RNA, 64 nt, Homo Sapiens
uacccguaaugcuuucuuuuuuccuuuauugccaaucuuugaacucauucaacuccaggacaug

SEQ ID NO: 226347 - RNA, 64 nt, Homo Sapiens
cugaaaaacuaaucauaacuguuaauucucagccaucuuugaagcuugaaagaagagucuuugg

SEQ ID NO: 226348 - RNA, 64 nt, Homo Sapiens
aauaguguuauagccuucauucucugaauaggccaucuuugacucauaaaauuacccuuacugu

SEQ ID NO: 226349 - RNA, 64 nt, Homo Sapiens
uucauaauuuuuccuuuugccaguuuuucacauuaucuuugauaugugagcaacauuuauuauu

SEQ ID NO: 226350 - RNA, 64 nt, Homo Sapiens
aagacuuuaaaaaaaugcuauuuuauccauuaucaucuuugauuuaugagagccuauauaguug

SEQ ID NO: 226351 - RNA, 64 nt, Homo Sapiens
uuuaccacaaaucuucauuuugugacuuggaguuaucuuugacucagugacaaaugaugcccug

SEQ ID NO: 226352 - RNA, 64 nt, Homo Sapiens
aucuaaauuggauggauuugaccaucauucuauuaucuuugauuucuacaaugucuauaucuua

SEQ ID NO: 226353 - RNA, 64 nt, Homo Sapiens
auagucaacucuuaauuaaugcuuauuguaccaaaucuuugagauauuuguacauaaaugaaau

SEQ ID NO: 226354 - RNA, 64 nt, Homo Sapiens
caccucuugaagcuaauuuaaaguuauuaaaauuaucuuugaaauuggaacugauucauaagaa

SEQ ID NO: 226355 - RNA, 64 nt, Homo Sapiens
uaucuugaacuguuuauugcaaacuggauuucuuaucuuugaaaauagcacuuuaucuagauga

SEQ ID NO: 226356 - RNA, 64 nt, Homo Sapiens
accaggguauuaaaauacagaggaguauggucaaaucuuugacaaaauuuucaugaucuucucu

SEQ ID NO: 226357 - RNA, 64 nt, Homo Sapiens
agaaccuguuuaauaagagcaaauauaggggaaaaucuuugaaaugaaagcuacaaauacaugu

SEQ ID NO: 226358 - RNA, 64 nt, Homo Sapiens
ccuuccucucccuccugauagaaaucuggaagucaucuuugacuucuacccauuggcucaagca

SEQ ID NO: 226359 - RNA, 64 nt, Homo Sapiens
caauauguccaaaguggaacgauauuucacaggcaucuuugauuccauuagacaccacuagcug

SEQ ID NO: 226360 - RNA, 64 nt, Homo Sapiens
caucaaauccugaucaaaugacagagagugggucaucuuugaaguuugcuuugguaaugaguuu

SEQ ID NO: 226361 - RNA, 64 nt, Homo Sapiens
ucugacucugcccgcgucuucugacucugccagcaucuuugaccaugaaugugccgagugacuu

SEQ ID NO: 226362 - RNA, 64 nt, Homo Sapiens
agacguauuaaagcucuuuucugcuuaaggugacaucuuugaacacuuuaacacaaaguugacu

SEQ ID NO: 226363 - RNA, 64 nt, Homo Sapiens
uaugguacccaaacucaccauuugguccucuuuaaucuuugaggguuucaauaaaaauuguuca

SEQ ID NO: 226364 - RNA, 64 nt, Homo Sapiens
ccuuuugcucaggaagucuuuggggaaauuaaggaucuuugaagcucugaaauaggugaucagg

SEQ ID NO: 226365 - RNA, 64 nt, Homo Sapiens
acuauuagguaugugagcuugggcaaaucgcuuaaucuuugagucuaguuuucucucaaaauga

SEQ ID NO: 226366 - RNA, 64 nt, Homo Sapiens
auacgugaaugaaaccaggccauagcugucauaaaucuuugacuuuugaauauuuacauucuuc

SEQ ID NO: 226367 - RNA, 64 nt, Homo Sapiens
gauuuucuuuuuuuuacuuuuauacaaaggcagcaucuuugaauuuuuuuuucuuuugauguug

SEQ ID NO: 226368 - RNA, 64 nt, Homo Sapiens
uagggagcucacucccacuggaacagcccauuuuaucuuugaauggucuucugccagcccauuu

SEQ ID NO: 226369 - RNA, 64 nt, Homo Sapiens
cauuaucauucaaaacaaccauccugcucauaacaucuuugaaaagaaaaauauauaugugcag

SEQ ID NO: 226370 - RNA, 64 nt, Homo Sapiens
ugaagcaaguucacuacagcaucaauagaaagucaucuuugagauaauuuaacccugccucuca

SEQ ID NO: 226371 - RNA, 64 nt, Homo Sapiens
gugucugugguccagaagaaauuauuuaauaugcaucuuugagaauauuauaaaaauaucaaaa

SEQ ID NO: 226372 - RNA, 64 nt, Homo Sapiens
gcuguucucaaccacguaguuacaaaaaccaauuaucuuugacuucacuuucucaucccaugug

SEQ ID NO: 226373 - RNA, 64 nt, Homo Sapiens
aauuccguggaguacagaacggcacagagcugccaucuuugacccuuauguaauguggaugcug

SEQ ID NO: 226374 - RNA, 64 nt, Homo Sapiens
uggcagacaaggcgaagcaucuuuucuccuguguaucuuugaaguguuugguuucagacaaaac

SEQ ID NO: 226375 - RNA, 64 nt, Homo Sapiens
uggcagauaaggugaagcaucuuuucuccuguguaucuuugaaggauuucagacaaaauuaacc

SEQ ID NO: 226376 - RNA, 64 nt, Homo Sapiens
ugcaaaacagccagacuugagcugugcucuggucaucuuugaguuuaaggccuuuuguuguaua

SEQ ID NO: 226377 - RNA, 64 nt, Homo Sapiens
cggagguugaaguuggaguuugagguuggaaaauaucuuugaaggcagaaucaguugaguugug

SEQ ID NO: 226378 - RNA, 64 nt, Homo Sapiens
accuaccucuuugucccguuguuuuuuuaauaaaaucuuugaaauuuaguguuauauaucuuug

SEQ ID NO: 226379 - RNA, 64 nt, Homo Sapiens
auuauuuuuaagcgaauuggaaaugaaauuuuuaaucuuugaaauuaaaaaaacacacacacac

SEQ ID NO: 226380 - RNA, 62 nt, Homo Sapiens
gaaucucguuaguagcauguggccuaacaaaaggaaaaaauguuuuuaaacacacacacaca

SEQ ID NO: 226381 - RNA, 62 nt, Homo Sapiens
gaggagacaucuggccuuuuuagaaccugagaggaaaaaaagagucuuuuuuuccccucugu

SEQ ID NO: 226382 - RNA, 62 nt, Homo Sapiens
acgucaccaagaaaacaugcaacucaaacgacggaaaaaaaaagggaaugggaaaaaagaaa

SEQ ID NO: 226383 - RNA, 62 nt, Homo Sapiens
gcaacucaaacgacggaaaaaaaaagggaaugggaaaaaagaaaacagauccugggaggggg

SEQ ID NO: 226384 - RNA, 62 nt, Homo Sapiens
aagcuaucuaccuauccugagucuaucuuaaaggaaaaaaagaaaaaaaccuuaucucuugc

SEQ ID NO: 226385 - RNA, 62 nt, Homo Sapiens
cucuuucauuaauuuguuuuaagcuccguguuggaaaaaagggguagugcauuuuaaauuga

SEQ ID NO: 226386 - RNA, 62 nt, Homo Sapiens
cuaacuccaguuuuacuauuauuauuuugguuggaaaaaaaauucacucuuuacgugcuaau

SEQ ID NO: 226387 - RNA, 62 nt, Homo Sapiens
cucucguaucucaccccaaaccccaaacugggggaaaaaaaguuaacucuuugugaauggaa

SEQ ID NO: 226388 - RNA, 62 nt, Homo Sapiens
gcacuuucugguaaaaaguuaaaaauuuuuaaggaaaaaauaauuucaaugguuaaaguuuu

SEQ ID NO: 226389 - RNA, 62 nt, Homo Sapiens
uuacauuuaaagaucauuugcaccuuuuucaaggaaaaaaaguauugaguaaacaauuguuu

SEQ ID NO: 226390 - RNA, 62 nt, Homo Sapiens
gacaagcuuuauuaaguugagagagagagaggggaaaaaaaaaagccuuucguaguucagua

SEQ ID NO: 226391 - RNA, 62 nt, Homo Sapiens
aaauacaaaauacccaagauuuaagaccggggggaaaaaaccacaaauugguaaauaaaggu

SEQ ID NO: 226392 - RNA, 62 nt, Homo Sapiens
uaaguaaucccagaacaauggcuauucaugugggaaaaaaagaaauuuuacuuucucucacc

SEQ ID NO: 226393 - RNA, 62 nt, Homo Sapiens
ucacaauaagaaugaaucucagaaaauauuaaggaaaaaagcaaguuugaagagaccacaug

SEQ ID NO: 226394 - RNA, 62 nt, Homo Sapiens
aaaaguaaaacaaagacaaaaccaucccaugaggaaaaaaaaaucuacgccauauacccauc

SEQ ID NO: 226395 - RNA, 62 nt, Homo Sapiens
cuuuggaaauagauugaaaaaccccaagggcaggaaaaaagugcacagcggcagcaaggauu

SEQ ID NO: 226396 - RNA, 62 nt, Homo Sapiens
caucaaaucaaauagaaucuaccuguuaauggggaaaaaauaauugcuuucuuuuaugguag

SEQ ID NO: 226397 - RNA, 62 nt, Homo Sapiens
caaaacuuuauaccaaugauuuuaaacuaucaggaaaaaaacguuuuuguacuuuacuaauc

SEQ ID NO: 226398 - RNA, 62 nt, Homo Sapiens
aauuaaaaaaaaaaugcaagggaauacggugaggaaaaaaaauuccccagccacagguaugu

SEQ ID NO: 226399 - RNA, 62 nt, Homo Sapiens
agaugggguaagaaaacuacguuaauuauugaggaaaaaaaaucaaacaaugguuucucugc

SEQ ID NO: 226400 - RNA, 62 nt, Homo Sapiens
aaaccgaagccaguauuuuaggaaauuugaaaggaaaaaaagaaauauguaaagcaauugua

SEQ ID NO: 226401 - RNA, 62 nt, Homo Sapiens
caccuuguggcauuaagucuaauuacucuuggggaaaaaagaaucaugggcuugauugaauu

SEQ ID NO: 226402 - RNA, 62 nt, Homo Sapiens
uuuuaacugaaauauuuauucuucaugcaaauggaaaaaaagaggagauauagugacccaga

SEQ ID NO: 226403 - RNA, 62 nt, Homo Sapiens
uugcaucacacuaauuacaaaauacaaguucuggaaaaaauauuuuucuucauuuuaaaacu

SEQ ID NO: 226404 - RNA, 62 nt, Homo Sapiens
uuuaacuggaguugucaaguaugagucccucaggaaaaaaaaaaaauucuguuuuaaaaagc

SEQ ID NO: 226405 - RNA, 62 nt, Homo Sapiens
ggauggagaaaaaucuaggacagugucuucucggaaaaaaccagccuugaagguaaugaaac

SEQ ID NO: 226406 - RNA, 62 nt, Homo Sapiens
augagaaggauucuuuuucgaauauaaccagaggaaaaaaggauggagaaauaucuaggaaa

SEQ ID NO: 226407 - RNA, 62 nt, Homo Sapiens
cugagaaaccaccaggcuugaagugucuucucggaaaaaaccauccuuggagguaaugaaac

SEQ ID NO: 226408 - RNA, 62 nt, Homo Sapiens
cuuguuuauauuucauacuuuuuauacuuugaggaaaaaaagucaaagaaaaauuguauuug

SEQ ID NO: 226409 - RNA, 62 nt, Homo Sapiens
ggaaaaaaagucaaagaaaaauuguauuugagggaaaaaaccaugaccaaguaaaggauaaa

SEQ ID NO: 226410 - RNA, 62 nt, Homo Sapiens
acccgccgaccuucagcuuugugggacuaucaggaaaaaacaaaacaaaaacaaaauguaga

SEQ ID NO: 226411 - RNA, 62 nt, Homo Sapiens
uugagaauguuaacuuauugcuuuguaucuugggaaaaaaacuuuguaaauaaguuauaaag

SEQ ID NO: 226412 - RNA, 62 nt, Homo Sapiens
aaaaaaaccaauguuuugcaaagaaaaaaaaaggaaaaaaaacauaugcaguaaaagaaaga

SEQ ID NO: 226413 - RNA, 62 nt, Homo Sapiens
aagacaggcugccacaguauuuuuuugguaguggaaaaaaaauuaaaagguaucaauguacc

SEQ ID NO: 226414 - RNA, 62 nt, Homo Sapiens
aaaaagucucugaaauuugauuucuugcuuuuggaaaaaaaauagcuugccuggagaugaug

SEQ ID NO: 226415 - RNA, 62 nt, Homo Sapiens
aaaugccuguaccuacaauguucauuguuuaaggaaaaaaaacauguugagaucauuguugu

SEQ ID NO: 226416 - RNA, 62 nt, Homo Sapiens
uuuccacuuagauauuuuacgcuauagaguugggaaaaaauauacugggacuuuuaaaucua

SEQ ID NO: 226417 - RNA, 62 nt, Homo Sapiens
caggaaaauauaucaaaucacuugguaggaggggaaaaaagugcugggagagacuaggaagg

SEQ ID NO: 226418 - RNA, 62 nt, Homo Sapiens
uagauucugaaccauuuauuagggaaaaaugaggaaaaaaaaauaagcuauaacaucaaauc

SEQ ID NO: 226419 - RNA, 62 nt, Homo Sapiens
guccuaggagaaagcgacguucauaccaugggggaaaaaaaauguggcuuuuagggcuuggu

SEQ ID NO: 226420 - RNA, 62 nt, Homo Sapiens
uuuaggaaacucaccuuccuaaaagauuuguuggaaaaaauuggugaucuaauccuaaauuu

SEQ ID NO: 226421 - RNA, 62 nt, Homo Sapiens
uauucaauaagagauuaggaaguagcaauuauggaaaaaaaacuuuggcaacccuuuugaaa

SEQ ID NO: 226422 - RNA, 62 nt, Homo Sapiens
aacaggucaaugaaugaaacauggauuuuauaggaaaaaauaauaauacagugggcuucugg

SEQ ID NO: 226423 - RNA, 62 nt, Homo Sapiens
cccuuugacugaucagugugauaaggacuuuaggaaaaaaagcauguauguuuuuuacuguu

SEQ ID NO: 226424 - RNA, 62 nt, Homo Sapiens
cguuaaucuugcugcuuaugugccaauuuaguggaaaaaaacaacccuugcugaaaaauucc

SEQ ID NO: 226425 - RNA, 62 nt, Homo Sapiens
uaguuuauaaugucuuacuaaugcagaaacaaggaaaaaagcaaaauuggccugaauauucu

SEQ ID NO: 226426 - RNA, 62 nt, Homo Sapiens
uaguugauucacaguacagaacaagguauaaaggaaaaaacccugcuagguaguguuauaau

SEQ ID NO: 226427 - RNA, 62 nt, Homo Sapiens
cugaagauacaugucuuucuccagggacauguggaaaaaaaaaagauguuauacaaccauca

SEQ ID NO: 226428 - RNA, 62 nt, Homo Sapiens
aaaggguaucccaaaaauaaaacuauccuuuuggaaaaaaaaagauuuaaaauaauuccugg

SEQ ID NO: 226429 - RNA, 62 nt, Homo Sapiens
aaggcgagcuaagaggagacuuagauccagugggaaaaaaaauagcguuucacauaaaaagc

SEQ ID NO: 226430 - RNA, 62 nt, Homo Sapiens
acacaccaaaaaagugaaagagaaauugaaagggaaaaaagacaaaaagcauaaggcuccaa

SEQ ID NO: 226431 - RNA, 62 nt, Homo Sapiens
ucugcaaaaaggaaaaagaaaccacaaauuggggaaaaaaaaagaagaaaaaccuguuuccg

SEQ ID NO: 226432 - RNA, 62 nt, Homo Sapiens
gaagagaggagagggagaaaaauaaaaugaaaggaaaaaaaaaaguuugcaaauucagacag

SEQ ID NO: 226433 - RNA, 62 nt, Homo Sapiens
gcuugacacccaccaagcaaaaguuucagccuggaaaaaaaaugggggggaaggguggauga

SEQ ID NO: 226434 - RNA, 62 nt, Homo Sapiens
uggggugccagaaagugucugcugauauuuguggaaaaaaaaucuauuuuguuuaccuacug

SEQ ID NO: 226435 - RNA, 62 nt, Homo Sapiens
uggagaaaacccgguacgcucaaaaagaaaaaggaaaaaaaaaaaucccaucacccacagca

SEQ ID NO: 226436 - RNA, 62 nt, Homo Sapiens
ggacauuuuaauuguuuaaaaauuguacaaaaggaaaaaauuagaauaaguacuggcgaacc

SEQ ID NO: 226437 - RNA, 62 nt, Homo Sapiens
cuacuguauguaacggaauuaaaaauagcuuuggaaaaaaaauuauauuaacgauacuaaaa

SEQ ID NO: 226438 - RNA, 62 nt, Homo Sapiens
aaaaacacgucaaaaguuagagauuggaaaaaggaaaaaaaacgggccaaccccgagaauga

SEQ ID NO: 226439 - RNA, 62 nt, Homo Sapiens
caugcugauacagcuggcuauuuaugauguacggaaaaaaacgcauagagaaacaaaaaucu

SEQ ID NO: 226440 - RNA, 62 nt, Homo Sapiens
uuugcagacaccugcccuaauuggcacuuuuuggaaaaaaagagagccaaaauaaauauacu

SEQ ID NO: 226441 - RNA, 62 nt, Homo Sapiens
uuaaauuuugaauugaguguguuauuuaaggaggaaaaaauacugccucaugacaaguacau

SEQ ID NO: 226442 - RNA, 62 nt, Homo Sapiens
guauuuuugagaauaacauauuugauuuuauaggaaaaaauaaaaaguguggccacugagca

SEQ ID NO: 226443 - RNA, 62 nt, Homo Sapiens
gccaccauucuugguauaaucuguauagauggggaaaaaauuuugccacuagauggcagugc

SEQ ID NO: 226444 - RNA, 62 nt, Homo Sapiens
gucuugcaaugugcuguaaucguuuauuaaaaggaaaaaaauggaaacucagaguacuagga

SEQ ID NO: 226445 - RNA, 62 nt, Homo Sapiens
gaagaaacugccgcucugagacugcacauccaggaaaaaagacuaggacuugccacacacug

SEQ ID NO: 226446 - RNA, 62 nt, Homo Sapiens
gccuauuaucuggaugucccuugccuagagcaggaaaaaagucucagaauuaccuaaaaaca

SEQ ID NO: 226447 - RNA, 62 nt, Homo Sapiens
uugcuccuccauagauuuuuuuuucuauaaagggaaaaaaguuucauaucacacaaaaugaa

SEQ ID NO: 226448 - RNA, 62 nt, Homo Sapiens
agaguucauaguuugagcugcuaaggcauaaaggaaaaaaacuucuuggagaauuuggaugc

SEQ ID NO: 226449 - RNA, 62 nt, Homo Sapiens
aaaauuuuccuuuaugauuccaaauagucgggggaaaaaauuucaauuauuucccaucucca

SEQ ID NO: 226450 - RNA, 62 nt, Homo Sapiens
ccauagugccuugauuuuaagguuauuugaggggaaaaaaccuuuagucagaaaugauucag

SEQ ID NO: 226451 - RNA, 62 nt, Homo Sapiens
uguucuauuuuuacaucuuucacauucagaguggaaaaaauuaaguacauugguaauuuggg

SEQ ID NO: 226452 - RNA, 62 nt, Homo Sapiens
aagaacucuuagacacugcuggugaagaugcgggaaaaaaaauaaaauaaaaauaacauauu

SEQ ID NO: 226453 - RNA, 62 nt, Homo Sapiens
uauuugaagauggagcacugcugauuuaugaaggaaaaaagaagaauuuucuaaagauuaca

SEQ ID NO: 226454 - RNA, 62 nt, Homo Sapiens
ucaggauuuaagucugagguagucaacccucaggaaaaaaaaaauggcuuaucugaaaucag

SEQ ID NO: 226455 - RNA, 62 nt, Homo Sapiens
uaauuaugacaugagaaugaagaaauuauuuuggaaaaaaaaaaugaccuaauuuaccuauc

SEQ ID NO: 226456 - RNA, 62 nt, Homo Sapiens
gcuuauggcaugaucucuggaacaaauuuguaggaaaaaauuacuccaauugaaugacugau

SEQ ID NO: 226457 - RNA, 62 nt, Homo Sapiens
auuaaccuccuaaaaggaauucauauuuuaaaggaaaaaaauacaacuaaugaugcacauuu

SEQ ID NO: 226458 - RNA, 62 nt, Homo Sapiens
cauaugguauugugauuuucuuuccccugcuaggaaaaaauugcacugaaaugcugacaaaa

SEQ ID NO: 226459 - RNA, 62 nt, Homo Sapiens
aaaacaucaguaacaaaagauuaacuguucuuggaaaaaauacaauaggugccuaguaaaug

SEQ ID NO: 226460 - RNA, 62 nt, Homo Sapiens
aauauuuagcaguauuguucaaaaaaaaagcaggaaaaaaggccaguauguuuuaacaaaaa

SEQ ID NO: 226461 - RNA, 62 nt, Homo Sapiens
auaacaaaauguuuuauuuuuuuucuauaaaaggaaaaaaguaagaaauaaaaauauuuuua

SEQ ID NO: 226462 - RNA, 62 nt, Homo Sapiens
aauaaaaauauuuuuauuuuggagagaaaggaggaaaaaagagagaccagagaccgccuacu

SEQ ID NO: 226463 - RNA, 62 nt, Homo Sapiens
aaaugaaaugaagagugggaauuugguccucuggaaaaaaaaaauguaauauguaaacugug

SEQ ID NO: 226464 - RNA, 62 nt, Homo Sapiens
accauguaagauaugugugcuuuacaaauaaaggaaaaaagaugacacaaucucuuuauaau

SEQ ID NO: 226465 - RNA, 62 nt, Homo Sapiens
agcaccguuuguucugugagcuggaaacagaaggaaaaaacauacccuuggguacccauagc

SEQ ID NO: 226466 - RNA, 62 nt, Homo Sapiens
gauaaugaaaagugauaucuucgcauacgaaaggaaaaaagguugagguauauaugauuuuu

SEQ ID NO: 226467 - RNA, 62 nt, Homo Sapiens
uccuuaagauuuaaaaaaaaaaaaaaaaaaaaggaaaaaaaagugauggaagccguaagugc

SEQ ID NO: 226468 - RNA, 62 nt, Homo Sapiens
gucuauuuuuucucuucauguuguaacaaaaaggaaaaaagaaaaaaaaaucccaucccuuu

SEQ ID NO: 226469 - RNA, 62 nt, Homo Sapiens
aaaaggacagacgaagaguuuaaagagaaaagggaaaaaagaaagaaaaaguaagcagggcu

SEQ ID NO: 226470 - RNA, 62 nt, Homo Sapiens
acaggggcagucaguggagggcgagugguuucggaaaaaaaaaaagaaaaaaagaaaaaaaa

SEQ ID NO: 226471 - RNA, 62 nt, Homo Sapiens
uaaaauucaaggccacaaaaacaauguuugggggaaaaaaaagaaaaaaucaugccagcuaa

SEQ ID NO: 226472 - RNA, 62 nt, Homo Sapiens
auaccuggcaaaacuaaauaaauuaccaaaaaggaaaaaaaauccaccaaaccaugauaaac

SEQ ID NO: 226473 - RNA, 62 nt, Homo Sapiens
guuuauuuauuguggauucccaucaggaaagaggaaaaaauacacauguucuuucauauagg

SEQ ID NO: 226474 - RNA, 62 nt, Homo Sapiens
ggaagcauauaccggggaauguguagccuucaggaaaaaaaugccaauugacacaaagcauu

SEQ ID NO: 226475 - RNA, 62 nt, Homo Sapiens
ucacauuuugauuuauuagguacuagcacugaggaaaaaaaauucagcacuuggacuaucau

SEQ ID NO: 226476 - RNA, 62 nt, Homo Sapiens
aacacuacaagucuugaguuaagaaggaaagaggaaaaaagaaaaaacaccaauacccagau

SEQ ID NO: 226477 - RNA, 62 nt, Homo Sapiens
ugcuuucuuuuccagucgucuuugagaauaaaggaaaaaaaaaucuucagaugcaaugguuu

SEQ ID NO: 226478 - RNA, 62 nt, Homo Sapiens
cuuuuaugaaagccaaagacugcuugcuaguaggaaaaaauuucaaauaauaaccaaagcug

SEQ ID NO: 226479 - RNA, 62 nt, Homo Sapiens
caccaucugcaaccauaugcuauuaauaaaauggaaaaaaacaaaauggucauuuugcauau

SEQ ID NO: 226480 - RNA, 62 nt, Homo Sapiens
uucuuuugcucucauagaaaaauuuugaacuuggaaaaaaguuaaauaauaaaacuugucau

SEQ ID NO: 226481 - RNA, 62 nt, Homo Sapiens
gauccuuuucaaaaagauuauggacaagagugggaaaaaagaugcucugauaugugaaguaa

SEQ ID NO: 226482 - RNA, 62 nt, Homo Sapiens
uugucgcuauuugagaaucugaaaaaaaaucaggaaaaaagcauaacaaaguugcuaggcag

SEQ ID NO: 226483 - RNA, 62 nt, Homo Sapiens
ucaggaaaaaagcuugucgcaguugcuaggcaggaaaaaaaagacagugaggauaauaacaa

SEQ ID NO: 226484 - RNA, 62 nt, Homo Sapiens
cauugguauaugguggcuguuuaccaauaaaaggaaaaaauucauuaaccgguugcuuccaa

SEQ ID NO: 226485 - RNA, 62 nt, Homo Sapiens
agaguuauccacuguauuuauaaggaagagucggaaaaaacaaugaccuuaguuuuuuuuaa

SEQ ID NO: 226486 - RNA, 62 nt, Homo Sapiens
cucacucauucccauguuguaaaguaaauuaaggaaaaaaucaaaaaaauguaagaggaaaa

SEQ ID NO: 226487 - RNA, 62 nt, Homo Sapiens
uaaauuaaggaaaaaauccuaaaaauguaagaggaaaaaaagucaauggagcaugugugcaa

SEQ ID NO: 226488 - RNA, 61 nt, Homo Sapiens
auguauaaccuuguaagugaaguacugucaagggaaaaaauauauggaugaaaauuaauaa

SEQ ID NO: 226489 - RNA, 62 nt, Homo Sapiens
aaagaaaaaagaaaaagccgcccgucucucucggaaaaaaaaccugggcaacauggugaccu

SEQ ID NO: 226490 - RNA, 62 nt, Homo Sapiens
uuuuucucuguaagaaaguuauacauuuuuaaggaaaaaagauucagccauuuuugccacau

SEQ ID NO: 226491 - RNA, 62 nt, Homo Sapiens
aucuacguuuuuaguuuuuuugaaacuguauaggaaaaaaguuacagcauauuuaagucuug

SEQ ID NO: 226492 - RNA, 62 nt, Homo Sapiens
uaaaaccuuuuagugacaaaauccuaauauguggaaaaaagcauaugcauaaaggaauaaua

SEQ ID NO: 226493 - RNA, 62 nt, Homo Sapiens
auuuuccuguuuuucccccuuugaaaaacucaggaaaaaaggaagauugaacuaauaaaauu

SEQ ID NO: 226494 - RNA, 62 nt, Homo Sapiens
ucacauuuuaauuuagcaaauugauuuaccuaggaaaaaauuaucaccuucaaagauaggca

SEQ ID NO: 226495 - RNA, 62 nt, Homo Sapiens
uucuauaaugcuuauuaugguaaaauaaaauuggaaaaaauuaaaacugaccuauaagagug

SEQ ID NO: 226496 - RNA, 62 nt, Homo Sapiens
aguggucuguaucucaacauuuucuuuuuaaaggaaaaaauauauauauauaguuucuuuuu

SEQ ID NO: 226497 - RNA, 62 nt, Homo Sapiens
ucucuuacuacguacucacagguuugcaaaugggaaaaaaguuuacauuucaguuuaggggc

SEQ ID NO: 226498 - RNA, 62 nt, Homo Sapiens
gcacuuaaaguugcauugccuacuguuauacuggaaaaaauagaguucaagaauaauaugac

SEQ ID NO: 226499 - RNA, 62 nt, Homo Sapiens
aagugugauagcgauauuagugccaaucaaauggaaaaaagguaguuuuaauaaacaagaca

SEQ ID NO: 226500 - RNA, 62 nt, Homo Sapiens
uaaguaauuuuuaguucuauauauaaaguacuggaaaaaagcuuuaaaaaagaucucaauuu

SEQ ID NO: 226501 - RNA, 62 nt, Homo Sapiens
ccacaaaaaucagcacuccuuguuuccuucugggaaaaaaccuuuuuccccuauuuauucuu

SEQ ID NO: 226502 - RNA, 62 nt, Homo Sapiens
ggacaaccucuugacuagguuaaccaugcaauggaaaaaaauaguuucuggggaaagaauag

SEQ ID NO: 226503 - RNA, 62 nt, Homo Sapiens
gaaauccaugaauccauacuccaauuccauugggaaaaaauagaaaaaaauaaaauaaauuc

SEQ ID NO: 226504 - RNA, 62 nt, Homo Sapiens
acucuuuuugguuguccucaaaaaaaaaaaaaggaaaaaaagugauauuucucuaguaguua

SEQ ID NO: 226505 - RNA, 62 nt, Homo Sapiens
aaaagaggaaaacccucaagauauacaauaauggaaaaaaaauaaaagucacaauguucuuu

SEQ ID NO: 226506 - RNA, 62 nt, Homo Sapiens
aucuuuaacagcucuuuguuauuaaugagaagggaaaaaaguggauucuuuucuaagguaau

SEQ ID NO: 226507 - RNA, 62 nt, Homo Sapiens
gguagcacuuauucauuccauaugccuacuuaggaaaaaaaggaaggaaaugaaaauauuuu

SEQ ID NO: 226508 - RNA, 62 nt, Homo Sapiens
aacuuauuuuucuaguaaauggagaacaaauaggaaaaaaaauuauuucauuaaagaaguug

SEQ ID NO: 226509 - RNA, 62 nt, Homo Sapiens
cagaagaaaagcaaaugacuaguaaacaugugggaaaaaauauuacauuuuaagggggaaaa

SEQ ID NO: 226510 - RNA, 62 nt, Homo Sapiens
aacaugugggaaaaaauauuacauuuuaagggggaaaaaaaaacccaccauucucuucuccc

SEQ ID NO: 226511 - RNA, 62 nt, Homo Sapiens
ggacaacauagggagaccccaucucuaccggaggaaaaaaaaaagagucaggccugguggug

SEQ ID NO: 226512 - RNA, 62 nt, Homo Sapiens
gagugagaccuugucucaaaaaaguaacauaaggaaaaaagaagccuugcuuuagcacaggu

SEQ ID NO: 226513 - RNA, 62 nt, Homo Sapiens
aguuugaacacaaaggcucuaaaaagaaaaaaggaaaaaaacaaaaaugaaaaaaaaaggaa

SEQ ID NO: 226514 - RNA, 62 nt, Homo Sapiens
aaaaaaggaaaaaaacaguuaugaaaaaaaaaggaaaaaaagaaaucuuaaaaaaagaaaaa

SEQ ID NO: 226515 - RNA, 62 nt, Homo Sapiens
cacauaauacaaacauacauagggagagaggaggaaaaaauacucucuagagcgagcaagag

SEQ ID NO: 226516 - RNA, 62 nt, Homo Sapiens
guauagcaccaagccaguauaaauauuaacuaggaaaaaacauacguagacagaaauaauaa

SEQ ID NO: 226517 - RNA, 62 nt, Homo Sapiens
aaaaauuauuccagugcacaacuuuuugccaaggaaaaaaauuuuuaaaaauguagcacuug

SEQ ID NO: 226518 - RNA, 62 nt, Homo Sapiens
uuauauauauauucuccuuuagaagggaaauuggaaaaaaaacccccucuucucugggugua

SEQ ID NO: 226519 - RNA, 62 nt, Homo Sapiens
gagcgcuuucuagggucagauacacccagggaggaaaaaaaguaaugauaccccaaaaugau

SEQ ID NO: 226520 - RNA, 62 nt, Homo Sapiens
ugugaacuaacuuauuuaauuuaagugcugggggaaaaaaaacauuagagacuaacuguaac

SEQ ID NO: 226521 - RNA, 62 nt, Homo Sapiens
ugucgucuuuaaugccuacuuuaugaauaaaaggaaaaaaccaaauuguugcaaauuuguuu

SEQ ID NO: 226522 - RNA, 62 nt, Homo Sapiens
auguuaacacaucacaggucuguagcuuuuagggaaaaaaaaaagagagguuauggagguac

SEQ ID NO: 226523 - RNA, 62 nt, Homo Sapiens
auguuuuaaauuucaaaaugauaauuuuauuaggaaaaaaucauaagaugucagaauaacua

SEQ ID NO: 226524 - RNA, 62 nt, Homo Sapiens
uuuuuuucaauaaucuuauuaaaagaaaaucaggaaaaaaauuacaaaaauaaccuucagga

SEQ ID NO: 226525 - RNA, 62 nt, Homo Sapiens
aaguuguuugcuuaaaaaaaauuucaugugagggaaaaaaaaaaaaccuauuccagaauaag

SEQ ID NO: 226526 - RNA, 62 nt, Homo Sapiens
acagaaaacaauuccacgaggccaaucuaaagggaaaaaauccuacacuacuuuuacuacuu

SEQ ID NO: 226527 - RNA, 62 nt, Homo Sapiens
aacuucuucugguugauaccugagacuguuaaggaaaaaaauuuuaaaccccugauuuauau

SEQ ID NO: 226528 - RNA, 62 nt, Homo Sapiens
uauagauguaaaaugaaauuucauuuguaauuggaaaaaauccaauaaaaaggauauucauu

SEQ ID NO: 226529 - RNA, 62 nt, Homo Sapiens
aguucucacaguauagaagagaacuuaaagagggaaaaaacaauaugaagauagggaaugca

SEQ ID NO: 226530 - RNA, 62 nt, Homo Sapiens
uggaccauacacuauguuacaaaacuaaaaguggaaaaaacuuauuggugaaugaauauagg

SEQ ID NO: 226531 - RNA, 62 nt, Homo Sapiens
guugcaggauaucuagcaauuuaagaaaauguggaaaaaauauuuuuauugagaaauagcau

SEQ ID NO: 226532 - RNA, 62 nt, Homo Sapiens
uagccuggaagacagagugagaccccaucucaggaaaaaagaaaaaaaaaaagaugucauuc

SEQ ID NO: 226533 - RNA, 62 nt, Homo Sapiens
gugaggaaggaugggccuugcugaaguguggaggaaaaaauuaugaacgggccaaggccugc

SEQ ID NO: 226534 - RNA, 62 nt, Homo Sapiens
agaucagccauauuucauuuugaaucugcaguggaaaaaaagcccacauuugagguggcuca

SEQ ID NO: 226535 - RNA, 62 nt, Homo Sapiens
aucuaauagucaccuaaaauaucuuuuuuguuggaaaaaaguuuauaauaaaaaaguuuguc

SEQ ID NO: 226536 - RNA, 62 nt, Homo Sapiens
aauguuuauuaaguagcuagaaauaauuauguggaaaaaaaugaauaauggaaaauagugag

SEQ ID NO: 226537 - RNA, 62 nt, Homo Sapiens
uuagaguauuucccuuccaaagagggauguuuggaaaaaacucugaaggagaggaggaauua

SEQ ID NO: 226538 - RNA, 62 nt, Homo Sapiens
acagccuagggcagacaauaguauagaagucuggaaaaaaacaaaaacagaauuugagaacc

SEQ ID NO: 226539 - RNA, 62 nt, Homo Sapiens
cuucaauuccauauauccuuuucuucuauguaggaaaaaaauagucuaguguaguauucuuc

SEQ ID NO: 226540 - RNA, 62 nt, Homo Sapiens
aggcuuucagcuuacacaaaucuauuuaauuaggaaaaaaacuauuaaggauguagcuuuuc

SEQ ID NO: 226541 - RNA, 62 nt, Homo Sapiens
auggagcaaaagagacagggagagguggagaaggaaaaaacccuacaaaacaaaaacaaacc

SEQ ID NO: 226542 - RNA, 62 nt, Homo Sapiens
ggugcccacaaaaagaaucaggacuuguacugggaaaaaaaccccuaaauuaauuauauuuc

SEQ ID NO: 226543 - RNA, 62 nt, Homo Sapiens
caagggaauuccagucaggcuuuaucaucuaaggaaaaaagacagcaaggcauguuacuacu

SEQ ID NO: 226544 - RNA, 62 nt, Homo Sapiens
gucaucuccccccaccucauuuuauugcaaggggaaaaaaauccguuucaagaccuuuuucu

SEQ ID NO: 226545 - RNA, 62 nt, Homo Sapiens
cagagagcaaagugcauuacauaagguagaauggaaaaaaccuuuuaauuaaugcacuuuaa

SEQ ID NO: 226546 - RNA, 62 nt, Homo Sapiens
ggggugggggguggggggugacaaaagggaaaggaaaaaaugcuggaugagcggugagacga

SEQ ID NO: 226547 - RNA, 62 nt, Homo Sapiens
aucugaacaauccuacagggaaaucagaauuaggaaaaaaaucuggagaacaauaugguuga

SEQ ID NO: 226548 - RNA, 62 nt, Homo Sapiens
gagugauacauugugggaacccucagaagauaggaaaaaagcauggaauagauucucccuca

SEQ ID NO: 226549 - RNA, 62 nt, Homo Sapiens
cugaccccagauucaacuuugcaaacaacaggggaaaaaaauggggaaaagaaaaaccacga

SEQ ID NO: 226550 - RNA, 62 nt, Homo Sapiens
aaaaaauggggaaaagaaaaaccacgagagagggaaaaaaaauuauucugcaccuguaaaaa

SEQ ID NO: 226551 - RNA, 62 nt, Homo Sapiens
uaaguucuucaaacacccauuuuugcucuaugggaaaaaaacgauuuaccaauuaauauuac

SEQ ID NO: 226552 - RNA, 62 nt, Homo Sapiens
gguauugcacuacauuauggaaucaugcaaaaggaaaaaaaguuucaugauaucuguuguug

SEQ ID NO: 226553 - RNA, 62 nt, Homo Sapiens
ggaaauaucaucguauuucuuuuuuuuaauaaggaaaaaauaauauccauacagucaagaua

SEQ ID NO: 226554 - RNA, 62 nt, Homo Sapiens
guuuugacuugaauaaaguacuacaucaguguggaaaaaaauucugauacauuagcagcuau

SEQ ID NO: 226555 - RNA, 62 nt, Homo Sapiens
cuuuuuuuuaaauuaaaaagcuuuguaucuggggaaaaaaaauuuuaugcaagggcaaaaau

SEQ ID NO: 226556 - RNA, 62 nt, Homo Sapiens
guggaucagugauuuuacuuuguguccaggaaggaaaaaaagaggcagggaagaaggaugug

SEQ ID NO: 226557 - RNA, 62 nt, Homo Sapiens
cacuuugggagaaaauaaaaacauuuauaggaggaaaaaaauacccucaguuaagcauguua

SEQ ID NO: 226558 - RNA, 62 nt, Homo Sapiens
uuguauuuuccugaagcuaccuuaaccagaagggaaaaaaagugcuccaaauucuuauuuua

SEQ ID NO: 226559 - RNA, 62 nt, Homo Sapiens
ccugauuaaagaguuucugcuguuuuagaguuggaaaaaaaguuaaggaaaaaaugggauuu

SEQ ID NO: 226560 - RNA, 62 nt, Homo Sapiens
ggauuuuguuuuagaguuggaacuaaauuuaaggaaaaaaugaaaguucucuguuccugagg

SEQ ID NO: 226561 - RNA, 62 nt, Homo Sapiens
uuugauguaacaauuuuuuacacagauuugaaggaaaaaaauacuguuguuugguuaaagga

SEQ ID NO: 226562 - RNA, 62 nt, Homo Sapiens
acuagugugaaguuuacaguuaauacuaacugggaaaaaaaaauuaaaaauuuucuaaauau

SEQ ID NO: 226563 - RNA, 62 nt, Homo Sapiens
aaacaaacaaaaaaaaauuuuaaacaaagaaaggaaaaaaauugacaauaaaagucacucuu

SEQ ID NO: 226564 - RNA, 62 nt, Homo Sapiens
agauucuuucuucugaaagccaagcaccacaaggaaaaaaaaaauuauuaauagcucagguu

SEQ ID NO: 226565 - RNA, 62 nt, Homo Sapiens
agcuuacuugaacuaauuacuugaaaacugguggaaaaaagagaccaacuuuguuauuuuuu

SEQ ID NO: 226566 - RNA, 62 nt, Homo Sapiens
gcaugugccucacuuuaagaaaguccuguaggggaaaaaaaaaacugucagagcgaauucau

SEQ ID NO: 226567 - RNA, 62 nt, Homo Sapiens
caaaguuaagaucgaauccauccgcuuguaggggaaaaaaaggaaaaaaauuaaccagagag

SEQ ID NO: 226568 - RNA, 62 nt, Homo Sapiens
gaucgaauccauccgcuuguaggggaaaaaaaggaaaaaaauuaaccagagagggucuguaa

SEQ ID NO: 226569 - RNA, 62 nt, Homo Sapiens
uaauguaguugaacuuuuuaaauuuuugaauuggaaaaaaauucuaaugaaacccugauauc

SEQ ID NO: 226570 - RNA, 62 nt, Homo Sapiens
aagguuaaucaggaaaaauagcuuuugacaggggaaaaaacucaauaacuagcuauuuuuga

SEQ ID NO: 226571 - RNA, 62 nt, Homo Sapiens
gcuacuugugaggcagaagaguuuucugugaaggaaaaaagcccauuagaguucuucaauuc

SEQ ID NO: 226572 - RNA, 62 nt, Homo Sapiens
uauauuuuaagacuuuaaguagaauaaacccuggaaaaaagaucaagaguaaaaauauauag

SEQ ID NO: 226573 - RNA, 62 nt, Homo Sapiens
caugauugauuagcaaugucugcacuggauacggaaaaaagaaggugcuugcagguuuacag

SEQ ID NO: 226574 - RNA, 62 nt, Homo Sapiens
augcaguuagguggcucuuuccaagacucuggggaaaaaaguaguaaaaagcuaaaugcaau

SEQ ID NO: 226575 - RNA, 62 nt, Homo Sapiens
uguauuaacucauacugccugucuuuuauaggggaaaaaaauaaccuuuuuuauuuuaaagu

SEQ ID NO: 226576 - RNA, 62 nt, Homo Sapiens
caccagcagguuccaaauugauguguaugauaggaaaaaaaccuuaauuuuaaauauaauau

SEQ ID NO: 226577 - RNA, 62 nt, Homo Sapiens
accagcacgcugucucagaaaacgaaaacggaggaaaaaaaccccaaaccccaaacaaucuu

SEQ ID NO: 226578 - RNA, 62 nt, Homo Sapiens
cguggaacuacacacgaaguguaauuagugggggaaaaaauauuuuuuaaacaaaggauaua

SEQ ID NO: 226579 - RNA, 62 nt, Homo Sapiens
aaaagcauaaaaaaccacagaaaaaaaaaaaaggaaaaaaccgcuaaaugaaauaaagugga

SEQ ID NO: 226580 - RNA, 62 nt, Homo Sapiens
aaaaaggaaaaaaccaaaagaugaaauaaaguggaaaaaaaaucuagccacugagcggcuaa

SEQ ID NO: 226581 - RNA, 62 nt, Homo Sapiens
gaugugacagggagugaagaaugaaaguguugggaaaaaaguagcagagcaaaauauggaua

SEQ ID NO: 226582 - RNA, 62 nt, Homo Sapiens
auccaagaaauguauugaauuuccugcaguuaggaaaaaaaagagcguuuuuauguaugcug

SEQ ID NO: 226583 - RNA, 62 nt, Homo Sapiens
ugguuucacaccucuuguuaaagguuuugaagggaaaaaaaggaaccuuaaaaaaaaaaaaa

SEQ ID NO: 226584 - RNA, 62 nt, Homo Sapiens
aaauuaaugaaccuuaaaaacuuuuguaaucaggaaaaaaaagaccaaaaaaugagguuuug

SEQ ID NO: 226585 - RNA, 62 nt, Homo Sapiens
uauuugaagaaagaaaaaacagauuuuaggguggaaaaaacagucaacucacacaaagaaug

SEQ ID NO: 226586 - RNA, 62 nt, Homo Sapiens
gguggaaaaaacagucaacucacacaaagaauggaaaaaaauacugaguuaaauuaagcaaa

SEQ ID NO: 226587 - RNA, 62 nt, Homo Sapiens
guuaauucuaauuaucuauuucaaauuuagcaggaaaaaagagaacaucaccuuguaaaacu

SEQ ID NO: 226588 - RNA, 62 nt, Homo Sapiens
agguuuaauaaauagccuuaacuauuuggaggggaaaaaaugggucaacuuuuuuuuuuuuu

SEQ ID NO: 226589 - RNA, 62 nt, Homo Sapiens
uuggauuaaaggguuguaacugacuacagcauggaaaaaaauaguucuuuuaauucuuucac

SEQ ID NO: 226590 - RNA, 62 nt, Homo Sapiens
uagaugcaccaaccguaucauuauuuguuugaggaaaaaaagaaaucugcauuuuaauucau

SEQ ID NO: 226591 - RNA, 62 nt, Homo Sapiens
ggauuuauauauauaagguuuucuucuacaaaggaaaaaauuuuuguaaaauuauuuugguu

SEQ ID NO: 226592 - RNA, 62 nt, Homo Sapiens
uugauuaggaccacagauuuuuucuuuuucuuggaaaaaaaguguauuuuaaacacauaucg

SEQ ID NO: 226593 - RNA, 62 nt, Homo Sapiens
agacaagucuaguggaaccaaaauaugagauuggaaaaaauuucaccuaucuggaaaaaaaa

SEQ ID NO: 226594 - RNA, 62 nt, Homo Sapiens
aaauaugagauuggaaaaaauuucaccuaucuggaaaaaaaaggaaggcacacugagcaagu

SEQ ID NO: 226595 - RNA, 62 nt, Homo Sapiens
guauaaaagguugccaaauugcacuguaaugaggaaaaaaugcggcagugucauuccccuuu

SEQ ID NO: 226596 - RNA, 62 nt, Homo Sapiens
uguagcgacagcauuuuaagcugaauuggaagggaaaaaaaacuaugguaacacuuugcuuu

SEQ ID NO: 226597 - RNA, 62 nt, Homo Sapiens
aaaaagcaauuagguagcacgaaaguuggaaaggaaaaaagacugcugcugccucugaaaca

SEQ ID NO: 226598 - RNA, 62 nt, Homo Sapiens
acuaaaaaaaguguguauuaggaggagagagaggaaaaaaagaggaaagaaggaaaaaaaaa

SEQ ID NO: 226599 - RNA, 62 nt, Homo Sapiens
aggaggagagagaggaaaaaaagaggaaagaaggaaaaaaaaaagaauuaaaaaaaaaaaaa

SEQ ID NO: 226600 - RNA, 62 nt, Homo Sapiens
aaaaaaaaagaaaaacagaagaugaccuugauggaaaaaaaauauuuuuuaaaaaaaagaua

SEQ ID NO: 226601 - RNA, 62 nt, Homo Sapiens
uaauaccagaccaaagacauuuucuguuuccuggaaaaaaaaaaugaaucauguuaggcuuu

SEQ ID NO: 226602 - RNA, 62 nt, Homo Sapiens
auuaguaggcuccugcugccaaaaugcaaaggggaaaaaaaggcagggauugggggggaugg

SEQ ID NO: 226603 - RNA, 62 nt, Homo Sapiens
agaucacauacguuaucaaaaacuacucccuuggaaaaaauaucuuucgaaaaucaaauuua

SEQ ID NO: 226604 - RNA, 62 nt, Homo Sapiens
agucaagguugcgaguacaggccaagaccaugggaaaaaaagccaugcucacuggccaauaa

SEQ ID NO: 226605 - RNA, 62 nt, Homo Sapiens
gggaaagcaaagcagaaaacagugccccaaauggaaaaaagauacucacacagaacaaaaca

SEQ ID NO: 226606 - RNA, 62 nt, Homo Sapiens
ugguugacuguuuuuguuuagcaauuauauuaggaaaaaagucacuuuguucugguauugac

SEQ ID NO: 226607 - RNA, 62 nt, Homo Sapiens
aucuuaaaacuuuggccauauuuugugccauaggaaaaaauuuuggguauacuugugguuag

SEQ ID NO: 226608 - RNA, 62 nt, Homo Sapiens
aacauguuacaguguuuuuuauguagccucugggaaaaaacaaaguauuccagcaaaagagg

SEQ ID NO: 226609 - RNA, 62 nt, Homo Sapiens
aaauaaggacuucaauccaaucucuaaguaaaggaaaaaacaagcagcacuguauauaccug

SEQ ID NO: 226610 - RNA, 62 nt, Homo Sapiens
gcaucaugaaaggcaaaaagcguggcuccuaaggaaaaaacaaauugaaguucagagucacc

SEQ ID NO: 226611 - RNA, 62 nt, Homo Sapiens
uguuuucaguuaaacacuaccaacagaaaaaaggaaaaaaauaaugcauaaugcuuucucac

SEQ ID NO: 226612 - RNA, 62 nt, Homo Sapiens
aaaagggcuucagucucauguugcucucuaugggaaaaaaacgcuugcugccuuuaauuguc

SEQ ID NO: 226613 - RNA, 62 nt, Homo Sapiens
gugguuuggccuugcugcuggcuuaacagagaggaaaaaaauaccucauuucaagaaaauau

SEQ ID NO: 226614 - RNA, 62 nt, Homo Sapiens
aaucacucuauguugccccaucugucaauuaaggaaaaaaaagcuuguugaaauguuuugca

SEQ ID NO: 226615 - RNA, 62 nt, Homo Sapiens
aaaaacuucuuuaggcauuuaucuuuggaaaaggaaaaaaaauaaacuagcucauuauuucc

SEQ ID NO: 226616 - RNA, 62 nt, Homo Sapiens
uagggagaaaacuagucuaaauuauuucaacuggaaaaaagaaaaaagaguccucuucuuuu

SEQ ID NO: 226617 - RNA, 62 nt, Homo Sapiens
uauggaagucgugucuuacuccaggugaagggggaaaaaaaaagccuauacuuuggcagguu

SEQ ID NO: 226618 - RNA, 62 nt, Homo Sapiens
ccagguucuagaugggugaaauguugagaaguggaaaaaaacauguuuccauguucccaacu

SEQ ID NO: 226619 - RNA, 62 nt, Homo Sapiens
acgaccuacugcacgaaggggucaaagugaggggaaaaaagcuaggcgggaucgcuuuguug

SEQ ID NO: 226620 - RNA, 62 nt, Homo Sapiens
aacucuaaaaaaaaaaaaaauacaaauaaaaaggaaaaaaaauuacauuuuuuaucuuauac

SEQ ID NO: 226621 - RNA, 62 nt, Homo Sapiens
caguauucagcuucuuaaccagucgcuauuuaggaaaaaaaacccacuaguuaggccaucaa

SEQ ID NO: 226622 - RNA, 62 nt, Homo Sapiens
ugauaucacugcugacuuuuauauuaugggagggaaaaaauaacauuaauaaaaaggugaua

SEQ ID NO: 226623 - RNA, 62 nt, Homo Sapiens
cccccccacuaugcccucauuuuuuuaaaaaaggaaaaaaaaaagaaacuggguuccagucu

SEQ ID NO: 226624 - RNA, 62 nt, Homo Sapiens
aaaaaauaaauaaaaauaaaaaaaauaaaaaaggaaaaaaaaaaaagaagaaacaagacaug

SEQ ID NO: 226625 - RNA, 62 nt, Homo Sapiens
ccacauagcucugggccuuugaaagguauuaaggaaaaaauuccgucuucacagacaaacuu

SEQ ID NO: 226626 - RNA, 62 nt, Homo Sapiens
caccccaucguucccuacucucugaaaugaagggaaaaaaaccuacaguagaagaacuuacu

SEQ ID NO: 226627 - RNA, 62 nt, Homo Sapiens
aaaccccacucagaaacagaguguacaauccaggaaaaaaacuccauuccaccugacccugu

SEQ ID NO: 226628 - RNA, 62 nt, Homo Sapiens
acauuagcugugguuguaaaacugggaacaauggaaaaaauuacacaauggguuuggagcug

SEQ ID NO: 226629 - RNA, 62 nt, Homo Sapiens
gggcuuugcacacaauggguauuuagaugcauggaaaaaaauuuucauagccuguaucuauc

SEQ ID NO: 226630 - RNA, 62 nt, Homo Sapiens
uuacuaaaaccuagguaacugcuuguuuuuguggaaaaaaacgcuuguauuauaguuauuaa

SEQ ID NO: 226631 - RNA, 62 nt, Homo Sapiens
guuuuuaauagaaaugaacuguagcuacuuaaggaaaaaaggaaaaaggaaucuugccagau

SEQ ID NO: 226632 - RNA, 62 nt, Homo Sapiens
augucucuaauuacuggcuuuuucuaguccugggaaaaaaaggcagucauguggaaccuugc

SEQ ID NO: 226633 - RNA, 62 nt, Homo Sapiens
acaguucaccauguggaguuugucaaaccaagggaaaaaaccgaauuuaauguauaaaaugu

SEQ ID NO: 226634 - RNA, 62 nt, Homo Sapiens
caacggccacuguguguggcugcucugagugaggaaaaaauuaaaaagaaaaacugguucca

SEQ ID NO: 226635 - RNA, 62 nt, Homo Sapiens
aggcucagcuggggaugguguuugacuucggaggaaaaaaguugcuauugcccguuaaaggc

SEQ ID NO: 226636 - RNA, 62 nt, Homo Sapiens
ccuguuugcaauugcuucccucaucucaguagggaaaaaauugagugggaguacugagaugu

SEQ ID NO: 226637 - RNA, 62 nt, Homo Sapiens
aaaaacaaacccagaccccauauauuugaaaaggaaaaaacauacagagguugaauugagua

SEQ ID NO: 226638 - RNA, 62 nt, Homo Sapiens
cuccaguuuguuuuacaggugguugauuaaagggaaaaaagguuaaaaaaaaagacauauaa

SEQ ID NO: 226639 - RNA, 62 nt, Homo Sapiens
aaaaacccuggaaaauagaaaaaaucccuccuggaaaaaaaaaauaacaaaagaggaaaaaa

SEQ ID NO: 226640 - RNA, 62 nt, Homo Sapiens
aaucccuccuggaaaaaaaaaauaacaaaagaggaaaaaaaagcgagcaagccuuuuugaaa

SEQ ID NO: 226641 - RNA, 62 nt, Homo Sapiens
cuucccuagagcuaguauccgcuguuuaaaaaggaaaaaaucccuaggcaacagagugauac

SEQ ID NO: 226642 - RNA, 62 nt, Homo Sapiens
ggaaaauaggagaagguggaaucucaacagaaggaaaaaaaagggugacagagugagacucc

SEQ ID NO: 226643 - RNA, 62 nt, Homo Sapiens
acucauccagaauucauauuguguugaaaacuggaaaaaauauuuugcaaaaaucuuuauug

SEQ ID NO: 226644 - RNA, 62 nt, Homo Sapiens
aaaagaaaggacauugaguucuggagcaaaaaggaaaaaaaacagaacaaaucgucaggugc

SEQ ID NO: 226645 - RNA, 62 nt, Homo Sapiens
aaaacaaaaaacuauaguuauuuuaacaacugggaaaaaacagaaacugugaguuguuuuuu

SEQ ID NO: 226646 - RNA, 62 nt, Homo Sapiens
aacagauuucagagauuaaauuauaaauggagggaaaaaaugaaugauaaauugaccccuuu

SEQ ID NO: 226647 - RNA, 62 nt, Homo Sapiens
uuauaugccaaaaagauccuacauuuugguagggaaaaaacaacacuguguuugacguauuu

SEQ ID NO: 226648 - RNA, 62 nt, Homo Sapiens
uacaguauaaacuaccucacuugccuuucuugggaaaaaaaaaaugaauggacuuuaacaau

SEQ ID NO: 226649 - RNA, 62 nt, Homo Sapiens
gauuuguagugcauagguguguguuucaagaaggaaaaaaaaagacuucuguucaaaguuaa

SEQ ID NO: 226650 - RNA, 62 nt, Homo Sapiens
auuauacacuguacauuuuuuucacagcaauuggaaaaaaacaaccacuugcaaucauucaa

SEQ ID NO: 226651 - RNA, 62 nt, Homo Sapiens
aguaaagcucagugugaaugaagaccuuaauaggaaaaaaagugaucauuaccuguaaauga

SEQ ID NO: 226652 - RNA, 62 nt, Homo Sapiens
ucuugugauugacuuucgcaccuagauaauggggaaaaaaagucauaaaauuuucauauaug

SEQ ID NO: 226653 - RNA, 62 nt, Homo Sapiens
uuguaauaaaauaaucuaauaugacugguaauggaaaaaaugaauguaacugugcacaggaa

SEQ ID NO: 226654 - RNA, 62 nt, Homo Sapiens
aaaugugcuaauaaaacuucucuucccuugggggaaaaaaaaccuucuccuccuccuccucc

SEQ ID NO: 226655 - RNA, 62 nt, Homo Sapiens
acaucacacaguguccuguagcuaagugucuaggaaaaaacaaaaacuccaaacccuucagu

SEQ ID NO: 226656 - RNA, 62 nt, Homo Sapiens
ccuauaacuuuucagcuggugcuuuuacuuagggaaaaaaacaauuuguaaauacagaacau

SEQ ID NO: 226657 - RNA, 62 nt, Homo Sapiens
uuuauaaauuaaacuuuagauauguauguacaggaaaaaauguaguauauaguaucguauau

SEQ ID NO: 226658 - RNA, 62 nt, Homo Sapiens
aaauguaguauauaguaucguauauauguacaggaaaaaaacguacuaucugugguuucagg

SEQ ID NO: 226659 - RNA, 62 nt, Homo Sapiens
aaaagacauaaacuggcaccaaaaaaaaaaaaggaaaaaaaaaaaacacacagaagagauuu

SEQ ID NO: 226660 - RNA, 62 nt, Homo Sapiens
gcaacaaaaaaagaaaacacacaaacagaagaggaaaaaaaacaaaaaagcgacaaaaaaac

SEQ ID NO: 226661 - RNA, 62 nt, Homo Sapiens
ugggcagcguggugggggauaaauaaauaaaaggaaaaaaaacuuagccuagaauuagaauu

SEQ ID NO: 226662 - RNA, 62 nt, Homo Sapiens
ccaagaauaagcagcagaacccuguuccauauggaaaaaagaaaaacaauuuuuugucccua

SEQ ID NO: 226663 - RNA, 62 nt, Homo Sapiens
uaguauuuaaaaauagagaaauugcacuuccuggaaaaaauuaaaaaguaguuaguuuaauu

SEQ ID NO: 226664 - RNA, 62 nt, Homo Sapiens
aacuagaccccacaccagggcacccuaagaggggaaaaaagugaauucaaagcaaaaauaac

SEQ ID NO: 226665 - RNA, 62 nt, Homo Sapiens
agaauucccuguaucaucuggaucucaacaucggaaaaaagaagcggauaguguuuauggag

SEQ ID NO: 226666 - RNA, 62 nt, Homo Sapiens
gaaaaaugggcuggagagaaggagaaggauuaggaaaaaacaaagaaggcaauaaggaaccc

SEQ ID NO: 226667 - RNA, 62 nt, Homo Sapiens
cagugaagcauuagaugcugaaagucuacaauggaaaaaaaguguauuuauucaagugcauu

SEQ ID NO: 226668 - RNA, 62 nt, Homo Sapiens
acuccauguauuuauucaagaauucauuuugaggaaaaaacaaucucagucuuuauuugugu

SEQ ID NO: 226669 - RNA, 62 nt, Homo Sapiens
aaacuuucaaauugaaaugaauaaaaaucaauggaaaaaaauauuuguguuauucuggaugu

SEQ ID NO: 226670 - RNA, 62 nt, Homo Sapiens
gcuucuuucuacuuuguuuauaaauacuguagggaaaaaaauggacuuuuucuuagguuugc

SEQ ID NO: 226671 - RNA, 62 nt, Homo Sapiens
auguuuuucaguuuaauucugagaaaaaugaaggaaaaaauuucugaccugcaaaaaugcug

SEQ ID NO: 226672 - RNA, 62 nt, Homo Sapiens
gggaaguuggggauaggcagaauguucagugaggaaaaaaaggaggaaaaaacauucagaca

SEQ ID NO: 226673 - RNA, 62 nt, Homo Sapiens
uucagacaaauguucagugacauguucagugaggaaaaaacauucagugugagugaggaaaa

SEQ ID NO: 226674 - RNA, 62 nt, Homo Sapiens
aucagaaauaauaaaaaauucauuacaagccuggaaaaaaacgcagauaaguggccuugaca

SEQ ID NO: 226675 - RNA, 62 nt, Homo Sapiens
gcuuuugagagaacauagauguucugugacuaggaaaaaauuaaguaguaaaagaagaaaua

SEQ ID NO: 226676 - RNA, 62 nt, Homo Sapiens
uuugguuuuauaaaauucauuucaaaguugaaggaaaaaaagcaacuuuuuaguuuuguucc

SEQ ID NO: 226677 - RNA, 62 nt, Homo Sapiens
agcccaaacuuaaccucugagaauuaaaagaaggaaaaaaaauuuguauaaaaauuuaaauu

SEQ ID NO: 226678 - RNA, 62 nt, Homo Sapiens
gggagcucaaagucacaagaagaaaaaugaaaggaaaaaacagcagcccuauucagaaauug

SEQ ID NO: 226679 - RNA, 62 nt, Homo Sapiens
ggagucaucaauucauccauaaauauaaaaagggaaaaaaacuuaaggcaguagucugcauu

SEQ ID NO: 226680 - RNA, 64 nt, Homo Sapiens; identical to SEQ ID NO: 123933

SEQ ID NO: 226681 - RNA, 64 nt, Homo Sapiens; identical to SEQ ID NO: 123934

SEQ ID NO: 226682 - RNA, 64 nt, Homo Sapiens; identical to SEQ ID NO: 123935

SEQ ID NO: 226683 - RNA, 64 nt, Homo Sapiens; identical to SEQ ID NO: 123936

SEQ ID NO: 226684 - RNA, 64 nt, Homo Sapiens; identical to SEQ ID NO: 123937

SEQ ID NO: 226685 - RNA, 57 nt, Homo Sapiens; identical to SEQ ID NO: 123938

SEQ ID NO: 226686 - RNA, 64 nt, Homo Sapiens; identical to SEQ ID NO: 123939

SEQ ID NO: 226687 - RNA, 64 nt, Homo Sapiens; identical to SEQ ID NO: 123940

SEQ ID NO: 226688 - RNA, 64 nt, Homo Sapiens; identical to SEQ ID NO: 123941

SEQ ID NO: 226689 - RNA, 64 nt, Homo Sapiens; identical to SEQ ID NO: 123942

SEQ ID NO: 226690 - RNA, 64 nt, Homo Sapiens; identical to SEQ ID NO: 123943

SEQ ID NO: 226691 - RNA, 64 nt, Homo Sapiens; identical to SEQ ID NO: 123944

SEQ ID NO: 226692 - RNA, 64 nt, Homo Sapiens; identical to SEQ ID NO: 123945

SEQ ID NO: 226693 - RNA, 64 nt, Homo Sapiens; identical to SEQ ID NO: 123946

SEQ ID NO: 226694 - RNA, 64 nt, Homo Sapiens; identical to SEQ ID NO: 123947

SEQ ID NO: 226695 - RNA, 64 nt, Homo Sapiens; identical to SEQ ID NO: 123948

SEQ ID NO: 226696 - RNA, 64 nt, Homo Sapiens; identical to SEQ ID NO: 123949

SEQ ID NO: 226697 - RNA, 64 nt, Homo Sapiens; identical to SEQ ID NO: 123950

SEQ ID NO: 226698 - RNA, 64 nt, Homo Sapiens; identical to SEQ ID NO: 123951

SEQ ID NO: 226699 - RNA, 64 nt, Homo Sapiens; identical to SEQ ID NO: 123952

SEQ ID NO: 226700 - RNA, 64 nt, Homo Sapiens; identical to SEQ ID NO: 123953

SEQ ID NO: 226701 - RNA, 64 nt, Homo Sapiens; identical to SEQ ID NO: 123954

SEQ ID NO: 226702 - RNA, 64 nt, Homo Sapiens; identical to SEQ ID NO: 123955

SEQ ID NO: 226703 - RNA, 64 nt, Homo Sapiens; identical to SEQ ID NO: 123956

SEQ ID NO: 226704 - RNA, 64 nt, Homo Sapiens; identical to SEQ ID NO: 123957

SEQ ID NO: 226705 - RNA, 64 nt, Homo Sapiens; identical to SEQ ID NO: 123958

SEQ ID NO: 226706 - RNA, 62 nt, Homo Sapiens
aguccuguggugcaguuacuaaggacguguggagacagcagcguggacagcccagacccuga

SEQ ID NO: 226707 - RNA, 62 nt, Homo Sapiens
gccuucuagggucaccuuaaucagccuccagaagacagcagaguuaugcuaaaguggagguu

SEQ ID NO: 226708 - RNA, 62 nt, Homo Sapiens
cgccucccccgcagguuaugucagcagcucugagacagcaguaucacaggccagauguuguu

SEQ ID NO: 226709 - RNA, 62 nt, Homo Sapiens
augagccccacguggagcucgggacggauaguagacagcaauaacucgguguguggccgccu

SEQ ID NO: 226710 - RNA, 62 nt, Homo Sapiens
auaaaaaagggaaaacuauagcuuugaguggcagacagcacacaucacaugcaucaacucac

SEQ ID NO: 226711 - RNA, 62 nt, Homo Sapiens
gcuuucuccuacagggcuuuuccugaguccccagacagcagaguaugaacugcugacaccca

SEQ ID NO: 226712 - RNA, 62 nt, Homo Sapiens
cuuaacaggcuuuccaauuacuuucuuaaucuagacagcaaaugaaugaaugaaaguugagu

SEQ ID NO: 226713 - RNA, 62 nt, Homo Sapiens
uucucuauuggccucucagguuagaaaaauucagacagcauccaaagacaaguacaacucca

SEQ ID NO: 226714 - RNA, 62 nt, Homo Sapiens
gaagcugucagcuuaauaacaagaauggccuaagacagcaaagacagcacuguuccugggcu

SEQ ID NO: 226715 - RNA, 62 nt, Homo Sapiens
agcuuaauaacaagaauggccuaagacagcaaagacagcacuguuccugggcugggacgcaa

SEQ ID NO: 226716 - RNA, 62 nt, Homo Sapiens
gaaaaaagaaacaugccacuugauuaggagagagacagcaguguuugaacuacagcaucuuu

SEQ ID NO: 226717 - RNA, 62 nt, Homo Sapiens
uggaggucagagucugcuuucguaggcucuuuagacagcaccuaccacuugguucuccagcg

SEQ ID NO: 226718 - RNA, 62 nt, Homo Sapiens
cacggcccgcagccuggcaugaguacaaggacagacagcaggaagaaauucaugcuugcacc

SEQ ID NO: 226719 - RNA, 62 nt, Homo Sapiens
gcagaugccgcaggcgcggccgacugagcuuuagacagcagaucaagcauccucagaagccu

SEQ ID NO: 226720 - RNA, 62 nt, Homo Sapiens
uagccaggccccagggagccuccgcugggcccagacagcagcguuugguuuuauccacuuuu

SEQ ID NO: 226721 - RNA, 62 nt, Homo Sapiens
ucucaaaaaaaaaaaaaaaaacaauggaaggcagacagcaagucccugaggacacaucacac

SEQ ID NO: 226722 - RNA, 64 nt, Homo Sapiens; identical to SEQ ID NO: 73453

SEQ ID NO: 226723 - RNA, 64 nt, Homo Sapiens; identical to SEQ ID NO: 73454

SEQ ID NO: 226724 - RNA, 64 nt, Homo Sapiens; identical to SEQ ID NO: 73455

SEQ ID NO: 226725 - RNA, 64 nt, Homo Sapiens; identical to SEQ ID NO: 73456

SEQ ID NO: 226726 - RNA, 64 nt, Homo Sapiens; identical to SEQ ID NO: 73457

SEQ ID NO: 226727 - RNA, 64 nt, Homo Sapiens; identical to SEQ ID NO: 73458

SEQ ID NO: 226728 - RNA, 64 nt, Homo Sapiens; identical to SEQ ID NO: 73459

SEQ ID NO: 226729 - RNA, 64 nt, Homo Sapiens; identical to SEQ ID NO: 73460

SEQ ID NO: 226730 - RNA, 64 nt, Homo Sapiens; identical to SEQ ID NO: 73461

SEQ ID NO: 226731 - RNA, 64 nt, Homo Sapiens; identical to SEQ ID NO: 73462

SEQ ID NO: 226732 - RNA, 64 nt, Homo Sapiens; identical to SEQ ID NO: 73463

SEQ ID NO: 226733 - RNA, 64 nt, Homo Sapiens; identical to SEQ ID NO: 73464

SEQ ID NO: 226734 - RNA, 64 nt, Homo Sapiens; identical to SEQ ID NO: 73465

SEQ ID NO: 226735 - RNA, 64 nt, Homo Sapiens; identical to SEQ ID NO: 73466

SEQ ID NO: 226736 - RNA, 64 nt, Homo Sapiens; identical to SEQ ID NO: 73467

SEQ ID NO: 226737 - RNA, 64 nt, Homo Sapiens; identical to SEQ ID NO: 73468

SEQ ID NO: 226738 - RNA, 64 nt, Homo Sapiens; identical to SEQ ID NO: 73469

SEQ ID NO: 226739 - RNA, 64 nt, Homo Sapiens; identical to SEQ ID NO: 73470

SEQ ID NO: 226740 - RNA, 64 nt, Homo Sapiens; identical to SEQ ID NO: 73471

SEQ ID NO: 226741 - RNA, 64 nt, Homo Sapiens; identical to SEQ ID NO: 73472

SEQ ID NO: 226742 - RNA, 64 nt, Homo Sapiens; identical to SEQ ID NO: 73473

SEQ ID NO: 226743 - RNA, 64 nt, Homo Sapiens; identical to SEQ ID NO: 73474

SEQ ID NO: 226744 - RNA, 64 nt, Homo Sapiens; identical to SEQ ID NO: 73475

SEQ ID NO: 226745 - RNA, 64 nt, Homo Sapiens; identical to SEQ ID NO: 73476

SEQ ID NO: 226746 - RNA, 64 nt, Homo Sapiens; identical to SEQ ID NO: 73477

SEQ ID NO: 226747 - RNA, 64 nt, Homo Sapiens; identical to SEQ ID NO: 73478

SEQ ID NO: 226748 - RNA, 64 nt, Homo Sapiens; identical to SEQ ID NO: 73479

SEQ ID NO: 226749 - RNA, 64 nt, Homo Sapiens; identical to SEQ ID NO: 73480

SEQ ID NO: 226750 - RNA, 64 nt, Homo Sapiens; identical to SEQ ID NO: 73481

SEQ ID NO: 226751 - RNA, 64 nt, Homo Sapiens; identical to SEQ ID NO: 73482

SEQ ID NO: 226752 - RNA, 64 nt, Homo Sapiens; identical to SEQ ID NO: 73483

SEQ ID NO: 226753 - RNA, 64 nt, Homo Sapiens; identical to SEQ ID NO: 73484

SEQ ID NO: 226754 - RNA, 64 nt, Homo Sapiens; identical to SEQ ID NO: 73485

SEQ ID NO: 226755 - RNA, 64 nt, Homo Sapiens; identical to SEQ ID NO: 73486

SEQ ID NO: 226756 - RNA, 64 nt, Homo Sapiens; identical to SEQ ID NO: 73487

SEQ ID NO: 226757 - RNA, 64 nt, Homo Sapiens; identical to SEQ ID NO: 73488

SEQ ID NO: 226758 - RNA, 64 nt, Homo Sapiens; identical to SEQ ID NO: 73489

SEQ ID NO: 226759 - RNA, 64 nt, Homo Sapiens; identical to SEQ ID NO: 73490

SEQ ID NO: 226760 - RNA, 64 nt, Homo Sapiens; identical to SEQ ID NO: 73491

SEQ ID NO: 226761 - RNA, 64 nt, Homo Sapiens; identical to SEQ ID NO: 73492

SEQ ID NO: 226762 - RNA, 64 nt, Homo Sapiens; identical to SEQ ID NO: 73493

SEQ ID NO: 226763 - RNA, 64 nt, Homo Sapiens; identical to SEQ ID NO: 73494

SEQ ID NO: 226764 - RNA, 64 nt, Homo Sapiens; identical to SEQ ID NO: 73495

SEQ ID NO: 226765 - RNA, 64 nt, Homo Sapiens; identical to SEQ ID NO: 73496

SEQ ID NO: 226766 - RNA, 64 nt, Homo Sapiens; identical to SEQ ID NO: 73497

SEQ ID NO: 226767 - RNA, 64 nt, Homo Sapiens; identical to SEQ ID NO: 73498

SEQ ID NO: 226768 - RNA, 64 nt, Homo Sapiens; identical to SEQ ID NO: 73499

SEQ ID NO: 226769 - RNA, 64 nt, Homo Sapiens; identical to SEQ ID NO: 73500

SEQ ID NO: 226770 - RNA, 64 nt, Homo Sapiens; identical to SEQ ID NO: 73501

SEQ ID NO: 226771 - RNA, 64 nt, Homo Sapiens; identical to SEQ ID NO: 73502

SEQ ID NO: 226772 - RNA, 64 nt, Homo Sapiens; identical to SEQ ID NO: 73503

SEQ ID NO: 226773 - RNA, 64 nt, Homo Sapiens; identical to SEQ ID NO: 73504

SEQ ID NO: 226774 - RNA, 64 nt, Homo Sapiens; identical to SEQ ID NO: 73505

SEQ ID NO: 226775 - RNA, 64 nt, Homo Sapiens; identical to SEQ ID NO: 73506

SEQ ID NO: 226776 - RNA, 64 nt, Homo Sapiens; identical to SEQ ID NO: 73507

SEQ ID NO: 226777 - RNA, 64 nt, Homo Sapiens; identical to SEQ ID NO: 73508

SEQ ID NO: 226778 - RNA, 64 nt, Homo Sapiens; identical to SEQ ID NO: 73509

SEQ ID NO: 226779 - RNA, 64 nt, Homo Sapiens; identical to SEQ ID NO: 73510

SEQ ID NO: 226780 - RNA, 64 nt, Homo Sapiens; identical to SEQ ID NO: 73511

SEQ ID NO: 226781 - RNA, 64 nt, Homo Sapiens; identical to SEQ ID NO: 73512

SEQ ID NO: 226782 - RNA, 64 nt, Homo Sapiens; identical to SEQ ID NO: 73513

SEQ ID NO: 226783 - RNA, 60 nt, Homo Sapiens
cagggcagucgugugucuuacccagcuacacagggugacauuuuggucuagaaccuaguc

SEQ ID NO: 226784 - RNA, 60 nt, Homo Sapiens
acccaaggaguccugugauuugagcuucagcagggugaucuacauuugggugcuuguuuc

SEQ ID NO: 226785 - RNA, 60 nt, Homo Sapiens
aaugccaauagauaugugagucacagucuccagggugacauuucaaguacggugucauuu

SEQ ID NO: 226786 - RNA, 60 nt, Homo Sapiens
guaauuaggaacgauaccagcugccccugucagggugaguugaaucauuacaucaaggag

SEQ ID NO: 226787 - RNA, 60 nt, Homo Sapiens
auaaagauacguuugcaaucagugacuacucagggugacacccuugcccuaaagcaggag

SEQ ID NO: 226788 - RNA, 60 nt, Homo Sapiens
cagcucucccuggacuugcccugccuggaacagggugauuugcuggaauggaguuaccac

SEQ ID NO: 226789 - RNA, 60 nt, Homo Sapiens
uucauguuauuguuuuauacgaagacaaaacagggugaucauguuuuacuuuucacugga

SEQ ID NO: 226790 - RNA, 60 nt, Homo Sapiens
agaagcuguccguggcggcuugacaugaaacagggugaagcucgauauuaaaaucauccu

SEQ ID NO: 226791 - RNA, 60 nt, Homo Sapiens
ggagaaagccugugcucugguugagagcuccagggugaagugccuucaggggguuguuac

SEQ ID NO: 226792 - RNA, 60 nt, Homo Sapiens
gcccagacucugcccuguugggggagaagccagggugauaugggcuuccuuuaaagggag

SEQ ID NO: 226793 - RNA, 60 nt, Homo Sapiens
guggagaguaggguggucuugugaguugugcagggugaagaccgcuucccugagacaggg

SEQ ID NO: 226794 - RNA, 60 nt, Homo Sapiens
gccugcccccgggcagcacgggagggagagcagggugagcacgcuuguugguuucagaug

SEQ ID NO: 226795 - RNA, 60 nt, Homo Sapiens
ccuucaguacccagccagguucucuggguccagggugacucuccaaagaaauuggccuuc

SEQ ID NO: 226796 - RNA, 60 nt, Homo Sapiens
aagguuuggcuacuuguauaggucugccugcagggugaaaaugccagugugaauauucua

SEQ ID NO: 226797 - RNA, 60 nt, Homo Sapiens
gguggcacuguucacuggcgcugggacagucagggugaccccaccgccuaccucucuaca

SEQ ID NO: 226798 - RNA, 60 nt, Homo Sapiens
ggaggguggcaggucuuugcagcucccggccagggugaggcggaagugagcccucauccu

SEQ ID NO: 226799 - RNA, 60 nt, Homo Sapiens
gccccaguguuauuuauuccccagugacuccagggugacaaggccugcuugacuuuccag

SEQ ID NO: 226800 - RNA, 60 nt, Homo Sapiens
agcaaccacacugcuuggcccuucaagggucagggugagacgugaugggcuaggccuccg

SEQ ID NO: 226801 - RNA, 64 nt, Homo Sapiens
ucauguagaauaaaaauuuuaaaucucacuucacuuagccgacauuccaugcccugaccaaucc

SEQ ID NO: 226802 - RNA, 64 nt, Homo Sapiens
cagcgcccccugcuggagaaguuuuuucauuuuguuagccgacuucugguagcuuagcaaagag

SEQ ID NO: 226803 - RNA, 64 nt, Homo Sapiens
agguugacaagugaaguuucucuaauguugauuguuagccgauuuguaaccuggcauuuacuua

SEQ ID NO: 226804 - RNA, 64 nt, Homo Sapiens
aggcuuuguaagaucucgccaccaggaagcugcguuagccgaucaccggggaaaauguuccuaa

SEQ ID NO: 226805 - RNA, 64 nt, Homo Sapiens
ccuuccauauucuuaugauucuuccauaguugucuuagccgaauaaauuuaugugguuguuaca

SEQ ID NO: 226806 - RNA, 64 nt, Homo Sapiens
acgguggugcaugccuguaaaaaaauacaaaaaauuagccgagcggugaaaccccaucucuacu

SEQ ID NO: 226807 - RNA, 64 nt, Homo Sapiens
gucuuugcccaccucuaugaggcccaguuuuguguuagccgaccggagaguagaguuaagacaa

SEQ ID NO: 226808 - RNA, 64 nt, Homo Sapiens
uggugaaaaccugucucuacuaaaaauacaaaaauuagccgagcgugguggugcgugccuguag

SEQ ID NO: 226809 - RNA, 64 nt, Homo Sapiens
gaacgugauuagucaucgccgagaagaaagcauauuagccgaggagguagucacgcggcacgcg

SEQ ID NO: 226810 - RNA, 64 nt, Homo Sapiens
uaagagaauggucacauugacuuuccauuaauuauuagccgagugcugugacuguaaaagugua

SEQ ID NO: 226811 - RNA, 64 nt, Homo Sapiens
uucuguucauuuccauugcugcuuauaugcaguguuagccgaauuagauuuacaagacaaucua

SEQ ID NO: 226812 - RNA, 64 nt, Homo Sapiens
uggagaaaccccgucucuaucagaaauacaaaauuuagccgagugugguggcacaugccugugg

SEQ ID NO: 226813 - RNA, 64 nt, Homo Sapiens
uggugaaaccccaucucuacuaaaaguacaaauauuagccgacuauguggcgggcaccuguaau

SEQ ID NO: 226814 - RNA, 64 nt, Homo Sapiens
gugguggcaugcaccugucauaaaaauacaaaaauuagccgagaggugaaaccuccgucucuau

SEQ ID NO: 226815 - RNA, 64 nt, Homo Sapiens
aaauauugccauguuuacaauauguaauauguuuuuagccgauggauuuaaacauguagauuca

SEQ ID NO: 226816 - RNA, 64 nt, Homo Sapiens
accugcacaucgcuccacugccgacccgcccagcuuagccgaugcuguacucccccugcccucc

SEQ ID NO: 226817 - RNA, 64 nt, Homo Sapiens
guagugacgggugcccguaaaaaaauaccaaaaauuagccgagcgugaaacccccaucucuacu

SEQ ID NO: 226818 - RNA, 64 nt, Homo Sapiens
cguggcguuccauugagugucugucaucauguguuuagccgaguggauggauagucugcuuguu

SEQ ID NO: 226819 - RNA, 64 nt, Homo Sapiens
uugagggaacccuguggcacggcucucccuguccuuagccgauuggggggaggcacuccuccag

SEQ ID NO: 226820 - RNA, 64 nt, Homo Sapiens
cuggacuugguacaguugcaggagcgugaaggacuuagccgacugcgcugcuuuuucaaaacgg

SEQ ID NO: 226821 - RNA, 64 nt, Homo Sapiens
uggcggaacccugucucuaccaaaauuacaaaaauuagccgagcaugguggcgcaugccuguag

SEQ ID NO: 226822 - RNA, 64 nt, Homo Sapiens
cuuagaggagcucuugugagguuuacuuaaucuguuagccgaggaaaaaugcguauauuucuau

SEQ ID NO: 226823 - RNA, 64 nt, Homo Sapiens
auuuuugucuaauaauaaagaauuucuauaaacuuuagccgaaauuggagucaacacuuauuca

SEQ ID NO: 226824 - RNA, 64 nt, Homo Sapiens
agaauggcgugaacccggaaggcggagcuugcaguuagccgagaucaugccacugcacuccagc

SEQ ID NO: 226825 - RNA, 64 nt, Homo Sapiens
augguggccugugccuguaauaaaaauacaaaaauuagccgagcaggugaaacccugucucuac

SEQ ID NO: 226826 - RNA, 64 nt, Homo Sapiens
gucuugaaacuauucauuuuauuugguuuguugguuagccgacuuguuuaguauucucuugugc

SEQ ID NO: 226827 - RNA, 64 nt, Homo Sapiens
cagggagacucaguuucuccaaaaaaauaaaaaauuagccgaucaugguggugcgugcuuauag

SEQ ID NO: 226828 - RNA, 64 nt, Homo Sapiens
agccacacaugcaaacaucaguguccuucuagcuuuagccgagaaagaaaccagucccagggaa

SEQ ID NO: 226829 - RNA, 64 nt, Homo Sapiens
ccccagcucucagugaccccgacugucuccugacuuagccgagguaaggucagugcagcagaca

SEQ ID NO: 226830 - RNA, 64 nt, Homo Sapiens
uggugaaaccccgucucuacuaaaaauagaagcauuagccgagccugguggugcgugccuguaa

SEQ ID NO: 226831 - RNA, 64 nt, Homo Sapiens
gaaaggcaugagugcgggcagugugggaaauccuuuagccgaaaaucuagccuuauuauacauc

SEQ ID NO: 226832 - RNA, 64 nt, Homo Sapiens
cucccccagaacuuugcacacaucuugcuauguauuagccgaugucuuuaguguugagccucug

SEQ ID NO: 226833 - RNA, 64 nt, Homo Sapiens
acagagacuggacugugggcgcgcaagaccagcuuuagccgacaggccaggguagaggcugacg

SEQ ID NO: 226834 - RNA, 64 nt, Homo Sapiens
uguucaagguaauaugccaggcgcuguaugucuccacugccaaguagaagugacucaaaacccu

SEQ ID NO: 226835 - RNA, 64 nt, Homo Sapiens
caugaccccaccuuuacuaagcacaaguacuugccacugccaucacugccaaguaacuagaugu

SEQ ID NO: 226836 - RNA, 64 nt, Homo Sapiens
accuuuacuaagcacaaguacuugccacugccaucacugccaaguaacuagaugucucuguuuc

SEQ ID NO: 226837 - RNA, 64 nt, Homo Sapiens
cugguuaucuuccuguuccuguagcauagccaggcacugccagucaccugugcccccauugcug

SEQ ID NO: 226838 - RNA, 64 nt, Homo Sapiens
ggguccugaguguggguauccacuuuuacccgcucacugccaccuguggacacucugugucuac

SEQ ID NO: 226839 - RNA, 64 nt, Homo Sapiens
caccaaauugcuuuauuccccuuugcaagaugggcacugccauaguucugccucuuugcugggg

SEQ ID NO: 226840 - RNA, 64 nt, Homo Sapiens
ccucccucaccagcucuuacgccucagccagcaccacugccaccagggcaacugcagcagcauc

SEQ ID NO: 226841 - RNA, 64 nt, Homo Sapiens
uuugccaagggaauuauagcugcagguucucucucacugccaucaaacuguaaaagauuaaacu

SEQ ID NO: 226842 - RNA, 64 nt, Homo Sapiens
gcccaugauggucacuuaaaaugugcaguaauagcacugccaggaucaagcaugaaaggcuuuu

SEQ ID NO: 226843 - RNA, 64 nt, Homo Sapiens
cuuccuugggaccaaggaccguuccaacagcauucacugccaguucuaauaggcgaggaaaaug

SEQ ID NO: 226844 - RNA, 64 nt, Homo Sapiens
cccugguugcaucccagaagcaucugacugucaccacugccaguggcuguggaacaguccuggg

SEQ ID NO: 226845 - RNA, 64 nt, Homo Sapiens
uucugaaacggucccacuggggacucccugccaccacugccagucucagcaguccucccucugg

SEQ ID NO: 226846 - RNA, 64 nt, Homo Sapiens
cccccaguucaaauccuuacgcuucuuaucuguccacugccacugaccagacgccacaccuugu

SEQ ID NO: 226847 - RNA, 64 nt, Homo Sapiens
ggagugcaggguggacaucaccuuggaggcccugcacugccagcaucuggagaccguccuggag

SEQ ID NO: 226848 - RNA, 64 nt, Homo Sapiens
cacccccaaccuccaucgccuugcagguuuucuucacugccaggaguagugagcuguacgaguc

SEQ ID NO: 226849 - RNA, 64 nt, Homo Sapiens
aggccccaaguggcuuguaagguggguaaacccucacugccagcuggagcaagcuggggcgggg

SEQ ID NO: 226850 - RNA, 64 nt, Homo Sapiens
cugucccucauuacccaaggagagcugagcagggcacugccagcgccuuuccuggacagacuga

SEQ ID NO: 226851 - RNA, 64 nt, Homo Sapiens
uggagucuugccaugccuguuugcuaaguugggucacugccacagacagccuggacauuggaca

SEQ ID NO: 226852 - RNA, 64 nt, Homo Sapiens
uggagccacugucaugcaggauacagugucuggacacugccacaggacgcugccacaucugggc

SEQ ID NO: 226853 - RNA, 64 nt, Homo Sapiens
uacucaauauucucuucaagcauuuuuuuucuuccacugccacucucuuuaccuuuaucauuuc

SEQ ID NO: 226854 - RNA, 64 nt, Homo Sapiens
gcacauccaggaaaaaagacuaggacuugccacacacugccaauucauaauccgcaggaucugu

SEQ ID NO: 226855 - RNA, 64 nt, Homo Sapiens
cgccuuuggggaggucuggaccacccagggccuccacugccaccuuggcuggcaagggagaaau

SEQ ID NO: 226856 - RNA, 64 nt, Homo Sapiens
gaccccauaccguuagcccuuguauguauaccaacacugccaaaguaaaacauuaggucaggca

SEQ ID NO: 226857 - RNA, 64 nt, Homo Sapiens
guguggugacccccauacauuccucccugcuccccacugccaggaggaccacuguccccagcca

SEQ ID NO: 226858 - RNA, 64 nt, Homo Sapiens
uccucacccccaccccacuuagguccugggcccccacugccaggcugggcccagcuugcucagu

SEQ ID NO: 226859 - RNA, 64 nt, Homo Sapiens
gaaaauuucugccuggcacacaccuggcuccaaccacugccaagugaucacucuuaggcccagg

SEQ ID NO: 226860 - RNA, 64 nt, Homo Sapiens
uagcuucuacuaaccacgguugcauguuuuuaugcacugccaauggcagguguguguucucuuc

SEQ ID NO: 226861 - RNA, 64 nt, Homo Sapiens
gucccuuggcacgcacacagcugucacaauggcacacugccacucugacggguguggccacccg

SEQ ID NO: 226862 - RNA, 64 nt, Homo Sapiens
acacacccaggcggcccgccuccaggacacuccacacugccaggagggggcugagcagagccca

SEQ ID NO: 226863 - RNA, 64 nt, Homo Sapiens
aggaggaggagccggggacucccaggcuggagagcacugccaggacccaccacuggaagcagga

SEQ ID NO: 226864 - RNA, 64 nt, Homo Sapiens
ccucguucugcucagaggccuugcuguggagcuccacugccauguacccaguaggguuugacau

SEQ ID NO: 226865 - RNA, 64 nt, Homo Sapiens
aggcaccuuggucccagugucuuccuuuuguucucacugccaaacugccuguccugggaucuag

SEQ ID NO: 226866 - RNA, 64 nt, Homo Sapiens
acacuuaaauuggguuuucaacagucccagcuuucacugccagggucccagucagauuccagga

SEQ ID NO: 226867 - RNA, 64 nt, Homo Sapiens
acuaaugaaaacagaaugucucuuccugguagaccacugccauaugauuuacauuuccucacca

SEQ ID NO: 226868 - RNA, 64 nt, Homo Sapiens
cucuggcuagaagcuaggggucccagugaagagccacugccauuaaagaauaugaaacauagau

SEQ ID NO: 226869 - RNA, 64 nt, Homo Sapiens
agccugugcccccaucaucucacuccuuugccugcacugccaggguggggcccaccaagauucc

SEQ ID NO: 226870 - RNA, 64 nt, Homo Sapiens
cccgagacugcugaugucuguaaccacuggggagcacugccaaaaauacagcuuucugguuugu

SEQ ID NO: 226871 - RNA, 64 nt, Homo Sapiens
caggaguggccugugccucccaccucuuccuucccacugccaaaggccuguguugagaaagaug

SEQ ID NO: 226872 - RNA, 64 nt, Homo Sapiens
ccucagccccagucgagaggaaagagaaucgggccacugccagaaagagagucaagcaaaccug

SEQ ID NO: 226873 - RNA, 64 nt, Homo Sapiens
ugaggcccugucucccagccacuuucccuccuggcacugccaccagccucaccgccugcgggca

SEQ ID NO: 226874 - RNA, 64 nt, Homo Sapiens
gggucugccucucacucgcccaggucccgaaggacacugccacagggacgccuucccuccccuc

SEQ ID NO: 226875 - RNA, 64 nt, Homo Sapiens
ucccaagcuucagacugcugcuucuccaaagacgcacugccaggugcugcuguggcuuuuuugc

SEQ ID NO: 226876 - RNA, 64 nt, Homo Sapiens
uucagagggguuccuugcuggcagcccugggagccacugccaccguugugguguccagugugca

SEQ ID NO: 226877 - RNA, 64 nt, Homo Sapiens
agcagcaggugauuggaccauaacucaccagccccacugccagcacuuuacccaccuagaacac

SEQ ID NO: 226878 - RNA, 64 nt, Homo Sapiens
cucuccaucacccucuuccuaaccccuuccagaucacugccacauagagguccucuggagcccu

SEQ ID NO: 226879 - RNA, 64 nt, Homo Sapiens
gcgggugggcuaagccgccaacugccaaucaacacacugccaauacucaucagcucaguaccua

SEQ ID NO: 226880 - RNA, 64 nt, Homo Sapiens
acacucacauucaauggaaagcggagccaaccaucacugccauuaaaaaaaaaaaggcaauugu

SEQ ID NO: 226881 - RNA, 64 nt, Homo Sapiens
gccagcaguguccuugggaacugcuaugaaacgacacugccaguguugucacugcugcucccuc

SEQ ID NO: 226882 - RNA, 64 nt, Homo Sapiens
ucagguuguucacagauuugagagagagcccucccacugccagcugugugugugugugugugug

SEQ ID NO: 226883 - RNA, 64 nt, Homo Sapiens
cucugcuccccucucacacaucugggaguagccccacugccaccugcagccgcagccuggacug

SEQ ID NO: 226884 - RNA, 64 nt, Homo Sapiens
gugggcccugggugggagcagcccacuucagcagcacugccacugccuuuggccaccugaggug

SEQ ID NO: 226885 - RNA, 64 nt, Homo Sapiens
ugguucccuuucauacagaggguuuucuauggaucacugccaaacauugggaucaucuccucug

SEQ ID NO: 226886 - RNA, 64 nt, Homo Sapiens
augauagcguucuggugagcugggaaggacccaccacugccacugaggauuguuuuggaagaaa

SEQ ID NO: 226887 - RNA, 64 nt, Homo Sapiens
gugccuaagcgggggugaaagaggacguguuacccacugccaugcaccaggacuggcuguguaa

SEQ ID NO: 226888 - RNA, 64 nt, Homo Sapiens
caccauggcccccucaucauagcaauaacauucccacugccagggguucuugagccagccaggc

SEQ ID NO: 226889 - RNA, 64 nt, Homo Sapiens
ggcccucuguagggcguuuaacuggaaauacccucacugccaaguggagacuggggcgugugcc

SEQ ID NO: 226890 - RNA, 64 nt, Homo Sapiens
ugccugcugagccuuuuccuuccacgccgccucucacugccaggccagcggcuuccgcugagac

SEQ ID NO: 226891 - RNA, 64 nt, Homo Sapiens; identical to SEQ ID NO: 117700

SEQ ID NO: 226892 - RNA, 64 nt, Homo Sapiens; identical to SEQ ID NO: 117701

SEQ ID NO: 226893 - RNA, 64 nt, Homo Sapiens; identical to SEQ ID NO: 117702

SEQ ID NO: 226894 - RNA, 64 nt, Homo Sapiens; identical to SEQ ID NO: 117703

SEQ ID NO: 226895 - RNA, 64 nt, Homo Sapiens; identical to SEQ ID NO: 117704

SEQ ID NO: 226896 - RNA, 64 nt, Homo Sapiens; identical to SEQ ID NO: 117705

SEQ ID NO: 226897 - RNA, 64 nt, Homo Sapiens; identical to SEQ ID NO: 117706

SEQ ID NO: 226898 - RNA, 64 nt, Homo Sapiens; identical to SEQ ID NO: 117707

SEQ ID NO: 226899 - RNA, 64 nt, Homo Sapiens; identical to SEQ ID NO: 117708

SEQ ID NO: 226900 - RNA, 64 nt, Homo Sapiens; identical to SEQ ID NO: 117709

SEQ ID NO: 226901 - RNA, 64 nt, Homo Sapiens
uuaagauuuguuuucaaguguuugaaacuaaauugacauuaaaaacuaggcagcuggaaaagua

SEQ ID NO: 226902 - RNA, 64 nt, Homo Sapiens
ucaaauuuuaauguuggccuugauauauuaauaagacauuaaagaagucggaacaauugccugu

SEQ ID NO: 226903 - RNA, 64 nt, Homo Sapiens
acacugaccucauguaggcaccuuaccaauauaugacauuaagugagagugaaucccuuaggac

SEQ ID NO: 226904 - RNA, 64 nt, Homo Sapiens
aaaucaauaucugcagccacuguuacuuuuaauugacauuaagagacacuucauagguucccac

SEQ ID NO: 226905 - RNA, 64 nt, Homo Sapiens
aucuaaaggauauuauuguuccauuucaauaaaugacauuaaaaauaaguuucuguuaugauug

SEQ ID NO: 226906 - RNA, 64 nt, Homo Sapiens
uucauaaaugaagcauaacaccugaaauacuguugacauuaacuaacuuguuuccuugaugagc

SEQ ID NO: 226907 - RNA, 64 nt, Homo Sapiens
uuuuuuuuaaacaaugaaguugguggugugccaagacauuaauucaaaaguugagauuuugggg

SEQ ID NO: 226908 - RNA, 64 nt, Homo Sapiens
gauuauuugggccaguuauauuaauucugcuugugacauuaaaauugagucuuugaagauaguu

SEQ ID NO: 226909 - RNA, 64 nt, Homo Sapiens
uauuccaccuuacucaagggguuauuaugccacagacauuaaccuauugugcauucagugaagu

SEQ ID NO: 226910 - RNA, 64 nt, Homo Sapiens
uaugagauguaugaugaaaauuugcuaugaaaaagacauuaaaaggugagcauuauuuauaaac

SEQ ID NO: 226911 - RNA, 64 nt, Homo Sapiens
uguaaaaugacggagagagagagaaagaaucccagacauuaacgguauuagagaguuugccuca

SEQ ID NO: 226912 - RNA, 64 nt, Homo Sapiens
cuggggaggagagaggcuuucgguggacacguuugacauuaaaaaaaaaaaaaaaaaaaaaaaa

SEQ ID NO: 226913 - RNA, 64 nt, Homo Sapiens; identical to SEQ ID NO: 117710

SEQ ID NO: 226914 - RNA, 64 nt, Homo Sapiens; identical to SEQ ID NO: 117711

SEQ ID NO: 226915 - RNA, 64 nt, Homo Sapiens; identical to SEQ ID NO: 117712

SEQ ID NO: 226916 - RNA, 64 nt, Homo Sapiens; identical to SEQ ID NO: 117713

SEQ ID NO: 226917 - RNA, 64 nt, Homo Sapiens; identical to SEQ ID NO: 117714

SEQ ID NO: 226918 - RNA, 64 nt, Homo Sapiens; identical to SEQ ID NO: 117715

SEQ ID NO: 226919 - RNA, 64 nt, Homo Sapiens; identical to SEQ ID NO: 117716

SEQ ID NO: 226920 - RNA, 64 nt, Homo Sapiens; identical to SEQ ID NO: 117717

SEQ ID NO: 226921 - RNA, 64 nt, Homo Sapiens; identical to SEQ ID NO: 117718

SEQ ID NO: 226922 - RNA, 64 nt, Homo Sapiens; identical to SEQ ID NO: 117719

SEQ ID NO: 226923 - RNA, 64 nt, Homo Sapiens; identical to SEQ ID NO: 117720

SEQ ID NO: 226924 - RNA, 64 nt, Homo Sapiens; identical to SEQ ID NO: 117721

SEQ ID NO: 226925 - RNA, 64 nt, Homo Sapiens; identical to SEQ ID NO: 117722

SEQ ID NO: 226926 - RNA, 64 nt, Homo Sapiens; identical to SEQ ID NO: 117723

SEQ ID NO: 226927 - RNA, 64 nt, Homo Sapiens; identical to SEQ ID NO: 117724

SEQ ID NO: 226928 - RNA, 64 nt, Homo Sapiens; identical to SEQ ID NO: 117725

SEQ ID NO: 226929 - RNA, 64 nt, Homo Sapiens; identical to SEQ ID NO: 117726

SEQ ID NO: 226930 - RNA, 64 nt, Homo Sapiens; identical to SEQ ID NO: 117727

SEQ ID NO: 226931 - RNA, 64 nt, Homo Sapiens; identical to SEQ ID NO: 117728

SEQ ID NO: 226932 - RNA, 64 nt, Homo Sapiens; identical to SEQ ID NO: 117729

SEQ ID NO: 226933 - RNA, 64 nt, Homo Sapiens; identical to SEQ ID NO: 117730

SEQ ID NO: 226934 - RNA, 64 nt, Homo Sapiens; identical to SEQ ID NO: 117731

SEQ ID NO: 226935 - RNA, 64 nt, Homo Sapiens; identical to SEQ ID NO: 117732

SEQ ID NO: 226936 - RNA, 64 nt, Homo Sapiens; identical to SEQ ID NO: 117733

SEQ ID NO: 226937 - RNA, 64 nt, Homo Sapiens; identical to SEQ ID NO: 117734

SEQ ID NO: 226938 - RNA, 64 nt, Homo Sapiens; identical to SEQ ID NO: 117735

SEQ ID NO: 226939 - RNA, 64 nt, Homo Sapiens; identical to SEQ ID NO: 117736

SEQ ID NO: 226940 - RNA, 64 nt, Homo Sapiens; identical to SEQ ID NO: 117737

SEQ ID NO: 226941 - RNA, 64 nt, Homo Sapiens; identical to SEQ ID NO: 117738

SEQ ID NO: 226942 - RNA, 64 nt, Homo Sapiens; identical to SEQ ID NO: 117739

SEQ ID NO: 226943 - RNA, 64 nt, Homo Sapiens; identical to SEQ ID NO: 117740

SEQ ID NO: 226944 - RNA, 64 nt, Homo Sapiens; identical to SEQ ID NO: 117741

SEQ ID NO: 226945 - RNA, 64 nt, Homo Sapiens; identical to SEQ ID NO: 117742

SEQ ID NO: 226946 - RNA, 64 nt, Homo Sapiens; identical to SEQ ID NO: 117743

SEQ ID NO: 226947 - RNA, 64 nt, Homo Sapiens; identical to SEQ ID NO: 117744

SEQ ID NO: 226948 - RNA, 64 nt, Homo Sapiens; identical to SEQ ID NO: 117745

SEQ ID NO: 226949 - RNA, 64 nt, Homo Sapiens; identical to SEQ ID NO: 117746

SEQ ID NO: 226950 - RNA, 64 nt, Homo Sapiens; identical to SEQ ID NO: 117747

SEQ ID NO: 226951 - RNA, 64 nt, Homo Sapiens; identical to SEQ ID NO: 117748

SEQ ID NO: 226952 - RNA, 64 nt, Homo Sapiens; identical to SEQ ID NO: 117749

SEQ ID NO: 226953 - RNA, 64 nt, Homo Sapiens; identical to SEQ ID NO: 117750

SEQ ID NO: 226954 - RNA, 64 nt, Homo Sapiens; identical to SEQ ID NO: 117751

SEQ ID NO: 226955 - RNA, 64 nt, Homo Sapiens; identical to SEQ ID NO: 117752

SEQ ID NO: 226956 - RNA, 64 nt, Homo Sapiens; identical to SEQ ID NO: 117753

SEQ ID NO: 226957 - RNA, 64 nt, Homo Sapiens; identical to SEQ ID NO: 117754

SEQ ID NO: 226958 - RNA, 64 nt, Homo Sapiens; identical to SEQ ID NO: 117755

SEQ ID NO: 226959 - RNA, 64 nt, Homo Sapiens; identical to SEQ ID NO: 117756

SEQ ID NO: 226960 - RNA, 64 nt, Homo Sapiens; identical to SEQ ID NO: 117757

SEQ ID NO: 226961 - RNA, 64 nt, Homo Sapiens; identical to SEQ ID NO: 117758

SEQ ID NO: 226962 - RNA, 64 nt, Homo Sapiens; identical to SEQ ID NO: 117759

SEQ ID NO: 226963 - RNA, 64 nt, Homo Sapiens; identical to SEQ ID NO: 117760

SEQ ID NO: 226964 - RNA, 64 nt, Homo Sapiens; identical to SEQ ID NO: 117761

SEQ ID NO: 226965 - RNA, 64 nt, Homo Sapiens; identical to SEQ ID NO: 117762

SEQ ID NO: 226966 - RNA, 64 nt, Homo Sapiens; identical to SEQ ID NO: 117763

SEQ ID NO: 226967 - RNA, 64 nt, Homo Sapiens; identical to SEQ ID NO: 117764

SEQ ID NO: 226968 - RNA, 64 nt, Homo Sapiens; identical to SEQ ID NO: 117765

SEQ ID NO: 226969 - RNA, 64 nt, Homo Sapiens; identical to SEQ ID NO: 117766

SEQ ID NO: 226970 - RNA, 64 nt, Homo Sapiens; identical to SEQ ID NO: 117767

SEQ ID NO: 226971 - RNA, 64 nt, Homo Sapiens; identical to SEQ ID NO: 117768

SEQ ID NO: 226972 - RNA, 64 nt, Homo Sapiens; identical to SEQ ID NO: 117769

SEQ ID NO: 226973 - RNA, 64 nt, Homo Sapiens; identical to SEQ ID NO: 117770

SEQ ID NO: 226974 - RNA, 64 nt, Homo Sapiens; identical to SEQ ID NO: 117771

SEQ ID NO: 226975 - RNA, 64 nt, Homo Sapiens; identical to SEQ ID NO: 117772

SEQ ID NO: 226976 - RNA, 64 nt, Homo Sapiens; identical to SEQ ID NO: 117773

SEQ ID NO: 226977 - RNA, 64 nt, Homo Sapiens; identical to SEQ ID NO: 117774

SEQ ID NO: 226978 - RNA, 64 nt, Homo Sapiens; identical to SEQ ID NO: 117775

SEQ ID NO: 226979 - RNA, 64 nt, Homo Sapiens; identical to SEQ ID NO: 117776

SEQ ID NO: 226980 - RNA, 64 nt, Homo Sapiens; identical to SEQ ID NO: 117777

SEQ ID NO: 226981 - RNA, 64 nt, Homo Sapiens; identical to SEQ ID NO: 117778

SEQ ID NO: 226982 - RNA, 64 nt, Homo Sapiens; identical to SEQ ID NO: 117779

SEQ ID NO: 226983 - RNA, 64 nt, Homo Sapiens; identical to SEQ ID NO: 117780

SEQ ID NO: 226984 - RNA, 64 nt, Homo Sapiens; identical to SEQ ID NO: 117781

SEQ ID NO: 226985 - RNA, 64 nt, Homo Sapiens; identical to SEQ ID NO: 117782

SEQ ID NO: 226986 - RNA, 64 nt, Homo Sapiens; identical to SEQ ID NO: 117783

SEQ ID NO: 226987 - RNA, 64 nt, Homo Sapiens; identical to SEQ ID NO: 117784

SEQ ID NO: 226988 - RNA, 64 nt, Homo Sapiens; identical to SEQ ID NO: 117785

SEQ ID NO: 226989 - RNA, 64 nt, Homo Sapiens; identical to SEQ ID NO: 117786

SEQ ID NO: 226990 - RNA, 59 nt, Homo Sapiens; identical to SEQ ID NO: 58889

SEQ ID NO: 226991 - RNA, 64 nt, Homo Sapiens; identical to SEQ ID NO: 117788

SEQ ID NO: 226992 - RNA, 64 nt, Homo Sapiens; identical to SEQ ID NO: 117789

SEQ ID NO: 226993 - RNA, 64 nt, Homo Sapiens; identical to SEQ ID NO: 117790

SEQ ID NO: 226994 - RNA, 64 nt, Homo Sapiens; identical to SEQ ID NO: 117791

SEQ ID NO: 226995 - RNA, 64 nt, Homo Sapiens; identical to SEQ ID NO: 117792

SEQ ID NO: 226996 - RNA, 64 nt, Homo Sapiens; identical to SEQ ID NO: 117793

SEQ ID NO: 226997 - RNA, 64 nt, Homo Sapiens; identical to SEQ ID NO: 117794

SEQ ID NO: 226998 - RNA, 64 nt, Homo Sapiens; identical to SEQ ID NO: 117795

SEQ ID NO: 226999 - RNA, 64 nt, Homo Sapiens; identical to SEQ ID NO: 117796

SEQ ID NO: 227000 - RNA, 64 nt, Homo Sapiens; identical to SEQ ID NO: 117797

SEQ ID NO: 227001 - RNA, 64 nt, Homo Sapiens; identical to SEQ ID NO: 117798

SEQ ID NO: 227002 - RNA, 64 nt, Homo Sapiens; identical to SEQ ID NO: 117799

SEQ ID NO: 227003 - RNA, 64 nt, Homo Sapiens; identical to SEQ ID NO: 117800

SEQ ID NO: 227004 - RNA, 64 nt, Homo Sapiens; identical to SEQ ID NO: 117801

SEQ ID NO: 227005 - RNA, 64 nt, Homo Sapiens; identical to SEQ ID NO: 117802

SEQ ID NO: 227006 - RNA, 64 nt, Homo Sapiens; identical to SEQ ID NO: 117803

SEQ ID NO: 227007 - RNA, 64 nt, Homo Sapiens; identical to SEQ ID NO: 117804

SEQ ID NO: 227008 - RNA, 64 nt, Homo Sapiens; identical to SEQ ID NO: 117805

SEQ ID NO: 227009 - RNA, 64 nt, Homo Sapiens; identical to SEQ ID NO: 117806

SEQ ID NO: 227010 - RNA, 64 nt, Homo Sapiens; identical to SEQ ID NO: 117807

SEQ ID NO: 227011 - RNA, 64 nt, Homo Sapiens; identical to SEQ ID NO: 117808

SEQ ID NO: 227012 - RNA, 64 nt, Homo Sapiens; identical to SEQ ID NO: 117809

SEQ ID NO: 227013 - RNA, 64 nt, Homo Sapiens; identical to SEQ ID NO: 117810

SEQ ID NO: 227014 - RNA, 64 nt, Homo Sapiens; identical to SEQ ID NO: 117811

SEQ ID NO: 227015 - RNA, 64 nt, Homo Sapiens; identical to SEQ ID NO: 117812

SEQ ID NO: 227016 - RNA, 64 nt, Homo Sapiens; identical to SEQ ID NO: 117813

SEQ ID NO: 227017 - RNA, 64 nt, Homo Sapiens; identical to SEQ ID NO: 117814

SEQ ID NO: 227018 - RNA, 64 nt, Homo Sapiens; identical to SEQ ID NO: 117815

SEQ ID NO: 227019 - RNA, 64 nt, Homo Sapiens; identical to SEQ ID NO: 117816

SEQ ID NO: 227020 - RNA, 64 nt, Homo Sapiens; identical to SEQ ID NO: 117817

SEQ ID NO: 227021 - RNA, 64 nt, Homo Sapiens; identical to SEQ ID NO: 117818

SEQ ID NO: 227022 - RNA, 64 nt, Homo Sapiens; identical to SEQ ID NO: 117819

SEQ ID NO: 227023 - RNA, 64 nt, Homo Sapiens; identical to SEQ ID NO: 117820

SEQ ID NO: 227024 - RNA, 64 nt, Homo Sapiens; identical to SEQ ID NO: 117821

SEQ ID NO: 227025 - RNA, 64 nt, Homo Sapiens; identical to SEQ ID NO: 117822

SEQ ID NO: 227026 - RNA, 64 nt, Homo Sapiens; identical to SEQ ID NO: 117823

SEQ ID NO: 227027 - RNA, 64 nt, Homo Sapiens
ggcucuuagagaaaucuggagaacuauaccugcuucagugaaauaauuacagaauauacuuaga

SEQ ID NO: 227028 - RNA, 64 nt, Homo Sapiens
agcuaauuggacuuuuauggcucuaucuuuuccuucagugaagaacccuauuuaaaacuggguc

SEQ ID NO: 227029 - RNA, 64 nt, Homo Sapiens
gagaucacuccaaccugggcggggugugaagguuucagugaacuaggagaauugcuagaaccug

SEQ ID NO: 227030 - RNA, 64 nt, Homo Sapiens
cccugagggcaggggcugucugucuccccacccaucagugaaaucaugauuaguuauguuugcc

SEQ ID NO: 227031 - RNA, 64 nt, Homo Sapiens
uguaacuagcauguuacaaggcuuccacccaccaucagugaagagaacuugaggcugaaacauu

SEQ ID NO: 227032 - RNA, 64 nt, Homo Sapiens
cucauuauacaaagagaaccagcaagaaucuuucucagugaaaugaagauuggaaugcuuccaa

SEQ ID NO: 227033 - RNA, 64 nt, Homo Sapiens
auaacuuuauuauaugaguucuguuaguugguugucagugaacauguauauugucagugaagaa

SEQ ID NO: 227034 - RNA, 64 nt, Homo Sapiens
acuguuaguugguugucaguacacuuguauauugucagugaagaugaaggcucgaaggcacugc

SEQ ID NO: 227035 - RNA, 64 nt, Homo Sapiens
caccacaaauugaaacucaguccauuuucccucaucagugaagaaagagaucaguaguaagaau

SEQ ID NO: 227036 - RNA, 64 nt, Homo Sapiens
acuaaugacagauuuuaugcagacaaaccauuauucagugaauuauguguguaauuauggcuaa

SEQ ID NO: 227037 - RNA, 64 nt, Homo Sapiens
auauccuaaaguaucacauaguuaaauuuuucagucagugaagaccgggagggaaugucaguga

SEQ ID NO: 227038 - RNA, 64 nt, Homo Sapiens
aaauuuuucagucagugaagaccgggagggaaugucagugaauuggcuugaauguucuguggca

SEQ ID NO: 227039 - RNA, 64 nt, Homo Sapiens
uucugaaucugguuuucaaauccaguggagccuuucagugaaauaggugacuauuaaaaaagua

SEQ ID NO: 227040 - RNA, 64 nt, Homo Sapiens
gguaguggagcuucccuccccacccccauauguaucagugaagccuuugaaauuacuuaaggca

SEQ ID NO: 227041 - RNA, 64 nt, Homo Sapiens
uuugggugccaaacaccuacaacagcauucuucuucagugaaauacuuugguuugauauuaaga

SEQ ID NO: 227042 - RNA, 64 nt, Homo Sapiens
aaucuaauguuucaaauguaguuuccuucccucaucagugaaaauucaaguagaacagaagccc

SEQ ID NO: 227043 - RNA, 64 nt, Homo Sapiens
ucuguuguguuuuugccuaaauacuaguaacauaucagugaaaaacccuaauuuuuuuucucuu

SEQ ID NO: 227044 - RNA, 64 nt, Homo Sapiens
cagugugaucugaucaacacucugguuaccuuggucagugaaaagaugcuacuauauugcuuuu

SEQ ID NO: 227045 - RNA, 64 nt, Homo Sapiens
gagaaaaaauucugaacugaauuuuauaacaguuucagugaauaaagaguuaucuuucagugaa

SEQ ID NO: 227046 - RNA, 64 nt, Homo Sapiens
uuuauaacaguuucagugaauuaagaguuaucuuucagugaaaucaggugucagaucagaauuu

SEQ ID NO: 227047 - RNA, 64 nt, Homo Sapiens
aaaaaggaaugaaguacugacacaugcugugacaucagugaacccugaaaacauccuucucagu

SEQ ID NO: 227048 - RNA, 64 nt, Homo Sapiens
gcugugacaucagugaacccugaaaacauccuucucagugaaacaagccagagagauguacaag

SEQ ID NO: 227049 - RNA, 64 nt, Homo Sapiens
uuauuagcaccagaaaucucuaaaguucuuauugucagugaacucuucuuuagguggaagaaag

SEQ ID NO: 227050 - RNA, 64 nt, Homo Sapiens
ggcucauaucaugacagaauuuguuccucacgguucagugaacaucuauucuuauuuuucaucc

SEQ ID NO: 227051 - RNA, 64 nt, Homo Sapiens
aguagaauauaaaaaaauauagacuccaguguguucagugaauaugaaaacuuauuuuagcuuu

SEQ ID NO: 227052 - RNA, 64 nt, Homo Sapiens
agaaagaucugauuuggccuucucuaccauugaaucagugaacucuucauguucaaguagaagu

SEQ ID NO: 227053 - RNA, 64 nt, Homo Sapiens
uacucuuuugaaguguuuuagucuaguuauuggaucagugaaaaacauuaguauacguuuuuaa

SEQ ID NO: 227054 - RNA, 64 nt, Homo Sapiens
aagcauuagauuccuuuccugugugaagaaagccucagugaaacaggucuuugccauaacuuua

SEQ ID NO: 227055 - RNA, 64 nt, Homo Sapiens
caacuaaagacaacaaacuaucagauucauucauucagugaagcagccucugauucucuaagag

SEQ ID NO: 227056 - RNA, 64 nt, Homo Sapiens
uuauuguuuuaauuuuuaaaccuaauuuauucacucagugaacauucuuaccuaagcaaggcua

SEQ ID NO: 227057 - RNA, 64 nt, Homo Sapiens
cagggagaacagaaagguagaguuacuaaggccuucagugaacagaaaggagcagagagcaaga

SEQ ID NO: 227058 - RNA, 64 nt, Homo Sapiens
cgucgggccaggaagagcaccuguugcugcaagcucagugaaguggggcacucccagaccugcc

SEQ ID NO: 227059 - RNA, 64 nt, Homo Sapiens
gugaagaugcguugggcugcaaguaacagaaaucucagugaacaguggccuggcgugguggcuc

SEQ ID NO: 227060 - RNA, 64 nt, Homo Sapiens
augaucauugcuagaacugagagaccagccuggcucagugaacuucagggcguuccguucauuc

SEQ ID NO: 227061 - RNA, 64 nt, Homo Sapiens
gaagaaccuccuuuuuaucaucaucccuuuaaacucagugaacccaaaccuauuuuuuucaauc

SEQ ID NO: 227062 - RNA, 64 nt, Homo Sapiens
cuuauggcuaggcuacuguaacacuugccuguaaucagugaagggcugugcaccuuguacuauu

SEQ ID NO: 227063 - RNA, 65 nt, Homo Sapiens
accuacagguuguguacuuuucauaaugguuuccaugaauguaguacguucauacaggcuucauu

SEQ ID NO: 227064 - RNA, 65 nt, Homo Sapiens
ucuuacaaaaauggaguauuuuaguaugaauuugcugaauguaagaccguggacuguuuuuuaua

SEQ ID NO: 227065 - RNA, 65 nt, Homo Sapiens
uagaaaguggggucaggaggccaagaaagggaauaugaauguauauccaagucacucaggaacuu

SEQ ID NO: 227066 - RNA, 65 nt, Homo Sapiens
gcauccucugggaucuucugagguggacagcacuuugaauguagcauuucacuggaacagagucu

SEQ ID NO: 227067 - RNA, 65 nt, Homo Sapiens
uugauucuuggucuauaauugcagauguuauuguaugaauguaccauaauauauuugagcagucc

SEQ ID NO: 227068 - RNA, 65 nt, Homo Sapiens
ccguuguuuaggguagaauaggcuguguauuuacaugaauguauaauaucuaugucagcaguauu

SEQ ID NO: 227069 - RNA, 65 nt, Homo Sapiens
gaccuaccucaaacacacuguuuccacccucuucuugaauguauucaguagccuuuacugaaugu

SEQ ID NO: 227070 - RNA, 65 nt, Homo Sapiens
uguuuuaauaugucaguuauugcccuuuuauauugugaauguaaugugcauaagcuauauccgua

SEQ ID NO: 227071 - RNA, 65 nt, Homo Sapiens
uuuuguaucucacaauucuggucuagauucaguuaugaauguaggcauuaguuaaaauuaacaag

SEQ ID NO: 227072 - RNA, 65 nt, Homo Sapiens
uugagaaaaacaaugagcugagaggcagacuucccugaauguauugaacuuggaaagaaaugccc

SEQ ID NO: 227073 - RNA, 65 nt, Homo Sapiens
uauuuuguuguguuaaaaguacuuuucuugauuuuugaauguauuuguuucagcagaagucauuu

SEQ ID NO: 227074 - RNA, 54 nt, Homo Sapiens
aagaaaugcagaaugcuuaaaggcugaauguaggauucuucaguauguggaaag

SEQ ID NO: 227075 - RNA, 65 nt, Homo Sapiens
acuccuaagagaguuguaaaaauagaggcuuggcuugaauguacauagaugguaccuggcaugga

SEQ ID NO: 227076 - RNA, 65 nt, Homo Sapiens
gggugacuuucauuccaguugcugggacggaaggcugaauguagggucauuuuguaugggauaug

SEQ ID NO: 227077 - RNA, 65 nt, Homo Sapiens
uuauagauauaggacaguacuguaucauaccucugugaauguaaaauaucuuguaccugcuuuau

SEQ ID NO: 227078 - RNA, 65 nt, Homo Sapiens
caaguaaucuagaagaauguggauacucuuaggcgugaauguaaaugccuuaauauugaaggucc

SEQ ID NO: 227079 - RNA, 65 nt, Homo Sapiens
caagauuucuuuauuuacaaaugauuacauuuaaaugaauguacauucuucucacugacuuuggu

SEQ ID NO: 227080 - RNA, 65 nt, Homo Sapiens
acccccgucuuauuaaggagcuuuuaaaguuuuucugaauguauagacauuucucggguuccuac

SEQ ID NO: 227081 - RNA, 65 nt, Homo Sapiens
ugcaacuguggcuuagcuaauauugcaauguggcuugaauguagguagcauccuuugaugcuucu

SEQ ID NO: 227082 - RNA, 65 nt, Homo Sapiens
gcugcuucaugaguagaaauuucaacaacucuuuuugaauguaugaagaguagcaguccccuuug

SEQ ID NO: 227083 - RNA, 65 nt, Homo Sapiens
gguuaaagguuuuggcugcuguaagaaugugaauuugaauguauuuugaauuguaagagcaaaag

SEQ ID NO: 227084 - RNA, 65 nt, Homo Sapiens; identical to SEQ ID NO: 58812

SEQ ID NO: 227085 - RNA, 65 nt, Homo Sapiens; identical to SEQ ID NO: 58813

SEQ ID NO: 227086 - RNA, 65 nt, Homo Sapiens
acuaguggaagauaguguucugcuuauaauuaaacugaauguagaguaucucuguauguuaauug

SEQ ID NO: 227087 - RNA, 65 nt, Homo Sapiens
auacugucaauuuuccuuguuugucuacuuguaagugaauguaacgaugaacuguauuuugcauu

SEQ ID NO: 227088 - RNA, 65 nt, Homo Sapiens
gacacaucugggaguauuuugcacugagugaaggaugaauguaugcagcaacaacccucacauau

SEQ ID NO: 227089 - RNA, 65 nt, Homo Sapiens
gcacuuaguacaguauaugaauuaaaaugaggaaaugaauguaaacucauaggguuguugugagg

SEQ ID NO: 227090 - RNA, 65 nt, Homo Sapiens
cuucuguaccaaaacuugaacguggcacucauaguugaauguauaaccaauguuugaugggaaaa

SEQ ID NO: 227091 - RNA, 65 nt, Homo Sapiens
gaaugaaaccuucugacacaaugucaacuugucauugaauguaaauccuuuucccucucaccuaa

SEQ ID NO: 227092 - RNA, 65 nt, Homo Sapiens
gagagaaaauguuuugaaaauaaggccuuuaguaaugaauguaauguagcaugauguauuuaaag

SEQ ID NO: 227093 - RNA, 65 nt, Homo Sapiens
aaggauauauuuaguuugaguacaaaaugucuuuuugaauguauccuaacuagcuuauuaaaauu

SEQ ID NO: 227094 - RNA, 65 nt, Homo Sapiens
cuguagauuuuuaacaaagcaguuuagccuuuacuugaauguauacaaauauaguuggcauugga

SEQ ID NO: 227095 - RNA, 65 nt, Homo Sapiens
caacauuucaauuugcauucgaaauagcaacgagaugaauguaucuuaaaggucuacuuuaauca

SEQ ID NO: 227096 - RNA, 65 nt, Homo Sapiens
uuuauauucucuguauaucuuuuucuaaaauaaagugaauguauucuuacucuaugagucuucau

SEQ ID NO: 227097 - RNA, 65 nt, Homo Sapiens
aaggaauucaacugaaauccauaaugacaauuauuugaauguaacuauuagaauaaaaugugcaa

SEQ ID NO: 227098 - RNA, 65 nt, Homo Sapiens
augacuauuugggaggacaccccuaaccaauacauugaauguaugaggugguuuagggauuuugg

SEQ ID NO: 227099 - RNA, 65 nt, Homo Sapiens; identical to SEQ ID NO: 58814

SEQ ID NO: 227100 - RNA, 65 nt, Homo Sapiens; identical to SEQ ID NO: 58815

SEQ ID NO: 227101 - RNA, 65 nt, Homo Sapiens
gaaaggaaauauucagagacuaugcccaaauauauugaauguacaaagauguauauagauguaua

SEQ ID NO: 227102 - RNA, 65 nt, Homo Sapiens
acgucucuguucugccagagggaagagcccagaucugaauguaaaccuauaccuuaccagagcau

SEQ ID NO: 227103 - RNA, 65 nt, Homo Sapiens
uuuuucuggacaagcuuacaucuccuuuacuauguugaauguauuugagucaaggaguguaaccu

SEQ ID NO: 227104 - RNA, 65 nt, Homo Sapiens
ugaaccacuguaauagcauuucuggaguuuccucuugaauguacagcucccauguccccaagacc

SEQ ID NO: 227105 - RNA, 65 nt, Homo Sapiens
uaggaacaagggggaaagucugcuuucauuuuccuugaauguacaggcagccucuagagccuucu

SEQ ID NO: 227106 - RNA, 65 nt, Homo Sapiens
uaggcuuuugacaaaaguuguggauuugggcaaacugaauguauauuacaauugugaaaaccuca

SEQ ID NO: 227107 - RNA, 65 nt, Homo Sapiens
uauguaguguauuaagaagcuugguagauaguuauugaauguauuguagcuacacaguaaguagc

SEQ ID NO: 227108 - RNA, 65 nt, Homo Sapiens
aaucuuagugcuggugcugacaauugcaaacaaacugaauguacauauguaaauggcucacaagu

SEQ ID NO: 227109 - RNA, 65 nt, Homo Sapiens
uacucagaagaaauaaaaaauuuagcuaaagcaauugaauguagaauuugcauguuuuuuguuaa

SEQ ID NO: 227110 - RNA, 65 nt, Homo Sapiens
uauuuaaaaggagccucuuguaaauguagaaguacugaauguauaacagaguuuaaaugaauaca

SEQ ID NO: 227111 - RNA, 65 nt, Homo Sapiens
aacaugaccuccguguaguguuguauuuagugucuugaauguaagauuuuugcauugccuucggu

SEQ ID NO: 227112 - RNA, 65 nt, Homo Sapiens; identical to SEQ ID NO: 58816

SEQ ID NO: 227113 - RNA, 65 nt, Homo Sapiens; identical to SEQ ID NO: 58817

SEQ ID NO: 227114 - RNA, 65 nt, Homo Sapiens
guguaggaaaguacuuaauuacuugagagaaacugugaauguaagaaaaacaugaacagucacau

SEQ ID NO: 227115 - RNA, 65 nt, Homo Sapiens
gugggaaaaauauugcuacaauuuuuuuuaaucucugaauguaauuucgauacuguguacauagc

SEQ ID NO: 227116 - RNA, 65 nt, Homo Sapiens
aacaugauuuuauucuaugccaacauuugggccucugaauguaucuguuauuugaauuuaaguau

SEQ ID NO: 227117 - RNA, 65 nt, Homo Sapiens
auauauuuauacacauacaauuuauguuuuccuguugaauguauuuuuaugagauuuuaaccaga

SEQ ID NO: 227118 - RNA, 65 nt, Homo Sapiens
uuaucugaaagaaguuucuggguuaggagaaguaaugaauguauccauuuguacaugguuuacau

SEQ ID NO: 227119 - RNA, 65 nt, Homo Sapiens
ugaacaaucauuaauucuucgauauuucuguagcuugaauguaacugcuuuaagaaagguucuca

SEQ ID NO: 227120 - RNA, 65 nt, Homo Sapiens
uagaguacuuuuuaaaauuauuucucacaaagaaaugaauguacaauccaaugaaaacauuuguu

SEQ ID NO: 227121 - RNA, 65 nt, Homo Sapiens
uuaaaacaaugaaagagcauuuaucguuugucccuugaauguagaauuuguuuuugauuucauaa

SEQ ID NO: 227122 - RNA, 65 nt, Homo Sapiens
cccaggggugggaaguuuucauuugcaggggggucugaauguaacucaccauguggugugcaagg

SEQ ID NO: 227123 - RNA, 65 nt, Homo Sapiens
acaauguauuauuaucacugucagaugagcaugcuugaauguagcaugacugccucuuuuugcuu

SEQ ID NO: 227124 - RNA, 65 nt, Homo Sapiens
aagacauccaaucaauaaugaaggaaauuuuuuucugaauguagguuugagugaggggcaccucu

SEQ ID NO: 227125 - RNA, 65 nt, Homo Sapiens
cagucccagccagaagaaucucugaaagcauauugugaauguauacaauguaguacaaacaaucu

SEQ ID NO: 227126 - RNA, 65 nt, Homo Sapiens
cuuuccuccugucuuagaagaacagaccuaacuagugaauguauuaaugaaaaugcaucuauuuc

SEQ ID NO: 227127 - RNA, 65 nt, Homo Sapiens
caccacacagcagaauuucuaauggaaguuuguugugaauguaaaggagggagcauucuuugcuu

SEQ ID NO: 227128 - RNA, 65 nt, Homo Sapiens
aaauuuaauguaguaacucacuuuuccauauauuuugaauguauauuucuauuuaugauaccaau

SEQ ID NO: 227129 - RNA, 65 nt, Homo Sapiens
uaacuugucuuuuuguuaugcaaaugagauuucuuugaauguauuguucuguuuguguuauuuca

SEQ ID NO: 227130 - RNA, 65 nt, Homo Sapiens
uuuauguaauuuagggaggacuggucuguaauuucugaauguauauagaauaauauuuauguuua

SEQ ID NO: 227131 - RNA, 65 nt, Homo Sapiens
cgagucauuucguucccugauuauuuauccuugucugaauguauuuauguguauauuuguagauu

SEQ ID NO: 227132 - RNA, 65 nt, Homo Sapiens
aucugaacuauaucuugacaaauauuauucaaacuugaauguaaauauauacaguauguauauuu

SEQ ID NO: 227133 - RNA, 65 nt, Homo Sapiens
aauaaagaaaugggugacaggcuuaaccucaccuaugaauguacaguauguggauuugugaaacu

SEQ ID NO: 227134 - RNA, 65 nt, Homo Sapiens; identical to SEQ ID NO: 58818

SEQ ID NO: 227135 - RNA, 65 nt, Homo Sapiens; identical to SEQ ID NO: 58819

SEQ ID NO: 227136 - RNA, 65 nt, Homo Sapiens
acacuguucugauaucucugauugucauguggauuugaauguagcuugacagagggaaugucuaa

SEQ ID NO: 227137 - RNA, 65 nt, Homo Sapiens
aaacagaaaagaacaacagcaacaaaaacauugugugaauguauguuuguauguguguauguaua

SEQ ID NO: 227138 - RNA, 65 nt, Homo Sapiens
uuuaacuauugauuuuuuuuaaaaaaaauugucuuugaauguauuggaaguagacaugcauuaac

SEQ ID NO: 227139 - RNA, 65 nt, Homo Sapiens
caucaggacaugcgucuucacuuuucagccagcacugaauguaucagggcacacacugaaguugg

SEQ ID NO: 227140 - RNA, 65 nt, Homo Sapiens
uugcguaucccaaggcacugcgcgugcccuguugcugaauguaugcacuuguccguagggucaca

SEQ ID NO: 227141 - RNA, 65 nt, Homo Sapiens
uuugaacuguuuaacacuuuuucauauaacugagaugaauguaauaagguauuuacacauacaac

SEQ ID NO: 227142 - RNA, 65 nt, Homo Sapiens
ccgugaagggagugccucucccugcccugagacagugaauguagugcuguucccuaaucccaccc

SEQ ID NO: 227143 - RNA, 65 nt, Homo Sapiens
aacaucauauggucugaaaauaauauaaauuuuguugaauguauuguaaauucacagcaguaaga

SEQ ID NO: 227144 - RNA, 65 nt, Homo Sapiens
auacaauucuguuuuaaucucugauaacucaaaagugaauguauacuggagugaauuaaguucac

SEQ ID NO: 227145 - RNA, 65 nt, Homo Sapiens
uacaaagacucagcuacuucuaaggaagauauguaugaauguauauuacaguguaguguuuauuc

SEQ ID NO: 227146 - RNA, 65 nt, Homo Sapiens
cagcccacauccauuccagagugggcagcuggcucugaauguagcggaggccucugcaagauucu

SEQ ID NO: 227147 - RNA, 65 nt, Homo Sapiens
aauaaaaguccuuaaaauaacagcaguaucuaucaugaauguagaaagacaucaugagaaaauac

SEQ ID NO: 227148 - RNA, 65 nt, Homo Sapiens
gaaugugggaacgcuuugauuagugagaaaccacgugaauguaauaaacaugggagaauccauac

SEQ ID NO: 227149 - RNA, 65 nt, Homo Sapiens; identical to SEQ ID NO: 58820

SEQ ID NO: 227150 - RNA, 65 nt, Homo Sapiens; identical to SEQ ID NO: 58821

SEQ ID NO: 227151 - RNA, 65 nt, Homo Sapiens
ggaagcaaggccuguauugcgaaucuuacugguauugaauguaaaucccuuccagcuuuucugua

SEQ ID NO: 227152 - RNA, 65 nt, Homo Sapiens
auuggcauaucauggaaaaucaucugaaauuuuaaugaauguauagauaagaauaauucagguag

SEQ ID NO: 227153 - RNA, 65 nt, Homo Sapiens
acagucuucauuguacuauucaauuccuuauugucugaauguaauuugcccugcaaauaaaaaga

SEQ ID NO: 227154 - RNA, 65 nt, Homo Sapiens
uaauuuuaugaauuauuuauuaguuuauuuuuuagugaauguauuuuuuucauuuuuuuacuuug

SEQ ID NO: 227155 - RNA, 65 nt, Homo Sapiens
aagacccacacuauugagacgaaguaagauccuuuugaauguacauaaaagcaaguuauaucagu

SEQ ID NO: 227156 - RNA, 65 nt, Homo Sapiens
aaaggugaagggacauuacaccaaauauuuugcacugaauguaccauaaagguaaaaaaaauucc

SEQ ID NO: 227157 - RNA, 65 nt, Homo Sapiens
cuagcauacaaggaucucaaaacaguagaaccuuaugaauguauacagucaaauggcuucaugag

SEQ ID NO: 227158 - RNA, 65 nt, Homo Sapiens
guauauaugaugucauuaauaauaauccaugauuuugaauguaaaugcauuugacacaauauugu

SEQ ID NO: 227159 - RNA, 65 nt, Homo Sapiens
auguuuucauauuuuucaaaauagguuuuuauuguugaauguacaucuaccccagccccucaaaa

SEQ ID NO: 227160 - RNA, 65 nt, Homo Sapiens
aaagaucauuuuauuaucuuuaacuguaucuauuuugaauguaaauuuaaaaaaaguaauucucu

SEQ ID NO: 227161 - RNA, 65 nt, Homo Sapiens
uuguauaauuacuugauucacacagugagaaaaaaugaauguauuccuguuuuugaagagaagaa

SEQ ID NO: 227162 - RNA, 65 nt, Homo Sapiens
uguuuaaggcucuucauccugguuagcaaaaggugugaauguaaugugauggaauuuaaaaguuu

SEQ ID NO: 227163 - RNA, 65 nt, Homo Sapiens
caacuggaauagcuaauuacagucuauuaaaacugugaauguauguagcaauccugcgugugaag

SEQ ID NO: 227164 - RNA, 65 nt, Homo Sapiens; identical to SEQ ID NO: 58822

SEQ ID NO: 227165 - RNA, 65 nt, Homo Sapiens; identical to SEQ ID NO: 58823

SEQ ID NO: 227166 - RNA, 65 nt, Homo Sapiens
agggggaacauuguaaagaaacaaaaagguccagaugaauguaugcuagaaauaaaaguugaaag

SEQ ID NO: 227167 - RNA, 65 nt, Homo Sapiens
gaauaaucuuccauuuggcugucgugaggaguaauugaauguaauccaucucuuacaaaauggag

SEQ ID NO: 227168 - RNA, 65 nt, Homo Sapiens
agcugcgcgggcuuauuuauuaacaggauaacccuugaauguagcagccccgggagggcggcaca

SEQ ID NO: 227169 - RNA, 65 nt, Homo Sapiens
ucggagggaaauuguaaauccuguguuucauuacuugaauguaguuaucuauugaaaauauauau

SEQ ID NO: 227170 - RNA, 65 nt, Homo Sapiens
uaaggguuucaaucaauuauuaaugcagagaguauugaauguaaaucagagcucucuagucuuca

SEQ ID NO: 227171 - RNA, 65 nt, Homo Sapiens
uacuuguuuaucuuguugcugcaaugagaaauaaaugaauguauguauuuuggugcagacaccug

SEQ ID NO: 227172 - RNA, 65 nt, Homo Sapiens
ucuauacacuaucaaauauauaaagcuuucuauauugaauguacauuauacagaucauucauaug

SEQ ID NO: 227173 - RNA, 65 nt, Homo Sapiens
uaccaucgccuuccaaagucagcacucuacacucuugaauguaccaaggaucucuuggcgacagu

SEQ ID NO: 227174 - RNA, 65 nt, Homo Sapiens
uuaugguauuuauuuucaguaguaaagacccagcuugaauguaaauuuuguauaguguaaguaug

SEQ ID NO: 227175 - RNA, 65 nt, Homo Sapiens
uuuccauuuuggcgcuauuacaaauagugcaacuaugaauguacugcauguuaccaucuuacuug

SEQ ID NO: 227176 - RNA, 65 nt, Homo Sapiens
auauucaauauuggucuguguuuaaguuuguuauuugaauguaauuuacauagaggaauauaaua

SEQ ID NO: 227177 - RNA, 65 nt, Homo Sapiens; identical to SEQ ID NO: 58824

SEQ ID NO: 227178 - RNA, 65 nt, Homo Sapiens; identical to SEQ ID NO: 58825

SEQ ID NO: 227179 - RNA, 65 nt, Homo Sapiens; identical to SEQ ID NO: 58826

SEQ ID NO: 227180 - RNA, 65 nt, Homo Sapiens; identical to SEQ ID NO: 58827

SEQ ID NO: 227181 - RNA, 65 nt, Homo Sapiens
uaaugugugguggccucagcuuuuuaugaagugcgugaauguaugagggucucucccucaggugu

SEQ ID NO: 227182 - RNA, 65 nt, Homo Sapiens
ucauucauauuuccucucaccucuguuuuuaaguaugaauguauuaaaguuuuggcaguaaaaua

SEQ ID NO: 227183 - RNA, 65 nt, Homo Sapiens
ccacugcaauuagaguauccaucucaaaaaaaaaaugaauguauguacagaaggaagggaguccc

SEQ ID NO: 227184 - RNA, 65 nt, Homo Sapiens
auuuuauuugcuucguaauauuuguucauauauuaugaauguauugauucuuaauguaugauuuc

SEQ ID NO: 227185 - RNA, 65 nt, Homo Sapiens
agagaaugucuuuguaacuguaagaccucuaugaaugaauguaucuuuacuauguauuuauacgu

SEQ ID NO: 227186 - RNA, 65 nt, Homo Sapiens
aagcauuuauuugucaauaagagaugggaaaaaccugaauguauauuggaaaccaucacuauuga

SEQ ID NO: 227187 - RNA, 65 nt, Homo Sapiens
guuuaauaaagaaauuacaauuaaagccuuuacacugaauguaauuaucauggugauuaugaugg

SEQ ID NO: 227188 - RNA, 65 nt, Homo Sapiens
ccuaaaugugguuauugaaaaucuaaucaguccuaugaauguaucauaaccauuucaccuggacu

SEQ ID NO: 227189 - RNA, 65 nt, Homo Sapiens
uggaauacuuacauauuauacccuaauucauacaaugaauguauuguuucuuauugcuuuuccuu

SEQ ID NO: 227190 - RNA, 65 nt, Homo Sapiens
uacuagggcaccauaauacugaaacuagcuaaaccugaauguaccgcuuccugauugcgcagacu

SEQ ID NO: 227191 - RNA, 65 nt, Homo Sapiens
uaaauaaacuguacauagguuuauuucacauccuaugaauguaugacuagcuuguuuugacaggu

SEQ ID NO: 227192 - RNA, 65 nt, Homo Sapiens
aauugauuuaaacaucaugucucagcguuagaauuugaauguauucugcauuaccuaauaauuac

SEQ ID NO: 227193 - RNA, 65 nt, Homo Sapiens
caauuguuauguguuuagaaaagacaucuuaauccugaauguaaacaaagucguuucaacucuua

SEQ ID NO: 227194 - RNA, 65 nt, Homo Sapiens
uuuauauuuugauuaagauuuguagauggcaguuaugaauguauaauaggaccaaaacagaauau

SEQ ID NO: 227195 - RNA, 65 nt, Homo Sapiens
ccuuccaacaccugacagaacagcaaaacaacggaugaauguagcagugaggcucccacaggcac

SEQ ID NO: 227196 - RNA, 65 nt, Homo Sapiens
gacagaaguaagccuggacaugauaugauuauuccugaauguacaugagaguuguauguaaccag

SEQ ID NO: 227197 - RNA, 65 nt, Homo Sapiens
uggcuagauguuuacauuuguaagaaauaacacugugaauguaaaacagagccauucccuuggaa

SEQ ID NO: 227198 - RNA, 65 nt, Homo Sapiens
ccuccagacguagccauuuccugacaucaagauguugaauguaaucuggucugagcugggccugu

SEQ ID NO: 227199 - RNA, 65 nt, Homo Sapiens
aaaaccucaauuuaagucuuuaaaagguuguauuuugaauguaaccaaaaguuuacaguuuuuug

SEQ ID NO: 227200 - RNA, 65 nt, Homo Sapiens
ugguuuuaugcugcuuuguuaggacagauguguuuugaauguaccauuauaagaagaauucuaug

SEQ ID NO: 227201 - RNA, 65 nt, Homo Sapiens
acaauguggaauuaccaaauuaaaagagaauacuaugaauguauucauauuuuuucuauauugaa

SEQ ID NO: 227202 - RNA, 65 nt, Homo Sapiens
caauggaauauuuucuaaaacauuuaguauacauuugaauguauuuuaaaccaugccaaacuacu

SEQ ID NO: 227203 - RNA, 65 nt, Homo Sapiens
aagguaauauuuuuaauaugauacauuacauauugugaauguauacuaaaaaaacauuuuaaaug

SEQ ID NO: 227204 - RNA, 65 nt, Homo Sapiens
uaagccuuuuuuuucuuuuuuuuuuuuuuggcaaaugaauguaccauuucaacuuugauuuuaau

SEQ ID NO: 227205 - RNA, 65 nt, Homo Sapiens
ugacuuuccucucccaguuuccagacagggcucuuugaauguaugucaaacucaguuacuccaga

SEQ ID NO: 227206 - RNA, 65 nt, Homo Sapiens
auuaucuuuuuguggugugaauaaaucuuuuaucuugaauguaauaagaauuugguggugucaau

SEQ ID NO: 227207 - RNA, 65 nt, Homo Sapiens
gacuuucuccaauguggacucugugugucagugaaugaauguaguaaaauucacuuuggaagguu

SEQ ID NO: 227208 - RNA, 65 nt, Homo Sapiens
ggugauaauuuugcuuuguguuacuuuuuugcucuugaauguaucguuaugauggucucuuauaa

SEQ ID NO: 227209 - RNA, 65 nt, Homo Sapiens
gauuucauugagggcaaggcugguggcagguacuaugaauguaauucauaauuuaaaaggaaaac

SEQ ID NO: 227210 - RNA, 65 nt, Homo Sapiens
aaauaaguaucuauguaaauuuguuuaaaauaaacugaauguauuuaaugguccauuuauauguu

SEQ ID NO: 227211 - RNA, 65 nt, Homo Sapiens; identical to SEQ ID NO: 58828

SEQ ID NO: 227212 - RNA, 65 nt, Homo Sapiens; identical to SEQ ID NO: 58829

SEQ ID NO: 227213 - RNA, 65 nt, Homo Sapiens
auacuaguguguucauuauagaguaucuguagaggugaauguaaaaguaaguccaaucuauuuuc

SEQ ID NO: 227214 - RNA, 65 nt, Homo Sapiens
gcaugaacauuacugcagguuuuugaugaauauaaugaauguauggaauucaauugaauuugcau

SEQ ID NO: 227215 - RNA, 65 nt, Homo Sapiens
uucugcuuuaaaggcauguguguuuuuaaaauuaaugaauguagaugugugauugucugagugag

SEQ ID NO: 227216 - RNA, 65 nt, Homo Sapiens
aaguaaauuaaccaaaaaagucaacguuacauuuuugaauguaguauuuaagacacuuuuuggac

SEQ ID NO: 227217 - RNA, 65 nt, Homo Sapiens
gaggggagccuccaaguguggcccgauucgggugcugaauguaaggucagagcuagggugggggu

SEQ ID NO: 227218 - RNA, 65 nt, Homo Sapiens
auuaacuuuauuuuggucugauguauauaugugacugaauguaaguuuaaggagcauuuaaaaau

SEQ ID NO: 227219 - RNA, 65 nt, Homo Sapiens
auaaggaucguauucccugcagguauauacuaaaaugaauguaaaaggucugugcuaccucugug

SEQ ID NO: 227220 - RNA, 65 nt, Homo Sapiens
ugcaugggauugguccuugaaacuaagaacagcucugaauguauuuauaaauuauaaaugcaauu

SEQ ID NO: 227221 - RNA, 65 nt, Homo Sapiens
gccuguucuaguccugguggugaagcauuucugucugaauguaaaaguucauuucacugggauuu

SEQ ID NO: 227222 - RNA, 65 nt, Homo Sapiens
agggaaauaaaagucuuuuggugaaauuugcauaaugaauguaaaugugugagaaaagaauagaa

SEQ ID NO: 227223 - RNA, 65 nt, Homo Sapiens; identical to SEQ ID NO: 58830

SEQ ID NO: 227224 - RNA, 65 nt, Homo Sapiens; identical to SEQ ID NO: 58831

SEQ ID NO: 227225 - RNA, 65 nt, Homo Sapiens
guuugcuaccuauuguaacuuuuuauauuuauuguugaauguauguauuuauuuaaauauuuaaa

SEQ ID NO: 227226 - RNA, 65 nt, Homo Sapiens
aaauaagaguaaaugcccuauguuucaaacauaucugaauguauauguuuuguagccuuaagaag

SEQ ID NO: 227227 - RNA, 65 nt, Homo Sapiens
uuaaauuugcucaaagaagccucuucuaccacaucugaauguaacgaaguaccuggagcaucauu

SEQ ID NO: 227228 - RNA, 65 nt, Homo Sapiens
uuaucuggucuuuucuauauauugccucucuuccuugaauguauuuucaggcuugacaacuucac

SEQ ID NO: 227229 - RNA, 65 nt, Homo Sapiens
gguuacucagcucccuggaaagcaggcaagcauguugaauguaucuaguggucugauuuuaauuu

SEQ ID NO: 227230 - RNA, 65 nt, Homo Sapiens
aacuggauuugauuucuuuuuaugaaaguuucauaugaauguaacuugauuuuuuacuauuauaa

SEQ ID NO: 227231 - RNA, 65 nt, Homo Sapiens
uacauaugguagacaauuugccuuaggaagugacuugaauguacaaagauacuugaugcacuuau

SEQ ID NO: 227232 - RNA, 65 nt, Homo Sapiens
uacacauaagccaaaacugagcauaaguccucuagugaauguaggcuggcuuucagaguaggcua

SEQ ID NO: 227233 - RNA, 65 nt, Homo Sapiens
ggaaauuaacacuggaacugacccuuuucuggcagugaauguaagcucuagcucccccaucuacu

SEQ ID NO: 227234 - RNA, 65 nt, Homo Sapiens
gaugguuacacuguuagaacacuauuuucagaaucugaauguaauuuguguaauaaaguguuuuc

SEQ ID NO: 227235 - RNA, 65 nt, Homo Sapiens
ugauggguuuguugguauuuaaaaugaauacaacuugaauguaauuaaagugcuguuuuuuggaa

SEQ ID NO: 227236 - RNA, 65 nt, Homo Sapiens
gagucuugaacacagaauaacgauugugaccauuaugaauguaacuaauuucaguuguacuguga

SEQ ID NO: 227237 - RNA, 65 nt, Homo Sapiens
auucuaaauagcgauuauaaucuccaacuuuauuuugaauguaccucuauuaguuucaauugagu

SEQ ID NO: 227238 - RNA, 65 nt, Homo Sapiens
uucaggcagauuaaaagaaucauuuguugaacaacugaauguauaaaaaaauuauaaacuggugu

SEQ ID NO: 227239 - RNA, 65 nt, Homo Sapiens
aacuauuaccuagagugaacuuuaagcuuuauuguugaauguaauuccauuauauuuccuuuugu

SEQ ID NO: 227240 - RNA, 65 nt, Homo Sapiens
gaggggcaaaaauauuuugcaagcucuggaauuguugaauguauucuuuuauauaacuacauuaa

SEQ ID NO: 227241 - RNA, 65 nt, Homo Sapiens
cuuuuauuuuguguccuugggcuauaaaagauuccugaauguaauuauaaggauuuggguuugga

SEQ ID NO: 227242 - RNA, 65 nt, Homo Sapiens
cugaaguaguguuuaggauccuccauggcaguuagugaauguaagaaguacaguguuaaaguguu

SEQ ID NO: 227243 - RNA, 65 nt, Homo Sapiens
aaacucgaucuaaaguuuagcauuuccaucugcgaugaauguaggccacaaaccacaguaguauu

SEQ ID NO: 227244 - RNA, 65 nt, Homo Sapiens
ccggccgccggggcacauagggguuuuaucgggcgugaauguaaauaaauuauauauauauauug

SEQ ID NO: 227245 - RNA, 65 nt, Homo Sapiens
agcugaacagugaugaucuguagacauuuauggacugaauguaaugguugauauauguacauucu

SEQ ID NO: 227246 - RNA, 65 nt, Homo Sapiens
uagcguugaguuaaaccccuggauauucggaacugugaauguacacguggcgacuuagaguuggc

SEQ ID NO: 227247 - RNA, 65 nt, Homo Sapiens
gcucaguaaaugacagaacuuccgucauuugcauuugaauguaaguuggcagcaguuuuauaaag

SEQ ID NO: 227248 - RNA, 65 nt, Homo Sapiens
aagugcuuuuucaaaucugucuuacuagacauaacugaauguaaagugucuuaaaacaaggcuua

SEQ ID NO: 227249 - RNA, 65 nt, Homo Sapiens
agaguauaaaauguuugccaagugccaccuaacagugaauguauuggaaaacuuacuuuucaugg

SEQ ID NO: 227250 - RNA, 65 nt, Homo Sapiens
gcugcauaagcuguuagguugugugggaaggccuuugaauguaaagccaacagaguugugaaugu

SEQ ID NO: 227251 - RNA, 65 nt, Homo Sapiens
ugccacuacauuuacaauaauaaugaugauuauucugaauguauuauaauuuucuaguuccuuuu

SEQ ID NO: 227252 - RNA, 65 nt, Homo Sapiens
uucaguguaagaugaaaauugaagaaaguuaagucugaauguaaaaauucauuaauuuaguguaa

SEQ ID NO: 227253 - RNA, 65 nt, Homo Sapiens; identical to SEQ ID NO: 58832

SEQ ID NO: 227254 - RNA, 65 nt, Homo Sapiens; identical to SEQ ID NO: 58833

SEQ ID NO: 227255 - RNA, 65 nt, Homo Sapiens; identical to SEQ ID NO: 58834

SEQ ID NO: 227256 - RNA, 65 nt, Homo Sapiens; identical to SEQ ID NO: 58835

SEQ ID NO: 227257 - RNA, 65 nt, Homo Sapiens
uuugaauuacuagguuucuugauccuuuucuaaauugaauguacuaaugauuuauuaauuaccag

SEQ ID NO: 227258 - RNA, 65 nt, Homo Sapiens
ugugggcaaacuauuuacccuucugccacugaggaugaauguaacagacuugguucuaguccaau

SEQ ID NO: 227259 - RNA, 65 nt, Homo Sapiens
cuuguuucuaccaauauucuuaguuauuugccauaugaauguauugaauuuuguuccaccauggu

SEQ ID NO: 227260 - RNA, 65 nt, Homo Sapiens; identical to SEQ ID NO: 58836

SEQ ID NO: 227261 - RNA, 65 nt, Homo Sapiens; identical to SEQ ID NO: 58837

SEQ ID NO: 227262 - RNA, 65 nt, Homo Sapiens
aauaaauaucgcuuagaaugauuccaggacaggagugaauguaaagcggaagucagggcggcugg

SEQ ID NO: 227263 - RNA, 65 nt, Homo Sapiens
aauguagggggucauggcuuggaagaaauaccuuaugaauguaagaagucucuccgaacucaaau

SEQ ID NO: 227264 - RNA, 65 nt, Homo Sapiens
uauuauuaguuaggcuucugagcuugcaaucauauugaauguaugaagagcgaaaucaaauucuu

SEQ ID NO: 227265 - RNA, 65 nt, Homo Sapiens
cuacuuauccagguuugcaaauguacauguucauuugaauguaaaucaccauuucuuggaacccc

SEQ ID NO: 227266 - RNA, 65 nt, Homo Sapiens
auuuauuauuuauuuauuauuuauuuauuuacagaugaauguauuuauuugggagaccgggguau

SEQ ID NO: 227267 - RNA, 65 nt, Homo Sapiens
ggcuggggagggaagcacugucauguggacguggaugaauguaggaccagcaucacccucugcuc

SEQ ID NO: 227268 - RNA, 65 nt, Homo Sapiens
aucugucauuauugcccugaucacaaacaaaagccugaauguacuauguuuaaaagacaaaccaa

SEQ ID NO: 227269 - RNA, 65 nt, Homo Sapiens
acuacucuaaugcauuugguauguaacuuuaaauuugaauguauucuuguaaaacauccaguauu

SEQ ID NO: 227270 - RNA, 65 nt, Homo Sapiens
ggcccugggccugcuccuugccaccaaccgaaccgugaauguagggcccccagccucaccucugc

SEQ ID NO: 227271 - RNA, 65 nt, Homo Sapiens
uugaacagcauggaaucucauugccaaauuauuagugaauguauaguucagguauucuuugagac

SEQ ID NO: 227272 - RNA, 65 nt, Homo Sapiens
aaaauuuuauucuuagcacacuguuauguccuaacugaauguauucaguauucaaauaaaagaca

SEQ ID NO: 227273 - RNA, 65 nt, Homo Sapiens
uauuuuggauguaaagauuccugugucucauaauaugaauguauuuuuugauauacaagaaacug

SEQ ID NO: 227274 - RNA, 65 nt, Homo Sapiens
aucuaauaaggagauuuaagauaagacccaauaaaugaauguauucuguaaugcuuuuaggaugu

SEQ ID NO: 227275 - RNA, 65 nt, Homo Sapiens
gcaccaugaaauuaaaaucaucucauuccugaagaugaauguaggaccagacauuuuagcuucac

SEQ ID NO: 227276 - RNA, 65 nt, Homo Sapiens
acuccaccucaaaaaauaaaaucaagauaaccucuugaauguaauagcucauagcacuuuaauuu

SEQ ID NO: 227277 - RNA, 65 nt, Homo Sapiens
ucaaguuagugauugcauuugaucccaaaacaagaugaauguaugcaaugggauguacauaaguu

SEQ ID NO: 227278 - RNA, 65 nt, Homo Sapiens
aucuuccuugggccuuuggaaaaauaugugacaagugaauguaagucugugccuggagagcuaau

SEQ ID NO: 227279 - RNA, 65 nt, Homo Sapiens
cucucagacuauucugaguaaugcuugcuugcuaaugaauguauaggagaccacauuguaauugu

SEQ ID NO: 227280 - RNA, 65 nt, Homo Sapiens
uuuuuugaaauuacauugcuuguuuaucagacaauugaauguaguaauucuguucuggauuuaau

SEQ ID NO: 227281 - RNA, 65 nt, Homo Sapiens
aaccaaaggcacagauuuguguacaauauacccauugaauguauauccugagaaaaauuggggcc

SEQ ID NO: 227282 - RNA, 65 nt, Homo Sapiens
uguucugaaaauauggugaugguugcacaccauugugaauguacugaaugccauucagugguacc

SEQ ID NO: 227283 - RNA, 65 nt, Homo Sapiens
uugaaggggagaguucauggcugguauuuaggcugugaauguaccguucguaaagaaaauuacuu

SEQ ID NO: 227284 - RNA, 65 nt, Homo Sapiens
cccaccagagcagacaucuuguuucucuccuaaaaugaauguaugaaugaaggguugugaguuua

SEQ ID NO: 227285 - RNA, 65 nt, Homo Sapiens
uacuguauugucaucaaggaggucuuggagaauugugaauguaugaccuugauauacacagagau

SEQ ID NO: 227286 - RNA, 65 nt, Homo Sapiens
ugcagaggaaguauuacaaaaagguuugaacuaagugaauguaucugagacuaacuuuguauguu

SEQ ID NO: 227287 - RNA, 65 nt, Homo Sapiens
uaguguguaggcacuguagugucucucuaaacgcaugaauguaugacuuacgcagggagaugcag

SEQ ID NO: 227288 - RNA, 65 nt, Homo Sapiens
uaaauagguuucuaaaaaguucuacugauuugggcugaauguaugauauagaaaaaaacauucua

SEQ ID NO: 227289 - RNA, 65 nt, Homo Sapiens
uuuuuuauuaacagggaaagaguacacugauucugugaauguaccucuguuuauuuuuuauucua

SEQ ID NO: 227290 - RNA, 65 nt, Homo Sapiens
uggcuaaacgauucuuacucauuacccaguaacauugaauguagaaauuauaauuugagaaaaau

SEQ ID NO: 227291 - RNA, 65 nt, Homo Sapiens
aucccuaauaacaaccuucaucagaacuuuauuucugaauguaacaauaaaguguucuaugaaau

SEQ ID NO: 227292 - RNA, 65 nt, Homo Sapiens
auucuauaaauugccuuucuuuuaaaaaucaaauuugaauguacuugaguuucugacaaauuugu

SEQ ID NO: 227293 - RNA, 65 nt, Homo Sapiens
auauuuuguuagaauggaaaaacucuuguuuaaacugaauguaugaaaacgugugucuggauauu

SEQ ID NO: 227294 - RNA, 65 nt, Homo Sapiens
gccaggagagguagagugaaaaucccagccauggaugaauguacuaauuugaaagccaaguguua

SEQ ID NO: 227295 - RNA, 65 nt, Homo Sapiens
gaaaccaagaaauguaaucaagcaguaaaaacaucugaauguagaccaugaucucaaguucuucc

SEQ ID NO: 227296 - RNA, 65 nt, Homo Sapiens
uguuccuaagacccuugucccagauacucuaaaugugaauguaugagcugggggagucaacccag

SEQ ID NO: 227297 - RNA, 65 nt, Homo Sapiens
acuuauuucauaauugccuacauuuaucaugguccugaauguagcguguaagcuuguguuucuug

SEQ ID NO: 227298 - RNA, 65 nt, Homo Sapiens
ccuucuauuccugagggcucagagcugaccaugcaugaauguauggcaguguccacuuuucugua

SEQ ID NO: 227299 - RNA, 65 nt, Homo Sapiens
cagaaaaauugacauugcugccuuuaagaauaccaugaauguaagaaauugaaagaaauuguaaa

SEQ ID NO: 227300 - RNA, 65 nt, Homo Sapiens
ugagugaguccuuuuuuuaugguguccucccucugugaauguacaggcggaacuguacgaacagc

SEQ ID NO: 227301 - RNA, 65 nt, Homo Sapiens; identical to SEQ ID NO: 58838

SEQ ID NO: 227302 - RNA, 65 nt, Homo Sapiens; identical to SEQ ID NO: 58839

SEQ ID NO: 227303 - RNA, 65 nt, Homo Sapiens; identical to SEQ ID NO: 58840

SEQ ID NO: 227304 - RNA, 65 nt, Homo Sapiens; identical to SEQ ID NO: 58841

SEQ ID NO: 227305 - RNA, 65 nt, Homo Sapiens
accaauuuaugggagaauugcacacagaugugaaaugaauguaaucuaauagaagccuaaucagc

SEQ ID NO: 227306 - RNA, 65 nt, Homo Sapiens; identical to SEQ ID NO: 58842

SEQ ID NO: 227307 - RNA, 65 nt, Homo Sapiens; identical to SEQ ID NO: 58843

SEQ ID NO: 227308 - RNA, 65 nt, Homo Sapiens
auuuaaacuaaaacuaguauaauuuagucuuuucaugaauguacauacauaaaauuauacauaaa

SEQ ID NO: 227309 - RNA, 65 nt, Homo Sapiens
ggggaagggauuguuguguagucaagucaccaugcugaauguacacugauuccuuuaugaugacu

SEQ ID NO: 227310 - RNA, 65 nt, Homo Sapiens
gcuggggacaggcaugcugcagccagagcagcaguugaauguaauaggccagccggccucucgag

SEQ ID NO: 227311 - RNA, 65 nt, Homo Sapiens; identical to SEQ ID NO: 58844

SEQ ID NO: 227312 - RNA, 65 nt, Homo Sapiens; identical to SEQ ID NO: 58845

SEQ ID NO: 227313 - RNA, 65 nt, Homo Sapiens
uuuuguguuauucgugaauaugauggauggcacaaugaauguauauuucagcucaauuguuaaug

SEQ ID NO: 227314 - RNA, 65 nt, Homo Sapiens
auuuggcauucucugaauuugcauuagcuuccugcugaauguaguccuggacugccggaauccca

SEQ ID NO: 227315 - RNA, 65 nt, Homo Sapiens
cuucauacagggaugguguuacugcuaagaauauuugaauguauguuccgugguuaaacucgcuc

SEQ ID NO: 227316 - RNA, 65 nt, Homo Sapiens
guacugugucugugaaaacuuuauacuguguauagugaauguauuguaaggaugggaauauuuug

SEQ ID NO: 227317 - RNA, 65 nt, Homo Sapiens
ccucagccuucucagcauuugcucuuuguuauuauugaauguacccaaauacuuagaacuggaag

SEQ ID NO: 227318 - RNA, 65 nt, Homo Sapiens
ggggacagcucaggguuguuuguauuuaauugacaugaauguaaaggacauuugacuuuuauuuu

SEQ ID NO: 227319 - RNA, 65 nt, Homo Sapiens
agaaaauuuuuuuucaaaaaugaacauaacucugcugaauguaaaaaaaauguagaaauucuuca

SEQ ID NO: 227320 - RNA, 65 nt, Homo Sapiens
caacauuccaacuggagcuccaagaggaagcugcaugaauguaauugugucaugaguguuuaaau

SEQ ID NO: 227321 - RNA, 65 nt, Homo Sapiens
agagaaagcuuauuggacucaagauuuaaauaagaugaauguaaaauuucuucacugugacagca

SEQ ID NO: 227322 - RNA, 65 nt, Homo Sapiens; identical to SEQ ID NO: 58846

SEQ ID NO: 227323 - RNA, 65 nt, Homo Sapiens; identical to SEQ ID NO: 58847

SEQ ID NO: 227324 - RNA, 65 nt, Homo Sapiens
uaacaccacugaguuaaacagauggcuacacauugugaauguaauuuuuugaacuaaauaguggu

SEQ ID NO: 227325 - RNA, 65 nt, Homo Sapiens
uaauucaugaauaaaugcacuuucuuccuucaaacugaauguaauugaugaacuuuggaguacug

SEQ ID NO: 227326 - RNA, 65 nt, Homo Sapiens
guaaaaggggaaaugccaaguuuaaaaaguaagccugaauguagaaauaaaaaugcuuguauuuc

SEQ ID NO: 227327 - RNA, 65 nt, Homo Sapiens
ugcucuuguuggaaaaauguggaaauguucuauauugaauguacagaaagacuguaacuauugcu

SEQ ID NO: 227328 - RNA, 65 nt, Homo Sapiens
ucaaauuuuuaggggaggguaagucaugcaauaauugaauguaccuugcuaaaaauauuaagacc

SEQ ID NO: 227329 - RNA, 65 nt, Homo Sapiens
uuuugagaaauacgagucuggcagacagugucuucugaauguaagucuaaagauuucaaauagug

SEQ ID NO: 227330 - RNA, 56 nt, Homo Sapiens
cgcccuaggaggagaacuugccgccgugaauguagaaggagacagaaacggaguga

SEQ ID NO: 227331 - RNA, 65 nt, Homo Sapiens
uucagaaguauauagauacuuccggugacuacauaugaauguacuuucaauauuauuuuuuuauu

SEQ ID NO: 227332 - RNA, 65 nt, Homo Sapiens
cauauacugcacauacugaaauagagggaaaucacugaauguaaagagguuucaucuaugccccc

SEQ ID NO: 227333 - RNA, 65 nt, Homo Sapiens
accaggacaugagagacauagaaaaacagaagucaugaauguaaauugaaugagaggcuuaacau

SEQ ID NO: 227334 - RNA, 65 nt, Homo Sapiens
auaaacuauaucuuggcuaguggcuacugugucugugaauguaaccaguacuucuuuaagcucua

SEQ ID NO: 227335 - RNA, 65 nt, Homo Sapiens
uuuuagucaugaguuguuuucaguuuucagacgaaugaauguaauaggaaacuauggaguuacca

SEQ ID NO: 227336 - RNA, 65 nt, Homo Sapiens
uuuagacuucuuaauaaccuaaauauuuaaaauaaugaauguaacaccuuuuuuaguucacugau

SEQ ID NO: 227337 - RNA, 65 nt, Homo Sapiens
gcuggaauuacaguugugagccaccacaccuggcuugaauguagauuuuaauaauugaauuuauu

SEQ ID NO: 227338 - RNA, 65 nt, Homo Sapiens
uaccagauucacuucugaauuggccagaggaaaucugaauguauuauccugugugugucuaggua

SEQ ID NO: 227339 - RNA, 65 nt, Homo Sapiens
cuggggaaaacaguuguggaauucuuacuucauuaugaauguauuuaaaaaacaaacaccaaaua

SEQ ID NO: 227340 - RNA, 65 nt, Homo Sapiens
ccaggagugugagagacacaagaauaugcacagucugaauguauaucaagaaaaaaaaaaaaaaa

SEQ ID NO: 227341 - RNA, 65 nt, Homo Sapiens
cuuucugucucaaacccugguaagagaaugaauucugaauguacauggcagcauaauuuuguggu

SEQ ID NO: 227342 - RNA, 65 nt, Homo Sapiens
guuccuguuagcguuacuuccagcauggucuugacugaauguacuuugcucucugccacagcuug

SEQ ID NO: 227343 - RNA, 65 nt, Homo Sapiens
cagccacccuguugugguauucauguauaucucauugaauguauaccuacugugugcaaaguguu

SEQ ID NO: 227344 - RNA, 65 nt, Homo Sapiens
ugccaggucuuagaagucagaaggaguagggcuagugaauguaucuuucagugaaagaggaagga

SEQ ID NO: 227345 - RNA, 65 nt, Homo Sapiens
gaucaaauuuauuuauuugaguugaaggauuuaacugaauguaugacuuuagguauuacuacaua

SEQ ID NO: 227346 - RNA, 65 nt, Homo Sapiens
uaaauguauguauuuaaggaauacccaugucagauugaauguauuaauguugacaggcaaauuuc

SEQ ID NO: 227347 - RNA, 65 nt, Homo Sapiens
aacuguugguggcccugaauccuauagcagaaaggugaauguacagacuaguaaauugucugccu

SEQ ID NO: 227348 - RNA, 65 nt, Homo Sapiens
ucuuuuugugagcuuacuuggcuaaauggauuagaugaauguacugaagcugauuugcaacauuu

SEQ ID NO: 227349 - RNA, 65 nt, Homo Sapiens
auacacacacacuuuagagaauguauuacuauacaugaauguauugggagaaaaacauuuuagau

SEQ ID NO: 227350 - RNA, 65 nt, Homo Sapiens
uuauuuaaaagauuuuaugggaugcucugagaaauugaauguaccuauaaauuaucugaauauua

SEQ ID NO: 227351 - RNA, 65 nt, Homo Sapiens; identical to SEQ ID NO: 58848

SEQ ID NO: 227352 - RNA, 65 nt, Homo Sapiens; identical to SEQ ID NO: 58849

SEQ ID NO: 227353 - RNA, 65 nt, Homo Sapiens
acuguggacauugacuucccccaacguaugagaaaugaauguaacggcuauuucaaaggaaccag

SEQ ID NO: 227354 - RNA, 65 nt, Homo Sapiens
aagcugcuaauuguuccuguuggggugacagauacugaauguauacguauugugccugagcucac

SEQ ID NO: 227355 - RNA, 65 nt, Homo Sapiens
ggucuuuuauuuguacccaugugucugucacaccaugaauguaccuggggaaaucaacugaccuc

SEQ ID NO: 227356 - RNA, 65 nt, Homo Sapiens
auaauuguugacuuucuuagauucacuuccauaugugaauguaagcucuuaacuaugucucuuug

SEQ ID NO: 227357 - RNA, 65 nt, Homo Sapiens
caaaaugagaugcacucauuuaaaucugcauucagugaauguauugggagaaaaauaggucuugc

SEQ ID NO: 227358 - RNA, 65 nt, Homo Sapiens
cuuaauauuaauggacuguuucagguaaaagagaaugaauguaugauugugaacugugaagagaa

SEQ ID NO: 227359 - RNA, 65 nt, Homo Sapiens
gccgccaguucucaaguuuuccuccuaacuccauuugaauguaagggcagcuggcccccaaugug

SEQ ID NO: 227360 - RNA, 65 nt, Homo Sapiens
auucugaaccacuagaguuuccuugauucagacuuugaauguacuguucuauaguuuuucaggau

SEQ ID NO: 227361 - RNA, 65 nt, Homo Sapiens
uauuuggcaggugaguggauggauagauggauaggugaauguagguggacaggugacugggugga

SEQ ID NO: 227362 - RNA, 65 nt, Homo Sapiens
aauauauguucuucauauuuaccuuuacauuguggugaauguaacuuuuauguaauaucaugugu

SEQ ID NO: 227363 - RNA, 65 nt, Homo Sapiens
guuguuguguuuuuuuuuaaagauugucugauuucugaauguaaagcauucaguggccuaucucc

SEQ ID NO: 227364 - RNA, 65 nt, Homo Sapiens
uauuauuagaguccgaaaguucagaagauaaggugugaauguaugaaccucccccauuuaaauac

SEQ ID NO: 227365 - RNA, 65 nt, Homo Sapiens
aagacagucccagaaguaaaaccaauugaggguagugaauguaagauaucagagauacacaaaaa

SEQ ID NO: 227366 - RNA, 65 nt, Homo Sapiens
uuacuuuuguauuugaauuugauauuuuggagugaugaauguaguuuuaacaauucuccuuaaaa

SEQ ID NO: 227367 - RNA, 65 nt, Homo Sapiens
gccuucaacaugaugcacauauuucacgacagaguugaauguaugccucauuuuucuauauauuu

SEQ ID NO: 227368 - RNA, 65 nt, Homo Sapiens
ugucuuggauagguugcuggcaauugccuuuuuaaugaauguacucccuuaguaccaaauacacu

SEQ ID NO: 227369 - RNA, 65 nt, Homo Sapiens
aagugaguuuaacaaagaaacauuuagaauagaucugaauguaagaacuacagaacuguuucaga

SEQ ID NO: 227370 - RNA, 65 nt, Homo Sapiens
acuuuuuuuuuuuaacacacuaaucuucaguuggaugaauguaauguauaacuauguuuucagca

SEQ ID NO: 227371 - RNA, 65 nt, Homo Sapiens
auaaccuauuguuagaaaauauguguuuuuauaaaugaauguaaaauaauuaaaugaauugugaa

SEQ ID NO: 227372 - RNA, 65 nt, Homo Sapiens
ucaaaggagcugaauguguuaugcuuccaaacaacugaauguaaaacacuccuagccaguuguug

SEQ ID NO: 227373 - RNA, 65 nt, Homo Sapiens
acugaccuguuguaggcagcuaucuuacagacgcaugaauguaagaguaggaagggguggguguc

SEQ ID NO: 227374 - RNA, 65 nt, Homo Sapiens
auucuacccucuuuuuccugcuaauccugucauaaugaauguagcuucucaguucacuguauaug

SEQ ID NO: 227375 - RNA, 65 nt, Homo Sapiens
cacuaacgacuucagggcagggcucugauauuccaugaauguaucaggaaauauauaugugugug

SEQ ID NO: 227376 - RNA, 57 nt, Homo Sapiens
uuguguuggaucugaggugauauguucugaauguaagcaccgucaacaucagacacc

SEQ ID NO: 227377 - RNA, 65 nt, Homo Sapiens
uuaugcucuggcaucuaacauaugauucuguaguaugaauguaaucaguguauguuaguacaaau

SEQ ID NO: 227378 - RNA, 65 nt, Homo Sapiens
caauuuucaguauuuuaacuaccucaauaaugcuaugaauguaagauauugggauagagauccca

SEQ ID NO: 227379 - RNA, 65 nt, Homo Sapiens; identical to SEQ ID NO: 58850

SEQ ID NO: 227380 - RNA, 65 nt, Homo Sapiens; identical to SEQ ID NO: 58851

SEQ ID NO: 227381 - RNA, 65 nt, Homo Sapiens
cccuucacccaaccucucccaccuccaccccacaaugaauguauuuauugugagaauggcuacac

SEQ ID NO: 227382 - RNA, 65 nt, Homo Sapiens
ccuguccagcacagcuucuggcacaggaugcuuggugaauguacccuuucuuucccucccugcag

SEQ ID NO: 227383 - RNA, 65 nt, Homo Sapiens
acugacggggaaaaaaaaaaaaaaagaauggggugugaauguaccaacacugaaucuuacagcag

SEQ ID NO: 227384 - RNA, 65 nt, Homo Sapiens
gaagcuguaagccagcccauacucauagauaaauaugaauguaggucuauuaccaauuuuucaga

SEQ ID NO: 227385 - RNA, 65 nt, Homo Sapiens
aauguuugguauuuaauucuuccaucuuucagaguugaauguaaucacaugcuuuaagauuucua

SEQ ID NO: 227386 - RNA, 65 nt, Homo Sapiens
caccuguguuaccacgaaugauguuaaaugccauuugaauguaauagggcaguuuggugcaauuu

SEQ ID NO: 227387 - RNA, 65 nt, Homo Sapiens
cugcuagcucuccgaaggccagagggccaucugccugaauguaacuucuguggguuuggguggga

SEQ ID NO: 227388 - RNA, 65 nt, Homo Sapiens
ugaauaacuucaguauacuugggaucuuuauaguuugaauguauuuugaugccaguaaucuauaa

SEQ ID NO: 227389 - RNA, 65 nt, Homo Sapiens
agucuuuccaagagccuacucuccauuguagacuuugaauguaguuagauccauuuugugccaca

SEQ ID NO: 227390 - RNA, 65 nt, Homo Sapiens
cccaaauuguggaauugccauuucugggauuacaaugaauguaaggaggguaaauggagaaaaua

SEQ ID NO: 227391 - RNA, 65 nt, Homo Sapiens
auuaucuauagauuauacauuuugccauuguccccugaauguaguuguucugcauugagccuagu

SEQ ID NO: 227392 - RNA, 65 nt, Homo Sapiens
uaguaugggaauuauuuuuuauguuaaauagaaacugaauguacuggguugaaugguguccucuc

SEQ ID NO: 227393 - RNA, 65 nt, Homo Sapiens
ugcauggagugaccauagcuccuucucucuuacauugaauguagagaauguagccauuguagcag

SEQ ID NO: 227394 - RNA, 65 nt, Homo Sapiens
aaaaauccuuuuauggaaaccauuuuuuuaaaaagugaauguacacaaauccacagaggacugug

SEQ ID NO: 227395 - RNA, 65 nt, Homo Sapiens
aaucauguucuuauaccuaauuuuagucuuucaaaugaauguacuguaaugcuuguauguauaaa

SEQ ID NO: 227396 - RNA, 65 nt, Homo Sapiens
gccccuucaggaaggaccccccaaagcugaggggcugaauguagccuuuucaacagagaaggcuc

SEQ ID NO: 227397 - RNA, 65 nt, Homo Sapiens
aucucaucguaaggcagcuaguucuaauuugcauuugaauguauaacaaauugcaucacuuuuca

SEQ ID NO: 227398 - RNA, 65 nt, Homo Sapiens
uuagaguugucuuucagcauucaaucaggcugagcugaauguagugauguuuacauuguuuacau

SEQ ID NO: 227399 - RNA, 65 nt, Homo Sapiens
cuucaucucuuuagagaaguccaagcaacagccuuugaauguaaccaauccuacuaauaaaccag

SEQ ID NO: 227400 - RNA, 65 nt, Homo Sapiens
aaaaggauggucacucuuccgaggucucccugaaaugaauguauuucucccccaaaagagcugau

SEQ ID NO: 227401 - RNA, 65 nt, Homo Sapiens
acagaugcagaagguuucucuggauagcacaccucugaauguaaaucaugauaaaauggauauuu

SEQ ID NO: 227402 - RNA, 65 nt, Homo Sapiens
ccacaugcuauugucugaacaccugucaaaaauuuugaauguacacauuuuuuaaugugcucugu

SEQ ID NO: 227403 - RNA, 65 nt, Homo Sapiens
gggggcuucaagguauggguugccaaacuuggucuugaauguacucugaaagaugcuaaucuauu

SEQ ID NO: 227404 - RNA, 65 nt, Homo Sapiens
gaaugcauacugccuaggccguacaggaauccuuaugaauguauacccaacuggggcuccugggg

SEQ ID NO: 227405 - RNA, 65 nt, Homo Sapiens
cuccauaaaauuccaguauuccuccuuucuuuaugugaauguauucuguuccaaaacaaaauuca

SEQ ID NO: 227406 - RNA, 65 nt, Homo Sapiens
aaaaacuaauuuuggagaaguuuguauaaccuaccugaauguauuccaggccucgggaccaacuc

SEQ ID NO: 227407 - RNA, 65 nt, Homo Sapiens
uuuucuaacaaacucaaaauuugauucaccaaacaugaauguacauucuuuucccagaagagucu

SEQ ID NO: 227408 - RNA, 65 nt, Homo Sapiens
auuugugaaacuugaguuuuagugacuucuuuuugugaauguaaagugugugacuuugagcaaaa

SEQ ID NO: 227409 - RNA, 65 nt, Homo Sapiens
ggggaaaaauaaggugagaacccacacuuagccauugaauguaaaggagcauuuacagaugaauc

SEQ ID NO: 227410 - RNA, 65 nt, Homo Sapiens
uuuuuuuguuguuguuaucucaaauacccguacuuugaauguaggguaguauaauuuguuacuuu

SEQ ID NO: 227411 - RNA, 65 nt, Homo Sapiens
ugaacauacuuuccuauuucaugugcaguauacguugaauguauauuuguauuguaguaaccaau

SEQ ID NO: 227412 - RNA, 65 nt, Homo Sapiens
gaugccaccucccucucucuggagagaccauggugugaauguagaaucccaagauccuggggaaa

SEQ ID NO: 227413 - RNA, 65 nt, Homo Sapiens
uuaaaacgugugcccuuuuaaguaguaaugucauaugaauguaucaucauuauuuauuuuuuugu

SEQ ID NO: 227414 - RNA, 65 nt, Homo Sapiens
uaugagagugcugccauuaagcuuugguugguccgugaauguaguccuuucuaggcuuggagaug

SEQ ID NO: 227415 - RNA, 65 nt, Homo Sapiens
uugcaucccugguuuuggacauuaagucuuugaacugaauguauuuuaauguugagcuaagaagc

SEQ ID NO: 227416 - RNA, 65 nt, Homo Sapiens
ggugucugccccgcguuuccugccugcggaccagaugaauguagcagauccccagccucuggccu

SEQ ID NO: 227417 - RNA, 65 nt, Homo Sapiens
augauacuaguaauucauaagggaucuguguaaucugaauguauuugaauaacuuuagcucuacu

SEQ ID NO: 227418 - RNA, 65 nt, Homo Sapiens
uuuucaggucauuuccugauagucuagucagcuuaugaauguaagcaaaacaggaccaaugaaag

SEQ ID NO: 227419 - RNA, 65 nt, Homo Sapiens
gaaagacugaggcauuuuccagucuacuugccuaaugaauguauaggaacugucuaugaguaugg

SEQ ID NO: 227420 - RNA, 65 nt, Homo Sapiens
ccacagcucaggaaaaagaugaggcauaacgaccuugaauguaauuggaguaagugacaaaauaa

SEQ ID NO: 227421 - RNA, 65 nt, Homo Sapiens
uaagaaaaaaauuugccuuuaagaguuacuuuuguugaauguauuugacuuaguucuuauuuuaa

SEQ ID NO: 227422 - RNA, 65 nt, Homo Sapiens
gucuucucuucauuaccuuuuaaggacagugucuuugaauguagggcccacccugaucuagggug

SEQ ID NO: 227423 - RNA, 65 nt, Homo Sapiens; identical to SEQ ID NO: 58852

SEQ ID NO: 227424 - RNA, 65 nt, Homo Sapiens; identical to SEQ ID NO: 58853

SEQ ID NO: 227425 - RNA, 65 nt, Homo Sapiens; identical to SEQ ID NO: 58854

SEQ ID NO: 227426 - RNA, 65 nt, Homo Sapiens; identical to SEQ ID NO: 58855

SEQ ID NO: 227427 - RNA, 65 nt, Homo Sapiens
cuuagugacccccaucuuguaaccuguugcaagagugaauguaaaaaauaguuguggcauuuuaa

SEQ ID NO: 227428 - RNA, 65 nt, Homo Sapiens
guugaacacacuaugaagaauuccagguguacuagugaauguaauuuauaguugccaaaaaaaaa

SEQ ID NO: 227429 - RNA, 65 nt, Homo Sapiens
uuacccucauauucuuuaaaaaacuuaaagcauuaugaauguagagaaauucaccagagcucacu

SEQ ID NO: 227430 - RNA, 57 nt, Homo Sapiens
ccuuagucauugcacaauaaggauuuuugaauguauaauaucaucuaagguaagcuu

SEQ ID NO: 227431 - RNA, 65 nt, Homo Sapiens
ggguuuuuuaguugaauuuuuuuuaacauuccucaugaauguaaauuuguacuauuuaacugacu

SEQ ID NO: 227432 - RNA, 65 nt, Homo Sapiens
ggauuugggcugccccaggcccacccagggggcucugaauguauuuuguaccguguuucuuuccc

SEQ ID NO: 227433 - RNA, 65 nt, Homo Sapiens
cccacugcucugaugggugguuuguccaaggaugcugaauguaaugccuggucaauguggaagcc

SEQ ID NO: 227434 - RNA, 65 nt, Homo Sapiens
ugcccuugaggagcacaggcagaagugugaacuugugaauguaauugaucuuuccuuccuuccag

SEQ ID NO: 227435 - RNA, 65 nt, Homo Sapiens
caucguuaacggguaccauuaaauauucugagaggugaauguaaaauauaaaagguauagguuuu

SEQ ID NO: 227436 - RNA, 65 nt, Homo Sapiens
uauuagucauguauauuuuaaaugcuaacauuugaugaauguaaguuuccacauuguugcuguuu

SEQ ID NO: 227437 - RNA, 65 nt, Homo Sapiens
cacauauuuuucacuugaauuuuuuuggaaauagcugaauguaaauagcagggaggaagaagcaa

SEQ ID NO: 227438 - RNA, 65 nt, Homo Sapiens; identical to SEQ ID NO: 58856

SEQ ID NO: 227439 - RNA, 65 nt, Homo Sapiens; identical to SEQ ID NO: 58857

SEQ ID NO: 227440 - RNA, 65 nt, Homo Sapiens; identical to SEQ ID NO: 58858

SEQ ID NO: 227441 - RNA, 65 nt, Homo Sapiens; identical to SEQ ID NO: 58859

SEQ ID NO: 227442 - RNA, 65 nt, Homo Sapiens
caaaggaauuauggcugguaguugguacuagauacugaauguaaaacuauuggaaggaguuagau

SEQ ID NO: 227443 - RNA, 65 nt, Homo Sapiens
uaaauauuuuuaacuccuauacauauauguauguaugaauguacaauuguuaaacauuuagacaa

SEQ ID NO: 227444 - RNA, 65 nt, Homo Sapiens
guuacacuguucacaaagguguuugucaucccugaugaauguaaaucuaggcaucauguccuaua

SEQ ID NO: 227445 - RNA, 65 nt, Homo Sapiens
auaaaauaaaaugcggacugaugcaggaacuuauaugaauguacugugaccugguuaccuuggaa

SEQ ID NO: 227446 - RNA, 65 nt, Homo Sapiens
uuguuugcacuuaauccuuaucgcuagucaagcugugaauguauauuauaaauugugauguagcc

SEQ ID NO: 227447 - RNA, 65 nt, Homo Sapiens
auauucuaaacaucuguuuuuuuuguauccuaaaaugaauguauggccuaaaaugugaaagcaua

SEQ ID NO: 227448 - RNA, 65 nt, Homo Sapiens
ccauuuuccaaaaaggaaacguucuaagacauuucugaauguagauaguuuuuuuuuaaaugcuu

SEQ ID NO: 227449 - RNA, 65 nt, Homo Sapiens; identical to SEQ ID NO: 58860

SEQ ID NO: 227450 - RNA, 65 nt, Homo Sapiens; identical to SEQ ID NO: 58861

SEQ ID NO: 227451 - RNA, 65 nt, Homo Sapiens
agaaagggacucauccagaacacuuccuuaaguuaugaauguacuuguagggcauuuucugauug

SEQ ID NO: 227452 - RNA, 65 nt, Homo Sapiens
uaccaaaagauuuagaaguggguuaugcuuaaauaugaauguaauucaguuuucuuuuuuauuuu

SEQ ID NO: 227453 - RNA, 65 nt, Homo Sapiens
cuuauaaagcacaaagcauauuaugucaucuauguugaauguaaguuacauuugaguaugguaac

SEQ ID NO: 227454 - RNA, 65 nt, Homo Sapiens
ucauucaaaucuguauuccuaauguauuuauggaaugaauguauuggugggaagguuuugcugcu

SEQ ID NO: 227455 - RNA, 65 nt, Homo Sapiens
augagaaauucaacguuaauuuuacuguuuuuagaugaauguacgaaucucccuucacaaguuuu

SEQ ID NO: 227456 - RNA, 65 nt, Homo Sapiens
uuccugaggcaucagaacuuauugggcaguuuaaaugaauguacauaauacaaccucaguguguc

SEQ ID NO: 227457 - RNA, 65 nt, Homo Sapiens
gguuaggagacuaaaauauaaauuaaguugugauuugaauguagauugguaucaccuccaacucc

SEQ ID NO: 227458 - RNA, 65 nt, Homo Sapiens
aguaagaaacuguccgauaugaaucacaacgugggugaauguaguauuuuccugaagugugaaag

SEQ ID NO: 227459 - RNA, 65 nt, Homo Sapiens
cauauuagugauugaaguauuuugacuuuugagauugaauguaaaauauuuuaaauuugggauca

SEQ ID NO: 227460 - RNA, 65 nt, Homo Sapiens
agcacacacauacacaccaccaccaacaacgcuugugaauguauuuuucuguuagcuggguuuac

SEQ ID NO: 227461 - RNA, 65 nt, Homo Sapiens
cggaacaguguggaagcagaauuuuuacugcuuucugaauguagaaaguguucauugcacaauau

SEQ ID NO: 227462 - RNA, 65 nt, Homo Sapiens
ucagugcuauaaaugccagaagagcuucucugggcugaauguauguguuuagagagccugucacc

SEQ ID NO: 227463 - RNA, 65 nt, Homo Sapiens
uagcacuaaacguuuucuuuagcagaguuuuaaaaugaauguaaaucagaauuaaauuuguauag

SEQ ID NO: 227464 - RNA, 65 nt, Homo Sapiens
aucacuugagucuaggaguucuugggaggaucacuugaauguaggccaagucugagucccaguua

SEQ ID NO: 227465 - RNA, 65 nt, Homo Sapiens
uuuuucuccaaagaacagcauauacuugaaaaaaaugaauguauuagcaucuuuguauauugcaa

SEQ ID NO: 227466 - RNA, 65 nt, Homo Sapiens; identical to SEQ ID NO: 58862

SEQ ID NO: 227467 - RNA, 65 nt, Homo Sapiens; identical to SEQ ID NO: 58863

SEQ ID NO: 227468 - RNA, 65 nt, Homo Sapiens
aaaauuaucaaauuguauucuuaaaaaguuuuuauugaauguaugguauuaugucuuuauuguug

SEQ ID NO: 227469 - RNA, 65 nt, Homo Sapiens
auucaaugauuuuuuaugauaaagaaaaauuaucuugaauguagugacaauagcccaaagccaag

SEQ ID NO: 227470 - RNA, 65 nt, Homo Sapiens
gugaucucccugaacauuuuauugcaagacaaaguugaauguaaaacuuuagaacagaggauugu

SEQ ID NO: 227471 - RNA, 65 nt, Homo Sapiens
uuugacauggaugauucugaggaggaagcuguuauugaauguauagagauuuauccaaauaaaua

SEQ ID NO: 227472 - RNA, 65 nt, Homo Sapiens
uuuguauugaaaugaaaccaccaguguuaucaacuugaauguaaauguacaugugcagauauucc

SEQ ID NO: 227473 - RNA, 65 nt, Homo Sapiens
guagaccugaccuuguuauuuauuagauaacauuuugaauguauccauuggauuucuaaaaugua

SEQ ID NO: 227474 - RNA, 65 nt, Homo Sapiens
caucacaguauuguuaggagauuuaaaugaauuagugaauguaagauacuuuagaaagcauguaa

SEQ ID NO: 227475 - RNA, 65 nt, Homo Sapiens
auggccuaagaaauaaggaucaauaaggaaugauuugaauguaauuuugugaauguguggaaaau

SEQ ID NO: 227476 - RNA, 65 nt, Homo Sapiens
uccauuccuacuguauuucuguaugaauguguuugugaauguauguguaaaagucuuucuuuucc

SEQ ID NO: 227477 - RNA, 65 nt, Homo Sapiens
ugaugcacuuugaauauugagauauuuugcacggaugaauguaugggaacuacccaugaugaugu

SEQ ID NO: 227478 - RNA, 65 nt, Homo Sapiens
caaauuccuguacauagagauauauuuuuuaagugugaauguaacaacauacugugaauuccauc

SEQ ID NO: 227479 - RNA, 65 nt, Homo Sapiens
guucuagugggauacacaaaucugcaaguauauugugaauguauucaugacgcgccaggcacagu

SEQ ID NO: 227480 - RNA, 65 nt, Homo Sapiens; identical to SEQ ID NO: 58864

SEQ ID NO: 227481 - RNA, 65 nt, Homo Sapiens; identical to SEQ ID NO: 58865

SEQ ID NO: 227482 - RNA, 65 nt, Homo Sapiens
ggaaagaaaggaaaaacugauuucacugugaauagugaauguaaaaaaaaaaaaacaugcaccug

SEQ ID NO: 227483 - RNA, 65 nt, Homo Sapiens
uaugacuuucuggaaaguuuauauaaaauguacaaugaauguaaaauaaauuuguauuuaugugu

SEQ ID NO: 227484 - RNA, 65 nt, Homo Sapiens
aauuucagauucucuaaaacuuuuaauuccauucuugaauguagauuuuuuccccucacauugaa

SEQ ID NO: 227485 - RNA, 65 nt, Homo Sapiens
uauuauuccucuugcuggucacacacacauuaagaugaauguaauuuaauguaaacagaacuggc

SEQ ID NO: 227486 - RNA, 65 nt, Homo Sapiens
uggggaaaaucaagaugguaagagaccagaccaggugaauguaacuucuacucuucuaagcuuac

SEQ ID NO: 227487 - RNA, 65 nt, Homo Sapiens
agacacaaaugaagaagaaccugauauuagcuuguugaauguaagcuucacucagagaagcaagg

SEQ ID NO: 227488 - RNA, 65 nt, Homo Sapiens
acauaaugguucucuucugucuaaaucagaaagucugaauguagcaaugucagguuauacuaaaa

SEQ ID NO: 227489 - RNA, 65 nt, Homo Sapiens
auguuuuacuuuaaauguguucucagucaacagugugaauguaucugcagugagcaucacuacag

SEQ ID NO: 227490 - RNA, 65 nt, Homo Sapiens
guccuugugacuucaacggacucuuccaaauuguaugaauguaucaauguauuagauaaacccag

SEQ ID NO: 227491 - RNA, 65 nt, Homo Sapiens; identical to SEQ ID NO: 58866

SEQ ID NO: 227492 - RNA, 65 nt, Homo Sapiens; identical to SEQ ID NO: 58867

SEQ ID NO: 227493 - RNA, 65 nt, Homo Sapiens
auuaaaaaguuucaaaucuagacacuaaaugugugugaauguacaaagaaaacaaaccauugcuu

SEQ ID NO: 227494 - RNA, 65 nt, Homo Sapiens
gcggggcagcguggccccaccggacuagcacaugaugaauguaaaguuggcacaaugaaaaugac

SEQ ID NO: 227495 - RNA, 65 nt, Homo Sapiens
uaaugcccuuuagggcacaacuaguuaucaguaacugaauguaucuuaaucauuauggcugcuuc

SEQ ID NO: 227496 - RNA, 58 nt, Homo Sapiens
uguuucuagggagaaagugacguauacaugaauguauuuaucuaucaaauuacugaag

SEQ ID NO: 227497 - RNA, 65 nt, Homo Sapiens
aauguauuagauaaacccagcucuuccaaauuguaugaauguaucguccuugugacuucaacgga

SEQ ID NO: 227498 - RNA, 65 nt, Homo Sapiens
aaguaguauuccacuguacuugguagaaacauguaugaauguacuuauauauaaaaaucuugaga

SEQ ID NO: 227499 - RNA, 65 nt, Homo Sapiens
agguaacaaauuuggggaagacagcacaaucuucuugaauguagcucuugggaaugcauuauuac

SEQ ID NO: 227500 - RNA, 65 nt, Homo Sapiens
ccauccucucccauaagcacccaugucuuugaauaugaauguauuuguaaaauaccacguuucau

SEQ ID NO: 227501 - RNA, 65 nt, Homo Sapiens
cuccuccucuccccaccuuugccauucuuaaguauugaauguacuuuguauaauuuuaguggaau

SEQ ID NO: 227502 - RNA, 65 nt, Homo Sapiens
acauugacauucauuccuauuuuacugggcaccuaugaauguaugcugugugcuagaaauagacu

SEQ ID NO: 227503 - RNA, 65 nt, Homo Sapiens
agggguucucaauggaaaaacgaaugcucuuacacugaauguacaggcagugggcuugcagcacu

SEQ ID NO: 227504 - RNA, 65 nt, Homo Sapiens
cuuguuugaauuaauuguauuguaauauuauuuguugaauguaguaauuagguauuuaugaauau

SEQ ID NO: 227505 - RNA, 65 nt, Homo Sapiens
aguugcaacacacaaacggauaagagaucugguuuugaauguaaaggguuacuaaccuugaaaug

SEQ ID NO: 227506 - RNA, 65 nt, Homo Sapiens; identical to SEQ ID NO: 58868

SEQ ID NO: 227507 - RNA, 65 nt, Homo Sapiens; identical to SEQ ID NO: 58869

SEQ ID NO: 227508 - RNA, 65 nt, Homo Sapiens
ccaauuuuacuucuuuaaaaccucaacuucuuugaugaauguaacuacauaaauucuacuuuauu

SEQ ID NO: 227509 - RNA, 65 nt, Homo Sapiens
gcuguuggaggacaucucgaugcccgugguuacuaugaauguauugggagagagccgcggggucc

SEQ ID NO: 227510 - RNA, 65 nt, Homo Sapiens
uagucuuugcagagguccaagcguguacguuaaugugaauguauacgccagaggccugaagcuga

SEQ ID NO: 227511 - RNA, 65 nt, Homo Sapiens
gccgcugugugucuuagcauggaaauaaauaaaccugaauguacgugcucgccucuggccugugu

SEQ ID NO: 227512 - RNA, 65 nt, Homo Sapiens
cuuuauuugcacgucaggggagccggcuccccccuugaauguaccagacccuggggggggucacu

SEQ ID NO: 227513 - RNA, 65 nt, Homo Sapiens
acuuucuggauuucucuugaagugcuacacugcacugaauguaaggaauuguugcuuguggaagu

SEQ ID NO: 227514 - RNA, 65 nt, Homo Sapiens
uugucagacuuccaaauccuggaaggacacagugaugaauguacuaugucugaacauagaaacuc

SEQ ID NO: 227515 - RNA, 65 nt, Homo Sapiens
cuuucuaauuaggcauuuuauguuagucacagucuugaauguauaaacagcacuaagacucucag

SEQ ID NO: 227516 - RNA, 65 nt, Homo Sapiens
aacaagacuuucccagcuuguauuaccuagaagcgugaauguauaggauaccugacuacuaagac

SEQ ID NO: 227517 - RNA, 65 nt, Homo Sapiens
guugauguuuuaacucuaucugucauacauccuagugaauguaaaaugcaaaauccuggugaugu

SEQ ID NO: 227518 - RNA, 65 nt, Homo Sapiens; identical to SEQ ID NO: 58870

SEQ ID NO: 227519 - RNA, 65 nt, Homo Sapiens; identical to SEQ ID NO: 58871

SEQ ID NO: 227520 - RNA, 65 nt, Homo Sapiens
uggagucuucuuucaaaccaguggggguuggacaaugaauguaguuaacugguuccugcucacac

SEQ ID NO: 227521 - RNA, 65 nt, Homo Sapiens
aucaaggcgccuuuccuaauaauaugguucaacugugaauguagaagugggggggaggggggaga

SEQ ID NO: 227522 - RNA, 65 nt, Homo Sapiens
gagagacccugcaagaccacggagggagcgacacuugaauguagaauaggcagggggcccugccc

SEQ ID NO: 227523 - RNA, 65 nt, Homo Sapiens; identical to SEQ ID NO: 58872

SEQ ID NO: 227524 - RNA, 65 nt, Homo Sapiens; identical to SEQ ID NO: 58873

SEQ ID NO: 227525 - RNA, 65 nt, Homo Sapiens
acguaugugcucuuauaaaguggacuucugaaaaaugaauguaaaagacacugguguaucucaga

SEQ ID NO: 227526 - RNA, 65 nt, Homo Sapiens
auuuaguugacuguauuauuugauuucggauugaaugaauguaaauagaaauuaaaugcaaauuu

SEQ ID NO: 227527 - RNA, 65 nt, Homo Sapiens
agguucaucuguccaugcaguccucuuggauucucugaauguaguaacuaugaagcuaugccaaa

SEQ ID NO: 227528 - RNA, 65 nt, Homo Sapiens
caaagccuucguuguauguugacgaugcacuuuuaugaauguaguuucuaucgcuguuuuuagcc

SEQ ID NO: 227529 - RNA, 65 nt, Homo Sapiens
agauuucaaauccaggggauuccaugcucaauggaugaauguagacacaaaacagcaacacuugu

SEQ ID NO: 227530 - RNA, 65 nt, Homo Sapiens
acaagcgaugagcaaacucuuggcaucguuguuuuugaauguagccugucacugaggguuuuggu

SEQ ID NO: 227531 - RNA, 65 nt, Homo Sapiens
cgccucgguucccaccacuguguucgacgcgucucugaauguaucccugacuugccuuauuuauu

SEQ ID NO: 227532 - RNA, 65 nt, Homo Sapiens
aaguuccaauuuuuaaggggugacgaauuuccuacugaauguaccggucuuggccacagccugag

SEQ ID NO: 227533 - RNA, 65 nt, Homo Sapiens
agaugaauugugcaagugacuggccuggccagcagugaauguagggauuucaacccaggugcccc

SEQ ID NO: 227534 - RNA, 65 nt, Homo Sapiens
uaaacuuugaauaguuuuaguagaugaucuuugucugaauguaaucccuauguagcaacaguggu

SEQ ID NO: 227535 - RNA, 65 nt, Homo Sapiens
cugccucugcuuucuccugcgccgagaucuugcccugaauguacccaucaggacucagaccccag

SEQ ID NO: 227536 - RNA, 65 nt, Homo Sapiens
aagacaccuuucccgauaacugaggaugaaaggagugaauguauaccuuccacacagggugcaug

SEQ ID NO: 227537 - RNA, 65 nt, Homo Sapiens
aaaggcugaauucuguaauaucacuaaagacagaaugaauguagaugagaacagcaguuuauuac

SEQ ID NO: 227538 - RNA, 65 nt, Homo Sapiens
aaguuuucacaugucccauuguccaaaaccuaaauugaauguacuacuuguuuauccaacuaagu

SEQ ID NO: 227539 - RNA, 65 nt, Homo Sapiens
uauuaaauggagauguugaacaacuauuaccugcuugaauguaaaaugucuaaacuauaagcuuc

SEQ ID NO: 227540 - RNA, 65 nt, Homo Sapiens
uauagcauuuuucaacauuuaauggucuguacaguugaauguaaguguucaauauguauugcuga

SEQ ID NO: 227541 - RNA, 65 nt, Homo Sapiens
aucauuugcauaagauuuaacagcauuuuuuauaaugaauguaaacauuuuaacuuaaugguacu

SEQ ID NO: 227542 - RNA, 65 nt, Homo Sapiens
uuucugcauagcgaaauaaacaucacagcccauggugaauguaugcuccauuacacgaucaccug

SEQ ID NO: 227543 - RNA, 65 nt, Homo Sapiens
augguuacuaauaguuuuaucuucauucucuaucuugaauguauucuccugaguggaugacaggu

SEQ ID NO: 227544 - RNA, 65 nt, Homo Sapiens
aaagaaaaagaucaaguuguaagaaauagaaauuuugaauguauagagaaauuuuaaaauaauag

SEQ ID NO: 227545 - RNA, 65 nt, Homo Sapiens
uuuuauuauagaauuuucuguaguaggaggagaagugaauguaaauaugcugauaaauguaagau

SEQ ID NO: 227546 - RNA, 65 nt, Homo Sapiens
uaaaagccucaacuagucauacauguuagaagcaaugaauguauacauuuuccuuauuguuaaaa

SEQ ID NO: 227547 - RNA, 65 nt, Homo Sapiens
uugagagggcacugaagaccugaaugaaauucaugugaauguagggucccucuguaauuucaaaa

SEQ ID NO: 227548 - RNA, 65 nt, Homo Sapiens
ugugcacaggaaaugacuggggggagcagguuuuaugaauguaacucacaaacaaacaaaggagg

SEQ ID NO: 227549 - RNA, 65 nt, Homo Sapiens
ggcgcgggggggaggcuggggucccgccgccgugaugaauguacugacgagccgaggcagcagug

SEQ ID NO: 227550 - RNA, 65 nt, Homo Sapiens; identical to SEQ ID NO: 58874

SEQ ID NO: 227551 - RNA, 65 nt, Homo Sapiens; identical to SEQ ID NO: 58875

SEQ ID NO: 227552 - RNA, 65 nt, Homo Sapiens
gucugggucauucaggcaguacaucugaauuaagcugaauguagacaaauaaagaaaaacaaaac

SEQ ID NO: 227553 - RNA, 65 nt, Homo Sapiens
gggcccccuccccaccaaaggguucaccucacacuugaauguacaacccaccccacugucgggaa

SEQ ID NO: 227554 - RNA, 65 nt, Homo Sapiens
uuacaugaaagauuucaaacugcagagaaccacuaugaauguaaacaaugugguaaagcauuuag

SEQ ID NO: 227555 - RNA, 65 nt, Homo Sapiens; identical to SEQ ID NO: 58876

SEQ ID NO: 227556 - RNA, 65 nt, Homo Sapiens; identical to SEQ ID NO: 58877

SEQ ID NO: 227557 - RNA, 65 nt, Homo Sapiens; identical to SEQ ID NO: 58878

SEQ ID NO: 227558 - RNA, 65 nt, Homo Sapiens; identical to SEQ ID NO: 58879

SEQ ID NO: 227559 - RNA, 65 nt, Homo Sapiens; identical to SEQ ID NO: 58880

SEQ ID NO: 227560 - RNA, 65 nt, Homo Sapiens; identical to SEQ ID NO: 58881

SEQ ID NO: 227561 - RNA, 65 nt, Homo Sapiens; identical to SEQ ID NO: 58882

SEQ ID NO: 227562 - RNA, 65 nt, Homo Sapiens; identical to SEQ ID NO: 58883

SEQ ID NO: 227563 - RNA, 65 nt, Homo Sapiens; identical to SEQ ID NO: 58884

SEQ ID NO: 227564 - RNA, 65 nt, Homo Sapiens; identical to SEQ ID NO: 58885

SEQ ID NO: 227565 - RNA, 65 nt, Homo Sapiens; identical to SEQ ID NO: 58886

SEQ ID NO: 227566 - RNA, 65 nt, Homo Sapiens
agauacauuaaaauacucacugaagagaagcccuaugaauguaaguaacgugggaaagcaugaaa

SEQ ID NO: 227567 - RNA, 65 nt, Homo Sapiens
cuguucuggggcuuguccuuccuuugcagcuguuuugaauguaguuuuccuuuucuauuuauuug

SEQ ID NO: 227568 - RNA, 65 nt, Homo Sapiens; identical to SEQ ID NO: 58887

SEQ ID NO: 227569 - RNA, 65 nt, Homo Sapiens; identical to SEQ ID NO: 58888

SEQ ID NO: 227570 - RNA, 65 nt, Homo Sapiens
aaacucaaucaauguuauugugaaaacugggaaugugaauguaauauauguagaaaaacauuuag

SEQ ID NO: 227571 - RNA, 59 nt, Homo Sapiens; identical to SEQ ID NO: 58889

SEQ ID NO: 227572 - RNA, 65 nt, Homo Sapiens; identical to SEQ ID NO: 58890

SEQ ID NO: 227573 - RNA, 65 nt, Homo Sapiens; identical to SEQ ID NO: 58891

SEQ ID NO: 227574 - RNA, 65 nt, Homo Sapiens
uaaggccugcccaccaccgcccgccugggcagccaugaauguagcgccccaggcccugccccagc

SEQ ID NO: 227575 - RNA, 65 nt, Homo Sapiens
agcauauaaugagaugcuugaugaauggugcauauugaauguauaaagcccaccgguccugagag

SEQ ID NO: 227576 - RNA, 65 nt, Homo Sapiens
uucuugcuucuucuaccuuuauuuauucucagcucugaauguaugaaccugcucaaucaccucau

SEQ ID NO: 227577 - RNA, 65 nt, Homo Sapiens
caaguuaguuuuguggcuuuccaucugacccuaugugaauguaaggugaugugaccuuguuggug

SEQ ID NO: 227578 - RNA, 65 nt, Homo Sapiens
guaguucacacuggaaaaaggccacguaugugccuugaauguagccaaaaugacgaacaacaccc

SEQ ID NO: 227579 - RNA, 65 nt, Homo Sapiens
cagcaucagagaguucacacuagagaaaggccuuaugaauguagugaaugugggaaauccuuuag

SEQ ID NO: 227580 - RNA, 65 nt, Homo Sapiens
gagccagacaaagcugugaacugccccgugcugaaugaauguacaaggcugguggcauggccccc

SEQ ID NO: 227581 - RNA, 65 nt, Homo Sapiens; identical to SEQ ID NO: 58892

SEQ ID NO: 227582 - RNA, 65 nt, Homo Sapiens; identical to SEQ ID NO: 58893

SEQ ID NO: 227583 - RNA, 60 nt, Homo Sapiens
gaauguggaaaucuuuuaggagaaaaacucugaauguaagaacauuuaaaaacacacuga

SEQ ID NO: 227584 - RNA, 65 nt, Homo Sapiens
gauaugaguguuguuaccauuggggagaaauacuaugaauguaagaugcaugaaagaauucacac

SEQ ID NO: 227585 - RNA, 65 nt, Homo Sapiens
gauagauauuuggacaucaaguccacgugcacacgugaauguagcgcacacgaauccauccaccu

SEQ ID NO: 227586 - RNA, 65 nt, Homo Sapiens; identical to SEQ ID NO: 58894

SEQ ID NO: 227587 - RNA, 65 nt, Homo Sapiens; identical to SEQ ID NO: 58895

SEQ ID NO: 227588 - RNA, 65 nt, Homo Sapiens; identical to SEQ ID NO: 58896

SEQ ID NO: 227589 - RNA, 65 nt, Homo Sapiens; identical to SEQ ID NO: 58897

SEQ ID NO: 227590 - RNA, 65 nt, Homo Sapiens; identical to SEQ ID NO: 58898

SEQ ID NO: 227591 - RNA, 65 nt, Homo Sapiens; identical to SEQ ID NO: 58899

SEQ ID NO: 227592 - RNA, 65 nt, Homo Sapiens; identical to SEQ ID NO: 58900

SEQ ID NO: 227593 - RNA, 65 nt, Homo Sapiens; identical to SEQ ID NO: 58901

SEQ ID NO: 227594 - RNA, 65 nt, Homo Sapiens; identical to SEQ ID NO: 58902

SEQ ID NO: 227595 - RNA, 65 nt, Homo Sapiens; identical to SEQ ID NO: 58903

SEQ ID NO: 227596 - RNA, 65 nt, Homo Sapiens; identical to SEQ ID NO: 58904

SEQ ID NO: 227597 - RNA, 65 nt, Homo Sapiens; identical to SEQ ID NO: 58905

SEQ ID NO: 227598 - RNA, 65 nt, Homo Sapiens; identical to SEQ ID NO: 58906

SEQ ID NO: 227599 - RNA, 65 nt, Homo Sapiens; identical to SEQ ID NO: 58907

SEQ ID NO: 227600 - RNA, 65 nt, Homo Sapiens; identical to SEQ ID NO: 58908

SEQ ID NO: 227601 - RNA, 65 nt, Homo Sapiens
cacuugguaaagccuuaaguuggagauagacccugugaauguaaggauacuuguacgaaacacau

SEQ ID NO: 227602 - RNA, 65 nt, Homo Sapiens
acccagccgaggggacggugacuucugacaaucagugaauguacacccccacagcaguaucagaa

SEQ ID NO: 227603 - RNA, 65 nt, Homo Sapiens
cauugugauuaagccuucaguggugagaaacaguaugaauguaaagagcacgaaagaauucccac

SEQ ID NO: 227604 - RNA, 65 nt, Homo Sapiens; identical to SEQ ID NO: 58909

SEQ ID NO: 227605 - RNA, 65 nt, Homo Sapiens; identical to SEQ ID NO: 58910

SEQ ID NO: 227606 - RNA, 65 nt, Homo Sapiens
aauuaaucuauuuugcuccauuauagaacauucuaugaauguaguaagucuuuucaacuucugug

SEQ ID NO: 227607 - RNA, 65 nt, Homo Sapiens
acaucuugcuucugcucagaauuucauaucuauaaugaauguagaauuuaagaaaaucuucaucu

SEQ ID NO: 227608 - RNA, 65 nt, Homo Sapiens; identical to SEQ ID NO: 58911

SEQ ID NO: 227609 - RNA, 65 nt, Homo Sapiens; identical to SEQ ID NO: 58912

SEQ ID NO: 227610 - RNA, 65 nt, Homo Sapiens; identical to SEQ ID NO: 58913

SEQ ID NO: 227611 - RNA, 65 nt, Homo Sapiens; identical to SEQ ID NO: 58914

SEQ ID NO: 227612 - RNA, 65 nt, Homo Sapiens; identical to SEQ ID NO: 58915

SEQ ID NO: 227613 - RNA, 65 nt, Homo Sapiens
auacauauguuguacuuuuacuaguggugggauucugaauguauaggacauauaacuacuuaucu

SEQ ID NO: 227614 - RNA, 65 nt, Homo Sapiens
agagccuuuaguuuuuguucacuuugcaaguauaaugaauguagcauaauuuauacuggagaaaa

SEQ ID NO: 227615 - RNA, 65 nt, Homo Sapiens
gaucccuucagucaccacucgcccugugaauacagugaauguaagagcagucacuuuggagagaa

SEQ ID NO: 227616 - RNA, 65 nt, Homo Sapiens
aaaaauaauaguauugaaugaugaagugcuaaaucugaauguaagugggugcccaggaguagaau

SEQ ID NO: 227617 - RNA, 65 nt, Homo Sapiens
ucugcauuauacuccugcaaugagauuuuccuguuugaauguaugugcacacaccacagaaugug

SEQ ID NO: 227618 - RNA, 65 nt, Homo Sapiens
ggcuauuuuaaaugucaaggucagcaguguuacuuugaauguaaacugguauaauagguaguuuu

SEQ ID NO: 227619 - RNA, 65 nt, Homo Sapiens
ucaguugacugguuuuguguccuguuugaacuugcugaauguaaggcaggcuacuaugcguuaua

SEQ ID NO: 227620 - RNA, 65 nt, Homo Sapiens
guaugucauucuggauaaauccccaagccccuuuaugaauguagugaaauacauggcaugugggu

SEQ ID NO: 227621 - RNA, 65 nt, Homo Sapiens
uuuuaaacaaaugaugcugagaauaaggagagaaaugaauguagagagagguagagagagaaaua

SEQ ID NO: 227622 - RNA, 65 nt, Homo Sapiens; identical to SEQ ID NO: 58916

SEQ ID NO: 227623 - RNA, 65 nt, Homo Sapiens; identical to SEQ ID NO: 58917

SEQ ID NO: 227624 - RNA, 65 nt, Homo Sapiens
cuuuuccugucugacucugacaaguccucccucacugaauguagaaucguugccaaguuucugag

SEQ ID NO: 227625 - RNA, 65 nt, Homo Sapiens
agccuuggaaauuaacaaaagccuagaaggaucagugaauguaaggguagaaauucucccuguau

SEQ ID NO: 227626 - RNA, 65 nt, Homo Sapiens
uuuccaaucacaucuuuaguuuggugauacuucuuugaauguagaauuggaauggguggcgguaa

SEQ ID NO: 227627 - RNA, 65 nt, Homo Sapiens
uuuuuuaaugguuuauugcuuggacugugauaaacugaauguaugggacagcucccaguauacug

SEQ ID NO: 227628 - RNA, 65 nt, Homo Sapiens
ugcugauacguugcucacauagaguagcacaagaaugaauguauuagcucuaugcuaaauaauga

SEQ ID NO: 227629 - RNA, 65 nt, Homo Sapiens
uaauuuuccuguuuauuguaagucaagcuugagaaugaauguaugagggcuggauagauuaucua

SEQ ID NO: 227630 - RNA, 65 nt, Homo Sapiens
cgcaugcugaagcuaaguaauuuaauuuuguauuuugaauguacaaaauuaaugacaacucaugc

SEQ ID NO: 227631 - RNA, 65 nt, Homo Sapiens
aaaauaccaauuauuuuccuuuuuaaccacauuucugaauguauauugggcuuucagauuucucu

SEQ ID NO: 227632 - RNA, 65 nt, Homo Sapiens; identical to SEQ ID NO: 58918

SEQ ID NO: 227633 - RNA, 65 nt, Homo Sapiens; identical to SEQ ID NO: 58919

SEQ ID NO: 227634 - RNA, 65 nt, Homo Sapiens
ccucguucaguugcacuucaguauuuucacggauaugaauguaaaauauauaaauauauaaaccu

SEQ ID NO: 227635 - RNA, 65 nt, Homo Sapiens
cauugagcagcugaagcuaacucaugacucuguuuugaauguaaauauuuguaauuaagccugca

SEQ ID NO: 227636 - RNA, 65 nt, Homo Sapiens
uuuuauuguuaguucucacuuguuuccauauuuagugaauguacauuuaauugcaaagcugucau

SEQ ID NO: 227637 - RNA, 65 nt, Homo Sapiens
ucaacuugagcucuugaacuccuccugugggccugugaauguauucauucauuccacaacucugg

SEQ ID NO: 227638 - RNA, 65 nt, Homo Sapiens
cuuuuaauuugauuuuagaaucuggacacuuucuaugaauguaauucggcugagaaacauguugc

SEQ ID NO: 227639 - RNA, 65 nt, Homo Sapiens
aucaggggacauuugaagauuacaagaaacacugaugaauguaaauauugaacauccccugggcu

SEQ ID NO: 227640 - RNA, 65 nt, Homo Sapiens
agggcacuuggccaguuuucuguucagcuuuucagugaauguaccccuuuaagguucagacuuaa

SEQ ID NO: 227641 - RNA, 65 nt, Homo Sapiens; identical to SEQ ID NO: 58920

SEQ ID NO: 227642 - RNA, 65 nt, Homo Sapiens; identical to SEQ ID NO: 58921

SEQ ID NO: 227643 - RNA, 65 nt, Homo Sapiens
ugggguauuggaaauguuuggggacuagguagaggugaauguacuaaaugccacugaauuuguau

SEQ ID NO: 227644 - RNA, 65 nt, Homo Sapiens
uuuuccuccauguuauuuaugaauuuuauauuccgugaauguauauugucuuguaauguugcaua

SEQ ID NO: 227645 - RNA, 65 nt, Homo Sapiens
auauaugcauuccauuugggagcauagcagcugugugaauguauguaauugugugugggggguuu

SEQ ID NO: 227646 - RNA, 65 nt, Homo Sapiens
ggaaacguaggagcaucugguugugaaagaaacugugaauguaaucuucuccuuugaaugcuguu

SEQ ID NO: 227647 - RNA, 65 nt, Homo Sapiens
acagcuugcagcuauucugugucuugcuuuggacaugaauguauuugugaagcuugcaacuuuau

SEQ ID NO: 227648 - RNA, 65 nt, Homo Sapiens; identical to SEQ ID NO: 58922

SEQ ID NO: 227649 - RNA, 65 nt, Homo Sapiens; identical to SEQ ID NO: 58923

SEQ ID NO: 227650 - RNA, 65 nt, Homo Sapiens
cuguggggauguuucauacucaaauuccucuuugaugaauguaccaagcacauggccuuggguga

SEQ ID NO: 227651 - RNA, 65 nt, Homo Sapiens; identical to SEQ ID NO: 58924

SEQ ID NO: 227652 - RNA, 65 nt, Homo Sapiens; identical to SEQ ID NO: 58925

SEQ ID NO: 227653 - RNA, 65 nt, Homo Sapiens
aauuucaaaccauuuaccaucugaaaguuuugauuugaauguaaaacaggaaauuggaauuccuu

SEQ ID NO: 227654 - RNA, 65 nt, Homo Sapiens
cuguuucucccuugggacugugucucauguuugugugaauguagaccaggaaagggggcugcaaa

SEQ ID NO: 227655 - RNA, 65 nt, Homo Sapiens
aagguuucaaaaaucauguaaggauuuaaacuugcugaauguaaagauugaaccucaagucacug

SEQ ID NO: 227656 - RNA, 65 nt, Homo Sapiens
uucauuuuuacuuuuucuuauuuuuaaaauuaggcugaauguacuucaugugauuugucaaccau

SEQ ID NO: 227657 - RNA, 65 nt, Homo Sapiens
cccaguagcaauaaacauauaauauaggaggagucugaauguagagaugaaaaauacagaaugua

SEQ ID NO: 227658 - RNA, 65 nt, Homo Sapiens
uaugucuugaacuuuuccucaaagcauuacacuugugaauguauuuuugucuaauagggucgaaa

SEQ ID NO: 227659 - RNA, 65 nt, Homo Sapiens
aaauauauaugcauaccuggauuuccuuggcuucgugaauguaagagaaauuaaaucugaauaaa

SEQ ID NO: 227660 - RNA, 65 nt, Homo Sapiens
ucuuaucaggcauuuucauuuggaaauuucauuauugaauguagcaagguuguaguuguuuuuuu

SEQ ID NO: 227661 - RNA, 65 nt, Homo Sapiens
uguauauacacacacaccucgaguaugugauaaagugaauguacaucucagaagucaagcugaug

SEQ ID NO: 227662 - RNA, 65 nt, Homo Sapiens
gaaagacauuuugguuauaccaaucugcuuguuucugaauguaugacaugcauaaaaauagaaga

SEQ ID NO: 227663 - RNA, 65 nt, Homo Sapiens
gcuacaugaaugcuugauuugagaaauguuucuguugaauguaauggaucuuaaacccaaaguac

SEQ ID NO: 227664 - RNA, 65 nt, Homo Sapiens
acuuccaaaauguacauaucuuguggaacagcuguugaauguaaucaguccuaaaaauggccaga

SEQ ID NO: 227665 - RNA, 65 nt, Homo Sapiens
ccaaaugcaaguccauuccauugccaguagcacagugaauguauguauucucguaaaacugcgcu

SEQ ID NO: 227666 - RNA, 65 nt, Homo Sapiens
ugguuaaugauacacauuccaucuaaugggaguugugaauguaacaaaaugaacugcccuucagc

SEQ ID NO: 227667 - RNA, 65 nt, Homo Sapiens
aggugucaacaaacugggaauugagcaguugccugugaauguaagaacuguauuucccaauacac

SEQ ID NO: 227668 - RNA, 65 nt, Homo Sapiens
uuguuugaaaaacuugcacaacuugugaauauauuugaauguaugguugccuuaguacuaucaag

SEQ ID NO: 227669 - RNA, 65 nt, Homo Sapiens
gacaggccuagggaccuugcuagcaagggaaggucugaauguaaguucugucaaggaauuacaag

SEQ ID NO: 227670 - RNA, 65 nt, Homo Sapiens
ucaucuugguguuauuauacagaaaaaugccuaauugaauguaacaaagucugcuuaauuucaaa

SEQ ID NO: 227671 - RNA, 65 nt, Homo Sapiens
agcaacagacuguauuuuugugacgccccguaguaugaauguacaucuuguaaaacugagauaua

SEQ ID NO: 227672 - RNA, 65 nt, Homo Sapiens
agcaguauucuucaguaaauaaagaauggaauugcugaauguaaucauugaaccucgagucacug

SEQ ID NO: 227673 - RNA, 64 nt, Homo Sapiens; identical to SEQ ID NO: 55558

SEQ ID NO: 227674 - RNA, 64 nt, Homo Sapiens; identical to SEQ ID NO: 55559

SEQ ID NO: 227675 - RNA, 64 nt, Homo Sapiens; identical to SEQ ID NO: 55560

SEQ ID NO: 227676 - RNA, 64 nt, Homo Sapiens; identical to SEQ ID NO: 55561

SEQ ID NO: 227677 - RNA, 64 nt, Homo Sapiens; identical to SEQ ID NO: 55562

SEQ ID NO: 227678 - RNA, 64 nt, Homo Sapiens; identical to SEQ ID NO: 55563

SEQ ID NO: 227679 - RNA, 64 nt, Homo Sapiens; identical to SEQ ID NO: 55564

SEQ ID NO: 227680 - RNA, 64 nt, Homo Sapiens; identical to SEQ ID NO: 55565

SEQ ID NO: 227681 - RNA, 64 nt, Homo Sapiens; identical to SEQ ID NO: 55566

SEQ ID NO: 227682 - RNA, 64 nt, Homo Sapiens; identical to SEQ ID NO: 55567

SEQ ID NO: 227683 - RNA, 64 nt, Homo Sapiens; identical to SEQ ID NO: 55568

SEQ ID NO: 227684 - RNA, 64 nt, Homo Sapiens; identical to SEQ ID NO: 55569

SEQ ID NO: 227685 - RNA, 64 nt, Homo Sapiens; identical to SEQ ID NO: 55570

SEQ ID NO: 227686 - RNA, 64 nt, Homo Sapiens; identical to SEQ ID NO: 55571

SEQ ID NO: 227687 - RNA, 64 nt, Homo Sapiens; identical to SEQ ID NO: 55572

SEQ ID NO: 227688 - RNA, 64 nt, Homo Sapiens; identical to SEQ ID NO: 55573

SEQ ID NO: 227689 - RNA, 64 nt, Homo Sapiens; identical to SEQ ID NO: 55574

SEQ ID NO: 227690 - RNA, 64 nt, Homo Sapiens; identical to SEQ ID NO: 55575

SEQ ID NO: 227691 - RNA, 64 nt, Homo Sapiens; identical to SEQ ID NO: 55576

SEQ ID NO: 227692 - RNA, 64 nt, Homo Sapiens; identical to SEQ ID NO: 55577

SEQ ID NO: 227693 - RNA, 64 nt, Homo Sapiens; identical to SEQ ID NO: 55578

SEQ ID NO: 227694 - RNA, 64 nt, Homo Sapiens; identical to SEQ ID NO: 55579

SEQ ID NO: 227695 - RNA, 64 nt, Homo Sapiens; identical to SEQ ID NO: 55580

SEQ ID NO: 227696 - RNA, 64 nt, Homo Sapiens; identical to SEQ ID NO: 55581

SEQ ID NO: 227697 - RNA, 64 nt, Homo Sapiens; identical to SEQ ID NO: 55582

SEQ ID NO: 227698 - RNA, 64 nt, Homo Sapiens; identical to SEQ ID NO: 55583

SEQ ID NO: 227699 - RNA, 64 nt, Homo Sapiens; identical to SEQ ID NO: 55584

SEQ ID NO: 227700 - RNA, 64 nt, Homo Sapiens; identical to SEQ ID NO: 55585

SEQ ID NO: 227701 - RNA, 64 nt, Homo Sapiens; identical to SEQ ID NO: 55586

SEQ ID NO: 227702 - RNA, 64 nt, Homo Sapiens; identical to SEQ ID NO: 55587

SEQ ID NO: 227703 - RNA, 64 nt, Homo Sapiens; identical to SEQ ID NO: 55588

SEQ ID NO: 227704 - RNA, 64 nt, Homo Sapiens; identical to SEQ ID NO: 55589

SEQ ID NO: 227705 - RNA, 64 nt, Homo Sapiens; identical to SEQ ID NO: 55590

SEQ ID NO: 227706 - RNA, 64 nt, Homo Sapiens; identical to SEQ ID NO: 55591

SEQ ID NO: 227707 - RNA, 64 nt, Homo Sapiens; identical to SEQ ID NO: 55592

SEQ ID NO: 227708 - RNA, 64 nt, Homo Sapiens; identical to SEQ ID NO: 55593

SEQ ID NO: 227709 - RNA, 64 nt, Homo Sapiens; identical to SEQ ID NO: 55594

SEQ ID NO: 227710 - RNA, 64 nt, Homo Sapiens; identical to SEQ ID NO: 55595

SEQ ID NO: 227711 - RNA, 64 nt, Homo Sapiens; identical to SEQ ID NO: 55596

SEQ ID NO: 227712 - RNA, 64 nt, Homo Sapiens; identical to SEQ ID NO: 55597

SEQ ID NO: 227713 - RNA, 64 nt, Homo Sapiens; identical to SEQ ID NO: 55598

SEQ ID NO: 227714 - RNA, 64 nt, Homo Sapiens; identical to SEQ ID NO: 55599

SEQ ID NO: 227715 - RNA, 64 nt, Homo Sapiens; identical to SEQ ID NO: 55600

SEQ ID NO: 227716 - RNA, 64 nt, Homo Sapiens; identical to SEQ ID NO: 55601

SEQ ID NO: 227717 - RNA, 64 nt, Homo Sapiens; identical to SEQ ID NO: 55602

SEQ ID NO: 227718 - RNA, 64 nt, Homo Sapiens; identical to SEQ ID NO: 55603

SEQ ID NO: 227719 - RNA, 64 nt, Homo Sapiens; identical to SEQ ID NO: 55604

SEQ ID NO: 227720 - RNA, 64 nt, Homo Sapiens; identical to SEQ ID NO: 55605

SEQ ID NO: 227721 - RNA, 64 nt, Homo Sapiens; identical to SEQ ID NO: 55606

SEQ ID NO: 227722 - RNA, 64 nt, Homo Sapiens; identical to SEQ ID NO: 55607

SEQ ID NO: 227723 - RNA, 64 nt, Homo Sapiens; identical to SEQ ID NO: 55608

SEQ ID NO: 227724 - RNA, 64 nt, Homo Sapiens; identical to SEQ ID NO: 55609

SEQ ID NO: 227725 - RNA, 64 nt, Homo Sapiens; identical to SEQ ID NO: 55610

SEQ ID NO: 227726 - RNA, 64 nt, Homo Sapiens; identical to SEQ ID NO: 55611

SEQ ID NO: 227727 - RNA, 64 nt, Homo Sapiens; identical to SEQ ID NO: 55612

SEQ ID NO: 227728 - RNA, 64 nt, Homo Sapiens; identical to SEQ ID NO: 55613

SEQ ID NO: 227729 - RNA, 64 nt, Homo Sapiens; identical to SEQ ID NO: 55614

SEQ ID NO: 227730 - RNA, 64 nt, Homo Sapiens; identical to SEQ ID NO: 55615

SEQ ID NO: 227731 - RNA, 64 nt, Homo Sapiens; identical to SEQ ID NO: 55616

SEQ ID NO: 227732 - RNA, 64 nt, Homo Sapiens; identical to SEQ ID NO: 55617

SEQ ID NO: 227733 - RNA, 64 nt, Homo Sapiens; identical to SEQ ID NO: 55618

SEQ ID NO: 227734 - RNA, 64 nt, Homo Sapiens; identical to SEQ ID NO: 55619

SEQ ID NO: 227735 - RNA, 64 nt, Homo Sapiens; identical to SEQ ID NO: 55620

SEQ ID NO: 227736 - RNA, 64 nt, Homo Sapiens; identical to SEQ ID NO: 55621

SEQ ID NO: 227737 - RNA, 64 nt, Homo Sapiens; identical to SEQ ID NO: 55622

SEQ ID NO: 227738 - RNA, 64 nt, Homo Sapiens; identical to SEQ ID NO: 55623

SEQ ID NO: 227739 - RNA, 64 nt, Homo Sapiens; identical to SEQ ID NO: 55624

SEQ ID NO: 227740 - RNA, 64 nt, Homo Sapiens; identical to SEQ ID NO: 55625

SEQ ID NO: 227741 - RNA, 64 nt, Homo Sapiens; identical to SEQ ID NO: 55626

SEQ ID NO: 227742 - RNA, 64 nt, Homo Sapiens; identical to SEQ ID NO: 55627

SEQ ID NO: 227743 - RNA, 64 nt, Homo Sapiens; identical to SEQ ID NO: 55628

SEQ ID NO: 227744 - RNA, 64 nt, Homo Sapiens; identical to SEQ ID NO: 55629

SEQ ID NO: 227745 - RNA, 64 nt, Homo Sapiens; identical to SEQ ID NO: 55630

SEQ ID NO: 227746 - RNA, 64 nt, Homo Sapiens; identical to SEQ ID NO: 55631

SEQ ID NO: 227747 - RNA, 64 nt, Homo Sapiens; identical to SEQ ID NO: 55632

SEQ ID NO: 227748 - RNA, 64 nt, Homo Sapiens; identical to SEQ ID NO: 55633

SEQ ID NO: 227749 - RNA, 64 nt, Homo Sapiens; identical to SEQ ID NO: 55634

SEQ ID NO: 227750 - RNA, 64 nt, Homo Sapiens; identical to SEQ ID NO: 55635

SEQ ID NO: 227751 - RNA, 64 nt, Homo Sapiens; identical to SEQ ID NO: 55636

SEQ ID NO: 227752 - RNA, 64 nt, Homo Sapiens; identical to SEQ ID NO: 55637

SEQ ID NO: 227753 - RNA, 64 nt, Homo Sapiens; identical to SEQ ID NO: 55638

SEQ ID NO: 227754 - RNA, 64 nt, Homo Sapiens; identical to SEQ ID NO: 55639

SEQ ID NO: 227755 - RNA, 64 nt, Homo Sapiens; identical to SEQ ID NO: 55640

SEQ ID NO: 227756 - RNA, 64 nt, Homo Sapiens; identical to SEQ ID NO: 55641

SEQ ID NO: 227757 - RNA, 64 nt, Homo Sapiens
caaacuaaaacuucugggcagcaaaaauauauaaaugcuucagaugucaaauacccaugcuuga

SEQ ID NO: 227758 - RNA, 64 nt, Homo Sapiens
uaacaggugucauuugacuaaacguuucgguagaaugcuucauacuugagugaugcuggauaag

SEQ ID NO: 227759 - RNA, 64 nt, Homo Sapiens
acuuuuuuuagaaugggccagaugguaaauauuuaugcuucacgguccauacagucucugucac

SEQ ID NO: 227760 - RNA, 64 nt, Homo Sapiens
aucuagcuacugaugucuuacuuugaguuuauuuaugcuucagaauacaguuguuugcccugug

SEQ ID NO: 227761 - RNA, 64 nt, Homo Sapiens
ucaucuucuucuuuaaucacuuaacauuccuaaaaugcuucacuguacguaguuaagucguagc

SEQ ID NO: 227762 - RNA, 64 nt, Homo Sapiens
aaacaaaaacaucccaagauuuuuucauuucaaaaugcuucaaaguccacauuagaucagauac

SEQ ID NO: 227763 - RNA, 64 nt, Homo Sapiens
caauaaagacauuucugcuuaauuuuauuuugucaugcuucaaaaagaaaugaaauguccuauc

SEQ ID NO: 227764 - RNA, 64 nt, Homo Sapiens
aauauuguugcuuagggugaacauguauguacacaugcuucagaugauauuuaaaaauauacac

SEQ ID NO: 227765 - RNA, 64 nt, Homo Sapiens
guaggggacaauaguagcauucgcaguggugauaaugcuucaagguggauguguuuggaaguuu

SEQ ID NO: 227766 - RNA, 64 nt, Homo Sapiens
acaaaugagcuuucaagaccauuuaaggaaacagaugcuucauuugcucuuaucucauauuuca

SEQ ID NO: 227767 - RNA, 64 nt, Homo Sapiens; identical to SEQ ID NO: 141798

SEQ ID NO: 227768 - RNA, 64 nt, Homo Sapiens; identical to SEQ ID NO: 141799

SEQ ID NO: 227769 - RNA, 64 nt, Homo Sapiens; identical to SEQ ID NO: 141800

SEQ ID NO: 227770 - RNA, 64 nt, Homo Sapiens; identical to SEQ ID NO: 141801

SEQ ID NO: 227771 - RNA, 64 nt, Homo Sapiens; identical to SEQ ID NO: 141802

SEQ ID NO: 227772 - RNA, 64 nt, Homo Sapiens; identical to SEQ ID NO: 141803

SEQ ID NO: 227773 - RNA, 64 nt, Homo Sapiens; identical to SEQ ID NO: 141804

SEQ ID NO: 227774 - RNA, 64 nt, Homo Sapiens; identical to SEQ ID NO: 141805

SEQ ID NO: 227775 - RNA, 64 nt, Homo Sapiens
auuuaacagaacuucucuaaccuuccaacugcuucccacaaacacauuggccucaaggcuccuu

SEQ ID NO: 227776 - RNA, 64 nt, Homo Sapiens
uuuccuccaagccacaugaggacucuggcacccacccacaaagcaagaccuguauuuauaagcc

SEQ ID NO: 227777 - RNA, 64 nt, Homo Sapiens
uccuguuacccgcugaacucaggcaaggaaaagccccacaaaaugucauuuccacaugaaggag

SEQ ID NO: 227778 - RNA, 64 nt, Homo Sapiens
acauugguuuugagaggugaacugacaguucauccccacaaaacauacucccugcacccuucug

SEQ ID NO: 227779 - RNA, 64 nt, Homo Sapiens
auuacacauaagauaauucauagcggagagaaaccccacaaaugugaagaauguggcagagcuu

SEQ ID NO: 227780 - RNA, 64 nt, Homo Sapiens
aguacacauaagaaaauucauacuggggagaaaccccacaaauguggagaaugcggaaaagccu

SEQ ID NO: 227781 - RNA, 64 nt, Homo Sapiens
ucugcacauaauauaauucauacuggagagaaaccccacaaauaugaagaaugugguaaugcuu

SEQ ID NO: 227782 - RNA, 64 nt, Homo Sapiens
uaacuauuauuuuagccuuaguagcuauuuggggcccacaaaaacuaaagaaagaaauucaaaa

SEQ ID NO: 227783 - RNA, 64 nt, Homo Sapiens
ugcuucuuugcuuuugcuccccucuuccgaguugcccacaaacuaggaaaugagaauaugaucc

SEQ ID NO: 227784 - RNA, 64 nt, Homo Sapiens
gcugguggaggaagaagauggaaacgugaugugucccacaaacuuucagcuguagcacuuggca

SEQ ID NO: 227785 - RNA, 64 nt, Homo Sapiens
aaugaauccagcguggaggagugcugcccucccucccacaaacacagaugggacugucaaaguu

SEQ ID NO: 227786 - RNA, 64 nt, Homo Sapiens; identical to SEQ ID NO: 155489

SEQ ID NO: 227787 - RNA, 64 nt, Homo Sapiens; identical to SEQ ID NO: 155490

SEQ ID NO: 227788 - RNA, 64 nt, Homo Sapiens; identical to SEQ ID NO: 155491

SEQ ID NO: 227789 - RNA, 64 nt, Homo Sapiens; identical to SEQ ID NO: 155492

SEQ ID NO: 227790 - RNA, 64 nt, Homo Sapiens; identical to SEQ ID NO: 155493

SEQ ID NO: 227791 - RNA, 64 nt, Homo Sapiens; identical to SEQ ID NO: 155494

SEQ ID NO: 227792 - RNA, 64 nt, Homo Sapiens; identical to SEQ ID NO: 155495

SEQ ID NO: 227793 - RNA, 64 nt, Homo Sapiens; identical to SEQ ID NO: 155496

SEQ ID NO: 227794 - RNA, 64 nt, Homo Sapiens; identical to SEQ ID NO: 155497

SEQ ID NO: 227795 - RNA, 64 nt, Homo Sapiens; identical to SEQ ID NO: 155498

SEQ ID NO: 227796 - RNA, 64 nt, Homo Sapiens; identical to SEQ ID NO: 155499

SEQ ID NO: 227797 - RNA, 64 nt, Homo Sapiens; identical to SEQ ID NO: 155500

SEQ ID NO: 227798 - RNA, 64 nt, Homo Sapiens; identical to SEQ ID NO: 155501

SEQ ID NO: 227799 - RNA, 64 nt, Homo Sapiens; identical to SEQ ID NO: 155502

SEQ ID NO: 227800 - RNA, 64 nt, Homo Sapiens; identical to SEQ ID NO: 155503

SEQ ID NO: 227801 - RNA, 64 nt, Homo Sapiens; identical to SEQ ID NO: 155504

SEQ ID NO: 227802 - RNA, 64 nt, Homo Sapiens; identical to SEQ ID NO: 155505

SEQ ID NO: 227803 - RNA, 64 nt, Homo Sapiens; identical to SEQ ID NO: 155506

SEQ ID NO: 227804 - RNA, 64 nt, Homo Sapiens; identical to SEQ ID NO: 155507

SEQ ID NO: 227805 - RNA, 64 nt, Homo Sapiens; identical to SEQ ID NO: 155508

SEQ ID NO: 227806 - RNA, 64 nt, Homo Sapiens; identical to SEQ ID NO: 155509

SEQ ID NO: 227807 - RNA, 64 nt, Homo Sapiens; identical to SEQ ID NO: 155510

SEQ ID NO: 227808 - RNA, 64 nt, Homo Sapiens; identical to SEQ ID NO: 155511

SEQ ID NO: 227809 - RNA, 64 nt, Homo Sapiens; identical to SEQ ID NO: 155512

SEQ ID NO: 227810 - RNA, 64 nt, Homo Sapiens; identical to SEQ ID NO: 155513

SEQ ID NO: 227811 - RNA, 61 nt, Homo Sapiens; identical to SEQ ID NO: 155514

SEQ ID NO: 227812 - RNA, 64 nt, Homo Sapiens; identical to SEQ ID NO: 155515

SEQ ID NO: 227813 - RNA, 64 nt, Homo Sapiens; identical to SEQ ID NO: 155516

SEQ ID NO: 227814 - RNA, 64 nt, Homo Sapiens; identical to SEQ ID NO: 155517

SEQ ID NO: 227815 - RNA, 64 nt, Homo Sapiens; identical to SEQ ID NO: 155518

SEQ ID NO: 227816 - RNA, 64 nt, Homo Sapiens; identical to SEQ ID NO: 155519

SEQ ID NO: 227817 - RNA, 64 nt, Homo Sapiens; identical to SEQ ID NO: 155520

SEQ ID NO: 227818 - RNA, 64 nt, Homo Sapiens; identical to SEQ ID NO: 155521

SEQ ID NO: 227819 - RNA, 64 nt, Homo Sapiens
gauuggaguggaccacggccaagcuugcuccguccucggacaggaagccacccugcguggggga

SEQ ID NO: 227820 - RNA, 64 nt, Homo Sapiens
ucaccacugaggccacgacaaagcacagcuccagcucggacagcacccucagugccagccagcc

SEQ ID NO: 227821 - RNA, 64 nt, Homo Sapiens
gaaaauuaucaaagaaccagaucaucacauaccccucucacagacaugagaugguagaaggaac

SEQ ID NO: 227822 - RNA, 64 nt, Homo Sapiens
agucuuagcccuaguaguuucaugacaaaugacacucucacaccauagaaaaaaagucuuuuca

SEQ ID NO: 227823 - RNA, 64 nt, Homo Sapiens
ccccucuccucuuccaaacaaaacauacauugaucucucacauccagcugccaaaagaaaaccc

SEQ ID NO: 227824 - RNA, 64 nt, Homo Sapiens
aaaaccccaucaaacacaguuacaccccacauaucucucacacacacacacacacgcacacaca

SEQ ID NO: 227825 - RNA, 64 nt, Homo Sapiens
ccucggcucugggguugauagucugcuaagguagcucucacacaucugcaguagccuuuuguga

SEQ ID NO: 227826 - RNA, 64 nt, Homo Sapiens
agugggauacagaauucagucucauuagaauuuccucucacaucggccccgcuggucccauuug

SEQ ID NO: 227827 - RNA, 64 nt, Homo Sapiens
acuugaacauuuuaaucuuugaaucuccccuuuccucucacaauuucugaacccauucuauuuu

SEQ ID NO: 227828 - RNA, 64 nt, Homo Sapiens
auuauuaucuacuuauaauuuccggagaauauuucucucacaauaggccaucacacuggccugu

SEQ ID NO: 227829 - RNA, 64 nt, Homo Sapiens
guccacugugcguuuguaugacccccaacgcguccucucacaccaagcccacauuuccaaaguc

SEQ ID NO: 227830 - RNA, 64 nt, Homo Sapiens
cggccacuggauuucccucacaagucagaguccucucucacagugaccaggugcuugugaccua

SEQ ID NO: 227831 - RNA, 64 nt, Homo Sapiens
gcaggccgcgugacguggggcugccuggccgcggcucucacauggugguuccugcugcacugau

SEQ ID NO: 227832 - RNA, 64 nt, Homo Sapiens
cucaagcgugugugcugggccggggagucccugucucucacagcaucuagcaguauuauuaaau

SEQ ID NO: 227833 - RNA, 64 nt, Homo Sapiens
ccagcgagacaccugagacaugcugaaauuauuucucucacacuuuugcuugaauuuaauacag

SEQ ID NO: 227834 - RNA, 64 nt, Homo Sapiens
uauggcaauuuagcucucuuggguucccaaaucccucucacaagaaugugcagaagaaaucaua

SEQ ID NO: 227835 - RNA, 64 nt, Homo Sapiens
uaguuguaaugcuguagcauucuuguaggagcuccucucacaaguacugggacaaguuuacugc

SEQ ID NO: 227836 - RNA, 64 nt, Homo Sapiens
ugucuguauuaauuucacauuaguuuugcacaaccucucacaaaugccauuuuuguaaauacag

SEQ ID NO: 227837 - RNA, 64 nt, Homo Sapiens
ugcugaaugugagaucagaaguacauucacauuucucucacauuuuuuucuggcagacauuuca

SEQ ID NO: 227838 - RNA, 64 nt, Homo Sapiens
gaugcucccaaggguuagggauuugcaccuuuaccucucacaugggagucaacaugcccaaguc

SEQ ID NO: 227839 - RNA, 64 nt, Homo Sapiens
gagcgagaggcgcugccccagccaggcccaccaccucucacagucagugcacgcaagcagggac

SEQ ID NO: 227840 - RNA, 64 nt, Homo Sapiens
gcaccuccaggucucuggacuccaguuuuggccccucucacacagagcugucagcaggggccgc

SEQ ID NO: 227841 - RNA, 64 nt, Homo Sapiens
ccaggcccaucgucuguucucaguguucugauugcucucacagcaacgagcccuccuauuuuca

SEQ ID NO: 227842 - RNA, 64 nt, Homo Sapiens
cacacacacacacacacacacucucucucucucucucucacacagucgauagugugcacucuuu

SEQ ID NO: 227843 - RNA, 64 nt, Homo Sapiens
uuuaugggauaguauggacuauggaaaaacaaauuugcacaauggccugggaaguugaggucac

SEQ ID NO: 227844 - RNA, 64 nt, Homo Sapiens
uuccguuuucccccuaaagaacauaucauaaucauugcacaaauaaccauguucuuugguaaug

SEQ ID NO: 227845 - RNA, 64 nt, Homo Sapiens
uuguauauacauauuauaaaauucaacacauuacuugcacaagcuucccuaucaaaacauauca

SEQ ID NO: 227846 - RNA, 64 nt, Homo Sapiens
ugagcaauucauuucacuuuaaaaaaaaaaaaaauugcacaauuaaaaaaaaaaaaaaaaaaaa

SEQ ID NO: 227847 - RNA, 64 nt, Homo Sapiens
auucucaggcacauuaaauuaagaugacauguauuugcacaaaagcuaugcauauuuuuaauga

SEQ ID NO: 227848 - RNA, 64 nt, Homo Sapiens
guugugaaugugaaagggggagagaaaaggaauguugcacaaggauguggucuggucugacuug

SEQ ID NO: 227849 - RNA, 64 nt, Homo Sapiens
uagggcacuggacuuucuggcaugggggcuguguuugcacaaguuauuuucauguuaccuggag

SEQ ID NO: 227850 - RNA, 64 nt, Homo Sapiens
uaaggagggucuggccagaggaacagaccagcuuuugcacaaugaagcgcaagggaacaagugg

SEQ ID NO: 227851 - RNA, 64 nt, Homo Sapiens
aaagcaaacuggcaugguucguauuuuaaaaaucuugcacaaauuguaaugugauacugugaaa

SEQ ID NO: 227852 - RNA, 64 nt, Homo Sapiens
aaauguguagauauuuuuaaacauuuugccauaauugcacaauuuuuugcauuuuuaccugaug

SEQ ID NO: 227853 - RNA, 64 nt, Homo Sapiens
aagacaggacccugggaccacagagggcaggaacuugcacaaaaucacacagccaagccaguca

SEQ ID NO: 227854 - RNA, 64 nt, Homo Sapiens
uaugugggugggaccacagacucacauccugaccuugcacaaacagccccucuggacacagccc

SEQ ID NO: 227855 - RNA, 64 nt, Homo Sapiens
ucaucucauuuguauuccauuguuaaguuacaguuugcacaagucauagaaacuuuguggggca

SEQ ID NO: 227856 - RNA, 64 nt, Homo Sapiens
uuguccuaauauauacauagaacuguugucaccauugcacaauuuaacuuuuauagguuaucaa

SEQ ID NO: 227857 - RNA, 64 nt, Homo Sapiens
ugacuccugagcaggaccugggcccgguucagcuccccacaaggacuucucugucuggagacag

SEQ ID NO: 227858 - RNA, 64 nt, Homo Sapiens
gccacagcugcagacugagagggugggucugaguccccacaaugucugaagcugccccugggau

SEQ ID NO: 227859 - RNA, 57 nt, Homo Sapiens
aagaagacacauacaaguaagaccuguccccacaacaaggacccuguguggagccag

SEQ ID NO: 227860 - RNA, 64 nt, Homo Sapiens
gucagccccuuguauguaagagaggacacugaggccccacaaggccucaucuccuuaaggcuag

SEQ ID NO: 227861 - RNA, 64 nt, Homo Sapiens
cauguugguuucaucuucgcugucucucucauuuccccacaaaguguugucucacuuucugccu

SEQ ID NO: 227862 - RNA, 64 nt, Homo Sapiens
auauaguagagugaggugagggucguggcuaaaaccccacaauaacuuuacauuccuagcuuua

SEQ ID NO: 227863 - RNA, 64 nt, Homo Sapiens
uuccuguuacccgcugaacugaggcaaggaaaagccccacaaaaugucauuuccacaugaagga

SEQ ID NO: 227864 - RNA, 64 nt, Homo Sapiens
cacauugguuuugagagguggacugacaguucauccccacaaaauauacucccugcacccuucu

SEQ ID NO: 227865 - RNA, 64 nt, Homo Sapiens
uauuacacauaagauaauucauagcggagagaaaccccacaaaugugaagaauguggcagagcu

SEQ ID NO: 227866 - RNA, 64 nt, Homo Sapiens
uaguacacauaagaaaauucauacuggggagaaaccccacaaauguggagaaugcggaaaagcc

SEQ ID NO: 227867 - RNA, 64 nt, Homo Sapiens
uucugcacauaauauaauucauacuggagagaaaccccacaaauaugaagaaugugguaaugcu

SEQ ID NO: 227868 - RNA, 64 nt, Homo Sapiens
agauaaguggcucuuacccagcucucagugacucccccacaaaacagcaacagccuccaccgcc

SEQ ID NO: 227869 - RNA, 64 nt, Homo Sapiens
agaccuccgguccgagacccugccuggguucaccccccacaacccagacccagaaccgcucucc

SEQ ID NO: 227870 - RNA, 64 nt, Homo Sapiens
uggaucuggcuguugaguugacggguuccuugaaccccacaaaaucccucuccaaccacaggac

SEQ ID NO: 227871 - RNA, 64 nt, Homo Sapiens
aggccuauucgcugcacuuccugccaaacuuugcccccacaagccuggucaucagccaggcagc

SEQ ID NO: 227872 - RNA, 64 nt, Homo Sapiens
uuuguaagaaacccaaccuauuuuuaagucaaguugagguuauuauaauuuuugccuucgaauu

SEQ ID NO: 227873 - RNA, 64 nt, Homo Sapiens
auaaaaggacucauuuaagccuuuauaaagaauuugagguuaagaaaaacaagcuauauuccca

SEQ ID NO: 227874 - RNA, 64 nt, Homo Sapiens
caaagaaucuacuccuuaaaccuggagaagaacaugagguuauuguuucauuuacuccaaagga

SEQ ID NO: 227875 - RNA, 64 nt, Homo Sapiens
aaaacuggacguuuccagauugugaauaacucugugagguuacugagauuugagcugugcuggc

SEQ ID NO: 227876 - RNA, 64 nt, Homo Sapiens
caccacuuugggaggccaagaugggaggagugcuugagguuaggcguuccagaccagccugggc

SEQ ID NO: 227877 - RNA, 64 nt, Homo Sapiens
ugaugauuacgauguugauuauaacauuugauuaugagguuaagcacaugagucuuuaccugug

SEQ ID NO: 227878 - RNA, 64 nt, Homo Sapiens; identical to SEQ ID NO: 160772

SEQ ID NO: 227879 - RNA, 64 nt, Homo Sapiens; identical to SEQ ID NO: 160773

SEQ ID NO: 227880 - RNA, 64 nt, Homo Sapiens; identical to SEQ ID NO: 160774

SEQ ID NO: 227881 - RNA, 64 nt, Homo Sapiens; identical to SEQ ID NO: 160775

SEQ ID NO: 227882 - RNA, 64 nt, Homo Sapiens; identical to SEQ ID NO: 160776

SEQ ID NO: 227883 - RNA, 64 nt, Homo Sapiens; identical to SEQ ID NO: 160777

SEQ ID NO: 227884 - RNA, 64 nt, Homo Sapiens; identical to SEQ ID NO: 160778

SEQ ID NO: 227885 - RNA, 64 nt, Homo Sapiens; identical to SEQ ID NO: 160779

SEQ ID NO: 227886 - RNA, 64 nt, Homo Sapiens; identical to SEQ ID NO: 160780

SEQ ID NO: 227887 - RNA, 64 nt, Homo Sapiens; identical to SEQ ID NO: 160781

SEQ ID NO: 227888 - RNA, 64 nt, Homo Sapiens; identical to SEQ ID NO: 160782

SEQ ID NO: 227889 - RNA, 64 nt, Homo Sapiens; identical to SEQ ID NO: 160783

SEQ ID NO: 227890 - RNA, 64 nt, Homo Sapiens; identical to SEQ ID NO: 160784

SEQ ID NO: 227891 - RNA, 64 nt, Homo Sapiens; identical to SEQ ID NO: 160785

SEQ ID NO: 227892 - RNA, 64 nt, Homo Sapiens; identical to SEQ ID NO: 160786

SEQ ID NO: 227893 - RNA, 64 nt, Homo Sapiens; identical to SEQ ID NO: 160787

SEQ ID NO: 227894 - RNA, 64 nt, Homo Sapiens; identical to SEQ ID NO: 160788

SEQ ID NO: 227895 - RNA, 64 nt, Homo Sapiens; identical to SEQ ID NO: 160789

SEQ ID NO: 227896 - RNA, 64 nt, Homo Sapiens; identical to SEQ ID NO: 160790

SEQ ID NO: 227897 - RNA, 64 nt, Homo Sapiens; identical to SEQ ID NO: 160791

SEQ ID NO: 227898 - RNA, 64 nt, Homo Sapiens; identical to SEQ ID NO: 160792

SEQ ID NO: 227899 - RNA, 64 nt, Homo Sapiens; identical to SEQ ID NO: 160793

SEQ ID NO: 227900 - RNA, 64 nt, Homo Sapiens; identical to SEQ ID NO: 160794

SEQ ID NO: 227901 - RNA, 64 nt, Homo Sapiens; identical to SEQ ID NO: 160795

SEQ ID NO: 227902 - RNA, 64 nt, Homo Sapiens; identical to SEQ ID NO: 160796

SEQ ID NO: 227903 - RNA, 64 nt, Homo Sapiens; identical to SEQ ID NO: 160797

SEQ ID NO: 227904 - RNA, 64 nt, Homo Sapiens; identical to SEQ ID NO: 160798

SEQ ID NO: 227905 - RNA, 64 nt, Homo Sapiens; identical to SEQ ID NO: 160799

SEQ ID NO: 227906 - RNA, 64 nt, Homo Sapiens; identical to SEQ ID NO: 160800

SEQ ID NO: 227907 - RNA, 64 nt, Homo Sapiens; identical to SEQ ID NO: 160801

SEQ ID NO: 227908 - RNA, 64 nt, Homo Sapiens; identical to SEQ ID NO: 160802

SEQ ID NO: 227909 - RNA, 64 nt, Homo Sapiens; identical to SEQ ID NO: 160803

SEQ ID NO: 227910 - RNA, 64 nt, Homo Sapiens; identical to SEQ ID NO: 160804

SEQ ID NO: 227911 - RNA, 64 nt, Homo Sapiens; identical to SEQ ID NO: 160805

SEQ ID NO: 227912 - RNA, 64 nt, Homo Sapiens; identical to SEQ ID NO: 160806

SEQ ID NO: 227913 - RNA, 64 nt, Homo Sapiens; identical to SEQ ID NO: 160807

SEQ ID NO: 227914 - RNA, 64 nt, Homo Sapiens; identical to SEQ ID NO: 160808

SEQ ID NO: 227915 - RNA, 64 nt, Homo Sapiens; identical to SEQ ID NO: 160809

SEQ ID NO: 227916 - RNA, 64 nt, Homo Sapiens; identical to SEQ ID NO: 160810

SEQ ID NO: 227917 - RNA, 64 nt, Homo Sapiens; identical to SEQ ID NO: 160811

SEQ ID NO: 227918 - RNA, 64 nt, Homo Sapiens; identical to SEQ ID NO: 160812

SEQ ID NO: 227919 - RNA, 64 nt, Homo Sapiens; identical to SEQ ID NO: 160813

SEQ ID NO: 227920 - RNA, 64 nt, Homo Sapiens; identical to SEQ ID NO: 160814

SEQ ID NO: 227921 - RNA, 64 nt, Homo Sapiens; identical to SEQ ID NO: 160815

SEQ ID NO: 227922 - RNA, 64 nt, Homo Sapiens; identical to SEQ ID NO: 160816

SEQ ID NO: 227923 - RNA, 64 nt, Homo Sapiens; identical to SEQ ID NO: 160817

SEQ ID NO: 227924 - RNA, 64 nt, Homo Sapiens; identical to SEQ ID NO: 160818

SEQ ID NO: 227925 - RNA, 64 nt, Homo Sapiens; identical to SEQ ID NO: 160819

SEQ ID NO: 227926 - RNA, 64 nt, Homo Sapiens; identical to SEQ ID NO: 160820

SEQ ID NO: 227927 - RNA, 64 nt, Homo Sapiens; identical to SEQ ID NO: 160821

SEQ ID NO: 227928 - RNA, 64 nt, Homo Sapiens; identical to SEQ ID NO: 160822

SEQ ID NO: 227929 - RNA, 64 nt, Homo Sapiens; identical to SEQ ID NO: 160823

SEQ ID NO: 227930 - RNA, 64 nt, Homo Sapiens; identical to SEQ ID NO: 160824

SEQ ID NO: 227931 - RNA, 64 nt, Homo Sapiens; identical to SEQ ID NO: 160825

SEQ ID NO: 227932 - RNA, 64 nt, Homo Sapiens; identical to SEQ ID NO: 160826

SEQ ID NO: 227933 - RNA, 64 nt, Homo Sapiens; identical to SEQ ID NO: 160827

SEQ ID NO: 227934 - RNA, 64 nt, Homo Sapiens; identical to SEQ ID NO: 160828

SEQ ID NO: 227935 - RNA, 64 nt, Homo Sapiens; identical to SEQ ID NO: 160829

SEQ ID NO: 227936 - RNA, 64 nt, Homo Sapiens; identical to SEQ ID NO: 160830

SEQ ID NO: 227937 - RNA, 64 nt, Homo Sapiens; identical to SEQ ID NO: 160831

SEQ ID NO: 227938 - RNA, 64 nt, Homo Sapiens; identical to SEQ ID NO: 160832

SEQ ID NO: 227939 - RNA, 64 nt, Homo Sapiens; identical to SEQ ID NO: 160833

SEQ ID NO: 227940 - RNA, 64 nt, Homo Sapiens; identical to SEQ ID NO: 160834

SEQ ID NO: 227941 - RNA, 64 nt, Homo Sapiens; identical to SEQ ID NO: 160835

SEQ ID NO: 227942 - RNA, 64 nt, Homo Sapiens; identical to SEQ ID NO: 160836

SEQ ID NO: 227943 - RNA, 64 nt, Homo Sapiens; identical to SEQ ID NO: 160837

SEQ ID NO: 227944 - RNA, 64 nt, Homo Sapiens; identical to SEQ ID NO: 160838

SEQ ID NO: 227945 - RNA, 64 nt, Homo Sapiens; identical to SEQ ID NO: 160839

SEQ ID NO: 227946 - RNA, 64 nt, Homo Sapiens; identical to SEQ ID NO: 160840

SEQ ID NO: 227947 - RNA, 64 nt, Homo Sapiens; identical to SEQ ID NO: 160841

SEQ ID NO: 227948 - RNA, 64 nt, Homo Sapiens; identical to SEQ ID NO: 160842

SEQ ID NO: 227949 - RNA, 64 nt, Homo Sapiens; identical to SEQ ID NO: 160843

SEQ ID NO: 227950 - RNA, 64 nt, Homo Sapiens; identical to SEQ ID NO: 160844

SEQ ID NO: 227951 - RNA, 64 nt, Homo Sapiens; identical to SEQ ID NO: 160845

SEQ ID NO: 227952 - RNA, 64 nt, Homo Sapiens; identical to SEQ ID NO: 160846

SEQ ID NO: 227953 - RNA, 64 nt, Homo Sapiens; identical to SEQ ID NO: 160847

SEQ ID NO: 227954 - RNA, 64 nt, Homo Sapiens; identical to SEQ ID NO: 160848

SEQ ID NO: 227955 - RNA, 64 nt, Homo Sapiens; identical to SEQ ID NO: 160849

SEQ ID NO: 227956 - RNA, 64 nt, Homo Sapiens; identical to SEQ ID NO: 160850

SEQ ID NO: 227957 - RNA, 64 nt, Homo Sapiens; identical to SEQ ID NO: 160851

SEQ ID NO: 227958 - RNA, 64 nt, Homo Sapiens; identical to SEQ ID NO: 160852

SEQ ID NO: 227959 - RNA, 64 nt, Homo Sapiens; identical to SEQ ID NO: 160853

SEQ ID NO: 227960 - RNA, 64 nt, Homo Sapiens; identical to SEQ ID NO: 160854

SEQ ID NO: 227961 - RNA, 64 nt, Homo Sapiens; identical to SEQ ID NO: 160855

SEQ ID NO: 227962 - RNA, 64 nt, Homo Sapiens; identical to SEQ ID NO: 160856

SEQ ID NO: 227963 - RNA, 64 nt, Homo Sapiens; identical to SEQ ID NO: 160857

SEQ ID NO: 227964 - RNA, 64 nt, Homo Sapiens; identical to SEQ ID NO: 160858

SEQ ID NO: 227965 - RNA, 64 nt, Homo Sapiens; identical to SEQ ID NO: 160859

SEQ ID NO: 227966 - RNA, 64 nt, Homo Sapiens; identical to SEQ ID NO: 160860

SEQ ID NO: 227967 - RNA, 64 nt, Homo Sapiens; identical to SEQ ID NO: 160861

SEQ ID NO: 227968 - RNA, 64 nt, Homo Sapiens; identical to SEQ ID NO: 160862

SEQ ID NO: 227969 - RNA, 64 nt, Homo Sapiens; identical to SEQ ID NO: 160863

SEQ ID NO: 227970 - RNA, 64 nt, Homo Sapiens; identical to SEQ ID NO: 160864

SEQ ID NO: 227971 - RNA, 64 nt, Homo Sapiens; identical to SEQ ID NO: 160865

SEQ ID NO: 227972 - RNA, 64 nt, Homo Sapiens; identical to SEQ ID NO: 160866

SEQ ID NO: 227973 - RNA, 64 nt, Homo Sapiens; identical to SEQ ID NO: 160867

SEQ ID NO: 227974 - RNA, 64 nt, Homo Sapiens; identical to SEQ ID NO: 160868

SEQ ID NO: 227975 - RNA, 64 nt, Homo Sapiens; identical to SEQ ID NO: 160869

SEQ ID NO: 227976 - RNA, 64 nt, Homo Sapiens; identical to SEQ ID NO: 160870

SEQ ID NO: 227977 - RNA, 64 nt, Homo Sapiens; identical to SEQ ID NO: 160871

SEQ ID NO: 227978 - RNA, 64 nt, Homo Sapiens; identical to SEQ ID NO: 160872

SEQ ID NO: 227979 - RNA, 64 nt, Homo Sapiens; identical to SEQ ID NO: 160873

SEQ ID NO: 227980 - RNA, 64 nt, Homo Sapiens; identical to SEQ ID NO: 160874

SEQ ID NO: 227981 - RNA, 64 nt, Homo Sapiens; identical to SEQ ID NO: 160875

SEQ ID NO: 227982 - RNA, 64 nt, Homo Sapiens; identical to SEQ ID NO: 160876

SEQ ID NO: 227983 - RNA, 64 nt, Homo Sapiens; identical to SEQ ID NO: 160877

SEQ ID NO: 227984 - RNA, 64 nt, Homo Sapiens; identical to SEQ ID NO: 160878

SEQ ID NO: 227985 - RNA, 64 nt, Homo Sapiens; identical to SEQ ID NO: 160879

SEQ ID NO: 227986 - RNA, 64 nt, Homo Sapiens; identical to SEQ ID NO: 160880

SEQ ID NO: 227987 - RNA, 64 nt, Homo Sapiens; identical to SEQ ID NO: 160881

SEQ ID NO: 227988 - RNA, 64 nt, Homo Sapiens; identical to SEQ ID NO: 160882

SEQ ID NO: 227989 - RNA, 64 nt, Homo Sapiens; identical to SEQ ID NO: 160883

SEQ ID NO: 227990 - RNA, 64 nt, Homo Sapiens; identical to SEQ ID NO: 160884

SEQ ID NO: 227991 - RNA, 64 nt, Homo Sapiens; identical to SEQ ID NO: 160885

SEQ ID NO: 227992 - RNA, 64 nt, Homo Sapiens; identical to SEQ ID NO: 160886

SEQ ID NO: 227993 - RNA, 64 nt, Homo Sapiens; identical to SEQ ID NO: 160887

SEQ ID NO: 227994 - RNA, 64 nt, Homo Sapiens; identical to SEQ ID NO: 160888

SEQ ID NO: 227995 - RNA, 64 nt, Homo Sapiens; identical to SEQ ID NO: 160889

SEQ ID NO: 227996 - RNA, 64 nt, Homo Sapiens; identical to SEQ ID NO: 160890

SEQ ID NO: 227997 - RNA, 64 nt, Homo Sapiens; identical to SEQ ID NO: 160891

SEQ ID NO: 227998 - RNA, 64 nt, Homo Sapiens; identical to SEQ ID NO: 160892

SEQ ID NO: 227999 - RNA, 64 nt, Homo Sapiens; identical to SEQ ID NO: 160893

SEQ ID NO: 228000 - RNA, 64 nt, Homo Sapiens; identical to SEQ ID NO: 160894

SEQ ID NO: 228001 - RNA, 64 nt, Homo Sapiens; identical to SEQ ID NO: 160895

SEQ ID NO: 228002 - RNA, 64 nt, Homo Sapiens; identical to SEQ ID NO: 160896

SEQ ID NO: 228003 - RNA, 64 nt, Homo Sapiens; identical to SEQ ID NO: 160897

SEQ ID NO: 228004 - RNA, 64 nt, Homo Sapiens; identical to SEQ ID NO: 160898

SEQ ID NO: 228005 - RNA, 64 nt, Homo Sapiens; identical to SEQ ID NO: 160899

SEQ ID NO: 228006 - RNA, 64 nt, Homo Sapiens; identical to SEQ ID NO: 160900

SEQ ID NO: 228007 - RNA, 64 nt, Homo Sapiens; identical to SEQ ID NO: 160901

SEQ ID NO: 228008 - RNA, 64 nt, Homo Sapiens; identical to SEQ ID NO: 160902

SEQ ID NO: 228009 - RNA, 64 nt, Homo Sapiens; identical to SEQ ID NO: 160903

SEQ ID NO: 228010 - RNA, 64 nt, Homo Sapiens; identical to SEQ ID NO: 160904

SEQ ID NO: 228011 - RNA, 64 nt, Homo Sapiens; identical to SEQ ID NO: 160905

SEQ ID NO: 228012 - RNA, 64 nt, Homo Sapiens; identical to SEQ ID NO: 160906

SEQ ID NO: 228013 - RNA, 64 nt, Homo Sapiens; identical to SEQ ID NO: 160907

SEQ ID NO: 228014 - RNA, 64 nt, Homo Sapiens; identical to SEQ ID NO: 160908

SEQ ID NO: 228015 - RNA, 64 nt, Homo Sapiens; identical to SEQ ID NO: 160909

SEQ ID NO: 228016 - RNA, 64 nt, Homo Sapiens; identical to SEQ ID NO: 160910

SEQ ID NO: 228017 - RNA, 64 nt, Homo Sapiens; identical to SEQ ID NO: 160911

SEQ ID NO: 228018 - RNA, 64 nt, Homo Sapiens; identical to SEQ ID NO: 160912

SEQ ID NO: 228019 - RNA, 64 nt, Homo Sapiens; identical to SEQ ID NO: 160913

SEQ ID NO: 228020 - RNA, 64 nt, Homo Sapiens; identical to SEQ ID NO: 160914

SEQ ID NO: 228021 - RNA, 64 nt, Homo Sapiens; identical to SEQ ID NO: 160915

SEQ ID NO: 228022 - RNA, 64 nt, Homo Sapiens; identical to SEQ ID NO: 160916

SEQ ID NO: 228023 - RNA, 64 nt, Homo Sapiens; identical to SEQ ID NO: 160917

SEQ ID NO: 228024 - RNA, 64 nt, Homo Sapiens; identical to SEQ ID NO: 160918

SEQ ID NO: 228025 - RNA, 64 nt, Homo Sapiens; identical to SEQ ID NO: 160919

SEQ ID NO: 228026 - RNA, 64 nt, Homo Sapiens; identical to SEQ ID NO: 160920

SEQ ID NO: 228027 - RNA, 64 nt, Homo Sapiens; identical to SEQ ID NO: 160921

SEQ ID NO: 228028 - RNA, 64 nt, Homo Sapiens; identical to SEQ ID NO: 160922

SEQ ID NO: 228029 - RNA, 64 nt, Homo Sapiens; identical to SEQ ID NO: 160923

SEQ ID NO: 228030 - RNA, 64 nt, Homo Sapiens; identical to SEQ ID NO: 160924

SEQ ID NO: 228031 - RNA, 64 nt, Homo Sapiens; identical to SEQ ID NO: 160925

SEQ ID NO: 228032 - RNA, 64 nt, Homo Sapiens; identical to SEQ ID NO: 160926

SEQ ID NO: 228033 - RNA, 64 nt, Homo Sapiens; identical to SEQ ID NO: 160927

SEQ ID NO: 228034 - RNA, 64 nt, Homo Sapiens; identical to SEQ ID NO: 160928

SEQ ID NO: 228035 - RNA, 64 nt, Homo Sapiens; identical to SEQ ID NO: 160929

SEQ ID NO: 228036 - RNA, 64 nt, Homo Sapiens; identical to SEQ ID NO: 160930

SEQ ID NO: 228037 - RNA, 64 nt, Homo Sapiens; identical to SEQ ID NO: 160931

SEQ ID NO: 228038 - RNA, 64 nt, Homo Sapiens; identical to SEQ ID NO: 160932

SEQ ID NO: 228039 - RNA, 64 nt, Homo Sapiens; identical to SEQ ID NO: 160933

SEQ ID NO: 228040 - RNA, 64 nt, Homo Sapiens; identical to SEQ ID NO: 160934

SEQ ID NO: 228041 - RNA, 64 nt, Homo Sapiens; identical to SEQ ID NO: 160935

SEQ ID NO: 228042 - RNA, 64 nt, Homo Sapiens; identical to SEQ ID NO: 160936

SEQ ID NO: 228043 - RNA, 64 nt, Homo Sapiens; identical to SEQ ID NO: 160937

SEQ ID NO: 228044 - RNA, 64 nt, Homo Sapiens; identical to SEQ ID NO: 160938

SEQ ID NO: 228045 - RNA, 64 nt, Homo Sapiens; identical to SEQ ID NO: 160939

SEQ ID NO: 228046 - RNA, 64 nt, Homo Sapiens; identical to SEQ ID NO: 160940

SEQ ID NO: 228047 - RNA, 62 nt, Homo Sapiens; identical to SEQ ID NO: 160941

SEQ ID NO: 228048 - RNA, 64 nt, Homo Sapiens; identical to SEQ ID NO: 160942

SEQ ID NO: 228049 - RNA, 64 nt, Homo Sapiens; identical to SEQ ID NO: 160943

SEQ ID NO: 228050 - RNA, 64 nt, Homo Sapiens; identical to SEQ ID NO: 160944

SEQ ID NO: 228051 - RNA, 64 nt, Homo Sapiens; identical to SEQ ID NO: 160945

SEQ ID NO: 228052 - RNA, 64 nt, Homo Sapiens; identical to SEQ ID NO: 160945

SEQ ID NO: 228053 - RNA, 64 nt, Homo Sapiens; identical to SEQ ID NO: 160947

SEQ ID NO: 228054 - RNA, 64 nt, Homo Sapiens; identical to SEQ ID NO: 160948

SEQ ID NO: 228055 - RNA, 64 nt, Homo Sapiens; identical to SEQ ID NO: 160949

SEQ ID NO: 228056 - RNA, 64 nt, Homo Sapiens; identical to SEQ ID NO: 160950

SEQ ID NO: 228057 - RNA, 64 nt, Homo Sapiens; identical to SEQ ID NO: 160951

SEQ ID NO: 228058 - RNA, 64 nt, Homo Sapiens; identical to SEQ ID NO: 160952

SEQ ID NO: 228059 - RNA, 64 nt, Homo Sapiens; identical to SEQ ID NO: 160953

SEQ ID NO: 228060 - RNA, 64 nt, Homo Sapiens; identical to SEQ ID NO: 160954

SEQ ID NO: 228061 - RNA, 64 nt, Homo Sapiens; identical to SEQ ID NO: 160955

SEQ ID NO: 228062 - RNA, 64 nt, Homo Sapiens; identical to SEQ ID NO: 160956

SEQ ID NO: 228063 - RNA, 64 nt, Homo Sapiens; identical to SEQ ID NO: 160957

SEQ ID NO: 228064 - RNA, 64 nt, Homo Sapiens; identical to SEQ ID NO: 160958

SEQ ID NO: 228065 - RNA, 64 nt, Homo Sapiens; identical to SEQ ID NO: 160959

SEQ ID NO: 228066 - RNA, 64 nt, Homo Sapiens; identical to SEQ ID NO: 160960

SEQ ID NO: 228067 - RNA, 64 nt, Homo Sapiens; identical to SEQ ID NO: 160961

SEQ ID NO: 228068 - RNA, 64 nt, Homo Sapiens; identical to SEQ ID NO: 160962

SEQ ID NO: 228069 - RNA, 64 nt, Homo Sapiens; identical to SEQ ID NO: 160963

SEQ ID NO: 228070 - RNA, 64 nt, Homo Sapiens; identical to SEQ ID NO: 160963

SEQ ID NO: 228071 - RNA, 64 nt, Homo Sapiens; identical to SEQ ID NO: 160965

SEQ ID NO: 228072 - RNA, 64 nt, Homo Sapiens; identical to SEQ ID NO: 160966

SEQ ID NO: 228073 - RNA, 64 nt, Homo Sapiens; identical to SEQ ID NO: 160967

SEQ ID NO: 228074 - RNA, 64 nt, Homo Sapiens; identical to SEQ ID NO: 160968

SEQ ID NO: 228075 - RNA, 64 nt, Homo Sapiens; identical to SEQ ID NO: 160969

SEQ ID NO: 228076 - RNA, 64 nt, Homo Sapiens; identical to SEQ ID NO: 160970

SEQ ID NO: 228077 - RNA, 64 nt, Homo Sapiens; identical to SEQ ID NO: 160971

SEQ ID NO: 228078 - RNA, 64 nt, Homo Sapiens; identical to SEQ ID NO: 160972

SEQ ID NO: 228079 - RNA, 64 nt, Homo Sapiens
auaaauuggagagcuuauaaaaugcagaacauuucuauccuauccuaccaaauauuuauccuuc

SEQ ID NO: 228080 - RNA, 64 nt, Homo Sapiens
uuggagagcuuauaaaaugcagaacauuucuauccuauccuaccaaauauuuauccuucucugu

SEQ ID NO: 228081 - RNA, 64 nt, Homo Sapiens
aucccggagauggauugaugucuccauuguauuuaaaccaaaaugaacugauacuuguuggaau

SEQ ID NO: 228082 - RNA, 64 nt, Homo Sapiens
uguuguuuuuguaagaaaugagaugcaggaaagaaaaccaaaucccauuccugcaccccagucc

SEQ ID NO: 228083 - RNA, 64 nt, Homo Sapiens
aggagcugguagccuaccuacacagcugcuacaaaaaccaaaauacagaauggcuucugugaua

SEQ ID NO: 228084 - RNA, 64 nt, Homo Sapiens
uggcaugacaucugagcacagaaauuaaggcaaaaaaccaaagcaaaacaaauacauggugcug

SEQ ID NO: 228085 - RNA, 64 nt, Homo Sapiens
ggcguacuauuuuuauugagcccaaaaacaagcaaaaccaaagaauauguagucuaagcauacg

SEQ ID NO: 228086 - RNA, 64 nt, Homo Sapiens
aacuaugcuauuaaaaaaaaagaagguaacugauaaaccaaaauugagcauaguaauuacccac

SEQ ID NO: 228087 - RNA, 64 nt, Homo Sapiens
ccuuuacuguuucuaaauuuuauacaugaaauauaaaccaaaaauaagguuggaacagcagcac

SEQ ID NO: 228088 - RNA, 64 nt, Homo Sapiens
gcgcugguugguagggugaguuguucuaaaacaaaaaccaaaggagccaccauuuaacccuucc

SEQ ID NO: 228089 - RNA, 64 nt, Homo Sapiens
uuuucucaaaccagggacuaaauuacuaaaugucaaaccaaacuaguaucaugcaauaaggcuu

SEQ ID NO: 228090 - RNA, 64 nt, Homo Sapiens
ccucuacacuugauuuauauuuuuuaacauuuaaaaaccaaaguaccuaucugcuccaauuaua

SEQ ID NO: 228091 - RNA, 64 nt, Homo Sapiens
guugaguuuccaauggaaccuaucacaauuuacgaaaccaaaaaacaguauacauauauauuua

SEQ ID NO: 228092 - RNA, 64 nt, Homo Sapiens
cgaagcccucuugcaaaguacauuguuggaguguaaaccaaauagccgucccagugaaaauccu

SEQ ID NO: 228093 - RNA, 64 nt, Homo Sapiens
ugagcuuuuaacuuucuccccuaacuugggccagaaaccaaagcggcuaaccuuucuaagcucc

SEQ ID NO: 228094 - RNA, 64 nt, Homo Sapiens
cuaaccagccuauccccaggacccaguugccuuuaaaccaaauuauccucccuccuugcuuguc

SEQ ID NO: 228095 - RNA, 64 nt, Homo Sapiens
auaucuaaguaguucucagccuuauuuaaaaacaaaaccaaaugcauucuaauuaaugcccuuu

SEQ ID NO: 228096 - RNA, 64 nt, Homo Sapiens
auuguucaaauuuagguuuaaauaacaaagaagaaaaccaaauuggucuaccuuuaaaauaagc

SEQ ID NO: 228097 - RNA, 64 nt, Homo Sapiens
uccuggaaucaaggaauccugagucugggcaaugaaaccaaagccaggaguugacgcauccugc

SEQ ID NO: 228098 - RNA, 64 nt, Homo Sapiens
ucuuggcaguauuccaugggauguuaagcaaaggaaaccaaaggaaucguuucaaauggacuca

SEQ ID NO: 228099 - RNA, 64 nt, Homo Sapiens
uucuuuuuuuaaauuguaucuaauccucaacaacaaaccaaaacagaacaauuaaacagccaaa

SEQ ID NO: 228100 - RNA, 64 nt, Homo Sapiens
cucugaaggccgggacccagucauacauccuuagaaaccaaaguaugguuuuuguuuucucuug

SEQ ID NO: 228101 - RNA, 64 nt, Homo Sapiens
cacagugaaaacccaucucaaaaaaaaaaaaaaaaaaccaaaaaaacuguccagcuguggacuu

SEQ ID NO: 228102 - RNA, 64 nt, Homo Sapiens
cuuauucucaguggaaaacuuuuaugugaggucaaaaccaaacuuuuuuucaagaacccuugga

SEQ ID NO: 228103 - RNA, 64 nt, Homo Sapiens
uuuaauguuaauucuuuuuauuuguuuuuugcacaaaccaaaaguaccuaacaugauauaaauu

SEQ ID NO: 228104 - RNA, 64 nt, Homo Sapiens
ucgguuuucuuacacugugaucuuaaaaguuaccaaaccaaagucauuuucaguuugaggcaac

SEQ ID NO: 228105 - RNA, 64 nt, Homo Sapiens
cucagaggcccuucucacugagacagcaacauuuaaaccaaaccagaggaaguauuuguggaac

SEQ ID NO: 228106 - RNA, 64 nt, Homo Sapiens
agucaaagggcaccauucuuuuuuuuuuuuuuugaaaccaaagcugucucagaaauggccaauu

SEQ ID NO: 228107 - RNA, 64 nt, Homo Sapiens
aagaagaaagcagcacugucaucagaugcaugauaaaccaaaauaugaaaaugggaaauguuua

SEQ ID NO: 228108 - RNA, 64 nt, Homo Sapiens
auugacuuucacaaaauuuaaaucauaaacaggcaaaccaaacagcacacuguagcuauaguug

SEQ ID NO: 228109 - RNA, 64 nt, Homo Sapiens
cuuuccgccucucuugcaaaccaugcuucgaggaaaaccaaacaauaccaugaucgaugauguc

SEQ ID NO: 228110 - RNA, 64 nt, Homo Sapiens
gucuuccuguagucacaauacucagugugauuuuaaaccaaauugauguguauauugagaugua

SEQ ID NO: 228111 - RNA, 64 nt, Homo Sapiens
cuggagagaaaaccaacguucgagcaacaaucggaaaccaaauaccaacucacccaagcagcaa

SEQ ID NO: 228112 - RNA, 64 nt, Homo Sapiens
cucugauuuuacuuugcguuucagggaaaguacuaaaccaaaauugauuuuuaaaacaagagac

SEQ ID NO: 228113 - RNA, 64 nt, Homo Sapiens
uuuagauucaaacaaucccuuacauuugaaauaaaaaccaaauuaagcucagcaaguaaccugg

SEQ ID NO: 228114 - RNA, 64 nt, Homo Sapiens
aaauauuucugcauuucaggaaaaacaaugaaggaaaccaaaauuaaaccaaaacaaaauuucc

SEQ ID NO: 228115 - RNA, 64 nt, Homo Sapiens
aaaauuuccaaaaacaaugauuucuauguuuuauaaaccaaaacuuugcuuuaaguguuggcua

SEQ ID NO: 228116 - RNA, 64 nt, Homo Sapiens
ucgccuaguaaccacggcaacccaaccuacucuaaaaccaaaccaaaaaaauaaaauaacacau

SEQ ID NO: 228117 - RNA, 64 nt, Homo Sapiens
uaguaaccacggcaacccaaccuacucuaaaaccaaaccaaaaaaauaaaauaacacauccucu

SEQ ID NO: 228118 - RNA, 64 nt, Homo Sapiens
uuugucucauuguguuauugucugacuaaaucuaaaaccaaacccauguugaaacuaguacuuu

SEQ ID NO: 228119 - RNA, 64 nt, Homo Sapiens
ccauguugaaacuaguacuuuucccuuuaaaaacaaaccaaaaaaaaaaacaaaaaaaaacuuu

SEQ ID NO: 228120 - RNA, 64 nt, Homo Sapiens
cuccuuuucccuaggaagucaaaaaaaaacccuaaaaccaaaaauuuugccuuaccagaaaaga

SEQ ID NO: 228121 - RNA, 64 nt, Homo Sapiens
ucaacuuaaguuuguuuguaaggugggcauuaacaaaccaaauuaacuguguuuugaccacaca

SEQ ID NO: 228122 - RNA, 64 nt, Homo Sapiens
uccuuaaccacugaccauuuaauagcacaaaggaaaaccaaaagaaagccauuauuuuuauauc

SEQ ID NO: 228123 - RNA, 64 nt, Homo Sapiens
gaaaucgcuuuggaaaucaguauugacauaucuaaaaccaaacuuuuucccacugccuuuuuau

SEQ ID NO: 228124 - RNA, 64 nt, Homo Sapiens
ggaugaccaaagaccuuucuuaugccggaagcaaaaaccaaaacuuuuuguuggcuuuuuccuu

SEQ ID NO: 228125 - RNA, 64 nt, Homo Sapiens
cuggaagcccucccuccacuuaaguuauuguuuuaaaccaaaguuuacagugucuguugguggc

SEQ ID NO: 228126 - RNA, 64 nt, Homo Sapiens
guaugucauaaaauauaacauuacagcuuauuuaaaaccaaauauaguugaacauauuuaaaau

SEQ ID NO: 228127 - RNA, 64 nt, Homo Sapiens
uuuuaccuuucuguccuugauaaaauaguaaagaaaaccaaacaaacccaggccugaugggaaa

SEQ ID NO: 228128 - RNA, 64 nt, Homo Sapiens
gauguggcuauaaugagaauugcaugauugcuuuaaaccaaaucaggugguggauuuuuuuuuu

SEQ ID NO: 228129 - RNA, 64 nt, Homo Sapiens
gagggaacgagcuguagguuugcagaaaugugugaaaccaaaaugaucacugccuacuugugau

SEQ ID NO: 228130 - RNA, 64 nt, Homo Sapiens
aacauaagucaagggaggaugaauaaaaacagcaaaaccaaauaaaguggagaugagugauuga

SEQ ID NO: 228131 - RNA, 64 nt, Homo Sapiens
ugagguagauugcugucccguuaacauagugcugaaaccaaaggcaguggggguccaaacucgu

SEQ ID NO: 228132 - RNA, 64 nt, Homo Sapiens
uuuagucaauuuaccguguccuuuauuuauauaaaaaccaaauagucaacggugugguuaugac

SEQ ID NO: 228133 - RNA, 64 nt, Homo Sapiens
uccugccuucuuugugggggcaauuaccuaaaagaaaccaaaaaucaucacaaauccuuuaaaa

SEQ ID NO: 228134 - RNA, 64 nt, Homo Sapiens
uuggauuuagauucaaaaggugacaucacaguagaaaccaaaccuggaauacuggucaucuuuc

SEQ ID NO: 228135 - RNA, 64 nt, Homo Sapiens
gcaguucauauaccugccugaagcauucaaaaccaaaccaaacauugcuuuuucagccauucac

SEQ ID NO: 228136 - RNA, 64 nt, Homo Sapiens
aaacagcaguucauauaccuuucacaagcauucaaaaccaaacccgccauugcuuuuucagcca

SEQ ID NO: 228137 - RNA, 64 nt, Homo Sapiens
ggagggaaacgucaacuccauaauuccccuccuaaaaccaaaaacaauuacaccacgauucaaa

SEQ ID NO: 228138 - RNA, 64 nt, Homo Sapiens
uuaaaaucaccuuuucuuccuaacugcaauuuucaaaccaaaguguccucucauuuggguuuug

SEQ ID NO: 228139 - RNA, 64 nt, Homo Sapiens
aaaaaucugaaauuuccaucaaaaaccaaaaagcaaaccaaaagcccccaugucuacaaaaaug

SEQ ID NO: 228140 - RNA, 64 nt, Homo Sapiens
gcaaaccaaaagaaaaaucuucuacaaaaaugaaaaaccaaaaaacauagcaacaccccccaug

SEQ ID NO: 228141 - RNA, 64 nt, Homo Sapiens
cccaaacacccuauguaacuucaaagugaaaaccaaaccaaaaaaaucuguauggcaccaaaaa

SEQ ID NO: 228142 - RNA, 64 nt, Homo Sapiens
aaaaacccaaacacccuaugaaaaaucaaagugaaaaccaaaccauauaaaucuguauggcacc

SEQ ID NO: 228143 - RNA, 64 nt, Homo Sapiens
uuggggaauuuuggccaggagacccugaaacaugaaaccaaacaggcuuugauauuuuuuuuuu

SEQ ID NO: 228144 - RNA, 64 nt, Homo Sapiens
uguggcuuugagaaguuaacuuuuguggaauaugaaaccaaaggaagaauuuccauguagauaa

SEQ ID NO: 228145 - RNA, 64 nt, Homo Sapiens
uuucauguagaaugcaaaauuuaagauuuuguuuaaaccaaaugggaaacaaaauagagaauuc

SEQ ID NO: 228146 - RNA, 64 nt, Homo Sapiens
ggauuuauccugcagcucaaaaaacaaaaugugaaaaccaaagucacuugaauugacgcaauau

SEQ ID NO: 228147 - RNA, 64 nt, Homo Sapiens
ugggagggggaagaggacccccucaucuggagggaaaccaaaaugaaccaacauucaaauucug

SEQ ID NO: 228148 - RNA, 64 nt, Homo Sapiens
aggagcagcagaagccauaggccagggguccugaaaaccaaaggacugacuagcccccgggggu

SEQ ID NO: 228149 - RNA, 64 nt, Homo Sapiens
ccagguccucauuuccaaagucccaaugcucugaaaaccaaaaguauuuucauaacccauuuga

SEQ ID NO: 228150 - RNA, 64 nt, Homo Sapiens
ucugaaaaccaaaaguauuuucauaacccauuugaaaccaaaccugaccugaacuuacacugau

SEQ ID NO: 228151 - RNA, 64 nt, Homo Sapiens
cuuagucauaccauccaucccuggugaaagaguaaaaccaaagguuauuauuuccuuuccaugg

SEQ ID NO: 228152 - RNA, 64 nt, Homo Sapiens
uagguauuguguaaaucuauaaauauuugaauccaaaccaaauauaauuuuuuaacuuacauua

SEQ ID NO: 228153 - RNA, 64 nt, Homo Sapiens
aaaugucuaaggaaaauguuucaacagaaaaccaaaaccaaacgagccaucugcuauaacucuu

SEQ ID NO: 228154 - RNA, 64 nt, Homo Sapiens
caaacgaaaugucuaaggaaacucuuucaacagaaaaccaaaacugaaauagccaucugcuaua

SEQ ID NO: 228155 - RNA, 64 nt, Homo Sapiens
uacaguggccucaaagcaaccauggccuacuuaaaaaccaaaccaaaaauaaagaguuuaguug

SEQ ID NO: 228156 - RNA, 64 nt, Homo Sapiens
uggccucaaagcaaccauggccuacuuaaaaaccaaaccaaaaauaaagaguuuaguugaggag

SEQ ID NO: 228157 - RNA, 64 nt, Homo Sapiens
cucacuaucggaaauucauuuugauucagaauaaaaaccaaauguauagagcuuuggguguagg

SEQ ID NO: 228158 - RNA, 64 nt, Homo Sapiens
ggaacuuucuguaucucuuaggaggaacaaguaaaaaccaaaugguuacauugugcugcuagaa

SEQ ID NO: 228159 - RNA, 64 nt, Homo Sapiens
cauggcaauucuggaagcugauuaaaacacacauaaaccaaaaccaaacaacaggcccuugggu

SEQ ID NO: 228160 - RNA, 64 nt, Homo Sapiens
aauucuggaagcugauuaaaacacacauaaaccaaaaccaaacaacaggcccuugggugaaagg

SEQ ID NO: 228161 - RNA, 64 nt, Homo Sapiens
cacagccaucccacucucugcuuccuugagauucaaaccaaaggcuguuuuucuauguuuaaag

SEQ ID NO: 228162 - RNA, 64 nt, Homo Sapiens
cuguuuuucuauguuuaaagaaaaaaaaaaguaaaaaccaaacacaacaccucacaaguuguaa

SEQ ID NO: 228163 - RNA, 64 nt, Homo Sapiens
cuccuuguuuuguuugcauauuuaauuuuaaauuaaaccaaagaauauguuaauucugaaagag

SEQ ID NO: 228164 - RNA, 64 nt, Homo Sapiens
aucaaggucuuguugauauuauauaguaaaaauaaaaccaaaaauaaauauuauucaaguggcu

SEQ ID NO: 228165 - RNA, 64 nt, Homo Sapiens
cagguucaugaauaugguguauuauguguugccaaaaccaaaccuguucacuucuaaaccaaaa

SEQ ID NO: 228166 - RNA, 64 nt, Homo Sapiens
uuauguguugccaaaaccaacauuguucacuucuaaaccaaaaagaaugugaaacauccguuuu

SEQ ID NO: 228167 - RNA, 64 nt, Homo Sapiens
gugcuaggaggugugggugcagaacuccaucagaaaaccaaaggaugcacugaugugugaagug

SEQ ID NO: 228168 - RNA, 64 nt, Homo Sapiens
uagguguucuuacauauuuauaaacuuuauuuuaaaaccaaauuucugaugagaaugguuguua

SEQ ID NO: 228169 - RNA, 52 nt, Homo Sapiens
guacacucauauuugugcacccaaaccaaaggcaccuccuuugaggucauag

SEQ ID NO: 228170 - RNA, 64 nt, Homo Sapiens
ucccuccccaucauccauuccugugaggugucucaaaccaaaguuaacagggagaggauggggg

SEQ ID NO: 228171 - RNA, 64 nt, Homo Sapiens
caugugggcuugccuucucugccaaacgacugggaaaccaaaaugagcccaccuuguguucuuc

SEQ ID NO: 228172 - RNA, 64 nt, Homo Sapiens
gccagcugauuggaugucuaggaaugacugaaagaaaccaaaacagccuguccacugcugcugu

SEQ ID NO: 228173 - RNA, 64 nt, Homo Sapiens
acaucuugauugcuuuuccucggcagcuuucaaaaaaccaaauaauaauaguuauccgucuucu

SEQ ID NO: 228174 - RNA, 64 nt, Homo Sapiens
ucaguaccccugguaaaccaagccucccacacugaaaccaaaacauaaaaaccaaacccagaca

SEQ ID NO: 228175 - RNA, 64 nt, Homo Sapiens
aaaccaagccucccacacugaaaccaaaacauaaaaaccaaacccagacaaccaaaacauauuc

SEQ ID NO: 228176 - RNA, 64 nt, Homo Sapiens
agaggaagacugccucaaacaaacaaaaaacaacaaaccaaaccaaaccaaaccaaaaaaaucu

SEQ ID NO: 228177 - RNA, 64 nt, Homo Sapiens
aagacugccucaaacaaacaaaaaacaacaaaccaaaccaaaccaaaccaaaaaaaucucaaag

SEQ ID NO: 228178 - RNA, 64 nt, Homo Sapiens
ugccucaaacaaacaaaaaacaacaaaccaaaccaaaccaaaccaaaaaaaucucaaagcgauu

SEQ ID NO: 228179 - RNA, 64 nt, Homo Sapiens
caaacaaacaaaaaacaacaaaccaaaccaaaccaaaccaaaaaaaucucaaagcgauuggacc

SEQ ID NO: 228180 - RNA, 64 nt, Homo Sapiens
gugacagucacugcauuugccugcuucuuuccagaaaccaaacuaggagaugaaacugguuccu

SEQ ID NO: 228181 - RNA, 64 nt, Homo Sapiens
uuuucuaaguuauuuuguacauuuuucagcagcaaaaccaaacugggucuucagcuuuaucccc

SEQ ID NO: 228182 - RNA, 64 nt, Homo Sapiens
aaacaaacaaaaaaaacccaggcaagaaaaccaaaaaccaaaacuuucuacaguuuugcaccac

SEQ ID NO: 228183 - RNA, 64 nt, Homo Sapiens
ccaaaacaaacaaacaaaaagcaccacggcaagaaaaccaaaaaaagcaacuuucuacaguuuu

SEQ ID NO: 228184 - RNA, 64 nt, Homo Sapiens
agaaucagaaaaaaaaagcauuaaaauuuauuugaaaccaaaaaagagcccaaaaagccaaagc

SEQ ID NO: 228185 - RNA, 64 nt, Homo Sapiens
gccauuauccuaaaugaacucacucagaaacagaaaaccaaauaccacauguucucacuuauaa

SEQ ID NO: 228186 - RNA, 64 nt, Homo Sapiens
guggguagaaaccccaaaugccaccucauuuagaaaaccaaagugaagauaccucccucccagu

SEQ ID NO: 228187 - RNA, 64 nt, Homo Sapiens
gaaagcaguggaggugggggcccaaacucaaaccaaaccaaacaaaaaagagcuagcccaaaau

SEQ ID NO: 228188 - RNA, 64 nt, Homo Sapiens
aaacagaaagcaguggagguaaaaucccaaacucaaaccaaaccaaagaaaaaagagcuagccc

SEQ ID NO: 228189 - RNA, 64 nt, Homo Sapiens
cuagggacaccaaaaaagaaaaaaaaaaaaacccaaaccaaaaacgcaaaccaaagcaggcagg

SEQ ID NO: 228190 - RNA, 64 nt, Homo Sapiens
aaaagaaaaaaaaaaaaacccaaaccaaaaacgcaaaccaaagcaggcaggcagacagcugcug

SEQ ID NO: 228191 - RNA, 64 nt, Homo Sapiens
ugauuggaaacaauuaauuguugcagagaaaacaaaaccaaagcagaugguguuugcauguaaa

SEQ ID NO: 228192 - RNA, 64 nt, Homo Sapiens
cgcgcgcugcccuuucgaggcaggagugcgcuccaaaccaaauacuaaaaaugugcuuugugau

SEQ ID NO: 228193 - RNA, 64 nt, Homo Sapiens
ugggccagcugggcuuuuuacagggcuuugcugaaaaccaaacaccagcgcaaacuucaagaga

SEQ ID NO: 228194 - RNA, 64 nt, Homo Sapiens
aaaaaaaaacccacaaaaucaaaaaaccaaaaacaaaccaaaaaagaggugaaaaacaaacaaa

SEQ ID NO: 228195 - RNA, 64 nt, Homo Sapiens
caaaccaaaaaaaaaaaaaaaaacaaacaaaaaaaaaccaaaaaccaaaggaaccagaggugaa

SEQ ID NO: 228196 - RNA, 64 nt, Homo Sapiens
uaaucacaacagaaaccagcaccaacaaaagagaaaaccaaaaaaaaaaaaaggaaagaaacua

SEQ ID NO: 228197 - RNA, 64 nt, Homo Sapiens
caacaaaauggcuuguugccaguccagacuuuagaaaccaaacauuuacuggcaguucuauagu

SEQ ID NO: 228198 - RNA, 64 nt, Homo Sapiens
uuaucuuuuacauggccccuaugagagaucaugaaaaccaaauucaauacagaaggagagauag

SEQ ID NO: 228199 - RNA, 64 nt, Homo Sapiens
ucguuuaggauuuuccuaaaagaagaaaauuuuaaaaccaaacccaggagaggagagccagcca

SEQ ID NO: 228200 - RNA, 64 nt, Homo Sapiens
cauguucuucuaaagugucaaggucuugcuuuugaaaccaaaauccccuucugccuuccaggag

SEQ ID NO: 228201 - RNA, 64 nt, Homo Sapiens
acagucucagccugucauuccaaagccaguaguuaaaccaaacuguauucgaggauuauugcaa

SEQ ID NO: 228202 - RNA, 64 nt, Homo Sapiens
cuuuguucuuucuuauuguguggaggaugaggacaaaccaaagcggcaggugugugggacagac

SEQ ID NO: 228203 - RNA, 64 nt, Homo Sapiens
uauaggauuuuuuuuucuucaaaaaccuguauaaaaaccaaaauggauuuuuuucuuuuuuagu

SEQ ID NO: 228204 - RNA, 64 nt, Homo Sapiens
uauaggauuuuuuucuuuuuaaaaaccuauaugaaaaccaaaauaggauuuuuucuuuuuuagu

SEQ ID NO: 228205 - RNA, 64 nt, Homo Sapiens
uauaggauuuuuucuuuuuuaaaaaccuauauaaaaaccaaaauggauuuuuuucuuuuuuagu

SEQ ID NO: 228206 - RNA, 64 nt, Homo Sapiens
uauaggauuuuuuucuuuuuaaaaaccgguaucaaaaccaaaauaggauuuuuucuuuuuuagu

SEQ ID NO: 228207 - RNA, 64 nt, Homo Sapiens
uauaggauuuuuucuuuuuuaaaaaccuauauaaaaaccaaaauuaauagagccacuggugagu

SEQ ID NO: 228208 - RNA, 64 nt, Homo Sapiens
guuccucuguuuuucuuuuugauuuuuguuuuuuaaaccaaaacagacaauagcuuauuuucuu

SEQ ID NO: 228209 - RNA, 64 nt, Homo Sapiens
aagcucauacccaaauucacaaagccuauuuuuuaaaccaaagcacauuuugaaugaguaugga

SEQ ID NO: 228210 - RNA, 64 nt, Homo Sapiens
aacagaccaugagcuggcuuacaagcucauuuuuaaaccaaauguuguugggcuucugcaaaau

SEQ ID NO: 228211 - RNA, 64 nt, Homo Sapiens
ggggccgggugcgguggcucuaagguucaguugaaaaccaaacuauaguugggcucugcuuuuu

SEQ ID NO: 228212 - RNA, 64 nt, Homo Sapiens
auauugcaagcacuucucauugcuaaaaauaaauaaaccaaaguuuaaccgaaucaguuaggga

SEQ ID NO: 228213 - RNA, 64 nt, Homo Sapiens
accaaaaaaaguauauagugacauuuuuaguaugaaaccaaauuacacuaaggucuuuuguugg

SEQ ID NO: 228214 - RNA, 64 nt, Homo Sapiens
acccuuucaagggaaauuuuaaucuaaaaggaaaaaaccaaaauauugaugagaaggaguccuc

SEQ ID NO: 228215 - RNA, 64 nt, Homo Sapiens
gaaggcuugucucaccuccaccggcauccacacaaaaccaaacaggagcaggcgucauccccac

SEQ ID NO: 228216 - RNA, 64 nt, Homo Sapiens
cucauuuaaaaguagguuaauaauaccaaacuuaaaaccaaacacuuaauuuaaguuugcacuu

SEQ ID NO: 228217 - RNA, 64 nt, Homo Sapiens
uauacuuuugaucuauaauaaauaaaauaaaacaaaaccaaaacgucauuugaacaugcuucua

SEQ ID NO: 228218 - RNA, 64 nt, Homo Sapiens
ccgucucauuuguaucuucugauauucuuuauacaaaccaaaaguccccuucaacauuuuuuau

SEQ ID NO: 228219 - RNA, 64 nt, Homo Sapiens
gguagaaaaaaaacaaacaaacaaacagaaaaaaaaaccaaaaaaaaccacccugaguuucucu

SEQ ID NO: 228220 - RNA, 64 nt, Homo Sapiens
gacucucaucuuaaaacaagagaaaaugccugccaaguauaaaugacuuuauuuuuucauugga

SEQ ID NO: 228221 - RNA, 64 nt, Homo Sapiens
caaucauauauucauucaaauggggauauaaaagaaguauaagguuucauaaucuauuagaaga

SEQ ID NO: 228222 - RNA, 64 nt, Homo Sapiens
augugaagaauauuugaaaaacuucuuuguuucuaaguauaagaugaauuaguuguuugggguu

SEQ ID NO: 228223 - RNA, 64 nt, Homo Sapiens
auuuguauccauguggaauacagggccuaaauuaaaguauaaucguuauauaauuuuaagccac

SEQ ID NO: 228224 - RNA, 64 nt, Homo Sapiens
aaaaaguaucagaagaaugacuuucuuuuuccuuaaguauaaaagcaaggcacauacauaauga

SEQ ID NO: 228225 - RNA, 64 nt, Homo Sapiens
aacuauguaaugcuuauguguucuugucaucaguaaguauaacaguuucuugcuucuggcuuug

SEQ ID NO: 228226 - RNA, 64 nt, Homo Sapiens
ucgcugugagugagugguguauuagauuaucaaaaaguauaaauuaauuggucauuccuaaugc

SEQ ID NO: 228227 - RNA, 64 nt, Homo Sapiens
uccagcacuaaagcugaaaugccacaaacacuaaaaguauaaauaugucugauuuuugaaacac

SEQ ID NO: 228228 - RNA, 64 nt, Homo Sapiens
gcaacuucgcauauuuucauugacaccaguguauaaguauaaauuuaaaugaacuaauuacuuu

SEQ ID NO: 228229 - RNA, 64 nt, Homo Sapiens
acucucaugacaugaaaaauaaauacaacuaguuaaguauaaaaugccaaauaaaagugacacg

SEQ ID NO: 228230 - RNA, 64 nt, Homo Sapiens
caauaaauucuagaagaguugccuugauucaaacaaguauaauucucaaguuaucacaaaauuu

SEQ ID NO: 228231 - RNA, 64 nt, Homo Sapiens
aaaauaaauaaauaauuucauaucccagaacuuaaaguauaauaaccugcacauucagcacaug

SEQ ID NO: 228232 - RNA, 64 nt, Homo Sapiens
uaagacacccuauugacuucuauuuuuuugauuaaaguauaaauauauuaaauauuuucuuauu

SEQ ID NO: 228233 - RNA, 64 nt, Homo Sapiens
auaaaacuaauuuuucuuacuuugaagaguuauaaaguauaacuacuuagcuauauucugagac

SEQ ID NO: 228234 - RNA, 64 nt, Homo Sapiens
caguacauuaauauucaugugaaguggaauuugaaaguauaaugugauuaaauguuagaccaca

SEQ ID NO: 228235 - RNA, 64 nt, Homo Sapiens
uaauuuuuuuuuuucucacauacuuauauaauaaaaguauaacacauacuuuuauuaaaauaua

SEQ ID NO: 228236 - RNA, 64 nt, Homo Sapiens
aaaucccuacauuucugagguaaaaguuauguagaaguauaauauguuauuuuuauggucauaa

SEQ ID NO: 228237 - RNA, 64 nt, Homo Sapiens; identical to SEQ ID NO: 58734

SEQ ID NO: 228238 - RNA, 64 nt, Homo Sapiens; identical to SEQ ID NO: 58735

SEQ ID NO: 228239 - RNA, 64 nt, Homo Sapiens; identical to SEQ ID NO: 58736

SEQ ID NO: 228240 - RNA, 64 nt, Homo Sapiens; identical to SEQ ID NO: 58737

SEQ ID NO: 228241 - RNA, 64 nt, Homo Sapiens; identical to SEQ ID NO: 58738

SEQ ID NO: 228242 - RNA, 64 nt, Homo Sapiens; identical to SEQ ID NO: 58739

SEQ ID NO: 228243 - RNA, 64 nt, Homo Sapiens
caacaucaauuaugaaauacugauaacgaaagguaguaaugaaauauauaugaugaaaagaauu

SEQ ID NO: 228244 - RNA, 64 nt, Homo Sapiens
agcuguuucuuugauagaagggccaugaaaauagaguaaugauauaguaggagauaagggauug

SEQ ID NO: 228245 - RNA, 64 nt, Homo Sapiens
gcugcgccacccaccaucaaaggaauauaagaaaaguaaugaagaaucacgauuucauccuuga

SEQ ID NO: 228246 - RNA, 64 nt, Homo Sapiens
uuuaguuuuacacuaggaaacguguuguaucuacaguaaugaaauguuuacuaaguggacuggu

SEQ ID NO: 228247 - RNA, 64 nt, Homo Sapiens
uucacuguguuuauaaauugcagaguacauguacaguaaugaaguuacagcuaagcuguaguug

SEQ ID NO: 228248 - RNA, 64 nt, Homo Sapiens
cauaguacccagucauguuacaguauuugugaaaaguaaugagcaccuuuuuuuuuuccaguca

SEQ ID NO: 228249 - RNA, 64 nt, Homo Sapiens
agcccaggaaauuucuccacggaagaugcaaggaaguaaugagauagaugugggcucuguuugg

SEQ ID NO: 228250 - RNA, 64 nt, Homo Sapiens
uccuggguuccaaaggggcacacgcaccuuccuuaguaaugaaaucuccuccaaugaggaaacc

SEQ ID NO: 228251 - RNA, 64 nt, Homo Sapiens
cuuuuaaacaaagauauucacuauacuuaaaaaaaauaacuaacaauggccuguauuucucacg

SEQ ID NO: 228252 - RNA, 64 nt, Homo Sapiens
ucugaacuccugagaucuagcucugaguuuauaaaauaacuacuuccugagaaaucuucuuaaa

SEQ ID NO: 228253 - RNA, 64 nt, Homo Sapiens
ugcuuuggugguuaauugcuuuugcugggaugcaaauaacuaaaguaaagugugggauuguugu

SEQ ID NO: 228254 - RNA, 64 nt, Homo Sapiens
uaggaagauuuuuccuaaaagggggcgcugcaggaauaacuauaguuuucaccaagaccuguuu

SEQ ID NO: 228255 - RNA, 64 nt, Homo Sapiens
aauaccaacugaagucaauuugggggacaugcuaaauaacuauauaagacauuaagagaacaaa

SEQ ID NO: 228256 - RNA, 64 nt, Homo Sapiens
gaaggucugauuugcaggauuuuuagagcauuaaaauaacuaucaggcagaagaaucuuucuuc

SEQ ID NO: 228257 - RNA, 64 nt, Homo Sapiens
ucgaggaguuuuaaaguacuguaacuuuaaaauaaauaacuacaaagcuucuuuguccaaacgu

SEQ ID NO: 228258 - RNA, 64 nt, Homo Sapiens
uggguuuuaaauaguuuuucugacccuucugaaaaauaacuacauaagugcuucuuguugcugg

SEQ ID NO: 228259 - RNA, 64 nt, Homo Sapiens
ugacucugauuuuguuuuauaauaaugauuaaagaauaacuaaaguauuaguguauuuuaaagu

SEQ ID NO: 228260 - RNA, 64 nt, Homo Sapiens
aaugaucagcgggagcguugaaauaaaaguccuaaauaacuaaguccuguuucccagaagagag

SEQ ID NO: 228261 - RNA, 64 nt, Homo Sapiens
aagauucuucucagcaguugcugaaaagcauguaaauaacuacauaauagccugagaauaaugg

SEQ ID NO: 228262 - RNA, 64 nt, Homo Sapiens
aagcaagccaaauuuuuagaugacgaaguccauaaauaacuagagaauuuuuguuaucuguugu

SEQ ID NO: 228263 - RNA, 64 nt, Homo Sapiens
uggguauucauugguuauuggccugaaaugaucaaauaacuacaaaugaucuguugaauaaaaa

SEQ ID NO: 228264 - RNA, 64 nt, Homo Sapiens
auuuuuaugaaaauuauuuuauuuaacuuuaagcaauaacuagagauuacaauuaaauuuuaau

SEQ ID NO: 228265 - RNA, 64 nt, Homo Sapiens
aguauaauuggauuguuuguagcuuaauuguacaaauaacuaaggggugaguauagucaauaau

SEQ ID NO: 228266 - RNA, 64 nt, Homo Sapiens
uccacuaaauuauacaguauauaauaucuuuugaaauaacuaagucauuuagcagggaagugga

SEQ ID NO: 228267 - RNA, 64 nt, Homo Sapiens; identical to SEQ ID NO: 158460

SEQ ID NO: 228268 - RNA, 64 nt, Homo Sapiens; identical to SEQ ID NO: 158461

SEQ ID NO: 228269 - RNA, 64 nt, Homo Sapiens; identical to SEQ ID NO: 158462

SEQ ID NO: 228270 - RNA, 64 nt, Homo Sapiens; identical to SEQ ID NO: 158463

SEQ ID NO: 228271 - RNA, 64 nt, Homo Sapiens; identical to SEQ ID NO: 158464

SEQ ID NO: 228272 - RNA, 64 nt, Homo Sapiens; identical to SEQ ID NO: 158465

SEQ ID NO: 228273 - RNA, 64 nt, Homo Sapiens; identical to SEQ ID NO: 158466

SEQ ID NO: 228274 - RNA, 64 nt, Homo Sapiens; identical to SEQ ID NO: 158467

SEQ ID NO: 228275 - RNA, 64 nt, Homo Sapiens; identical to SEQ ID NO: 158468

SEQ ID NO: 228276 - RNA, 64 nt, Homo Sapiens; identical to SEQ ID NO: 158469

SEQ ID NO: 228277 - RNA, 64 nt, Homo Sapiens; identical to SEQ ID NO: 158470

SEQ ID NO: 228278 - RNA, 64 nt, Homo Sapiens
ugugaagaaaaacagacucuguccagguagaaauggugaggagggggaagagaauuacauuucc

SEQ ID NO: 228279 - RNA, 64 nt, Homo Sapiens
ucaguguguguuggggggaugcuuggcagcugggggugaggagacaacaaaccucgggaacugg

SEQ ID NO: 228280 - RNA, 64 nt, Homo Sapiens
uuagaguugaccuccagcccaugguuucaaggauggugaggaauagggaagcccauccaucugg

SEQ ID NO: 228281 - RNA, 64 nt, Homo Sapiens
ugagccugcucaaggagugggggaagggggcaggggugaggagccuguucuuguggcccuuaau

SEQ ID NO: 228282 - RNA, 64 nt, Homo Sapiens
agggcaaggagaccaccaacagcccucaggucagggugaggauggccucugcuaagcucaaggc

SEQ ID NO: 228283 - RNA, 64 nt, Homo Sapiens
cuaggaacauacuucagcucacacaugagaucuaggugaggauugauuaccuaguagucauuuc

SEQ ID NO: 228284 - RNA, 64 nt, Homo Sapiens
cauuacugugcugaaagucagcccacgucggagcggugaggaggagccacagcacauggggugc

SEQ ID NO: 228285 - RNA, 64 nt, Homo Sapiens
cggauugugaaaacauuggccaccuaguagcaguggugaggagugggagggcccagcaagcauu

SEQ ID NO: 228286 - RNA, 64 nt, Homo Sapiens
uugccaaccacaggccucucuucacacacuuggcggugaggaucggagggcgcuaugucguggc

SEQ ID NO: 228287 - RNA, 64 nt, Homo Sapiens
ccuguauugugcccgggcccauggggaggacgauggugaggagauccuguuggacacccagugc

SEQ ID NO: 228288 - RNA, 64 nt, Homo Sapiens
uaaagcaggcccagugaaauagaggacagaggcuggugaggaggagcaagaaaacgguaacuca

SEQ ID NO: 228289 - RNA, 64 nt, Homo Sapiens
gaagugggguauggaauaugacuccuuucugaggggugaggagggugguggaggggggagaaug

SEQ ID NO: 228290 - RNA, 64 nt, Homo Sapiens
agccaguuccuauccccuaaccuaaacacuuauaggugaggacuccauccuccuguuccauuca

SEQ ID NO: 228291 - RNA, 64 nt, Homo Sapiens
aaucaauucugacugagcucccccauuccccucgggugaggaugacuguuauuuuuguagcuga

SEQ ID NO: 228292 - RNA, 64 nt, Homo Sapiens
cucuuggaaguuuucugaaccuuccaagcucuguggugaggacaaaccaguguuugaaucauau

SEQ ID NO: 228293 - RNA, 64 nt, Homo Sapiens
uagaaacagcccaccugugcccacuuugaccauuggugaggauagauauaaaaucacuucuucc

SEQ ID NO: 228294 - RNA, 64 nt, Homo Sapiens
ggagaggagggagaccugcuagacgcguagggauggugaggaggcacgcguagggauggugagg

SEQ ID NO: 228295 - RNA, 64 nt, Homo Sapiens
cgcguagggauggugaggagucacgcguagggauggugaggagaauuuuuaucaggaaagucag

SEQ ID NO: 228296 - RNA, 64 nt, Homo Sapiens
gugggccuagggcuuggcgagcccuuuggagcuuggugaggaggaggcugggaggacugguguu

SEQ ID NO: 228297 - RNA, 64 nt, Homo Sapiens
gucugcugucacccucuacugacacguaggcuggggugaggaguggguccuugcuggggccgca

SEQ ID NO: 228298 - RNA, 64 nt, Homo Sapiens
auuucucuccaagcuccugacacucacuucauuaggugaggauuaaucaaaggauggaagggcu

SEQ ID NO: 228299 - RNA, 64 nt, Homo Sapiens
cauaggaagaguagaacucaggaccacaacuguaggugaggauuaugcugagacuauuacuccu

SEQ ID NO: 228300 - RNA, 64 nt, Homo Sapiens
guaacaaaugaaggacaagcauacuacauaauauaauccauacaauucucuucaguuaguguaa

SEQ ID NO: 228301 - RNA, 64 nt, Homo Sapiens
aagaaaccaaggggaaguaauaaguugaaaaagaaauccauaacuauuaaaagauuuuaacuuu

SEQ ID NO: 228302 - RNA, 64 nt, Homo Sapiens
ccuuuuuucuaaauagcucuggaaccaggcuuguaauccauagcaucaccgacucugcaaagga

SEQ ID NO: 228303 - RNA, 64 nt, Homo Sapiens
aauuuucguaaacuuuguuuuauauuaaaagaaaaauccauaagucuguguguguuaaacauga

SEQ ID NO: 228304 - RNA, 64 nt, Homo Sapiens
auguauuaacaaauauauacauuucuauuuuuauaauccauaaggauaugccuguuuuaaauaa

SEQ ID NO: 228305 - RNA, 64 nt, Homo Sapiens
cucaaacuauauuuauaaaaauuugcuagggccaaauccauacuugcagaauaauucaucaaau

SEQ ID NO: 228306 - RNA, 64 nt, Homo Sapiens
gccuuacacaauagcagagaauauaaacugaaaaaauccauacaaauauuaaaaauguggcaaa

SEQ ID NO: 228307 - RNA, 64 nt, Homo Sapiens
uuauuuuaaacugugcucaacccuuacucaagauaauccauacuagagaaacacuauagaugua

SEQ ID NO: 228308 - RNA, 64 nt, Homo Sapiens
cgucaaagcuuugagaguauuccaagucccagagaauccauaguaacaacuuaauuucuaaggg

SEQ ID NO: 228309 - RNA, 64 nt, Homo Sapiens
gaaagagucagcaccagcagcaagagacuccaauaauccauauuuccucugagaacagucagug

SEQ ID NO: 228310 - RNA, 64 nt, Homo Sapiens
gagagaucuuacaaguguaagcaaaucauuggagaauccauaauucaguaaugcuacaaccauu

SEQ ID NO: 228311 - RNA, 64 nt, Homo Sapiens
auagggaaacuugacuaauaauucaccaucaagcaauccauaguuuagugggcagucaccacuu

SEQ ID NO: 228312 - RNA, 64 nt, Homo Sapiens
uacuauugcuuaaacaaaacuggaacuguuguugaauccauagccaauacauuuacagcaaucu

SEQ ID NO: 228313 - RNA, 64 nt, Homo Sapiens
auaaacuacaaaaacuuuuuguuguuuaucaggaaauccauauuuauuuuguaauuaacuguca

SEQ ID NO: 228314 - RNA, 62 nt, Homo Sapiens; identical to SEQ ID NO: 64857

SEQ ID NO: 228315 - RNA, 62 nt, Homo Sapiens; identical to SEQ ID NO: 64858

SEQ ID NO: 228316 - RNA, 62 nt, Homo Sapiens; identical to SEQ ID NO: 64859

SEQ ID NO: 228317 - RNA, 62 nt, Homo Sapiens; identical to SEQ ID NO: 64860

SEQ ID NO: 228318 - RNA, 62 nt, Homo Sapiens; identical to SEQ ID NO: 64861

SEQ ID NO: 228319 - RNA, 62 nt, Homo Sapiens; identical to SEQ ID NO: 64862

SEQ ID NO: 228320 - RNA, 62 nt, Homo Sapiens; identical to SEQ ID NO: 64863

SEQ ID NO: 228321 - RNA, 62 nt, Homo Sapiens; identical to SEQ ID NO: 64864

SEQ ID NO: 228322 - RNA, 62 nt, Homo Sapiens; identical to SEQ ID NO: 64865

SEQ ID NO: 228323 - RNA, 62 nt, Homo Sapiens; identical to SEQ ID NO: 64866

SEQ ID NO: 228324 - RNA, 62 nt, Homo Sapiens; identical to SEQ ID NO: 64867

SEQ ID NO: 228325 - RNA, 62 nt, Homo Sapiens; identical to SEQ ID NO: 64868

SEQ ID NO: 228326 - RNA, 62 nt, Homo Sapiens; identical to SEQ ID NO: 64869

SEQ ID NO: 228327 - RNA, 62 nt, Homo Sapiens; identical to SEQ ID NO: 64870

SEQ ID NO: 228328 - RNA, 62 nt, Homo Sapiens; identical to SEQ ID NO: 64871

SEQ ID NO: 228329 - RNA, 62 nt, Homo Sapiens; identical to SEQ ID NO: 64872

SEQ ID NO: 228330 - RNA, 62 nt, Homo Sapiens; identical to SEQ ID NO: 64873

SEQ ID NO: 228331 - RNA, 62 nt, Homo Sapiens; identical to SEQ ID NO: 64874

SEQ ID NO: 228332 - RNA, 62 nt, Homo Sapiens; identical to SEQ ID NO: 64875

SEQ ID NO: 228333 - RNA, 62 nt, Homo Sapiens; identical to SEQ ID NO: 64876

SEQ ID NO: 228334 - RNA, 62 nt, Homo Sapiens; identical to SEQ ID NO: 64877

SEQ ID NO: 228335 - RNA, 62 nt, Homo Sapiens; identical to SEQ ID NO: 64878

SEQ ID NO: 228336 - RNA, 62 nt, Homo Sapiens; identical to SEQ ID NO: 64879

SEQ ID NO: 228337 - RNA, 62 nt, Homo Sapiens; identical to SEQ ID NO: 64880

SEQ ID NO: 228338 - RNA, 62 nt, Homo Sapiens; identical to SEQ ID NO: 64881

SEQ ID NO: 228339 - RNA, 62 nt, Homo Sapiens; identical to SEQ ID NO: 64882

SEQ ID NO: 228340 - RNA, 62 nt, Homo Sapiens; identical to SEQ ID NO: 64883

SEQ ID NO: 228341 - RNA, 62 nt, Homo Sapiens; identical to SEQ ID NO: 64884

SEQ ID NO: 228342 - RNA, 62 nt, Homo Sapiens; identical to SEQ ID NO: 64885

SEQ ID NO: 228343 - RNA, 62 nt, Homo Sapiens; identical to SEQ ID NO: 64886

SEQ ID NO: 228344 - RNA, 62 nt, Homo Sapiens; identical to SEQ ID NO: 64887

SEQ ID NO: 228345 - RNA, 62 nt, Homo Sapiens; identical to SEQ ID NO: 64888

SEQ ID NO: 228346 - RNA, 62 nt, Homo Sapiens; identical to SEQ ID NO: 64889

SEQ ID NO: 228347 - RNA, 62 nt, Homo Sapiens; identical to SEQ ID NO: 64890

SEQ ID NO: 228348 - RNA, 62 nt, Homo Sapiens; identical to SEQ ID NO: 64891

SEQ ID NO: 228349 - RNA, 62 nt, Homo Sapiens; identical to SEQ ID NO: 64892

SEQ ID NO: 228350 - RNA, 62 nt, Homo Sapiens; identical to SEQ ID NO: 64893

SEQ ID NO: 228351 - RNA, 62 nt, Homo Sapiens; identical to SEQ ID NO: 64894

SEQ ID NO: 228352 - RNA, 62 nt, Homo Sapiens; identical to SEQ ID NO: 64895

SEQ ID NO: 228353 - RNA, 62 nt, Homo Sapiens; identical to SEQ ID NO: 64896

SEQ ID NO: 228354 - RNA, 62 nt, Homo Sapiens; identical to SEQ ID NO: 64897

SEQ ID NO: 228355 - RNA, 62 nt, Homo Sapiens; identical to SEQ ID NO: 64898

SEQ ID NO: 228356 - RNA, 62 nt, Homo Sapiens; identical to SEQ ID NO: 64899

SEQ ID NO: 228357 - RNA, 62 nt, Homo Sapiens; identical to SEQ ID NO: 64900

SEQ ID NO: 228358 - RNA, 62 nt, Homo Sapiens; identical to SEQ ID NO: 64901

SEQ ID NO: 228359 - RNA, 62 nt, Homo Sapiens; identical to SEQ ID NO: 64902

SEQ ID NO: 228360 - RNA, 62 nt, Homo Sapiens; identical to SEQ ID NO: 64903

SEQ ID NO: 228361 - RNA, 62 nt, Homo Sapiens; identical to SEQ ID NO: 64904

SEQ ID NO: 228362 - RNA, 62 nt, Homo Sapiens; identical to SEQ ID NO: 64905

SEQ ID NO: 228363 - RNA, 62 nt, Homo Sapiens; identical to SEQ ID NO: 64906

SEQ ID NO: 228364 - RNA, 62 nt, Homo Sapiens; identical to SEQ ID NO: 64907

SEQ ID NO: 228365 - RNA, 62 nt, Homo Sapiens; identical to SEQ ID NO: 64908

SEQ ID NO: 228366 - RNA, 62 nt, Homo Sapiens; identical to SEQ ID NO: 64909

SEQ ID NO: 228367 - RNA, 62 nt, Homo Sapiens; identical to SEQ ID NO: 64910

SEQ ID NO: 228368 - RNA, 62 nt, Homo Sapiens; identical to SEQ ID NO: 64911

SEQ ID NO: 228369 - RNA, 62 nt, Homo Sapiens; identical to SEQ ID NO: 64912

SEQ ID NO: 228370 - RNA, 62 nt, Homo Sapiens; identical to SEQ ID NO: 64913

SEQ ID NO: 228371 - RNA, 62 nt, Homo Sapiens; identical to SEQ ID NO: 64914

SEQ ID NO: 228372 - RNA, 62 nt, Homo Sapiens; identical to SEQ ID NO: 64915

SEQ ID NO: 228373 - RNA, 62 nt, Homo Sapiens; identical to SEQ ID NO: 64916

SEQ ID NO: 228374 - RNA, 62 nt, Homo Sapiens; identical to SEQ ID NO: 64917

SEQ ID NO: 228375 - RNA, 62 nt, Homo Sapiens; identical to SEQ ID NO: 64918

SEQ ID NO: 228376 - RNA, 62 nt, Homo Sapiens; identical to SEQ ID NO: 64919

SEQ ID NO: 228377 - RNA, 62 nt, Homo Sapiens; identical to SEQ ID NO: 64920

SEQ ID NO: 228378 - RNA, 62 nt, Homo Sapiens; identical to SEQ ID NO: 64921

SEQ ID NO: 228379 - RNA, 62 nt, Homo Sapiens; identical to SEQ ID NO: 64922

SEQ ID NO: 228380 - RNA, 62 nt, Homo Sapiens; identical to SEQ ID NO: 64923

SEQ ID NO: 228381 - RNA, 62 nt, Homo Sapiens; identical to SEQ ID NO: 64924

SEQ ID NO: 228382 - RNA, 62 nt, Homo Sapiens; identical to SEQ ID NO: 64925

SEQ ID NO: 228383 - RNA, 62 nt, Homo Sapiens; identical to SEQ ID NO: 64926

SEQ ID NO: 228384 - RNA, 62 nt, Homo Sapiens; identical to SEQ ID NO: 64927

SEQ ID NO: 228385 - RNA, 62 nt, Homo Sapiens; identical to SEQ ID NO: 64928

SEQ ID NO: 228386 - RNA, 62 nt, Homo Sapiens; identical to SEQ ID NO: 64929

SEQ ID NO: 228387 - RNA, 62 nt, Homo Sapiens; identical to SEQ ID NO: 64930

SEQ ID NO: 228388 - RNA, 62 nt, Homo Sapiens; identical to SEQ ID NO: 64931

SEQ ID NO: 228389 - RNA, 62 nt, Homo Sapiens; identical to SEQ ID NO: 64932

SEQ ID NO: 228390 - RNA, 62 nt, Homo Sapiens; identical to SEQ ID NO: 64933

SEQ ID NO: 228391 - RNA, 62 nt, Homo Sapiens; identical to SEQ ID NO: 64934

SEQ ID NO: 228392 - RNA, 62 nt, Homo Sapiens; identical to SEQ ID NO: 64935

SEQ ID NO: 228393 - RNA, 62 nt, Homo Sapiens; identical to SEQ ID NO: 64936

SEQ ID NO: 228394 - RNA, 62 nt, Homo Sapiens; identical to SEQ ID NO: 64937

SEQ ID NO: 228395 - RNA, 62 nt, Homo Sapiens; identical to SEQ ID NO: 64938

SEQ ID NO: 228396 - RNA, 62 nt, Homo Sapiens; identical to SEQ ID NO: 64939

SEQ ID NO: 228397 - RNA, 62 nt, Homo Sapiens; identical to SEQ ID NO: 64940

SEQ ID NO: 228398 - RNA, 62 nt, Homo Sapiens; identical to SEQ ID NO: 64941

SEQ ID NO: 228399 - RNA, 62 nt, Homo Sapiens; identical to SEQ ID NO: 64942

SEQ ID NO: 228400 - RNA, 62 nt, Homo Sapiens; identical to SEQ ID NO: 64943

SEQ ID NO: 228401 - RNA, 62 nt, Homo Sapiens; identical to SEQ ID NO: 64944

SEQ ID NO: 228402 - RNA, 62 nt, Homo Sapiens; identical to SEQ ID NO: 64945

SEQ ID NO: 228403 - RNA, 62 nt, Homo Sapiens; identical to SEQ ID NO: 64946

SEQ ID NO: 228404 - RNA, 62 nt, Homo Sapiens; identical to SEQ ID NO: 64947

SEQ ID NO: 228405 - RNA, 62 nt, Homo Sapiens; identical to SEQ ID NO: 64948

SEQ ID NO: 228406 - RNA, 62 nt, Homo Sapiens; identical to SEQ ID NO: 64949

SEQ ID NO: 228407 - RNA, 62 nt, Homo Sapiens; identical to SEQ ID NO: 64950

SEQ ID NO: 228408 - RNA, 62 nt, Homo Sapiens; identical to SEQ ID NO: 64951

SEQ ID NO: 228409 - RNA, 62 nt, Homo Sapiens; identical to SEQ ID NO: 64952

SEQ ID NO: 228410 - RNA, 62 nt, Homo Sapiens; identical to SEQ ID NO: 64953

SEQ ID NO: 228411 - RNA, 62 nt, Homo Sapiens; identical to SEQ ID NO: 64954

SEQ ID NO: 228412 - RNA, 62 nt, Homo Sapiens; identical to SEQ ID NO: 64955

SEQ ID NO: 228413 - RNA, 62 nt, Homo Sapiens; identical to SEQ ID NO: 64956

SEQ ID NO: 228414 - RNA, 62 nt, Homo Sapiens; identical to SEQ ID NO: 64957

SEQ ID NO: 228415 - RNA, 62 nt, Homo Sapiens; identical to SEQ ID NO: 64958

SEQ ID NO: 228416 - RNA, 62 nt, Homo Sapiens; identical to SEQ ID NO: 64959

SEQ ID NO: 228417 - RNA, 62 nt, Homo Sapiens; identical to SEQ ID NO: 64960

SEQ ID NO: 228418 - RNA, 62 nt, Homo Sapiens; identical to SEQ ID NO: 64961

SEQ ID NO: 228419 - RNA, 62 nt, Homo Sapiens; identical to SEQ ID NO: 64962

SEQ ID NO: 228420 - RNA, 62 nt, Homo Sapiens; identical to SEQ ID NO: 64963

SEQ ID NO: 228421 - RNA, 62 nt, Homo Sapiens; identical to SEQ ID NO: 64964

SEQ ID NO: 228422 - RNA, 62 nt, Homo Sapiens; identical to SEQ ID NO: 64965

SEQ ID NO: 228423 - RNA, 62 nt, Homo Sapiens; identical to SEQ ID NO: 64966

SEQ ID NO: 228424 - RNA, 62 nt, Homo Sapiens; identical to SEQ ID NO: 64967

SEQ ID NO: 228425 - RNA, 62 nt, Homo Sapiens; identical to SEQ ID NO: 64968

SEQ ID NO: 228426 - RNA, 62 nt, Homo Sapiens; identical to SEQ ID NO: 64969

SEQ ID NO: 228427 - RNA, 62 nt, Homo Sapiens; identical to SEQ ID NO: 64970

SEQ ID NO: 228428 - RNA, 62 nt, Homo Sapiens; identical to SEQ ID NO: 64971

SEQ ID NO: 228429 - RNA, 62 nt, Homo Sapiens; identical to SEQ ID NO: 64972

SEQ ID NO: 228430 - RNA, 62 nt, Homo Sapiens; identical to SEQ ID NO: 64973

SEQ ID NO: 228431 - RNA, 62 nt, Homo Sapiens; identical to SEQ ID NO: 64974

SEQ ID NO: 228432 - RNA, 62 nt, Homo Sapiens; identical to SEQ ID NO: 64975

SEQ ID NO: 228433 - RNA, 62 nt, Homo Sapiens; identical to SEQ ID NO: 64976

SEQ ID NO: 228434 - RNA, 62 nt, Homo Sapiens; identical to SEQ ID NO: 64977

SEQ ID NO: 228435 - RNA, 62 nt, Homo Sapiens; identical to SEQ ID NO: 64978

SEQ ID NO: 228436 - RNA, 62 nt, Homo Sapiens; identical to SEQ ID NO: 64979

SEQ ID NO: 228437 - RNA, 62 nt, Homo Sapiens; identical to SEQ ID NO: 64980

SEQ ID NO: 228438 - RNA, 62 nt, Homo Sapiens; identical to SEQ ID NO: 64981

SEQ ID NO: 228439 - RNA, 62 nt, Homo Sapiens; identical to SEQ ID NO: 64982

SEQ ID NO: 228440 - RNA, 62 nt, Homo Sapiens; identical to SEQ ID NO: 64983

SEQ ID NO: 228441 - RNA, 62 nt, Homo Sapiens; identical to SEQ ID NO: 64984

SEQ ID NO: 228442 - RNA, 62 nt, Homo Sapiens; identical to SEQ ID NO: 64985

SEQ ID NO: 228443 - RNA, 62 nt, Homo Sapiens; identical to SEQ ID NO: 64986

SEQ ID NO: 228444 - RNA, 62 nt, Homo Sapiens; identical to SEQ ID NO: 64987

SEQ ID NO: 228445 - RNA, 62 nt, Homo Sapiens; identical to SEQ ID NO: 64988

SEQ ID NO: 228446 - RNA, 62 nt, Homo Sapiens; identical to SEQ ID NO: 64989

SEQ ID NO: 228447 - RNA, 62 nt, Homo Sapiens; identical to SEQ ID NO: 64990

SEQ ID NO: 228448 - RNA, 62 nt, Homo Sapiens; identical to SEQ ID NO: 64991

SEQ ID NO: 228449 - RNA, 62 nt, Homo Sapiens; identical to SEQ ID NO: 64992

SEQ ID NO: 228450 - RNA, 62 nt, Homo Sapiens; identical to SEQ ID NO: 64993

SEQ ID NO: 228451 - RNA, 62 nt, Homo Sapiens; identical to SEQ ID NO: 64994

SEQ ID NO: 228452 - RNA, 56 nt, Homo Sapiens; identical to SEQ ID NO: 61369

SEQ ID NO: 228453 - RNA, 62 nt, Homo Sapiens; identical to SEQ ID NO: 64996

SEQ ID NO: 228454 - RNA, 62 nt, Homo Sapiens; identical to SEQ ID NO: 64997

SEQ ID NO: 228455 - RNA, 62 nt, Homo Sapiens; identical to SEQ ID NO: 64998

SEQ ID NO: 228456 - RNA, 62 nt, Homo Sapiens; identical to SEQ ID NO: 64999

SEQ ID NO: 228457 - RNA, 62 nt, Homo Sapiens; identical to SEQ ID NO: 65000

SEQ ID NO: 228458 - RNA, 62 nt, Homo Sapiens; identical to SEQ ID NO: 65001

SEQ ID NO: 228459 - RNA, 62 nt, Homo Sapiens; identical to SEQ ID NO: 65002

SEQ ID NO: 228460 - RNA, 62 nt, Homo Sapiens; identical to SEQ ID NO: 65003

SEQ ID NO: 228461 - RNA, 62 nt, Homo Sapiens; identical to SEQ ID NO: 65004

SEQ ID NO: 228462 - RNA, 62 nt, Homo Sapiens; identical to SEQ ID NO: 65005

SEQ ID NO: 228463 - RNA, 62 nt, Homo Sapiens; identical to SEQ ID NO: 65006

SEQ ID NO: 228464 - RNA, 62 nt, Homo Sapiens; identical to SEQ ID NO: 65007

SEQ ID NO: 228465 - RNA, 62 nt, Homo Sapiens; identical to SEQ ID NO: 65008

SEQ ID NO: 228466 - RNA, 62 nt, Homo Sapiens; identical to SEQ ID NO: 65009

SEQ ID NO: 228467 - RNA, 62 nt, Homo Sapiens; identical to SEQ ID NO: 65010

SEQ ID NO: 228468 - RNA, 62 nt, Homo Sapiens; identical to SEQ ID NO: 65011

SEQ ID NO: 228469 - RNA, 62 nt, Homo Sapiens; identical to SEQ ID NO: 65012

SEQ ID NO: 228470 - RNA, 62 nt, Homo Sapiens; identical to SEQ ID NO: 65013

SEQ ID NO: 228471 - RNA, 62 nt, Homo Sapiens; identical to SEQ ID NO: 65014

SEQ ID NO: 228472 - RNA, 62 nt, Homo Sapiens; identical to SEQ ID NO: 65015

SEQ ID NO: 228473 - RNA, 62 nt, Homo Sapiens; identical to SEQ ID NO: 65016

SEQ ID NO: 228474 - RNA, 62 nt, Homo Sapiens; identical to SEQ ID NO: 65017

SEQ ID NO: 228475 - RNA, 62 nt, Homo Sapiens; identical to SEQ ID NO: 65018

SEQ ID NO: 228476 - RNA, 62 nt, Homo Sapiens; identical to SEQ ID NO: 65019

SEQ ID NO: 228477 - RNA, 62 nt, Homo Sapiens; identical to SEQ ID NO: 65020

SEQ ID NO: 228478 - RNA, 62 nt, Homo Sapiens; identical to SEQ ID NO: 65021

SEQ ID NO: 228479 - RNA, 62 nt, Homo Sapiens; identical to SEQ ID NO: 65022

SEQ ID NO: 228480 - RNA, 62 nt, Homo Sapiens; identical to SEQ ID NO: 65023

SEQ ID NO: 228481 - RNA, 62 nt, Homo Sapiens; identical to SEQ ID NO: 65024

SEQ ID NO: 228482 - RNA, 62 nt, Homo Sapiens; identical to SEQ ID NO: 65025

SEQ ID NO: 228483 - RNA, 62 nt, Homo Sapiens; identical to SEQ ID NO: 65026

SEQ ID NO: 228484 - RNA, 62 nt, Homo Sapiens; identical to SEQ ID NO: 65027

SEQ ID NO: 228485 - RNA, 62 nt, Homo Sapiens; identical to SEQ ID NO: 65028

SEQ ID NO: 228486 - RNA, 62 nt, Homo Sapiens; identical to SEQ ID NO: 65029

SEQ ID NO: 228487 - RNA, 62 nt, Homo Sapiens; identical to SEQ ID NO: 65030

SEQ ID NO: 228488 - RNA, 62 nt, Homo Sapiens; identical to SEQ ID NO: 65031

SEQ ID NO: 228489 - RNA, 62 nt, Homo Sapiens; identical to SEQ ID NO: 65032

SEQ ID NO: 228490 - RNA, 62 nt, Homo Sapiens; identical to SEQ ID NO: 65033

SEQ ID NO: 228491 - RNA, 62 nt, Homo Sapiens; identical to SEQ ID NO: 65034

SEQ ID NO: 228492 - RNA, 62 nt, Homo Sapiens; identical to SEQ ID NO: 65035

SEQ ID NO: 228493 - RNA, 62 nt, Homo Sapiens; identical to SEQ ID NO: 65036

SEQ ID NO: 228494 - RNA, 62 nt, Homo Sapiens; identical to SEQ ID NO: 65037

SEQ ID NO: 228495 - RNA, 62 nt, Homo Sapiens; identical to SEQ ID NO: 65038

SEQ ID NO: 228496 - RNA, 62 nt, Homo Sapiens; identical to SEQ ID NO: 65039

SEQ ID NO: 228497 - RNA, 62 nt, Homo Sapiens; identical to SEQ ID NO: 65040

SEQ ID NO: 228498 - RNA, 62 nt, Homo Sapiens; identical to SEQ ID NO: 65041

SEQ ID NO: 228499 - RNA, 62 nt, Homo Sapiens; identical to SEQ ID NO: 65042

SEQ ID NO: 228500 - RNA, 62 nt, Homo Sapiens; identical to SEQ ID NO: 65043

SEQ ID NO: 228501 - RNA, 62 nt, Homo Sapiens; identical to SEQ ID NO: 65044

SEQ ID NO: 228502 - RNA, 62 nt, Homo Sapiens; identical to SEQ ID NO: 65045

SEQ ID NO: 228503 - RNA, 62 nt, Homo Sapiens; identical to SEQ ID NO: 65046

SEQ ID NO: 228504 - RNA, 62 nt, Homo Sapiens; identical to SEQ ID NO: 65047

SEQ ID NO: 228505 - RNA, 62 nt, Homo Sapiens; identical to SEQ ID NO: 65048

SEQ ID NO: 228506 - RNA, 62 nt, Homo Sapiens; identical to SEQ ID NO: 65049

SEQ ID NO: 228507 - RNA, 62 nt, Homo Sapiens; identical to SEQ ID NO: 65050

SEQ ID NO: 228508 - RNA, 62 nt, Homo Sapiens; identical to SEQ ID NO: 65051

SEQ ID NO: 228509 - RNA, 62 nt, Homo Sapiens; identical to SEQ ID NO: 65052

SEQ ID NO: 228510 - RNA, 62 nt, Homo Sapiens; identical to SEQ ID NO: 65053

SEQ ID NO: 228511 - RNA, 62 nt, Homo Sapiens; identical to SEQ ID NO: 65054

SEQ ID NO: 228512 - RNA, 62 nt, Homo Sapiens; identical to SEQ ID NO: 65055

SEQ ID NO: 228513 - RNA, 62 nt, Homo Sapiens; identical to SEQ ID NO: 65056

SEQ ID NO: 228514 - RNA, 62 nt, Homo Sapiens; identical to SEQ ID NO: 65057

SEQ ID NO: 228515 - RNA, 62 nt, Homo Sapiens; identical to SEQ ID NO: 65058

SEQ ID NO: 228516 - RNA, 62 nt, Homo Sapiens; identical to SEQ ID NO: 65059

SEQ ID NO: 228517 - RNA, 62 nt, Homo Sapiens; identical to SEQ ID NO: 65060

SEQ ID NO: 228518 - RNA, 62 nt, Homo Sapiens; identical to SEQ ID NO: 65061

SEQ ID NO: 228519 - RNA, 62 nt, Homo Sapiens; identical to SEQ ID NO: 65062

SEQ ID NO: 228520 - RNA, 62 nt, Homo Sapiens; identical to SEQ ID NO: 65063

SEQ ID NO: 228521 - RNA, 62 nt, Homo Sapiens; identical to SEQ ID NO: 65064

SEQ ID NO: 228522 - RNA, 62 nt, Homo Sapiens; identical to SEQ ID NO: 65065

SEQ ID NO: 228523 - RNA, 62 nt, Homo Sapiens; identical to SEQ ID NO: 65066

SEQ ID NO: 228524 - RNA, 62 nt, Homo Sapiens; identical to SEQ ID NO: 65067

SEQ ID NO: 228525 - RNA, 62 nt, Homo Sapiens; identical to SEQ ID NO: 65068

SEQ ID NO: 228526 - RNA, 62 nt, Homo Sapiens; identical to SEQ ID NO: 65069

SEQ ID NO: 228527 - RNA, 62 nt, Homo Sapiens; identical to SEQ ID NO: 65070

SEQ ID NO: 228528 - RNA, 62 nt, Homo Sapiens; identical to SEQ ID NO: 65071

SEQ ID NO: 228529 - RNA, 62 nt, Homo Sapiens; identical to SEQ ID NO: 65072

SEQ ID NO: 228530 - RNA, 62 nt, Homo Sapiens; identical to SEQ ID NO: 65073

SEQ ID NO: 228531 - RNA, 62 nt, Homo Sapiens; identical to SEQ ID NO: 65074

SEQ ID NO: 228532 - RNA, 62 nt, Homo Sapiens; identical to SEQ ID NO: 65075

SEQ ID NO: 228533 - RNA, 62 nt, Homo Sapiens; identical to SEQ ID NO: 65076

SEQ ID NO: 228534 - RNA, 62 nt, Homo Sapiens; identical to SEQ ID NO: 65077

SEQ ID NO: 228535 - RNA, 62 nt, Homo Sapiens; identical to SEQ ID NO: 65078

SEQ ID NO: 228536 - RNA, 62 nt, Homo Sapiens; identical to SEQ ID NO: 65079

SEQ ID NO: 228537 - RNA, 62 nt, Homo Sapiens; identical to SEQ ID NO: 65080

SEQ ID NO: 228538 - RNA, 62 nt, Homo Sapiens; identical to SEQ ID NO: 65081

SEQ ID NO: 228539 - RNA, 62 nt, Homo Sapiens; identical to SEQ ID NO: 65082

SEQ ID NO: 228540 - RNA, 62 nt, Homo Sapiens; identical to SEQ ID NO: 65083

SEQ ID NO: 228541 - RNA, 62 nt, Homo Sapiens; identical to SEQ ID NO: 65084

SEQ ID NO: 228542 - RNA, 62 nt, Homo Sapiens; identical to SEQ ID NO: 65085

SEQ ID NO: 228543 - RNA, 62 nt, Homo Sapiens; identical to SEQ ID NO: 65086

SEQ ID NO: 228544 - RNA, 60 nt, Homo Sapiens; identical to SEQ ID NO: 65087

SEQ ID NO: 228545 - RNA, 62 nt, Homo Sapiens; identical to SEQ ID NO: 65088

SEQ ID NO: 228546 - RNA, 62 nt, Homo Sapiens; identical to SEQ ID NO: 65089

SEQ ID NO: 228547 - RNA, 62 nt, Homo Sapiens; identical to SEQ ID NO: 65090

SEQ ID NO: 228548 - RNA, 62 nt, Homo Sapiens; identical to SEQ ID NO: 65091

SEQ ID NO: 228549 - RNA, 62 nt, Homo Sapiens; identical to SEQ ID NO: 65092

SEQ ID NO: 228550 - RNA, 62 nt, Homo Sapiens; identical to SEQ ID NO: 65093

SEQ ID NO: 228551 - RNA, 51 nt, Homo Sapiens; identical to SEQ ID NO: 65094

SEQ ID NO: 228552 - RNA, 62 nt, Homo Sapiens; identical to SEQ ID NO: 65095

SEQ ID NO: 228553 - RNA, 62 nt, Homo Sapiens; identical to SEQ ID NO: 65096

SEQ ID NO: 228554 - RNA, 62 nt, Homo Sapiens; identical to SEQ ID NO: 65097

SEQ ID NO: 228555 - RNA, 62 nt, Homo Sapiens; identical to SEQ ID NO: 65098

SEQ ID NO: 228556 - RNA, 62 nt, Homo Sapiens; identical to SEQ ID NO: 65099

SEQ ID NO: 228557 - RNA, 62 nt, Homo Sapiens; identical to SEQ ID NO: 65100

SEQ ID NO: 228558 - RNA, 62 nt, Homo Sapiens; identical to SEQ ID NO: 65101

SEQ ID NO: 228559 - RNA, 62 nt, Homo Sapiens; identical to SEQ ID NO: 65102

SEQ ID NO: 228560 - RNA, 62 nt, Homo Sapiens; identical to SEQ ID NO: 65103

SEQ ID NO: 228561 - RNA, 62 nt, Homo Sapiens; identical to SEQ ID NO: 65104

SEQ ID NO: 228562 - RNA, 62 nt, Homo Sapiens; identical to SEQ ID NO: 65105

SEQ ID NO: 228563 - RNA, 62 nt, Homo Sapiens; identical to SEQ ID NO: 65106

SEQ ID NO: 228564 - RNA, 62 nt, Homo Sapiens; identical to SEQ ID NO: 65107

SEQ ID NO: 228565 - RNA, 62 nt, Homo Sapiens; identical to SEQ ID NO: 65108

SEQ ID NO: 228566 - RNA, 62 nt, Homo Sapiens; identical to SEQ ID NO: 65109

SEQ ID NO: 228567 - RNA, 62 nt, Homo Sapiens; identical to SEQ ID NO: 65110

SEQ ID NO: 228568 - RNA, 62 nt, Homo Sapiens; identical to SEQ ID NO: 65111

SEQ ID NO: 228569 - RNA, 62 nt, Homo Sapiens; identical to SEQ ID NO: 65112

SEQ ID NO: 228570 - RNA, 62 nt, Homo Sapiens; identical to SEQ ID NO: 65113

SEQ ID NO: 228571 - RNA, 62 nt, Homo Sapiens; identical to SEQ ID NO: 65114

SEQ ID NO: 228572 - RNA, 62 nt, Homo Sapiens; identical to SEQ ID NO: 65115

SEQ ID NO: 228573 - RNA, 62 nt, Homo Sapiens; identical to SEQ ID NO: 65116

SEQ ID NO: 228574 - RNA, 62 nt, Homo Sapiens; identical to SEQ ID NO: 65117

SEQ ID NO: 228575 - RNA, 62 nt, Homo Sapiens; identical to SEQ ID NO: 65118

SEQ ID NO: 228576 - RNA, 62 nt, Homo Sapiens; identical to SEQ ID NO: 65119

SEQ ID NO: 228577 - RNA, 62 nt, Homo Sapiens; identical to SEQ ID NO: 65120

SEQ ID NO: 228578 - RNA, 62 nt, Homo Sapiens; identical to SEQ ID NO: 65121

SEQ ID NO: 228579 - RNA, 62 nt, Homo Sapiens; identical to SEQ ID NO: 65122

SEQ ID NO: 228580 - RNA, 62 nt, Homo Sapiens; identical to SEQ ID NO: 65123

SEQ ID NO: 228581 - RNA, 62 nt, Homo Sapiens; identical to SEQ ID NO: 65124

SEQ ID NO: 228582 - RNA, 62 nt, Homo Sapiens; identical to SEQ ID NO: 65125

SEQ ID NO: 228583 - RNA, 62 nt, Homo Sapiens; identical to SEQ ID NO: 65126

SEQ ID NO: 228584 - RNA, 62 nt, Homo Sapiens; identical to SEQ ID NO: 65127

SEQ ID NO: 228585 - RNA, 62 nt, Homo Sapiens; identical to SEQ ID NO: 65128

SEQ ID NO: 228586 - RNA, 62 nt, Homo Sapiens; identical to SEQ ID NO: 65129

SEQ ID NO: 228587 - RNA, 62 nt, Homo Sapiens; identical to SEQ ID NO: 65130

SEQ ID NO: 228588 - RNA, 62 nt, Homo Sapiens; identical to SEQ ID NO: 65131

SEQ ID NO: 228589 - RNA, 62 nt, Homo Sapiens; identical to SEQ ID NO: 65132

SEQ ID NO: 228590 - RNA, 62 nt, Homo Sapiens; identical to SEQ ID NO: 65133

SEQ ID NO: 228591 - RNA, 62 nt, Homo Sapiens; identical to SEQ ID NO: 65134

SEQ ID NO: 228592 - RNA, 62 nt, Homo Sapiens; identical to SEQ ID NO: 65135

SEQ ID NO: 228593 - RNA, 63 nt, Homo Sapiens; identical to SEQ ID NO: 65136

SEQ ID NO: 228594 - RNA, 63 nt, Homo Sapiens; identical to SEQ ID NO: 65137

SEQ ID NO: 228595 - RNA, 63 nt, Homo Sapiens; identical to SEQ ID NO: 65138

SEQ ID NO: 228596 - RNA, 63 nt, Homo Sapiens; identical to SEQ ID NO: 65139

SEQ ID NO: 228597 - RNA, 63 nt, Homo Sapiens; identical to SEQ ID NO: 65140

SEQ ID NO: 228598 - RNA, 63 nt, Homo Sapiens; identical to SEQ ID NO: 65141

SEQ ID NO: 228599 - RNA, 63 nt, Homo Sapiens; identical to SEQ ID NO: 65142

SEQ ID NO: 228600 - RNA, 63 nt, Homo Sapiens; identical to SEQ ID NO: 65143

SEQ ID NO: 228601 - RNA, 63 nt, Homo Sapiens; identical to SEQ ID NO: 65144

SEQ ID NO: 228602 - RNA, 63 nt, Homo Sapiens; identical to SEQ ID NO: 65145

SEQ ID NO: 228603 - RNA, 63 nt, Homo Sapiens; identical to SEQ ID NO: 65146

SEQ ID NO: 228604 - RNA, 63 nt, Homo Sapiens; identical to SEQ ID NO: 65147

SEQ ID NO: 228605 - RNA, 63 nt, Homo Sapiens; identical to SEQ ID NO: 65148

SEQ ID NO: 228606 - RNA, 63 nt, Homo Sapiens; identical to SEQ ID NO: 65149

SEQ ID NO: 228607 - RNA, 63 nt, Homo Sapiens; identical to SEQ ID NO: 65150

SEQ ID NO: 228608 - RNA, 63 nt, Homo Sapiens; identical to SEQ ID NO: 65151

SEQ ID NO: 228609 - RNA, 63 nt, Homo Sapiens; identical to SEQ ID NO: 65152

SEQ ID NO: 228610 - RNA, 63 nt, Homo Sapiens; identical to SEQ ID NO: 65153

SEQ ID NO: 228611 - RNA, 63 nt, Homo Sapiens; identical to SEQ ID NO: 65154

SEQ ID NO: 228612 - RNA, 63 nt, Homo Sapiens; identical to SEQ ID NO: 65155

SEQ ID NO: 228613 - RNA, 63 nt, Homo Sapiens; identical to SEQ ID NO: 65156

SEQ ID NO: 228614 - RNA, 63 nt, Homo Sapiens; identical to SEQ ID NO: 65157

SEQ ID NO: 228615 - RNA, 63 nt, Homo Sapiens; identical to SEQ ID NO: 65158

SEQ ID NO: 228616 - RNA, 63 nt, Homo Sapiens; identical to SEQ ID NO: 65159

SEQ ID NO: 228617 - RNA, 63 nt, Homo Sapiens; identical to SEQ ID NO: 65160

SEQ ID NO: 228618 - RNA, 63 nt, Homo Sapiens; identical to SEQ ID NO: 65161

SEQ ID NO: 228619 - RNA, 63 nt, Homo Sapiens; identical to SEQ ID NO: 65162

SEQ ID NO: 228620 - RNA, 63 nt, Homo Sapiens; identical to SEQ ID NO: 65163

SEQ ID NO: 228621 - RNA, 63 nt, Homo Sapiens; identical to SEQ ID NO: 65164

SEQ ID NO: 228622 - RNA, 63 nt, Homo Sapiens; identical to SEQ ID NO: 65165

SEQ ID NO: 228623 - RNA, 63 nt, Homo Sapiens; identical to SEQ ID NO: 65166

SEQ ID NO: 228624 - RNA, 63 nt, Homo Sapiens; identical to SEQ ID NO: 65167

SEQ ID NO: 228625 - RNA, 63 nt, Homo Sapiens; identical to SEQ ID NO: 65168

SEQ ID NO: 228626 - RNA, 63 nt, Homo Sapiens; identical to SEQ ID NO: 65169

SEQ ID NO: 228627 - RNA, 63 nt, Homo Sapiens; identical to SEQ ID NO: 65170

SEQ ID NO: 228628 - RNA, 63 nt, Homo Sapiens; identical to SEQ ID NO: 65171

SEQ ID NO: 228629 - RNA, 63 nt, Homo Sapiens; identical to SEQ ID NO: 65172

SEQ ID NO: 228630 - RNA, 63 nt, Homo Sapiens; identical to SEQ ID NO: 65173

SEQ ID NO: 228631 - RNA, 63 nt, Homo Sapiens; identical to SEQ ID NO: 65174

SEQ ID NO: 228632 - RNA, 63 nt, Homo Sapiens; identical to SEQ ID NO: 65175

SEQ ID NO: 228633 - RNA, 63 nt, Homo Sapiens; identical to SEQ ID NO: 65176

SEQ ID NO: 228634 - RNA, 63 nt, Homo Sapiens; identical to SEQ ID NO: 65177

SEQ ID NO: 228635 - RNA, 63 nt, Homo Sapiens; identical to SEQ ID NO: 65178

SEQ ID NO: 228636 - RNA, 63 nt, Homo Sapiens; identical to SEQ ID NO: 65179

SEQ ID NO: 228637 - RNA, 63 nt, Homo Sapiens; identical to SEQ ID NO: 65180

SEQ ID NO: 228638 - RNA, 63 nt, Homo Sapiens; identical to SEQ ID NO: 65181

SEQ ID NO: 228639 - RNA, 63 nt, Homo Sapiens; identical to SEQ ID NO: 65182

SEQ ID NO: 228640 - RNA, 63 nt, Homo Sapiens; identical to SEQ ID NO: 65183

SEQ ID NO: 228641 - RNA, 63 nt, Homo Sapiens; identical to SEQ ID NO: 65184

SEQ ID NO: 228642 - RNA, 63 nt, Homo Sapiens; identical to SEQ ID NO: 65185

SEQ ID NO: 228643 - RNA, 63 nt, Homo Sapiens; identical to SEQ ID NO: 65186

SEQ ID NO: 228644 - RNA, 63 nt, Homo Sapiens; identical to SEQ ID NO: 65187

SEQ ID NO: 228645 - RNA, 63 nt, Homo Sapiens; identical to SEQ ID NO: 65188

SEQ ID NO: 228646 - RNA, 63 nt, Homo Sapiens; identical to SEQ ID NO: 65189

SEQ ID NO: 228647 - RNA, 63 nt, Homo Sapiens; identical to SEQ ID NO: 65190

SEQ ID NO: 228648 - RNA, 63 nt, Homo Sapiens; identical to SEQ ID NO: 65191

SEQ ID NO: 228649 - RNA, 63 nt, Homo Sapiens; identical to SEQ ID NO: 65192

SEQ ID NO: 228650 - RNA, 63 nt, Homo Sapiens; identical to SEQ ID NO: 65193

SEQ ID NO: 228651 - RNA, 63 nt, Homo Sapiens; identical to SEQ ID NO: 65194

SEQ ID NO: 228652 - RNA, 63 nt, Homo Sapiens; identical to SEQ ID NO: 65195

SEQ ID NO: 228653 - RNA, 63 nt, Homo Sapiens; identical to SEQ ID NO: 65196

SEQ ID NO: 228654 - RNA, 63 nt, Homo Sapiens; identical to SEQ ID NO: 65197

SEQ ID NO: 228655 - RNA, 63 nt, Homo Sapiens; identical to SEQ ID NO: 65198

SEQ ID NO: 228656 - RNA, 63 nt, Homo Sapiens; identical to SEQ ID NO: 65199

SEQ ID NO: 228657 - RNA, 63 nt, Homo Sapiens; identical to SEQ ID NO: 65200

SEQ ID NO: 228658 - RNA, 63 nt, Homo Sapiens; identical to SEQ ID NO: 65201

SEQ ID NO: 228659 - RNA, 63 nt, Homo Sapiens; identical to SEQ ID NO: 65202

SEQ ID NO: 228660 - RNA, 63 nt, Homo Sapiens; identical to SEQ ID NO: 65203

SEQ ID NO: 228661 - RNA, 63 nt, Homo Sapiens; identical to SEQ ID NO: 65204

SEQ ID NO: 228662 - RNA, 63 nt, Homo Sapiens; identical to SEQ ID NO: 65205

SEQ ID NO: 228663 - RNA, 63 nt, Homo Sapiens; identical to SEQ ID NO: 65206

SEQ ID NO: 228664 - RNA, 63 nt, Homo Sapiens; identical to SEQ ID NO: 65207

SEQ ID NO: 228665 - RNA, 63 nt, Homo Sapiens; identical to SEQ ID NO: 65208

SEQ ID NO: 228666 - RNA, 63 nt, Homo Sapiens; identical to SEQ ID NO: 65209

SEQ ID NO: 228667 - RNA, 63 nt, Homo Sapiens; identical to SEQ ID NO: 65210

SEQ ID NO: 228668 - RNA, 63 nt, Homo Sapiens; identical to SEQ ID NO: 65211

SEQ ID NO: 228669 - RNA, 63 nt, Homo Sapiens; identical to SEQ ID NO: 65212

SEQ ID NO: 228670 - RNA, 63 nt, Homo Sapiens; identical to SEQ ID NO: 65213

SEQ ID NO: 228671 - RNA, 63 nt, Homo Sapiens; identical to SEQ ID NO: 65214

SEQ ID NO: 228672 - RNA, 63 nt, Homo Sapiens; identical to SEQ ID NO: 65215

SEQ ID NO: 228673 - RNA, 63 nt, Homo Sapiens; identical to SEQ ID NO: 65216

SEQ ID NO: 228674 - RNA, 63 nt, Homo Sapiens; identical to SEQ ID NO: 65217

SEQ ID NO: 228675 - RNA, 63 nt, Homo Sapiens; identical to SEQ ID NO: 65218

SEQ ID NO: 228676 - RNA, 63 nt, Homo Sapiens; identical to SEQ ID NO: 65219

SEQ ID NO: 228677 - RNA, 63 nt, Homo Sapiens; identical to SEQ ID NO: 65220

SEQ ID NO: 228678 - RNA, 63 nt, Homo Sapiens; identical to SEQ ID NO: 65221

SEQ ID NO: 228679 - RNA, 63 nt, Homo Sapiens; identical to SEQ ID NO: 65222

SEQ ID NO: 228680 - RNA, 63 nt, Homo Sapiens; identical to SEQ ID NO: 65223

SEQ ID NO: 228681 - RNA, 63 nt, Homo Sapiens; identical to SEQ ID NO: 65224

SEQ ID NO: 228682 - RNA, 63 nt, Homo Sapiens; identical to SEQ ID NO: 65225

SEQ ID NO: 228683 - RNA, 63 nt, Homo Sapiens; identical to SEQ ID NO: 65226

SEQ ID NO: 228684 - RNA, 63 nt, Homo Sapiens; identical to SEQ ID NO: 65227

SEQ ID NO: 228685 - RNA, 63 nt, Homo Sapiens; identical to SEQ ID NO: 65228

SEQ ID NO: 228686 - RNA, 63 nt, Homo Sapiens; identical to SEQ ID NO: 65229

SEQ ID NO: 228687 - RNA, 63 nt, Homo Sapiens; identical to SEQ ID NO: 65230

SEQ ID NO: 228688 - RNA, 63 nt, Homo Sapiens; identical to SEQ ID NO: 65231

SEQ ID NO: 228689 - RNA, 63 nt, Homo Sapiens; identical to SEQ ID NO: 65232

SEQ ID NO: 228690 - RNA, 63 nt, Homo Sapiens; identical to SEQ ID NO: 65233

SEQ ID NO: 228691 - RNA, 63 nt, Homo Sapiens; identical to SEQ ID NO: 65234

SEQ ID NO: 228692 - RNA, 63 nt, Homo Sapiens; identical to SEQ ID NO: 65235

SEQ ID NO: 228693 - RNA, 63 nt, Homo Sapiens; identical to SEQ ID NO: 65236

SEQ ID NO: 228694 - RNA, 63 nt, Homo Sapiens; identical to SEQ ID NO: 65237

SEQ ID NO: 228695 - RNA, 63 nt, Homo Sapiens; identical to SEQ ID NO: 65238

SEQ ID NO: 228696 - RNA, 63 nt, Homo Sapiens; identical to SEQ ID NO: 65239

SEQ ID NO: 228697 - RNA, 63 nt, Homo Sapiens; identical to SEQ ID NO: 65240

SEQ ID NO: 228698 - RNA, 63 nt, Homo Sapiens; identical to SEQ ID NO: 65241

SEQ ID NO: 228699 - RNA, 63 nt, Homo Sapiens; identical to SEQ ID NO: 65242

SEQ ID NO: 228700 - RNA, 63 nt, Homo Sapiens; identical to SEQ ID NO: 65243

SEQ ID NO: 228701 - RNA, 63 nt, Homo Sapiens; identical to SEQ ID NO: 65244

SEQ ID NO: 228702 - RNA, 63 nt, Homo Sapiens; identical to SEQ ID NO: 65245

SEQ ID NO: 228703 - RNA, 63 nt, Homo Sapiens; identical to SEQ ID NO: 65246

SEQ ID NO: 228704 - RNA, 63 nt, Homo Sapiens; identical to SEQ ID NO: 65247

SEQ ID NO: 228705 - RNA, 63 nt, Homo Sapiens; identical to SEQ ID NO: 65248

SEQ ID NO: 228706 - RNA, 63 nt, Homo Sapiens; identical to SEQ ID NO: 65249

SEQ ID NO: 228707 - RNA, 63 nt, Homo Sapiens; identical to SEQ ID NO: 65250

SEQ ID NO: 228708 - RNA, 63 nt, Homo Sapiens; identical to SEQ ID NO: 65251

SEQ ID NO: 228709 - RNA, 63 nt, Homo Sapiens; identical to SEQ ID NO: 65252

SEQ ID NO: 228710 - RNA, 63 nt, Homo Sapiens; identical to SEQ ID NO: 65253

SEQ ID NO: 228711 - RNA, 63 nt, Homo Sapiens; identical to SEQ ID NO: 65254

SEQ ID NO: 228712 - RNA, 63 nt, Homo Sapiens; identical to SEQ ID NO: 65255

SEQ ID NO: 228713 - RNA, 63 nt, Homo Sapiens; identical to SEQ ID NO: 65256

SEQ ID NO: 228714 - RNA, 63 nt, Homo Sapiens; identical to SEQ ID NO: 65257

SEQ ID NO: 228715 - RNA, 63 nt, Homo Sapiens; identical to SEQ ID NO: 65258

SEQ ID NO: 228716 - RNA, 63 nt, Homo Sapiens; identical to SEQ ID NO: 65259

SEQ ID NO: 228717 - RNA, 63 nt, Homo Sapiens; identical to SEQ ID NO: 65260

SEQ ID NO: 228718 - RNA, 63 nt, Homo Sapiens; identical to SEQ ID NO: 65261

SEQ ID NO: 228719 - RNA, 63 nt, Homo Sapiens; identical to SEQ ID NO: 65262

SEQ ID NO: 228720 - RNA, 63 nt, Homo Sapiens; identical to SEQ ID NO: 65263

SEQ ID NO: 228721 - RNA, 63 nt, Homo Sapiens; identical to SEQ ID NO: 65264

SEQ ID NO: 228722 - RNA, 63 nt, Homo Sapiens; identical to SEQ ID NO: 65265

SEQ ID NO: 228723 - RNA, 63 nt, Homo Sapiens; identical to SEQ ID NO: 65266

SEQ ID NO: 228724 - RNA, 63 nt, Homo Sapiens; identical to SEQ ID NO: 65267

SEQ ID NO: 228725 - RNA, 63 nt, Homo Sapiens; identical to SEQ ID NO: 65268

SEQ ID NO: 228726 - RNA, 63 nt, Homo Sapiens; identical to SEQ ID NO: 65269

SEQ ID NO: 228727 - RNA, 63 nt, Homo Sapiens; identical to SEQ ID NO: 65270

SEQ ID NO: 228728 - RNA, 63 nt, Homo Sapiens; identical to SEQ ID NO: 65271

SEQ ID NO: 228729 - RNA, 63 nt, Homo Sapiens; identical to SEQ ID NO: 65272

SEQ ID NO: 228730 - RNA, 63 nt, Homo Sapiens; identical to SEQ ID NO: 65273

SEQ ID NO: 228731 - RNA, 56 nt, Homo Sapiens; identical to SEQ ID NO: 61369

SEQ ID NO: 228732 - RNA, 63 nt, Homo Sapiens; identical to SEQ ID NO: 65275

SEQ ID NO: 228733 - RNA, 63 nt, Homo Sapiens; identical to SEQ ID NO: 65276

SEQ ID NO: 228734 - RNA, 63 nt, Homo Sapiens; identical to SEQ ID NO: 65277

SEQ ID NO: 228735 - RNA, 63 nt, Homo Sapiens; identical to SEQ ID NO: 65278

SEQ ID NO: 228736 - RNA, 63 nt, Homo Sapiens; identical to SEQ ID NO: 65279

SEQ ID NO: 228737 - RNA, 63 nt, Homo Sapiens; identical to SEQ ID NO: 65280

SEQ ID NO: 228738 - RNA, 63 nt, Homo Sapiens; identical to SEQ ID NO: 65281

SEQ ID NO: 228739 - RNA, 63 nt, Homo Sapiens; identical to SEQ ID NO: 65282

SEQ ID NO: 228740 - RNA, 63 nt, Homo Sapiens; identical to SEQ ID NO: 65283

SEQ ID NO: 228741 - RNA, 63 nt, Homo Sapiens; identical to SEQ ID NO: 65284

SEQ ID NO: 228742 - RNA, 63 nt, Homo Sapiens; identical to SEQ ID NO: 65285

SEQ ID NO: 228743 - RNA, 63 nt, Homo Sapiens; identical to SEQ ID NO: 65286

SEQ ID NO: 228744 - RNA, 63 nt, Homo Sapiens; identical to SEQ ID NO: 65287

SEQ ID NO: 228745 - RNA, 63 nt, Homo Sapiens; identical to SEQ ID NO: 65288

SEQ ID NO: 228746 - RNA, 63 nt, Homo Sapiens; identical to SEQ ID NO: 65289

SEQ ID NO: 228747 - RNA, 63 nt, Homo Sapiens; identical to SEQ ID NO: 65290

SEQ ID NO: 228748 - RNA, 63 nt, Homo Sapiens; identical to SEQ ID NO: 65291

SEQ ID NO: 228749 - RNA, 63 nt, Homo Sapiens; identical to SEQ ID NO: 65292

SEQ ID NO: 228750 - RNA, 63 nt, Homo Sapiens; identical to SEQ ID NO: 65293

SEQ ID NO: 228751 - RNA, 63 nt, Homo Sapiens; identical to SEQ ID NO: 65294

SEQ ID NO: 228752 - RNA, 63 nt, Homo Sapiens; identical to SEQ ID NO: 65295

SEQ ID NO: 228753 - RNA, 63 nt, Homo Sapiens; identical to SEQ ID NO: 65296

SEQ ID NO: 228754 - RNA, 63 nt, Homo Sapiens; identical to SEQ ID NO: 65297

SEQ ID NO: 228755 - RNA, 63 nt, Homo Sapiens; identical to SEQ ID NO: 65298

SEQ ID NO: 228756 - RNA, 63 nt, Homo Sapiens; identical to SEQ ID NO: 65299

SEQ ID NO: 228757 - RNA, 63 nt, Homo Sapiens; identical to SEQ ID NO: 65300

SEQ ID NO: 228758 - RNA, 63 nt, Homo Sapiens; identical to SEQ ID NO: 65301

SEQ ID NO: 228759 - RNA, 63 nt, Homo Sapiens; identical to SEQ ID NO: 65302

SEQ ID NO: 228760 - RNA, 63 nt, Homo Sapiens; identical to SEQ ID NO: 65303

SEQ ID NO: 228761 - RNA, 63 nt, Homo Sapiens; identical to SEQ ID NO: 65304

SEQ ID NO: 228762 - RNA, 63 nt, Homo Sapiens; identical to SEQ ID NO: 65305

SEQ ID NO: 228763 - RNA, 63 nt, Homo Sapiens; identical to SEQ ID NO: 65306

SEQ ID NO: 228764 - RNA, 63 nt, Homo Sapiens; identical to SEQ ID NO: 65307

SEQ ID NO: 228765 - RNA, 63 nt, Homo Sapiens; identical to SEQ ID NO: 65308

SEQ ID NO: 228766 - RNA, 63 nt, Homo Sapiens; identical to SEQ ID NO: 65309

SEQ ID NO: 228767 - RNA, 63 nt, Homo Sapiens; identical to SEQ ID NO: 65310

SEQ ID NO: 228768 - RNA, 63 nt, Homo Sapiens; identical to SEQ ID NO: 65311

SEQ ID NO: 228769 - RNA, 63 nt, Homo Sapiens; identical to SEQ ID NO: 65312

SEQ ID NO: 228770 - RNA, 63 nt, Homo Sapiens; identical to SEQ ID NO: 65313

SEQ ID NO: 228771 - RNA, 63 nt, Homo Sapiens; identical to SEQ ID NO: 65314

SEQ ID NO: 228772 - RNA, 63 nt, Homo Sapiens; identical to SEQ ID NO: 65315

SEQ ID NO: 228773 - RNA, 63 nt, Homo Sapiens; identical to SEQ ID NO: 65316

SEQ ID NO: 228774 - RNA, 63 nt, Homo Sapiens; identical to SEQ ID NO: 65317

SEQ ID NO: 228775 - RNA, 63 nt, Homo Sapiens; identical to SEQ ID NO: 65318

SEQ ID NO: 228776 - RNA, 63 nt, Homo Sapiens; identical to SEQ ID NO: 65319

SEQ ID NO: 228777 - RNA, 63 nt, Homo Sapiens; identical to SEQ ID NO: 65320

SEQ ID NO: 228778 - RNA, 63 nt, Homo Sapiens; identical to SEQ ID NO: 65321

SEQ ID NO: 228779 - RNA, 63 nt, Homo Sapiens; identical to SEQ ID NO: 65322

SEQ ID NO: 228780 - RNA, 63 nt, Homo Sapiens; identical to SEQ ID NO: 65323

SEQ ID NO: 228781 - RNA, 63 nt, Homo Sapiens; identical to SEQ ID NO: 65324

SEQ ID NO: 228782 - RNA, 63 nt, Homo Sapiens; identical to SEQ ID NO: 65325

SEQ ID NO: 228783 - RNA, 63 nt, Homo Sapiens; identical to SEQ ID NO: 65326

SEQ ID NO: 228784 - RNA, 63 nt, Homo Sapiens; identical to SEQ ID NO: 65327

SEQ ID NO: 228785 - RNA, 63 nt, Homo Sapiens; identical to SEQ ID NO: 65328

SEQ ID NO: 228786 - RNA, 63 nt, Homo Sapiens; identical to SEQ ID NO: 65329

SEQ ID NO: 228787 - RNA, 63 nt, Homo Sapiens; identical to SEQ ID NO: 65330

SEQ ID NO: 228788 - RNA, 63 nt, Homo Sapiens; identical to SEQ ID NO: 65331

SEQ ID NO: 228789 - RNA, 63 nt, Homo Sapiens; identical to SEQ ID NO: 65332

SEQ ID NO: 228790 - RNA, 63 nt, Homo Sapiens; identical to SEQ ID NO: 65333

SEQ ID NO: 228791 - RNA, 63 nt, Homo Sapiens; identical to SEQ ID NO: 65334

SEQ ID NO: 228792 - RNA, 63 nt, Homo Sapiens; identical to SEQ ID NO: 65335

SEQ ID NO: 228793 - RNA, 63 nt, Homo Sapiens; identical to SEQ ID NO: 65336

SEQ ID NO: 228794 - RNA, 63 nt, Homo Sapiens; identical to SEQ ID NO: 65337

SEQ ID NO: 228795 - RNA, 63 nt, Homo Sapiens; identical to SEQ ID NO: 65338

SEQ ID NO: 228796 - RNA, 63 nt, Homo Sapiens; identical to SEQ ID NO: 65339

SEQ ID NO: 228797 - RNA, 63 nt, Homo Sapiens; identical to SEQ ID NO: 65340

SEQ ID NO: 228798 - RNA, 63 nt, Homo Sapiens; identical to SEQ ID NO: 65341

SEQ ID NO: 228799 - RNA, 63 nt, Homo Sapiens; identical to SEQ ID NO: 65342

SEQ ID NO: 228800 - RNA, 63 nt, Homo Sapiens; identical to SEQ ID NO: 65343

SEQ ID NO: 228801 - RNA, 63 nt, Homo Sapiens; identical to SEQ ID NO: 65344

SEQ ID NO: 228802 - RNA, 63 nt, Homo Sapiens; identical to SEQ ID NO: 65345

SEQ ID NO: 228803 - RNA, 63 nt, Homo Sapiens; identical to SEQ ID NO: 65346

SEQ ID NO: 228804 - RNA, 63 nt, Homo Sapiens; identical to SEQ ID NO: 65347

SEQ ID NO: 228805 - RNA, 63 nt, Homo Sapiens; identical to SEQ ID NO: 65348

SEQ ID NO: 228806 - RNA, 63 nt, Homo Sapiens; identical to SEQ ID NO: 65349

SEQ ID NO: 228807 - RNA, 63 nt, Homo Sapiens; identical to SEQ ID NO: 65350

SEQ ID NO: 228808 - RNA, 63 nt, Homo Sapiens; identical to SEQ ID NO: 65351

SEQ ID NO: 228809 - RNA, 63 nt, Homo Sapiens; identical to SEQ ID NO: 65352

SEQ ID NO: 228810 - RNA, 63 nt, Homo Sapiens; identical to SEQ ID NO: 65353

SEQ ID NO: 228811 - RNA, 63 nt, Homo Sapiens; identical to SEQ ID NO: 65354

SEQ ID NO: 228812 - RNA, 63 nt, Homo Sapiens; identical to SEQ ID NO: 65355

SEQ ID NO: 228813 - RNA, 63 nt, Homo Sapiens; identical to SEQ ID NO: 65356

SEQ ID NO: 228814 - RNA, 63 nt, Homo Sapiens; identical to SEQ ID NO: 65357

SEQ ID NO: 228815 - RNA, 63 nt, Homo Sapiens; identical to SEQ ID NO: 65358

SEQ ID NO: 228816 - RNA, 63 nt, Homo Sapiens; identical to SEQ ID NO: 65359

SEQ ID NO: 228817 - RNA, 63 nt, Homo Sapiens; identical to SEQ ID NO: 65360

SEQ ID NO: 228818 - RNA, 63 nt, Homo Sapiens; identical to SEQ ID NO: 65361

SEQ ID NO: 228819 - RNA, 63 nt, Homo Sapiens; identical to SEQ ID NO: 65362

SEQ ID NO: 228820 - RNA, 63 nt, Homo Sapiens; identical to SEQ ID NO: 65363

SEQ ID NO: 228821 - RNA, 63 nt, Homo Sapiens; identical to SEQ ID NO: 65364

SEQ ID NO: 228822 - RNA, 63 nt, Homo Sapiens; identical to SEQ ID NO: 65365

SEQ ID NO: 228823 - RNA, 60 nt, Homo Sapiens; identical to SEQ ID NO: 65087

SEQ ID NO: 228824 - RNA, 63 nt, Homo Sapiens; identical to SEQ ID NO: 65367

SEQ ID NO: 228825 - RNA, 63 nt, Homo Sapiens; identical to SEQ ID NO: 65368

SEQ ID NO: 228826 - RNA, 63 nt, Homo Sapiens; identical to SEQ ID NO: 65369

SEQ ID NO: 228827 - RNA, 63 nt, Homo Sapiens; identical to SEQ ID NO: 65370

SEQ ID NO: 228828 - RNA, 63 nt, Homo Sapiens; identical to SEQ ID NO: 65371

SEQ ID NO: 228829 - RNA, 63 nt, Homo Sapiens; identical to SEQ ID NO: 65372

SEQ ID NO: 228830 - RNA, 51 nt, Homo Sapiens; identical to SEQ ID NO: 65094

SEQ ID NO: 228831 - RNA, 63 nt, Homo Sapiens; identical to SEQ ID NO: 65374

SEQ ID NO: 228832 - RNA, 63 nt, Homo Sapiens; identical to SEQ ID NO: 65375

SEQ ID NO: 228833 - RNA, 63 nt, Homo Sapiens; identical to SEQ ID NO: 65376

SEQ ID NO: 228834 - RNA, 63 nt, Homo Sapiens; identical to SEQ ID NO: 65377

SEQ ID NO: 228835 - RNA, 63 nt, Homo Sapiens; identical to SEQ ID NO: 65378

SEQ ID NO: 228836 - RNA, 63 nt, Homo Sapiens; identical to SEQ ID NO: 65379

SEQ ID NO: 228837 - RNA, 63 nt, Homo Sapiens; identical to SEQ ID NO: 65380

SEQ ID NO: 228838 - RNA, 63 nt, Homo Sapiens; identical to SEQ ID NO: 65381

SEQ ID NO: 228839 - RNA, 63 nt, Homo Sapiens; identical to SEQ ID NO: 65382

SEQ ID NO: 228840 - RNA, 63 nt, Homo Sapiens; identical to SEQ ID NO: 65383

SEQ ID NO: 228841 - RNA, 63 nt, Homo Sapiens; identical to SEQ ID NO: 65384

SEQ ID NO: 228842 - RNA, 63 nt, Homo Sapiens; identical to SEQ ID NO: 65385

SEQ ID NO: 228843 - RNA, 63 nt, Homo Sapiens; identical to SEQ ID NO: 65386

SEQ ID NO: 228844 - RNA, 63 nt, Homo Sapiens; identical to SEQ ID NO: 65387

SEQ ID NO: 228845 - RNA, 63 nt, Homo Sapiens; identical to SEQ ID NO: 65388

SEQ ID NO: 228846 - RNA, 63 nt, Homo Sapiens; identical to SEQ ID NO: 65389

SEQ ID NO: 228847 - RNA, 63 nt, Homo Sapiens; identical to SEQ ID NO: 65390

SEQ ID NO: 228848 - RNA, 63 nt, Homo Sapiens; identical to SEQ ID NO: 65391

SEQ ID NO: 228849 - RNA, 63 nt, Homo Sapiens; identical to SEQ ID NO: 65392

SEQ ID NO: 228850 - RNA, 63 nt, Homo Sapiens; identical to SEQ ID NO: 65393

SEQ ID NO: 228851 - RNA, 63 nt, Homo Sapiens; identical to SEQ ID NO: 65394

SEQ ID NO: 228852 - RNA, 63 nt, Homo Sapiens; identical to SEQ ID NO: 65395

SEQ ID NO: 228853 - RNA, 63 nt, Homo Sapiens; identical to SEQ ID NO: 65396

SEQ ID NO: 228854 - RNA, 63 nt, Homo Sapiens; identical to SEQ ID NO: 65397

SEQ ID NO: 228855 - RNA, 63 nt, Homo Sapiens; identical to SEQ ID NO: 65398

SEQ ID NO: 228856 - RNA, 63 nt, Homo Sapiens; identical to SEQ ID NO: 65399

SEQ ID NO: 228857 - RNA, 63 nt, Homo Sapiens; identical to SEQ ID NO: 65400

SEQ ID NO: 228858 - RNA, 63 nt, Homo Sapiens; identical to SEQ ID NO: 65401

SEQ ID NO: 228859 - RNA, 63 nt, Homo Sapiens; identical to SEQ ID NO: 65402

SEQ ID NO: 228860 - RNA, 63 nt, Homo Sapiens; identical to SEQ ID NO: 65403

SEQ ID NO: 228861 - RNA, 63 nt, Homo Sapiens; identical to SEQ ID NO: 65404

SEQ ID NO: 228862 - RNA, 63 nt, Homo Sapiens; identical to SEQ ID NO: 65405

SEQ ID NO: 228863 - RNA, 63 nt, Homo Sapiens; identical to SEQ ID NO: 65406

SEQ ID NO: 228864 - RNA, 63 nt, Homo Sapiens; identical to SEQ ID NO: 65407

SEQ ID NO: 228865 - RNA, 63 nt, Homo Sapiens; identical to SEQ ID NO: 65408

SEQ ID NO: 228866 - RNA, 63 nt, Homo Sapiens; identical to SEQ ID NO: 65409

SEQ ID NO: 228867 - RNA, 63 nt, Homo Sapiens; identical to SEQ ID NO: 65410

SEQ ID NO: 228868 - RNA, 63 nt, Homo Sapiens; identical to SEQ ID NO: 65411

SEQ ID NO: 228869 - RNA, 63 nt, Homo Sapiens; identical to SEQ ID NO: 65412

SEQ ID NO: 228870 - RNA, 63 nt, Homo Sapiens; identical to SEQ ID NO: 65413

SEQ ID NO: 228871 - RNA, 63 nt, Homo Sapiens; identical to SEQ ID NO: 65414

SEQ ID NO: 228872 - RNA, 64 nt, Homo Sapiens
gggaacaucgacuucuaauccagcuuucuuguuuaauuaugaccuaaaucuaauuuacuuccac

SEQ ID NO: 228873 - RNA, 64 nt, Homo Sapiens
auaggugucauugaaauguaaaaucuaaguaugaaauuaugaaaggacauucuuuaauuacugc

SEQ ID NO: 228874 - RNA, 64 nt, Homo Sapiens
auuucaauaguauaugaguaugagauuucuuaucaauuaugagugaaauauucuaucugaaugc

SEQ ID NO: 228875 - RNA, 64 nt, Homo Sapiens
gaaaacacaaaucuaaaguaaaacaaucaagaauaauuaugagaucauagcuuuuggcucaaau

SEQ ID NO: 228876 - RNA, 64 nt, Homo Sapiens
uucuagcacuugauuaaagucaaugccauaacuuaauuaugauuuccuucaaaauaauuuuaga

SEQ ID NO: 228877 - RNA, 64 nt, Homo Sapiens
cccugccuauuguccauuacaugugaguuagucaaauuaugaguggacacgaucaugcuugagc

SEQ ID NO: 228878 - RNA, 64 nt, Homo Sapiens
uuccccccauuguuacacauauguuuucagguagaauuaugacuuuuauuuccucuuacaaucc

SEQ ID NO: 228879 - RNA, 64 nt, Homo Sapiens
ugugcugucuauguggacacuuugguaaaaugcaaauuaugauauggacguuaucauuggucug

SEQ ID NO: 228880 - RNA, 64 nt, Homo Sapiens
ugagauguuucauauuugugacaguuaauuuaaaaauuaugaguuaaugcugccugugucuaug

SEQ ID NO: 228881 - RNA, 64 nt, Homo Sapiens
acccuaaagauguguuuuauuauaaauaauauucaauuaugaaacaaaaaaauuaugauguuuu

SEQ ID NO: 228882 - RNA, 64 nt, Homo Sapiens
uuauuauaaauaauauucaauuaugaaacaaaaaaauuaugauguuuuucaaaaugcaagugag

SEQ ID NO: 228883 - RNA, 64 nt, Homo Sapiens
ugaugaaaauaauaaagccagccuauuuauuauaaauuaugagaauauuuaucaguugcagaua

SEQ ID NO: 228884 - RNA, 64 nt, Homo Sapiens
ugaaacaauuauuguacacugaauauucaaauguaauuaugagggcuaaauuuuucuuaaucaa

SEQ ID NO: 228885 - RNA, 64 nt, Homo Sapiens
cagcccgaaaggauguuaauugacaagcucaaauaauuaugagugccauguacauauuacagca

SEQ ID NO: 228886 - RNA, 64 nt, Homo Sapiens
gaagauaacauugucauuccuucuacuguugcuuaauuaugaugagcucuuaaguagggguauu

SEQ ID NO: 228887 - RNA, 64 nt, Homo Sapiens
aggauauacuaauaaauacagaaagucagugcaaaauuaugaaucagagauuuaauuuuauauu

SEQ ID NO: 228888 - RNA, 64 nt, Homo Sapiens
aauuauuuucuuguaucaagaaauuauauugucuaauuaugaugauuuugucucaaaaguggaa

SEQ ID NO: 228889 - RNA, 64 nt, Homo Sapiens
uauuuuaaugucuacuuuuacaaagauucccuccaauuaugaaagauuagaugccacuaaucuc

SEQ ID NO: 228890 - RNA, 64 nt, Homo Sapiens
aaguugaagguacuucuuuuuccgcuuuggcuacaauuaugaaggaauuauuaaauauuccauu

SEQ ID NO: 228891 - RNA, 64 nt, Homo Sapiens
auccauuauuuuaaauaaacuaauagguuuucagaauuaugaauuuuucagaacucauccaguc

SEQ ID NO: 228892 - RNA, 64 nt, Homo Sapiens
caaaugugagcaaaucuguuuuacuguuaacuucaauuaugaacuugaaauugugccacaugac

SEQ ID NO: 228893 - RNA, 64 nt, Homo Sapiens
cuggcuuacaaugagaugcuucaaaugaaaagggaauuaugaguaaaauugaacuuugaugggg

SEQ ID NO: 228894 - RNA, 64 nt, Homo Sapiens
acuauugcccauguuccccagggucagaaguucuaauuaugaugauagaggcuggguuguaagu

SEQ ID NO: 228895 - RNA, 64 nt, Homo Sapiens
uugccguaaugauucuauaaugccaucaugcagcaauuaugagaggcuaggucauccaaagaga

SEQ ID NO: 228896 - RNA, 64 nt, Homo Sapiens
acugauuacaaauacuuuccuauucauacuuuccaauuaugagauggacuguggguacugggag

SEQ ID NO: 228897 - RNA, 64 nt, Homo Sapiens
aauaauauuggggaccaaaucaaaugaaugauuaaauuaugaagcucauauccuuuugaaggua

SEQ ID NO: 228898 - RNA, 64 nt, Homo Sapiens
aaaacauuugauuaauaaaauaucuauuugaauaaauuaugagcuauccuuucaaacagcuauu

SEQ ID NO: 228899 - RNA, 64 nt, Homo Sapiens
ugugaauccagccucagacugagugaacuguaauaauuaugaauucauuacagaguccaggugg

SEQ ID NO: 228900 - RNA, 64 nt, Homo Sapiens
cuucuuguuaaauugggaggaaauuuaugauagcaauuaugaagauuguuuuaugacauucuuu

SEQ ID NO: 228901 - RNA, 64 nt, Homo Sapiens
ucucauucuguuuuaucagauaggaauucccaugaauuaugacucacaggaucagcaccuugua

SEQ ID NO: 228902 - RNA, 64 nt, Homo Sapiens
agauauggaggccagagcucuagauacuucauaaaauuaugaacuuaaacuaaugaaugacauu

SEQ ID NO: 228903 - RNA, 64 nt, Homo Sapiens
aauuacagaauuacucauuuccucuaaauuucaaaauuaugaagccagagauuuaagaagaaaa

SEQ ID NO: 228904 - RNA, 64 nt, Homo Sapiens
gcauauccuauuuccaggcaucuugguauuuuuuaauuaugaauuggcuaauucuguaacauag

SEQ ID NO: 228905 - RNA, 64 nt, Homo Sapiens
uaggcgguuuucauacauuuuucaccuuguacaaaauuaugaauucauuuuuccuccaggccga

SEQ ID NO: 228906 - RNA, 64 nt, Homo Sapiens
uucuacuuuuaauuucuguguguuggccauacugaauuaugagacuaacagaugucuacaauac

SEQ ID NO: 228907 - RNA, 64 nt, Homo Sapiens
acaaugaaaauuaucaagagauaauuuaccuuucaauuaugauaaauagaugugauugguugcc

SEQ ID NO: 228908 - RNA, 64 nt, Homo Sapiens
uucucauuugcuuuaaaaaauuuaaaaguguaaaaauuaugagagacuuuauucguuaacaaug

SEQ ID NO: 228909 - RNA, 64 nt, Homo Sapiens
aacuuguauguauacauauauacacauaacauccaauuaugacuggguaauaagugugaaaauu

SEQ ID NO: 228910 - RNA, 64 nt, Homo Sapiens
aaauaugcauaccuaaugaaguaugugaaaagaaaauuaugaaaguagccuauucucuuaaaaa

SEQ ID NO: 228911 - RNA, 64 nt, Homo Sapiens
uuuaguaucuaagguuagaaagagccuaaaaauaaauuaugacaauuucaauuuccaccauggg

SEQ ID NO: 228912 - RNA, 64 nt, Homo Sapiens
cucuauuuccugaaccuggaugaguugucacagaaauuaugaucccagugaguaccugcaaaaa

SEQ ID NO: 228913 - RNA, 64 nt, Homo Sapiens
uccagggggagaaggaagauuuaagacggaaguaaauuaugaugcggcagaccucuuagagucc

SEQ ID NO: 228914 - RNA, 64 nt, Homo Sapiens
acuaauagccaaaaaaccuugugcaacauaagaaaauuaugaaagagaggaaucuuguuuuugu

SEQ ID NO: 228915 - RNA, 64 nt, Homo Sapiens
aaggggaaauuuuugguuaacauaauacuaggaaaauuaugagauagaacuaggcauaaccuua

SEQ ID NO: 228916 - RNA, 64 nt, Homo Sapiens
aguagauauuaauuugauaccuucaugguaaugaaauuaugauggagcuguguuauaaauuccu

SEQ ID NO: 228917 - RNA, 64 nt, Homo Sapiens
caaauguccccuuuuuaccaauacuuuuucauuaaauuaugaaaacugcuaccuacugucagug

SEQ ID NO: 228918 - RNA, 64 nt, Homo Sapiens
auacagcugugcuaaucucacuagguguuugcaauguacaaauaauuuuguuucccaucucuuu

SEQ ID NO: 228919 - RNA, 64 nt, Homo Sapiens
aucgaagacacuaccauaugaaaauacuacacauuguacaaaauuggucacuucuuuacuauuu

SEQ ID NO: 228920 - RNA, 64 nt, Homo Sapiens
auaaaauaaucauauugcuauuuuuaguccucauuguacaaaaucuuuuuuuucugaaggcuug

SEQ ID NO: 228921 - RNA, 64 nt, Homo Sapiens
aaaugcacuuaaaccuguuuaugugauagucaguuguacaaagaaauuaauugccaguuuuuac

SEQ ID NO: 228922 - RNA, 64 nt, Homo Sapiens
uuuuuaaauuuuauauuauuucuugaauagcuuauguacaaaacaucagucagugcuggagaaa

SEQ ID NO: 228923 - RNA, 64 nt, Homo Sapiens
acuagcuaaaccagaaagguaaaccucauuguucuguacaaagucagggagacuccgcuguggg

SEQ ID NO: 228924 - RNA, 64 nt, Homo Sapiens
uacaagcguaccuaaugcacacuuuaucuuuuauuguacaaagaaauaguguacaaaauucuuu

SEQ ID NO: 228925 - RNA, 64 nt, Homo Sapiens
ugcacacuuuaucuuuuauuguacaaagaaauaguguacaaaauucuuugguuucuauggagua

SEQ ID NO: 228926 - RNA, 64 nt, Homo Sapiens
uggaaaacacaaaaguaacuuguuuaucucagucuguacaaaaacaguaaggaggcagaaagcc

SEQ ID NO: 228927 - RNA, 64 nt, Homo Sapiens
ccaugcuacuaguuucucugucuauucacacauauguacaaauacaugaacacagccugucugu

SEQ ID NO: 228928 - RNA, 64 nt, Homo Sapiens
uugucaugcuggauguuaacuaaauugugaacuuuguacaaauuuugcugugauacuucauuuu

SEQ ID NO: 228929 - RNA, 64 nt, Homo Sapiens
cuuacaguuuuccacaaggauuuauacuguucacuguacaaaaguauguauaucccagcggcac

SEQ ID NO: 228930 - RNA, 64 nt, Homo Sapiens
uauuuauuuauagaaauuuugaguauuacuuuuauguacaaagugagaggcaaugugaaagagg

SEQ ID NO: 228931 - RNA, 64 nt, Homo Sapiens
gcaaaaaaaguauuugauaucaagaggggauuuguguacaaaaggaucugaagcacaguaaacg

SEQ ID NO: 228932 - RNA, 64 nt, Homo Sapiens
gaacucuuuauaagguggcugacauaaauuaauuuguacaaaaaaugcacacuaaauuaaaugu

SEQ ID NO: 228933 - RNA, 64 nt, Homo Sapiens
aaguaaugguuugaacaccugagguuugaguagauguacaaaucgcugaauaaagaccgaugaa

SEQ ID NO: 228934 - RNA, 64 nt, Homo Sapiens
auaauaaugcaucucuaucuguacaaauuaaggguguacaaauuauaaauauauuuucaauugu

SEQ ID NO: 228935 - RNA, 64 nt, Homo Sapiens
aaggguguacaaauuauaauuauauuuucaauuguguacaaauucuuguaaaauuucacauaaa

SEQ ID NO: 228936 - RNA, 64 nt, Homo Sapiens
ugccucccacuccauaccccgccaaggaaaggcauguacaaaaauuaugcaauucaguguucca

SEQ ID NO: 228937 - RNA, 64 nt, Homo Sapiens
auuagugauguccuuaaaauguggucugccaaucuguacaaaaugguccuauuuuugugaagag

SEQ ID NO: 228938 - RNA, 64 nt, Homo Sapiens
cgagccguggaccccggccaggaaccacuccuguuguacaaagcucacacccaccgcccagguc

SEQ ID NO: 228939 - RNA, 64 nt, Homo Sapiens
guguaaauuguguuauuauguauauggguaaagauguacaaauauauguccucuuuguagcaga

SEQ ID NO: 228940 - RNA, 64 nt, Homo Sapiens
auuuuuuugaaaaaauacuuuuugacaguauuuuuguacaaaacuugaaagcuuuuuaggaaau

SEQ ID NO: 228941 - RNA, 64 nt, Homo Sapiens
gguuuuaaaaaaaauugcugguaaacuauaaacuuguacaaauuuuugagaacuuggaaacaaa

SEQ ID NO: 228942 - RNA, 64 nt, Homo Sapiens
uaagcauuaaucagauauuuguuuauauucgaguuguacaaaguuaauuucuaauauuuuuaaa

SEQ ID NO: 228943 - RNA, 64 nt, Homo Sapiens
guuauaugcacucaaauguugcaauucauccuaauguacaaaacaaagaggaaauggacagcau

SEQ ID NO: 228944 - RNA, 64 nt, Homo Sapiens
uuguacaagauaaguuccacaacuuuauaaaacauguacaaaaacuacuaugcauuaaaucuug

SEQ ID NO: 228945 - RNA, 64 nt, Homo Sapiens
aaaaacccuuauacucaccuguuaagguuguuaauguacaaaaauguaacuuaauauacuagau

SEQ ID NO: 228946 - RNA, 64 nt, Homo Sapiens
uugucauuuuuuccaguauucaauaaguagccuuuguacaaauuuaaaaccaaaaacuauucug

SEQ ID NO: 228947 - RNA, 64 nt, Homo Sapiens
uuuguuuuauuggaaaacuucauguuaacuagaguguacaaaaagucuguuuccugcugagcca

SEQ ID NO: 228948 - RNA, 64 nt, Homo Sapiens
caguauuuauugaacagcugucuaugccaggcucuguacaaagugauaggaguagagcugugaa

SEQ ID NO: 228949 - RNA, 64 nt, Homo Sapiens
uggaauuacuucucccauguugccauuuuugagguguacaaaggucaggccguacacaccucug

SEQ ID NO: 228950 - RNA, 64 nt, Homo Sapiens
ccccauauguauauaguauguuguacacugcacauguacaaagaaugucuucagaucaaagaaa

SEQ ID NO: 228951 - RNA, 64 nt, Homo Sapiens
cccuuaagaugaaaaguuccuuuucuuguguuaauguacaaagcuuuucuuuuggcacugacaa

SEQ ID NO: 228952 - RNA, 64 nt, Homo Sapiens
aaaguaccauuuuugugguuguuuggagcagggauguacaaaauaauuuuaauguauuaacuca

SEQ ID NO: 228953 - RNA, 64 nt, Homo Sapiens
uguaaaccuagaacugcggaaggacugggacuuuuguacaaauuucacauuuauuuuacagcaa

SEQ ID NO: 228954 - RNA, 64 nt, Homo Sapiens
uuuauuuugcauuggagaacuccuggagauaagcuguacaaauugaaucuauguggaaaugcuu

SEQ ID NO: 228955 - RNA, 64 nt, Homo Sapiens
cagcuuguaauguuguauacacauuuauucuguuuguacaaagguuuuccauucuauggagagg

SEQ ID NO: 228956 - RNA, 64 nt, Homo Sapiens
acuugaaauguaaauacuguuggcauacaucuuuuguacaaagaucaacaauauucuuccaaaa

SEQ ID NO: 228957 - RNA, 64 nt, Homo Sapiens
cugcccaccagccagaugugguuuagcuugcagcuguacaaaaaucuaaaaauguaaaaaccau

SEQ ID NO: 228958 - RNA, 64 nt, Homo Sapiens
aaaccacucuugaacuuugauuuguauaaacaauuguacaaaaagcgauuuuaccuuuguugaa

SEQ ID NO: 228959 - RNA, 64 nt, Homo Sapiens
guuuaaaaguuauuuaugcaugcagaacuauuuuuguacaaauuuuuuguuacaucuuacauua

SEQ ID NO: 228960 - RNA, 64 nt, Homo Sapiens
ucuguuuuuacaucauaauguguuguacaaaaucuguacaaaaauaaaagguuauuacgaauuu

SEQ ID NO: 228961 - RNA, 64 nt, Homo Sapiens
cuguacaaaaaucuguuuuuauuacgaauuuuguuguacaaaauucuaaaaaugauaaaagguu

SEQ ID NO: 228962 - RNA, 64 nt, Homo Sapiens
uaucuuucaggaaauuuuugcauguuuaauaauauguacaaauaauauugccuugauguuucua

SEQ ID NO: 228963 - RNA, 64 nt, Homo Sapiens
cacguuuuccauuaugaggaaacuuggacauuuauguacaaaaugaauugccuuugauaauucu

SEQ ID NO: 228964 - RNA, 64 nt, Homo Sapiens
cuauauaauaagguacgccugaaaagaaauauauuguacaaauuuguggguaaaauaugcaaac

SEQ ID NO: 228965 - RNA, 64 nt, Homo Sapiens
gacacuguuccuaacgagagcagagcauaccuguuguacaaacagcuguaaagaaauccuguuc

SEQ ID NO: 228966 - RNA, 64 nt, Homo Sapiens
cauauaauucucccugcaaggauguaugauaauauguacaaaguaauuccaacugaggaagcuc

SEQ ID NO: 228967 - RNA, 64 nt, Homo Sapiens
uucaaacagauacagcaugguccagagucccagauguacaaaaacagggauucaucacaaaucc

SEQ ID NO: 228968 - RNA, 64 nt, Homo Sapiens
acuaagaguauaauuggauuaauaauagcuuaauuguacaaauaacaaccgggugaguauaguc

SEQ ID NO: 228969 - RNA, 64 nt, Homo Sapiens
cuauguaguuagaaaguauaggggaugcuuaauguguacaaaaaaggggugugcgaggggaacu

SEQ ID NO: 228970 - RNA, 64 nt, Homo Sapiens
caaacauuaucuccuuuaguuuuucagaaaaugcaucccugauuucauucauuuccagcuugaa

SEQ ID NO: 228971 - RNA, 64 nt, Homo Sapiens
caaauuaacgaguauuauaaaaggauaauaaagcaucccugaagccaaagauccucaaagucau

SEQ ID NO: 228972 - RNA, 64 nt, Homo Sapiens
ugacauuauagccugggaaaugcagacaagagcaaucccugacacuguggcucccaauauaggg

SEQ ID NO: 228973 - RNA, 64 nt, Homo Sapiens
aaaggaggucuacaugaaagguacuguuccuuccaucccugauagugucuguggccacaauccu

SEQ ID NO: 228974 - RNA, 64 nt, Homo Sapiens
uauaaaaguaaguggccacuaacuauucucucauaucccugaaacauuuuucugaaaauucaug

SEQ ID NO: 228975 - RNA, 64 nt, Homo Sapiens
cuuccccccccgcaaauguuggagaaaaacucucaucccugaccaacagaccuaauuuggaugg

SEQ ID NO: 228976 - RNA, 64 nt, Homo Sapiens
gugugaaaucacacucuuccucugggcauccuggaucccugaauuauccccccccccaugaagu

SEQ ID NO: 228977 - RNA, 64 nt, Homo Sapiens
ggaaauaaaagucaccccguuggugagaggugcuaucccugagucucagugcaggaccagugga

SEQ ID NO: 228978 - RNA, 64 nt, Homo Sapiens
ccuuccaccugcucugcugacagcccaaucccugaucccugaucuccugcaaccaaacucccau

SEQ ID NO: 228979 - RNA, 64 nt, Homo Sapiens
ccugaucccuuccaccugcucucccaucagcccaaucccugaucaagcaaguccugcaaccaaa

SEQ ID NO: 228980 - RNA, 64 nt, Homo Sapiens
uuacaggcggcuauugcagacggcuaauuuaugcuuaacuuaggaagagauaaggcaagagcua

SEQ ID NO: 228981 - RNA, 64 nt, Homo Sapiens
gauuuuuuucaugugaucuuuuccaagcuucaacuuaacuuaacuacauuucucuguaugauga

SEQ ID NO: 228982 - RNA, 64 nt, Homo Sapiens
auuauauaguuuguacugagcuauugaagucccauuaacuuaaaguauauguuuucaaauugcc

SEQ ID NO: 228983 - RNA, 64 nt, Homo Sapiens
uuguuuuugacuuuggaagagaugaacuguguauuuaacuuaagcuauugcucuuaaaaccagg

SEQ ID NO: 228984 - RNA, 64 nt, Homo Sapiens
ccagccauuugacacccuuuaugaugucacaccuuuaacuuaaggagacggguaaaggaucuua

SEQ ID NO: 228985 - RNA, 64 nt, Homo Sapiens
auugacacugauuuggauuugugcacucuaauuuuuaacuuauugaugcucuauugugcaguag

SEQ ID NO: 228986 - RNA, 64 nt, Homo Sapiens
uaucgucuuugaaaauguuaaauugagaaaccuguuaacuuacauuuuaugaauuggcacauug

SEQ ID NO: 228987 - RNA, 64 nt, Homo Sapiens
aauuacuuuaugucuucuauaguuaauguauuuauuaacuuaauaauggcuuuucuuuugcaac

SEQ ID NO: 228988 - RNA, 64 nt, Homo Sapiens
guuuuuuauguagccaaagguuccaauauaagguuuaacuuacauugaagccaaaauucuaguu

SEQ ID NO: 228989 - RNA, 64 nt, Homo Sapiens
ggacugaauuuauugugaaguaacauuggcaaucuuaacuuauucauuuaacuuauuuuuauag

SEQ ID NO: 228990 - RNA, 64 nt, Homo Sapiens
ugugaaguaacauuggcaaucuuaacuuauucauuuaacuuauuuuuauagcuagauaaauauu

SEQ ID NO: 228991 - RNA, 64 nt, Homo Sapiens
acuuuguuuuuaagcaauaggucuggauacacauuuaacuuaggaggcuccuccaauuugccuc

SEQ ID NO: 228992 - RNA, 64 nt, Homo Sapiens
gacuucuuuuauguauacuggaguucaaagaucuuuaacuuaccuggcuuaauguaauuucaca

SEQ ID NO: 228993 - RNA, 64 nt, Homo Sapiens
aauaugaccaaaauauuuaaaaugcacaaugcuuuuaacuuaaaugugcuaacccuguuucugu

SEQ ID NO: 228994 - RNA, 64 nt, Homo Sapiens
gggacuaaguguuuaugggacaauuauguacuauuuaacuuaaauauauuuuguuuaauaggaa

SEQ ID NO: 228995 - RNA, 64 nt, Homo Sapiens
aguauuuaugaaaugguuaacuguaaaaugucuguuaacuuaauuucuuauuuaacuuaacauu

SEQ ID NO: 228996 - RNA, 64 nt, Homo Sapiens
auucuguaaaaugucuguuauacuuuuuucuuauuuaacuuaacuccuccaggcaaaauugaua

SEQ ID NO: 228997 - RNA, 64 nt, Homo Sapiens
guauuuaaacucuagacacaguuuuuauccuggauuaacuuagauaacuuuuguagcagugguu

SEQ ID NO: 228998 - RNA, 64 nt, Homo Sapiens
ugauuuacuauaaugauauauacaugcaagauauuuaacuuaauaucuuagacaagaguucugg

SEQ ID NO: 228999 - RNA, 64 nt, Homo Sapiens
gggugggggcgggggugagguugacugcauuaacuuaacuuacgauauugaucccaaaguuacu

SEQ ID NO: 229000 - RNA, 64 nt, Homo Sapiens
uuacggggugggggcggggguuacuuugacugcauuaacuuaacugcuaauauugaucccaaag

SEQ ID NO: 229001 - RNA, 64 nt, Homo Sapiens
cuguagguguuauguauuccuagcuugaaauugauuaacuuauaaguguuguauuucuauacag

SEQ ID NO: 229002 - RNA, 64 nt, Homo Sapiens
gcuagauaauaggguuuucaugucugucucuaauuuaacuuauuuagauucaugcaaguggagc

SEQ ID NO: 229003 - RNA, 64 nt, Homo Sapiens
cacagaccccuuauaauuacaagcagcuuuuaguuuaacuuauugccuaauuuguagauuguga

SEQ ID NO: 229004 - RNA, 64 nt, Homo Sapiens
auuagcucuaaagauuucaaucuuagacuagucauuaacuuaugguuuuccccaccaaguggcc

SEQ ID NO: 229005 - RNA, 64 nt, Homo Sapiens
ucaagaucaggaaaacacccuuuugcuagugugcuuaacuuauuuauuucuucuaggaaacaau

SEQ ID NO: 229006 - RNA, 64 nt, Homo Sapiens
aacaucauaucauauaggauaacaaaggaggaaguuaacuuaauucaccucagacuucagccua

SEQ ID NO: 229007 - RNA, 64 nt, Homo Sapiens
agggaguuacucagccuaauugagcccuauuauuuuaacuuaacaaaauaaauacagaaguacc

SEQ ID NO: 229008 - RNA, 64 nt, Homo Sapiens
uugauuggcauaugguaauagagcaaccauagccuuaacuuacagaccugugaaauaaagggca

SEQ ID NO: 229009 - RNA, 64 nt, Homo Sapiens
gagcaaauuuuuauuacuacgaaauuaauuuuaauuaacuuaauuguuuuuugaagcacuuuga

SEQ ID NO: 229010 - RNA, 64 nt, Homo Sapiens
auaguuuaugaaauaaaaacaaaaucuauucacuuuaacuuauaaugcuacaaggaauauuaaa

SEQ ID NO: 229011 - RNA, 64 nt, Homo Sapiens
uguuuuguuucguuuucuccuuaauagaaaaauguuaacuuacugggaauagcuacucagccuu

SEQ ID NO: 229012 - RNA, 64 nt, Homo Sapiens
uacaaguaaagacuuauacagauagauuuuuguuuuaacuuacaauccguuuuuuccucuuuuu

SEQ ID NO: 229013 - RNA, 64 nt, Homo Sapiens
gaacugaacuuucugaaaacuagaaaugcaggccuuaacuuacuuguuuuaucaucagugcuuu

SEQ ID NO: 229014 - RNA, 64 nt, Homo Sapiens
uugacucuuaauguguauauuaucacuugaauuauuaacuuaaucaaaucaauuucagugccuu

SEQ ID NO: 229015 - RNA, 64 nt, Homo Sapiens
uuuaacagcauuuuuuauaaugaauguaaacauuuuaacuuaaugguacuuaaaauaauuuaaa

SEQ ID NO: 229016 - RNA, 64 nt, Homo Sapiens
uuaaugguacuuaaaauaauuuaaaagaaaaauguuaacuuagacauucuuaugcuucuuuuac

SEQ ID NO: 229017 - RNA, 62 nt, Homo Sapiens
aauguuauuccaacauuagauucacaguuauuuauuaacuuaagacugaacauaugguuaua

SEQ ID NO: 229018 - RNA, 64 nt, Homo Sapiens
caaagaagugcaaaugucaagucuagucuagccguuaacuuagacaguuucugucaucuuaacu

SEQ ID NO: 229019 - RNA, 64 nt, Homo Sapiens
cuuuuuauccuucuguuuuucuuuuauccuuccuuuaacuuaauuucaggagcaguugacuaaa

SEQ ID NO: 229020 - RNA, 64 nt, Homo Sapiens
cuccuuuccuuccccaccaauuucuuuaucuugcuuaacuuaucugcaugaaguuucugugagc

SEQ ID NO: 229021 - RNA, 64 nt, Homo Sapiens
uucuaccuggauaaacuucuuccaauuuaugcuuuuaacuuauuguuccuuccucuuucuccuc

SEQ ID NO: 229022 - RNA, 64 nt, Homo Sapiens
aacagcuuuuaaaacaacuuuuuauaagguucacuuaacuuaaaaguccauuuuuucuuauguc

SEQ ID NO: 229023 - RNA, 64 nt, Homo Sapiens
uauggguaaauuuacauuggacaaaguccuuguuuuaacuuagguucaugagauacuguguuac

SEQ ID NO: 229024 - RNA, 64 nt, Homo Sapiens
aagaguauuugauaaacucagggggaaaacuggauuaacuuaauugaauugcccgaacuucuuu

SEQ ID NO: 229025 - RNA, 64 nt, Homo Sapiens
cccuguaacuugccaccugcaguucuuagggcuguggggucagauggugguggugagaggccuu

SEQ ID NO: 229026 - RNA, 64 nt, Homo Sapiens
cugugcuuuugaugccuuuggagucaaaggcagguggggucaccugaugagcuaagauccagcc

SEQ ID NO: 229027 - RNA, 64 nt, Homo Sapiens
cucggcaggagucccacuccggcagccuugaaguuggggucagcggacacucccaucagaacuu

SEQ ID NO: 229028 - RNA, 64 nt, Homo Sapiens
cucagggcaggagucccacuggcagccccaaaacuggggucagcggacacucccaucagaaccu

SEQ ID NO: 229029 - RNA, 64 nt, Homo Sapiens
aauguaggaacugguauccacuguuuuaugguaguggggucagggcuuugcaacaggaaacauc

SEQ ID NO: 229030 - RNA, 64 nt, Homo Sapiens
gcagcaggacugaucaaguggccccuccuggagauggggucaagcucuacucccucuggccaua

SEQ ID NO: 229031 - RNA, 64 nt, Homo Sapiens
ggccagagugcaggggagggagagugggaacagguggggucaggcuuuguugauaaauugccaa

SEQ ID NO: 229032 - RNA, 64 nt, Homo Sapiens
gaugccuagcuggacacagcuuauucaugccauuuggggucacagcucuuagcaaccugcccuu

SEQ ID NO: 229033 - RNA, 64 nt, Homo Sapiens
uggucagaaggggcugagcuggggcugaaguuucuggggucacaagccucacaaccuuucugcu

SEQ ID NO: 229034 - RNA, 64 nt, Homo Sapiens
gcccacagcuagguggggacggcccacagcuagguggggucacgucagcacagcauggggucac

SEQ ID NO: 229035 - RNA, 64 nt, Homo Sapiens
gcccacagcuagguggggucucaucagcacagcauggggucacguucuguguagcuucucauuu

SEQ ID NO: 229036 - RNA, 64 nt, Homo Sapiens
cuuacaccgcacucagggagaccacuucucaggauggggucagauggagagaccucuagggaga

SEQ ID NO: 229037 - RNA, 64 nt, Homo Sapiens
uccagguagauuuccacaauaugcaaaguggugguggggucaagacagaugacaccagcacuuu

SEQ ID NO: 229038 - RNA, 64 nt, Homo Sapiens
gaacauuuuggggcaguuuacaacuuugugucuuuggggucacacccuggacccagauaagcag

SEQ ID NO: 229039 - RNA, 64 nt, Homo Sapiens
gucggcugcgcauguccagaccuccugccguggcuggggucauggcccagacugauccucgagg

SEQ ID NO: 229040 - RNA, 64 nt, Homo Sapiens
acagcacagccccuauugcguggcugcugguguguggggucaguuccagcagaugaauguguca

SEQ ID NO: 229041 - RNA, 64 nt, Homo Sapiens
uaacccccccucccccaccaacauccugcagggauggggucagugguuccaccuucacaggcca

SEQ ID NO: 229042 - RNA, 64 nt, Homo Sapiens
uucacacagaccaccccggaggacacguggaugauggggucagagaucacugagcugccccuca

SEQ ID NO: 229043 - RNA, 64 nt, Homo Sapiens
agcugccccucaagggggccuggaacccgggugcuggggucaugcugccuccguggcuccaagg

SEQ ID NO: 229044 - RNA, 64 nt, Homo Sapiens
aaaggggugaccuuguuccuuagauguccugccuuggggucacucucuuucucuauaacuggga

SEQ ID NO: 229045 - RNA, 64 nt, Homo Sapiens
accucgucagaccagguucgcccaucuagcuacuuggggucaggaccagcaaguauugagggua

SEQ ID NO: 229046 - RNA, 64 nt, Homo Sapiens
gggcuugauagaccuggcacaagguggcccaguguggggucauacuagcaggaagacugaaagc

SEQ ID NO: 229047 - RNA, 64 nt, Homo Sapiens
ccauaggggcccuguucucucuggggucccacacuggggucaugagagcuaguuaguacucagc

SEQ ID NO: 229048 - RNA, 64 nt, Homo Sapiens
guaccucagugaagagugcaggcaaguagagugauggggucaguguccauccaguuuacgcuga

SEQ ID NO: 229049 - RNA, 64 nt, Homo Sapiens
ucucuacaaauuuuucugugaguacuugauguauuggggucaaaaaaggucuuggugccucugc

SEQ ID NO: 229050 - RNA, 64 nt, Homo Sapiens
ugcuagaaaaauuguuaagguaggaguucuauuuuggggucaaaggagacuguguuugguccug

SEQ ID NO: 229051 - RNA, 64 nt, Homo Sapiens
agauucuccuggccaccaagaagaggagggagaguggggucagaucuuggggucuucaggacug

SEQ ID NO: 229052 - RNA, 64 nt, Homo Sapiens
ggucucauucuggggcuaaaccagcccuccugcuuggggucacucccucucuucccuccagauc

SEQ ID NO: 229053 - RNA, 64 nt, Homo Sapiens
uugacaggagguuggagggaugcugccccugccuuggggucaggcaggggcccugcagcucuca

SEQ ID NO: 229054 - RNA, 64 nt, Homo Sapiens
ccgggcagagcacagcggggcaggcaggcuggccuggggucaggggaggcaguaggacaaggug

SEQ ID NO: 229055 - RNA, 64 nt, Homo Sapiens
aaaagcaccacuguucuguucauuuccuagcuguucuaauuaagaaaacuauuaagaugagcaa

SEQ ID NO: 229056 - RNA, 64 nt, Homo Sapiens
auguuuauugacaggucuuuucaaauaaugcuuuucuaauuaauagccaaagauuucauaucua

SEQ ID NO: 229057 - RNA, 64 nt, Homo Sapiens
auuucuuuuaucuugauaacuccuagugagggaaucuaauuaagauuucaugcuguucuuugua

SEQ ID NO: 229058 - RNA, 64 nt, Homo Sapiens
uauuguuuauuuccaaggcauguauuauucaauuucuaauuaaaauauaucagggcuuauauuu

SEQ ID NO: 229059 - RNA, 64 nt, Homo Sapiens
gaagauuacuuucauucuagaagaauguaguuucucuaauuauuugaaauguucauuuagccuu

SEQ ID NO: 229060 - RNA, 64 nt, Homo Sapiens
guugauuggugaaaugcaggguauguggaaguuaucuaauuaaccucaguuguauaugaauaac

SEQ ID NO: 229061 - RNA, 64 nt, Homo Sapiens
aaauguaguuauuuuauccuguuagaacaaaaauucuaauuaaaauaguuaacuugaagaguag

SEQ ID NO: 229062 - RNA, 64 nt, Homo Sapiens
aaguuauguuucuuugcuuacuucauuuuuucccucuaauuauuuaagauuggaacaaaaguau

SEQ ID NO: 229063 - RNA, 64 nt, Homo Sapiens
uccaacuguacuuuuaaggcaugugaacuuaaacucuaauuaaucuaaaacaaauaguuuauaa

SEQ ID NO: 229064 - RNA, 64 nt, Homo Sapiens
uugcaguugggcaacagagauuuuuuucauuauaucuaauuauuucauuuuuuucuccucuucu

SEQ ID NO: 229065 - RNA, 64 nt, Homo Sapiens
uaaauuaaaagagcgguuuggauuucauuguucaucuaauuaaauaaaugcugaaaaggaaaac

SEQ ID NO: 229066 - RNA, 64 nt, Homo Sapiens
guuacuuuccuugugaugaacugucauaaaaggcucuaauuaugaugaaaaacaaauuuucuca

SEQ ID NO: 229067 - RNA, 64 nt, Homo Sapiens
auuucccuagucagugcucuuugccuuacaaggcucuaauuauguguccuugucaugaaaacac

SEQ ID NO: 229068 - RNA, 64 nt, Homo Sapiens
gggaagaaaaagugguuuaagcugauaaagacauacccgagacuuauuaguccguuuucacgcu

SEQ ID NO: 229069 - RNA, 64 nt, Homo Sapiens
gggaagaaaaagagguuuacgcugauaaagacguacccgagacuuauuagucuguauuaaugcu

SEQ ID NO: 229070 - RNA, 64 nt, Homo Sapiens
gcagcugugaugguuucagagcucagacugaucaggcaucaagcuacccucaagaguuucuggg

SEQ ID NO: 229071 - RNA, 64 nt, Homo Sapiens
gaguauaaauccugugcauagauuccucuagaaaggcaucaaaaggcucaacagacugaauggc

SEQ ID NO: 229072 - RNA, 64 nt, Homo Sapiens
acagcagaacagaaaguucaacugcuucguaauuggcaucaacuucauggaaagaaagaagcgu

SEQ ID NO: 229073 - RNA, 64 nt, Homo Sapiens
uuuuacuggcucaaaacuaccuacuucuuucucaggcaucaaaagcauuuugagcaggagagua

SEQ ID NO: 229074 - RNA, 64 nt, Homo Sapiens
acaaaaucacugcuguuucuagucaacagacacuggcaucaauuggcaucugauaugcagaguu

SEQ ID NO: 229075 - RNA, 59 nt, Homo Sapiens
ucauuuuauggauuucugucucugcuccaggcaucaagcggcaggaagacaagcuauga

SEQ ID NO: 229076 - RNA, 64 nt, Homo Sapiens
ccggaacaucacaggguuuauaagcuuuuacccaggcaucaaaaacaaauguaacgugcaugcu

SEQ ID NO: 229077 - RNA, 64 nt, Homo Sapiens
acuuuuuugaugaaaccauaccaaagucucacuaggcaucaaaaugauagagauuuuccgcagg

SEQ ID NO: 229078 - RNA, 64 nt, Homo Sapiens
gacaugucccuuuguguuuauaaauacuacuaaggugaccuaguuguucuccuuguugcaauaa

SEQ ID NO: 229079 - RNA, 64 nt, Homo Sapiens
uuuccacccccuccaauuugugaaaaacagagcagugaccuagcuguugcaucaucaugacugc

SEQ ID NO: 229080 - RNA, 64 nt, Homo Sapiens; identical to SEQ ID NO: 193740

SEQ ID NO: 229081 - RNA, 64 nt, Homo Sapiens; identical to SEQ ID NO: 193741

SEQ ID NO: 229082 - RNA, 64 nt, Homo Sapiens; identical to SEQ ID NO: 193742

SEQ ID NO: 229083 - RNA, 64 nt, Homo Sapiens; identical to SEQ ID NO: 193743

SEQ ID NO: 229084 - RNA, 64 nt, Homo Sapiens; identical to SEQ ID NO: 193744

SEQ ID NO: 229085 - RNA, 64 nt, Homo Sapiens; identical to SEQ ID NO: 193745

SEQ ID NO: 229086 - RNA, 64 nt, Homo Sapiens
uucccccuuccuuuggugccucacugggggcuuugggccgaaucccccagggaaucagggacca

SEQ ID NO: 229087 - RNA, 64 nt, Homo Sapiens
ccgguccuuccugggcaaaucuaagccuuggccagggccgaaguuuaggccccugucuuguuca

SEQ ID NO: 229088 - RNA, 64 nt, Homo Sapiens
cuccauuuuuauuucuucgugaacauagaguuuggggccgaaaauguuuuuaaaguauguguuu

SEQ ID NO: 229089 - RNA, 64 nt, Homo Sapiens
gggaguggaauauuugacauuugggggaugguuugggccgaauggugggguggggguguauucc

SEQ ID NO: 229090 - RNA, 64 nt, Homo Sapiens
gcgauccgagucgcggucuccggggugccugggagggccgaaccacuggugagggcguggggag

SEQ ID NO: 229091 - RNA, 62 nt, Homo Sapiens
agucccaagagccuucgugaggccgguacuuggggccgaaaaacuguggccugcagaagucc

SEQ ID NO: 229092 - RNA, 64 nt, Homo Sapiens
cuuguaauuggaauacauggacucucuaaggaaggggccgaacggcaugagugcugagauaugg

SEQ ID NO: 229093 - RNA, 64 nt, Homo Sapiens
aaaaaaccaucaccucccaucauacucuguacuagggccgaaguauggaauccagcuucaagag

SEQ ID NO: 229094 - RNA, 64 nt, Homo Sapiens
ccuaacuccgggaggcucccgaguccugagggcggggccgaacauagaauuugaguuuuagcaa

SEQ ID NO: 229095 - RNA, 64 nt, Homo Sapiens
uuggagauguacacauacauacccuauaccaagagggccgaaacucuucaccuugauguauguu

SEQ ID NO: 229096 - RNA, 64 nt, Homo Sapiens
cuccgccccugcaccagucacaugcacuggacgagggccgaaacuccugucugcuaucgagccc

SEQ ID NO: 229097 - RNA, 64 nt, Homo Sapiens
guugagaaauggacauucuucaccagguacgcaagggccgaauacaguuccuaggcaacuuguu

SEQ ID NO: 229098 - RNA, 64 nt, Homo Sapiens
gaugacuauaaaauguucaucauauuucacaacagggccgaagaucugaauugaacuggaauca

SEQ ID NO: 229099 - RNA, 64 nt, Homo Sapiens
cccuucuucccuggcugccaaaaggccucuguaugggccgaagaugcugcgagcugcugcgugg

SEQ ID NO: 229100 - RNA, 64 nt, Homo Sapiens
aacaguccauugaaagggagaggaauguuugcuggggccgaaagccuccucaaaccuaccacuc

SEQ ID NO: 229101 - RNA, 64 nt, Homo Sapiens
gaacaagggguccagcuugcuccguucuccucacgggccgaacggguuccccuuggccgccagu

SEQ ID NO: 229102 - RNA, 64 nt, Homo Sapiens
ucuucccuugaagccacuggcgcccaggagcggugggccgaagacgugcccuacccuaccacaa

SEQ ID NO: 229103 - RNA, 64 nt, Homo Sapiens
agugugcugagcaaaaagaacuguguauuagacagggccgaacucccaagccugucuaagguua

SEQ ID NO: 229104 - RNA, 64 nt, Homo Sapiens
gccccugcccugccucugagaacuggcugucuuggggccgaacagcgcccuggcaaaggcugac

SEQ ID NO: 229105 - RNA, 61 nt, Homo Sapiens
ugcgggauaucgaccugugaggaugccaguugggccgaaagagagagacgcguccauaauc

SEQ ID NO: 229106 - RNA, 64 nt, Homo Sapiens
ucuaguuuaguaaaagaugugcaaaggccagagagggccgaaaaugaagcuuucuugcuacaca

SEQ ID NO: 229107 - RNA, 64 nt, Homo Sapiens
cugacuaguguggccucacugauugguguagggagggccgaacgacaacuaggagcccagcugg

SEQ ID NO: 229108 - RNA, 64 nt, Homo Sapiens
cuucccugggcucccacugcauuaggcugcacuggggccgaacgcuacccaucccucccuccca

SEQ ID NO: 229109 - RNA, 64 nt, Homo Sapiens
gcucgcagcuggagugagaggcagguggcggccggggccgaagccagcagugucuaaacccccg

SEQ ID NO: 229110 - RNA, 64 nt, Homo Sapiens
cccucccugucaaagcugucugaggagccaggccgggccgaaucgucucaagggcuagcauccc

SEQ ID NO: 229111 - RNA, 64 nt, Homo Sapiens
guugcucugcccgccgcgcuugcgaggauggcuugggccgaaggcaggaagcuucuguguaagc

SEQ ID NO: 229112 - RNA, 64 nt, Homo Sapiens
acgucccaccacacagugccuaggggcagugucugggccgaagcgugggguuggagcaugccuu

SEQ ID NO: 229113 - RNA, 64 nt, Homo Sapiens
ggaggugguguacauaggaaggccacugaccucagggccgaagguuaccccaucacccgacucu

SEQ ID NO: 229114 - RNA, 64 nt, Homo Sapiens
cggaguuggguuugccuuaucccuggggccagcggggccgaaaguaaggucccgcccccaaaga

SEQ ID NO: 229115 - RNA, 64 nt, Homo Sapiens
ugaccuuuagcucccuccugcacccauggugccagggccgaagcuccucaccccuccucugacc

SEQ ID NO: 229116 - RNA, 64 nt, Homo Sapiens
cccguguccccccaggugcuggaggcagacucgagggccgaauuguuucuaguuaggccacgcu

SEQ ID NO: 229117 - RNA, 64 nt, Homo Sapiens
uugauggcaggaggguccuuguggacguggagaggggccgaaccgugaagggcuggaggccccg

SEQ ID NO: 229118 - RNA, 64 nt, Homo Sapiens
ggaucccgggaaagcgauggacagacagacgauggggccgaagccccaagcugggcacaaagua

SEQ ID NO: 229119 - RNA, 64 nt, Homo Sapiens
ugauaccugccugggacagcgggcacucaggugugggccgaacccccagcccugcccagaguau

SEQ ID NO: 229120 - RNA, 64 nt, Homo Sapiens; identical to SEQ ID NO: 158491

SEQ ID NO: 229121 - RNA, 64 nt, Homo Sapiens; identical to SEQ ID NO: 158492

SEQ ID NO: 229122 - RNA, 64 nt, Homo Sapiens; identical to SEQ ID NO: 158493

SEQ ID NO: 229123 - RNA, 64 nt, Homo Sapiens; identical to SEQ ID NO: 158494

SEQ ID NO: 229124 - RNA, 64 nt, Homo Sapiens; identical to SEQ ID NO: 158495

SEQ ID NO: 229125 - RNA, 64 nt, Homo Sapiens; identical to SEQ ID NO: 158496

SEQ ID NO: 229126 - RNA, 64 nt, Homo Sapiens; identical to SEQ ID NO: 158497

SEQ ID NO: 229127 - RNA, 64 nt, Homo Sapiens; identical to SEQ ID NO: 158498

SEQ ID NO: 229128 - RNA, 64 nt, Homo Sapiens; identical to SEQ ID NO: 158499

SEQ ID NO: 229129 - RNA, 64 nt, Homo Sapiens; identical to SEQ ID NO: 158500

SEQ ID NO: 229130 - RNA, 64 nt, Homo Sapiens; identical to SEQ ID NO: 158501

SEQ ID NO: 229131 - RNA, 64 nt, Homo Sapiens; identical to SEQ ID NO: 158502

SEQ ID NO: 229132 - RNA, 64 nt, Homo Sapiens; identical to SEQ ID NO: 158503

SEQ ID NO: 229133 - RNA, 64 nt, Homo Sapiens; identical to SEQ ID NO: 158504

SEQ ID NO: 229134 - RNA, 64 nt, Homo Sapiens; identical to SEQ ID NO: 158505

SEQ ID NO: 229135 - RNA, 64 nt, Homo Sapiens; identical to SEQ ID NO: 158506

SEQ ID NO: 229136 - RNA, 64 nt, Homo Sapiens; identical to SEQ ID NO: 158507

SEQ ID NO: 229137 - RNA, 64 nt, Homo Sapiens; identical to SEQ ID NO: 158508

SEQ ID NO: 229138 - RNA, 64 nt, Homo Sapiens; identical to SEQ ID NO: 158509

SEQ ID NO: 229139 - RNA, 64 nt, Homo Sapiens; identical to SEQ ID NO: 158510

SEQ ID NO: 229140 - RNA, 64 nt, Homo Sapiens; identical to SEQ ID NO: 158511

SEQ ID NO: 229141 - RNA, 64 nt, Homo Sapiens; identical to SEQ ID NO: 158512

SEQ ID NO: 229142 - RNA, 64 nt, Homo Sapiens; identical to SEQ ID NO: 158513

SEQ ID NO: 229143 - RNA, 64 nt, Homo Sapiens; identical to SEQ ID NO: 158514

SEQ ID NO: 229144 - RNA, 64 nt, Homo Sapiens; identical to SEQ ID NO: 158515

SEQ ID NO: 229145 - RNA, 64 nt, Homo Sapiens; identical to SEQ ID NO: 158516

SEQ ID NO: 229146 - RNA, 64 nt, Homo Sapiens; identical to SEQ ID NO: 158517

SEQ ID NO: 229147 - RNA, 64 nt, Homo Sapiens; identical to SEQ ID NO: 158518

SEQ ID NO: 229148 - RNA, 64 nt, Homo Sapiens; identical to SEQ ID NO: 158519

SEQ ID NO: 229149 - RNA, 64 nt, Homo Sapiens; identical to SEQ ID NO: 158520

SEQ ID NO: 229150 - RNA, 64 nt, Homo Sapiens; identical to SEQ ID NO: 158521

SEQ ID NO: 229151 - RNA, 64 nt, Homo Sapiens; identical to SEQ ID NO: 158522

SEQ ID NO: 229152 - RNA, 64 nt, Homo Sapiens; identical to SEQ ID NO: 158523

SEQ ID NO: 229153 - RNA, 64 nt, Homo Sapiens; identical to SEQ ID NO: 158524

SEQ ID NO: 229154 - RNA, 64 nt, Homo Sapiens; identical to SEQ ID NO: 158525

SEQ ID NO: 229155 - RNA, 64 nt, Homo Sapiens; identical to SEQ ID NO: 158526

SEQ ID NO: 229156 - RNA, 64 nt, Homo Sapiens
auuucucuucugcacagagcauaaugugaaguuuuauaccuacuuuuaaaauucugcuuuccag

SEQ ID NO: 229157 - RNA, 64 nt, Homo Sapiens
gaauauuaacaugaaggauaaaccaacuuauuuguauaccuaaggcaggcauuuggaucaguaa

SEQ ID NO: 229158 - RNA, 64 nt, Homo Sapiens
ucauaacccaacgcucauucaacaucaaagaauuuauaccuaagagaacuuauuuggguguagu

SEQ ID NO: 229159 - RNA, 64 nt, Homo Sapiens
uacagauguuggcucaaguucagggccaccaucauauaccuaacaagaguucaugauucuuuag

SEQ ID NO: 229160 - RNA, 64 nt, Homo Sapiens
auguuaaccauauaguuuuuuuccuugcuuguuauauaccuaaacauuuuuucucauccuugca

SEQ ID NO: 229161 - RNA, 62 nt, Homo Sapiens
gcaaggccacagaaaagagcagcaagaaggccuauaccuauuaagaaaaggggcuuuucuaa

SEQ ID NO: 229162 - RNA, 64 nt, Homo Sapiens
aguaauucugucuuuccuaaaauucagaacauuuuauaccuaaauaagcacuauagaauuugca

SEQ ID NO: 229163 - RNA, 64 nt, Homo Sapiens
uuaucuaguuaccuuucauuuucuuaagcaaauauauaccuauuaaagaaauauuuuuaaaaug

SEQ ID NO: 229164 - RNA, 64 nt, Homo Sapiens
auggaauagguaagagaacccagaaauaaaggcauauaccuacaaccaugugauccucaacaaa

SEQ ID NO: 229165 - RNA, 64 nt, Homo Sapiens
cauagcauucaacccagcaucccauuacuggguguauaccuaaaggaauauaaucauuccacca

SEQ ID NO: 229166 - RNA, 64 nt, Homo Sapiens
gaaaacuaguuguugggaaaucuguguauguauauauaccuaugaccuauugaaauucucucac

SEQ ID NO: 229167 - RNA, 64 nt, Homo Sapiens
gaaauucucucacucuguguauauaguagauauauauaccuauuuguguguguauaccugacau

SEQ ID NO: 229168 - RNA, 64 nt, Homo Sapiens
uaaggcaucauuuucgagggucuaaaauuaucugguaaaacaaaugaaauuaagugauccaaag

SEQ ID NO: 229169 - RNA, 64 nt, Homo Sapiens
ucccuguuucaaauguguucagaggaaauagaauguaaaacaucacaaaaaaaauugcaguaca

SEQ ID NO: 229170 - RNA, 64 nt, Homo Sapiens
caucuuuccuucggguuggcaaaauauuuuaaagguaaaacaugcuggugaaccagggguguug

SEQ ID NO: 229171 - RNA, 64 nt, Homo Sapiens
uuuauuuaugacagugaacauucugauuuuacauguaaaacaagaaaaguugaagaagauaugu

SEQ ID NO: 229172 - RNA, 64 nt, Homo Sapiens
augauauuagaaaauguuuugguuuauacugguuguaaaacagaaucagaucuugauucuucug

SEQ ID NO: 229173 - RNA, 64 nt, Homo Sapiens
uuuaauuuuauuugacuuuauugugaggaaaaaaguaaaacaugcuuccguaauuuuuauguuc

SEQ ID NO: 229174 - RNA, 64 nt, Homo Sapiens
agcugaguccgcgacagaaauuugcccuaugugaguaaaacauacuuugggagaagaacuuggu

SEQ ID NO: 229175 - RNA, 64 nt, Homo Sapiens
cuggguuuucuuuuugacaauucuuggacuugagguaaaacaaggaggauuguggccggauuuc

SEQ ID NO: 229176 - RNA, 64 nt, Homo Sapiens
uguuagcuccacgagugcaaacugcagucaccaaguaaaacaacaaauagcuaccacuuuugcu

SEQ ID NO: 229177 - RNA, 64 nt, Homo Sapiens
uguguuuuuacuuuuuauucccguuaaaacugauguaaaacaggauaaaggcuuguuauaguca

SEQ ID NO: 229178 - RNA, 64 nt, Homo Sapiens
augcagguguaaugauuauaaaaggccuguaccuguaaaacaaaagagcuaauguggguuacca

SEQ ID NO: 229179 - RNA, 64 nt, Homo Sapiens
uauucaaauuccguauaccaauguacucuguugaguaaaacacagcugcauucuuguugguagc

SEQ ID NO: 229180 - RNA, 64 nt, Homo Sapiens
uuuccaccaguauuuucccuaaagcugcuuuuggguaaaacaggaaccugguuaaacagauauu

SEQ ID NO: 229181 - RNA, 64 nt, Homo Sapiens
agcaacuuugggugaguuuuacguacaacucuuuguaaaacaaauuuuagaaauaagauaauca

SEQ ID NO: 229182 - RNA, 64 nt, Homo Sapiens
auuuugcuauucugcccuuguaaucggugucccuguaaaacaauccccacagauuacuuucaga

SEQ ID NO: 229183 - RNA, 64 nt, Homo Sapiens
gaugugguucauagauauaugaauacguaucuguguaaaacagugagugugcaguguguaaaua

SEQ ID NO: 229184 - RNA, 64 nt, Homo Sapiens
cuuuuauuuccaaauuguuacaaagaaauacauaguaaaacaacaacuuuguagugaugacuac

SEQ ID NO: 229185 - RNA, 64 nt, Homo Sapiens
uggcccaaaguaaugaaucacauccaugucucucguaaaacagauauuuucauuguguuauuga

SEQ ID NO: 229186 - RNA, 54 nt, Homo Sapiens
auacuagagaaaaacuuuaaaaauguaaaacauggagcagauuuuuuacuuguu

SEQ ID NO: 229187 - RNA, 64 nt, Homo Sapiens
uaucagcauuuuucauggaaguuuaaugccaaauguaaaacacaugaaaauuuuuaaaaauaug

SEQ ID NO: 229188 - RNA, 64 nt, Homo Sapiens
gauaugcuaagaagaacaaagugcccagcaucacguaaaacaucagccaucuuagguccccgag

SEQ ID NO: 229189 - RNA, 64 nt, Homo Sapiens
gaaugagccaccuuagcaggaccacucuauucagguaaaacaauaauuugaaccuucaccaucc

SEQ ID NO: 229190 - RNA, 64 nt, Homo Sapiens; identical to SEQ ID NO: 137738

SEQ ID NO: 229191 - RNA, 64 nt, Homo Sapiens; identical to SEQ ID NO: 137739

SEQ ID NO: 229192 - RNA, 64 nt, Homo Sapiens; identical to SEQ ID NO: 137740

SEQ ID NO: 229193 - RNA, 64 nt, Homo Sapiens; identical to SEQ ID NO: 137741

SEQ ID NO: 229194 - RNA, 64 nt, Homo Sapiens; identical to SEQ ID NO: 137742

SEQ ID NO: 229195 - RNA, 64 nt, Homo Sapiens; identical to SEQ ID NO: 137743

SEQ ID NO: 229196 - RNA, 64 nt, Homo Sapiens; identical to SEQ ID NO: 137744

SEQ ID NO: 229197 - RNA, 64 nt, Homo Sapiens; identical to SEQ ID NO: 137745

SEQ ID NO: 229198 - RNA, 64 nt, Homo Sapiens; identical to SEQ ID NO: 137746

SEQ ID NO: 229199 - RNA, 64 nt, Homo Sapiens; identical to SEQ ID NO: 137747

SEQ ID NO: 229200 - RNA, 64 nt, Homo Sapiens; identical to SEQ ID NO: 137748

SEQ ID NO: 229201 - RNA, 64 nt, Homo Sapiens; identical to SEQ ID NO: 137749

SEQ ID NO: 229202 - RNA, 64 nt, Homo Sapiens; identical to SEQ ID NO: 137750

SEQ ID NO: 229203 - RNA, 64 nt, Homo Sapiens; identical to SEQ ID NO: 137751

SEQ ID NO: 229204 - RNA, 64 nt, Homo Sapiens; identical to SEQ ID NO: 137752

SEQ ID NO: 229205 - RNA, 64 nt, Homo Sapiens; identical to SEQ ID NO: 137753

SEQ ID NO: 229206 - RNA, 64 nt, Homo Sapiens; identical to SEQ ID NO: 137754

SEQ ID NO: 229207 - RNA, 64 nt, Homo Sapiens; identical to SEQ ID NO: 137755

SEQ ID NO: 229208 - RNA, 64 nt, Homo Sapiens; identical to SEQ ID NO: 137756

SEQ ID NO: 229209 - RNA, 64 nt, Homo Sapiens; identical to SEQ ID NO: 137757

SEQ ID NO: 229210 - RNA, 64 nt, Homo Sapiens; identical to SEQ ID NO: 137758

SEQ ID NO: 229211 - RNA, 64 nt, Homo Sapiens; identical to SEQ ID NO: 137759

SEQ ID NO: 229212 - RNA, 64 nt, Homo Sapiens; identical to SEQ ID NO: 137760

SEQ ID NO: 229213 - RNA, 64 nt, Homo Sapiens; identical to SEQ ID NO: 137761

SEQ ID NO: 229214 - RNA, 64 nt, Homo Sapiens; identical to SEQ ID NO: 137762

SEQ ID NO: 229215 - RNA, 64 nt, Homo Sapiens; identical to SEQ ID NO: 137763

SEQ ID NO: 229216 - RNA, 64 nt, Homo Sapiens; identical to SEQ ID NO: 137764

SEQ ID NO: 229217 - RNA, 64 nt, Homo Sapiens; identical to SEQ ID NO: 137765

SEQ ID NO: 229218 - RNA, 64 nt, Homo Sapiens; identical to SEQ ID NO: 137766

SEQ ID NO: 229219 - RNA, 64 nt, Homo Sapiens; identical to SEQ ID NO: 137767

SEQ ID NO: 229220 - RNA, 64 nt, Homo Sapiens; identical to SEQ ID NO: 125003

SEQ ID NO: 229221 - RNA, 64 nt, Homo Sapiens; identical to SEQ ID NO: 125004

SEQ ID NO: 229222 - RNA, 64 nt, Homo Sapiens; identical to SEQ ID NO: 125005

SEQ ID NO: 229223 - RNA, 64 nt, Homo Sapiens; identical to SEQ ID NO: 125006

SEQ ID NO: 229224 - RNA, 64 nt, Homo Sapiens; identical to SEQ ID NO: 125007

SEQ ID NO: 229225 - RNA, 64 nt, Homo Sapiens; identical to SEQ ID NO: 125008

SEQ ID NO: 229226 - RNA, 64 nt, Homo Sapiens; identical to SEQ ID NO: 125009

SEQ ID NO: 229227 - RNA, 64 nt, Homo Sapiens; identical to SEQ ID NO: 125010

SEQ ID NO: 229228 - RNA, 64 nt, Homo Sapiens; identical to SEQ ID NO: 125011

SEQ ID NO: 229229 - RNA, 64 nt, Homo Sapiens; identical to SEQ ID NO: 125012

SEQ ID NO: 229230 - RNA, 64 nt, Homo Sapiens; identical to SEQ ID NO: 125013

SEQ ID NO: 229231 - RNA, 64 nt, Homo Sapiens; identical to SEQ ID NO: 125014

SEQ ID NO: 229232 - RNA, 64 nt, Homo Sapiens; identical to SEQ ID NO: 125015

SEQ ID NO: 229233 - RNA, 64 nt, Homo Sapiens; identical to SEQ ID NO: 125016

SEQ ID NO: 229234 - RNA, 64 nt, Homo Sapiens; identical to SEQ ID NO: 125017

SEQ ID NO: 229235 - RNA, 64 nt, Homo Sapiens; identical to SEQ ID NO: 82479

SEQ ID NO: 229236 - RNA, 64 nt, Homo Sapiens; identical to SEQ ID NO: 82480

SEQ ID NO: 229237 - RNA, 64 nt, Homo Sapiens; identical to SEQ ID NO: 82481

SEQ ID NO: 229238 - RNA, 64 nt, Homo Sapiens; identical to SEQ ID NO: 82482

SEQ ID NO: 229239 - RNA, 64 nt, Homo Sapiens; identical to SEQ ID NO: 82483

SEQ ID NO: 229240 - RNA, 64 nt, Homo Sapiens; identical to SEQ ID NO: 82484

SEQ ID NO: 229241 - RNA, 64 nt, Homo Sapiens; identical to SEQ ID NO: 82485

SEQ ID NO: 229242 - RNA, 64 nt, Homo Sapiens; identical to SEQ ID NO: 82486

SEQ ID NO: 229243 - RNA, 64 nt, Homo Sapiens; identical to SEQ ID NO: 82487

SEQ ID NO: 229244 - RNA, 64 nt, Homo Sapiens; identical to SEQ ID NO: 82488

SEQ ID NO: 229245 - RNA, 64 nt, Homo Sapiens; identical to SEQ ID NO: 82489

SEQ ID NO: 229246 - RNA, 64 nt, Homo Sapiens; identical to SEQ ID NO: 82490

SEQ ID NO: 229247 - RNA, 64 nt, Homo Sapiens; identical to SEQ ID NO: 82491

SEQ ID NO: 229248 - RNA, 64 nt, Homo Sapiens; identical to SEQ ID NO: 82492

SEQ ID NO: 229249 - RNA, 64 nt, Homo Sapiens; identical to SEQ ID NO: 82493

SEQ ID NO: 229250 - RNA, 64 nt, Homo Sapiens; identical to SEQ ID NO: 82494

SEQ ID NO: 229251 - RNA, 64 nt, Homo Sapiens; identical to SEQ ID NO: 82495

SEQ ID NO: 229252 - RNA, 63 nt, Homo Sapiens; identical to SEQ ID NO: 82496

SEQ ID NO: 229253 - RNA, 64 nt, Homo Sapiens; identical to SEQ ID NO: 82497

SEQ ID NO: 229254 - RNA, 64 nt, Homo Sapiens; identical to SEQ ID NO: 82498

SEQ ID NO: 229255 - RNA, 64 nt, Homo Sapiens; identical to SEQ ID NO: 82499

SEQ ID NO: 229256 - RNA, 64 nt, Homo Sapiens; identical to SEQ ID NO: 82500

SEQ ID NO: 229257 - RNA, 64 nt, Homo Sapiens; identical to SEQ ID NO: 82501

SEQ ID NO: 229258 - RNA, 64 nt, Homo Sapiens; identical to SEQ ID NO: 82502

SEQ ID NO: 229259 - RNA, 64 nt, Homo Sapiens; identical to SEQ ID NO: 82503

SEQ ID NO: 229260 - RNA, 64 nt, Homo Sapiens; identical to SEQ ID NO: 82504

SEQ ID NO: 229261 - RNA, 64 nt, Homo Sapiens; identical to SEQ ID NO: 82505

SEQ ID NO: 229262 - RNA, 64 nt, Homo Sapiens; identical to SEQ ID NO: 82506

SEQ ID NO: 229263 - RNA, 64 nt, Homo Sapiens; identical to SEQ ID NO: 82507

SEQ ID NO: 229264 - RNA, 64 nt, Homo Sapiens; identical to SEQ ID NO: 82508

SEQ ID NO: 229265 - RNA, 64 nt, Homo Sapiens; identical to SEQ ID NO: 82509

SEQ ID NO: 229266 - RNA, 64 nt, Homo Sapiens; identical to SEQ ID NO: 82510

SEQ ID NO: 229267 - RNA, 64 nt, Homo Sapiens; identical to SEQ ID NO: 82511

SEQ ID NO: 229268 - RNA, 64 nt, Homo Sapiens; identical to SEQ ID NO: 82512

SEQ ID NO: 229269 - RNA, 57 nt, Homo Sapiens; identical to SEQ ID NO: 82513

SEQ ID NO: 229270 - RNA, 64 nt, Homo Sapiens; identical to SEQ ID NO: 82514

SEQ ID NO: 229271 - RNA, 64 nt, Homo Sapiens; identical to SEQ ID NO: 82515

SEQ ID NO: 229272 - RNA, 64 nt, Homo Sapiens; identical to SEQ ID NO: 82516

SEQ ID NO: 229273 - RNA, 64 nt, Homo Sapiens; identical to SEQ ID NO: 82517

SEQ ID NO: 229274 - RNA, 64 nt, Homo Sapiens; identical to SEQ ID NO: 82518

SEQ ID NO: 229275 - RNA, 64 nt, Homo Sapiens; identical to SEQ ID NO: 82519

SEQ ID NO: 229276 - RNA, 64 nt, Homo Sapiens; identical to SEQ ID NO: 82520

SEQ ID NO: 229277 - RNA, 64 nt, Homo Sapiens; identical to SEQ ID NO: 82521

SEQ ID NO: 229278 - RNA, 64 nt, Homo Sapiens; identical to SEQ ID NO: 82522

SEQ ID NO: 229279 - RNA, 64 nt, Homo Sapiens; identical to SEQ ID NO: 82523

SEQ ID NO: 229280 - RNA, 64 nt, Homo Sapiens; identical to SEQ ID NO: 82524

SEQ ID NO: 229281 - RNA, 64 nt, Homo Sapiens; identical to SEQ ID NO: 82525

SEQ ID NO: 229282 - RNA, 64 nt, Homo Sapiens; identical to SEQ ID NO: 82526

SEQ ID NO: 229283 - RNA, 64 nt, Homo Sapiens; identical to SEQ ID NO: 82527

SEQ ID NO: 229284 - RNA, 64 nt, Homo Sapiens; identical to SEQ ID NO: 82528

SEQ ID NO: 229285 - RNA, 64 nt, Homo Sapiens; identical to SEQ ID NO: 82529

SEQ ID NO: 229286 - RNA, 64 nt, Homo Sapiens; identical to SEQ ID NO: 82530

SEQ ID NO: 229287 - RNA, 64 nt, Homo Sapiens; identical to SEQ ID NO: 82531

SEQ ID NO: 229288 - RNA, 64 nt, Homo Sapiens; identical to SEQ ID NO: 82532

SEQ ID NO: 229289 - RNA, 64 nt, Homo Sapiens; identical to SEQ ID NO: 82533

SEQ ID NO: 229290 - RNA, 64 nt, Homo Sapiens; identical to SEQ ID NO: 82534

SEQ ID NO: 229291 - RNA, 64 nt, Homo Sapiens; identical to SEQ ID NO: 82535

SEQ ID NO: 229292 - RNA, 64 nt, Homo Sapiens; identical to SEQ ID NO: 82536

SEQ ID NO: 229293 - RNA, 64 nt, Homo Sapiens; identical to SEQ ID NO: 82537

SEQ ID NO: 229294 - RNA, 64 nt, Homo Sapiens; identical to SEQ ID NO: 82538

SEQ ID NO: 229295 - RNA, 64 nt, Homo Sapiens; identical to SEQ ID NO: 82539

SEQ ID NO: 229296 - RNA, 64 nt, Homo Sapiens; identical to SEQ ID NO: 82540

SEQ ID NO: 229297 - RNA, 64 nt, Homo Sapiens; identical to SEQ ID NO: 82541

SEQ ID NO: 229298 - RNA, 64 nt, Homo Sapiens; identical to SEQ ID NO: 82542

SEQ ID NO: 229299 - RNA, 64 nt, Homo Sapiens; identical to SEQ ID NO: 82543

SEQ ID NO: 229300 - RNA, 64 nt, Homo Sapiens; identical to SEQ ID NO: 82544

SEQ ID NO: 229301 - RNA, 64 nt, Homo Sapiens; identical to SEQ ID NO: 82545

SEQ ID NO: 229302 - RNA, 64 nt, Homo Sapiens; identical to SEQ ID NO: 82546

SEQ ID NO: 229303 - RNA, 64 nt, Homo Sapiens; identical to SEQ ID NO: 82547

SEQ ID NO: 229304 - RNA, 64 nt, Homo Sapiens; identical to SEQ ID NO: 82548

SEQ ID NO: 229305 - RNA, 64 nt, Homo Sapiens; identical to SEQ ID NO: 82549

SEQ ID NO: 229306 - RNA, 64 nt, Homo Sapiens; identical to SEQ ID NO: 82550

SEQ ID NO: 229307 - RNA, 64 nt, Homo Sapiens; identical to SEQ ID NO: 82551

SEQ ID NO: 229308 - RNA, 64 nt, Homo Sapiens; identical to SEQ ID NO: 82552

SEQ ID NO: 229309 - RNA, 64 nt, Homo Sapiens; identical to SEQ ID NO: 82553

SEQ ID NO: 229310 - RNA, 64 nt, Homo Sapiens; identical to SEQ ID NO: 82554

SEQ ID NO: 229311 - RNA, 64 nt, Homo Sapiens; identical to SEQ ID NO: 82555

SEQ ID NO: 229312 - RNA, 64 nt, Homo Sapiens; identical to SEQ ID NO: 82556

SEQ ID NO: 229313 - RNA, 64 nt, Homo Sapiens; identical to SEQ ID NO: 82557

SEQ ID NO: 229314 - RNA, 64 nt, Homo Sapiens; identical to SEQ ID NO: 82558

SEQ ID NO: 229315 - RNA, 64 nt, Homo Sapiens; identical to SEQ ID NO: 82559

SEQ ID NO: 229316 - RNA, 64 nt, Homo Sapiens; identical to SEQ ID NO: 82560

SEQ ID NO: 229317 - RNA, 64 nt, Homo Sapiens; identical to SEQ ID NO: 82561

SEQ ID NO: 229318 - RNA, 64 nt, Homo Sapiens; identical to SEQ ID NO: 82562

SEQ ID NO: 229319 - RNA, 64 nt, Homo Sapiens; identical to SEQ ID NO: 82563

SEQ ID NO: 229320 - RNA, 64 nt, Homo Sapiens; identical to SEQ ID NO: 82564

SEQ ID NO: 229321 - RNA, 64 nt, Homo Sapiens; identical to SEQ ID NO: 82565

SEQ ID NO: 229322 - RNA, 64 nt, Homo Sapiens; identical to SEQ ID NO: 82566

SEQ ID NO: 229323 - RNA, 64 nt, Homo Sapiens; identical to SEQ ID NO: 82567

SEQ ID NO: 229324 - RNA, 64 nt, Homo Sapiens; identical to SEQ ID NO: 82568

SEQ ID NO: 229325 - RNA, 64 nt, Homo Sapiens; identical to SEQ ID NO: 82569

SEQ ID NO: 229326 - RNA, 59 nt, Homo Sapiens; identical to SEQ ID NO: 82570

SEQ ID NO: 229327 - RNA, 64 nt, Homo Sapiens; identical to SEQ ID NO: 82571

SEQ ID NO: 229328 - RNA, 64 nt, Homo Sapiens; identical to SEQ ID NO: 82572

SEQ ID NO: 229329 - RNA, 64 nt, Homo Sapiens; identical to SEQ ID NO: 82573

SEQ ID NO: 229330 - RNA, 64 nt, Homo Sapiens; identical to SEQ ID NO: 82574

SEQ ID NO: 229331 - RNA, 64 nt, Homo Sapiens; identical to SEQ ID NO: 82575

SEQ ID NO: 229332 - RNA, 64 nt, Homo Sapiens; identical to SEQ ID NO: 82576

SEQ ID NO: 229333 - RNA, 64 nt, Homo Sapiens; identical to SEQ ID NO: 82577

SEQ ID NO: 229334 - RNA, 52 nt, Homo Sapiens; identical to SEQ ID NO: 82578

SEQ ID NO: 229335 - RNA, 64 nt, Homo Sapiens; identical to SEQ ID NO: 82579

SEQ ID NO: 229336 - RNA, 64 nt, Homo Sapiens; identical to SEQ ID NO: 82580

SEQ ID NO: 229337 - RNA, 64 nt, Homo Sapiens; identical to SEQ ID NO: 82581

SEQ ID NO: 229338 - RNA, 64 nt, Homo Sapiens; identical to SEQ ID NO: 82582

SEQ ID NO: 229339 - RNA, 64 nt, Homo Sapiens; identical to SEQ ID NO: 82583

SEQ ID NO: 229340 - RNA, 64 nt, Homo Sapiens; identical to SEQ ID NO: 82584

SEQ ID NO: 229341 - RNA, 64 nt, Homo Sapiens; identical to SEQ ID NO: 82585

SEQ ID NO: 229342 - RNA, 64 nt, Homo Sapiens; identical to SEQ ID NO: 82586

SEQ ID NO: 229343 - RNA, 64 nt, Homo Sapiens; identical to SEQ ID NO: 82587

SEQ ID NO: 229344 - RNA, 64 nt, Homo Sapiens; identical to SEQ ID NO: 82588

SEQ ID NO: 229345 - RNA, 64 nt, Homo Sapiens; identical to SEQ ID NO: 82589

SEQ ID NO: 229346 - RNA, 64 nt, Homo Sapiens; identical to SEQ ID NO: 82590

SEQ ID NO: 229347 - RNA, 64 nt, Homo Sapiens
gacuauaauaguuugguuucuaaugaaaagucaauagcauuagcaguuauaauucuguuuauaa

SEQ ID NO: 229348 - RNA, 64 nt, Homo Sapiens
ccaaauggauugucuguggcaaugcagaagcugauagcauuaacagcaggguguuacagcauaa

SEQ ID NO: 229349 - RNA, 64 nt, Homo Sapiens
auaccaacuauuucaauaaguguuguaccauauguagcauuaaauauaaaauacauaaaagaau

SEQ ID NO: 229350 - RNA, 64 nt, Homo Sapiens
uaaacacacuuagaauacuacagcauaaaucuguuagcauuauugccaaauaagacaguuggga

SEQ ID NO: 229351 - RNA, 64 nt, Homo Sapiens
acuuuauuaccuucuuucuaauacaagcauauguuagcauuaaaguucuaggcauacuuuucaa

SEQ ID NO: 229352 - RNA, 64 nt, Homo Sapiens
uaaauaguauuccaaucacugugcuuaauuuaaauagcauuaucuuaucauuuaucagccuuuu

SEQ ID NO: 229353 - RNA, 64 nt, Homo Sapiens
gguuucugcagagcacaguuagcuagaaaggugauagcauuaaauguucaucuagaguuaauag

SEQ ID NO: 229354 - RNA, 64 nt, Homo Sapiens
aacaagcuaccaggaacugugaggcuuugucauuuagcauuagacuuuaaacaagaauuaaaau

SEQ ID NO: 229355 - RNA, 64 nt, Homo Sapiens
auagaucaacaaauggucauugaaaacacuuguuuagcauuagaauaaaauuauauauguccuu

SEQ ID NO: 229356 - RNA, 64 nt, Homo Sapiens
agagccaggaaauuucacaggucacaccgauuuuuagcauuaaaaacuaaggaauauacuuagc

SEQ ID NO: 229357 - RNA, 64 nt, Homo Sapiens
gauaggacauauggaaaaccaacacaaagugcuuuagcauuaaaacucaccaucaaauagaugu

SEQ ID NO: 229358 - RNA, 64 nt, Homo Sapiens
augacucuugauaacuuguuaaucuguugcugacuagcauuagacuguuacacgaagauaaacu

SEQ ID NO: 229359 - RNA, 64 nt, Homo Sapiens
cuugguuuaaauuucucucuaccuauaaacaguuuagcauuaaggguuucuauuaaugacacag

SEQ ID NO: 229360 - RNA, 64 nt, Homo Sapiens
cagaauuauuggccaaguguaauuucuuaaaauuuagcauuacuuuaaauagccagcauguaau

SEQ ID NO: 229361 - RNA, 64 nt, Homo Sapiens
uggccauaagugggaaaguuuucuguauauugcauagcauuacacauuuaugccuauuuuaaca

SEQ ID NO: 229362 - RNA, 64 nt, Homo Sapiens
ccaaagccccaagccuuuggugagaagccaauucccacuugacagaaggcguccauccauucau

SEQ ID NO: 229363 - RNA, 64 nt, Homo Sapiens
cuuggacacaaguguucagagaggucccccucugccacuugacagggaccuucaaaccucgaca

SEQ ID NO: 229364 - RNA, 64 nt, Homo Sapiens
caaauauaaaauuguauuuauugauauucaacagccacuugagccuggagggacucggcaccac

SEQ ID NO: 229365 - RNA, 64 nt, Homo Sapiens
uucaacagccacuugagccaggagggacucggcaccacuugauaagggggucaguaggugcucu

SEQ ID NO: 229366 - RNA, 64 nt, Homo Sapiens
aaugauuuccauuuguauuuguguugaugauggaccacuugaccaucacauuucaguauucaua

SEQ ID NO: 229367 - RNA, 64 nt, Homo Sapiens
uauucauagaugacugucacauuuuaaaauguucccacuugagcagguacacaacuggucauaa

SEQ ID NO: 229368 - RNA, 64 nt, Homo Sapiens
aacuuacuaacuuuauugugaaaggucuaaaugcccacuugaaugaagcugagagagagaucua

SEQ ID NO: 229369 - RNA, 64 nt, Homo Sapiens
uuauccuauuuuuagcaauaauucguuaaugauuccacuugauuuucagaauauuguccugguu

SEQ ID NO: 229370 - RNA, 64 nt, Homo Sapiens
cugcagggaccucaguguccacccuuccugccucaugucucaaggcagcagcuccucucuggua

SEQ ID NO: 229371 - RNA, 64 nt, Homo Sapiens
ucaagauuguuguauaugugaaugaaaugauacgaugucucagauuugcuuuaaaauaauaggg

SEQ ID NO: 229372 - RNA, 64 nt, Homo Sapiens
uuccuugugugaugccuccuuaggcacacaggcaaugucucaaguacuuugaccuuaggguaga

SEQ ID NO: 229373 - RNA, 64 nt, Homo Sapiens
uugaccuuaggguagaaggcaaagcugccaguaaaugucucagcauugcugcuaauuuuggucc

SEQ ID NO: 229374 - RNA, 64 nt, Homo Sapiens
auugcugcuaauuuugguccaaagcugccaguaaaugucucagcuugaccuuaggguagaaggc

SEQ ID NO: 229375 - RNA, 64 nt, Homo Sapiens
uacuuugaccuuaggguagauaggcacacaggcaaugucucaaguuccuugugugaugccuccu

SEQ ID NO: 229376 - RNA, 64 nt, Homo Sapiens; identical to SEQ ID NO: 189946

SEQ ID NO: 229377 - RNA, 64 nt, Homo Sapiens; identical to SEQ ID NO: 189947

SEQ ID NO: 229378 - RNA, 64 nt, Homo Sapiens; identical to SEQ ID NO: 189948

SEQ ID NO: 229379 - RNA, 64 nt, Homo Sapiens; identical to SEQ ID NO: 189949

SEQ ID NO: 229380 - RNA, 64 nt, Homo Sapiens; identical to SEQ ID NO: 189950

SEQ ID NO: 229381 - RNA, 64 nt, Homo Sapiens; identical to SEQ ID NO: 189951

SEQ ID NO: 229382 - RNA, 64 nt, Homo Sapiens; identical to SEQ ID NO: 189952

SEQ ID NO: 229383 - RNA, 64 nt, Homo Sapiens; identical to SEQ ID NO: 189953

SEQ ID NO: 229384 - RNA, 64 nt, Homo Sapiens; identical to SEQ ID NO: 189954

SEQ ID NO: 229385 - RNA, 64 nt, Homo Sapiens
guuggagaauguaaaccgccguauuuucccugccgaagugaauucugguuugacguagucuuuu

SEQ ID NO: 229386 - RNA, 64 nt, Homo Sapiens
cuggagugaagaagcggucugcugaagacuggaggaagugaacaugaccgcagauguccucucg

SEQ ID NO: 229387 - RNA, 64 nt, Homo Sapiens
ggcuguuuugcuccagccacugucuugugagcaugaagugaacguccaggaagaacggaaaugc

SEQ ID NO: 229388 - RNA, 64 nt, Homo Sapiens
cuuuuguaaaguaaagcaccuuuaagggaacccagaagugaauuuguauuugagaagcuggcug

SEQ ID NO: 229389 - RNA, 64 nt, Homo Sapiens
gugaagcaagccgcugguagcaucacccuuaugagaagugaagguuuuguaaacuuuccaguau

SEQ ID NO: 229390 - RNA, 64 nt, Homo Sapiens
accugccaagcaaggcaauagaaggcaaaaaauggaagugaauuaagaugaacucaucugaaau

SEQ ID NO: 229391 - RNA, 64 nt, Homo Sapiens
ggaaagggugaggacuucacagacuaggagaccagaagugaaugcugggggagggggauuagcu

SEQ ID NO: 229392 - RNA, 64 nt, Homo Sapiens
ugccacauuuugcuuuauaaagaacugcuaccaugaagugaaaauacuguguaaauaaacuuuc

SEQ ID NO: 229393 - RNA, 64 nt, Homo Sapiens
gugauuggaaauuuuuagcuaaggugguauauuugaagugaaugaaaguaaaaaaaguaaaauc

SEQ ID NO: 229394 - RNA, 64 nt, Homo Sapiens
caugcagugacuggaugauuaagaagauauggaugaagugaaccauaaagaguauucugaaaaa

SEQ ID NO: 229395 - RNA, 64 nt, Homo Sapiens
uaauucauccuagcaaauucuaccuuauuuuacagaagugaaagugagguaucagaaguguuaa

SEQ ID NO: 229396 - RNA, 64 nt, Homo Sapiens
aagcuaauaaagaaaagagguuuauacugcaaaagaagugaaacuauauguauucacaguugau

SEQ ID NO: 229397 - RNA, 64 nt, Homo Sapiens
cucugagcuggugguguggugaccgucccaccgugaagugaauuguucacaguagacuuugagu

SEQ ID NO: 229398 - RNA, 64 nt, Homo Sapiens
ugaaaaagaaauguuacuuaacaguugaguauuugaagugaauuuugcuguuuuuuaaaugaac

SEQ ID NO: 229399 - RNA, 64 nt, Homo Sapiens
augacuagcaaugguuuaaaaaggaagaagaguggaagugaagaaggugguauaaaugcuguca

SEQ ID NO: 229400 - RNA, 64 nt, Homo Sapiens
ugagguuuuuaauaucaucuaaaaauaaagcauugaagugaaguuggugaaaauuuguuccugg

SEQ ID NO: 229401 - RNA, 64 nt, Homo Sapiens
ggccagggauugccuucuaaauuaugauaaaacagaagugaagaguuucagagcaucagauuga

SEQ ID NO: 229402 - RNA, 64 nt, Homo Sapiens
cguccacaucacaccugugacggaagcacuucuggaagugaacacucguuuugaaagcuugauu

SEQ ID NO: 229403 - RNA, 53 nt, Homo Sapiens; identical to SEQ ID NO: 167525

SEQ ID NO: 229404 - RNA, 64 nt, Homo Sapiens; identical to SEQ ID NO: 167526

SEQ ID NO: 229405 - RNA, 64 nt, Homo Sapiens; identical to SEQ ID NO: 167527

SEQ ID NO: 229406 - RNA, 64 nt, Homo Sapiens; identical to SEQ ID NO: 167528

SEQ ID NO: 229407 - RNA, 64 nt, Homo Sapiens; identical to SEQ ID NO: 167529

SEQ ID NO: 229408 - RNA, 64 nt, Homo Sapiens; identical to SEQ ID NO: 167530

SEQ ID NO: 229409 - RNA, 64 nt, Homo Sapiens; identical to SEQ ID NO: 167531

SEQ ID NO: 229410 - RNA, 64 nt, Homo Sapiens; identical to SEQ ID NO: 167532

SEQ ID NO: 229411 - RNA, 64 nt, Homo Sapiens; identical to SEQ ID NO: 167533

SEQ ID NO: 229412 - RNA, 64 nt, Homo Sapiens; identical to SEQ ID NO: 167534

SEQ ID NO: 229413 - RNA, 64 nt, Homo Sapiens; identical to SEQ ID NO: 167535

SEQ ID NO: 229414 - RNA, 64 nt, Homo Sapiens; identical to SEQ ID NO: 167536

SEQ ID NO: 229415 - RNA, 64 nt, Homo Sapiens; identical to SEQ ID NO: 167537

SEQ ID NO: 229416 - RNA, 64 nt, Homo Sapiens; identical to SEQ ID NO: 167538

SEQ ID NO: 229417 - RNA, 64 nt, Homo Sapiens; identical to SEQ ID NO: 167539

SEQ ID NO: 229418 - RNA, 64 nt, Homo Sapiens; identical to SEQ ID NO: 167540

SEQ ID NO: 229419 - RNA, 64 nt, Homo Sapiens; identical to SEQ ID NO: 167541

SEQ ID NO: 229420 - RNA, 64 nt, Homo Sapiens; identical to SEQ ID NO: 167542

SEQ ID NO: 229421 - RNA, 64 nt, Homo Sapiens; identical to SEQ ID NO: 167543

SEQ ID NO: 229422 - RNA, 64 nt, Homo Sapiens; identical to SEQ ID NO: 167544

SEQ ID NO: 229423 - RNA, 64 nt, Homo Sapiens; identical to SEQ ID NO: 167545

SEQ ID NO: 229424 - RNA, 64 nt, Homo Sapiens; identical to SEQ ID NO: 167546

SEQ ID NO: 229425 - RNA, 64 nt, Homo Sapiens; identical to SEQ ID NO: 167547

SEQ ID NO: 229426 - RNA, 64 nt, Homo Sapiens; identical to SEQ ID NO: 167548

SEQ ID NO: 229427 - RNA, 64 nt, Homo Sapiens; identical to SEQ ID NO: 167549

SEQ ID NO: 229428 - RNA, 64 nt, Homo Sapiens; identical to SEQ ID NO: 167550

SEQ ID NO: 229429 - RNA, 64 nt, Homo Sapiens; identical to SEQ ID NO: 167551

SEQ ID NO: 229430 - RNA, 64 nt, Homo Sapiens; identical to SEQ ID NO: 167552

SEQ ID NO: 229431 - RNA, 64 nt, Homo Sapiens; identical to SEQ ID NO: 167553

SEQ ID NO: 229432 - RNA, 64 nt, Homo Sapiens; identical to SEQ ID NO: 167554

SEQ ID NO: 229433 - RNA, 64 nt, Homo Sapiens; identical to SEQ ID NO: 167555

SEQ ID NO: 229434 - RNA, 64 nt, Homo Sapiens; identical to SEQ ID NO: 167556

SEQ ID NO: 229435 - RNA, 64 nt, Homo Sapiens; identical to SEQ ID NO: 167557

SEQ ID NO: 229436 - RNA, 64 nt, Homo Sapiens; identical to SEQ ID NO: 167558

SEQ ID NO: 229437 - RNA, 64 nt, Homo Sapiens; identical to SEQ ID NO: 167559

SEQ ID NO: 229438 - RNA, 64 nt, Homo Sapiens; identical to SEQ ID NO: 167560

SEQ ID NO: 229439 - RNA, 64 nt, Homo Sapiens; identical to SEQ ID NO: 167561

SEQ ID NO: 229440 - RNA, 64 nt, Homo Sapiens; identical to SEQ ID NO: 167562

SEQ ID NO: 229441 - RNA, 64 nt, Homo Sapiens; identical to SEQ ID NO: 167563

SEQ ID NO: 229442 - RNA, 64 nt, Homo Sapiens; identical to SEQ ID NO: 167564

SEQ ID NO: 229443 - RNA, 64 nt, Homo Sapiens; identical to SEQ ID NO: 167565

SEQ ID NO: 229444 - RNA, 64 nt, Homo Sapiens; identical to SEQ ID NO: 167566

SEQ ID NO: 229445 - RNA, 64 nt, Homo Sapiens; identical to SEQ ID NO: 167567

SEQ ID NO: 229446 - RNA, 64 nt, Homo Sapiens; identical to SEQ ID NO: 167568

SEQ ID NO: 229447 - RNA, 64 nt, Homo Sapiens; identical to SEQ ID NO: 167569

SEQ ID NO: 229448 - RNA, 64 nt, Homo Sapiens; identical to SEQ ID NO: 167570

SEQ ID NO: 229449 - RNA, 64 nt, Homo Sapiens; identical to SEQ ID NO: 167571

SEQ ID NO: 229450 - RNA, 64 nt, Homo Sapiens; identical to SEQ ID NO: 167572

SEQ ID NO: 229451 - RNA, 64 nt, Homo Sapiens; identical to SEQ ID NO: 167573

SEQ ID NO: 229452 - RNA, 64 nt, Homo Sapiens; identical to SEQ ID NO: 167574

SEQ ID NO: 229453 - RNA, 64 nt, Homo Sapiens; identical to SEQ ID NO: 167575

SEQ ID NO: 229454 - RNA, 64 nt, Homo Sapiens; identical to SEQ ID NO: 199847

SEQ ID NO: 229455 - RNA, 64 nt, Homo Sapiens; identical to SEQ ID NO: 199848

SEQ ID NO: 229456 - RNA, 64 nt, Homo Sapiens; identical to SEQ ID NO: 199849

SEQ ID NO: 229457 - RNA, 64 nt, Homo Sapiens; identical to SEQ ID NO: 199850

SEQ ID NO: 229458 - RNA, 64 nt, Homo Sapiens; identical to SEQ ID NO: 199851

SEQ ID NO: 229459 - RNA, 64 nt, Homo Sapiens; identical to SEQ ID NO: 199852

SEQ ID NO: 229460 - RNA, 64 nt, Homo Sapiens; identical to SEQ ID NO: 199853

SEQ ID NO: 229461 - RNA, 64 nt, Homo Sapiens; identical to SEQ ID NO: 199854

SEQ ID NO: 229462 - RNA, 55 nt, Homo Sapiens; identical to SEQ ID NO: 199855

SEQ ID NO: 229463 - RNA, 64 nt, Homo Sapiens; identical to SEQ ID NO: 199856

SEQ ID NO: 229464 - RNA, 64 nt, Homo Sapiens; identical to SEQ ID NO: 199857

SEQ ID NO: 229465 - RNA, 64 nt, Homo Sapiens; identical to SEQ ID NO: 199858

SEQ ID NO: 229466 - RNA, 64 nt, Homo Sapiens; identical to SEQ ID NO: 199859

SEQ ID NO: 229467 - RNA, 64 nt, Homo Sapiens; identical to SEQ ID NO: 199860

SEQ ID NO: 229468 - RNA, 64 nt, Homo Sapiens; identical to SEQ ID NO: 199861

SEQ ID NO: 229469 - RNA, 64 nt, Homo Sapiens; identical to SEQ ID NO: 199862

SEQ ID NO: 229470 - RNA, 64 nt, Homo Sapiens; identical to SEQ ID NO: 199863

SEQ ID NO: 229471 - RNA, 64 nt, Homo Sapiens; identical to SEQ ID NO: 199864

SEQ ID NO: 229472 - RNA, 64 nt, Homo Sapiens; identical to SEQ ID NO: 199865

SEQ ID NO: 229473 - RNA, 64 nt, Homo Sapiens; identical to SEQ ID NO: 199866

SEQ ID NO: 229474 - RNA, 64 nt, Homo Sapiens; identical to SEQ ID NO: 39347

SEQ ID NO: 229475 - RNA, 64 nt, Homo Sapiens; identical to SEQ ID NO: 39348

SEQ ID NO: 229476 - RNA, 64 nt, Homo Sapiens; identical to SEQ ID NO: 39349

SEQ ID NO: 229477 - RNA, 64 nt, Homo Sapiens; identical to SEQ ID NO: 39350

SEQ ID NO: 229478 - RNA, 64 nt, Homo Sapiens; identical to SEQ ID NO: 39351

SEQ ID NO: 229479 - RNA, 64 nt, Homo Sapiens; identical to SEQ ID NO: 39352

SEQ ID NO: 229480 - RNA, 64 nt, Homo Sapiens; identical to SEQ ID NO: 39353

SEQ ID NO: 229481 - RNA, 64 nt, Homo Sapiens; identical to SEQ ID NO: 39354

SEQ ID NO: 229482 - RNA, 64 nt, Homo Sapiens; identical to SEQ ID NO: 39355

SEQ ID NO: 229483 - RNA, 64 nt, Homo Sapiens; identical to SEQ ID NO: 39356

SEQ ID NO: 229484 - RNA, 64 nt, Homo Sapiens; identical to SEQ ID NO: 39357

SEQ ID NO: 229485 - RNA, 64 nt, Homo Sapiens; identical to SEQ ID NO: 39358

SEQ ID NO: 229486 - RNA, 64 nt, Homo Sapiens; identical to SEQ ID NO: 39359

SEQ ID NO: 229487 - RNA, 64 nt, Homo Sapiens; identical to SEQ ID NO: 39360

SEQ ID NO: 229488 - RNA, 64 nt, Homo Sapiens; identical to SEQ ID NO: 39361

SEQ ID NO: 229489 - RNA, 64 nt, Homo Sapiens; identical to SEQ ID NO: 39362

SEQ ID NO: 229490 - RNA, 64 nt, Homo Sapiens; identical to SEQ ID NO: 39363

SEQ ID NO: 229491 - RNA, 64 nt, Homo Sapiens; identical to SEQ ID NO: 39364

SEQ ID NO: 229492 - RNA, 64 nt, Homo Sapiens; identical to SEQ ID NO: 39365

SEQ ID NO: 229493 - RNA, 64 nt, Homo Sapiens; identical to SEQ ID NO: 39366

SEQ ID NO: 229494 - RNA, 64 nt, Homo Sapiens; identical to SEQ ID NO: 39367

SEQ ID NO: 229495 - RNA, 64 nt, Homo Sapiens; identical to SEQ ID NO: 39368

SEQ ID NO: 229496 - RNA, 64 nt, Homo Sapiens; identical to SEQ ID NO: 39369

SEQ ID NO: 229497 - RNA, 64 nt, Homo Sapiens; identical to SEQ ID NO: 39370

SEQ ID NO: 229498 - RNA, 64 nt, Homo Sapiens; identical to SEQ ID NO: 39371

SEQ ID NO: 229499 - RNA, 64 nt, Homo Sapiens; identical to SEQ ID NO: 39372

SEQ ID NO: 229500 - RNA, 64 nt, Homo Sapiens; identical to SEQ ID NO: 39373

SEQ ID NO: 229501 - RNA, 64 nt, Homo Sapiens; identical to SEQ ID NO: 39374

SEQ ID NO: 229502 - RNA, 64 nt, Homo Sapiens; identical to SEQ ID NO: 39375

SEQ ID NO: 229503 - RNA, 64 nt, Homo Sapiens; identical to SEQ ID NO: 39376

SEQ ID NO: 229504 - RNA, 64 nt, Homo Sapiens; identical to SEQ ID NO: 39377

SEQ ID NO: 229505 - RNA, 64 nt, Homo Sapiens; identical to SEQ ID NO: 39378

SEQ ID NO: 229506 - RNA, 64 nt, Homo Sapiens; identical to SEQ ID NO: 39379

SEQ ID NO: 229507 - RNA, 64 nt, Homo Sapiens; identical to SEQ ID NO: 39380

SEQ ID NO: 229508 - RNA, 64 nt, Homo Sapiens; identical to SEQ ID NO: 39381

SEQ ID NO: 229509 - RNA, 64 nt, Homo Sapiens; identical to SEQ ID NO: 39382

SEQ ID NO: 229510 - RNA, 64 nt, Homo Sapiens; identical to SEQ ID NO: 39383

SEQ ID NO: 229511 - RNA, 64 nt, Homo Sapiens; identical to SEQ ID NO: 39384

SEQ ID NO: 229512 - RNA, 64 nt, Homo Sapiens; identical to SEQ ID NO: 39385

SEQ ID NO: 229513 - RNA, 64 nt, Homo Sapiens; identical to SEQ ID NO: 39386

SEQ ID NO: 229514 - RNA, 64 nt, Homo Sapiens; identical to SEQ ID NO: 39387

SEQ ID NO: 229515 - RNA, 64 nt, Homo Sapiens; identical to SEQ ID NO: 39388

SEQ ID NO: 229516 - RNA, 64 nt, Homo Sapiens; identical to SEQ ID NO: 39389

SEQ ID NO: 229517 - RNA, 64 nt, Homo Sapiens; identical to SEQ ID NO: 39390

SEQ ID NO: 229518 - RNA, 64 nt, Homo Sapiens; identical to SEQ ID NO: 39391

SEQ ID NO: 229519 - RNA, 64 nt, Homo Sapiens; identical to SEQ ID NO: 39392

SEQ ID NO: 229520 - RNA, 64 nt, Homo Sapiens; identical to SEQ ID NO: 39393

SEQ ID NO: 229521 - RNA, 64 nt, Homo Sapiens; identical to SEQ ID NO: 39394

SEQ ID NO: 229522 - RNA, 64 nt, Homo Sapiens; identical to SEQ ID NO: 39395

SEQ ID NO: 229523 - RNA, 64 nt, Homo Sapiens; identical to SEQ ID NO: 39396

SEQ ID NO: 229524 - RNA, 64 nt, Homo Sapiens; identical to SEQ ID NO: 39397

SEQ ID NO: 229525 - RNA, 64 nt, Homo Sapiens; identical to SEQ ID NO: 39398

SEQ ID NO: 229526 - RNA, 64 nt, Homo Sapiens; identical to SEQ ID NO: 39399

SEQ ID NO: 229527 - RNA, 64 nt, Homo Sapiens; identical to SEQ ID NO: 39400

SEQ ID NO: 229528 - RNA, 64 nt, Homo Sapiens; identical to SEQ ID NO: 39401

SEQ ID NO: 229529 - RNA, 64 nt, Homo Sapiens; identical to SEQ ID NO: 39402

SEQ ID NO: 229530 - RNA, 64 nt, Homo Sapiens; identical to SEQ ID NO: 39403

SEQ ID NO: 229531 - RNA, 64 nt, Homo Sapiens; identical to SEQ ID NO: 39404

SEQ ID NO: 229532 - RNA, 64 nt, Homo Sapiens; identical to SEQ ID NO: 39405

SEQ ID NO: 229533 - RNA, 64 nt, Homo Sapiens; identical to SEQ ID NO: 39406

SEQ ID NO: 229534 - RNA, 64 nt, Homo Sapiens; identical to SEQ ID NO: 39407

SEQ ID NO: 229535 - RNA, 64 nt, Homo Sapiens; identical to SEQ ID NO: 39408

SEQ ID NO: 229536 - RNA, 64 nt, Homo Sapiens; identical to SEQ ID NO: 39409

SEQ ID NO: 229537 - RNA, 64 nt, Homo Sapiens; identical to SEQ ID NO: 39410

SEQ ID NO: 229538 - RNA, 64 nt, Homo Sapiens; identical to SEQ ID NO: 39411

SEQ ID NO: 229539 - RNA, 64 nt, Homo Sapiens; identical to SEQ ID NO: 39412

SEQ ID NO: 229540 - RNA, 64 nt, Homo Sapiens; identical to SEQ ID NO: 39413

SEQ ID NO: 229541 - RNA, 64 nt, Homo Sapiens; identical to SEQ ID NO: 39414

SEQ ID NO: 229542 - RNA, 64 nt, Homo Sapiens; identical to SEQ ID NO: 39415

SEQ ID NO: 229543 - RNA, 64 nt, Homo Sapiens; identical to SEQ ID NO: 39416

SEQ ID NO: 229544 - RNA, 64 nt, Homo Sapiens; identical to SEQ ID NO: 39417

SEQ ID NO: 229545 - RNA, 64 nt, Homo Sapiens; identical to SEQ ID NO: 39418

SEQ ID NO: 229546 - RNA, 64 nt, Homo Sapiens; identical to SEQ ID NO: 39419

SEQ ID NO: 229547 - RNA, 64 nt, Homo Sapiens; identical to SEQ ID NO: 39420

SEQ ID NO: 229548 - RNA, 64 nt, Homo Sapiens; identical to SEQ ID NO: 39421

SEQ ID NO: 229549 - RNA, 64 nt, Homo Sapiens; identical to SEQ ID NO: 39422

SEQ ID NO: 229550 - RNA, 64 nt, Homo Sapiens; identical to SEQ ID NO: 39423

SEQ ID NO: 229551 - RNA, 64 nt, Homo Sapiens; identical to SEQ ID NO: 39424

SEQ ID NO: 229552 - RNA, 64 nt, Homo Sapiens; identical to SEQ ID NO: 39425

SEQ ID NO: 229553 - RNA, 64 nt, Homo Sapiens; identical to SEQ ID NO: 39426

SEQ ID NO: 229554 - RNA, 64 nt, Homo Sapiens; identical to SEQ ID NO: 39427

SEQ ID NO: 229555 - RNA, 64 nt, Homo Sapiens; identical to SEQ ID NO: 39428

SEQ ID NO: 229556 - RNA, 64 nt, Homo Sapiens; identical to SEQ ID NO: 39429

SEQ ID NO: 229557 - RNA, 64 nt, Homo Sapiens; identical to SEQ ID NO: 39430

SEQ ID NO: 229558 - RNA, 64 nt, Homo Sapiens; identical to SEQ ID NO: 39431

SEQ ID NO: 229559 - RNA, 64 nt, Homo Sapiens; identical to SEQ ID NO: 39432

SEQ ID NO: 229560 - RNA, 64 nt, Homo Sapiens; identical to SEQ ID NO: 39433

SEQ ID NO: 229561 - RNA, 64 nt, Homo Sapiens; identical to SEQ ID NO: 39434

SEQ ID NO: 229562 - RNA, 64 nt, Homo Sapiens; identical to SEQ ID NO: 39435

SEQ ID NO: 229563 - RNA, 64 nt, Homo Sapiens; identical to SEQ ID NO: 39436

SEQ ID NO: 229564 - RNA, 64 nt, Homo Sapiens; identical to SEQ ID NO: 39437

SEQ ID NO: 229565 - RNA, 64 nt, Homo Sapiens; identical to SEQ ID NO: 39438

SEQ ID NO: 229566 - RNA, 64 nt, Homo Sapiens; identical to SEQ ID NO: 39439

SEQ ID NO: 229567 - RNA, 64 nt, Homo Sapiens; identical to SEQ ID NO: 39440

SEQ ID NO: 229568 - RNA, 64 nt, Homo Sapiens; identical to SEQ ID NO: 39441

SEQ ID NO: 229569 - RNA, 64 nt, Homo Sapiens; identical to SEQ ID NO: 39442

SEQ ID NO: 229570 - RNA, 64 nt, Homo Sapiens; identical to SEQ ID NO: 39443

SEQ ID NO: 229571 - RNA, 64 nt, Homo Sapiens; identical to SEQ ID NO: 39444

SEQ ID NO: 229572 - RNA, 64 nt, Homo Sapiens; identical to SEQ ID NO: 39445

SEQ ID NO: 229573 - RNA, 64 nt, Homo Sapiens; identical to SEQ ID NO: 39446

SEQ ID NO: 229574 - RNA, 64 nt, Homo Sapiens; identical to SEQ ID NO: 39447

SEQ ID NO: 229575 - RNA, 64 nt, Homo Sapiens; identical to SEQ ID NO: 39448

SEQ ID NO: 229576 - RNA, 64 nt, Homo Sapiens; identical to SEQ ID NO: 39449

SEQ ID NO: 229577 - RNA, 64 nt, Homo Sapiens; identical to SEQ ID NO: 39450

SEQ ID NO: 229578 - RNA, 64 nt, Homo Sapiens; identical to SEQ ID NO: 39451

SEQ ID NO: 229579 - RNA, 64 nt, Homo Sapiens; identical to SEQ ID NO: 39452

SEQ ID NO: 229580 - RNA, 64 nt, Homo Sapiens; identical to SEQ ID NO: 39453

SEQ ID NO: 229581 - RNA, 64 nt, Homo Sapiens; identical to SEQ ID NO: 39454

SEQ ID NO: 229582 - RNA, 64 nt, Homo Sapiens; identical to SEQ ID NO: 39455

SEQ ID NO: 229583 - RNA, 64 nt, Homo Sapiens; identical to SEQ ID NO: 39456

SEQ ID NO: 229584 - RNA, 64 nt, Homo Sapiens; identical to SEQ ID NO: 39457

SEQ ID NO: 229585 - RNA, 64 nt, Homo Sapiens; identical to SEQ ID NO: 39458

SEQ ID NO: 229586 - RNA, 64 nt, Homo Sapiens; identical to SEQ ID NO: 39459

SEQ ID NO: 229587 - RNA, 64 nt, Homo Sapiens; identical to SEQ ID NO: 39460

SEQ ID NO: 229588 - RNA, 64 nt, Homo Sapiens; identical to SEQ ID NO: 39461

SEQ ID NO: 229589 - RNA, 64 nt, Homo Sapiens; identical to SEQ ID NO: 39462

SEQ ID NO: 229590 - RNA, 64 nt, Homo Sapiens; identical to SEQ ID NO: 39463

SEQ ID NO: 229591 - RNA, 64 nt, Homo Sapiens; identical to SEQ ID NO: 39464

SEQ ID NO: 229592 - RNA, 64 nt, Homo Sapiens; identical to SEQ ID NO: 39465

SEQ ID NO: 229593 - RNA, 64 nt, Homo Sapiens; identical to SEQ ID NO: 39466

SEQ ID NO: 229594 - RNA, 64 nt, Homo Sapiens; identical to SEQ ID NO: 39467

SEQ ID NO: 229595 - RNA, 64 nt, Homo Sapiens; identical to SEQ ID NO: 39468

SEQ ID NO: 229596 - RNA, 64 nt, Homo Sapiens; identical to SEQ ID NO: 39469

SEQ ID NO: 229597 - RNA, 64 nt, Homo Sapiens; identical to SEQ ID NO: 39470

SEQ ID NO: 229598 - RNA, 64 nt, Homo Sapiens; identical to SEQ ID NO: 39471

SEQ ID NO: 229599 - RNA, 64 nt, Homo Sapiens; identical to SEQ ID NO: 39472

SEQ ID NO: 229600 - RNA, 64 nt, Homo Sapiens; identical to SEQ ID NO: 39473

SEQ ID NO: 229601 - RNA, 64 nt, Homo Sapiens; identical to SEQ ID NO: 39474

SEQ ID NO: 229602 - RNA, 64 nt, Homo Sapiens; identical to SEQ ID NO: 39475

SEQ ID NO: 229603 - RNA, 64 nt, Homo Sapiens; identical to SEQ ID NO: 39476

SEQ ID NO: 229604 - RNA, 64 nt, Homo Sapiens; identical to SEQ ID NO: 39477

SEQ ID NO: 229605 - RNA, 64 nt, Homo Sapiens; identical to SEQ ID NO: 39478

SEQ ID NO: 229606 - RNA, 64 nt, Homo Sapiens; identical to SEQ ID NO: 39479

SEQ ID NO: 229607 - RNA, 64 nt, Homo Sapiens; identical to SEQ ID NO: 39480

SEQ ID NO: 229608 - RNA, 64 nt, Homo Sapiens; identical to SEQ ID NO: 39481

SEQ ID NO: 229609 - RNA, 64 nt, Homo Sapiens; identical to SEQ ID NO: 39482

SEQ ID NO: 229610 - RNA, 64 nt, Homo Sapiens; identical to SEQ ID NO: 39483

SEQ ID NO: 229611 - RNA, 64 nt, Homo Sapiens; identical to SEQ ID NO: 39484

SEQ ID NO: 229612 - RNA, 64 nt, Homo Sapiens; identical to SEQ ID NO: 39485

SEQ ID NO: 229613 - RNA, 64 nt, Homo Sapiens; identical to SEQ ID NO: 39486

SEQ ID NO: 229614 - RNA, 64 nt, Homo Sapiens; identical to SEQ ID NO: 39487

SEQ ID NO: 229615 - RNA, 64 nt, Homo Sapiens; identical to SEQ ID NO: 39488

SEQ ID NO: 229616 - RNA, 64 nt, Homo Sapiens; identical to SEQ ID NO: 39489

SEQ ID NO: 229617 - RNA, 64 nt, Homo Sapiens; identical to SEQ ID NO: 39490

SEQ ID NO: 229618 - RNA, 64 nt, Homo Sapiens; identical to SEQ ID NO: 39491

SEQ ID NO: 229619 - RNA, 64 nt, Homo Sapiens; identical to SEQ ID NO: 39492

SEQ ID NO: 229620 - RNA, 64 nt, Homo Sapiens; identical to SEQ ID NO: 39493

SEQ ID NO: 229621 - RNA, 64 nt, Homo Sapiens; identical to SEQ ID NO: 39494

SEQ ID NO: 229622 - RNA, 64 nt, Homo Sapiens; identical to SEQ ID NO: 39495

SEQ ID NO: 229623 - RNA, 64 nt, Homo Sapiens; identical to SEQ ID NO: 39496

SEQ ID NO: 229624 - RNA, 64 nt, Homo Sapiens; identical to SEQ ID NO: 39497

SEQ ID NO: 229625 - RNA, 64 nt, Homo Sapiens; identical to SEQ ID NO: 39498

SEQ ID NO: 229626 - RNA, 64 nt, Homo Sapiens; identical to SEQ ID NO: 39499

SEQ ID NO: 229627 - RNA, 64 nt, Homo Sapiens; identical to SEQ ID NO: 39500

SEQ ID NO: 229628 - RNA, 64 nt, Homo Sapiens; identical to SEQ ID NO: 39501

SEQ ID NO: 229629 - RNA, 64 nt, Homo Sapiens; identical to SEQ ID NO: 39502

SEQ ID NO: 229630 - RNA, 64 nt, Homo Sapiens; identical to SEQ ID NO: 39503

SEQ ID NO: 229631 - RNA, 64 nt, Homo Sapiens; identical to SEQ ID NO: 39504

SEQ ID NO: 229632 - RNA, 64 nt, Homo Sapiens; identical to SEQ ID NO: 39505

SEQ ID NO: 229633 - RNA, 64 nt, Homo Sapiens; identical to SEQ ID NO: 39506

SEQ ID NO: 229634 - RNA, 64 nt, Homo Sapiens; identical to SEQ ID NO: 39507

SEQ ID NO: 229635 - RNA, 64 nt, Homo Sapiens; identical to SEQ ID NO: 39508

SEQ ID NO: 229636 - RNA, 64 nt, Homo Sapiens; identical to SEQ ID NO: 39509

SEQ ID NO: 229637 - RNA, 64 nt, Homo Sapiens; identical to SEQ ID NO: 39510

SEQ ID NO: 229638 - RNA, 64 nt, Homo Sapiens; identical to SEQ ID NO: 39511

SEQ ID NO: 229639 - RNA, 64 nt, Homo Sapiens; identical to SEQ ID NO: 39512

SEQ ID NO: 229640 - RNA, 64 nt, Homo Sapiens; identical to SEQ ID NO: 39513

SEQ ID NO: 229641 - RNA, 64 nt, Homo Sapiens; identical to SEQ ID NO: 39514

SEQ ID NO: 229642 - RNA, 64 nt, Homo Sapiens; identical to SEQ ID NO: 39515

SEQ ID NO: 229643 - RNA, 64 nt, Homo Sapiens; identical to SEQ ID NO: 39516

SEQ ID NO: 229644 - RNA, 64 nt, Homo Sapiens; identical to SEQ ID NO: 39517

SEQ ID NO: 229645 - RNA, 64 nt, Homo Sapiens; identical to SEQ ID NO: 39518

SEQ ID NO: 229646 - RNA, 64 nt, Homo Sapiens; identical to SEQ ID NO: 39519

SEQ ID NO: 229647 - RNA, 64 nt, Homo Sapiens; identical to SEQ ID NO: 39520

SEQ ID NO: 229648 - RNA, 64 nt, Homo Sapiens; identical to SEQ ID NO: 39521

SEQ ID NO: 229649 - RNA, 64 nt, Homo Sapiens; identical to SEQ ID NO: 39522

SEQ ID NO: 229650 - RNA, 64 nt, Homo Sapiens; identical to SEQ ID NO: 39523

SEQ ID NO: 229651 - RNA, 64 nt, Homo Sapiens; identical to SEQ ID NO: 39524

SEQ ID NO: 229652 - RNA, 64 nt, Homo Sapiens; identical to SEQ ID NO: 39525

SEQ ID NO: 229653 - RNA, 64 nt, Homo Sapiens; identical to SEQ ID NO: 39526

SEQ ID NO: 229654 - RNA, 64 nt, Homo Sapiens; identical to SEQ ID NO: 39527

SEQ ID NO: 229655 - RNA, 64 nt, Homo Sapiens; identical to SEQ ID NO: 39528

SEQ ID NO: 229656 - RNA, 64 nt, Homo Sapiens; identical to SEQ ID NO: 39529

SEQ ID NO: 229657 - RNA, 64 nt, Homo Sapiens; identical to SEQ ID NO: 39530

SEQ ID NO: 229658 - RNA, 64 nt, Homo Sapiens; identical to SEQ ID NO: 39531

SEQ ID NO: 229659 - RNA, 64 nt, Homo Sapiens; identical to SEQ ID NO: 39532

SEQ ID NO: 229660 - RNA, 64 nt, Homo Sapiens; identical to SEQ ID NO: 39533

SEQ ID NO: 229661 - RNA, 64 nt, Homo Sapiens; identical to SEQ ID NO: 39534

SEQ ID NO: 229662 - RNA, 64 nt, Homo Sapiens; identical to SEQ ID NO: 39535

SEQ ID NO: 229663 - RNA, 64 nt, Homo Sapiens; identical to SEQ ID NO: 39536

SEQ ID NO: 229664 - RNA, 64 nt, Homo Sapiens; identical to SEQ ID NO: 39537

SEQ ID NO: 229665 - RNA, 64 nt, Homo Sapiens; identical to SEQ ID NO: 39538

SEQ ID NO: 229666 - RNA, 64 nt, Homo Sapiens; identical to SEQ ID NO: 39539

SEQ ID NO: 229667 - RNA, 64 nt, Homo Sapiens; identical to SEQ ID NO: 39540

SEQ ID NO: 229668 - RNA, 64 nt, Homo Sapiens; identical to SEQ ID NO: 39541

SEQ ID NO: 229669 - RNA, 64 nt, Homo Sapiens; identical to SEQ ID NO: 39542

SEQ ID NO: 229670 - RNA, 64 nt, Homo Sapiens; identical to SEQ ID NO: 39543

SEQ ID NO: 229671 - RNA, 64 nt, Homo Sapiens; identical to SEQ ID NO: 39544

SEQ ID NO: 229672 - RNA, 64 nt, Homo Sapiens; identical to SEQ ID NO: 39545

SEQ ID NO: 229673 - RNA, 64 nt, Homo Sapiens; identical to SEQ ID NO: 39546

SEQ ID NO: 229674 - RNA, 64 nt, Homo Sapiens; identical to SEQ ID NO: 39547

SEQ ID NO: 229675 - RNA, 64 nt, Homo Sapiens; identical to SEQ ID NO: 39548

SEQ ID NO: 229676 - RNA, 64 nt, Homo Sapiens; identical to SEQ ID NO: 39549

SEQ ID NO: 229677 - RNA, 64 nt, Homo Sapiens; identical to SEQ ID NO: 39550

SEQ ID NO: 229678 - RNA, 64 nt, Homo Sapiens; identical to SEQ ID NO: 39551

SEQ ID NO: 229679 - RNA, 64 nt, Homo Sapiens; identical to SEQ ID NO: 39552

SEQ ID NO: 229680 - RNA, 64 nt, Homo Sapiens; identical to SEQ ID NO: 39553

SEQ ID NO: 229681 - RNA, 64 nt, Homo Sapiens; identical to SEQ ID NO: 39554

SEQ ID NO: 229682 - RNA, 64 nt, Homo Sapiens; identical to SEQ ID NO: 39555

SEQ ID NO: 229683 - RNA, 64 nt, Homo Sapiens; identical to SEQ ID NO: 39556

SEQ ID NO: 229684 - RNA, 64 nt, Homo Sapiens; identical to SEQ ID NO: 39557

SEQ ID NO: 229685 - RNA, 64 nt, Homo Sapiens; identical to SEQ ID NO: 39558

SEQ ID NO: 229686 - RNA, 64 nt, Homo Sapiens; identical to SEQ ID NO: 39559

SEQ ID NO: 229687 - RNA, 64 nt, Homo Sapiens; identical to SEQ ID NO: 39560

SEQ ID NO: 229688 - RNA, 64 nt, Homo Sapiens; identical to SEQ ID NO: 39561

SEQ ID NO: 229689 - RNA, 64 nt, Homo Sapiens; identical to SEQ ID NO: 39562

SEQ ID NO: 229690 - RNA, 64 nt, Homo Sapiens; identical to SEQ ID NO: 39563

SEQ ID NO: 229691 - RNA, 64 nt, Homo Sapiens; identical to SEQ ID NO: 39564

SEQ ID NO: 229692 - RNA, 64 nt, Homo Sapiens; identical to SEQ ID NO: 39565

SEQ ID NO: 229693 - RNA, 64 nt, Homo Sapiens; identical to SEQ ID NO: 39566

SEQ ID NO: 229694 - RNA, 64 nt, Homo Sapiens; identical to SEQ ID NO: 39567

SEQ ID NO: 229695 - RNA, 64 nt, Homo Sapiens; identical to SEQ ID NO: 39568

SEQ ID NO: 229696 - RNA, 64 nt, Homo Sapiens; identical to SEQ ID NO: 39569

SEQ ID NO: 229697 - RNA, 64 nt, Homo Sapiens; identical to SEQ ID NO: 39570

SEQ ID NO: 229698 - RNA, 64 nt, Homo Sapiens; identical to SEQ ID NO: 39571

SEQ ID NO: 229699 - RNA, 64 nt, Homo Sapiens; identical to SEQ ID NO: 39572

SEQ ID NO: 229700 - RNA, 64 nt, Homo Sapiens; identical to SEQ ID NO: 39573

SEQ ID NO: 229701 - RNA, 64 nt, Homo Sapiens; identical to SEQ ID NO: 39574

SEQ ID NO: 229702 - RNA, 64 nt, Homo Sapiens; identical to SEQ ID NO: 39575

SEQ ID NO: 229703 - RNA, 64 nt, Homo Sapiens; identical to SEQ ID NO: 39576

SEQ ID NO: 229704 - RNA, 64 nt, Homo Sapiens; identical to SEQ ID NO: 39577

SEQ ID NO: 229705 - RNA, 64 nt, Homo Sapiens; identical to SEQ ID NO: 39578

SEQ ID NO: 229706 - RNA, 64 nt, Homo Sapiens; identical to SEQ ID NO: 39579

SEQ ID NO: 229707 - RNA, 64 nt, Homo Sapiens; identical to SEQ ID NO: 39580

SEQ ID NO: 229708 - RNA, 64 nt, Homo Sapiens; identical to SEQ ID NO: 39581

SEQ ID NO: 229709 - RNA, 64 nt, Homo Sapiens; identical to SEQ ID NO: 39582

SEQ ID NO: 229710 - RNA, 64 nt, Homo Sapiens; identical to SEQ ID NO: 39583

SEQ ID NO: 229711 - RNA, 64 nt, Homo Sapiens; identical to SEQ ID NO: 39584

SEQ ID NO: 229712 - RNA, 64 nt, Homo Sapiens; identical to SEQ ID NO: 39585

SEQ ID NO: 229713 - RNA, 64 nt, Homo Sapiens; identical to SEQ ID NO: 39586

SEQ ID NO: 229714 - RNA, 64 nt, Homo Sapiens; identical to SEQ ID NO: 39587

SEQ ID NO: 229715 - RNA, 64 nt, Homo Sapiens; identical to SEQ ID NO: 39588

SEQ ID NO: 229716 - RNA, 64 nt, Homo Sapiens; identical to SEQ ID NO: 39589

SEQ ID NO: 229717 - RNA, 64 nt, Homo Sapiens; identical to SEQ ID NO: 39590

SEQ ID NO: 229718 - RNA, 64 nt, Homo Sapiens; identical to SEQ ID NO: 39591

SEQ ID NO: 229719 - RNA, 64 nt, Homo Sapiens; identical to SEQ ID NO: 39592

SEQ ID NO: 229720 - RNA, 64 nt, Homo Sapiens; identical to SEQ ID NO: 39593

SEQ ID NO: 229721 - RNA, 64 nt, Homo Sapiens; identical to SEQ ID NO: 39594

SEQ ID NO: 229722 - RNA, 64 nt, Homo Sapiens; identical to SEQ ID NO: 39595

SEQ ID NO: 229723 - RNA, 64 nt, Homo Sapiens; identical to SEQ ID NO: 39596

SEQ ID NO: 229724 - RNA, 64 nt, Homo Sapiens; identical to SEQ ID NO: 39597

SEQ ID NO: 229725 - RNA, 64 nt, Homo Sapiens; identical to SEQ ID NO: 39598

SEQ ID NO: 229726 - RNA, 64 nt, Homo Sapiens; identical to SEQ ID NO: 39599

SEQ ID NO: 229727 - RNA, 64 nt, Homo Sapiens; identical to SEQ ID NO: 39600

SEQ ID NO: 229728 - RNA, 64 nt, Homo Sapiens; identical to SEQ ID NO: 39601

SEQ ID NO: 229729 - RNA, 64 nt, Homo Sapiens; identical to SEQ ID NO: 39602

SEQ ID NO: 229730 - RNA, 64 nt, Homo Sapiens; identical to SEQ ID NO: 39603

SEQ ID NO: 229731 - RNA, 64 nt, Homo Sapiens; identical to SEQ ID NO: 39604

SEQ ID NO: 229732 - RNA, 64 nt, Homo Sapiens; identical to SEQ ID NO: 39605

SEQ ID NO: 229733 - RNA, 64 nt, Homo Sapiens; identical to SEQ ID NO: 39606

SEQ ID NO: 229734 - RNA, 64 nt, Homo Sapiens; identical to SEQ ID NO: 39607

SEQ ID NO: 229735 - RNA, 64 nt, Homo Sapiens; identical to SEQ ID NO: 39608

SEQ ID NO: 229736 - RNA, 64 nt, Homo Sapiens; identical to SEQ ID NO: 39609

SEQ ID NO: 229737 - RNA, 64 nt, Homo Sapiens; identical to SEQ ID NO: 39610

SEQ ID NO: 229738 - RNA, 64 nt, Homo Sapiens; identical to SEQ ID NO: 39611

SEQ ID NO: 229739 - RNA, 64 nt, Homo Sapiens; identical to SEQ ID NO: 39612

SEQ ID NO: 229740 - RNA, 64 nt, Homo Sapiens; identical to SEQ ID NO: 39613

SEQ ID NO: 229741 - RNA, 64 nt, Homo Sapiens; identical to SEQ ID NO: 39614

SEQ ID NO: 229742 - RNA, 64 nt, Homo Sapiens; identical to SEQ ID NO: 39615

SEQ ID NO: 229743 - RNA, 64 nt, Homo Sapiens; identical to SEQ ID NO: 39616

SEQ ID NO: 229744 - RNA, 64 nt, Homo Sapiens; identical to SEQ ID NO: 39617

SEQ ID NO: 229745 - RNA, 64 nt, Homo Sapiens; identical to SEQ ID NO: 39618

SEQ ID NO: 229746 - RNA, 64 nt, Homo Sapiens; identical to SEQ ID NO: 39619

SEQ ID NO: 229747 - RNA, 64 nt, Homo Sapiens; identical to SEQ ID NO: 39620

SEQ ID NO: 229748 - RNA, 64 nt, Homo Sapiens; identical to SEQ ID NO: 39621

SEQ ID NO: 229749 - RNA, 64 nt, Homo Sapiens; identical to SEQ ID NO: 39622

SEQ ID NO: 229750 - RNA, 64 nt, Homo Sapiens; identical to SEQ ID NO: 39623

SEQ ID NO: 229751 - RNA, 64 nt, Homo Sapiens; identical to SEQ ID NO: 39624

SEQ ID NO: 229752 - RNA, 64 nt, Homo Sapiens; identical to SEQ ID NO: 39625

SEQ ID NO: 229753 - RNA, 64 nt, Homo Sapiens; identical to SEQ ID NO: 39626

SEQ ID NO: 229754 - RNA, 64 nt, Homo Sapiens; identical to SEQ ID NO: 39627

SEQ ID NO: 229755 - RNA, 64 nt, Homo Sapiens; identical to SEQ ID NO: 39628

SEQ ID NO: 229756 - RNA, 64 nt, Homo Sapiens; identical to SEQ ID NO: 39629

SEQ ID NO: 229757 - RNA, 64 nt, Homo Sapiens; identical to SEQ ID NO: 39630

SEQ ID NO: 229758 - RNA, 64 nt, Homo Sapiens; identical to SEQ ID NO: 39631

SEQ ID NO: 229759 - RNA, 64 nt, Homo Sapiens; identical to SEQ ID NO: 39632

SEQ ID NO: 229760 - RNA, 64 nt, Homo Sapiens; identical to SEQ ID NO: 39633

SEQ ID NO: 229761 - RNA, 64 nt, Homo Sapiens; identical to SEQ ID NO: 39634

SEQ ID NO: 229762 - RNA, 64 nt, Homo Sapiens; identical to SEQ ID NO: 39635

SEQ ID NO: 229763 - RNA, 64 nt, Homo Sapiens; identical to SEQ ID NO: 39636

SEQ ID NO: 229764 - RNA, 64 nt, Homo Sapiens; identical to SEQ ID NO: 39637

SEQ ID NO: 229765 - RNA, 64 nt, Homo Sapiens; identical to SEQ ID NO: 39638

SEQ ID NO: 229766 - RNA, 64 nt, Homo Sapiens; identical to SEQ ID NO: 39639

SEQ ID NO: 229767 - RNA, 64 nt, Homo Sapiens; identical to SEQ ID NO: 39640

SEQ ID NO: 229768 - RNA, 64 nt, Homo Sapiens; identical to SEQ ID NO: 39641

SEQ ID NO: 229769 - RNA, 64 nt, Homo Sapiens; identical to SEQ ID NO: 39642

SEQ ID NO: 229770 - RNA, 64 nt, Homo Sapiens; identical to SEQ ID NO: 39643

SEQ ID NO: 229771 - RNA, 64 nt, Homo Sapiens; identical to SEQ ID NO: 39644

SEQ ID NO: 229772 - RNA, 64 nt, Homo Sapiens; identical to SEQ ID NO: 39645

SEQ ID NO: 229773 - RNA, 64 nt, Homo Sapiens; identical to SEQ ID NO: 39646

SEQ ID NO: 229774 - RNA, 64 nt, Homo Sapiens; identical to SEQ ID NO: 39647

SEQ ID NO: 229775 - RNA, 64 nt, Homo Sapiens; identical to SEQ ID NO: 39648

SEQ ID NO: 229776 - RNA, 64 nt, Homo Sapiens; identical to SEQ ID NO: 39649

SEQ ID NO: 229777 - RNA, 64 nt, Homo Sapiens; identical to SEQ ID NO: 39650

SEQ ID NO: 229778 - RNA, 64 nt, Homo Sapiens; identical to SEQ ID NO: 39651

SEQ ID NO: 229779 - RNA, 64 nt, Homo Sapiens; identical to SEQ ID NO: 39652

SEQ ID NO: 229780 - RNA, 64 nt, Homo Sapiens; identical to SEQ ID NO: 39653

SEQ ID NO: 229781 - RNA, 64 nt, Homo Sapiens; identical to SEQ ID NO: 39654

SEQ ID NO: 229782 - RNA, 64 nt, Homo Sapiens; identical to SEQ ID NO: 39655

SEQ ID NO: 229783 - RNA, 64 nt, Homo Sapiens; identical to SEQ ID NO: 39656

SEQ ID NO: 229784 - RNA, 64 nt, Homo Sapiens; identical to SEQ ID NO: 39657

SEQ ID NO: 229785 - RNA, 64 nt, Homo Sapiens; identical to SEQ ID NO: 39658

SEQ ID NO: 229786 - RNA, 64 nt, Homo Sapiens; identical to SEQ ID NO: 39659

SEQ ID NO: 229787 - RNA, 64 nt, Homo Sapiens; identical to SEQ ID NO: 39660

SEQ ID NO: 229788 - RNA, 64 nt, Homo Sapiens; identical to SEQ ID NO: 39661

SEQ ID NO: 229789 - RNA, 64 nt, Homo Sapiens; identical to SEQ ID NO: 39662

SEQ ID NO: 229790 - RNA, 64 nt, Homo Sapiens; identical to SEQ ID NO: 39663

SEQ ID NO: 229791 - RNA, 64 nt, Homo Sapiens; identical to SEQ ID NO: 39664

SEQ ID NO: 229792 - RNA, 64 nt, Homo Sapiens; identical to SEQ ID NO: 39665

SEQ ID NO: 229793 - RNA, 64 nt, Homo Sapiens; identical to SEQ ID NO: 39666

SEQ ID NO: 229794 - RNA, 64 nt, Homo Sapiens; identical to SEQ ID NO: 39667

SEQ ID NO: 229795 - RNA, 64 nt, Homo Sapiens; identical to SEQ ID NO: 39668

SEQ ID NO: 229796 - RNA, 64 nt, Homo Sapiens; identical to SEQ ID NO: 39669

SEQ ID NO: 229797 - RNA, 64 nt, Homo Sapiens; identical to SEQ ID NO: 39670

SEQ ID NO: 229798 - RNA, 64 nt, Homo Sapiens; identical to SEQ ID NO: 39671

SEQ ID NO: 229799 - RNA, 64 nt, Homo Sapiens; identical to SEQ ID NO: 39672

SEQ ID NO: 229800 - RNA, 64 nt, Homo Sapiens; identical to SEQ ID NO: 39673

SEQ ID NO: 229801 - RNA, 64 nt, Homo Sapiens; identical to SEQ ID NO: 39674

SEQ ID NO: 229802 - RNA, 64 nt, Homo Sapiens; identical to SEQ ID NO: 39675

SEQ ID NO: 229803 - RNA, 64 nt, Homo Sapiens; identical to SEQ ID NO: 39676

SEQ ID NO: 229804 - RNA, 64 nt, Homo Sapiens; identical to SEQ ID NO: 39677

SEQ ID NO: 229805 - RNA, 64 nt, Homo Sapiens; identical to SEQ ID NO: 39678

SEQ ID NO: 229806 - RNA, 64 nt, Homo Sapiens; identical to SEQ ID NO: 39679

SEQ ID NO: 229807 - RNA, 64 nt, Homo Sapiens; identical to SEQ ID NO: 39680

SEQ ID NO: 229808 - RNA, 64 nt, Homo Sapiens; identical to SEQ ID NO: 39681

SEQ ID NO: 229809 - RNA, 64 nt, Homo Sapiens; identical to SEQ ID NO: 39682

SEQ ID NO: 229810 - RNA, 64 nt, Homo Sapiens; identical to SEQ ID NO: 39683

SEQ ID NO: 229811 - RNA, 64 nt, Homo Sapiens; identical to SEQ ID NO: 39684

SEQ ID NO: 229812 - RNA, 64 nt, Homo Sapiens; identical to SEQ ID NO: 39685

SEQ ID NO: 229813 - RNA, 64 nt, Homo Sapiens; identical to SEQ ID NO: 39686

SEQ ID NO: 229814 - RNA, 64 nt, Homo Sapiens; identical to SEQ ID NO: 39687

SEQ ID NO: 229815 - RNA, 64 nt, Homo Sapiens; identical to SEQ ID NO: 39688

SEQ ID NO: 229816 - RNA, 64 nt, Homo Sapiens; identical to SEQ ID NO: 39689

SEQ ID NO: 229817 - RNA, 64 nt, Homo Sapiens; identical to SEQ ID NO: 39690

SEQ ID NO: 229818 - RNA, 64 nt, Homo Sapiens; identical to SEQ ID NO: 39691

SEQ ID NO: 229819 - RNA, 64 nt, Homo Sapiens; identical to SEQ ID NO: 39692

SEQ ID NO: 229820 - RNA, 64 nt, Homo Sapiens; identical to SEQ ID NO: 39693

SEQ ID NO: 229821 - RNA, 64 nt, Homo Sapiens; identical to SEQ ID NO: 39694

SEQ ID NO: 229822 - RNA, 64 nt, Homo Sapiens; identical to SEQ ID NO: 39695

SEQ ID NO: 229823 - RNA, 64 nt, Homo Sapiens; identical to SEQ ID NO: 39696

SEQ ID NO: 229824 - RNA, 64 nt, Homo Sapiens; identical to SEQ ID NO: 39697

SEQ ID NO: 229825 - RNA, 64 nt, Homo Sapiens; identical to SEQ ID NO: 39698

SEQ ID NO: 229826 - RNA, 64 nt, Homo Sapiens; identical to SEQ ID NO: 39699

SEQ ID NO: 229827 - RNA, 64 nt, Homo Sapiens; identical to SEQ ID NO: 39700

SEQ ID NO: 229828 - RNA, 64 nt, Homo Sapiens; identical to SEQ ID NO: 39701

SEQ ID NO: 229829 - RNA, 64 nt, Homo Sapiens; identical to SEQ ID NO: 39702

SEQ ID NO: 229830 - RNA, 64 nt, Homo Sapiens; identical to SEQ ID NO: 39703

SEQ ID NO: 229831 - RNA, 64 nt, Homo Sapiens; identical to SEQ ID NO: 39704

SEQ ID NO: 229832 - RNA, 64 nt, Homo Sapiens; identical to SEQ ID NO: 39705

SEQ ID NO: 229833 - RNA, 64 nt, Homo Sapiens; identical to SEQ ID NO: 39706

SEQ ID NO: 229834 - RNA, 64 nt, Homo Sapiens; identical to SEQ ID NO: 39707

SEQ ID NO: 229835 - RNA, 64 nt, Homo Sapiens; identical to SEQ ID NO: 39708

SEQ ID NO: 229836 - RNA, 64 nt, Homo Sapiens; identical to SEQ ID NO: 39709

SEQ ID NO: 229837 - RNA, 64 nt, Homo Sapiens; identical to SEQ ID NO: 39710

SEQ ID NO: 229838 - RNA, 64 nt, Homo Sapiens; identical to SEQ ID NO: 39711

SEQ ID NO: 229839 - RNA, 64 nt, Homo Sapiens; identical to SEQ ID NO: 39712

SEQ ID NO: 229840 - RNA, 64 nt, Homo Sapiens; identical to SEQ ID NO: 39713

SEQ ID NO: 229841 - RNA, 64 nt, Homo Sapiens; identical to SEQ ID NO: 39714

SEQ ID NO: 229842 - RNA, 64 nt, Homo Sapiens; identical to SEQ ID NO: 39715

SEQ ID NO: 229843 - RNA, 64 nt, Homo Sapiens; identical to SEQ ID NO: 39716

SEQ ID NO: 229844 - RNA, 64 nt, Homo Sapiens; identical to SEQ ID NO: 39717

SEQ ID NO: 229845 - RNA, 64 nt, Homo Sapiens; identical to SEQ ID NO: 39718

SEQ ID NO: 229846 - RNA, 64 nt, Homo Sapiens; identical to SEQ ID NO: 39719

SEQ ID NO: 229847 - RNA, 64 nt, Homo Sapiens; identical to SEQ ID NO: 39720

SEQ ID NO: 229848 - RNA, 64 nt, Homo Sapiens; identical to SEQ ID NO: 39721

SEQ ID NO: 229849 - RNA, 64 nt, Homo Sapiens; identical to SEQ ID NO: 39722

SEQ ID NO: 229850 - RNA, 64 nt, Homo Sapiens; identical to SEQ ID NO: 39723

SEQ ID NO: 229851 - RNA, 64 nt, Homo Sapiens; identical to SEQ ID NO: 39724

SEQ ID NO: 229852 - RNA, 64 nt, Homo Sapiens; identical to SEQ ID NO: 39725

SEQ ID NO: 229853 - RNA, 64 nt, Homo Sapiens; identical to SEQ ID NO: 39726

SEQ ID NO: 229854 - RNA, 64 nt, Homo Sapiens; identical to SEQ ID NO: 39727

SEQ ID NO: 229855 - RNA, 64 nt, Homo Sapiens; identical to SEQ ID NO: 39728

SEQ ID NO: 229856 - RNA, 64 nt, Homo Sapiens; identical to SEQ ID NO: 39729

SEQ ID NO: 229857 - RNA, 64 nt, Homo Sapiens; identical to SEQ ID NO: 39730

SEQ ID NO: 229858 - RNA, 64 nt, Homo Sapiens; identical to SEQ ID NO: 39731

SEQ ID NO: 229859 - RNA, 64 nt, Homo Sapiens; identical to SEQ ID NO: 39732

SEQ ID NO: 229860 - RNA, 64 nt, Homo Sapiens; identical to SEQ ID NO: 39733

SEQ ID NO: 229861 - RNA, 64 nt, Homo Sapiens; identical to SEQ ID NO: 39734

SEQ ID NO: 229862 - RNA, 64 nt, Homo Sapiens; identical to SEQ ID NO: 39735

SEQ ID NO: 229863 - RNA, 64 nt, Homo Sapiens; identical to SEQ ID NO: 39736

SEQ ID NO: 229864 - RNA, 64 nt, Homo Sapiens; identical to SEQ ID NO: 39737

SEQ ID NO: 229865 - RNA, 64 nt, Homo Sapiens; identical to SEQ ID NO: 39738

SEQ ID NO: 229866 - RNA, 64 nt, Homo Sapiens; identical to SEQ ID NO: 39739

SEQ ID NO: 229867 - RNA, 64 nt, Homo Sapiens; identical to SEQ ID NO: 39740

SEQ ID NO: 229868 - RNA, 64 nt, Homo Sapiens; identical to SEQ ID NO: 39741

SEQ ID NO: 229869 - RNA, 64 nt, Homo Sapiens; identical to SEQ ID NO: 39742

SEQ ID NO: 229870 - RNA, 64 nt, Homo Sapiens; identical to SEQ ID NO: 39743

SEQ ID NO: 229871 - RNA, 64 nt, Homo Sapiens; identical to SEQ ID NO: 39744

SEQ ID NO: 229872 - RNA, 64 nt, Homo Sapiens; identical to SEQ ID NO: 39745

SEQ ID NO: 229873 - RNA, 64 nt, Homo Sapiens; identical to SEQ ID NO: 39746

SEQ ID NO: 229874 - RNA, 64 nt, Homo Sapiens; identical to SEQ ID NO: 39747

SEQ ID NO: 229875 - RNA, 64 nt, Homo Sapiens; identical to SEQ ID NO: 39748

SEQ ID NO: 229876 - RNA, 64 nt, Homo Sapiens; identical to SEQ ID NO: 39749

SEQ ID NO: 229877 - RNA, 64 nt, Homo Sapiens; identical to SEQ ID NO: 39750

SEQ ID NO: 229878 - RNA, 64 nt, Homo Sapiens; identical to SEQ ID NO: 39751

SEQ ID NO: 229879 - RNA, 64 nt, Homo Sapiens; identical to SEQ ID NO: 39752

SEQ ID NO: 229880 - RNA, 64 nt, Homo Sapiens; identical to SEQ ID NO: 39753

SEQ ID NO: 229881 - RNA, 64 nt, Homo Sapiens; identical to SEQ ID NO: 39754

SEQ ID NO: 229882 - RNA, 64 nt, Homo Sapiens; identical to SEQ ID NO: 39755

SEQ ID NO: 229883 - RNA, 64 nt, Homo Sapiens; identical to SEQ ID NO: 39756

SEQ ID NO: 229884 - RNA, 64 nt, Homo Sapiens; identical to SEQ ID NO: 39757

SEQ ID NO: 229885 - RNA, 64 nt, Homo Sapiens; identical to SEQ ID NO: 39758

SEQ ID NO: 229886 - RNA, 64 nt, Homo Sapiens; identical to SEQ ID NO: 39759

SEQ ID NO: 229887 - RNA, 64 nt, Homo Sapiens; identical to SEQ ID NO: 39760

SEQ ID NO: 229888 - RNA, 64 nt, Homo Sapiens; identical to SEQ ID NO: 39761

SEQ ID NO: 229889 - RNA, 64 nt, Homo Sapiens; identical to SEQ ID NO: 39762

SEQ ID NO: 229890 - RNA, 64 nt, Homo Sapiens; identical to SEQ ID NO: 39763

SEQ ID NO: 229891 - RNA, 64 nt, Homo Sapiens; identical to SEQ ID NO: 39764

SEQ ID NO: 229892 - RNA, 64 nt, Homo Sapiens; identical to SEQ ID NO: 39765

SEQ ID NO: 229893 - RNA, 64 nt, Homo Sapiens; identical to SEQ ID NO: 39766

SEQ ID NO: 229894 - RNA, 64 nt, Homo Sapiens; identical to SEQ ID NO: 39767

SEQ ID NO: 229895 - RNA, 64 nt, Homo Sapiens; identical to SEQ ID NO: 39768

SEQ ID NO: 229896 - RNA, 64 nt, Homo Sapiens; identical to SEQ ID NO: 39769

SEQ ID NO: 229897 - RNA, 64 nt, Homo Sapiens; identical to SEQ ID NO: 39770

SEQ ID NO: 229898 - RNA, 64 nt, Homo Sapiens; identical to SEQ ID NO: 39771

SEQ ID NO: 229899 - RNA, 64 nt, Homo Sapiens; identical to SEQ ID NO: 39772

SEQ ID NO: 229900 - RNA, 64 nt, Homo Sapiens; identical to SEQ ID NO: 39773

SEQ ID NO: 229901 - RNA, 64 nt, Homo Sapiens; identical to SEQ ID NO: 39774

SEQ ID NO: 229902 - RNA, 64 nt, Homo Sapiens; identical to SEQ ID NO: 39775

SEQ ID NO: 229903 - RNA, 64 nt, Homo Sapiens; identical to SEQ ID NO: 39776

SEQ ID NO: 229904 - RNA, 64 nt, Homo Sapiens; identical to SEQ ID NO: 39777

SEQ ID NO: 229905 - RNA, 64 nt, Homo Sapiens; identical to SEQ ID NO: 39778

SEQ ID NO: 229906 - RNA, 64 nt, Homo Sapiens; identical to SEQ ID NO: 39779

SEQ ID NO: 229907 - RNA, 64 nt, Homo Sapiens; identical to SEQ ID NO: 39780

SEQ ID NO: 229908 - RNA, 64 nt, Homo Sapiens; identical to SEQ ID NO: 39781

SEQ ID NO: 229909 - RNA, 64 nt, Homo Sapiens; identical to SEQ ID NO: 39782

SEQ ID NO: 229910 - RNA, 64 nt, Homo Sapiens; identical to SEQ ID NO: 39783

SEQ ID NO: 229911 - RNA, 64 nt, Homo Sapiens; identical to SEQ ID NO: 39784

SEQ ID NO: 229912 - RNA, 64 nt, Homo Sapiens; identical to SEQ ID NO: 39785

SEQ ID NO: 229913 - RNA, 64 nt, Homo Sapiens; identical to SEQ ID NO: 39786

SEQ ID NO: 229914 - RNA, 64 nt, Homo Sapiens; identical to SEQ ID NO: 39787

SEQ ID NO: 229915 - RNA, 64 nt, Homo Sapiens; identical to SEQ ID NO: 39788

SEQ ID NO: 229916 - RNA, 64 nt, Homo Sapiens; identical to SEQ ID NO: 39789

SEQ ID NO: 229917 - RNA, 64 nt, Homo Sapiens; identical to SEQ ID NO: 39790

SEQ ID NO: 229918 - RNA, 64 nt, Homo Sapiens; identical to SEQ ID NO: 39791

SEQ ID NO: 229919 - RNA, 64 nt, Homo Sapiens; identical to SEQ ID NO: 39792

SEQ ID NO: 229920 - RNA, 64 nt, Homo Sapiens; identical to SEQ ID NO: 39793

SEQ ID NO: 229921 - RNA, 64 nt, Homo Sapiens; identical to SEQ ID NO: 39794

SEQ ID NO: 229922 - RNA, 64 nt, Homo Sapiens; identical to SEQ ID NO: 39795

SEQ ID NO: 229923 - RNA, 64 nt, Homo Sapiens; identical to SEQ ID NO: 39796

SEQ ID NO: 229924 - RNA, 64 nt, Homo Sapiens; identical to SEQ ID NO: 39797

SEQ ID NO: 229925 - RNA, 64 nt, Homo Sapiens; identical to SEQ ID NO: 39798

SEQ ID NO: 229926 - RNA, 64 nt, Homo Sapiens; identical to SEQ ID NO: 39799

SEQ ID NO: 229927 - RNA, 64 nt, Homo Sapiens; identical to SEQ ID NO: 39800

SEQ ID NO: 229928 - RNA, 64 nt, Homo Sapiens; identical to SEQ ID NO: 39801

SEQ ID NO: 229929 - RNA, 64 nt, Homo Sapiens; identical to SEQ ID NO: 39802

SEQ ID NO: 229930 - RNA, 64 nt, Homo Sapiens; identical to SEQ ID NO: 39803

SEQ ID NO: 229931 - RNA, 64 nt, Homo Sapiens; identical to SEQ ID NO: 39804

SEQ ID NO: 229932 - RNA, 64 nt, Homo Sapiens; identical to SEQ ID NO: 39805

SEQ ID NO: 229933 - RNA, 64 nt, Homo Sapiens; identical to SEQ ID NO: 39806

SEQ ID NO: 229934 - RNA, 64 nt, Homo Sapiens; identical to SEQ ID NO: 39807

SEQ ID NO: 229935 - RNA, 64 nt, Homo Sapiens; identical to SEQ ID NO: 39808

SEQ ID NO: 229936 - RNA, 64 nt, Homo Sapiens; identical to SEQ ID NO: 39809

SEQ ID NO: 229937 - RNA, 64 nt, Homo Sapiens; identical to SEQ ID NO: 39810

SEQ ID NO: 229938 - RNA, 64 nt, Homo Sapiens; identical to SEQ ID NO: 39811

SEQ ID NO: 229939 - RNA, 64 nt, Homo Sapiens; identical to SEQ ID NO: 39812

SEQ ID NO: 229940 - RNA, 64 nt, Homo Sapiens; identical to SEQ ID NO: 39813

SEQ ID NO: 229941 - RNA, 64 nt, Homo Sapiens; identical to SEQ ID NO: 39814

SEQ ID NO: 229942 - RNA, 64 nt, Homo Sapiens; identical to SEQ ID NO: 39815

SEQ ID NO: 229943 - RNA, 64 nt, Homo Sapiens; identical to SEQ ID NO: 39816

SEQ ID NO: 229944 - RNA, 64 nt, Homo Sapiens; identical to SEQ ID NO: 39817

SEQ ID NO: 229945 - RNA, 64 nt, Homo Sapiens; identical to SEQ ID NO: 39818

SEQ ID NO: 229946 - RNA, 64 nt, Homo Sapiens; identical to SEQ ID NO: 39819

SEQ ID NO: 229947 - RNA, 64 nt, Homo Sapiens; identical to SEQ ID NO: 39820

SEQ ID NO: 229948 - RNA, 64 nt, Homo Sapiens; identical to SEQ ID NO: 39821

SEQ ID NO: 229949 - RNA, 64 nt, Homo Sapiens; identical to SEQ ID NO: 39822

SEQ ID NO: 229950 - RNA, 64 nt, Homo Sapiens; identical to SEQ ID NO: 39823

SEQ ID NO: 229951 - RNA, 64 nt, Homo Sapiens; identical to SEQ ID NO: 39824

SEQ ID NO: 229952 - RNA, 64 nt, Homo Sapiens; identical to SEQ ID NO: 39825

SEQ ID NO: 229953 - RNA, 64 nt, Homo Sapiens; identical to SEQ ID NO: 39826

SEQ ID NO: 229954 - RNA, 64 nt, Homo Sapiens; identical to SEQ ID NO: 39827

SEQ ID NO: 229955 - RNA, 64 nt, Homo Sapiens; identical to SEQ ID NO: 39828

SEQ ID NO: 229956 - RNA, 64 nt, Homo Sapiens; identical to SEQ ID NO: 39829

SEQ ID NO: 229957 - RNA, 64 nt, Homo Sapiens; identical to SEQ ID NO: 39830

SEQ ID NO: 229958 - RNA, 64 nt, Homo Sapiens; identical to SEQ ID NO: 39831

SEQ ID NO: 229959 - RNA, 64 nt, Homo Sapiens; identical to SEQ ID NO: 39832

SEQ ID NO: 229960 - RNA, 64 nt, Homo Sapiens; identical to SEQ ID NO: 39833

SEQ ID NO: 229961 - RNA, 64 nt, Homo Sapiens; identical to SEQ ID NO: 39834

SEQ ID NO: 229962 - RNA, 64 nt, Homo Sapiens; identical to SEQ ID NO: 39835

SEQ ID NO: 229963 - RNA, 64 nt, Homo Sapiens; identical to SEQ ID NO: 39836

SEQ ID NO: 229964 - RNA, 64 nt, Homo Sapiens; identical to SEQ ID NO: 39837

SEQ ID NO: 229965 - RNA, 64 nt, Homo Sapiens; identical to SEQ ID NO: 39838

SEQ ID NO: 229966 - RNA, 64 nt, Homo Sapiens; identical to SEQ ID NO: 39839

SEQ ID NO: 229967 - RNA, 64 nt, Homo Sapiens; identical to SEQ ID NO: 39840

SEQ ID NO: 229968 - RNA, 64 nt, Homo Sapiens; identical to SEQ ID NO: 39841

SEQ ID NO: 229969 - RNA, 64 nt, Homo Sapiens; identical to SEQ ID NO: 39842

SEQ ID NO: 229970 - RNA, 64 nt, Homo Sapiens; identical to SEQ ID NO: 39843

SEQ ID NO: 229971 - RNA, 64 nt, Homo Sapiens; identical to SEQ ID NO: 39844

SEQ ID NO: 229972 - RNA, 64 nt, Homo Sapiens; identical to SEQ ID NO: 39845

SEQ ID NO: 229973 - RNA, 64 nt, Homo Sapiens; identical to SEQ ID NO: 39846

SEQ ID NO: 229974 - RNA, 64 nt, Homo Sapiens; identical to SEQ ID NO: 39847

SEQ ID NO: 229975 - RNA, 64 nt, Homo Sapiens; identical to SEQ ID NO: 39848

SEQ ID NO: 229976 - RNA, 64 nt, Homo Sapiens; identical to SEQ ID NO: 39849

SEQ ID NO: 229977 - RNA, 64 nt, Homo Sapiens; identical to SEQ ID NO: 39850

SEQ ID NO: 229978 - RNA, 64 nt, Homo Sapiens; identical to SEQ ID NO: 39851

SEQ ID NO: 229979 - RNA, 64 nt, Homo Sapiens; identical to SEQ ID NO: 39852

SEQ ID NO: 229980 - RNA, 64 nt, Homo Sapiens; identical to SEQ ID NO: 39853

SEQ ID NO: 229981 - RNA, 64 nt, Homo Sapiens; identical to SEQ ID NO: 39854

SEQ ID NO: 229982 - RNA, 64 nt, Homo Sapiens; identical to SEQ ID NO: 39855

SEQ ID NO: 229983 - RNA, 64 nt, Homo Sapiens; identical to SEQ ID NO: 39856

SEQ ID NO: 229984 - RNA, 64 nt, Homo Sapiens; identical to SEQ ID NO: 39857

SEQ ID NO: 229985 - RNA, 64 nt, Homo Sapiens; identical to SEQ ID NO: 39858

SEQ ID NO: 229986 - RNA, 64 nt, Homo Sapiens; identical to SEQ ID NO: 39859

SEQ ID NO: 229987 - RNA, 64 nt, Homo Sapiens; identical to SEQ ID NO: 39860

SEQ ID NO: 229988 - RNA, 64 nt, Homo Sapiens; identical to SEQ ID NO: 39861

SEQ ID NO: 229989 - RNA, 64 nt, Homo Sapiens; identical to SEQ ID NO: 39862

SEQ ID NO: 229990 - RNA, 64 nt, Homo Sapiens; identical to SEQ ID NO: 39863

SEQ ID NO: 229991 - RNA, 64 nt, Homo Sapiens; identical to SEQ ID NO: 39864

SEQ ID NO: 229992 - RNA, 64 nt, Homo Sapiens; identical to SEQ ID NO: 39865

SEQ ID NO: 229993 - RNA, 64 nt, Homo Sapiens; identical to SEQ ID NO: 39866

SEQ ID NO: 229994 - RNA, 64 nt, Homo Sapiens; identical to SEQ ID NO: 39867

SEQ ID NO: 229995 - RNA, 64 nt, Homo Sapiens; identical to SEQ ID NO: 39868

SEQ ID NO: 229996 - RNA, 64 nt, Homo Sapiens; identical to SEQ ID NO: 39869

SEQ ID NO: 229997 - RNA, 64 nt, Homo Sapiens; identical to SEQ ID NO: 39870

SEQ ID NO: 229998 - RNA, 64 nt, Homo Sapiens; identical to SEQ ID NO: 39871

SEQ ID NO: 229999 - RNA, 64 nt, Homo Sapiens; identical to SEQ ID NO: 39872

SEQ ID NO: 230000 - RNA, 64 nt, Homo Sapiens; identical to SEQ ID NO: 39873

SEQ ID NO: 230001 - RNA, 64 nt, Homo Sapiens; identical to SEQ ID NO: 39874

SEQ ID NO: 230002 - RNA, 64 nt, Homo Sapiens; identical to SEQ ID NO: 39875

SEQ ID NO: 230003 - RNA, 64 nt, Homo Sapiens; identical to SEQ ID NO: 39876

SEQ ID NO: 230004 - RNA, 64 nt, Homo Sapiens; identical to SEQ ID NO: 39877

SEQ ID NO: 230005 - RNA, 64 nt, Homo Sapiens; identical to SEQ ID NO: 39878

SEQ ID NO: 230006 - RNA, 64 nt, Homo Sapiens; identical to SEQ ID NO: 39879

SEQ ID NO: 230007 - RNA, 64 nt, Homo Sapiens; identical to SEQ ID NO: 39880

SEQ ID NO: 230008 - RNA, 64 nt, Homo Sapiens; identical to SEQ ID NO: 39881

SEQ ID NO: 230009 - RNA, 64 nt, Homo Sapiens; identical to SEQ ID NO: 39882

SEQ ID NO: 230010 - RNA, 64 nt, Homo Sapiens; identical to SEQ ID NO: 39883

SEQ ID NO: 230011 - RNA, 64 nt, Homo Sapiens; identical to SEQ ID NO: 39884

SEQ ID NO: 230012 - RNA, 64 nt, Homo Sapiens; identical to SEQ ID NO: 39885

SEQ ID NO: 230013 - RNA, 64 nt, Homo Sapiens; identical to SEQ ID NO: 39886

SEQ ID NO: 230014 - RNA, 64 nt, Homo Sapiens; identical to SEQ ID NO: 39887

SEQ ID NO: 230015 - RNA, 64 nt, Homo Sapiens; identical to SEQ ID NO: 39888

SEQ ID NO: 230016 - RNA, 64 nt, Homo Sapiens; identical to SEQ ID NO: 39889

SEQ ID NO: 230017 - RNA, 64 nt, Homo Sapiens; identical to SEQ ID NO: 39890

SEQ ID NO: 230018 - RNA, 64 nt, Homo Sapiens; identical to SEQ ID NO: 39891

SEQ ID NO: 230019 - RNA, 64 nt, Homo Sapiens; identical to SEQ ID NO: 39892

SEQ ID NO: 230020 - RNA, 64 nt, Homo Sapiens; identical to SEQ ID NO: 39893

SEQ ID NO: 230021 - RNA, 64 nt, Homo Sapiens; identical to SEQ ID NO: 39894

SEQ ID NO: 230022 - RNA, 64 nt, Homo Sapiens; identical to SEQ ID NO: 39895

SEQ ID NO: 230023 - RNA, 64 nt, Homo Sapiens; identical to SEQ ID NO: 39896

SEQ ID NO: 230024 - RNA, 64 nt, Homo Sapiens; identical to SEQ ID NO: 39897

SEQ ID NO: 230025 - RNA, 64 nt, Homo Sapiens; identical to SEQ ID NO: 39898

SEQ ID NO: 230026 - RNA, 64 nt, Homo Sapiens; identical to SEQ ID NO: 39899

SEQ ID NO: 230027 - RNA, 64 nt, Homo Sapiens; identical to SEQ ID NO: 39900

SEQ ID NO: 230028 - RNA, 64 nt, Homo Sapiens; identical to SEQ ID NO: 39901

SEQ ID NO: 230029 - RNA, 64 nt, Homo Sapiens; identical to SEQ ID NO: 39902

SEQ ID NO: 230030 - RNA, 64 nt, Homo Sapiens; identical to SEQ ID NO: 39903

SEQ ID NO: 230031 - RNA, 64 nt, Homo Sapiens; identical to SEQ ID NO: 39904

SEQ ID NO: 230032 - RNA, 64 nt, Homo Sapiens; identical to SEQ ID NO: 39905

SEQ ID NO: 230033 - RNA, 64 nt, Homo Sapiens; identical to SEQ ID NO: 39906

SEQ ID NO: 230034 - RNA, 64 nt, Homo Sapiens; identical to SEQ ID NO: 39907

SEQ ID NO: 230035 - RNA, 64 nt, Homo Sapiens; identical to SEQ ID NO: 39908

SEQ ID NO: 230036 - RNA, 64 nt, Homo Sapiens; identical to SEQ ID NO: 39909

SEQ ID NO: 230037 - RNA, 64 nt, Homo Sapiens; identical to SEQ ID NO: 39910

SEQ ID NO: 230038 - RNA, 64 nt, Homo Sapiens; identical to SEQ ID NO: 39911

SEQ ID NO: 230039 - RNA, 64 nt, Homo Sapiens; identical to SEQ ID NO: 39912

SEQ ID NO: 230040 - RNA, 64 nt, Homo Sapiens; identical to SEQ ID NO: 39913

SEQ ID NO: 230041 - RNA, 64 nt, Homo Sapiens; identical to SEQ ID NO: 39914

SEQ ID NO: 230042 - RNA, 64 nt, Homo Sapiens; identical to SEQ ID NO: 39915

SEQ ID NO: 230043 - RNA, 64 nt, Homo Sapiens; identical to SEQ ID NO: 39916

SEQ ID NO: 230044 - RNA, 64 nt, Homo Sapiens; identical to SEQ ID NO: 39917

SEQ ID NO: 230045 - RNA, 64 nt, Homo Sapiens; identical to SEQ ID NO: 39918

SEQ ID NO: 230046 - RNA, 64 nt, Homo Sapiens; identical to SEQ ID NO: 39919

SEQ ID NO: 230047 - RNA, 64 nt, Homo Sapiens; identical to SEQ ID NO: 39920

SEQ ID NO: 230048 - RNA, 64 nt, Homo Sapiens; identical to SEQ ID NO: 39921

SEQ ID NO: 230049 - RNA, 64 nt, Homo Sapiens; identical to SEQ ID NO: 39922

SEQ ID NO: 230050 - RNA, 64 nt, Homo Sapiens; identical to SEQ ID NO: 39923

SEQ ID NO: 230051 - RNA, 64 nt, Homo Sapiens; identical to SEQ ID NO: 39924

SEQ ID NO: 230052 - RNA, 64 nt, Homo Sapiens; identical to SEQ ID NO: 39925

SEQ ID NO: 230053 - RNA, 64 nt, Homo Sapiens; identical to SEQ ID NO: 39926

SEQ ID NO: 230054 - RNA, 64 nt, Homo Sapiens; identical to SEQ ID NO: 39927

SEQ ID NO: 230055 - RNA, 64 nt, Homo Sapiens; identical to SEQ ID NO: 39928

SEQ ID NO: 230056 - RNA, 64 nt, Homo Sapiens; identical to SEQ ID NO: 39929

SEQ ID NO: 230057 - RNA, 64 nt, Homo Sapiens; identical to SEQ ID NO: 39930

SEQ ID NO: 230058 - RNA, 64 nt, Homo Sapiens; identical to SEQ ID NO: 39931

SEQ ID NO: 230059 - RNA, 64 nt, Homo Sapiens; identical to SEQ ID NO: 39932

SEQ ID NO: 230060 - RNA, 64 nt, Homo Sapiens; identical to SEQ ID NO: 39933

SEQ ID NO: 230061 - RNA, 64 nt, Homo Sapiens; identical to SEQ ID NO: 39934

SEQ ID NO: 230062 - RNA, 64 nt, Homo Sapiens; identical to SEQ ID NO: 39935

SEQ ID NO: 230063 - RNA, 64 nt, Homo Sapiens; identical to SEQ ID NO: 39936

SEQ ID NO: 230064 - RNA, 64 nt, Homo Sapiens; identical to SEQ ID NO: 39937

SEQ ID NO: 230065 - RNA, 64 nt, Homo Sapiens; identical to SEQ ID NO: 39938

SEQ ID NO: 230066 - RNA, 64 nt, Homo Sapiens; identical to SEQ ID NO: 39939

SEQ ID NO: 230067 - RNA, 64 nt, Homo Sapiens; identical to SEQ ID NO: 39940

SEQ ID NO: 230068 - RNA, 64 nt, Homo Sapiens; identical to SEQ ID NO: 39941

SEQ ID NO: 230069 - RNA, 64 nt, Homo Sapiens; identical to SEQ ID NO: 39942

SEQ ID NO: 230070 - RNA, 64 nt, Homo Sapiens; identical to SEQ ID NO: 39943

SEQ ID NO: 230071 - RNA, 64 nt, Homo Sapiens; identical to SEQ ID NO: 39944

SEQ ID NO: 230072 - RNA, 64 nt, Homo Sapiens; identical to SEQ ID NO: 39945

SEQ ID NO: 230073 - RNA, 64 nt, Homo Sapiens; identical to SEQ ID NO: 39946

SEQ ID NO: 230074 - RNA, 64 nt, Homo Sapiens; identical to SEQ ID NO: 39947

SEQ ID NO: 230075 - RNA, 64 nt, Homo Sapiens; identical to SEQ ID NO: 39948

SEQ ID NO: 230076 - RNA, 64 nt, Homo Sapiens; identical to SEQ ID NO: 39949

SEQ ID NO: 230077 - RNA, 64 nt, Homo Sapiens; identical to SEQ ID NO: 39950

SEQ ID NO: 230078 - RNA, 64 nt, Homo Sapiens; identical to SEQ ID NO: 39951

SEQ ID NO: 230079 - RNA, 64 nt, Homo Sapiens; identical to SEQ ID NO: 39952

SEQ ID NO: 230080 - RNA, 64 nt, Homo Sapiens; identical to SEQ ID NO: 39953

SEQ ID NO: 230081 - RNA, 64 nt, Homo Sapiens; identical to SEQ ID NO: 39954

SEQ ID NO: 230082 - RNA, 64 nt, Homo Sapiens; identical to SEQ ID NO: 39955

SEQ ID NO: 230083 - RNA, 64 nt, Homo Sapiens; identical to SEQ ID NO: 39956

SEQ ID NO: 230084 - RNA, 64 nt, Homo Sapiens; identical to SEQ ID NO: 39957

SEQ ID NO: 230085 - RNA, 64 nt, Homo Sapiens; identical to SEQ ID NO: 39958

SEQ ID NO: 230086 - RNA, 64 nt, Homo Sapiens; identical to SEQ ID NO: 39959

SEQ ID NO: 230087 - RNA, 64 nt, Homo Sapiens; identical to SEQ ID NO: 39960

SEQ ID NO: 230088 - RNA, 64 nt, Homo Sapiens; identical to SEQ ID NO: 39961

SEQ ID NO: 230089 - RNA, 64 nt, Homo Sapiens; identical to SEQ ID NO: 39962

SEQ ID NO: 230090 - RNA, 64 nt, Homo Sapiens; identical to SEQ ID NO: 39963

SEQ ID NO: 230091 - RNA, 64 nt, Homo Sapiens; identical to SEQ ID NO: 39964

SEQ ID NO: 230092 - RNA, 64 nt, Homo Sapiens; identical to SEQ ID NO: 39965

SEQ ID NO: 230093 - RNA, 64 nt, Homo Sapiens; identical to SEQ ID NO: 39966

SEQ ID NO: 230094 - RNA, 64 nt, Homo Sapiens; identical to SEQ ID NO: 39967

SEQ ID NO: 230095 - RNA, 64 nt, Homo Sapiens; identical to SEQ ID NO: 39968

SEQ ID NO: 230096 - RNA, 64 nt, Homo Sapiens; identical to SEQ ID NO: 39969

SEQ ID NO: 230097 - RNA, 64 nt, Homo Sapiens; identical to SEQ ID NO: 39970

SEQ ID NO: 230098 - RNA, 64 nt, Homo Sapiens; identical to SEQ ID NO: 39971

SEQ ID NO: 230099 - RNA, 64 nt, Homo Sapiens; identical to SEQ ID NO: 39972

SEQ ID NO: 230100 - RNA, 64 nt, Homo Sapiens; identical to SEQ ID NO: 39973

SEQ ID NO: 230101 - RNA, 64 nt, Homo Sapiens; identical to SEQ ID NO: 39974

SEQ ID NO: 230102 - RNA, 64 nt, Homo Sapiens; identical to SEQ ID NO: 39975

SEQ ID NO: 230103 - RNA, 64 nt, Homo Sapiens; identical to SEQ ID NO: 39976

SEQ ID NO: 230104 - RNA, 64 nt, Homo Sapiens; identical to SEQ ID NO: 39977

SEQ ID NO: 230105 - RNA, 64 nt, Homo Sapiens; identical to SEQ ID NO: 39978

SEQ ID NO: 230106 - RNA, 64 nt, Homo Sapiens; identical to SEQ ID NO: 39979

SEQ ID NO: 230107 - RNA, 64 nt, Homo Sapiens; identical to SEQ ID NO: 39980

SEQ ID NO: 230108 - RNA, 64 nt, Homo Sapiens; identical to SEQ ID NO: 39981

SEQ ID NO: 230109 - RNA, 64 nt, Homo Sapiens; identical to SEQ ID NO: 39982

SEQ ID NO: 230110 - RNA, 64 nt, Homo Sapiens; identical to SEQ ID NO: 39983

SEQ ID NO: 230111 - RNA, 64 nt, Homo Sapiens; identical to SEQ ID NO: 39984

SEQ ID NO: 230112 - RNA, 64 nt, Homo Sapiens; identical to SEQ ID NO: 39985

SEQ ID NO: 230113 - RNA, 64 nt, Homo Sapiens; identical to SEQ ID NO: 39986

SEQ ID NO: 230114 - RNA, 64 nt, Homo Sapiens; identical to SEQ ID NO: 39987

SEQ ID NO: 230115 - RNA, 64 nt, Homo Sapiens; identical to SEQ ID NO: 39988

SEQ ID NO: 230116 - RNA, 64 nt, Homo Sapiens; identical to SEQ ID NO: 39989

SEQ ID NO: 230117 - RNA, 64 nt, Homo Sapiens; identical to SEQ ID NO: 39990

SEQ ID NO: 230118 - RNA, 64 nt, Homo Sapiens; identical to SEQ ID NO: 39991

SEQ ID NO: 230119 - RNA, 64 nt, Homo Sapiens; identical to SEQ ID NO: 39992

SEQ ID NO: 230120 - RNA, 64 nt, Homo Sapiens; identical to SEQ ID NO: 39993

SEQ ID NO: 230121 - RNA, 64 nt, Homo Sapiens; identical to SEQ ID NO: 39994

SEQ ID NO: 230122 - RNA, 64 nt, Homo Sapiens; identical to SEQ ID NO: 39995

SEQ ID NO: 230123 - RNA, 64 nt, Homo Sapiens; identical to SEQ ID NO: 39996

SEQ ID NO: 230124 - RNA, 64 nt, Homo Sapiens; identical to SEQ ID NO: 39997

SEQ ID NO: 230125 - RNA, 64 nt, Homo Sapiens; identical to SEQ ID NO: 39998

SEQ ID NO: 230126 - RNA, 64 nt, Homo Sapiens; identical to SEQ ID NO: 39999

SEQ ID NO: 230127 - RNA, 64 nt, Homo Sapiens; identical to SEQ ID NO: 40000

SEQ ID NO: 230128 - RNA, 64 nt, Homo Sapiens; identical to SEQ ID NO: 40001

SEQ ID NO: 230129 - RNA, 64 nt, Homo Sapiens; identical to SEQ ID NO: 40002

SEQ ID NO: 230130 - RNA, 64 nt, Homo Sapiens; identical to SEQ ID NO: 40003

SEQ ID NO: 230131 - RNA, 64 nt, Homo Sapiens; identical to SEQ ID NO: 40004

SEQ ID NO: 230132 - RNA, 64 nt, Homo Sapiens; identical to SEQ ID NO: 40005

SEQ ID NO: 230133 - RNA, 64 nt, Homo Sapiens; identical to SEQ ID NO: 40006

SEQ ID NO: 230134 - RNA, 64 nt, Homo Sapiens; identical to SEQ ID NO: 40007

SEQ ID NO: 230135 - RNA, 64 nt, Homo Sapiens; identical to SEQ ID NO: 40008

SEQ ID NO: 230136 - RNA, 64 nt, Homo Sapiens; identical to SEQ ID NO: 40009

SEQ ID NO: 230137 - RNA, 64 nt, Homo Sapiens; identical to SEQ ID NO: 40010

SEQ ID NO: 230138 - RNA, 64 nt, Homo Sapiens; identical to SEQ ID NO: 40011

SEQ ID NO: 230139 - RNA, 64 nt, Homo Sapiens; identical to SEQ ID NO: 40012

SEQ ID NO: 230140 - RNA, 64 nt, Homo Sapiens; identical to SEQ ID NO: 40013

SEQ ID NO: 230141 - RNA, 64 nt, Homo Sapiens; identical to SEQ ID NO: 40014

SEQ ID NO: 230142 - RNA, 64 nt, Homo Sapiens; identical to SEQ ID NO: 40015

SEQ ID NO: 230143 - RNA, 64 nt, Homo Sapiens; identical to SEQ ID NO: 40016

SEQ ID NO: 230144 - RNA, 64 nt, Homo Sapiens; identical to SEQ ID NO: 40017

SEQ ID NO: 230145 - RNA, 64 nt, Homo Sapiens; identical to SEQ ID NO: 40018

SEQ ID NO: 230146 - RNA, 64 nt, Homo Sapiens; identical to SEQ ID NO: 40019

SEQ ID NO: 230147 - RNA, 64 nt, Homo Sapiens; identical to SEQ ID NO: 40020

SEQ ID NO: 230148 - RNA, 64 nt, Homo Sapiens; identical to SEQ ID NO: 40021

SEQ ID NO: 230149 - RNA, 64 nt, Homo Sapiens; identical to SEQ ID NO: 40022

SEQ ID NO: 230150 - RNA, 64 nt, Homo Sapiens; identical to SEQ ID NO: 40023

SEQ ID NO: 230151 - RNA, 64 nt, Homo Sapiens; identical to SEQ ID NO: 40024

SEQ ID NO: 230152 - RNA, 64 nt, Homo Sapiens; identical to SEQ ID NO: 40025

SEQ ID NO: 230153 - RNA, 64 nt, Homo Sapiens; identical to SEQ ID NO: 40026

SEQ ID NO: 230154 - RNA, 64 nt, Homo Sapiens; identical to SEQ ID NO: 40027

SEQ ID NO: 230155 - RNA, 64 nt, Homo Sapiens; identical to SEQ ID NO: 40028

SEQ ID NO: 230156 - RNA, 64 nt, Homo Sapiens; identical to SEQ ID NO: 40029

SEQ ID NO: 230157 - RNA, 64 nt, Homo Sapiens; identical to SEQ ID NO: 40030

SEQ ID NO: 230158 - RNA, 64 nt, Homo Sapiens; identical to SEQ ID NO: 40031

SEQ ID NO: 230159 - RNA, 64 nt, Homo Sapiens; identical to SEQ ID NO: 40032

SEQ ID NO: 230160 - RNA, 64 nt, Homo Sapiens; identical to SEQ ID NO: 40033

SEQ ID NO: 230161 - RNA, 64 nt, Homo Sapiens; identical to SEQ ID NO: 40034

SEQ ID NO: 230162 - RNA, 64 nt, Homo Sapiens; identical to SEQ ID NO: 40035

SEQ ID NO: 230163 - RNA, 64 nt, Homo Sapiens; identical to SEQ ID NO: 40036

SEQ ID NO: 230164 - RNA, 64 nt, Homo Sapiens; identical to SEQ ID NO: 40037

SEQ ID NO: 230165 - RNA, 64 nt, Homo Sapiens; identical to SEQ ID NO: 40038

SEQ ID NO: 230166 - RNA, 64 nt, Homo Sapiens; identical to SEQ ID NO: 40039

SEQ ID NO: 230167 - RNA, 64 nt, Homo Sapiens; identical to SEQ ID NO: 40040

SEQ ID NO: 230168 - RNA, 64 nt, Homo Sapiens; identical to SEQ ID NO: 40041

SEQ ID NO: 230169 - RNA, 64 nt, Homo Sapiens; identical to SEQ ID NO: 40042

SEQ ID NO: 230170 - RNA, 64 nt, Homo Sapiens; identical to SEQ ID NO: 40043

SEQ ID NO: 230171 - RNA, 64 nt, Homo Sapiens; identical to SEQ ID NO: 40044

SEQ ID NO: 230172 - RNA, 64 nt, Homo Sapiens; identical to SEQ ID NO: 40045

SEQ ID NO: 230173 - RNA, 64 nt, Homo Sapiens; identical to SEQ ID NO: 40046

SEQ ID NO: 230174 - RNA, 64 nt, Homo Sapiens; identical to SEQ ID NO: 40047

SEQ ID NO: 230175 - RNA, 64 nt, Homo Sapiens; identical to SEQ ID NO: 40048

SEQ ID NO: 230176 - RNA, 64 nt, Homo Sapiens; identical to SEQ ID NO: 40049

SEQ ID NO: 230177 - RNA, 64 nt, Homo Sapiens; identical to SEQ ID NO: 40050

SEQ ID NO: 230178 - RNA, 64 nt, Homo Sapiens; identical to SEQ ID NO: 40051

SEQ ID NO: 230179 - RNA, 64 nt, Homo Sapiens; identical to SEQ ID NO: 40052

SEQ ID NO: 230180 - RNA, 64 nt, Homo Sapiens; identical to SEQ ID NO: 40053

SEQ ID NO: 230181 - RNA, 64 nt, Homo Sapiens; identical to SEQ ID NO: 40054

SEQ ID NO: 230182 - RNA, 64 nt, Homo Sapiens; identical to SEQ ID NO: 40055

SEQ ID NO: 230183 - RNA, 64 nt, Homo Sapiens; identical to SEQ ID NO: 40056

SEQ ID NO: 230184 - RNA, 64 nt, Homo Sapiens; identical to SEQ ID NO: 40057

SEQ ID NO: 230185 - RNA, 64 nt, Homo Sapiens; identical to SEQ ID NO: 40058

SEQ ID NO: 230186 - RNA, 64 nt, Homo Sapiens; identical to SEQ ID NO: 40059

SEQ ID NO: 230187 - RNA, 64 nt, Homo Sapiens; identical to SEQ ID NO: 40060

SEQ ID NO: 230188 - RNA, 64 nt, Homo Sapiens; identical to SEQ ID NO: 40061

SEQ ID NO: 230189 - RNA, 64 nt, Homo Sapiens; identical to SEQ ID NO: 40062

SEQ ID NO: 230190 - RNA, 64 nt, Homo Sapiens; identical to SEQ ID NO: 40063

SEQ ID NO: 230191 - RNA, 64 nt, Homo Sapiens; identical to SEQ ID NO: 40064

SEQ ID NO: 230192 - RNA, 64 nt, Homo Sapiens; identical to SEQ ID NO: 40065

SEQ ID NO: 230193 - RNA, 64 nt, Homo Sapiens; identical to SEQ ID NO: 40066

SEQ ID NO: 230194 - RNA, 64 nt, Homo Sapiens; identical to SEQ ID NO: 40067

SEQ ID NO: 230195 - RNA, 64 nt, Homo Sapiens; identical to SEQ ID NO: 40068

SEQ ID NO: 230196 - RNA, 64 nt, Homo Sapiens; identical to SEQ ID NO: 40069

SEQ ID NO: 230197 - RNA, 64 nt, Homo Sapiens; identical to SEQ ID NO: 40070

SEQ ID NO: 230198 - RNA, 64 nt, Homo Sapiens; identical to SEQ ID NO: 40071

SEQ ID NO: 230199 - RNA, 64 nt, Homo Sapiens; identical to SEQ ID NO: 40072

SEQ ID NO: 230200 - RNA, 64 nt, Homo Sapiens; identical to SEQ ID NO: 40073

SEQ ID NO: 230201 - RNA, 64 nt, Homo Sapiens; identical to SEQ ID NO: 40074

SEQ ID NO: 230202 - RNA, 64 nt, Homo Sapiens; identical to SEQ ID NO: 40075

SEQ ID NO: 230203 - RNA, 64 nt, Homo Sapiens; identical to SEQ ID NO: 40076

SEQ ID NO: 230204 - RNA, 64 nt, Homo Sapiens; identical to SEQ ID NO: 40077

SEQ ID NO: 230205 - RNA, 64 nt, Homo Sapiens; identical to SEQ ID NO: 40078

SEQ ID NO: 230206 - RNA, 64 nt, Homo Sapiens; identical to SEQ ID NO: 40079

SEQ ID NO: 230207 - RNA, 64 nt, Homo Sapiens; identical to SEQ ID NO: 40080

SEQ ID NO: 230208 - RNA, 64 nt, Homo Sapiens; identical to SEQ ID NO: 40081

SEQ ID NO: 230209 - RNA, 64 nt, Homo Sapiens; identical to SEQ ID NO: 40082

SEQ ID NO: 230210 - RNA, 64 nt, Homo Sapiens; identical to SEQ ID NO: 40083

SEQ ID NO: 230211 - RNA, 64 nt, Homo Sapiens; identical to SEQ ID NO: 40084

SEQ ID NO: 230212 - RNA, 64 nt, Homo Sapiens; identical to SEQ ID NO: 40085

SEQ ID NO: 230213 - RNA, 64 nt, Homo Sapiens; identical to SEQ ID NO: 40086

SEQ ID NO: 230214 - RNA, 64 nt, Homo Sapiens; identical to SEQ ID NO: 40087

SEQ ID NO: 230215 - RNA, 64 nt, Homo Sapiens; identical to SEQ ID NO: 40088

SEQ ID NO: 230216 - RNA, 64 nt, Homo Sapiens; identical to SEQ ID NO: 40089

SEQ ID NO: 230217 - RNA, 64 nt, Homo Sapiens; identical to SEQ ID NO: 40090

SEQ ID NO: 230218 - RNA, 64 nt, Homo Sapiens; identical to SEQ ID NO: 40091

SEQ ID NO: 230219 - RNA, 64 nt, Homo Sapiens; identical to SEQ ID NO: 40092

SEQ ID NO: 230220 - RNA, 64 nt, Homo Sapiens; identical to SEQ ID NO: 40093

SEQ ID NO: 230221 - RNA, 64 nt, Homo Sapiens; identical to SEQ ID NO: 40094

SEQ ID NO: 230222 - RNA, 64 nt, Homo Sapiens; identical to SEQ ID NO: 40095

SEQ ID NO: 230223 - RNA, 64 nt, Homo Sapiens; identical to SEQ ID NO: 40096

SEQ ID NO: 230224 - RNA, 64 nt, Homo Sapiens; identical to SEQ ID NO: 40097

SEQ ID NO: 230225 - RNA, 64 nt, Homo Sapiens; identical to SEQ ID NO: 40098

SEQ ID NO: 230226 - RNA, 64 nt, Homo Sapiens; identical to SEQ ID NO: 40099

SEQ ID NO: 230227 - RNA, 64 nt, Homo Sapiens; identical to SEQ ID NO: 40100

SEQ ID NO: 230228 - RNA, 64 nt, Homo Sapiens; identical to SEQ ID NO: 40101

SEQ ID NO: 230229 - RNA, 64 nt, Homo Sapiens; identical to SEQ ID NO: 40102

SEQ ID NO: 230230 - RNA, 64 nt, Homo Sapiens; identical to SEQ ID NO: 40103

SEQ ID NO: 230231 - RNA, 64 nt, Homo Sapiens; identical to SEQ ID NO: 40104

SEQ ID NO: 230232 - RNA, 64 nt, Homo Sapiens; identical to SEQ ID NO: 40105

SEQ ID NO: 230233 - RNA, 64 nt, Homo Sapiens; identical to SEQ ID NO: 40106

SEQ ID NO: 230234 - RNA, 64 nt, Homo Sapiens; identical to SEQ ID NO: 40107

SEQ ID NO: 230235 - RNA, 64 nt, Homo Sapiens; identical to SEQ ID NO: 40108

SEQ ID NO: 230236 - RNA, 64 nt, Homo Sapiens; identical to SEQ ID NO: 40109

SEQ ID NO: 230237 - RNA, 64 nt, Homo Sapiens; identical to SEQ ID NO: 40110

SEQ ID NO: 230238 - RNA, 64 nt, Homo Sapiens; identical to SEQ ID NO: 40111

SEQ ID NO: 230239 - RNA, 64 nt, Homo Sapiens; identical to SEQ ID NO: 40112

SEQ ID NO: 230240 - RNA, 64 nt, Homo Sapiens; identical to SEQ ID NO: 40113

SEQ ID NO: 230241 - RNA, 64 nt, Homo Sapiens; identical to SEQ ID NO: 40114

SEQ ID NO: 230242 - RNA, 64 nt, Homo Sapiens; identical to SEQ ID NO: 40115

SEQ ID NO: 230243 - RNA, 64 nt, Homo Sapiens; identical to SEQ ID NO: 40116

SEQ ID NO: 230244 - RNA, 64 nt, Homo Sapiens; identical to SEQ ID NO: 40117

SEQ ID NO: 230245 - RNA, 64 nt, Homo Sapiens; identical to SEQ ID NO: 40118

SEQ ID NO: 230246 - RNA, 64 nt, Homo Sapiens; identical to SEQ ID NO: 40119

SEQ ID NO: 230247 - RNA, 64 nt, Homo Sapiens; identical to SEQ ID NO: 40120

SEQ ID NO: 230248 - RNA, 64 nt, Homo Sapiens; identical to SEQ ID NO: 40121

SEQ ID NO: 230249 - RNA, 64 nt, Homo Sapiens; identical to SEQ ID NO: 40122

SEQ ID NO: 230250 - RNA, 64 nt, Homo Sapiens; identical to SEQ ID NO: 40123

SEQ ID NO: 230251 - RNA, 64 nt, Homo Sapiens; identical to SEQ ID NO: 40124

SEQ ID NO: 230252 - RNA, 64 nt, Homo Sapiens; identical to SEQ ID NO: 40125

SEQ ID NO: 230253 - RNA, 64 nt, Homo Sapiens; identical to SEQ ID NO: 40126

SEQ ID NO: 230254 - RNA, 64 nt, Homo Sapiens; identical to SEQ ID NO: 40127

SEQ ID NO: 230255 - RNA, 64 nt, Homo Sapiens; identical to SEQ ID NO: 40128

SEQ ID NO: 230256 - RNA, 64 nt, Homo Sapiens; identical to SEQ ID NO: 40129

SEQ ID NO: 230257 - RNA, 64 nt, Homo Sapiens; identical to SEQ ID NO: 40130

SEQ ID NO: 230258 - RNA, 64 nt, Homo Sapiens; identical to SEQ ID NO: 40131

SEQ ID NO: 230259 - RNA, 64 nt, Homo Sapiens; identical to SEQ ID NO: 40132

SEQ ID NO: 230260 - RNA, 64 nt, Homo Sapiens; identical to SEQ ID NO: 40133

SEQ ID NO: 230261 - RNA, 64 nt, Homo Sapiens; identical to SEQ ID NO: 40134

SEQ ID NO: 230262 - RNA, 64 nt, Homo Sapiens; identical to SEQ ID NO: 40135

SEQ ID NO: 230263 - RNA, 64 nt, Homo Sapiens; identical to SEQ ID NO: 40136

SEQ ID NO: 230264 - RNA, 64 nt, Homo Sapiens; identical to SEQ ID NO: 40137

SEQ ID NO: 230265 - RNA, 64 nt, Homo Sapiens; identical to SEQ ID NO: 40138

SEQ ID NO: 230266 - RNA, 64 nt, Homo Sapiens; identical to SEQ ID NO: 40139

SEQ ID NO: 230267 - RNA, 64 nt, Homo Sapiens; identical to SEQ ID NO: 40140

SEQ ID NO: 230268 - RNA, 64 nt, Homo Sapiens; identical to SEQ ID NO: 40141

SEQ ID NO: 230269 - RNA, 64 nt, Homo Sapiens; identical to SEQ ID NO: 40142

SEQ ID NO: 230270 - RNA, 64 nt, Homo Sapiens; identical to SEQ ID NO: 40143

SEQ ID NO: 230271 - RNA, 64 nt, Homo Sapiens; identical to SEQ ID NO: 40144

SEQ ID NO: 230272 - RNA, 64 nt, Homo Sapiens; identical to SEQ ID NO: 40145

SEQ ID NO: 230273 - RNA, 64 nt, Homo Sapiens; identical to SEQ ID NO: 40146

SEQ ID NO: 230274 - RNA, 64 nt, Homo Sapiens; identical to SEQ ID NO: 40147

SEQ ID NO: 230275 - RNA, 64 nt, Homo Sapiens; identical to SEQ ID NO: 40148

SEQ ID NO: 230276 - RNA, 64 nt, Homo Sapiens; identical to SEQ ID NO: 40149

SEQ ID NO: 230277 - RNA, 64 nt, Homo Sapiens; identical to SEQ ID NO: 40150

SEQ ID NO: 230278 - RNA, 64 nt, Homo Sapiens; identical to SEQ ID NO: 40151

SEQ ID NO: 230279 - RNA, 64 nt, Homo Sapiens; identical to SEQ ID NO: 40152

SEQ ID NO: 230280 - RNA, 64 nt, Homo Sapiens; identical to SEQ ID NO: 40153

SEQ ID NO: 230281 - RNA, 64 nt, Homo Sapiens; identical to SEQ ID NO: 40154

SEQ ID NO: 230282 - RNA, 64 nt, Homo Sapiens; identical to SEQ ID NO: 40155

SEQ ID NO: 230283 - RNA, 64 nt, Homo Sapiens; identical to SEQ ID NO: 40156

SEQ ID NO: 230284 - RNA, 64 nt, Homo Sapiens; identical to SEQ ID NO: 40157

SEQ ID NO: 230285 - RNA, 64 nt, Homo Sapiens; identical to SEQ ID NO: 40158

SEQ ID NO: 230286 - RNA, 64 nt, Homo Sapiens; identical to SEQ ID NO: 40159

SEQ ID NO: 230287 - RNA, 64 nt, Homo Sapiens; identical to SEQ ID NO: 40160

SEQ ID NO: 230288 - RNA, 64 nt, Homo Sapiens; identical to SEQ ID NO: 40161

SEQ ID NO: 230289 - RNA, 64 nt, Homo Sapiens; identical to SEQ ID NO: 40162

SEQ ID NO: 230290 - RNA, 64 nt, Homo Sapiens; identical to SEQ ID NO: 40163

SEQ ID NO: 230291 - RNA, 64 nt, Homo Sapiens; identical to SEQ ID NO: 40164

SEQ ID NO: 230292 - RNA, 64 nt, Homo Sapiens; identical to SEQ ID NO: 40165

SEQ ID NO: 230293 - RNA, 64 nt, Homo Sapiens; identical to SEQ ID NO: 40166

SEQ ID NO: 230294 - RNA, 64 nt, Homo Sapiens; identical to SEQ ID NO: 40167

SEQ ID NO: 230295 - RNA, 64 nt, Homo Sapiens; identical to SEQ ID NO: 40168

SEQ ID NO: 230296 - RNA, 64 nt, Homo Sapiens; identical to SEQ ID NO: 40169

SEQ ID NO: 230297 - RNA, 64 nt, Homo Sapiens; identical to SEQ ID NO: 40170

SEQ ID NO: 230298 - RNA, 64 nt, Homo Sapiens; identical to SEQ ID NO: 40171

SEQ ID NO: 230299 - RNA, 64 nt, Homo Sapiens; identical to SEQ ID NO: 40172

SEQ ID NO: 230300 - RNA, 64 nt, Homo Sapiens; identical to SEQ ID NO: 40173

SEQ ID NO: 230301 - RNA, 64 nt, Homo Sapiens; identical to SEQ ID NO: 40174

SEQ ID NO: 230302 - RNA, 64 nt, Homo Sapiens; identical to SEQ ID NO: 40175

SEQ ID NO: 230303 - RNA, 64 nt, Homo Sapiens; identical to SEQ ID NO: 40176

SEQ ID NO: 230304 - RNA, 64 nt, Homo Sapiens; identical to SEQ ID NO: 40177

SEQ ID NO: 230305 - RNA, 64 nt, Homo Sapiens; identical to SEQ ID NO: 40178

SEQ ID NO: 230306 - RNA, 64 nt, Homo Sapiens; identical to SEQ ID NO: 40179

SEQ ID NO: 230307 - RNA, 64 nt, Homo Sapiens; identical to SEQ ID NO: 40180

SEQ ID NO: 230308 - RNA, 64 nt, Homo Sapiens; identical to SEQ ID NO: 40181

SEQ ID NO: 230309 - RNA, 64 nt, Homo Sapiens; identical to SEQ ID NO: 40182

SEQ ID NO: 230310 - RNA, 64 nt, Homo Sapiens; identical to SEQ ID NO: 40183

SEQ ID NO: 230311 - RNA, 64 nt, Homo Sapiens; identical to SEQ ID NO: 40184

SEQ ID NO: 230312 - RNA, 64 nt, Homo Sapiens; identical to SEQ ID NO: 40185

SEQ ID NO: 230313 - RNA, 64 nt, Homo Sapiens; identical to SEQ ID NO: 40186

SEQ ID NO: 230314 - RNA, 64 nt, Homo Sapiens; identical to SEQ ID NO: 40187

SEQ ID NO: 230315 - RNA, 64 nt, Homo Sapiens; identical to SEQ ID NO: 40188

SEQ ID NO: 230316 - RNA, 64 nt, Homo Sapiens; identical to SEQ ID NO: 40189

SEQ ID NO: 230317 - RNA, 64 nt, Homo Sapiens; identical to SEQ ID NO: 40190

SEQ ID NO: 230318 - RNA, 64 nt, Homo Sapiens; identical to SEQ ID NO: 40191

SEQ ID NO: 230319 - RNA, 64 nt, Homo Sapiens; identical to SEQ ID NO: 40192

SEQ ID NO: 230320 - RNA, 64 nt, Homo Sapiens; identical to SEQ ID NO: 40193

SEQ ID NO: 230321 - RNA, 64 nt, Homo Sapiens; identical to SEQ ID NO: 40194

SEQ ID NO: 230322 - RNA, 64 nt, Homo Sapiens; identical to SEQ ID NO: 40195

SEQ ID NO: 230323 - RNA, 64 nt, Homo Sapiens; identical to SEQ ID NO: 40196

SEQ ID NO: 230324 - RNA, 64 nt, Homo Sapiens; identical to SEQ ID NO: 40197

SEQ ID NO: 230325 - RNA, 64 nt, Homo Sapiens; identical to SEQ ID NO: 40198

SEQ ID NO: 230326 - RNA, 64 nt, Homo Sapiens; identical to SEQ ID NO: 40199

SEQ ID NO: 230327 - RNA, 64 nt, Homo Sapiens; identical to SEQ ID NO: 40200

SEQ ID NO: 230328 - RNA, 64 nt, Homo Sapiens; identical to SEQ ID NO: 40201

SEQ ID NO: 230329 - RNA, 64 nt, Homo Sapiens; identical to SEQ ID NO: 40202

SEQ ID NO: 230330 - RNA, 64 nt, Homo Sapiens; identical to SEQ ID NO: 40203

SEQ ID NO: 230331 - RNA, 64 nt, Homo Sapiens; identical to SEQ ID NO: 40204

SEQ ID NO: 230332 - RNA, 64 nt, Homo Sapiens; identical to SEQ ID NO: 40205

SEQ ID NO: 230333 - RNA, 64 nt, Homo Sapiens; identical to SEQ ID NO: 40206

SEQ ID NO: 230334 - RNA, 64 nt, Homo Sapiens; identical to SEQ ID NO: 40207

SEQ ID NO: 230335 - RNA, 64 nt, Homo Sapiens; identical to SEQ ID NO: 40208

SEQ ID NO: 230336 - RNA, 64 nt, Homo Sapiens; identical to SEQ ID NO: 40209

SEQ ID NO: 230337 - RNA, 64 nt, Homo Sapiens; identical to SEQ ID NO: 40210

SEQ ID NO: 230338 - RNA, 64 nt, Homo Sapiens; identical to SEQ ID NO: 40211

SEQ ID NO: 230339 - RNA, 64 nt, Homo Sapiens; identical to SEQ ID NO: 40212

SEQ ID NO: 230340 - RNA, 64 nt, Homo Sapiens; identical to SEQ ID NO: 40213

SEQ ID NO: 230341 - RNA, 64 nt, Homo Sapiens; identical to SEQ ID NO: 40214

SEQ ID NO: 230342 - RNA, 64 nt, Homo Sapiens; identical to SEQ ID NO: 40215

SEQ ID NO: 230343 - RNA, 64 nt, Homo Sapiens; identical to SEQ ID NO: 40216

SEQ ID NO: 230344 - RNA, 64 nt, Homo Sapiens; identical to SEQ ID NO: 40217

SEQ ID NO: 230345 - RNA, 64 nt, Homo Sapiens; identical to SEQ ID NO: 40218

SEQ ID NO: 230346 - RNA, 64 nt, Homo Sapiens; identical to SEQ ID NO: 40219

SEQ ID NO: 230347 - RNA, 64 nt, Homo Sapiens; identical to SEQ ID NO: 40220

SEQ ID NO: 230348 - RNA, 64 nt, Homo Sapiens; identical to SEQ ID NO: 40221

SEQ ID NO: 230349 - RNA, 64 nt, Homo Sapiens; identical to SEQ ID NO: 40222

SEQ ID NO: 230350 - RNA, 64 nt, Homo Sapiens; identical to SEQ ID NO: 40223

SEQ ID NO: 230351 - RNA, 64 nt, Homo Sapiens; identical to SEQ ID NO: 40224

SEQ ID NO: 230352 - RNA, 64 nt, Homo Sapiens; identical to SEQ ID NO: 40225

SEQ ID NO: 230353 - RNA, 64 nt, Homo Sapiens; identical to SEQ ID NO: 40226

SEQ ID NO: 230354 - RNA, 64 nt, Homo Sapiens; identical to SEQ ID NO: 40227

SEQ ID NO: 230355 - RNA, 64 nt, Homo Sapiens; identical to SEQ ID NO: 40228

SEQ ID NO: 230356 - RNA, 64 nt, Homo Sapiens; identical to SEQ ID NO: 40229

SEQ ID NO: 230357 - RNA, 64 nt, Homo Sapiens; identical to SEQ ID NO: 40230

SEQ ID NO: 230358 - RNA, 64 nt, Homo Sapiens; identical to SEQ ID NO: 40231

SEQ ID NO: 230359 - RNA, 64 nt, Homo Sapiens; identical to SEQ ID NO: 40232

SEQ ID NO: 230360 - RNA, 64 nt, Homo Sapiens; identical to SEQ ID NO: 40233

SEQ ID NO: 230361 - RNA, 64 nt, Homo Sapiens; identical to SEQ ID NO: 40234

SEQ ID NO: 230362 - RNA, 64 nt, Homo Sapiens; identical to SEQ ID NO: 40235

SEQ ID NO: 230363 - RNA, 64 nt, Homo Sapiens; identical to SEQ ID NO: 40236

SEQ ID NO: 230364 - RNA, 64 nt, Homo Sapiens; identical to SEQ ID NO: 40237

SEQ ID NO: 230365 - RNA, 64 nt, Homo Sapiens; identical to SEQ ID NO: 40238

SEQ ID NO: 230366 - RNA, 64 nt, Homo Sapiens; identical to SEQ ID NO: 40239

SEQ ID NO: 230367 - RNA, 64 nt, Homo Sapiens; identical to SEQ ID NO: 40240

SEQ ID NO: 230368 - RNA, 64 nt, Homo Sapiens; identical to SEQ ID NO: 40241

SEQ ID NO: 230369 - RNA, 64 nt, Homo Sapiens; identical to SEQ ID NO: 40242

SEQ ID NO: 230370 - RNA, 64 nt, Homo Sapiens; identical to SEQ ID NO: 40243

SEQ ID NO: 230371 - RNA, 64 nt, Homo Sapiens; identical to SEQ ID NO: 40244

SEQ ID NO: 230372 - RNA, 64 nt, Homo Sapiens; identical to SEQ ID NO: 40245

SEQ ID NO: 230373 - RNA, 64 nt, Homo Sapiens; identical to SEQ ID NO: 40246

SEQ ID NO: 230374 - RNA, 64 nt, Homo Sapiens; identical to SEQ ID NO: 40247

SEQ ID NO: 230375 - RNA, 64 nt, Homo Sapiens; identical to SEQ ID NO: 40248

SEQ ID NO: 230376 - RNA, 64 nt, Homo Sapiens; identical to SEQ ID NO: 40249

SEQ ID NO: 230377 - RNA, 64 nt, Homo Sapiens; identical to SEQ ID NO: 40250

SEQ ID NO: 230378 - RNA, 64 nt, Homo Sapiens; identical to SEQ ID NO: 40251

SEQ ID NO: 230379 - RNA, 64 nt, Homo Sapiens; identical to SEQ ID NO: 40252

SEQ ID NO: 230380 - RNA, 64 nt, Homo Sapiens; identical to SEQ ID NO: 40253

SEQ ID NO: 230381 - RNA, 64 nt, Homo Sapiens; identical to SEQ ID NO: 40254

SEQ ID NO: 230382 - RNA, 64 nt, Homo Sapiens; identical to SEQ ID NO: 40255

SEQ ID NO: 230383 - RNA, 64 nt, Homo Sapiens; identical to SEQ ID NO: 40256

SEQ ID NO: 230384 - RNA, 64 nt, Homo Sapiens; identical to SEQ ID NO: 40257

SEQ ID NO: 230385 - RNA, 64 nt, Homo Sapiens; identical to SEQ ID NO: 40258

SEQ ID NO: 230386 - RNA, 64 nt, Homo Sapiens; identical to SEQ ID NO: 40259

SEQ ID NO: 230387 - RNA, 64 nt, Homo Sapiens; identical to SEQ ID NO: 40260

SEQ ID NO: 230388 - RNA, 64 nt, Homo Sapiens; identical to SEQ ID NO: 40261

SEQ ID NO: 230389 - RNA, 64 nt, Homo Sapiens; identical to SEQ ID NO: 40262

SEQ ID NO: 230390 - RNA, 64 nt, Homo Sapiens; identical to SEQ ID NO: 40263

SEQ ID NO: 230391 - RNA, 64 nt, Homo Sapiens; identical to SEQ ID NO: 40264

SEQ ID NO: 230392 - RNA, 64 nt, Homo Sapiens; identical to SEQ ID NO: 40265

SEQ ID NO: 230393 - RNA, 64 nt, Homo Sapiens; identical to SEQ ID NO: 40266

SEQ ID NO: 230394 - RNA, 64 nt, Homo Sapiens; identical to SEQ ID NO: 40267

SEQ ID NO: 230395 - RNA, 64 nt, Homo Sapiens; identical to SEQ ID NO: 40268

SEQ ID NO: 230396 - RNA, 64 nt, Homo Sapiens; identical to SEQ ID NO: 40269

SEQ ID NO: 230397 - RNA, 64 nt, Homo Sapiens; identical to SEQ ID NO: 40270

SEQ ID NO: 230398 - RNA, 64 nt, Homo Sapiens; identical to SEQ ID NO: 40271

SEQ ID NO: 230399 - RNA, 64 nt, Homo Sapiens; identical to SEQ ID NO: 40272

SEQ ID NO: 230400 - RNA, 64 nt, Homo Sapiens; identical to SEQ ID NO: 40273

SEQ ID NO: 230401 - RNA, 64 nt, Homo Sapiens; identical to SEQ ID NO: 40274

SEQ ID NO: 230402 - RNA, 64 nt, Homo Sapiens; identical to SEQ ID NO: 40275

SEQ ID NO: 230403 - RNA, 64 nt, Homo Sapiens; identical to SEQ ID NO: 40276

SEQ ID NO: 230404 - RNA, 64 nt, Homo Sapiens; identical to SEQ ID NO: 40277

SEQ ID NO: 230405 - RNA, 64 nt, Homo Sapiens; identical to SEQ ID NO: 40278

SEQ ID NO: 230406 - RNA, 64 nt, Homo Sapiens; identical to SEQ ID NO: 40279

SEQ ID NO: 230407 - RNA, 64 nt, Homo Sapiens; identical to SEQ ID NO: 40280

SEQ ID NO: 230408 - RNA, 64 nt, Homo Sapiens; identical to SEQ ID NO: 40281

SEQ ID NO: 230409 - RNA, 64 nt, Homo Sapiens; identical to SEQ ID NO: 40282

SEQ ID NO: 230410 - RNA, 64 nt, Homo Sapiens; identical to SEQ ID NO: 40283

SEQ ID NO: 230411 - RNA, 64 nt, Homo Sapiens; identical to SEQ ID NO: 40284

SEQ ID NO: 230412 - RNA, 64 nt, Homo Sapiens; identical to SEQ ID NO: 40285

SEQ ID NO: 230413 - RNA, 64 nt, Homo Sapiens; identical to SEQ ID NO: 40286

SEQ ID NO: 230414 - RNA, 64 nt, Homo Sapiens; identical to SEQ ID NO: 40287

SEQ ID NO: 230415 - RNA, 64 nt, Homo Sapiens; identical to SEQ ID NO: 40288

SEQ ID NO: 230416 - RNA, 64 nt, Homo Sapiens; identical to SEQ ID NO: 40289

SEQ ID NO: 230417 - RNA, 64 nt, Homo Sapiens; identical to SEQ ID NO: 40290

SEQ ID NO: 230418 - RNA, 64 nt, Homo Sapiens; identical to SEQ ID NO: 40291

SEQ ID NO: 230419 - RNA, 64 nt, Homo Sapiens; identical to SEQ ID NO: 40292

SEQ ID NO: 230420 - RNA, 64 nt, Homo Sapiens; identical to SEQ ID NO: 40293

SEQ ID NO: 230421 - RNA, 64 nt, Homo Sapiens; identical to SEQ ID NO: 40294

SEQ ID NO: 230422 - RNA, 64 nt, Homo Sapiens; identical to SEQ ID NO: 40295

SEQ ID NO: 230423 - RNA, 64 nt, Homo Sapiens; identical to SEQ ID NO: 40296

SEQ ID NO: 230424 - RNA, 64 nt, Homo Sapiens; identical to SEQ ID NO: 40297

SEQ ID NO: 230425 - RNA, 64 nt, Homo Sapiens; identical to SEQ ID NO: 40298

SEQ ID NO: 230426 - RNA, 64 nt, Homo Sapiens; identical to SEQ ID NO: 40299

SEQ ID NO: 230427 - RNA, 64 nt, Homo Sapiens; identical to SEQ ID NO: 40300

SEQ ID NO: 230428 - RNA, 64 nt, Homo Sapiens; identical to SEQ ID NO: 40301

SEQ ID NO: 230429 - RNA, 64 nt, Homo Sapiens; identical to SEQ ID NO: 40302

SEQ ID NO: 230430 - RNA, 64 nt, Homo Sapiens; identical to SEQ ID NO: 40303

SEQ ID NO: 230431 - RNA, 64 nt, Homo Sapiens; identical to SEQ ID NO: 40304

SEQ ID NO: 230432 - RNA, 64 nt, Homo Sapiens; identical to SEQ ID NO: 40305

SEQ ID NO: 230433 - RNA, 64 nt, Homo Sapiens; identical to SEQ ID NO: 40306

SEQ ID NO: 230434 - RNA, 64 nt, Homo Sapiens; identical to SEQ ID NO: 40307

SEQ ID NO: 230435 - RNA, 64 nt, Homo Sapiens; identical to SEQ ID NO: 40308

SEQ ID NO: 230436 - RNA, 64 nt, Homo Sapiens; identical to SEQ ID NO: 40309

SEQ ID NO: 230437 - RNA, 64 nt, Homo Sapiens; identical to SEQ ID NO: 40310

SEQ ID NO: 230438 - RNA, 64 nt, Homo Sapiens; identical to SEQ ID NO: 40311

SEQ ID NO: 230439 - RNA, 64 nt, Homo Sapiens; identical to SEQ ID NO: 40312

SEQ ID NO: 230440 - RNA, 64 nt, Homo Sapiens; identical to SEQ ID NO: 40313

SEQ ID NO: 230441 - RNA, 64 nt, Homo Sapiens; identical to SEQ ID NO: 40314

SEQ ID NO: 230442 - RNA, 64 nt, Homo Sapiens; identical to SEQ ID NO: 40315

SEQ ID NO: 230443 - RNA, 64 nt, Homo Sapiens; identical to SEQ ID NO: 40316

SEQ ID NO: 230444 - RNA, 64 nt, Homo Sapiens; identical to SEQ ID NO: 40317

SEQ ID NO: 230445 - RNA, 64 nt, Homo Sapiens; identical to SEQ ID NO: 40318

SEQ ID NO: 230446 - RNA, 64 nt, Homo Sapiens; identical to SEQ ID NO: 40319

SEQ ID NO: 230447 - RNA, 64 nt, Homo Sapiens; identical to SEQ ID NO: 40320

SEQ ID NO: 230448 - RNA, 64 nt, Homo Sapiens; identical to SEQ ID NO: 40321

SEQ ID NO: 230449 - RNA, 64 nt, Homo Sapiens; identical to SEQ ID NO: 40322

SEQ ID NO: 230450 - RNA, 64 nt, Homo Sapiens; identical to SEQ ID NO: 40323

SEQ ID NO: 230451 - RNA, 64 nt, Homo Sapiens; identical to SEQ ID NO: 40324

SEQ ID NO: 230452 - RNA, 64 nt, Homo Sapiens; identical to SEQ ID NO: 40325

SEQ ID NO: 230453 - RNA, 64 nt, Homo Sapiens; identical to SEQ ID NO: 40326

SEQ ID NO: 230454 - RNA, 64 nt, Homo Sapiens; identical to SEQ ID NO: 40327

SEQ ID NO: 230455 - RNA, 64 nt, Homo Sapiens; identical to SEQ ID NO: 40328

SEQ ID NO: 230456 - RNA, 64 nt, Homo Sapiens; identical to SEQ ID NO: 40329

SEQ ID NO: 230457 - RNA, 64 nt, Homo Sapiens; identical to SEQ ID NO: 40330

SEQ ID NO: 230458 - RNA, 64 nt, Homo Sapiens; identical to SEQ ID NO: 40331

SEQ ID NO: 230459 - RNA, 64 nt, Homo Sapiens; identical to SEQ ID NO: 40332

SEQ ID NO: 230460 - RNA, 64 nt, Homo Sapiens; identical to SEQ ID NO: 40333

SEQ ID NO: 230461 - RNA, 64 nt, Homo Sapiens; identical to SEQ ID NO: 40334

SEQ ID NO: 230462 - RNA, 64 nt, Homo Sapiens; identical to SEQ ID NO: 40335

SEQ ID NO: 230463 - RNA, 64 nt, Homo Sapiens; identical to SEQ ID NO: 40336

SEQ ID NO: 230464 - RNA, 64 nt, Homo Sapiens; identical to SEQ ID NO: 40337

SEQ ID NO: 230465 - RNA, 64 nt, Homo Sapiens; identical to SEQ ID NO: 40338

SEQ ID NO: 230466 - RNA, 64 nt, Homo Sapiens; identical to SEQ ID NO: 40339

SEQ ID NO: 230467 - RNA, 64 nt, Homo Sapiens; identical to SEQ ID NO: 40340

SEQ ID NO: 230468 - RNA, 64 nt, Homo Sapiens; identical to SEQ ID NO: 40341

SEQ ID NO: 230469 - RNA, 64 nt, Homo Sapiens; identical to SEQ ID NO: 40342

SEQ ID NO: 230470 - RNA, 64 nt, Homo Sapiens; identical to SEQ ID NO: 40343

SEQ ID NO: 230471 - RNA, 64 nt, Homo Sapiens; identical to SEQ ID NO: 40344

SEQ ID NO: 230472 - RNA, 64 nt, Homo Sapiens; identical to SEQ ID NO: 40345

SEQ ID NO: 230473 - RNA, 64 nt, Homo Sapiens; identical to SEQ ID NO: 40346

SEQ ID NO: 230474 - RNA, 64 nt, Homo Sapiens; identical to SEQ ID NO: 40347

SEQ ID NO: 230475 - RNA, 64 nt, Homo Sapiens; identical to SEQ ID NO: 40348

SEQ ID NO: 230476 - RNA, 64 nt, Homo Sapiens; identical to SEQ ID NO: 40349

SEQ ID NO: 230477 - RNA, 64 nt, Homo Sapiens; identical to SEQ ID NO: 40350

SEQ ID NO: 230478 - RNA, 64 nt, Homo Sapiens; identical to SEQ ID NO: 40351

SEQ ID NO: 230479 - RNA, 64 nt, Homo Sapiens; identical to SEQ ID NO: 40352

SEQ ID NO: 230480 - RNA, 64 nt, Homo Sapiens; identical to SEQ ID NO: 40353

SEQ ID NO: 230481 - RNA, 64 nt, Homo Sapiens; identical to SEQ ID NO: 40354

SEQ ID NO: 230482 - RNA, 64 nt, Homo Sapiens; identical to SEQ ID NO: 40355

SEQ ID NO: 230483 - RNA, 64 nt, Homo Sapiens; identical to SEQ ID NO: 40356

SEQ ID NO: 230484 - RNA, 64 nt, Homo Sapiens; identical to SEQ ID NO: 40357

SEQ ID NO: 230485 - RNA, 64 nt, Homo Sapiens; identical to SEQ ID NO: 40358

SEQ ID NO: 230486 - RNA, 64 nt, Homo Sapiens; identical to SEQ ID NO: 40359

SEQ ID NO: 230487 - RNA, 64 nt, Homo Sapiens; identical to SEQ ID NO: 40360

SEQ ID NO: 230488 - RNA, 64 nt, Homo Sapiens; identical to SEQ ID NO: 40361

SEQ ID NO: 230489 - RNA, 64 nt, Homo Sapiens; identical to SEQ ID NO: 40362

SEQ ID NO: 230490 - RNA, 64 nt, Homo Sapiens; identical to SEQ ID NO: 40363

SEQ ID NO: 230491 - RNA, 64 nt, Homo Sapiens; identical to SEQ ID NO: 40364

SEQ ID NO: 230492 - RNA, 64 nt, Homo Sapiens; identical to SEQ ID NO: 40365

SEQ ID NO: 230493 - RNA, 64 nt, Homo Sapiens; identical to SEQ ID NO: 40366

SEQ ID NO: 230494 - RNA, 64 nt, Homo Sapiens; identical to SEQ ID NO: 40367

SEQ ID NO: 230495 - RNA, 64 nt, Homo Sapiens; identical to SEQ ID NO: 40368

SEQ ID NO: 230496 - RNA, 64 nt, Homo Sapiens; identical to SEQ ID NO: 40369

SEQ ID NO: 230497 - RNA, 64 nt, Homo Sapiens; identical to SEQ ID NO: 40370

SEQ ID NO: 230498 - RNA, 64 nt, Homo Sapiens; identical to SEQ ID NO: 40371

SEQ ID NO: 230499 - RNA, 64 nt, Homo Sapiens; identical to SEQ ID NO: 40372

SEQ ID NO: 230500 - RNA, 64 nt, Homo Sapiens; identical to SEQ ID NO: 40373

SEQ ID NO: 230501 - RNA, 64 nt, Homo Sapiens; identical to SEQ ID NO: 40374

SEQ ID NO: 230502 - RNA, 64 nt, Homo Sapiens; identical to SEQ ID NO: 40375

SEQ ID NO: 230503 - RNA, 64 nt, Homo Sapiens; identical to SEQ ID NO: 40376

SEQ ID NO: 230504 - RNA, 64 nt, Homo Sapiens; identical to SEQ ID NO: 40377

SEQ ID NO: 230505 - RNA, 64 nt, Homo Sapiens; identical to SEQ ID NO: 40378

SEQ ID NO: 230506 - RNA, 64 nt, Homo Sapiens; identical to SEQ ID NO: 40379

SEQ ID NO: 230507 - RNA, 64 nt, Homo Sapiens; identical to SEQ ID NO: 40380

SEQ ID NO: 230508 - RNA, 64 nt, Homo Sapiens; identical to SEQ ID NO: 40381

SEQ ID NO: 230509 - RNA, 64 nt, Homo Sapiens; identical to SEQ ID NO: 40382

SEQ ID NO: 230510 - RNA, 64 nt, Homo Sapiens; identical to SEQ ID NO: 40383

SEQ ID NO: 230511 - RNA, 64 nt, Homo Sapiens; identical to SEQ ID NO: 40384

SEQ ID NO: 230512 - RNA, 64 nt, Homo Sapiens; identical to SEQ ID NO: 40385

SEQ ID NO: 230513 - RNA, 64 nt, Homo Sapiens; identical to SEQ ID NO: 40386

SEQ ID NO: 230514 - RNA, 64 nt, Homo Sapiens; identical to SEQ ID NO: 40387

SEQ ID NO: 230515 - RNA, 64 nt, Homo Sapiens; identical to SEQ ID NO: 40388

SEQ ID NO: 230516 - RNA, 64 nt, Homo Sapiens; identical to SEQ ID NO: 40389

SEQ ID NO: 230517 - RNA, 64 nt, Homo Sapiens; identical to SEQ ID NO: 40390

SEQ ID NO: 230518 - RNA, 64 nt, Homo Sapiens; identical to SEQ ID NO: 40391

SEQ ID NO: 230519 - RNA, 64 nt, Homo Sapiens; identical to SEQ ID NO: 40392

SEQ ID NO: 230520 - RNA, 64 nt, Homo Sapiens; identical to SEQ ID NO: 40393

SEQ ID NO: 230521 - RNA, 64 nt, Homo Sapiens; identical to SEQ ID NO: 40394

SEQ ID NO: 230522 - RNA, 64 nt, Homo Sapiens; identical to SEQ ID NO: 40395

SEQ ID NO: 230523 - RNA, 64 nt, Homo Sapiens; identical to SEQ ID NO: 40396

SEQ ID NO: 230524 - RNA, 64 nt, Homo Sapiens; identical to SEQ ID NO: 40397

SEQ ID NO: 230525 - RNA, 64 nt, Homo Sapiens; identical to SEQ ID NO: 40398

SEQ ID NO: 230526 - RNA, 64 nt, Homo Sapiens; identical to SEQ ID NO: 40399

SEQ ID NO: 230527 - RNA, 64 nt, Homo Sapiens; identical to SEQ ID NO: 40400

SEQ ID NO: 230528 - RNA, 64 nt, Homo Sapiens; identical to SEQ ID NO: 40401

SEQ ID NO: 230529 - RNA, 64 nt, Homo Sapiens; identical to SEQ ID NO: 40402

SEQ ID NO: 230530 - RNA, 64 nt, Homo Sapiens; identical to SEQ ID NO: 40403

SEQ ID NO: 230531 - RNA, 64 nt, Homo Sapiens; identical to SEQ ID NO: 40404

SEQ ID NO: 230532 - RNA, 64 nt, Homo Sapiens; identical to SEQ ID NO: 40405

SEQ ID NO: 230533 - RNA, 64 nt, Homo Sapiens; identical to SEQ ID NO: 40406

SEQ ID NO: 230534 - RNA, 64 nt, Homo Sapiens; identical to SEQ ID NO: 40407

SEQ ID NO: 230535 - RNA, 64 nt, Homo Sapiens; identical to SEQ ID NO: 40408

SEQ ID NO: 230536 - RNA, 64 nt, Homo Sapiens; identical to SEQ ID NO: 40409

SEQ ID NO: 230537 - RNA, 64 nt, Homo Sapiens; identical to SEQ ID NO: 40410

SEQ ID NO: 230538 - RNA, 64 nt, Homo Sapiens; identical to SEQ ID NO: 40411

SEQ ID NO: 230539 - RNA, 64 nt, Homo Sapiens; identical to SEQ ID NO: 40412

SEQ ID NO: 230540 - RNA, 64 nt, Homo Sapiens; identical to SEQ ID NO: 40413

SEQ ID NO: 230541 - RNA, 64 nt, Homo Sapiens; identical to SEQ ID NO: 40414

SEQ ID NO: 230542 - RNA, 64 nt, Homo Sapiens; identical to SEQ ID NO: 40415

SEQ ID NO: 230543 - RNA, 64 nt, Homo Sapiens; identical to SEQ ID NO: 40416

SEQ ID NO: 230544 - RNA, 64 nt, Homo Sapiens; identical to SEQ ID NO: 40417

SEQ ID NO: 230545 - RNA, 64 nt, Homo Sapiens; identical to SEQ ID NO: 40418

SEQ ID NO: 230546 - RNA, 64 nt, Homo Sapiens; identical to SEQ ID NO: 40419

SEQ ID NO: 230547 - RNA, 64 nt, Homo Sapiens; identical to SEQ ID NO: 40420

SEQ ID NO: 230548 - RNA, 64 nt, Homo Sapiens; identical to SEQ ID NO: 40421

SEQ ID NO: 230549 - RNA, 64 nt, Homo Sapiens; identical to SEQ ID NO: 40422

SEQ ID NO: 230550 - RNA, 64 nt, Homo Sapiens; identical to SEQ ID NO: 40423

SEQ ID NO: 230551 - RNA, 64 nt, Homo Sapiens; identical to SEQ ID NO: 40424

SEQ ID NO: 230552 - RNA, 64 nt, Homo Sapiens; identical to SEQ ID NO: 40425

SEQ ID NO: 230553 - RNA, 64 nt, Homo Sapiens; identical to SEQ ID NO: 40426

SEQ ID NO: 230554 - RNA, 64 nt, Homo Sapiens; identical to SEQ ID NO: 40427

SEQ ID NO: 230555 - RNA, 64 nt, Homo Sapiens; identical to SEQ ID NO: 40428

SEQ ID NO: 230556 - RNA, 64 nt, Homo Sapiens; identical to SEQ ID NO: 40429

SEQ ID NO: 230557 - RNA, 64 nt, Homo Sapiens; identical to SEQ ID NO: 40430

SEQ ID NO: 230558 - RNA, 64 nt, Homo Sapiens; identical to SEQ ID NO: 40431

SEQ ID NO: 230559 - RNA, 64 nt, Homo Sapiens; identical to SEQ ID NO: 40432

SEQ ID NO: 230560 - RNA, 64 nt, Homo Sapiens; identical to SEQ ID NO: 40433

SEQ ID NO: 230561 - RNA, 64 nt, Homo Sapiens; identical to SEQ ID NO: 40434

SEQ ID NO: 230562 - RNA, 64 nt, Homo Sapiens; identical to SEQ ID NO: 40435

SEQ ID NO: 230563 - RNA, 64 nt, Homo Sapiens; identical to SEQ ID NO: 40436

SEQ ID NO: 230564 - RNA, 64 nt, Homo Sapiens; identical to SEQ ID NO: 40437

SEQ ID NO: 230565 - RNA, 64 nt, Homo Sapiens; identical to SEQ ID NO: 40438

SEQ ID NO: 230566 - RNA, 64 nt, Homo Sapiens; identical to SEQ ID NO: 40439

SEQ ID NO: 230567 - RNA, 64 nt, Homo Sapiens; identical to SEQ ID NO: 40440

SEQ ID NO: 230568 - RNA, 64 nt, Homo Sapiens; identical to SEQ ID NO: 40441

SEQ ID NO: 230569 - RNA, 64 nt, Homo Sapiens; identical to SEQ ID NO: 40442

SEQ ID NO: 230570 - RNA, 64 nt, Homo Sapiens; identical to SEQ ID NO: 40443

SEQ ID NO: 230571 - RNA, 64 nt, Homo Sapiens; identical to SEQ ID NO: 40444

SEQ ID NO: 230572 - RNA, 64 nt, Homo Sapiens; identical to SEQ ID NO: 40445

SEQ ID NO: 230573 - RNA, 64 nt, Homo Sapiens; identical to SEQ ID NO: 40446

SEQ ID NO: 230574 - RNA, 64 nt, Homo Sapiens; identical to SEQ ID NO: 40447

SEQ ID NO: 230575 - RNA, 64 nt, Homo Sapiens; identical to SEQ ID NO: 40448

SEQ ID NO: 230576 - RNA, 64 nt, Homo Sapiens; identical to SEQ ID NO: 40449

SEQ ID NO: 230577 - RNA, 64 nt, Homo Sapiens; identical to SEQ ID NO: 40450

SEQ ID NO: 230578 - RNA, 64 nt, Homo Sapiens; identical to SEQ ID NO: 40451

SEQ ID NO: 230579 - RNA, 64 nt, Homo Sapiens; identical to SEQ ID NO: 40452

SEQ ID NO: 230580 - RNA, 64 nt, Homo Sapiens; identical to SEQ ID NO: 40453

SEQ ID NO: 230581 - RNA, 64 nt, Homo Sapiens; identical to SEQ ID NO: 40454

SEQ ID NO: 230582 - RNA, 64 nt, Homo Sapiens; identical to SEQ ID NO: 40455

SEQ ID NO: 230583 - RNA, 64 nt, Homo Sapiens; identical to SEQ ID NO: 40456

SEQ ID NO: 230584 - RNA, 64 nt, Homo Sapiens; identical to SEQ ID NO: 40457

SEQ ID NO: 230585 - RNA, 64 nt, Homo Sapiens; identical to SEQ ID NO: 40458

SEQ ID NO: 230586 - RNA, 64 nt, Homo Sapiens; identical to SEQ ID NO: 40459

SEQ ID NO: 230587 - RNA, 64 nt, Homo Sapiens; identical to SEQ ID NO: 40460

SEQ ID NO: 230588 - RNA, 64 nt, Homo Sapiens; identical to SEQ ID NO: 40461

SEQ ID NO: 230589 - RNA, 64 nt, Homo Sapiens; identical to SEQ ID NO: 40462

SEQ ID NO: 230590 - RNA, 64 nt, Homo Sapiens; identical to SEQ ID NO: 40463

SEQ ID NO: 230591 - RNA, 64 nt, Homo Sapiens; identical to SEQ ID NO: 40464

SEQ ID NO: 230592 - RNA, 64 nt, Homo Sapiens; identical to SEQ ID NO: 40465

SEQ ID NO: 230593 - RNA, 64 nt, Homo Sapiens; identical to SEQ ID NO: 40466

SEQ ID NO: 230594 - RNA, 64 nt, Homo Sapiens; identical to SEQ ID NO: 40467

SEQ ID NO: 230595 - RNA, 64 nt, Homo Sapiens; identical to SEQ ID NO: 40468

SEQ ID NO: 230596 - RNA, 64 nt, Homo Sapiens; identical to SEQ ID NO: 40469

SEQ ID NO: 230597 - RNA, 64 nt, Homo Sapiens; identical to SEQ ID NO: 40470

SEQ ID NO: 230598 - RNA, 64 nt, Homo Sapiens; identical to SEQ ID NO: 40471

SEQ ID NO: 230599 - RNA, 64 nt, Homo Sapiens; identical to SEQ ID NO: 40472

SEQ ID NO: 230600 - RNA, 64 nt, Homo Sapiens; identical to SEQ ID NO: 40473

SEQ ID NO: 230601 - RNA, 64 nt, Homo Sapiens; identical to SEQ ID NO: 40474

SEQ ID NO: 230602 - RNA, 64 nt, Homo Sapiens; identical to SEQ ID NO: 40475

SEQ ID NO: 230603 - RNA, 64 nt, Homo Sapiens; identical to SEQ ID NO: 40476

SEQ ID NO: 230604 - RNA, 64 nt, Homo Sapiens; identical to SEQ ID NO: 40477

SEQ ID NO: 230605 - RNA, 64 nt, Homo Sapiens; identical to SEQ ID NO: 40478

SEQ ID NO: 230606 - RNA, 64 nt, Homo Sapiens; identical to SEQ ID NO: 40479

SEQ ID NO: 230607 - RNA, 64 nt, Homo Sapiens; identical to SEQ ID NO: 40480

SEQ ID NO: 230608 - RNA, 64 nt, Homo Sapiens; identical to SEQ ID NO: 40481

SEQ ID NO: 230609 - RNA, 64 nt, Homo Sapiens; identical to SEQ ID NO: 40482

SEQ ID NO: 230610 - RNA, 64 nt, Homo Sapiens; identical to SEQ ID NO: 40483

SEQ ID NO: 230611 - RNA, 64 nt, Homo Sapiens; identical to SEQ ID NO: 40484

SEQ ID NO: 230612 - RNA, 64 nt, Homo Sapiens; identical to SEQ ID NO: 40485

SEQ ID NO: 230613 - RNA, 64 nt, Homo Sapiens; identical to SEQ ID NO: 40486

SEQ ID NO: 230614 - RNA, 64 nt, Homo Sapiens; identical to SEQ ID NO: 40487

SEQ ID NO: 230615 - RNA, 64 nt, Homo Sapiens; identical to SEQ ID NO: 40488

SEQ ID NO: 230616 - RNA, 64 nt, Homo Sapiens; identical to SEQ ID NO: 40489

SEQ ID NO: 230617 - RNA, 64 nt, Homo Sapiens; identical to SEQ ID NO: 40490

SEQ ID NO: 230618 - RNA, 64 nt, Homo Sapiens; identical to SEQ ID NO: 40491

SEQ ID NO: 230619 - RNA, 64 nt, Homo Sapiens; identical to SEQ ID NO: 40492

SEQ ID NO: 230620 - RNA, 64 nt, Homo Sapiens; identical to SEQ ID NO: 40493

SEQ ID NO: 230621 - RNA, 64 nt, Homo Sapiens; identical to SEQ ID NO: 40494

SEQ ID NO: 230622 - RNA, 64 nt, Homo Sapiens; identical to SEQ ID NO: 40495

SEQ ID NO: 230623 - RNA, 64 nt, Homo Sapiens; identical to SEQ ID NO: 40496

SEQ ID NO: 230624 - RNA, 64 nt, Homo Sapiens; identical to SEQ ID NO: 40497

SEQ ID NO: 230625 - RNA, 64 nt, Homo Sapiens; identical to SEQ ID NO: 40498

SEQ ID NO: 230626 - RNA, 64 nt, Homo Sapiens; identical to SEQ ID NO: 40499

SEQ ID NO: 230627 - RNA, 64 nt, Homo Sapiens; identical to SEQ ID NO: 40500

SEQ ID NO: 230628 - RNA, 64 nt, Homo Sapiens; identical to SEQ ID NO: 40501

SEQ ID NO: 230629 - RNA, 64 nt, Homo Sapiens; identical to SEQ ID NO: 40502

SEQ ID NO: 230630 - RNA, 64 nt, Homo Sapiens; identical to SEQ ID NO: 40503

SEQ ID NO: 230631 - RNA, 64 nt, Homo Sapiens; identical to SEQ ID NO: 40504

SEQ ID NO: 230632 - RNA, 64 nt, Homo Sapiens; identical to SEQ ID NO: 40505

SEQ ID NO: 230633 - RNA, 64 nt, Homo Sapiens; identical to SEQ ID NO: 40506

SEQ ID NO: 230634 - RNA, 64 nt, Homo Sapiens; identical to SEQ ID NO: 40507

SEQ ID NO: 230635 - RNA, 64 nt, Homo Sapiens; identical to SEQ ID NO: 40508

SEQ ID NO: 230636 - RNA, 64 nt, Homo Sapiens; identical to SEQ ID NO: 40509

SEQ ID NO: 230637 - RNA, 64 nt, Homo Sapiens; identical to SEQ ID NO: 40510

SEQ ID NO: 230638 - RNA, 64 nt, Homo Sapiens; identical to SEQ ID NO: 40511

SEQ ID NO: 230639 - RNA, 64 nt, Homo Sapiens; identical to SEQ ID NO: 40512

SEQ ID NO: 230640 - RNA, 64 nt, Homo Sapiens; identical to SEQ ID NO: 40513

SEQ ID NO: 230641 - RNA, 64 nt, Homo Sapiens; identical to SEQ ID NO: 40514

SEQ ID NO: 230642 - RNA, 64 nt, Homo Sapiens; identical to SEQ ID NO: 40515

SEQ ID NO: 230643 - RNA, 64 nt, Homo Sapiens; identical to SEQ ID NO: 40516

SEQ ID NO: 230644 - RNA, 64 nt, Homo Sapiens; identical to SEQ ID NO: 40517

SEQ ID NO: 230645 - RNA, 64 nt, Homo Sapiens; identical to SEQ ID NO: 40518

SEQ ID NO: 230646 - RNA, 64 nt, Homo Sapiens; identical to SEQ ID NO: 40519

SEQ ID NO: 230647 - RNA, 64 nt, Homo Sapiens; identical to SEQ ID NO: 40520

SEQ ID NO: 230648 - RNA, 64 nt, Homo Sapiens; identical to SEQ ID NO: 40521

SEQ ID NO: 230649 - RNA, 64 nt, Homo Sapiens; identical to SEQ ID NO: 40522

SEQ ID NO: 230650 - RNA, 64 nt, Homo Sapiens; identical to SEQ ID NO: 40523

SEQ ID NO: 230651 - RNA, 64 nt, Homo Sapiens; identical to SEQ ID NO: 40524

SEQ ID NO: 230652 - RNA, 64 nt, Homo Sapiens; identical to SEQ ID NO: 40525

SEQ ID NO: 230653 - RNA, 64 nt, Homo Sapiens; identical to SEQ ID NO: 40526

SEQ ID NO: 230654 - RNA, 64 nt, Homo Sapiens; identical to SEQ ID NO: 40527

SEQ ID NO: 230655 - RNA, 64 nt, Homo Sapiens; identical to SEQ ID NO: 40528

SEQ ID NO: 230656 - RNA, 64 nt, Homo Sapiens; identical to SEQ ID NO: 40529

SEQ ID NO: 230657 - RNA, 64 nt, Homo Sapiens; identical to SEQ ID NO: 40530

SEQ ID NO: 230658 - RNA, 64 nt, Homo Sapiens; identical to SEQ ID NO: 40531

SEQ ID NO: 230659 - RNA, 64 nt, Homo Sapiens; identical to SEQ ID NO: 40532

SEQ ID NO: 230660 - RNA, 64 nt, Homo Sapiens; identical to SEQ ID NO: 40533

SEQ ID NO: 230661 - RNA, 64 nt, Homo Sapiens; identical to SEQ ID NO: 40534

SEQ ID NO: 230662 - RNA, 64 nt, Homo Sapiens; identical to SEQ ID NO: 40535

SEQ ID NO: 230663 - RNA, 64 nt, Homo Sapiens; identical to SEQ ID NO: 40536

SEQ ID NO: 230664 - RNA, 64 nt, Homo Sapiens; identical to SEQ ID NO: 40537

SEQ ID NO: 230665 - RNA, 64 nt, Homo Sapiens; identical to SEQ ID NO: 40538

SEQ ID NO: 230666 - RNA, 64 nt, Homo Sapiens; identical to SEQ ID NO: 40539

SEQ ID NO: 230667 - RNA, 64 nt, Homo Sapiens; identical to SEQ ID NO: 40540

SEQ ID NO: 230668 - RNA, 64 nt, Homo Sapiens; identical to SEQ ID NO: 40541

SEQ ID NO: 230669 - RNA, 64 nt, Homo Sapiens; identical to SEQ ID NO: 40542

SEQ ID NO: 230670 - RNA, 64 nt, Homo Sapiens; identical to SEQ ID NO: 40543

SEQ ID NO: 230671 - RNA, 64 nt, Homo Sapiens; identical to SEQ ID NO: 40544

SEQ ID NO: 230672 - RNA, 64 nt, Homo Sapiens; identical to SEQ ID NO: 40545

SEQ ID NO: 230673 - RNA, 64 nt, Homo Sapiens; identical to SEQ ID NO: 40546

SEQ ID NO: 230674 - RNA, 64 nt, Homo Sapiens; identical to SEQ ID NO: 40547

SEQ ID NO: 230675 - RNA, 64 nt, Homo Sapiens; identical to SEQ ID NO: 40548

SEQ ID NO: 230676 - RNA, 64 nt, Homo Sapiens; identical to SEQ ID NO: 40549

SEQ ID NO: 230677 - RNA, 64 nt, Homo Sapiens; identical to SEQ ID NO: 40550

SEQ ID NO: 230678 - RNA, 64 nt, Homo Sapiens; identical to SEQ ID NO: 40551

SEQ ID NO: 230679 - RNA, 64 nt, Homo Sapiens; identical to SEQ ID NO: 40552

SEQ ID NO: 230680 - RNA, 64 nt, Homo Sapiens; identical to SEQ ID NO: 40553

SEQ ID NO: 230681 - RNA, 64 nt, Homo Sapiens; identical to SEQ ID NO: 40554

SEQ ID NO: 230682 - RNA, 64 nt, Homo Sapiens; identical to SEQ ID NO: 40555

SEQ ID NO: 230683 - RNA, 64 nt, Homo Sapiens; identical to SEQ ID NO: 40556

SEQ ID NO: 230684 - RNA, 64 nt, Homo Sapiens; identical to SEQ ID NO: 40557

SEQ ID NO: 230685 - RNA, 64 nt, Homo Sapiens; identical to SEQ ID NO: 40558

SEQ ID NO: 230686 - RNA, 64 nt, Homo Sapiens; identical to SEQ ID NO: 40559

SEQ ID NO: 230687 - RNA, 64 nt, Homo Sapiens; identical to SEQ ID NO: 40560

SEQ ID NO: 230688 - RNA, 64 nt, Homo Sapiens; identical to SEQ ID NO: 40561

SEQ ID NO: 230689 - RNA, 64 nt, Homo Sapiens; identical to SEQ ID NO: 40562

SEQ ID NO: 230690 - RNA, 64 nt, Homo Sapiens; identical to SEQ ID NO: 40563

SEQ ID NO: 230691 - RNA, 64 nt, Homo Sapiens; identical to SEQ ID NO: 40564

SEQ ID NO: 230692 - RNA, 64 nt, Homo Sapiens; identical to SEQ ID NO: 40565

SEQ ID NO: 230693 - RNA, 64 nt, Homo Sapiens; identical to SEQ ID NO: 40566

SEQ ID NO: 230694 - RNA, 64 nt, Homo Sapiens; identical to SEQ ID NO: 40567

SEQ ID NO: 230695 - RNA, 64 nt, Homo Sapiens; identical to SEQ ID NO: 40568

SEQ ID NO: 230696 - RNA, 64 nt, Homo Sapiens; identical to SEQ ID NO: 40569

SEQ ID NO: 230697 - RNA, 64 nt, Homo Sapiens; identical to SEQ ID NO: 40570

SEQ ID NO: 230698 - RNA, 64 nt, Homo Sapiens; identical to SEQ ID NO: 40571

SEQ ID NO: 230699 - RNA, 64 nt, Homo Sapiens; identical to SEQ ID NO: 40572

SEQ ID NO: 230700 - RNA, 64 nt, Homo Sapiens; identical to SEQ ID NO: 40573

SEQ ID NO: 230701 - RNA, 64 nt, Homo Sapiens; identical to SEQ ID NO: 40574

SEQ ID NO: 230702 - RNA, 64 nt, Homo Sapiens; identical to SEQ ID NO: 40575

SEQ ID NO: 230703 - RNA, 64 nt, Homo Sapiens; identical to SEQ ID NO: 40576

SEQ ID NO: 230704 - RNA, 64 nt, Homo Sapiens; identical to SEQ ID NO: 40577

SEQ ID NO: 230705 - RNA, 64 nt, Homo Sapiens; identical to SEQ ID NO: 40578

SEQ ID NO: 230706 - RNA, 64 nt, Homo Sapiens; identical to SEQ ID NO: 40579

SEQ ID NO: 230707 - RNA, 64 nt, Homo Sapiens; identical to SEQ ID NO: 40580

SEQ ID NO: 230708 - RNA, 64 nt, Homo Sapiens; identical to SEQ ID NO: 40581

SEQ ID NO: 230709 - RNA, 64 nt, Homo Sapiens; identical to SEQ ID NO: 40582

SEQ ID NO: 230710 - RNA, 64 nt, Homo Sapiens; identical to SEQ ID NO: 40583

SEQ ID NO: 230711 - RNA, 64 nt, Homo Sapiens; identical to SEQ ID NO: 40584

SEQ ID NO: 230712 - RNA, 64 nt, Homo Sapiens; identical to SEQ ID NO: 40585

SEQ ID NO: 230713 - RNA, 64 nt, Homo Sapiens; identical to SEQ ID NO: 40586

SEQ ID NO: 230714 - RNA, 64 nt, Homo Sapiens; identical to SEQ ID NO: 40587

SEQ ID NO: 230715 - RNA, 64 nt, Homo Sapiens; identical to SEQ ID NO: 40588

SEQ ID NO: 230716 - RNA, 64 nt, Homo Sapiens; identical to SEQ ID NO: 40589

SEQ ID NO: 230717 - RNA, 64 nt, Homo Sapiens; identical to SEQ ID NO: 40590

SEQ ID NO: 230718 - RNA, 64 nt, Homo Sapiens; identical to SEQ ID NO: 40591

SEQ ID NO: 230719 - RNA, 64 nt, Homo Sapiens; identical to SEQ ID NO: 40592

SEQ ID NO: 230720 - RNA, 64 nt, Homo Sapiens; identical to SEQ ID NO: 40593

SEQ ID NO: 230721 - RNA, 64 nt, Homo Sapiens; identical to SEQ ID NO: 40594

SEQ ID NO: 230722 - RNA, 64 nt, Homo Sapiens; identical to SEQ ID NO: 40595

SEQ ID NO: 230723 - RNA, 64 nt, Homo Sapiens; identical to SEQ ID NO: 40596

SEQ ID NO: 230724 - RNA, 64 nt, Homo Sapiens; identical to SEQ ID NO: 40597

SEQ ID NO: 230725 - RNA, 64 nt, Homo Sapiens; identical to SEQ ID NO: 40598

SEQ ID NO: 230726 - RNA, 64 nt, Homo Sapiens; identical to SEQ ID NO: 40599

SEQ ID NO: 230727 - RNA, 64 nt, Homo Sapiens; identical to SEQ ID NO: 40600

SEQ ID NO: 230728 - RNA, 64 nt, Homo Sapiens; identical to SEQ ID NO: 40601

SEQ ID NO: 230729 - RNA, 64 nt, Homo Sapiens; identical to SEQ ID NO: 40602

SEQ ID NO: 230730 - RNA, 64 nt, Homo Sapiens; identical to SEQ ID NO: 40603

SEQ ID NO: 230731 - RNA, 64 nt, Homo Sapiens; identical to SEQ ID NO: 40604

SEQ ID NO: 230732 - RNA, 64 nt, Homo Sapiens; identical to SEQ ID NO: 40605

SEQ ID NO: 230733 - RNA, 64 nt, Homo Sapiens; identical to SEQ ID NO: 40606

SEQ ID NO: 230734 - RNA, 64 nt, Homo Sapiens; identical to SEQ ID NO: 40607

SEQ ID NO: 230735 - RNA, 64 nt, Homo Sapiens; identical to SEQ ID NO: 40608

SEQ ID NO: 230736 - RNA, 64 nt, Homo Sapiens; identical to SEQ ID NO: 40609

SEQ ID NO: 230737 - RNA, 64 nt, Homo Sapiens; identical to SEQ ID NO: 40610

SEQ ID NO: 230738 - RNA, 64 nt, Homo Sapiens; identical to SEQ ID NO: 40611

SEQ ID NO: 230739 - RNA, 64 nt, Homo Sapiens; identical to SEQ ID NO: 40612

SEQ ID NO: 230740 - RNA, 64 nt, Homo Sapiens; identical to SEQ ID NO: 40613

SEQ ID NO: 230741 - RNA, 64 nt, Homo Sapiens; identical to SEQ ID NO: 40614

SEQ ID NO: 230742 - RNA, 64 nt, Homo Sapiens; identical to SEQ ID NO: 40615

SEQ ID NO: 230743 - RNA, 64 nt, Homo Sapiens; identical to SEQ ID NO: 40616

SEQ ID NO: 230744 - RNA, 64 nt, Homo Sapiens; identical to SEQ ID NO: 40617

SEQ ID NO: 230745 - RNA, 64 nt, Homo Sapiens; identical to SEQ ID NO: 40618

SEQ ID NO: 230746 - RNA, 64 nt, Homo Sapiens; identical to SEQ ID NO: 40619

SEQ ID NO: 230747 - RNA, 64 nt, Homo Sapiens; identical to SEQ ID NO: 40620

SEQ ID NO: 230748 - RNA, 64 nt, Homo Sapiens; identical to SEQ ID NO: 40621

SEQ ID NO: 230749 - RNA, 64 nt, Homo Sapiens; identical to SEQ ID NO: 40622

SEQ ID NO: 230750 - RNA, 64 nt, Homo Sapiens; identical to SEQ ID NO: 40623

SEQ ID NO: 230751 - RNA, 64 nt, Homo Sapiens; identical to SEQ ID NO: 40624

SEQ ID NO: 230752 - RNA, 64 nt, Homo Sapiens; identical to SEQ ID NO: 40625

SEQ ID NO: 230753 - RNA, 64 nt, Homo Sapiens; identical to SEQ ID NO: 40626

SEQ ID NO: 230754 - RNA, 64 nt, Homo Sapiens; identical to SEQ ID NO: 40627

SEQ ID NO: 230755 - RNA, 64 nt, Homo Sapiens; identical to SEQ ID NO: 40628

SEQ ID NO: 230756 - RNA, 64 nt, Homo Sapiens; identical to SEQ ID NO: 40629

SEQ ID NO: 230757 - RNA, 64 nt, Homo Sapiens; identical to SEQ ID NO: 40630

SEQ ID NO: 230758 - RNA, 64 nt, Homo Sapiens; identical to SEQ ID NO: 40631

SEQ ID NO: 230759 - RNA, 64 nt, Homo Sapiens; identical to SEQ ID NO: 40632

SEQ ID NO: 230760 - RNA, 64 nt, Homo Sapiens; identical to SEQ ID NO: 40633

SEQ ID NO: 230761 - RNA, 64 nt, Homo Sapiens; identical to SEQ ID NO: 40634

SEQ ID NO: 230762 - RNA, 64 nt, Homo Sapiens; identical to SEQ ID NO: 40635

SEQ ID NO: 230763 - RNA, 64 nt, Homo Sapiens; identical to SEQ ID NO: 40636

SEQ ID NO: 230764 - RNA, 64 nt, Homo Sapiens; identical to SEQ ID NO: 40637

SEQ ID NO: 230765 - RNA, 64 nt, Homo Sapiens; identical to SEQ ID NO: 40638

SEQ ID NO: 230766 - RNA, 64 nt, Homo Sapiens; identical to SEQ ID NO: 40639

SEQ ID NO: 230767 - RNA, 64 nt, Homo Sapiens; identical to SEQ ID NO: 40640

SEQ ID NO: 230768 - RNA, 64 nt, Homo Sapiens; identical to SEQ ID NO: 40641

SEQ ID NO: 230769 - RNA, 64 nt, Homo Sapiens; identical to SEQ ID NO: 40642

SEQ ID NO: 230770 - RNA, 64 nt, Homo Sapiens; identical to SEQ ID NO: 40643

SEQ ID NO: 230771 - RNA, 64 nt, Homo Sapiens; identical to SEQ ID NO: 40644

SEQ ID NO: 230772 - RNA, 64 nt, Homo Sapiens; identical to SEQ ID NO: 40645

SEQ ID NO: 230773 - RNA, 64 nt, Homo Sapiens; identical to SEQ ID NO: 40646

SEQ ID NO: 230774 - RNA, 64 nt, Homo Sapiens; identical to SEQ ID NO: 40647

SEQ ID NO: 230775 - RNA, 64 nt, Homo Sapiens; identical to SEQ ID NO: 40648

SEQ ID NO: 230776 - RNA, 64 nt, Homo Sapiens; identical to SEQ ID NO: 40649

SEQ ID NO: 230777 - RNA, 64 nt, Homo Sapiens; identical to SEQ ID NO: 40650

SEQ ID NO: 230778 - RNA, 64 nt, Homo Sapiens; identical to SEQ ID NO: 40651

SEQ ID NO: 230779 - RNA, 64 nt, Homo Sapiens; identical to SEQ ID NO: 40652

SEQ ID NO: 230780 - RNA, 64 nt, Homo Sapiens; identical to SEQ ID NO: 40653

SEQ ID NO: 230781 - RNA, 64 nt, Homo Sapiens; identical to SEQ ID NO: 40654

SEQ ID NO: 230782 - RNA, 64 nt, Homo Sapiens; identical to SEQ ID NO: 40655

SEQ ID NO: 230783 - RNA, 64 nt, Homo Sapiens; identical to SEQ ID NO: 40656

SEQ ID NO: 230784 - RNA, 64 nt, Homo Sapiens; identical to SEQ ID NO: 40657

SEQ ID NO: 230785 - RNA, 64 nt, Homo Sapiens; identical to SEQ ID NO: 40658

SEQ ID NO: 230786 - RNA, 64 nt, Homo Sapiens; identical to SEQ ID NO: 40659

SEQ ID NO: 230787 - RNA, 64 nt, Homo Sapiens; identical to SEQ ID NO: 40660

SEQ ID NO: 230788 - RNA, 64 nt, Homo Sapiens; identical to SEQ ID NO: 40661

SEQ ID NO: 230789 - RNA, 64 nt, Homo Sapiens; identical to SEQ ID NO: 40662

SEQ ID NO: 230790 - RNA, 64 nt, Homo Sapiens; identical to SEQ ID NO: 40663

SEQ ID NO: 230791 - RNA, 64 nt, Homo Sapiens; identical to SEQ ID NO: 40664

SEQ ID NO: 230792 - RNA, 64 nt, Homo Sapiens; identical to SEQ ID NO: 40665

SEQ ID NO: 230793 - RNA, 64 nt, Homo Sapiens; identical to SEQ ID NO: 40666

SEQ ID NO: 230794 - RNA, 64 nt, Homo Sapiens; identical to SEQ ID NO: 40667

SEQ ID NO: 230795 - RNA, 64 nt, Homo Sapiens; identical to SEQ ID NO: 40668

SEQ ID NO: 230796 - RNA, 64 nt, Homo Sapiens; identical to SEQ ID NO: 40669

SEQ ID NO: 230797 - RNA, 64 nt, Homo Sapiens; identical to SEQ ID NO: 40670

SEQ ID NO: 230798 - RNA, 64 nt, Homo Sapiens; identical to SEQ ID NO: 40671

SEQ ID NO: 230799 - RNA, 64 nt, Homo Sapiens; identical to SEQ ID NO: 40672

SEQ ID NO: 230800 - RNA, 64 nt, Homo Sapiens; identical to SEQ ID NO: 40673

SEQ ID NO: 230801 - RNA, 64 nt, Homo Sapiens; identical to SEQ ID NO: 40674

SEQ ID NO: 230802 - RNA, 64 nt, Homo Sapiens; identical to SEQ ID NO: 40675

SEQ ID NO: 230803 - RNA, 64 nt, Homo Sapiens; identical to SEQ ID NO: 40676

SEQ ID NO: 230804 - RNA, 64 nt, Homo Sapiens; identical to SEQ ID NO: 40677

SEQ ID NO: 230805 - RNA, 64 nt, Homo Sapiens; identical to SEQ ID NO: 40678

SEQ ID NO: 230806 - RNA, 64 nt, Homo Sapiens; identical to SEQ ID NO: 40679

SEQ ID NO: 230807 - RNA, 64 nt, Homo Sapiens; identical to SEQ ID NO: 40680

SEQ ID NO: 230808 - RNA, 64 nt, Homo Sapiens; identical to SEQ ID NO: 40681

SEQ ID NO: 230809 - RNA, 64 nt, Homo Sapiens; identical to SEQ ID NO: 40682

SEQ ID NO: 230810 - RNA, 64 nt, Homo Sapiens; identical to SEQ ID NO: 40683

SEQ ID NO: 230811 - RNA, 64 nt, Homo Sapiens; identical to SEQ ID NO: 40684

SEQ ID NO: 230812 - RNA, 64 nt, Homo Sapiens; identical to SEQ ID NO: 40685

SEQ ID NO: 230813 - RNA, 64 nt, Homo Sapiens; identical to SEQ ID NO: 40686

SEQ ID NO: 230814 - RNA, 64 nt, Homo Sapiens; identical to SEQ ID NO: 40687

SEQ ID NO: 230815 - RNA, 64 nt, Homo Sapiens; identical to SEQ ID NO: 40688

SEQ ID NO: 230816 - RNA, 64 nt, Homo Sapiens; identical to SEQ ID NO: 40689

SEQ ID NO: 230817 - RNA, 64 nt, Homo Sapiens; identical to SEQ ID NO: 40690

SEQ ID NO: 230818 - RNA, 64 nt, Homo Sapiens; identical to SEQ ID NO: 40691

SEQ ID NO: 230819 - RNA, 64 nt, Homo Sapiens; identical to SEQ ID NO: 40692

SEQ ID NO: 230820 - RNA, 64 nt, Homo Sapiens; identical to SEQ ID NO: 40693

SEQ ID NO: 230821 - RNA, 64 nt, Homo Sapiens; identical to SEQ ID NO: 40694

SEQ ID NO: 230822 - RNA, 64 nt, Homo Sapiens; identical to SEQ ID NO: 40695

SEQ ID NO: 230823 - RNA, 64 nt, Homo Sapiens; identical to SEQ ID NO: 40696

SEQ ID NO: 230824 - RNA, 64 nt, Homo Sapiens; identical to SEQ ID NO: 40697

SEQ ID NO: 230825 - RNA, 64 nt, Homo Sapiens; identical to SEQ ID NO: 40698

SEQ ID NO: 230826 - RNA, 64 nt, Homo Sapiens; identical to SEQ ID NO: 40699

SEQ ID NO: 230827 - RNA, 64 nt, Homo Sapiens; identical to SEQ ID NO: 40700

SEQ ID NO: 230828 - RNA, 64 nt, Homo Sapiens; identical to SEQ ID NO: 40701

SEQ ID NO: 230829 - RNA, 64 nt, Homo Sapiens; identical to SEQ ID NO: 40702

SEQ ID NO: 230830 - RNA, 64 nt, Homo Sapiens; identical to SEQ ID NO: 40703

SEQ ID NO: 230831 - RNA, 64 nt, Homo Sapiens; identical to SEQ ID NO: 40704

SEQ ID NO: 230832 - RNA, 64 nt, Homo Sapiens; identical to SEQ ID NO: 40705

SEQ ID NO: 230833 - RNA, 64 nt, Homo Sapiens; identical to SEQ ID NO: 40706

SEQ ID NO: 230834 - RNA, 64 nt, Homo Sapiens; identical to SEQ ID NO: 40707

SEQ ID NO: 230835 - RNA, 64 nt, Homo Sapiens; identical to SEQ ID NO: 40708

SEQ ID NO: 230836 - RNA, 64 nt, Homo Sapiens; identical to SEQ ID NO: 40709

SEQ ID NO: 230837 - RNA, 64 nt, Homo Sapiens; identical to SEQ ID NO: 40710

SEQ ID NO: 230838 - RNA, 64 nt, Homo Sapiens; identical to SEQ ID NO: 40711

SEQ ID NO: 230839 - RNA, 64 nt, Homo Sapiens; identical to SEQ ID NO: 40712

SEQ ID NO: 230840 - RNA, 64 nt, Homo Sapiens; identical to SEQ ID NO: 40713

SEQ ID NO: 230841 - RNA, 64 nt, Homo Sapiens; identical to SEQ ID NO: 40714

SEQ ID NO: 230842 - RNA, 64 nt, Homo Sapiens; identical to SEQ ID NO: 40715

SEQ ID NO: 230843 - RNA, 64 nt, Homo Sapiens; identical to SEQ ID NO: 40716

SEQ ID NO: 230844 - RNA, 64 nt, Homo Sapiens; identical to SEQ ID NO: 40717

SEQ ID NO: 230845 - RNA, 64 nt, Homo Sapiens; identical to SEQ ID NO: 40718

SEQ ID NO: 230846 - RNA, 64 nt, Homo Sapiens; identical to SEQ ID NO: 40719

SEQ ID NO: 230847 - RNA, 64 nt, Homo Sapiens; identical to SEQ ID NO: 40720

SEQ ID NO: 230848 - RNA, 64 nt, Homo Sapiens; identical to SEQ ID NO: 40721

SEQ ID NO: 230849 - RNA, 64 nt, Homo Sapiens; identical to SEQ ID NO: 40722

SEQ ID NO: 230850 - RNA, 64 nt, Homo Sapiens; identical to SEQ ID NO: 40723

SEQ ID NO: 230851 - RNA, 64 nt, Homo Sapiens; identical to SEQ ID NO: 40724

SEQ ID NO: 230852 - RNA, 64 nt, Homo Sapiens; identical to SEQ ID NO: 40725

SEQ ID NO: 230853 - RNA, 64 nt, Homo Sapiens; identical to SEQ ID NO: 40726

SEQ ID NO: 230854 - RNA, 64 nt, Homo Sapiens; identical to SEQ ID NO: 40727

SEQ ID NO: 230855 - RNA, 64 nt, Homo Sapiens; identical to SEQ ID NO: 40728

SEQ ID NO: 230856 - RNA, 64 nt, Homo Sapiens; identical to SEQ ID NO: 40729

SEQ ID NO: 230857 - RNA, 64 nt, Homo Sapiens; identical to SEQ ID NO: 40730

SEQ ID NO: 230858 - RNA, 64 nt, Homo Sapiens; identical to SEQ ID NO: 40731

SEQ ID NO: 230859 - RNA, 64 nt, Homo Sapiens; identical to SEQ ID NO: 40732

SEQ ID NO: 230860 - RNA, 64 nt, Homo Sapiens; identical to SEQ ID NO: 40733

SEQ ID NO: 230861 - RNA, 64 nt, Homo Sapiens; identical to SEQ ID NO: 40734

SEQ ID NO: 230862 - RNA, 64 nt, Homo Sapiens; identical to SEQ ID NO: 40735

SEQ ID NO: 230863 - RNA, 64 nt, Homo Sapiens; identical to SEQ ID NO: 40736

SEQ ID NO: 230864 - RNA, 64 nt, Homo Sapiens; identical to SEQ ID NO: 40737

SEQ ID NO: 230865 - RNA, 64 nt, Homo Sapiens; identical to SEQ ID NO: 40738

SEQ ID NO: 230866 - RNA, 64 nt, Homo Sapiens; identical to SEQ ID NO: 40739

SEQ ID NO: 230867 - RNA, 64 nt, Homo Sapiens; identical to SEQ ID NO: 40740

SEQ ID NO: 230868 - RNA, 64 nt, Homo Sapiens; identical to SEQ ID NO: 40741

SEQ ID NO: 230869 - RNA, 64 nt, Homo Sapiens; identical to SEQ ID NO: 40742

SEQ ID NO: 230870 - RNA, 64 nt, Homo Sapiens; identical to SEQ ID NO: 40743

SEQ ID NO: 230871 - RNA, 64 nt, Homo Sapiens; identical to SEQ ID NO: 40744

SEQ ID NO: 230872 - RNA, 64 nt, Homo Sapiens; identical to SEQ ID NO: 40745

SEQ ID NO: 230873 - RNA, 64 nt, Homo Sapiens; identical to SEQ ID NO: 40746

SEQ ID NO: 230874 - RNA, 64 nt, Homo Sapiens; identical to SEQ ID NO: 40747

SEQ ID NO: 230875 - RNA, 64 nt, Homo Sapiens; identical to SEQ ID NO: 40748

SEQ ID NO: 230876 - RNA, 64 nt, Homo Sapiens; identical to SEQ ID NO: 40749

SEQ ID NO: 230877 - RNA, 64 nt, Homo Sapiens; identical to SEQ ID NO: 40750

SEQ ID NO: 230878 - RNA, 64 nt, Homo Sapiens; identical to SEQ ID NO: 40751

SEQ ID NO: 230879 - RNA, 64 nt, Homo Sapiens; identical to SEQ ID NO: 40752

SEQ ID NO: 230880 - RNA, 64 nt, Homo Sapiens; identical to SEQ ID NO: 40753

SEQ ID NO: 230881 - RNA, 64 nt, Homo Sapiens; identical to SEQ ID NO: 40754

SEQ ID NO: 230882 - RNA, 64 nt, Homo Sapiens; identical to SEQ ID NO: 40755

SEQ ID NO: 230883 - RNA, 64 nt, Homo Sapiens; identical to SEQ ID NO: 40756

SEQ ID NO: 230884 - RNA, 64 nt, Homo Sapiens; identical to SEQ ID NO: 40757

SEQ ID NO: 230885 - RNA, 64 nt, Homo Sapiens; identical to SEQ ID NO: 40758

SEQ ID NO: 230886 - RNA, 64 nt, Homo Sapiens; identical to SEQ ID NO: 40759

SEQ ID NO: 230887 - RNA, 64 nt, Homo Sapiens; identical to SEQ ID NO: 40760

SEQ ID NO: 230888 - RNA, 64 nt, Homo Sapiens; identical to SEQ ID NO: 40761

SEQ ID NO: 230889 - RNA, 64 nt, Homo Sapiens; identical to SEQ ID NO: 40762

SEQ ID NO: 230890 - RNA, 64 nt, Homo Sapiens; identical to SEQ ID NO: 40763

SEQ ID NO: 230891 - RNA, 64 nt, Homo Sapiens; identical to SEQ ID NO: 40764

SEQ ID NO: 230892 - RNA, 64 nt, Homo Sapiens; identical to SEQ ID NO: 40765

SEQ ID NO: 230893 - RNA, 64 nt, Homo Sapiens; identical to SEQ ID NO: 40766

SEQ ID NO: 230894 - RNA, 64 nt, Homo Sapiens; identical to SEQ ID NO: 40767

SEQ ID NO: 230895 - RNA, 64 nt, Homo Sapiens; identical to SEQ ID NO: 40768

SEQ ID NO: 230896 - RNA, 64 nt, Homo Sapiens; identical to SEQ ID NO: 40769

SEQ ID NO: 230897 - RNA, 64 nt, Homo Sapiens; identical to SEQ ID NO: 40770

SEQ ID NO: 230898 - RNA, 64 nt, Homo Sapiens; identical to SEQ ID NO: 40771

SEQ ID NO: 230899 - RNA, 64 nt, Homo Sapiens; identical to SEQ ID NO: 40772

SEQ ID NO: 230900 - RNA, 64 nt, Homo Sapiens; identical to SEQ ID NO: 40773

SEQ ID NO: 230901 - RNA, 64 nt, Homo Sapiens; identical to SEQ ID NO: 40774

SEQ ID NO: 230902 - RNA, 64 nt, Homo Sapiens; identical to SEQ ID NO: 40775

SEQ ID NO: 230903 - RNA, 64 nt, Homo Sapiens; identical to SEQ ID NO: 40776

SEQ ID NO: 230904 - RNA, 64 nt, Homo Sapiens; identical to SEQ ID NO: 40777

SEQ ID NO: 230905 - RNA, 64 nt, Homo Sapiens; identical to SEQ ID NO: 40778

SEQ ID NO: 230906 - RNA, 64 nt, Homo Sapiens; identical to SEQ ID NO: 40779

SEQ ID NO: 230907 - RNA, 64 nt, Homo Sapiens; identical to SEQ ID NO: 40780

SEQ ID NO: 230908 - RNA, 64 nt, Homo Sapiens; identical to SEQ ID NO: 40781

SEQ ID NO: 230909 - RNA, 64 nt, Homo Sapiens; identical to SEQ ID NO: 40782

SEQ ID NO: 230910 - RNA, 64 nt, Homo Sapiens; identical to SEQ ID NO: 40783

SEQ ID NO: 230911 - RNA, 64 nt, Homo Sapiens; identical to SEQ ID NO: 40784

SEQ ID NO: 230912 - RNA, 64 nt, Homo Sapiens; identical to SEQ ID NO: 40785

SEQ ID NO: 230913 - RNA, 64 nt, Homo Sapiens; identical to SEQ ID NO: 40786

SEQ ID NO: 230914 - RNA, 64 nt, Homo Sapiens; identical to SEQ ID NO: 40787

SEQ ID NO: 230915 - RNA, 64 nt, Homo Sapiens; identical to SEQ ID NO: 40788

SEQ ID NO: 230916 - RNA, 64 nt, Homo Sapiens; identical to SEQ ID NO: 40789

SEQ ID NO: 230917 - RNA, 64 nt, Homo Sapiens; identical to SEQ ID NO: 40790

SEQ ID NO: 230918 - RNA, 64 nt, Homo Sapiens; identical to SEQ ID NO: 40791

SEQ ID NO: 230919 - RNA, 64 nt, Homo Sapiens; identical to SEQ ID NO: 40792

SEQ ID NO: 230920 - RNA, 64 nt, Homo Sapiens; identical to SEQ ID NO: 40793

SEQ ID NO: 230921 - RNA, 64 nt, Homo Sapiens; identical to SEQ ID NO: 40794

SEQ ID NO: 230922 - RNA, 64 nt, Homo Sapiens; identical to SEQ ID NO: 40795

SEQ ID NO: 230923 - RNA, 64 nt, Homo Sapiens; identical to SEQ ID NO: 40796

SEQ ID NO: 230924 - RNA, 64 nt, Homo Sapiens; identical to SEQ ID NO: 40797

SEQ ID NO: 230925 - RNA, 64 nt, Homo Sapiens; identical to SEQ ID NO: 40798

SEQ ID NO: 230926 - RNA, 64 nt, Homo Sapiens; identical to SEQ ID NO: 40799

SEQ ID NO: 230927 - RNA, 64 nt, Homo Sapiens; identical to SEQ ID NO: 40800

SEQ ID NO: 230928 - RNA, 64 nt, Homo Sapiens; identical to SEQ ID NO: 40801

SEQ ID NO: 230929 - RNA, 64 nt, Homo Sapiens; identical to SEQ ID NO: 40802

SEQ ID NO: 230930 - RNA, 64 nt, Homo Sapiens; identical to SEQ ID NO: 40803

SEQ ID NO: 230931 - RNA, 64 nt, Homo Sapiens; identical to SEQ ID NO: 40804

SEQ ID NO: 230932 - RNA, 64 nt, Homo Sapiens; identical to SEQ ID NO: 40805

SEQ ID NO: 230933 - RNA, 64 nt, Homo Sapiens; identical to SEQ ID NO: 40806

SEQ ID NO: 230934 - RNA, 64 nt, Homo Sapiens; identical to SEQ ID NO: 40807

SEQ ID NO: 230935 - RNA, 64 nt, Homo Sapiens; identical to SEQ ID NO: 40808

SEQ ID NO: 230936 - RNA, 64 nt, Homo Sapiens; identical to SEQ ID NO: 40809

SEQ ID NO: 230937 - RNA, 64 nt, Homo Sapiens; identical to SEQ ID NO: 40810

SEQ ID NO: 230938 - RNA, 64 nt, Homo Sapiens; identical to SEQ ID NO: 40811

SEQ ID NO: 230939 - RNA, 64 nt, Homo Sapiens; identical to SEQ ID NO: 40812

SEQ ID NO: 230940 - RNA, 64 nt, Homo Sapiens; identical to SEQ ID NO: 40813

SEQ ID NO: 230941 - RNA, 64 nt, Homo Sapiens; identical to SEQ ID NO: 40814

SEQ ID NO: 230942 - RNA, 64 nt, Homo Sapiens; identical to SEQ ID NO: 40815

SEQ ID NO: 230943 - RNA, 64 nt, Homo Sapiens; identical to SEQ ID NO: 40816

SEQ ID NO: 230944 - RNA, 64 nt, Homo Sapiens; identical to SEQ ID NO: 40817

SEQ ID NO: 230945 - RNA, 64 nt, Homo Sapiens; identical to SEQ ID NO: 40818

SEQ ID NO: 230946 - RNA, 64 nt, Homo Sapiens; identical to SEQ ID NO: 40819

SEQ ID NO: 230947 - RNA, 64 nt, Homo Sapiens; identical to SEQ ID NO: 40820

SEQ ID NO: 230948 - RNA, 64 nt, Homo Sapiens; identical to SEQ ID NO: 40821

SEQ ID NO: 230949 - RNA, 64 nt, Homo Sapiens; identical to SEQ ID NO: 40822

SEQ ID NO: 230950 - RNA, 64 nt, Homo Sapiens; identical to SEQ ID NO: 40823

SEQ ID NO: 230951 - RNA, 64 nt, Homo Sapiens; identical to SEQ ID NO: 40824

SEQ ID NO: 230952 - RNA, 64 nt, Homo Sapiens; identical to SEQ ID NO: 40825

SEQ ID NO: 230953 - RNA, 64 nt, Homo Sapiens; identical to SEQ ID NO: 40826

SEQ ID NO: 230954 - RNA, 64 nt, Homo Sapiens; identical to SEQ ID NO: 40827

SEQ ID NO: 230955 - RNA, 64 nt, Homo Sapiens; identical to SEQ ID NO: 40828

SEQ ID NO: 230956 - RNA, 64 nt, Homo Sapiens; identical to SEQ ID NO: 40829

SEQ ID NO: 230957 - RNA, 64 nt, Homo Sapiens; identical to SEQ ID NO: 40830

SEQ ID NO: 230958 - RNA, 64 nt, Homo Sapiens; identical to SEQ ID NO: 40831

SEQ ID NO: 230959 - RNA, 64 nt, Homo Sapiens; identical to SEQ ID NO: 40832

SEQ ID NO: 230960 - RNA, 64 nt, Homo Sapiens; identical to SEQ ID NO: 40833

SEQ ID NO: 230961 - RNA, 64 nt, Homo Sapiens; identical to SEQ ID NO: 40834

SEQ ID NO: 230962 - RNA, 64 nt, Homo Sapiens; identical to SEQ ID NO: 40835

SEQ ID NO: 230963 - RNA, 64 nt, Homo Sapiens; identical to SEQ ID NO: 40836

SEQ ID NO: 230964 - RNA, 64 nt, Homo Sapiens; identical to SEQ ID NO: 40837

SEQ ID NO: 230965 - RNA, 64 nt, Homo Sapiens; identical to SEQ ID NO: 40838

SEQ ID NO: 230966 - RNA, 64 nt, Homo Sapiens; identical to SEQ ID NO: 40839

SEQ ID NO: 230967 - RNA, 64 nt, Homo Sapiens; identical to SEQ ID NO: 40840

SEQ ID NO: 230968 - RNA, 64 nt, Homo Sapiens; identical to SEQ ID NO: 40841

SEQ ID NO: 230969 - RNA, 64 nt, Homo Sapiens; identical to SEQ ID NO: 40842

SEQ ID NO: 230970 - RNA, 64 nt, Homo Sapiens; identical to SEQ ID NO: 40843

SEQ ID NO: 230971 - RNA, 64 nt, Homo Sapiens; identical to SEQ ID NO: 40844

SEQ ID NO: 230972 - RNA, 64 nt, Homo Sapiens; identical to SEQ ID NO: 40845

SEQ ID NO: 230973 - RNA, 64 nt, Homo Sapiens; identical to SEQ ID NO: 40846

SEQ ID NO: 230974 - RNA, 64 nt, Homo Sapiens; identical to SEQ ID NO: 40847

SEQ ID NO: 230975 - RNA, 64 nt, Homo Sapiens; identical to SEQ ID NO: 40848

SEQ ID NO: 230976 - RNA, 64 nt, Homo Sapiens; identical to SEQ ID NO: 40849

SEQ ID NO: 230977 - RNA, 64 nt, Homo Sapiens; identical to SEQ ID NO: 40850

SEQ ID NO: 230978 - RNA, 64 nt, Homo Sapiens; identical to SEQ ID NO: 40851

SEQ ID NO: 230979 - RNA, 64 nt, Homo Sapiens; identical to SEQ ID NO: 40852

SEQ ID NO: 230980 - RNA, 64 nt, Homo Sapiens; identical to SEQ ID NO: 40853

SEQ ID NO: 230981 - RNA, 64 nt, Homo Sapiens; identical to SEQ ID NO: 40854

SEQ ID NO: 230982 - RNA, 64 nt, Homo Sapiens; identical to SEQ ID NO: 40855

SEQ ID NO: 230983 - RNA, 64 nt, Homo Sapiens; identical to SEQ ID NO: 40856

SEQ ID NO: 230984 - RNA, 64 nt, Homo Sapiens; identical to SEQ ID NO: 40857

SEQ ID NO: 230985 - RNA, 64 nt, Homo Sapiens; identical to SEQ ID NO: 40858

SEQ ID NO: 230986 - RNA, 64 nt, Homo Sapiens; identical to SEQ ID NO: 40859

SEQ ID NO: 230987 - RNA, 64 nt, Homo Sapiens; identical to SEQ ID NO: 40860

SEQ ID NO: 230988 - RNA, 64 nt, Homo Sapiens; identical to SEQ ID NO: 40861

SEQ ID NO: 230989 - RNA, 64 nt, Homo Sapiens; identical to SEQ ID NO: 40862

SEQ ID NO: 230990 - RNA, 64 nt, Homo Sapiens; identical to SEQ ID NO: 40863

SEQ ID NO: 230991 - RNA, 64 nt, Homo Sapiens; identical to SEQ ID NO: 40864

SEQ ID NO: 230992 - RNA, 64 nt, Homo Sapiens; identical to SEQ ID NO: 40865

SEQ ID NO: 230993 - RNA, 64 nt, Homo Sapiens; identical to SEQ ID NO: 40866

SEQ ID NO: 230994 - RNA, 64 nt, Homo Sapiens; identical to SEQ ID NO: 40867

SEQ ID NO: 230995 - RNA, 64 nt, Homo Sapiens; identical to SEQ ID NO: 40868

SEQ ID NO: 230996 - RNA, 64 nt, Homo Sapiens; identical to SEQ ID NO: 40869

SEQ ID NO: 230997 - RNA, 64 nt, Homo Sapiens; identical to SEQ ID NO: 40870

SEQ ID NO: 230998 - RNA, 64 nt, Homo Sapiens; identical to SEQ ID NO: 40871

SEQ ID NO: 230999 - RNA, 64 nt, Homo Sapiens; identical to SEQ ID NO: 40872

SEQ ID NO: 231000 - RNA, 64 nt, Homo Sapiens; identical to SEQ ID NO: 40873

SEQ ID NO: 231001 - RNA, 64 nt, Homo Sapiens; identical to SEQ ID NO: 40874

SEQ ID NO: 231002 - RNA, 64 nt, Homo Sapiens; identical to SEQ ID NO: 40875

SEQ ID NO: 231003 - RNA, 64 nt, Homo Sapiens; identical to SEQ ID NO: 40876

SEQ ID NO: 231004 - RNA, 64 nt, Homo Sapiens; identical to SEQ ID NO: 40877

SEQ ID NO: 231005 - RNA, 64 nt, Homo Sapiens; identical to SEQ ID NO: 40878

SEQ ID NO: 231006 - RNA, 64 nt, Homo Sapiens; identical to SEQ ID NO: 40879

SEQ ID NO: 231007 - RNA, 64 nt, Homo Sapiens; identical to SEQ ID NO: 40880

SEQ ID NO: 231008 - RNA, 64 nt, Homo Sapiens; identical to SEQ ID NO: 40881

SEQ ID NO: 231009 - RNA, 64 nt, Homo Sapiens; identical to SEQ ID NO: 40882

SEQ ID NO: 231010 - RNA, 64 nt, Homo Sapiens; identical to SEQ ID NO: 40883

SEQ ID NO: 231011 - RNA, 64 nt, Homo Sapiens; identical to SEQ ID NO: 40884

SEQ ID NO: 231012 - RNA, 64 nt, Homo Sapiens; identical to SEQ ID NO: 40885

SEQ ID NO: 231013 - RNA, 64 nt, Homo Sapiens; identical to SEQ ID NO: 40886

SEQ ID NO: 231014 - RNA, 64 nt, Homo Sapiens; identical to SEQ ID NO: 40887

SEQ ID NO: 231015 - RNA, 64 nt, Homo Sapiens; identical to SEQ ID NO: 40888

SEQ ID NO: 231016 - RNA, 64 nt, Homo Sapiens; identical to SEQ ID NO: 40889

SEQ ID NO: 231017 - RNA, 64 nt, Homo Sapiens; identical to SEQ ID NO: 40890

SEQ ID NO: 231018 - RNA, 64 nt, Homo Sapiens; identical to SEQ ID NO: 40891

SEQ ID NO: 231019 - RNA, 64 nt, Homo Sapiens; identical to SEQ ID NO: 40892

SEQ ID NO: 231020 - RNA, 64 nt, Homo Sapiens; identical to SEQ ID NO: 40893

SEQ ID NO: 231021 - RNA, 64 nt, Homo Sapiens; identical to SEQ ID NO: 40894

SEQ ID NO: 231022 - RNA, 64 nt, Homo Sapiens; identical to SEQ ID NO: 40895

SEQ ID NO: 231023 - RNA, 64 nt, Homo Sapiens; identical to SEQ ID NO: 40896

SEQ ID NO: 231024 - RNA, 64 nt, Homo Sapiens; identical to SEQ ID NO: 40897

SEQ ID NO: 231025 - RNA, 64 nt, Homo Sapiens; identical to SEQ ID NO: 40898

SEQ ID NO: 231026 - RNA, 64 nt, Homo Sapiens; identical to SEQ ID NO: 40899

SEQ ID NO: 231027 - RNA, 64 nt, Homo Sapiens; identical to SEQ ID NO: 40900

SEQ ID NO: 231028 - RNA, 64 nt, Homo Sapiens; identical to SEQ ID NO: 40901

SEQ ID NO: 231029 - RNA, 64 nt, Homo Sapiens; identical to SEQ ID NO: 40902

SEQ ID NO: 231030 - RNA, 64 nt, Homo Sapiens; identical to SEQ ID NO: 40903

SEQ ID NO: 231031 - RNA, 64 nt, Homo Sapiens; identical to SEQ ID NO: 40904

SEQ ID NO: 231032 - RNA, 64 nt, Homo Sapiens; identical to SEQ ID NO: 40905

SEQ ID NO: 231033 - RNA, 64 nt, Homo Sapiens; identical to SEQ ID NO: 40906

SEQ ID NO: 231034 - RNA, 64 nt, Homo Sapiens; identical to SEQ ID NO: 40907

SEQ ID NO: 231035 - RNA, 64 nt, Homo Sapiens; identical to SEQ ID NO: 40908

SEQ ID NO: 231036 - RNA, 64 nt, Homo Sapiens; identical to SEQ ID NO: 40909

SEQ ID NO: 231037 - RNA, 64 nt, Homo Sapiens; identical to SEQ ID NO: 40910

SEQ ID NO: 231038 - RNA, 64 nt, Homo Sapiens; identical to SEQ ID NO: 40911

SEQ ID NO: 231039 - RNA, 64 nt, Homo Sapiens; identical to SEQ ID NO: 40912

SEQ ID NO: 231040 - RNA, 64 nt, Homo Sapiens; identical to SEQ ID NO: 40913

SEQ ID NO: 231041 - RNA, 64 nt, Homo Sapiens; identical to SEQ ID NO: 40914

SEQ ID NO: 231042 - RNA, 64 nt, Homo Sapiens; identical to SEQ ID NO: 40915

SEQ ID NO: 231043 - RNA, 64 nt, Homo Sapiens; identical to SEQ ID NO: 40916

SEQ ID NO: 231044 - RNA, 64 nt, Homo Sapiens; identical to SEQ ID NO: 40917

SEQ ID NO: 231045 - RNA, 64 nt, Homo Sapiens; identical to SEQ ID NO: 40918

SEQ ID NO: 231046 - RNA, 64 nt, Homo Sapiens; identical to SEQ ID NO: 40919

SEQ ID NO: 231047 - RNA, 64 nt, Homo Sapiens; identical to SEQ ID NO: 40920

SEQ ID NO: 231048 - RNA, 64 nt, Homo Sapiens; identical to SEQ ID NO: 40921

SEQ ID NO: 231049 - RNA, 64 nt, Homo Sapiens; identical to SEQ ID NO: 40922

SEQ ID NO: 231050 - RNA, 64 nt, Homo Sapiens; identical to SEQ ID NO: 40923

SEQ ID NO: 231051 - RNA, 64 nt, Homo Sapiens; identical to SEQ ID NO: 40924

SEQ ID NO: 231052 - RNA, 64 nt, Homo Sapiens; identical to SEQ ID NO: 40925

SEQ ID NO: 231053 - RNA, 64 nt, Homo Sapiens; identical to SEQ ID NO: 40926

SEQ ID NO: 231054 - RNA, 64 nt, Homo Sapiens; identical to SEQ ID NO: 40927

SEQ ID NO: 231055 - RNA, 64 nt, Homo Sapiens; identical to SEQ ID NO: 40928

SEQ ID NO: 231056 - RNA, 64 nt, Homo Sapiens; identical to SEQ ID NO: 40929

SEQ ID NO: 231057 - RNA, 64 nt, Homo Sapiens; identical to SEQ ID NO: 40930

SEQ ID NO: 231058 - RNA, 64 nt, Homo Sapiens; identical to SEQ ID NO: 40931

SEQ ID NO: 231059 - RNA, 64 nt, Homo Sapiens; identical to SEQ ID NO: 40932

SEQ ID NO: 231060 - RNA, 64 nt, Homo Sapiens; identical to SEQ ID NO: 40933

SEQ ID NO: 231061 - RNA, 64 nt, Homo Sapiens; identical to SEQ ID NO: 40934

SEQ ID NO: 231062 - RNA, 64 nt, Homo Sapiens; identical to SEQ ID NO: 40935

SEQ ID NO: 231063 - RNA, 64 nt, Homo Sapiens; identical to SEQ ID NO: 40936

SEQ ID NO: 231064 - RNA, 64 nt, Homo Sapiens; identical to SEQ ID NO: 40937

SEQ ID NO: 231065 - RNA, 64 nt, Homo Sapiens; identical to SEQ ID NO: 40938

SEQ ID NO: 231066 - RNA, 64 nt, Homo Sapiens; identical to SEQ ID NO: 40939

SEQ ID NO: 231067 - RNA, 64 nt, Homo Sapiens; identical to SEQ ID NO: 40940

SEQ ID NO: 231068 - RNA, 64 nt, Homo Sapiens; identical to SEQ ID NO: 40941

SEQ ID NO: 231069 - RNA, 64 nt, Homo Sapiens; identical to SEQ ID NO: 40942

SEQ ID NO: 231070 - RNA, 64 nt, Homo Sapiens; identical to SEQ ID NO: 40943

SEQ ID NO: 231071 - RNA, 64 nt, Homo Sapiens; identical to SEQ ID NO: 40944

SEQ ID NO: 231072 - RNA, 64 nt, Homo Sapiens; identical to SEQ ID NO: 40945

SEQ ID NO: 231073 - RNA, 64 nt, Homo Sapiens; identical to SEQ ID NO: 40946

SEQ ID NO: 231074 - RNA, 64 nt, Homo Sapiens; identical to SEQ ID NO: 40947

SEQ ID NO: 231075 - RNA, 64 nt, Homo Sapiens; identical to SEQ ID NO: 40948

SEQ ID NO: 231076 - RNA, 64 nt, Homo Sapiens; identical to SEQ ID NO: 40949

SEQ ID NO: 231077 - RNA, 64 nt, Homo Sapiens; identical to SEQ ID NO: 40950

SEQ ID NO: 231078 - RNA, 64 nt, Homo Sapiens; identical to SEQ ID NO: 40951

SEQ ID NO: 231079 - RNA, 64 nt, Homo Sapiens; identical to SEQ ID NO: 40952

SEQ ID NO: 231080 - RNA, 64 nt, Homo Sapiens; identical to SEQ ID NO: 40953

SEQ ID NO: 231081 - RNA, 64 nt, Homo Sapiens; identical to SEQ ID NO: 40954

SEQ ID NO: 231082 - RNA, 64 nt, Homo Sapiens; identical to SEQ ID NO: 40955

SEQ ID NO: 231083 - RNA, 64 nt, Homo Sapiens; identical to SEQ ID NO: 40956

SEQ ID NO: 231084 - RNA, 64 nt, Homo Sapiens; identical to SEQ ID NO: 40957

SEQ ID NO: 231085 - RNA, 64 nt, Homo Sapiens; identical to SEQ ID NO: 40958

SEQ ID NO: 231086 - RNA, 64 nt, Homo Sapiens; identical to SEQ ID NO: 40959

SEQ ID NO: 231087 - RNA, 64 nt, Homo Sapiens; identical to SEQ ID NO: 40960

SEQ ID NO: 231088 - RNA, 64 nt, Homo Sapiens; identical to SEQ ID NO: 40961

SEQ ID NO: 231089 - RNA, 64 nt, Homo Sapiens; identical to SEQ ID NO: 40962

SEQ ID NO: 231090 - RNA, 64 nt, Homo Sapiens; identical to SEQ ID NO: 40963

SEQ ID NO: 231091 - RNA, 64 nt, Homo Sapiens; identical to SEQ ID NO: 40964

SEQ ID NO: 231092 - RNA, 64 nt, Homo Sapiens; identical to SEQ ID NO: 40965

SEQ ID NO: 231093 - RNA, 64 nt, Homo Sapiens; identical to SEQ ID NO: 40966

SEQ ID NO: 231094 - RNA, 64 nt, Homo Sapiens; identical to SEQ ID NO: 40967

SEQ ID NO: 231095 - RNA, 64 nt, Homo Sapiens; identical to SEQ ID NO: 40968

SEQ ID NO: 231096 - RNA, 64 nt, Homo Sapiens; identical to SEQ ID NO: 40969

SEQ ID NO: 231097 - RNA, 64 nt, Homo Sapiens; identical to SEQ ID NO: 40970

SEQ ID NO: 231098 - RNA, 64 nt, Homo Sapiens; identical to SEQ ID NO: 40971

SEQ ID NO: 231099 - RNA, 64 nt, Homo Sapiens; identical to SEQ ID NO: 40972

SEQ ID NO: 231100 - RNA, 64 nt, Homo Sapiens; identical to SEQ ID NO: 40973

SEQ ID NO: 231101 - RNA, 64 nt, Homo Sapiens; identical to SEQ ID NO: 40974

SEQ ID NO: 231102 - RNA, 64 nt, Homo Sapiens; identical to SEQ ID NO: 40975

SEQ ID NO: 231103 - RNA, 64 nt, Homo Sapiens; identical to SEQ ID NO: 40976

SEQ ID NO: 231104 - RNA, 64 nt, Homo Sapiens; identical to SEQ ID NO: 40977

SEQ ID NO: 231105 - RNA, 64 nt, Homo Sapiens; identical to SEQ ID NO: 40978

SEQ ID NO: 231106 - RNA, 64 nt, Homo Sapiens; identical to SEQ ID NO: 40979

SEQ ID NO: 231107 - RNA, 64 nt, Homo Sapiens; identical to SEQ ID NO: 40980

SEQ ID NO: 231108 - RNA, 64 nt, Homo Sapiens; identical to SEQ ID NO: 40981

SEQ ID NO: 231109 - RNA, 64 nt, Homo Sapiens; identical to SEQ ID NO: 40982

SEQ ID NO: 231110 - RNA, 64 nt, Homo Sapiens; identical to SEQ ID NO: 40983

SEQ ID NO: 231111 - RNA, 64 nt, Homo Sapiens; identical to SEQ ID NO: 40984

SEQ ID NO: 231112 - RNA, 64 nt, Homo Sapiens; identical to SEQ ID NO: 40985

SEQ ID NO: 231113 - RNA, 64 nt, Homo Sapiens; identical to SEQ ID NO: 40986

SEQ ID NO: 231114 - RNA, 64 nt, Homo Sapiens; identical to SEQ ID NO: 40987

SEQ ID NO: 231115 - RNA, 64 nt, Homo Sapiens; identical to SEQ ID NO: 40988

SEQ ID NO: 231116 - RNA, 64 nt, Homo Sapiens; identical to SEQ ID NO: 40989

SEQ ID NO: 231117 - RNA, 64 nt, Homo Sapiens; identical to SEQ ID NO: 40990

SEQ ID NO: 231118 - RNA, 64 nt, Homo Sapiens; identical to SEQ ID NO: 40991

SEQ ID NO: 231119 - RNA, 64 nt, Homo Sapiens; identical to SEQ ID NO: 40992

SEQ ID NO: 231120 - RNA, 64 nt, Homo Sapiens; identical to SEQ ID NO: 40993

SEQ ID NO: 231121 - RNA, 64 nt, Homo Sapiens; identical to SEQ ID NO: 40994

SEQ ID NO: 231122 - RNA, 64 nt, Homo Sapiens; identical to SEQ ID NO: 40995

SEQ ID NO: 231123 - RNA, 64 nt, Homo Sapiens; identical to SEQ ID NO: 40996

SEQ ID NO: 231124 - RNA, 64 nt, Homo Sapiens; identical to SEQ ID NO: 40997

SEQ ID NO: 231125 - RNA, 64 nt, Homo Sapiens; identical to SEQ ID NO: 40998

SEQ ID NO: 231126 - RNA, 64 nt, Homo Sapiens; identical to SEQ ID NO: 40999

SEQ ID NO: 231127 - RNA, 64 nt, Homo Sapiens; identical to SEQ ID NO: 41000

SEQ ID NO: 231128 - RNA, 64 nt, Homo Sapiens; identical to SEQ ID NO: 41001

SEQ ID NO: 231129 - RNA, 64 nt, Homo Sapiens; identical to SEQ ID NO: 41002

SEQ ID NO: 231130 - RNA, 64 nt, Homo Sapiens; identical to SEQ ID NO: 41003

SEQ ID NO: 231131 - RNA, 64 nt, Homo Sapiens; identical to SEQ ID NO: 41004

SEQ ID NO: 231132 - RNA, 64 nt, Homo Sapiens; identical to SEQ ID NO: 41005

SEQ ID NO: 231133 - RNA, 64 nt, Homo Sapiens; identical to SEQ ID NO: 41006

SEQ ID NO: 231134 - RNA, 63 nt, Homo Sapiens; identical to SEQ ID NO: 41007

SEQ ID NO: 231135 - RNA, 64 nt, Homo Sapiens; identical to SEQ ID NO: 41008

SEQ ID NO: 231136 - RNA, 64 nt, Homo Sapiens; identical to SEQ ID NO: 41009

SEQ ID NO: 231137 - RNA, 64 nt, Homo Sapiens; identical to SEQ ID NO: 41010

SEQ ID NO: 231138 - RNA, 64 nt, Homo Sapiens; identical to SEQ ID NO: 41011

SEQ ID NO: 231139 - RNA, 64 nt, Homo Sapiens; identical to SEQ ID NO: 41012

SEQ ID NO: 231140 - RNA, 64 nt, Homo Sapiens; identical to SEQ ID NO: 41013

SEQ ID NO: 231141 - RNA, 64 nt, Homo Sapiens; identical to SEQ ID NO: 41014

SEQ ID NO: 231142 - RNA, 64 nt, Homo Sapiens; identical to SEQ ID NO: 41015

SEQ ID NO: 231143 - RNA, 64 nt, Homo Sapiens; identical to SEQ ID NO: 41016

SEQ ID NO: 231144 - RNA, 64 nt, Homo Sapiens; identical to SEQ ID NO: 41017

SEQ ID NO: 231145 - RNA, 64 nt, Homo Sapiens; identical to SEQ ID NO: 41018

SEQ ID NO: 231146 - RNA, 64 nt, Homo Sapiens; identical to SEQ ID NO: 41019

SEQ ID NO: 231147 - RNA, 64 nt, Homo Sapiens; identical to SEQ ID NO: 41020

SEQ ID NO: 231148 - RNA, 64 nt, Homo Sapiens; identical to SEQ ID NO: 41021

SEQ ID NO: 231149 - RNA, 64 nt, Homo Sapiens; identical to SEQ ID NO: 41022

SEQ ID NO: 231150 - RNA, 64 nt, Homo Sapiens; identical to SEQ ID NO: 41023

SEQ ID NO: 231151 - RNA, 64 nt, Homo Sapiens; identical to SEQ ID NO: 41024

SEQ ID NO: 231152 - RNA, 64 nt, Homo Sapiens; identical to SEQ ID NO: 41025

SEQ ID NO: 231153 - RNA, 64 nt, Homo Sapiens; identical to SEQ ID NO: 41026

SEQ ID NO: 231154 - RNA, 64 nt, Homo Sapiens; identical to SEQ ID NO: 41027

SEQ ID NO: 231155 - RNA, 64 nt, Homo Sapiens; identical to SEQ ID NO: 41028

SEQ ID NO: 231156 - RNA, 64 nt, Homo Sapiens; identical to SEQ ID NO: 41029

SEQ ID NO: 231157 - RNA, 64 nt, Homo Sapiens; identical to SEQ ID NO: 41030

SEQ ID NO: 231158 - RNA, 64 nt, Homo Sapiens; identical to SEQ ID NO: 41031

SEQ ID NO: 231159 - RNA, 64 nt, Homo Sapiens; identical to SEQ ID NO: 41032

SEQ ID NO: 231160 - RNA, 64 nt, Homo Sapiens; identical to SEQ ID NO: 41033

SEQ ID NO: 231161 - RNA, 64 nt, Homo Sapiens; identical to SEQ ID NO: 41034

SEQ ID NO: 231162 - RNA, 64 nt, Homo Sapiens; identical to SEQ ID NO: 41035

SEQ ID NO: 231163 - RNA, 64 nt, Homo Sapiens; identical to SEQ ID NO: 41036

SEQ ID NO: 231164 - RNA, 64 nt, Homo Sapiens; identical to SEQ ID NO: 41037

SEQ ID NO: 231165 - RNA, 64 nt, Homo Sapiens; identical to SEQ ID NO: 41038

SEQ ID NO: 231166 - RNA, 64 nt, Homo Sapiens; identical to SEQ ID NO: 41039

SEQ ID NO: 231167 - RNA, 64 nt, Homo Sapiens; identical to SEQ ID NO: 41040

SEQ ID NO: 231168 - RNA, 64 nt, Homo Sapiens; identical to SEQ ID NO: 41041

SEQ ID NO: 231169 - RNA, 64 nt, Homo Sapiens; identical to SEQ ID NO: 41042

SEQ ID NO: 231170 - RNA, 64 nt, Homo Sapiens; identical to SEQ ID NO: 41043

SEQ ID NO: 231171 - RNA, 64 nt, Homo Sapiens; identical to SEQ ID NO: 41044

SEQ ID NO: 231172 - RNA, 64 nt, Homo Sapiens; identical to SEQ ID NO: 41045

SEQ ID NO: 231173 - RNA, 64 nt, Homo Sapiens; identical to SEQ ID NO: 41046

SEQ ID NO: 231174 - RNA, 64 nt, Homo Sapiens; identical to SEQ ID NO: 41047

SEQ ID NO: 231175 - RNA, 64 nt, Homo Sapiens; identical to SEQ ID NO: 41048

SEQ ID NO: 231176 - RNA, 64 nt, Homo Sapiens; identical to SEQ ID NO: 41049

SEQ ID NO: 231177 - RNA, 64 nt, Homo Sapiens; identical to SEQ ID NO: 41050

SEQ ID NO: 231178 - RNA, 64 nt, Homo Sapiens; identical to SEQ ID NO: 41051

SEQ ID NO: 231179 - RNA, 64 nt, Homo Sapiens; identical to SEQ ID NO: 41052

SEQ ID NO: 231180 - RNA, 64 nt, Homo Sapiens; identical to SEQ ID NO: 41053

SEQ ID NO: 231181 - RNA, 64 nt, Homo Sapiens; identical to SEQ ID NO: 41054

SEQ ID NO: 231182 - RNA, 64 nt, Homo Sapiens; identical to SEQ ID NO: 41055

SEQ ID NO: 231183 - RNA, 64 nt, Homo Sapiens; identical to SEQ ID NO: 41056

SEQ ID NO: 231184 - RNA, 64 nt, Homo Sapiens; identical to SEQ ID NO: 41057

SEQ ID NO: 231185 - RNA, 64 nt, Homo Sapiens; identical to SEQ ID NO: 41058

SEQ ID NO: 231186 - RNA, 64 nt, Homo Sapiens; identical to SEQ ID NO: 41059

SEQ ID NO: 231187 - RNA, 64 nt, Homo Sapiens; identical to SEQ ID NO: 41060

SEQ ID NO: 231188 - RNA, 64 nt, Homo Sapiens; identical to SEQ ID NO: 41061

SEQ ID NO: 231189 - RNA, 64 nt, Homo Sapiens; identical to SEQ ID NO: 41062

SEQ ID NO: 231190 - RNA, 64 nt, Homo Sapiens; identical to SEQ ID NO: 41063

SEQ ID NO: 231191 - RNA, 64 nt, Homo Sapiens; identical to SEQ ID NO: 41064

SEQ ID NO: 231192 - RNA, 64 nt, Homo Sapiens; identical to SEQ ID NO: 41065

SEQ ID NO: 231193 - RNA, 64 nt, Homo Sapiens; identical to SEQ ID NO: 41066

SEQ ID NO: 231194 - RNA, 64 nt, Homo Sapiens; identical to SEQ ID NO: 41067

SEQ ID NO: 231195 - RNA, 64 nt, Homo Sapiens; identical to SEQ ID NO: 41068

SEQ ID NO: 231196 - RNA, 64 nt, Homo Sapiens; identical to SEQ ID NO: 41069

SEQ ID NO: 231197 - RNA, 64 nt, Homo Sapiens; identical to SEQ ID NO: 41070

SEQ ID NO: 231198 - RNA, 64 nt, Homo Sapiens; identical to SEQ ID NO: 41071

SEQ ID NO: 231199 - RNA, 64 nt, Homo Sapiens; identical to SEQ ID NO: 41072

SEQ ID NO: 231200 - RNA, 64 nt, Homo Sapiens; identical to SEQ ID NO: 41073

SEQ ID NO: 231201 - RNA, 64 nt, Homo Sapiens; identical to SEQ ID NO: 41074

SEQ ID NO: 231202 - RNA, 64 nt, Homo Sapiens; identical to SEQ ID NO: 41075

SEQ ID NO: 231203 - RNA, 64 nt, Homo Sapiens; identical to SEQ ID NO: 41076

SEQ ID NO: 231204 - RNA, 64 nt, Homo Sapiens; identical to SEQ ID NO: 41077

SEQ ID NO: 231205 - RNA, 64 nt, Homo Sapiens; identical to SEQ ID NO: 41078

SEQ ID NO: 231206 - RNA, 64 nt, Homo Sapiens; identical to SEQ ID NO: 41079

SEQ ID NO: 231207 - RNA, 64 nt, Homo Sapiens; identical to SEQ ID NO: 41080

SEQ ID NO: 231208 - RNA, 64 nt, Homo Sapiens; identical to SEQ ID NO: 41081

SEQ ID NO: 231209 - RNA, 64 nt, Homo Sapiens; identical to SEQ ID NO: 41082

SEQ ID NO: 231210 - RNA, 64 nt, Homo Sapiens; identical to SEQ ID NO: 41083

SEQ ID NO: 231211 - RNA, 64 nt, Homo Sapiens; identical to SEQ ID NO: 41084

SEQ ID NO: 231212 - RNA, 64 nt, Homo Sapiens; identical to SEQ ID NO: 41085

SEQ ID NO: 231213 - RNA, 64 nt, Homo Sapiens; identical to SEQ ID NO: 41086

SEQ ID NO: 231214 - RNA, 64 nt, Homo Sapiens; identical to SEQ ID NO: 41087

SEQ ID NO: 231215 - RNA, 64 nt, Homo Sapiens; identical to SEQ ID NO: 41088

SEQ ID NO: 231216 - RNA, 64 nt, Homo Sapiens; identical to SEQ ID NO: 41089

SEQ ID NO: 231217 - RNA, 64 nt, Homo Sapiens; identical to SEQ ID NO: 41090

SEQ ID NO: 231218 - RNA, 64 nt, Homo Sapiens; identical to SEQ ID NO: 41091

SEQ ID NO: 231219 - RNA, 64 nt, Homo Sapiens; identical to SEQ ID NO: 41092

SEQ ID NO: 231220 - RNA, 64 nt, Homo Sapiens; identical to SEQ ID NO: 41093

SEQ ID NO: 231221 - RNA, 64 nt, Homo Sapiens; identical to SEQ ID NO: 41094

SEQ ID NO: 231222 - RNA, 64 nt, Homo Sapiens; identical to SEQ ID NO: 41095

SEQ ID NO: 231223 - RNA, 64 nt, Homo Sapiens; identical to SEQ ID NO: 41096

SEQ ID NO: 231224 - RNA, 64 nt, Homo Sapiens; identical to SEQ ID NO: 41097

SEQ ID NO: 231225 - RNA, 64 nt, Homo Sapiens; identical to SEQ ID NO: 41098

SEQ ID NO: 231226 - RNA, 64 nt, Homo Sapiens; identical to SEQ ID NO: 41099

SEQ ID NO: 231227 - RNA, 64 nt, Homo Sapiens; identical to SEQ ID NO: 41100

SEQ ID NO: 231228 - RNA, 64 nt, Homo Sapiens; identical to SEQ ID NO: 41101

SEQ ID NO: 231229 - RNA, 64 nt, Homo Sapiens; identical to SEQ ID NO: 41102

SEQ ID NO: 231230 - RNA, 64 nt, Homo Sapiens; identical to SEQ ID NO: 41103

SEQ ID NO: 231231 - RNA, 64 nt, Homo Sapiens; identical to SEQ ID NO: 41104

SEQ ID NO: 231232 - RNA, 64 nt, Homo Sapiens; identical to SEQ ID NO: 41105

SEQ ID NO: 231233 - RNA, 64 nt, Homo Sapiens; identical to SEQ ID NO: 41106

SEQ ID NO: 231234 - RNA, 64 nt, Homo Sapiens; identical to SEQ ID NO: 41107

SEQ ID NO: 231235 - RNA, 64 nt, Homo Sapiens; identical to SEQ ID NO: 41108

SEQ ID NO: 231236 - RNA, 64 nt, Homo Sapiens; identical to SEQ ID NO: 41109

SEQ ID NO: 231237 - RNA, 64 nt, Homo Sapiens; identical to SEQ ID NO: 41110

SEQ ID NO: 231238 - RNA, 64 nt, Homo Sapiens; identical to SEQ ID NO: 41111

SEQ ID NO: 231239 - RNA, 64 nt, Homo Sapiens; identical to SEQ ID NO: 41112

SEQ ID NO: 231240 - RNA, 64 nt, Homo Sapiens; identical to SEQ ID NO: 41113

SEQ ID NO: 231241 - RNA, 64 nt, Homo Sapiens; identical to SEQ ID NO: 41114

SEQ ID NO: 231242 - RNA, 64 nt, Homo Sapiens; identical to SEQ ID NO: 41115

SEQ ID NO: 231243 - RNA, 64 nt, Homo Sapiens; identical to SEQ ID NO: 41116

SEQ ID NO: 231244 - RNA, 64 nt, Homo Sapiens; identical to SEQ ID NO: 41117

SEQ ID NO: 231245 - RNA, 64 nt, Homo Sapiens; identical to SEQ ID NO: 41118

SEQ ID NO: 231246 - RNA, 64 nt, Homo Sapiens; identical to SEQ ID NO: 41119

SEQ ID NO: 231247 - RNA, 64 nt, Homo Sapiens; identical to SEQ ID NO: 41120

SEQ ID NO: 231248 - RNA, 64 nt, Homo Sapiens; identical to SEQ ID NO: 41121

SEQ ID NO: 231249 - RNA, 64 nt, Homo Sapiens; identical to SEQ ID NO: 41122

SEQ ID NO: 231250 - RNA, 64 nt, Homo Sapiens; identical to SEQ ID NO: 41123

SEQ ID NO: 231251 - RNA, 64 nt, Homo Sapiens; identical to SEQ ID NO: 41124

SEQ ID NO: 231252 - RNA, 64 nt, Homo Sapiens; identical to SEQ ID NO: 41125

SEQ ID NO: 231253 - RNA, 64 nt, Homo Sapiens; identical to SEQ ID NO: 41126

SEQ ID NO: 231254 - RNA, 64 nt, Homo Sapiens; identical to SEQ ID NO: 41127

SEQ ID NO: 231255 - RNA, 64 nt, Homo Sapiens; identical to SEQ ID NO: 41128

SEQ ID NO: 231256 - RNA, 64 nt, Homo Sapiens; identical to SEQ ID NO: 41129

SEQ ID NO: 231257 - RNA, 64 nt, Homo Sapiens; identical to SEQ ID NO: 41130

SEQ ID NO: 231258 - RNA, 64 nt, Homo Sapiens; identical to SEQ ID NO: 41131

SEQ ID NO: 231259 - RNA, 64 nt, Homo Sapiens; identical to SEQ ID NO: 41132

SEQ ID NO: 231260 - RNA, 64 nt, Homo Sapiens; identical to SEQ ID NO: 41133

SEQ ID NO: 231261 - RNA, 64 nt, Homo Sapiens; identical to SEQ ID NO: 41134

SEQ ID NO: 231262 - RNA, 64 nt, Homo Sapiens; identical to SEQ ID NO: 41135

SEQ ID NO: 231263 - RNA, 64 nt, Homo Sapiens; identical to SEQ ID NO: 41136

SEQ ID NO: 231264 - RNA, 64 nt, Homo Sapiens; identical to SEQ ID NO: 41137

SEQ ID NO: 231265 - RNA, 64 nt, Homo Sapiens; identical to SEQ ID NO: 41138

SEQ ID NO: 231266 - RNA, 64 nt, Homo Sapiens; identical to SEQ ID NO: 41139

SEQ ID NO: 231267 - RNA, 64 nt, Homo Sapiens; identical to SEQ ID NO: 41140

SEQ ID NO: 231268 - RNA, 64 nt, Homo Sapiens; identical to SEQ ID NO: 41141

SEQ ID NO: 231269 - RNA, 64 nt, Homo Sapiens; identical to SEQ ID NO: 41142

SEQ ID NO: 231270 - RNA, 64 nt, Homo Sapiens; identical to SEQ ID NO: 41143

SEQ ID NO: 231271 - RNA, 64 nt, Homo Sapiens; identical to SEQ ID NO: 41144

SEQ ID NO: 231272 - RNA, 64 nt, Homo Sapiens; identical to SEQ ID NO: 41145

SEQ ID NO: 231273 - RNA, 64 nt, Homo Sapiens; identical to SEQ ID NO: 41146

SEQ ID NO: 231274 - RNA, 64 nt, Homo Sapiens; identical to SEQ ID NO: 41147

SEQ ID NO: 231275 - RNA, 64 nt, Homo Sapiens; identical to SEQ ID NO: 41148

SEQ ID NO: 231276 - RNA, 64 nt, Homo Sapiens; identical to SEQ ID NO: 41149

SEQ ID NO: 231277 - RNA, 64 nt, Homo Sapiens; identical to SEQ ID NO: 41150

SEQ ID NO: 231278 - RNA, 64 nt, Homo Sapiens; identical to SEQ ID NO: 41151

SEQ ID NO: 231279 - RNA, 64 nt, Homo Sapiens; identical to SEQ ID NO: 41152

SEQ ID NO: 231280 - RNA, 64 nt, Homo Sapiens; identical to SEQ ID NO: 41153

SEQ ID NO: 231281 - RNA, 64 nt, Homo Sapiens; identical to SEQ ID NO: 41154

SEQ ID NO: 231282 - RNA, 64 nt, Homo Sapiens; identical to SEQ ID NO: 41155

SEQ ID NO: 231283 - RNA, 64 nt, Homo Sapiens; identical to SEQ ID NO: 41156

SEQ ID NO: 231284 - RNA, 64 nt, Homo Sapiens; identical to SEQ ID NO: 41157

SEQ ID NO: 231285 - RNA, 64 nt, Homo Sapiens; identical to SEQ ID NO: 41158

SEQ ID NO: 231286 - RNA, 64 nt, Homo Sapiens; identical to SEQ ID NO: 41159

SEQ ID NO: 231287 - RNA, 64 nt, Homo Sapiens; identical to SEQ ID NO: 41160

SEQ ID NO: 231288 - RNA, 64 nt, Homo Sapiens; identical to SEQ ID NO: 41161

SEQ ID NO: 231289 - RNA, 64 nt, Homo Sapiens; identical to SEQ ID NO: 41162

SEQ ID NO: 231290 - RNA, 64 nt, Homo Sapiens; identical to SEQ ID NO: 41163

SEQ ID NO: 231291 - RNA, 64 nt, Homo Sapiens; identical to SEQ ID NO: 41164

SEQ ID NO: 231292 - RNA, 64 nt, Homo Sapiens; identical to SEQ ID NO: 41165

SEQ ID NO: 231293 - RNA, 64 nt, Homo Sapiens; identical to SEQ ID NO: 41166

SEQ ID NO: 231294 - RNA, 64 nt, Homo Sapiens; identical to SEQ ID NO: 41167

SEQ ID NO: 231295 - RNA, 64 nt, Homo Sapiens; identical to SEQ ID NO: 41168

SEQ ID NO: 231296 - RNA, 64 nt, Homo Sapiens; identical to SEQ ID NO: 41169

SEQ ID NO: 231297 - RNA, 64 nt, Homo Sapiens; identical to SEQ ID NO: 41170

SEQ ID NO: 231298 - RNA, 64 nt, Homo Sapiens; identical to SEQ ID NO: 41171

SEQ ID NO: 231299 - RNA, 64 nt, Homo Sapiens; identical to SEQ ID NO: 41172

SEQ ID NO: 231300 - RNA, 64 nt, Homo Sapiens; identical to SEQ ID NO: 41173

SEQ ID NO: 231301 - RNA, 64 nt, Homo Sapiens; identical to SEQ ID NO: 41174

SEQ ID NO: 231302 - RNA, 64 nt, Homo Sapiens; identical to SEQ ID NO: 41175

SEQ ID NO: 231303 - RNA, 64 nt, Homo Sapiens; identical to SEQ ID NO: 41176

SEQ ID NO: 231304 - RNA, 64 nt, Homo Sapiens; identical to SEQ ID NO: 41177

SEQ ID NO: 231305 - RNA, 64 nt, Homo Sapiens; identical to SEQ ID NO: 41178

SEQ ID NO: 231306 - RNA, 64 nt, Homo Sapiens; identical to SEQ ID NO: 41179

SEQ ID NO: 231307 - RNA, 64 nt, Homo Sapiens; identical to SEQ ID NO: 41180

SEQ ID NO: 231308 - RNA, 64 nt, Homo Sapiens; identical to SEQ ID NO: 41181

SEQ ID NO: 231309 - RNA, 64 nt, Homo Sapiens; identical to SEQ ID NO: 41182

SEQ ID NO: 231310 - RNA, 64 nt, Homo Sapiens; identical to SEQ ID NO: 41183

SEQ ID NO: 231311 - RNA, 64 nt, Homo Sapiens; identical to SEQ ID NO: 41184

SEQ ID NO: 231312 - RNA, 64 nt, Homo Sapiens; identical to SEQ ID NO: 41185

SEQ ID NO: 231313 - RNA, 64 nt, Homo Sapiens; identical to SEQ ID NO: 41186

SEQ ID NO: 231314 - RNA, 64 nt, Homo Sapiens; identical to SEQ ID NO: 41187

SEQ ID NO: 231315 - RNA, 64 nt, Homo Sapiens; identical to SEQ ID NO: 41188

SEQ ID NO: 231316 - RNA, 64 nt, Homo Sapiens; identical to SEQ ID NO: 41189

SEQ ID NO: 231317 - RNA, 64 nt, Homo Sapiens; identical to SEQ ID NO: 41190

SEQ ID NO: 231318 - RNA, 64 nt, Homo Sapiens; identical to SEQ ID NO: 41191

SEQ ID NO: 231319 - RNA, 64 nt, Homo Sapiens; identical to SEQ ID NO: 41192

SEQ ID NO: 231320 - RNA, 64 nt, Homo Sapiens; identical to SEQ ID NO: 41193

SEQ ID NO: 231321 - RNA, 64 nt, Homo Sapiens; identical to SEQ ID NO: 41194

SEQ ID NO: 231322 - RNA, 64 nt, Homo Sapiens; identical to SEQ ID NO: 41195

SEQ ID NO: 231323 - RNA, 64 nt, Homo Sapiens; identical to SEQ ID NO: 41196

SEQ ID NO: 231324 - RNA, 64 nt, Homo Sapiens; identical to SEQ ID NO: 41197

SEQ ID NO: 231325 - RNA, 64 nt, Homo Sapiens; identical to SEQ ID NO: 41198

SEQ ID NO: 231326 - RNA, 64 nt, Homo Sapiens; identical to SEQ ID NO: 41199

SEQ ID NO: 231327 - RNA, 64 nt, Homo Sapiens; identical to SEQ ID NO: 41200

SEQ ID NO: 231328 - RNA, 64 nt, Homo Sapiens; identical to SEQ ID NO: 41201

SEQ ID NO: 231329 - RNA, 64 nt, Homo Sapiens; identical to SEQ ID NO: 41202

SEQ ID NO: 231330 - RNA, 64 nt, Homo Sapiens; identical to SEQ ID NO: 41203

SEQ ID NO: 231331 - RNA, 64 nt, Homo Sapiens; identical to SEQ ID NO: 41204

SEQ ID NO: 231332 - RNA, 64 nt, Homo Sapiens; identical to SEQ ID NO: 41205

SEQ ID NO: 231333 - RNA, 64 nt, Homo Sapiens; identical to SEQ ID NO: 41206

SEQ ID NO: 231334 - RNA, 64 nt, Homo Sapiens; identical to SEQ ID NO: 41207

SEQ ID NO: 231335 - RNA, 64 nt, Homo Sapiens; identical to SEQ ID NO: 41208

SEQ ID NO: 231336 - RNA, 64 nt, Homo Sapiens; identical to SEQ ID NO: 41209

SEQ ID NO: 231337 - RNA, 64 nt, Homo Sapiens; identical to SEQ ID NO: 41210

SEQ ID NO: 231338 - RNA, 64 nt, Homo Sapiens; identical to SEQ ID NO: 41211

SEQ ID NO: 231339 - RNA, 64 nt, Homo Sapiens; identical to SEQ ID NO: 41212

SEQ ID NO: 231340 - RNA, 64 nt, Homo Sapiens; identical to SEQ ID NO: 41213

SEQ ID NO: 231341 - RNA, 64 nt, Homo Sapiens; identical to SEQ ID NO: 41214

SEQ ID NO: 231342 - RNA, 64 nt, Homo Sapiens; identical to SEQ ID NO: 41215

SEQ ID NO: 231343 - RNA, 64 nt, Homo Sapiens; identical to SEQ ID NO: 41216

SEQ ID NO: 231344 - RNA, 64 nt, Homo Sapiens; identical to SEQ ID NO: 41217

SEQ ID NO: 231345 - RNA, 64 nt, Homo Sapiens; identical to SEQ ID NO: 41218

SEQ ID NO: 231346 - RNA, 64 nt, Homo Sapiens; identical to SEQ ID NO: 41219

SEQ ID NO: 231347 - RNA, 64 nt, Homo Sapiens; identical to SEQ ID NO: 41220

SEQ ID NO: 231348 - RNA, 64 nt, Homo Sapiens; identical to SEQ ID NO: 41221

SEQ ID NO: 231349 - RNA, 64 nt, Homo Sapiens; identical to SEQ ID NO: 41222

SEQ ID NO: 231350 - RNA, 64 nt, Homo Sapiens; identical to SEQ ID NO: 41223

SEQ ID NO: 231351 - RNA, 64 nt, Homo Sapiens; identical to SEQ ID NO: 41224

SEQ ID NO: 231352 - RNA, 64 nt, Homo Sapiens; identical to SEQ ID NO: 41225

SEQ ID NO: 231353 - RNA, 64 nt, Homo Sapiens; identical to SEQ ID NO: 41226

SEQ ID NO: 231354 - RNA, 64 nt, Homo Sapiens; identical to SEQ ID NO: 41227

SEQ ID NO: 231355 - RNA, 64 nt, Homo Sapiens; identical to SEQ ID NO: 41228

SEQ ID NO: 231356 - RNA, 64 nt, Homo Sapiens; identical to SEQ ID NO: 41229

SEQ ID NO: 231357 - RNA, 64 nt, Homo Sapiens; identical to SEQ ID NO: 41230

SEQ ID NO: 231358 - RNA, 64 nt, Homo Sapiens; identical to SEQ ID NO: 41231

SEQ ID NO: 231359 - RNA, 64 nt, Homo Sapiens; identical to SEQ ID NO: 41232

SEQ ID NO: 231360 - RNA, 64 nt, Homo Sapiens; identical to SEQ ID NO: 41233

SEQ ID NO: 231361 - RNA, 64 nt, Homo Sapiens; identical to SEQ ID NO: 41234

SEQ ID NO: 231362 - RNA, 64 nt, Homo Sapiens; identical to SEQ ID NO: 41235

SEQ ID NO: 231363 - RNA, 62 nt, Homo Sapiens; identical to SEQ ID NO: 41236

SEQ ID NO: 231364 - RNA, 60 nt, Homo Sapiens; identical to SEQ ID NO: 41237

SEQ ID NO: 231365 - RNA, 58 nt, Homo Sapiens; identical to SEQ ID NO: 41238

SEQ ID NO: 231366 - RNA, 56 nt, Homo Sapiens; identical to SEQ ID NO: 41239

SEQ ID NO: 231367 - RNA, 54 nt, Homo Sapiens; identical to SEQ ID NO: 41240

SEQ ID NO: 231368 - RNA, 64 nt, Homo Sapiens; identical to SEQ ID NO: 41241

SEQ ID NO: 231369 - RNA, 64 nt, Homo Sapiens; identical to SEQ ID NO: 41242

SEQ ID NO: 231370 - RNA, 64 nt, Homo Sapiens; identical to SEQ ID NO: 41243

SEQ ID NO: 231371 - RNA, 64 nt, Homo Sapiens; identical to SEQ ID NO: 41244

SEQ ID NO: 231372 - RNA, 64 nt, Homo Sapiens; identical to SEQ ID NO: 41245

SEQ ID NO: 231373 - RNA, 64 nt, Homo Sapiens; identical to SEQ ID NO: 41246

SEQ ID NO: 231374 - RNA, 64 nt, Homo Sapiens; identical to SEQ ID NO: 41247

SEQ ID NO: 231375 - RNA, 64 nt, Homo Sapiens; identical to SEQ ID NO: 41248

SEQ ID NO: 231376 - RNA, 64 nt, Homo Sapiens; identical to SEQ ID NO: 41249

SEQ ID NO: 231377 - RNA, 64 nt, Homo Sapiens; identical to SEQ ID NO: 41250

SEQ ID NO: 231378 - RNA, 64 nt, Homo Sapiens; identical to SEQ ID NO: 41251

SEQ ID NO: 231379 - RNA, 64 nt, Homo Sapiens; identical to SEQ ID NO: 41252

SEQ ID NO: 231380 - RNA, 64 nt, Homo Sapiens; identical to SEQ ID NO: 41253

SEQ ID NO: 231381 - RNA, 64 nt, Homo Sapiens; identical to SEQ ID NO: 41254

SEQ ID NO: 231382 - RNA, 64 nt, Homo Sapiens; identical to SEQ ID NO: 41255

SEQ ID NO: 231383 - RNA, 64 nt, Homo Sapiens; identical to SEQ ID NO: 41256

SEQ ID NO: 231384 - RNA, 64 nt, Homo Sapiens; identical to SEQ ID NO: 41257

SEQ ID NO: 231385 - RNA, 64 nt, Homo Sapiens; identical to SEQ ID NO: 41258

SEQ ID NO: 231386 - RNA, 64 nt, Homo Sapiens; identical to SEQ ID NO: 41259

SEQ ID NO: 231387 - RNA, 64 nt, Homo Sapiens; identical to SEQ ID NO: 41260

SEQ ID NO: 231388 - RNA, 64 nt, Homo Sapiens; identical to SEQ ID NO: 41261

SEQ ID NO: 231389 - RNA, 64 nt, Homo Sapiens; identical to SEQ ID NO: 41262

SEQ ID NO: 231390 - RNA, 64 nt, Homo Sapiens; identical to SEQ ID NO: 41263

SEQ ID NO: 231391 - RNA, 64 nt, Homo Sapiens; identical to SEQ ID NO: 41264

SEQ ID NO: 231392 - RNA, 64 nt, Homo Sapiens; identical to SEQ ID NO: 41265

SEQ ID NO: 231393 - RNA, 64 nt, Homo Sapiens; identical to SEQ ID NO: 41266

SEQ ID NO: 231394 - RNA, 64 nt, Homo Sapiens; identical to SEQ ID NO: 41267

SEQ ID NO: 231395 - RNA, 64 nt, Homo Sapiens; identical to SEQ ID NO: 41268

SEQ ID NO: 231396 - RNA, 64 nt, Homo Sapiens; identical to SEQ ID NO: 41269

SEQ ID NO: 231397 - RNA, 64 nt, Homo Sapiens; identical to SEQ ID NO: 41270

SEQ ID NO: 231398 - RNA, 64 nt, Homo Sapiens; identical to SEQ ID NO: 41271

SEQ ID NO: 231399 - RNA, 64 nt, Homo Sapiens; identical to SEQ ID NO: 41272

SEQ ID NO: 231400 - RNA, 64 nt, Homo Sapiens; identical to SEQ ID NO: 41273

SEQ ID NO: 231401 - RNA, 64 nt, Homo Sapiens; identical to SEQ ID NO: 41274

SEQ ID NO: 231402 - RNA, 64 nt, Homo Sapiens; identical to SEQ ID NO: 41275

SEQ ID NO: 231403 - RNA, 64 nt, Homo Sapiens; identical to SEQ ID NO: 41276

SEQ ID NO: 231404 - RNA, 64 nt, Homo Sapiens; identical to SEQ ID NO: 41277

SEQ ID NO: 231405 - RNA, 64 nt, Homo Sapiens; identical to SEQ ID NO: 41278

SEQ ID NO: 231406 - RNA, 64 nt, Homo Sapiens; identical to SEQ ID NO: 41279

SEQ ID NO: 231407 - RNA, 64 nt, Homo Sapiens; identical to SEQ ID NO: 41280

SEQ ID NO: 231408 - RNA, 64 nt, Homo Sapiens; identical to SEQ ID NO: 41281

SEQ ID NO: 231409 - RNA, 64 nt, Homo Sapiens; identical to SEQ ID NO: 41282

SEQ ID NO: 231410 - RNA, 64 nt, Homo Sapiens; identical to SEQ ID NO: 41283

SEQ ID NO: 231411 - RNA, 64 nt, Homo Sapiens; identical to SEQ ID NO: 41284

SEQ ID NO: 231412 - RNA, 64 nt, Homo Sapiens; identical to SEQ ID NO: 41285

SEQ ID NO: 231413 - RNA, 64 nt, Homo Sapiens; identical to SEQ ID NO: 41286

SEQ ID NO: 231414 - RNA, 64 nt, Homo Sapiens; identical to SEQ ID NO: 41287

SEQ ID NO: 231415 - RNA, 64 nt, Homo Sapiens; identical to SEQ ID NO: 41288

SEQ ID NO: 231416 - RNA, 64 nt, Homo Sapiens; identical to SEQ ID NO: 41289

SEQ ID NO: 231417 - RNA, 64 nt, Homo Sapiens; identical to SEQ ID NO: 41290

SEQ ID NO: 231418 - RNA, 64 nt, Homo Sapiens; identical to SEQ ID NO: 41291

SEQ ID NO: 231419 - RNA, 64 nt, Homo Sapiens; identical to SEQ ID NO: 41292

SEQ ID NO: 231420 - RNA, 64 nt, Homo Sapiens; identical to SEQ ID NO: 41293

SEQ ID NO: 231421 - RNA, 64 nt, Homo Sapiens; identical to SEQ ID NO: 41294

SEQ ID NO: 231422 - RNA, 64 nt, Homo Sapiens; identical to SEQ ID NO: 41295

SEQ ID NO: 231423 - RNA, 64 nt, Homo Sapiens; identical to SEQ ID NO: 41296

SEQ ID NO: 231424 - RNA, 64 nt, Homo Sapiens; identical to SEQ ID NO: 41297

SEQ ID NO: 231425 - RNA, 64 nt, Homo Sapiens; identical to SEQ ID NO: 41298

SEQ ID NO: 231426 - RNA, 64 nt, Homo Sapiens; identical to SEQ ID NO: 41299

SEQ ID NO: 231427 - RNA, 64 nt, Homo Sapiens; identical to SEQ ID NO: 41300

SEQ ID NO: 231428 - RNA, 64 nt, Homo Sapiens; identical to SEQ ID NO: 41301

SEQ ID NO: 231429 - RNA, 64 nt, Homo Sapiens; identical to SEQ ID NO: 41302

SEQ ID NO: 231430 - RNA, 64 nt, Homo Sapiens; identical to SEQ ID NO: 41303

SEQ ID NO: 231431 - RNA, 64 nt, Homo Sapiens; identical to SEQ ID NO: 41304

SEQ ID NO: 231432 - RNA, 64 nt, Homo Sapiens; identical to SEQ ID NO: 41305

SEQ ID NO: 231433 - RNA, 64 nt, Homo Sapiens; identical to SEQ ID NO: 41306

SEQ ID NO: 231434 - RNA, 64 nt, Homo Sapiens; identical to SEQ ID NO: 41307

SEQ ID NO: 231435 - RNA, 64 nt, Homo Sapiens; identical to SEQ ID NO: 41308

SEQ ID NO: 231436 - RNA, 64 nt, Homo Sapiens; identical to SEQ ID NO: 41309

SEQ ID NO: 231437 - RNA, 64 nt, Homo Sapiens; identical to SEQ ID NO: 41310

SEQ ID NO: 231438 - RNA, 64 nt, Homo Sapiens; identical to SEQ ID NO: 41311

SEQ ID NO: 231439 - RNA, 64 nt, Homo Sapiens; identical to SEQ ID NO: 41312

SEQ ID NO: 231440 - RNA, 64 nt, Homo Sapiens; identical to SEQ ID NO: 41313

SEQ ID NO: 231441 - RNA, 64 nt, Homo Sapiens; identical to SEQ ID NO: 41314

SEQ ID NO: 231442 - RNA, 64 nt, Homo Sapiens; identical to SEQ ID NO: 41315

SEQ ID NO: 231443 - RNA, 64 nt, Homo Sapiens; identical to SEQ ID NO: 41316

SEQ ID NO: 231444 - RNA, 64 nt, Homo Sapiens; identical to SEQ ID NO: 41317

SEQ ID NO: 231445 - RNA, 64 nt, Homo Sapiens; identical to SEQ ID NO: 41318

SEQ ID NO: 231446 - RNA, 64 nt, Homo Sapiens; identical to SEQ ID NO: 41319

SEQ ID NO: 231447 - RNA, 64 nt, Homo Sapiens; identical to SEQ ID NO: 41320

SEQ ID NO: 231448 - RNA, 64 nt, Homo Sapiens; identical to SEQ ID NO: 41321

SEQ ID NO: 231449 - RNA, 64 nt, Homo Sapiens; identical to SEQ ID NO: 41322

SEQ ID NO: 231450 - RNA, 64 nt, Homo Sapiens; identical to SEQ ID NO: 41323

SEQ ID NO: 231451 - RNA, 64 nt, Homo Sapiens; identical to SEQ ID NO: 41324

SEQ ID NO: 231452 - RNA, 64 nt, Homo Sapiens; identical to SEQ ID NO: 41325

SEQ ID NO: 231453 - RNA, 64 nt, Homo Sapiens; identical to SEQ ID NO: 41326

SEQ ID NO: 231454 - RNA, 64 nt, Homo Sapiens; identical to SEQ ID NO: 41327

SEQ ID NO: 231455 - RNA, 64 nt, Homo Sapiens; identical to SEQ ID NO: 41328

SEQ ID NO: 231456 - RNA, 64 nt, Homo Sapiens; identical to SEQ ID NO: 41329

SEQ ID NO: 231457 - RNA, 64 nt, Homo Sapiens; identical to SEQ ID NO: 41330

SEQ ID NO: 231458 - RNA, 64 nt, Homo Sapiens; identical to SEQ ID NO: 41331

SEQ ID NO: 231459 - RNA, 64 nt, Homo Sapiens; identical to SEQ ID NO: 41332

SEQ ID NO: 231460 - RNA, 64 nt, Homo Sapiens; identical to SEQ ID NO: 41333

SEQ ID NO: 231461 - RNA, 64 nt, Homo Sapiens; identical to SEQ ID NO: 41334

SEQ ID NO: 231462 - RNA, 64 nt, Homo Sapiens; identical to SEQ ID NO: 41335

SEQ ID NO: 231463 - RNA, 64 nt, Homo Sapiens; identical to SEQ ID NO: 41336

SEQ ID NO: 231464 - RNA, 64 nt, Homo Sapiens; identical to SEQ ID NO: 41337

SEQ ID NO: 231465 - RNA, 64 nt, Homo Sapiens; identical to SEQ ID NO: 41338

SEQ ID NO: 231466 - RNA, 64 nt, Homo Sapiens; identical to SEQ ID NO: 41339

SEQ ID NO: 231467 - RNA, 64 nt, Homo Sapiens; identical to SEQ ID NO: 41340

SEQ ID NO: 231468 - RNA, 64 nt, Homo Sapiens; identical to SEQ ID NO: 41341

SEQ ID NO: 231469 - RNA, 64 nt, Homo Sapiens; identical to SEQ ID NO: 41342

SEQ ID NO: 231470 - RNA, 64 nt, Homo Sapiens; identical to SEQ ID NO: 41343

SEQ ID NO: 231471 - RNA, 64 nt, Homo Sapiens; identical to SEQ ID NO: 41344

SEQ ID NO: 231472 - RNA, 64 nt, Homo Sapiens; identical to SEQ ID NO: 41345

SEQ ID NO: 231473 - RNA, 64 nt, Homo Sapiens; identical to SEQ ID NO: 41346

SEQ ID NO: 231474 - RNA, 64 nt, Homo Sapiens; identical to SEQ ID NO: 41347

SEQ ID NO: 231475 - RNA, 64 nt, Homo Sapiens; identical to SEQ ID NO: 41348

SEQ ID NO: 231476 - RNA, 64 nt, Homo Sapiens; identical to SEQ ID NO: 41349

SEQ ID NO: 231477 - RNA, 64 nt, Homo Sapiens; identical to SEQ ID NO: 41350

SEQ ID NO: 231478 - RNA, 64 nt, Homo Sapiens; identical to SEQ ID NO: 41351

SEQ ID NO: 231479 - RNA, 64 nt, Homo Sapiens; identical to SEQ ID NO: 41352

SEQ ID NO: 231480 - RNA, 64 nt, Homo Sapiens; identical to SEQ ID NO: 41353

SEQ ID NO: 231481 - RNA, 64 nt, Homo Sapiens; identical to SEQ ID NO: 41354

SEQ ID NO: 231482 - RNA, 64 nt, Homo Sapiens; identical to SEQ ID NO: 41355

SEQ ID NO: 231483 - RNA, 64 nt, Homo Sapiens; identical to SEQ ID NO: 41356

SEQ ID NO: 231484 - RNA, 64 nt, Homo Sapiens; identical to SEQ ID NO: 41357

SEQ ID NO: 231485 - RNA, 64 nt, Homo Sapiens; identical to SEQ ID NO: 41358

SEQ ID NO: 231486 - RNA, 64 nt, Homo Sapiens; identical to SEQ ID NO: 41359

SEQ ID NO: 231487 - RNA, 64 nt, Homo Sapiens; identical to SEQ ID NO: 41360

SEQ ID NO: 231488 - RNA, 64 nt, Homo Sapiens; identical to SEQ ID NO: 41361

SEQ ID NO: 231489 - RNA, 64 nt, Homo Sapiens; identical to SEQ ID NO: 41362

SEQ ID NO: 231490 - RNA, 64 nt, Homo Sapiens; identical to SEQ ID NO: 41363

SEQ ID NO: 231491 - RNA, 64 nt, Homo Sapiens; identical to SEQ ID NO: 41364

SEQ ID NO: 231492 - RNA, 64 nt, Homo Sapiens; identical to SEQ ID NO: 41365

SEQ ID NO: 231493 - RNA, 64 nt, Homo Sapiens; identical to SEQ ID NO: 41366

SEQ ID NO: 231494 - RNA, 64 nt, Homo Sapiens; identical to SEQ ID NO: 41367

SEQ ID NO: 231495 - RNA, 64 nt, Homo Sapiens; identical to SEQ ID NO: 41368

SEQ ID NO: 231496 - RNA, 64 nt, Homo Sapiens; identical to SEQ ID NO: 41369

SEQ ID NO: 231497 - RNA, 64 nt, Homo Sapiens; identical to SEQ ID NO: 41370

SEQ ID NO: 231498 - RNA, 64 nt, Homo Sapiens; identical to SEQ ID NO: 41371

SEQ ID NO: 231499 - RNA, 64 nt, Homo Sapiens; identical to SEQ ID NO: 41372

SEQ ID NO: 231500 - RNA, 64 nt, Homo Sapiens; identical to SEQ ID NO: 41373

SEQ ID NO: 231501 - RNA, 64 nt, Homo Sapiens; identical to SEQ ID NO: 41374

SEQ ID NO: 231502 - RNA, 64 nt, Homo Sapiens; identical to SEQ ID NO: 41375

SEQ ID NO: 231503 - RNA, 64 nt, Homo Sapiens; identical to SEQ ID NO: 41376

SEQ ID NO: 231504 - RNA, 64 nt, Homo Sapiens; identical to SEQ ID NO: 41377

SEQ ID NO: 231505 - RNA, 64 nt, Homo Sapiens; identical to SEQ ID NO: 41378

SEQ ID NO: 231506 - RNA, 64 nt, Homo Sapiens; identical to SEQ ID NO: 41379

SEQ ID NO: 231507 - RNA, 64 nt, Homo Sapiens; identical to SEQ ID NO: 41380

SEQ ID NO: 231508 - RNA, 64 nt, Homo Sapiens; identical to SEQ ID NO: 41381

SEQ ID NO: 231509 - RNA, 64 nt, Homo Sapiens; identical to SEQ ID NO: 41382

SEQ ID NO: 231510 - RNA, 64 nt, Homo Sapiens; identical to SEQ ID NO: 41383

SEQ ID NO: 231511 - RNA, 64 nt, Homo Sapiens; identical to SEQ ID NO: 41384

SEQ ID NO: 231512 - RNA, 64 nt, Homo Sapiens; identical to SEQ ID NO: 41385

SEQ ID NO: 231513 - RNA, 64 nt, Homo Sapiens; identical to SEQ ID NO: 41386

SEQ ID NO: 231514 - RNA, 64 nt, Homo Sapiens; identical to SEQ ID NO: 41387

SEQ ID NO: 231515 - RNA, 64 nt, Homo Sapiens; identical to SEQ ID NO: 41388

SEQ ID NO: 231516 - RNA, 64 nt, Homo Sapiens; identical to SEQ ID NO: 41389

SEQ ID NO: 231517 - RNA, 64 nt, Homo Sapiens; identical to SEQ ID NO: 41390

SEQ ID NO: 231518 - RNA, 64 nt, Homo Sapiens; identical to SEQ ID NO: 41391

SEQ ID NO: 231519 - RNA, 64 nt, Homo Sapiens; identical to SEQ ID NO: 41392

SEQ ID NO: 231520 - RNA, 64 nt, Homo Sapiens; identical to SEQ ID NO: 41393

SEQ ID NO: 231521 - RNA, 64 nt, Homo Sapiens; identical to SEQ ID NO: 41394

SEQ ID NO: 231522 - RNA, 64 nt, Homo Sapiens; identical to SEQ ID NO: 41395

SEQ ID NO: 231523 - RNA, 64 nt, Homo Sapiens; identical to SEQ ID NO: 41396

SEQ ID NO: 231524 - RNA, 64 nt, Homo Sapiens; identical to SEQ ID NO: 41397

SEQ ID NO: 231525 - RNA, 64 nt, Homo Sapiens; identical to SEQ ID NO: 41398

SEQ ID NO: 231526 - RNA, 64 nt, Homo Sapiens; identical to SEQ ID NO: 41399

SEQ ID NO: 231527 - RNA, 64 nt, Homo Sapiens; identical to SEQ ID NO: 41400

SEQ ID NO: 231528 - RNA, 64 nt, Homo Sapiens; identical to SEQ ID NO: 41401

SEQ ID NO: 231529 - RNA, 64 nt, Homo Sapiens; identical to SEQ ID NO: 41402

SEQ ID NO: 231530 - RNA, 64 nt, Homo Sapiens; identical to SEQ ID NO: 41403

SEQ ID NO: 231531 - RNA, 64 nt, Homo Sapiens; identical to SEQ ID NO: 41404

SEQ ID NO: 231532 - RNA, 64 nt, Homo Sapiens; identical to SEQ ID NO: 41405

SEQ ID NO: 231533 - RNA, 64 nt, Homo Sapiens; identical to SEQ ID NO: 41406

SEQ ID NO: 231534 - RNA, 64 nt, Homo Sapiens; identical to SEQ ID NO: 41407

SEQ ID NO: 231535 - RNA, 64 nt, Homo Sapiens; identical to SEQ ID NO: 41408

SEQ ID NO: 231536 - RNA, 64 nt, Homo Sapiens; identical to SEQ ID NO: 41409

SEQ ID NO: 231537 - RNA, 64 nt, Homo Sapiens; identical to SEQ ID NO: 41410

SEQ ID NO: 231538 - RNA, 64 nt, Homo Sapiens; identical to SEQ ID NO: 41411

SEQ ID NO: 231539 - RNA, 64 nt, Homo Sapiens; identical to SEQ ID NO: 41412

SEQ ID NO: 231540 - RNA, 64 nt, Homo Sapiens; identical to SEQ ID NO: 41413

SEQ ID NO: 231541 - RNA, 64 nt, Homo Sapiens; identical to SEQ ID NO: 41414

SEQ ID NO: 231542 - RNA, 64 nt, Homo Sapiens; identical to SEQ ID NO: 41415

SEQ ID NO: 231543 - RNA, 64 nt, Homo Sapiens; identical to SEQ ID NO: 41416

SEQ ID NO: 231544 - RNA, 64 nt, Homo Sapiens; identical to SEQ ID NO: 41417

SEQ ID NO: 231545 - RNA, 64 nt, Homo Sapiens; identical to SEQ ID NO: 41418

SEQ ID NO: 231546 - RNA, 64 nt, Homo Sapiens; identical to SEQ ID NO: 41419

SEQ ID NO: 231547 - RNA, 64 nt, Homo Sapiens; identical to SEQ ID NO: 41420

SEQ ID NO: 231548 - RNA, 64 nt, Homo Sapiens; identical to SEQ ID NO: 41421

SEQ ID NO: 231549 - RNA, 64 nt, Homo Sapiens; identical to SEQ ID NO: 41422

SEQ ID NO: 231550 - RNA, 64 nt, Homo Sapiens; identical to SEQ ID NO: 41423

SEQ ID NO: 231551 - RNA, 64 nt, Homo Sapiens; identical to SEQ ID NO: 41424

SEQ ID NO: 231552 - RNA, 64 nt, Homo Sapiens; identical to SEQ ID NO: 41425

SEQ ID NO: 231553 - RNA, 64 nt, Homo Sapiens; identical to SEQ ID NO: 41426

SEQ ID NO: 231554 - RNA, 64 nt, Homo Sapiens; identical to SEQ ID NO: 41427

SEQ ID NO: 231555 - RNA, 64 nt, Homo Sapiens; identical to SEQ ID NO: 41428

SEQ ID NO: 231556 - RNA, 64 nt, Homo Sapiens; identical to SEQ ID NO: 41429

SEQ ID NO: 231557 - RNA, 64 nt, Homo Sapiens; identical to SEQ ID NO: 41430

SEQ ID NO: 231558 - RNA, 64 nt, Homo Sapiens; identical to SEQ ID NO: 41431

SEQ ID NO: 231559 - RNA, 64 nt, Homo Sapiens; identical to SEQ ID NO: 41432

SEQ ID NO: 231560 - RNA, 64 nt, Homo Sapiens; identical to SEQ ID NO: 41433

SEQ ID NO: 231561 - RNA, 64 nt, Homo Sapiens; identical to SEQ ID NO: 41434

SEQ ID NO: 231562 - RNA, 64 nt, Homo Sapiens; identical to SEQ ID NO: 41435

SEQ ID NO: 231563 - RNA, 64 nt, Homo Sapiens; identical to SEQ ID NO: 41436

SEQ ID NO: 231564 - RNA, 64 nt, Homo Sapiens; identical to SEQ ID NO: 41437

SEQ ID NO: 231565 - RNA, 64 nt, Homo Sapiens; identical to SEQ ID NO: 41438

SEQ ID NO: 231566 - RNA, 64 nt, Homo Sapiens; identical to SEQ ID NO: 41439

SEQ ID NO: 231567 - RNA, 64 nt, Homo Sapiens; identical to SEQ ID NO: 41440

SEQ ID NO: 231568 - RNA, 64 nt, Homo Sapiens; identical to SEQ ID NO: 41441

SEQ ID NO: 231569 - RNA, 64 nt, Homo Sapiens; identical to SEQ ID NO: 41442

SEQ ID NO: 231570 - RNA, 64 nt, Homo Sapiens; identical to SEQ ID NO: 41443

SEQ ID NO: 231571 - RNA, 64 nt, Homo Sapiens; identical to SEQ ID NO: 41444

SEQ ID NO: 231572 - RNA, 64 nt, Homo Sapiens; identical to SEQ ID NO: 41445

SEQ ID NO: 231573 - RNA, 64 nt, Homo Sapiens; identical to SEQ ID NO: 41446

SEQ ID NO: 231574 - RNA, 64 nt, Homo Sapiens; identical to SEQ ID NO: 41447

SEQ ID NO: 231575 - RNA, 64 nt, Homo Sapiens; identical to SEQ ID NO: 41448

SEQ ID NO: 231576 - RNA, 64 nt, Homo Sapiens; identical to SEQ ID NO: 41449

SEQ ID NO: 231577 - RNA, 64 nt, Homo Sapiens; identical to SEQ ID NO: 41450

SEQ ID NO: 231578 - RNA, 64 nt, Homo Sapiens; identical to SEQ ID NO: 41451

SEQ ID NO: 231579 - RNA, 64 nt, Homo Sapiens; identical to SEQ ID NO: 41452

SEQ ID NO: 231580 - RNA, 64 nt, Homo Sapiens; identical to SEQ ID NO: 41453

SEQ ID NO: 231581 - RNA, 64 nt, Homo Sapiens; identical to SEQ ID NO: 41454

SEQ ID NO: 231582 - RNA, 64 nt, Homo Sapiens; identical to SEQ ID NO: 41455

SEQ ID NO: 231583 - RNA, 64 nt, Homo Sapiens; identical to SEQ ID NO: 41456

SEQ ID NO: 231584 - RNA, 64 nt, Homo Sapiens; identical to SEQ ID NO: 41457

SEQ ID NO: 231585 - RNA, 64 nt, Homo Sapiens; identical to SEQ ID NO: 41458

SEQ ID NO: 231586 - RNA, 64 nt, Homo Sapiens; identical to SEQ ID NO: 41459

SEQ ID NO: 231587 - RNA, 64 nt, Homo Sapiens; identical to SEQ ID NO: 41460

SEQ ID NO: 231588 - RNA, 64 nt, Homo Sapiens; identical to SEQ ID NO: 41461

SEQ ID NO: 231589 - RNA, 64 nt, Homo Sapiens; identical to SEQ ID NO: 41462

SEQ ID NO: 231590 - RNA, 64 nt, Homo Sapiens; identical to SEQ ID NO: 41463

SEQ ID NO: 231591 - RNA, 64 nt, Homo Sapiens; identical to SEQ ID NO: 41464

SEQ ID NO: 231592 - RNA, 64 nt, Homo Sapiens; identical to SEQ ID NO: 41465

SEQ ID NO: 231593 - RNA, 64 nt, Homo Sapiens; identical to SEQ ID NO: 41466

SEQ ID NO: 231594 - RNA, 64 nt, Homo Sapiens; identical to SEQ ID NO: 41467

SEQ ID NO: 231595 - RNA, 64 nt, Homo Sapiens; identical to SEQ ID NO: 41468

SEQ ID NO: 231596 - RNA, 64 nt, Homo Sapiens; identical to SEQ ID NO: 41469

SEQ ID NO: 231597 - RNA, 64 nt, Homo Sapiens; identical to SEQ ID NO: 41470

SEQ ID NO: 231598 - RNA, 64 nt, Homo Sapiens; identical to SEQ ID NO: 41471

SEQ ID NO: 231599 - RNA, 64 nt, Homo Sapiens; identical to SEQ ID NO: 41472

SEQ ID NO: 231600 - RNA, 64 nt, Homo Sapiens; identical to SEQ ID NO: 41473

SEQ ID NO: 231601 - RNA, 64 nt, Homo Sapiens; identical to SEQ ID NO: 41474

SEQ ID NO: 231602 - RNA, 64 nt, Homo Sapiens; identical to SEQ ID NO: 41475

SEQ ID NO: 231603 - RNA, 64 nt, Homo Sapiens; identical to SEQ ID NO: 41476

SEQ ID NO: 231604 - RNA, 64 nt, Homo Sapiens; identical to SEQ ID NO: 41477

SEQ ID NO: 231605 - RNA, 64 nt, Homo Sapiens; identical to SEQ ID NO: 41478

SEQ ID NO: 231606 - RNA, 64 nt, Homo Sapiens; identical to SEQ ID NO: 41479

SEQ ID NO: 231607 - RNA, 64 nt, Homo Sapiens; identical to SEQ ID NO: 41480

SEQ ID NO: 231608 - RNA, 64 nt, Homo Sapiens; identical to SEQ ID NO: 41481

SEQ ID NO: 231609 - RNA, 64 nt, Homo Sapiens; identical to SEQ ID NO: 41482

SEQ ID NO: 231610 - RNA, 64 nt, Homo Sapiens; identical to SEQ ID NO: 41483

SEQ ID NO: 231611 - RNA, 64 nt, Homo Sapiens; identical to SEQ ID NO: 41484

SEQ ID NO: 231612 - RNA, 64 nt, Homo Sapiens; identical to SEQ ID NO: 41485

SEQ ID NO: 231613 - RNA, 64 nt, Homo Sapiens; identical to SEQ ID NO: 41486

SEQ ID NO: 231614 - RNA, 64 nt, Homo Sapiens; identical to SEQ ID NO: 41487

SEQ ID NO: 231615 - RNA, 64 nt, Homo Sapiens; identical to SEQ ID NO: 41488

SEQ ID NO: 231616 - RNA, 64 nt, Homo Sapiens; identical to SEQ ID NO: 41489

SEQ ID NO: 231617 - RNA, 64 nt, Homo Sapiens; identical to SEQ ID NO: 41490

SEQ ID NO: 231618 - RNA, 64 nt, Homo Sapiens; identical to SEQ ID NO: 41491

SEQ ID NO: 231619 - RNA, 64 nt, Homo Sapiens; identical to SEQ ID NO: 41492

SEQ ID NO: 231620 - RNA, 64 nt, Homo Sapiens; identical to SEQ ID NO: 41493

SEQ ID NO: 231621 - RNA, 64 nt, Homo Sapiens; identical to SEQ ID NO: 41494

SEQ ID NO: 231622 - RNA, 64 nt, Homo Sapiens; identical to SEQ ID NO: 41495

SEQ ID NO: 231623 - RNA, 64 nt, Homo Sapiens; identical to SEQ ID NO: 41496

SEQ ID NO: 231624 - RNA, 64 nt, Homo Sapiens; identical to SEQ ID NO: 41497

SEQ ID NO: 231625 - RNA, 64 nt, Homo Sapiens; identical to SEQ ID NO: 41498

SEQ ID NO: 231626 - RNA, 64 nt, Homo Sapiens; identical to SEQ ID NO: 41499

SEQ ID NO: 231627 - RNA, 64 nt, Homo Sapiens; identical to SEQ ID NO: 41500

SEQ ID NO: 231628 - RNA, 64 nt, Homo Sapiens; identical to SEQ ID NO: 41501

SEQ ID NO: 231629 - RNA, 64 nt, Homo Sapiens; identical to SEQ ID NO: 41502

SEQ ID NO: 231630 - RNA, 64 nt, Homo Sapiens; identical to SEQ ID NO: 41503

SEQ ID NO: 231631 - RNA, 64 nt, Homo Sapiens; identical to SEQ ID NO: 41504

SEQ ID NO: 231632 - RNA, 64 nt, Homo Sapiens; identical to SEQ ID NO: 41505

SEQ ID NO: 231633 - RNA, 64 nt, Homo Sapiens; identical to SEQ ID NO: 41506

SEQ ID NO: 231634 - RNA, 64 nt, Homo Sapiens; identical to SEQ ID NO: 41507

SEQ ID NO: 231635 - RNA, 64 nt, Homo Sapiens; identical to SEQ ID NO: 41508

SEQ ID NO: 231636 - RNA, 64 nt, Homo Sapiens; identical to SEQ ID NO: 41509

SEQ ID NO: 231637 - RNA, 64 nt, Homo Sapiens; identical to SEQ ID NO: 41510

SEQ ID NO: 231638 - RNA, 64 nt, Homo Sapiens; identical to SEQ ID NO: 41511

SEQ ID NO: 231639 - RNA, 64 nt, Homo Sapiens; identical to SEQ ID NO: 41512

SEQ ID NO: 231640 - RNA, 64 nt, Homo Sapiens; identical to SEQ ID NO: 41513

SEQ ID NO: 231641 - RNA, 64 nt, Homo Sapiens; identical to SEQ ID NO: 41514

SEQ ID NO: 231642 - RNA, 64 nt, Homo Sapiens; identical to SEQ ID NO: 41515

SEQ ID NO: 231643 - RNA, 64 nt, Homo Sapiens; identical to SEQ ID NO: 41516

SEQ ID NO: 231644 - RNA, 64 nt, Homo Sapiens; identical to SEQ ID NO: 41517

SEQ ID NO: 231645 - RNA, 64 nt, Homo Sapiens; identical to SEQ ID NO: 41518

SEQ ID NO: 231646 - RNA, 64 nt, Homo Sapiens; identical to SEQ ID NO: 41519

SEQ ID NO: 231647 - RNA, 64 nt, Homo Sapiens; identical to SEQ ID NO: 41520

SEQ ID NO: 231648 - RNA, 64 nt, Homo Sapiens; identical to SEQ ID NO: 41521

SEQ ID NO: 231649 - RNA, 64 nt, Homo Sapiens; identical to SEQ ID NO: 41522

SEQ ID NO: 231650 - RNA, 64 nt, Homo Sapiens; identical to SEQ ID NO: 41523

SEQ ID NO: 231651 - RNA, 64 nt, Homo Sapiens; identical to SEQ ID NO: 41524

SEQ ID NO: 231652 - RNA, 64 nt, Homo Sapiens; identical to SEQ ID NO: 41525

SEQ ID NO: 231653 - RNA, 64 nt, Homo Sapiens; identical to SEQ ID NO: 41526

SEQ ID NO: 231654 - RNA, 64 nt, Homo Sapiens; identical to SEQ ID NO: 41527

SEQ ID NO: 231655 - RNA, 64 nt, Homo Sapiens; identical to SEQ ID NO: 41528

SEQ ID NO: 231656 - RNA, 64 nt, Homo Sapiens; identical to SEQ ID NO: 41529

SEQ ID NO: 231657 - RNA, 64 nt, Homo Sapiens; identical to SEQ ID NO: 41530

SEQ ID NO: 231658 - RNA, 64 nt, Homo Sapiens; identical to SEQ ID NO: 41531

SEQ ID NO: 231659 - RNA, 64 nt, Homo Sapiens; identical to SEQ ID NO: 41532

SEQ ID NO: 231660 - RNA, 64 nt, Homo Sapiens; identical to SEQ ID NO: 41533

SEQ ID NO: 231661 - RNA, 64 nt, Homo Sapiens; identical to SEQ ID NO: 41534

SEQ ID NO: 231662 - RNA, 64 nt, Homo Sapiens; identical to SEQ ID NO: 41535

SEQ ID NO: 231663 - RNA, 64 nt, Homo Sapiens; identical to SEQ ID NO: 41536

SEQ ID NO: 231664 - RNA, 64 nt, Homo Sapiens; identical to SEQ ID NO: 41537

SEQ ID NO: 231665 - RNA, 64 nt, Homo Sapiens; identical to SEQ ID NO: 41538

SEQ ID NO: 231666 - RNA, 64 nt, Homo Sapiens; identical to SEQ ID NO: 41539

SEQ ID NO: 231667 - RNA, 64 nt, Homo Sapiens; identical to SEQ ID NO: 41540

SEQ ID NO: 231668 - RNA, 64 nt, Homo Sapiens; identical to SEQ ID NO: 41541

SEQ ID NO: 231669 - RNA, 64 nt, Homo Sapiens; identical to SEQ ID NO: 41542

SEQ ID NO: 231670 - RNA, 64 nt, Homo Sapiens; identical to SEQ ID NO: 41543

SEQ ID NO: 231671 - RNA, 64 nt, Homo Sapiens; identical to SEQ ID NO: 41544

SEQ ID NO: 231672 - RNA, 64 nt, Homo Sapiens; identical to SEQ ID NO: 41545

SEQ ID NO: 231673 - RNA, 64 nt, Homo Sapiens; identical to SEQ ID NO: 41546

SEQ ID NO: 231674 - RNA, 64 nt, Homo Sapiens; identical to SEQ ID NO: 41547

SEQ ID NO: 231675 - RNA, 64 nt, Homo Sapiens; identical to SEQ ID NO: 41548

SEQ ID NO: 231676 - RNA, 64 nt, Homo Sapiens; identical to SEQ ID NO: 41549

SEQ ID NO: 231677 - RNA, 64 nt, Homo Sapiens; identical to SEQ ID NO: 41550

SEQ ID NO: 231678 - RNA, 64 nt, Homo Sapiens; identical to SEQ ID NO: 41551

SEQ ID NO: 231679 - RNA, 64 nt, Homo Sapiens; identical to SEQ ID NO: 41552

SEQ ID NO: 231680 - RNA, 64 nt, Homo Sapiens; identical to SEQ ID NO: 41553

SEQ ID NO: 231681 - RNA, 64 nt, Homo Sapiens; identical to SEQ ID NO: 41554

SEQ ID NO: 231682 - RNA, 64 nt, Homo Sapiens; identical to SEQ ID NO: 41555

SEQ ID NO: 231683 - RNA, 64 nt, Homo Sapiens; identical to SEQ ID NO: 41556

SEQ ID NO: 231684 - RNA, 64 nt, Homo Sapiens; identical to SEQ ID NO: 41557

SEQ ID NO: 231685 - RNA, 64 nt, Homo Sapiens; identical to SEQ ID NO: 41558

SEQ ID NO: 231686 - RNA, 64 nt, Homo Sapiens; identical to SEQ ID NO: 41559

SEQ ID NO: 231687 - RNA, 64 nt, Homo Sapiens; identical to SEQ ID NO: 41560

SEQ ID NO: 231688 - RNA, 64 nt, Homo Sapiens; identical to SEQ ID NO: 41561

SEQ ID NO: 231689 - RNA, 64 nt, Homo Sapiens; identical to SEQ ID NO: 41562

SEQ ID NO: 231690 - RNA, 64 nt, Homo Sapiens; identical to SEQ ID NO: 41563

SEQ ID NO: 231691 - RNA, 64 nt, Homo Sapiens; identical to SEQ ID NO: 41564

SEQ ID NO: 231692 - RNA, 64 nt, Homo Sapiens; identical to SEQ ID NO: 41565

SEQ ID NO: 231693 - RNA, 64 nt, Homo Sapiens; identical to SEQ ID NO: 41566

SEQ ID NO: 231694 - RNA, 64 nt, Homo Sapiens; identical to SEQ ID NO: 41567

SEQ ID NO: 231695 - RNA, 64 nt, Homo Sapiens; identical to SEQ ID NO: 41568

SEQ ID NO: 231696 - RNA, 64 nt, Homo Sapiens; identical to SEQ ID NO: 41569

SEQ ID NO: 231697 - RNA, 64 nt, Homo Sapiens; identical to SEQ ID NO: 41570

SEQ ID NO: 231698 - RNA, 64 nt, Homo Sapiens; identical to SEQ ID NO: 41571

SEQ ID NO: 231699 - RNA, 64 nt, Homo Sapiens; identical to SEQ ID NO: 41572

SEQ ID NO: 231700 - RNA, 64 nt, Homo Sapiens; identical to SEQ ID NO: 41573

SEQ ID NO: 231701 - RNA, 64 nt, Homo Sapiens; identical to SEQ ID NO: 41574

SEQ ID NO: 231702 - RNA, 64 nt, Homo Sapiens; identical to SEQ ID NO: 41575

SEQ ID NO: 231703 - RNA, 64 nt, Homo Sapiens; identical to SEQ ID NO: 41576

SEQ ID NO: 231704 - RNA, 64 nt, Homo Sapiens; identical to SEQ ID NO: 41577

SEQ ID NO: 231705 - RNA, 64 nt, Homo Sapiens; identical to SEQ ID NO: 41578

SEQ ID NO: 231706 - RNA, 64 nt, Homo Sapiens; identical to SEQ ID NO: 41579

SEQ ID NO: 231707 - RNA, 64 nt, Homo Sapiens; identical to SEQ ID NO: 41580

SEQ ID NO: 231708 - RNA, 64 nt, Homo Sapiens; identical to SEQ ID NO: 41581

SEQ ID NO: 231709 - RNA, 64 nt, Homo Sapiens; identical to SEQ ID NO: 41582

SEQ ID NO: 231710 - RNA, 64 nt, Homo Sapiens; identical to SEQ ID NO: 41583

SEQ ID NO: 231711 - RNA, 64 nt, Homo Sapiens; identical to SEQ ID NO: 41584

SEQ ID NO: 231712 - RNA, 64 nt, Homo Sapiens; identical to SEQ ID NO: 41585

SEQ ID NO: 231713 - RNA, 64 nt, Homo Sapiens; identical to SEQ ID NO: 41586

SEQ ID NO: 231714 - RNA, 64 nt, Homo Sapiens; identical to SEQ ID NO: 41587

SEQ ID NO: 231715 - RNA, 64 nt, Homo Sapiens; identical to SEQ ID NO: 41588

SEQ ID NO: 231716 - RNA, 64 nt, Homo Sapiens; identical to SEQ ID NO: 41589

SEQ ID NO: 231717 - RNA, 64 nt, Homo Sapiens; identical to SEQ ID NO: 41590

SEQ ID NO: 231718 - RNA, 64 nt, Homo Sapiens; identical to SEQ ID NO: 41591

SEQ ID NO: 231719 - RNA, 64 nt, Homo Sapiens; identical to SEQ ID NO: 41592

SEQ ID NO: 231720 - RNA, 64 nt, Homo Sapiens; identical to SEQ ID NO: 41593

SEQ ID NO: 231721 - RNA, 64 nt, Homo Sapiens; identical to SEQ ID NO: 41594

SEQ ID NO: 231722 - RNA, 64 nt, Homo Sapiens; identical to SEQ ID NO: 41595

SEQ ID NO: 231723 - RNA, 64 nt, Homo Sapiens; identical to SEQ ID NO: 41596

SEQ ID NO: 231724 - RNA, 64 nt, Homo Sapiens; identical to SEQ ID NO: 41597

SEQ ID NO: 231725 - RNA, 64 nt, Homo Sapiens; identical to SEQ ID NO: 41598

SEQ ID NO: 231726 - RNA, 64 nt, Homo Sapiens; identical to SEQ ID NO: 41599

SEQ ID NO: 231727 - RNA, 64 nt, Homo Sapiens; identical to SEQ ID NO: 41600

SEQ ID NO: 231728 - RNA, 64 nt, Homo Sapiens; identical to SEQ ID NO: 41601

SEQ ID NO: 231729 - RNA, 64 nt, Homo Sapiens; identical to SEQ ID NO: 41602

SEQ ID NO: 231730 - RNA, 64 nt, Homo Sapiens; identical to SEQ ID NO: 41603

SEQ ID NO: 231731 - RNA, 64 nt, Homo Sapiens; identical to SEQ ID NO: 41604

SEQ ID NO: 231732 - RNA, 64 nt, Homo Sapiens; identical to SEQ ID NO: 41605

SEQ ID NO: 231733 - RNA, 64 nt, Homo Sapiens; identical to SEQ ID NO: 41606

SEQ ID NO: 231734 - RNA, 64 nt, Homo Sapiens; identical to SEQ ID NO: 41607

SEQ ID NO: 231735 - RNA, 64 nt, Homo Sapiens; identical to SEQ ID NO: 41608

SEQ ID NO: 231736 - RNA, 64 nt, Homo Sapiens; identical to SEQ ID NO: 41609

SEQ ID NO: 231737 - RNA, 64 nt, Homo Sapiens; identical to SEQ ID NO: 41610

SEQ ID NO: 231738 - RNA, 64 nt, Homo Sapiens; identical to SEQ ID NO: 41611

SEQ ID NO: 231739 - RNA, 64 nt, Homo Sapiens; identical to SEQ ID NO: 41612

SEQ ID NO: 231740 - RNA, 64 nt, Homo Sapiens; identical to SEQ ID NO: 41613

SEQ ID NO: 231741 - RNA, 64 nt, Homo Sapiens; identical to SEQ ID NO: 41614

SEQ ID NO: 231742 - RNA, 64 nt, Homo Sapiens; identical to SEQ ID NO: 41615

SEQ ID NO: 231743 - RNA, 64 nt, Homo Sapiens; identical to SEQ ID NO: 41616

SEQ ID NO: 231744 - RNA, 64 nt, Homo Sapiens; identical to SEQ ID NO: 41617

SEQ ID NO: 231745 - RNA, 64 nt, Homo Sapiens; identical to SEQ ID NO: 41618

SEQ ID NO: 231746 - RNA, 64 nt, Homo Sapiens; identical to SEQ ID NO: 41619

SEQ ID NO: 231747 - RNA, 64 nt, Homo Sapiens; identical to SEQ ID NO: 41620

SEQ ID NO: 231748 - RNA, 64 nt, Homo Sapiens; identical to SEQ ID NO: 41621

SEQ ID NO: 231749 - RNA, 63 nt, Homo Sapiens; identical to SEQ ID NO: 41622

SEQ ID NO: 231750 - RNA, 64 nt, Homo Sapiens; identical to SEQ ID NO: 41623

SEQ ID NO: 231751 - RNA, 64 nt, Homo Sapiens; identical to SEQ ID NO: 41624

SEQ ID NO: 231752 - RNA, 64 nt, Homo Sapiens; identical to SEQ ID NO: 41625

SEQ ID NO: 231753 - RNA, 64 nt, Homo Sapiens; identical to SEQ ID NO: 41626

SEQ ID NO: 231754 - RNA, 64 nt, Homo Sapiens; identical to SEQ ID NO: 41627

SEQ ID NO: 231755 - RNA, 64 nt, Homo Sapiens; identical to SEQ ID NO: 41628

SEQ ID NO: 231756 - RNA, 64 nt, Homo Sapiens; identical to SEQ ID NO: 41629

SEQ ID NO: 231757 - RNA, 64 nt, Homo Sapiens; identical to SEQ ID NO: 41630

SEQ ID NO: 231758 - RNA, 64 nt, Homo Sapiens; identical to SEQ ID NO: 41631

SEQ ID NO: 231759 - RNA, 64 nt, Homo Sapiens; identical to SEQ ID NO: 41632

SEQ ID NO: 231760 - RNA, 64 nt, Homo Sapiens; identical to SEQ ID NO: 41633

SEQ ID NO: 231761 - RNA, 64 nt, Homo Sapiens; identical to SEQ ID NO: 41634

SEQ ID NO: 231762 - RNA, 64 nt, Homo Sapiens; identical to SEQ ID NO: 41635

SEQ ID NO: 231763 - RNA, 64 nt, Homo Sapiens; identical to SEQ ID NO: 41636

SEQ ID NO: 231764 - RNA, 64 nt, Homo Sapiens; identical to SEQ ID NO: 41637

SEQ ID NO: 231765 - RNA, 64 nt, Homo Sapiens; identical to SEQ ID NO: 41638

SEQ ID NO: 231766 - RNA, 64 nt, Homo Sapiens; identical to SEQ ID NO: 41639

SEQ ID NO: 231767 - RNA, 64 nt, Homo Sapiens; identical to SEQ ID NO: 41640

SEQ ID NO: 231768 - RNA, 64 nt, Homo Sapiens; identical to SEQ ID NO: 41641

SEQ ID NO: 231769 - RNA, 64 nt, Homo Sapiens; identical to SEQ ID NO: 41642

SEQ ID NO: 231770 - RNA, 64 nt, Homo Sapiens; identical to SEQ ID NO: 41643

SEQ ID NO: 231771 - RNA, 64 nt, Homo Sapiens; identical to SEQ ID NO: 41644

SEQ ID NO: 231772 - RNA, 64 nt, Homo Sapiens; identical to SEQ ID NO: 41645

SEQ ID NO: 231773 - RNA, 64 nt, Homo Sapiens; identical to SEQ ID NO: 41646

SEQ ID NO: 231774 - RNA, 64 nt, Homo Sapiens; identical to SEQ ID NO: 41647

SEQ ID NO: 231775 - RNA, 64 nt, Homo Sapiens; identical to SEQ ID NO: 41648

SEQ ID NO: 231776 - RNA, 64 nt, Homo Sapiens; identical to SEQ ID NO: 41649

SEQ ID NO: 231777 - RNA, 64 nt, Homo Sapiens; identical to SEQ ID NO: 41650

SEQ ID NO: 231778 - RNA, 64 nt, Homo Sapiens; identical to SEQ ID NO: 41651

SEQ ID NO: 231779 - RNA, 64 nt, Homo Sapiens; identical to SEQ ID NO: 41652

SEQ ID NO: 231780 - RNA, 64 nt, Homo Sapiens; identical to SEQ ID NO: 41653

SEQ ID NO: 231781 - RNA, 64 nt, Homo Sapiens; identical to SEQ ID NO: 41654

SEQ ID NO: 231782 - RNA, 64 nt, Homo Sapiens; identical to SEQ ID NO: 41655

SEQ ID NO: 231783 - RNA, 64 nt, Homo Sapiens; identical to SEQ ID NO: 41656

SEQ ID NO: 231784 - RNA, 64 nt, Homo Sapiens; identical to SEQ ID NO: 41657

SEQ ID NO: 231785 - RNA, 64 nt, Homo Sapiens; identical to SEQ ID NO: 41658

SEQ ID NO: 231786 - RNA, 64 nt, Homo Sapiens; identical to SEQ ID NO: 41659

SEQ ID NO: 231787 - RNA, 64 nt, Homo Sapiens; identical to SEQ ID NO: 41660

SEQ ID NO: 231788 - RNA, 64 nt, Homo Sapiens; identical to SEQ ID NO: 41661

SEQ ID NO: 231789 - RNA, 64 nt, Homo Sapiens; identical to SEQ ID NO: 41662

SEQ ID NO: 231790 - RNA, 64 nt, Homo Sapiens; identical to SEQ ID NO: 41663

SEQ ID NO: 231791 - RNA, 64 nt, Homo Sapiens; identical to SEQ ID NO: 41664

SEQ ID NO: 231792 - RNA, 64 nt, Homo Sapiens; identical to SEQ ID NO: 41665

SEQ ID NO: 231793 - RNA, 64 nt, Homo Sapiens; identical to SEQ ID NO: 41666

SEQ ID NO: 231794 - RNA, 64 nt, Homo Sapiens; identical to SEQ ID NO: 41667

SEQ ID NO: 231795 - RNA, 64 nt, Homo Sapiens; identical to SEQ ID NO: 41668

SEQ ID NO: 231796 - RNA, 64 nt, Homo Sapiens; identical to SEQ ID NO: 41669

SEQ ID NO: 231797 - RNA, 64 nt, Homo Sapiens; identical to SEQ ID NO: 41670

SEQ ID NO: 231798 - RNA, 64 nt, Homo Sapiens; identical to SEQ ID NO: 41671

SEQ ID NO: 231799 - RNA, 64 nt, Homo Sapiens; identical to SEQ ID NO: 41672

SEQ ID NO: 231800 - RNA, 64 nt, Homo Sapiens; identical to SEQ ID NO: 41673

SEQ ID NO: 231801 - RNA, 64 nt, Homo Sapiens; identical to SEQ ID NO: 41674

SEQ ID NO: 231802 - RNA, 64 nt, Homo Sapiens; identical to SEQ ID NO: 41675

SEQ ID NO: 231803 - RNA, 64 nt, Homo Sapiens; identical to SEQ ID NO: 41676

SEQ ID NO: 231804 - RNA, 64 nt, Homo Sapiens; identical to SEQ ID NO: 41677

SEQ ID NO: 231805 - RNA, 64 nt, Homo Sapiens; identical to SEQ ID NO: 41678

SEQ ID NO: 231806 - RNA, 64 nt, Homo Sapiens; identical to SEQ ID NO: 41679

SEQ ID NO: 231807 - RNA, 64 nt, Homo Sapiens; identical to SEQ ID NO: 41680

SEQ ID NO: 231808 - RNA, 64 nt, Homo Sapiens; identical to SEQ ID NO: 41681

SEQ ID NO: 231809 - RNA, 64 nt, Homo Sapiens; identical to SEQ ID NO: 41682

SEQ ID NO: 231810 - RNA, 64 nt, Homo Sapiens; identical to SEQ ID NO: 41683

SEQ ID NO: 231811 - RNA, 64 nt, Homo Sapiens; identical to SEQ ID NO: 41684

SEQ ID NO: 231812 - RNA, 64 nt, Homo Sapiens; identical to SEQ ID NO: 41685

SEQ ID NO: 231813 - RNA, 64 nt, Homo Sapiens; identical to SEQ ID NO: 41686

SEQ ID NO: 231814 - RNA, 64 nt, Homo Sapiens; identical to SEQ ID NO: 41687

SEQ ID NO: 231815 - RNA, 64 nt, Homo Sapiens; identical to SEQ ID NO: 41688

SEQ ID NO: 231816 - RNA, 64 nt, Homo Sapiens; identical to SEQ ID NO: 41689

SEQ ID NO: 231817 - RNA, 64 nt, Homo Sapiens; identical to SEQ ID NO: 41690

SEQ ID NO: 231818 - RNA, 64 nt, Homo Sapiens; identical to SEQ ID NO: 41691

SEQ ID NO: 231819 - RNA, 64 nt, Homo Sapiens; identical to SEQ ID NO: 41692

SEQ ID NO: 231820 - RNA, 64 nt, Homo Sapiens; identical to SEQ ID NO: 41693

SEQ ID NO: 231821 - RNA, 64 nt, Homo Sapiens; identical to SEQ ID NO: 41694

SEQ ID NO: 231822 - RNA, 64 nt, Homo Sapiens; identical to SEQ ID NO: 41695

SEQ ID NO: 231823 - RNA, 64 nt, Homo Sapiens; identical to SEQ ID NO: 41696

SEQ ID NO: 231824 - RNA, 64 nt, Homo Sapiens; identical to SEQ ID NO: 41697

SEQ ID NO: 231825 - RNA, 64 nt, Homo Sapiens; identical to SEQ ID NO: 41698

SEQ ID NO: 231826 - RNA, 64 nt, Homo Sapiens; identical to SEQ ID NO: 41699

SEQ ID NO: 231827 - RNA, 64 nt, Homo Sapiens; identical to SEQ ID NO: 41700

SEQ ID NO: 231828 - RNA, 64 nt, Homo Sapiens; identical to SEQ ID NO: 41701

SEQ ID NO: 231829 - RNA, 64 nt, Homo Sapiens; identical to SEQ ID NO: 41702

SEQ ID NO: 231830 - RNA, 64 nt, Homo Sapiens; identical to SEQ ID NO: 41703

SEQ ID NO: 231831 - RNA, 64 nt, Homo Sapiens; identical to SEQ ID NO: 41704

SEQ ID NO: 231832 - RNA, 64 nt, Homo Sapiens; identical to SEQ ID NO: 41705

SEQ ID NO: 231833 - RNA, 64 nt, Homo Sapiens; identical to SEQ ID NO: 41706

SEQ ID NO: 231834 - RNA, 64 nt, Homo Sapiens; identical to SEQ ID NO: 41707

SEQ ID NO: 231835 - RNA, 64 nt, Homo Sapiens; identical to SEQ ID NO: 41708

SEQ ID NO: 231836 - RNA, 64 nt, Homo Sapiens; identical to SEQ ID NO: 41709

SEQ ID NO: 231837 - RNA, 64 nt, Homo Sapiens; identical to SEQ ID NO: 41710

SEQ ID NO: 231838 - RNA, 64 nt, Homo Sapiens; identical to SEQ ID NO: 41711

SEQ ID NO: 231839 - RNA, 64 nt, Homo Sapiens; identical to SEQ ID NO: 41712

SEQ ID NO: 231840 - RNA, 64 nt, Homo Sapiens; identical to SEQ ID NO: 41713

SEQ ID NO: 231841 - RNA, 64 nt, Homo Sapiens; identical to SEQ ID NO: 41714

SEQ ID NO: 231842 - RNA, 64 nt, Homo Sapiens; identical to SEQ ID NO: 41715

SEQ ID NO: 231843 - RNA, 64 nt, Homo Sapiens; identical to SEQ ID NO: 41716

SEQ ID NO: 231844 - RNA, 64 nt, Homo Sapiens; identical to SEQ ID NO: 41717

SEQ ID NO: 231845 - RNA, 64 nt, Homo Sapiens; identical to SEQ ID NO: 41718

SEQ ID NO: 231846 - RNA, 64 nt, Homo Sapiens; identical to SEQ ID NO: 41719

SEQ ID NO: 231847 - RNA, 64 nt, Homo Sapiens; identical to SEQ ID NO: 41720

SEQ ID NO: 231848 - RNA, 64 nt, Homo Sapiens; identical to SEQ ID NO: 41721

SEQ ID NO: 231849 - RNA, 64 nt, Homo Sapiens; identical to SEQ ID NO: 41722

SEQ ID NO: 231850 - RNA, 64 nt, Homo Sapiens; identical to SEQ ID NO: 41723

SEQ ID NO: 231851 - RNA, 64 nt, Homo Sapiens; identical to SEQ ID NO: 41724

SEQ ID NO: 231852 - RNA, 64 nt, Homo Sapiens; identical to SEQ ID NO: 41725

SEQ ID NO: 231853 - RNA, 64 nt, Homo Sapiens; identical to SEQ ID NO: 41726

SEQ ID NO: 231854 - RNA, 64 nt, Homo Sapiens; identical to SEQ ID NO: 41727

SEQ ID NO: 231855 - RNA, 64 nt, Homo Sapiens; identical to SEQ ID NO: 41728

SEQ ID NO: 231856 - RNA, 64 nt, Homo Sapiens; identical to SEQ ID NO: 41729

SEQ ID NO: 231857 - RNA, 64 nt, Homo Sapiens; identical to SEQ ID NO: 41730

SEQ ID NO: 231858 - RNA, 64 nt, Homo Sapiens; identical to SEQ ID NO: 41731

SEQ ID NO: 231859 - RNA, 64 nt, Homo Sapiens; identical to SEQ ID NO: 41732

SEQ ID NO: 231860 - RNA, 64 nt, Homo Sapiens; identical to SEQ ID NO: 41733

SEQ ID NO: 231861 - RNA, 64 nt, Homo Sapiens; identical to SEQ ID NO: 41734

SEQ ID NO: 231862 - RNA, 64 nt, Homo Sapiens; identical to SEQ ID NO: 41735

SEQ ID NO: 231863 - RNA, 64 nt, Homo Sapiens; identical to SEQ ID NO: 41736

SEQ ID NO: 231864 - RNA, 64 nt, Homo Sapiens; identical to SEQ ID NO: 41737

SEQ ID NO: 231865 - RNA, 64 nt, Homo Sapiens; identical to SEQ ID NO: 41738

SEQ ID NO: 231866 - RNA, 64 nt, Homo Sapiens; identical to SEQ ID NO: 41739

SEQ ID NO: 231867 - RNA, 64 nt, Homo Sapiens; identical to SEQ ID NO: 41740

SEQ ID NO: 231868 - RNA, 64 nt, Homo Sapiens; identical to SEQ ID NO: 41741

SEQ ID NO: 231869 - RNA, 64 nt, Homo Sapiens; identical to SEQ ID NO: 41742

SEQ ID NO: 231870 - RNA, 64 nt, Homo Sapiens; identical to SEQ ID NO: 41743

SEQ ID NO: 231871 - RNA, 64 nt, Homo Sapiens; identical to SEQ ID NO: 41744

SEQ ID NO: 231872 - RNA, 64 nt, Homo Sapiens; identical to SEQ ID NO: 41745

SEQ ID NO: 231873 - RNA, 64 nt, Homo Sapiens; identical to SEQ ID NO: 41746

SEQ ID NO: 231874 - RNA, 64 nt, Homo Sapiens; identical to SEQ ID NO: 41747

SEQ ID NO: 231875 - RNA, 64 nt, Homo Sapiens; identical to SEQ ID NO: 41748

SEQ ID NO: 231876 - RNA, 64 nt, Homo Sapiens; identical to SEQ ID NO: 41749

SEQ ID NO: 231877 - RNA, 64 nt, Homo Sapiens; identical to SEQ ID NO: 41750

SEQ ID NO: 231878 - RNA, 64 nt, Homo Sapiens; identical to SEQ ID NO: 41751

SEQ ID NO: 231879 - RNA, 64 nt, Homo Sapiens; identical to SEQ ID NO: 41752

SEQ ID NO: 231880 - RNA, 64 nt, Homo Sapiens; identical to SEQ ID NO: 41753

SEQ ID NO: 231881 - RNA, 64 nt, Homo Sapiens; identical to SEQ ID NO: 41754

SEQ ID NO: 231882 - RNA, 64 nt, Homo Sapiens; identical to SEQ ID NO: 41755

SEQ ID NO: 231883 - RNA, 64 nt, Homo Sapiens; identical to SEQ ID NO: 41756

SEQ ID NO: 231884 - RNA, 64 nt, Homo Sapiens; identical to SEQ ID NO: 41757

SEQ ID NO: 231885 - RNA, 64 nt, Homo Sapiens; identical to SEQ ID NO: 41758

SEQ ID NO: 231886 - RNA, 64 nt, Homo Sapiens; identical to SEQ ID NO: 41759

SEQ ID NO: 231887 - RNA, 64 nt, Homo Sapiens; identical to SEQ ID NO: 41760

SEQ ID NO: 231888 - RNA, 64 nt, Homo Sapiens; identical to SEQ ID NO: 41761

SEQ ID NO: 231889 - RNA, 64 nt, Homo Sapiens; identical to SEQ ID NO: 41762

SEQ ID NO: 231890 - RNA, 64 nt, Homo Sapiens; identical to SEQ ID NO: 41763

SEQ ID NO: 231891 - RNA, 64 nt, Homo Sapiens; identical to SEQ ID NO: 41764

SEQ ID NO: 231892 - RNA, 64 nt, Homo Sapiens; identical to SEQ ID NO: 41765

SEQ ID NO: 231893 - RNA, 64 nt, Homo Sapiens; identical to SEQ ID NO: 41766

SEQ ID NO: 231894 - RNA, 64 nt, Homo Sapiens; identical to SEQ ID NO: 41767

SEQ ID NO: 231895 - RNA, 64 nt, Homo Sapiens; identical to SEQ ID NO: 41768

SEQ ID NO: 231896 - RNA, 64 nt, Homo Sapiens; identical to SEQ ID NO: 41769

SEQ ID NO: 231897 - RNA, 64 nt, Homo Sapiens; identical to SEQ ID NO: 41770

SEQ ID NO: 231898 - RNA, 64 nt, Homo Sapiens; identical to SEQ ID NO: 41771

SEQ ID NO: 231899 - RNA, 64 nt, Homo Sapiens; identical to SEQ ID NO: 41772

SEQ ID NO: 231900 - RNA, 64 nt, Homo Sapiens; identical to SEQ ID NO: 41773

SEQ ID NO: 231901 - RNA, 64 nt, Homo Sapiens; identical to SEQ ID NO: 41774

SEQ ID NO: 231902 - RNA, 64 nt, Homo Sapiens; identical to SEQ ID NO: 41775

SEQ ID NO: 231903 - RNA, 64 nt, Homo Sapiens; identical to SEQ ID NO: 41776

SEQ ID NO: 231904 - RNA, 64 nt, Homo Sapiens; identical to SEQ ID NO: 41777

SEQ ID NO: 231905 - RNA, 64 nt, Homo Sapiens; identical to SEQ ID NO: 41778

SEQ ID NO: 231906 - RNA, 64 nt, Homo Sapiens; identical to SEQ ID NO: 41779

SEQ ID NO: 231907 - RNA, 64 nt, Homo Sapiens; identical to SEQ ID NO: 41780

SEQ ID NO: 231908 - RNA, 64 nt, Homo Sapiens; identical to SEQ ID NO: 41781

SEQ ID NO: 231909 - RNA, 64 nt, Homo Sapiens; identical to SEQ ID NO: 41782

SEQ ID NO: 231910 - RNA, 64 nt, Homo Sapiens; identical to SEQ ID NO: 41783

SEQ ID NO: 231911 - RNA, 64 nt, Homo Sapiens; identical to SEQ ID NO: 41784

SEQ ID NO: 231912 - RNA, 64 nt, Homo Sapiens; identical to SEQ ID NO: 41785

SEQ ID NO: 231913 - RNA, 64 nt, Homo Sapiens; identical to SEQ ID NO: 41786

SEQ ID NO: 231914 - RNA, 64 nt, Homo Sapiens; identical to SEQ ID NO: 41787

SEQ ID NO: 231915 - RNA, 64 nt, Homo Sapiens; identical to SEQ ID NO: 41788

SEQ ID NO: 231916 - RNA, 64 nt, Homo Sapiens; identical to SEQ ID NO: 41789

SEQ ID NO: 231917 - RNA, 64 nt, Homo Sapiens; identical to SEQ ID NO: 41790

SEQ ID NO: 231918 - RNA, 64 nt, Homo Sapiens; identical to SEQ ID NO: 41791

SEQ ID NO: 231919 - RNA, 64 nt, Homo Sapiens; identical to SEQ ID NO: 41792

SEQ ID NO: 231920 - RNA, 64 nt, Homo Sapiens; identical to SEQ ID NO: 41793

SEQ ID NO: 231921 - RNA, 64 nt, Homo Sapiens; identical to SEQ ID NO: 41794

SEQ ID NO: 231922 - RNA, 64 nt, Homo Sapiens; identical to SEQ ID NO: 41795

SEQ ID NO: 231923 - RNA, 64 nt, Homo Sapiens; identical to SEQ ID NO: 41796

SEQ ID NO: 231924 - RNA, 64 nt, Homo Sapiens; identical to SEQ ID NO: 41797

SEQ ID NO: 231925 - RNA, 64 nt, Homo Sapiens; identical to SEQ ID NO: 41798

SEQ ID NO: 231926 - RNA, 64 nt, Homo Sapiens; identical to SEQ ID NO: 41799

SEQ ID NO: 231927 - RNA, 64 nt, Homo Sapiens; identical to SEQ ID NO: 41800

SEQ ID NO: 231928 - RNA, 64 nt, Homo Sapiens; identical to SEQ ID NO: 41801

SEQ ID NO: 231929 - RNA, 64 nt, Homo Sapiens; identical to SEQ ID NO: 41802

SEQ ID NO: 231930 - RNA, 64 nt, Homo Sapiens; identical to SEQ ID NO: 41803

SEQ ID NO: 231931 - RNA, 64 nt, Homo Sapiens; identical to SEQ ID NO: 41804

SEQ ID NO: 231932 - RNA, 64 nt, Homo Sapiens; identical to SEQ ID NO: 41805

SEQ ID NO: 231933 - RNA, 64 nt, Homo Sapiens; identical to SEQ ID NO: 41806

SEQ ID NO: 231934 - RNA, 64 nt, Homo Sapiens; identical to SEQ ID NO: 41807

SEQ ID NO: 231935 - RNA, 64 nt, Homo Sapiens; identical to SEQ ID NO: 41808

SEQ ID NO: 231936 - RNA, 64 nt, Homo Sapiens; identical to SEQ ID NO: 41809

SEQ ID NO: 231937 - RNA, 64 nt, Homo Sapiens; identical to SEQ ID NO: 41810

SEQ ID NO: 231938 - RNA, 64 nt, Homo Sapiens; identical to SEQ ID NO: 41811

SEQ ID NO: 231939 - RNA, 64 nt, Homo Sapiens; identical to SEQ ID NO: 41812

SEQ ID NO: 231940 - RNA, 64 nt, Homo Sapiens; identical to SEQ ID NO: 41813

SEQ ID NO: 231941 - RNA, 64 nt, Homo Sapiens; identical to SEQ ID NO: 41814

SEQ ID NO: 231942 - RNA, 64 nt, Homo Sapiens; identical to SEQ ID NO: 41815

SEQ ID NO: 231943 - RNA, 64 nt, Homo Sapiens; identical to SEQ ID NO: 41816

SEQ ID NO: 231944 - RNA, 64 nt, Homo Sapiens; identical to SEQ ID NO: 41817

SEQ ID NO: 231945 - RNA, 64 nt, Homo Sapiens; identical to SEQ ID NO: 41818

SEQ ID NO: 231946 - RNA, 64 nt, Homo Sapiens; identical to SEQ ID NO: 41819

SEQ ID NO: 231947 - RNA, 64 nt, Homo Sapiens; identical to SEQ ID NO: 41820

SEQ ID NO: 231948 - RNA, 64 nt, Homo Sapiens; identical to SEQ ID NO: 41821

SEQ ID NO: 231949 - RNA, 64 nt, Homo Sapiens; identical to SEQ ID NO: 41822

SEQ ID NO: 231950 - RNA, 64 nt, Homo Sapiens; identical to SEQ ID NO: 41823

SEQ ID NO: 231951 - RNA, 64 nt, Homo Sapiens; identical to SEQ ID NO: 41824

SEQ ID NO: 231952 - RNA, 64 nt, Homo Sapiens; identical to SEQ ID NO: 41825

SEQ ID NO: 231953 - RNA, 64 nt, Homo Sapiens; identical to SEQ ID NO: 41826

SEQ ID NO: 231954 - RNA, 64 nt, Homo Sapiens; identical to SEQ ID NO: 41827

SEQ ID NO: 231955 - RNA, 64 nt, Homo Sapiens; identical to SEQ ID NO: 41828

SEQ ID NO: 231956 - RNA, 64 nt, Homo Sapiens; identical to SEQ ID NO: 41829

SEQ ID NO: 231957 - RNA, 64 nt, Homo Sapiens; identical to SEQ ID NO: 41830

SEQ ID NO: 231958 - RNA, 64 nt, Homo Sapiens; identical to SEQ ID NO: 41831

SEQ ID NO: 231959 - RNA, 64 nt, Homo Sapiens; identical to SEQ ID NO: 41832

SEQ ID NO: 231960 - RNA, 64 nt, Homo Sapiens; identical to SEQ ID NO: 41833

SEQ ID NO: 231961 - RNA, 64 nt, Homo Sapiens; identical to SEQ ID NO: 41834

SEQ ID NO: 231962 - RNA, 64 nt, Homo Sapiens; identical to SEQ ID NO: 41835

SEQ ID NO: 231963 - RNA, 64 nt, Homo Sapiens; identical to SEQ ID NO: 41836

SEQ ID NO: 231964 - RNA, 64 nt, Homo Sapiens; identical to SEQ ID NO: 41837

SEQ ID NO: 231965 - RNA, 64 nt, Homo Sapiens; identical to SEQ ID NO: 41838

SEQ ID NO: 231966 - RNA, 64 nt, Homo Sapiens; identical to SEQ ID NO: 41839

SEQ ID NO: 231967 - RNA, 64 nt, Homo Sapiens; identical to SEQ ID NO: 41840

SEQ ID NO: 231968 - RNA, 64 nt, Homo Sapiens; identical to SEQ ID NO: 41841

SEQ ID NO: 231969 - RNA, 64 nt, Homo Sapiens; identical to SEQ ID NO: 41842

SEQ ID NO: 231970 - RNA, 64 nt, Homo Sapiens; identical to SEQ ID NO: 41843

SEQ ID NO: 231971 - RNA, 64 nt, Homo Sapiens; identical to SEQ ID NO: 41844

SEQ ID NO: 231972 - RNA, 64 nt, Homo Sapiens; identical to SEQ ID NO: 41845

SEQ ID NO: 231973 - RNA, 64 nt, Homo Sapiens; identical to SEQ ID NO: 41846

SEQ ID NO: 231974 - RNA, 64 nt, Homo Sapiens; identical to SEQ ID NO: 41847

SEQ ID NO: 231975 - RNA, 64 nt, Homo Sapiens; identical to SEQ ID NO: 41848

SEQ ID NO: 231976 - RNA, 64 nt, Homo Sapiens; identical to SEQ ID NO: 41849

SEQ ID NO: 231977 - RNA, 64 nt, Homo Sapiens; identical to SEQ ID NO: 41850

SEQ ID NO: 231978 - RNA, 64 nt, Homo Sapiens; identical to SEQ ID NO: 41851

SEQ ID NO: 231979 - RNA, 64 nt, Homo Sapiens; identical to SEQ ID NO: 41852

SEQ ID NO: 231980 - RNA, 64 nt, Homo Sapiens; identical to SEQ ID NO: 41853

SEQ ID NO: 231981 - RNA, 64 nt, Homo Sapiens; identical to SEQ ID NO: 41854

SEQ ID NO: 231982 - RNA, 64 nt, Homo Sapiens; identical to SEQ ID NO: 41855

SEQ ID NO: 231983 - RNA, 64 nt, Homo Sapiens; identical to SEQ ID NO: 41856

SEQ ID NO: 231984 - RNA, 64 nt, Homo Sapiens; identical to SEQ ID NO: 41857

SEQ ID NO: 231985 - RNA, 64 nt, Homo Sapiens; identical to SEQ ID NO: 41858

SEQ ID NO: 231986 - RNA, 64 nt, Homo Sapiens; identical to SEQ ID NO: 41859

SEQ ID NO: 231987 - RNA, 64 nt, Homo Sapiens; identical to SEQ ID NO: 41860

SEQ ID NO: 231988 - RNA, 64 nt, Homo Sapiens; identical to SEQ ID NO: 41861

SEQ ID NO: 231989 - RNA, 64 nt, Homo Sapiens; identical to SEQ ID NO: 41862

SEQ ID NO: 231990 - RNA, 64 nt, Homo Sapiens; identical to SEQ ID NO: 41863

SEQ ID NO: 231991 - RNA, 64 nt, Homo Sapiens; identical to SEQ ID NO: 41864

SEQ ID NO: 231992 - RNA, 64 nt, Homo Sapiens; identical to SEQ ID NO: 41865

SEQ ID NO: 231993 - RNA, 64 nt, Homo Sapiens; identical to SEQ ID NO: 41866

SEQ ID NO: 231994 - RNA, 64 nt, Homo Sapiens; identical to SEQ ID NO: 41867

SEQ ID NO: 231995 - RNA, 64 nt, Homo Sapiens; identical to SEQ ID NO: 41868

SEQ ID NO: 231996 - RNA, 64 nt, Homo Sapiens; identical to SEQ ID NO: 41869

SEQ ID NO: 231997 - RNA, 64 nt, Homo Sapiens; identical to SEQ ID NO: 41870

SEQ ID NO: 231998 - RNA, 64 nt, Homo Sapiens; identical to SEQ ID NO: 41871

SEQ ID NO: 231999 - RNA, 64 nt, Homo Sapiens; identical to SEQ ID NO: 41872

SEQ ID NO: 232000 - RNA, 64 nt, Homo Sapiens; identical to SEQ ID NO: 41873

SEQ ID NO: 232001 - RNA, 64 nt, Homo Sapiens; identical to SEQ ID NO: 41874

SEQ ID NO: 232002 - RNA, 64 nt, Homo Sapiens; identical to SEQ ID NO: 41875

SEQ ID NO: 232003 - RNA, 64 nt, Homo Sapiens; identical to SEQ ID NO: 41876

SEQ ID NO: 232004 - RNA, 64 nt, Homo Sapiens; identical to SEQ ID NO: 41877

SEQ ID NO: 232005 - RNA, 64 nt, Homo Sapiens; identical to SEQ ID NO: 41878

SEQ ID NO: 232006 - RNA, 64 nt, Homo Sapiens; identical to SEQ ID NO: 41879

SEQ ID NO: 232007 - RNA, 64 nt, Homo Sapiens; identical to SEQ ID NO: 41880

SEQ ID NO: 232008 - RNA, 64 nt, Homo Sapiens; identical to SEQ ID NO: 41881

SEQ ID NO: 232009 - RNA, 64 nt, Homo Sapiens; identical to SEQ ID NO: 41882

SEQ ID NO: 232010 - RNA, 64 nt, Homo Sapiens; identical to SEQ ID NO: 41883

SEQ ID NO: 232011 - RNA, 64 nt, Homo Sapiens; identical to SEQ ID NO: 41884

SEQ ID NO: 232012 - RNA, 64 nt, Homo Sapiens; identical to SEQ ID NO: 41885

SEQ ID NO: 232013 - RNA, 64 nt, Homo Sapiens; identical to SEQ ID NO: 41886

SEQ ID NO: 232014 - RNA, 64 nt, Homo Sapiens; identical to SEQ ID NO: 41887

SEQ ID NO: 232015 - RNA, 64 nt, Homo Sapiens; identical to SEQ ID NO: 41888

SEQ ID NO: 232016 - RNA, 64 nt, Homo Sapiens; identical to SEQ ID NO: 41889

SEQ ID NO: 232017 - RNA, 64 nt, Homo Sapiens; identical to SEQ ID NO: 41890

SEQ ID NO: 232018 - RNA, 64 nt, Homo Sapiens; identical to SEQ ID NO: 41891

SEQ ID NO: 232019 - RNA, 64 nt, Homo Sapiens; identical to SEQ ID NO: 41892

SEQ ID NO: 232020 - RNA, 64 nt, Homo Sapiens; identical to SEQ ID NO: 41893

SEQ ID NO: 232021 - RNA, 64 nt, Homo Sapiens; identical to SEQ ID NO: 41894

SEQ ID NO: 232022 - RNA, 64 nt, Homo Sapiens; identical to SEQ ID NO: 41895

SEQ ID NO: 232023 - RNA, 64 nt, Homo Sapiens; identical to SEQ ID NO: 41896

SEQ ID NO: 232024 - RNA, 64 nt, Homo Sapiens; identical to SEQ ID NO: 41897

SEQ ID NO: 232025 - RNA, 64 nt, Homo Sapiens; identical to SEQ ID NO: 41898

SEQ ID NO: 232026 - RNA, 64 nt, Homo Sapiens; identical to SEQ ID NO: 41899

SEQ ID NO: 232027 - RNA, 64 nt, Homo Sapiens; identical to SEQ ID NO: 41900

SEQ ID NO: 232028 - RNA, 64 nt, Homo Sapiens; identical to SEQ ID NO: 41901

SEQ ID NO: 232029 - RNA, 64 nt, Homo Sapiens; identical to SEQ ID NO: 41902

SEQ ID NO: 232030 - RNA, 64 nt, Homo Sapiens; identical to SEQ ID NO: 41903

SEQ ID NO: 232031 - RNA, 64 nt, Homo Sapiens; identical to SEQ ID NO: 41904

SEQ ID NO: 232032 - RNA, 64 nt, Homo Sapiens; identical to SEQ ID NO: 41905

SEQ ID NO: 232033 - RNA, 64 nt, Homo Sapiens; identical to SEQ ID NO: 41906

SEQ ID NO: 232034 - RNA, 64 nt, Homo Sapiens; identical to SEQ ID NO: 41907

SEQ ID NO: 232035 - RNA, 64 nt, Homo Sapiens; identical to SEQ ID NO: 41908

SEQ ID NO: 232036 - RNA, 64 nt, Homo Sapiens; identical to SEQ ID NO: 41909

SEQ ID NO: 232037 - RNA, 64 nt, Homo Sapiens; identical to SEQ ID NO: 41910

SEQ ID NO: 232038 - RNA, 64 nt, Homo Sapiens; identical to SEQ ID NO: 41911

SEQ ID NO: 232039 - RNA, 64 nt, Homo Sapiens; identical to SEQ ID NO: 41912

SEQ ID NO: 232040 - RNA, 64 nt, Homo Sapiens; identical to SEQ ID NO: 41913

SEQ ID NO: 232041 - RNA, 64 nt, Homo Sapiens; identical to SEQ ID NO: 41914

SEQ ID NO: 232042 - RNA, 64 nt, Homo Sapiens; identical to SEQ ID NO: 41915

SEQ ID NO: 232043 - RNA, 64 nt, Homo Sapiens; identical to SEQ ID NO: 41916

SEQ ID NO: 232044 - RNA, 64 nt, Homo Sapiens; identical to SEQ ID NO: 41917

SEQ ID NO: 232045 - RNA, 64 nt, Homo Sapiens; identical to SEQ ID NO: 41918

SEQ ID NO: 232046 - RNA, 64 nt, Homo Sapiens; identical to SEQ ID NO: 41919

SEQ ID NO: 232047 - RNA, 64 nt, Homo Sapiens; identical to SEQ ID NO: 41920

SEQ ID NO: 232048 - RNA, 64 nt, Homo Sapiens; identical to SEQ ID NO: 41921

SEQ ID NO: 232049 - RNA, 64 nt, Homo Sapiens; identical to SEQ ID NO: 41922

SEQ ID NO: 232050 - RNA, 64 nt, Homo Sapiens; identical to SEQ ID NO: 41923

SEQ ID NO: 232051 - RNA, 64 nt, Homo Sapiens; identical to SEQ ID NO: 41924

SEQ ID NO: 232052 - RNA, 64 nt, Homo Sapiens; identical to SEQ ID NO: 41925

SEQ ID NO: 232053 - RNA, 64 nt, Homo Sapiens; identical to SEQ ID NO: 41926

SEQ ID NO: 232054 - RNA, 64 nt, Homo Sapiens; identical to SEQ ID NO: 41927

SEQ ID NO: 232055 - RNA, 64 nt, Homo Sapiens; identical to SEQ ID NO: 41928

SEQ ID NO: 232056 - RNA, 64 nt, Homo Sapiens; identical to SEQ ID NO: 41929

SEQ ID NO: 232057 - RNA, 64 nt, Homo Sapiens; identical to SEQ ID NO: 41930

SEQ ID NO: 232058 - RNA, 64 nt, Homo Sapiens; identical to SEQ ID NO: 41931

SEQ ID NO: 232059 - RNA, 64 nt, Homo Sapiens; identical to SEQ ID NO: 41932

SEQ ID NO: 232060 - RNA, 64 nt, Homo Sapiens; identical to SEQ ID NO: 41933

SEQ ID NO: 232061 - RNA, 64 nt, Homo Sapiens; identical to SEQ ID NO: 41934

SEQ ID NO: 232062 - RNA, 64 nt, Homo Sapiens; identical to SEQ ID NO: 41935

SEQ ID NO: 232063 - RNA, 64 nt, Homo Sapiens; identical to SEQ ID NO: 41936

SEQ ID NO: 232064 - RNA, 64 nt, Homo Sapiens; identical to SEQ ID NO: 41937

SEQ ID NO: 232065 - RNA, 64 nt, Homo Sapiens; identical to SEQ ID NO: 41938

SEQ ID NO: 232066 - RNA, 64 nt, Homo Sapiens; identical to SEQ ID NO: 41939

SEQ ID NO: 232067 - RNA, 64 nt, Homo Sapiens; identical to SEQ ID NO: 41940

SEQ ID NO: 232068 - RNA, 64 nt, Homo Sapiens; identical to SEQ ID NO: 41941

SEQ ID NO: 232069 - RNA, 64 nt, Homo Sapiens; identical to SEQ ID NO: 41942

SEQ ID NO: 232070 - RNA, 64 nt, Homo Sapiens; identical to SEQ ID NO: 41943

SEQ ID NO: 232071 - RNA, 64 nt, Homo Sapiens; identical to SEQ ID NO: 41944

SEQ ID NO: 232072 - RNA, 64 nt, Homo Sapiens; identical to SEQ ID NO: 41945

SEQ ID NO: 232073 - RNA, 64 nt, Homo Sapiens; identical to SEQ ID NO: 41946

SEQ ID NO: 232074 - RNA, 64 nt, Homo Sapiens; identical to SEQ ID NO: 41947

SEQ ID NO: 232075 - RNA, 64 nt, Homo Sapiens; identical to SEQ ID NO: 41948

SEQ ID NO: 232076 - RNA, 64 nt, Homo Sapiens; identical to SEQ ID NO: 41949

SEQ ID NO: 232077 - RNA, 64 nt, Homo Sapiens; identical to SEQ ID NO: 41950

SEQ ID NO: 232078 - RNA, 64 nt, Homo Sapiens; identical to SEQ ID NO: 41951

SEQ ID NO: 232079 - RNA, 64 nt, Homo Sapiens; identical to SEQ ID NO: 41952

SEQ ID NO: 232080 - RNA, 64 nt, Homo Sapiens; identical to SEQ ID NO: 41953

SEQ ID NO: 232081 - RNA, 64 nt, Homo Sapiens; identical to SEQ ID NO: 41954

SEQ ID NO: 232082 - RNA, 64 nt, Homo Sapiens; identical to SEQ ID NO: 41955

SEQ ID NO: 232083 - RNA, 64 nt, Homo Sapiens; identical to SEQ ID NO: 41956

SEQ ID NO: 232084 - RNA, 64 nt, Homo Sapiens; identical to SEQ ID NO: 41957

SEQ ID NO: 232085 - RNA, 64 nt, Homo Sapiens; identical to SEQ ID NO: 41958

SEQ ID NO: 232086 - RNA, 64 nt, Homo Sapiens; identical to SEQ ID NO: 41959

SEQ ID NO: 232087 - RNA, 64 nt, Homo Sapiens; identical to SEQ ID NO: 41960

SEQ ID NO: 232088 - RNA, 64 nt, Homo Sapiens; identical to SEQ ID NO: 41961

SEQ ID NO: 232089 - RNA, 64 nt, Homo Sapiens; identical to SEQ ID NO: 41962

SEQ ID NO: 232090 - RNA, 64 nt, Homo Sapiens; identical to SEQ ID NO: 41963

SEQ ID NO: 232091 - RNA, 64 nt, Homo Sapiens; identical to SEQ ID NO: 41964

SEQ ID NO: 232092 - RNA, 64 nt, Homo Sapiens; identical to SEQ ID NO: 41965

SEQ ID NO: 232093 - RNA, 64 nt, Homo Sapiens; identical to SEQ ID NO: 41966

SEQ ID NO: 232094 - RNA, 64 nt, Homo Sapiens; identical to SEQ ID NO: 41967

SEQ ID NO: 232095 - RNA, 64 nt, Homo Sapiens; identical to SEQ ID NO: 41968

SEQ ID NO: 232096 - RNA, 64 nt, Homo Sapiens; identical to SEQ ID NO: 41969

SEQ ID NO: 232097 - RNA, 64 nt, Homo Sapiens; identical to SEQ ID NO: 41970

SEQ ID NO: 232098 - RNA, 64 nt, Homo Sapiens; identical to SEQ ID NO: 41971

SEQ ID NO: 232099 - RNA, 64 nt, Homo Sapiens; identical to SEQ ID NO: 41972

SEQ ID NO: 232100 - RNA, 64 nt, Homo Sapiens; identical to SEQ ID NO: 41973

SEQ ID NO: 232101 - RNA, 64 nt, Homo Sapiens; identical to SEQ ID NO: 41974

SEQ ID NO: 232102 - RNA, 64 nt, Homo Sapiens; identical to SEQ ID NO: 41975

SEQ ID NO: 232103 - RNA, 64 nt, Homo Sapiens; identical to SEQ ID NO: 41976

SEQ ID NO: 232104 - RNA, 64 nt, Homo Sapiens; identical to SEQ ID NO: 41977

SEQ ID NO: 232105 - RNA, 64 nt, Homo Sapiens; identical to SEQ ID NO: 41978

SEQ ID NO: 232106 - RNA, 64 nt, Homo Sapiens; identical to SEQ ID NO: 41979

SEQ ID NO: 232107 - RNA, 64 nt, Homo Sapiens; identical to SEQ ID NO: 41980

SEQ ID NO: 232108 - RNA, 64 nt, Homo Sapiens; identical to SEQ ID NO: 41981

SEQ ID NO: 232109 - RNA, 64 nt, Homo Sapiens; identical to SEQ ID NO: 41982

SEQ ID NO: 232110 - RNA, 64 nt, Homo Sapiens; identical to SEQ ID NO: 41983

SEQ ID NO: 232111 - RNA, 64 nt, Homo Sapiens; identical to SEQ ID NO: 41984

SEQ ID NO: 232112 - RNA, 64 nt, Homo Sapiens; identical to SEQ ID NO: 41985

SEQ ID NO: 232113 - RNA, 64 nt, Homo Sapiens; identical to SEQ ID NO: 41986

SEQ ID NO: 232114 - RNA, 64 nt, Homo Sapiens; identical to SEQ ID NO: 41987

SEQ ID NO: 232115 - RNA, 64 nt, Homo Sapiens; identical to SEQ ID NO: 41988

SEQ ID NO: 232116 - RNA, 64 nt, Homo Sapiens; identical to SEQ ID NO: 41989

SEQ ID NO: 232117 - RNA, 64 nt, Homo Sapiens; identical to SEQ ID NO: 41990

SEQ ID NO: 232118 - RNA, 64 nt, Homo Sapiens; identical to SEQ ID NO: 41991

SEQ ID NO: 232119 - RNA, 64 nt, Homo Sapiens; identical to SEQ ID NO: 41992

SEQ ID NO: 232120 - RNA, 64 nt, Homo Sapiens; identical to SEQ ID NO: 41993

SEQ ID NO: 232121 - RNA, 64 nt, Homo Sapiens; identical to SEQ ID NO: 41994

SEQ ID NO: 232122 - RNA, 64 nt, Homo Sapiens; identical to SEQ ID NO: 41995

SEQ ID NO: 232123 - RNA, 64 nt, Homo Sapiens; identical to SEQ ID NO: 41996

SEQ ID NO: 232124 - RNA, 64 nt, Homo Sapiens; identical to SEQ ID NO: 41997

SEQ ID NO: 232125 - RNA, 64 nt, Homo Sapiens; identical to SEQ ID NO: 41998

SEQ ID NO: 232126 - RNA, 64 nt, Homo Sapiens; identical to SEQ ID NO: 41999

SEQ ID NO: 232127 - RNA, 64 nt, Homo Sapiens; identical to SEQ ID NO: 42000

SEQ ID NO: 232128 - RNA, 64 nt, Homo Sapiens; identical to SEQ ID NO: 42001

SEQ ID NO: 232129 - RNA, 64 nt, Homo Sapiens; identical to SEQ ID NO: 42002

SEQ ID NO: 232130 - RNA, 64 nt, Homo Sapiens; identical to SEQ ID NO: 42003

SEQ ID NO: 232131 - RNA, 64 nt, Homo Sapiens; identical to SEQ ID NO: 42004

SEQ ID NO: 232132 - RNA, 64 nt, Homo Sapiens; identical to SEQ ID NO: 42005

SEQ ID NO: 232133 - RNA, 64 nt, Homo Sapiens; identical to SEQ ID NO: 42006

SEQ ID NO: 232134 - RNA, 64 nt, Homo Sapiens; identical to SEQ ID NO: 42007

SEQ ID NO: 232135 - RNA, 64 nt, Homo Sapiens; identical to SEQ ID NO: 42008

SEQ ID NO: 232136 - RNA, 64 nt, Homo Sapiens; identical to SEQ ID NO: 42009

SEQ ID NO: 232137 - RNA, 64 nt, Homo Sapiens; identical to SEQ ID NO: 42010

SEQ ID NO: 232138 - RNA, 64 nt, Homo Sapiens; identical to SEQ ID NO: 42011

SEQ ID NO: 232139 - RNA, 64 nt, Homo Sapiens; identical to SEQ ID NO: 42012

SEQ ID NO: 232140 - RNA, 64 nt, Homo Sapiens; identical to SEQ ID NO: 42013

SEQ ID NO: 232141 - RNA, 64 nt, Homo Sapiens; identical to SEQ ID NO: 42014

SEQ ID NO: 232142 - RNA, 64 nt, Homo Sapiens; identical to SEQ ID NO: 42015

SEQ ID NO: 232143 - RNA, 64 nt, Homo Sapiens; identical to SEQ ID NO: 42016

SEQ ID NO: 232144 - RNA, 64 nt, Homo Sapiens; identical to SEQ ID NO: 42017

SEQ ID NO: 232145 - RNA, 64 nt, Homo Sapiens; identical to SEQ ID NO: 42018

SEQ ID NO: 232146 - RNA, 64 nt, Homo Sapiens; identical to SEQ ID NO: 42019

SEQ ID NO: 232147 - RNA, 64 nt, Homo Sapiens; identical to SEQ ID NO: 42020

SEQ ID NO: 232148 - RNA, 64 nt, Homo Sapiens; identical to SEQ ID NO: 42021

SEQ ID NO: 232149 - RNA, 64 nt, Homo Sapiens; identical to SEQ ID NO: 42022

SEQ ID NO: 232150 - RNA, 64 nt, Homo Sapiens; identical to SEQ ID NO: 42023

SEQ ID NO: 232151 - RNA, 64 nt, Homo Sapiens; identical to SEQ ID NO: 42024

SEQ ID NO: 232152 - RNA, 64 nt, Homo Sapiens; identical to SEQ ID NO: 42025

SEQ ID NO: 232153 - RNA, 64 nt, Homo Sapiens; identical to SEQ ID NO: 42026

SEQ ID NO: 232154 - RNA, 64 nt, Homo Sapiens; identical to SEQ ID NO: 42027

SEQ ID NO: 232155 - RNA, 64 nt, Homo Sapiens; identical to SEQ ID NO: 42028

SEQ ID NO: 232156 - RNA, 64 nt, Homo Sapiens; identical to SEQ ID NO: 42029

SEQ ID NO: 232157 - RNA, 64 nt, Homo Sapiens; identical to SEQ ID NO: 42030

SEQ ID NO: 232158 - RNA, 64 nt, Homo Sapiens; identical to SEQ ID NO: 42031

SEQ ID NO: 232159 - RNA, 64 nt, Homo Sapiens; identical to SEQ ID NO: 42032

SEQ ID NO: 232160 - RNA, 64 nt, Homo Sapiens; identical to SEQ ID NO: 42033

SEQ ID NO: 232161 - RNA, 64 nt, Homo Sapiens; identical to SEQ ID NO: 42034

SEQ ID NO: 232162 - RNA, 64 nt, Homo Sapiens; identical to SEQ ID NO: 42035

SEQ ID NO: 232163 - RNA, 64 nt, Homo Sapiens; identical to SEQ ID NO: 42036

SEQ ID NO: 232164 - RNA, 64 nt, Homo Sapiens; identical to SEQ ID NO: 42037

SEQ ID NO: 232165 - RNA, 64 nt, Homo Sapiens; identical to SEQ ID NO: 42038

SEQ ID NO: 232166 - RNA, 64 nt, Homo Sapiens; identical to SEQ ID NO: 42039

SEQ ID NO: 232167 - RNA, 64 nt, Homo Sapiens; identical to SEQ ID NO: 42040

SEQ ID NO: 232168 - RNA, 64 nt, Homo Sapiens; identical to SEQ ID NO: 42041

SEQ ID NO: 232169 - RNA, 64 nt, Homo Sapiens; identical to SEQ ID NO: 42042

SEQ ID NO: 232170 - RNA, 64 nt, Homo Sapiens; identical to SEQ ID NO: 42043

SEQ ID NO: 232171 - RNA, 64 nt, Homo Sapiens; identical to SEQ ID NO: 42044

SEQ ID NO: 232172 - RNA, 64 nt, Homo Sapiens; identical to SEQ ID NO: 42045

SEQ ID NO: 232173 - RNA, 64 nt, Homo Sapiens; identical to SEQ ID NO: 42046

SEQ ID NO: 232174 - RNA, 64 nt, Homo Sapiens; identical to SEQ ID NO: 42047

SEQ ID NO: 232175 - RNA, 64 nt, Homo Sapiens; identical to SEQ ID NO: 42048

SEQ ID NO: 232176 - RNA, 64 nt, Homo Sapiens; identical to SEQ ID NO: 42049

SEQ ID NO: 232177 - RNA, 64 nt, Homo Sapiens; identical to SEQ ID NO: 42050

SEQ ID NO: 232178 - RNA, 64 nt, Homo Sapiens; identical to SEQ ID NO: 42051

SEQ ID NO: 232179 - RNA, 64 nt, Homo Sapiens; identical to SEQ ID NO: 42052

SEQ ID NO: 232180 - RNA, 64 nt, Homo Sapiens; identical to SEQ ID NO: 42053

SEQ ID NO: 232181 - RNA, 64 nt, Homo Sapiens; identical to SEQ ID NO: 42054

SEQ ID NO: 232182 - RNA, 64 nt, Homo Sapiens; identical to SEQ ID NO: 42055

SEQ ID NO: 232183 - RNA, 64 nt, Homo Sapiens; identical to SEQ ID NO: 42056

SEQ ID NO: 232184 - RNA, 64 nt, Homo Sapiens; identical to SEQ ID NO: 42057

SEQ ID NO: 232185 - RNA, 64 nt, Homo Sapiens; identical to SEQ ID NO: 42058

SEQ ID NO: 232186 - RNA, 64 nt, Homo Sapiens; identical to SEQ ID NO: 42059

SEQ ID NO: 232187 - RNA, 64 nt, Homo Sapiens; identical to SEQ ID NO: 42060

SEQ ID NO: 232188 - RNA, 64 nt, Homo Sapiens; identical to SEQ ID NO: 42061

SEQ ID NO: 232189 - RNA, 64 nt, Homo Sapiens; identical to SEQ ID NO: 42062

SEQ ID NO: 232190 - RNA, 64 nt, Homo Sapiens; identical to SEQ ID NO: 42063

SEQ ID NO: 232191 - RNA, 64 nt, Homo Sapiens; identical to SEQ ID NO: 42064

SEQ ID NO: 232192 - RNA, 64 nt, Homo Sapiens; identical to SEQ ID NO: 42065

SEQ ID NO: 232193 - RNA, 64 nt, Homo Sapiens; identical to SEQ ID NO: 42066

SEQ ID NO: 232194 - RNA, 64 nt, Homo Sapiens; identical to SEQ ID NO: 42067

SEQ ID NO: 232195 - RNA, 64 nt, Homo Sapiens; identical to SEQ ID NO: 42068

SEQ ID NO: 232196 - RNA, 64 nt, Homo Sapiens; identical to SEQ ID NO: 42069

SEQ ID NO: 232197 - RNA, 64 nt, Homo Sapiens; identical to SEQ ID NO: 42070

SEQ ID NO: 232198 - RNA, 64 nt, Homo Sapiens; identical to SEQ ID NO: 42071

SEQ ID NO: 232199 - RNA, 64 nt, Homo Sapiens; identical to SEQ ID NO: 42072

SEQ ID NO: 232200 - RNA, 64 nt, Homo Sapiens; identical to SEQ ID NO: 42073

SEQ ID NO: 232201 - RNA, 64 nt, Homo Sapiens; identical to SEQ ID NO: 42074

SEQ ID NO: 232202 - RNA, 64 nt, Homo Sapiens; identical to SEQ ID NO: 42075

SEQ ID NO: 232203 - RNA, 64 nt, Homo Sapiens; identical to SEQ ID NO: 42076

SEQ ID NO: 232204 - RNA, 64 nt, Homo Sapiens; identical to SEQ ID NO: 42077

SEQ ID NO: 232205 - RNA, 64 nt, Homo Sapiens; identical to SEQ ID NO: 42078

SEQ ID NO: 232206 - RNA, 64 nt, Homo Sapiens; identical to SEQ ID NO: 42079

SEQ ID NO: 232207 - RNA, 64 nt, Homo Sapiens; identical to SEQ ID NO: 42080

SEQ ID NO: 232208 - RNA, 64 nt, Homo Sapiens; identical to SEQ ID NO: 42081

SEQ ID NO: 232209 - RNA, 64 nt, Homo Sapiens; identical to SEQ ID NO: 42082

SEQ ID NO: 232210 - RNA, 64 nt, Homo Sapiens; identical to SEQ ID NO: 42083

SEQ ID NO: 232211 - RNA, 64 nt, Homo Sapiens; identical to SEQ ID NO: 42084

SEQ ID NO: 232212 - RNA, 64 nt, Homo Sapiens; identical to SEQ ID NO: 42085

SEQ ID NO: 232213 - RNA, 64 nt, Homo Sapiens; identical to SEQ ID NO: 42086

SEQ ID NO: 232214 - RNA, 64 nt, Homo Sapiens; identical to SEQ ID NO: 42087

SEQ ID NO: 232215 - RNA, 64 nt, Homo Sapiens; identical to SEQ ID NO: 42088

SEQ ID NO: 232216 - RNA, 64 nt, Homo Sapiens; identical to SEQ ID NO: 42089

SEQ ID NO: 232217 - RNA, 64 nt, Homo Sapiens; identical to SEQ ID NO: 42090

SEQ ID NO: 232218 - RNA, 64 nt, Homo Sapiens; identical to SEQ ID NO: 42091

SEQ ID NO: 232219 - RNA, 64 nt, Homo Sapiens; identical to SEQ ID NO: 42092

SEQ ID NO: 232220 - RNA, 64 nt, Homo Sapiens; identical to SEQ ID NO: 42093

SEQ ID NO: 232221 - RNA, 64 nt, Homo Sapiens; identical to SEQ ID NO: 42094

SEQ ID NO: 232222 - RNA, 64 nt, Homo Sapiens; identical to SEQ ID NO: 42095

SEQ ID NO: 232223 - RNA, 64 nt, Homo Sapiens; identical to SEQ ID NO: 42096

SEQ ID NO: 232224 - RNA, 64 nt, Homo Sapiens; identical to SEQ ID NO: 42097

SEQ ID NO: 232225 - RNA, 64 nt, Homo Sapiens; identical to SEQ ID NO: 42098

SEQ ID NO: 232226 - RNA, 64 nt, Homo Sapiens; identical to SEQ ID NO: 42099

SEQ ID NO: 232227 - RNA, 64 nt, Homo Sapiens; identical to SEQ ID NO: 42100

SEQ ID NO: 232228 - RNA, 64 nt, Homo Sapiens; identical to SEQ ID NO: 42101

SEQ ID NO: 232229 - RNA, 64 nt, Homo Sapiens; identical to SEQ ID NO: 42102

SEQ ID NO: 232230 - RNA, 64 nt, Homo Sapiens; identical to SEQ ID NO: 42103

SEQ ID NO: 232231 - RNA, 64 nt, Homo Sapiens; identical to SEQ ID NO: 42104

SEQ ID NO: 232232 - RNA, 64 nt, Homo Sapiens; identical to SEQ ID NO: 42105

SEQ ID NO: 232233 - RNA, 64 nt, Homo Sapiens; identical to SEQ ID NO: 42106

SEQ ID NO: 232234 - RNA, 64 nt, Homo Sapiens; identical to SEQ ID NO: 42107

SEQ ID NO: 232235 - RNA, 64 nt, Homo Sapiens; identical to SEQ ID NO: 42108

SEQ ID NO: 232236 - RNA, 64 nt, Homo Sapiens; identical to SEQ ID NO: 42109

SEQ ID NO: 232237 - RNA, 64 nt, Homo Sapiens; identical to SEQ ID NO: 42110

SEQ ID NO: 232238 - RNA, 64 nt, Homo Sapiens; identical to SEQ ID NO: 42111

SEQ ID NO: 232239 - RNA, 64 nt, Homo Sapiens; identical to SEQ ID NO: 42112

SEQ ID NO: 232240 - RNA, 64 nt, Homo Sapiens; identical to SEQ ID NO: 42113

SEQ ID NO: 232241 - RNA, 64 nt, Homo Sapiens; identical to SEQ ID NO: 42114

SEQ ID NO: 232242 - RNA, 64 nt, Homo Sapiens; identical to SEQ ID NO: 42115

SEQ ID NO: 232243 - RNA, 64 nt, Homo Sapiens; identical to SEQ ID NO: 42116

SEQ ID NO: 232244 - RNA, 64 nt, Homo Sapiens; identical to SEQ ID NO: 42117

SEQ ID NO: 232245 - RNA, 64 nt, Homo Sapiens; identical to SEQ ID NO: 42118

SEQ ID NO: 232246 - RNA, 64 nt, Homo Sapiens; identical to SEQ ID NO: 42119

SEQ ID NO: 232247 - RNA, 64 nt, Homo Sapiens; identical to SEQ ID NO: 42120

SEQ ID NO: 232248 - RNA, 64 nt, Homo Sapiens; identical to SEQ ID NO: 42121

SEQ ID NO: 232249 - RNA, 64 nt, Homo Sapiens; identical to SEQ ID NO: 42122

SEQ ID NO: 232250 - RNA, 64 nt, Homo Sapiens; identical to SEQ ID NO: 42123

SEQ ID NO: 232251 - RNA, 64 nt, Homo Sapiens; identical to SEQ ID NO: 42124

SEQ ID NO: 232252 - RNA, 64 nt, Homo Sapiens; identical to SEQ ID NO: 42125

SEQ ID NO: 232253 - RNA, 64 nt, Homo Sapiens; identical to SEQ ID NO: 42126

SEQ ID NO: 232254 - RNA, 64 nt, Homo Sapiens; identical to SEQ ID NO: 42127

SEQ ID NO: 232255 - RNA, 64 nt, Homo Sapiens; identical to SEQ ID NO: 42128

SEQ ID NO: 232256 - RNA, 64 nt, Homo Sapiens; identical to SEQ ID NO: 42129

SEQ ID NO: 232257 - RNA, 64 nt, Homo Sapiens; identical to SEQ ID NO: 42130

SEQ ID NO: 232258 - RNA, 64 nt, Homo Sapiens; identical to SEQ ID NO: 42131

SEQ ID NO: 232259 - RNA, 64 nt, Homo Sapiens; identical to SEQ ID NO: 42132

SEQ ID NO: 232260 - RNA, 64 nt, Homo Sapiens; identical to SEQ ID NO: 42133

SEQ ID NO: 232261 - RNA, 64 nt, Homo Sapiens; identical to SEQ ID NO: 42134

SEQ ID NO: 232262 - RNA, 64 nt, Homo Sapiens; identical to SEQ ID NO: 42135

SEQ ID NO: 232263 - RNA, 64 nt, Homo Sapiens; identical to SEQ ID NO: 42136

SEQ ID NO: 232264 - RNA, 64 nt, Homo Sapiens; identical to SEQ ID NO: 42137

SEQ ID NO: 232265 - RNA, 64 nt, Homo Sapiens; identical to SEQ ID NO: 42138

SEQ ID NO: 232266 - RNA, 64 nt, Homo Sapiens; identical to SEQ ID NO: 42139

SEQ ID NO: 232267 - RNA, 64 nt, Homo Sapiens; identical to SEQ ID NO: 42140

SEQ ID NO: 232268 - RNA, 64 nt, Homo Sapiens; identical to SEQ ID NO: 42141

SEQ ID NO: 232269 - RNA, 64 nt, Homo Sapiens; identical to SEQ ID NO: 42142

SEQ ID NO: 232270 - RNA, 64 nt, Homo Sapiens; identical to SEQ ID NO: 42143

SEQ ID NO: 232271 - RNA, 64 nt, Homo Sapiens; identical to SEQ ID NO: 42144

SEQ ID NO: 232272 - RNA, 64 nt, Homo Sapiens; identical to SEQ ID NO: 42145

SEQ ID NO: 232273 - RNA, 64 nt, Homo Sapiens; identical to SEQ ID NO: 42146

SEQ ID NO: 232274 - RNA, 64 nt, Homo Sapiens; identical to SEQ ID NO: 42147

SEQ ID NO: 232275 - RNA, 64 nt, Homo Sapiens; identical to SEQ ID NO: 42148

SEQ ID NO: 232276 - RNA, 64 nt, Homo Sapiens; identical to SEQ ID NO: 42149

SEQ ID NO: 232277 - RNA, 64 nt, Homo Sapiens; identical to SEQ ID NO: 42150

SEQ ID NO: 232278 - RNA, 64 nt, Homo Sapiens; identical to SEQ ID NO: 42151

SEQ ID NO: 232279 - RNA, 64 nt, Homo Sapiens; identical to SEQ ID NO: 42152

SEQ ID NO: 232280 - RNA, 64 nt, Homo Sapiens; identical to SEQ ID NO: 42153

SEQ ID NO: 232281 - RNA, 64 nt, Homo Sapiens; identical to SEQ ID NO: 42154

SEQ ID NO: 232282 - RNA, 64 nt, Homo Sapiens; identical to SEQ ID NO: 42155

SEQ ID NO: 232283 - RNA, 64 nt, Homo Sapiens; identical to SEQ ID NO: 42156

SEQ ID NO: 232284 - RNA, 64 nt, Homo Sapiens; identical to SEQ ID NO: 42157

SEQ ID NO: 232285 - RNA, 64 nt, Homo Sapiens; identical to SEQ ID NO: 42158

SEQ ID NO: 232286 - RNA, 64 nt, Homo Sapiens; identical to SEQ ID NO: 42159

SEQ ID NO: 232287 - RNA, 64 nt, Homo Sapiens; identical to SEQ ID NO: 42160

SEQ ID NO: 232288 - RNA, 64 nt, Homo Sapiens; identical to SEQ ID NO: 42161

SEQ ID NO: 232289 - RNA, 64 nt, Homo Sapiens; identical to SEQ ID NO: 42162

SEQ ID NO: 232290 - RNA, 64 nt, Homo Sapiens; identical to SEQ ID NO: 42163

SEQ ID NO: 232291 - RNA, 64 nt, Homo Sapiens; identical to SEQ ID NO: 42164

SEQ ID NO: 232292 - RNA, 64 nt, Homo Sapiens; identical to SEQ ID NO: 42165

SEQ ID NO: 232293 - RNA, 64 nt, Homo Sapiens; identical to SEQ ID NO: 42166

SEQ ID NO: 232294 - RNA, 64 nt, Homo Sapiens; identical to SEQ ID NO: 42167

SEQ ID NO: 232295 - RNA, 64 nt, Homo Sapiens; identical to SEQ ID NO: 42168

SEQ ID NO: 232296 - RNA, 64 nt, Homo Sapiens; identical to SEQ ID NO: 42169

SEQ ID NO: 232297 - RNA, 64 nt, Homo Sapiens; identical to SEQ ID NO: 42170

SEQ ID NO: 232298 - RNA, 64 nt, Homo Sapiens; identical to SEQ ID NO: 42171

SEQ ID NO: 232299 - RNA, 64 nt, Homo Sapiens; identical to SEQ ID NO: 42172

SEQ ID NO: 232300 - RNA, 64 nt, Homo Sapiens; identical to SEQ ID NO: 42173

SEQ ID NO: 232301 - RNA, 64 nt, Homo Sapiens; identical to SEQ ID NO: 42174

SEQ ID NO: 232302 - RNA, 64 nt, Homo Sapiens; identical to SEQ ID NO: 42175

SEQ ID NO: 232303 - RNA, 64 nt, Homo Sapiens; identical to SEQ ID NO: 42176

SEQ ID NO: 232304 - RNA, 64 nt, Homo Sapiens; identical to SEQ ID NO: 42177

SEQ ID NO: 232305 - RNA, 64 nt, Homo Sapiens; identical to SEQ ID NO: 42178

SEQ ID NO: 232306 - RNA, 64 nt, Homo Sapiens; identical to SEQ ID NO: 42179

SEQ ID NO: 232307 - RNA, 64 nt, Homo Sapiens; identical to SEQ ID NO: 42180

SEQ ID NO: 232308 - RNA, 64 nt, Homo Sapiens; identical to SEQ ID NO: 42181

SEQ ID NO: 232309 - RNA, 64 nt, Homo Sapiens; identical to SEQ ID NO: 42182

SEQ ID NO: 232310 - RNA, 64 nt, Homo Sapiens; identical to SEQ ID NO: 42183

SEQ ID NO: 232311 - RNA, 64 nt, Homo Sapiens; identical to SEQ ID NO: 42184

SEQ ID NO: 232312 - RNA, 64 nt, Homo Sapiens; identical to SEQ ID NO: 42185

SEQ ID NO: 232313 - RNA, 64 nt, Homo Sapiens; identical to SEQ ID NO: 42186

SEQ ID NO: 232314 - RNA, 64 nt, Homo Sapiens; identical to SEQ ID NO: 42187

SEQ ID NO: 232315 - RNA, 64 nt, Homo Sapiens; identical to SEQ ID NO: 42188

SEQ ID NO: 232316 - RNA, 64 nt, Homo Sapiens; identical to SEQ ID NO: 42189

SEQ ID NO: 232317 - RNA, 64 nt, Homo Sapiens; identical to SEQ ID NO: 42190

SEQ ID NO: 232318 - RNA, 64 nt, Homo Sapiens; identical to SEQ ID NO: 42191

SEQ ID NO: 232319 - RNA, 64 nt, Homo Sapiens; identical to SEQ ID NO: 42192

SEQ ID NO: 232320 - RNA, 64 nt, Homo Sapiens; identical to SEQ ID NO: 42193

SEQ ID NO: 232321 - RNA, 64 nt, Homo Sapiens; identical to SEQ ID NO: 42194

SEQ ID NO: 232322 - RNA, 64 nt, Homo Sapiens; identical to SEQ ID NO: 42195

SEQ ID NO: 232323 - RNA, 64 nt, Homo Sapiens; identical to SEQ ID NO: 42196

SEQ ID NO: 232324 - RNA, 64 nt, Homo Sapiens; identical to SEQ ID NO: 42197

SEQ ID NO: 232325 - RNA, 64 nt, Homo Sapiens; identical to SEQ ID NO: 42198

SEQ ID NO: 232326 - RNA, 64 nt, Homo Sapiens; identical to SEQ ID NO: 42199

SEQ ID NO: 232327 - RNA, 64 nt, Homo Sapiens; identical to SEQ ID NO: 42200

SEQ ID NO: 232328 - RNA, 64 nt, Homo Sapiens; identical to SEQ ID NO: 42201

SEQ ID NO: 232329 - RNA, 64 nt, Homo Sapiens; identical to SEQ ID NO: 42202

SEQ ID NO: 232330 - RNA, 64 nt, Homo Sapiens; identical to SEQ ID NO: 42203

SEQ ID NO: 232331 - RNA, 64 nt, Homo Sapiens; identical to SEQ ID NO: 42204

SEQ ID NO: 232332 - RNA, 64 nt, Homo Sapiens; identical to SEQ ID NO: 42205

SEQ ID NO: 232333 - RNA, 64 nt, Homo Sapiens; identical to SEQ ID NO: 42206

SEQ ID NO: 232334 - RNA, 64 nt, Homo Sapiens; identical to SEQ ID NO: 42207

SEQ ID NO: 232335 - RNA, 64 nt, Homo Sapiens; identical to SEQ ID NO: 42208

SEQ ID NO: 232336 - RNA, 64 nt, Homo Sapiens; identical to SEQ ID NO: 42209

SEQ ID NO: 232337 - RNA, 64 nt, Homo Sapiens; identical to SEQ ID NO: 42210

SEQ ID NO: 232338 - RNA, 64 nt, Homo Sapiens; identical to SEQ ID NO: 42211

SEQ ID NO: 232339 - RNA, 64 nt, Homo Sapiens; identical to SEQ ID NO: 42212

SEQ ID NO: 232340 - RNA, 64 nt, Homo Sapiens; identical to SEQ ID NO: 42213

SEQ ID NO: 232341 - RNA, 64 nt, Homo Sapiens; identical to SEQ ID NO: 42214

SEQ ID NO: 232342 - RNA, 64 nt, Homo Sapiens; identical to SEQ ID NO: 42215

SEQ ID NO: 232343 - RNA, 64 nt, Homo Sapiens; identical to SEQ ID NO: 42216

SEQ ID NO: 232344 - RNA, 64 nt, Homo Sapiens; identical to SEQ ID NO: 42217

SEQ ID NO: 232345 - RNA, 64 nt, Homo Sapiens; identical to SEQ ID NO: 42218

SEQ ID NO: 232346 - RNA, 64 nt, Homo Sapiens; identical to SEQ ID NO: 42219

SEQ ID NO: 232347 - RNA, 64 nt, Homo Sapiens; identical to SEQ ID NO: 42220

SEQ ID NO: 232348 - RNA, 64 nt, Homo Sapiens; identical to SEQ ID NO: 42221

SEQ ID NO: 232349 - RNA, 64 nt, Homo Sapiens; identical to SEQ ID NO: 42222

SEQ ID NO: 232350 - RNA, 64 nt, Homo Sapiens; identical to SEQ ID NO: 42223

SEQ ID NO: 232351 - RNA, 64 nt, Homo Sapiens; identical to SEQ ID NO: 42224

SEQ ID NO: 232352 - RNA, 64 nt, Homo Sapiens; identical to SEQ ID NO: 42225

SEQ ID NO: 232353 - RNA, 64 nt, Homo Sapiens; identical to SEQ ID NO: 42226

SEQ ID NO: 232354 - RNA, 64 nt, Homo Sapiens; identical to SEQ ID NO: 42227

SEQ ID NO: 232355 - RNA, 64 nt, Homo Sapiens; identical to SEQ ID NO: 42228

SEQ ID NO: 232356 - RNA, 64 nt, Homo Sapiens; identical to SEQ ID NO: 42229

SEQ ID NO: 232357 - RNA, 64 nt, Homo Sapiens; identical to SEQ ID NO: 42230

SEQ ID NO: 232358 - RNA, 64 nt, Homo Sapiens; identical to SEQ ID NO: 42231

SEQ ID NO: 232359 - RNA, 64 nt, Homo Sapiens; identical to SEQ ID NO: 42232

SEQ ID NO: 232360 - RNA, 64 nt, Homo Sapiens; identical to SEQ ID NO: 42233

SEQ ID NO: 232361 - RNA, 64 nt, Homo Sapiens; identical to SEQ ID NO: 42234

SEQ ID NO: 232362 - RNA, 64 nt, Homo Sapiens; identical to SEQ ID NO: 42235

SEQ ID NO: 232363 - RNA, 64 nt, Homo Sapiens
ucuauuccugccgggaggaaccucaguuggguaagguguacauaccuguacaguuuuggucauc

SEQ ID NO: 232364 - RNA, 64 nt, Homo Sapiens
agcugauggccaguguauacagagcguggcccgcgguguacaauacccauauaagguacauugu

SEQ ID NO: 232365 - RNA, 64 nt, Homo Sapiens
gagcaagucaccuacauaacccugccuguacuaagguguacaccugucuauuguaaguuugccu

SEQ ID NO: 232366 - RNA, 64 nt, Homo Sapiens
uacaccugucuauuguaaguuugccuaggcuguugguguacagagaccagaggagagagacaca

SEQ ID NO: 232367 - RNA, 64 nt, Homo Sapiens
gggcaauauuguucuuguuuagcuacaucacuguggugaauauagauggaauuaaggaaguaaa

SEQ ID NO: 232368 - RNA, 64 nt, Homo Sapiens
ugaauuuucucuauuauauauuucccauauuucaggugaauaauuuaauuuaaaugacaaaacc

SEQ ID NO: 232369 - RNA, 64 nt, Homo Sapiens
auucucacggagagaagccccagcgagauuuuccggugaauacgggauugcacuuacucuuuca

SEQ ID NO: 232370 - RNA, 64 nt, Homo Sapiens
agaccccccgagagaagccccaacgagauuuuccggugaauacgggacugcacguacucucuca

SEQ ID NO: 232371 - RNA, 64 nt, Homo Sapiens
cuccgaguggugcauaaucuuauuuuguuugggaguaacaaaucguggaauauuuuuaaggaaa

SEQ ID NO: 232372 - RNA, 64 nt, Homo Sapiens
acauuguguacuuggugguucugucccucugccuguaacaaaucucauuuuuguuaccaagaac

SEQ ID NO: 232373 - RNA, 64 nt, Homo Sapiens
cuagaauauugacauucucuuccagucuguugcaguaacaaacuagucuguugcaguaacaaac

SEQ ID NO: 232374 - RNA, 64 nt, Homo Sapiens
ccagucuguugcaguaacaauccagucuguugcaguaacaaacuugucguuugcaguaacaaac

SEQ ID NO: 232375 - RNA, 64 nt, Homo Sapiens
ccagucuguugcaguaacaacccugucguuugcaguaacaaacucaccucgugaagaacucuuu

SEQ ID NO: 232376 - RNA, 64 nt, Homo Sapiens
gaaaacaggugagacaauguuuuuguuuccuuuuguaacaaagucacucugagcagagauuugg

SEQ ID NO: 232377 - RNA, 64 nt, Homo Sapiens
uacuggaauuauuaaaacguuaaauuaagcccaaguaacaaaaaucaaaaagaggaaaauaagu

SEQ ID NO: 232378 - RNA, 64 nt, Homo Sapiens
cuugauauaaagauuuuauuugucccuugaaaaaguaacaaaugugcauagaucaauuuguacu

SEQ ID NO: 232379 - RNA, 64 nt, Homo Sapiens
uacaauacugaaugggaaaaguaucuaauauuuuguaacaaaaagaccuucauauuaucuguuu

SEQ ID NO: 232380 - RNA, 64 nt, Homo Sapiens
guuuucacgguguauauuuuuuuucaaaaauucuguaacaaauauauuuaauguguugccauaa

SEQ ID NO: 232381 - RNA, 64 nt, Homo Sapiens
ugaugcacuggacuaacucuuguuuaccauucauguaacaaaacccagcacauuaucugcacua

SEQ ID NO: 232382 - RNA, 64 nt, Homo Sapiens
gcaccaaguuuuaauuuaaaccaucaguuucugaguaacaaagaugaaguaaauguguuuuuau

SEQ ID NO: 232383 - RNA, 64 nt, Homo Sapiens
guauuugauugauggaauuucucugauaaaucagguaacaaaauugcucagagcugagauauuu

SEQ ID NO: 232384 - RNA, 64 nt, Homo Sapiens
agcacuuccugcgcauguacacaccuuuauguauguaacaaaccguguaacaaacccccaugac

SEQ ID NO: 232385 - RNA, 64 nt, Homo Sapiens
cccaugacacaccuuuauguaugaaauaaucuguguaacaaaccacuaauggauacuuagggug

SEQ ID NO: 232386 - RNA, 64 nt, Homo Sapiens
agugaaacuccaucuccaaaaaaaaaaagaaaaaguaacaaaaggaaauuauuuguuuuugaaa

SEQ ID NO: 232387 - RNA, 64 nt, Homo Sapiens
gggucaaaguaaauguauacaguuuuauuacaauguaacaaaaguugaaaaucaggcagaugug

SEQ ID NO: 232388 - RNA, 64 nt, Homo Sapiens
uugugcauuuuaacaguaauaguaagcaauggagguaacaaauaaacauguuuuuaucacucaa

SEQ ID NO: 232389 - RNA, 64 nt, Homo Sapiens
aggucgggacauauauuuacauuuuaacauuaguguaacaaauaaccauauggcacuaauuuug

SEQ ID NO: 232390 - RNA, 59 nt, Homo Sapiens; identical to SEQ ID NO: 188365

SEQ ID NO: 232391 - RNA, 64 nt, Homo Sapiens; identical to SEQ ID NO: 188366

SEQ ID NO: 232392 - RNA, 64 nt, Homo Sapiens; identical to SEQ ID NO: 188367

SEQ ID NO: 232393 - RNA, 64 nt, Homo Sapiens; identical to SEQ ID NO: 188368

SEQ ID NO: 232394 - RNA, 64 nt, Homo Sapiens; identical to SEQ ID NO: 188369

SEQ ID NO: 232395 - RNA, 64 nt, Homo Sapiens; identical to SEQ ID NO: 188370

SEQ ID NO: 232396 - RNA, 64 nt, Homo Sapiens; identical to SEQ ID NO: 188371

SEQ ID NO: 232397 - RNA, 64 nt, Homo Sapiens; identical to SEQ ID NO: 188372

SEQ ID NO: 232398 - RNA, 64 nt, Homo Sapiens; identical to SEQ ID NO: 188373

SEQ ID NO: 232399 - RNA, 64 nt, Homo Sapiens; identical to SEQ ID NO: 188374

SEQ ID NO: 232400 - RNA, 64 nt, Homo Sapiens; identical to SEQ ID NO: 188375

SEQ ID NO: 232401 - RNA, 64 nt, Homo Sapiens; identical to SEQ ID NO: 188376

SEQ ID NO: 232402 - RNA, 64 nt, Homo Sapiens; identical to SEQ ID NO: 188377

SEQ ID NO: 232403 - RNA, 64 nt, Homo Sapiens; identical to SEQ ID NO: 188378

SEQ ID NO: 232404 - RNA, 64 nt, Homo Sapiens; identical to SEQ ID NO: 188379

SEQ ID NO: 232405 - RNA, 64 nt, Homo Sapiens; identical to SEQ ID NO: 188380

SEQ ID NO: 232406 - RNA, 64 nt, Homo Sapiens; identical to SEQ ID NO: 188381

SEQ ID NO: 232407 - RNA, 64 nt, Homo Sapiens; identical to SEQ ID NO: 188382

SEQ ID NO: 232408 - RNA, 64 nt, Homo Sapiens; identical to SEQ ID NO: 188383

SEQ ID NO: 232409 - RNA, 64 nt, Homo Sapiens; identical to SEQ ID NO: 188384

SEQ ID NO: 232410 - RNA, 64 nt, Homo Sapiens; identical to SEQ ID NO: 188385

SEQ ID NO: 232411 - RNA, 64 nt, Homo Sapiens; identical to SEQ ID NO: 188386

SEQ ID NO: 232412 - RNA, 64 nt, Homo Sapiens; identical to SEQ ID NO: 188387

SEQ ID NO: 232413 - RNA, 64 nt, Homo Sapiens; identical to SEQ ID NO: 188388

SEQ ID NO: 232414 - RNA, 64 nt, Homo Sapiens; identical to SEQ ID NO: 188389

SEQ ID NO: 232415 - RNA, 64 nt, Homo Sapiens; identical to SEQ ID NO: 188390

SEQ ID NO: 232416 - RNA, 64 nt, Homo Sapiens; identical to SEQ ID NO: 188391

SEQ ID NO: 232417 - RNA, 64 nt, Homo Sapiens; identical to SEQ ID NO: 188392

SEQ ID NO: 232418 - RNA, 64 nt, Homo Sapiens; identical to SEQ ID NO: 188393

SEQ ID NO: 232419 - RNA, 52 nt, Homo Sapiens; identical to SEQ ID NO: 188394

SEQ ID NO: 232420 - RNA, 62 nt, Homo Sapiens; identical to SEQ ID NO: 188395

SEQ ID NO: 232421 - RNA, 55 nt, Homo Sapiens; identical to SEQ ID NO: 188396

SEQ ID NO: 232422 - RNA, 64 nt, Homo Sapiens; identical to SEQ ID NO: 188397

SEQ ID NO: 232423 - RNA, 64 nt, Homo Sapiens; identical to SEQ ID NO: 188398

SEQ ID NO: 232424 - RNA, 64 nt, Homo Sapiens; identical to SEQ ID NO: 188399

SEQ ID NO: 232425 - RNA, 64 nt, Homo Sapiens; identical to SEQ ID NO: 188400

SEQ ID NO: 232426 - RNA, 64 nt, Homo Sapiens; identical to SEQ ID NO: 188401

SEQ ID NO: 232427 - RNA, 64 nt, Homo Sapiens; identical to SEQ ID NO: 188402

SEQ ID NO: 232428 - RNA, 64 nt, Homo Sapiens; identical to SEQ ID NO: 188403

SEQ ID NO: 232429 - RNA, 64 nt, Homo Sapiens; identical to SEQ ID NO: 188404

SEQ ID NO: 232430 - RNA, 64 nt, Homo Sapiens; identical to SEQ ID NO: 188405

SEQ ID NO: 232431 - RNA, 64 nt, Homo Sapiens; identical to SEQ ID NO: 188406

SEQ ID NO: 232432 - RNA, 64 nt, Homo Sapiens; identical to SEQ ID NO: 188407

SEQ ID NO: 232433 - RNA, 64 nt, Homo Sapiens; identical to SEQ ID NO: 188408

SEQ ID NO: 232434 - RNA, 64 nt, Homo Sapiens; identical to SEQ ID NO: 188409

SEQ ID NO: 232435 - RNA, 64 nt, Homo Sapiens; identical to SEQ ID NO: 188410

SEQ ID NO: 232436 - RNA, 64 nt, Homo Sapiens; identical to SEQ ID NO: 188411

SEQ ID NO: 232437 - RNA, 64 nt, Homo Sapiens; identical to SEQ ID NO: 188412

SEQ ID NO: 232438 - RNA, 64 nt, Homo Sapiens; identical to SEQ ID NO: 188413

SEQ ID NO: 232439 - RNA, 64 nt, Homo Sapiens; identical to SEQ ID NO: 188414

SEQ ID NO: 232440 - RNA, 64 nt, Homo Sapiens; identical to SEQ ID NO: 188415

SEQ ID NO: 232441 - RNA, 64 nt, Homo Sapiens; identical to SEQ ID NO: 188416

SEQ ID NO: 232442 - RNA, 64 nt, Homo Sapiens; identical to SEQ ID NO: 188417

SEQ ID NO: 232443 - RNA, 64 nt, Homo Sapiens; identical to SEQ ID NO: 188418

SEQ ID NO: 232444 - RNA, 64 nt, Homo Sapiens; identical to SEQ ID NO: 188419

SEQ ID NO: 232445 - RNA, 64 nt, Homo Sapiens; identical to SEQ ID NO: 188420

SEQ ID NO: 232446 - RNA, 64 nt, Homo Sapiens; identical to SEQ ID NO: 188421

SEQ ID NO: 232447 - RNA, 64 nt, Homo Sapiens; identical to SEQ ID NO: 188422

SEQ ID NO: 232448 - RNA, 64 nt, Homo Sapiens; identical to SEQ ID NO: 188423

SEQ ID NO: 232449 - RNA, 64 nt, Homo Sapiens; identical to SEQ ID NO: 188424

SEQ ID NO: 232450 - RNA, 64 nt, Homo Sapiens; identical to SEQ ID NO: 188425

SEQ ID NO: 232451 - RNA, 64 nt, Homo Sapiens; identical to SEQ ID NO: 188426

SEQ ID NO: 232452 - RNA, 64 nt, Homo Sapiens; identical to SEQ ID NO: 188427

SEQ ID NO: 232453 - RNA, 64 nt, Homo Sapiens; identical to SEQ ID NO: 188428

SEQ ID NO: 232454 - RNA, 64 nt, Homo Sapiens; identical to SEQ ID NO: 188429

SEQ ID NO: 232455 - RNA, 64 nt, Homo Sapiens; identical to SEQ ID NO: 188430

SEQ ID NO: 232456 - RNA, 64 nt, Homo Sapiens; identical to SEQ ID NO: 188431

SEQ ID NO: 232457 - RNA, 64 nt, Homo Sapiens; identical to SEQ ID NO: 188432

SEQ ID NO: 232458 - RNA, 64 nt, Homo Sapiens; identical to SEQ ID NO: 188433

SEQ ID NO: 232459 - RNA, 64 nt, Homo Sapiens; identical to SEQ ID NO: 188434

SEQ ID NO: 232460 - RNA, 64 nt, Homo Sapiens; identical to SEQ ID NO: 188435

SEQ ID NO: 232461 - RNA, 64 nt, Homo Sapiens; identical to SEQ ID NO: 188436

SEQ ID NO: 232462 - RNA, 64 nt, Homo Sapiens; identical to SEQ ID NO: 188437

SEQ ID NO: 232463 - RNA, 64 nt, Homo Sapiens; identical to SEQ ID NO: 188438

SEQ ID NO: 232464 - RNA, 64 nt, Homo Sapiens; identical to SEQ ID NO: 188439

SEQ ID NO: 232465 - RNA, 64 nt, Homo Sapiens; identical to SEQ ID NO: 188440

SEQ ID NO: 232466 - RNA, 64 nt, Homo Sapiens; identical to SEQ ID NO: 188441

SEQ ID NO: 232467 - RNA, 64 nt, Homo Sapiens; identical to SEQ ID NO: 188442

SEQ ID NO: 232468 - RNA, 64 nt, Homo Sapiens; identical to SEQ ID NO: 188443

SEQ ID NO: 232469 - RNA, 64 nt, Homo Sapiens; identical to SEQ ID NO: 188444

SEQ ID NO: 232470 - RNA, 64 nt, Homo Sapiens; identical to SEQ ID NO: 188445

SEQ ID NO: 232471 - RNA, 64 nt, Homo Sapiens; identical to SEQ ID NO: 188446

SEQ ID NO: 232472 - RNA, 64 nt, Homo Sapiens; identical to SEQ ID NO: 188447

SEQ ID NO: 232473 - RNA, 64 nt, Homo Sapiens; identical to SEQ ID NO: 188448

SEQ ID NO: 232474 - RNA, 64 nt, Homo Sapiens; identical to SEQ ID NO: 188449

SEQ ID NO: 232475 - RNA, 64 nt, Homo Sapiens; identical to SEQ ID NO: 188450

SEQ ID NO: 232476 - RNA, 64 nt, Homo Sapiens; identical to SEQ ID NO: 188451

SEQ ID NO: 232477 - RNA, 64 nt, Homo Sapiens; identical to SEQ ID NO: 188452

SEQ ID NO: 232478 - RNA, 64 nt, Homo Sapiens; identical to SEQ ID NO: 188453

SEQ ID NO: 232479 - RNA, 64 nt, Homo Sapiens; identical to SEQ ID NO: 188454

SEQ ID NO: 232480 - RNA, 64 nt, Homo Sapiens; identical to SEQ ID NO: 188455

SEQ ID NO: 232481 - RNA, 64 nt, Homo Sapiens; identical to SEQ ID NO: 188456

SEQ ID NO: 232482 - RNA, 64 nt, Homo Sapiens; identical to SEQ ID NO: 188457

SEQ ID NO: 232483 - RNA, 64 nt, Homo Sapiens; identical to SEQ ID NO: 188458

SEQ ID NO: 232484 - RNA, 64 nt, Homo Sapiens
guagccagagcuccucuucccagagucguguccaccaagggacacugaggcaucauuccugggc

SEQ ID NO: 232485 - RNA, 64 nt, Homo Sapiens
aagcaagaggagacauuuccuucccuugaguuggccaagggaauuggaggccccgagaagcguc

SEQ ID NO: 232486 - RNA, 64 nt, Homo Sapiens
ggcagaacugggccgccucuuucuagccauaaggccaagggaguccacaccccagcaggguguc

SEQ ID NO: 232487 - RNA, 64 nt, Homo Sapiens
cagccagcgugcaacugcccgaggggagaccuggccaagggagcaaagucacgauuccacaaug

SEQ ID NO: 232488 - RNA, 64 nt, Homo Sapiens
guucacggcuugggacuuggccaccuaugucuuuccaagggacugggcugcugagcuagaauuc

SEQ ID NO: 232489 - RNA, 64 nt, Homo Sapiens
agccacguuaggaagagagaagacacggaagaguccaagggagccugcgcaccugcucuguagc

SEQ ID NO: 232490 - RNA, 64 nt, Homo Sapiens
augccucauuuuagaaccaccaacaagcaagcucccaagggauggugcccuguucucuaccaag

SEQ ID NO: 232491 - RNA, 64 nt, Homo Sapiens
aaaucagggaauuguuuuaagucuuaucaagcagccaagggaugaaagagaagguggguuuuca

SEQ ID NO: 232492 - RNA, 64 nt, Homo Sapiens
ggugggccuggcggccugugugcugggcacugcuccaagggacagaucucugaccucugcugag

SEQ ID NO: 232493 - RNA, 64 nt, Homo Sapiens
gaagggccacccugcugcacgcaaagacucugagccaagggagggccuccuaggggaagggggu

SEQ ID NO: 232494 - RNA, 64 nt, Homo Sapiens
ugaccagcucugagccaucgcaagccacucaguuccaagggauguucugggauggcuggcccca

SEQ ID NO: 232495 - RNA, 64 nt, Homo Sapiens
ccugccugcaaaggcuguugcagcccguaggcuaccaagggacaguuaagcagcugacauaaga

SEQ ID NO: 232496 - RNA, 64 nt, Homo Sapiens
aaacgguagcuauuuccuguccugguacaugggcagugcccaaucuuuaaagugcuuaauagug

SEQ ID NO: 232497 - RNA, 64 nt, Homo Sapiens
accucgguuuccucaucuguaaacaaaugaaaucagugcccagacucacaagcugugugacuuc

SEQ ID NO: 232498 - RNA, 64 nt, Homo Sapiens
uucguucgucuccuugccugugagcacagugcccagugcccaucgggcaggaaguaggcucccc

SEQ ID NO: 232499 - RNA, 64 nt, Homo Sapiens
gcccaucuucguucgucuccgcuccccugagcacagugcccaguccccagggggcaggaaguag

SEQ ID NO: 232500 - RNA, 64 nt, Homo Sapiens
gucagaguuccguacucgggagccccuuucccugagugcccagggugucuccucugcccagagg

SEQ ID NO: 232501 - RNA, 64 nt, Homo Sapiens
ccagggcagacgggguagggcgggcucaggacccagugcccaugguuccucacuccuaccagca

SEQ ID NO: 232502 - RNA, 64 nt, Homo Sapiens
ccacccuccccucccuugcugcucugccccugccagugcccagcccagcggcucugggaagggg

SEQ ID NO: 232503 - RNA, 64 nt, Homo Sapiens
ugccagugcagguggagggcuguaggggagggccagugcccagacagggucauggggcucagac

SEQ ID NO: 232504 - RNA, 64 nt, Homo Sapiens
agagauagaugguaguuugguacuucugguucccagugcccaggaaugguccacucccaagaaa

SEQ ID NO: 232505 - RNA, 64 nt, Homo Sapiens
uugaguugucaggggccaggacuggccccacugcagugcccaggccagucuugagcagcaggga

SEQ ID NO: 232506 - RNA, 64 nt, Homo Sapiens
acucaaggacagcacuucucgcagaaggucuggaagugcccagaaugggaggcacggaagcccc

SEQ ID NO: 232507 - RNA, 64 nt, Homo Sapiens
ugagacaagugcaauuccuuccaugucgccccagagugcccaggaggcaggcagugcggggugc

SEQ ID NO: 232508 - RNA, 64 nt, Homo Sapiens
ucuguguccuuuuucaagccuguuuagaugggggagugcccaugcccucugugaagugcccaaa

SEQ ID NO: 232509 - RNA, 64 nt, Homo Sapiens
uguuuagaugggggagugcccaugcccucugugaagugcccaaaugcgaaagaauaacaccuuu

SEQ ID NO: 232510 - RNA, 64 nt, Homo Sapiens
gccaagguagggucacuaacacucuucccaccucagugcccacaugucuguagagccgcauggc

SEQ ID NO: 232511 - RNA, 64 nt, Homo Sapiens
augaagguggggccagugcuucugggagccugacagugcccagcgcacugccucuuccagggcc

SEQ ID NO: 232512 - RNA, 64 nt, Homo Sapiens
agccuuguccuaauaaaauugaaggugccacuccagugcccauccagugccucuccuggcccug

SEQ ID NO: 232513 - RNA, 64 nt, Homo Sapiens
cgcuuggccucuccuucucugagagggagggaacagugcccaagggaggaaaauggaugaauga

SEQ ID NO: 232514 - RNA, 64 nt, Homo Sapiens
uccuguacuguugcccuucuuguuguccccacaucuacccaacuugccucugccacagucucuc

SEQ ID NO: 232515 - RNA, 64 nt, Homo Sapiens
cccucuuaccucucuggaugagaggcaaagggugcuacccaagcgaaguuuuugcggaagugac

SEQ ID NO: 232516 - RNA, 64 nt, Homo Sapiens
agaccagcauguucuccccaaagacuggaauauucuacccaaaugucaggaccaggauuuucua

SEQ ID NO: 232517 - RNA, 64 nt, Homo Sapiens
agaccugcauguucucuccaacgaccagaauauucuacccaaaugucaggaccaagauuuucua

SEQ ID NO: 232518 - RNA, 64 nt, Homo Sapiens
ucacuguaacaguuaagugucugucuuuagggcccuacccaaagcccgcccucuggagcgugug

SEQ ID NO: 232519 - RNA, 64 nt, Homo Sapiens
uugcacuuguaguuuugaguucuggcagcucucucuacccaacuaugccuaaugagcuaguguu

SEQ ID NO: 232520 - RNA, 64 nt, Homo Sapiens; identical to SEQ ID NO: 21574

SEQ ID NO: 232521 - RNA, 64 nt, Homo Sapiens; identical to SEQ ID NO: 21575

SEQ ID NO: 232522 - RNA, 64 nt, Homo Sapiens; identical to SEQ ID NO: 21576

SEQ ID NO: 232523 - RNA, 64 nt, Homo Sapiens; identical to SEQ ID NO: 21577

SEQ ID NO: 232524 - RNA, 64 nt, Homo Sapiens; identical to SEQ ID NO: 21578

SEQ ID NO: 232525 - RNA, 64 nt, Homo Sapiens; identical to SEQ ID NO: 21579

SEQ ID NO: 232526 - RNA, 64 nt, Homo Sapiens; identical to SEQ ID NO: 21580

SEQ ID NO: 232527 - RNA, 64 nt, Homo Sapiens; identical to SEQ ID NO: 21581

SEQ ID NO: 232528 - RNA, 64 nt, Homo Sapiens; identical to SEQ ID NO: 21582

SEQ ID NO: 232529 - RNA, 64 nt, Homo Sapiens; identical to SEQ ID NO: 21583

SEQ ID NO: 232530 - RNA, 64 nt, Homo Sapiens; identical to SEQ ID NO: 21584

SEQ ID NO: 232531 - RNA, 64 nt, Homo Sapiens; identical to SEQ ID NO: 21585

SEQ ID NO: 232532 - RNA, 64 nt, Homo Sapiens; identical to SEQ ID NO: 21586

SEQ ID NO: 232533 - RNA, 64 nt, Homo Sapiens; identical to SEQ ID NO: 21587

SEQ ID NO: 232534 - RNA, 64 nt, Homo Sapiens; identical to SEQ ID NO: 21588

SEQ ID NO: 232535 - RNA, 64 nt, Homo Sapiens; identical to SEQ ID NO: 21589

SEQ ID NO: 232536 - RNA, 64 nt, Homo Sapiens; identical to SEQ ID NO: 21590

SEQ ID NO: 232537 - RNA, 64 nt, Homo Sapiens; identical to SEQ ID NO: 21591

SEQ ID NO: 232538 - RNA, 64 nt, Homo Sapiens; identical to SEQ ID NO: 21592

SEQ ID NO: 232539 - RNA, 64 nt, Homo Sapiens; identical to SEQ ID NO: 21593

SEQ ID NO: 232540 - RNA, 64 nt, Homo Sapiens; identical to SEQ ID NO: 21594

SEQ ID NO: 232541 - RNA, 64 nt, Homo Sapiens; identical to SEQ ID NO: 21595

SEQ ID NO: 232542 - RNA, 64 nt, Homo Sapiens; identical to SEQ ID NO: 21596

SEQ ID NO: 232543 - RNA, 64 nt, Homo Sapiens; identical to SEQ ID NO: 21597

SEQ ID NO: 232544 - RNA, 64 nt, Homo Sapiens; identical to SEQ ID NO: 21598

SEQ ID NO: 232545 - RNA, 64 nt, Homo Sapiens; identical to SEQ ID NO: 21599

SEQ ID NO: 232546 - RNA, 64 nt, Homo Sapiens; identical to SEQ ID NO: 21600

SEQ ID NO: 232547 - RNA, 64 nt, Homo Sapiens; identical to SEQ ID NO: 21601

SEQ ID NO: 232548 - RNA, 64 nt, Homo Sapiens; identical to SEQ ID NO: 21602

SEQ ID NO: 232549 - RNA, 64 nt, Homo Sapiens; identical to SEQ ID NO: 21603

SEQ ID NO: 232550 - RNA, 64 nt, Homo Sapiens; identical to SEQ ID NO: 21604

SEQ ID NO: 232551 - RNA, 64 nt, Homo Sapiens; identical to SEQ ID NO: 21605

SEQ ID NO: 232552 - RNA, 64 nt, Homo Sapiens; identical to SEQ ID NO: 21606

SEQ ID NO: 232553 - RNA, 64 nt, Homo Sapiens; identical to SEQ ID NO: 21607

SEQ ID NO: 232554 - RNA, 64 nt, Homo Sapiens; identical to SEQ ID NO: 21608

SEQ ID NO: 232555 - RNA, 64 nt, Homo Sapiens; identical to SEQ ID NO: 21609

SEQ ID NO: 232556 - RNA, 64 nt, Homo Sapiens; identical to SEQ ID NO: 21610

SEQ ID NO: 232557 - RNA, 64 nt, Homo Sapiens; identical to SEQ ID NO: 21611

SEQ ID NO: 232558 - RNA, 64 nt, Homo Sapiens; identical to SEQ ID NO: 21612

SEQ ID NO: 232559 - RNA, 64 nt, Homo Sapiens; identical to SEQ ID NO: 21613

SEQ ID NO: 232560 - RNA, 64 nt, Homo Sapiens; identical to SEQ ID NO: 21614

SEQ ID NO: 232561 - RNA, 64 nt, Homo Sapiens; identical to SEQ ID NO: 21615

SEQ ID NO: 232562 - RNA, 64 nt, Homo Sapiens; identical to SEQ ID NO: 21616

SEQ ID NO: 232563 - RNA, 64 nt, Homo Sapiens; identical to SEQ ID NO: 21617

SEQ ID NO: 232564 - RNA, 64 nt, Homo Sapiens; identical to SEQ ID NO: 21618

SEQ ID NO: 232565 - RNA, 64 nt, Homo Sapiens; identical to SEQ ID NO: 21619

SEQ ID NO: 232566 - RNA, 64 nt, Homo Sapiens; identical to SEQ ID NO: 21620

SEQ ID NO: 232567 - RNA, 64 nt, Homo Sapiens; identical to SEQ ID NO: 21621

SEQ ID NO: 232568 - RNA, 64 nt, Homo Sapiens; identical to SEQ ID NO: 21622

SEQ ID NO: 232569 - RNA, 64 nt, Homo Sapiens; identical to SEQ ID NO: 21623

SEQ ID NO: 232570 - RNA, 64 nt, Homo Sapiens; identical to SEQ ID NO: 21624

SEQ ID NO: 232571 - RNA, 64 nt, Homo Sapiens; identical to SEQ ID NO: 21625

SEQ ID NO: 232572 - RNA, 64 nt, Homo Sapiens; identical to SEQ ID NO: 21626

SEQ ID NO: 232573 - RNA, 64 nt, Homo Sapiens; identical to SEQ ID NO: 21627

SEQ ID NO: 232574 - RNA, 64 nt, Homo Sapiens; identical to SEQ ID NO: 21628

SEQ ID NO: 232575 - RNA, 64 nt, Homo Sapiens; identical to SEQ ID NO: 21629

SEQ ID NO: 232576 - RNA, 64 nt, Homo Sapiens; identical to SEQ ID NO: 21630

SEQ ID NO: 232577 - RNA, 57 nt, Homo Sapiens; identical to SEQ ID NO: 21631

SEQ ID NO: 232578 - RNA, 64 nt, Homo Sapiens; identical to SEQ ID NO: 21632

SEQ ID NO: 232579 - RNA, 64 nt, Homo Sapiens; identical to SEQ ID NO: 21633

SEQ ID NO: 232580 - RNA, 64 nt, Homo Sapiens; identical to SEQ ID NO: 21634

SEQ ID NO: 232581 - RNA, 64 nt, Homo Sapiens; identical to SEQ ID NO: 21635

SEQ ID NO: 232582 - RNA, 64 nt, Homo Sapiens; identical to SEQ ID NO: 21636

SEQ ID NO: 232583 - RNA, 64 nt, Homo Sapiens; identical to SEQ ID NO: 21637

SEQ ID NO: 232584 - RNA, 64 nt, Homo Sapiens; identical to SEQ ID NO: 21638

SEQ ID NO: 232585 - RNA, 64 nt, Homo Sapiens; identical to SEQ ID NO: 21639

SEQ ID NO: 232586 - RNA, 64 nt, Homo Sapiens; identical to SEQ ID NO: 21640

SEQ ID NO: 232587 - RNA, 64 nt, Homo Sapiens; identical to SEQ ID NO: 21641

SEQ ID NO: 232588 - RNA, 64 nt, Homo Sapiens; identical to SEQ ID NO: 21642

SEQ ID NO: 232589 - RNA, 64 nt, Homo Sapiens; identical to SEQ ID NO: 21643

SEQ ID NO: 232590 - RNA, 64 nt, Homo Sapiens; identical to SEQ ID NO: 21644

SEQ ID NO: 232591 - RNA, 64 nt, Homo Sapiens; identical to SEQ ID NO: 21645

SEQ ID NO: 232592 - RNA, 64 nt, Homo Sapiens; identical to SEQ ID NO: 21646

SEQ ID NO: 232593 - RNA, 64 nt, Homo Sapiens; identical to SEQ ID NO: 21647

SEQ ID NO: 232594 - RNA, 64 nt, Homo Sapiens; identical to SEQ ID NO: 21648

SEQ ID NO: 232595 - RNA, 64 nt, Homo Sapiens; identical to SEQ ID NO: 21649

SEQ ID NO: 232596 - RNA, 64 nt, Homo Sapiens; identical to SEQ ID NO: 21650

SEQ ID NO: 232597 - RNA, 64 nt, Homo Sapiens; identical to SEQ ID NO: 21651

SEQ ID NO: 232598 - RNA, 64 nt, Homo Sapiens; identical to SEQ ID NO: 21652

SEQ ID NO: 232599 - RNA, 64 nt, Homo Sapiens; identical to SEQ ID NO: 21653

SEQ ID NO: 232600 - RNA, 64 nt, Homo Sapiens; identical to SEQ ID NO: 21654

SEQ ID NO: 232601 - RNA, 64 nt, Homo Sapiens; identical to SEQ ID NO: 21655

SEQ ID NO: 232602 - RNA, 64 nt, Homo Sapiens; identical to SEQ ID NO: 21656

SEQ ID NO: 232603 - RNA, 64 nt, Homo Sapiens; identical to SEQ ID NO: 21657

SEQ ID NO: 232604 - RNA, 64 nt, Homo Sapiens; identical to SEQ ID NO: 21658

SEQ ID NO: 232605 - RNA, 64 nt, Homo Sapiens; identical to SEQ ID NO: 21659

SEQ ID NO: 232606 - RNA, 64 nt, Homo Sapiens; identical to SEQ ID NO: 21660

SEQ ID NO: 232607 - RNA, 64 nt, Homo Sapiens; identical to SEQ ID NO: 21661

SEQ ID NO: 232608 - RNA, 64 nt, Homo Sapiens; identical to SEQ ID NO: 21662

SEQ ID NO: 232609 - RNA, 64 nt, Homo Sapiens; identical to SEQ ID NO: 21663

SEQ ID NO: 232610 - RNA, 64 nt, Homo Sapiens; identical to SEQ ID NO: 21664

SEQ ID NO: 232611 - RNA, 64 nt, Homo Sapiens; identical to SEQ ID NO: 21665

SEQ ID NO: 232612 - RNA, 64 nt, Homo Sapiens; identical to SEQ ID NO: 21666

SEQ ID NO: 232613 - RNA, 64 nt, Homo Sapiens; identical to SEQ ID NO: 21667

SEQ ID NO: 232614 - RNA, 64 nt, Homo Sapiens; identical to SEQ ID NO: 21668

SEQ ID NO: 232615 - RNA, 64 nt, Homo Sapiens; identical to SEQ ID NO: 21669

SEQ ID NO: 232616 - RNA, 64 nt, Homo Sapiens; identical to SEQ ID NO: 21670

SEQ ID NO: 232617 - RNA, 64 nt, Homo Sapiens; identical to SEQ ID NO: 21671

SEQ ID NO: 232618 - RNA, 64 nt, Homo Sapiens; identical to SEQ ID NO: 21672

SEQ ID NO: 232619 - RNA, 64 nt, Homo Sapiens; identical to SEQ ID NO: 21673

SEQ ID NO: 232620 - RNA, 64 nt, Homo Sapiens; identical to SEQ ID NO: 21674

SEQ ID NO: 232621 - RNA, 64 nt, Homo Sapiens; identical to SEQ ID NO: 21675

SEQ ID NO: 232622 - RNA, 64 nt, Homo Sapiens; identical to SEQ ID NO: 21676

SEQ ID NO: 232623 - RNA, 64 nt, Homo Sapiens; identical to SEQ ID NO: 21677

SEQ ID NO: 232624 - RNA, 64 nt, Homo Sapiens; identical to SEQ ID NO: 21678

SEQ ID NO: 232625 - RNA, 64 nt, Homo Sapiens; identical to SEQ ID NO: 21679

SEQ ID NO: 232626 - RNA, 64 nt, Homo Sapiens; identical to SEQ ID NO: 21680

SEQ ID NO: 232627 - RNA, 64 nt, Homo Sapiens; identical to SEQ ID NO: 21681

SEQ ID NO: 232628 - RNA, 64 nt, Homo Sapiens; identical to SEQ ID NO: 21682

SEQ ID NO: 232629 - RNA, 64 nt, Homo Sapiens
gcugauuacagauaauaguagguuuuaauauuuuuaaaucaaacauucugugucaagcacugug

SEQ ID NO: 232630 - RNA, 64 nt, Homo Sapiens
ugccaaauuuauuaaggugguuaaaacuuccuuuuaaaucaaaaaaaccuuuuuagugugacug

SEQ ID NO: 232631 - RNA, 64 nt, Homo Sapiens
accuauuuuugacauggaaaaaaaugagcuugauuaaaucaaccuaacgcaaccaagugugcua

SEQ ID NO: 232632 - RNA, 64 nt, Homo Sapiens
guccaucaggugaggugugcguuuaaggugagcauaaaucaacuugugcugcuucucaauuagc

SEQ ID NO: 232633 - RNA, 64 nt, Homo Sapiens
ucauauuguucccuauuuugccagugggaacuccuaaaucaaguuggcuucuaaucaaagcuuu

SEQ ID NO: 232634 - RNA, 64 nt, Homo Sapiens
uaaauacuguuuuuaacaacuaugauuuggaaaauaaaucaaugcuauaacuauguugauaaaa

SEQ ID NO: 232635 - RNA, 64 nt, Homo Sapiens
uuauucagggucugagcagcaguaaaagucacccuaaaucaaggggcuuuucagaaggucauuc

SEQ ID NO: 232636 - RNA, 64 nt, Homo Sapiens
guuucagaguuuucuaauauagagauauauauauuaaaucaaucacaaguaauuuugagugcuc

SEQ ID NO: 232637 - RNA, 64 nt, Homo Sapiens
uggaauaucugauucaaaccaaaucaauaaguguuaaaucaaaaauuaaaaaggaaaaaauauu

SEQ ID NO: 232638 - RNA, 64 nt, Homo Sapiens
aguguuaaaucaaaauggaaaaaggaaaaaauauuaaaucaauacuuuuuagaaacaugauuaa

SEQ ID NO: 232639 - RNA, 64 nt, Homo Sapiens
uuuaauuuaaaauauacugucauguuguguuuuguaaaucaacugaauugagguacuauuuacu

SEQ ID NO: 232640 - RNA, 64 nt, Homo Sapiens
uaggaaacugaacucagcacucagaauuuuaaauuaaaucaaugaucuucaaguauuugccacu

SEQ ID NO: 232641 - RNA, 64 nt, Homo Sapiens
uauagugacucuacuguuugaaauacuauuuuuuuaaaucaaguuuuauaaaaguguagaauuu

SEQ ID NO: 232642 - RNA, 64 nt, Homo Sapiens
uccauauuacuucuagaauuagaccaacaauuuauaaaucaaacaaacccaagagcauugaaau

SEQ ID NO: 232643 - RNA, 64 nt, Homo Sapiens
uaugcuguucuguccuucuuuaucaaaauacaaauaaaucaaucaaaauaaaucuucacugccc

SEQ ID NO: 232644 - RNA, 64 nt, Homo Sapiens
ccaaagaaaguuuauucaauuuauuauaggaaaauaaaucaaacuuuacauaaaaugcuaaaau

SEQ ID NO: 232645 - RNA, 64 nt, Homo Sapiens
auaagguuauaguaacaucaaaauguguauggguuaaaucaaagaaaucaagauuaugaugagu

SEQ ID NO: 232646 - RNA, 64 nt, Homo Sapiens
uuaugaugaguaaauguguaucguagcaugaguuuaaaucaagaaugucuuuugugcuacaguu

SEQ ID NO: 232647 - RNA, 64 nt, Homo Sapiens
ccaguuugggaaaagauuauuuuauacuuggguauaaaucaaucugcuauaggccaagggucau

SEQ ID NO: 232648 - RNA, 64 nt, Homo Sapiens
acacagaauaaggaacauauuuguuauaguuguauaaaucaaaauccuucugucuuguagaguc

SEQ ID NO: 232649 - RNA, 64 nt, Homo Sapiens
gaaaggugacauugccagaacuguaaaaguuuuauaaaucaaauaucuccacuuuaaaucuguc

SEQ ID NO: 232650 - RNA, 64 nt, Homo Sapiens
ugaaacuuuuuugauguucauuaccuuggauuuguaaaucaagcagcuuuucagaagaagcaau

SEQ ID NO: 232651 - RNA, 64 nt, Homo Sapiens
uuuaguuguaauuuuccagcauugcuuuuggugguaaaucaagagauuauacauaacuacaucu

SEQ ID NO: 232652 - RNA, 64 nt, Homo Sapiens
uuacauaagaaauguauuccugaaaagcugcauuuaaaucaagucccaaauucauugacuuagg

SEQ ID NO: 232653 - RNA, 64 nt, Homo Sapiens
cuguuugauuacugugacagucuuaaugauaccauaaaucaauauuagaaagcuaguugacuua

SEQ ID NO: 232654 - RNA, 64 nt, Homo Sapiens
cuggaaacucuguauuauauuaaacuauguucuuuaaaucaacaacaucaugcuucucauuuuu

SEQ ID NO: 232655 - RNA, 64 nt, Homo Sapiens
auauaagaauguauagacaaaauaguuaucugaauaaaucaaucugguaauaauguuggcaagu

SEQ ID NO: 232656 - RNA, 64 nt, Homo Sapiens
uauuccaaaucucuucuaacuguuuaagcauguuuaaaucaaggacagaauguuaaaacacugu

SEQ ID NO: 232657 - RNA, 64 nt, Homo Sapiens
uauucaaagacuggauuaaauaaacuauugaaaauaaaucaaaucuaagaggucuagaaaugcu

SEQ ID NO: 232658 - RNA, 64 nt, Homo Sapiens
auuuugaaggaagcacccauaagauggcagaaucuaaaucaaguuucuuagguucuaugugaau

SEQ ID NO: 232659 - RNA, 64 nt, Homo Sapiens
augaauauguuucaagcaucccccuuuucuggcauaaaucaacugaugacaauacuuucagugu

SEQ ID NO: 232660 - RNA, 64 nt, Homo Sapiens
acccuuacaagcaagggugcuaggggcucagcuauacgaccauucucccugacagggaguccaa

SEQ ID NO: 232661 - RNA, 64 nt, Homo Sapiens
ggaagccagcacccaaggaagaguugagacaaauuacgaccacugcucuguuguaggugguucc

SEQ ID NO: 232662 - RNA, 64 nt, Homo Sapiens
uuuuagaaauuuagauuuuaaaaggcgugggacauacgaccaggcccuauagccacauaaauau

SEQ ID NO: 232663 - RNA, 64 nt, Homo Sapiens
aauuuugguaaauuggauaucuuuuuuuuacaaauacgaccauuaaccucaguuaaauuuuugu

SEQ ID NO: 232664 - RNA, 64 nt, Homo Sapiens
uagcugagugauguaagcgucugggaccacauuuuacgaccaccugaaaaaggaagcccuacuu

SEQ ID NO: 232665 - RNA, 64 nt, Homo Sapiens
aauuaaaaguggagucacuaaaacaucuuagucauacgaccauauacggauaggcuuauauuca

SEQ ID NO: 232666 - RNA, 64 nt, Homo Sapiens
uauuaaauaggucaaucagacuaugacagcuauguacgaccauuuguauguguaucuaugucag

SEQ ID NO: 232667 - RNA, 64 nt, Homo Sapiens
gugauuauccauuaaauccagucuuuguauacauuacgaccauuuacgagaaagugguauauaa

SEQ ID NO: 232668 - RNA, 64 nt, Homo Sapiens
gaaggauuucagcaaaccacaaacgcucaagccuuacgaccagacacugaacaaacaaaaaaca

SEQ ID NO: 232669 - RNA, 64 nt, Homo Sapiens
aguacuugcaccgugugguaagcccaucagcgccuacgaccacaccgggugcugcuggacggca

SEQ ID NO: 232670 - RNA, 64 nt, Homo Sapiens
ugguuucagcaugucaggagauuuguuuugaacuuacgaccauuaaauuaaaaacaagucacug

SEQ ID NO: 232671 - RNA, 64 nt, Homo Sapiens
aauagauucauuuaauuuuccugugguugaccuauacgaccaggauguagaaaacuagaaagaa

SEQ ID NO: 232672 - RNA, 64 nt, Homo Sapiens
accugcaaaaucuuuaaggaaaaaagcugaaggguacgaccaugcacauaugugaccuggaaaa

SEQ ID NO: 232673 - RNA, 64 nt, Homo Sapiens
ccaggaguggccguugcuacaagucaccuggugcuacgaccagggugagaauaaagacgucucc

SEQ ID NO: 232674 - RNA, 65 nt, Homo Sapiens
uuaugguugcuuguguaauaaagcauguccuucguaugucacaguuuggggcaacggaagucuuu

SEQ ID NO: 232675 - RNA, 65 nt, Homo Sapiens
uuccacccgcaacuguggggcuaagaauucuuaagaugucacagaauuauaccauccuaccucau

SEQ ID NO: 232676 - RNA, 65 nt, Homo Sapiens
uacuccuguuggcuaucaguacggucaaggaucugaugucacauccaaaagcuuuccagguaccc

SEQ ID NO: 232677 - RNA, 65 nt, Homo Sapiens
cuuuugugaaugugugacauaaacagauguaaugcaugucacagugacggagauaacacugccau

SEQ ID NO: 232678 - RNA, 65 nt, Homo Sapiens
ucccaucaugacaugguccccaggcuggccugaggaugucacagcuugaggcuguggugugaaag

SEQ ID NO: 232679 - RNA, 65 nt, Homo Sapiens
uauagaaaugccuuuuguuucuccugcccuucuugaugucacaguuuuuuguacuuccagcuguc

SEQ ID NO: 232680 - RNA, 65 nt, Homo Sapiens
cccaacaguuuuaccucgggaugguugguuagugcaugucacaugacauccacaugcacauguau

SEQ ID NO: 232681 - RNA, 65 nt, Homo Sapiens
auacagugcuccccacugaaaauuaaaccuaaaaaaugucacauauugguauguuguuaaccugg

SEQ ID NO: 232682 - RNA, 65 nt, Homo Sapiens
uccagggaaucgcaauguuguggcgucugacuuguaugucacauuuguguaaaaugguauauucu

SEQ ID NO: 232683 - RNA, 65 nt, Homo Sapiens
ucauuguugcacacaaacguuuaauuuucugucugaugucacagaguaaauucagucccugguuu

SEQ ID NO: 232684 - RNA, 65 nt, Homo Sapiens
aaaaggcaaacuugaggggauccugaggucugucaaugucacaggcagagaagaucuauaguccg

SEQ ID NO: 232685 - RNA, 65 nt, Homo Sapiens
uuugcaagcucugccuuggguaacacacuguacugaugucacaacuggccccuggacggguacaa

SEQ ID NO: 232686 - RNA, 65 nt, Homo Sapiens
uugaaauagcaaauagaaauuggccucagagauucaugucacauaccuguauacgugugacaugc

SEQ ID NO: 232687 - RNA, 65 nt, Homo Sapiens
ggcuaucaaagaauaagaaauguaacaucuucaacaugucacacuguaugguggguugguuuugg

SEQ ID NO: 232688 - RNA, 65 nt, Homo Sapiens
ucugccucuugcaaaauugcgucucacucaauucaaugucacacugccaacccacccacacgcuc

SEQ ID NO: 232689 - RNA, 65 nt, Homo Sapiens
auaaauuuauauuacacauuucuucaaugaggaaaaugucacagauuuuaaucuauguuaaaaua

SEQ ID NO: 232690 - RNA, 65 nt, Homo Sapiens
uaaagcaucauccucaaauauguaauucauuucaaaugucacaagaagaaauccuaacauuuaag

SEQ ID NO: 232691 - RNA, 65 nt, Homo Sapiens
agcugucucccagcucauuuaagcuuucauaccaaaugucacagguacaugaaaauugcaaucua

SEQ ID NO: 232692 - RNA, 65 nt, Homo Sapiens
cccagcucuucaccagaagcaugaaagaagaacaaaugucacagguuucuauagacccaaagcuu

SEQ ID NO: 232693 - RNA, 65 nt, Homo Sapiens
uucccuuaccccuguaccugugucugauguccaggaugucacaugucuccccagaaggcacuucc

SEQ ID NO: 232694 - RNA, 65 nt, Homo Sapiens
cuggugaaaaaaaaaaaaagaauuucuaauucaccaugucacagaaaaaguuuuuaaacacucuc

SEQ ID NO: 232695 - RNA, 65 nt, Homo Sapiens
caguauaucuucuuugggguugauuuuuuuuuguuaugucacaauguguuuaagccuacaaucau

SEQ ID NO: 232696 - RNA, 65 nt, Homo Sapiens
ugaauaguugguuuccaaugaaggaacuuuuaauuaugucacaaaaaguggaagaauucauuaau

SEQ ID NO: 232697 - RNA, 65 nt, Homo Sapiens
aauauguaguggccuuuucaugcagacaguaaugcaugucacacuacaagguuagcuuuuuuaau

SEQ ID NO: 232698 - RNA, 65 nt, Homo Sapiens
cagugucaggcuggacgccgugauuucagggaccuaugucacaauguucgcugaggccccaggug

SEQ ID NO: 232699 - RNA, 65 nt, Homo Sapiens
uguauuuucaagaacucuucuauuuauuaaggaaaaugucacauugugauguauuaagccaguac

SEQ ID NO: 232700 - RNA, 65 nt, Homo Sapiens
cuguaaaaccauccagccauuugacacccuuuaugaugucacaccuuuaacuuaaggagacgggu

SEQ ID NO: 232701 - RNA, 65 nt, Homo Sapiens
uccaaccacugucagcagcacucuggaguuuucaaaugucacauuagccucacccugcaugcuag

SEQ ID NO: 232702 - RNA, 65 nt, Homo Sapiens
uucuuuguuuuuacccccuggcugccaccacugccaugucacagcugcuuucucuggcuggagug

SEQ ID NO: 232703 - RNA, 65 nt, Homo Sapiens
auauaaaaaugaaaaugaagauacgugaaauucaaaugucacaacuugccuauuauuuauuuuag

SEQ ID NO: 232704 - RNA, 65 nt, Homo Sapiens
aggauauuaccgucucaggaaaggaucaggacuccaugucacaguccugccaucuuacuuuccuc

SEQ ID NO: 232705 - RNA, 65 nt, Homo Sapiens
aagagaguagggccagugaaggcugcccagagagaaugucacagaugaggcugccccugcccccc

SEQ ID NO: 232706 - RNA, 65 nt, Homo Sapiens
cuggagggaaguaacauuuacugagcaccuguuguaugucacaugccuuaugaauagaaucuuaa

SEQ ID NO: 232707 - RNA, 65 nt, Homo Sapiens
auuuugcuaaauccuguuuaguuuucagccauuaaaugucacaugaagccuugauagaauuuguu

SEQ ID NO: 232708 - RNA, 65 nt, Homo Sapiens
aauguuaacuuauggaaaugcuaguucaaaugguaaugucacaguguuuuguaugcagagagcaa

SEQ ID NO: 232709 - RNA, 65 nt, Homo Sapiens
gguccacucagugacaaacaugucacgaagacgagaugucacagaucuaauaagcuuaaccuaag

SEQ ID NO: 232710 - RNA, 65 nt, Homo Sapiens
uuguuuaacauuauuuuucccaaaaucauguaaauaugucacauuuugugacaaguuugcacuua

SEQ ID NO: 232711 - RNA, 65 nt, Homo Sapiens
cgggaacuguuuaacaaauaguauccuggaaacauaugucacauguucucauaucaaugucagaa

SEQ ID NO: 232712 - RNA, 65 nt, Homo Sapiens
aaaauaccugccagucaacaaccgugacaacugccaugucacaaguuagagaugcagccacggaa

SEQ ID NO: 232713 - RNA, 65 nt, Homo Sapiens
gagcugacagugcuucuacauugccuuugaaggguaugucacaaauauugaaugauaauucaguc

SEQ ID NO: 232714 - RNA, 65 nt, Homo Sapiens
gauggcugucauagggguugggggagccugcuagaaugucacaugagccauauaauggcgguuug

SEQ ID NO: 232715 - RNA, 65 nt, Homo Sapiens
aaauucaugguuuucauucagaugaggcucccccaaugucacauugugggugguaaaaagggaag

SEQ ID NO: 232716 - RNA, 65 nt, Homo Sapiens
aaucagcccugggcagacacuccagcauacggccaaugucacaacccuccgaaucugguugggca

SEQ ID NO: 232717 - RNA, 65 nt, Homo Sapiens
uuggugauagaaugaauucaagucuugguuaaagaaugucacauauacucaauccauucuucaca

SEQ ID NO: 232718 - RNA, 65 nt, Homo Sapiens
aaauuaucaugacaaauauuacauuuucucugaugaugucacacaaagcaacacuuuaacgucuu

SEQ ID NO: 232719 - RNA, 65 nt, Homo Sapiens
ggcaaagcaaucaagcaccagcaguuugaagucaaaugucacauaauguuuauaaagguaaaaug

SEQ ID NO: 232720 - RNA, 65 nt, Homo Sapiens
uguuuacugugcugcugcacgcccugguggggcugaugucacagguggaguccccagcaccuggg

SEQ ID NO: 232721 - RNA, 65 nt, Homo Sapiens
auuuucucuaccuucaagaaccaggcagcccugccaugucacaauaggccaggggaguuuccaaa

SEQ ID NO: 232722 - RNA, 65 nt, Homo Sapiens
ugguugcauucagggauugcaaggaccauauagacaugucacagguggaaaaagggccacaagcc

SEQ ID NO: 232723 - RNA, 65 nt, Homo Sapiens
cagaguggcauuauguuuuuacaaaauaaugacauaugucacauguuugcauguuuguuugcuug

SEQ ID NO: 232724 - RNA, 65 nt, Homo Sapiens
aauucuguauuucuuaagauggagccacugacgagaugucacaguauagagccugcagucucaac

SEQ ID NO: 232725 - RNA, 65 nt, Homo Sapiens
acauguaccaggaaccauuuaacaaagaauauaaaaugucacaaucuguguacuguuagccuuug

SEQ ID NO: 232726 - RNA, 65 nt, Homo Sapiens
uuacagggcugcuauuuucauaauguacaugaacaaugucacagaacuuuuuuaauuuuuuugaa

SEQ ID NO: 232727 - RNA, 65 nt, Homo Sapiens
acucauugauuuuguuuugcuuguuaagcaaaggaaugucacauaccucuguccagcuuuuuagg

SEQ ID NO: 232728 - RNA, 65 nt, Homo Sapiens
aauuuauagcuccaaaaacaaaaauauacuuguauaugucacagagaaaaaaaaugcaaaauuua

SEQ ID NO: 232729 - RNA, 65 nt, Homo Sapiens
cgggacuuucuucagagagucuucuggaggaaugcaugucacaggcaugggauuuuggaaaucag

SEQ ID NO: 232730 - RNA, 65 nt, Homo Sapiens
acaugauuuggagaaauuagagacuuugggcucuuaugucacaucgagaggugggauucauuaca

SEQ ID NO: 232731 - RNA, 65 nt, Homo Sapiens
aaacgauucucugcuuuuuggucuauagaaacaucaugucacaugugucaccuagagagcaagag

SEQ ID NO: 232732 - RNA, 65 nt, Homo Sapiens
uucuuauaaagugugaacaacaaccacaccaccaaaugucacaccauuauuuuauaaauugagaa

SEQ ID NO: 232733 - RNA, 65 nt, Homo Sapiens
cucauacaauuuaauugcucgacauugucuaauccaugucacaucagaaauaguuugguacuacc

SEQ ID NO: 232734 - RNA, 65 nt, Homo Sapiens
cauaguauugaucagaaaucuuuugacuccuuucaaugucacacagcagcuaagucauacauuca

SEQ ID NO: 232735 - RNA, 65 nt, Homo Sapiens
guacaucaaacaaccuugugaguagcguccuauggaugucacauuaaaaaaccaaggcuuuuuuc

SEQ ID NO: 232736 - RNA, 65 nt, Homo Sapiens
auuaugccuucaucaaaacuuuaaagguuacuugaaugucacaaacgauggaauaaaaguauguu

SEQ ID NO: 232737 - RNA, 60 nt, Homo Sapiens
agaaggcaggacucaaaugaugcccuggagaugucacagauuccuggcagagccaugguc

SEQ ID NO: 232738 - RNA, 65 nt, Homo Sapiens
uucauuuugcaaauucagaaaguugguccagauauaugucacagaacuuuucacuuguauacuac

SEQ ID NO: 232739 - RNA, 65 nt, Homo Sapiens
cauuugaguaggugucauuuaaaaauaguuggugaaugucacaaaugccuucuauguuguuugcu

SEQ ID NO: 232740 - RNA, 65 nt, Homo Sapiens
aaauuagugaaguucuuuuacuguaauuggugacaaugucacauaaugaaugcuauugaaaaggu

SEQ ID NO: 232741 - RNA, 65 nt, Homo Sapiens
uuguucagugagguaugaugcauacuuuggcugugaugucacaguggggcacaaguuuuuuuguu

SEQ ID NO: 232742 - RNA, 65 nt, Homo Sapiens
uuguacauggaaacaagaacacuaagcuuaacuacaugucacacagguuacaugaaaaaaaauuu

SEQ ID NO: 232743 - RNA, 65 nt, Homo Sapiens
guucagaauucaagcauauuauugggagccaucauaugucacaguagcauaaccuaagacaggga

SEQ ID NO: 232744 - RNA, 65 nt, Homo Sapiens
aggcagcuacuuuauaagccuugucuucaagcagaaugucacagaguuauguuugggcaaagccu

SEQ ID NO: 232745 - RNA, 65 nt, Homo Sapiens
acaguaaguaaagugguuuuucaugcuuaauaaacaugucacaauuuaggaguacugauaggggu

SEQ ID NO: 232746 - RNA, 65 nt, Homo Sapiens
aggaaaaggaagacuaaagcugugccuugaagggaaugucacaggguccacuguuuauaauauuu

SEQ ID NO: 232747 - RNA, 65 nt, Homo Sapiens
gaugcaugucuuagcacugaugauugaauuucauuaugucacaguagucucagcaugaucagucc

SEQ ID NO: 232748 - RNA, 65 nt, Homo Sapiens
cucgugaagagcagcacaacauggaaagagccaaaaugucacaguuccuaucugugagggaaugg

SEQ ID NO: 232749 - RNA, 65 nt, Homo Sapiens
uacaacugucuuugauggcauuuucagaacaauaaaugucacaaucccuucuauagcccccuaca

SEQ ID NO: 232750 - RNA, 65 nt, Homo Sapiens
gugaucagggaacuaaaagucugagggggacacaaaugucacaccuaagaggacaaucaaucauu

SEQ ID NO: 232751 - RNA, 65 nt, Homo Sapiens
ggacccuuauaaaauccugugcaauagacacauacaugucacauuuagcugugcucagaagggcu

SEQ ID NO: 232752 - RNA, 65 nt, Homo Sapiens
uuucuccccaaaagaaucagcagcacaggggaacuaugucacaguuuaccucuuccugauucaga

SEQ ID NO: 232753 - RNA, 65 nt, Homo Sapiens
uaaugcccaauuauuaaaugaacacaagagcugagaugucacauucgucagcauuacaggugauc

SEQ ID NO: 232754 - RNA, 65 nt, Homo Sapiens
ucacaagugcagcauuccuuaauuccuucugcuauaugucacacaguuguuauuuggagaaccaa

SEQ ID NO: 232755 - RNA, 65 nt, Homo Sapiens
cugccagguaucgaguuggaauauccaguuauuucaugucacacaucggcacguaugaugguggu

SEQ ID NO: 232756 - RNA, 65 nt, Homo Sapiens
cgucaguuugaggggacgguggggggaugauaugaaugucacaggaggagacaccuucugucuuu

SEQ ID NO: 232757 - RNA, 65 nt, Homo Sapiens
gaguuaauuaaaaauuguuuuuauuuggggucauuaugucacagucuugaguuaacaagaucuua

SEQ ID NO: 232758 - RNA, 65 nt, Homo Sapiens
gaaucugggaauaugaagcuauaauuuuuuaauuaaugucacaaagcucuagugcaaucuaguug

SEQ ID NO: 232759 - RNA, 59 nt, Homo Sapiens
cagaaucagaacagaaguaguaccaaucaaugucacaugaacaaacaagcugcccccag

SEQ ID NO: 232760 - RNA, 65 nt, Homo Sapiens
aacccagcacauuaucugcacuauaagcucaaagaaugucacauccgcccagacagcucuuugau

SEQ ID NO: 232761 - RNA, 65 nt, Homo Sapiens
uauaccaaauuaaggauguucaagagagcaagaaaaugucacaucuauggugauuuagcagaaca

SEQ ID NO: 232762 - RNA, 65 nt, Homo Sapiens
ccacaaccacggucacaccuuuguuuccaaagugcaugucacauguuuuuuuuuaaguagaaaaa

SEQ ID NO: 232763 - RNA, 65 nt, Homo Sapiens
gguauccucaguaacacagauuuuuguuugaaugaaugucacauaaguccauuucauuaggaacu

SEQ ID NO: 232764 - RNA, 65 nt, Homo Sapiens
gagacaguucucagucagcagauuugacagggugcaugucacagaacugcugaggaagguuuaug

SEQ ID NO: 232765 - RNA, 65 nt, Homo Sapiens
ugaaacuuaaaugauaacccucacuaaggaucacaaugucacagauacugucucuugaucugauc

SEQ ID NO: 232766 - RNA, 65 nt, Homo Sapiens
ugugaugaagggagaguaggaauauaaauugcaagaugucacaggauuagauaaugacacaauca

SEQ ID NO: 232767 - RNA, 65 nt, Homo Sapiens
caggauucuguggggacugucauuagagaggggggaugucacacgggacauuccaaaacauuuac

SEQ ID NO: 232768 - RNA, 65 nt, Homo Sapiens
gaggagaucaugaucuuuauacugugaauagcagaaugucacagaugaagaauauuaaaauuagg

SEQ ID NO: 232769 - RNA, 65 nt, Homo Sapiens
auuuucuccuucuucuaggaaaucccuucugagugaugucacaucuuggcagggguggaggagag

SEQ ID NO: 232770 - RNA, 65 nt, Homo Sapiens
aagccaucaggacagaguagcagugucuguuucccaugucacaaguccucuggccucucccugca

SEQ ID NO: 232771 - RNA, 65 nt, Homo Sapiens
uaacuagaauauauuauuuuagguauaauuuacaaaugucacaccuaauaaucuuuuauaauaua

SEQ ID NO: 232772 - RNA, 65 nt, Homo Sapiens
auauuuauuugccuguauuucauuucccccaaugaaugucacaaggagaugggcacggagcugcu

SEQ ID NO: 232773 - RNA, 65 nt, Homo Sapiens
ugagagggaaggggacagauguuucucauugcauaaugucacaguugccucaaaugagcaccauu

SEQ ID NO: 232774 - RNA, 65 nt, Homo Sapiens
aauaaauuugcacacagauaacaugcaugcuauuuaugucacaucucacauuaaauuauuuuaaa

SEQ ID NO: 232775 - RNA, 65 nt, Homo Sapiens
auacuuguuacgcauuguuccaacuuuuugcacccaugucacagauauaacuugauugaaaauga

SEQ ID NO: 232776 - RNA, 65 nt, Homo Sapiens
cccuaucucaggaauuucuuuuuucucaguggcccaugucacaaaaggccccaaccacggauuuu

SEQ ID NO: 232777 - RNA, 65 nt, Homo Sapiens
uuuaauagaucagccuuguaucuuuuuaaauaaaaaugucacaagccauugauauucuuguuuau

SEQ ID NO: 232778 - RNA, 65 nt, Homo Sapiens
uaauaacugcuguuguuuguucauacgccaauaaaaugucacaagacagggacccuuguaaauug

SEQ ID NO: 232779 - RNA, 65 nt, Homo Sapiens
gaugaaacagauucaaagaacuccagucacaaacaaugucacagagauaauuuacucagguagca

SEQ ID NO: 232780 - RNA, 65 nt, Homo Sapiens
uguuuuguuuucuuuuuuacaggauaaguuuauguaugucacagaugacuggauuaauuaagugc

SEQ ID NO: 232781 - RNA, 65 nt, Homo Sapiens
ugccugggggggcggggacuccgcacaugccugugaugucacaguuacugucaguucacagugaa

SEQ ID NO: 232782 - RNA, 65 nt, Homo Sapiens
aggaacuguccagagagcaacucugagaucuaaggaugucacagggccaacuugagggcccagag

SEQ ID NO: 232783 - RNA, 65 nt, Homo Sapiens
agcaucugugauagcuucugucccuucaucgguucaugucacagggauuuucuuucccaggaagc

SEQ ID NO: 232784 - RNA, 65 nt, Homo Sapiens
auucuaugucuuuaaaaauuugaucuugacauuuaaugucacaaaguuuuguuuuuuuaaaaagu

SEQ ID NO: 232785 - RNA, 65 nt, Homo Sapiens
auauccaugaccaagauugacauguugcucacaacaugucacaauuuagugaggagcuacaugua

SEQ ID NO: 232786 - RNA, 65 nt, Homo Sapiens
gcaaacugcagugacuguaaggcgguagauuugugaugucacaguuuucugggggcgggcaagcu

SEQ ID NO: 232787 - RNA, 65 nt, Homo Sapiens
cucuuugagcugcuggcuuucccuucccacgucccaugucacagggccacagcgggcucucagca

SEQ ID NO: 232788 - RNA, 65 nt, Homo Sapiens
auuacuuucguaauagcucaggaaguagcugucagaugucacauagcuaauucagugucacauga

SEQ ID NO: 232789 - RNA, 65 nt, Homo Sapiens
uuucuuagaaaacauuuugguagccucccuuuagaaugucacauuaauggaaaucaaaacugaaa

SEQ ID NO: 232790 - RNA, 65 nt, Homo Sapiens
aaugcaagcaaaguaucaaaaggacugagaugcaaaugucacagugugaacuccaucauucaucc

SEQ ID NO: 232791 - RNA, 65 nt, Homo Sapiens
gguuugguguacauauuauucuauagaucaauuacaugucacaggggaacacgugcagguuuguu

SEQ ID NO: 232792 - RNA, 56 nt, Homo Sapiens
agaaaaccacaaacuuguuuaaagaaaugucacagauugagauggaggaguuauaa

SEQ ID NO: 232793 - RNA, 65 nt, Homo Sapiens
agaguauggaaauaaaagaaauacuugugccacacaugucacaaauaacaucccugugagauuga

SEQ ID NO: 232794 - RNA, 65 nt, Homo Sapiens
cucagcugagacaugaaacuauuugaaauggcuuuaugucacagaagacuuuaauccgucaaauu

SEQ ID NO: 232795 - RNA, 65 nt, Homo Sapiens
cucucugaucuugugcucagucuaucgaguuugcaaugucacaacagucucccaggcccccugca

SEQ ID NO: 232796 - RNA, 65 nt, Homo Sapiens
gugucaugugucugaugcaggugugaaugaaauggaugucacagaucugacuguggggguggggg

SEQ ID NO: 232797 - RNA, 65 nt, Homo Sapiens
ugaauucuugaucucuaaugcauggacgaauaugaaugucacauuuguuaugaaucugugcuggc

SEQ ID NO: 232798 - RNA, 65 nt, Homo Sapiens
gucacauuaaugucacacugauaauuguaaaguauaugucacauuagguauuugcuuaagugauc

SEQ ID NO: 232799 - RNA, 65 nt, Homo Sapiens
gagugggaggcuucauccaaucaggaauuacuuuuaugucacauuuuuauugacuuuccaaaguu

SEQ ID NO: 232800 - RNA, 65 nt, Homo Sapiens
ucugcucuauuuauuauuauuugguugacccuuguaugucacagcgcauaaaaacuuccaguacu

SEQ ID NO: 232801 - RNA, 65 nt, Homo Sapiens
auuuugcuaagaaacaaacuuugaaugucaaacugaugucacaguaguuuuuguuagcuuuaaau

SEQ ID NO: 232802 - RNA, 65 nt, Homo Sapiens
uucauaaaauccauauuuuaagacaauaguucuucaugucacaaacacaaucuauucuacaugag

SEQ ID NO: 232803 - RNA, 65 nt, Homo Sapiens
aacaccuccacuaccucacugacuucauaauuggaaugucacaugguuuuuuuaaucaagaugca

SEQ ID NO: 232804 - RNA, 65 nt, Homo Sapiens
gaagggcucuuucacagcuggcagagcgagagaauaugucacauuucugacaguuacccccaacc

SEQ ID NO: 232805 - RNA, 65 nt, Homo Sapiens
agcggcauccucagucguuguuacuuacucagcugaugucacagugcagacauccaccguuccac

SEQ ID NO: 232806 - RNA, 65 nt, Homo Sapiens
cugccacuacuauguaccuggcuguuugcccguucaugucacaaacguuagcugcaucugcccug

SEQ ID NO: 232807 - RNA, 65 nt, Homo Sapiens
guuuggccguggggacucugauccauauccaggugaugucacaaaagaugggagccuagcuaaua

SEQ ID NO: 232808 - RNA, 65 nt, Homo Sapiens
auuaaaugugcaguuuggggugccugguucagcagaugucacaggcccagcuucugcaguggaaa

SEQ ID NO: 232809 - RNA, 65 nt, Homo Sapiens
acaggaaccagcauucuaauaaauccuguuuuaaaaugucacaaaccuuuuuauucuuugugauu

SEQ ID NO: 232810 - RNA, 65 nt, Homo Sapiens
auuucuaaucugagcauccuacacacuaaauauugaugucacaccuugaaucuuagaacuuuugu

SEQ ID NO: 232811 - RNA, 65 nt, Homo Sapiens
gcuuucuucaaugggauguugcuuuuaagaagcaaaugucacaagguaguuuuguuacuacuguu

SEQ ID NO: 232812 - RNA, 65 nt, Homo Sapiens
uuguuguacaugagaaacuuaaagccuuuagcaagaugucacacccugauuuuaaagaguguuag

SEQ ID NO: 232813 - RNA, 65 nt, Homo Sapiens
ugaaggucuggccuagcgagccugcugacagcuggaugucacacagcaguggagacugacuucuu

SEQ ID NO: 232814 - RNA, 65 nt, Homo Sapiens
gguauccagagcaaggcuggaacacacaccaccccaugucacacgguccuccuggcagccccuca

SEQ ID NO: 232815 - RNA, 65 nt, Homo Sapiens
cagucugugugguuacagcggccgugagacucccgaugucacagggcugcgggcccaggacagcu

SEQ ID NO: 232816 - RNA, 65 nt, Homo Sapiens
aagccaccaugcugugcggaacugcgucagggcaaaugucacagcaggauuuccccaacccagcu

SEQ ID NO: 232817 - RNA, 65 nt, Homo Sapiens
aaaagaggaccacacaucuguuggucacagaguucaugucacaccagugcuagaaguuucaugau

SEQ ID NO: 232818 - RNA, 65 nt, Homo Sapiens
cagagaugugagaagauaauacagaugaaccaaagaugucacacaguugccauccacugcuuugg

SEQ ID NO: 232819 - RNA, 65 nt, Homo Sapiens
gguagagacacuuaauaguaucaugucgcaugcagaugucacaucggccucugcaaaaacuguac

SEQ ID NO: 232820 - RNA, 65 nt, Homo Sapiens
ugcccgucuugucccucugccccucccaccugcacaugucacacugaccacaucuguagacaucu

SEQ ID NO: 232821 - RNA, 65 nt, Homo Sapiens
ggcuuaauauaggcguuuccccuuucacccaagugaugucacaguucgaugcaaaaucaaugauc

SEQ ID NO: 232822 - RNA, 65 nt, Homo Sapiens
aauuauuuuaaaacguacacacuuuucuuguaaauaugucacaucugaguucaaaaaaauuacuu

SEQ ID NO: 232823 - RNA, 65 nt, Homo Sapiens
aaacgaacgaaggacaacaaaacaugcccgucaacaugucacagaguaaguaucauugaaaacaa

SEQ ID NO: 232824 - RNA, 65 nt, Homo Sapiens
uccugugauucaauguuauaacagcaguauagcauaugucacagcaauuacuuguuacugacacc

SEQ ID NO: 232825 - RNA, 65 nt, Homo Sapiens
gcaguggaaagaauacggacgcaccuggcucaaucaugucacacacauucccugaccacagggaa

SEQ ID NO: 232826 - RNA, 65 nt, Homo Sapiens
cuuucaucuucccuuugagcacagagacacugcagaugucacacguugcucucagcugcagagac

SEQ ID NO: 232827 - RNA, 65 nt, Homo Sapiens
ccuagacuaugaggcaggcauugucucauuuuucaaugucacaaaccacggagcacucaucuaca

SEQ ID NO: 232828 - RNA, 65 nt, Homo Sapiens
aauaaaggcuguaucuaaaauaucaaagguucuauaugucacacaaucguaauuccaaaagccau

SEQ ID NO: 232829 - RNA, 65 nt, Homo Sapiens
guuggguuuuuggaccccagggauaagcuuuuccgaugucacaauguggaggaaagcaccugggg

SEQ ID NO: 232830 - RNA, 65 nt, Homo Sapiens
ugggccaccgggcagccuggggcggugugugugccaugucacagcauggccucucggccuuggga

SEQ ID NO: 232831 - RNA, 65 nt, Homo Sapiens
aaauuccagagaacaauggaagcauugccuggcagaugucacaacagaauaaccacuuguuugga

SEQ ID NO: 232832 - RNA, 65 nt, Homo Sapiens
uaacuaaauacucagacuuagaagucagaugcuucaugucacagcauuuaguuuguucaacaguu

SEQ ID NO: 232833 - RNA, 65 nt, Homo Sapiens
acauuuuuggugagugcugcuuuuauaaauaugugaugucacauauuucagugacagcugauguu

SEQ ID NO: 232834 - RNA, 65 nt, Homo Sapiens
gcuggcugacaugcccagggcuccacucucaucuaaugucacagcccucagaacuaaagcggacu

SEQ ID NO: 232835 - RNA, 65 nt, Homo Sapiens
auuacuagagcuuuggucaguauuuccuucccuauaugucacagagggcaccacugagaacugcg

SEQ ID NO: 232836 - RNA, 65 nt, Homo Sapiens
gggggcagaugucaaaauaccuguacaauuuuaaaaugucacaauuaaacaugagcugguuuccc

SEQ ID NO: 232837 - RNA, 65 nt, Homo Sapiens
cggccuuacaugugugccguaggccaggguaccacaugucacaggaugcaguuguguccaguugg

SEQ ID NO: 232838 - RNA, 65 nt, Homo Sapiens
ucuucaaugugacccuucugggaaccuccacccucaugucacauugaguguaagagugcuggaca

SEQ ID NO: 232839 - RNA, 65 nt, Homo Sapiens
gcaaaggcugcccaaaucccuauuuuucuuccuaaaugucacauaugcaguaauucaaaagcugg

SEQ ID NO: 232840 - RNA, 65 nt, Homo Sapiens
caccagcaucaccaaagugagguucugauugcuagaugucacacccuccugugagucauuggcug

SEQ ID NO: 232841 - RNA, 65 nt, Homo Sapiens
gaguuagucaaagcacaaagaagguggccaagcagaugucacaugaaaucuguuagcauaauucc

SEQ ID NO: 232842 - RNA, 65 nt, Homo Sapiens
auauuccauugcaucugacaacuccaaauaauccuaugucacaauagagauccccauggcugaau

SEQ ID NO: 232843 - RNA, 65 nt, Homo Sapiens
uugcucuccuuguaacucauggggacaaauugacuaugucacaggcguucuaaucaugagaucuu

SEQ ID NO: 232844 - RNA, 65 nt, Homo Sapiens
uuauugccagggagugagguacaagacgauggcucaugucacaggccuaccugauacggugucag

SEQ ID NO: 232845 - RNA, 65 nt, Homo Sapiens
aguaguagaaccuguucugaaaccagaaacuguugaugucacauccuuugacccuggucugagcu

SEQ ID NO: 232846 - RNA, 65 nt, Homo Sapiens
uauucugguccgaggguucaguuccuuuagucaagaugucacaaguuuaaaaacaaaacuugaga

SEQ ID NO: 232847 - RNA, 65 nt, Homo Sapiens
cuugccuugcuccaggaugggguggcagcagaggaaugucacaggucagcagccuaggccuccag

SEQ ID NO: 232848 - RNA, 65 nt, Homo Sapiens
uguacgagcucccugaaccauuguucagaggaccaaugucacaucgcuucaugggcauggcccau

SEQ ID NO: 232849 - RNA, 65 nt, Homo Sapiens
aaguacgauuuacuguagugucuuaucacucuuucaugucacaauagcguggagcauuagagaaa

SEQ ID NO: 232850 - RNA, 65 nt, Homo Sapiens
auuucucccuauguuuauuuuuguacauuugagccaugucacacaaacugaugaugacaggucag

SEQ ID NO: 232851 - RNA, 65 nt, Homo Sapiens
gcccagaggaccacgcagaggcaaugguaguacagaugucacagcugaggguacgaugaggccug

SEQ ID NO: 232852 - RNA, 65 nt, Homo Sapiens
cgaugaaauaucucugcugauagcaacuuccaggaaugucacacauucguacuuugggacuuuga

SEQ ID NO: 232853 - RNA, 65 nt, Homo Sapiens
cugagcauacucugugcauuucuguuuucuuccugaugucacagcaguccguguuaagguaaaua

SEQ ID NO: 232854 - RNA, 65 nt, Homo Sapiens
uuuccaaucucuugcaagccuuugucauuggcuugaugucacacaucucagauuuacagcuuuuu

SEQ ID NO: 232855 - RNA, 65 nt, Homo Sapiens
uuauuauuuaauuguacuugcucuuccuaagggaaaugucacauauuuucuuaacuuuuuauuag

SEQ ID NO: 232856 - RNA, 65 nt, Homo Sapiens
aauaaccuccauagcaccucagauuucgaagcaacaugucacaacguuccuguugugugguuuau

SEQ ID NO: 232857 - RNA, 65 nt, Homo Sapiens
augaaguuguauagaaacaguuucacagcuggaauaugucacaugacauuucuguacuguuccuc

SEQ ID NO: 232858 - RNA, 65 nt, Homo Sapiens
cccaccagggcugaagacaagccccauggcccuggaugucacacuauccaggagacagagccccu

SEQ ID NO: 232859 - RNA, 65 nt, Homo Sapiens
uggccugcagcaggucccugcauuucugcucucuuaugucacagcgcugucucucagagaucuug

SEQ ID NO: 232860 - RNA, 65 nt, Homo Sapiens
uuucuguuacuauaaucagaguucuuaauguuggcaugucacauuauuuaguucuuaagaaaccu

SEQ ID NO: 232861 - RNA, 65 nt, Homo Sapiens
ugugaagaucuggcacaagauauggaauuuaaaccaugucacagcggcuccucuuggggauggau

SEQ ID NO: 232862 - RNA, 65 nt, Homo Sapiens
ccaaaacuuuacaagcuuugaaaggagcaaccaaaaugucacaacgaaugacucagauuucauag

SEQ ID NO: 232863 - RNA, 65 nt, Homo Sapiens
uguaaaggggaaggcggacaccaaaggugcuuuaaaugucacauuguaauugugauuuaccugug

SEQ ID NO: 232864 - RNA, 65 nt, Homo Sapiens
cuguagcacaaauaauauaaucuaauaagauuuaaaugucacaaaaauagguuuggugcuuaucu

SEQ ID NO: 232865 - RNA, 65 nt, Homo Sapiens
gaaaaaaaaaagucaaauucaaauaucaucuggacaugucacaauggaucgcggauccuuaugag

SEQ ID NO: 232866 - RNA, 65 nt, Homo Sapiens
aggauagggauagguaagguaaacuuguaaaaaggaugucacagaagucacuuuuuaauuaaguc

SEQ ID NO: 232867 - RNA, 65 nt, Homo Sapiens
uggaagugcagucagcagaugcuguugugaagcuaaugucacaauuaugugcaaaggugugcuuc

SEQ ID NO: 232868 - RNA, 65 nt, Homo Sapiens
cuauuuuggguauuaauauaggccuuacacugaaaaugucacauugguugucuccaggccaugau

SEQ ID NO: 232869 - RNA, 65 nt, Homo Sapiens
aaaaaaaugucuucugcaaaaauaauguacauuuaaugucacaagagauuacuuuuucaacugua

SEQ ID NO: 232870 - RNA, 65 nt, Homo Sapiens
cugacacaagaugcaagucucaaacugagccuuugaugucacauucguuagaaaagugaccccau

SEQ ID NO: 232871 - RNA, 65 nt, Homo Sapiens
gugguauuauagaaggauaauuagaagacugauagaugucacacauauauaaguaaucagaacac

SEQ ID NO: 232872 - RNA, 65 nt, Homo Sapiens
caagcagcauguaacagacucaauauguaaccaacaugucacaaagcccaaaccucagcauucug

SEQ ID NO: 232873 - RNA, 65 nt, Homo Sapiens
ucagagaguaucauuaaaagggcuuuaucaccaggaugucacauguucagagugaagaucugucu

SEQ ID NO: 232874 - RNA, 65 nt, Homo Sapiens
auggugcuacuucuucuucuagccugacucagcuaaugucacaacguaugagaagaacauaauga

SEQ ID NO: 232875 - RNA, 65 nt, Homo Sapiens
uuguacguuuuuuauauacucagcaacuugaacgaaugucacaacagcucagaauacccauguag

SEQ ID NO: 232876 - RNA, 65 nt, Homo Sapiens
cgugccuugcugccccccugcgugccgagacucucaugucacaggucacuguugacccuaccuca

SEQ ID NO: 232877 - RNA, 65 nt, Homo Sapiens
ggcugggggaacugugucuggucaaguuauggcagaugucacagcuuuagguagguaaaaagggu

SEQ ID NO: 232878 - RNA, 65 nt, Homo Sapiens
ggaaccauacacuucuggcauguuuggaaaucaaaaugucacauucucgggggaggaagcccaga

SEQ ID NO: 232879 - RNA, 65 nt, Homo Sapiens
gacaguguuuuucacucugugguaagcugaggaauaugucacauuuucagucaaagaaccaugau

SEQ ID NO: 232880 - RNA, 65 nt, Homo Sapiens
guuugcauucugugaaaugccucuccacguugcauaugucacacuuuugucugcacauaacucuu

SEQ ID NO: 232881 - RNA, 65 nt, Homo Sapiens
accauugaccauuauuauagggacccaugaaguaaaugucacaaucaucuuacuagcucucucuc

SEQ ID NO: 232882 - RNA, 65 nt, Homo Sapiens
aguaguaaagugggguuuauguauaacauguugaaaugucacauucuuuacauaugucuuaucag

SEQ ID NO: 232883 - RNA, 65 nt, Homo Sapiens
ugaccauguuggaucauugaaggugcaaguguagcaugucacaugguaucagcuuguuugguacu

SEQ ID NO: 232884 - RNA, 65 nt, Homo Sapiens
aucucugucccgucggcacuggcugcaugaucgugaugucacacgguacaauguccuacccacaa

SEQ ID NO: 232885 - RNA, 65 nt, Homo Sapiens
uuuugauuaauguuucuuaaauggaauuauuuugaaugucacaaauugaucaagauauuaaaaug

SEQ ID NO: 232886 - RNA, 65 nt, Homo Sapiens
ccccagacucuuuuuuugagugacagcuuucugggaugucacaguccaaccagaaacaccccucu

SEQ ID NO: 232887 - RNA, 65 nt, Homo Sapiens
uuuaaaaaugaaucuugcuucauuugaugaauuucaugucacaaagcuucucucaagagcucucg

SEQ ID NO: 232888 - RNA, 65 nt, Homo Sapiens
cuccuucagccuccuccucccucaucuguucccugaugucacauucccugugcaaucuucccuug

SEQ ID NO: 232889 - RNA, 65 nt, Homo Sapiens
ugauuuugcuaaacuccuguucccuacaaugggaaaugucacaagaaugugcaaaaauaaaaauc

SEQ ID NO: 232890 - RNA, 65 nt, Homo Sapiens
aaaacaaucucuucuuuuuugggucaaugucauaaaugucacaaucggucauuccugucaacaag

SEQ ID NO: 232891 - RNA, 65 nt, Homo Sapiens
ucugggaggggacuuaagacaaagacaccugucaaaugucacagaggacaccgagguccagagga

SEQ ID NO: 232892 - RNA, 65 nt, Homo Sapiens
acagcacacccuucgcggcugucagcgcucuccugaugucacaguggcugcguguccuuggggug

SEQ ID NO: 232893 - RNA, 65 nt, Homo Sapiens
aagggagcaagacaagagcaagcaacggcuauuaaaugucacaauccuuuaauuagaaaccauuu

SEQ ID NO: 232894 - RNA, 65 nt, Homo Sapiens
ugacagugccaauaaaugauaaaaaaaaaauuaacaugucacaauguaacggaugaccauaugca

SEQ ID NO: 232895 - RNA, 65 nt, Homo Sapiens
gugucuuuuuucacuacauuauaaaugucucuuuaaugucacaggcagguccaggguuugaguuc

SEQ ID NO: 232896 - RNA, 65 nt, Homo Sapiens
aguacacgucacauuauuuuaccggugagaugagaaugucacaaacauuaaaagccuuaugugcu

SEQ ID NO: 232897 - RNA, 65 nt, Homo Sapiens
cggccgcucugugacuggaguuaugcucuuuugaaaugucacaaggccgccucccaccucugggg

SEQ ID NO: 232898 - RNA, 65 nt, Homo Sapiens
uguguuguguaaacaguugguggugccagagucagaugucacagagcugaaagcugcggcgccac

SEQ ID NO: 232899 - RNA, 65 nt, Homo Sapiens
guuccucuacgacccgaccuauuuuguuucugucuaugucacaguaauacccuguuuuugaguuu

SEQ ID NO: 232900 - RNA, 65 nt, Homo Sapiens
gucuuuuuuuuuaaagcacuaaauaugguuugaauaugucacaaguuauuggaaaguauucaaau

SEQ ID NO: 232901 - RNA, 65 nt, Homo Sapiens
uuuguguccuuaggcaaagcugugggagucuugaaaugucacaguaguaaauaacuuauuacuuu

SEQ ID NO: 232902 - RNA, 65 nt, Homo Sapiens
acucauucccucaaaauauuuauugagcaccaacaaugucacaagcacugugcuaaacacugugg

SEQ ID NO: 232903 - RNA, 65 nt, Homo Sapiens
acacuaaaauguuuuaaguuuucuuauugcuaacaaugucacagugaacauuuauauauucauua

SEQ ID NO: 232904 - RNA, 65 nt, Homo Sapiens
cccgguccugcccuuccugaagaagaucccagaggaugucacaaagaucaugaaaguccagguua

SEQ ID NO: 232905 - RNA, 65 nt, Homo Sapiens
gauguggccugaaagcacuuagcgggcgcgcugggaugucacagaguuggagucauuguuggggg

SEQ ID NO: 232906 - RNA, 65 nt, Homo Sapiens
gugcccagaauggaugaccaucucuguucagguaaaugucacacuaucuucuagugccauucucc

SEQ ID NO: 232907 - RNA, 65 nt, Homo Sapiens
agguggcguguaaggaaugccuugaccaaugaccuaugucacaagccucuguagcauuccagcgg

SEQ ID NO: 232908 - RNA, 65 nt, Homo Sapiens
gcugguuucagcaugguauuaaguauugcgcuguaaugucacagaaugucuuauccucacaacaa

SEQ ID NO: 232909 - RNA, 65 nt, Homo Sapiens
uguuucuuguucauccaaggcagauuccacacaaaaugucacacuagccaugcuaaggugguuuu

SEQ ID NO: 232910 - RNA, 65 nt, Homo Sapiens
auuuauauuggcauuuuucaacccagugucacuagaugucacacacauuuguggugcuuugaugu

SEQ ID NO: 232911 - RNA, 65 nt, Homo Sapiens
caugcacauucaagagagaaauggcaaaauacaguaugucacagucuauuaaacugaguuuaaca

SEQ ID NO: 232912 - RNA, 65 nt, Homo Sapiens
gcuacaauuaggucuuugucaugcacaaagagauaaugucacaguuuuauuacauuagcagaagc

SEQ ID NO: 232913 - RNA, 65 nt, Homo Sapiens
aaguuaaugugauuaagauucaaucucauuggaacaugucacaaaaucccaaauuauaaauguga

SEQ ID NO: 232914 - RNA, 65 nt, Homo Sapiens
gaagaauuucuucaugauacauuauuuaugacuuuaugucacauuaaucuguuuaucauacauuu

SEQ ID NO: 232915 - RNA, 65 nt, Homo Sapiens
gacagugacagccuccgucagacucccgcgugaagaugucacaagggauuggcaauuguccccag

SEQ ID NO: 232916 - RNA, 65 nt, Homo Sapiens
gcacauauuggucaccuacugugugccuggcacucaugucacaaagauaaguuccugauucggua

SEQ ID NO: 232917 - RNA, 65 nt, Homo Sapiens
uuaaaauaauaauaauaacacaucuuuggucaucuaugucacacaaaaauuuuccuuuguuugcg

SEQ ID NO: 232918 - RNA, 65 nt, Homo Sapiens
aauuuauacuggacagaaauccuaaagugugaagaaugucacaaagcccuuaauaaguccucaau

SEQ ID NO: 232919 - RNA, 65 nt, Homo Sapiens
uguuucauacuggagcgaaacuacaauccugaaugaugucacagugcuuuuaacaauaccucaaa

SEQ ID NO: 232920 - RNA, 65 nt, Homo Sapiens
cuucugaggggcugcccugagagcauucaguucacaugucacaggguauggugugacagggugcc

SEQ ID NO: 232921 - RNA, 65 nt, Homo Sapiens
uguaugaauaugaccaguuucaagcagagcccaaaaugucacaguugucaagagaacacacaaca

SEQ ID NO: 232922 - RNA, 65 nt, Homo Sapiens
ugacaagugacaucuugaaaaugccacauucccucaugucacaggaaguucugggaucaccaagg

SEQ ID NO: 232923 - RNA, 65 nt, Homo Sapiens
aucaaaucugugcucuuucauuugcuaaguguaugaugucacacaagcuccuuaaccuuccaugu

SEQ ID NO: 232924 - RNA, 65 nt, Homo Sapiens
uaugcaaaacauaggagaauucaugcaggagagaaaugucacaagugugaugaguguugcaaagc

SEQ ID NO: 232925 - RNA, 65 nt, Homo Sapiens
uuuaguauagauccuccuugacuuaugaugggguuaugucacaauaaacccauugcaaguugaaa

SEQ ID NO: 232926 - RNA, 65 nt, Homo Sapiens
agcaauaaaacaaacuagaaaauccacaaauuccaaugucacaaaggauggggggagagagagaa

SEQ ID NO: 232927 - RNA, 65 nt, Homo Sapiens
gccgcagagauuuuguuuauauagccaucacgagcaugucacagucaaccuccagcauggguguc

SEQ ID NO: 232928 - RNA, 65 nt, Homo Sapiens
gcugcagagauuuuguuuauauagccaucacgagcaugucacagucagccuccagcaugggcguc

SEQ ID NO: 232929 - RNA, 65 nt, Homo Sapiens
cauccugcuccaggacugguuucucacgucagugcaugucacauggcacugaugaugcuccggcc

SEQ ID NO: 232930 - RNA, 65 nt, Homo Sapiens
cagacacagugacaacacacacacagacggugaugaugucacacaacagacgcggcgauggcauc

SEQ ID NO: 232931 - RNA, 65 nt, Homo Sapiens
gacgcggcgauggcaucacaacgucacacauauuaaugucacacacgacgucacgggccaugucg

SEQ ID NO: 232932 - RNA, 65 nt, Homo Sapiens
uggcuguucuggagagggccaaugaccacagcagaaugucacacauguauauuauuguaaauaga

SEQ ID NO: 232933 - RNA, 65 nt, Homo Sapiens
uggcuguucuggagagggccaaugaccacaucagaaugucacacauguauauuauuguaaauaga

SEQ ID NO: 232934 - RNA, 65 nt, Homo Sapiens
auuuacacuuaggguuuggagcuauucaagaggaaaugucacagaagcagcuaaaccaaggacug

SEQ ID NO: 232935 - RNA, 65 nt, Homo Sapiens
ucuugguauaaaggcuucuccggaucaguacaugcaugucacauuaacacacacacacacacaca

SEQ ID NO: 232936 - RNA, 65 nt, Homo Sapiens
uuuauuuacauguauauuuucacaugaaauaccaaaugucacagcauuauuacugaaugucaguc

SEQ ID NO: 232937 - RNA, 65 nt, Homo Sapiens
gggcuccuugcuggugggcaucuucaacuguucuuaugucacagauuuccgguggguauguucau

SEQ ID NO: 232938 - RNA, 65 nt, Homo Sapiens
uaaaacuguguggaauaagaaaacuuugauuucuaaugucacacuuucguuugugcuauaaccuc

SEQ ID NO: 232939 - RNA, 65 nt, Homo Sapiens
ccaauaaauggggcacuuucagccaucucagccugaugucacaacauccuugcuuuccagcccua

SEQ ID NO: 232940 - RNA, 65 nt, Homo Sapiens
gaaccaaaaagcacagaaaagguugcacaggaagaaugucacaggagcucuuuuucugugagcug

SEQ ID NO: 232941 - RNA, 65 nt, Homo Sapiens
uagaaguggcagagucaggucgaugccucucccagaugucacaauaaccaaggcuaagagaugag

SEQ ID NO: 232942 - RNA, 65 nt, Homo Sapiens
agaacaaaauaacccgaccugaguggauauagggcaugucacaaauugcugucacuuuggcgagg

SEQ ID NO: 232943 - RNA, 65 nt, Homo Sapiens
aaaacgaaugaaugaaaaugaaguuccuguaauaaaugucacaaucgaaaggaaaauugacccgg

SEQ ID NO: 232944 - RNA, 65 nt, Homo Sapiens
ccccuaggagccagugaugcuguauguuugguuccaugucacagcgcucugcucucucauacgcg

SEQ ID NO: 232945 - RNA, 65 nt, Homo Sapiens
aucaucagguaaaugagucagcauauccuuguaguaugucacaguauacgcccaaauuguuuuca

SEQ ID NO: 232946 - RNA, 65 nt, Homo Sapiens
ccugugcgggugccccugacuucgaccccuagcuuaugucacagcccgaaccagaucgacugguc

SEQ ID NO: 232947 - RNA, 65 nt, Homo Sapiens
gaaguuucagucggugagccuugggcaccucacccaugucacauccugucuccugcaauuggaau

SEQ ID NO: 232948 - RNA, 65 nt, Homo Sapiens
uuuuaaaaauucucauuacauagacgcacaagaauaugucacauaaagaaaauguguuuagaaua

SEQ ID NO: 232949 - RNA, 65 nt, Homo Sapiens
ccuggacuaaauugauuuuaauuuauuguaagcuuaugucacagguuucccaaccaauagaaacu

SEQ ID NO: 232950 - RNA, 65 nt, Homo Sapiens
aaggaggugccccccugugcguccaugccuggaccaugucacaaaacuaacaaguguuguuuugg

SEQ ID NO: 232951 - RNA, 65 nt, Homo Sapiens
aaugucugugucugaauccaggugggaaguuagggaugucacagaugcuguggccugagguagca

SEQ ID NO: 232952 - RNA, 65 nt, Homo Sapiens
caagaggccuuggcagcuccggccucuaaccugugaugucacacucugugcuagcagcucagcag

SEQ ID NO: 232953 - RNA, 65 nt, Homo Sapiens
auaaauugucuugauuccaagcuuagauuugauucaugucacagcgccgaguagccagcugcauu

SEQ ID NO: 232954 - RNA, 65 nt, Homo Sapiens
uaagcuaccugguaaaggguuugaacauuuacaaaaugucacacuuuuucuuaaaagaaaaauau

SEQ ID NO: 232955 - RNA, 65 nt, Homo Sapiens
cuuccaaugaaaccaagaauuucucaaaauauuuaaugucacauauuauaagaaguuaccuaauc

SEQ ID NO: 232956 - RNA, 65 nt, Homo Sapiens
uccuagaauuggcacuuucugccuccuugcucuaaaugucacaaaaaauuauacuuccuuaaagu

SEQ ID NO: 232957 - RNA, 65 nt, Homo Sapiens
ugacuuuauuagggacacuaaacuacaucauuaacaugucacagcuugguugacaauaaucacca

SEQ ID NO: 232958 - RNA, 65 nt, Homo Sapiens
cucuugcucuuuugcaucuaauaauuuuuggcugaaugucacagauguuguauguaggacaguag

SEQ ID NO: 232959 - RNA, 65 nt, Homo Sapiens
aaaaagaagacaagcugaagcuacacacauggcugaugucacauugaaaaugugacugaaaauuu

SEQ ID NO: 232960 - RNA, 65 nt, Homo Sapiens
gaagacauucauaggucccaaaucugcccauucagaugucacauaauauggugggauaucaauuu

SEQ ID NO: 232961 - RNA, 65 nt, Homo Sapiens
caaaucacaaauuguucaguucuuaaaauguaauuaugucacacacacaaaaaauccuuuucaau

SEQ ID NO: 232962 - RNA, 65 nt, Homo Sapiens
agaacauucucaaaaaucuugugggucuucuacguaugucacauugauucacacauucagaaaag

SEQ ID NO: 232963 - RNA, 65 nt, Homo Sapiens
cauucauugcuccagcuacuaaauaccccaccagaaugucacaauaggugcaccucaggcugcac

SEQ ID NO: 232964 - RNA, 65 nt, Homo Sapiens
ccauuuuaucccuucagugguaacuugaugaggucaugucacagaaaacauaguuauguuuucuc

SEQ ID NO: 232965 - RNA, 65 nt, Homo Sapiens
aauauggaagagauuguguacgugcauauuugcucaugucacagguuuguauuauuuuuuuuauu

SEQ ID NO: 232966 - RNA, 65 nt, Homo Sapiens
ccuuaauagggaccugugacgacacucaauggaauaugucacacuugcuagggcaauucuaccaa

SEQ ID NO: 232967 - RNA, 65 nt, Homo Sapiens
ucaaaugaauggaaacuuugaaaaagggaauugacaugucacauacagcauauguaaaaaaaaaa

SEQ ID NO: 232968 - RNA, 65 nt, Homo Sapiens
auucauccugaguccgagacuacuugaucaaugaaaugucacauuagcucuacaaucaaaaugaa

SEQ ID NO: 232969 - RNA, 65 nt, Homo Sapiens
cuaauagaaagaaauuacuuauuuuuuaaauguucaugucacaucucuauagacugacuuuuucc

SEQ ID NO: 232970 - RNA, 65 nt, Homo Sapiens
gauagauggacauuuguugaagccaucccauggccaugucacagguggcccccaauggucagaag

SEQ ID NO: 232971 - RNA, 65 nt, Homo Sapiens
ccugucccucacucaacacaacacagacacacaaaaugucacaauacuucagggcuggaaaaguc

SEQ ID NO: 232972 - RNA, 65 nt, Homo Sapiens
uaagacaggaucaaaccugaagcuuguugcugaggaugucacauagguauaauucagaucauuuu

SEQ ID NO: 232973 - RNA, 65 nt, Homo Sapiens
caaaucacaaauuguucaguucuuaaaauguaauuaugucacacacacaaaaaaauccuuuucaa

SEQ ID NO: 232974 - RNA, 64 nt, Homo Sapiens
ccccuccugccguugucauccacagcucacccacgcggcgcacagucacccccaccccgcggau

SEQ ID NO: 232975 - RNA, 64 nt, Homo Sapiens
gggccaccgagaggccgaagaaggccaaggaggagcggcgcauggaccagguaggccugcggcu

SEQ ID NO: 232976 - RNA, 64 nt, Homo Sapiens
caacccugagccugcagggaaccaggagccaggugcggcgcagcacagggaugcucacgggugc

SEQ ID NO: 232977 - RNA, 64 nt, Homo Sapiens
agugacuggcguauuuagcccaccaugugucccugcggcgcauguaccugggcacgccagucug

SEQ ID NO: 232978 - RNA, 64 nt, Homo Sapiens
ccugcaaucccagcuacuuguuuagcuaggcauggcggcgcaugacuaaaaaugcaaaaaaaaa

SEQ ID NO: 232979 - RNA, 64 nt, Homo Sapiens
agggccaaagcacagcugggcaugccaugucugagcggcgcagagcccuccaggccugcagggg

SEQ ID NO: 232980 - RNA, 64 nt, Homo Sapiens
ucagggaucuccgagucaggugacgaaggaagcggcggcgcagcaucaaguagcugcuggaugu

SEQ ID NO: 232981 - RNA, 64 nt, Homo Sapiens
ccuagagugcuguggacuggacccaggagccccggcggcgcagcugcaagguugccaggaccca

SEQ ID NO: 232982 - RNA, 64 nt, Homo Sapiens
ggccucuccugccccaggaggacaucucacggcugcggcgcaagcuggaaaagcagaggaaggu

SEQ ID NO: 232983 - RNA, 64 nt, Homo Sapiens
ccaucugcaccgacgccugcccccgucccaccucgcggcgcagccccuggagcuccugcugggg

SEQ ID NO: 232984 - RNA, 64 nt, Homo Sapiens
gugguaccaggaaagaggauacacugugaguccagcggcgcaggggugugcagccucucaucuc

SEQ ID NO: 232985 - RNA, 64 nt, Homo Sapiens
gagaucgcgcacgcccuguguaccugacgcggcggcggcgcaucaggaguuucacuacaaucgc

SEQ ID NO: 232986 - RNA, 64 nt, Homo Sapiens
ggggggcgugcucucgggggggccucacgcacccgcggcgcaggagcuucaguggucuggggcc

SEQ ID NO: 232987 - RNA, 64 nt, Homo Sapiens
gccuuugggaauaaaaagcccugggcccaggugcgcggcgcagacuaagccagcccacccuggg

SEQ ID NO: 232988 - RNA, 64 nt, Homo Sapiens
gagauggauaagaccaggggugggagcaccagcugcggcgcauguggacagcgagcugggcacc

SEQ ID NO: 232989 - RNA, 64 nt, Homo Sapiens
cgcaagaggcgcgcuucgagggcacugggccagggcggcgcacgcagccauuccugcagccaag

SEQ ID NO: 232990 - RNA, 64 nt, Homo Sapiens
uuuuuugaggagagugaaagagaguaccaugcuggcggcgcagagggaaggggccuacacccgu

SEQ ID NO: 232991 - RNA, 64 nt, Homo Sapiens
aagggguggggccgaggaugcaaguccaggcagagcggcgcaggcagcugugagcuuuucucca

SEQ ID NO: 232992 - RNA, 64 nt, Homo Sapiens
cgcguggagacuuaugacucgucgugggcgcauggcggcgcaccugcugcaggagcggccacgu

SEQ ID NO: 232993 - RNA, 64 nt, Homo Sapiens
agacgcaggccucuccauuguccaggggagccuggcggcgcaucccuccucucccaccuccugg

SEQ ID NO: 232994 - RNA, 64 nt, Homo Sapiens
uagagacaaaacaagcagacaccugaaacaaucaacgcccaauaaaacaaaguaggaugaaaau

SEQ ID NO: 232995 - RNA, 64 nt, Homo Sapiens
aaaccaacuaaggacucucauuucuuacuaccuaacgcccaagauggcugggguuccuggugga

SEQ ID NO: 232996 - RNA, 64 nt, Homo Sapiens
aauuuuuguauuuuuaguagcaccgugccuggccacgcccaacucugggauuacaggcgugagc

SEQ ID NO: 232997 - RNA, 64 nt, Homo Sapiens
cuuccccacugcacacaccuaggugacaucucuuacgcccaaccacgugcuacccccaugcugg

SEQ ID NO: 232998 - RNA, 64 nt, Homo Sapiens
ggaaagccccgccuccuacaggugccguggagccacgcccaaaagagagcucccuuagggaaaa

SEQ ID NO: 232999 - RNA, 64 nt, Homo Sapiens
auuuugugaaccgugaaguacgugagacuagaagacgcccaaacaagucagauaauaguaacua

SEQ ID NO: 233000 - RNA, 64 nt, Homo Sapiens
cauggcagucccuccgcagccccagucccuggccacgcccaagggaagagggaggugaggacuu

SEQ ID NO: 233001 - RNA, 64 nt, Homo Sapiens
ggcgugagaggagcggcagccacacugcggccccacgcccaaggacugggcugcucucgagggg

SEQ ID NO: 233002 - RNA, 52 nt, Homo Sapiens
uaauuaguaggaguucaucuaaacgcccaaaaugaagcgcaaagcugaauga

SEQ ID NO: 233003 - RNA, 64 nt, Homo Sapiens
gggaccaggguuuucuguuuaggcgugagccaccacgcccaacuucccaaagugcugggauuac

SEQ ID NO: 233004 - RNA, 64 nt, Homo Sapiens
cuugaaguccauugcugaaagaaagaaaaaaaaaacgcccaacucuuaaauguagauaugugcu

SEQ ID NO: 233005 - RNA, 64 nt, Homo Sapiens
aauagggggcacucauuuuguuucaacgguccaaacgcccaaccuucagaaagaggaagucaga

SEQ ID NO: 233006 - RNA, 64 nt, Homo Sapiens
acugggcucuguccugcagacaccucuuucagaaacgcccaagcccagccccuaggagggggug

SEQ ID NO: 233007 - RNA, 64 nt, Homo Sapiens
uggacacaggugccaguucaaacucugacacagaacgcccaacgucucacgucauauuauagga

SEQ ID NO: 233008 - RNA, 64 nt, Homo Sapiens
aaccacauaccccaggcccaagcgccuugcugccacgcccaaccucuuugggagaaguaugaau

SEQ ID NO: 233009 - RNA, 64 nt, Homo Sapiens
gaaauaaaauccuaucuaauucaauaaaugcacaacgcccaaagauguauucucuauaaggcau

SEQ ID NO: 233010 - RNA, 64 nt, Homo Sapiens
acgagugcuucuucaucuuccgcaccgcgccuacacgcccaacgggugaggcgggcucugcgug

SEQ ID NO: 233011 - RNA, 64 nt, Homo Sapiens
cccugaugaccugguucuuccagcucccaggccaacgcccaaagccacgggauuuguagccagc

SEQ ID NO: 233012 - RNA, 64 nt, Homo Sapiens
agaaacguauugcucacaguccuggggggcugggacgcccaagaucaagaggccagcagauucg

SEQ ID NO: 233013 - RNA, 64 nt, Homo Sapiens
aacuuuuguauuuuuaguagaggcgccccccaccacgcccaaguucccuaguagcugggauuau

SEQ ID NO: 233014 - RNA, 64 nt, Homo Sapiens
aaggaggcaggacagaggcaccgaggccagggagacgcccaacgaggcagcccugggcucuucu

SEQ ID NO: 233015 - RNA, 64 nt, Homo Sapiens
auuucugaacaaaugaaacugugcgcugauguuuacgcccaagcacacacgugugcauguuccu

SEQ ID NO: 233016 - RNA, 64 nt, Homo Sapiens
agacagccggcuagccccacugcccguuccuuuuacgcccaaguuuugcuccuugagagcagau

SEQ ID NO: 233017 - RNA, 64 nt, Homo Sapiens
ccauggccugcaaccccaggcugcacucagggauacgcccaacaaagugaaucccgcaggacag

SEQ ID NO: 233018 - RNA, 64 nt, Homo Sapiens
cuuugcuuuucuccuccuccacuggacccucccaacgcccaaugucucggugauaaaggcgccc

SEQ ID NO: 233019 - RNA, 64 nt, Homo Sapiens
aauuuuuauauuuuuaguagaggcacaugccaccacgcccaacuccccuaguagcuggcauuac

SEQ ID NO: 233020 - RNA, 64 nt, Homo Sapiens
uucugaguagcugggauuacaggcaugcgccaccacgcccaacuaauuuuguauuuuuaguaga

SEQ ID NO: 233021 - RNA, 64 nt, Homo Sapiens
gcccauggugccugucagcccgcagagcccaucuacgcccaacacagagcucacacaggucacu

SEQ ID NO: 233022 - RNA, 64 nt, Homo Sapiens
gauuuuuguauuuuuaguagaggcgcacaccaccacgcccaacuucccaaguagcugagauuac

SEQ ID NO: 233023 - RNA, 64 nt, Homo Sapiens
ugagucagcauauccuuguaguaugucacaguauacgcccaaauuguuuucaccauauugcaug

SEQ ID NO: 233024 - RNA, 64 nt, Homo Sapiens
gcugugggauguggcuuucagcaaaaaauaaaugacgcccaagaagauccuaauuuaugccuau

SEQ ID NO: 233025 - RNA, 64 nt, Homo Sapiens
uuugaauacauuaaaagaaguaaccaacugaacgacaaagcaugguauuugaauuuuaaauuaa

SEQ ID NO: 233026 - RNA, 64 nt, Homo Sapiens
uugaauuuuaaauuaaagcaaaguaaauaaaaguacaaagcauauuuuaguuaguacuaaauuc

SEQ ID NO: 233027 - RNA, 64 nt, Homo Sapiens
ccuuuuucccuuaaacuucuguacuuuuucacuuacaaagcacuaagagaaaggccaaagauuu

SEQ ID NO: 233028 - RNA, 64 nt, Homo Sapiens
auaacggcauauaacacugcguuguuuucuuuauacaaagcaagcaguauuaaaaaucucucau

SEQ ID NO: 233029 - RNA, 64 nt, Homo Sapiens
gcuguuuacauuuauuuucuucagccugugcaaaacaaagcaauggaaaaggaaacuaaaaaau

SEQ ID NO: 233030 - RNA, 64 nt, Homo Sapiens
uuaaaaugucagcaagaaggccugccucaucuuaacaaagcaaaaaaaaaugcuuuaauucaaa

SEQ ID NO: 233031 - RNA, 64 nt, Homo Sapiens
cucgaagccuucucugggaagaaagggaauucugacaaagcacaauuccauaugguauguaacu

SEQ ID NO: 233032 - RNA, 64 nt, Homo Sapiens
uaagcuugcacacauuauuaacacauaagauugaacaaagcauuuagauuauuccagguuauau

SEQ ID NO: 233033 - RNA, 64 nt, Homo Sapiens
uaauaucccuauccagugcuuuguacaaauaucuacaaagcagacauguagucuuaacagucuu

SEQ ID NO: 233034 - RNA, 64 nt, Homo Sapiens
ugacuucccuggaucuucccccacaaacccaaauacaaagcagcccugccaaggccauuacauc

SEQ ID NO: 233035 - RNA, 64 nt, Homo Sapiens
uaacaacaccugggucaacucuuuuaauuuauauacaaagcaaagaacaacauuaauggagaug

SEQ ID NO: 233036 - RNA, 64 nt, Homo Sapiens
acaagaauuagaaugacuugagaacgggcaaauaacaaagcaaaccaauauaauuauaugguca

SEQ ID NO: 233037 - RNA, 64 nt, Homo Sapiens
uagcugcugaugcaaguugucccccaaggccaucacaaagcaguggggcaugagcuguguuuca

SEQ ID NO: 233038 - RNA, 64 nt, Homo Sapiens
uggcuugucccaucagcagaugaauguguuaagcacaaagcaucuuccuuaaagcacaaagaga

SEQ ID NO: 233039 - RNA, 64 nt, Homo Sapiens
acaaauuaaaaauaugugggcauaaccaaaauaaacaaagcaagucaugaagagaaaggacuug

SEQ ID NO: 233040 - RNA, 64 nt, Homo Sapiens
acauucuuuuaucuuuuuugaccccauuaagaauacaaagcacuuucgcugaucuaucaacauc

SEQ ID NO: 233041 - RNA, 64 nt, Homo Sapiens
ugacugagauggucaaaggaacugccaacagaaaacaaagcagcuccucucaccuugucccucc

SEQ ID NO: 233042 - RNA, 64 nt, Homo Sapiens
aguggcgaaucaucaguccccacauuucaagcggacaaagcacaguucuuccucuuccccgacc

SEQ ID NO: 233043 - RNA, 64 nt, Homo Sapiens
auuucuucacaaaaugaaaauuaaaauggaaauaacaaagcagauguuagaaaaauuagaaaau

SEQ ID NO: 233044 - RNA, 64 nt, Homo Sapiens
uauauagcuaagcuaaaagauguugaauuagacgacaaagcaucuagggugugaauuauuuuga

SEQ ID NO: 233045 - RNA, 64 nt, Homo Sapiens
aagagguuguuaccucaguaaaaaccuucaggccacaaagcaaaaaguugcauagccacaacga

SEQ ID NO: 233046 - RNA, 64 nt, Homo Sapiens
uaaagcagggcuuaaaauuuuuuggaaaaguuugacaaagcauaccacaugaauucagauuuac

SEQ ID NO: 233047 - RNA, 64 nt, Homo Sapiens
uuuucccccuaggggugggacaacuucccaaagcacaaagcagucuguccccggguuucagaga

SEQ ID NO: 233048 - RNA, 64 nt, Homo Sapiens
aacaucggauuuggggaacgcaggaagggccacgacaaagcagacacuggguucggaggagagu

SEQ ID NO: 233049 - RNA, 64 nt, Homo Sapiens
ccccggccuucuggggaaggaacaaaguccccaaacaaagcaaccagcacaauucugaaggggc

SEQ ID NO: 233050 - RNA, 64 nt, Homo Sapiens
ucucuuucucucucuuucuuaauuguaugaaaacacaaagcacaggucaggauccucugagaga

SEQ ID NO: 233051 - RNA, 64 nt, Homo Sapiens
uacacauuagaaagcaaagauuauuuucauuuauccagaugaccauuuucugccacagguaaca

SEQ ID NO: 233052 - RNA, 64 nt, Homo Sapiens
uaucccuuugcagucaguucaucccuacccuggcccagaugaucacugaucuugucauuauaga

SEQ ID NO: 233053 - RNA, 64 nt, Homo Sapiens
cuugcacagacaaccuaccucagauucccagcuuccagaugaucaccugcguaucugagaguuc

SEQ ID NO: 233054 - RNA, 64 nt, Homo Sapiens
gaaaggaagaccucaagaaagggcuccacuucauccagaugaagcucacugacacaggagggcu

SEQ ID NO: 233055 - RNA, 64 nt, Homo Sapiens
guacaccccaacagcacccucaacagcacccucuccagaugagacuccagaugagaguacaccc

SEQ ID NO: 233056 - RNA, 64 nt, Homo Sapiens; identical to SEQ ID NO: 233055

SEQ ID NO: 233057 - RNA, 64 nt, Homo Sapiens
guacaccccaacagcacccucaacagcacccucuccagaugagaucuccagaugggagugcccc

SEQ ID NO: 233058 - RNA, 64 nt, Homo Sapiens
ugugagaaugcuguguuaaccaccuuaaguguguacaauucaaguuauuaagccacuuugcuua

SEQ ID NO: 233059 - RNA, 64 nt, Homo Sapiens
uaacacuacugcuuuugugcucacauucuuuuccacaauucacaccuccccuccaaacaccuuc

SEQ ID NO: 233060 - RNA, 64 nt, Homo Sapiens
gguuuuaacauauuuaaauacacauuuaaaauacacaauucaguauucacauaccauauaauca

SEQ ID NO: 233061 - RNA, 64 nt, Homo Sapiens
uaccauauaaucacacauuuagccuucaugagauacaauucacacaguguuguuuuguuuaaaa

SEQ ID NO: 233062 - RNA, 64 nt, Homo Sapiens
caggcuacuggaaaauuaaaguuuuauguggggaacaauucaugauucagucacuaacuguaca

SEQ ID NO: 233063 - RNA, 64 nt, Homo Sapiens
cacuaacuguacaguuuuauugggacuuaaguauacaauucagugucucacuaauguaaaauac

SEQ ID NO: 233064 - RNA, 64 nt, Homo Sapiens
uuguuuuaauaucuugcucucugacaggaaagaaacaauucacuuaccagccuccucaccccau

SEQ ID NO: 233065 - RNA, 64 nt, Homo Sapiens
guauuuucaacggaauacacuuugaaagguaaaaacaauucaaaaguaucgauuaucauaaauu

SEQ ID NO: 233066 - RNA, 64 nt, Homo Sapiens
caaagcuaccuuuuuuuuacuaaauacaauucaaacaauucaaugcaugacuggacagcgguug

SEQ ID NO: 233067 - RNA, 64 nt, Homo Sapiens
caauucaaucaaagcuaccucagcgguuguaaauacaauucaaauaacagacagcaugacugga

SEQ ID NO: 233068 - RNA, 63 nt, Homo Sapiens
uuauguuaaaauaauuuuuauuaauuuagagaagacaaucaaugucugugagaaaacggacuu

SEQ ID NO: 233069 - RNA, 63 nt, Homo Sapiens
uuuguucuaaaacuuagacugacaucuagcuuugacaaucauaguauguuuuauuuuccugag

SEQ ID NO: 233070 - RNA, 63 nt, Homo Sapiens
ugcccggguuuuuacauuuuaaaaguuauucuagacaaucacuauuggcuuuuuucuuuuauu

SEQ ID NO: 233071 - RNA, 63 nt, Homo Sapiens
uuucuuuuauuuuuaaaaaacucacauagaggagacaaucagaaauuuaccauagucccaaga

SEQ ID NO: 233072 - RNA, 63 nt, Homo Sapiens
uuaaguuuuaagauaacagauuauuuuaaaugagacaaucauuucauauuauuuuagaaucau

SEQ ID NO: 233073 - RNA, 63 nt, Homo Sapiens
uuauuuuagaaucauuuauuacuauuuaaaugagacaaucauaacauuauuuuagaaucauuu

SEQ ID NO: 233074 - RNA, 63 nt, Homo Sapiens
gcuuccagugcccgcugugcaaucaggccuuuggacaaucacccuccuuuugagaucguggac

SEQ ID NO: 233075 - RNA, 63 nt, Homo Sapiens
ccuuuggacaaucaccgcuuuuuugagaucguggacaaucaggcacaaaaauaccagaucucc

SEQ ID NO: 233076 - RNA, 63 nt, Homo Sapiens
uggagcucagugucaggaaagggggugauaaaugacaaucaaaucgacauggagguugagcac

SEQ ID NO: 233077 - RNA, 63 nt, Homo Sapiens
aaacacauacauggccaaaugcaauacugaagagacaaucauccuguaucuuuuaugguuuuu

SEQ ID NO: 233078 - RNA, 63 nt, Homo Sapiens
aaugaaugaucauggcuauggaaaacagcuauagacaaucauauugaacuuccauugugauau

SEQ ID NO: 233079 - RNA, 63 nt, Homo Sapiens
aaugaaugaucauggcuauggaaaacagcuauagacaaucauacaauucuaccacugugguau

SEQ ID NO: 233080 - RNA, 62 nt, Homo Sapiens
gcaggcuagaccaucuaaguagccauuuucgaacaauucaccaggcauguaaacucaucugc

SEQ ID NO: 233081 - RNA, 62 nt, Homo Sapiens
aucugcuucucugccccucaaacuuuuaguucacaauucaucuucuaccuuaacuugggcuu

SEQ ID NO: 233082 - RNA, 62 nt, Homo Sapiens
gcaaaccaccccuccauauuuccguaccauuuacaauucaguuucugugacaucuuuuuaaa

SEQ ID NO: 233083 - RNA, 62 nt, Homo Sapiens
guguuacagccccuucagaauauaacuucaggacaauucaaacuaugcuuaauguaugauuu

SEQ ID NO: 233084 - RNA, 62 nt, Homo Sapiens
gccgucacuuuggguucuggcauaaguucagaacaauucaaguccaugugucccauggcugg

SEQ ID NO: 233085 - RNA, 62 nt, Homo Sapiens
acaagaaaaggcaacaucucauuuuaaauaguacaauucagaagggauacuaaaucaauaaa

SEQ ID NO: 233086 - RNA, 62 nt, Homo Sapiens
uaaggguguuuaugaaaugagaaaauuauuggacaauucagacuuuacuaaagcacaguuag

SEQ ID NO: 233087 - RNA, 62 nt, Homo Sapiens
ggaaucaagauuuaauccuagagauuugguguacaauucaggcuuuggauguuucuuuagca

SEQ ID NO: 233088 - RNA, 62 nt, Homo Sapiens
aaauacaguagauaagcugucgaaaauggaaaacaauucaauuuuaauuuucugcucugagu

SEQ ID NO: 233089 - RNA, 62 nt, Homo Sapiens
uuaauaaaguugccaaagaagauguauuaugaacaauucagcaauaagacaauugucaacac

SEQ ID NO: 233090 - RNA, 62 nt, Homo Sapiens
ugcacuaauucucaacaugcuaaacauuaacuacaauucacuguugugagaauauuccucgu

SEQ ID NO: 233091 - RNA, 62 nt, Homo Sapiens
ugccauguuuugccacccccggugcuaagcagacaauucaacgaggaauaguacagacagaa

SEQ ID NO: 233092 - RNA, 62 nt, Homo Sapiens
cucuucuucaaaucaaaaugaggugugagguaacaauucaauugcugcuacuuucuguuuua

SEQ ID NO: 233093 - RNA, 62 nt, Homo Sapiens
uuaaggcaacaaacauauaccccugccuggccacaauucaaaucugaauuuagaucuccaga

SEQ ID NO: 233094 - RNA, 62 nt, Homo Sapiens
cacaugcaaucauacaugcaacauauucauacacaauucauaacauacgugcacacacacau

SEQ ID NO: 233095 - RNA, 62 nt, Homo Sapiens
ccggguuccgcaaacacugcgaacuccaggacacaauucagcaguucggcugucauuuaaga

SEQ ID NO: 233096 - RNA, 62 nt, Homo Sapiens
uuccuuauucugagaauuuguggguagggguuacaauucacaggcccucccucagcucucug

SEQ ID NO: 233097 - RNA, 62 nt, Homo Sapiens
cucuccugguuguguaacugaaacucuaguggacaauucagaaggcauagguccagagcacc

SEQ ID NO: 233098 - RNA, 62 nt, Homo Sapiens
aagauuucucuuuuauaccuaucaaucugaacacaauucauaauauauuauguuuauacaaa

SEQ ID NO: 233099 - RNA, 62 nt, Homo Sapiens
cucuuaagauuagcuucacaucaagacacagcacaauucaguaggcaagaggacaggaucuc

SEQ ID NO: 233100 - RNA, 62 nt, Homo Sapiens
guuuucccuuguuuuccucuagcugggcuguaacaauucaggauaccacguuuugcucaaga

SEQ ID NO: 233101 - RNA, 62 nt, Homo Sapiens
gugcuaaaaugaaaaccucuugggauuucaucacaauucauguccugccauagugagagaaa

SEQ ID NO: 233102 - RNA, 62 nt, Homo Sapiens
aaauauuuccaauauaauuugcuuucauaaaaacaauucagccuuacagaauccaagaggaa

SEQ ID NO: 233103 - RNA, 62 nt, Homo Sapiens
augagauuugagugggaacaauuauaggagcuacaauucaaguccucccacaacacguggga

SEQ ID NO: 233104 - RNA, 62 nt, Homo Sapiens
acauucuccugaccacuaaugggagccaauucacaauucacuaagugacuaaaguaaguuaa

SEQ ID NO: 233105 - RNA, 62 nt, Homo Sapiens
gugacagaauacgacucaauucaccggcuacaacaauucauagaauuuuucaauguuuucuu

SEQ ID NO: 233106 - RNA, 62 nt, Homo Sapiens
aaaauauaguuaucuucuuaaaaaccauuauaacaauucagagagaguucuuuacaaagcca

SEQ ID NO: 233107 - RNA, 62 nt, Homo Sapiens
ugagcaaauggaaaagacuuuucauuuaguagacaauucacuucuuuuucugugcuuccccu

SEQ ID NO: 233108 - RNA, 62 nt, Homo Sapiens
uaggugggaugaauuuuuuuuuuaauugugaaacaauucauaagcacaauaugauuuacaga

SEQ ID NO: 233109 - RNA, 62 nt, Homo Sapiens
cuacauuauuuucccucaaacaauuuauuuucacaauucauauuuauuauagauagcagaag

SEQ ID NO: 233110 - RNA, 62 nt, Homo Sapiens
gauacuucucuuuuuuugcuguuccaccaaauacaauucaaaugcuuuuuguuuuauuuuuu

SEQ ID NO: 233111 - RNA, 62 nt, Homo Sapiens
uaaguauauuuuggaacagauuuguaauuuguacaauucaaugcuuuaauuauuuuuucuau

SEQ ID NO: 233112 - RNA, 62 nt, Homo Sapiens
gaacuguuaucggauauaggcagccucaaacgacaauucacgcacuucuuucaggaaauggc

SEQ ID NO: 233113 - RNA, 62 nt, Homo Sapiens
uugagauuuguggggggacaauucugggagauacaauucaagcugucccacaacacguggga

SEQ ID NO: 233114 - RNA, 62 nt, Homo Sapiens
uccauggcccagaugguacucuaggugcacagacaauucaggaaccacaguuuugcugcccu

SEQ ID NO: 233115 - RNA, 62 nt, Homo Sapiens
ucucguccugggcauugugagaacuuaaggccacaauucacguaugcugugcuaucugaaaa

SEQ ID NO: 233116 - RNA, 62 nt, Homo Sapiens
ggcuccuggauuuuaaguaggggaugagacacacaauucauugcagccugcucuugggccug

SEQ ID NO: 233117 - RNA, 62 nt, Homo Sapiens
ggucccuauuuccuuuguacugucuuuaagauacaauucagaaaauauucauugucugaaaa

SEQ ID NO: 233118 - RNA, 62 nt, Homo Sapiens
aguuucugagaccacagaauauccuagacuuaacaauucaucgaacaaaugcaucuuugcgu

SEQ ID NO: 233119 - RNA, 62 nt, Homo Sapiens
cacuuuuauucguaucauugaaaucaagggcuacaauucaagguauuuguacgcacaacauu

SEQ ID NO: 233120 - RNA, 62 nt, Homo Sapiens
cacgacagcucaccucacuucacaacacugggacaauucagacccacacccacccacccaca

SEQ ID NO: 233121 - RNA, 62 nt, Homo Sapiens
gaauuuuaaaguaccucgguuuauagggauuuacaauucaguagaaacuuguuauucaugug

SEQ ID NO: 233122 - RNA, 62 nt, Homo Sapiens
uggguaaggaaaccacuugggguagcaguucaacaauucacuuacgaauguuuauaagcuuu

SEQ ID NO: 233123 - RNA, 62 nt, Homo Sapiens
ggcaacuuggaaucccuaaauucuguaaaaagacaauucaucucauugugaguggaaguagu

SEQ ID NO: 233124 - RNA, 62 nt, Homo Sapiens
uuauuucacugauacuauuaaucaugcaguguacaauucaaaaucaugcaauguuucacuuu

SEQ ID NO: 233125 - RNA, 62 nt, Homo Sapiens
aaauacaguucuguuaauguauuucuucccaaacaauucauuuuucucuucuaaagguaguc

SEQ ID NO: 233126 - RNA, 62 nt, Homo Sapiens
gaaaccagcagauaguaaaccugguucaaaguacaauucaagaaacugaguauuuaugggca

SEQ ID NO: 233127 - RNA, 62 nt, Homo Sapiens
acucaugcugcaugacaaaauguuuacuaauaacaauucauuauaaaguuauaucccucuuu

SEQ ID NO: 233128 - RNA, 62 nt, Homo Sapiens
caaagaaauagaucaguuggagaaaauacaaaacaauucaaagcucuuaagguauuuaaacc

SEQ ID NO: 233129 - RNA, 62 nt, Homo Sapiens
agagaaaggagagucuuuucaagguucccaagacaauucaauacggucaauugauuuuugac

SEQ ID NO: 233130 - RNA, 62 nt, Homo Sapiens
uucaccaccucugguguucaaaauccaagaacacaauucauuguggaggcuuaaaaaaaaaa

SEQ ID NO: 233131 - RNA, 62 nt, Homo Sapiens
uuuauaauauacuuuacuuaaaguaaaaugaaacaauucauucugguaaacacauuuuuaaa

SEQ ID NO: 233132 - RNA, 62 nt, Homo Sapiens
gagugggcuaagcacgggcccacuaaaaucaaacaauucagguuaggaagaauuuuuauauc

SEQ ID NO: 233133 - RNA, 62 nt, Homo Sapiens
uuuauuagcucuacuacuugaacacuaaaaauacaauucaaaaguuacauuuuuuucuuuuu

SEQ ID NO: 233134 - RNA, 62 nt, Homo Sapiens
uucuaugaccaaaaugaguuagaaaucuauucacaauucagcuccaguugaaagaggguggu

SEQ ID NO: 233135 - RNA, 62 nt, Homo Sapiens
gaaauacagcaguguguggaauauuagggaucacaauucacuggucuaaagcuguguccuga

SEQ ID NO: 233136 - RNA, 62 nt, Homo Sapiens
uauuucuguaguuuguaaacucugcauguguuacaauucaguuagaagcacuugaaauaauc

SEQ ID NO: 233137 - RNA, 62 nt, Homo Sapiens
agaccagaaguggacgcaacaaacugccuuccacaauucacuacucaugacuccuuucucua

SEQ ID NO: 233138 - RNA, 62 nt, Homo Sapiens
ugauuucuauguuucuuaaucauaguuuuaauacaauucacauauauaauauugucauaugu

SEQ ID NO: 233139 - RNA, 62 nt, Homo Sapiens
aaagcauccugccucagaaucccugguugaaaacaauucagucucauuccugauguuugaua

SEQ ID NO: 233140 - RNA, 62 nt, Homo Sapiens
ugugagaaugcuguguuaacccuuaaguguguacaauucaagauuaagccacuuugcuuaca

SEQ ID NO: 233141 - RNA, 62 nt, Homo Sapiens
uaacacuacugcuuuugugcacauucuuuuccacaauucacauccccuccaaacaccuucuc

SEQ ID NO: 233142 - RNA, 62 nt, Homo Sapiens
cuauuuaaucuauuaaauuuuuaaaaauugagacaauucaauaaaauuuaugguggaaaacc

SEQ ID NO: 233143 - RNA, 62 nt, Homo Sapiens
cugaggguugagacaaaacuagaucaauccucacaauucagaugcuggcuggacugaacuga

SEQ ID NO: 233144 - RNA, 62 nt, Homo Sapiens
acuuaaguaccaaaaugcauuucuuguucuucacaauucaugcugugacuauaguacguugc

SEQ ID NO: 233145 - RNA, 62 nt, Homo Sapiens
ccuaugggcuaguguguggugaucaaacuaucacaauucagugugaugagcagcauagcaaa

SEQ ID NO: 233146 - RNA, 62 nt, Homo Sapiens
aauuuuacuuuaaaugcauuuuacuacaaagcacaauucauuuguaaugcauauccaucuug

SEQ ID NO: 233147 - RNA, 62 nt, Homo Sapiens
uuuagacuuaaguggugcuuugugguaucugaacaauucauaacauguaaauaaugugggaa

SEQ ID NO: 233148 - RNA, 62 nt, Homo Sapiens
agcuuuuguucacagcuugaaauagaugccucacaauucagacaguuuaauucaggaacugu

SEQ ID NO: 233149 - RNA, 62 nt, Homo Sapiens
cgcuacuaguuauucagagcaugguuggaagcacaauucauuugaggacgauguuuggaaau

SEQ ID NO: 233150 - RNA, 62 nt, Homo Sapiens
agcaacaguauauacacugauauuauacuccaacaauucaugcuuaguuaaggauaguuaac

SEQ ID NO: 233151 - RNA, 62 nt, Homo Sapiens
ggcgaggagauucuguaaacaaaugguuaaugacaauucagaguuagauaugauaguauaaa

SEQ ID NO: 233152 - RNA, 62 nt, Homo Sapiens
aaaaauaaauaugucauuguaaagucacaaaaacaauucacuaaaaacaaaugauuuuuuua

SEQ ID NO: 233153 - RNA, 62 nt, Homo Sapiens
uuuuaguuuucuuuuacuuacuuuuguagaccacaauucacucuuauagucgugacuuuaaa

SEQ ID NO: 233154 - RNA, 62 nt, Homo Sapiens
ugaauuugacaaacugaaacacuuaagaaaauacaauucacucuuuuuuuguaaagcaaauu

SEQ ID NO: 233155 - RNA, 62 nt, Homo Sapiens
auuuuauaccuucaaugggacuaagucuuacaacaauucaucuccagacugagacucagugu

SEQ ID NO: 233156 - RNA, 62 nt, Homo Sapiens
gguuuuaacauauuuaaauacauuuaaaauacacaauucaguucacauaccauauaaucaca

SEQ ID NO: 233157 - RNA, 62 nt, Homo Sapiens
uaccauauaaucacacauuuccuucaugagauacaauucacaguguuguuuuguuuaaaaag

SEQ ID NO: 233158 - RNA, 62 nt, Homo Sapiens
ucaacuuuugaaauuuaaaaaucuuucagaauacaauucaguuuuaguuucaaaauguuaac

SEQ ID NO: 233159 - RNA, 62 nt, Homo Sapiens
uggucacaggggugucuugucugagaacaaauacaauucagucuucucuuugggguuuuagu

SEQ ID NO: 233160 - RNA, 62 nt, Homo Sapiens
acacugcagcucuuuucaguuuuugcuuauacacaauucauucuuugcagcuaauuaagccg

SEQ ID NO: 233161 - RNA, 62 nt, Homo Sapiens
aacuuucucuugcuaucauugcuccuuuugaaacaauucaauuuucaugucuacagcugacu

SEQ ID NO: 233162 - RNA, 62 nt, Homo Sapiens
uucuuugucccaccaacuuaaaaaaaaaaaguacaauucauuguuuugcaaaaguguauggu

SEQ ID NO: 233163 - RNA, 62 nt, Homo Sapiens
cauuuaccuuuauuccugguucuuaaaaggugacaauucauucuuuaacccagauggucuua

SEQ ID NO: 233164 - RNA, 62 nt, Homo Sapiens
agguucucauuccuuuucccauuauacuucucacaauucaguuucuaugaguuugaucaccu

SEQ ID NO: 233165 - RNA, 62 nt, Homo Sapiens
uaaggcuauuuaaauuaauucaaauuaaauguacaauucagucacucauucucaucaaccac

SEQ ID NO: 233166 - RNA, 55 nt, Homo Sapiens
gauauuuauguguacauuuaguaugacaauucacuuuccugaaucugagucuuga

SEQ ID NO: 233167 - RNA, 62 nt, Homo Sapiens
gcacaguacacacaaaaaccuuugaagcaaauacaauucacacccugugaaacgucccacac

SEQ ID NO: 233168 - RNA, 62 nt, Homo Sapiens
uuugacaaaugcugacagggaaaacauggaagacaauucauguuccauaaguggccuuuaag

SEQ ID NO: 233169 - RNA, 62 nt, Homo Sapiens
cuugugugugcgugucaguuacuuuuuuaguaacaauucagauccaguguaaacuuccguuc

SEQ ID NO: 233170 - RNA, 62 nt, Homo Sapiens
cgcaacucaaaucugugcuggacuuuaaaaaaacaauucaggaccaaauuuuuucucagugu

SEQ ID NO: 233171 - RNA, 62 nt, Homo Sapiens
cccacccacgacacgugggaauugugggagcuacaauucaagaugagauuuggaugggacac

SEQ ID NO: 233172 - RNA, 62 nt, Homo Sapiens
aauugacauuaagagacacuucauagguucccacaauucaguaugggauaggcuuuuuaaaa

SEQ ID NO: 233173 - RNA, 62 nt, Homo Sapiens
uuuugaguuguucuugucauagacauaaaaagacaauucauuuucuuguuuuauuaacucug

SEQ ID NO: 233174 - RNA, 62 nt, Homo Sapiens
gguccaauauccagaaucuacaaggaacuuaaacaauucaacaagcaagaagaaaaaaccca

SEQ ID NO: 233175 - RNA, 62 nt, Homo Sapiens
ugcauauaauagccuaacucacccucaaauuaacaauucaauaauaaaaagaauuauaaaau

SEQ ID NO: 233176 - RNA, 62 nt, Homo Sapiens
gccuguggucuccacauaaacucaccucaaagacaauucauaagguccuucccaccugugac

SEQ ID NO: 233177 - RNA, 62 nt, Homo Sapiens
caggcuacuggaaaauuaaauuuauguggggaacaauucaugucagucacuaacuguacagu

SEQ ID NO: 233178 - RNA, 62 nt, Homo Sapiens
cacuaacuguacaguuuuauggacuuaaguauacaauucagucucacuaauguaaaauacug

SEQ ID NO: 233179 - RNA, 62 nt, Homo Sapiens
auggcagaaguaauuugggagacuacugaugcacaauucagagaagucuggaaaacuccucu

SEQ ID NO: 233180 - RNA, 62 nt, Homo Sapiens
uucuacuaaauguguaccaugugcaguguuucacaauucauucuugagaaaugauguugcua

SEQ ID NO: 233181 - RNA, 62 nt, Homo Sapiens
uuaauuccccaaccuuauucgaauggaauauaacaauucagcuuaaaaauauuuauuaaugu

SEQ ID NO: 233182 - RNA, 62 nt, Homo Sapiens
uuuguuuuguuuuguuuguucuuuuaaauuauacaauucauuuacauaccauaagauucacc

SEQ ID NO: 233183 - RNA, 62 nt, Homo Sapiens
auuauuauucagcagcacauucugaggggggaacaauucacaccaccaauaauaaccuggua

SEQ ID NO: 233184 - RNA, 62 nt, Homo Sapiens
aaagaauauaaaugaggucucguugaugcuggacaauucaagaauucagacuugaaccuuaa

SEQ ID NO: 233185 - RNA, 62 nt, Homo Sapiens
agcagggaccuaaacuuuggcaaaaagugaacacaauucaaauacgaaugaaggaagagccc

SEQ ID NO: 233186 - RNA, 62 nt, Homo Sapiens
gaaauagcauaucugagacugaagagaaauugacaauucacuuauuugugguuuuuuucuca

SEQ ID NO: 233187 - RNA, 62 nt, Homo Sapiens
ugaaauacuaauugugucagaaugccuaauaaacaauucaagugucuuuugucauguggcua

SEQ ID NO: 233188 - RNA, 62 nt, Homo Sapiens
gacuuaauaucuauuccauuuuauguagcuugacaauucaguggugguugauugguuuuauu

SEQ ID NO: 233189 - RNA, 62 nt, Homo Sapiens
cugcacgcagaagucagaauucuugcuccucuacaauucauuccagcuguuccugcuuccac

SEQ ID NO: 233190 - RNA, 62 nt, Homo Sapiens
augcaacuugcuuuuauaccaauaaacugcauacaauucaaauguaaaauuauucuuuucug

SEQ ID NO: 233191 - RNA, 62 nt, Homo Sapiens
uaagaugcuuugacacugaaaaaauuacuuacacaauucaguuuacuucuaaaauuacagac

SEQ ID NO: 233192 - RNA, 62 nt, Homo Sapiens
uuuauuaauagaaaauaaacuccacuuuugucacaauucauuggggggaggggaagccagag

SEQ ID NO: 233193 - RNA, 62 nt, Homo Sapiens
acugauuauucuucuuacauucauuccacuauacaauucagucgguuggaaccuaaugggaa

SEQ ID NO: 233194 - RNA, 62 nt, Homo Sapiens
ucauugaccaagaugaucaccccagaaauaggacaauucacugauucgccaucacccccuac

SEQ ID NO: 233195 - RNA, 62 nt, Homo Sapiens
agucaauguauuggugacuguugauuuguugaacaauucaggaaucaagggcuguggagaaa

SEQ ID NO: 233196 - RNA, 62 nt, Homo Sapiens
agaugaaauaguuugaauaaacugguaaaauaacaauucauacuaucucuacauauuuuuag

SEQ ID NO: 233197 - RNA, 62 nt, Homo Sapiens
cuuguuacuuucuacucugcaaugauguauuaacaauucaugguauuuauuuguuauucuuc

SEQ ID NO: 233198 - RNA, 62 nt, Homo Sapiens
agccucagauucuucaucugacaaaaaacaaaacaauucauugguaugaauuaaaagcaaaa

SEQ ID NO: 233199 - RNA, 62 nt, Homo Sapiens
guuuaaaaauaaaaauauuuuaugaaagauguacaauucaguggcuagaaucucauguuuua

SEQ ID NO: 233200 - RNA, 62 nt, Homo Sapiens
cuacguuauuuucccucaaacaauuuauuuucacaauucauauuuauuauagauagcagaag

SEQ ID NO: 233201 - RNA, 62 nt, Homo Sapiens
guuuuaauaucuugcucucugacaggaaagaaacaauucacuuaccagccuccucaccccau

SEQ ID NO: 233202 - RNA, 62 nt, Homo Sapiens
auuuucaacggaauacacuuugaaagguaaaaacaauucaaaaguaucgauuaucauaaauu

SEQ ID NO: 233203 - RNA, 62 nt, Homo Sapiens
uucuuuucucaguuuuauaaacacagaauauaacaauucacuuuaaacuuuuauuaccacag

SEQ ID NO: 233204 - RNA, 62 nt, Homo Sapiens
uaauuauuuuuaauugagaacaacucaugaucacaauucauaaaauccauauuuuaagacaa

SEQ ID NO: 233205 - RNA, 62 nt, Homo Sapiens
cugcucugggaaggggcuuuuagauguaaccuacaauucaguuaggcuagagacagaugcug

SEQ ID NO: 233206 - RNA, 62 nt, Homo Sapiens
caucucuuagccuaauuugaaauagcacaaucacaauucaaaauguuuagucuucucacuaa

SEQ ID NO: 233207 - RNA, 62 nt, Homo Sapiens
uuuauuauagauagcagaagcaauuuauuuucacaauucauaaaaccuacauuauuuucccu

SEQ ID NO: 233208 - RNA, 62 nt, Homo Sapiens
uccaggucuucaucaggguuucugaaaaacgaacaauucacucaaggucaaggaagcuagag

SEQ ID NO: 233209 - RNA, 62 nt, Homo Sapiens
aaaaaaaaagaugaaaaaagaaauguuuguguacaauucaaauguauguuggauuauguagg

SEQ ID NO: 233210 - RNA, 62 nt, Homo Sapiens
gguuagguugcagagagcugucaacaaaagauacaauucaagaacuggguuugaaaaaauaa

SEQ ID NO: 233211 - RNA, 62 nt, Homo Sapiens
guuaaaaaacaaccaaaccuuaaaugcccagcacaauucauuaauaauaagcccucuauaca

SEQ ID NO: 233212 - RNA, 62 nt, Homo Sapiens
uucacccgcccugaugcuaagguggagcuggaacaauucagacugagcuuucugugcuucua

SEQ ID NO: 233213 - RNA, 62 nt, Homo Sapiens
uucacuugggaauagcagaaauguauaaaguaacaauucagaaagauacuuuucauuuuaaa

SEQ ID NO: 233214 - RNA, 62 nt, Homo Sapiens
uccauaugccagggcccugguuugaccgacagacaauucacacagagcuccuggccagagcg

SEQ ID NO: 233215 - RNA, 62 nt, Homo Sapiens
gggaagcagcauuucuuguuuacacccccgaaacaauucaaaauagaaauaagugcaauuuc

SEQ ID NO: 233216 - RNA, 62 nt, Homo Sapiens
ucuuauuaucaagguucuaccuauguuaauuuacaauucauguuucaagacauuugccaaau

SEQ ID NO: 233217 - RNA, 62 nt, Homo Sapiens
uugccaccccuucacgugcacccucaauuuccacaauucacuugaaugacuuguuuuauuug

SEQ ID NO: 233218 - RNA, 62 nt, Homo Sapiens
gucgguuagucauugauagaacuacuuugaaaacaauucaguggucuuauuuuugggugauu

SEQ ID NO: 233219 - RNA, 62 nt, Homo Sapiens
uccacgcccuuuuccucuuugaagagucaaguacaauucagacaaacugcuuucuccugucc

SEQ ID NO: 233220 - RNA, 62 nt, Homo Sapiens
gaggagcugccccaccagccauccuugaagagacaauucagggcaguugaugaauaucaggg

SEQ ID NO: 233221 - RNA, 62 nt, Homo Sapiens
acuagaaaacaaagaaaaaugauuaauaaaugacaauucagagccauuuauucucugcaugc

SEQ ID NO: 233222 - RNA, 62 nt, Homo Sapiens
cccgauaugauuuaggaugcauaucaguucuaacaauucaaucagaagucaagcucauugga

SEQ ID NO: 233223 - RNA, 62 nt, Homo Sapiens
gccagugggccugccuuaggguaccaugcaggacaauucaaggaccagccuuuuuaccacug

SEQ ID NO: 233224 - RNA, 62 nt, Homo Sapiens
acuuuuccccacauauggggcacuggcuucaaacaauucaguucaguaucauuacuuuuaau

SEQ ID NO: 233225 - RNA, 62 nt, Homo Sapiens
cuaagagauuuuuaaauucugaaaaacugcuuacaauucauguuuucuagccacuccacaaa

SEQ ID NO: 233226 - RNA, 62 nt, Homo Sapiens
gucuuauuaacucuuagcuccucaguuagaaaacaauucaccuggcuuagucuugucuaguu

SEQ ID NO: 233227 - RNA, 62 nt, Homo Sapiens
gguuuuuaguauuuuugcaguaaaauauacauacaauucaguuaccauacaguucacucauu

SEQ ID NO: 233228 - RNA, 62 nt, Homo Sapiens
auauaauuacacaaauaauuuaauacucauuuacaauucaauuccgaauggagguucaugua

SEQ ID NO: 233229 - RNA, 62 nt, Homo Sapiens
gccugcuuuccccagcuccaaagucucucuagacaauucagggggccguggccuccuccacc

SEQ ID NO: 233230 - RNA, 62 nt, Homo Sapiens
uacauguucuacccagcauuugucuguacuuuacaauucaacucagauggguagaguaaaag

SEQ ID NO: 233231 - RNA, 62 nt, Homo Sapiens
ccuuugaaaaucuggcuuucuaauucagcacuacaauucagaguguuuaccaaacauaccaa

SEQ ID NO: 233232 - RNA, 62 nt, Homo Sapiens
ggggccugcauggcaggagugguauguuuuucacaauucaugagaaagaaagaaggaaagag

SEQ ID NO: 233233 - RNA, 62 nt, Homo Sapiens
uacaaaagcggcagcagccauugagguuuaaaacaauucaauacagcggcaguccuguuugu

SEQ ID NO: 233234 - RNA, 62 nt, Homo Sapiens
aaucauuagcucgggucacuaaaaacuucacaacaauucagcgaguagguggcagauguagc

SEQ ID NO: 233235 - RNA, 62 nt, Homo Sapiens
augguaacgugacugucaucuagcuucucuggacaauucagcagcccugaguaguaacuggu

SEQ ID NO: 233236 - RNA, 62 nt, Homo Sapiens
uuucaguugguuucugcuuuuaauuuacuuguacaauucauuguuacuguucuguuuuucua

SEQ ID NO: 233237 - RNA, 62 nt, Homo Sapiens
gaacuuaauuuaaaagucuuaaauauucugauacaauucagcugucuucucuaccuuaccau

SEQ ID NO: 233238 - RNA, 62 nt, Homo Sapiens
auuauauuacuaauaaaacuuaaccaacacuuacaauucagucaucaaaguaaguaaaaauu

SEQ ID NO: 233239 - RNA, 62 nt, Homo Sapiens
cuucgggaauauuuuauaaguaaacuaaaagcacaauucauaucaauuuaaaucauauaucc

SEQ ID NO: 233240 - RNA, 62 nt, Homo Sapiens
augcagcaguuucuccaaaauucaaagugguuacaauucauacgucauugaaggacaauuuc

SEQ ID NO: 233241 - RNA, 62 nt, Homo Sapiens
agugaguuuucuuauuauagaacagaaacaucacaauucaaauaacguauuguccuuccguu

SEQ ID NO: 233242 - RNA, 62 nt, Homo Sapiens
uguuggcuuguuuugacuuacuggccauagguacaauucaguauguauuuuagugccaccca

SEQ ID NO: 233243 - RNA, 62 nt, Homo Sapiens
ugucuaccacaagucuguaaauauuggaaugaacaauucacacuaccacugcaauucacauu

SEQ ID NO: 233244 - RNA, 62 nt, Homo Sapiens
uuaguggcuguuuuacuaauuaaaggacauccacaauucaauguauaacagaaaaaguaaug

SEQ ID NO: 233245 - RNA, 62 nt, Homo Sapiens
acaaagcaaaucacauuuagcuucaaauuguaacaauucaauugaauuuuaaaaugacaccu

SEQ ID NO: 233246 - RNA, 62 nt, Homo Sapiens
gaaaauccaguuggccucucuccucuauccacacaauucaacuugauaacuggacuuuagga

SEQ ID NO: 233247 - RNA, 62 nt, Homo Sapiens
augaaugccuuuauagauagucacuuguuucuacaauucaguauuugauguggucguguaaa

SEQ ID NO: 233248 - RNA, 62 nt, Homo Sapiens
cuaagacacuaauauauguaucuuauaaacaaacaauucaacucagaaguuuaugagaagac

SEQ ID NO: 233249 - RNA, 51 nt, Homo Sapiens
auuuaguucuuuuggacuaauacaauucaggaaagaaaaaacccaaaaacc

SEQ ID NO: 233250 - RNA, 62 nt, Homo Sapiens
uccuuucauuuuuccagccaugcauuccuaacacaauucagugguacuuggaauccuguuuu

SEQ ID NO: 233251 - RNA, 62 nt, Homo Sapiens
uuugggacuucugacaggcaucuggugaagagacaauucaagccuuagugacuauuuagaau

SEQ ID NO: 233252 - RNA, 62 nt, Homo Sapiens
gcguggcagcaaccaugcagagugacugaaacacaauucauuucugacugacauuccuuucu

SEQ ID NO: 233253 - RNA, 62 nt, Homo Sapiens
ccugaagucaaaucucuaucuauacaagugauacaauucauagggggcuggcuccucccaga

SEQ ID NO: 233254 - RNA, 62 nt, Homo Sapiens
aauaccauaaagcucucacccuucuaaaguguacaauucaguggugugaguauauucauaag

SEQ ID NO: 233255 - RNA, 62 nt, Homo Sapiens
cacggguuuccauagccaggcaguugguauguacaauucaguucagcguaugaacuuguauc

SEQ ID NO: 233256 - RNA, 62 nt, Homo Sapiens
uacccauuuacuuguugauguauggauauaccacaauucauuaaauguugaauauucccuug

SEQ ID NO: 233257 - RNA, 62 nt, Homo Sapiens
uucagcucuggauuacuucauugaaaaucugcacaauucaguacaugacuucugugacuuca

SEQ ID NO: 233258 - RNA, 62 nt, Homo Sapiens
ugcuuuuuuuuuuugguccauccagcuacaaaacaauucaauggaccccccuugcccaugcc

SEQ ID NO: 233259 - RNA, 62 nt, Homo Sapiens
auguugcugcuuuccauuaagaguuugaucacacaauucauauucuaauuagcucauuugug

SEQ ID NO: 233260 - RNA, 62 nt, Homo Sapiens
aucuacaccaguuggcucuucagaagggaaggacaauucagucauacaaggaguuugaaaag

SEQ ID NO: 233261 - RNA, 62 nt, Homo Sapiens
uugaaaagagcuuuuuucccuuugccaacaucacaauucauccuagcauauaaguuuggaag

SEQ ID NO: 233262 - RNA, 62 nt, Homo Sapiens
uucaaaggagcuuuucaaauguaaguuuaaaaacaauucaugauuaggcuuauugcuagacu

SEQ ID NO: 233263 - RNA, 62 nt, Homo Sapiens
uuuuaaaaaauaaagcuuaauacauuguaaauacaauucaguucaauuuuauagacuuguuc

SEQ ID NO: 233264 - RNA, 62 nt, Homo Sapiens
ucaguaagaagauggaguagauaucagauaaaacaauucacguuuaauauguaaauguacca

SEQ ID NO: 233265 - RNA, 62 nt, Homo Sapiens
uguuucuugcugccaugauguauauccauauaacaauucaguaacaaagguuuaaaguuuga

SEQ ID NO: 233266 - RNA, 62 nt, Homo Sapiens
cugguucuuauccauuaucaucuucacuucagacaauucagaagcaucaccaugcauggugg

SEQ ID NO: 233267 - RNA, 62 nt, Homo Sapiens
agguuaagaaucaaucuucuuuuuguaucugcacaauucaguaauuuugucaugcuaagcac

SEQ ID NO: 233268 - RNA, 62 nt, Homo Sapiens
ucgaagaguugugaacuguuaccagauucauuacaauucaaaauuagagaaaaauccuuguc

SEQ ID NO: 233269 - RNA, 62 nt, Homo Sapiens
aaauguuauuguaagucuguguuguaaauauuacaauucaugagagagacucuuacuaacau

SEQ ID NO: 233270 - RNA, 62 nt, Homo Sapiens
guuagauuugggugaggacaguggggauugcuacaauucaagccuggucccacccuugacac

SEQ ID NO: 233271 - RNA, 62 nt, Homo Sapiens
ccacuacuuguaucuuucuuuugaaccauuagacaauucaaagcacucugggccuauuugua

SEQ ID NO: 233272 - RNA, 62 nt, Homo Sapiens
cucauggggcaaaaguaaauaaacagcuuauuacaauucaacaauucaaacucaauauuuuu

SEQ ID NO: 233273 - RNA, 62 nt, Homo Sapiens
ugccucagccuucacuaauuaggaauauugugacaauucauugcuaauaaaacauaacauga

SEQ ID NO: 233274 - RNA, 62 nt, Homo Sapiens
agucuugucauuuuguuuacacauuggggaaaacaauucaguuuauuaaacguuucauguaa

SEQ ID NO: 233275 - RNA, 62 nt, Homo Sapiens
aaacauaaacuuuuuuuauaaaaauauuuuguacaauucauuaaaggcuaauuuaugaaauu

SEQ ID NO: 233276 - RNA, 62 nt, Homo Sapiens
guguuuuuguaaaguguggucccaacaggaggacaauucaugaacuucgcaucaaaagacaa

SEQ ID NO: 233277 - RNA, 62 nt, Homo Sapiens
uccucccaaccaaccagucugcuucuuuguucacaauucaguauuuaugcaaauuugaacua

SEQ ID NO: 233278 - RNA, 62 nt, Homo Sapiens
cauuugcauccaugggcacaucaagccuaaagacaauucauuguugaguagccagaugaaau

SEQ ID NO: 233279 - RNA, 62 nt, Homo Sapiens
cagcaauguaugauugauccacagccacucauacaauucagaaguggcucuacuuuuuacau

SEQ ID NO: 233280 - RNA, 62 nt, Homo Sapiens
gaguuuugauaaauugauauuacuuuaaauauacaauucaguuauuuacaauaaaauguucc

SEQ ID NO: 233281 - RNA, 62 nt, Homo Sapiens
aacaacggcuaauuuuuucuagcaaaacaaaaacaauucaggguugauaucguugaaugaaa

SEQ ID NO: 233282 - RNA, 62 nt, Homo Sapiens
uuuacauguuuugggcaguaaggugaauuuuuacaauucaguaccuccuuuuaccuuuagau

SEQ ID NO: 233283 - RNA, 62 nt, Homo Sapiens
aaagaaacaaaguuaugggguuaaucuccuacacaauucauuuacuucguuugaauguuaua

SEQ ID NO: 233284 - RNA, 62 nt, Homo Sapiens
uucuuugggaugguuuuuacuuaaguccauuaacaauucagguuucuaacgagacccauccu

SEQ ID NO: 233285 - RNA, 62 nt, Homo Sapiens
acuaaaauuguuuuucuaccauaucaaauuaaacaauucaugccuuuauagggucaggccua

SEQ ID NO: 233286 - RNA, 62 nt, Homo Sapiens
acuuucucuuuugaauguuaagaauaacuaauacaauucauugugaacagaaguccuuaagc

SEQ ID NO: 233287 - RNA, 62 nt, Homo Sapiens
agcauuugccuucuuuaaugaaugauggucucacaauucaguugacuuugaccuaauauuua

SEQ ID NO: 233288 - RNA, 62 nt, Homo Sapiens
gucuccaaaaagauauuaccuuauugggcuuaacaauucacaaggcacuuucacacccauua

SEQ ID NO: 233289 - RNA, 62 nt, Homo Sapiens
uuagcugcaagaaugcacuuuagaacuauuugacaauucagacuuucaaaauaaagauguaa

SEQ ID NO: 233290 - RNA, 62 nt, Homo Sapiens
aacaacaaaaaguuacgggguucaucuccuacacaauucauuuacuccauuugaaugcuaga

SEQ ID NO: 233291 - RNA, 62 nt, Homo Sapiens
ccaagucccucuaacuuugccuuugauaccaaacaauucaaaaguuggaucugaguuuggag

SEQ ID NO: 233292 - RNA, 62 nt, Homo Sapiens
uuggugcacagagauugacuugauucagagagacaauucacuccaucccuauggcagaggaa

SEQ ID NO: 233293 - RNA, 62 nt, Homo Sapiens
acaucuaaaacauuauucuuuaaugggauaauacaauucauugagcagcuaccacuuaaaaa

SEQ ID NO: 233294 - RNA, 62 nt, Homo Sapiens
uacuucauuugaauguuauauuaaucuccuacacaauucauuaaagaaacaaaguuaugggg

SEQ ID NO: 233295 - RNA, 62 nt, Homo Sapiens
uacuucauuugaauguuagauuaaucuccuacacaauucauuaacgaaacaaaguuaugggg

SEQ ID NO: 233296 - RNA, 62 nt, Homo Sapiens
guguuaccuguagauucaggcuugccugugcuacaauucauugucgauuuaugccucagcca

SEQ ID NO: 233297 - RNA, 62 nt, Homo Sapiens
uugauuauaaacuauuugacaucaaguuaaacacaauucauuugaaguuauuccauauaagu

SEQ ID NO: 233298 - RNA, 62 nt, Homo Sapiens
caugccacuggaaacaacagacucuuaaacuaacaauucaagcaggcgccaagugcuaugac

SEQ ID NO: 233299 - RNA, 62 nt, Homo Sapiens
auucagccuacccuguauuugccauaaacuccacaauucacaccaaaaugucuguacuuaga

SEQ ID NO: 233300 - RNA, 62 nt, Homo Sapiens
uuguguauuuucuuuggggguggaaaaggaaaacaauucaagcugagaaaaguauucucaaa

SEQ ID NO: 233301 - RNA, 62 nt, Homo Sapiens
aaucuucuguaaggauuuuagaugauaaggcuacaauucagaaucuucugaaccaucuaugu

SEQ ID NO: 233302 - RNA, 62 nt, Homo Sapiens
aguggccuuggauauccuguuuguuaauaaagacaauucaaccagcucccaccaugcaggcc

SEQ ID NO: 233303 - RNA, 62 nt, Homo Sapiens
ccucuacaacuuguuacagccuucacauuuguacaauucauugauucucuuuuccuuccaca

SEQ ID NO: 233304 - RNA, 62 nt, Homo Sapiens
agucaggucaagugaugcuuuugagcuuacacacaauucacaggcccaccagugacaauuua

SEQ ID NO: 233305 - RNA, 62 nt, Homo Sapiens
gggcauuuuccucuccuuaucuugccccagagacaauucaagauuucuauaugggguugugg

SEQ ID NO: 233306 - RNA, 62 nt, Homo Sapiens
auuaucagcaugaugaaaggugugucuaaaaaacaauucagaauaccagcagcauuguacag

SEQ ID NO: 233307 - RNA, 62 nt, Homo Sapiens
aaaaaauauaaaugaggucucguugauguuggacaauucaagaauucagacuugaaccuuaa

SEQ ID NO: 233308 - RNA, 62 nt, Homo Sapiens
cccccuuaaagcgaacacugaaaugcagguagacaauucaaagucuggagaagagggaucau

SEQ ID NO: 233309 - RNA, 62 nt, Homo Sapiens
caauuuuauuuuuagcauacggacaaaaucauacaauucaguaaaagagacuucaauguugu

SEQ ID NO: 233310 - RNA, 62 nt, Homo Sapiens
agcaccuaaaaagaauaggcaauuaaauauccacaauucaaauauaagcaauauggaacucg

SEQ ID NO: 233311 - RNA, 62 nt, Homo Sapiens
ccuguguaccugccacauccgcugggcagcucacaauucacaaccugccuucuccacuagua

SEQ ID NO: 233312 - RNA, 62 nt, Homo Sapiens
cagcccaggcuuccuccacacagucauaauucacaauucagauguuaucucuggugggcugg

SEQ ID NO: 233313 - RNA, 62 nt, Homo Sapiens
guucuugagcaaacugaguucccacuggcaggacaauucacacaggucccauuucugaucac

SEQ ID NO: 233314 - RNA, 62 nt, Homo Sapiens
gguuuuaaugagacccaaaugacucucucuuaacaauucaagcaguagacaaaguugcucac

SEQ ID NO: 233315 - RNA, 62 nt, Homo Sapiens
auuaaauuuggcagaguuuaauugagcaaaggacaauucacaaaucagguagccccugaacc

SEQ ID NO: 233316 - RNA, 62 nt, Homo Sapiens
ccuuucauaguuuauuauuauguaacacauaaacaauucaugcaauauaaaccguggucuca

SEQ ID NO: 233317 - RNA, 62 nt, Homo Sapiens
gagaauuugccuuuguggcacucacguuacgaacaauucacaugcagcauguugacaccaac

SEQ ID NO: 233318 - RNA, 62 nt, Homo Sapiens
gggcacggucaaagugcuuucaccgagugcuuacaauucagugggauaacaauaguagguaa

SEQ ID NO: 233319 - RNA, 62 nt, Homo Sapiens
ccaugacagaauccaaagguuuuugcgguuacacaauucaauuuaggacuucaauauauaaa

SEQ ID NO: 233320 - RNA, 62 nt, Homo Sapiens
cccagaauccauuccauuugugauuccaugauacaauucaccaguaaccuaucuuacaugag

SEQ ID NO: 233321 - RNA, 62 nt, Homo Sapiens
gagcauguguguauucagucagauacuggcagacaauucagaacuuucaccacaugagauaa

SEQ ID NO: 233322 - RNA, 62 nt, Homo Sapiens
aacucuagccugaauucuuuucaauaaaaaauacaauucaaguugcuucucauggauggcac

SEQ ID NO: 233323 - RNA, 62 nt, Homo Sapiens
gagagugugagcagggcuugcuccugccaaccacaauucaaugaauccccgaccccccuacc

SEQ ID NO: 233324 - RNA, 62 nt, Homo Sapiens
auaauccucaauuuuuccuuaucuuguuuuccacaauucacaagcaacagcaagcauuuucu

SEQ ID NO: 233325 - RNA, 62 nt, Homo Sapiens
uauagccaaucuugcaugagugguuucguaauacaauucaccaaaaucuagaagaacuugga

SEQ ID NO: 233326 - RNA, 62 nt, Homo Sapiens
cuggugacaaacccuaugaaaauaaacaucagacaauucacauuacuuggcuuucaaacuug

SEQ ID NO: 233327 - RNA, 62 nt, Homo Sapiens
ccuuguaagucacaaagccaacaccuuccaucacaauucaacaaaguguaaugaguguggca

SEQ ID NO: 233328 - RNA, 62 nt, Homo Sapiens
ccuguaagucauaaggcaauagaccuuccaucacaauucaacauaguguaaugaguguggca

SEQ ID NO: 233329 - RNA, 62 nt, Homo Sapiens
ccuuucacaucaguuaauuuaggucauuagguacaauucacuccuuacaaaugaguguggug

SEQ ID NO: 233330 - RNA, 62 nt, Homo Sapiens
ccuacacagcaucagagaauagguuuucagucacaauucacucaaguauaauaaauguggca

SEQ ID NO: 233331 - RNA, 62 nt, Homo Sapiens
ggccucucauacccucuacuaaaauuccuaagacaauucagguucgcaaaugcucacugaag

SEQ ID NO: 233332 - RNA, 62 nt, Homo Sapiens
ugaaaacugaaugucaagaaaaggagucaagaacaauucacaguaugagaagaaaaauggaa

SEQ ID NO: 233333 - RNA, 62 nt, Homo Sapiens
gcauuagaaacauugagaguuauuugugcacuacaauucaaaaauauaaugaaauaaauauu

SEQ ID NO: 233334 - RNA, 62 nt, Homo Sapiens
uagaggcuucaaucauagaaucccucuccugcacaauucauuguagucaguuguuuacaaac

SEQ ID NO: 233335 - RNA, 62 nt, Homo Sapiens
gaccucaccugucggaccuaugcuaaccuaugacaauucaggaggucugugugucugcagac

SEQ ID NO: 233336 - RNA, 62 nt, Homo Sapiens
guugcacccccaccucagagcuggaggaauacacaauucaucccuccacuccgcugagaauc

SEQ ID NO: 233337 - RNA, 62 nt, Homo Sapiens
gguucuguagaaagagggaaaagaugauugugacaauucagagcauaacucagauggcgaga

SEQ ID NO: 233338 - RNA, 62 nt, Homo Sapiens
caccagauauuuuguucuuauuuguacaauccacaauucauuaggucuguuuuuauguucag

SEQ ID NO: 233339 - RNA, 62 nt, Homo Sapiens
cuuuaauuucuaggcuauaauuacauauuuuuacaauucauaacauguacuucuguauacau

SEQ ID NO: 233340 - RNA, 62 nt, Homo Sapiens
gaauagcaguuucacugccaaauuuagcuuauacaauucagagaucugaaauuccucuguag

SEQ ID NO: 233341 - RNA, 62 nt, Homo Sapiens
gguauccaaugucgcuguaacuguccguggcuacaauucaaaaggaaagauucaugucacua

SEQ ID NO: 233342 - RNA, 62 nt, Homo Sapiens
gaauauauuuauauuuuucuuuuuuuugucuuacaauucaggaaagcuggcuguuaaaauua

SEQ ID NO: 233343 - RNA, 62 nt, Homo Sapiens
caaagcuaccuuuuuuuuacaauacaauucaaacaauucaauaugacuggacagcgguugua

SEQ ID NO: 233344 - RNA, 62 nt, Homo Sapiens
caauucaaucaaagcuaccugcgguuguaaauacaauucaaaacagacagcaugacuggaca

SEQ ID NO: 233345 - RNA, 62 nt, Homo Sapiens
agugauguucuuugcauuugaauauacaacuaacaauucaacugcauuuauaauuuuaccag

SEQ ID NO: 233346 - RNA, 62 nt, Homo Sapiens
cguuauacaaagucauaggagaaaaauaugggacaauucaugauuauacuuaaucuaauuug

SEQ ID NO: 233347 - RNA, 62 nt, Homo Sapiens
aagucaggggcuuccucucucgccugcuccuaacaauucagcgggcucagaaucucgagaac

SEQ ID NO: 233348 - RNA, 62 nt, Homo Sapiens
cuccagauuucuggcaguggcuggagacccagacaauucaguuggugggguuggacucucuu

SEQ ID NO: 233349 - RNA, 62 nt, Homo Sapiens
gagccucccucccugggcucaaggaaucagagacaauucacaacgaggcaggggcuccagga

SEQ ID NO: 233350 - RNA, 62 nt, Homo Sapiens
gaagcaagucaaaggacuggagcacaauuaugacaauucagaccaguuucuggcacaauucc

SEQ ID NO: 233351 - RNA, 62 nt, Homo Sapiens
gggugagggccucgcuugggagggugucagccacaauucagcugcccaagcuuccugugccc

SEQ ID NO: 233352 - RNA, 62 nt, Homo Sapiens
auuugagaaaggaucugcaaaauaaagauaccacaauucaucuuaaaacugcagagauuuaa

SEQ ID NO: 233353 - RNA, 62 nt, Homo Sapiens
uuggcuuaauuccaaucauuguuaaaguaaaaacaauucaaagaaucaccuaauuaauuuca

SEQ ID NO: 233354 - RNA, 62 nt, Homo Sapiens
cacauaacauaaaguuaaccauuuuaaagggaacaauucaguggcauuugguacugaacauc

SEQ ID NO: 233355 - RNA, 62 nt, Homo Sapiens
cauaacacuaagcguaaaucaguaacaaauacacaauucacaaacuccgccccaaaaaggag

SEQ ID NO: 233356 - RNA, 62 nt, Homo Sapiens
cauuccauguggaacaaacaaacagcugccuuacaauucacugaugaacaguguaugacuca

SEQ ID NO: 233357 - RNA, 62 nt, Homo Sapiens
auuagugggaaaaagugggcuuuggguuuccaacaauucagcccccuuggcucucaaugcug

SEQ ID NO: 233358 - RNA, 62 nt, Homo Sapiens
uauuuuaaggguacaauuuauucacauaccuuacaauucacuguaacauuauugagauauaa

SEQ ID NO: 233359 - RNA, 61 nt, Homo Sapiens
accccagggggauugacucugcaguuugggagccacaaaaagcguagcggugugauuucua

SEQ ID NO: 233360 - RNA, 61 nt, Homo Sapiens
acagcuucacagccccuugaggagugaccaagccacaaaguaaauccuaaagccacaaccc

SEQ ID NO: 233361 - RNA, 61 nt, Homo Sapiens
cugcccuccuucccaucccacaugcugagccgccacaaagaccaaagaagugauggcuuuu

SEQ ID NO: 233362 - RNA, 61 nt, Homo Sapiens
cugcccaaauguggcuuaggaggcugcuucugccacaaaaccgucauacucuugugcgugc

SEQ ID NO: 233363 - RNA, 61 nt, Homo Sapiens
gggauugagcauuuauggcagcaacagaggagccacaaaauguucuuuguucuuuggcucc

SEQ ID NO: 233364 - RNA, 61 nt, Homo Sapiens
uuuucaagaaccauacuucgacauuuccucugccacaaaaaaugaacgcauuuuaaguuag

SEQ ID NO: 233365 - RNA, 61 nt, Homo Sapiens
ucaagccccagaggaggcggcaagaggaacagccacaaacaaguacuuuaccccacagcuu

SEQ ID NO: 233366 - RNA, 61 nt, Homo Sapiens
gacuuucacaccauuaauggggaaaagcguggccacaaaaacagaugcuaggaagcuuggc

SEQ ID NO: 233367 - RNA, 61 nt, Homo Sapiens
gggcucucaauaaauauuaugcacagugcuugccacaaagucugcugauucccugcaccua

SEQ ID NO: 233368 - RNA, 61 nt, Homo Sapiens
aaagcaagggcuccagcaucccugagcuggggccacaaaucgauggaccgggugggccugg

SEQ ID NO: 233369 - RNA, 61 nt, Homo Sapiens
uaaaaggccuggccccauucaauaaaaauaagccacaaaacaaacccaaauucugcaaaaa

SEQ ID NO: 233370 - RNA, 61 nt, Homo Sapiens
cuguauuacugaauaauaucaaugcauauuugccacaaaacuuucauuaugcacuuuuaga

SEQ ID NO: 233371 - RNA, 61 nt, Homo Sapiens
uuaauguguugaaagaaugauacauucauccgccacaaauccuggagacuuugaguucucc

SEQ ID NO: 233372 - RNA, 59 nt, Homo Sapiens
agcaugcaaagucauuguuaugugccucggccacaaaaacuuaccugaugcuaaaauaa

SEQ ID NO: 233373 - RNA, 61 nt, Homo Sapiens
ggaugcuugggaagacuccuagaucucugaagccacaaauauugagcaucugucccccuuu

SEQ ID NO: 233374 - RNA, 61 nt, Homo Sapiens
uguauggauauuucaugauaagaaauaggaagccacaaauuauaaaugaagaaggaauaaa

SEQ ID NO: 233375 - RNA, 61 nt, Homo Sapiens
guugcaagucaugauggauggcuccacagaggccacaaaaucuuggccuggugggaccagg

SEQ ID NO: 233376 - RNA, 61 nt, Homo Sapiens
ugaaugcugaaaagcuacuaauuucccaugagccacaaaacacaucuugaugcuaaguaac

SEQ ID NO: 233377 - RNA, 61 nt, Homo Sapiens
agauuacauaauuagcagagaauauuuuaaagccacaaagugucuuaaaaucaaaguaucc

SEQ ID NO: 233378 - RNA, 61 nt, Homo Sapiens
ugccacauguuaguauaucagugccuaugaagccacaaagauaaauguguguugaaugaau

SEQ ID NO: 233379 - RNA, 61 nt, Homo Sapiens
ccauaugugcaguacuuuacuuccaaggacugccacaaaacuuaaguucuaccuaggauau

SEQ ID NO: 233380 - RNA, 61 nt, Homo Sapiens
agaauacagguaucuuggauuuuuuuugacagccacaaacaagcucaaaggagaaccagaa

SEQ ID NO: 233381 - RNA, 61 nt, Homo Sapiens
gagcccaccuuggaauuaagggcgugccucagccacaaaugugacccaggauacagagugu

SEQ ID NO: 233382 - RNA, 61 nt, Homo Sapiens
uuauuuccuccuccccuaccccuaguuaagugccacaaagacuguguuauguagucaguac

SEQ ID NO: 233383 - RNA, 61 nt, Homo Sapiens
uggugccaugcaauccccuuuugguagaauugccacaaacaaggcucaaaauucucaucau

SEQ ID NO: 233384 - RNA, 61 nt, Homo Sapiens
agucuguggaaaccaggaagauaaaacaacagccacaaaagagaaaaucaagaguguugca

SEQ ID NO: 233385 - RNA, 61 nt, Homo Sapiens
guguuuuguuugaaugugcaauaguuuauaggccacaaauaagcuuucuuguaagcucucu

SEQ ID NO: 233386 - RNA, 61 nt, Homo Sapiens
ucaauucuuacauuuccauuuugaggguagagccacaaauuuguguuuuaauuugagaauc

SEQ ID NO: 233387 - RNA, 61 nt, Homo Sapiens
cuagguacacuggcugcugcaggugguggcagccacaaauucaagccaguccuaagagaaa

SEQ ID NO: 233388 - RNA, 61 nt, Homo Sapiens
cccagagcaaacccacucccuaaacucugaagccacaaagaguaacagaguagcagaaauu

SEQ ID NO: 233389 - RNA, 61 nt, Homo Sapiens
cuccuuuaucuuuuaaaaauaaugcagcugugccacaaauuagacuggugucuguuuuguu

SEQ ID NO: 233390 - RNA, 61 nt, Homo Sapiens
cgguaaaugccucaauacgugugccauugaagccacaaagcaagguagggguucagaaaug

SEQ ID NO: 233391 - RNA, 61 nt, Homo Sapiens
uguggcggcuucagaucucccagagccaucugccacaaaccgcugcuugucauagcugaca

SEQ ID NO: 233392 - RNA, 61 nt, Homo Sapiens
ugcucuugacauccgugacagcacgguuuacgccacaaaagagaacucguagcucgugacu

SEQ ID NO: 233393 - RNA, 61 nt, Homo Sapiens
ugggaaaggaguagaaaaaguuagucuauuagccacaaaauuuuuguuauuagggugguau

SEQ ID NO: 233394 - RNA, 61 nt, Homo Sapiens
guaaagcccuaucaguauaauuuuaaaaugagccacaaacaucaugaagagaagacaccag

SEQ ID NO: 233395 - RNA, 61 nt, Homo Sapiens
acaucuggugcuuuucaugugucauuugugagccacaaaugcaaaguugccauuugaauuc

SEQ ID NO: 233396 - RNA, 61 nt, Homo Sapiens
agaaucaaguaucugagacuguggaguaauagccacaaaacagagggcccacugcacagca

SEQ ID NO: 233397 - RNA, 61 nt, Homo Sapiens
auaaugacaguuacaugguagaacugcccaugccacaaauauuuauuuggaaaaguaguca

SEQ ID NO: 233398 - RNA, 61 nt, Homo Sapiens
ucaguuuggucugcuccgccuggggcagaaagccacaaacuccauccagauccggaacguc

SEQ ID NO: 233399 - RNA, 61 nt, Homo Sapiens
gaguggccaaguauggggucauggauuccaggccacaaauuccaggccuaguucagucugg

SEQ ID NO: 233400 - RNA, 61 nt, Homo Sapiens
ggugggagugguuuaggcuauuuguaaaucugccacaaaaacagguauauacuuugaaagg

SEQ ID NO: 233401 - RNA, 61 nt, Homo Sapiens
agaugugcgaguuauugacuguggaguacuugccacaaaaucaauaaaagaugguaagaac

SEQ ID NO: 233402 - RNA, 61 nt, Homo Sapiens
ccuguuccaauucggaaaacaauaggggaaagccacaaaagcacaaacaugggucaaagga

SEQ ID NO: 233403 - RNA, 61 nt, Homo Sapiens
uuccugggaaaguaauugcugagccaguacagccacaaacaguacuauuuugcagaugcuc

SEQ ID NO: 233404 - RNA, 61 nt, Homo Sapiens
aaaauggacaugguggcuuuguuuagguagagccacaaaagaaaagacuuguaauauuuuu

SEQ ID NO: 233405 - RNA, 61 nt, Homo Sapiens
ccaaacauaaagagaacucuggggagccugagccacaaaaauguuccuuuauuuuauguaa

SEQ ID NO: 233406 - RNA, 61 nt, Homo Sapiens
aauguuuugagucagugcauuucaaggaacagccacaaaauacacaccccuaagaaaaggc

SEQ ID NO: 233407 - RNA, 61 nt, Homo Sapiens
cagccucacgacagauaccaggcaauccagagccacaaaacgugauuccuccaggcucugc

SEQ ID NO: 233408 - RNA, 61 nt, Homo Sapiens
acagaggcuuagguuugccaaagcauauauggccacaaagccuuugaaaccccuuagagag

SEQ ID NO: 233409 - RNA, 61 nt, Homo Sapiens
ugaacuccaucuacaagugagucaacugaaggccacaaaaagggaauucaacccugcagau

SEQ ID NO: 233410 - RNA, 61 nt, Homo Sapiens
ugccuuaauuugagcucguaccagaggacaagccacaaaaaugggaggguagaaugccauu

SEQ ID NO: 233411 - RNA, 61 nt, Homo Sapiens
ugucccagugaacaguuuggugaaaacccaggccacaaaugauuuugacacaauguugcac

SEQ ID NO: 233412 - RNA, 61 nt, Homo Sapiens
guucaucauuuggugcuuagccaaaacaaaagccacaaacaaacacaaaacuuaagauggc

SEQ ID NO: 233413 - RNA, 61 nt, Homo Sapiens
ucugucguggaauauauuuuuuuucauuugugccacaaaaaguuucauguauuuuuuaaag

SEQ ID NO: 233414 - RNA, 61 nt, Homo Sapiens
uguggaaggugacaaagcuuauaugaauguggccacaaagccagaguccgagcuuaucuaa

SEQ ID NO: 233415 - RNA, 61 nt, Homo Sapiens
ccagagaaaguaccaagccccaguaauauuggccacaaaagaacuugauaccacgggaguc

SEQ ID NO: 233416 - RNA, 61 nt, Homo Sapiens
cuaaauauaagagaaaugauauuggugagaagccacaaaaauaugaaaaauguggcaaagc

SEQ ID NO: 233417 - RNA, 61 nt, Homo Sapiens
ggauggccuggcagcagggauguuuccgugagccacaaauaccagaaacugaggcgaggcu

SEQ ID NO: 233418 - RNA, 61 nt, Homo Sapiens
aaucucaaagaaugagacuuguaaugagaaugccacaaacuugaauaccuuaugcacaaaa

SEQ ID NO: 233419 - RNA, 61 nt, Homo Sapiens
aaauacucacacgugaaauuucaaaaaagaagccacaaauauguaguucugaagauguuga

SEQ ID NO: 233420 - RNA, 61 nt, Homo Sapiens
uguuaucgucauauaauuuucauguacaaaugccacaaauaaauugaauguuuaaagcuau

SEQ ID NO: 233421 - RNA, 60 nt, Homo Sapiens
uuucccccaugaaguucaauaaaccagcuuagccacaaagaaauuguguuuuauuuucuu

SEQ ID NO: 233422 - RNA, 61 nt, Homo Sapiens
auaaaauggacaugacugugaagcguucaccgccacaaaucaaaaaaauaaaaaggaaagg

SEQ ID NO: 233423 - RNA, 61 nt, Homo Sapiens
ugaauguguuuguuguuuccguagauguuuugccacaaauaauuugccaugucaugaguag

SEQ ID NO: 233424 - RNA, 61 nt, Homo Sapiens
caauacucuggugacacauguugcuuccucugccacaaagauaacaauuuaguguuugaca

SEQ ID NO: 233425 - RNA, 61 nt, Homo Sapiens
aagaugaaauguaauuucuaagcuauguacugccacaaaaagauaccauuauauuuauaug

SEQ ID NO: 233426 - RNA, 61 nt, Homo Sapiens
auguacuuuuuucacuuuuuuucugucaugugccacaaaauaguuuaguuauuuuguucug

SEQ ID NO: 233427 - RNA, 61 nt, Homo Sapiens
cuuuuuuuucaaaauuuuagacaaacaaacagccacaaauauuuaggaagacaaauaaaua

SEQ ID NO: 233428 - RNA, 61 nt, Homo Sapiens
caagacuguucuuaaauggagaaaaugaaaagccacaaaugaauaaaauuagagcuguaag

SEQ ID NO: 233429 - RNA, 61 nt, Homo Sapiens
caggccacagaugcaaauaugaaacacaacagccacaaauguaauacagugcuguccaaua

SEQ ID NO: 233430 - RNA, 61 nt, Homo Sapiens
aagucauuaguaauaaaaccucaucucaauagccacaaaaagacaaauguggucaccacac

SEQ ID NO: 233431 - RNA, 61 nt, Homo Sapiens
acauugggucuauaaaugugcauuuguaagggccacaaaagugaacgugugguacuguagu

SEQ ID NO: 233432 - RNA, 61 nt, Homo Sapiens
uuaaaacuaacuccagcacuaaagcugaaaugccacaaacacuaaaaguauaaauaugucu

SEQ ID NO: 233433 - RNA, 61 nt, Homo Sapiens
acagauauaauauacagugaucauucucuaugccacaaauuagcuaaugcuuucuuguuuu

SEQ ID NO: 233434 - RNA, 61 nt, Homo Sapiens
agagaaagaucagaauggccuugagaauagagccacaaaaauaacuaugaaaaugccagua

SEQ ID NO: 233435 - RNA, 61 nt, Homo Sapiens
ccuuccaaacauacaaacauaaugauuugaugccacaaagcucgcuuacucagaccaagga

SEQ ID NO: 233436 - RNA, 61 nt, Homo Sapiens
aguuuagcauuuccaucugcgaugaauguaggccacaaaccacaguaguauuagcagugcc

SEQ ID NO: 233437 - RNA, 61 nt, Homo Sapiens
guauggugauaaaagucacgaaugaggaaaugccacaaauucuugauucuacaauguagaa

SEQ ID NO: 233438 - RNA, 61 nt, Homo Sapiens
ugacaguaaaucucacaaauacacaguuaaugccacaaaacgaaaucacauuuacaaaauu

SEQ ID NO: 233439 - RNA, 61 nt, Homo Sapiens
accaaagaauuguaggcaguuaacacauuuggccacaaaacaaaacucuuuggugcacaag

SEQ ID NO: 233440 - RNA, 61 nt, Homo Sapiens
aauuuaauauaacccuaagccaagcuuuggggccacaaaaucccuuagcccugacaucugu

SEQ ID NO: 233441 - RNA, 61 nt, Homo Sapiens
aaauguugggagaaaugauacuccuuucucagccacaaaauugaaaguuuucuauaccugu

SEQ ID NO: 233442 - RNA, 61 nt, Homo Sapiens
uuuuaguuuuuaacuucaaaagauuaugaaagccacaaacucuuuuuuucuuagaaauuaa

SEQ ID NO: 233443 - RNA, 61 nt, Homo Sapiens
gcuacuuacuuucuuuuccuaaaaaguguuagccacaaaagaaaaauguauuugucauguu

SEQ ID NO: 233444 - RNA, 61 nt, Homo Sapiens
uaggaugguucugugacccacacccaccuuugccacaaagccccacaaucuggcuuagugc

SEQ ID NO: 233445 - RNA, 61 nt, Homo Sapiens
gccguguagaauauuugucuuaaaauucaaggccacaaaaacaauguuugggggaaaaaaa

SEQ ID NO: 233446 - RNA, 61 nt, Homo Sapiens
cuccccaaggagaucggucaccaggagagcagccacaaaggucaagaaagacacacacgga

SEQ ID NO: 233447 - RNA, 61 nt, Homo Sapiens
aucaaucaaaagacuuucucaaucuauuuuggccacaaacaaacauauucaacugaagcuu

SEQ ID NO: 233448 - RNA, 61 nt, Homo Sapiens
uuccucauuucaucauuggucuuuauauguagccacaaacacugaccucauguaggcaccu

SEQ ID NO: 233449 - RNA, 61 nt, Homo Sapiens
auauaaaaauaagcauugguuguucuuaccagccacaaaguaaacuucauuuucaggcagu

SEQ ID NO: 233450 - RNA, 61 nt, Homo Sapiens
gagguucagugguggcagcaggaaggacacugccacaaauuuugucuauuucauauuuguc

SEQ ID NO: 233451 - RNA, 61 nt, Homo Sapiens
auaaaucagguaaacauuuuaugaaaucuuagccacaaaaaggcuaauuaaaaaaauaguu

SEQ ID NO: 233452 - RNA, 61 nt, Homo Sapiens
ucaguuuccaaauauuuguuuuaaucucucagccacaaacccuucagaaguuucacccuuu

SEQ ID NO: 233453 - RNA, 61 nt, Homo Sapiens
cacuacguuauuaaauuuuuucccccugugugccacaaaugggccucccaugcaucuguac

SEQ ID NO: 233454 - RNA, 61 nt, Homo Sapiens
cguauuuugccacaguguauuugucuauaaagccacaaauauuguauagaauggauuuaga

SEQ ID NO: 233455 - RNA, 61 nt, Homo Sapiens
caguaaccuguggcacugagguacacaucuugccacaaaacggaagccaugcugucagcag

SEQ ID NO: 233456 - RNA, 61 nt, Homo Sapiens
uuuccuuaauucaaagaucauauuuuagcuggccacaaaaccaagaacauaucuagcaaga

SEQ ID NO: 233457 - RNA, 61 nt, Homo Sapiens
gcagcgggugcagccaggugucugcagagcagccacaaagguggccuaggaugcggguguc

SEQ ID NO: 233458 - RNA, 61 nt, Homo Sapiens
gccuuugaaauggcuuugcuaaaaugcucccgccacaaaguuguaggaaaugggaagagga

SEQ ID NO: 233459 - RNA, 61 nt, Homo Sapiens
aagacuugugcauucagugaagcguuauuaugccacaaacuaaccuaccucaccuuacuca

SEQ ID NO: 233460 - RNA, 61 nt, Homo Sapiens
aauuugaaucaugagaauuauggguuaaaaagccacaaagaagcacauauuggugaccauc

SEQ ID NO: 233461 - RNA, 61 nt, Homo Sapiens
auuuuuaaugauaugagaaaaauuuuguuaggccacaaaaacacugcacugugaacauuuu

SEQ ID NO: 233462 - RNA, 61 nt, Homo Sapiens
ccauaugucccugaguuauuuuuaucauaaagccacaaauguauuauaacaaggcaaauug

SEQ ID NO: 233463 - RNA, 61 nt, Homo Sapiens
ucucauccuuucuccucccucuccuuuuccugccacaaaaggugaaaaaugagauccaauc

SEQ ID NO: 233464 - RNA, 61 nt, Homo Sapiens
cacuuucggggccuaguuuuggaggugcagagccacaaacggguuuuuugaacucacuucu

SEQ ID NO: 233465 - RNA, 61 nt, Homo Sapiens
auucagaucagccacuugcuuugguuccauggccacaaaccaugaaaaagaauaagucaca

SEQ ID NO: 233466 - RNA, 61 nt, Homo Sapiens
uuggugcccuuuucagacuaaaaguggaagagccacaaacauauuguugaucuuagauuaa

SEQ ID NO: 233467 - RNA, 61 nt, Homo Sapiens
aaagaaaaucaaaucuuagcugucuuuuagugccacaaauaugcucuucaucacagcuauc

SEQ ID NO: 233468 - RNA, 61 nt, Homo Sapiens
uagagaaaauucaggucuguaaacgugaaacgccacaaaaaauuauuaauccucuugagag

SEQ ID NO: 233469 - RNA, 61 nt, Homo Sapiens
cauucgaagagaaugaaguguaucacuguaagccacaaaggaaggaacgaauauaugugau

SEQ ID NO: 233470 - RNA, 61 nt, Homo Sapiens
augugcaaaugcccuucagcuccugagagaagccacaaaagugucgccaaggcccacauuu

SEQ ID NO: 233471 - RNA, 61 nt, Homo Sapiens
gaaauaucugaaagucaacagugguucguuagccacaaagauuugguccauccuuugaugu

SEQ ID NO: 233472 - RNA, 61 nt, Homo Sapiens
ugccauaaugccuguugguacccagacucuggccacaaaaaggcucuuguucagucaagac

SEQ ID NO: 233473 - RNA, 61 nt, Homo Sapiens
uuuagcuuuucuuuuguuauauaaacugcuagccacaaauuuuaguuauguaaaaggcuac

SEQ ID NO: 233474 - RNA, 61 nt, Homo Sapiens
augcauuccugucauuacccauuguaacagagccacaaacuaauacuaugcaauguuuuac

SEQ ID NO: 233475 - RNA, 61 nt, Homo Sapiens
cuuuuuuaaauuaaaggacuuuguuacuuuagccacaaagcuaaaacagcauuaccucagc

SEQ ID NO: 233476 - RNA, 61 nt, Homo Sapiens
cuuauauaacaagugagcauagcuaucaaaagccacaaaguuuuggucaggacuguaaauc

SEQ ID NO: 233477 - RNA, 61 nt, Homo Sapiens
uucucuuucccacuguuuaacaccagugaaugccacaaaagcuugcaagcagagucagggu

SEQ ID NO: 233478 - RNA, 61 nt, Homo Sapiens
caaaccuucuaccuccuacccaccauccagagccacaaaagauuuuccuuuuaccuuucuc

SEQ ID NO: 233479 - RNA, 61 nt, Homo Sapiens
uucaaaugcuacaaaauauaauagaaaucuugccacaaaacacaagacaacauucaauuug

SEQ ID NO: 233480 - RNA, 61 nt, Homo Sapiens
agccaggugaaguuucacacguggaggcauugccacaaauccuacugaauuuagcgaauuu

SEQ ID NO: 233481 - RNA, 61 nt, Homo Sapiens
auugcuugaagcacauacuuuuuguguguuugccacaaaacauuugaagagcaaagcaugu

SEQ ID NO: 233482 - RNA, 61 nt, Homo Sapiens
uuguuuuuucaaacuuaccuuauaguuucuugccacaaauuaaauaauccuguuuauaugu

SEQ ID NO: 233483 - RNA, 61 nt, Homo Sapiens
gaaaccauuaaagacccuuauggggggaagggccacaaaaugcugggacagucaccagggu

SEQ ID NO: 233484 - RNA, 61 nt, Homo Sapiens
ugacagugaaguauguuuuauggacuuaaaugccacaaacaguuaaguccauuggcuugga

SEQ ID NO: 233485 - RNA, 61 nt, Homo Sapiens
aaauggacauuuucauaugcaauggaaaacagccacaaaaaaaccuaccuuauauggaagu

SEQ ID NO: 233486 - RNA, 61 nt, Homo Sapiens
uaaagagagcccugguccuagacauaguucagccacaaaguaguugucccuuuguggacaa

SEQ ID NO: 233487 - RNA, 61 nt, Homo Sapiens
ggaaacagccucucucuuuucuacacacucagccacaaagccccccagcucccacaccgcg

SEQ ID NO: 233488 - RNA, 61 nt, Homo Sapiens
acaaucaaaguggcagaacuaucauuagucagccacaaaagaaaggaaggccaaaguaucc

SEQ ID NO: 233489 - RNA, 61 nt, Homo Sapiens
acuagaaucaugaaaucuuuccucuguggcugccacaaaagcaaucauaauguguuaaagc

SEQ ID NO: 233490 - RNA, 61 nt, Homo Sapiens
ggccuaugauuuagcuggcaaugcuguaguggccacaaauauuagggagaaaaauaaauau

SEQ ID NO: 233491 - RNA, 61 nt, Homo Sapiens
cuuuaaaguguaucaugagccacaccugucugccacaaauguaaaggaaggccuuugagga

SEQ ID NO: 233492 - RNA, 61 nt, Homo Sapiens
ugggaccugucuuuccaacuucacuaucagagccacaaauccuaaccaaggaacaagaauc

SEQ ID NO: 233493 - RNA, 61 nt, Homo Sapiens
uacauggaggccagcugguuucuucuucagcgccacaaaauccacggagggcuccugccuc

SEQ ID NO: 233494 - RNA, 61 nt, Homo Sapiens
agcaucgagcaccuccccauagaccuuuagugccacaaauacagucagggggcaucuugca

SEQ ID NO: 233495 - RNA, 61 nt, Homo Sapiens
ugaaaacaggccacuucucaggagaacaagugccacaaaaaucuccaaacuacacuucccu

SEQ ID NO: 233496 - RNA, 61 nt, Homo Sapiens
guggccuggcaucgcaucguggugugucaaugccacaaaaucguguguccguggaaccagu

SEQ ID NO: 233497 - RNA, 61 nt, Homo Sapiens
aggaugucugcagaacuuuguucuguuuucugccacaaaaaugugaauaguucagagugaa

SEQ ID NO: 233498 - RNA, 61 nt, Homo Sapiens
cucugccuaucgccuggauggcuuuaaauuagccacaaaaaaucacaagccauuuucuuug

SEQ ID NO: 233499 - RNA, 61 nt, Homo Sapiens
agucauaaugcaguaucuuccccugacuccagccacaaagcucauacccagcccuaccaau

SEQ ID NO: 233500 - RNA, 61 nt, Homo Sapiens
aagagaaaagccaugcccaccaugaagauaagccacaaaugcucacuagcuugagggggca

SEQ ID NO: 233501 - RNA, 61 nt, Homo Sapiens
uggcgaaaaacuucaugcuguuggggguggggccacaaaucaggccucuccgcguggguac

SEQ ID NO: 233502 - RNA, 61 nt, Homo Sapiens
agauucuuaccaagagugggcaagcuuuuuugccacaaagaauuucagccuacauugaugc

SEQ ID NO: 233503 - RNA, 61 nt, Homo Sapiens
ucuagccuaaguguggagaaggauagccucagccacaaaacucugucaggcauugaaugac

SEQ ID NO: 233504 - RNA, 61 nt, Homo Sapiens
gagaguuguuuuuguucuauguaacaguauugccacaaaacuauaggcaaaucguguuugc

SEQ ID NO: 233505 - RNA, 61 nt, Homo Sapiens
gcaacaaccuugaagggacagcaauggcaaagccacaaaggcuucacuguacucaggggag

SEQ ID NO: 233506 - RNA, 61 nt, Homo Sapiens
gucuuccuuccacccuguggccugcacuugagccacaaagugugugugugugugugcgugu

SEQ ID NO: 233507 - RNA, 54 nt, Homo Sapiens
aaaaaaaagcgacagccugaagcagccacaaaauccuguguuagaagcagcugu

SEQ ID NO: 233508 - RNA, 61 nt, Homo Sapiens
cugccucuuuuccccaugaaaccgcuucucagccacaaacccugccacucuccccauuggc

SEQ ID NO: 233509 - RNA, 61 nt, Homo Sapiens
agccaggggggcuccccggaagaggaaaacagccacaaacaccagaugccagggaagggac

SEQ ID NO: 233510 - RNA, 61 nt, Homo Sapiens
gacacacagugacaaaaggcucucuuacauggccacaaaggcucagccuacagcagugugg

SEQ ID NO: 233511 - RNA, 61 nt, Homo Sapiens
uaauuagaggcuucucaucuaaccaaaaaaggccacaaaauuuuuuuuuuuuaaaccaaca

SEQ ID NO: 233512 - RNA, 61 nt, Homo Sapiens
uaaaauuaaacuggauucauguguuagacaagccacaaagucccaacucuuaacugaaaau

SEQ ID NO: 233513 - RNA, 61 nt, Homo Sapiens
uucucugacauaguucuuggcaugggagccagccacaaaugagauucugacguguccaggu

SEQ ID NO: 233514 - RNA, 61 nt, Homo Sapiens
uucccucuuccccuuuauaaauuaugcuaaagccacaaagcacauuuuuggggaucauaga

SEQ ID NO: 233515 - RNA, 61 nt, Homo Sapiens
uuucugaaaauaacccuuaacguauccaacagccacaaagcaugaacaaccuaacaauaau

SEQ ID NO: 233516 - RNA, 61 nt, Homo Sapiens
aaagcaggaguaaugugccgauucugaaguugccacaaaaaauaagacacuggugaaugag

SEQ ID NO: 233517 - RNA, 61 nt, Homo Sapiens
ucugcccccacccugguacugccuggugccugccacaaaauaagcacuaacaaaaguguau

SEQ ID NO: 233518 - RNA, 61 nt, Homo Sapiens
aacuguguaucucaaaaaccauauuuccagagccacaaacaugaggaccaaaaaggaugga

SEQ ID NO: 233519 - RNA, 61 nt, Homo Sapiens
gcagcauccaggcugaccucaaggaagcauagccacaaaacagaauagcaccugucuguac

SEQ ID NO: 233520 - RNA, 61 nt, Homo Sapiens
cuuuccucaaagaagcaugaggugagagaaagccacaaagucagugccuggagaaggguuc

SEQ ID NO: 233521 - RNA, 61 nt, Homo Sapiens
gacgaugcacaaaaaaccacccuguacgaaggccacaaagaacagcucagaugcacaaaga

SEQ ID NO: 233522 - RNA, 61 nt, Homo Sapiens
ccuggcuggagaauguggagaacuaaagguggccacaaauucuuugacacucaaguccccc

SEQ ID NO: 233523 - RNA, 61 nt, Homo Sapiens
gggagugggccuugauggccgggccucgaaggccacaaacaaggcgucgaggaauuggaaa

SEQ ID NO: 233524 - RNA, 61 nt, Homo Sapiens
ucauuuucuccuucuaaguaaaaauaaaaaugccacaaauucaaaguaagacuaauuauuu

SEQ ID NO: 233525 - RNA, 59 nt, Homo Sapiens
cagcugaagggaccaaggugcagggcccagccacaaauuaugggggccccagcaguuaa

SEQ ID NO: 233526 - RNA, 61 nt, Homo Sapiens
guaauugaguuguuacugguaauaaaaagaagccacaaagacuucuagauuauugauucaa

SEQ ID NO: 233527 - RNA, 61 nt, Homo Sapiens
cauggguguuguauagauccgccucucaagagccacaaaugauauauauaucuuagucccu

SEQ ID NO: 233528 - RNA, 61 nt, Homo Sapiens
uguaucacuuuuauaauauuaacauuuaagagccacaaaaucuguugaaaucaaguaauua

SEQ ID NO: 233529 - RNA, 61 nt, Homo Sapiens
gaauucgagacauacuuaauccgcaccaucugccacaaacaccgagggcugagcuccagag

SEQ ID NO: 233530 - RNA, 61 nt, Homo Sapiens
accaacagcuggucaggacgcacaccccucugccacaaaugagaugcaggcgaaaagcagc

SEQ ID NO: 233531 - RNA, 61 nt, Homo Sapiens
ucugcaucuuuccuacaugagaagcuucucugccacaaaagugacuucaaagacggauggg

SEQ ID NO: 233532 - RNA, 61 nt, Homo Sapiens
agguagaggcuggcacuuuauuagaaugcaagccacaaaaauaucaauuuuguuuuuuuug

SEQ ID NO: 233533 - RNA, 61 nt, Homo Sapiens
ucuuuucuuacacucuuggacaauggaccaugccacaaaaacuuaccguuuucuaugagaa

SEQ ID NO: 233534 - RNA, 61 nt, Homo Sapiens
cauacuauccuguuuccuccucaauagaauugccacaaacugcaugcuaaauaaagaugua

SEQ ID NO: 233535 - RNA, 61 nt, Homo Sapiens
uacacacaugcacacacauauacacacaugugccacaaacaagugcacacuguccuggugu

SEQ ID NO: 233536 - RNA, 61 nt, Homo Sapiens
cccacauuggaaagacccauucugugcaccagccacaaauagaguauugugucuacuuuua

SEQ ID NO: 233537 - RNA, 61 nt, Homo Sapiens
uuucaucaucagaacuaauaaccauuuugcugccacaaaauaguuaucuuucguagcagaa

SEQ ID NO: 233538 - RNA, 61 nt, Homo Sapiens
auccugcuuucuuuauccucgauuggaacgcgccacaaaucucugacuucuuauuaccucc

SEQ ID NO: 233539 - RNA, 61 nt, Homo Sapiens
auuuaauguguugugccuucauuagaccauagccacaaaauguuguuguaacacaaguguu

SEQ ID NO: 233540 - RNA, 61 nt, Homo Sapiens
uacuuuggggaaauuccacaauguauuagcagccacaaauuuccacugguaaccaaagagu

SEQ ID NO: 233541 - RNA, 61 nt, Homo Sapiens
ggcacugugaaauuuaaguguaagacauugagccacaaacauggaaucucuucuuuguacu

SEQ ID NO: 233542 - RNA, 61 nt, Homo Sapiens
cagaguccuggcccuugaugcccagcucagugccacaaagcucaauaggagggauguucca

SEQ ID NO: 233543 - RNA, 61 nt, Homo Sapiens
cccuuaaaguggucaaguacauuuuugaaaugccacaaaacaucuggauaaagagauuuug

SEQ ID NO: 233544 - RNA, 61 nt, Homo Sapiens
aauuccagguccgagccaacgugaaaaaggugccacaaagggucuuuuuuuucugaaguga

SEQ ID NO: 233545 - RNA, 61 nt, Homo Sapiens
agccaaaggucagucccucugaacaccuccagccacaaagaggacccccucaccaggccug

SEQ ID NO: 233546 - RNA, 61 nt, Homo Sapiens
aagagguuguuaccucaguaaaaaccuucaggccacaaagcaaaaaguugcauagccacaa

SEQ ID NO: 233547 - RNA, 61 nt, Homo Sapiens
auugaugauaauacuguacuucaucuuacuugccacaaaauaacauuuuauaaauccucaa

SEQ ID NO: 233548 - RNA, 61 nt, Homo Sapiens
cucaccugccucugguggcugggauucagaugccacaaaacugucaguaucuauagaccag

SEQ ID NO: 233549 - RNA, 61 nt, Homo Sapiens
uaaaaagagagcuuaaugauaauauuguggugccacaaauaaaauggauuuauuagaauuu

SEQ ID NO: 233550 - RNA, 61 nt, Homo Sapiens
aguaguuugaguguuaugaaaaacauaaauggccacaaaaaaccauacaaucuagugucaa

SEQ ID NO: 233551 - RNA, 61 nt, Homo Sapiens
uguuuaaaguuguucugguugauugcuuguugccacaaagguguguugagcccauucauuu

SEQ ID NO: 233552 - RNA, 61 nt, Homo Sapiens
ccaguuacuuggagugggggguggggguggggccacaaaaggaaaaccggaggagcaauug

SEQ ID NO: 233553 - RNA, 61 nt, Homo Sapiens
aauaaagaacuucaggagcuucuuaggucuugccacaaaaaucugcaaauuugauaauucu

SEQ ID NO: 233554 - RNA, 61 nt, Homo Sapiens
ugccucccagccucggcucagcacaucccuugccacaaaucagugucuggggcuuggccac

SEQ ID NO: 233555 - RNA, 61 nt, Homo Sapiens
uccuaugaauuuagugguuuuauguggauaugccacaaaacacaagugguaugcuuuagau

SEQ ID NO: 233556 - RNA, 61 nt, Homo Sapiens
caagugcccccgacaagauagcacagugccugccacaaaaauaugcauggggagccuguua

SEQ ID NO: 233557 - RNA, 61 nt, Homo Sapiens
aagggcuauagagagauuuuuuugauaaaaugccacaaaauggacucugauuucauagcau

SEQ ID NO: 233558 - RNA, 61 nt, Homo Sapiens
ccaaaucaagaaugcaauccuauucacaauugccacaaaaagaauaaaauaccuaggaaua

SEQ ID NO: 233559 - RNA, 61 nt, Homo Sapiens
uucggugugcugccaacuugauguuccaccugccacaaaccaccaggacugaaagaagaaa

SEQ ID NO: 233560 - RNA, 61 nt, Homo Sapiens
aagacaaaaacaaauuuaaaaaaaaauuuaagccacaaaaaaaggcacauagggaauuaug

SEQ ID NO: 233561 - RNA, 61 nt, Homo Sapiens
cuguauaaauguuuuacauuaaguguuacgagccacaaauuucauguacauuuauuauaua

SEQ ID NO: 233562 - RNA, 61 nt, Homo Sapiens
ggcgcugucccgcccaaccccgccuuuaaacgccacaaauaaagagcauuguuaccgccac

SEQ ID NO: 233563 - RNA, 61 nt, Homo Sapiens
accgcuagcgaggugauaggacaucuggcuugccacaaaggucuguucgaccagacauauc

SEQ ID NO: 233564 - RNA, 61 nt, Homo Sapiens
gaugauacaguguuuuuuaggaaaagcaucugccacaaaaauguucacuucgaaauucuga

SEQ ID NO: 233565 - RNA, 61 nt, Homo Sapiens
aacaguucuucuaauugagacugacuccaaggccacaaacuguucaacacacacaaagugg

SEQ ID NO: 233566 - RNA, 61 nt, Homo Sapiens
gguguacauauacaccauggaauacuauucagccacaaaaaggaacaaaauaauggcauuc

SEQ ID NO: 233567 - RNA, 61 nt, Homo Sapiens
acuaaugucauuuggucauaaaacuaucaaggccacaaaauucaaauauauuaaguuguau

SEQ ID NO: 233568 - RNA, 61 nt, Homo Sapiens
ucuacuagaggacuugaaagagaacugaggggccacaaaauaaacuucaccuuccauuaag

SEQ ID NO: 233569 - RNA, 60 nt, Homo Sapiens
uacagcauucuuacuccuaaacagcagucagccacaaacugacccagaguuuaauuagca

SEQ ID NO: 233570 - RNA, 61 nt, Homo Sapiens
cucauuccucuuccucuuuguguagguuucagccacaaaacugucauucacucuaggggac

SEQ ID NO: 233571 - RNA, 61 nt, Homo Sapiens
uuacuuuaaccccuaaauugauuuuguaaaugccacaaaugcauagaauuguuaccaaccu

SEQ ID NO: 233572 - RNA, 61 nt, Homo Sapiens
gaaaauaugaccagaucagguggggaugggugccacaaauaguauugcuuauauguccuua

SEQ ID NO: 233573 - RNA, 61 nt, Homo Sapiens
acgucuauuuuuuuaugaaagcugggaugcggccacaaagcagcugaucccuuacccccag

SEQ ID NO: 233574 - RNA, 61 nt, Homo Sapiens
ccuucccagcagcagaaucuguugaguugcugccacaaacaaaaaauacaauaaauauuug

SEQ ID NO: 233575 - RNA, 61 nt, Homo Sapiens
uggcccacucccccagacaccuggacacguggccacaaaucugggacaaggggcccccgca

SEQ ID NO: 233576 - RNA, 61 nt, Homo Sapiens
gccuucgcccucugaagcuguuccucuacuggccacaaacucugggccuggugggagaggc

SEQ ID NO: 233577 - RNA, 61 nt, Homo Sapiens
ccaacauucagauucaggaaauacagagaacgccacaaagauacuccuugagaagagcaac

SEQ ID NO: 233578 - RNA, 61 nt, Homo Sapiens
cacaaccgcacacccauacacaacuacaagggccacaaagcaacugcuggguuagcuuucc

SEQ ID NO: 233579 - RNA, 61 nt, Homo Sapiens
uucuuuccugaguucaggugacugaggaagagccacaaaacaaaacacaacaaaaccaaac

SEQ ID NO: 233580 - RNA, 61 nt, Homo Sapiens
uggccagcacaugagggcucaccaaguguaagccacaaauacacaucagcuauagcacaaa

SEQ ID NO: 233581 - RNA, 61 nt, Homo Sapiens
ccaaaucaagaauggaaucccauucacaguagccacaaaaaguauaaaauaccuaggaaua

SEQ ID NO: 233582 - RNA, 61 nt, Homo Sapiens
gaugcuggugauucggauaugccaaagagaagccacaaagugcuuccuuuuaaaugaaaag

SEQ ID NO: 233583 - RNA, 61 nt, Homo Sapiens
gucuucaucuuagggcaucgcuccuccucacgccacaaaucuggugccucucucuugcuua

SEQ ID NO: 233584 - RNA, 61 nt, Homo Sapiens
uaugaaacauuagagaauuccuucugaaaaagccacaaauuaacuaugaaugugggauagc

SEQ ID NO: 233585 - RNA, 61 nt, Homo Sapiens
cugcagagaccaggugaaggcgggcuguguugccacaaacacgcugccuucccccagagug

SEQ ID NO: 233586 - RNA, 61 nt, Homo Sapiens
ucuacaagugccugcuauccgccgcccaugggccacaaaucggcggaggagggugaggggu

SEQ ID NO: 233587 - RNA, 61 nt, Homo Sapiens
cuuucacaacaucagagaauccaguuuuucagccacaaauuaaccuuacaaaggagugcgg

SEQ ID NO: 233588 - RNA, 61 nt, Homo Sapiens
acccuccacuggaaucaccuuguccauugaggccacaaaucuguguuuaaccccuaagaug

SEQ ID NO: 233589 - RNA, 60 nt, Homo Sapiens
uugaaggaugcccuguguagauuauucagugccacaaauugaaagcuuccauguuuaaug

SEQ ID NO: 233590 - RNA, 61 nt, Homo Sapiens
aauugcuuaaaaaagaguuuucuuuaguauagccacaaaugccuugaacuguugucuggga

SEQ ID NO: 233591 - RNA, 61 nt, Homo Sapiens
gucucucagaccccuggauucagaacccaaggccacaaaucauaggcaugaagcacuuucu

SEQ ID NO: 233592 - RNA, 61 nt, Homo Sapiens
cuuaaggcggccuacagaaaaaggaaaaaaggccacaaaaguucccucucacuuucaguaa

SEQ ID NO: 233593 - RNA, 61 nt, Homo Sapiens
aagcaaaaauaacuauuugacuauaauauaggccacaaaaaaucuugauauaacuccuagu

SEQ ID NO: 233594 - RNA, 61 nt, Homo Sapiens
aggggggagacuggaggcaccccuccucuuagccacaaaaggacucucagauccuccucuc

SEQ ID NO: 233595 - RNA, 61 nt, Homo Sapiens
aaggaaggccgaggauggaugcagugacacagccacaaaccccgugacagaggcagagggu

SEQ ID NO: 233596 - RNA, 61 nt, Homo Sapiens
cuaucggagaacaugaaucaaccagcccaucgccacaaacuuuucccaucagcgugcauuc

SEQ ID NO: 233597 - RNA, 61 nt, Homo Sapiens
uguaaccucaaggaaaccaucacuaagagcagccacaaaacaucugcuuuuuucugaaaua

SEQ ID NO: 233598 - RNA, 61 nt, Homo Sapiens
ccugguucccuggggcaggugaagacuuggugccacaaagaaugccacaguggauacgcca

SEQ ID NO: 233599 - RNA, 61 nt, Homo Sapiens
uuagcagacagcuuuccaagugugcuuucuugccacaaaaguguccuggcaagagccccuu

SEQ ID NO: 233600 - RNA, 61 nt, Homo Sapiens
agaaccggccacaccgcugaaggccaaagaggccacaaagaagaaaaagaaacaguuuggg

SEQ ID NO: 233601 - RNA, 61 nt, Homo Sapiens
augaccaaguauugcuuggcgagaaugguuggccacaaacacgcugucauucagacauuca

SEQ ID NO: 233602 - RNA, 61 nt, Homo Sapiens
cugggccgagagauggggcuccaggccuccugccacaaagaccucagugucgccucugagc

SEQ ID NO: 233603 - RNA, 61 nt, Homo Sapiens
ccacaugccucugauaggagugagggccccagccacaaagguucuggcaguggcugucuuu

SEQ ID NO: 233604 - RNA, 61 nt, Homo Sapiens
aaaaccaguuuuauuugccccaccccuuggagccacaaauguuuagaacucuucaacuucg

SEQ ID NO: 233605 - RNA, 61 nt, Homo Sapiens
uacuccacaguuauucccagggcuggcccuagccacaaaggaacuuuagggcaggguaggg

SEQ ID NO: 233606 - RNA, 61 nt, Homo Sapiens
uugcugugcuuuggaacaaucacagggaauggccacaaaccugcccgccuaagacccugaa

SEQ ID NO: 233607 - RNA, 61 nt, Homo Sapiens
aauucuggggcaauagagaagcaacagaacugccacaaaguauaccucaauauaauuccuc

SEQ ID NO: 233608 - RNA, 61 nt, Homo Sapiens
ugauugaugaagcagaugaguuuguagcagggccacaaaacaaagugaaacguccagggga

SEQ ID NO: 233609 - RNA, 61 nt, Homo Sapiens
ccugagggagccgccugcaagcggcccugcagccacaaagcaacccgcccucugcaaaaac

SEQ ID NO: 233610 - RNA, 61 nt, Homo Sapiens
gagugaggccucaucucaaaaaaaaaaaaaggccacaaaacucaacaauaaaaacaaacag

SEQ ID NO: 233611 - RNA, 61 nt, Homo Sapiens
gcuuugaugauguaauaccucuauuuucauugccacaaaguaauuagagggguaaaaaaag

SEQ ID NO: 233612 - RNA, 61 nt, Homo Sapiens
cauuguuagauagauaucuacauaauuuuuagccacaaaccuuguuagauguguucuuaag

SEQ ID NO: 233613 - RNA, 61 nt, Homo Sapiens
ccccagagcugaauucauugccucagagcuagccacaaagcggggaugaagugcccuccag

SEQ ID NO: 233614 - RNA, 61 nt, Homo Sapiens
ggacaagaagcuggguauuuguaguaauauagccacaaacuucugcucauguguuucaucu

SEQ ID NO: 233615 - RNA, 63 nt, Homo Sapiens
auugugcggauuaaaagaaauaauauauguaaagcacuuuaacacagcaccaggcccacggaa

SEQ ID NO: 233616 - RNA, 63 nt, Homo Sapiens
aaggggaucuuuggggcuaacuucgggaucccugcacuuuauguaagaauguaaaccuggagu

SEQ ID NO: 233617 - RNA, 63 nt, Homo Sapiens
guuauagggaguaguuuuuucccuuaggacucugcacuuuauagaauguuguaaaacagacaa

SEQ ID NO: 233618 - RNA, 63 nt, Homo Sapiens
gcugauaguuuuguuuaagguuuuggauaaggagcacuuuaaaacaaacugguguguuguuuu

SEQ ID NO: 233619 - RNA, 63 nt, Homo Sapiens
uuauucucuagguucugagagugaaugcauugggcacuuuaaguugauauuuucucuucuccg

SEQ ID NO: 233620 - RNA, 63 nt, Homo Sapiens
aguguccacaacaguuagggaaaugaugcuagagcacuuuaaaaaucagcaggacaacccuga

SEQ ID NO: 233621 - RNA, 63 nt, Homo Sapiens
uuucuaccugcauauggacuacuugcuucuguugcacuuuaguaagugaguacacucuaauua

SEQ ID NO: 233622 - RNA, 63 nt, Homo Sapiens
aaaagugaaagcgacaaauugacauuuuauguagcacuuuauaguuuuuaaauuuggaaauau

SEQ ID NO: 233623 - RNA, 63 nt, Homo Sapiens
augcuagucuuugugaccgauugcuaaucuucugcacuuuaauuuauuuuauauaaacuuuac

SEQ ID NO: 233624 - RNA, 63 nt, Homo Sapiens
acaaucaagaauguuauuaauguguaauacugagcacuuuacuucuuaauaaaaacuugauau

SEQ ID NO: 233625 - RNA, 63 nt, Homo Sapiens
guaacaaacuuacaaggacaaagaggcuuguuggcacuuuacauauacaguguauacaugugu

SEQ ID NO: 233626 - RNA, 63 nt, Homo Sapiens
caaacgaagacauuccaauacugcuuaauuauagcacuuuauuuuuagcugcugaacugccaa

SEQ ID NO: 233627 - RNA, 63 nt, Homo Sapiens
cacaguuaugucuuauaacuuuuaauuugaaaugcacuuuaugauuucucuccugauggguac

SEQ ID NO: 233628 - RNA, 63 nt, Homo Sapiens
uuucucuccugauggguacuuaccuuauguauugcacuuuaaacaacuuugcacuauguaaag

SEQ ID NO: 233629 - RNA, 63 nt, Homo Sapiens
cuguuguguucuauuuccacugagggucucaaagcacuuuaaaauucacguguacuguuuaac

SEQ ID NO: 233630 - RNA, 63 nt, Homo Sapiens
aaauauaagggagaaaaugaaugaguuuuuaaagcacuuuagacugaaaaauguguagauuaa

SEQ ID NO: 233631 - RNA, 63 nt, Homo Sapiens
cauacaaaauaaucaaaauauaauccagucucagcacuuuauuggaggcccauucuguauucc

SEQ ID NO: 233632 - RNA, 63 nt, Homo Sapiens
auuugcacuuuucaaaugccuuuggaugacccagcacuuuaaucugaaaccugcaacaagacu

SEQ ID NO: 233633 - RNA, 63 nt, Homo Sapiens
cucuggagccuauggcuuuaagcaagcacuacugcacuuuacagaauuaccccacuggauccu

SEQ ID NO: 233634 - RNA, 63 nt, Homo Sapiens
aggaguucuuagcuccucagcgagcaacagagagcacuuuagauggcaccuuucaccacuugg

SEQ ID NO: 233635 - RNA, 63 nt, Homo Sapiens
uucuauuuauaucuuauuacaauaaaauuaguggcacuuuauucauaaauauucaugagccug

SEQ ID NO: 233636 - RNA, 63 nt, Homo Sapiens
ucuuuauuuaaauuuuuuuugagugcacugagugcacuuuacaugugaagguaguacuuuuua

SEQ ID NO: 233637 - RNA, 63 nt, Homo Sapiens
uaaccaaagcuuagcaguuuacaucauugaacugcacuuuauaauuugaaugauugggaugau

SEQ ID NO: 233638 - RNA, 63 nt, Homo Sapiens
cuaaugggucacaaaucuuggcacugaacauaagcacuuuauacuucugagucugccuuuuuu

SEQ ID NO: 233639 - RNA, 63 nt, Homo Sapiens
uuagacuugccacucugaaaccauuuaaaagaggcacuuuacuugaacaaaugaaacucuucu

SEQ ID NO: 233640 - RNA, 63 nt, Homo Sapiens
guccuguggcuugugaccuccaauaaauuucaugcacuuuaaauauacaugcggcuucauugc

SEQ ID NO: 233641 - RNA, 63 nt, Homo Sapiens
cauuucuuuuaaaaggucuacaugcagagcaaagcacuuuaacgugccacccucucuggcauu

SEQ ID NO: 233642 - RNA, 63 nt, Homo Sapiens
gguuuuguuucaguuuguaagauuucuuuucuggcacuuuaauggcuugagguaucauuauca

SEQ ID NO: 233643 - RNA, 63 nt, Homo Sapiens
ggcagggcacgguagcucacaccuguaaucccagcacuuuaggaggucaaggugggcagauca

SEQ ID NO: 233644 - RNA, 63 nt, Homo Sapiens
gacuuggauuuuguaaaucuuuugugauugaaagcacuuuaguaggcuuuuggucuuucaaaa

SEQ ID NO: 233645 - RNA, 63 nt, Homo Sapiens
caguuaacuuggugcaaaaccgguuccuuaauggcacuuuaacauuucauucuagaauggaaa

SEQ ID NO: 233646 - RNA, 63 nt, Homo Sapiens
cgccgaagacagcccugcagguauuccucaguagcacuuuaaagaacuuacgugacaaugauu

SEQ ID NO: 233647 - RNA, 63 nt, Homo Sapiens
uucgucaaguuucaagucuggaguuuugacagagcacuuuauucagcugaaaaccugcuguga

SEQ ID NO: 233648 - RNA, 64 nt, Homo Sapiens
gagcuaaugaacuagggagaaaaacuuuccaugugugcgguaucgucuuucagaaugucuccug

SEQ ID NO: 233649 - RNA, 64 nt, Homo Sapiens
gagugcuggcuccacgcccuggggagugagcuuggugcgguaggugcuggccucaaacagccac

SEQ ID NO: 233650 - RNA, 64 nt, Homo Sapiens
aaugcagcacaguacucaggcagugcaauacucagugcgguacucaguaacacagugcaguacu

SEQ ID NO: 233651 - RNA, 64 nt, Homo Sapiens
cccagucgggaguguggucagucugccugcugcugugcgguagcuccagaaccaccucguuccu

SEQ ID NO: 233652 - RNA, 64 nt, Homo Sapiens
agaacuuuuagaagaaacagggaaaugaccgguggugcgguaaccugcguggcuccugauagcg

SEQ ID NO: 233653 - RNA, 64 nt, Homo Sapiens
uuuuucuuuuuuuggcaaaggcuugguacccaaggugcgguagggggucgagggggaggaggcc

SEQ ID NO: 233654 - RNA, 64 nt, Homo Sapiens
aucuggagcccacagcugucgagcugagaugggagugcgguacaaguggagccaggcuggccca

SEQ ID NO: 233655 - RNA, 64 nt, Homo Sapiens
ggauugaaagaaugugugugaagggguagaauuugugcgguaaagacuuaaaaaaaaaaguagg

SEQ ID NO: 233656 - RNA, 64 nt, Homo Sapiens
agaauugccuuagaagauacccaacccagacacagugcgguaccggcucagacauuuaaauagg

SEQ ID NO: 233657 - RNA, 64 nt, Homo Sapiens
ggcaggagcugagaaauccucugaguagcgggaagugcgguacagucugggcauucugauguuu

SEQ ID NO: 233658 - RNA, 64 nt, Homo Sapiens
gcucugugaauucaaguucaugcuaaaauauuuagugcgguauuaagugguguagugccgaaag

SEQ ID NO: 233659 - RNA, 64 nt, Homo Sapiens
gcacucagcugugggcugcacguggagcugucccgugcgguaguagcugugucuguguccccuc

SEQ ID NO: 233660 - RNA, 64 nt, Homo Sapiens
uauugaaugauauuucuauaucgaagugagguaggugcgguauuaaagugaaagggaaggugau

SEQ ID NO: 233661 - RNA, 64 nt, Homo Sapiens
uauuuguuuacaugcagauuagggaggcucuucagugcgguagccccgggugugccugcccugg

SEQ ID NO: 233662 - RNA, 64 nt, Homo Sapiens
aagcaguaauccuacuucauuaagccuuccuggggugcgguacacaccguuaauucagcaaccc

SEQ ID NO: 233663 - RNA, 64 nt, Homo Sapiens
cgccugugcacacgcgugucuucgugcacuccccgugcgguacaggggcacuucguaacccagg

SEQ ID NO: 233664 - RNA, 64 nt, Homo Sapiens
uguauaucagaaaaaaaucuaucucuaauuuagagugcgguacauaauuauauccgcaaauaaa

SEQ ID NO: 233665 - RNA, 64 nt, Homo Sapiens
ugccgcacuggacccuaggaaccggugaaggcaggugcgguaacguucagcuggcuaaagguuc

SEQ ID NO: 233666 - RNA, 64 nt, Homo Sapiens
gagcuguguuauaaauuccuuaugucagaggccagugcgguagccuuugucccuucaugccuuu

SEQ ID NO: 233667 - RNA, 64 nt, Homo Sapiens
ggucagcuggcaugagaauauuuuuuuuuuuuaagugcgguaguuuuuaaacuguuuguuuuua

SEQ ID NO: 233668 - RNA, 64 nt, Homo Sapiens
aaugaagcagugaguguucaacucccugcaacaggaggaauagagagacaaaggagaagaaauu

SEQ ID NO: 233669 - RNA, 64 nt, Homo Sapiens
caccgagaugcucagagauacaucuuaaguaaaugaggaauagccacauccagaaugacuaaaa

SEQ ID NO: 233670 - RNA, 64 nt, Homo Sapiens
acuaauuuucagccuuaagauaaggcuaaaauuugaggaauauauacuuuuggaauuucauuaa

SEQ ID NO: 233671 - RNA, 64 nt, Homo Sapiens
uguuccuaugggaacuauguaaggugugagagcugaggaauauggcccaucuccugugucuuca

SEQ ID NO: 233672 - RNA, 64 nt, Homo Sapiens
agcccuuuuuauauauuuacugggagggagggaggaggaauacuauauauaccacuggugugug

SEQ ID NO: 233673 - RNA, 64 nt, Homo Sapiens
caccccagaugaaaauguucuuuggaaauuauuggaggaauaugcuuuuuuuuccccagaaaua

SEQ ID NO: 233674 - RNA, 64 nt, Homo Sapiens
uccuaauuccaucucacuggagauguuuaaaguuggccucuauccuaaugacucaaaacuuggu

SEQ ID NO: 233675 - RNA, 64 nt, Homo Sapiens
uuuguaguugaauugucuucuaaagagauuggauggccucuaaagagguauguguaucuuuauu

SEQ ID NO: 233676 - RNA, 64 nt, Homo Sapiens
agacaggccucccuccccacaggcccgcugcugcggccucuaugacacuguccauccccaagug

SEQ ID NO: 233677 - RNA, 64 nt, Homo Sapiens
cuugccccugcucuguagccaccuccuuggcaccggccucuauuugucauaaggcggcgugggc

SEQ ID NO: 233678 - RNA, 64 nt, Homo Sapiens
uuuucaaagcugcauaucucuuauauuugguauuggccucuaagucuaauauugcaguuggaau

SEQ ID NO: 233679 - RNA, 64 nt, Homo Sapiens
gaaagaacucuuuccacgagaucugcuaguuccaggccucuaagacaggaacguaugugccaua

SEQ ID NO: 233680 - RNA, 64 nt, Homo Sapiens
uuauggcucuugcuuccuuucacaaaugagcugaggccucuacuuuuuuuuuuaagcugcauac

SEQ ID NO: 233681 - RNA, 64 nt, Homo Sapiens
uucgcaauguuggccaggccgaucucgaacuucuggccucuagcgaucugcccgccucggccuc

SEQ ID NO: 233682 - RNA, 64 nt, Homo Sapiens
ucccacuuugaaaacuuacaccuaaaggccuguaggccucuaacucuuucugcccuuucauuca

SEQ ID NO: 233683 - RNA, 64 nt, Homo Sapiens
ugugcugcucaagagacuggagucgggggccacaggccucuagccaggucugaguauggcuggg

SEQ ID NO: 233684 - RNA, 64 nt, Homo Sapiens
aaccaccugccagauuucagggcaagcucccuguggccucuaaacauuucaccaggaugacuaa

SEQ ID NO: 233685 - RNA, 64 nt, Homo Sapiens
ucuccauuuguaaaacaagugcuucaucucucugggccucuauuugugugaccuuggacaaggc

SEQ ID NO: 233686 - RNA, 64 nt, Homo Sapiens
aaaaauacaaaaauuagccgacauggugaaaccuggccucuacuguuugagaccagccuggcca

SEQ ID NO: 233687 - RNA, 64 nt, Homo Sapiens
cuucuguuucuguuuaccagucucuuucuaguuaggccucuaauucucucugcuaacaccagug

SEQ ID NO: 233688 - RNA, 64 nt, Homo Sapiens
ccccacaccccagugccacuaguuccccuacucuggccucuacuaaagagcuaaaaucaggcuc

SEQ ID NO: 233689 - RNA, 64 nt, Homo Sapiens
cagguacacacguguaccugaccagaagcagaggggccucuacgauacuugaugcagggaagga

SEQ ID NO: 233690 - RNA, 64 nt, Homo Sapiens
acacccacuggccaguccuauuccaaccccagcuggccucuagagaaguguccagaccauuguc

SEQ ID NO: 233691 - RNA, 64 nt, Homo Sapiens
aggucugcuccugaaccaguggucuagaaggccaggccucuacuuccacugaccugguugucca

SEQ ID NO: 233692 - RNA, 64 nt, Homo Sapiens
uccaccccccaagugaaacguuuuaucauaacgcggccucuaauggcaaacucaggagcuuccu

SEQ ID NO: 233693 - RNA, 64 nt, Homo Sapiens
ugaaaauugccuuuaugagugauacccauuugagggccucuaaacccuucaauuugguacucac

SEQ ID NO: 233694 - RNA, 64 nt, Homo Sapiens
agcauccgggcauguacgagggaagagggaggcaggccucuauucaaaggcagaaauuccuuua

SEQ ID NO: 233695 - RNA, 64 nt, Homo Sapiens
uuuaaaggacacuguacaggcccucccuccccuuggccucuaggaggaaacaguuuuuuagacu

SEQ ID NO: 233696 - RNA, 64 nt, Homo Sapiens
aacguaggaaacuugauuuuuuuguuuugaucauggccucuacaugcaccuuuccagagugguc

SEQ ID NO: 233697 - RNA, 64 nt, Homo Sapiens
ccuccucugccucuguucgcccaaacuggggcugggccucuauccugccagccccagcacagac

SEQ ID NO: 233698 - RNA, 64 nt, Homo Sapiens
ccagguggggaccagaagucgagucaggccccugggccucuauguguggggggcaagaucagga

SEQ ID NO: 233699 - RNA, 64 nt, Homo Sapiens
uuuucucagaaugguuuccucuucgcuucaaggcggccucuaccggguggaggagggagccagg

SEQ ID NO: 233700 - RNA, 64 nt, Homo Sapiens
uuucuuuugauauuucauagugccucuuuguccuggccucuaguugcaguggcuuggcugacau

SEQ ID NO: 233701 - RNA, 64 nt, Homo Sapiens
aaccacagccacagagucagggcccccugagcugggccucuaagccagagggaucggaggcuca

SEQ ID NO: 233702 - RNA, 64 nt, Homo Sapiens
ccugugcuaggacugcagauucuauacuugcguuggccucuaacucuccaauccagagccuccu

SEQ ID NO: 233703 - RNA, 64 nt, Homo Sapiens
cuacuuuucccugcuggaagccagaagggcuugaggccucuaugggugggggcagaaggcagag

SEQ ID NO: 233704 - RNA, 64 nt, Homo Sapiens
ccccaagcccugcccuucaccgcccggcugcacuggccucuaggacucacagcagccagcccca

SEQ ID NO: 233705 - RNA, 64 nt, Homo Sapiens
cgauucccgggugcagaauuguaacucgggguugggccucuauauggagugaccaaaaugccaa

SEQ ID NO: 233706 - RNA, 64 nt, Homo Sapiens
aaacccaguagccuagaagauacaaaacuccacuggccucuaaaauuauauuagccaagagugg

SEQ ID NO: 233707 - RNA, 64 nt, Homo Sapiens
augucaagcccauugcucucccacugcagaacauggccucuagauuaaugccaccgauucagga

SEQ ID NO: 233708 - RNA, 64 nt, Homo Sapiens
uuccucccagcaaccuucccucucugaccaauggggccucuaggcucugcccuucacguugggg

SEQ ID NO: 233709 - RNA, 64 nt, Homo Sapiens
ucaccuggagagccucgaaauuccaauccuggcuggccucuaaacagggguuuuacaacaggcu

SEQ ID NO: 233710 - RNA, 64 nt, Homo Sapiens
cugcacucucuuucuggcccagcaguguuggaggggccucuaaguggaggcugcuccagaacuc

SEQ ID NO: 233711 - RNA, 64 nt, Homo Sapiens
auccucucuguggccacuucgugacucuccacagggccucuaccagcugcccagcauggaccug

SEQ ID NO: 233712 - RNA, 64 nt, Homo Sapiens
cagacauuccugcagagggucggggaggggcucgggccucuagucaaggcuucccugucuccca

SEQ ID NO: 233713 - RNA, 64 nt, Homo Sapiens
acaagggcucucuuaggcaucugccuagcaagcuggccucuaccuguaggggucuccugccuag

SEQ ID NO: 233714 - RNA, 64 nt, Homo Sapiens
cuagcaccccguaagaagagcagaggguggaaauggccucuaagguagggggccugcagggagc

SEQ ID NO: 233715 - RNA, 64 nt, Homo Sapiens
uaaccaguuuaaauugguucguccuagggccucuggccucuaggccaagaaugaugccuuucag

SEQ ID NO: 233716 - RNA, 64 nt, Homo Sapiens
uacaacccuucuuuacaaaagaucucuagcuacuggccucuaaauucaagagguccacugguug

SEQ ID NO: 233717 - RNA, 64 nt, Homo Sapiens
cacuaggugccaggaaugcguuaguagcaccccuggccucuaccgugcucccacgguaggaugu

SEQ ID NO: 233718 - RNA, 64 nt, Homo Sapiens
ucucagggcaaacauggugagaguggcaggcagaggccucuaaagccuucacaaacagggugug

SEQ ID NO: 233719 - RNA, 64 nt, Homo Sapiens
uuuuacacacacaccucucaagacggagaugcauggccucuaagagugcccgugucgguucuuc

SEQ ID NO: 233720 - RNA, 64 nt, Homo Sapiens
gcccuuuuauagcccaccguaguggugggugacuggccucuaguuuauauaauuauuuaccucu

SEQ ID NO: 233721 - RNA, 64 nt, Homo Sapiens
ugcucaugauuucacuugacagcguaugcuccuuggccucuaauuguacuuugcuuuuccagag

SEQ ID NO: 233722 - RNA, 64 nt, Homo Sapiens
gccuauuguaacuacacugggcaucagaauaaaaggccucuagaaauugcugaacaaugguuaa

SEQ ID NO: 233723 - RNA, 64 nt, Homo Sapiens
agaugauaagccuaaaaaaacaccuuaaguaaauggccucuaguuuagcuccaucuuaaaauuu

SEQ ID NO: 233724 - RNA, 64 nt, Homo Sapiens
ccaguaaaccugauuggguuuauuuuaguuauuuggccucuacucucaccccgcaacccaucag

SEQ ID NO: 233725 - RNA, 64 nt, Homo Sapiens
uccuuugaauggagcguaagcccagcagacauuuggccucuagaaucacgaggaacagagaugg

SEQ ID NO: 233726 - RNA, 64 nt, Homo Sapiens
cagagaucuugaguguagugguuauuccacagaaggccucuagcgacaagaaaauuaauagagc

SEQ ID NO: 233727 - RNA, 52 nt, Homo Sapiens
cugcuguccugaaaagauaacuggccucuauuucuuaauaaauucuuccaag

SEQ ID NO: 233728 - RNA, 64 nt, Homo Sapiens
cugaagcaaaagagauuauaguuaccagaaguauggccucuaaugguguugagccuuuucaaga

SEQ ID NO: 233729 - RNA, 64 nt, Homo Sapiens
acacauuccagcccugcccagcaugcugaccuuuggccucuaacccucagugggcccccagguc

SEQ ID NO: 233730 - RNA, 64 nt, Homo Sapiens
uguaauaagauagagggucacaagaaagaugccaggccucuaaaguguccuuaagcuugucuca

SEQ ID NO: 233731 - RNA, 64 nt, Homo Sapiens
uuacaucauauaauuucugcuaacuuuauggaagggccucuauuccuucuucuacccuaaaucu

SEQ ID NO: 233732 - RNA, 64 nt, Homo Sapiens
guuccauguuguaaauacccugccccccaacccaggccucuauucccccuccucccugccgcag

SEQ ID NO: 233733 - RNA, 64 nt, Homo Sapiens
uguuguuuugugcaauauacgacuaugaucugauggccucuaggcuuccuuggaagcccagagg

SEQ ID NO: 233734 - RNA, 64 nt, Homo Sapiens
uuauauugcuuugcacuuugucaagagaagacuuggccucuaauuuacagaaguaaaucgaccg

SEQ ID NO: 233735 - RNA, 64 nt, Homo Sapiens
ucaaauuccugaccuuaagugauccaccugccuaggccucuaaaaugcugggauuacaggcgug

SEQ ID NO: 233736 - RNA, 64 nt, Homo Sapiens
acaaguguuggggaagaugggagguugugggugaggccucuaaagguccucucccaaacugacc

SEQ ID NO: 233737 - RNA, 64 nt, Homo Sapiens
uuaagcaucucagaggaagcagcccucccucgauggccucuagcccagagaagcccgcgcaucu

SEQ ID NO: 233738 - RNA, 64 nt, Homo Sapiens
gaguuuuauggaauaccugguacgaaauguaaauggccucuacauaagguguaauuacagaauu

SEQ ID NO: 233739 - RNA, 64 nt, Homo Sapiens
accucuacugucucgucggccgcucccgcaggacggccucuauucucggacgccgaggggcugg

SEQ ID NO: 233740 - RNA, 64 nt, Homo Sapiens
ccaacugguuccuuuuguucaugaauugaagucgggccucuaugccauccucaguugaaguuug

SEQ ID NO: 233741 - RNA, 64 nt, Homo Sapiens
gggaguguggggucugucucggcaggaagaauggggccucuaaggcugggggugcuaauuacau

SEQ ID NO: 233742 - RNA, 64 nt, Homo Sapiens
cugaagagggaaggugcuaggcucuggcuggcugggccucuaucggugaagggagaaagccugu

SEQ ID NO: 233743 - RNA, 64 nt, Homo Sapiens
aggggcccucuggaauggcaucccaugagcuuguggccucuaucugcuaccaucuguguuuuau

SEQ ID NO: 233744 - RNA, 64 nt, Homo Sapiens
ccagcuuuaucacuuauuuagccaugcuagccuaggccucuauuuccuugucuccaaaaugaga

SEQ ID NO: 233745 - RNA, 64 nt, Homo Sapiens
guugugagauaauugaguuuaaagggaauuguguggccucuagccuagucauuuaaagaaggau

SEQ ID NO: 233746 - RNA, 64 nt, Homo Sapiens
gcagcucugccaccauccugcugggaacugggggggccucuauuggguuauaggcaaggccuuu

SEQ ID NO: 233747 - RNA, 64 nt, Homo Sapiens
aucucgguuuuucauccacuaugucuuuagcagaggccucuagcauccucauguguugacccug

SEQ ID NO: 233748 - RNA, 64 nt, Homo Sapiens
cugccagcuggcuccgagggcaacacaggggccuggccucuagagggcuggugauugaggggcc

SEQ ID NO: 233749 - RNA, 64 nt, Homo Sapiens
ucacucucaccuuccaaaucagggacaagaggcuggccucuacauuguaaacagaagcaacaga

SEQ ID NO: 233750 - RNA, 64 nt, Homo Sapiens
accaggguuugccaggcuaaauggaacucccgagggccucuaggucuaaccagccccagcacaa

SEQ ID NO: 233751 - RNA, 64 nt, Homo Sapiens
cccaggccccgaggacccaggugccuuccaugucggccucuaacagccucuguuccccuaguaa

SEQ ID NO: 233752 - RNA, 64 nt, Homo Sapiens
ccaaacacaugacuucuucccagcagcccuucccggccucuaaaguuuggucccagcagcccuu

SEQ ID NO: 233753 - RNA, 64 nt, Homo Sapiens
gaguuaagucuacaaaggaauaaacauaauguguggccucuauauacaaacucuauuucuguca

SEQ ID NO: 233754 - RNA, 64 nt, Homo Sapiens
gguauugggguuauaugauucuuucuuagauaauggccucuacuaaauaacucaagaucuuucu

SEQ ID NO: 233755 - RNA, 64 nt, Homo Sapiens
caugcgcaagacuaaagcagcggaagaggaggugggccucuaggaucuuugucuucuggcugga

SEQ ID NO: 233756 - RNA, 64 nt, Homo Sapiens
cccacgcugggaggacacgggcugggcugagcagggccucuaguggaacacaugggggucucau

SEQ ID NO: 233757 - RNA, 64 nt, Homo Sapiens
cggguccgcggggcacccgccggaugcgcagccuggccucuacuacagcgccaacgagcagugc

SEQ ID NO: 233758 - RNA, 64 nt, Homo Sapiens
uuuguauccaggagaaacuggggcaaaggcugauggccucuaccauuucacuuuccucuucuag

SEQ ID NO: 233759 - RNA, 64 nt, Homo Sapiens
cuggcucgagagcaucuuggccaggaagggcccuggccucuaaacuaggccacgggacagaugg

SEQ ID NO: 233760 - RNA, 64 nt, Homo Sapiens
gaaggcaaugggguuucuccaagacagccuguguggccucuacucugaacaaauacacugauga

SEQ ID NO: 233761 - RNA, 64 nt, Homo Sapiens
cgaaccauguagcuucaccugacucagugcugggggccucuaccaucuacugugcuugugucau

SEQ ID NO: 233762 - RNA, 64 nt, Homo Sapiens
cacagggcucccaggccaggccucauucuccucuggccucuaauagucaaugauuguguagcca

SEQ ID NO: 233763 - RNA, 64 nt, Homo Sapiens
auuccacugaaccuaaaaucaucaaagcagcaguggccucuacguuuuacuccuuugcugaaaa

SEQ ID NO: 233764 - RNA, 64 nt, Homo Sapiens
ggggagggaacugcaagugccugaggaccagaguggccucuagccccgaauugaacacuuuuaa

SEQ ID NO: 233765 - RNA, 64 nt, Homo Sapiens
ccuccucugcugcagggcucccccacccccacacggccucuaaagauguuuauuuccuuauaga

SEQ ID NO: 233766 - RNA, 64 nt, Homo Sapiens
ucgcccuuuagcggggaggucauuacagccucauggccucuaccaaggccccagaucacaggau

SEQ ID NO: 233767 - RNA, 64 nt, Homo Sapiens
aaaccuucuacccccauuauuuaaggugaccacuggccucuaggugucagacugaagcuuuguu

SEQ ID NO: 233768 - RNA, 64 nt, Homo Sapiens
gcugaggccuggcucagagcuccucuccaggaugggccucuaaauguucccugcaagugccauu

SEQ ID NO: 233769 - RNA, 64 nt, Homo Sapiens
gaagagccccccacugcagaaggcagccggccaaggccucuaggaacucagcccccugaccugg

SEQ ID NO: 233770 - RNA, 64 nt, Homo Sapiens
gagccuuuuagggggaggggccugggcugggccuggccucuacaagauuugcccccccaguggc

SEQ ID NO: 233771 - RNA, 64 nt, Homo Sapiens
uccuuugcacuguaggagauuuacuaauaucccuggccucuacccaguaguaccacuagcaccu

SEQ ID NO: 233772 - RNA, 64 nt, Homo Sapiens
guucccgguggaaaaccgugggagaggaagcuugggccucuacuccaaguaucagagccuguuc

SEQ ID NO: 233773 - RNA, 64 nt, Homo Sapiens
ccugcuguccugcccaagaacugagggucuccccggccucuacugcccuggcugcagucagugc

SEQ ID NO: 233774 - RNA, 64 nt, Homo Sapiens
ccucucuggacuuucuccaaaggcacugacccucggccucuacuuuguccccucaccuccaccc

SEQ ID NO: 233775 - RNA, 64 nt, Homo Sapiens
acaaguuuugcauuguagaagauauaaucagucuggccucuacauuguguucgagcacagaacg

SEQ ID NO: 233776 - RNA, 64 nt, Homo Sapiens
uagaggagugacuacagguuuucuuuacaaccauggccucuaguauacuuaaaauaagcgucca

SEQ ID NO: 233777 - RNA, 64 nt, Homo Sapiens
ucucucucacuugaauucuggcauuauuuuuaguggccucuacugauaauaccuacccuagagu

SEQ ID NO: 233778 - RNA, 64 nt, Homo Sapiens
ugugagagggccacauuggcuaaaaccuaaagguggccucuaggagaugagaccuaccuuccag

SEQ ID NO: 233779 - RNA, 64 nt, Homo Sapiens
uuuguuuuuuuaguuuguuauccccuuacugagcggccucuacuagguggcugugauuaaaugu

SEQ ID NO: 233780 - RNA, 61 nt, Homo Sapiens
cacgggguaccaaggccugagggccgccagcggccucuacggccccgacggacgcuuguga

SEQ ID NO: 233781 - RNA, 64 nt, Homo Sapiens
uuagaggcugauuaucuaguuuuguaguuccucaggccucuaauuuauuuuuugcuuucugcuu

SEQ ID NO: 233782 - RNA, 64 nt, Homo Sapiens
ucagaacuggggaaggaguggaacuuaugacuugggccucuaggcugucucuguccccucagcu

SEQ ID NO: 233783 - RNA, 64 nt, Homo Sapiens
agguugggaaguuuuagcguuucccauuguuucuggccucuaauauucugagaaaugucugggc

SEQ ID NO: 233784 - RNA, 64 nt, Homo Sapiens
ccucuguuuuuguuugaugacucucauggacacuggccucuagcguuuacaaaggggcaaggac

SEQ ID NO: 233785 - RNA, 64 nt, Homo Sapiens
cuucccugcucuccgagguagccuauccucuccuggccucuagucagagccgucuccucagguu

SEQ ID NO: 233786 - RNA, 64 nt, Homo Sapiens
gcagucgcuaacuacucugcuuccuccucugcccggccucuagcccagguccuggcugccagcu

SEQ ID NO: 233787 - RNA, 64 nt, Homo Sapiens
acuuccaacuccagccaccagaccguagaucucaggccucuaacaggugcuguagcaggcgcaa

SEQ ID NO: 233788 - RNA, 64 nt, Homo Sapiens
aucagauccccuaguuacucgaacagaaaauuaaggccucuaaauuuuacuuuuaacaguccau

SEQ ID NO: 233789 - RNA, 64 nt, Homo Sapiens
ccuaaugagcuaguguuucuauuugauuugcuguggccucuaugaagaaugaguuuguggaaca

SEQ ID NO: 233790 - RNA, 64 nt, Homo Sapiens
cauaccaaggaggccagccuuacuucaccaaacuggccucuaucuugacugagacuggggucuc

SEQ ID NO: 233791 - RNA, 64 nt, Homo Sapiens
ccaagcuggugcagcggcagugcuggcccagggcggccucuacggcagggcacccaccagcagc

SEQ ID NO: 233792 - RNA, 64 nt, Homo Sapiens
uuauucguuuaacgaccgcacagcuccgagguuuggccucuaucguuaugcugcagaucaguuu

SEQ ID NO: 233793 - RNA, 64 nt, Homo Sapiens
caccccccacucuacuuaucuccggaggagaccaggccucuacaugcaguugggaggggcaccg

SEQ ID NO: 233794 - RNA, 64 nt, Homo Sapiens
gugaugauuccuauuuccucuaugauuaaaauugggccucuacucuuuuaaaauuugcacacau

SEQ ID NO: 233795 - RNA, 64 nt, Homo Sapiens
gcccccauucagacacgcugacucaggagguccaggccucuaaggcuucucucccuggagugag

SEQ ID NO: 233796 - RNA, 64 nt, Homo Sapiens
uugcaucauuuaaaaaaaauaauuaaauccucauggccucuaaauuaguauguagaacacugaa

SEQ ID NO: 233797 - RNA, 64 nt, Homo Sapiens
gaaccguggggcaggguggcgugcugagcuggagggccucuaggccucaucugggguugggucu

SEQ ID NO: 233798 - RNA, 64 nt, Homo Sapiens
cucccugcuccugggaugcuucccaagcagcccaggccucuagccuccauggcugaugaccuca

SEQ ID NO: 233799 - RNA, 64 nt, Homo Sapiens
uggcccggggcugcagccugaccccucugccaucggccucuaguucuccaaggaccuagaagac

SEQ ID NO: 233800 - RNA, 64 nt, Homo Sapiens
ugcccacucugauaugccugacucgggggacaugggccucuaacgacucaguucccuucugaac

SEQ ID NO: 233801 - RNA, 64 nt, Homo Sapiens
uccagaaggauccaagacaaaucugcacacuccaggccucuaguagacuguaaauacgaaccca

SEQ ID NO: 233802 - RNA, 64 nt, Homo Sapiens
caucugacagagacucggccgcaggguagacccaggccucuaacacccaaacacgccucuccug

SEQ ID NO: 233803 - RNA, 64 nt, Homo Sapiens
auguuccuuguuaauucuugcagaggauuggguuggccucuaacauguuaccccagggaguucu

SEQ ID NO: 233804 - RNA, 64 nt, Homo Sapiens
cuggccggaggaaggaccgcaggcagacagccugggccucuaacagcuuuuguccggagcuaga

SEQ ID NO: 233805 - RNA, 64 nt, Homo Sapiens
ggggccuccugagguacaccuuugccccuguaagggccucuaggcccugggccugccuccccaa

SEQ ID NO: 233806 - RNA, 64 nt, Homo Sapiens
ugcuccuaaccccugccacuuucuguuucauuaaggccucuacucuggcucaggacccagucca

SEQ ID NO: 233807 - RNA, 64 nt, Homo Sapiens
agcugagagacagccggcagccacagccaugagcggccucuaaguggcuuugaggacacgggga

SEQ ID NO: 233808 - RNA, 64 nt, Homo Sapiens
ugggcagcagggcuccauucucuggccuggcccaggccucuacauacuuacuccagccauuugg

SEQ ID NO: 233809 - RNA, 64 nt, Homo Sapiens
uucugugcauauguacauaugaauacaaaucgaaggccucuaccuccuggaguuauacaacuug

SEQ ID NO: 233810 - RNA, 64 nt, Homo Sapiens
auccucccacccugacgccaucuuucuggugaccggccucuaaaucgcugucucucugucucuu

SEQ ID NO: 233811 - RNA, 64 nt, Homo Sapiens
ugaaggauggaggugcugaauaaauuaggccucaggccucuaccaccagagagcuggagaaugg

SEQ ID NO: 233812 - RNA, 64 nt, Homo Sapiens
gaaaggggcccagucguucuugggcccaggauggggccucuagacuugcaagggagaggaacag

SEQ ID NO: 233813 - RNA, 64 nt, Homo Sapiens
aagaaacuaacaagaaagcacucaagcaucuuagggccucuaugccagggaugaggacacugug

SEQ ID NO: 233814 - RNA, 64 nt, Homo Sapiens
caaacuuaacccuuguagcccagggcuugaacuuggccucuaccauggccauggcuauugucuc

SEQ ID NO: 233815 - RNA, 64 nt, Homo Sapiens
cuucugcuuacuggugugggagcuauggauuucaggccucuacaucagaaaaaugcuaaguccc

SEQ ID NO: 233816 - RNA, 64 nt, Homo Sapiens
cacaccuggaccuccgugccggguggaugcaaggggccucuacccagggacaggagagccagca

SEQ ID NO: 233817 - RNA, 64 nt, Homo Sapiens
auuuaaacaugaacauauauuugcggugcuuagaggccucuauaaugagacuguaagaaacagu

SEQ ID NO: 233818 - RNA, 64 nt, Homo Sapiens
uaguuuuagaugacaaggucuuccucgggaaccuggccucuaauguuuuuuggaauacugacaa

SEQ ID NO: 233819 - RNA, 64 nt, Homo Sapiens
ugcuguucacacgcucagccugucugggggagcgggccucuagcuucagccagggcggguacac

SEQ ID NO: 233820 - RNA, 64 nt, Homo Sapiens
gaagguccuugagaugaugcucagcuguggggcgggccucuaagaugccccauacuuugggggu

SEQ ID NO: 233821 - RNA, 64 nt, Homo Sapiens
uaaagggucgggggaggggggagccuuguagggaggccucuacacagaagaaagcagcccccau

SEQ ID NO: 233822 - RNA, 64 nt, Homo Sapiens
ugacagcacccugcuggcccuccagggggcccugggccucuaugauggacacaccccgccauau

SEQ ID NO: 233823 - RNA, 64 nt, Homo Sapiens
gugagaggggacugcuguacaaagaauauaggaaggccucuagacuacauccauuccuuccuca

SEQ ID NO: 233824 - RNA, 64 nt, Homo Sapiens
cucaugugguuguaagccagaccggggaugggucggccucuaaguggucucaucucaacguuca

SEQ ID NO: 233825 - RNA, 64 nt, Homo Sapiens
cugucccuccaccccacccuuucagcugacaggaggccucuaucuggaugaaagagaauaagaa

SEQ ID NO: 233826 - RNA, 64 nt, Homo Sapiens
aaacuguguccuauaugcccgccugaggucugauggccucuaauagacuccacaugcugguggu

SEQ ID NO: 233827 - RNA, 64 nt, Homo Sapiens
uuggaggcuauuuuugaagguuccauguugaaauggccucuaaucuggaauugucaccccagaa

SEQ ID NO: 233828 - RNA, 64 nt, Homo Sapiens
ugggugucccagggcaagccaccuugccugucuaggccucuaugucaggacucccuggccuuca

SEQ ID NO: 233829 - RNA, 64 nt, Homo Sapiens
gggcacccuccccagggauuggaaacggaugacgggccucuaggcggucuucugccacgagcag

SEQ ID NO: 233830 - RNA, 64 nt, Homo Sapiens
cgugcucuggggccgggccucgcugcuuagcagcggccucuagcuccgucucccggggaccugg

SEQ ID NO: 233831 - RNA, 64 nt, Homo Sapiens
gcaucuuggaucucagaauggccuggaaacggauggccucuacgcuguuccaucacagucucca

SEQ ID NO: 233832 - RNA, 64 nt, Homo Sapiens
ccacccuggugugucccuagaauucccacugcugggccucuaucuccaugacaacaaaauaaaa

SEQ ID NO: 233833 - RNA, 64 nt, Homo Sapiens
aacaagagagcgcuccucucccagauaggaaaagggccucuaacaaggagaaauuagugugcgg

SEQ ID NO: 233834 - RNA, 64 nt, Homo Sapiens
aagguuucucuuugauuucaagaaugaccaaaauggccucuaaaagauguuaaucaucucaaau

SEQ ID NO: 233835 - RNA, 64 nt, Homo Sapiens
ccucugcacagcccuucugggugccccucuguguggccucuaaccaucccccacaaaaacauga

SEQ ID NO: 233836 - RNA, 64 nt, Homo Sapiens
cacucuggggaguaucuauuauugaauauacaggggccucuauauuugauucuuuguggucauc

SEQ ID NO: 233837 - RNA, 64 nt, Homo Sapiens
aucuuuaacucaugcauggcucauccaguaaacuggccucuacuccacuccauaauauaacauu

SEQ ID NO: 233838 - RNA, 64 nt, Homo Sapiens
aggccacaguaggccucucuaccagggguccuugggccucuagaggggugaagaaucugggcca

SEQ ID NO: 233839 - RNA, 64 nt, Homo Sapiens
auccuuaauaggcaggaagucugggaauucugguggccucuagggcaguguucucacagcaccg

SEQ ID NO: 233840 - RNA, 64 nt, Homo Sapiens
gcuucacccacacuggacuuccuuucacgaccuuggccucuaaggcaccagcccuccaguagau

SEQ ID NO: 233841 - RNA, 64 nt, Homo Sapiens
cugugaugucacacucaagauagcagcucagcagggccucuaacauuucuccacugcacugugc

SEQ ID NO: 233842 - RNA, 64 nt, Homo Sapiens
cccuauucccugugucugccgagaaauuagccugggccucuaccucccugcuuugcugugaagg

SEQ ID NO: 233843 - RNA, 64 nt, Homo Sapiens
uccaugugcgcagccccacaccuguggccuuccuggccucuacuacuucuuuuggggcaauuuu

SEQ ID NO: 233844 - RNA, 64 nt, Homo Sapiens
ggggggaggggacaugaagguagguaaauagguaggccucuaauugaaccaccucucuaaguua

SEQ ID NO: 233845 - RNA, 64 nt, Homo Sapiens
ucuuuggaccauuguaacuguguuugaccuacauggccucuaauggauguguucgccauuucug

SEQ ID NO: 233846 - RNA, 64 nt, Homo Sapiens
agagguccucaucuccaucucucaccucugaucuggccucuacggagguucagagaagagaacc

SEQ ID NO: 233847 - RNA, 64 nt, Homo Sapiens
ccacaggcccgcuaagccccaaaggcaggaucuagaugaugaugaacaugauuaugaagaaaua

SEQ ID NO: 233848 - RNA, 64 nt, Homo Sapiens
caggcccgcuaagccccaaaggcaggaucuagaugaugaugaacaugauuaugaagaaauacuu

SEQ ID NO: 233849 - RNA, 64 nt, Homo Sapiens
auucuuggaaaaguggcaagaccaaaaugacaaugaugaugauaaugaugaugacgacgacaac

SEQ ID NO: 233850 - RNA, 64 nt, Homo Sapiens
guggcaagaccaaaaugacaaugaugaugauaaugaugaugacgacgacaacgaugaugcuugu

SEQ ID NO: 233851 - RNA, 64 nt, Homo Sapiens
acauucaguuugugcagguaagguguuuggcagugaugaugaccccuacuagauggacaggcug

SEQ ID NO: 233852 - RNA, 64 nt, Homo Sapiens
uaaugguguuuacuccuuuaugugggcagagaacgaugaugauuuucuccuaagaaaaauccgc

SEQ ID NO: 233853 - RNA, 64 nt, Homo Sapiens
agagcuggguuccuugggaggaaguuguaguggugaugaugaugaugauaaugaugaugaugau

SEQ ID NO: 233854 - RNA, 64 nt, Homo Sapiens
gcuggguuccuugggaggaaguuguaguggugaugaugaugaugauaaugaugaugaugauggu

SEQ ID NO: 233855 - RNA, 64 nt, Homo Sapiens
ggguuccuugggaggaaguuguaguggugaugaugaugaugauaaugaugaugaugaugguggu

SEQ ID NO: 233856 - RNA, 64 nt, Homo Sapiens
aggaaguuguaguggugaugaugaugaugauaaugaugaugaugauggugguguugaugguggc

SEQ ID NO: 233857 - RNA, 64 nt, Homo Sapiens
aaguuguaguggugaugaugaugaugauaaugaugaugaugauggugguguugaugguggcggu

SEQ ID NO: 233858 - RNA, 64 nt, Homo Sapiens
ucaguaguggggaauucugugacagcugauugaagaugaugaugaagaaccucugcauucuagu

SEQ ID NO: 233859 - RNA, 64 nt, Homo Sapiens
guaguggggaauucugugacagcugauugaagaugaugaugaagaaccucugcauucuaguuac

SEQ ID NO: 233860 - RNA, 64 nt, Homo Sapiens
ugcuacuggugcaauuggaucaguguaugauauggaugaugaugaaauggaccccaauuaugcc

SEQ ID NO: 233861 - RNA, 64 nt, Homo Sapiens
uacuggugcaauuggaucaguguaugauauggaugaugaugaaauggaccccaauuaugccaga

SEQ ID NO: 233862 - RNA, 64 nt, Homo Sapiens
gagucuccccuuaauuagaccccugccuugugaugaugaugaguauccuguggugcccccuucc

SEQ ID NO: 233863 - RNA, 64 nt, Homo Sapiens
agugagucuccccuuaauuaucccccugccuugugaugaugauggaaauccuguggugcccccu

SEQ ID NO: 233864 - RNA, 64 nt, Homo Sapiens
gauggcauccuagugaagaaugacucccuacugggaugaugaaguagaaguucuaagcgggaga

SEQ ID NO: 233865 - RNA, 64 nt, Homo Sapiens
uuuaaaauacacacucaaauugcacugucaagaugaugaugaucuguuuucauuaucucaaaac

SEQ ID NO: 233866 - RNA, 64 nt, Homo Sapiens
aucuuuaaaauacacacucaaacugcacugucaagaugaugauguuuuguuuucauuaucucaa

SEQ ID NO: 233867 - RNA, 64 nt, Homo Sapiens
cacaccuccaagaucaagauccuguucugagucagaugaugaugacagcagugaaacuccuccu

SEQ ID NO: 233868 - RNA, 64 nt, Homo Sapiens
accuccaagaucaagauccuguucugagucagaugaugaugacagcagugaaacuccuccucac

SEQ ID NO: 233869 - RNA, 64 nt, Homo Sapiens
ggagaguucaagugaugagcagacgccuagucgggaugaugauagccaguccaggaguccaagu

SEQ ID NO: 233870 - RNA, 64 nt, Homo Sapiens
cuuguuuugugacuggaccacugcccaggugcuugaugaugaccaggagugugcucugggaaug

SEQ ID NO: 233871 - RNA, 64 nt, Homo Sapiens
uaugagcugacuccaaauggacagcccagaagcugaugaugagaauucuuaucacucaccuuua

SEQ ID NO: 233872 - RNA, 64 nt, Homo Sapiens
uugaagagaugggagaagaaaguuagaagguggagaugaugauagcuagaagcuaaauuugccg

SEQ ID NO: 233873 - RNA, 64 nt, Homo Sapiens
uuuacuacuucagguaaagccugcuaaagugguagaugaugaaaauugaagagguuuucacucu

SEQ ID NO: 233874 - RNA, 64 nt, Homo Sapiens
agaauacagacaacucagagaugcagauaaaggugaugaugagacguggccucuguauuugcaa

SEQ ID NO: 233875 - RNA, 64 nt, Homo Sapiens
ggcucagaggauagcgguuuccaucauaaaccaagaugaugaguucagccuuuaucccucgugg

SEQ ID NO: 233876 - RNA, 64 nt, Homo Sapiens
gggucagaggauagcgguuuccaucauaaaccaagaugaugaguucagccuuuaucccucgugg

SEQ ID NO: 233877 - RNA, 64 nt, Homo Sapiens
gaaguaguugagggagagauugggggaauggggagaugaugaugauggucaaagggugcaaaau

SEQ ID NO: 233878 - RNA, 64 nt, Homo Sapiens
guaguugagggagagauugggggaauggggagaugaugaugauggucaaagggugcaaaaucuc

SEQ ID NO: 233879 - RNA, 64 nt, Homo Sapiens
acuccauuuugagcaggcugcuuaaagugguggugaugaugaugaugaugauggcagcuuuaua

SEQ ID NO: 233880 - RNA, 64 nt, Homo Sapiens
ccauuuugagcaggcugcuuaaagugguggugaugaugaugaugaugauggcagcuuuauaucg

SEQ ID NO: 233881 - RNA, 64 nt, Homo Sapiens
uuuugagcaggcugcuuaaagugguggugaugaugaugaugaugauggcagcuuuauaucgagu

SEQ ID NO: 233882 - RNA, 64 nt, Homo Sapiens
ugagcaggcugcuuaaagugguggugaugaugaugaugaugauggcagcuuuauaucgagugcc

SEQ ID NO: 233883 - RNA, 64 nt, Homo Sapiens
cuugcguugccauuuucugcuuacugugacagucgaugaugaaucauuuuugugcccccucugc

SEQ ID NO: 233884 - RNA, 64 nt, Homo Sapiens
aaagagucuauuuuaguguuaauguaaauagagagaugaugaaaagugaugugucuguaucuuu

SEQ ID NO: 233885 - RNA, 64 nt, Homo Sapiens
gggcaauagagcgagacccugucucuuaaaaaacgaugaugaugaacacagaggacggggcacu

SEQ ID NO: 233886 - RNA, 64 nt, Homo Sapiens
caauagagcgagacccugucucuuaaaaaacgaugaugaugaacacagaggacggggcacugug

SEQ ID NO: 233887 - RNA, 64 nt, Homo Sapiens
ggcaaggacuagagagcagggccucuuggagacagaugaugacuucaaaggcugcaacccuaug

SEQ ID NO: 233888 - RNA, 64 nt, Homo Sapiens
gagaucaagaaaaagccacggcucagugcugcuggaugaugaggaauaacccacuagugccuga

SEQ ID NO: 233889 - RNA, 64 nt, Homo Sapiens
ggacuguaaaucucucgcagacccugggagcucagaugaugaugauguuaguaguuuggaagaa

SEQ ID NO: 233890 - RNA, 64 nt, Homo Sapiens
cuguaaaucucucgcagacccugggagcucagaugaugaugauguuaguaguuuggaagaagaa

SEQ ID NO: 233891 - RNA, 64 nt, Homo Sapiens
acuaaggauuuuucaagagaauaaugaugaugaugaugaugaaaugauuaauauuauuaauaua

SEQ ID NO: 233892 - RNA, 64 nt, Homo Sapiens
aaaacuaaggauuuuucaagauaauaaugaugaugaugaugaugauaugauuaauauuauuaau

SEQ ID NO: 233893 - RNA, 64 nt, Homo Sapiens
augaaaacuaaggauuuuucaauauaauaaugaugaugaugaugaggauaugauuaauauuauu

SEQ ID NO: 233894 - RNA, 64 nt, Homo Sapiens
augaugaaaacuaaggauuuauuaauauaauaaugaugaugauguuaaggauaugauuaauauu

SEQ ID NO: 233895 - RNA, 64 nt, Homo Sapiens
guuauuuaauagccagaggcuuaaauuucuggaugaugaugauuccuuggccagggcugacucc

SEQ ID NO: 233896 - RNA, 64 nt, Homo Sapiens
auuguuauuuaauagccagauccuuaaauuucuggaugaugaugccaccuuggccagggcugac

SEQ ID NO: 233897 - RNA, 64 nt, Homo Sapiens
agguauuccguuuaucacaguccacuuaaaaaaugaugaugaugauaaaaaccacgacccaacc

SEQ ID NO: 233898 - RNA, 64 nt, Homo Sapiens
uauuccguuuaucacaguccacuuaaaaaaugaugaugaugauaaaaaccacgacccaaccagg

SEQ ID NO: 233899 - RNA, 64 nt, Homo Sapiens
uuaacaguuuuacuucuggcaugaugaucaugaugaugaugauugggcuguguuuucgaugaug

SEQ ID NO: 233900 - RNA, 64 nt, Homo Sapiens
auuuuaacaguuuuacuucuaugaugaugaucaugaugaugaugcuggggcuguguuuucgaug

SEQ ID NO: 233901 - RNA, 64 nt, Homo Sapiens
augaugaugaucaucaugauguguuuucgaugaugaugaugauccuguaaagcaaacuggggcu

SEQ ID NO: 233902 - RNA, 64 nt, Homo Sapiens
aucaugaugaugaucaucaugcuguguuuucgaugaugaugauggggcuguaaagcaaacuggg

SEQ ID NO: 233903 - RNA, 64 nt, Homo Sapiens
augaucaugaugaugaucauggggcuguguuuucgaugaugaugcuugggcuguaaagcaaacu

SEQ ID NO: 233904 - RNA, 64 nt, Homo Sapiens
ugcauuacaacuuguuuucuuauguaauaauaaugaugaugaugaugauaauaauaaauauuuu

SEQ ID NO: 233905 - RNA, 64 nt, Homo Sapiens
auuacaacuuguuuucuuauguaauaauaaugaugaugaugaugauaauaauaaauauuuuuga

SEQ ID NO: 233906 - RNA, 64 nt, Homo Sapiens
acaacuuguuuucuuauguaauaauaaugaugaugaugaugauaauaauaaauauuuuugagug

SEQ ID NO: 233907 - RNA, 64 nt, Homo Sapiens
ugggcagaaaaaaguaaaacuugcugcugcugcugaugaugaugaugaugaagaugaugaugau

SEQ ID NO: 233908 - RNA, 64 nt, Homo Sapiens
gcagaaaaaaguaaaacuugcugcugcugcugaugaugaugaugaugaagaugaugaugaugau

SEQ ID NO: 233909 - RNA, 64 nt, Homo Sapiens
gaaaaaaguaaaacuugcugcugcugcugaugaugaugaugaugaagaugaugaugaugaugau

SEQ ID NO: 233910 - RNA, 64 nt, Homo Sapiens
aaaaguaaaacuugcugcugcugcugaugaugaugaugaugaagaugaugaugaugaugaugac

SEQ ID NO: 233911 - RNA, 64 nt, Homo Sapiens
acuugcugcugcugcugaugaugaugaugaugaagaugaugaugaugaugaugacgaggaagcu

SEQ ID NO: 233912 - RNA, 64 nt, Homo Sapiens
ugcugcugcugcugaugaugaugaugaugaagaugaugaugaugaugaugacgaggaagcugaa

SEQ ID NO: 233913 - RNA, 64 nt, Homo Sapiens
ugcugcugcugaugaugaugaugaugaagaugaugaugaugaugaugacgaggaagcugaagaa

SEQ ID NO: 233914 - RNA, 64 nt, Homo Sapiens
ugcugcugaugaugaugaugaugaagaugaugaugaugaugaugacgaggaagcugaagaaaaa

SEQ ID NO: 233915 - RNA, 64 nt, Homo Sapiens
ugcugaugaugaugaugaugaagaugaugaugaugaugaugacgaggaagcugaagaaaaagcg

SEQ ID NO: 233916 - RNA, 64 nt, Homo Sapiens
ucuggaugcccgggauggcaaugagguggagccugaugaugaccacuucuccauugugaguggc

SEQ ID NO: 233917 - RNA, 64 nt, Homo Sapiens
cagccagcccaggauccguccucauuuuauuggugaugaugaaugggaaugaaaucagggggcu

SEQ ID NO: 233918 - RNA, 64 nt, Homo Sapiens
aaccaguuuaauuuuuuuuuuccucauuguuggggaugaugagaagaaaugauuugggaaaauu

SEQ ID NO: 233919 - RNA, 64 nt, Homo Sapiens
aauugucacagugucccuucuacuucccucuauugaugaugaugaugaugaugaugaugaugau

SEQ ID NO: 233920 - RNA, 64 nt, Homo Sapiens
ugucacagugucccuucuacuucccucuauugaugaugaugaugaugaugaugaugaugaugau

SEQ ID NO: 233921 - RNA, 64 nt, Homo Sapiens
cacagugucccuucuacuucccucuauugaugaugaugaugaugaugaugaugaugaugaugau

SEQ ID NO: 233922 - RNA, 64 nt, Homo Sapiens
agugucccuucuacuucccucuauugaugaugaugaugaugaugaugaugaugaugaugaugau

SEQ ID NO: 233923 - RNA, 64 nt, Homo Sapiens
gucccuucuacuucccucuauugaugaugaugaugaugaugaugaugaugaugaugaugaugau

SEQ ID NO: 233924 - RNA, 64 nt, Homo Sapiens
ccuucuacuucccucuauugaugaugaugaugaugaugaugaugaugaugaugaugaugaugau

SEQ ID NO: 233925 - RNA, 64 nt, Homo Sapiens
ucuacuucccucuauugaugaugaugaugaugaugaugaugaugaugaugaugaugaugauggu

SEQ ID NO: 233926 - RNA, 64 nt, Homo Sapiens
acuucccucuauugaugaugaugaugaugaugaugaugaugaugaugaugaugaugaugguuuu

SEQ ID NO: 233927 - RNA, 64 nt, Homo Sapiens
ucccucuauugaugaugaugaugaugaugaugaugaugaugaugaugaugaugaugguuuuuuc

SEQ ID NO: 233928 - RNA, 64 nt, Homo Sapiens
cucuauugaugaugaugaugaugaugaugaugaugaugaugaugaugaugaugguuuuuucuaa

SEQ ID NO: 233929 - RNA, 64 nt, Homo Sapiens
uauugaugaugaugaugaugaugaugaugaugaugaugaugaugaugaugguuuuuucuaauca

SEQ ID NO: 233930 - RNA, 64 nt, Homo Sapiens
ugaugaugaugaugaugaugaugaugaugaugaugaugaugaugaugguuuuuucuaaucagaa

SEQ ID NO: 233931 - RNA, 64 nt, Homo Sapiens
ugaugaugaugaugaugaugaugaugaugaugaugaugaugaugguuuuuucuaaucagaagaa

SEQ ID NO: 233932 - RNA, 64 nt, Homo Sapiens
gauuucagaaucaggagucagcucugacaaugaagaugaugaugaugaagaagaugggaauuac

SEQ ID NO: 233933 - RNA, 64 nt, Homo Sapiens
uucagaaucaggagucagcucugacaaugaagaugaugaugaugaagaagaugggaauuaccuu

SEQ ID NO: 233934 - RNA, 64 nt, Homo Sapiens
agaaucaggagucagcucugacaaugaagaugaugaugaugaagaagaugggaauuaccuucau

SEQ ID NO: 233935 - RNA, 64 nt, Homo Sapiens
ucugcuuccccuggaaaaaaaucguguuaagcuagaugaugacagugaugaugaugaagaaagc

SEQ ID NO: 233936 - RNA, 64 nt, Homo Sapiens
ggaaaaaaaucguguuaagcuagaugaugacagugaugaugaugaagaaagcaaagaaggccaa

SEQ ID NO: 233937 - RNA, 64 nt, Homo Sapiens
aaaaaaucguguuaagcuagaugaugacagugaugaugaugaagaaagcaaagaaggccaagaa

SEQ ID NO: 233938 - RNA, 64 nt, Homo Sapiens
aaaaacauagauauugcuugggccugccaaagaagaugaugauuugcauguccagcuggauucu

SEQ ID NO: 233939 - RNA, 64 nt, Homo Sapiens
acacauggauuuugauauguucacuugcuuucaagaugaugaccguauauacauauauauauuu

SEQ ID NO: 233940 - RNA, 64 nt, Homo Sapiens
augaagauaaggaagauacgaugaugaugaagaugaugaugagggggucugguagauuauccug

SEQ ID NO: 233941 - RNA, 64 nt, Homo Sapiens
aggaugaagauaaggaagaucugaugaugaugaagaugaugaugcgugggucugguagauuauc

SEQ ID NO: 233942 - RNA, 64 nt, Homo Sapiens
augaugaugaggaugaagauuagauuauccugaugaugaugaaggggaggccucgugggucugg

SEQ ID NO: 233943 - RNA, 64 nt, Homo Sapiens
aagaugaugaugaggaugaaugguagauuauccugaugaugaugacagggaggccucguggguc

SEQ ID NO: 233944 - RNA, 64 nt, Homo Sapiens
uuauggauccaauaaguaaaacaaaacuaaaaaugaugaugauaagcuguagugucuccaucug

SEQ ID NO: 233945 - RNA, 64 nt, Homo Sapiens
uuccucaaaguuguaguugucuguugaugauggugaugaugaugaugaugacgauagugaugcc

SEQ ID NO: 233946 - RNA, 64 nt, Homo Sapiens
cucaaaguuguaguugucuguugaugauggugaugaugaugaugaugacgauagugaugccaca

SEQ ID NO: 233947 - RNA, 64 nt, Homo Sapiens
aaaguuguaguugucuguugaugauggugaugaugaugaugaugacgauagugaugccacacau

SEQ ID NO: 233948 - RNA, 64 nt, Homo Sapiens
guuguaguugucuguugaugauggugaugaugaugaugaugacgauagugaugccacacauucu

SEQ ID NO: 233949 - RNA, 64 nt, Homo Sapiens
ugcagaauaguguaaaaugcgcuucaagaauguugaugaugaugauauagaauuguggcuuuag

SEQ ID NO: 233950 - RNA, 64 nt, Homo Sapiens
agaauaguguaaaaugcgcuucaagaauguugaugaugaugauauagaauuguggcuuuaguag

SEQ ID NO: 233951 - RNA, 64 nt, Homo Sapiens
ucacugugccacuuggacaguuugacucauggaugaugaugaugugccuaaaaaggacaggugg

SEQ ID NO: 233952 - RNA, 64 nt, Homo Sapiens
augucacugugccacuuggaugguuugacucauggaugaugaugaaaugccuaaaaaggacagg

SEQ ID NO: 233953 - RNA, 64 nt, Homo Sapiens
auaauaauaauaauaacaacaugaugaugaugaugaugaugauaggacgugaaauacuucgaug

SEQ ID NO: 233954 - RNA, 64 nt, Homo Sapiens
auaauaauaauaauaauaacaugaugaugaugaugaugaugaugucuggacgugaaauacuucg

SEQ ID NO: 233955 - RNA, 64 nt, Homo Sapiens
augauaauaauaauaauaauucgaugaugaugaugaugaugaugagcucuggacgugaaauacu

SEQ ID NO: 233956 - RNA, 64 nt, Homo Sapiens
augaugauaauaauaauaauacuucgaugaugaugaugaugaugcuuagcucuggacgugaaau

SEQ ID NO: 233957 - RNA, 64 nt, Homo Sapiens
augaugaugauaauaauaauaauacuucgaugaugaugaugaugugucuuagcucuggacguga

SEQ ID NO: 233958 - RNA, 64 nt, Homo Sapiens
augaugaugaugauaauaauugaaauacuucgaugaugaugaugucuugucuuagcucuggacg

SEQ ID NO: 233959 - RNA, 64 nt, Homo Sapiens
augaugaugaugaugauaauacgugaaauacuucgaugaugauguagucuugucuuagcucugg

SEQ ID NO: 233960 - RNA, 64 nt, Homo Sapiens
gagggguugcgggggagcuggaaauaaaccuggagaugaugaugaugaugaugaugaugaugau

SEQ ID NO: 233961 - RNA, 64 nt, Homo Sapiens
ggguugcgggggagcuggaaauaaaccuggagaugaugaugaugaugaugaugaugaugaugga

SEQ ID NO: 233962 - RNA, 64 nt, Homo Sapiens
uugcgggggagcuggaaauaaaccuggagaugaugaugaugaugaugaugaugaugauggagcg

SEQ ID NO: 233963 - RNA, 64 nt, Homo Sapiens
cgggggagcuggaaauaaaccuggagaugaugaugaugaugaugaugaugaugauggagcggau

SEQ ID NO: 233964 - RNA, 64 nt, Homo Sapiens
gggagcuggaaauaaaccuggagaugaugaugaugaugaugaugaugaugauggagcggaucug

SEQ ID NO: 233965 - RNA, 64 nt, Homo Sapiens
cucccccacagguucgaacccaggccacauggaugaugaugauugggauuguuaggauggagcc

SEQ ID NO: 233966 - RNA, 64 nt, Homo Sapiens
auucucccccacagguucgagcccaggccacauggaugaugaugauggggauuguuaggaugga

SEQ ID NO: 233967 - RNA, 64 nt, Homo Sapiens
aaagaaauguaaacagaucgcacagaguaaagaagaugaugauguaauagugaauaaaccucau

SEQ ID NO: 233968 - RNA, 64 nt, Homo Sapiens
gguuccuguggagaaaaauggugaagaaaacaaagaugaugauaauguuuucagcagcaauuug

SEQ ID NO: 233969 - RNA, 64 nt, Homo Sapiens
uauuuaugcccuuauaucccugagaagaacuuuagaugaugaugaaaggcacuuuuauugagaa

SEQ ID NO: 233970 - RNA, 64 nt, Homo Sapiens
aaacuucuacagauauuacuaaggccuuuccagugaugaugaaguaagauggcagaucaccuug

SEQ ID NO: 233971 - RNA, 64 nt, Homo Sapiens
caucugaccaguuuucucuuaaagccauuuccaugaugaugaugaugggacucaauuguauuuu

SEQ ID NO: 233972 - RNA, 64 nt, Homo Sapiens
cugaccaguuuucucuuaaagccauuuccaugaugaugaugaugggacucaauuguauuuuuua

SEQ ID NO: 233973 - RNA, 64 nt, Homo Sapiens
aaguugucaaggaaugagggaaaguaaauccucaugaggaaaaguacaaauggaaaucguauua

SEQ ID NO: 233974 - RNA, 64 nt, Homo Sapiens
cuuuucuuucugcuucaaacacacaguucgucucugaggaaaguaaaauaaauggaauaagagu

SEQ ID NO: 233975 - RNA, 64 nt, Homo Sapiens
uuuauuuggaaauauucuaugaccacuuuacagaugaggaaacaggccucaagcguggaggggu

SEQ ID NO: 233976 - RNA, 64 nt, Homo Sapiens
caagucuugcugugcuuuauuugugaaacuuuaaugaggaaaaaacaaauaauaaauguucucg

SEQ ID NO: 233977 - RNA, 64 nt, Homo Sapiens
ugagaucuucuaccccaacucaucauuuuccuauugaggaaacggguccagggcagucgugugu

SEQ ID NO: 233978 - RNA, 64 nt, Homo Sapiens
aucuacauguuuguagaauuauuuugaauauguuugaggaaaauguuuaaaaucuaaauauacu

SEQ ID NO: 233979 - RNA, 64 nt, Homo Sapiens
gaggcaaagagagguuauaccuccauuuuaguguugaggaaaacgaggaaagugcuauucuugu

SEQ ID NO: 233980 - RNA, 64 nt, Homo Sapiens
gcuauucuugucuccauuuucucacagcaacuccugaggaaaguacuuuagguaucauugaauu

SEQ ID NO: 233981 - RNA, 64 nt, Homo Sapiens
uagcacuggcagagggcaccuauuauuauugacaugaggaaaccguuauuauaauuauaauuau

SEQ ID NO: 233982 - RNA, 64 nt, Homo Sapiens
ggagggcaugauccuggcaaauguggggcgggaaugaggaaaggaaguccuuguuggcagaggg

SEQ ID NO: 233983 - RNA, 64 nt, Homo Sapiens
aaaaugauuccucuucccaugaccuaaaacacugugaggaaaaaucauucaaguggcaugccaa

SEQ ID NO: 233984 - RNA, 64 nt, Homo Sapiens
augagcauuguaauuaauauucccauuuuacagaugaggaaacugaagcuaagagaagcuaagu

SEQ ID NO: 233985 - RNA, 64 nt, Homo Sapiens
gaaucaccuagaaguggaauccuguuaugagucaugaggaaacuaagguugagaccaaugauuu

SEQ ID NO: 233986 - RNA, 64 nt, Homo Sapiens
aaggcucagaggggcaaaguacuuguuuuauagaugaggaaacccagggucuacaauggggaga

SEQ ID NO: 233987 - RNA, 64 nt, Homo Sapiens
gaggagaggacaaguguaauaaaaauguuauuacugaggaaaggaaauacauuauuagaauaua

SEQ ID NO: 233988 - RNA, 64 nt, Homo Sapiens
agggaaaguuccagcaguuuuuacucagaugaccugaggaaaggaggggauggcccauuaagag

SEQ ID NO: 233989 - RNA, 64 nt, Homo Sapiens
aaguuaaguuuguuuuaaauguuuuaagugaaagugaggaaauacauguguuuuauaaaaucaa

SEQ ID NO: 233990 - RNA, 58 nt, Homo Sapiens
aauguaauuguaauuuugaaggaugacaugaggaaaauaaauuccugucaaugacuga

SEQ ID NO: 233991 - RNA, 64 nt, Homo Sapiens
uguuggcucacuacguagagcauauccaaaauaaugaggaaaugaugccuucaacugaaaaaaa

SEQ ID NO: 233992 - RNA, 64 nt, Homo Sapiens
ccacaaauuguauggugauauacaauguagaaaaugaggaaauguuuauuuacacucuugauuc

SEQ ID NO: 233993 - RNA, 64 nt, Homo Sapiens
agaaauggcauggggaauauuugggcaggcaauuugaggaaagaguacuuugauuucuuauuuc

SEQ ID NO: 233994 - RNA, 64 nt, Homo Sapiens
aacuuuaaguaauuauuuuugagaugcauaugagugaggaaauagaugcuuagaaauccuuucu

SEQ ID NO: 233995 - RNA, 64 nt, Homo Sapiens
cauagguuaccauuuuauaaaagaucucauuauaugaggaaaauaaaagcucaaggacuuuaug

SEQ ID NO: 233996 - RNA, 64 nt, Homo Sapiens
agaucacaucuuugucacugcagucaaacauuuaugaggaaaugcagugaaaauaauuuuauuu

SEQ ID NO: 233997 - RNA, 64 nt, Homo Sapiens
uguccuugaagcagcuauuugaagauguguuuucugaggaaaacaggcuacaacuguuuauuaa

SEQ ID NO: 233998 - RNA, 64 nt, Homo Sapiens
uuauacuguaaauaaacuugaugaauauuauaugugaggaaaacuuucauguauagcacucauu

SEQ ID NO: 233999 - RNA, 64 nt, Homo Sapiens
uugguuugugauaaaaauauaaagacagaagacaugaggaaaaacaaaagguuugaggaaauca

SEQ ID NO: 234000 - RNA, 64 nt, Homo Sapiens
uaaagacagaagacaugaggaaaaacaaaagguuugaggaaaucaggcauaugacuuuauacuu

SEQ ID NO: 234001 - RNA, 64 nt, Homo Sapiens
auuucauccccuugugacauauaaagaaaaaaaaugaggaaauuagacagcuuuuccuacacug

SEQ ID NO: 234002 - RNA, 64 nt, Homo Sapiens
caagcuguauggaaaagcugucucaucucauuagugaggaaagcaagaucccagcugucagugg

SEQ ID NO: 234003 - RNA, 64 nt, Homo Sapiens
aggcuggaagagcugccaagagcauggauugugaugaggaaacaggucugaguucugaauggag

SEQ ID NO: 234004 - RNA, 64 nt, Homo Sapiens
ccuguggggagauucugacccaaagccaggauucugaggaaagucucagaaucagaaacgucuc

SEQ ID NO: 234005 - RNA, 64 nt, Homo Sapiens
aauuuucuaaaaacacacacagaaaucgcuugagugaggaaaaguccacauggcagagacaggu

SEQ ID NO: 234006 - RNA, 64 nt, Homo Sapiens
ucuccaacaguucugaagccaacccacaaaucuuugaggaaaaggggucacuuuguuuacuauu

SEQ ID NO: 234007 - RNA, 64 nt, Homo Sapiens
aacaugacccuaaaucuugaauugaauucuugguugaggaaacaccaauccaugaaccaagacc

SEQ ID NO: 234008 - RNA, 64 nt, Homo Sapiens
aagcauucacaacuuguuuuagcccagcacugcuugaggaaaacguaccuucaaacuagggcca

SEQ ID NO: 234009 - RNA, 64 nt, Homo Sapiens
ugcagugaccuggucaccuggggugggggugauuugaggaaaugacaugaggaaaagaaaccua

SEQ ID NO: 234010 - RNA, 64 nt, Homo Sapiens
ucaccuggggugggggugauuugaggaaaugacaugaggaaaagaaaccuauuccugcccuggg

SEQ ID NO: 234011 - RNA, 64 nt, Homo Sapiens
ugccuaauacaauuagaauccaacaucuaacuagugaggaaaaguggaguuuuagaggaaaagu

SEQ ID NO: 234012 - RNA, 64 nt, Homo Sapiens
aagguuguccaugagauuugggaaggagguucagugaggaaaauuugaaggcaaaggaaacuaa

SEQ ID NO: 234013 - RNA, 64 nt, Homo Sapiens
cagucuacucccuucuuccuaaaaaugacacuauugaggaaagucaucauucuagucuuuaagu

SEQ ID NO: 234014 - RNA, 64 nt, Homo Sapiens
aaaaucagguagauggugcuaugggauauugggaugaggaaaggucuagggaguuagcauguag

SEQ ID NO: 234015 - RNA, 64 nt, Homo Sapiens
cagggccuuggucagagagauugcuacucaacuuugaggaaagacuggugaggcauuuguuaau

SEQ ID NO: 234016 - RNA, 64 nt, Homo Sapiens
gauucaggaagagccacucaucccaucuucccaaugaggaaacgacucugaacaggcacagccc

SEQ ID NO: 234017 - RNA, 64 nt, Homo Sapiens
gaagcucagagcacaaaccauguccauuuagcgaugaggaaagugagggugaguucugcugccu

SEQ ID NO: 234018 - RNA, 64 nt, Homo Sapiens
cauauuuuuuuucugcuuagacuuacuuauucuuugaggaaaaaagguaauguaggagcucauu

SEQ ID NO: 234019 - RNA, 64 nt, Homo Sapiens
uuuucauuuugcugcaaaucuauaucugaccugcugaggaaaucguuuggugaaaugaauccag

SEQ ID NO: 234020 - RNA, 64 nt, Homo Sapiens
gauacggcaaccaccacggaccuguggggaccaaugaggaaagagagaggcaggucugggccag

SEQ ID NO: 234021 - RNA, 64 nt, Homo Sapiens
uaaccuggaauucccuguuuccuuguccagggccugaggaaauggcuccccaggucugucucug

SEQ ID NO: 234022 - RNA, 64 nt, Homo Sapiens
caucuguugacaaugucuuguggagcauuuuugcugaggaaaaggucacuuguaaacagaggag

SEQ ID NO: 234023 - RNA, 64 nt, Homo Sapiens
uuuguuucuuuuuaauuaaaauacaagaagcagcugaggaaagggagacaagguauuuuauuuc

SEQ ID NO: 234024 - RNA, 64 nt, Homo Sapiens
cacuugugugauugaauuguuaugauaguugucuugaggaaaagaaguaccucugugucugaag

SEQ ID NO: 234025 - RNA, 64 nt, Homo Sapiens
gaggcucauagagguugaaaccucauuuuuuaguugaggaaacugaaguaaacacuauuauuau

SEQ ID NO: 234026 - RNA, 64 nt, Homo Sapiens
gcauuuuccaaggcuguuuucuucacaggcauugugaggaaagaaaauuuggauggauuuacga

SEQ ID NO: 234027 - RNA, 64 nt, Homo Sapiens
agcagcuggucuggaggagaauucccugggccccugaggaaauacauuuacagccagaaucaac

SEQ ID NO: 234028 - RNA, 64 nt, Homo Sapiens
aaaaaaaaaaaaaaguuuaaucugaaucuaaccaugaggaaauaaucagacaaauccacauuag

SEQ ID NO: 234029 - RNA, 64 nt, Homo Sapiens
acucuguuggguguacucugcuaaguucuggggaugaggaaauuaauaaagguacagucuugcc

SEQ ID NO: 234030 - RNA, 64 nt, Homo Sapiens
auugauuuggggauguuugccccgaaugagagguugaggaaaagacuguggguggggaggcccu

SEQ ID NO: 234031 - RNA, 64 nt, Homo Sapiens
ggaccaauacuaagaauaacaagaagcccaguggugaggaaagugcguucucccagcacugccu

SEQ ID NO: 234032 - RNA, 64 nt, Homo Sapiens
gauuaauagagauagcaagguuuuaaggauaaauugaggaaacuaacuaagcauuugaggaaaa

SEQ ID NO: 234033 - RNA, 64 nt, Homo Sapiens
uuuaaggauaaauugaggaaaauaacuaagcauuugaggaaaauuuuuaaaaagcaaauaauaa

SEQ ID NO: 234034 - RNA, 64 nt, Homo Sapiens
acagcuuuaaaagaaaaagaauaaaguuuucccuugaggaaacaaacauuuuacccacacacag

SEQ ID NO: 234035 - RNA, 64 nt, Homo Sapiens
cggacaucagcuggucaaacacuucuuggcuuggugaggaaaagagaccagagauaguggggag

SEQ ID NO: 234036 - RNA, 64 nt, Homo Sapiens
aaggcuccuaggggagaaauucaccauuuacugaugaggaaacuuaaaggaggguuugugauug

SEQ ID NO: 234037 - RNA, 64 nt, Homo Sapiens
cacgcaccuuccuuaguaauaucaucuccuccaaugaggaaacccuuguuaucaucuccauuug

SEQ ID NO: 234038 - RNA, 64 nt, Homo Sapiens
aaggggaaguuggggauaggagacaaauguucagugaggaaaaaucagugaggaaaaaacauuc

SEQ ID NO: 234039 - RNA, 64 nt, Homo Sapiens
acauucagacaaauguucaggaaaacauguucagugaggaaaaaaaauguucagugugagugag

SEQ ID NO: 234040 - RNA, 64 nt, Homo Sapiens
auguucagugaggaaaaaacauguucagugugagugaggaaaacgcagccacaguuucagacaa

SEQ ID NO: 234041 - RNA, 64 nt, Homo Sapiens
aaucaauaaacaguugaucuacauguguaguauuugaggaaaaauucaguuuaacaguuccuuu

SEQ ID NO: 234042 - RNA, 64 nt, Homo Sapiens
aauuaugccaggaaggugggagguggcagauguuugaggaaaggccguguguaggcuuagccuc

SEQ ID NO: 234043 - RNA, 64 nt, Homo Sapiens
aucucccuauucccuuacccaugcgcaccagucuugaggaaacguuaaauuauggcacagauug

SEQ ID NO: 234044 - RNA, 64 nt, Homo Sapiens
uaggugucacuuuuuagaacgcacagcuuucuguugaggaaacccaaggggauuugggauugaa

SEQ ID NO: 234045 - RNA, 64 nt, Homo Sapiens
cgguggaagauucuggaauguguccacauguucuugaggaaagcgggcacucagugcauuggac

SEQ ID NO: 234046 - RNA, 64 nt, Homo Sapiens
ggggagagguauccugggcccccaaucuggguugugaggaaauaugguaaccgggugccugagc

SEQ ID NO: 234047 - RNA, 64 nt, Homo Sapiens
uguagcuucaaucaugucugguaagcggagggccugaggaaaccgcacugauggggucuaccug

SEQ ID NO: 234048 - RNA, 64 nt, Homo Sapiens
ucgagauugugaagcaacacaagcaagagaaaaacagcucuaauagacaacugcaaacucauuu

SEQ ID NO: 234049 - RNA, 64 nt, Homo Sapiens
gaccagcuguuaagacagacaaaauagauaggggcagcucuaaaaguggucguggggcacagaa

SEQ ID NO: 234050 - RNA, 64 nt, Homo Sapiens
uguuuccucuaacgcuaaaguccauuaacaguuccagcucuaugaaacucagcugugacugcuu

SEQ ID NO: 234051 - RNA, 64 nt, Homo Sapiens
gcugccuggaccugcaggccaccccagcuucuagcagcucuacagagaaagcggggagagcaac

SEQ ID NO: 234052 - RNA, 64 nt, Homo Sapiens
ggauaggaacugucaguguuaccacaugacucaacagcucuaugguuccccaaaacugucuuca

SEQ ID NO: 234053 - RNA, 64 nt, Homo Sapiens
aguccaugacuuuuuaaggacucuacuaacccuucagcucuagcagcagagagugggaagacag

SEQ ID NO: 234054 - RNA, 64 nt, Homo Sapiens
aacccuucagcucuagcaguagagagugggaagacagcucuacuugcauaaaaaggggagaagc

SEQ ID NO: 234055 - RNA, 64 nt, Homo Sapiens
cacugccacacagggucugcaaaggcuagguacacagcucuagauagcuuugcucuuugguaga

SEQ ID NO: 234056 - RNA, 64 nt, Homo Sapiens
ggucuuguggaauugggagcgaccaaaauaaaaccagcucuacuacuguuccuugucacuggua

SEQ ID NO: 234057 - RNA, 64 nt, Homo Sapiens
accacuacccucagagagaguuuuugauaaagcaugcugguaaagacucucccugauaguuuag

SEQ ID NO: 234058 - RNA, 64 nt, Homo Sapiens
guauuuugguggcagcugcccagucagaagggugugcugguaaacuuucuucugagaaaugcug

SEQ ID NO: 234059 - RNA, 64 nt, Homo Sapiens
agacucccugggaccuagaggaguggauucuugcugcugguauggcccccauguugggagaggg

SEQ ID NO: 234060 - RNA, 64 nt, Homo Sapiens
guccuagcaucuuccccucaucacuacaaccuugugcugguaaggccuugucuccacccaugac

SEQ ID NO: 234061 - RNA, 64 nt, Homo Sapiens
auucuccaucuauccaggcugcucucuacgugguggccgguagagagccugcuguguccugggu

SEQ ID NO: 234062 - RNA, 50 nt, Homo Sapiens
agucccaagagccuucgugaggccgguacuuggggccgaaaaacuguggc

SEQ ID NO: 234063 - RNA, 64 nt, Homo Sapiens
cgagaaggccucaauguggcgaggaagaugcuggggccgguagggcugugagaucuucugggga

SEQ ID NO: 234064 - RNA, 64 nt, Homo Sapiens
cucugaggggaggggguccgugguagaggccuggggccgguagaggcuccccagggcucccuua

SEQ ID NO: 234065 - RNA, 64 nt, Homo Sapiens
gaugucggacuaagcgaacagcgcccccacugccggccgguagcagccggaagugccagaccgg

SEQ ID NO: 234066 - RNA, 64 nt, Homo Sapiens
guguccauggguuagggccaugcuggggaaaacgggccgguauuuacacacgcgcaaaacaccc

SEQ ID NO: 234067 - RNA, 64 nt, Homo Sapiens
ugggggaaggugauggggcggcccuccacauucuggccgguaacagcuggcggccaccgcaggg

SEQ ID NO: 234068 - RNA, 64 nt, Homo Sapiens
gcagaaugagugagcaagcagauugccccagaggggccgguaauaaucacgugagggauaauca

SEQ ID NO: 234069 - RNA, 64 nt, Homo Sapiens
cucugagaagcuuggccuggacaccugagccugcggccgguacuccugccuucuccccaucuau

SEQ ID NO: 234070 - RNA, 64 nt, Homo Sapiens
ggaauggcuguguccuaguccacuuucgcuuccuggccgguacuccuuugagcuggccugaggg

SEQ ID NO: 234071 - RNA, 64 nt, Homo Sapiens
gggggugauguauguggagaaggguugggggagaggccgguagggcaggggcugcuaguggcug

SEQ ID NO: 234072 - RNA, 64 nt, Homo Sapiens
cugcccgucacuuuggaucaagugggguggugcaggccgguagugcugucuugugugcagccug

SEQ ID NO: 234073 - RNA, 64 nt, Homo Sapiens
cagguacugccuuacaaagcuguggccaggaaguggccgguauaaaggaugcccaaggucuuug

SEQ ID NO: 234074 - RNA, 64 nt, Homo Sapiens
agggggccuaguuugggaugagaacagcucugacggccgguaugugaaggagaacugcaaaccu

SEQ ID NO: 234075 - RNA, 64 nt, Homo Sapiens
ccugaguggagugcugggggaaggaggagguccaggccgguaguggccauucgccgugccucag

SEQ ID NO: 234076 - RNA, 64 nt, Homo Sapiens
ggggaaccccggggacaugcccccacccgggaggggccgguaaccccugggcuaucuucuagac

SEQ ID NO: 234077 - RNA, 53 nt, Homo Sapiens
ucugcgaguuccccuucuagcggggccgguaccccgccucccugcccauccca

SEQ ID NO: 234078 - RNA, 64 nt, Homo Sapiens
uccccuacagcagcccuuggaaaggggguucagaggccgguacccacccuguuggggagagaag

SEQ ID NO: 234079 - RNA, 64 nt, Homo Sapiens
gggcucacuacaugggccagcccuugcucuaccuggccgguaggcugcuggcgccuagguugug

SEQ ID NO: 234080 - RNA, 61 nt, Homo Sapiens
aauguuuaaucauauuugcuaagaaauguuucugcuguaguuggauuugcccauauuuaug

SEQ ID NO: 234081 - RNA, 61 nt, Homo Sapiens
uuuccucaucuugaaaugaggauaauaauaccugcuguaccuaccucacagggcuguugug

SEQ ID NO: 234082 - RNA, 61 nt, Homo Sapiens
gcacuccuccgagcccgguggagaaugcaggcugcuguagucucagguaaugaaggcacag

SEQ ID NO: 234083 - RNA, 61 nt, Homo Sapiens
gucauagcugcugcugcugccaugcgcagagcugcuguaacagcucuuccuguucugcucc

SEQ ID NO: 234084 - RNA, 61 nt, Homo Sapiens
uuaccagaaaguguucuauacuuguuuuuugcugcuguaaccuugcuuaaaaaggaugccu

SEQ ID NO: 234085 - RNA, 54 nt, Homo Sapiens
gaugaaacucuugcuuaaaaacagcugcuguaguugagaggaauucaggucuga

SEQ ID NO: 234086 - RNA, 61 nt, Homo Sapiens
uuccagugcaagauaauucauuagaaggcaucugcuguaacagggggacaugccacaugua

SEQ ID NO: 234087 - RNA, 61 nt, Homo Sapiens
agggggacaugccacauguaccguuaucacucugcuguagagcuucuagcccugucucagu

SEQ ID NO: 234088 - RNA, 61 nt, Homo Sapiens
cucaucccugcacugagcacuucgccucuuccugcuguaugucuguaaaugaaaugcugac

SEQ ID NO: 234089 - RNA, 61 nt, Homo Sapiens
uguuuuauggucuacauaguauggcagagcacugcuguaucgauaacucauaauuauuuua

SEQ ID NO: 234090 - RNA, 61 nt, Homo Sapiens
ucugcauuaagcucacaugauuuuuguuuuucugcuguaauaaaggaaauuaaugaaaaug

SEQ ID NO: 234091 - RNA, 61 nt, Homo Sapiens
uauccugugcagaacuaggaucccaugucuucugcuguaauggugauugccaugggacuuu

SEQ ID NO: 234092 - RNA, 61 nt, Homo Sapiens
uuuaggcccuguuccagcaauaagaaccaaucugcuguacaaucugaggacuuggcucugu

SEQ ID NO: 234093 - RNA, 61 nt, Homo Sapiens
cacuugcaguuuugcuuuucucugcauuucucugcuguaagaugacuguugcauuguugaa

SEQ ID NO: 234094 - RNA, 61 nt, Homo Sapiens
acaauuuugggaucuaguuccccuggaaaagcugcuguauuuuuaauuuuuaauggaaugu

SEQ ID NO: 234095 - RNA, 61 nt, Homo Sapiens
uaacaucugagagcaguaacacugauuuuaucugcuguaugagacuuugugcauuuuacuu

SEQ ID NO: 234096 - RNA, 61 nt, Homo Sapiens
agugaaagagcaucaggagaugugaaaaacccugcuguaguauugggaccaaugaaucugg

SEQ ID NO: 234097 - RNA, 61 nt, Homo Sapiens
agcaauaguggagaaaaaugugcugcuuuugcugcuguaacgcccccucugccagccuuuc

SEQ ID NO: 234098 - RNA, 61 nt, Homo Sapiens
uuuuuuuuuuuuuuuuuuuuuguccaacacucugcuguaucuuccuuggaguggcuuugca

SEQ ID NO: 234099 - RNA, 61 nt, Homo Sapiens
acgaugccauaucuggcugcggguccauucccugcuguagagagccccaaaucauugcuca

SEQ ID NO: 234100 - RNA, 61 nt, Homo Sapiens
uuguuuuuuuuucccccaugcuuuuguuuggcugcuguaauuuuuaaguauuugaguuuga

SEQ ID NO: 234101 - RNA, 61 nt, Homo Sapiens
agcaguccaacccagaauggcacacacugcucugcuguagcaucaugucagggcuuccugg

SEQ ID NO: 234102 - RNA, 61 nt, Homo Sapiens
ugucuuuuagaguaggaaucgugaaugcuuucugcuguaaguuccuucauaauggucaugg

SEQ ID NO: 234103 - RNA, 61 nt, Homo Sapiens
uguucuggguagauggaguagccuauuuuuucugcuguaaucuugggaagacuuuggaggu

SEQ ID NO: 234104 - RNA, 61 nt, Homo Sapiens
uaauaaacuggaauucuguugaugaauauagcugcuguacuguauauuaauauuuaauaga

SEQ ID NO: 234105 - RNA, 61 nt, Homo Sapiens
uguagguagugucagugaguggcucuugugccugcuguagacauuaggccugcacuagggc

SEQ ID NO: 234106 - RNA, 61 nt, Homo Sapiens
aaaagaccaagcaaaugcacucugcuuuuugcugcuguaagaccaccaaaaaugagucaga

SEQ ID NO: 234107 - RNA, 61 nt, Homo Sapiens
aggccagaacuaguuuaucugaacaccucagcugcuguaagcuucuccucucucaccccgu

SEQ ID NO: 234108 - RNA, 61 nt, Homo Sapiens
ggcagcaccaggugagugugucaccaucccccugcuguacccacaggagugauuggucuau

SEQ ID NO: 234109 - RNA, 61 nt, Homo Sapiens
ggaaggacacgaggacgucaaaguggcggaccugcuguacucauuggcccacagaaggcaa

SEQ ID NO: 234110 - RNA, 61 nt, Homo Sapiens
cagucuccuucaacaguucggccaagcagaacugcuguaccucugaccacuuguguuagga

SEQ ID NO: 234111 - RNA, 61 nt, Homo Sapiens
gcagucugauggacugcggguuuggauaccacugcuguaauguaacccucuuuguuuagau

SEQ ID NO: 234112 - RNA, 61 nt, Homo Sapiens
ugacucaugccucugagcuucuaaacugaagcugcuguaacuaaaggaaucugaaaagaac

SEQ ID NO: 234113 - RNA, 61 nt, Homo Sapiens
ucuuuaaaucaguauuccaucaggcagauaacugcuguauucaugaaucuugagaguguuc

SEQ ID NO: 234114 - RNA, 64 nt, Homo Sapiens
agagagguuuuugcagcauguuugaaagcccuugggacuccaggugacugccccugguggaaca

SEQ ID NO: 234115 - RNA, 64 nt, Homo Sapiens
cacaaaacuccugggauuuuuguuggaaaacccaggacuccacacagaaugcuggaaugauguc

SEQ ID NO: 234116 - RNA, 64 nt, Homo Sapiens
uaaaaauagguaugaauaaggaccuuuagucuguggacuccauuaagcuucagucucggaacau

SEQ ID NO: 234117 - RNA, 64 nt, Homo Sapiens
cuguaacuuccuagaguugccaguuuaugcaguuggacuccaagaccaccaccaccaccaaaac

SEQ ID NO: 234118 - RNA, 64 nt, Homo Sapiens
agccuugacccccucccugaccuccccgccagcuggacuccagccauccuccugccucagcuuc

SEQ ID NO: 234119 - RNA, 64 nt, Homo Sapiens
gucgugcggcaugcccgccgccugcuccccacacggacuccaggcgguccccacccacagaagc

SEQ ID NO: 234120 - RNA, 64 nt, Homo Sapiens
auuucucuccucaaaggaaaccuguuccuccccgggacuccagagacuauggucacagggccgu

SEQ ID NO: 234121 - RNA, 64 nt, Homo Sapiens
uccaaguggguuuucuuggcccccgacggccacaggacuccagcccucugcuucccugggggag

SEQ ID NO: 234122 - RNA, 64 nt, Homo Sapiens
cccccagccccuccuuccugccuuccuggacccaggacuccaggacuccaggcccccagccccu

SEQ ID NO: 234123 - RNA, 64 nt, Homo Sapiens
cccccagccccuccuuccugcucccucagacccaggacuccagguucccgggccccaguaccuc

SEQ ID NO: 234124 - RNA, 64 nt, Homo Sapiens
ugggcucggucccccacaguagagaaggggaggaggacuccagcccagagagaccugcugccgg

SEQ ID NO: 234125 - RNA, 64 nt, Homo Sapiens
acccuggagaagggagaccucgucucagcuaccuggacuccagggcuccccguguccccaguuc

SEQ ID NO: 234126 - RNA, 64 nt, Homo Sapiens; identical to SEQ ID NO: 97987

SEQ ID NO: 234127 - RNA, 64 nt, Homo Sapiens; identical to SEQ ID NO: 97988

SEQ ID NO: 234128 - RNA, 64 nt, Homo Sapiens; identical to SEQ ID NO: 97989

SEQ ID NO: 234129 - RNA, 64 nt, Homo Sapiens; identical to SEQ ID NO: 97990

SEQ ID NO: 234130 - RNA, 64 nt, Homo Sapiens; identical to SEQ ID NO: 97991

SEQ ID NO: 234131 - RNA, 64 nt, Homo Sapiens; identical to SEQ ID NO: 97992

SEQ ID NO: 234132 - RNA, 64 nt, Homo Sapiens; identical to SEQ ID NO: 97993

SEQ ID NO: 234133 - RNA, 64 nt, Homo Sapiens; identical to SEQ ID NO: 97994

SEQ ID NO: 234134 - RNA, 64 nt, Homo Sapiens; identical to SEQ ID NO: 97995

SEQ ID NO: 234135 - RNA, 64 nt, Homo Sapiens; identical to SEQ ID NO: 97996

SEQ ID NO: 234136 - RNA, 64 nt, Homo Sapiens; identical to SEQ ID NO: 97997

SEQ ID NO: 234137 - RNA, 64 nt, Homo Sapiens; identical to SEQ ID NO: 97998

SEQ ID NO: 234138 - RNA, 64 nt, Homo Sapiens; identical to SEQ ID NO: 97999

SEQ ID NO: 234139 - RNA, 64 nt, Homo Sapiens; identical to SEQ ID NO: 98000

SEQ ID NO: 234140 - RNA, 64 nt, Homo Sapiens; identical to SEQ ID NO: 98001

SEQ ID NO: 234141 - RNA, 64 nt, Homo Sapiens; identical to SEQ ID NO: 98002

SEQ ID NO: 234142 - RNA, 64 nt, Homo Sapiens; identical to SEQ ID NO: 98003

SEQ ID NO: 234143 - RNA, 64 nt, Homo Sapiens; identical to SEQ ID NO: 98004

SEQ ID NO: 234144 - RNA, 64 nt, Homo Sapiens; identical to SEQ ID NO: 98005

SEQ ID NO: 234145 - RNA, 64 nt, Homo Sapiens; identical to SEQ ID NO: 98006

SEQ ID NO: 234146 - RNA, 64 nt, Homo Sapiens; identical to SEQ ID NO: 98007

SEQ ID NO: 234147 - RNA, 64 nt, Homo Sapiens; identical to SEQ ID NO: 98008

SEQ ID NO: 234148 - RNA, 53 nt, Homo Sapiens; identical to SEQ ID NO: 98009

SEQ ID NO: 234149 - RNA, 64 nt, Homo Sapiens; identical to SEQ ID NO: 98010

SEQ ID NO: 234150 - RNA, 64 nt, Homo Sapiens
gagaccgaggcacagcccagggcgcacagagaccgaggcgcauaggugcuugaggcgggaccga

SEQ ID NO: 234151 - RNA, 64 nt, Homo Sapiens
gagaccgaggcgcauagagacuugaggcgggaccgaggcgcacaagcggagacgccacccggug

SEQ ID NO: 234152 - RNA, 63 nt, Homo Sapiens
gccggagucagcaggugccaugugugaugaagugacagggaggaccaaaguuuuaagauuugc

SEQ ID NO: 234153 - RNA, 63 nt, Homo Sapiens
aguggcauuuguuuccuagcugcuguucuuuaugacagggauccugccuucuuguagaugacu

SEQ ID NO: 234154 - RNA, 63 nt, Homo Sapiens
cuuucuaagcccuggggcgcccaagucccaugggacagggaaacgugguccucagugaggcug

SEQ ID NO: 234155 - RNA, 63 nt, Homo Sapiens
cacaucccuauuaacagaggcagcuccacuucagacagggacaaggcuuccugcugugccuuu

SEQ ID NO: 234156 - RNA, 63 nt, Homo Sapiens
aggauaccacucugucacugggaagaagucagggacagggacccccaggaggaggagcccuag

SEQ ID NO: 234157 - RNA, 63 nt, Homo Sapiens
auggagcccaaguagccucugcccaggcagggggacagggaaagaccacggccuggaggacug

SEQ ID NO: 234158 - RNA, 63 nt, Homo Sapiens
gcaaguucaugguacauacgaaggagacucuaagacagggaaaaccuguuauguugcuuuugg

SEQ ID NO: 234159 - RNA, 63 nt, Homo Sapiens
ggggagaagaaagacccccaggcagcggggauagacagggaaugaggccugcccagacuagga

SEQ ID NO: 234160 - RNA, 63 nt, Homo Sapiens
uucaggaacuucugaccucacgccaacggggacgacagggaucagcuccacaaugggcucccc

SEQ ID NO: 234161 - RNA, 63 nt, Homo Sapiens
gaaaggacaggucccaaggguagaagccaaagggacagggacgucuaagacaaggaaguccua

SEQ ID NO: 234162 - RNA, 63 nt, Homo Sapiens
ucagagauugcacguuugaacaccuggacaguagacagggacuuuauaaaaauccaugcuuua

SEQ ID NO: 234163 - RNA, 63 nt, Homo Sapiens
cgagugccccucagagucccgcagcggggcagggacagggagcaguauguuaggaggggccag

SEQ ID NO: 234164 - RNA, 63 nt, Homo Sapiens
agugggaucaaagcuaggaagagggaguacaaagacagggaauggcuggaaagaggagaagga

SEQ ID NO: 234165 - RNA, 63 nt, Homo Sapiens
guauaaacaagccuaacauuuauuugcuuuagagacagggacuggagaggaugcacaguuugc

SEQ ID NO: 234166 - RNA, 63 nt, Homo Sapiens
uggagcagugucauugucagacugacauuugaggacagggagacuaccugggugguugagggg

SEQ ID NO: 234167 - RNA, 63 nt, Homo Sapiens
gauaauuacugauaaaugaagcaaggaagaagggacagggaaacuuugccagaugaugggaag

SEQ ID NO: 234168 - RNA, 63 nt, Homo Sapiens
ucuccccagcucugcccucuggguccacaugaggacagggaagcucgggaaggggaagggaga

SEQ ID NO: 234169 - RNA, 63 nt, Homo Sapiens
ccccgcugggcacucucugucccaucccucuaggacagggaagcuggccugguccagggcacu

SEQ ID NO: 234170 - RNA, 63 nt, Homo Sapiens
agccccaaauugucaccugcacagugcaccugggacagggagcauuccaggcccgaagcauga

SEQ ID NO: 234171 - RNA, 63 nt, Homo Sapiens
ugugaggcaggagagacaguccaaccacguugggacagggagguccccccaccucccccacuc

SEQ ID NO: 234172 - RNA, 64 nt, Homo Sapiens; identical to SEQ ID NO: 77430

SEQ ID NO: 234173 - RNA, 64 nt, Homo Sapiens; identical to SEQ ID NO: 77431

SEQ ID NO: 234174 - RNA, 64 nt, Homo Sapiens; identical to SEQ ID NO: 77432

SEQ ID NO: 234175 - RNA, 64 nt, Homo Sapiens; identical to SEQ ID NO: 77433

SEQ ID NO: 234176 - RNA, 64 nt, Homo Sapiens; identical to SEQ ID NO: 77434

SEQ ID NO: 234177 - RNA, 64 nt, Homo Sapiens; identical to SEQ ID NO: 77435

SEQ ID NO: 234178 - RNA, 64 nt, Homo Sapiens; identical to SEQ ID NO: 77436

SEQ ID NO: 234179 - RNA, 64 nt, Homo Sapiens; identical to SEQ ID NO: 77437

SEQ ID NO: 234180 - RNA, 64 nt, Homo Sapiens; identical to SEQ ID NO: 77438

SEQ ID NO: 234181 - RNA, 64 nt, Homo Sapiens; identical to SEQ ID NO: 77439

SEQ ID NO: 234182 - RNA, 64 nt, Homo Sapiens; identical to SEQ ID NO: 77440

SEQ ID NO: 234183 - RNA, 64 nt, Homo Sapiens; identical to SEQ ID NO: 77441

SEQ ID NO: 234184 - RNA, 64 nt, Homo Sapiens; identical to SEQ ID NO: 77442

SEQ ID NO: 234185 - RNA, 64 nt, Homo Sapiens; identical to SEQ ID NO: 77443

SEQ ID NO: 234186 - RNA, 64 nt, Homo Sapiens; identical to SEQ ID NO: 77444

SEQ ID NO: 234187 - RNA, 64 nt, Homo Sapiens; identical to SEQ ID NO: 77445

SEQ ID NO: 234188 - RNA, 64 nt, Homo Sapiens; identical to SEQ ID NO: 77446

SEQ ID NO: 234189 - RNA, 64 nt, Homo Sapiens; identical to SEQ ID NO: 77447

SEQ ID NO: 234190 - RNA, 64 nt, Homo Sapiens; identical to SEQ ID NO: 77448

SEQ ID NO: 234191 - RNA, 64 nt, Homo Sapiens; identical to SEQ ID NO: 77449

SEQ ID NO: 234192 - RNA, 64 nt, Homo Sapiens; identical to SEQ ID NO: 77450

SEQ ID NO: 234193 - RNA, 64 nt, Homo Sapiens; identical to SEQ ID NO: 77451

SEQ ID NO: 234194 - RNA, 64 nt, Homo Sapiens; identical to SEQ ID NO: 77452

SEQ ID NO: 234195 - RNA, 64 nt, Homo Sapiens; identical to SEQ ID NO: 77453

SEQ ID NO: 234196 - RNA, 64 nt, Homo Sapiens; identical to SEQ ID NO: 77454

SEQ ID NO: 234197 - RNA, 64 nt, Homo Sapiens; identical to SEQ ID NO: 77455

SEQ ID NO: 234198 - RNA, 64 nt, Homo Sapiens; identical to SEQ ID NO: 77456

SEQ ID NO: 234199 - RNA, 64 nt, Homo Sapiens; identical to SEQ ID NO: 77457

SEQ ID NO: 234200 - RNA, 64 nt, Homo Sapiens; identical to SEQ ID NO: 77458

SEQ ID NO: 234201 - RNA, 64 nt, Homo Sapiens; identical to SEQ ID NO: 77459

SEQ ID NO: 234202 - RNA, 64 nt, Homo Sapiens; identical to SEQ ID NO: 77460

SEQ ID NO: 234203 - RNA, 64 nt, Homo Sapiens; identical to SEQ ID NO: 77461

SEQ ID NO: 234204 - RNA, 64 nt, Homo Sapiens; identical to SEQ ID NO: 77462

SEQ ID NO: 234205 - RNA, 64 nt, Homo Sapiens; identical to SEQ ID NO: 77463

SEQ ID NO: 234206 - RNA, 64 nt, Homo Sapiens; identical to SEQ ID NO: 77464

SEQ ID NO: 234207 - RNA, 64 nt, Homo Sapiens; identical to SEQ ID NO: 77465

SEQ ID NO: 234208 - RNA, 64 nt, Homo Sapiens; identical to SEQ ID NO: 77466

SEQ ID NO: 234209 - RNA, 64 nt, Homo Sapiens; identical to SEQ ID NO: 77467

SEQ ID NO: 234210 - RNA, 64 nt, Homo Sapiens; identical to SEQ ID NO: 77468

SEQ ID NO: 234211 - RNA, 64 nt, Homo Sapiens; identical to SEQ ID NO: 77469

SEQ ID NO: 234212 - RNA, 64 nt, Homo Sapiens; identical to SEQ ID NO: 77470

SEQ ID NO: 234213 - RNA, 64 nt, Homo Sapiens; identical to SEQ ID NO: 77471

SEQ ID NO: 234214 - RNA, 64 nt, Homo Sapiens; identical to SEQ ID NO: 77472

SEQ ID NO: 234215 - RNA, 64 nt, Homo Sapiens; identical to SEQ ID NO: 77473

SEQ ID NO: 234216 - RNA, 64 nt, Homo Sapiens; identical to SEQ ID NO: 77474

SEQ ID NO: 234217 - RNA, 64 nt, Homo Sapiens; identical to SEQ ID NO: 77475

SEQ ID NO: 234218 - RNA, 64 nt, Homo Sapiens; identical to SEQ ID NO: 77476

SEQ ID NO: 234219 - RNA, 64 nt, Homo Sapiens; identical to SEQ ID NO: 77477

SEQ ID NO: 234220 - RNA, 64 nt, Homo Sapiens; identical to SEQ ID NO: 77478

SEQ ID NO: 234221 - RNA, 64 nt, Homo Sapiens; identical to SEQ ID NO: 77479

SEQ ID NO: 234222 - RNA, 64 nt, Homo Sapiens; identical to SEQ ID NO: 77480

SEQ ID NO: 234223 - RNA, 64 nt, Homo Sapiens; identical to SEQ ID NO: 77481

SEQ ID NO: 234224 - RNA, 64 nt, Homo Sapiens; identical to SEQ ID NO: 77482

SEQ ID NO: 234225 - RNA, 64 nt, Homo Sapiens; identical to SEQ ID NO: 77483

SEQ ID NO: 234226 - RNA, 64 nt, Homo Sapiens; identical to SEQ ID NO: 77484

SEQ ID NO: 234227 - RNA, 64 nt, Homo Sapiens; identical to SEQ ID NO: 77485

SEQ ID NO: 234228 - RNA, 64 nt, Homo Sapiens; identical to SEQ ID NO: 77486

SEQ ID NO: 234229 - RNA, 62 nt, Homo Sapiens
gagcaguggagagggaaagcaacuucuugcuggaagaauaucucugccuucuuaccuuaaau

SEQ ID NO: 234230 - RNA, 62 nt, Homo Sapiens
ccaaaagauauuuugcucuauuuuaaaguguagaagaauacacugcuaauaaauaauaaaag

SEQ ID NO: 234231 - RNA, 62 nt, Homo Sapiens
caauggcaauaucaacaaugaggaaaauuacugaagaauaaguuuccauaagucuccuacau

SEQ ID NO: 234232 - RNA, 62 nt, Homo Sapiens
uucagguuuagaucauaugacacucgagcacagaagaauaauuucaaggaggucaucuugua

SEQ ID NO: 234233 - RNA, 62 nt, Homo Sapiens
aauuaaaaugggguuugcaggcuuuuuauggugaagaauaauauaucucugucuauagcuuu

SEQ ID NO: 234234 - RNA, 62 nt, Homo Sapiens
ggccauuucauugagggaaaacauaauaucuugaagaauauuguuaaaaccuuacuuaaagc

SEQ ID NO: 234235 - RNA, 62 nt, Homo Sapiens
gaaauucacacugugcguuuuagaguaugcaagaagaauauaaauaaauaaaaauauucucc

SEQ ID NO: 234236 - RNA, 62 nt, Homo Sapiens
uuuccgcaggucugcuccccaccccugccucggaagaauaaagagaauguaguucccuacuc

SEQ ID NO: 234237 - RNA, 62 nt, Homo Sapiens
agaaaaaaugaauguauuccuguuuuugaagagaagaauaauuuuuuuuuucucuagggaga

SEQ ID NO: 234238 - RNA, 62 nt, Homo Sapiens
auugcuguauacaccucaugcuuaugcaaugggaagaauaugggggccagggggugugguac

SEQ ID NO: 234239 - RNA, 62 nt, Homo Sapiens
aaagcaguaucuucacucaaaagucuugcuuggaagaauaagcagaaauaauuuuauauauu

SEQ ID NO: 234240 - RNA, 62 nt, Homo Sapiens
gaauagaagagagaaaucacucccucucuguggaagaauacuuugaagguaaugacuauggg

SEQ ID NO: 234241 - RNA, 62 nt, Homo Sapiens
aauaguuccacaacauccuguggcuacuuauggaagaauagggguuucagccgugguccuag

SEQ ID NO: 234242 - RNA, 62 nt, Homo Sapiens
uuaaggucauuacucucaaccaccuaggcaaugaagaauauaccauuucaaauauuuacagu

SEQ ID NO: 234243 - RNA, 62 nt, Homo Sapiens
agcccuccaagaaaaaaaauagaaaagcacuugaagaauauucccaauauucccggucagca

SEQ ID NO: 234244 - RNA, 62 nt, Homo Sapiens
agggauaugaugacaagguugaauaaaagggugaagaauaaagggacugucauaccagugaa

SEQ ID NO: 234245 - RNA, 62 nt, Homo Sapiens
agggugaagaauaaaagggaugucauaccagugaagaauaaaggcuaagaugguauagggac

SEQ ID NO: 234246 - RNA, 62 nt, Homo Sapiens
gaaaaauuaaggggggauccauugaaagacuugaagaauacauauacuuauauucggggaua

SEQ ID NO: 234247 - RNA, 62 nt, Homo Sapiens
gauucaaugaaugaucucuagaaagauuuaaagaagaauauucagauaaggauguugaagau

SEQ ID NO: 234248 - RNA, 62 nt, Homo Sapiens
uacuugguauuuagaacuccuagcaccacggggaagaauagagguaucaucaaacguggcaa

SEQ ID NO: 234249 - RNA, 62 nt, Homo Sapiens
guauauacauuucccuauuacucucaucagcugaagaauauguacuauuguguuacucaaau

SEQ ID NO: 234250 - RNA, 62 nt, Homo Sapiens
ugaacacugaucaaguaguuguggagagaugagaagaauauaugcagcaaaggugcugugag

SEQ ID NO: 234251 - RNA, 62 nt, Homo Sapiens
ugaugcuuuuucuugaugcuaagaucacugcagaagaauaaccugaccuuuucuuugcauuu

SEQ ID NO: 234252 - RNA, 62 nt, Homo Sapiens
acugcauuagauguaauucuauggaaaggugggaagaauauuuggugcuucuuacauuuaau

SEQ ID NO: 234253 - RNA, 62 nt, Homo Sapiens
aaauguaguugagaaauaauaucuaaaacugcgaagaauacuuucgcuuaaaggaaaaaaaa

SEQ ID NO: 234254 - RNA, 62 nt, Homo Sapiens
cuauugucuuucauuuugccucaucacagugggaagaauagcaccaggaagugcuuauucuc

SEQ ID NO: 234255 - RNA, 62 nt, Homo Sapiens
ugcaaacaaacaagcuuacugugagcuauagugaagaauagguugauuuccucccaaaguag

SEQ ID NO: 234256 - RNA, 61 nt, Homo Sapiens
uguuggacucugaauguuauacaguuguuaaagaagaauaauaugcugugaaguaggcaau

SEQ ID NO: 234257 - RNA, 62 nt, Homo Sapiens
auucaagaaugugauguuuuaagacuagauuggaagaauaaaaguucaaucugucucuggga

SEQ ID NO: 234258 - RNA, 64 nt, Homo Sapiens; identical to SEQ ID NO: 53984

SEQ ID NO: 234259 - RNA, 64 nt, Homo Sapiens; identical to SEQ ID NO: 53985

SEQ ID NO: 234260 - RNA, 64 nt, Homo Sapiens; identical to SEQ ID NO: 53986

SEQ ID NO: 234261 - RNA, 64 nt, Homo Sapiens; identical to SEQ ID NO: 54015

SEQ ID NO: 234262 - RNA, 64 nt, Homo Sapiens; identical to SEQ ID NO: 54016

SEQ ID NO: 234263 - RNA, 64 nt, Homo Sapiens; identical to SEQ ID NO: 54128

SEQ ID NO: 234264 - RNA, 64 nt, Homo Sapiens; identical to SEQ ID NO: 54129

SEQ ID NO: 234265 - RNA, 64 nt, Homo Sapiens; identical to SEQ ID NO: 54130

SEQ ID NO: 234266 - RNA, 64 nt, Homo Sapiens; identical to SEQ ID NO: 54166

SEQ ID NO: 234267 - RNA, 64 nt, Homo Sapiens; identical to SEQ ID NO: 54167

SEQ ID NO: 234268 - RNA, 64 nt, Homo Sapiens; identical to SEQ ID NO: 54231

SEQ ID NO: 234269 - RNA, 64 nt, Homo Sapiens; identical to SEQ ID NO: 54232

SEQ ID NO: 234270 - RNA, 64 nt, Homo Sapiens
agggaggaacuuguccauuaguuuggaauuguguucuucguaaagacugaggcaagcaagugcu

SEQ ID NO: 234271 - RNA, 64 nt, Homo Sapiens
uggugguucugugccuuccccuacucucuucucaucuucguauaugacgaagucagaaaacuca

SEQ ID NO: 234272 - RNA, 64 nt, Homo Sapiens
cuucccugcuggaaggcauucucagagcuuuaugucuucguaccucucagagauuggacuuuuu

SEQ ID NO: 234273 - RNA, 64 nt, Homo Sapiens
ugaauaauaauacugucuuauaaugaaugaaccaucuucguacauuuaauaaauauucauugaa

SEQ ID NO: 234274 - RNA, 64 nt, Homo Sapiens
ucaagaucagcuucacucagucaagaucuaucucucuucguagaggucagcaucuccucgacga

SEQ ID NO: 234275 - RNA, 64 nt, Homo Sapiens
ugaugcucacagaggaagaaacuaaaauuucucaucuucguacuuaacacuucacuaauuuaua

SEQ ID NO: 234276 - RNA, 58 nt, Homo Sapiens
ugguuuggacuucgauaggugcauccuaucuucguagucuucccguucuucuggauga

SEQ ID NO: 234277 - RNA, 64 nt, Homo Sapiens
cauuccaucuaccuaaucaauuugggcuuccucuucuucguacaauuucugauuucugcuucac

SEQ ID NO: 234278 - RNA, 64 nt, Homo Sapiens
cacauaggaaaugauaaggaagaccaggaggagcucuucguaguccagaaagguagaaguggga

SEQ ID NO: 234279 - RNA, 64 nt, Homo Sapiens
uuuaaaaaaauuuguuuuagccuucaauaucuguucuucguauugucuuugcaggcaccucuuc

SEQ ID NO: 234280 - RNA, 64 nt, Homo Sapiens
gaccuugauuuuggggacaccugugcccaccucaucuucguaggcccucaugcucgcagccacu

SEQ ID NO: 234281 - RNA, 64 nt, Homo Sapiens
agccaaaugguuccagauacuucagcuuuguguaucuucguaacuucauauuaauauaaguuuc

SEQ ID NO: 234282 - RNA, 64 nt, Homo Sapiens
aaaagcaaaguuuuugaaccuacaguccagauguucuucguaaucugguuucguuagagguguc

SEQ ID NO: 234283 - RNA, 64 nt, Homo Sapiens
aguuagaucugacuucagacaucugaaacuauugucuucguaaacugaaauuuauuugauucug

SEQ ID NO: 234284 - RNA, 64 nt, Homo Sapiens
cacucuccauuucuaauguucuuguguugccccuucuucguacuguuugugaacuuugguuacc

SEQ ID NO: 234285 - RNA, 64 nt, Homo Sapiens
ugccagacuuuaagauugcccggaggaagcaaacucuucguauaaaaaaagcaggccaucugcu

SEQ ID NO: 234286 - RNA, 64 nt, Homo Sapiens
cgucuagcaguaugugccgagaagaggcuuacucucuucguaggugacugugaauuuuguacua

SEQ ID NO: 234287 - RNA, 64 nt, Homo Sapiens
guucuucgggaagagaggaguagucguggagaugucuucguacagaugaauaaaccaguaugac

SEQ ID NO: 234288 - RNA, 64 nt, Homo Sapiens
agaaauguucaguuuaauuauucaaaaugcgcuuucuucguagauugugaccauaggaccauuu

SEQ ID NO: 234289 - RNA, 64 nt, Homo Sapiens
uuccauuaagagacucauugcuugggaaaugcuuucuucguacuaaaauuugauuccuuuuuuu

SEQ ID NO: 234290 - RNA, 64 nt, Homo Sapiens
aaaccaacauguggcugagccuuuuuuuuuuuaaucuucguaacauguuuaaaaaaaaacagug

SEQ ID NO: 234291 - RNA, 64 nt, Homo Sapiens
cccauuagaccaagcuugucgggagccagggcugucuucguauuacugaagggguucucacagu

SEQ ID NO: 234292 - RNA, 64 nt, Homo Sapiens
uuuauggaguagguaccauucagguuuuauguguucuucguaacgcacuauuauaagugcuuca

SEQ ID NO: 234293 - RNA, 64 nt, Homo Sapiens
uccaaguccugaaguagaugguugagauaugaguucuucguacuggaaaagcccuuccguaguu

SEQ ID NO: 234294 - RNA, 64 nt, Homo Sapiens
aaaguucaaccucaaguuaaaugguuugacuuauucuucguaucauuagaagaaccccagagau

SEQ ID NO: 234295 - RNA, 64 nt, Homo Sapiens
ugguguguucacgugagccuacauccgagggugcucuucguaagggguaguuguuguuuuauag

SEQ ID NO: 234296 - RNA, 64 nt, Homo Sapiens
uagucuguuccuuuucucucauagucuguuccuuucuucguacagccuguugcuuucuuccugc

SEQ ID NO: 234297 - RNA, 64 nt, Homo Sapiens
ggcagacgcuggcccucuccacagcucuugcaacucuucguaacguaucugggcagaaguaggc

SEQ ID NO: 234298 - RNA, 64 nt, Homo Sapiens
gucagaauaggccccuacagguauauuuuaaaacucuucguaauucuaauguguacugcuggua

SEQ ID NO: 234299 - RNA, 64 nt, Homo Sapiens
uugucuuuaucauccuuuccccuuucccuucaacucuucguacauucaaugcauggaucaauca

SEQ ID NO: 234300 - RNA, 64 nt, Homo Sapiens
cuuuuccauuucgucaugaccuagaugaccugucucuucguacucgguuauuaaauggccuagc

SEQ ID NO: 234301 - RNA, 64 nt, Homo Sapiens
gacuugggacaaucuggcuuugauauuuuuuccuucuucguaggugcaucuuauuaauuuucua

SEQ ID NO: 234302 - RNA, 64 nt, Homo Sapiens
uacacacaaaaaggagcgggagcuguuccuguguucuucguauaggaaugacugaaagaagaac

SEQ ID NO: 234303 - RNA, 64 nt, Homo Sapiens
aaacuagaaaguaugauaaaagaaugcuagguaaucuucguagaaaaaaaaaaaaaaaaaaaaa

SEQ ID NO: 234304 - RNA, 64 nt, Homo Sapiens
ugcaaccuugggcaaguuccucaaccucucugugucuucguacccucaucuguaacaugcgugu

SEQ ID NO: 234305 - RNA, 64 nt, Homo Sapiens
aguauaauagcacuggaggagacugugguagccaucuucguaaauuuaaacuuugagcacccac

SEQ ID NO: 234306 - RNA, 64 nt, Homo Sapiens
aagaauuaaaggaauggggaaccauugucgagauucuucguaggcaucuucaaugacaucugca

SEQ ID NO: 234307 - RNA, 64 nt, Homo Sapiens
gaugcacaugagcuggcgggauugaaggaugcugucuucguacugggaaagggauuuucagccc

SEQ ID NO: 234308 - RNA, 64 nt, Homo Sapiens
auuuugauaaucuguucucuuauuauuuuuuucuucuucguaaaucuguagauuuccuuaaaac

SEQ ID NO: 234309 - RNA, 64 nt, Homo Sapiens
ccugagguagaagagauuuuucaguugcuauuucucuucguaaugaauuuucuuuacauccugu

SEQ ID NO: 234310 - RNA, 64 nt, Homo Sapiens; identical to SEQ ID NO: 229168

SEQ ID NO: 234311 - RNA, 64 nt, Homo Sapiens; identical to SEQ ID NO: 229169

SEQ ID NO: 234312 - RNA, 64 nt, Homo Sapiens; identical to SEQ ID NO: 229170

SEQ ID NO: 234313 - RNA, 64 nt, Homo Sapiens; identical to SEQ ID NO: 229171

SEQ ID NO: 234314 - RNA, 64 nt, Homo Sapiens; identical to SEQ ID NO: 229172

SEQ ID NO: 234315 - RNA, 64 nt, Homo Sapiens; identical to SEQ ID NO: 229173

SEQ ID NO: 234316 - RNA, 64 nt, Homo Sapiens; identical to SEQ ID NO: 229174

SEQ ID NO: 234317 - RNA, 64 nt, Homo Sapiens; identical to SEQ ID NO: 229175

SEQ ID NO: 234318 - RNA, 64 nt, Homo Sapiens; identical to SEQ ID NO: 229176

SEQ ID NO: 234319 - RNA, 64 nt, Homo Sapiens; identical to SEQ ID NO: 229177

SEQ ID NO: 234320 - RNA, 64 nt, Homo Sapiens; identical to SEQ ID NO: 229178

SEQ ID NO: 234321 - RNA, 64 nt, Homo Sapiens; identical to SEQ ID NO: 229179

SEQ ID NO: 234322 - RNA, 64 nt, Homo Sapiens; identical to SEQ ID NO: 229180

SEQ ID NO: 234323 - RNA, 64 nt, Homo Sapiens; identical to SEQ ID NO: 229181

SEQ ID NO: 234324 - RNA, 64 nt, Homo Sapiens; identical to SEQ ID NO: 229182

SEQ ID NO: 234325 - RNA, 64 nt, Homo Sapiens; identical to SEQ ID NO: 229183

SEQ ID NO: 234326 - RNA, 64 nt, Homo Sapiens; identical to SEQ ID NO: 229184

SEQ ID NO: 234327 - RNA, 64 nt, Homo Sapiens; identical to SEQ ID NO: 229185

SEQ ID NO: 234328 - RNA, 54 nt, Homo Sapiens; identical to SEQ ID NO: 229186

SEQ ID NO: 234329 - RNA, 64 nt, Homo Sapiens; identical to SEQ ID NO: 229187

SEQ ID NO: 234330 - RNA, 64 nt, Homo Sapiens; identical to SEQ ID NO: 229188

SEQ ID NO: 234331 - RNA, 64 nt, Homo Sapiens; identical to SEQ ID NO: 229189

SEQ ID NO: 234332 - RNA, 63 nt, Homo Sapiens
gaaaaugaaaagccacaaauuuaaauaaaauuagagcuguaagcauuuguguauucaggcuuu

SEQ ID NO: 234333 - RNA, 63 nt, Homo Sapiens
caugguuuaaaaaauaguacuaaucuugcuguugagcuguauaauguguguauuauaacuuau

SEQ ID NO: 234334 - RNA, 63 nt, Homo Sapiens
ggguaaauugguugaauuauuguauugaagcuugagcuguagcuaaaaguaauuuagguuucc

SEQ ID NO: 234335 - RNA, 63 nt, Homo Sapiens
aaguuguauaauaugcuuguaaaggcugagggugagcuguaucuggaugccuuuuuacaauuu

SEQ ID NO: 234336 - RNA, 64 nt, Homo Sapiens
cuucauuuaccagugcaggaagucucauaaaacucagauguacucccacaaaaauuuuauuggc

SEQ ID NO: 234337 - RNA, 64 nt, Homo Sapiens
ugcccucuguaaauguguugagugauauagcuaucagauguauugaaggcaaaguucucgcaga

SEQ ID NO: 234338 - RNA, 64 nt, Homo Sapiens
gaaauuguacuuagauuuaagaaaaagagaaaaucagauguauuuauuugacuucauuccguau

SEQ ID NO: 234339 - RNA, 64 nt, Homo Sapiens
gaaaugccuaaaagacuuuauuguucuaauuauccagauguaccuuuguaaaauagcucuuuua

SEQ ID NO: 234340 - RNA, 64 nt, Homo Sapiens
uugauaggauacauacugaaaucagcaaacaaaacagauguauagauuagaguguggagaaaac

SEQ ID NO: 234341 - RNA, 64 nt, Homo Sapiens
agaguucaaacagauacagcaugguccagagucccagauguacaaaaacagggauucaucacaa

SEQ ID NO: 234342 - RNA, 64 nt, Homo Sapiens
guguacaccaugcccauguauauacaaguacacacagauguacacacagauguacacaugcucc

SEQ ID NO: 234343 - RNA, 64 nt, Homo Sapiens
cccauguauauacaaguacacacagauguacacacagauguacacaugcuccagccccagcucu

SEQ ID NO: 234344 - RNA, 64 nt, Homo Sapiens
uucaaccucuguuauucuggaguuggcacuuauucagauguaucuuugaaacagcugcagcaag

SEQ ID NO: 234345 - RNA, 64 nt, Homo Sapiens
acagaaugggaaagccagcacauaagagaugguucagauguauauuuacaugacaauuuguaau

SEQ ID NO: 234346 - RNA, 64 nt, Homo Sapiens
uuaugccaaauaucaagaugugaaggacuaauucaggaugcaaaaacguuauugggggguugua

SEQ ID NO: 234347 - RNA, 64 nt, Homo Sapiens
ugggggguuguaaauaucaacuauucaacaguuuaggaugcaauuacgaguguaaacugugugc

SEQ ID NO: 234348 - RNA, 64 nt, Homo Sapiens
ucuagucagggccuugggcaagacauugggcucuaggaugcaauuggcaaauacguccccguua

SEQ ID NO: 234349 - RNA, 64 nt, Homo Sapiens
cuguaggaaagcaaauguagguaaggggagagcaaggaugcacagaaaacacacugacuguggg

SEQ ID NO: 234350 - RNA, 64 nt, Homo Sapiens
ugcacagaaaacacacugacugugggacugugccaggaugcauuuggaaagauagagcauucug

SEQ ID NO: 234351 - RNA, 64 nt, Homo Sapiens
cccugggggaugacacucaguucugucacugucaaggaugcagagagcuggugguaggugggaa

SEQ ID NO: 234352 - RNA, 64 nt, Homo Sapiens
accagugggauugaaaaccagcagaagccaagacaggaugcacagcugaauuggaggagaguag

SEQ ID NO: 234353 - RNA, 64 nt, Homo Sapiens
agaccuguuccacaucaugcuucauuuuagugaaaggaugcaucgccucaaucccauuuugaua

SEQ ID NO: 234354 - RNA, 64 nt, Homo Sapiens
aagaugaugcugagcgugaaacugcuaggaagcaaggaugcaacaaugaggaguuguugaaccc

SEQ ID NO: 234355 - RNA, 64 nt, Homo Sapiens
gauagccaaguaaguuuuaaaaaccaaagcauccaggaugcacaccccugcaccauuugcugug

SEQ ID NO: 234356 - RNA, 64 nt, Homo Sapiens
ggaugaauguuugacggggaagaggaaggguaggaggaugcauggaugaguggaugaguggauc

SEQ ID NO: 234357 - RNA, 64 nt, Homo Sapiens
gaagugggaggaucaccugagcccagggaggucaaggaugcagugagccauggucucaccacug

SEQ ID NO: 234358 - RNA, 64 nt, Homo Sapiens; identical to SEQ ID NO: 234336

SEQ ID NO: 234359 - RNA, 64 nt, Homo Sapiens; identical to SEQ ID NO: 234337

SEQ ID NO: 234360 - RNA, 64 nt, Homo Sapiens; identical to SEQ ID NO: 234338

SEQ ID NO: 234361 - RNA, 64 nt, Homo Sapiens; identical to SEQ ID NO: 234339

SEQ ID NO: 234362 - RNA, 64 nt, Homo Sapiens; identical to SEQ ID NO: 234340

SEQ ID NO: 234363 - RNA, 64 nt, Homo Sapiens; identical to SEQ ID NO: 234341

SEQ ID NO: 234364 - RNA, 64 nt, Homo Sapiens; identical to SEQ ID NO: 234342

SEQ ID NO: 234365 - RNA, 64 nt, Homo Sapiens; identical to SEQ ID NO: 234343

SEQ ID NO: 234366 - RNA, 64 nt, Homo Sapiens; identical to SEQ ID NO: 234344

SEQ ID NO: 234367 - RNA, 64 nt, Homo Sapiens; identical to SEQ ID NO: 234345

SEQ ID NO: 234368 - RNA, 64 nt, Homo Sapiens; identical to SEQ ID NO: 234346

SEQ ID NO: 234369 - RNA, 64 nt, Homo Sapiens; identical to SEQ ID NO: 234347

SEQ ID NO: 234370 - RNA, 64 nt, Homo Sapiens; identical to SEQ ID NO: 234348

SEQ ID NO: 234371 - RNA, 64 nt, Homo Sapiens; identical to SEQ ID NO: 234349

SEQ ID NO: 234372 - RNA, 64 nt, Homo Sapiens; identical to SEQ ID NO: 234350

SEQ ID NO: 234373 - RNA, 64 nt, Homo Sapiens; identical to SEQ ID NO: 234351

SEQ ID NO: 234374 - RNA, 64 nt, Homo Sapiens; identical to SEQ ID NO: 234352

SEQ ID NO: 234375 - RNA, 64 nt, Homo Sapiens; identical to SEQ ID NO: 234353

SEQ ID NO: 234376 - RNA, 64 nt, Homo Sapiens; identical to SEQ ID NO: 234354

SEQ ID NO: 234377 - RNA, 64 nt, Homo Sapiens; identical to SEQ ID NO: 234355

SEQ ID NO: 234378 - RNA, 64 nt, Homo Sapiens; identical to SEQ ID NO: 234356

SEQ ID NO: 234379 - RNA, 64 nt, Homo Sapiens; identical to SEQ ID NO: 234357

SEQ ID NO: 234380 - RNA, 64 nt, Homo Sapiens
gaaaucuuacagaaaacaggggugggaaucucuuccgauagagucgcuauuucugguuaauaua

SEQ ID NO: 234381 - RNA, 64 nt, Homo Sapiens
uccccugccugaacgaagacuuccgccgcgaagcccgauagaucgggggaaaauggggccuucg

SEQ ID NO: 234382 - RNA, 64 nt, Homo Sapiens
accuuuucuuuuuguaaaaguuuaugguauuauaccgauagaccaaaacagcauguguaagagg

SEQ ID NO: 234383 - RNA, 64 nt, Homo Sapiens
aguaaccaucagcaaauacuggucacuguguaaaccgauagaaagcauauuagcaaaguauaga

SEQ ID NO: 234384 - RNA, 64 nt, Homo Sapiens
aaugaguaagcagugccaccaacuaguguuuugcccgauagaagagccagcauguucacguuau

SEQ ID NO: 234385 - RNA, 64 nt, Homo Sapiens
gugucaggaaaaaaugugggguaugccaaguaugccgauagaauaagugcuaaugaugccauug

SEQ ID NO: 234386 - RNA, 64 nt, Homo Sapiens
aguggcucagaucuuacuugccacagacacccuaccgauagaacacuucuuugaccaaggaaua

SEQ ID NO: 234387 - RNA, 64 nt, Homo Sapiens
uuuaacuuauugacaaccgagaagguuuaucccgccgauagagggacggccaagaauguacguc

SEQ ID NO: 234388 - RNA, 64 nt, Homo Sapiens
acccagccccaccccuguaagaggaagccaggcaccgauagagcccccuacugcaccccuggga

SEQ ID NO: 234389 - RNA, 64 nt, Homo Sapiens
acugauggcaaaagauugugaacaguuguagaauccgauagauguuguuagccugacacuccca

SEQ ID NO: 234390 - RNA, 64 nt, Homo Sapiens
caccuugagccagagucaagggcugcagcacugcccgauagaacacgcccgcccucacugcugu

SEQ ID NO: 234391 - RNA, 64 nt, Homo Sapiens
uuucuuaccucauuuuuuuaucaguuucacuuuuccgauagaaaaccuugguuugguuuaugug

SEQ ID NO: 234392 - RNA, 64 nt, Homo Sapiens
gauaugguauguuguaaagcuuagaaaccuuuaaccgauagaagaaggagagaagguuuuuagg

SEQ ID NO: 234393 - RNA, 64 nt, Homo Sapiens
cgucagcugggccucuaucugaaauaaagucguuccgauagacacugguggggcccaguguacu

SEQ ID NO: 234394 - RNA, 64 nt, Homo Sapiens
gacuugcuaaaauauaaauccuuggggaucauagccgauagagauaguuucucuaaaaagaaaa

SEQ ID NO: 234395 - RNA, 64 nt, Homo Sapiens
cagcugaagaguucuacauauucuuugagcugggccgauagaucgcauccugguuauuaugacg

SEQ ID NO: 234396 - RNA, 64 nt, Homo Sapiens
acuuucaggcagaucccacccucauacaagcucuccgauagagauaaucauuuuauuuugaagu

SEQ ID NO: 234397 - RNA, 64 nt, Homo Sapiens
cuuucuugaauuauaauacugaauguuuucuguuccgauagagaaaagugaagcaaauauguga

SEQ ID NO: 234398 - RNA, 64 nt, Homo Sapiens
ugaagcaguccacggggaggggacuggccuguccccgauagaauuggcuccuugcagccuccag

SEQ ID NO: 234399 - RNA, 64 nt, Homo Sapiens; identical to SEQ ID NO: 97553

SEQ ID NO: 234400 - RNA, 64 nt, Homo Sapiens; identical to SEQ ID NO: 97554

SEQ ID NO: 234401 - RNA, 64 nt, Homo Sapiens; identical to SEQ ID NO: 97555

SEQ ID NO: 234402 - RNA, 64 nt, Homo Sapiens; identical to SEQ ID NO: 97556

SEQ ID NO: 234403 - RNA, 64 nt, Homo Sapiens
ggcacuggcccacuugcggaaccugacucaggcugcuggcaagcguagcuauguguuggcccug

SEQ ID NO: 234404 - RNA, 64 nt, Homo Sapiens
ccucccucuacagccucauuccuuaguucccggagcuggcaagggcuggagccccgccuggguc

SEQ ID NO: 234405 - RNA, 64 nt, Homo Sapiens
gggauuacuagaaaaccugacuaauggugucacugcuggcaauggugauaauggauuaauuccu

SEQ ID NO: 234406 - RNA, 64 nt, Homo Sapiens
cggauucccagaaaaccugacuaauggugccacugcuggcaauggugaugauggauuaauuccu

SEQ ID NO: 234407 - RNA, 64 nt, Homo Sapiens
uguggggcugggucagaaaguggcaaacagacuggcuggcaagucugggcagucuguuuacagc

SEQ ID NO: 234408 - RNA, 64 nt, Homo Sapiens
agacuggcuggcaaguuguggcagucuguuuacagcuggcaaacgucccagagaggcagccugg

SEQ ID NO: 234409 - RNA, 64 nt, Homo Sapiens
uucuagggaaacuuggccagaggaaguuaauuuggcuggcaaaaguaaucaaauaguuaacauc

SEQ ID NO: 234410 - RNA, 64 nt, Homo Sapiens
gaaggucaugagaugaguucuaacguguggcacugcuggcaaaugaguuuuguggugcuguagg

SEQ ID NO: 234411 - RNA, 64 nt, Homo Sapiens
uuucuaaaacuuucacuggacucggagacgucuagcuggcaaugaguauaucaaucaacucuaa

SEQ ID NO: 234412 - RNA, 64 nt, Homo Sapiens
gacuuagcuauuaguauauuuucaccgggaccuggcuggcaaauaagcuccuuguucucuacug

SEQ ID NO: 234413 - RNA, 64 nt, Homo Sapiens
gcccuuaggaugccgcauggcuguccggauaagagcuggcaaguuuguccaacaacagugcuga

SEQ ID NO: 234414 - RNA, 64 nt, Homo Sapiens
guaagucccccaguugcucugaggagugugcugugcuggcaaguuggauuucugcccaagacca

SEQ ID NO: 234415 - RNA, 64 nt, Homo Sapiens
aaugggaacaguggcugucucucuccguccugcugcuggcaagguagggaggugggguagagca

SEQ ID NO: 234416 - RNA, 58 nt, Homo Sapiens
aaaugaguuguucaccuuaacccauuacgcuggcaaacugauacaacucagaaacugc

SEQ ID NO: 234417 - RNA, 64 nt, Homo Sapiens
aacugaaauuuagccuuacucccaaguuauaaaugcuggcaacaaaucacaguaguaaaagcag

SEQ ID NO: 234418 - RNA, 64 nt, Homo Sapiens
uccuagcugcucuggaggcuccuuugauucucuagaccuggaaaaggugucccuaggcagagcc

SEQ ID NO: 234419 - RNA, 64 nt, Homo Sapiens
gcucagagcuggggauuuccugccuggaacaagggaccuggagaauguuuuugcgugggaugau

SEQ ID NO: 234420 - RNA, 64 nt, Homo Sapiens
ccauccccuuggaaagacaauacaugauacaguggaccuggagaccaguuucaagaugaagaac

SEQ ID NO: 234421 - RNA, 64 nt, Homo Sapiens
aaaucguuucucagaaguacggucauuugaaugagaccuggaacggcuuacagaaaugacugcc

SEQ ID NO: 234422 - RNA, 64 nt, Homo Sapiens
guuggacauguguguggcucugcaguaugucuuggaccuggaaauggcuauuacaaagcaguac

SEQ ID NO: 234423 - RNA, 64 nt, Homo Sapiens
gccauugcugccauggcacucugcuccauguauggaccuggaagcugggcugaccuacuaaaac

SEQ ID NO: 234424 - RNA, 64 nt, Homo Sapiens
guguuuggacugcaguuugcuggccagacccagggaccuggagucugacuucuuagagaaugug

SEQ ID NO: 234425 - RNA, 64 nt, Homo Sapiens
agauucauagacugaaagcuaagugacccaaagugaccuggacacauguucugaugaaagaacc

SEQ ID NO: 234426 - RNA, 64 nt, Homo Sapiens
aacucauggaagauguugggccuccagugaccuggaccuggagcugucccccuugaggacgaag

SEQ ID NO: 234427 - RNA, 64 nt, Homo Sapiens
uggagcaacucauggaagauacgaagccuccagugaccuggaccuggaagugucccccuugagg

SEQ ID NO: 234428 - RNA, 64 nt, Homo Sapiens
aggacagagacuacaccuuguacuuuuugugcaugaccuggaccugcuaaggaaaaaaaaaucu

SEQ ID NO: 234429 - RNA, 64 nt, Homo Sapiens
gacacccuuggacagaagacuggccuaccuagcagaccuggauuuuucuuccugaucugcugcu

SEQ ID NO: 234430 - RNA, 64 nt, Homo Sapiens
uuuuggaguuccucucggguuaucucccacgccugaccuggaaccagcaagccccuuuccugcc

SEQ ID NO: 234431 - RNA, 64 nt, Homo Sapiens
aguuugugaagcaccuggucagcaaccugccccagaccuggagggucuuuguggacugaaggua

SEQ ID NO: 234432 - RNA, 64 nt, Homo Sapiens
cugaccuguaaccagcugaagggagggagagucugaccuggaucgguggagaaucagauuuaga

SEQ ID NO: 234433 - RNA, 64 nt, Homo Sapiens
gggggccuuugucaaacacuucugucaggcccuugaccuggaaucucaagcgggaccuucuuuc

SEQ ID NO: 234434 - RNA, 64 nt, Homo Sapiens
cagccacaucuucuaugagccagaugcuuaugaugaccuggaccaagaagacccagaugacgac

SEQ ID NO: 234435 - RNA, 64 nt, Homo Sapiens
uuaugaugaccuggaccaagaagacccagaugacgaccuggauauuugacuggccagauuugau

SEQ ID NO: 234436 - RNA, 64 nt, Homo Sapiens
gaagcccaccaagaccgaaacuggagaagggcuggaccuggaccuggaccuggaccuacagcgg

SEQ ID NO: 234437 - RNA, 64 nt, Homo Sapiens
caccaagaccgaaacuggagaagggcuggaccuggaccuggaccuggaccuacagcggggacuu

SEQ ID NO: 234438 - RNA, 64 nt, Homo Sapiens
gaccgaaacuggagaagggcuggaccuggaccuggaccuggaccuacagcggggacuuaaaugc

SEQ ID NO: 234439 - RNA, 64 nt, Homo Sapiens
ccagcagacucuggaggccugugccuugcuagcugaccuggagaugcugccugguggggaucag

SEQ ID NO: 234440 - RNA, 64 nt, Homo Sapiens
cauccugguuuuagacgaggccacagcugccaucgaccuggagacugacaaccucauccaggcu

SEQ ID NO: 234441 - RNA, 64 nt, Homo Sapiens
aagcaaagagcagacacacauacagccugaaacagaccuggacagacagacacagccugaaaca

SEQ ID NO: 234442 - RNA, 64 nt, Homo Sapiens
cagacagagagacaggcagacacagccuaaaacagaccuggacagacaggcagacguagucuga

SEQ ID NO: 234443 - RNA, 64 nt, Homo Sapiens
aagacuggcaguucuagauuccucuauauggggagaccuggauuguugaccagggugagaagcc

SEQ ID NO: 234444 - RNA, 64 nt, Homo Sapiens
ggacucaggacuucagaagcaacauuucuggccugaccuggaaggugaaggugaaggugagacc

SEQ ID NO: 234445 - RNA, 64 nt, Homo Sapiens
acuggucagaaccguuacugucgcauccacgugcgaccuggaggcuccucccuccccaccccug

SEQ ID NO: 234446 - RNA, 64 nt, Homo Sapiens
cuccgucagcuccguccuugcgccccucgggccugaccuggaagagccacguccugccucgcgc

SEQ ID NO: 234447 - RNA, 64 nt, Homo Sapiens
cgggacagaauggauauuuggcugaccuuggugagaccuggagcugccuguuucuucccuaggg

SEQ ID NO: 234448 - RNA, 64 nt, Homo Sapiens
acaugugccgcuaacugaccgcguugccauuggcgaccuggacucugaacucagguuuauucua

SEQ ID NO: 234449 - RNA, 64 nt, Homo Sapiens
cgcagguuguccucaaacccucuccucacaggaaaaggcggauugaggcugcugggucagccuu

SEQ ID NO: 234450 - RNA, 64 nt, Homo Sapiens
gggguugcuccugguccaagaggcuaccugcuccaaggcggagggugggagcaggugugccagg

SEQ ID NO: 234451 - RNA, 64 nt, Homo Sapiens
accggagucccugcagaagguccuaugcugguggaaggcggaggggugggccagaagcccgucc

SEQ ID NO: 234452 - RNA, 64 nt, Homo Sapiens
augggugaaagacgaguaagccuuaugccgaaucaaggcggaacgccccacuggagcagucugu

SEQ ID NO: 234453 - RNA, 64 nt, Homo Sapiens
agaacugcauuugaagaagugaaaagcuuaaagcaaggcggaacccaugaaacagauuucaaag

SEQ ID NO: 234454 - RNA, 64 nt, Homo Sapiens
cggggcaagauccuuccagagcuaagagauguccaaggcggagcucauccuugugugcugcucu

SEQ ID NO: 234455 - RNA, 64 nt, Homo Sapiens
cugcuggugugaggaccaugacaagcucccagguaaggcggaggugggagauccugcauuucua

SEQ ID NO: 234456 - RNA, 64 nt, Homo Sapiens
ccaccgagaaccaccagccacaccauuauaccagaaggcggaucccccaagaccacagugagag

SEQ ID NO: 234457 - RNA, 64 nt, Homo Sapiens
cccguuuuguuucucugggcgguuguggcagcugaaggcggacguuguuuccuaaccauaggug

SEQ ID NO: 234458 - RNA, 64 nt, Homo Sapiens
uugcagugagcggagauuguucgcuugaaccuagaaggcggagggggaggcugaggcaggagaa

SEQ ID NO: 234459 - RNA, 64 nt, Homo Sapiens
caggaggaucgcuugaggccucccagcacuucggaaggcggaggguggugacucaagccuauaa

SEQ ID NO: 234460 - RNA, 64 nt, Homo Sapiens
cccacaguguuaccugacuuuccccgcguccgagaaggcggaaagaagccuccugucuccccuu

SEQ ID NO: 234461 - RNA, 64 nt, Homo Sapiens
ccauccaacccucgcccgacccugcaagggacugaaggcggagcccgccgggccgcgccaagga

SEQ ID NO: 234462 - RNA, 64 nt, Homo Sapiens
gagggaggggaacgugugggccacggugggucagaaggcggaagaggggccacauaggaaagcc

SEQ ID NO: 234463 - RNA, 64 nt, Homo Sapiens
uguggagagagccgcacaccagcgccacccaggaaaggcggagcgguuaccaguguuuuguguu

SEQ ID NO: 234464 - RNA, 64 nt, Homo Sapiens
ugaauugugcgaugccaacggauuacaauaacaaaaggcggaauaguccucuucaacuucagcu

SEQ ID NO: 234465 - RNA, 54 nt, Homo Sapiens
ugggcccccacagagcccacugggaaggcggaggucuucugguugcaggacuag

SEQ ID NO: 234466 - RNA, 64 nt, Homo Sapiens
gauaugacuaacucaccaaacaaugccaaggagaaaggcggacaggucaccaucaccuuucauc

SEQ ID NO: 234467 - RNA, 64 nt, Homo Sapiens
aggccuuuuguaauggaaaucgacgcuuccagacaaggcggaaacugccaacaccggaacaagc

SEQ ID NO: 234468 - RNA, 64 nt, Homo Sapiens
augaaggugguggcggcagaagcucuccuaacccaaggcggagaggauccccaaacacuagaga

SEQ ID NO: 234469 - RNA, 64 nt, Homo Sapiens
uugcagugagcugagauugcuggcaugaaccuggaaggcggagcgggaggcugaggcaggagaa

SEQ ID NO: 234470 - RNA, 64 nt, Homo Sapiens
ggagccuugggaaccccucgccgcagcccccuccaaggcggagucccaggucaccuccgggcuu

SEQ ID NO: 234471 - RNA, 64 nt, Homo Sapiens
aggaggcugaggcaggagaauggcgugaacccggaaggcggagcuugcaguuagccgagaucau

SEQ ID NO: 234472 - RNA, 64 nt, Homo Sapiens
gcaucuguauguagugaaauguuauauggaauaaaaggcggacuagauauaggaaggcaggaug

SEQ ID NO: 234473 - RNA, 64 nt, Homo Sapiens
agauuuggaaguuuagucaccauuuguaaaggggaaggcggacacaaaggugcuuuaaauguca

SEQ ID NO: 234474 - RNA, 64 nt, Homo Sapiens
gagccugcuacaggccgcaggcauagcuggagugaaggcggaggcaaaaggcuuuuggauuugu

SEQ ID NO: 234475 - RNA, 64 nt, Homo Sapiens
ugccauacgugacagccagaggcccagcguuaucaaggcggacaauuagacucuugagaacaca

SEQ ID NO: 234476 - RNA, 64 nt, Homo Sapiens
agaaaaggaccuugugagacggaggaagcggcagaaggcggacgcgugccggcgggaggagcca

SEQ ID NO: 234477 - RNA, 64 nt, Homo Sapiens
gagcuggggcucagacaugggcuucuccccacagaaggcggagaguucucggaaagaccggagg

SEQ ID NO: 234478 - RNA, 64 nt, Homo Sapiens
ccuuggaacgcugccuccacugaggcgggcacacaaggcggacccuccugaaacagccuccauu

SEQ ID NO: 234479 - RNA, 64 nt, Homo Sapiens
augugggaacuauaaaucaccuaaugccuucuggaaggcggaaaggcagagguuggcccuuucu

SEQ ID NO: 234480 - RNA, 64 nt, Homo Sapiens
gcucgcgccuguaaucccagcacuuugggaggccaaggcggacggaucacuugagguuaggagu

SEQ ID NO: 234481 - RNA, 64 nt, Homo Sapiens
cauucauagagcagaaagaauuuguccggcaaaaaaggcggauugacauuuacaauggauugua

SEQ ID NO: 234482 - RNA, 64 nt, Homo Sapiens
uugcagugagccaagaucacuuguuugaaccuggaaggcggaggaggaggcugagaaaagagaa

SEQ ID NO: 234483 - RNA, 64 nt, Homo Sapiens
augcaacuauccgucucgaauaccagggcagggcaaggcggacugaugccguccaaccaauuau

SEQ ID NO: 234484 - RNA, 64 nt, Homo Sapiens
uggccccacugcagaauuaaagaaggaagaagggaaggcggaggagucuauaagaaggaaucau

SEQ ID NO: 234485 - RNA, 64 nt, Homo Sapiens
gccaugaugacaauggcgguuuuguggaauagaaaaggcggaaagguggggaaaagauugagaa

SEQ ID NO: 234486 - RNA, 64 nt, Homo Sapiens
gggaggcugaggcaggagaauugcuugaacucagaaggcggaggcugcagugagccgagaucgu

SEQ ID NO: 234487 - RNA, 64 nt, Homo Sapiens
ggcucaugccuguaauccagcacuuugggaggccaaggcggacagaccaccugaggucaggagu

SEQ ID NO: 234488 - RNA, 64 nt, Homo Sapiens
gaugaugggcucucucuguggaagauggcaaugaaaggcggaggcuccagccguuggaaucgcu

SEQ ID NO: 234489 - RNA, 64 nt, Homo Sapiens
aauggagugcaauugugugauggagaaaacaaggaaggcggaaguccccccuaucaggugguuu

SEQ ID NO: 234490 - RNA, 64 nt, Homo Sapiens
uaacaguuuaccacuaugcuugauuauaaugugaaaggcggaauucugaguguguuaagauggu

SEQ ID NO: 234491 - RNA, 64 nt, Homo Sapiens
gcucacgccuguaaucccagcacuuuaagaggccaaggcggauggaucacuugagcccaggagu

SEQ ID NO: 234492 - RNA, 64 nt, Homo Sapiens
gggaggcugaggcaggagaaucgcuugaacccagaaggcggaaguugcagugagcugagauugc

SEQ ID NO: 234493 - RNA, 64 nt, Homo Sapiens
uguggaggagaggccggcuugcaggucucugagcaaggcggaggauggaguggggucccauggu

SEQ ID NO: 234494 - RNA, 64 nt, Homo Sapiens
cuuccaugugucuccugccagcucugagacugacaaggcggaaaguaaagacuaaaaggcguuu

SEQ ID NO: 234495 - RNA, 64 nt, Homo Sapiens
uuuuaaauuuaaaacauuuuaaaaacgcaugcagaaggcggaguagauaguugcccacuugggc

SEQ ID NO: 234496 - RNA, 64 nt, Homo Sapiens
aguucccagaggcuucuguagucuaaauauuuagaaggcggagagauuccccauccaucucauu

SEQ ID NO: 234497 - RNA, 64 nt, Homo Sapiens
uacgaggccgacccggggaggacauggguuaguuaaggcggaggccaguaggcugcagaccagg

SEQ ID NO: 234498 - RNA, 64 nt, Homo Sapiens
cuuaaagcccaaccuuaggaauauagugccccaaaaggcggaugcuucuuccauuaucuuauuu

SEQ ID NO: 234499 - RNA, 64 nt, Homo Sapiens
guugacuuguuggcugccaguaggggcgggaggaaaggcggaggcgagcccuggaggagggagg

SEQ ID NO: 234500 - RNA, 64 nt, Homo Sapiens
gucucccugggcacccugcaaacuuggacuucuaaaggcggaggcagggagggggcugggaaag

SEQ ID NO: 234501 - RNA, 64 nt, Homo Sapiens
uuaguugagggagagcaguggagcagagaccaagaaggcggaggugaaagagaagcugcugcgu

SEQ ID NO: 234502 - RNA, 64 nt, Homo Sapiens
caggcauccuucccuuuauagauugauuccagcaaaggcggaauaaaacaaauuuccuaugaag

SEQ ID NO: 234503 - RNA, 64 nt, Homo Sapiens
caggggaacccaacaguccuaugucaucuaagagaaggcggaaugcuacuaucauucacgaugg

SEQ ID NO: 234504 - RNA, 64 nt, Homo Sapiens
gucccaggagaugacaggaaggaagcaccagggcaaggcggacgcucacccugugaccacgaug

SEQ ID NO: 234505 - RNA, 64 nt, Homo Sapiens
ugggcuuccacccucaugaacaguucuuaccuucaaggcggaucaggggaguuuccucugcuca

SEQ ID NO: 234506 - RNA, 64 nt, Homo Sapiens
agccugccucugugaugacuugcaacucaccucgaaggcggaccuuucugcugcucagccugcc

SEQ ID NO: 234507 - RNA, 64 nt, Homo Sapiens
ugaggacagccagcuccgccuuuugcggggagggaaggcggagccgcccacccuggggagagac

SEQ ID NO: 234508 - RNA, 64 nt, Homo Sapiens
acgacccagccagacccucgcggagauggugcagaaggcggagcgggugagcggccgugcgucc

SEQ ID NO: 234509 - RNA, 64 nt, Homo Sapiens; identical to SEQ ID NO: 129516

SEQ ID NO: 234510 - RNA, 64 nt, Homo Sapiens; identical to SEQ ID NO: 129517

SEQ ID NO: 234511 - RNA, 64 nt, Homo Sapiens; identical to SEQ ID NO: 129518

SEQ ID NO: 234512 - RNA, 64 nt, Homo Sapiens; identical to SEQ ID NO: 129519

SEQ ID NO: 234513 - RNA, 64 nt, Homo Sapiens; identical to SEQ ID NO: 129520

SEQ ID NO: 234514 - RNA, 64 nt, Homo Sapiens; identical to SEQ ID NO: 129521

SEQ ID NO: 234515 - RNA, 64 nt, Homo Sapiens; identical to SEQ ID NO: 129522

SEQ ID NO: 234516 - RNA, 64 nt, Homo Sapiens; identical to SEQ ID NO: 129523

SEQ ID NO: 234517 - RNA, 64 nt, Homo Sapiens; identical to SEQ ID NO: 129524

SEQ ID NO: 234518 - RNA, 64 nt, Homo Sapiens; identical to SEQ ID NO: 129525

SEQ ID NO: 234519 - RNA, 59 nt, Homo Sapiens; identical to SEQ ID NO: 129526

SEQ ID NO: 234520 - RNA, 64 nt, Homo Sapiens; identical to SEQ ID NO: 129527

SEQ ID NO: 234521 - RNA, 64 nt, Homo Sapiens; identical to SEQ ID NO: 129528

SEQ ID NO: 234522 - RNA, 64 nt, Homo Sapiens; identical to SEQ ID NO: 129529

SEQ ID NO: 234523 - RNA, 64 nt, Homo Sapiens; identical to SEQ ID NO: 129530

SEQ ID NO: 234524 - RNA, 64 nt, Homo Sapiens; identical to SEQ ID NO: 129531

SEQ ID NO: 234525 - RNA, 64 nt, Homo Sapiens; identical to SEQ ID NO: 129532

SEQ ID NO: 234526 - RNA, 53 nt, Homo Sapiens; identical to SEQ ID NO: 129533

SEQ ID NO: 234527 - RNA, 64 nt, Homo Sapiens; identical to SEQ ID NO: 129534

SEQ ID NO: 234528 - RNA, 64 nt, Homo Sapiens; identical to SEQ ID NO: 129535

SEQ ID NO: 234529 - RNA, 64 nt, Homo Sapiens; identical to SEQ ID NO: 129536

SEQ ID NO: 234530 - RNA, 64 nt, Homo Sapiens; identical to SEQ ID NO: 129537

SEQ ID NO: 234531 - RNA, 64 nt, Homo Sapiens; identical to SEQ ID NO: 129538

SEQ ID NO: 234532 - RNA, 64 nt, Homo Sapiens; identical to SEQ ID NO: 129539

SEQ ID NO: 234533 - RNA, 64 nt, Homo Sapiens; identical to SEQ ID NO: 129540

SEQ ID NO: 234534 - RNA, 64 nt, Homo Sapiens; identical to SEQ ID NO: 129541

SEQ ID NO: 234535 - RNA, 64 nt, Homo Sapiens; identical to SEQ ID NO: 129542

SEQ ID NO: 234536 - RNA, 64 nt, Homo Sapiens; identical to SEQ ID NO: 129543

SEQ ID NO: 234537 - RNA, 64 nt, Homo Sapiens; identical to SEQ ID NO: 129544

SEQ ID NO: 234538 - RNA, 64 nt, Homo Sapiens; identical to SEQ ID NO: 129545

SEQ ID NO: 234539 - RNA, 64 nt, Homo Sapiens; identical to SEQ ID NO: 129546

SEQ ID NO: 234540 - RNA, 64 nt, Homo Sapiens; identical to SEQ ID NO: 129547

SEQ ID NO: 234541 - RNA, 64 nt, Homo Sapiens; identical to SEQ ID NO: 129548

SEQ ID NO: 234542 - RNA, 64 nt, Homo Sapiens; identical to SEQ ID NO: 129549

SEQ ID NO: 234543 - RNA, 64 nt, Homo Sapiens; identical to SEQ ID NO: 129550

SEQ ID NO: 234544 - RNA, 64 nt, Homo Sapiens; identical to SEQ ID NO: 129551

SEQ ID NO: 234545 - RNA, 64 nt, Homo Sapiens; identical to SEQ ID NO: 129552

SEQ ID NO: 234546 - RNA, 64 nt, Homo Sapiens; identical to SEQ ID NO: 129553

SEQ ID NO: 234547 - RNA, 64 nt, Homo Sapiens; identical to SEQ ID NO: 129554

SEQ ID NO: 234548 - RNA, 64 nt, Homo Sapiens; identical to SEQ ID NO: 129555

SEQ ID NO: 234549 - RNA, 64 nt, Homo Sapiens; identical to SEQ ID NO: 129556

SEQ ID NO: 234550 - RNA, 64 nt, Homo Sapiens; identical to SEQ ID NO: 129557

SEQ ID NO: 234551 - RNA, 64 nt, Homo Sapiens
aaguaacugggacuauagcaugccaccacacccagcugauuaucauauuuuuuuuuguagaggu

SEQ ID NO: 234552 - RNA, 64 nt, Homo Sapiens; identical to SEQ ID NO: 234551

SEQ ID NO: 234553 - RNA, 64 nt, Homo Sapiens
cuagucucuucucuacauggugaugcauuucagcaauuauaaauuaauauaaaugaccaaaagu

SEQ ID NO: 234554 - RNA, 64 nt, Homo Sapiens
gauauuugcuauuucauucauugggcacauaucaaauuauaauuuugauuuuaaauggucaccc

SEQ ID NO: 234555 - RNA, 64 nt, Homo Sapiens
aaaacauuggaaaguuaagagaguucgagggaagaauuauaaagacuaggaguccuagaaagag

SEQ ID NO: 234556 - RNA, 64 nt, Homo Sapiens
cauaaguaaauuuaaacuguuguuuguauaaaacaauuauaaugaaguguuuauaagaaauugu

SEQ ID NO: 234557 - RNA, 64 nt, Homo Sapiens
uaaucacaguaggucugauagagaauuggagcuaaauuauaauauuuuuguugguaaaguugag

SEQ ID NO: 234558 - RNA, 64 nt, Homo Sapiens
uuaaauaauuuaagucuagcauuuacuuuuaaauaauuauaaugaaguuuugaaauacuaaguu

SEQ ID NO: 234559 - RNA, 64 nt, Homo Sapiens
augacuuuauccuggcuauagacagaaaauuauaaauuauaaauugauuuuuauuaaaaaccug

SEQ ID NO: 234560 - RNA, 64 nt, Homo Sapiens
uauaaauaugacuuuauccuaaaccuggacagaaaauuauaaauacauuacugauuuuuauuaa

SEQ ID NO: 234561 - RNA, 64 nt, Homo Sapiens
ugcaaaugagcagaauaaauuucuugccaguuaaaauuauaacuaaaaaaauucugcuguguaa

SEQ ID NO: 234562 - RNA, 64 nt, Homo Sapiens
gaaagguuuaaauauacuacgagggggugguaauaauuauaacuuaaguggggggaagggggug

SEQ ID NO: 234563 - RNA, 64 nt, Homo Sapiens
gagaauacuguuuuccuuagcauacugacaaaccaauuauaagugaaaauacucugggaauagu

SEQ ID NO: 234564 - RNA, 64 nt, Homo Sapiens
uaccuuuaaagacaugcacugaggaaaaagucaaaauuauaaaaaaaccucagugauuacaauu

SEQ ID NO: 234565 - RNA, 64 nt, Homo Sapiens
uguugauaauagaucaucuuguauauacuucugcaauuauaagauguuuuuugaugaugaaagc

SEQ ID NO: 234566 - RNA, 64 nt, Homo Sapiens
ucuuuccugaguuugguucagauggucugucacuaauuauaaggcagauaggaacagacagaaa

SEQ ID NO: 234567 - RNA, 64 nt, Homo Sapiens
uuuguacagguuauuuaauagcuuuguuaaagauaauuauaauaauuauaacauuaauaaaaau

SEQ ID NO: 234568 - RNA, 64 nt, Homo Sapiens
guuauuuaauagcuuuguuaaagauaauuauaauaauuauaacauuaauaaaaauguugcuuuu

SEQ ID NO: 234569 - RNA, 64 nt, Homo Sapiens
cuccaccccacaacccaaaagguuuaagaaauagaauuauaacuguaaagauguuuauuucagg

SEQ ID NO: 234570 - RNA, 64 nt, Homo Sapiens
uaacacagcauuguauaugugaagcaaacucuaaaauuauaaaugacaaccugaauuaucuauu

SEQ ID NO: 234571 - RNA, 64 nt, Homo Sapiens
agauaauauauuauuuuuuguguauauauuuuaaaauuauaaauguuguuguuuuugagcuggc

SEQ ID NO: 234572 - RNA, 64 nt, Homo Sapiens
ggccucagcaguuuugcucaguuuucauucuuugaauuauaaauaauguaguaaacuauucuaa

SEQ ID NO: 234573 - RNA, 64 nt, Homo Sapiens
aaaaugaguaacagaguccacggcgugcaaugguaauuauaaauuggugaugcuuguuugcaaa

SEQ ID NO: 234574 - RNA, 64 nt, Homo Sapiens
cauuaagauaugauucauguaacaauguuaaauuaauuauaaugggauuggguuuguuaucugu

SEQ ID NO: 234575 - RNA, 64 nt, Homo Sapiens
agcacuggcuucuauauuuuauuucauauuuaugaauuauaaauaugaauuuaauuacuaaaga

SEQ ID NO: 234576 - RNA, 64 nt, Homo Sapiens
auguacuguuuagaaauauacauauuuuauacaaaauuauaaagaaagcauagagagguaagca

SEQ ID NO: 234577 - RNA, 64 nt, Homo Sapiens
aauagaaaugggaggccucugauggaccuucuagaauuauaagucacaaagaguucuggaaaag

SEQ ID NO: 234578 - RNA, 64 nt, Homo Sapiens
ggugaagagccagaagugaagagugacuaguacaaauuauaaaaagccacuagacucuucacug

SEQ ID NO: 234579 - RNA, 64 nt, Homo Sapiens
gaaaugaacucacaguacaagaaugguucucaagaauuauaagauuauacaaauagauugcuua

SEQ ID NO: 234580 - RNA, 64 nt, Homo Sapiens
acaagcuuugaccacuuaccaagacagugaaaguaauuauaaaaauaagaaagacuuuuugccc

SEQ ID NO: 234581 - RNA, 64 nt, Homo Sapiens
gggauuaugaaagggaauuagauuuauaagagggaauuauaagauauaauguaauuauaacagg

SEQ ID NO: 234582 - RNA, 64 nt, Homo Sapiens
gggauuuauaagagggaauuuguucuuauaauguaauuauaacaaauguuuaaccaaagaaagu

SEQ ID NO: 234583 - RNA, 64 nt, Homo Sapiens
aaaagaguugguuuguguacuucaacaaauuguaaauuauaagaaacagcaaaacaauaauuuu

SEQ ID NO: 234584 - RNA, 64 nt, Homo Sapiens
auggagaauuuuuucuucuguauagauugaucagaauuauaaccucucuuuuaaaaaguacauu

SEQ ID NO: 234585 - RNA, 64 nt, Homo Sapiens
aaaaaagcucucuugaaucuagguagcaugaacaaauuauaaaauuuguuuaaaaaagcaaacu

SEQ ID NO: 234586 - RNA, 64 nt, Homo Sapiens
aucgcacaagugguuuauggaguguuuggauuguaauuauaaaugguucuuugauaugcaaauu

SEQ ID NO: 234587 - RNA, 64 nt, Homo Sapiens
guaauagcuacguuugggaaggaggaaacauuuaaauuauaaaggacugaauaaucuaaaaagc

SEQ ID NO: 234588 - RNA, 64 nt, Homo Sapiens
uaucuuauuaccuauaacuauuaauuuuucauagaauuauaaaugucauuugacuaugucaauc

SEQ ID NO: 234589 - RNA, 64 nt, Homo Sapiens
aacucuguauuaguuuccuaguuuaauuuuuauuaauuauaaaagaaaaucauuccaaauaaga

SEQ ID NO: 234590 - RNA, 64 nt, Homo Sapiens
uugaauuuugcagacuaaauugauaaguuacuucaauuauaaaauuucuuaauucuuacaaugg

SEQ ID NO: 234591 - RNA, 64 nt, Homo Sapiens
ucuguauuuuuuuucccuguuggagaaagugggaaauuauaaugucgaacucugaaacaaaagu

SEQ ID NO: 234592 - RNA, 64 nt, Homo Sapiens
aggaaacuuuuuuuguuugcucuugcauugcaaaaauuauaaaguaauuuauuauuuauugucg

SEQ ID NO: 234593 - RNA, 64 nt, Homo Sapiens
uucuauugacauccuuuuguuuucuaauuuuaaaaauuauaaagauguaaauggaauuauaaau

SEQ ID NO: 234594 - RNA, 64 nt, Homo Sapiens
uuucuaauuuuaaaaauuauaaagauguaaauggaauuauaaauacugugaccuaagaaaagac

SEQ ID NO: 234595 - RNA, 64 nt, Homo Sapiens
cugucaaauugccacgaucuccuuuauugagcuuaauuauaauaucuuccagguaccccaugua

SEQ ID NO: 234596 - RNA, 64 nt, Homo Sapiens
auccuuuuugaaaagagcuauaggacauccuuuaaauuauaagcccuguaccuuuccuucccau

SEQ ID NO: 234597 - RNA, 64 nt, Homo Sapiens
cuccuuuaauucguugguuuugaaaguuuugcuaaauuauaaaguguuugagagacauguaagu

SEQ ID NO: 234598 - RNA, 64 nt, Homo Sapiens
uaaauauguuaauuuuuuuguaaucugaugugcaaauuauaauucucugacacaucugaaaaag

SEQ ID NO: 234599 - RNA, 64 nt, Homo Sapiens
uuuacaagcaugaaggauauuaggguaaguggcuaauuauaaaucuacucuagagacauauaau

SEQ ID NO: 234600 - RNA, 64 nt, Homo Sapiens
ggcaagauacaauuauaugcguuccucuuccugaaauuauaacauuucuaaacuuacccacgua

SEQ ID NO: 234601 - RNA, 64 nt, Homo Sapiens
guuaaugguuuggggguguuaagcaaaucauuaaaauuauaacauuuggccccacaaauacuuu

SEQ ID NO: 234602 - RNA, 64 nt, Homo Sapiens
aaagauacuuucuaacaguauuuuuauauucugaaauuauaacagauuauagcuuuuauaugcc

SEQ ID NO: 234603 - RNA, 64 nt, Homo Sapiens
ggugugauagaauccacaugugaagauugcuguaaauuauaaaguacaguuuugcuuuaaccac

SEQ ID NO: 234604 - RNA, 64 nt, Homo Sapiens
cccuguauuuaaaaugguuuaacuaugccaaucuaauuauaauuaugucuauaguuuuggccuu

SEQ ID NO: 234605 - RNA, 64 nt, Homo Sapiens
gguacagcagaaaauauaccuugugucaaauuauaauuauaaaaauauuuuauuuuuuaguuau

SEQ ID NO: 234606 - RNA, 64 nt, Homo Sapiens
auaaaagguacagcagaaaaaguuauuugugucaaauuauaauuuagggaauauuuuauuuuuu

SEQ ID NO: 234607 - RNA, 64 nt, Homo Sapiens
gaucuuaauuaaaagguaauuguagcacauuaccaauuauaaggugaagaaauguuuuuuuccc

SEQ ID NO: 234608 - RNA, 64 nt, Homo Sapiens
uuagauauuuauuagauagcccugaauucacucuaauuauaaacagggaguguaaacugccccc

SEQ ID NO: 234609 - RNA, 64 nt, Homo Sapiens
augacauucguucacaauagcacuauuuuaaauaaauuauaagcuuuaagguacgaaguauuua

SEQ ID NO: 234610 - RNA, 64 nt, Homo Sapiens
auauguugauucauggcuauaauaaagcaggagcaauuauaaaaucuucaaucaauugaacuuu

SEQ ID NO: 234611 - RNA, 64 nt, Homo Sapiens
auaaauuccuuugaaacuauaagucuuugaggaaaauuauaagguaaaauuuuccuguuuuucc

SEQ ID NO: 234612 - RNA, 64 nt, Homo Sapiens
gugaugaaaaacaaaaaauugcaaguaguaugcaaauuauaaauauacagucuucccacuucac

SEQ ID NO: 234613 - RNA, 64 nt, Homo Sapiens
gcaagaaaugauacauaaucauucucuuuaagacaauuauaaauuggauggagcuauuauucac

SEQ ID NO: 234614 - RNA, 64 nt, Homo Sapiens
agcuauuauucacuacuucuuuucuuaguuugaaaauuauaaacaaauuuuaagcuuuauucaa

SEQ ID NO: 234615 - RNA, 64 nt, Homo Sapiens
uuuuuuguuuuguuuuccagaaucaagauguuuaaauuauaagucaaauccaaaauuauuuuca

SEQ ID NO: 234616 - RNA, 64 nt, Homo Sapiens
gggaggggggaaaggauucguguccucugugaagaauuauaaaaaauguauguaacuaaagcuu

SEQ ID NO: 234617 - RNA, 64 nt, Homo Sapiens
auauuucaauugugaauucacauagaaaacauuaaauuauaauguuugacuauuauauaugugu

SEQ ID NO: 234618 - RNA, 64 nt, Homo Sapiens
auuuauggaggauuuuuuugccccuuguguuuggaauuauaaaauauagguaaaaguacguaau

SEQ ID NO: 234619 - RNA, 64 nt, Homo Sapiens
guaugaccuuuuuaaaucaauauuucuguggaauaauuauaaaacuuuugugauuuaauaauac

SEQ ID NO: 234620 - RNA, 64 nt, Homo Sapiens
caugguuuuguuuuuuuuuucucagcccaucucuaauuauaaaauauuauuauuucagaacuag

SEQ ID NO: 234621 - RNA, 64 nt, Homo Sapiens
ugagcacugauggaaucccuaugguugaauaaauaauuauaaauaauaaauacagaaaagucau

SEQ ID NO: 234622 - RNA, 64 nt, Homo Sapiens
gacagacacuugguuaguggccuggaaugugucaaauuauaagaugaccauuagaauagucaua

SEQ ID NO: 234623 - RNA, 64 nt, Homo Sapiens
uauuagcagucgcgagcacauuagagauuaaaccaauuauaacuccauuugcaauauggauuuc

SEQ ID NO: 234624 - RNA, 64 nt, Homo Sapiens
uuaguuuauauuaauuucggauucuuauuuuagaaauuauaauuuacuuaaauuugguuuguua

SEQ ID NO: 234625 - RNA, 64 nt, Homo Sapiens
accacucuugagaaguaauuacuuuaucccauuuaauuauaaaacugugauaacuacuuuuuau

SEQ ID NO: 234626 - RNA, 64 nt, Homo Sapiens
uuuccuuauuucaacaagauugaaaucuaagguuaauuauaaucauaaaaacaguguuuuauag

SEQ ID NO: 234627 - RNA, 64 nt, Homo Sapiens
acaacagaaaugcuccuggaacuucaaguugcugaauuauaaguuuauuuuuuaucaauaaaua

SEQ ID NO: 234628 - RNA, 64 nt, Homo Sapiens
uauauuuuuacauaaaagcuugaacauacagaugaauuauaaccuaugugaagaaaucuuagau

SEQ ID NO: 234629 - RNA, 64 nt, Homo Sapiens
gcucaaaaagauuuggcuuaguguuuucauugcaaauuauaauugcuguagagccacacacaac

SEQ ID NO: 234630 - RNA, 64 nt, Homo Sapiens
uugcuguagagccacacacaacuuuugaacuuuuaauuauaaguguuauggcuaaaguuauuua

SEQ ID NO: 234631 - RNA, 64 nt, Homo Sapiens
uuaaauuuugacuguacuaacuauaaauguaaugaauuauaauaauuauaaaugguauaaaugc

SEQ ID NO: 234632 - RNA, 64 nt, Homo Sapiens
gacuguacuaacuauaaauguaaugaauuauaauaauuauaaaugguauaaaugcauucuacaa

SEQ ID NO: 234633 - RNA, 64 nt, Homo Sapiens
augaagugucaaaaaaucucaauaauuucuugauaauuauaaaacuuuuaauaauuauaaaauu

SEQ ID NO: 234634 - RNA, 64 nt, Homo Sapiens
uuaauaauuucuugauaauuugguagcuuuuaauaauuauaaaagaugcaaagccugaagacac

SEQ ID NO: 234635 - RNA, 64 nt, Homo Sapiens
augaauuuggaaaaacauuuuuucaaaaacuacaaauuauaaaacaccaaaguguucauacuaa

SEQ ID NO: 234636 - RNA, 64 nt, Homo Sapiens
guacuucuaugaaauaauaugcagucuauuuuuaaauuauaaauuaugugugaacuuagcuuuu

SEQ ID NO: 234637 - RNA, 64 nt, Homo Sapiens
ccuaccucauaaugcuuuguauaaaaugggggauaauuauaauaugcgugucucaguaaaaauu

SEQ ID NO: 234638 - RNA, 64 nt, Homo Sapiens
ugggggauaauuauaauacccgugucucaguaaaaauuauaaaauuucuguucauauauacaug

SEQ ID NO: 234639 - RNA, 64 nt, Homo Sapiens
gauuccccucaacaauccaguaaaaauguaauguaauuauaagccagagaaacuuuaugcauau

SEQ ID NO: 234640 - RNA, 64 nt, Homo Sapiens
acaaaauuguuaguguuuauauuuuugaaaagugaauuauaaacguuuugccuauaccauccug

SEQ ID NO: 234641 - RNA, 64 nt, Homo Sapiens
uuuacuuuuuggguccagaaugacuuucuccaagaauuauaagaugaaaauuauauauuuugcc

SEQ ID NO: 234642 - RNA, 64 nt, Homo Sapiens
uaaucagaauuuuaaauguucauguuacauaccaaauuauaauaucuaauggagcaauuugucu

SEQ ID NO: 234643 - RNA, 64 nt, Homo Sapiens
ucugauacaaaaugagggccucugcucuugauuuaauuauaaaaugucuacgucuuucuccagu

SEQ ID NO: 234644 - RNA, 64 nt, Homo Sapiens
uuucuaaucauacuuaauccacacuaaugugcgcaauuauaauaaaugguaagauaucacaugu

SEQ ID NO: 234645 - RNA, 64 nt, Homo Sapiens
accugcaucuugguuuauaaccuggcugagcuagagaagccaguaaagcugugcagucaggcac

SEQ ID NO: 234646 - RNA, 64 nt, Homo Sapiens
uggaagcuuuucucuuugccuuuagacuguuaguagaagccaucggagagaagauggcuuagug

SEQ ID NO: 234647 - RNA, 64 nt, Homo Sapiens
aaaacaguuuguugccagacgaaguauuauguucagaagccaaccaccagccccucccucugaa

SEQ ID NO: 234648 - RNA, 64 nt, Homo Sapiens
cagcuaaaggacaaggaaugacucaggugccuagagaagccaggcuucuaacccaggaccauga

SEQ ID NO: 234649 - RNA, 64 nt, Homo Sapiens
caaagacuuggagagcugcagacuucagguggagagaagccaaacccuccuagauggcuacauu

SEQ ID NO: 234650 - RNA, 64 nt, Homo Sapiens
auuuauuguauucugggguauggcguaaguacagagaagccaucaccucagauggcagcuuuua

SEQ ID NO: 234651 - RNA, 64 nt, Homo Sapiens
cauggagaaagcugacuuggcuggugugguacagagaagccagcuuguuuacaugcuuauucca

SEQ ID NO: 234652 - RNA, 64 nt, Homo Sapiens
caguggugccaggcagcuugccacuugggagggcagaagccaggaauuccacacccuuguguug

SEQ ID NO: 234653 - RNA, 64 nt, Homo Sapiens
ugacacagaagauugccuuacgcucgugagcgugagaagccauaagagagagaccgaauucugu

SEQ ID NO: 234654 - RNA, 64 nt, Homo Sapiens
gcacagacuuguauagaggagaagaaaugacagcagaagccauguccuggugaagagcaaagca

SEQ ID NO: 234655 - RNA, 64 nt, Homo Sapiens
gcagggaggaaaggagccggaggaggggagcagcagaagccacggaagagaggcucugaaagaa

SEQ ID NO: 234656 - RNA, 64 nt, Homo Sapiens
gauuggcaugaaggauccugagguggggacagcaagaagccacaguuggugagagcaggaggag

SEQ ID NO: 234657 - RNA, 64 nt, Homo Sapiens
gaaggaggucauucaucaacagauguugagagacagaagccaacagacacagcugcuacgugau

SEQ ID NO: 234658 - RNA, 64 nt, Homo Sapiens
uggagacucaaauucgcaucuuuuagaagccaagagaagccacaaucccugggagccucacgua

SEQ ID NO: 234659 - RNA, 64 nt, Homo Sapiens
agaagccacauggagacucagccucacguauuuuagaagccaagagguucccugaucccuggga

SEQ ID NO: 234660 - RNA, 64 nt, Homo Sapiens
cccuagcccaggggugcuguuggaaggggagcugagaagccaacaggggccaacuagggccagg

SEQ ID NO: 234661 - RNA, 64 nt, Homo Sapiens
ggcuccccagcuuucuccagaaaggaggagcagcagaagccauaugccagggguccugaaaacc

SEQ ID NO: 234662 - RNA, 64 nt, Homo Sapiens
ccgggugguauuuuauugcucugcaaagauguccagaagccauguauauaauguuuuuuaaaca

SEQ ID NO: 234663 - RNA, 64 nt, Homo Sapiens
cccccaguacugcagaucucacaguuugccuuccagaagccagccuaucucuagcccaugguuu

SEQ ID NO: 234664 - RNA, 64 nt, Homo Sapiens
ucuuccaagggcagugcuccaaggcagggacuggagaagccaaggggagagucuaaaagggcua

SEQ ID NO: 234665 - RNA, 64 nt, Homo Sapiens
aacaugacaggagcugggacuaauacagauacucagaagccaauaugcuggcaggaacaacuau

SEQ ID NO: 234666 - RNA, 63 nt, Homo Sapiens
gucugguccuggcuccucuugagcgagccuuucagaagccagguggugguauguacaagauga

SEQ ID NO: 234667 - RNA, 64 nt, Homo Sapiens
auggaagugccuuuugaugucuuacaauaagagaagaagccaauggaaaugaaagagauuggca

SEQ ID NO: 234668 - RNA, 64 nt, Homo Sapiens
auugguccuagaacuuccaaaggcugcuugucauagaagccauugcaucuauaaagcaacggcu

SEQ ID NO: 234669 - RNA, 64 nt, Homo Sapiens
cccaccccaccucaccccaacaaacuccucuagaagaagccaagaauuucucucuaugucuguu

SEQ ID NO: 234670 - RNA, 64 nt, Homo Sapiens
ugagacaaauccuaggcuccugggaggcccuggcagaagccagaacacauggcugggccuuucc

SEQ ID NO: 234671 - RNA, 64 nt, Homo Sapiens
cauauccuucaucagguguuuuaagaugucucugagaagccaucaaggcaaaagagaacuuuaa

SEQ ID NO: 234672 - RNA, 64 nt, Homo Sapiens
cccugaaacacacacauuucccccuuccuuucccagaagccacuggccccccauagcacccagu

SEQ ID NO: 234673 - RNA, 64 nt, Homo Sapiens
caaguacaaagugucaaggguuaaguaaguugccagaagccauaaggugugagaaacagaguua

SEQ ID NO: 234674 - RNA, 64 nt, Homo Sapiens
aguauuucaguaucacagugcagaagauuauuccagaagccagcagaugucuaauuccacaugu

SEQ ID NO: 234675 - RNA, 64 nt, Homo Sapiens
gaagaagaugagagaccugcaaauccagcgccacagaagccaggugaccagggacccgcgggcu

SEQ ID NO: 234676 - RNA, 64 nt, Homo Sapiens
aacaugcaggcugguggugauggguucuguguggagaagccaaacaauaaaacaaccuaguggg

SEQ ID NO: 234677 - RNA, 64 nt, Homo Sapiens
agauagaucuuggaaggagagauccauugaguccagaagccagaucagcaaauggaggaaccuc

SEQ ID NO: 234678 - RNA, 64 nt, Homo Sapiens
aguacuguggcagagcugcuguuuucugaaggugagaagccauuuuuagcucagagcaacccuu

SEQ ID NO: 234679 - RNA, 64 nt, Homo Sapiens
agaaauugguuuucuucuucgagcaucucugcuaagaagccaaaucucugacagccaagacaug

SEQ ID NO: 234680 - RNA, 64 nt, Homo Sapiens
ccaaccuugcuuucaagcaagaguuauucccugaagaagccacacacagccagauuucagcuuu

SEQ ID NO: 234681 - RNA, 64 nt, Homo Sapiens
gcauucagaaacugcaggagacaagaugaauuugagaagccaaauggaauuuuuaauggaaacc

SEQ ID NO: 234682 - RNA, 64 nt, Homo Sapiens
cgacugugcuuguccauuauuuuacacaugcccuagaagccaaaacugaaagccacuggauccu

SEQ ID NO: 234683 - RNA, 64 nt, Homo Sapiens
uccaucuuuggggguggaaggacuugacaugaaaagaagccagucccaugacuuuggaugacaa

SEQ ID NO: 234684 - RNA, 64 nt, Homo Sapiens
ugcucccacggcagcaccaucaacucaacaagucagaagccaaguggaucaucuguguccccuu

SEQ ID NO: 234685 - RNA, 64 nt, Homo Sapiens
uguugguaggcauuaaugaguauuuucagucaucagaagccagcagacccucacugaauaagag

SEQ ID NO: 234686 - RNA, 64 nt, Homo Sapiens
uggugcucgcaauugugcuuccaggaguucuaugagaagccaaauaacccugugaacacccaag

SEQ ID NO: 234687 - RNA, 64 nt, Homo Sapiens
uaacuuucacauuccuaagcuggcuucccggcacagaagccauggauuuccccucucucccuuc

SEQ ID NO: 234688 - RNA, 64 nt, Homo Sapiens
uauuaaucacguaucgcagggcuccagcuguuuuagaagccacaucauguuaaacauuaacugg

SEQ ID NO: 234689 - RNA, 64 nt, Homo Sapiens
uguugacccaagggccgugguccacgguacuugaagaagccagagcccacauccugugcacugc

SEQ ID NO: 234690 - RNA, 64 nt, Homo Sapiens
ggaccgucacucagacugagacuugaguuauuacagaagccaggaaaaguguauuagaaacugu

SEQ ID NO: 234691 - RNA, 64 nt, Homo Sapiens
uuuaucuaacggcuacugaauuccugcuguauccagaagccaguguaagccuaguugcugaaau

SEQ ID NO: 234692 - RNA, 64 nt, Homo Sapiens
gggagaaagaacucagggcaccaaaagacagucgagaagccaggaucaaucuugaaauacucaa

SEQ ID NO: 234693 - RNA, 64 nt, Homo Sapiens
cuuugccuuuugcacacgcaccuggaaaagacacagaagccaaccugagaaccccuggugcuau

SEQ ID NO: 234694 - RNA, 64 nt, Homo Sapiens
ugauguuucggacugaccuaaaaacuaauugucgagaagccaagggugaggaggcaggaagcac

SEQ ID NO: 234695 - RNA, 64 nt, Homo Sapiens
cuaauuuucaugccuccugauucuguuucgaggcagaagccagaggacuugaccgaggucccac

SEQ ID NO: 234696 - RNA, 64 nt, Homo Sapiens
agucauguggcucgcagaugcuggccgcuggucaagaagccaacugagaaucugagggugaugu

SEQ ID NO: 234697 - RNA, 63 nt, Homo Sapiens
gaacugcucccacguccugcuccacgucuuuuucuccugcaaucauucagagguguggcuuuu

SEQ ID NO: 234698 - RNA, 63 nt, Homo Sapiens
gauggugggaaagaaaaauuagaacacuuugggcuccugcaguuggguggguggguuugauug

SEQ ID NO: 234699 - RNA, 63 nt, Homo Sapiens
uacuugcuuauuugacaacgccccagcccagggcuccugcacucggcugcagaggccagaggc

SEQ ID NO: 234700 - RNA, 63 nt, Homo Sapiens
ccacgcccguccugccuguggggccuggagauccuccugcagagacuguagggagggcggcag

SEQ ID NO: 234701 - RNA, 63 nt, Homo Sapiens
guuuaauuuguuaucauguagacaguuuaaguucuccugcaagucacaggaagacuuuguaag

SEQ ID NO: 234702 - RNA, 63 nt, Homo Sapiens
gucucaagcaaccauauauucagcagcaguacucuccugcacaaccaacagucugucagugua

SEQ ID NO: 234703 - RNA, 63 nt, Homo Sapiens
acuuuuuccuucugaaaauaacaaaucugauggcuccugcagcagggagcuguauuccuuuau

SEQ ID NO: 234704 - RNA, 63 nt, Homo Sapiens
gcaacaaaaugugugucaccuugaacuaugagucuccugcauggaaaaaagcaagauugaaau

SEQ ID NO: 234705 - RNA, 63 nt, Homo Sapiens
ucggggccccugcguguguugcgccugcgccuccuccugcaugguccucuguccgucuguccu

SEQ ID NO: 234706 - RNA, 63 nt, Homo Sapiens
cggacuccgggguucggaucggccugggucccccuccugcacggggcggggcgagggcggcgg

SEQ ID NO: 234707 - RNA, 63 nt, Homo Sapiens
gccaggaccgagcucuuccugcuguuugccggccuccugcagagguaccgccugcugcccccg

SEQ ID NO: 234708 - RNA, 63 nt, Homo Sapiens
gcgugcgagcccugcaccccccagguccugggacuccugcagaccccacuccauucccgcucc

SEQ ID NO: 234709 - RNA, 63 nt, Homo Sapiens
uuggguuccuaagucagcaauaggcugaaauggcuccugcacuaaaauucgcugggaggccaa

SEQ ID NO: 234710 - RNA, 63 nt, Homo Sapiens
gauuggagaagguagaggagaagggggacuuaucuccugcagaaguauaacugauaugauaug

SEQ ID NO: 234711 - RNA, 63 nt, Homo Sapiens
cugaccccaggcagcucgagccagucaaguucccuccugcagcggaucccagcaucucagagu

SEQ ID NO: 234712 - RNA, 63 nt, Homo Sapiens
aauggaacuccccagggccuucuguccagccagcuccugcacaacagcuuccugagucacccc

SEQ ID NO: 234713 - RNA, 63 nt, Homo Sapiens
gcacuucugccguccacaucugcccagcaccaccuccugcacuccucccgucugugagcuccc

SEQ ID NO: 234714 - RNA, 63 nt, Homo Sapiens
cugacaagcucaucacugaacuuccgucauuaccuccugcaguacagaacuccacauauacaa

SEQ ID NO: 234715 - RNA, 63 nt, Homo Sapiens
ugcacaaaaacaagugguggcaugauuccuucucuccugcaauaaucaaacucaaccaggagg

SEQ ID NO: 234716 - RNA, 63 nt, Homo Sapiens
agcuguaggacucuugaauuugcuggaaacacacuccugcagacucacacaugaucuucagag

SEQ ID NO: 234717 - RNA, 63 nt, Homo Sapiens
uuggaagcacaauuuuccccgauccggcucauucuccugcaagcagccgggcucucuaguggu

SEQ ID NO: 234718 - RNA, 63 nt, Homo Sapiens
cuggaaagaggagggaggccggcaaggugggaccuccugcagcgggcaaggcgguggguggug

SEQ ID NO: 234719 - RNA, 63 nt, Homo Sapiens
cauauguacauguacccaccacaaacgugcaagcuccugcacacaugcaugcacacaaacgug

SEQ ID NO: 234720 - RNA, 63 nt, Homo Sapiens
cacgcacacguacauucacuacaaacgugcagccuccugcacacgugcacauucauguguaca

SEQ ID NO: 234721 - RNA, 63 nt, Homo Sapiens
ugcacauguacgcaccacaaacacaugcgcaggcuccugcaggcgugaauacacacaugcaca

SEQ ID NO: 234722 - RNA, 63 nt, Homo Sapiens
ucuccucuccccuccuucccccaccacaggucucuccugcauaggcagccacuguccguucuu

SEQ ID NO: 234723 - RNA, 63 nt, Homo Sapiens
gccaaccacggagaugugccaagcaucucaucucuccugcacacuuuagucagaaggacuucu

SEQ ID NO: 234724 - RNA, 63 nt, Homo Sapiens
cugcccacguguggccuccgcuggcucugccugcuccugcaacagugcggucccugcccggag

SEQ ID NO: 234725 - RNA, 63 nt, Homo Sapiens
acacaugcugucacgcauacacacacgcacauacuccugcacauguucccaugcaugugugug

SEQ ID NO: 234726 - RNA, 63 nt, Homo Sapiens
uaccugccccccuucacacacugggacugaggccuccugcagguguuccucaauagcuggggg

SEQ ID NO: 234727 - RNA, 63 nt, Homo Sapiens
guugugggguggaacaggguggugggcuagggccuccugcaggcaguccccugggugucagaa

SEQ ID NO: 234728 - RNA, 63 nt, Homo Sapiens
gcccugccucccaagccccgcagagaacauggucuccugcaggagcugggaucugccugagga

SEQ ID NO: 234729 - RNA, 63 nt, Homo Sapiens
ccacggagccccugcugccacccccugcugggucuccugcauuuccguccacacuggccggca

SEQ ID NO: 234730 - RNA, 63 nt, Homo Sapiens
gcuccuuuccaaacacuguagucauagucaucccuccugcacuuacuccaggcuugcuucgga

SEQ ID NO: 234731 - RNA, 63 nt, Homo Sapiens
ccuuugaucggggacuuacuuuccaccuaccaccuccugcaccaaaccuaccaucuguucaac

SEQ ID NO: 234732 - RNA, 63 nt, Homo Sapiens
cagaacccgaguagugcaagccacccucugccccuccugcagucacagggacuaggacaucga

SEQ ID NO: 234733 - RNA, 63 nt, Homo Sapiens
gaguugcucucaguuccuucgaggcuggcagcccuccugcaauucuugccuugggacacucuu

SEQ ID NO: 234734 - RNA, 63 nt, Homo Sapiens
auggagcaaucagucaugugaccugcuccuuuucuccugcagcacagguaacugacuguuccc

SEQ ID NO: 234735 - RNA, 63 nt, Homo Sapiens
gugcguccggccgccugagccucucgccagccacuccugcaguuucaugucccugcggcuggc

SEQ ID NO: 234736 - RNA, 64 nt, Homo Sapiens; identical to SEQ ID NO: 234645

SEQ ID NO: 234737 - RNA, 64 nt, Homo Sapiens; identical to SEQ ID NO: 234646

SEQ ID NO: 234738 - RNA, 64 nt, Homo Sapiens; identical to SEQ ID NO: 234647

SEQ ID NO: 234739 - RNA, 64 nt, Homo Sapiens; identical to SEQ ID NO: 234648

SEQ ID NO: 234740 - RNA, 64 nt, Homo Sapiens; identical to SEQ ID NO: 234649

SEQ ID NO: 234741 - RNA, 64 nt, Homo Sapiens; identical to SEQ ID NO: 234650

SEQ ID NO: 234742 - RNA, 64 nt, Homo Sapiens; identical to SEQ ID NO: 234651

SEQ ID NO: 234743 - RNA, 64 nt, Homo Sapiens; identical to SEQ ID NO: 234652

SEQ ID NO: 234744 - RNA, 64 nt, Homo Sapiens; identical to SEQ ID NO: 234653

SEQ ID NO: 234745 - RNA, 64 nt, Homo Sapiens; identical to SEQ ID NO: 234654

SEQ ID NO: 234746 - RNA, 64 nt, Homo Sapiens; identical to SEQ ID NO: 234655

SEQ ID NO: 234747 - RNA, 64 nt, Homo Sapiens; identical to SEQ ID NO: 234656

SEQ ID NO: 234748 - RNA, 64 nt, Homo Sapiens; identical to SEQ ID NO: 234657

SEQ ID NO: 234749 - RNA, 64 nt, Homo Sapiens; identical to SEQ ID NO: 234658

SEQ ID NO: 234750 - RNA, 64 nt, Homo Sapiens; identical to SEQ ID NO: 234659

SEQ ID NO: 234751 - RNA, 64 nt, Homo Sapiens; identical to SEQ ID NO: 234660

SEQ ID NO: 234752 - RNA, 64 nt, Homo Sapiens; identical to SEQ ID NO: 234661

SEQ ID NO: 234753 - RNA, 64 nt, Homo Sapiens; identical to SEQ ID NO: 234662

SEQ ID NO: 234754 - RNA, 64 nt, Homo Sapiens; identical to SEQ ID NO: 234663

SEQ ID NO: 234755 - RNA, 64 nt, Homo Sapiens; identical to SEQ ID NO: 234664

SEQ ID NO: 234756 - RNA, 64 nt, Homo Sapiens; identical to SEQ ID NO: 234665

SEQ ID NO: 234757 - RNA, 63 nt, Homo Sapiens; identical to SEQ ID NO: 234666

SEQ ID NO: 234758 - RNA, 64 nt, Homo Sapiens; identical to SEQ ID NO: 234667

SEQ ID NO: 234759 - RNA, 64 nt, Homo Sapiens; identical to SEQ ID NO: 234668

SEQ ID NO: 234760 - RNA, 64 nt, Homo Sapiens; identical to SEQ ID NO: 234669

SEQ ID NO: 234761 - RNA, 64 nt, Homo Sapiens; identical to SEQ ID NO: 234670

SEQ ID NO: 234762 - RNA, 64 nt, Homo Sapiens; identical to SEQ ID NO: 234671

SEQ ID NO: 234763 - RNA, 64 nt, Homo Sapiens; identical to SEQ ID NO: 234672

SEQ ID NO: 234764 - RNA, 64 nt, Homo Sapiens; identical to SEQ ID NO: 234673

SEQ ID NO: 234765 - RNA, 64 nt, Homo Sapiens; identical to SEQ ID NO: 234674

SEQ ID NO: 234766 - RNA, 64 nt, Homo Sapiens; identical to SEQ ID NO: 234675

SEQ ID NO: 234767 - RNA, 64 nt, Homo Sapiens; identical to SEQ ID NO: 234676

SEQ ID NO: 234768 - RNA, 64 nt, Homo Sapiens; identical to SEQ ID NO: 234677

SEQ ID NO: 234769 - RNA, 64 nt, Homo Sapiens; identical to SEQ ID NO: 234678

SEQ ID NO: 234770 - RNA, 64 nt, Homo Sapiens; identical to SEQ ID NO: 234679

SEQ ID NO: 234771 - RNA, 64 nt, Homo Sapiens; identical to SEQ ID NO: 234680

SEQ ID NO: 234772 - RNA, 64 nt, Homo Sapiens; identical to SEQ ID NO: 234681

SEQ ID NO: 234773 - RNA, 64 nt, Homo Sapiens; identical to SEQ ID NO: 234682

SEQ ID NO: 234774 - RNA, 64 nt, Homo Sapiens; identical to SEQ ID NO: 234683

SEQ ID NO: 234775 - RNA, 64 nt, Homo Sapiens; identical to SEQ ID NO: 234684

SEQ ID NO: 234776 - RNA, 64 nt, Homo Sapiens; identical to SEQ ID NO: 234685

SEQ ID NO: 234777 - RNA, 64 nt, Homo Sapiens; identical to SEQ ID NO: 234686

SEQ ID NO: 234778 - RNA, 64 nt, Homo Sapiens; identical to SEQ ID NO: 234687

SEQ ID NO: 234779 - RNA, 64 nt, Homo Sapiens; identical to SEQ ID NO: 234688

SEQ ID NO: 234780 - RNA, 64 nt, Homo Sapiens; identical to SEQ ID NO: 234689

SEQ ID NO: 234781 - RNA, 64 nt, Homo Sapiens; identical to SEQ ID NO: 234690

SEQ ID NO: 234782 - RNA, 64 nt, Homo Sapiens; identical to SEQ ID NO: 234691

SEQ ID NO: 234783 - RNA, 64 nt, Homo Sapiens; identical to SEQ ID NO: 234692

SEQ ID NO: 234784 - RNA, 64 nt, Homo Sapiens; identical to SEQ ID NO: 234693

SEQ ID NO: 234785 - RNA, 64 nt, Homo Sapiens; identical to SEQ ID NO: 234694

SEQ ID NO: 234786 - RNA, 64 nt, Homo Sapiens; identical to SEQ ID NO: 234695

SEQ ID NO: 234787 - RNA, 64 nt, Homo Sapiens; identical to SEQ ID NO: 234696

SEQ ID NO: 234788 - RNA, 64 nt, Homo Sapiens; identical to SEQ ID NO: 78063

SEQ ID NO: 234789 - RNA, 64 nt, Homo Sapiens; identical to SEQ ID NO: 78064

SEQ ID NO: 234790 - RNA, 64 nt, Homo Sapiens; identical to SEQ ID NO: 78065

SEQ ID NO: 234791 - RNA, 64 nt, Homo Sapiens; identical to SEQ ID NO: 78066

SEQ ID NO: 234792 - RNA, 64 nt, Homo Sapiens; identical to SEQ ID NO: 78067

SEQ ID NO: 234793 - RNA, 64 nt, Homo Sapiens; identical to SEQ ID NO: 78068

SEQ ID NO: 234794 - RNA, 64 nt, Homo Sapiens; identical to SEQ ID NO: 78069

SEQ ID NO: 234795 - RNA, 64 nt, Homo Sapiens; identical to SEQ ID NO: 78070

SEQ ID NO: 234796 - RNA, 64 nt, Homo Sapiens; identical to SEQ ID NO: 78071

SEQ ID NO: 234797 - RNA, 64 nt, Homo Sapiens; identical to SEQ ID NO: 78072

SEQ ID NO: 234798 - RNA, 64 nt, Homo Sapiens; identical to SEQ ID NO: 234645

SEQ ID NO: 234799 - RNA, 64 nt, Homo Sapiens; identical to SEQ ID NO: 234646

SEQ ID NO: 234800 - RNA, 64 nt, Homo Sapiens; identical to SEQ ID NO: 234647

SEQ ID NO: 234801 - RNA, 64 nt, Homo Sapiens; identical to SEQ ID NO: 234648

SEQ ID NO: 234802 - RNA, 64 nt, Homo Sapiens; identical to SEQ ID NO: 234649

SEQ ID NO: 234803 - RNA, 64 nt, Homo Sapiens; identical to SEQ ID NO: 234650

SEQ ID NO: 234804 - RNA, 64 nt, Homo Sapiens; identical to SEQ ID NO: 234651

SEQ ID NO: 234805 - RNA, 64 nt, Homo Sapiens; identical to SEQ ID NO: 234652

SEQ ID NO: 234806 - RNA, 64 nt, Homo Sapiens; identical to SEQ ID NO: 234653

SEQ ID NO: 234807 - RNA, 64 nt, Homo Sapiens; identical to SEQ ID NO: 234654

SEQ ID NO: 234808 - RNA, 64 nt, Homo Sapiens; identical to SEQ ID NO: 234655

SEQ ID NO: 234809 - RNA, 64 nt, Homo Sapiens; identical to SEQ ID NO: 234656

SEQ ID NO: 234810 - RNA, 64 nt, Homo Sapiens; identical to SEQ ID NO: 234657

SEQ ID NO: 234811 - RNA, 64 nt, Homo Sapiens; identical to SEQ ID NO: 234658

SEQ ID NO: 234812 - RNA, 64 nt, Homo Sapiens; identical to SEQ ID NO: 234659

SEQ ID NO: 234813 - RNA, 64 nt, Homo Sapiens; identical to SEQ ID NO: 234660

SEQ ID NO: 234814 - RNA, 64 nt, Homo Sapiens; identical to SEQ ID NO: 234661

SEQ ID NO: 234815 - RNA, 64 nt, Homo Sapiens; identical to SEQ ID NO: 234662

SEQ ID NO: 234816 - RNA, 64 nt, Homo Sapiens; identical to SEQ ID NO: 234663

SEQ ID NO: 234817 - RNA, 64 nt, Homo Sapiens; identical to SEQ ID NO: 234664

SEQ ID NO: 234818 - RNA, 64 nt, Homo Sapiens; identical to SEQ ID NO: 234665

SEQ ID NO: 234819 - RNA, 63 nt, Homo Sapiens; identical to SEQ ID NO: 234666

SEQ ID NO: 234820 - RNA, 64 nt, Homo Sapiens; identical to SEQ ID NO: 234667

SEQ ID NO: 234821 - RNA, 64 nt, Homo Sapiens; identical to SEQ ID NO: 234668

SEQ ID NO: 234822 - RNA, 64 nt, Homo Sapiens; identical to SEQ ID NO: 234669

SEQ ID NO: 234823 - RNA, 64 nt, Homo Sapiens; identical to SEQ ID NO: 234670

SEQ ID NO: 234824 - RNA, 64 nt, Homo Sapiens; identical to SEQ ID NO: 234671

SEQ ID NO: 234825 - RNA, 64 nt, Homo Sapiens; identical to SEQ ID NO: 234672

SEQ ID NO: 234826 - RNA, 64 nt, Homo Sapiens; identical to SEQ ID NO: 234673

SEQ ID NO: 234827 - RNA, 64 nt, Homo Sapiens; identical to SEQ ID NO: 234674

SEQ ID NO: 234828 - RNA, 64 nt, Homo Sapiens; identical to SEQ ID NO: 234675

SEQ ID NO: 234829 - RNA, 64 nt, Homo Sapiens; identical to SEQ ID NO: 234676

SEQ ID NO: 234830 - RNA, 64 nt, Homo Sapiens; identical to SEQ ID NO: 234677

SEQ ID NO: 234831 - RNA, 64 nt, Homo Sapiens; identical to SEQ ID NO: 234678

SEQ ID NO: 234832 - RNA, 64 nt, Homo Sapiens; identical to SEQ ID NO: 234679

SEQ ID NO: 234833 - RNA, 64 nt, Homo Sapiens; identical to SEQ ID NO: 234680

SEQ ID NO: 234834 - RNA, 64 nt, Homo Sapiens; identical to SEQ ID NO: 234681

SEQ ID NO: 234835 - RNA, 64 nt, Homo Sapiens; identical to SEQ ID NO: 234682

SEQ ID NO: 234836 - RNA, 64 nt, Homo Sapiens; identical to SEQ ID NO: 234683

SEQ ID NO: 234837 - RNA, 64 nt, Homo Sapiens; identical to SEQ ID NO: 234684

SEQ ID NO: 234838 - RNA, 64 nt, Homo Sapiens; identical to SEQ ID NO: 234685

SEQ ID NO: 234839 - RNA, 64 nt, Homo Sapiens; identical to SEQ ID NO: 234686

SEQ ID NO: 234840 - RNA, 64 nt, Homo Sapiens; identical to SEQ ID NO: 234687

SEQ ID NO: 234841 - RNA, 64 nt, Homo Sapiens; identical to SEQ ID NO: 234688

SEQ ID NO: 234842 - RNA, 64 nt, Homo Sapiens; identical to SEQ ID NO: 234689

SEQ ID NO: 234843 - RNA, 64 nt, Homo Sapiens; identical to SEQ ID NO: 234690

SEQ ID NO: 234844 - RNA, 64 nt, Homo Sapiens; identical to SEQ ID NO: 234691

SEQ ID NO: 234845 - RNA, 64 nt, Homo Sapiens; identical to SEQ ID NO: 234692

SEQ ID NO: 234846 - RNA, 64 nt, Homo Sapiens; identical to SEQ ID NO: 234693

SEQ ID NO: 234847 - RNA, 64 nt, Homo Sapiens; identical to SEQ ID NO: 234694

SEQ ID NO: 234848 - RNA, 64 nt, Homo Sapiens; identical to SEQ ID NO: 234695

SEQ ID NO: 234849 - RNA, 64 nt, Homo Sapiens; identical to SEQ ID NO: 234696

SEQ ID NO: 234850 - RNA, 64 nt, Homo Sapiens; identical to SEQ ID NO: 78063

SEQ ID NO: 234851 - RNA, 64 nt, Homo Sapiens; identical to SEQ ID NO: 78064

SEQ ID NO: 234852 - RNA, 64 nt, Homo Sapiens; identical to SEQ ID NO: 78065

SEQ ID NO: 234853 - RNA, 64 nt, Homo Sapiens; identical to SEQ ID NO: 78066

SEQ ID NO: 234854 - RNA, 64 nt, Homo Sapiens; identical to SEQ ID NO: 78067

SEQ ID NO: 234855 - RNA, 64 nt, Homo Sapiens; identical to SEQ ID NO: 78068

SEQ ID NO: 234856 - RNA, 64 nt, Homo Sapiens; identical to SEQ ID NO: 78069

SEQ ID NO: 234857 - RNA, 64 nt, Homo Sapiens; identical to SEQ ID NO: 78070

SEQ ID NO: 234858 - RNA, 64 nt, Homo Sapiens; identical to SEQ ID NO: 78071

SEQ ID NO: 234859 - RNA, 64 nt, Homo Sapiens; identical to SEQ ID NO: 78072

SEQ ID NO: 234860 - RNA, 64 nt, Homo Sapiens
caucuuucucuacuguaaagugauuuuguuugcagguaagaaaauaauagaugacucaccacac

SEQ ID NO: 234861 - RNA, 64 nt, Homo Sapiens
guaaagcagaucuguggauggggagccuacgggugguaagaagugguguuuuguguuucaucuc

SEQ ID NO: 234862 - RNA, 64 nt, Homo Sapiens
ggaagagccucccauaaaaucacaccuacucugugguaagaauaaaaucccacccaccugggac

SEQ ID NO: 234863 - RNA, 64 nt, Homo Sapiens
uuccugugugggagcccauagcuguugucuaacagguaagaaaugaaauugaacuauugacugg

SEQ ID NO: 234864 - RNA, 64 nt, Homo Sapiens
aucuaagaaggaauuaccuuugacaauauuuuucgguaagaaguaaaaccucuggagaccuauc

SEQ ID NO: 234865 - RNA, 64 nt, Homo Sapiens
uguuaaaaggguccuuuugaagcaauuaagugcugguaagaauauuucucuguuguugccaggu

SEQ ID NO: 234866 - RNA, 64 nt, Homo Sapiens
ugaaggucaagcccauagacacacacucucugcugguaagaaaccauagcccagaacugagcca

SEQ ID NO: 234867 - RNA, 64 nt, Homo Sapiens
agaguuuuauugugucuauggcagguuugggaaagguaagaaauggguccuuuuuccuccuaau

SEQ ID NO: 234868 - RNA, 64 nt, Homo Sapiens
ucaucuaugauaugagugagauaauuaugggagugguaagaauuaugacuugaauucuucuuug

SEQ ID NO: 234869 - RNA, 64 nt, Homo Sapiens
uuuuuuuccuuuagucuuuucuuuagugggggaggguaagaaaagcaguuugcacuuaaaaaga

SEQ ID NO: 234870 - RNA, 64 nt, Homo Sapiens
auuuuuuuuuuuuuggcaucuuuggggugaacaagguaagaaaguuaguccagauuugagaaag

SEQ ID NO: 234871 - RNA, 64 nt, Homo Sapiens
gagaauuagccagcccuguguaaacacguuuuuugguaagaaaauggagaaguuugaaucaaca

SEQ ID NO: 234872 - RNA, 64 nt, Homo Sapiens
ugggcauugcuuggcucuuuaaaauuuguugauugguaagaaauaucugcauuauaauagcucu

SEQ ID NO: 234873 - RNA, 64 nt, Homo Sapiens
ggacuugaggucccaggagaaauaugcuuauagugguaagaaauuguuuugauauauaucuguu

SEQ ID NO: 234874 - RNA, 64 nt, Homo Sapiens
uauaaaaugagguuuauuuugccugaauauuccagguaagaaaacuuggcucacguauuuaaga

SEQ ID NO: 234875 - RNA, 64 nt, Homo Sapiens
aaucuuugcuaauuuuuuuuuuacugagucccaugguaagaaagaagauauugauguaauaaca

SEQ ID NO: 234876 - RNA, 64 nt, Homo Sapiens
uaaauaagaggagaaggaaguucuccauauccuggguaagaaugagaaauuaaggucuauucca

SEQ ID NO: 234877 - RNA, 64 nt, Homo Sapiens
aaacagauuucuacagacugugauauuggauguugguaagaauaccagagcuaugccauggaaa

SEQ ID NO: 234878 - RNA, 64 nt, Homo Sapiens
cuacccaugcaugauguagaaaaaaaaaagaugggguaagaaaacucugcguuaauuauugagg

SEQ ID NO: 234879 - RNA, 64 nt, Homo Sapiens
caagugaagcuuggugcaagucaaaucuuuuaaugguaagaaagcuucaucuuucccuuucccu

SEQ ID NO: 234880 - RNA, 64 nt, Homo Sapiens
gaaaauagacugggagugggaggccugagguccagguaagaagggacgcugcuaccugagggga

SEQ ID NO: 234881 - RNA, 64 nt, Homo Sapiens
acuaauggaaaauaaugaaaucauuuuuuuuugugguaagaauagauaaaauugcuuuuccagg

SEQ ID NO: 234882 - RNA, 64 nt, Homo Sapiens
auuaaugcaguuuugcacaauaccccuauuagaugguaagaacacauugcguguucuuaaguuu

SEQ ID NO: 234883 - RNA, 64 nt, Homo Sapiens
uggggcaugugcaaagcaagcaaggaacauuugggguaagaaaacaaacaugaggcaaaagaaa

SEQ ID NO: 234884 - RNA, 64 nt, Homo Sapiens
agaauacauuaaaauaaaaaacuugccccuacuagguaagaacuuuauaaugaagacauacauu

SEQ ID NO: 234885 - RNA, 64 nt, Homo Sapiens
ucaaaagaaaugauugacuugagggucucuguuugguaagaauacaucauuagcuuaaauaagc

SEQ ID NO: 234886 - RNA, 64 nt, Homo Sapiens
ccuacaacuuuggaaaugcuggggucccuggugugguaagaaacucaacaucagacggguaugc

SEQ ID NO: 234887 - RNA, 64 nt, Homo Sapiens
uugguugcuguugaguuuuuguuuugucuucugugguaagaacacuuaacucaagaccuacccu

SEQ ID NO: 234888 - RNA, 64 nt, Homo Sapiens
auucaagaaguuauugucuaagagaugagcaguagguaagaaaaccucagucauugacucuuca

SEQ ID NO: 234889 - RNA, 64 nt, Homo Sapiens
aaugaacuagaagauauuaaaaacauuugacauugguaagaaauauugauacugauauugauuu

SEQ ID NO: 234890 - RNA, 64 nt, Homo Sapiens
auacauuuuuuuggacuuuguuauaauucauugugguaagaaugauugaaaugcagauuuaaca

SEQ ID NO: 234891 - RNA, 64 nt, Homo Sapiens
uuaaaguugugaagaaauuguuaauugccagacagguaagaaaauguuuauaaucuaucucauu

SEQ ID NO: 234892 - RNA, 64 nt, Homo Sapiens
uuuucaaaacucggugaaaguuacaaguuugcaugguaagaauaaaauaagaauauugaaacug

SEQ ID NO: 234893 - RNA, 64 nt, Homo Sapiens
cuucuguuccuggaagacccaucaugcagaauuggguaagaauggguuuagaugaagcaagguu

SEQ ID NO: 234894 - RNA, 64 nt, Homo Sapiens
aguuuuuaacugcuuuguaagaauagcaugcaaggguaagaaugaggcagccaucauaaccauu

SEQ ID NO: 234895 - RNA, 64 nt, Homo Sapiens
uguauucauauaaucugccuuuauuuguagcagagguaagaauaaugaaggguuugggguguuu

SEQ ID NO: 234896 - RNA, 64 nt, Homo Sapiens
guguugaaaauucacaguuuaccugaaaagguuggguaagaauauccaaauuacaggaaaugaa

SEQ ID NO: 234897 - RNA, 64 nt, Homo Sapiens
gcaccuagcuuuucauauugugugggugggaaucgguaagaaauggggagugggaauaugcgug

SEQ ID NO: 234898 - RNA, 64 nt, Homo Sapiens
aacuguauuaaguagauguaccagguuuacaauagguaagaauaaacgcauauucuauaggaag

SEQ ID NO: 234899 - RNA, 64 nt, Homo Sapiens
aaauauguaaaagagauaauaaguaguaaaauaagguaagaaguaaauaagugaauaaacaaau

SEQ ID NO: 234900 - RNA, 64 nt, Homo Sapiens
uucauuuaagucaggguuacuuuaauuaaacuuagguaagaagagggagaaaauuaagggccga

SEQ ID NO: 234901 - RNA, 64 nt, Homo Sapiens
gaaccuaagucauaguuguaaccuacagcugauugguaagaacuaugggccagacauuuaaucu

SEQ ID NO: 234902 - RNA, 64 nt, Homo Sapiens
guuacaguggaaucuggugcuugucaggguguuugguaagaacuguauauagucagaauuaccu

SEQ ID NO: 234903 - RNA, 61 nt, Homo Sapiens
gguuugauacugaccuguaaaucauccuuuagguaagaaguuuuaaaaagccaguuugggu

SEQ ID NO: 234904 - RNA, 64 nt, Homo Sapiens
aaauuaaagacccacauucugcuuucuuacucaugguaagaaaaguggccaugaguagagauug

SEQ ID NO: 234905 - RNA, 64 nt, Homo Sapiens
ugcaaaccuguuauaaguuaaaaaaaaagaaguggguaagaaaaccucggcuuuuaauuuaaaa

SEQ ID NO: 234906 - RNA, 64 nt, Homo Sapiens
uacaucagcuggcagccccaaggcccucaucugagguaagaaugucugaggcaucggccagucc

SEQ ID NO: 234907 - RNA, 64 nt, Homo Sapiens
ugcagccggagccucaguccggacaacuacaauagguaagaaaacagccauauuuggggaggau

SEQ ID NO: 234908 - RNA, 64 nt, Homo Sapiens
cacuaaccuuuugauuugauuuccucagugagcugguaagaaugucuuuuuucuggaccucagu

SEQ ID NO: 234909 - RNA, 64 nt, Homo Sapiens
ggaguuauguuuuuaaauuucaugcuguucucaugguaagaacuagaagauccuucgugaucac

SEQ ID NO: 234910 - RNA, 64 nt, Homo Sapiens
aacuuuaauaaaauaguuagcuaauagaaaaacagguaagaauaaagcaauguugccuuaauuu

SEQ ID NO: 234911 - RNA, 64 nt, Homo Sapiens
uaguagggacuccauggaauauuugcccaguaaugguaagaaaucuuucggguaagaguaugga

SEQ ID NO: 234912 - RNA, 64 nt, Homo Sapiens
gagaaaaggauugagaaggauaaacuggaauccugguaagaagccuuuaugccagcccgacacc

SEQ ID NO: 234913 - RNA, 64 nt, Homo Sapiens
cuuaaagccaaaagucugcuuuagcaaucuuuuugguaagaacuugagccccucucauuccacu

SEQ ID NO: 234914 - RNA, 64 nt, Homo Sapiens
uuaauggcuucacuugaauugaacaguccagacugguaagaaaaaacugugaagugacauguca

SEQ ID NO: 234915 - RNA, 64 nt, Homo Sapiens
uuuaugccugaauaacauuuuugagggaacaguggguaagaaacuacuagggucaaaaaugaau

SEQ ID NO: 234916 - RNA, 64 nt, Homo Sapiens
ggaaacaaguagaaaucagcaguggagugucugugguaagaaaacaugaacuuuaugcuucacu

SEQ ID NO: 234917 - RNA, 64 nt, Homo Sapiens
uguacauaugugcaaaaaaaaauccacuugcaaugguaagaaauugaaguauccuuaaaggcca

SEQ ID NO: 234918 - RNA, 64 nt, Homo Sapiens
ugaaaguuuauaguuuuauauuuggaccuugaaagguaagaaaaaaccagguucuccaaaguua

SEQ ID NO: 234919 - RNA, 64 nt, Homo Sapiens
gagugggcugaauccaguucauuguuuuuuuuuugguaagaagugagacuacaguuccagcuac

SEQ ID NO: 234920 - RNA, 64 nt, Homo Sapiens
gaauucagggaagagcagcgugggguguaggguugguaagaaaaugguugucagguuagaagga

SEQ ID NO: 234921 - RNA, 64 nt, Homo Sapiens
gcaauuuaaagucagcgagcaacugaacugagaagguaagaaaacaucaauugagguacggaga

SEQ ID NO: 234922 - RNA, 64 nt, Homo Sapiens
ccccuucuuuggcugggaauuaaacugugggauggguaagaaauccacaaacaaaauuaagauu

SEQ ID NO: 234923 - RNA, 64 nt, Homo Sapiens
aagcaaaagcaagggaccuuuccgaugguaucuggguaagaagacaagugccaaacagaguaug

SEQ ID NO: 234924 - RNA, 64 nt, Homo Sapiens
gagaagggaggcaugaggcggagggaggggccaagguaagaacugcaaagaccuugacaggaaa

SEQ ID NO: 234925 - RNA, 64 nt, Homo Sapiens
uauacuuugugggauaaaacuugggaaugagugugguaagaaauuuauaaaguuuugcuuuuaa

SEQ ID NO: 234926 - RNA, 64 nt, Homo Sapiens
aauagguggaugguaaguugaaauuauugauguggguaagaagggagguuguggaaaguuaaca

SEQ ID NO: 234927 - RNA, 64 nt, Homo Sapiens
ccugacaacuucugaauauugggaguggggaggugguaagaacauggaagcagggacugguuga

SEQ ID NO: 234928 - RNA, 64 nt, Homo Sapiens
aagacauuuguagauuuuaauuaguuguuuuaaugguaagaauuauugguuuuggguuuuguuu

SEQ ID NO: 234929 - RNA, 64 nt, Homo Sapiens
uucagcuggucuggguccuccaaaaggcuuaccugguaagaauaacuguaaucugaagcuucaa

SEQ ID NO: 234930 - RNA, 64 nt, Homo Sapiens
agucgucaaaucuaaugucaaguucucuuaagcagguaagaacucagaacauaauaccugagug

SEQ ID NO: 234931 - RNA, 64 nt, Homo Sapiens
caaagccuuuaaaugguugucacacuugauuguagguaagaauccauacugaagaaaacuccug

SEQ ID NO: 234932 - RNA, 64 nt, Homo Sapiens
uuuauaugaaggaauagccugaacucaaacagaugguaagaauaguacaaacaccuuagcacau

SEQ ID NO: 234933 - RNA, 64 nt, Homo Sapiens
aagggguugcuaggggguggggacggcuaaccaggguaagaauguucagggggcugcccaggag

SEQ ID NO: 234934 - RNA, 64 nt, Homo Sapiens
ggaucgguggagagccugucgagaccugguccaggguaagaauggacuuccccaagccgcaggu

SEQ ID NO: 234935 - RNA, 64 nt, Homo Sapiens
gcuuucauuugucugguagaugccugggagaugggguaagaagaucagagcccuugcugggggg

SEQ ID NO: 234936 - RNA, 64 nt, Homo Sapiens
augcuguuuuguuucaugaucagcuuuaaguuucgguaagaaaccaaagcuacuguuccuaguc

SEQ ID NO: 234937 - RNA, 64 nt, Homo Sapiens
ggauguaaggcagcugguguggauaaaaaucaaggguaagaagaaugaagcaggaucaaugaug

SEQ ID NO: 234938 - RNA, 64 nt, Homo Sapiens
cagccccaguaaucaguaagauucccacaguuuugguaagaaaccuagcuauuuggaauaaccg

SEQ ID NO: 234939 - RNA, 64 nt, Homo Sapiens
auaacuuagucuuuauuuugcgcuucauauguuggguaagaaacuuagaggugcaucacacauc

SEQ ID NO: 234940 - RNA, 64 nt, Homo Sapiens
uggguuguguacuuucugguauggcagcaggcuggguaagaagcaaaugguuugauaguugaug

SEQ ID NO: 234941 - RNA, 64 nt, Homo Sapiens
aauaaugaguaaaugguaagaaguaaaucugagagguaagaaguuuuuaaaagauuaucucaga

SEQ ID NO: 234942 - RNA, 64 nt, Homo Sapiens
ccuuuuacagacauucuuuaaauauauucugcacgguaagaauuguaacuguauuuaccaugau

SEQ ID NO: 234943 - RNA, 64 nt, Homo Sapiens
uauuucuauuuuuauaaauugugugauaauuagagguaagaauaacaaguaacuauaaacgggu

SEQ ID NO: 234944 - RNA, 64 nt, Homo Sapiens
uggcuuauucacaacugggcaagaaaacaucauugguaagaacugcugagugugcccuuagaaa

SEQ ID NO: 234945 - RNA, 64 nt, Homo Sapiens
uaccuucaaucuucaacuaaagauuucuaaaagggguaagaaaugaggcaguaguuuauuaaau

SEQ ID NO: 234946 - RNA, 64 nt, Homo Sapiens
aaugaaugucuuuuuucaaaccuuaaagggagaugguaagaaacgagauuguuuucuuuuucua

SEQ ID NO: 234947 - RNA, 64 nt, Homo Sapiens
acuguaucuacaccuguucuuaucccugaggguggguaagaaggagcugggccuuucccucucu

SEQ ID NO: 234948 - RNA, 64 nt, Homo Sapiens
gcuggauuuuuuagaaaagaggcuggaucggguagguaagaauacucuucagaguggaagggcu

SEQ ID NO: 234949 - RNA, 64 nt, Homo Sapiens
gagaucucaauucucuguguccaacaggauauuagguaagaaaguacaaagauaaaccuggacu

SEQ ID NO: 234950 - RNA, 64 nt, Homo Sapiens
ucugucaugcuuauuucaaacucccugagugauggguaagaaaucaaacauugccucaguggua

SEQ ID NO: 234951 - RNA, 64 nt, Homo Sapiens
ucccagccccugcagauucugagcaaaggcccuggguaagaagggugggaguggggccuuugcc

SEQ ID NO: 234952 - RNA, 64 nt, Homo Sapiens
aggcaguuaaguggagaaccagguuucaaaaucagguaagaaaaccaucaucauuaacugagca

SEQ ID NO: 234953 - RNA, 64 nt, Homo Sapiens
gaaugauaggcuugucagagauuucuguucaccugguaagaaaaguuucuggcauuagcagaug

SEQ ID NO: 234954 - RNA, 64 nt, Homo Sapiens
uccacuaaugagucacaagaaaaggaguggauuugguaagaauagagauuuguuuuauuuaaac

SEQ ID NO: 234955 - RNA, 64 nt, Homo Sapiens
uuuucuuaaaguguguaaauaguuuauuuauagggguaagaauguucucacaccauuucacuuc

SEQ ID NO: 234956 - RNA, 64 nt, Homo Sapiens
uccacaaaugaagggauauaaaaauaaugucauagguaagaaacacagcaacaaugacuuaacc

SEQ ID NO: 234957 - RNA, 64 nt, Homo Sapiens
uauuagucugguagauaaaaugaaaaaccacucagguaagaacacucacucauggcaguuuuua

SEQ ID NO: 234958 - RNA, 64 nt, Homo Sapiens
ccccucccccgacacagacucucaaucugccggugguaagaaccgguucugagcuggcgucuga

SEQ ID NO: 234959 - RNA, 64 nt, Homo Sapiens
cuuuuuuucauuucaaacuugaaacugugaauaagguaagaaaacuauuuugaauaaauaaacu

SEQ ID NO: 234960 - RNA, 64 nt, Homo Sapiens
cgggaacagacaacagaaguaacaagaauuucuugguaagaagcacaaucuagaaaaccaaaag

SEQ ID NO: 234961 - RNA, 64 nt, Homo Sapiens
cuguauuuuuuuucccugaaacacuggauaauuugguaagaaaaaaaauucuaaccagucauau

SEQ ID NO: 234962 - RNA, 64 nt, Homo Sapiens
aauacuaccgaaguaaaauaaagccuauguauuugguaagaagaauagguucuguuuuuucuug

SEQ ID NO: 234963 - RNA, 64 nt, Homo Sapiens
auauuuaaucaugacaugcauuuagggugacugugguaagaaggcuaguccuaagcuuugguuc

SEQ ID NO: 234964 - RNA, 64 nt, Homo Sapiens
cauccucucuuggccuuacugaagaugggggaaggguaagaaggaaggguguaggccaaggcuc

SEQ ID NO: 234965 - RNA, 64 nt, Homo Sapiens
gaaacugaacucaccauuucuauuaauuucuguugguaagaacuuggugagaaugccccgugga

SEQ ID NO: 234966 - RNA, 64 nt, Homo Sapiens
agaggggcuaaggauagucagcgagcuggacugggguaagaaagaaaaccagauguccuagggc

SEQ ID NO: 234967 - RNA, 64 nt, Homo Sapiens
uccuaauuaaaagguuuuuuuuaaaucauaacuugguaagaaacauuuacacaucugauaaaua

SEQ ID NO: 234968 - RNA, 64 nt, Homo Sapiens
auuguaaaaaaaaauuacaauaaauuaagaucaagguaagaaacgaggucuuccuaguguuacu

SEQ ID NO: 234969 - RNA, 64 nt, Homo Sapiens
acuaguuccucuaguuguuguaggaaucuucccagguaagaagauaagaaaccuaauuugugcu

SEQ ID NO: 234970 - RNA, 64 nt, Homo Sapiens
gucgcuccacuuuacagagguuaggccugacugggguaagaaauuuggcuccucaggccaccau

SEQ ID NO: 234971 - RNA, 64 nt, Homo Sapiens
ugaaguucuaaugaacuguuauuuaauucuucacgguaagaaaacuucagaacagguuuuuagu

SEQ ID NO: 234972 - RNA, 64 nt, Homo Sapiens
guagauguggccuuugaauugacaaaagagcagugguaagaauacaaagucauuaaagacagga

SEQ ID NO: 234973 - RNA, 64 nt, Homo Sapiens
agauauugguaccaagaaaagugguugugguggugguaagaaggaaagcuuugccucccauucu

SEQ ID NO: 234974 - RNA, 64 nt, Homo Sapiens
aaaggacuuauagccaauugauuguucuaggccagguaagaauggauauggacaugcauuuauu

SEQ ID NO: 234975 - RNA, 64 nt, Homo Sapiens
caccaagcaauuaugguggaccuauuacccuauggguaagaaauaaauggaaauaugacaucgg

SEQ ID NO: 234976 - RNA, 64 nt, Homo Sapiens
aucuguguuuuuuaaauugaucguucuucauggggguaagaaaagcuggucuggaguugcugaa

SEQ ID NO: 234977 - RNA, 64 nt, Homo Sapiens
gaauuucuuucccuaaagaaauguguggcccagagguaagaauaguucuuguuagaaucauggg

SEQ ID NO: 234978 - RNA, 64 nt, Homo Sapiens
gcuacagucauuuuuucuuuugucaauauuuugugguaagaaaaaguaggcuauaagggaagau

SEQ ID NO: 234979 - RNA, 64 nt, Homo Sapiens
uucuaucaguuauugaaacuaaaauuagggucuugguaagaaauaaauuaacauuuuugaugcc

SEQ ID NO: 234980 - RNA, 64 nt, Homo Sapiens
guaauugaagccaauuauuucugacaagaauuaggguaagaacaaaaugaugauaaagauguuu

SEQ ID NO: 234981 - RNA, 64 nt, Homo Sapiens
agcuuucaacucauaggcuugaacaguaaacauugguaagaaugauuucaagauauuuguaaaa

SEQ ID NO: 234982 - RNA, 64 nt, Homo Sapiens
caaggaaggcucuguuaauuaguuaaaaaucucagguaagaaggcccauccuagcuucugugag

SEQ ID NO: 234983 - RNA, 64 nt, Homo Sapiens
ugcccauuguucagaggcaaagcagccccugccugguaagaaggggucugcugaccuuuaccua

SEQ ID NO: 234984 - RNA, 64 nt, Homo Sapiens
aaaaaagaaauggauaaacuuggccuuucuaagugguaagaaugaccugucacuauaauauacu

SEQ ID NO: 234985 - RNA, 64 nt, Homo Sapiens
uuaaggaacuuagccuuggauuccugaauagaaagguaagaauucuaucauucuggaguugaug

SEQ ID NO: 234986 - RNA, 64 nt, Homo Sapiens
uaaaauauuuauuugaaguagaggguaaaucagcgguaagaacagugaacacagugguugggau

SEQ ID NO: 234987 - RNA, 64 nt, Homo Sapiens
ugagaccagccugggcaaaaggaagaucucuugagguaagaauuugcuuugaagggccaaaggg

SEQ ID NO: 234988 - RNA, 64 nt, Homo Sapiens
cugauagcuccuccauguugugucaaggaagaaagguaagaaaguugaaguucaugaaucuugc

SEQ ID NO: 234989 - RNA, 64 nt, Homo Sapiens
auggaacaaauuuuuaucuaaaaccugggaguaagguaagaaaacaccaagcagaugauugaua

SEQ ID NO: 234990 - RNA, 64 nt, Homo Sapiens
guguggcugcuucccuuguaaauaguuguucucugguaagaagccaaauauuuaagcucacuuc

SEQ ID NO: 234991 - RNA, 64 nt, Homo Sapiens
cugagguuaaaaacaaaaaguacgugaccagucugguaagaaguauuaaugaaguagcuaauau

SEQ ID NO: 234992 - RNA, 64 nt, Homo Sapiens
aaugcacaguauaaagaacuuacacaauauaccagguaagaauccuacaauuacuucagguagc

SEQ ID NO: 234993 - RNA, 64 nt, Homo Sapiens
gcauuuccucagacucccagucuuccauuucuuagguaagaagagcagggccuccuaggcccca

SEQ ID NO: 234994 - RNA, 64 nt, Homo Sapiens
aauuucuccuccuuuaacuccuccuaccccccaagguaagaaacaaaaaacaaacaaacaaaca

SEQ ID NO: 234995 - RNA, 64 nt, Homo Sapiens
uauuacaaaggguuuccugcucaagugauguuuugguaagaacuucgcugaguuccacugugga

SEQ ID NO: 234996 - RNA, 64 nt, Homo Sapiens
aacucagcagaauucugaaaaugaggucacgcuggguaagaaugccuuuuuuuuuuuuucauag

SEQ ID NO: 234997 - RNA, 64 nt, Homo Sapiens
uaguuuauuuugcauuuggcuauaggauaguugugguaagaaucgaaagaauaguugcaguguu

SEQ ID NO: 234998 - RNA, 64 nt, Homo Sapiens
cugauuuggacuucgcuuugagagugguagaaucgguaagaacuggaacuucugagaguauuac

SEQ ID NO: 234999 - RNA, 64 nt, Homo Sapiens
guucucugaugcagaaauuauugggcucuuuuaggguaagaaguuugugucuuugucuggccac

SEQ ID NO: 235000 - RNA, 64 nt, Homo Sapiens
aaccaguaaggcaacacgaauaaacuaagaaaaagguaagaacugucucaaaaacgaaagcaca

SEQ ID NO: 235001 - RNA, 64 nt, Homo Sapiens
cuucaccuuccagcuuuugucuuugucuuucuaagguaagaagcggccuuccacgguugcccca

SEQ ID NO: 235002 - RNA, 64 nt, Homo Sapiens
aggugggugaagggucaccacagacacuuagaacgguaagaaaccaugagcacucacaauucug

SEQ ID NO: 235003 - RNA, 64 nt, Homo Sapiens
uaucccauugcccccuccuccacuggguucagaggguaagaaagcacccuccaauaaacccagg

SEQ ID NO: 235004 - RNA, 64 nt, Homo Sapiens
cauuaagguauuuuguuaagaacuuuaaguuuaggguaagaagaaugaaaaugauccagaaaaa

SEQ ID NO: 235005 - RNA, 64 nt, Homo Sapiens
uuaauuugugaggcagcucuuuaagacguucagagguaagaaauacuggauuuauaaagcaaau

SEQ ID NO: 235006 - RNA, 64 nt, Homo Sapiens
uucuuuuuuuucccccuaaacaaccucuuaaagggguaagaaguuaggggguuguuuauuaaga

SEQ ID NO: 235007 - RNA, 64 nt, Homo Sapiens
caguguagccaaaagagaaacagauaagugaauugguaagaaauaagauucagagcacuuggga

SEQ ID NO: 235008 - RNA, 64 nt, Homo Sapiens
ucuggggaagagguuuuauuuacauuuuaggguggguaagaaagccaccuuguuacaaauuuuu

SEQ ID NO: 235009 - RNA, 64 nt, Homo Sapiens
uuugaaagaucuuccauuucucccaaagguaccugguaagaaugguuaaaacuacagaaccaca

SEQ ID NO: 235010 - RNA, 64 nt, Homo Sapiens
aaugaacucuuucaauugagcuaaugagcucugugguaagaaaaugcuucgagcacuuuucuaa

SEQ ID NO: 235011 - RNA, 64 nt, Homo Sapiens
uucugugcugucucauugaacuaaugggauguuggguaagaaggagcucagugaaacacugaag

SEQ ID NO: 235012 - RNA, 64 nt, Homo Sapiens
ugcuuguggaagacaagucucacuucguggcuaagguaagaacguuuaguacguguggcuuggu

SEQ ID NO: 235013 - RNA, 64 nt, Homo Sapiens
auagaaaaggcucucagagagugaguggaccugugguaagaagaguccauaccagcugcgauuu

SEQ ID NO: 235014 - RNA, 64 nt, Homo Sapiens
ggcacauggcacaguuaaagucugcagaaagugggguaagaaaggguacguucauaugaaacaa

SEQ ID NO: 235015 - RNA, 64 nt, Homo Sapiens
ucagggaaaauacuucugugcccccugauuugaggguaagaaguagauaaugaggccacugugg

SEQ ID NO: 235016 - RNA, 64 nt, Homo Sapiens
gguaggucacugguuguaagaccuacuggggccagguaagaacaguaauuggcccagacaggua

SEQ ID NO: 235017 - RNA, 64 nt, Homo Sapiens
uuauggucaucugggacaacaagaaagcuuccgagguaagaauuugugaacucccaucaccuuc

SEQ ID NO: 235018 - RNA, 64 nt, Homo Sapiens
caaagaguagccaccgggagcugcacagaacugggguaagaagacccagaagggcuucugcaag

SEQ ID NO: 235019 - RNA, 64 nt, Homo Sapiens
ucugguuuuuuggucaaagguaauuauucaauuagguaagaagaaggaugaaaacuaaaucaau

SEQ ID NO: 235020 - RNA, 64 nt, Homo Sapiens
uccgguggggccaugaggaagaagaggagcugaagguaagaaacucauaaacaagaugacucuu

SEQ ID NO: 235021 - RNA, 64 nt, Homo Sapiens
uggugguaaauaugaagauagacauggagguugggguaagaagagcuuccuuuaauuacacaca

SEQ ID NO: 235022 - RNA, 64 nt, Homo Sapiens
uuuacaucuaacaaaguaaaaaaauuaaaaagaggguaagaaacgauuccggugggaugauuuu

SEQ ID NO: 235023 - RNA, 64 nt, Homo Sapiens
uuacuuggguggguagacuuaaaacaaaaaacaggguaagaaaaaaauaagcccucacuccaaa

SEQ ID NO: 235024 - RNA, 64 nt, Homo Sapiens
uacagcuacagaaaauaguuuuaaaguggaaugagguaagaagaaaucaauacgguauacagag

SEQ ID NO: 235025 - RNA, 64 nt, Homo Sapiens
ucaagagaauuggaacaaaaccuugugacuuuuagguaagaaauaggcaugaugauaagcuaug

SEQ ID NO: 235026 - RNA, 64 nt, Homo Sapiens
uuagaguauauuaaugugagcuauauccuuuacugguaagaaguuuuagaaaaguuuguuuugu

SEQ ID NO: 235027 - RNA, 64 nt, Homo Sapiens
aggaacacaaggaugaaggggaugucauuugccugguaagaacuggguuauuuccacugaaauu

SEQ ID NO: 235028 - RNA, 64 nt, Homo Sapiens
aaacaaugaaagcgaugaggggucuuaucugaaagguaagaaauuccccagcaccaugccaaaa

SEQ ID NO: 235029 - RNA, 64 nt, Homo Sapiens
guugugcagggagggagcaccaaagcuaaggcuggguaagaauaccuuuaugcaaaauaggauc

SEQ ID NO: 235030 - RNA, 64 nt, Homo Sapiens
agcaaaaggcauuucccaccgcccccucuucccugguaagaaaaaggucuugcucuccuaggua

SEQ ID NO: 235031 - RNA, 64 nt, Homo Sapiens
accaggaaaccauuaagcccguuuauuguggauugguaagaauccagauaugccaaugggccau

SEQ ID NO: 235032 - RNA, 64 nt, Homo Sapiens
acuaccaaaauguaacugcuuucuagaaauuggggguaagaagugaucuggauuugaaaaggau

SEQ ID NO: 235033 - RNA, 64 nt, Homo Sapiens
gaugcuuagggaaagacccuuacagcugucuccaaacccacagucugcugacagcugcacacau

SEQ ID NO: 235034 - RNA, 64 nt, Homo Sapiens
uccacuuugcuucugaaggcaugggcagagguucaacccacaccuugaaagucagcacuaaagg

SEQ ID NO: 235035 - RNA, 64 nt, Homo Sapiens
gucaauucacaacugauaucuaauccuccuaaugaacccacaagccuguagcaagcccagccgg

SEQ ID NO: 235036 - RNA, 64 nt, Homo Sapiens
gcccucuggagaccgccuagcaucgaagaaguacaacccacauauguggugacucucacauggg

SEQ ID NO: 235037 - RNA, 64 nt, Homo Sapiens
accuuauguugagggaacucugccaccugcgugcaacccacagcuaaaguaaauucaaugacac

SEQ ID NO: 235038 - RNA, 64 nt, Homo Sapiens
cucuaccaacccuaaacccugaggacaggggaggaacccacagcuuccuucuccugccagcugc

SEQ ID NO: 235039 - RNA, 64 nt, Homo Sapiens
augaagacagggagugaggguguuggcagccaagaacccacaccuuaauaaaggcugacaguuc

SEQ ID NO: 235040 - RNA, 64 nt, Homo Sapiens
ggagacuggagacagggcaaauggccuccagcccaacccacaguuguuugcagucccacguggc

SEQ ID NO: 235041 - RNA, 64 nt, Homo Sapiens
ggcgaacacaaauggacacacauaccuggccacgaacccacaccuccucagacacucagacacc

SEQ ID NO: 235042 - RNA, 64 nt, Homo Sapiens
ugguggccuccaaauccuuccugggauucccccaaacccacacugaugcgaagcuguucuugac

SEQ ID NO: 235043 - RNA, 64 nt, Homo Sapiens
caccugugggaggcugugugcaggcugcaggauaucuggguaugauuucagguccucugcacgu

SEQ ID NO: 235044 - RNA, 64 nt, Homo Sapiens
acacaugacuaggauaggcaggaguaagggugggucuggguauaugacugugcagcuguuugug

SEQ ID NO: 235045 - RNA, 64 nt, Homo Sapiens
uuggcugaaaauuuuguuuucaggauauuucuuuucuggguaucagcagcuuuuccuggaggcc

SEQ ID NO: 235046 - RNA, 64 nt, Homo Sapiens
agaucaauuuccaacuggaaucccagcagccgguucuggguagccucagauuccagauuucaca

SEQ ID NO: 235047 - RNA, 64 nt, Homo Sapiens
gggcaccugcuacagaagagaauguuucguucccucuggguaugcacagcuaaggggccucauu

SEQ ID NO: 235048 - RNA, 64 nt, Homo Sapiens
uuucuucuagcguugcgcaaacacugacccagcuucuggguauggaaauaacccugugaugaug

SEQ ID NO: 235049 - RNA, 64 nt, Homo Sapiens
gcagccuuucauccggcagagccuuccugcguuugcagcagagaggaggccccacagcuugccc

SEQ ID NO: 235050 - RNA, 64 nt, Homo Sapiens
ugcagguggcaaaauggcacugaauauccccuuggcagcagagaaaacccacugaaagaucgua

SEQ ID NO: 235051 - RNA, 64 nt, Homo Sapiens
augcggcuauagcagauggccauggcagucaguggcagcagaaagaggcagcagaaggugaaga

SEQ ID NO: 235052 - RNA, 64 nt, Homo Sapiens
agauggccauggcagucaguggcagcagaaagaggcagcagaaggugaagagguuauagguggu

SEQ ID NO: 235053 - RNA, 64 nt, Homo Sapiens
caucucuuugcagguagcagcaacaguuguagcagcagcagacgaagccauugcagaggcagaa

SEQ ID NO: 235054 - RNA, 64 nt, Homo Sapiens
aacguucccuugcagauggagacugaaucugagggcagcagacuuuuaucagcuugaguuuaug

SEQ ID NO: 235055 - RNA, 64 nt, Homo Sapiens
cauuuucgugaguagaaggaaagauaagaaugaggcagcagauuuucccuccuggaauuacaca

SEQ ID NO: 235056 - RNA, 64 nt, Homo Sapiens
agaauuuuauuugucccacuuuuacuaaacaguggcagcagauuuuaaguuaaagaauauggaa

SEQ ID NO: 235057 - RNA, 64 nt, Homo Sapiens
cuccuaauuuuuaacacuaagggacagagccuaggcagcagauuuugacuccaucaacuucaag

SEQ ID NO: 235058 - RNA, 64 nt, Homo Sapiens
aaagagaaaaacccuccucuuuagaagaaaaaaagcagcagacguuuaccuuuuuaaaaaucug

SEQ ID NO: 235059 - RNA, 64 nt, Homo Sapiens
ccccucuuaggacaggcacugcccagcagcaagggcagcagaguugggugcuaagauccugagg

SEQ ID NO: 235060 - RNA, 64 nt, Homo Sapiens
agaagggacuugccuaaagccacccagcaacucagcagcagaaccaagaugggccccaggcucc

SEQ ID NO: 235061 - RNA, 64 nt, Homo Sapiens
acuagcuuguaaaauuuaucguuuaaaacuagaagcagcagaaaucaucagaaacaugguuaaa

SEQ ID NO: 235062 - RNA, 64 nt, Homo Sapiens
uugguuuacucugcagccugcaaagacugguuuagcagcagacaauguacacuggacaugaaaa

SEQ ID NO: 235063 - RNA, 64 nt, Homo Sapiens
aggccauagcugcuccagccggggcuccggggcggcagcagagcuggcacaccgauucugggaa

SEQ ID NO: 235064 - RNA, 64 nt, Homo Sapiens
acaaagacaacgcugagggguagugacuccuguagcagcagagacgccuuggaguuuaaccccc

SEQ ID NO: 235065 - RNA, 64 nt, Homo Sapiens
aaguaguaauaaccaccguggcacuccagccugggcagcagagcugagccgagaucgcaccacu

SEQ ID NO: 235066 - RNA, 64 nt, Homo Sapiens
aaaaccacagcagccuccuagacaagguccgggagcagcagacccgcagggcuggugaauccau

SEQ ID NO: 235067 - RNA, 64 nt, Homo Sapiens
gcaggagccccagcuuagccgagaggagucggcugcagcagaggcagcccagaggggggcuaca

SEQ ID NO: 235068 - RNA, 64 nt, Homo Sapiens
agaccugaugucccggugcuuagaagucgcacacgcagcagagcccccuccucccaggggagag

SEQ ID NO: 235069 - RNA, 64 nt, Homo Sapiens
ugaccgaaagugaccaagaccaaggcccaccaaggcagcagacuguuaaucagacaaacagauc

SEQ ID NO: 235070 - RNA, 64 nt, Homo Sapiens
cauuuacuucagccuuugauucaguaaauguuaagcagcagaagacuucgaaugguugaaauuc

SEQ ID NO: 235071 - RNA, 64 nt, Homo Sapiens
cugaggcauagccagcuucauucuggcuaagagugcagcagagaggcccucaauacccagcugc

SEQ ID NO: 235072 - RNA, 64 nt, Homo Sapiens
guccguccucuguugauugauccucugccucucugcagcagaauagucaccccagcugcugggc

SEQ ID NO: 235073 - RNA, 64 nt, Homo Sapiens
auugaacggccuguccaaagauccucucucuagggcagcagagagcuuuuugcacuuuaaaaaa

SEQ ID NO: 235074 - RNA, 64 nt, Homo Sapiens
uaaauuggucagcagaaaagggagcccagaaaaggcagcagauggaccaugcccuugcuggguu

SEQ ID NO: 235075 - RNA, 64 nt, Homo Sapiens
cacauauccaagagcucagggccaguucuggugggcagcagagaccugcucugccaaguugucc

SEQ ID NO: 235076 - RNA, 64 nt, Homo Sapiens
ugggcagcagagaccugcucugccaaguuguccagcagcagaguggcccuggccugggcaucac

SEQ ID NO: 235077 - RNA, 64 nt, Homo Sapiens
ugaaaauugccuccaaauuaauguuauagaaacugcagcagaguuggguacuaucauuaguccc

SEQ ID NO: 235078 - RNA, 64 nt, Homo Sapiens
gaggccaaaugcagagaugagguacugagaagcagcagcagaauguagaacccaaggacuucug

SEQ ID NO: 235079 - RNA, 64 nt, Homo Sapiens
cccaacaguaaccuccuccuaagguauuuguggugcagcagauuuggagugcgggcccugccag

SEQ ID NO: 235080 - RNA, 64 nt, Homo Sapiens
cacgcacaugcacguaagcacagaggagggcacggcagcagagagugagcaguucagccugcag

SEQ ID NO: 235081 - RNA, 62 nt, Homo Sapiens
agggcacggcagcagagacagcaguucagccugcagcagaggcucagcacaccaauguguga

SEQ ID NO: 235082 - RNA, 64 nt, Homo Sapiens
aguuggaaaggacacgugagagugagcucaaguggcagcagaggcaguuuggaauaagcugcgg

SEQ ID NO: 235083 - RNA, 64 nt, Homo Sapiens
aucugagaggcaguaaagcagugaugaagacagugcagcagaacauugaaguccugauugcagc

SEQ ID NO: 235084 - RNA, 64 nt, Homo Sapiens
gguagccuccgcagaggcugggggccuccacccagcagcagaccaaccaggaagcagcuugaac

SEQ ID NO: 235085 - RNA, 64 nt, Homo Sapiens
ucugcaccccaagcccuugccccagcccaguccagcagcagauguuacaaucugagugaggaca

SEQ ID NO: 235086 - RNA, 64 nt, Homo Sapiens
aggaguagggacaggaaggaagugcaagccggaggcagcagaucccugagcaggauagauuuga

SEQ ID NO: 235087 - RNA, 64 nt, Homo Sapiens
gagcuguacugccgggcccgccccaccaggcacugcagcagacguucucuccgggccaccuucu

SEQ ID NO: 235088 - RNA, 64 nt, Homo Sapiens
gagacucucucucaaaaaaagcacuccagccugggcagcagaguugagccgagauugugccacg

SEQ ID NO: 235089 - RNA, 64 nt, Homo Sapiens
gucacuacucacauuauagucugucaccaucuuugcagcagaaggucaccaucuuugcaccaaa

SEQ ID NO: 235090 - RNA, 64 nt, Homo Sapiens; identical to SEQ ID NO: 115592

SEQ ID NO: 235091 - RNA, 64 nt, Homo Sapiens; identical to SEQ ID NO: 115593

SEQ ID NO: 235092 - RNA, 64 nt, Homo Sapiens; identical to SEQ ID NO: 115594

SEQ ID NO: 235093 - RNA, 64 nt, Homo Sapiens; identical to SEQ ID NO: 115595

SEQ ID NO: 235094 - RNA, 64 nt, Homo Sapiens; identical to SEQ ID NO: 115596

SEQ ID NO: 235095 - RNA, 64 nt, Homo Sapiens; identical to SEQ ID NO: 115597

SEQ ID NO: 235096 - RNA, 64 nt, Homo Sapiens; identical to SEQ ID NO: 115598

SEQ ID NO: 235097 - RNA, 64 nt, Homo Sapiens; identical to SEQ ID NO: 115599

SEQ ID NO: 235098 - RNA, 64 nt, Homo Sapiens; identical to SEQ ID NO: 115600

SEQ ID NO: 235099 - RNA, 64 nt, Homo Sapiens; identical to SEQ ID NO: 115601

SEQ ID NO: 235100 - RNA, 64 nt, Homo Sapiens; identical to SEQ ID NO: 115602

SEQ ID NO: 235101 - RNA, 64 nt, Homo Sapiens; identical to SEQ ID NO: 115603

SEQ ID NO: 235102 - RNA, 64 nt, Homo Sapiens; identical to SEQ ID NO: 115604

SEQ ID NO: 235103 - RNA, 64 nt, Homo Sapiens; identical to SEQ ID NO: 115605

SEQ ID NO: 235104 - RNA, 64 nt, Homo Sapiens; identical to SEQ ID NO: 115606

SEQ ID NO: 235105 - RNA, 64 nt, Homo Sapiens; identical to SEQ ID NO: 115607

SEQ ID NO: 235106 - RNA, 64 nt, Homo Sapiens; identical to SEQ ID NO: 115608

SEQ ID NO: 235107 - RNA, 64 nt, Homo Sapiens; identical to SEQ ID NO: 115609

SEQ ID NO: 235108 - RNA, 64 nt, Homo Sapiens; identical to SEQ ID NO: 115610

SEQ ID NO: 235109 - RNA, 64 nt, Homo Sapiens; identical to SEQ ID NO: 115611

SEQ ID NO: 235110 - RNA, 64 nt, Homo Sapiens; identical to SEQ ID NO: 115612

SEQ ID NO: 235111 - RNA, 64 nt, Homo Sapiens; identical to SEQ ID NO: 115613

SEQ ID NO: 235112 - RNA, 64 nt, Homo Sapiens; identical to SEQ ID NO: 115614

SEQ ID NO: 235113 - RNA, 64 nt, Homo Sapiens; identical to SEQ ID NO: 115615

SEQ ID NO: 235114 - RNA, 52 nt, Homo Sapiens; identical to SEQ ID NO: 115616

SEQ ID NO: 235115 - RNA, 64 nt, Homo Sapiens; identical to SEQ ID NO: 115617

SEQ ID NO: 235116 - RNA, 64 nt, Homo Sapiens; identical to SEQ ID NO: 115618

SEQ ID NO: 235117 - RNA, 64 nt, Homo Sapiens; identical to SEQ ID NO: 115619

SEQ ID NO: 235118 - RNA, 64 nt, Homo Sapiens; identical to SEQ ID NO: 115620

SEQ ID NO: 235119 - RNA, 64 nt, Homo Sapiens; identical to SEQ ID NO: 115621

SEQ ID NO: 235120 - RNA, 64 nt, Homo Sapiens; identical to SEQ ID NO: 115622

SEQ ID NO: 235121 - RNA, 64 nt, Homo Sapiens; identical to SEQ ID NO: 115623

SEQ ID NO: 235122 - RNA, 64 nt, Homo Sapiens; identical to SEQ ID NO: 115624

SEQ ID NO: 235123 - RNA, 64 nt, Homo Sapiens; identical to SEQ ID NO: 115625

SEQ ID NO: 235124 - RNA, 64 nt, Homo Sapiens; identical to SEQ ID NO: 115626

SEQ ID NO: 235125 - RNA, 64 nt, Homo Sapiens; identical to SEQ ID NO: 115627

SEQ ID NO: 235126 - RNA, 64 nt, Homo Sapiens; identical to SEQ ID NO: 115628

SEQ ID NO: 235127 - RNA, 64 nt, Homo Sapiens; identical to SEQ ID NO: 115629

SEQ ID NO: 235128 - RNA, 64 nt, Homo Sapiens; identical to SEQ ID NO: 115630

SEQ ID NO: 235129 - RNA, 64 nt, Homo Sapiens; identical to SEQ ID NO: 115631

SEQ ID NO: 235130 - RNA, 64 nt, Homo Sapiens; identical to SEQ ID NO: 115632

SEQ ID NO: 235131 - RNA, 64 nt, Homo Sapiens; identical to SEQ ID NO: 115633

SEQ ID NO: 235132 - RNA, 64 nt, Homo Sapiens; identical to SEQ ID NO: 115634

SEQ ID NO: 235133 - RNA, 64 nt, Homo Sapiens; identical to SEQ ID NO: 115635

SEQ ID NO: 235134 - RNA, 64 nt, Homo Sapiens; identical to SEQ ID NO: 115636

SEQ ID NO: 235135 - RNA, 64 nt, Homo Sapiens; identical to SEQ ID NO: 115637

SEQ ID NO: 235136 - RNA, 64 nt, Homo Sapiens; identical to SEQ ID NO: 115636

SEQ ID NO: 235137 - RNA, 64 nt, Homo Sapiens; identical to SEQ ID NO: 115639

SEQ ID NO: 235138 - RNA, 64 nt, Homo Sapiens; identical to SEQ ID NO: 115640

SEQ ID NO: 235139 - RNA, 64 nt, Homo Sapiens; identical to SEQ ID NO: 115641

SEQ ID NO: 235140 - RNA, 64 nt, Homo Sapiens; identical to SEQ ID NO: 115642

SEQ ID NO: 235141 - RNA, 64 nt, Homo Sapiens; identical to SEQ ID NO: 115643

SEQ ID NO: 235142 - RNA, 64 nt, Homo Sapiens; identical to SEQ ID NO: 115644

SEQ ID NO: 235143 - RNA, 64 nt, Homo Sapiens; identical to SEQ ID NO: 115645

SEQ ID NO: 235144 - RNA, 64 nt, Homo Sapiens; identical to SEQ ID NO: 115646

SEQ ID NO: 235145 - RNA, 64 nt, Homo Sapiens; identical to SEQ ID NO: 115647

SEQ ID NO: 235146 - RNA, 64 nt, Homo Sapiens; identical to SEQ ID NO: 115648

SEQ ID NO: 235147 - RNA, 64 nt, Homo Sapiens; identical to SEQ ID NO: 115649

SEQ ID NO: 235148 - RNA, 64 nt, Homo Sapiens; identical to SEQ ID NO: 115650

SEQ ID NO: 235149 - RNA, 64 nt, Homo Sapiens; identical to SEQ ID NO: 115651

SEQ ID NO: 235150 - RNA, 64 nt, Homo Sapiens; identical to SEQ ID NO: 115652

SEQ ID NO: 235151 - RNA, 64 nt, Homo Sapiens; identical to SEQ ID NO: 115653

SEQ ID NO: 235152 - RNA, 64 nt, Homo Sapiens; identical to SEQ ID NO: 115654

SEQ ID NO: 235153 - RNA, 64 nt, Homo Sapiens; identical to SEQ ID NO: 115655

SEQ ID NO: 235154 - RNA, 64 nt, Homo Sapiens; identical to SEQ ID NO: 115656

SEQ ID NO: 235155 - RNA, 64 nt, Homo Sapiens; identical to SEQ ID NO: 115657

SEQ ID NO: 235156 - RNA, 64 nt, Homo Sapiens; identical to SEQ ID NO: 115658

SEQ ID NO: 235157 - RNA, 64 nt, Homo Sapiens; identical to SEQ ID NO: 115659

SEQ ID NO: 235158 - RNA, 64 nt, Homo Sapiens; identical to SEQ ID NO: 77753

SEQ ID NO: 235159 - RNA, 64 nt, Homo Sapiens; identical to SEQ ID NO: 77754

SEQ ID NO: 235160 - RNA, 64 nt, Homo Sapiens; identical to SEQ ID NO: 77755

SEQ ID NO: 235161 - RNA, 64 nt, Homo Sapiens; identical to SEQ ID NO: 77756

SEQ ID NO: 235162 - RNA, 64 nt, Homo Sapiens; identical to SEQ ID NO: 77757

SEQ ID NO: 235163 - RNA, 64 nt, Homo Sapiens; identical to SEQ ID NO: 77758

SEQ ID NO: 235164 - RNA, 64 nt, Homo Sapiens; identical to SEQ ID NO: 77759

SEQ ID NO: 235165 - RNA, 64 nt, Homo Sapiens; identical to SEQ ID NO: 77760

SEQ ID NO: 235166 - RNA, 64 nt, Homo Sapiens; identical to SEQ ID NO: 77761

SEQ ID NO: 235167 - RNA, 64 nt, Homo Sapiens; identical to SEQ ID NO: 77762

SEQ ID NO: 235168 - RNA, 64 nt, Homo Sapiens; identical to SEQ ID NO: 77763

SEQ ID NO: 235169 - RNA, 64 nt, Homo Sapiens; identical to SEQ ID NO: 77764

SEQ ID NO: 235170 - RNA, 64 nt, Homo Sapiens; identical to SEQ ID NO: 77765

SEQ ID NO: 235171 - RNA, 64 nt, Homo Sapiens; identical to SEQ ID NO: 77766

SEQ ID NO: 235172 - RNA, 64 nt, Homo Sapiens; identical to SEQ ID NO: 77767

SEQ ID NO: 235173 - RNA, 64 nt, Homo Sapiens; identical to SEQ ID NO: 77768

SEQ ID NO: 235174 - RNA, 64 nt, Homo Sapiens; identical to SEQ ID NO: 77769

SEQ ID NO: 235175 - RNA, 64 nt, Homo Sapiens; identical to SEQ ID NO: 77770

SEQ ID NO: 235176 - RNA, 64 nt, Homo Sapiens; identical to SEQ ID NO: 77771

SEQ ID NO: 235177 - RNA, 64 nt, Homo Sapiens; identical to SEQ ID NO: 77772

SEQ ID NO: 235178 - RNA, 64 nt, Homo Sapiens; identical to SEQ ID NO: 77773

SEQ ID NO: 235179 - RNA, 64 nt, Homo Sapiens; identical to SEQ ID NO: 77774

SEQ ID NO: 235180 - RNA, 64 nt, Homo Sapiens; identical to SEQ ID NO: 77775

SEQ ID NO: 235181 - RNA, 64 nt, Homo Sapiens; identical to SEQ ID NO: 77776

SEQ ID NO: 235182 - RNA, 64 nt, Homo Sapiens; identical to SEQ ID NO: 77777

SEQ ID NO: 235183 - RNA, 64 nt, Homo Sapiens; identical to SEQ ID NO: 77778

SEQ ID NO: 235184 - RNA, 64 nt, Homo Sapiens; identical to SEQ ID NO: 77779

SEQ ID NO: 235185 - RNA, 64 nt, Homo Sapiens; identical to SEQ ID NO: 77780

SEQ ID NO: 235186 - RNA, 64 nt, Homo Sapiens; identical to SEQ ID NO: 77781

SEQ ID NO: 235187 - RNA, 64 nt, Homo Sapiens; identical to SEQ ID NO: 77782

SEQ ID NO: 235188 - RNA, 64 nt, Homo Sapiens; identical to SEQ ID NO: 77783

SEQ ID NO: 235189 - RNA, 64 nt, Homo Sapiens; identical to SEQ ID NO: 77784

SEQ ID NO: 235190 - RNA, 64 nt, Homo Sapiens; identical to SEQ ID NO: 77785

SEQ ID NO: 235191 - RNA, 64 nt, Homo Sapiens; identical to SEQ ID NO: 171819

SEQ ID NO: 235192 - RNA, 64 nt, Homo Sapiens; identical to SEQ ID NO: 171820

SEQ ID NO: 235193 - RNA, 64 nt, Homo Sapiens; identical to SEQ ID NO: 171821

SEQ ID NO: 235194 - RNA, 64 nt, Homo Sapiens; identical to SEQ ID NO: 171822

SEQ ID NO: 235195 - RNA, 64 nt, Homo Sapiens; identical to SEQ ID NO: 171823

SEQ ID NO: 235196 - RNA, 64 nt, Homo Sapiens; identical to SEQ ID NO: 171824

SEQ ID NO: 235197 - RNA, 64 nt, Homo Sapiens; identical to SEQ ID NO: 171825

SEQ ID NO: 235198 - RNA, 64 nt, Homo Sapiens; identical to SEQ ID NO: 171826

SEQ ID NO: 235199 - RNA, 64 nt, Homo Sapiens; identical to SEQ ID NO: 171827

SEQ ID NO: 235200 - RNA, 64 nt, Homo Sapiens; identical to SEQ ID NO: 171828

SEQ ID NO: 235201 - RNA, 64 nt, Homo Sapiens; identical to SEQ ID NO: 171829

SEQ ID NO: 235202 - RNA, 64 nt, Homo Sapiens; identical to SEQ ID NO: 88616

SEQ ID NO: 235203 - RNA, 64 nt, Homo Sapiens; identical to SEQ ID NO: 88617

SEQ ID NO: 235204 - RNA, 64 nt, Homo Sapiens; identical to SEQ ID NO: 88618

SEQ ID NO: 235205 - RNA, 64 nt, Homo Sapiens; identical to SEQ ID NO: 88619

SEQ ID NO: 235206 - RNA, 64 nt, Homo Sapiens; identical to SEQ ID NO: 88620

SEQ ID NO: 235207 - RNA, 64 nt, Homo Sapiens; identical to SEQ ID NO: 88621

SEQ ID NO: 235208 - RNA, 64 nt, Homo Sapiens; identical to SEQ ID NO: 88622

SEQ ID NO: 235209 - RNA, 64 nt, Homo Sapiens; identical to SEQ ID NO: 88623

SEQ ID NO: 235210 - RNA, 64 nt, Homo Sapiens; identical to SEQ ID NO: 110959

SEQ ID NO: 235211 - RNA, 64 nt, Homo Sapiens; identical to SEQ ID NO: 110960

SEQ ID NO: 235212 - RNA, 64 nt, Homo Sapiens; identical to SEQ ID NO: 110961

SEQ ID NO: 235213 - RNA, 64 nt, Homo Sapiens; identical to SEQ ID NO: 110962

SEQ ID NO: 235214 - RNA, 64 nt, Homo Sapiens; identical to SEQ ID NO: 110963

SEQ ID NO: 235215 - RNA, 64 nt, Homo Sapiens; identical to SEQ ID NO: 110964

SEQ ID NO: 235216 - RNA, 64 nt, Homo Sapiens; identical to SEQ ID NO: 110965

SEQ ID NO: 235217 - RNA, 64 nt, Homo Sapiens; identical to SEQ ID NO: 110966

SEQ ID NO: 235218 - RNA, 64 nt, Homo Sapiens; identical to SEQ ID NO: 110967

SEQ ID NO: 235219 - RNA, 64 nt, Homo Sapiens; identical to SEQ ID NO: 110968

SEQ ID NO: 235220 - RNA, 64 nt, Homo Sapiens; identical to SEQ ID NO: 110969

SEQ ID NO: 235221 - RNA, 64 nt, Homo Sapiens; identical to SEQ ID NO: 110970

SEQ ID NO: 235222 - RNA, 64 nt, Homo Sapiens; identical to SEQ ID NO: 110971

SEQ ID NO: 235223 - RNA, 64 nt, Homo Sapiens; identical to SEQ ID NO: 110972

SEQ ID NO: 235224 - RNA, 64 nt, Homo Sapiens; identical to SEQ ID NO: 110973

SEQ ID NO: 235225 - RNA, 64 nt, Homo Sapiens; identical to SEQ ID NO: 110974

SEQ ID NO: 235226 - RNA, 64 nt, Homo Sapiens; identical to SEQ ID NO: 110975

SEQ ID NO: 235227 - RNA, 64 nt, Homo Sapiens; identical to SEQ ID NO: 110976

SEQ ID NO: 235228 - RNA, 64 nt, Homo Sapiens; identical to SEQ ID NO: 110977

SEQ ID NO: 235229 - RNA, 64 nt, Homo Sapiens; identical to SEQ ID NO: 110978

SEQ ID NO: 235230 - RNA, 64 nt, Homo Sapiens; identical to SEQ ID NO: 110979

SEQ ID NO: 235231 - RNA, 64 nt, Homo Sapiens; identical to SEQ ID NO: 110980

SEQ ID NO: 235232 - RNA, 64 nt, Homo Sapiens; identical to SEQ ID NO: 72205

SEQ ID NO: 235233 - RNA, 64 nt, Homo Sapiens; identical to SEQ ID NO: 72206

SEQ ID NO: 235234 - RNA, 64 nt, Homo Sapiens; identical to SEQ ID NO: 72207

SEQ ID NO: 235235 - RNA, 64 nt, Homo Sapiens; identical to SEQ ID NO: 72208

SEQ ID NO: 235236 - RNA, 64 nt, Homo Sapiens; identical to SEQ ID NO: 72209

SEQ ID NO: 235237 - RNA, 64 nt, Homo Sapiens; identical to SEQ ID NO: 72210

SEQ ID NO: 235238 - RNA, 64 nt, Homo Sapiens; identical to SEQ ID NO: 72211

SEQ ID NO: 235239 - RNA, 64 nt, Homo Sapiens; identical to SEQ ID NO: 72212

SEQ ID NO: 235240 - RNA, 64 nt, Homo Sapiens; identical to SEQ ID NO: 72213

SEQ ID NO: 235241 - RNA, 64 nt, Homo Sapiens; identical to SEQ ID NO: 72214

SEQ ID NO: 235242 - RNA, 64 nt, Homo Sapiens; identical to SEQ ID NO: 72215

SEQ ID NO: 235243 - RNA, 64 nt, Homo Sapiens; identical to SEQ ID NO: 72216

SEQ ID NO: 235244 - RNA, 64 nt, Homo Sapiens; identical to SEQ ID NO: 72217

SEQ ID NO: 235245 - RNA, 64 nt, Homo Sapiens; identical to SEQ ID NO: 72218

SEQ ID NO: 235246 - RNA, 64 nt, Homo Sapiens; identical to SEQ ID NO: 72219

SEQ ID NO: 235247 - RNA, 64 nt, Homo Sapiens; identical to SEQ ID NO: 72220

SEQ ID NO: 235248 - RNA, 64 nt, Homo Sapiens; identical to SEQ ID NO: 72221

SEQ ID NO: 235249 - RNA, 64 nt, Homo Sapiens; identical to SEQ ID NO: 72222

SEQ ID NO: 235250 - RNA, 64 nt, Homo Sapiens; identical to SEQ ID NO: 72223

SEQ ID NO: 235251 - RNA, 64 nt, Homo Sapiens; identical to SEQ ID NO: 72224

SEQ ID NO: 235252 - RNA, 64 nt, Homo Sapiens; identical to SEQ ID NO: 72225

SEQ ID NO: 235253 - RNA, 64 nt, Homo Sapiens; identical to SEQ ID NO: 72226

SEQ ID NO: 235254 - RNA, 64 nt, Homo Sapiens; identical to SEQ ID NO: 72227

SEQ ID NO: 235255 - RNA, 64 nt, Homo Sapiens; identical to SEQ ID NO: 72228

SEQ ID NO: 235256 - RNA, 64 nt, Homo Sapiens; identical to SEQ ID NO: 72229

SEQ ID NO: 235257 - RNA, 64 nt, Homo Sapiens; identical to SEQ ID NO: 72230

SEQ ID NO: 235258 - RNA, 64 nt, Homo Sapiens; identical to SEQ ID NO: 72231

SEQ ID NO: 235259 - RNA, 64 nt, Homo Sapiens; identical to SEQ ID NO: 72232

SEQ ID NO: 235260 - RNA, 64 nt, Homo Sapiens; identical to SEQ ID NO: 72233

SEQ ID NO: 235261 - RNA, 64 nt, Homo Sapiens; identical to SEQ ID NO: 72234

SEQ ID NO: 235262 - RNA, 64 nt, Homo Sapiens; identical to SEQ ID NO: 72235

SEQ ID NO: 235263 - RNA, 64 nt, Homo Sapiens; identical to SEQ ID NO: 72236

SEQ ID NO: 235264 - RNA, 64 nt, Homo Sapiens; identical to SEQ ID NO: 72237

SEQ ID NO: 235265 - RNA, 64 nt, Homo Sapiens; identical to SEQ ID NO: 72238

SEQ ID NO: 235266 - RNA, 64 nt, Homo Sapiens; identical to SEQ ID NO: 72239

SEQ ID NO: 235267 - RNA, 64 nt, Homo Sapiens; identical to SEQ ID NO: 72240

SEQ ID NO: 235268 - RNA, 64 nt, Homo Sapiens; identical to SEQ ID NO: 72241

SEQ ID NO: 235269 - RNA, 64 nt, Homo Sapiens; identical to SEQ ID NO: 72242

SEQ ID NO: 235270 - RNA, 64 nt, Homo Sapiens; identical to SEQ ID NO: 72243

SEQ ID NO: 235271 - RNA, 64 nt, Homo Sapiens; identical to SEQ ID NO: 72244

SEQ ID NO: 235272 - RNA, 64 nt, Homo Sapiens; identical to SEQ ID NO: 72245

SEQ ID NO: 235273 - RNA, 64 nt, Homo Sapiens; identical to SEQ ID NO: 72246

SEQ ID NO: 235274 - RNA, 64 nt, Homo Sapiens; identical to SEQ ID NO: 72247

SEQ ID NO: 235275 - RNA, 64 nt, Homo Sapiens; identical to SEQ ID NO: 72248

SEQ ID NO: 235276 - RNA, 64 nt, Homo Sapiens; identical to SEQ ID NO: 72249

SEQ ID NO: 235277 - RNA, 64 nt, Homo Sapiens; identical to SEQ ID NO: 72250

SEQ ID NO: 235278 - RNA, 64 nt, Homo Sapiens; identical to SEQ ID NO: 72251

SEQ ID NO: 235279 - RNA, 64 nt, Homo Sapiens; identical to SEQ ID NO: 72252

SEQ ID NO: 235280 - RNA, 64 nt, Homo Sapiens; identical to SEQ ID NO: 72253

SEQ ID NO: 235281 - RNA, 64 nt, Homo Sapiens; identical to SEQ ID NO: 72254

SEQ ID NO: 235282 - RNA, 64 nt, Homo Sapiens; identical to SEQ ID NO: 72255

SEQ ID NO: 235283 - RNA, 64 nt, Homo Sapiens; identical to SEQ ID NO: 72256

SEQ ID NO: 235284 - RNA, 64 nt, Homo Sapiens; identical to SEQ ID NO: 72257

SEQ ID NO: 235285 - RNA, 64 nt, Homo Sapiens; identical to SEQ ID NO: 72258

SEQ ID NO: 235286 - RNA, 64 nt, Homo Sapiens; identical to SEQ ID NO: 72259

SEQ ID NO: 235287 - RNA, 64 nt, Homo Sapiens; identical to SEQ ID NO: 72260

SEQ ID NO: 235288 - RNA, 64 nt, Homo Sapiens; identical to SEQ ID NO: 72261

SEQ ID NO: 235289 - RNA, 64 nt, Homo Sapiens; identical to SEQ ID NO: 72262

SEQ ID NO: 235290 - RNA, 64 nt, Homo Sapiens; identical to SEQ ID NO: 72263

SEQ ID NO: 235291 - RNA, 64 nt, Homo Sapiens; identical to SEQ ID NO: 72264

SEQ ID NO: 235292 - RNA, 64 nt, Homo Sapiens; identical to SEQ ID NO: 72265

SEQ ID NO: 235293 - RNA, 64 nt, Homo Sapiens; identical to SEQ ID NO: 72266

SEQ ID NO: 235294 - RNA, 64 nt, Homo Sapiens; identical to SEQ ID NO: 72267

SEQ ID NO: 235295 - RNA, 64 nt, Homo Sapiens; identical to SEQ ID NO: 72268

SEQ ID NO: 235296 - RNA, 64 nt, Homo Sapiens; identical to SEQ ID NO: 72269

SEQ ID NO: 235297 - RNA, 64 nt, Homo Sapiens; identical to SEQ ID NO: 72270

SEQ ID NO: 235298 - RNA, 64 nt, Homo Sapiens; identical to SEQ ID NO: 72271

SEQ ID NO: 235299 - RNA, 64 nt, Homo Sapiens; identical to SEQ ID NO: 72272

SEQ ID NO: 235300 - RNA, 64 nt, Homo Sapiens; identical to SEQ ID NO: 72273

SEQ ID NO: 235301 - RNA, 64 nt, Homo Sapiens
agcugagaagaagcugaggauccucacaggagcagacagagaaaugugaagggugggguuuuau

SEQ ID NO: 235302 - RNA, 64 nt, Homo Sapiens
aaguggagggggugucuggaagcugagcaggcccgacagagagaugaagccaucagaaggacuu

SEQ ID NO: 235303 - RNA, 64 nt, Homo Sapiens
ggcuuggucaguuucuuaagguaugguucucugagacagagagcaacgaccuuugaguuaagcu

SEQ ID NO: 235304 - RNA, 64 nt, Homo Sapiens
augcaucucauaaucagacuccaugcuuuuuaaagacagagauaauaucuucucuauucuauuc

SEQ ID NO: 235305 - RNA, 64 nt, Homo Sapiens
cuugcagacaccauccgugcuccugguaaagggggacagagagccucaccuugccacauauuug

SEQ ID NO: 235306 - RNA, 64 nt, Homo Sapiens
ccuuuuaccucgggguuuugaggccaacagggacgacagagacaguuucuaguuagagccuugg

SEQ ID NO: 235307 - RNA, 64 nt, Homo Sapiens
guacguguugucuaccaguacacaggcugcagaagacagagacagaagaaagagaucaagggca

SEQ ID NO: 235308 - RNA, 64 nt, Homo Sapiens
ccaguuuuucuagcuagacuguaaacuccuuaaggacagagacuacaccuuguacuuuuugugc

SEQ ID NO: 235309 - RNA, 64 nt, Homo Sapiens
acuugugacugcaucccucuggagucuacccagagacagagaaugugucuuuaugugggagugg

SEQ ID NO: 235310 - RNA, 64 nt, Homo Sapiens
aaugugucuuuaugugggaguggugacucugaaagacagagagggcuccuguggcugccaggag

SEQ ID NO: 235311 - RNA, 64 nt, Homo Sapiens
aaguaaaacagguuuuacugagucugguagucaagacagagauuguuccaacaaacaucaugau

SEQ ID NO: 235312 - RNA, 64 nt, Homo Sapiens
aauggagagcaggaauuacauuuucaacuugggggacagagagauucuaaagauuuggguuaua

SEQ ID NO: 235313 - RNA, 64 nt, Homo Sapiens
cuugacauggaaugccuuugaccauuggugcucugacagagaagucauggagucauugccauuu

SEQ ID NO: 235314 - RNA, 64 nt, Homo Sapiens
auaaaguccuuuucucuuacagguauuaaaugaggacagagaaccucagguguucuuaugcuag

SEQ ID NO: 235315 - RNA, 64 nt, Homo Sapiens
aguggagaacugugggagcugguggcucugcccugacagagagccauggagcagaggagccucu

SEQ ID NO: 235316 - RNA, 64 nt, Homo Sapiens
agccgagaucgugucacugcacuccagccugggugacagagacuccauuuaaaaaaaaaaaaaa

SEQ ID NO: 235317 - RNA, 64 nt, Homo Sapiens
cacaauggagcaggaaggauaaaaaauaaagaaagacagagagaaacaaauuugcugggagagg

SEQ ID NO: 235318 - RNA, 64 nt, Homo Sapiens
uuuuguaauauugucaaaugucucuauggauucugacagagauuucuuuuuguuuuguuauucu

SEQ ID NO: 235319 - RNA, 64 nt, Homo Sapiens
uguguguaugagagagagagagagagacaacagagacagagagaggcagagaggcauagagaga

SEQ ID NO: 235320 - RNA, 64 nt, Homo Sapiens
aacagagacagagagaggcagagaggcauagagagacagagagagagacaagaaacagagauag

SEQ ID NO: 235321 - RNA, 64 nt, Homo Sapiens
uguuugaaaucuggucuguuugcauuucuguuaugacagagagaugauguuugcauuucuguua

SEQ ID NO: 235322 - RNA, 64 nt, Homo Sapiens
uaugacagagagaugauguuugcauuucuguuaugacagagagaugaugaaaguaggcagggcu

SEQ ID NO: 235323 - RNA, 64 nt, Homo Sapiens
gagggcaugggagggagggagagguggggagggagacagagacagaaacagagagagacagaga

SEQ ID NO: 235324 - RNA, 64 nt, Homo Sapiens
gguggggagggagacagagacagaaacagagagagacagagacagagagagacugagggagaga

SEQ ID NO: 235325 - RNA, 64 nt, Homo Sapiens
gagggagacagagacagaaacagagagagacagagacagagagagacugagggagagacucuga

SEQ ID NO: 235326 - RNA, 64 nt, Homo Sapiens
ggcaaucuacaaaacuacacguuucaugugguaggacagagaacgaacagaaggccgaauccaa

SEQ ID NO: 235327 - RNA, 64 nt, Homo Sapiens
agaaggccgaauccaaguuuguuucauguaguaggacagagaacuuagugaaggcugaauccaa

SEQ ID NO: 235328 - RNA, 64 nt, Homo Sapiens
uacauuccucgccagggucucucagugggucuucgacagagagcuuuugcaguuuaaaauguug

SEQ ID NO: 235329 - RNA, 64 nt, Homo Sapiens
cagauguggguauggggcccagugugagaaggaagacagagaaguucuugaaagcugggggaug

SEQ ID NO: 235330 - RNA, 64 nt, Homo Sapiens
uaagcauuagagaccugcaagagagagagacagagacagagaaacugguagacuuuuguuaaaa

SEQ ID NO: 235331 - RNA, 64 nt, Homo Sapiens
gagaaauaagcauuagagacuuaaaagagagagagacagagacaaggccgcugguagacuuuug

SEQ ID NO: 235332 - RNA, 64 nt, Homo Sapiens
cggagugagaagcuuugcccuccuaagagagagagacagagagacagagagagagaaagagaga

SEQ ID NO: 235333 - RNA, 64 nt, Homo Sapiens
gaagcuuugcccuccuaagagagagagacagagagacagagagagagaaagagagagugugugg

SEQ ID NO: 235334 - RNA, 64 nt, Homo Sapiens
uagcugaccuggagaugcugccugguggggaucagacagagauuggagagaagguacagagucc

SEQ ID NO: 235335 - RNA, 64 nt, Homo Sapiens
ucguggcuguggagagggucaaggaguacuccaagacagagacagagguggguacuggcaugag

SEQ ID NO: 235336 - RNA, 64 nt, Homo Sapiens
gauagagcaggaggucgggggagagggagagagggacagagagagggagagaggcagagagaca

SEQ ID NO: 235337 - RNA, 64 nt, Homo Sapiens
gagagagggacagagagagagagagaggcagagagacagagagggagggagagaggcagagagg

SEQ ID NO: 235338 - RNA, 64 nt, Homo Sapiens
gagagagagacagagggagaagagaaacagaggagacagagagggacagaggaggcagagaggg

SEQ ID NO: 235339 - RNA, 64 nt, Homo Sapiens
cacgcccuugcccaccuuccaaaaggaaggaaaugacagagacaacucggaaaguaaaugcuuc

SEQ ID NO: 235340 - RNA, 64 nt, Homo Sapiens
cuaccgggccggaugaaucucucucauggaaucagacagagauccuagggccuuugcucccaca

SEQ ID NO: 235341 - RNA, 64 nt, Homo Sapiens
ggagcccaggugacaggagauguugaggccaucggacagagacuguagcuaugcuuugaugucc

SEQ ID NO: 235342 - RNA, 64 nt, Homo Sapiens
aaugcuggacuaccuggguacuuuuaaucagagagacagagaauuccuggcuccagagcccauu

SEQ ID NO: 235343 - RNA, 64 nt, Homo Sapiens
uccccuacagcccagagaugaggucagagguggggacagagaacaagggcccucccuccagccu

SEQ ID NO: 235344 - RNA, 64 nt, Homo Sapiens
ugucuccacgccuccgggaguugaaguccucugggacagagaccugccucugggcugggugagc

SEQ ID NO: 235345 - RNA, 64 nt, Homo Sapiens
uuccugagaccucgccggccuuguuuuauucaaagacagagaagaccaaagcauugccugccag

SEQ ID NO: 235346 - RNA, 64 nt, Homo Sapiens
aggccagggaaagcccgugucaaugaaugccggggacagagaggggcagguugaccgggacuuc

SEQ ID NO: 235347 - RNA, 64 nt, Homo Sapiens
uuaggcucacaguuacaguuuauuacaguaaaaggacagagauuaagaucagcaaagggaggag

SEQ ID NO: 235348 - RNA, 64 nt, Homo Sapiens
aagagaaaauaagcaggacagaggauuugcucuggacagagauggaagagccgggaacagagaa

SEQ ID NO: 235349 - RNA, 64 nt, Homo Sapiens
cagagggcagcgucagacacgugggggagggagggacagagacccaaacaaacaaaaagagcca

SEQ ID NO: 235350 - RNA, 64 nt, Homo Sapiens
aagagcaggggauagaagccauccagaguggggagacagagacccgcagaagagaggaacagaa

SEQ ID NO: 235351 - RNA, 64 nt, Homo Sapiens
caaagggagagaaacagagauggaaacccagagagacagagaccgacccagaaaaaggaagagg

SEQ ID NO: 235352 - RNA, 64 nt, Homo Sapiens
auugcuggagggugagagaagggagucacagccagacagagaguucaugucuacuguuagguga

SEQ ID NO: 235353 - RNA, 64 nt, Homo Sapiens
gugucuccauuccucaguucccucuuaggucugugacagagaguccacauauccacaagaagug

SEQ ID NO: 235354 - RNA, 64 nt, Homo Sapiens; identical to SEQ ID NO: 56346

SEQ ID NO: 235355 - RNA, 64 nt, Homo Sapiens; identical to SEQ ID NO: 56347

SEQ ID NO: 235356 - RNA, 64 nt, Homo Sapiens; identical to SEQ ID NO: 56348

SEQ ID NO: 235357 - RNA, 64 nt, Homo Sapiens; identical to SEQ ID NO: 56349

SEQ ID NO: 235358 - RNA, 64 nt, Homo Sapiens; identical to SEQ ID NO: 56350

SEQ ID NO: 235359 - RNA, 64 nt, Homo Sapiens; identical to SEQ ID NO: 56351

SEQ ID NO: 235360 - RNA, 64 nt, Homo Sapiens; identical to SEQ ID NO: 56352

SEQ ID NO: 235361 - RNA, 64 nt, Homo Sapiens; identical to SEQ ID NO: 56353

SEQ ID NO: 235362 - RNA, 64 nt, Homo Sapiens; identical to SEQ ID NO: 56354

SEQ ID NO: 235363 - RNA, 64 nt, Homo Sapiens; identical to SEQ ID NO: 56355

SEQ ID NO: 235364 - RNA, 64 nt, Homo Sapiens; identical to SEQ ID NO: 56356

SEQ ID NO: 235365 - RNA, 64 nt, Homo Sapiens; identical to SEQ ID NO: 56357

SEQ ID NO: 235366 - RNA, 64 nt, Homo Sapiens; identical to SEQ ID NO: 56358

SEQ ID NO: 235367 - RNA, 64 nt, Homo Sapiens; identical to SEQ ID NO: 56359

SEQ ID NO: 235368 - RNA, 64 nt, Homo Sapiens; identical to SEQ ID NO: 43975

SEQ ID NO: 235369 - RNA, 64 nt, Homo Sapiens; identical to SEQ ID NO: 43976

SEQ ID NO: 235370 - RNA, 64 nt, Homo Sapiens; identical to SEQ ID NO: 43977

SEQ ID NO: 235371 - RNA, 64 nt, Homo Sapiens; identical to SEQ ID NO: 43978

SEQ ID NO: 235372 - RNA, 64 nt, Homo Sapiens; identical to SEQ ID NO: 43979

SEQ ID NO: 235373 - RNA, 64 nt, Homo Sapiens; identical to SEQ ID NO: 43980

SEQ ID NO: 235374 - RNA, 64 nt, Homo Sapiens; identical to SEQ ID NO: 43981

SEQ ID NO: 235375 - RNA, 64 nt, Homo Sapiens; identical to SEQ ID NO: 43982

SEQ ID NO: 235376 - RNA, 64 nt, Homo Sapiens; identical to SEQ ID NO: 43983

SEQ ID NO: 235377 - RNA, 64 nt, Homo Sapiens; identical to SEQ ID NO: 43984

SEQ ID NO: 235378 - RNA, 64 nt, Homo Sapiens; identical to SEQ ID NO: 43985

SEQ ID NO: 235379 - RNA, 64 nt, Homo Sapiens; identical to SEQ ID NO: 43986

SEQ ID NO: 235380 - RNA, 64 nt, Homo Sapiens; identical to SEQ ID NO: 43987

SEQ ID NO: 235381 - RNA, 64 nt, Homo Sapiens; identical to SEQ ID NO: 43988

SEQ ID NO: 235382 - RNA, 64 nt, Homo Sapiens; identical to SEQ ID NO: 111411

SEQ ID NO: 235383 - RNA, 64 nt, Homo Sapiens; identical to SEQ ID NO: 111412

SEQ ID NO: 235384 - RNA, 64 nt, Homo Sapiens; identical to SEQ ID NO: 111413

SEQ ID NO: 235385 - RNA, 64 nt, Homo Sapiens; identical to SEQ ID NO: 111414

SEQ ID NO: 235386 - RNA, 64 nt, Homo Sapiens; identical to SEQ ID NO: 111415

SEQ ID NO: 235387 - RNA, 64 nt, Homo Sapiens; identical to SEQ ID NO: 111416

SEQ ID NO: 235388 - RNA, 64 nt, Homo Sapiens; identical to SEQ ID NO: 111417

SEQ ID NO: 235389 - RNA, 64 nt, Homo Sapiens; identical to SEQ ID NO: 111418

SEQ ID NO: 235390 - RNA, 64 nt, Homo Sapiens; identical to SEQ ID NO: 111419

SEQ ID NO: 235391 - RNA, 64 nt, Homo Sapiens; identical to SEQ ID NO: 111420

SEQ ID NO: 235392 - RNA, 64 nt, Homo Sapiens; identical to SEQ ID NO: 111421

SEQ ID NO: 235393 - RNA, 64 nt, Homo Sapiens; identical to SEQ ID NO: 111422

SEQ ID NO: 235394 - RNA, 64 nt, Homo Sapiens; identical to SEQ ID NO: 111423

SEQ ID NO: 235395 - RNA, 64 nt, Homo Sapiens; identical to SEQ ID NO: 111424

SEQ ID NO: 235396 - RNA, 64 nt, Homo Sapiens; identical to SEQ ID NO: 111425

SEQ ID NO: 235397 - RNA, 64 nt, Homo Sapiens; identical to SEQ ID NO: 111426

SEQ ID NO: 235398 - RNA, 64 nt, Homo Sapiens; identical to SEQ ID NO: 111427

SEQ ID NO: 235399 - RNA, 64 nt, Homo Sapiens; identical to SEQ ID NO: 111428

SEQ ID NO: 235400 - RNA, 64 nt, Homo Sapiens; identical to SEQ ID NO: 111429

SEQ ID NO: 235401 - RNA, 64 nt, Homo Sapiens; identical to SEQ ID NO: 111430

SEQ ID NO: 235402 - RNA, 64 nt, Homo Sapiens; identical to SEQ ID NO: 111431

SEQ ID NO: 235403 - RNA, 64 nt, Homo Sapiens; identical to SEQ ID NO: 111432

SEQ ID NO: 235404 - RNA, 64 nt, Homo Sapiens; identical to SEQ ID NO: 111433

SEQ ID NO: 235405 - RNA, 64 nt, Homo Sapiens; identical to SEQ ID NO: 111434

SEQ ID NO: 235406 - RNA, 58 nt, Homo Sapiens; identical to SEQ ID NO: 111435

SEQ ID NO: 235407 - RNA, 64 nt, Homo Sapiens; identical to SEQ ID NO: 111436

SEQ ID NO: 235408 - RNA, 64 nt, Homo Sapiens; identical to SEQ ID NO: 111437

SEQ ID NO: 235409 - RNA, 64 nt, Homo Sapiens; identical to SEQ ID NO: 111438

SEQ ID NO: 235410 - RNA, 64 nt, Homo Sapiens; identical to SEQ ID NO: 111439

SEQ ID NO: 235411 - RNA, 64 nt, Homo Sapiens; identical to SEQ ID NO: 111440

SEQ ID NO: 235412 - RNA, 64 nt, Homo Sapiens; identical to SEQ ID NO: 111441

SEQ ID NO: 235413 - RNA, 64 nt, Homo Sapiens; identical to SEQ ID NO: 111442

SEQ ID NO: 235414 - RNA, 64 nt, Homo Sapiens; identical to SEQ ID NO: 111443

SEQ ID NO: 235415 - RNA, 64 nt, Homo Sapiens; identical to SEQ ID NO: 111444

SEQ ID NO: 235416 - RNA, 64 nt, Homo Sapiens; identical to SEQ ID NO: 111445

SEQ ID NO: 235417 - RNA, 64 nt, Homo Sapiens; identical to SEQ ID NO: 111446

SEQ ID NO: 235418 - RNA, 64 nt, Homo Sapiens; identical to SEQ ID NO: 111447

SEQ ID NO: 235419 - RNA, 64 nt, Homo Sapiens; identical to SEQ ID NO: 111448

SEQ ID NO: 235420 - RNA, 64 nt, Homo Sapiens; identical to SEQ ID NO: 111449

SEQ ID NO: 235421 - RNA, 64 nt, Homo Sapiens; identical to SEQ ID NO: 111450

SEQ ID NO: 235422 - RNA, 64 nt, Homo Sapiens; identical to SEQ ID NO: 111451

SEQ ID NO: 235423 - RNA, 64 nt, Homo Sapiens; identical to SEQ ID NO: 111452

SEQ ID NO: 235424 - RNA, 64 nt, Homo Sapiens; identical to SEQ ID NO: 111453

SEQ ID NO: 235425 - RNA, 64 nt, Homo Sapiens; identical to SEQ ID NO: 111454

SEQ ID NO: 235426 - RNA, 64 nt, Homo Sapiens; identical to SEQ ID NO: 111455

SEQ ID NO: 235427 - RNA, 64 nt, Homo Sapiens; identical to SEQ ID NO: 111456

SEQ ID NO: 235428 - RNA, 64 nt, Homo Sapiens; identical to SEQ ID NO: 111457

SEQ ID NO: 235429 - RNA, 64 nt, Homo Sapiens; identical to SEQ ID NO: 111458

SEQ ID NO: 235430 - RNA, 64 nt, Homo Sapiens; identical to SEQ ID NO: 111459

SEQ ID NO: 235431 - RNA, 52 nt, Homo Sapiens; identical to SEQ ID NO: 111460

SEQ ID NO: 235432 - RNA, 64 nt, Homo Sapiens; identical to SEQ ID NO: 111461

SEQ ID NO: 235433 - RNA, 64 nt, Homo Sapiens; identical to SEQ ID NO: 111462

SEQ ID NO: 235434 - RNA, 64 nt, Homo Sapiens; identical to SEQ ID NO: 111463

SEQ ID NO: 235435 - RNA, 64 nt, Homo Sapiens; identical to SEQ ID NO: 111464

SEQ ID NO: 235436 - RNA, 64 nt, Homo Sapiens; identical to SEQ ID NO: 111465

SEQ ID NO: 235437 - RNA, 64 nt, Homo Sapiens; identical to SEQ ID NO: 111466

SEQ ID NO: 235438 - RNA, 64 nt, Homo Sapiens; identical to SEQ ID NO: 111467

SEQ ID NO: 235439 - RNA, 64 nt, Homo Sapiens
auaaaacuuaaggaaaaccaugcaugaacuucauccuaauaaggaguuaagaguaguguagaaa

SEQ ID NO: 235440 - RNA, 64 nt, Homo Sapiens
caaucagauugguuuuauucuccagaacaaauuuccuaauaacacaauaauuuaugaauaaguu

SEQ ID NO: 235441 - RNA, 64 nt, Homo Sapiens
uuuagugugccuuccaaaccuaugaggaauuggaccuaauaaaugaaagucagccacugugucu

SEQ ID NO: 235442 - RNA, 64 nt, Homo Sapiens
uguggucuguuugucugaacgcguuuuauaucuuccuaauaagguucccaaguguaauuaucau

SEQ ID NO: 235443 - RNA, 64 nt, Homo Sapiens
aaaacugcuuuucgccuccacucuuacagcugugccuaauaauaauuaauuaauaaacgcacag

SEQ ID NO: 235444 - RNA, 64 nt, Homo Sapiens
caguguucaaggcaugacuaguauuucuaauuagccuaauaaauucccacacuuucugaaguga

SEQ ID NO: 235445 - RNA, 64 nt, Homo Sapiens
guuuguuuuagagaaaguuguauuccacacacaaccuaauaauuucuuauaaaaauuuuaaacu

SEQ ID NO: 235446 - RNA, 64 nt, Homo Sapiens
aauguuucuugauagcacauggcaauaccaucauccuaauaacagaagaucuugcaaagaauca

SEQ ID NO: 235447 - RNA, 64 nt, Homo Sapiens
uauauuauuuuagguauaauuuacaaaugucacaccuaauaaucuuuuauaauauaccauauuu

SEQ ID NO: 235448 - RNA, 64 nt, Homo Sapiens
uuacuauuuuguuauauggaaugguuaauuuuuaccuaauaaaaacauagaugaaauacauugu

SEQ ID NO: 235449 - RNA, 64 nt, Homo Sapiens
accaugugcuuaaacaaguaugugccaauuaaugccuaauaaauguacucgugccuuauauuug

SEQ ID NO: 235450 - RNA, 64 nt, Homo Sapiens
agaacaggguaagaugugaguuuuauaaacagacccuaauaaagaaagaauuuuuuuuuuccuu

SEQ ID NO: 235451 - RNA, 64 nt, Homo Sapiens
uauuugaaaacguugcuggguucaguuuuaaauuccuaauaaauuucuuuuuccagguuuuauu

SEQ ID NO: 235452 - RNA, 64 nt, Homo Sapiens
gagaagcugcauuuuauugguuuuuuuaauguuuccuaauaaaauucguguuuuggguuuuuuu

SEQ ID NO: 235453 - RNA, 64 nt, Homo Sapiens
gacacauuauuuucuucugaacuuggcaauauaaccuaauaaggcagaauaaguuucuguuaaa

SEQ ID NO: 235454 - RNA, 64 nt, Homo Sapiens
uacuuuuauuacauuucuuaauccauuguuuuuaccuaauaaaauuuccuccucuauauuccaa

SEQ ID NO: 235455 - RNA, 64 nt, Homo Sapiens
caccuauuucacuaacuuguaaauggaaagauccccuaauaauaucauuugaaaucuaggaguc

SEQ ID NO: 235456 - RNA, 64 nt, Homo Sapiens
aaugcaguuaacaaguauauauuuuaaauguugcccuaauaauccggcugcagccaucccccuc

SEQ ID NO: 235457 - RNA, 64 nt, Homo Sapiens
uuagcuacucgccaagcuggcccuguguguaaguccuaauaaacucgagcugucuugcugagug

SEQ ID NO: 235458 - RNA, 64 nt, Homo Sapiens
acuugcugguuuugcggcuucccuuuugaaagucccuaauaaaacccuauucauacacucccuc

SEQ ID NO: 235459 - RNA, 64 nt, Homo Sapiens
uuuggucagaccgguugcucagaggaaauucccgccuaauaaaucgcucccaggcuuauuagga

SEQ ID NO: 235460 - RNA, 64 nt, Homo Sapiens
caguuuucuugucuucauucagugauauguagggaggaaggagguugauagcauagauggcaac

SEQ ID NO: 235461 - RNA, 64 nt, Homo Sapiens
cauagauggcaacugauucccaguuuaagauaggaggaaggagagcaauuucuaaguuucaauc

SEQ ID NO: 235462 - RNA, 64 nt, Homo Sapiens
cagacaggugggagauggagguagggcuggcuggaggaaggaaacaacaaaggaagugagguag

SEQ ID NO: 235463 - RNA, 64 nt, Homo Sapiens
gacaucugaggaaaauggaagaccuaaggcagacaggaaggaagcacaaaagacaagcauuggg

SEQ ID NO: 235464 - RNA, 64 nt, Homo Sapiens
augaucccuccagaagucucacgggggguggggaaggaaggaacggagcaucugcuguuugagg

SEQ ID NO: 235465 - RNA, 64 nt, Homo Sapiens
ugaacggaguuagcucccagaaguggguaagggcaggaaggaaauggccugcccacaggacaag

SEQ ID NO: 235466 - RNA, 64 nt, Homo Sapiens
aggaggagcagggaaaucagugagucugauuuuuaggaaggaaucucaagacuacuggucacaa

SEQ ID NO: 235467 - RNA, 64 nt, Homo Sapiens
ggagagagcaggaucccuggggagaaaguuggugaggaaggaaugcugucauucaaauuggaua

SEQ ID NO: 235468 - RNA, 64 nt, Homo Sapiens
ggaaaagagugagagaaugguucuaaaucaggccaggaaggaggauccugggacagucagauuc

SEQ ID NO: 235469 - RNA, 64 nt, Homo Sapiens
uuaccucuucuguuauuuuuagugaaggaagaauaggaaggauagaggugggaggaggggcaga

SEQ ID NO: 235470 - RNA, 64 nt, Homo Sapiens
uggaaaaggucauggggaaguuggaagacagaguaggaaggauaguuucaguucugugucaugg

SEQ ID NO: 235471 - RNA, 64 nt, Homo Sapiens
ccuggguaugccauugacuuuucuuugagggaucaggaaggaauuuaaaguguuuauuccccau

SEQ ID NO: 235472 - RNA, 64 nt, Homo Sapiens
auccuauuuugggguaucaguaaucuucagaggaaggaaggaaauccucuuggauuuuuugaaa

SEQ ID NO: 235473 - RNA, 64 nt, Homo Sapiens
gaaaauccuauuuugggguagaaauaaucuucagaggaaggaaguuauuccucuuggauuuuuu

SEQ ID NO: 235474 - RNA, 64 nt, Homo Sapiens
gaaacugaagacaccguggcuguagccagagaggaggaaggagguccacccaccuggagacgaa

SEQ ID NO: 235475 - RNA, 64 nt, Homo Sapiens
gagauggaaaggggauaucauuggcaagucaagcaggaaggagggggggaagcagcaggacaca

SEQ ID NO: 235476 - RNA, 64 nt, Homo Sapiens
uuaaauucuuucccugguaagcuuuuggggaggaaggaaggacauacuggauugcaccaaggaa

SEQ ID NO: 235477 - RNA, 64 nt, Homo Sapiens
gacauuaaauucuuucccugggaagcuuuuggggaggaaggaagucuguacuggauugcaccaa

SEQ ID NO: 235478 - RNA, 64 nt, Homo Sapiens
uuucugcaguagcuagagggacagguuuccuuccaggaaggauucgaguuccugugccuguggg

SEQ ID NO: 235479 - RNA, 64 nt, Homo Sapiens
auaugccuugagaugccuugaaccaugcuugagaaggaaggacaaacacauuauuaucuuggaa

SEQ ID NO: 235480 - RNA, 64 nt, Homo Sapiens
aaccauuuuucuaauucuaacaaguuagaaugugaggaaggaaugaacaugaguguuuaggaac

SEQ ID NO: 235481 - RNA, 64 nt, Homo Sapiens
gacgggccucauggucugcugugcagagagaggcaggaaggaucccugaagagucuuggagaaa

SEQ ID NO: 235482 - RNA, 64 nt, Homo Sapiens
aggguugugccaagguauugacaaauugaaaagcaggaaggaagacaguagcaaauauuuauug

SEQ ID NO: 235483 - RNA, 64 nt, Homo Sapiens
gacuuuuuaaaaaauaaaaacagggaaugcaaucaggaaggaaagaagcacauacaaaagaaga

SEQ ID NO: 235484 - RNA, 64 nt, Homo Sapiens
uauuuugagaauauauugaggaaaaggaagaggaaggaaggaaaacacuuagaaagaaaagaca

SEQ ID NO: 235485 - RNA, 64 nt, Homo Sapiens
gaaauauuuugagaauauaugacagaaaaggaagaggaaggaagauacacacuuagaaagaaaa

SEQ ID NO: 235486 - RNA, 64 nt, Homo Sapiens
cgcauaauuuuuuucugcaaaacugaaaauacuuaggaaggaucgcaauaaauuuuuuuuaaaa

SEQ ID NO: 235487 - RNA, 64 nt, Homo Sapiens
cucuugacuccuugugauguuggauaugaaacuuaggaaggaucauaggcaucacauuuuugug

SEQ ID NO: 235488 - RNA, 64 nt, Homo Sapiens
ggaaaaguccccgcagcacacuggacagagaggaaggaaggauucccccucagccuggcagccu

SEQ ID NO: 235489 - RNA, 64 nt, Homo Sapiens
gauuggaaaaguccccgcaggccucuggacagagaggaaggaagguggcccccucagccuggca

SEQ ID NO: 235490 - RNA, 64 nt, Homo Sapiens
agaaggagacagagcugguugggaagacauggggaggaaggacaaggcuagaucaugaagaacc

SEQ ID NO: 235491 - RNA, 64 nt, Homo Sapiens
ugcagaagguuuacucuguggccaaaggagggucaggaaggaugagcauuuagggcaaggagac

SEQ ID NO: 235492 - RNA, 64 nt, Homo Sapiens
cacacaccuguaaucccagcuacucgggaggcugaggaaggagaauugcuugaaccugggaggu

SEQ ID NO: 235493 - RNA, 64 nt, Homo Sapiens
cuuauauacauauuuuuuaaaaguagcuuuacauaggaaggaaguggcauaguuuuaucaauau

SEQ ID NO: 235494 - RNA, 64 nt, Homo Sapiens
ucaaaaaaaaaccccacaaucuaggaugggaacaaggaaggaaagaugugaauaggcugauggg

SEQ ID NO: 235495 - RNA, 64 nt, Homo Sapiens
gucaacauagugagacacugucucuaccaaaaaaaggaaggaagggacacauaucaaacugaaa

SEQ ID NO: 235496 - RNA, 64 nt, Homo Sapiens
auuugucuaaauugccccuuuuucuguuccuaaaaggaaggauaagagagaacauuccagguga

SEQ ID NO: 235497 - RNA, 64 nt, Homo Sapiens
ugcaaacuggaggugaggcggaggaaaggcagguaggaaggaguaaggauggagaugcucagaa

SEQ ID NO: 235498 - RNA, 64 nt, Homo Sapiens
gcaaggcugucuguccauccgaguggaccgaggaaggaaggaagcccuggaucccaggagaaag

SEQ ID NO: 235499 - RNA, 64 nt, Homo Sapiens
gaaggcaaggcugucuguccaaaggaguggaccgaggaaggaagccaacccuggaucccaggag

SEQ ID NO: 235500 - RNA, 64 nt, Homo Sapiens
uuacccuuuuguucuuccccggugucaaaguuucaggaaggauuuucaaugugaagcugugugu

SEQ ID NO: 235501 - RNA, 64 nt, Homo Sapiens
ugaugcagcucuggcuccuuccuggccaagccccaggaaggaaauuccagaccguuacgugucu

SEQ ID NO: 235502 - RNA, 64 nt, Homo Sapiens
cauagugauucguauacaauuaaugucaugaaucaggaaggauauucuuuaagcuuuuuuuuuu

SEQ ID NO: 235503 - RNA, 64 nt, Homo Sapiens
auccugccauaguaaaauuguuaaucaccuuaucaggaaggaauagugagcaccaaaaacuuca

SEQ ID NO: 235504 - RNA, 64 nt, Homo Sapiens
uaauucuucauuuuaaaaauuuuuggccaaaggaaggaaggaacaucccaaguuucccaggcac

SEQ ID NO: 235505 - RNA, 64 nt, Homo Sapiens
gaacuaauucuucauuuuaagcacuuuuggccaaaggaaggaagcuucaucccaaguuucccag

SEQ ID NO: 235506 - RNA, 64 nt, Homo Sapiens
guccaucagguuuucuguugcacaaggacgggucaggaaggaaggagaggcuuuuccagaaaca

SEQ ID NO: 235507 - RNA, 64 nt, Homo Sapiens
aucagguuuucuguugcacaaggacgggucaggaaggaaggagaggcuuuuccagaaacaaaaa

SEQ ID NO: 235508 - RNA, 64 nt, Homo Sapiens
gcuagcuaagaagccgagguucagugguggcagcaggaaggacacugccacaaauuuugucuau

SEQ ID NO: 235509 - RNA, 64 nt, Homo Sapiens
aaccuuucagcacauuccaagguuuuaguuacucaggaaggaguuaauuaaaaugauuuuauuu

SEQ ID NO: 235510 - RNA, 64 nt, Homo Sapiens
gaagggagggaaacagggaggaaggaaggaagaaaggaaggaaacuucagugaauucuaagaag

SEQ ID NO: 235511 - RNA, 64 nt, Homo Sapiens
aaaggaaggaaagaagggagaauucuaagaaggaaggaaggaagaccuaggaaauacuucagug

SEQ ID NO: 235512 - RNA, 64 nt, Homo Sapiens
gaagaaaggaaggaaagaagagugaauucuaagaaggaaggaagggcuaccuaggaaauacuuc

SEQ ID NO: 235513 - RNA, 64 nt, Homo Sapiens
ccugagggccaugaaagccacagaggaugggcugaggaaggaaagaaaugggguuacugcuccc

SEQ ID NO: 235514 - RNA, 64 nt, Homo Sapiens
cacuaucacugccuucuuuauauaaaggcuaauaaggaaggaguguuauuuauggcuuugccaa

SEQ ID NO: 235515 - RNA, 64 nt, Homo Sapiens
cucucauaagcaccuugguccucucauaaggcccaggaaggaugagaagggcccaggaaggaug

SEQ ID NO: 235516 - RNA, 64 nt, Homo Sapiens
cucucauaaggcccaggaagcaagagaagggcccaggaaggaugccauccacggccuuuucugg

SEQ ID NO: 235517 - RNA, 64 nt, Homo Sapiens
cccaggaggccaagccugaaaacagaggggagggaggaaggaaggagucccagcaggagcacag

SEQ ID NO: 235518 - RNA, 64 nt, Homo Sapiens
ggaggccaagccugaaaacagaggggagggaggaaggaaggagucccagcaggagcacagcccu

SEQ ID NO: 235519 - RNA, 64 nt, Homo Sapiens
ucuacuuucccuauucuuauggagguaaaaggaaaggaaggaaggaaaaagcagcuuucacuua

SEQ ID NO: 235520 - RNA, 64 nt, Homo Sapiens
cuuucccuauucuuauggagguaaaaggaaaggaaggaaggaaaaagcagcuuucacuuacaaa

SEQ ID NO: 235521 - RNA, 64 nt, Homo Sapiens
acguagcugcaguuguccaccuuaagacaaaauaaggaaggaaagaaacagcuuuucuuguguc

SEQ ID NO: 235522 - RNA, 64 nt, Homo Sapiens
accgaccugaaacaccaagcguaacgugucagagaggaaggaucaaucacugccaaagucaagc

SEQ ID NO: 235523 - RNA, 64 nt, Homo Sapiens
caaagagcuacugaguaacgugucagcauucucaaggaaggaggaaaacccgcuaugaaaugua

SEQ ID NO: 235524 - RNA, 64 nt, Homo Sapiens
cagacagcuggcaguuccuccucugggucaaggcaggaaggagagcccagaggccggggccagg

SEQ ID NO: 235525 - RNA, 64 nt, Homo Sapiens
ggaguagggcuagugaauguucuuucagugaaagaggaaggaaaggagaaggagcuguggccug

SEQ ID NO: 235526 - RNA, 64 nt, Homo Sapiens
ggaaggccuaggcuaggacguuggccucagggccaggaaggacagacuggccgggcaggcguga

SEQ ID NO: 235527 - RNA, 64 nt, Homo Sapiens
ccgggcaggcgugacucagcagccugcgcucggcaggaaggagcggcgcccuggacuugguaca

SEQ ID NO: 235528 - RNA, 64 nt, Homo Sapiens
aauuaauugagauuuucaggcauggaaaaggaauaggaaggagaucugagaaaaugaggcagag

SEQ ID NO: 235529 - RNA, 64 nt, Homo Sapiens
ggcaaccuaaaagcccacuucguggcccacaaggaggaaggaagagccccuuccccuucccucu

SEQ ID NO: 235530 - RNA, 64 nt, Homo Sapiens
uaaagugguaugaucugggguguguaauauaggaaggaaggaugauauuuaagagauguacaca

SEQ ID NO: 235531 - RNA, 64 nt, Homo Sapiens
gauguaaagugguaugaucucacauguguaauauaggaaggaagauaaauauuuaagagaugua

SEQ ID NO: 235532 - RNA, 64 nt, Homo Sapiens
aauaaguuuuauugaaaaugguguuucuguuucaaggaaggaugaaauuauguuuuaauuccaa

SEQ ID NO: 235533 - RNA, 64 nt, Homo Sapiens
cagcucccagcccacucauccgaacacgcacagaaggaaggagcggcgaggacgugaagccucc

SEQ ID NO: 235534 - RNA, 64 nt, Homo Sapiens
gggagacucugucucgaaagaaagaaagaaaaaaaggaaggaaggagaaggaaggaaggagaag

SEQ ID NO: 235535 - RNA, 64 nt, Homo Sapiens
gacucugucucgaaagaaagaaagaaaaaaaggaaggaaggagaaggaaggaaggagaagaaaa

SEQ ID NO: 235536 - RNA, 64 nt, Homo Sapiens
cgaaagaaagaaagaaaaaaaggaaggaaggagaaggaaggaaggagaagaaaagguaccuguu

SEQ ID NO: 235537 - RNA, 64 nt, Homo Sapiens
agaaagaaagaaaaaaaggaaggaaggagaaggaaggaaggagaagaaaagguaccuguucuac

SEQ ID NO: 235538 - RNA, 64 nt, Homo Sapiens
aacuuguuacugaaagagacgaaagaaagaaggaaggaaggaaagauaauuggacaaagagaga

SEQ ID NO: 235539 - RNA, 64 nt, Homo Sapiens
gaaaaacuuguuacugaaaggagagaaagaaagaaggaaggaaguauugauaauuggacaaaga

SEQ ID NO: 235540 - RNA, 64 nt, Homo Sapiens
cacggucuuggauauaaguaacucuuggccucagaggaaggaaaagcaacucaacacucauggu

SEQ ID NO: 235541 - RNA, 64 nt, Homo Sapiens
uguuguuuuaauuaguauuuguguaguucaaaccaggaaggauuugacuaucauuagauuuugc

SEQ ID NO: 235542 - RNA, 64 nt, Homo Sapiens
gagggagcugcuggcccgcucuaaggggugcaagaggaaggagugugcccagaccagcuggggg

SEQ ID NO: 235543 - RNA, 64 nt, Homo Sapiens
caaaugauguauggggagaggagaaggaagggcaaggaaggaauugacagauaagaagcaaaug

SEQ ID NO: 235544 - RNA, 64 nt, Homo Sapiens
ggcugcuggagcccagucacgacggaagcaaggaaggaaggaagcggaaggaggaggaaggaag

SEQ ID NO: 235545 - RNA, 64 nt, Homo Sapiens
gaagggcugcuggagcccaggaaggacggaagcaaggaaggaagcagacggaaggaggaggaag

SEQ ID NO: 235546 - RNA, 64 nt, Homo Sapiens
gaagcaaggaaggaaggaagcggaaggaggaggaaggaaggacgaugcaggaaggaggugcaga

SEQ ID NO: 235547 - RNA, 64 nt, Homo Sapiens
gacggaagcaaggaaggaagcagacggaaggaggaggaaggaagccggaugcaggaaggaggug

SEQ ID NO: 235548 - RNA, 64 nt, Homo Sapiens
ugcagacggaaggaggaggagaggugccggaugcaggaaggaggcagcacaagcucaggacaug

SEQ ID NO: 235549 - RNA, 64 nt, Homo Sapiens
ggcaaaucuggucuagcuggcacguuaacuucagaggaaggaugguuuaugcuuuuuaaaaaca

SEQ ID NO: 235550 - RNA, 64 nt, Homo Sapiens
uucagugaggaaaauaagguggcaaaggaaacuaaggaaggagggaagagaggaaugacuugaa

SEQ ID NO: 235551 - RNA, 64 nt, Homo Sapiens
cauccaucaagagagacagagcgcacaauggagcaggaaggauaaaaaauaaagaaagacagag

SEQ ID NO: 235552 - RNA, 64 nt, Homo Sapiens
uuucugccuacaccguucaucagccccauaacccaggaaggaacaggcauuguuagcaucagau

SEQ ID NO: 235553 - RNA, 64 nt, Homo Sapiens
uugccuuguuuguuaguuugccugggucugucugaggaaggagggggucccgccuuccaccuca

SEQ ID NO: 235554 - RNA, 64 nt, Homo Sapiens
gggaugggcgcuuuccucucugguugugaacgaaaggaaggaacaucuuucuauggcuaacaaa

SEQ ID NO: 235555 - RNA, 64 nt, Homo Sapiens
guaugcuuugggcuuucuccuucuguggccccggaggaaggagagacugaggcaaggcaaagug

SEQ ID NO: 235556 - RNA, 64 nt, Homo Sapiens
uaaucaucuaagaccacgaagacauuuuuuccuaaggaaggaaauccugcauuguuucaagacu

SEQ ID NO: 235557 - RNA, 64 nt, Homo Sapiens
cggugacagacgggcugaagcuuuggagaaggcaaggaaggaggccucaaguccaaggcuuuau

SEQ ID NO: 235558 - RNA, 64 nt, Homo Sapiens
gcugugggggacggggggcacccccccgcuccagaggaaggaaagggggcgacuaccccagugc

SEQ ID NO: 235559 - RNA, 64 nt, Homo Sapiens
caggcccggcaugaggaccuacaggaauggggcgaggaaggagccggugagggcuuggaaggag

SEQ ID NO: 235560 - RNA, 64 nt, Homo Sapiens
uacccaguauuacugcugcuagauguuuuacgcaaggaaggacuuaccuucaaugaauuaauuc

SEQ ID NO: 235561 - RNA, 64 nt, Homo Sapiens
cccugaguccgccugcgccugacucccccaaccaaggaaggagcgcaggagcagggcggcugcc

SEQ ID NO: 235562 - RNA, 64 nt, Homo Sapiens
guaggagauuugugggggaaaacaugauauaggaaggaaggauuugaaacccgauaaaaucagg

SEQ ID NO: 235563 - RNA, 64 nt, Homo Sapiens
gauuguaggagauuugugggcaggaacaugauauaggaaggaagaaaaugaaacccgauaaaau

SEQ ID NO: 235564 - RNA, 64 nt, Homo Sapiens
uauugcccacuguucucauagcuaaaaguuaagaaggaaggaaggaaagcaggagaaaggaagg

SEQ ID NO: 235565 - RNA, 64 nt, Homo Sapiens
gcccacuguucucauagcuaaaaguuaagaaggaaggaaggaaagcaggagaaaggaaggauua

SEQ ID NO: 235566 - RNA, 64 nt, Homo Sapiens
aaaaguuaagaaggaaggaaggaaagcaggagaaaggaaggauuaauugccuguaugugaggac

SEQ ID NO: 235567 - RNA, 64 nt, Homo Sapiens
aagguucuuucuggcugguugcagaguagcugucaggaaggagacaaaacccaggagguagcug

SEQ ID NO: 235568 - RNA, 64 nt, Homo Sapiens
ucgggcaggacugacacuguacaccgucuggaacaggaaggacacuucacauggggcaccagga

SEQ ID NO: 235569 - RNA, 64 nt, Homo Sapiens
aaguuguagagagaaaaagaggacaaauggggacaggaaggaucaucugcaccuuacaacucgg

SEQ ID NO: 235570 - RNA, 64 nt, Homo Sapiens
uugcuuuggacccuacacacucccgggcacauccaggaaggaccacgcuugagguccccggagc

SEQ ID NO: 235571 - RNA, 64 nt, Homo Sapiens
cucucauuuccccaagcauacaaacaaggcccugaggaaggagaaugcuguguggcuucagacc

SEQ ID NO: 235572 - RNA, 64 nt, Homo Sapiens
gagcugaugacuuaagggcacauggagccuguugaggaaggauuuggauucccacuucuuaccu

SEQ ID NO: 235573 - RNA, 64 nt, Homo Sapiens
gauaacgaggagaaaauaaauuacuggugcugaaaggaaggaugaagagagguguucuuuuucc

SEQ ID NO: 235574 - RNA, 64 nt, Homo Sapiens
uguucauuuucauuuguccacgcgggggccacugaggaaggaaaucucaaaggaagccacaagg

SEQ ID NO: 235575 - RNA, 64 nt, Homo Sapiens
aguccagaagggccacagagucccuuaucacugaaggaaggaagccaaguguguaccucauucu

SEQ ID NO: 235576 - RNA, 64 nt, Homo Sapiens
aguaagucauuaguaauaaaacgccccagucugcaggaaggaugccagaggacacacaggggag

SEQ ID NO: 235577 - RNA, 64 nt, Homo Sapiens
gagcggggagcacugaugaggugcuggggaugacaggaaggaaggaacacugggcagaaccaga

SEQ ID NO: 235578 - RNA, 64 nt, Homo Sapiens
ggggagcacugaugaggugcuggggaugacaggaaggaaggaacacugggcagaaccagagaga

SEQ ID NO: 235579 - RNA, 64 nt, Homo Sapiens
gagaggaagggaagguggcagaaagucucauuucaggaaggagggauagaaggaaggaaggaag

SEQ ID NO: 235580 - RNA, 64 nt, Homo Sapiens
ggcagaaagucucauuucaggaaggagggauagaaggaaggaaggaaggaaccccccccccccc

SEQ ID NO: 235581 - RNA, 64 nt, Homo Sapiens
gaaagucucauuucaggaaggagggauagaaggaaggaaggaaggaacccccccccccccgaaa

SEQ ID NO: 235582 - RNA, 64 nt, Homo Sapiens
gucucauuucaggaaggagggauagaaggaaggaaggaaggaacccccccccccccgaaaaaaa

SEQ ID NO: 235583 - RNA, 64 nt, Homo Sapiens
gccaguuugaugcagcacuucagaucaagugcuuaggaaggagaggaaacuugccuuuuuuaug

SEQ ID NO: 235584 - RNA, 64 nt, Homo Sapiens
auuuucuccuguggagcccuagagcagguuacuaaggaaggacacauuguuuuccagaagccuc

SEQ ID NO: 235585 - RNA, 64 nt, Homo Sapiens
cugcugaugcgcugggaucugauugaggauaaaaaggaaggagagaugaccccuacccccucau

SEQ ID NO: 235586 - RNA, 64 nt, Homo Sapiens
gcacugggcgucugacucccuccccacccaagagaggaaggaccccucaccacccccacuggug

SEQ ID NO: 235587 - RNA, 64 nt, Homo Sapiens
uacugaccaucggcugccugaagacaugcccaagaggaaggaagaauacucugugcacggagga

SEQ ID NO: 235588 - RNA, 64 nt, Homo Sapiens
gagguguguucccaccguaccauugcccgguacuaggaaggaguagggacccgacuugcagacg

SEQ ID NO: 235589 - RNA, 64 nt, Homo Sapiens
cgcuuccuguugucggugcuaggcugccugaggaaggaaggacccccccuccccggccagccug

SEQ ID NO: 235590 - RNA, 64 nt, Homo Sapiens
gacccgcuuccuguugucggccugaggcugccugaggaaggaagcccacccccuccccggccag

SEQ ID NO: 235591 - RNA, 64 nt, Homo Sapiens
auucagucuccacugagaggaggcagccuccugaaggaaggaagggaccccaggucuucccugg

SEQ ID NO: 235592 - RNA, 54 nt, Homo Sapiens
ccaggucuucccuggaggcagugcaggaaggaccggacagccagccagcgcuga

SEQ ID NO: 235593 - RNA, 64 nt, Homo Sapiens
cucacgccuauacacccagcacuuuggaaggcugaggaaggaggaucgcuugaggccaggaguu

SEQ ID NO: 235594 - RNA, 64 nt, Homo Sapiens
gagaaagaaagaaagaaagaaagggaaagauggaaggaaggaaggaaaaagaaagagaaagaga

SEQ ID NO: 235595 - RNA, 64 nt, Homo Sapiens
aagaaagaaagaaagaaagggaaagauggaaggaaggaaggaaaaagaaagagaaagagagaga

SEQ ID NO: 235596 - RNA, 64 nt, Homo Sapiens
aggaggggagaggaggggaaaaggaaaggaaggaaggaaggaaacaaauggugcucagugcucc

SEQ ID NO: 235597 - RNA, 64 nt, Homo Sapiens
gaaaaggaggggagaggaggcuccaaggaaaggaaggaaggaagcuuccaaauggugcucagug

SEQ ID NO: 235598 - RNA, 64 nt, Homo Sapiens
gaaggaaaaggaggggagagagugcuccaaggaaaggaaggaagcaagcuuccaaauggugcuc

SEQ ID NO: 235599 - RNA, 64 nt, Homo Sapiens
cugccuugauuuuacuucagugaggaccaaaggcaggaaggaucggucuggaguucuggcuacu

SEQ ID NO: 235600 - RNA, 64 nt, Homo Sapiens
uugggucuggaguucuggcucuggauucugaggcaggaaggaauagaaagaaacaggcuggggc

SEQ ID NO: 235601 - RNA, 64 nt, Homo Sapiens
uuuuuuuccuaaaagauaauguuuauuuuuaaaaaggaaggaaggagcaagugaaguuucauuc

SEQ ID NO: 235602 - RNA, 64 nt, Homo Sapiens
uuuccuaaaagauaauguuuauuuuuaaaaaggaaggaaggagcaagugaaguuucauucugcu

SEQ ID NO: 235603 - RNA, 64 nt, Homo Sapiens
gaaggaagggaggacccaaugcaggaagaaaggaaggaaggaaaaauguagcuucucaggggag

SEQ ID NO: 235604 - RNA, 64 nt, Homo Sapiens
gaaagaaggaagggaggaccggaggcaggaagaaaggaaggaagcaaaaauguagcuucucagg

SEQ ID NO: 235605 - RNA, 64 nt, Homo Sapiens
gccagagggagagcuuggucucuggaccugccuuaggaaggagagggagggcaggaaggaaaag

SEQ ID NO: 235606 - RNA, 64 nt, Homo Sapiens
ucucuggaccugccuuaggaaggagagggagggcaggaaggaaaagaaaggacuuggagguggc

SEQ ID NO: 235607 - RNA, 64 nt, Homo Sapiens
uguaggaucacuacugcauucagugaaucagacaaggaaggaugcucccccacuggagugauuu

SEQ ID NO: 235608 - RNA, 64 nt, Homo Sapiens
aauagcuagguaagauuuuuuauuuuuuauuuaaaggaaggaaccacuuuuuuuaauuuaauuu

SEQ ID NO: 235609 - RNA, 64 nt, Homo Sapiens
ccaucuguucaaaaauuguggucaguaaacaggaaggaaggagguuuuucucagagccuugcau

SEQ ID NO: 235610 - RNA, 64 nt, Homo Sapiens
gaggccaucuguucaaaaaugcaugucaguaaacaggaaggaagauuauuuuucucagagccuu

SEQ ID NO: 235611 - RNA, 64 nt, Homo Sapiens
cccggagucccccagcacagucccaggagaugacaggaaggaagcaccagggcaaggcggacgc

SEQ ID NO: 235612 - RNA, 64 nt, Homo Sapiens
accuuccuggcaagaggcagaccccggggcccucaggaaggagggaguuggcagcgggggcugc

SEQ ID NO: 235613 - RNA, 64 nt, Homo Sapiens
gaaagaugggaggaagugcaagcaaaggaacagaaggaaggaaaggaaggagggaagaaaagaa

SEQ ID NO: 235614 - RNA, 64 nt, Homo Sapiens
gaagaaaagaaagcaaaggaaagggaagggcagaaggaaggagggcggagaggggagaagaagg

SEQ ID NO: 235615 - RNA, 64 nt, Homo Sapiens
cuccccuagagccuccaggggagcugggagaggcaggaaggaucgggacaccuggagcccccag

SEQ ID NO: 235616 - RNA, 64 nt, Homo Sapiens
cuccccuagagucucuggaggagcugggagaggcaggaaggaccgggaugccuggaguccccag

SEQ ID NO: 235617 - RNA, 65 nt, Homo Sapiens; identical to SEQ ID NO: 65698

SEQ ID NO: 235618 - RNA, 65 nt, Homo Sapiens; identical to SEQ ID NO: 65699

SEQ ID NO: 235619 - RNA, 65 nt, Homo Sapiens; identical to SEQ ID NO: 65706

SEQ ID NO: 235620 - RNA, 65 nt, Homo Sapiens; identical to SEQ ID NO: 65707

SEQ ID NO: 235621 - RNA, 65 nt, Homo Sapiens; identical to SEQ ID NO: 65720

SEQ ID NO: 235622 - RNA, 65 nt, Homo Sapiens; identical to SEQ ID NO: 65721

SEQ ID NO: 235623 - RNA, 65 nt, Homo Sapiens; identical to SEQ ID NO: 65744

SEQ ID NO: 235624 - RNA, 65 nt, Homo Sapiens; identical to SEQ ID NO: 65745

SEQ ID NO: 235625 - RNA, 65 nt, Homo Sapiens; identical to SEQ ID NO: 65788

SEQ ID NO: 235626 - RNA, 65 nt, Homo Sapiens; identical to SEQ ID NO: 65789

SEQ ID NO: 235627 - RNA, 65 nt, Homo Sapiens; identical to SEQ ID NO: 65808

SEQ ID NO: 235628 - RNA, 65 nt, Homo Sapiens; identical to SEQ ID NO: 65809

SEQ ID NO: 235629 - RNA, 65 nt, Homo Sapiens; identical to SEQ ID NO: 65810

SEQ ID NO: 235630 - RNA, 65 nt, Homo Sapiens; identical to SEQ ID NO: 65811

SEQ ID NO: 235631 - RNA, 65 nt, Homo Sapiens; identical to SEQ ID NO: 65827

SEQ ID NO: 235632 - RNA, 65 nt, Homo Sapiens; identical to SEQ ID NO: 65828

SEQ ID NO: 235633 - RNA, 65 nt, Homo Sapiens; identical to SEQ ID NO: 65831

SEQ ID NO: 235634 - RNA, 56 nt, Homo Sapiens; identical to SEQ ID NO: 61369

SEQ ID NO: 235635 - RNA, 65 nt, Homo Sapiens; identical to SEQ ID NO: 65853

SEQ ID NO: 235636 - RNA, 65 nt, Homo Sapiens; identical to SEQ ID NO: 65854

SEQ ID NO: 235637 - RNA, 65 nt, Homo Sapiens; identical to SEQ ID NO: 65891

SEQ ID NO: 235638 - RNA, 65 nt, Homo Sapiens; identical to SEQ ID NO: 65892

SEQ ID NO: 235639 - RNA, 65 nt, Homo Sapiens; identical to SEQ ID NO: 65896

SEQ ID NO: 235640 - RNA, 65 nt, Homo Sapiens; identical to SEQ ID NO: 65897

SEQ ID NO: 235641 - RNA, 64 nt, Homo Sapiens
auauccugaugcaucuguuucaccauuuugauuuuuaaaguaugcuguagcauuucuuaauaac

SEQ ID NO: 235642 - RNA, 64 nt, Homo Sapiens
aauaaauuauaggcucauuuuguucucugcuaguuuaaaguaauucguuuaauaauagaugugu

SEQ ID NO: 235643 - RNA, 64 nt, Homo Sapiens
ucugaccaaucaaguacacuaaauuagaauauuuuuaaaguauguaacauucccaguuucagcc

SEQ ID NO: 235644 - RNA, 64 nt, Homo Sapiens
aacuguguuuuuuaauuaaucaauaacugcaaaauuaaaguaccuucaauggauaagacaauug

SEQ ID NO: 235645 - RNA, 64 nt, Homo Sapiens
gauaaaaacaaaauauuuuggaguguuuuccaacuuaaaguaugaagacauacucaguucuugg

SEQ ID NO: 235646 - RNA, 64 nt, Homo Sapiens
uuuccuaaucuuuccuauuucuuaacaaaagauuuuaaaguacuucucuagucauugaaguuuu

SEQ ID NO: 235647 - RNA, 64 nt, Homo Sapiens
accaaguauugaauaaagagaguuaauuaucuuuuuaaaguaaauaaaauuaugaaaauauaua

SEQ ID NO: 235648 - RNA, 64 nt, Homo Sapiens
uaacugguaagcgauuugaaacacuauuuuuauauuaaaguaaauggcauggaguauagugcaa

SEQ ID NO: 235649 - RNA, 64 nt, Homo Sapiens
uucgugaacauagaguuuggggccgaaaauguuuuuaaaguauguguuugaguuaaauauaaag

SEQ ID NO: 235650 - RNA, 64 nt, Homo Sapiens
uauggauuauggaagucuaguuucuagauugaauuuaaaguaaggccuaauaugagucauguua

SEQ ID NO: 235651 - RNA, 64 nt, Homo Sapiens
ucucuuauuuuagcaaauauaagcacucuaauuuuuaaaguaaaugguguacuuugcaagaaau

SEQ ID NO: 235652 - RNA, 64 nt, Homo Sapiens
uuucaguucugugucauggucaaggaugagauuuuuaaaguaugugugagccaccgugccuagc

SEQ ID NO: 235653 - RNA, 64 nt, Homo Sapiens
aacugcuacuguauuuaguggcuuuaguaguaguuuaaaguaguaggucauuuggagaacaagu

SEQ ID NO: 235654 - RNA, 64 nt, Homo Sapiens
cuuaaaaucaaaguauccaauagguucuuuucauuuaaaguagucuggcuuuaugguauuccau

SEQ ID NO: 235655 - RNA, 64 nt, Homo Sapiens
caccacaccauguuucugucuaaauguaagcuuguuaaaguaagaccaacccaauuacagggga

SEQ ID NO: 235656 - RNA, 64 nt, Homo Sapiens
ugugaaccuugucuaaguacaauauagaagucuuuuaaaguaaagauccuuagauuugcauuaa

SEQ ID NO: 235657 - RNA, 64 nt, Homo Sapiens
auuuggacccagagccagaaugaauaaucugauauuaaaguaguuauuuuuauaacuucccuga

SEQ ID NO: 235658 - RNA, 64 nt, Homo Sapiens
uuuuucugagaugcucacuuuauuaucccuauuuuuaaaguacacaauuguuuuaccuguucug

SEQ ID NO: 235659 - RNA, 64 nt, Homo Sapiens
uuauaaggaaauguauuuugacacugguaucuuauuaaaguauucugauccuaccacugcuggu

SEQ ID NO: 235660 - RNA, 64 nt, Homo Sapiens
uaaaaaaaagaaaccuugcaauguacccuagaacuuaaaguauacaaaccugcacguugugcac

SEQ ID NO: 235661 - RNA, 64 nt, Homo Sapiens
gacggggcuuugccauauugaauuuuuguacuuuuuaaaguagagugugccacuacacccggcu

SEQ ID NO: 235662 - RNA, 64 nt, Homo Sapiens
auuaaaauauacuauccaguuuuguuuuuauagauuaaaguaagugauguauauuuaaguuauu

SEQ ID NO: 235663 - RNA, 64 nt, Homo Sapiens
cauucauaaaaacuuacauuauuaguuaaaucccuuaaaguagauucuuuggucuuucauaugc

SEQ ID NO: 235664 - RNA, 64 nt, Homo Sapiens
agacucauugguacugacuggcaaguauucugcuuuaaaguaucauguauuaaaauguuuagac

SEQ ID NO: 235665 - RNA, 64 nt, Homo Sapiens
cuugaacugugcuacaaguaggggaaaaccuacuuuaaaguaugguaaauguguguuuuaaacu

SEQ ID NO: 235666 - RNA, 64 nt, Homo Sapiens
uguauguagcuuucuaggaaaauuuuacagacacuuaaaguauuuaugcuuaagugugcauuuu

SEQ ID NO: 235667 - RNA, 64 nt, Homo Sapiens
accaaggaauacuauauaaaguaaugagacugguuuaaaguaacaugccagaacuuacgcaucc

SEQ ID NO: 235668 - RNA, 64 nt, Homo Sapiens
ccucaaguccaguccucuaucacuuuugcaugaauuaaaguauauagcgcaaaagagcaccuaa

SEQ ID NO: 235669 - RNA, 64 nt, Homo Sapiens
guuucuuucaagaaaauauauuuggauggccuuuuuaaaguaacaggauauuuaauaagagucc

SEQ ID NO: 235670 - RNA, 64 nt, Homo Sapiens
uguguguaucagugucucaaauuugcuguuuuuauuaaaguaugaaaguaggugauauaagacc

SEQ ID NO: 235671 - RNA, 64 nt, Homo Sapiens
uguuuuacugagccuucugauuauuagucagcuuuuaaaguaauaguucuuucacuuacccuuu

SEQ ID NO: 235672 - RNA, 64 nt, Homo Sapiens
uucuaaagcaguuuauuauaaaauguguauaauuuuaaaguaauuuuaaaaaaucuguuguucc

SEQ ID NO: 235673 - RNA, 64 nt, Homo Sapiens
uuauggccuuuuuaaguauuuaugaugaagguaauuaaaguagauuuauuuauaguuaauaauc

SEQ ID NO: 235674 - RNA, 64 nt, Homo Sapiens
guaaaaagguuaauaucaaguaacuuauuagcucuuaaaguaaaauugaacuuauuaaaagcua

SEQ ID NO: 235675 - RNA, 64 nt, Homo Sapiens
aguagauuuuuuaccauguuaaauuauagugagauuaaaguauuacuaaacugugaugcuaugu

SEQ ID NO: 235676 - RNA, 64 nt, Homo Sapiens
uuuauuucuuuaaacaugauuuuugaaaguaccauuaaaguaaaaauuuguuauggauuagucu

SEQ ID NO: 235677 - RNA, 64 nt, Homo Sapiens
auccaguucuuacugauugagaacaguagcuaaauuaaaguaauaauguuuacuuuuuaggaca

SEQ ID NO: 235678 - RNA, 64 nt, Homo Sapiens
guuaaaaauacaaauguacuauauuguagucauuuuaaaguacacaaagggcacaaucaaaaug

SEQ ID NO: 235679 - RNA, 64 nt, Homo Sapiens
guuuccuuuugaauuuuaaguaucauaaauauuuuuaaaguaaauaauacggggugucaguaau

SEQ ID NO: 235680 - RNA, 64 nt, Homo Sapiens
aguuucaaaguugaaagauuaauuuugggaaauuuuaaaguaaaucuuuuucugcuuucauuuu

SEQ ID NO: 235681 - RNA, 64 nt, Homo Sapiens
aaugauuaaagaauaacuaauguauuaguguauuuuaaaguaauuggagggaaguagauaagaa

SEQ ID NO: 235682 - RNA, 64 nt, Homo Sapiens
uugcacugauaaauauauuuugcaacuuuaaaauuuaaaguauccagccaaggaaaaaugauac

SEQ ID NO: 235683 - RNA, 64 nt, Homo Sapiens
guagccucaguacugguguaaggcuguuuucuuuuuaaaguacuugcauaggcaaagaaggauu

SEQ ID NO: 235684 - RNA, 64 nt, Homo Sapiens
auauguaaacauauggguauaaaaggaaaauuguuuaaaguauuugccuaaaauuuuauuuuua

SEQ ID NO: 235685 - RNA, 64 nt, Homo Sapiens
auuaauaauauaugucuguaaaaacagaaaaaaauuaaaguauucaugggaauauuuuuuccuu

SEQ ID NO: 235686 - RNA, 64 nt, Homo Sapiens
cuuuaucuaggaguuuguuuuucauuuuguuuuuuuaaaguauuagaaaagguuuuagcugaaa

SEQ ID NO: 235687 - RNA, 64 nt, Homo Sapiens
gugacccuuuauacauuucauuuuuuauuugauauuaaaguaugagauagaguugagagacaau

SEQ ID NO: 235688 - RNA, 64 nt, Homo Sapiens
aaaacaacaauucuauagauauagacauauuuuuuuaaaguauaaaaaagaaaaaaaagaaagc

SEQ ID NO: 235689 - RNA, 64 nt, Homo Sapiens
auuugaacuuuuuaagaugauuccccaaauaauauuaaaguauuggucaaauuucuguucucuc

SEQ ID NO: 235690 - RNA, 64 nt, Homo Sapiens
uauaagccacuugucuugaaaacugugcaacuuuuuaaaguaaauuauuaagcagacuggaaaa

SEQ ID NO: 235691 - RNA, 64 nt, Homo Sapiens
cuuuuucaucccagaccaauggcauuauuaggucuuaaaguaguuacucccuucucguguuugc

SEQ ID NO: 235692 - RNA, 64 nt, Homo Sapiens
ucuacauucuugguuguuaauuuagagcguuugguuaaaguauguccuucagcugacuccagua

SEQ ID NO: 235693 - RNA, 64 nt, Homo Sapiens
uauuucucuggcaaacuuuucuuucuuuucuuuuuuaaaguaaacuuguguauugagucuuaac

SEQ ID NO: 235694 - RNA, 64 nt, Homo Sapiens
auaaaaauaaauaaauaauuauguaucccagaacuuaaaguauacaaaccugcacauucagcac

SEQ ID NO: 235695 - RNA, 64 nt, Homo Sapiens
aauuaagacacccuauugacauuuauuuuuuugauuaaaguauaaaaauauuaaauauuuucuu

SEQ ID NO: 235696 - RNA, 64 nt, Homo Sapiens
aguuugguauguuuauuguaaaaaacucuuuuuuuuaaaguaacuucuuuccaaagcaaugucu

SEQ ID NO: 235697 - RNA, 64 nt, Homo Sapiens
cccuccauacauggggaaguaucaacugcauggauuaaaguaguguuauucguauuuugcuaau

SEQ ID NO: 235698 - RNA, 64 nt, Homo Sapiens
ugaaauucauuuaaacaguuuggcuguauaauuguuaauucaaagcgaauguaggaccucugag

SEQ ID NO: 235699 - RNA, 64 nt, Homo Sapiens
ugaacccaucaacuggaugcagccuccaaaccauuuaauucaaaucaauuuaaaaaaucacguu

SEQ ID NO: 235700 - RNA, 64 nt, Homo Sapiens
aacaacaaaaaauacauauaauuugacauugaguuuaauucagcuuguauuuuuuaauuuuuga

SEQ ID NO: 235701 - RNA, 64 nt, Homo Sapiens
gauugaaaaauuaacuggauuuguugacuuaaauuuaauucaagagaaaauacuuaauacacau

SEQ ID NO: 235702 - RNA, 64 nt, Homo Sapiens
gcuuccacuucacccaaaauguuaaaauuuuuacuuaauucauagccuuccuugguuucauauu

SEQ ID NO: 235703 - RNA, 64 nt, Homo Sapiens
ucauagccuuccuugguuucauauuuguuugcauuuaauucauguuugagucucuuaacugaug

SEQ ID NO: 235704 - RNA, 64 nt, Homo Sapiens
auuuucuaccugauacuuaagccaguggccuacuuuaauucacaauuccauuuugauuagcagg

SEQ ID NO: 235705 - RNA, 64 nt, Homo Sapiens
aauagcaacuuuaucaaagugacuguacugcaaauuaauucauaaugccugauaguuuuauaua

SEQ ID NO: 235706 - RNA, 64 nt, Homo Sapiens
ccugcugcugaguuaugcacagcuuugguuuaauuuaauucaggauugauggccaucacaaugc

SEQ ID NO: 235707 - RNA, 64 nt, Homo Sapiens
uacucuauuugaugauaaacuuaaaaaugaaaucuuaauucauuauaaauaugucucuuuauuu

SEQ ID NO: 235708 - RNA, 64 nt, Homo Sapiens
augauaaauacauaguauucaaauuaauuuuuuauuaauucauguauacagcaauuacuuuuca

SEQ ID NO: 235709 - RNA, 64 nt, Homo Sapiens
ugaaucacuuaugaauugauccaguuuuaagguuuuaauucauuguucgcaacaucaaguagua

SEQ ID NO: 235710 - RNA, 64 nt, Homo Sapiens
uaugcuguguuuugaaaugaugguuucagauugauuaauucacaagauuuugaguuaugguuau

SEQ ID NO: 235711 - RNA, 64 nt, Homo Sapiens
aaugcaguuuuaccaaaagauuccaaucauaacuuuaauucaagucccuauagacauauuaaua

SEQ ID NO: 235712 - RNA, 64 nt, Homo Sapiens
cagcuugaaauagaugccucacaauucagacaguuuaauucaggaacugugacccugcaguguu

SEQ ID NO: 235713 - RNA, 64 nt, Homo Sapiens
gucaaguaucaguuuaccacauauuauuuuuauauuaauucaacauuugccuuaaguguguugu

SEQ ID NO: 235714 - RNA, 64 nt, Homo Sapiens
auuuaauaaaacauauauuauauugaacuauguguuaauucauuuguaucuuuuaaaaaauuau

SEQ ID NO: 235715 - RNA, 64 nt, Homo Sapiens
ccaagguaauaggaaaaguuugaguuaaguguuuuuaauucagucagugaauucagaauaagua

SEQ ID NO: 235716 - RNA, 64 nt, Homo Sapiens
ugccagacuccaauucugaauauuucuguucauauuaauucacucaauuguuuuaagaaaacuc

SEQ ID NO: 235717 - RNA, 64 nt, Homo Sapiens
uugacuucucauauguguuccagaacaaaaccuguuaauucagccucaccuuguugacuuccac

SEQ ID NO: 235718 - RNA, 64 nt, Homo Sapiens
auugaaaauaugcaguaacaggugauucuugcccuuaauucauagaauguauucacaggaagac

SEQ ID NO: 235719 - RNA, 64 nt, Homo Sapiens
uuuuucuucuuaaaaaucagcauauuacaagauuuuaauucaaaaaagaaacaaguccagaaau

SEQ ID NO: 235720 - RNA, 64 nt, Homo Sapiens
ccaaaaugaaauuauagggcuacugagaaguuaauuaauucaguuguucagcaccucagccccc

SEQ ID NO: 235721 - RNA, 64 nt, Homo Sapiens
ggcauuauagaauaauguguuauaacugugaagcuuaauucagaauaaaacauuuaacaaaauc

SEQ ID NO: 235722 - RNA, 64 nt, Homo Sapiens
ccuuaaaaaaauaggaagggaugacauuuauuuauuaauucauggcuucagcaacugcuuugca

SEQ ID NO: 235723 - RNA, 64 nt, Homo Sapiens
ggaaaaugagauuuacuaaguuucugacaaucacuuaauucagagaaaaggaagggugauucac

SEQ ID NO: 235724 - RNA, 64 nt, Homo Sapiens
ugauagcaaaaaacuugaaauauugcagcccaguuuaauucagcacuuucccauuuucauaacu

SEQ ID NO: 235725 - RNA, 64 nt, Homo Sapiens
guaauaguuaacauuaaacauuugauucauaaaguuaauucacugcuuaagcauguggcucaua

SEQ ID NO: 235726 - RNA, 64 nt, Homo Sapiens
auuauuuguuugaggaaaaaaagaaaucugcauuuuaauucauguuggucaaagucgaauuacu

SEQ ID NO: 235727 - RNA, 64 nt, Homo Sapiens
caaacuuguuuucuuuuuucuguuuuuuucuuuguuaauucauuuaaacucauugaaaacauag

SEQ ID NO: 235728 - RNA, 64 nt, Homo Sapiens
gauaagucccaauugaguaggcuacuagaaagguuuaauucaggguuuauuuucuugugcuuca

SEQ ID NO: 235729 - RNA, 64 nt, Homo Sapiens
uaacuuacacuagguguucucuccuuugccaucuuuaauucaccgucaguguugaggauguaau

SEQ ID NO: 235730 - RNA, 64 nt, Homo Sapiens
aauguacagaaaucuauuuuauaauaauuuauuuuuaauucauaagcaauuaauucacuaagcu

SEQ ID NO: 235731 - RNA, 64 nt, Homo Sapiens
auuuuauaauaauuuauuuuuaauucauaagcaauuaauucacuaagcugccuagccacacucu

SEQ ID NO: 235732 - RNA, 64 nt, Homo Sapiens
gggacuaagauggaaacacuuuuuuuauaaguuuuuaauucauagucacuaaagagauaaaugu

SEQ ID NO: 235733 - RNA, 64 nt, Homo Sapiens
cucaagauuuucuuaauuuaguucgcuguuuaaauuaauucauguccuguaaaguucugaccuu

SEQ ID NO: 235734 - RNA, 64 nt, Homo Sapiens
ggacuucuagacucaccuguucucacucccuguuuuaauucaacccagccaugcaaugccaaau

SEQ ID NO: 235735 - RNA, 64 nt, Homo Sapiens
ggagcuaucacuguacuuguagaguggugcugcuuuaauucauaaaucacaaauaaaagccaau

SEQ ID NO: 235736 - RNA, 64 nt, Homo Sapiens
gucuuuuagugcuuuuuaaaauuuuacccauucuuuaauucagcaucucccuauguauguguca

SEQ ID NO: 235737 - RNA, 64 nt, Homo Sapiens
acacacacauacuacuuuaagggggugaggaucauuaauucagauaauuuuuaaguuuccuagu

SEQ ID NO: 235738 - RNA, 64 nt, Homo Sapiens
uguuguauuacaauguauguagaaauaguaaccugugaacuaugcuuuuccauaacuuuuuaaa

SEQ ID NO: 235739 - RNA, 64 nt, Homo Sapiens
augcaaugugcauaaauauuuuuuaaacauaacagugaacuauugcaccuuuugcuaaugccuc

SEQ ID NO: 235740 - RNA, 64 nt, Homo Sapiens; identical to SEQ ID NO: 83364

SEQ ID NO: 235741 - RNA, 64 nt, Homo Sapiens; identical to SEQ ID NO: 83365

SEQ ID NO: 235742 - RNA, 64 nt, Homo Sapiens
aaucgccccagacuccuuuccucugaggaagaagggauaauagacacaucaaaugccccgaauu

SEQ ID NO: 235743 - RNA, 64 nt, Homo Sapiens
ucucuaagccacagcuucuucaucuuuaaaauaaggauaauaaucauucuuuccccucagagcu

SEQ ID NO: 235744 - RNA, 64 nt, Homo Sapiens
ucuuaacuuuauucaacuggacucagaauuguagggauaauaugaaugcaggaggaaacauucu

SEQ ID NO: 235745 - RNA, 64 nt, Homo Sapiens
cacaucggcacguaugauggugguuuggucagauggauaauacagcagacacacuuagaacacu

SEQ ID NO: 235746 - RNA, 64 nt, Homo Sapiens
uaauggcuauucuuccccagaacccagugucaggucuaggaaaucuuccuggcagacacaaaua

SEQ ID NO: 235747 - RNA, 64 nt, Homo Sapiens
gggucuguuucacaggccauuuuuccucugucucucuaggaauaugugccauaccagcugaggu

SEQ ID NO: 235748 - RNA, 64 nt, Homo Sapiens
gaauauaaccagaggaaaaaaggauggagaaauaucuaggaaagguaauuuugcgaaacacauu

SEQ ID NO: 235749 - RNA, 64 nt, Homo Sapiens
gaauauaaccagagaaaaaaaggauggagaaauaucuaggaaagguaauuuugcgaaacacauu

SEQ ID NO: 235750 - RNA, 64 nt, Homo Sapiens
aagugaggagcgucucugcccggccgccaucccaucuaggaagugaggagcgccucuucccacc

SEQ ID NO: 235751 - RNA, 64 nt, Homo Sapiens
aagugaggagcgccucuucccacccgccaucccaucuaggaagugaggagcuucucugccuggc

SEQ ID NO: 235752 - RNA, 64 nt, Homo Sapiens
uaccaacuguuuaaugcuauuugguaaagguuaaucuaggaaguguauugccauuauuuuguau

SEQ ID NO: 235753 - RNA, 64 nt, Homo Sapiens
gaaaauuuguuucaaauaugaauuaagcaacuggucuaggaaaguauuggagaaguagauaaug

SEQ ID NO: 235754 - RNA, 64 nt, Homo Sapiens
ucucaguuggaccauccuuaacuugauugaacugucuaggaacuuuacagauuguucugcaguu

SEQ ID NO: 235755 - RNA, 64 nt, Homo Sapiens
uauuugaacauuuuuucaauaauuccuuuuuacuucuaggaagucucaaaagaccaucuuaaau

SEQ ID NO: 235756 - RNA, 64 nt, Homo Sapiens
auucaguacaacccccaggcucacagcaguggcuucuaggaaacugggaguuuagaucagcuuu

SEQ ID NO: 235757 - RNA, 64 nt, Homo Sapiens
gcucaaaaacaugcugacagaaaacucccauggcucuaggaagaagugacacuaagccaacacc

SEQ ID NO: 235758 - RNA, 64 nt, Homo Sapiens
uccuaaagauuugggguuuucuaaaacuaaagaaucuaggaaccuugccugcgaccaaucaugg

SEQ ID NO: 235759 - RNA, 64 nt, Homo Sapiens
uacaaggaauacuaauggaucgucuuaaaauuggucuaggaaaaaaccuugguguguguuaugg

SEQ ID NO: 235760 - RNA, 64 nt, Homo Sapiens
aagugaggagcgccucugcccggccgccaucccaucuaggaagugaggagcgccucuucccagc

SEQ ID NO: 235761 - RNA, 64 nt, Homo Sapiens
aagugaggagcgccucuucccagccgccaucccaucuaggaagugaggagcgucucugcccggc

SEQ ID NO: 235762 - RNA, 64 nt, Homo Sapiens
uucagcaauacugauauucaguuuuauccaauauucuaggaauuuauucauguuuucauuuaaa

SEQ ID NO: 235763 - RNA, 64 nt, Homo Sapiens
uucagcaauacuaauauucuguuuuauccaguauucuaggaauuaguuguucauguuauuuaaa

SEQ ID NO: 235764 - RNA, 64 nt, Homo Sapiens; identical to SEQ ID NO: 193740

SEQ ID NO: 235765 - RNA, 64 nt, Homo Sapiens; identical to SEQ ID NO: 193741

SEQ ID NO: 235766 - RNA, 64 nt, Homo Sapiens; identical to SEQ ID NO: 193742

SEQ ID NO: 235767 - RNA, 64 nt, Homo Sapiens; identical to SEQ ID NO: 193743

SEQ ID NO: 235768 - RNA, 64 nt, Homo Sapiens; identical to SEQ ID NO: 193744

SEQ ID NO: 235769 - RNA, 64 nt, Homo Sapiens; identical to SEQ ID NO: 193745

SEQ ID NO: 235770 - RNA, 64 nt, Homo Sapiens
uaugaacaguuuucuuuuaaaauuuugagauuaagaaugccaggaauauugucauccuuugagc

SEQ ID NO: 235771 - RNA, 64 nt, Homo Sapiens
uaaguaaaaaaguaugcuuguuaauuuuauucaagaaugccaguagaaaauucauaacguguau

SEQ ID NO: 235772 - RNA, 64 nt, Homo Sapiens
cagaagccugauugguuaguuuaaugaaucuccagaaugccagccuggaguauuuauauggugc

SEQ ID NO: 235773 - RNA, 64 nt, Homo Sapiens
auuuuggaggaaauucuacucauuuugaaggggggaaugccagcgucagccuccaugcuuucuu

SEQ ID NO: 235774 - RNA, 64 nt, Homo Sapiens
ggggaccuacccaaaccaauauucauccccaauggaaugccaaacacuguugugccauguggaa

SEQ ID NO: 235775 - RNA, 64 nt, Homo Sapiens
cugucaccucaggagaaucgccccagccucuuuggaaugccauugauuguuccaugcacugugc

SEQ ID NO: 235776 - RNA, 62 nt, Homo Sapiens
auuaccaccaacuuucugacuaagcuaaaaaugaaugaaaaugguggcuaaagaaaauaggg

SEQ ID NO: 235777 - RNA, 62 nt, Homo Sapiens
ggaagaauguucaaguugaauccuaaugccgugaaugaaacacagucuguguagggaaugag

SEQ ID NO: 235778 - RNA, 62 nt, Homo Sapiens
aauuuggaagcccaguuccuuaggugggauaggaaugaaagccuaaaccucuuccuuuagcu

SEQ ID NO: 235779 - RNA, 62 nt, Homo Sapiens
aaaaugauuucuuaguaugauuguacaguaaugaaugaaaguggaacauguuucuuuuugaa

SEQ ID NO: 235780 - RNA, 62 nt, Homo Sapiens
ugaaaccggcaguuacacuaaguaaguggagggaaugaaaguguuucgaggugaauguggau

SEQ ID NO: 235781 - RNA, 62 nt, Homo Sapiens
cuuauaguaauucaggcucuaauuagcugagggaaugaaacacacaaaaaucacugaauucc

SEQ ID NO: 235782 - RNA, 62 nt, Homo Sapiens
aucuuuagagaccauuggcccacugaugaauggaaugaaaaagcgagcagauacuguugguc

SEQ ID NO: 235783 - RNA, 62 nt, Homo Sapiens
augacucgaaguuugcaguauggagaacaggugaaugaaauccugugccguucuucagucug

SEQ ID NO: 235784 - RNA, 62 nt, Homo Sapiens
acauuaguauguauaacuggcuuuaccaaauugaaugaaaaggagcuugugcaaaaaaauuu

SEQ ID NO: 235785 - RNA, 62 nt, Homo Sapiens
uuugggguuuaaagaaauggucugcauaaccugaaugaaagaagcaaaugacuauucucuga

SEQ ID NO: 235786 - RNA, 62 nt, Homo Sapiens
cuuuuauauuuacccuuuuugucaucacuuuagaaugaaaauucccauuuaaaucugaaagu

SEQ ID NO: 235787 - RNA, 62 nt, Homo Sapiens
ugcuuauuucuaaacauucugucauuuuuauagaaugaaaugugagccacugugccugaccu

SEQ ID NO: 235788 - RNA, 62 nt, Homo Sapiens
auaaaauguuuuaauaguagaggucagauuaugaaugaaaggauugcuucugauuauugaag

SEQ ID NO: 235789 - RNA, 62 nt, Homo Sapiens
ugguuggaaacuaaagguuccgggucugcagagaaugaaaacguuuuuauaaaaagaaagcc

SEQ ID NO: 235790 - RNA, 62 nt, Homo Sapiens
gcacaugcuuuuauccgugacaucccagagaagaaugaaaagagagcguguugcuguuguaa

SEQ ID NO: 235791 - RNA, 62 nt, Homo Sapiens
ccacuuuccugcuuuccauuaauuauuagagugaaugaaaaaucucuagcuuaucccugcac

SEQ ID NO: 235792 - RNA, 62 nt, Homo Sapiens
uaauuuaagaggacagaagaguaauauaaucagaaugaaaaaccuccacagcucauuucuuu

SEQ ID NO: 235793 - RNA, 60 nt, Homo Sapiens; identical to SEQ ID NO: 23583

SEQ ID NO: 235794 - RNA, 62 nt, Homo Sapiens
aaguuuacccagccugcuuugcuuuacugcaugaaugaaacugaugguucaauuucagaagu

SEQ ID NO: 235795 - RNA, 62 nt, Homo Sapiens
caaaacaaaaaucuguguaacuguaaaacauugaaugaaacuauuuuaccugaacuagauuu

SEQ ID NO: 235796 - RNA, 62 nt, Homo Sapiens
ccacauacaacauaacuguagaguucugacaagaaugaaauuagaaauuuuauuuccauugu

SEQ ID NO: 235797 - RNA, 62 nt, Homo Sapiens
aaagugugugcuguccaaaucuggcaccuuuggaaugaaagauccauggaucuguguucuga

SEQ ID NO: 235798 - RNA, 62 nt, Homo Sapiens
cagcaacuucuagcauauaguucuugguggcagaaugaaaauccauaaauaaaaguacaguu

SEQ ID NO: 235799 - RNA, 62 nt, Homo Sapiens
aaguauaaaguaacccauaagcaauucugggagaaugaaagggacgacaccuagcucuaaga

SEQ ID NO: 235800 - RNA, 62 nt, Homo Sapiens
uaagaaaaaauauauauugcucuucaacuagugaaugaaagaaacuucagaaagcuagaauu

SEQ ID NO: 235801 - RNA, 62 nt, Homo Sapiens
aacuaaacuaucagucauuuacauccucucaugaaugaaaugcaguguagggagaggagaug

SEQ ID NO: 235802 - RNA, 62 nt, Homo Sapiens
uuacuauaauuaccaaaaacauguauauaaaagaaugaaauugaaaaauaaaauauauaaac

SEQ ID NO: 235803 - RNA, 62 nt, Homo Sapiens
uacauucaaguuguacuuguuauaucugacaugaaugaaauaaaaucuuaauuacagaugcu

SEQ ID NO: 235804 - RNA, 62 nt, Homo Sapiens
auacauauauuuuuggaaaaguuaauuguguggaaugaaaaaagauuaaauuggagaaacgu

SEQ ID NO: 235805 - RNA, 62 nt, Homo Sapiens
uacuuuccccuuuguguuuuugucauuuuuuugaaugaaaaauguguugugugacauucaaa

SEQ ID NO: 235806 - RNA, 62 nt, Homo Sapiens
agauugggacaauagagacucauaaauaacaugaaugaaaaacaaucugguuuucuuuuacc

SEQ ID NO: 235807 - RNA, 62 nt, Homo Sapiens
gccaggagcugguacacuacagagucagaccagaaugaaaauaacaugaaaugguuuuagcu

SEQ ID NO: 235808 - RNA, 62 nt, Homo Sapiens
ucuuugguuguuuuauauauacuuacuaagaagaaugaaaaugccuagaauguauuuuaaau

SEQ ID NO: 235809 - RNA, 62 nt, Homo Sapiens
uucauuaauauuaaaauuguacuucaaacucagaaugaaauucagacccuugaagaaacguc

SEQ ID NO: 235810 - RNA, 62 nt, Homo Sapiens
aucuuuaaucaacacucaacucccaagggucugaaugaaagcgaggcgaauuuguugaaaag

SEQ ID NO: 235811 - RNA, 62 nt, Homo Sapiens
gucuguuguuacccacguaagucaguauaggggaaugaaagcuuggaauuuuuguuuuagug

SEQ ID NO: 235812 - RNA, 62 nt, Homo Sapiens
auuagacauaaugauaauuuuuuccauacucagaaugaaaaacuggauauuacguuuuuguu

SEQ ID NO: 235813 - RNA, 62 nt, Homo Sapiens
uuccucuuugcuguuuguaguagagacauuuugaaugaaacuuggcacugcuugauucaaaa

SEQ ID NO: 235814 - RNA, 62 nt, Homo Sapiens
uauuguguaacauggauaguuaaaacaauguugaaugaaaaaaaucaaaauacaaaugaaac

SEQ ID NO: 235815 - RNA, 62 nt, Homo Sapiens
gaaacauuguguaauaauauuuauguaaauuggaaugaaaucauuuauaaagaacaacuguu

SEQ ID NO: 235816 - RNA, 62 nt, Homo Sapiens
auaacucuuccugcuauucagaauaaguaggagaaugaaaacugcagcauaucagacagcaa

SEQ ID NO: 235817 - RNA, 62 nt, Homo Sapiens
guaauaaacuauucuuugaaacuuguuggguagaaugaaaauuaaagccauaaugguagaag

SEQ ID NO: 235818 - RNA, 62 nt, Homo Sapiens
gcuuuaaaaauagccuuaagcccacgaccccagaaugaaacauuuuaaaaacuuucucgcuc

SEQ ID NO: 235819 - RNA, 62 nt, Homo Sapiens
acuuugauuccugcgccuuuagaaagagaauagaaugaaauguccugagggcuagaggacag

SEQ ID NO: 235820 - RNA, 62 nt, Homo Sapiens
aagguuuuuuugauguuaccgcuaaaguaucagaaugaaagccgguauugacuggauugaca

SEQ ID NO: 235821 - RNA, 62 nt, Homo Sapiens
gcuacagcugagaaauaaaaucuccaguuucugaaugaaaaaacaacucagugaaaagaugg

SEQ ID NO: 235822 - RNA, 64 nt, Homo Sapiens
ugguacccaugugagacaugaacaacaggagggagggaaagagcccaggugggacgugggacag

SEQ ID NO: 235823 - RNA, 64 nt, Homo Sapiens
gaaagagcccaggugggacgugggacaggcuuaggggaaagagcuuguccuaucucaggaacaa

SEQ ID NO: 235824 - RNA, 64 nt, Homo Sapiens
cacacacacacacacacacuuuugcaagagugaugggaaagacccuaggugcucauaacuagag

SEQ ID NO: 235825 - RNA, 64 nt, Homo Sapiens
gggcuauaugccuauauuuauaaaccagcagcaggggaaagauuauauuuuauaagagggaaca

SEQ ID NO: 235826 - RNA, 64 nt, Homo Sapiens
uugcuaagugugcuuaguuuauaaagauaggauugggaaagaagauuuggcaccaggcaaacga

SEQ ID NO: 235827 - RNA, 64 nt, Homo Sapiens
uagguucuguuuuguuuuguguagcaaaggaugggggaaagaagauuugaggagggaaugauug

SEQ ID NO: 235828 - RNA, 64 nt, Homo Sapiens
ucuccuuuaaaacuaucaugguuauaauucuauugggaaagacuuuuagauaacaaagauuuca

SEQ ID NO: 235829 - RNA, 64 nt, Homo Sapiens
uuaaaacuuacugauauauuggacuuugagccaagggaaagaaugaguacuaucuuuccagaua

SEQ ID NO: 235830 - RNA, 64 nt, Homo Sapiens
augacuggauugcucuuuauccagcccacagcaggggaaagaaaggcaacucgcaaagaugaga

SEQ ID NO: 235831 - RNA, 64 nt, Homo Sapiens
uauauccugccugaauggggaagucuucuaaaaugggaaagaagugguuucaucuccacacagu

SEQ ID NO: 235832 - RNA, 64 nt, Homo Sapiens
ggucaccacuggacgggaaggagaacagaggagagggaaagagaagcccaaccucugugaucau

SEQ ID NO: 235833 - RNA, 64 nt, Homo Sapiens
guccaaggaauaagcaugaaugacaagaaaacaagggaaagaguuaaccugucacauagcaggu

SEQ ID NO: 235834 - RNA, 64 nt, Homo Sapiens
ggcccccaugauucaauuaccacgagaauagcacgggaaagacuucaugagacuuauucacugu

SEQ ID NO: 235835 - RNA, 64 nt, Homo Sapiens
ggcccccaugauucaauuaccacaagaauagcaugggaaagacuuugugaaacuuauucacuau

SEQ ID NO: 235836 - RNA, 64 nt, Homo Sapiens
aaacucgcccuaggcccuagauaguucagucccagggaaagagaaaacccuuuagugcuuugug

SEQ ID NO: 235837 - RNA, 64 nt, Homo Sapiens
ucugaauucaacacagagaaugugccccgacugugggaaagacacacagagagggacgacaucc

SEQ ID NO: 235838 - RNA, 64 nt, Homo Sapiens
ugucugcucagcagcucagcugauucagaucagagggaaagaaauaccaacccugcaauaagug

SEQ ID NO: 235839 - RNA, 64 nt, Homo Sapiens
ggaaaaaagcaaaauuggccugaauauucucuuggggaaagagggcaccaaagaaaaggguaag

SEQ ID NO: 235840 - RNA, 64 nt, Homo Sapiens
uguucuuccugccaucauuccuccuuuucccacagggaaagaaaaguuggaucacuaguggcca

SEQ ID NO: 235841 - RNA, 64 nt, Homo Sapiens
cuuucuucaccugcucuaggugcaaaggcauguugggaaagagauggauguuggggaggaagag

SEQ ID NO: 235842 - RNA, 64 nt, Homo Sapiens
gcuguagacuucuuuauguggcucaguggagagagggaaagaauguugcaccugcucuaguacc

SEQ ID NO: 235843 - RNA, 64 nt, Homo Sapiens
ugagcaggaggcagugaugucccuggucuauucagggaaagauuucagugugaaaugguaaaca

SEQ ID NO: 235844 - RNA, 64 nt, Homo Sapiens
aguugaugauagauugccuuucuggagcauaucagggaaagaaauuccacccaccccucuuuau

SEQ ID NO: 235845 - RNA, 64 nt, Homo Sapiens
ucagguuccuuuaaucacaggcaauguaggcugagggaaagacgcccaggccuggagcugggau

SEQ ID NO: 235846 - RNA, 55 nt, Homo Sapiens
gccaagugauggaacccugacccuggggaaagacgccuucaucugggacaaaacu

SEQ ID NO: 235847 - RNA, 64 nt, Homo Sapiens
acgccuucaucugggacaaaacuggagaugcaucgggaaagaagaaacuccgaagaaaagaauu

SEQ ID NO: 235848 - RNA, 64 nt, Homo Sapiens
uuuucuucuaguaagugucaagaauuagagaaaagggaaagaccaguuaccucagcagaagacu

SEQ ID NO: 235849 - RNA, 64 nt, Homo Sapiens
acacuacaugccuguugauucuguucacuguggugggaaagaucgccuuggacaaagaaucccu

SEQ ID NO: 235850 - RNA, 64 nt, Homo Sapiens
gacaaggggacggggucugugagagucaauucaggggaaagauacaagauugauuuguaaaacc

SEQ ID NO: 235851 - RNA, 64 nt, Homo Sapiens
uaaggaaauggcccaaugaacgugguugugggaggggaaagaggaaacagagcuagucagaugu

SEQ ID NO: 235852 - RNA, 64 nt, Homo Sapiens
uaacauuuguaggauuauuucgagggcagggcaggggaaagaaacgcguuaaagggccaugaca

SEQ ID NO: 235853 - RNA, 64 nt, Homo Sapiens
aguggagggcaggauucucagguccccauagagagggaaagagaagaccagaugugcauagaag

SEQ ID NO: 235854 - RNA, 64 nt, Homo Sapiens
caaguugggcaggauauggcaaccaggaggaauggggaaagaagaugaagaacccuugugaagu

SEQ ID NO: 235855 - RNA, 64 nt, Homo Sapiens
cuaaagacuucgugugauugcuccuguuugccaggggaaagaaccaguccucccaaucccacac

SEQ ID NO: 235856 - RNA, 64 nt, Homo Sapiens
auauuccauagguuuagggcgaccucccuuuauagggaaagaccgagaggucccucagaccugg

SEQ ID NO: 235857 - RNA, 64 nt, Homo Sapiens
cuuuauggaauguaagaagacagggacaagagaggggaaagauggugugacauccuucagcacc

SEQ ID NO: 235858 - RNA, 64 nt, Homo Sapiens
auguuauuucucccuaaguccuaaacacaaaaaagggaaagaaaacacugcuuuggaaauuauu

SEQ ID NO: 235859 - RNA, 64 nt, Homo Sapiens
gggcaggggcugcugggacaguagcagaggggcugggaaagaggugaggaggagggacucugga

SEQ ID NO: 235860 - RNA, 64 nt, Homo Sapiens
acaaaugacuauccugaacaggguggaggggugugggaaagaaaccagccauauugguuuuggu

SEQ ID NO: 235861 - RNA, 64 nt, Homo Sapiens
uuucccuagaaauuggcucaccuugggaaacccagggaaagaaucagcagguucucugcccucc

SEQ ID NO: 235862 - RNA, 64 nt, Homo Sapiens
aauuuucagcagaaaacauuuuccccuuaugauugggaaagauguuucaaguugcauauuuggu

SEQ ID NO: 235863 - RNA, 64 nt, Homo Sapiens
aacaagugacugagaagucuaaggaaaagugaaagggaaagagaccuuuguuuucaaaagcaca

SEQ ID NO: 235864 - RNA, 64 nt, Homo Sapiens
cucgggccgcuccccugcgcgaaagaccuacagagggaaagaccucuggauguuccuacagagg

SEQ ID NO: 235865 - RNA, 64 nt, Homo Sapiens
uacagagggaaagacccucggauguuccuacagagggaaagacccuugcuuccagaaucuucug

SEQ ID NO: 235866 - RNA, 64 nt, Homo Sapiens
cccagagcagaaaagaagcacauccuaagauucagggaaagacuaacugugaaaaggaaggcug

SEQ ID NO: 235867 - RNA, 64 nt, Homo Sapiens
gaggugccucugaggauuaggguugagcacucaagggaaagauggaguagagggcaaauagcaa

SEQ ID NO: 235868 - RNA, 64 nt, Homo Sapiens
agcagaauacuugagaugaacuuguuugucuguggggaaagaaagucugcuguaaagaacaaca

SEQ ID NO: 235869 - RNA, 64 nt, Homo Sapiens
ucugcuguaaagaacaacacgauugguauguagagggaaagaggaguaguuaugcgaguggaua

SEQ ID NO: 235870 - RNA, 64 nt, Homo Sapiens
auuacugauaaaugaaggggaggaagaagggacagggaaagauaugccagaugaugggaaggca

SEQ ID NO: 235871 - RNA, 64 nt, Homo Sapiens
ggguguguguccgcaucccccugcuaggggaguugggaaagaguagccaagucagcucugccaa

SEQ ID NO: 235872 - RNA, 64 nt, Homo Sapiens
gacaucuuucccguggagcaacuuccugcuccacgggaaagaggucgauggauuuaccccugga

SEQ ID NO: 235873 - RNA, 64 nt, Homo Sapiens
uggaauuguacauuuauuuuuuaaaacucaaagagggaaagagccuuguaucauaugugaacau

SEQ ID NO: 235874 - RNA, 64 nt, Homo Sapiens
guccagcacagcggccugcuggacucugagaacugggaaagaucagagcaagccuugccucuua

SEQ ID NO: 235875 - RNA, 64 nt, Homo Sapiens
ggguggaguugaccagagaaaggggagagaauucgggaaagacccaaaguguuuguaauucuuc

SEQ ID NO: 235876 - RNA, 64 nt, Homo Sapiens
aagggcaccguggguguaaggccagguggagagggggaaagaggcagugccugcagguugccug

SEQ ID NO: 235877 - RNA, 64 nt, Homo Sapiens
cugauaugaggaagggucugugagccaggcagaggggaaagaaggggagaagcccagcagaagc

SEQ ID NO: 235878 - RNA, 64 nt, Homo Sapiens
gcugccauuccugacagccugccaugaaggaagagggaaagagguucagacccagucuguugga

SEQ ID NO: 235879 - RNA, 64 nt, Homo Sapiens
ucccaccucauucggcaccaaaaaguucacacuagggaaagaacuuacaaaugcagcaaaugug

SEQ ID NO: 235880 - RNA, 64 nt, Homo Sapiens
acaccagauaaagaauguauauauaaagcagauggggaaagacuucacacagaaaucuacucug

SEQ ID NO: 235881 - RNA, 64 nt, Homo Sapiens
aggaagcccuggugguaccagaggccagaauggugggaaagacagauccagauaaugcugggaa

SEQ ID NO: 235882 - RNA, 64 nt, Homo Sapiens
ugcuucgauggccccaaagcugggccagaguuaagggaaagaggaggaaguccuaagcagagaa

SEQ ID NO: 235883 - RNA, 64 nt, Homo Sapiens
aguagagccacagaaaaagaagaauuccaggagagggaaagaucguaaggaugagagaggagac

SEQ ID NO: 235884 - RNA, 64 nt, Homo Sapiens
agaguccucucccaaguggcugaggcaggcuuaggggaaagaaccagaggggcaggggaggacu

SEQ ID NO: 235885 - RNA, 64 nt, Homo Sapiens
cuuucuucucuagaauaaaucaggagacaaaauggggaaagaugaaaauauccaguguaaaguu

SEQ ID NO: 235886 - RNA, 64 nt, Homo Sapiens
ugcugacaggaauguaaaaugguacagccacucugggaaagaguuuaugaauuucuuaucaagu

SEQ ID NO: 235887 - RNA, 62 nt, Homo Sapiens
gacugagaggcuuuucuagcaugaggggucuacaccugcaaggugagggccaugcaugcagu

SEQ ID NO: 235888 - RNA, 62 nt, Homo Sapiens
ggacgaguccccgggccuggugagaaggucuacaccugcaagugcaggcauugcacauggug

SEQ ID NO: 235889 - RNA, 62 nt, Homo Sapiens
ggcugaggcccugggcccaggugaggaguguacaccugcaaggcacaggcauugcacacggu

SEQ ID NO: 235890 - RNA, 62 nt, Homo Sapiens
ggcugagucccugggcucagugaaugggucuacaccugcauguacaggcauugcacacagug

SEQ ID NO: 235891 - RNA, 62 nt, Homo Sapiens
ggcugaguuccugggcucgagugaagggucuacaccugcacagugcaggcauugcacacggu

SEQ ID NO: 235892 - RNA, 62 nt, Homo Sapiens
cccaggccucccucccccggaauggaagccuccaccugcagcccccuccugaccccaccuag

SEQ ID NO: 235893 - RNA, 62 nt, Homo Sapiens
gagcagcacgccaaccccaggacucacggcugcaccugcaggagcugaggggcagggccgua

SEQ ID NO: 235894 - RNA, 62 nt, Homo Sapiens
caggugauuaaaaagcuuuauuggacucagcccaccugcaccccacccuuugcugacucuuu

SEQ ID NO: 235895 - RNA, 62 nt, Homo Sapiens
cccagcaccuuaggaggccgcgugguggcucacaccugcaauagugcugcaguauggccaga

SEQ ID NO: 235896 - RNA, 62 nt, Homo Sapiens
guuucugguugucacugcacccacuggguguucaccugcaaaggggacccugccagggaagg

SEQ ID NO: 235897 - RNA, 62 nt, Homo Sapiens
caagguacccgaagaagcagccugccccaaugcaccugcaggaccuggcccaacagaaaaac

SEQ ID NO: 235898 - RNA, 62 nt, Homo Sapiens
ggcacgccuggcuuuccuuggauacccacugucaccugcacuaugaagugcugcuggcuggg

SEQ ID NO: 235899 - RNA, 62 nt, Homo Sapiens
ccccccuuuggcuuaauuaagugugcugucugcaccugcaagguauggccacccaaucuucu

SEQ ID NO: 235900 - RNA, 62 nt, Homo Sapiens
ucagugcccccuuuuggagagaugagcuguaucaccugcagaugugggguaaguggggagca

SEQ ID NO: 235901 - RNA, 62 nt, Homo Sapiens
gcagagcucauuguggaaacucuuggagaagccaccugcacaaccugcaaggcugucaacag

SEQ ID NO: 235902 - RNA, 62 nt, Homo Sapiens
gcugucaacagucuuggagacgaugccaaguacaccugcaagagugauguuugcggggauga

SEQ ID NO: 235903 - RNA, 62 nt, Homo Sapiens
ugccuugccaucgggcccaguucuccgggccccaccugcaccccuuucuucccccugggaua

SEQ ID NO: 235904 - RNA, 62 nt, Homo Sapiens
cuuugccccagggugggugcaggugcgagugucaccugcagcugccucagucauucagaguu

SEQ ID NO: 235905 - RNA, 62 nt, Homo Sapiens
cccagcuacuugggaggccaugugguaauguucaccugcaguucuacuaaaaauuagccaag

SEQ ID NO: 235906 - RNA, 62 nt, Homo Sapiens
agaagugcguaccagaaguagcagugugcugucaccugcaacaaaugaugaaguugcaaaug

SEQ ID NO: 235907 - RNA, 62 nt, Homo Sapiens
cccgugcacaggcacacgugcuggucugcacacaccugcacacaccugcacacucgcuaugc

SEQ ID NO: 235908 - RNA, 62 nt, Homo Sapiens
ggcacacgugcuggucugcacacaccugcacacaccugcacacucgcuaugccaggccuccu

SEQ ID NO: 235909 - RNA, 62 nt, Homo Sapiens
ccgcaaucuggcuccuccuggaaaauuucccccaccugcagcgcugggccccaaggcuugcc

SEQ ID NO: 235910 - RNA, 62 nt, Homo Sapiens
cccauacucccacuuugugccaaaugacuuugcaccugcaaauggugcuucaaugucguuuu

SEQ ID NO: 235911 - RNA, 62 nt, Homo Sapiens
aaauacaaaaaucagccagacaugguggcaugcaccugcaaucccagcuacucgggaggcug

SEQ ID NO: 235912 - RNA, 62 nt, Homo Sapiens
guuaacaugacauuuaccagcaacuugaacuucaccugcaaagcucuguggccacauuuuca

SEQ ID NO: 235913 - RNA, 62 nt, Homo Sapiens
cguaguucccugaaaacccagcuguguccuugcaccugcaucgacugccccaacuccuggaa

SEQ ID NO: 235914 - RNA, 62 nt, Homo Sapiens
uccccccacugcaggccccgcagggacagagacaccugcaccggagaaaugcauccauuccu

SEQ ID NO: 235915 - RNA, 62 nt, Homo Sapiens
cccagcuacuugggaggcugcaugauggcacgcaccugcaguaaguacaaaaauuagcuggg

SEQ ID NO: 235916 - RNA, 62 nt, Homo Sapiens
guccagugaaaugauauauugaucauccaaagcaccugcagaacagccauguccuauuccuu

SEQ ID NO: 235917 - RNA, 62 nt, Homo Sapiens
cacguguguaugcacuccccugcagggcuaugcaccugcaggacggugccaucucuugugua

SEQ ID NO: 235918 - RNA, 62 nt, Homo Sapiens
gucacucuuuugaugcugggcauuacugccuucaccugcauaagccacauuuccauuugcau

SEQ ID NO: 235919 - RNA, 62 nt, Homo Sapiens
aaagggucccaggcugucaggggcguuugcgccaccugcaagggcgugggucagagaguuuu

SEQ ID NO: 235920 - RNA, 62 nt, Homo Sapiens
ugcugucccggcuccaucuugguucuagccgccaccugcaugaacacaguggcccggcuuaa

SEQ ID NO: 235921 - RNA, 62 nt, Homo Sapiens
uguucuggucaaaacuaaaggaacucccuccccaccugcaggacuccgaagacagugcgacu

SEQ ID NO: 235922 - RNA, 62 nt, Homo Sapiens
cugagucagacaagugggagcuguaggaacugcaccugcagccucuucuuacuccccauuga

SEQ ID NO: 235923 - RNA, 62 nt, Homo Sapiens
guuguuggugucagggaggcuuacuggagccacaccugcaggcgcuguguucaggcaccacc

SEQ ID NO: 235924 - RNA, 62 nt, Homo Sapiens
gugucagcccagaugacuccucacccauccaccaccugcagcuugagauguuaacuauuaga

SEQ ID NO: 235925 - RNA, 62 nt, Homo Sapiens
agaagacgagagauagugggugugguggcucacaccugcaaucccagcacuuuggaaggccg

SEQ ID NO: 235926 - RNA, 62 nt, Homo Sapiens
ugacugcuggggacccucgccuucccuccucucaccugcaggcugauccuucuuuucacuuu

SEQ ID NO: 235927 - RNA, 62 nt, Homo Sapiens
uuacaccccgacccuccuccugucagcccccucaccugcagccuguugcccaauaaauuuaa

SEQ ID NO: 235928 - RNA, 62 nt, Homo Sapiens
augcugacccuaggauuuuccuucccugcccucaccugcaaaugaguuaaagaagaggcgug

SEQ ID NO: 235929 - RNA, 62 nt, Homo Sapiens
ccgucccucuccccggacaacaccccugcacacaccugcacaugcacgugcacacaccugca

SEQ ID NO: 235930 - RNA, 62 nt, Homo Sapiens
ccccugcacacaccugcacaugcacgugcacacaccugcacacugcccuagcaguuugccuc

SEQ ID NO: 235931 - RNA, 62 nt, Homo Sapiens
gaacgcucaacuugguugcgguaccaucagcccaccugcauuuggcuuucgacuugcuuguu

SEQ ID NO: 235932 - RNA, 62 nt, Homo Sapiens
guuuagauccaugccauucacugacucacuaacaccugcaaaaucuuuaaggaaaaaagcug

SEQ ID NO: 235933 - RNA, 62 nt, Homo Sapiens
uuggguggggcuccugggagggugcaggucuccaccugcacaaacuugcccugagcacuccu

SEQ ID NO: 235934 - RNA, 62 nt, Homo Sapiens
ggcugcccucuggggccacuacagccagguggcaccugcagcggagagacauggaaagggag

SEQ ID NO: 235935 - RNA, 64 nt, Homo Sapiens
aguugagcagacagccacauugggcagcgcccuuccucuccacccucccagaccugccucuucc

SEQ ID NO: 235936 - RNA, 64 nt, Homo Sapiens
cucuucccccugcuuccaccucaccccacuuaucccucuccauaaccccacccuugcccacccc

SEQ ID NO: 235937 - RNA, 64 nt, Homo Sapiens
ggguuugggcaggagauggccaaucaugcgcccaccucuccagugcugccugcagucagcucgg

SEQ ID NO: 235938 - RNA, 64 nt, Homo Sapiens
ccuggggacuaggaaaaggaaccaacuguaggcaccucuccagggccuagggagacaagugucc

SEQ ID NO: 235939 - RNA, 64 nt, Homo Sapiens
aaugcugguccuucagacccugcccgaacucccaccucuccauggccugccuagccaggcuggc

SEQ ID NO: 235940 - RNA, 64 nt, Homo Sapiens
uguaugugcgugugaugcuaccucuccucccgucccucuccaggggccccgcauacacacggcc

SEQ ID NO: 235941 - RNA, 64 nt, Homo Sapiens
caguguuggugcacauuugccucucacaugcugcccucuccacccacccagggacaccccacgg

SEQ ID NO: 235942 - RNA, 64 nt, Homo Sapiens
augaggcuaaaugucacccaacaaaaguuacauuccucuccacauauuuuaaaauauuauuuua

SEQ ID NO: 235943 - RNA, 64 nt, Homo Sapiens
cauuccauuuacagaguaugaaggcucuccuaacccucuccacaagcaucucuaguacuaccug

SEQ ID NO: 235944 - RNA, 64 nt, Homo Sapiens
ugcagaccccaugcgucccgggggcggccagcacccucuccacgccuacgucgggcuuccugcu

SEQ ID NO: 235945 - RNA, 64 nt, Homo Sapiens
cccacagggcagcagcaugagggugcacguccugccucuccagcugccccgccagccacaggcu

SEQ ID NO: 235946 - RNA, 64 nt, Homo Sapiens
ucugggcugaagccuccccaaggcgucugucaacccucuccacuccggcuuuuucuaaucaggc

SEQ ID NO: 235947 - RNA, 64 nt, Homo Sapiens
aagagcuuccuuucgugacggcgaccacguuuugccucuccaaauacagcugcgccggaucugg

SEQ ID NO: 235948 - RNA, 64 nt, Homo Sapiens
uauugauuucacagucagcugcucaacggaauggccucuccacaccagggauccuuagcaccca

SEQ ID NO: 235949 - RNA, 64 nt, Homo Sapiens
aauaguauuagaagaauugauccuauuuugaaccccucuccaguaucuucacacucuugucaac

SEQ ID NO: 235950 - RNA, 64 nt, Homo Sapiens
cuguucuguuuuucuccuagucccucuccugccaccucuccaagacuuccgugggacacccacu

SEQ ID NO: 235951 - RNA, 64 nt, Homo Sapiens
ugggcucagcaccugaggcggguuuccuggguccccucuccagcaagccuccaccagcaagcuc

SEQ ID NO: 235952 - RNA, 64 nt, Homo Sapiens
gaaggagaggaggaauuaguugggaugccaauuuccucuccacugcuggacaugagauggagag

SEQ ID NO: 235953 - RNA, 64 nt, Homo Sapiens
gguggccauguuaugcuggugguuaaggccagggccucuccaaccacugugccacugacuugcu

SEQ ID NO: 235954 - RNA, 64 nt, Homo Sapiens
uuggggagugcguggugucagaucccauccugcuccucuccagaguuuccggucaccuccgugu

SEQ ID NO: 235955 - RNA, 64 nt, Homo Sapiens
ucggggagugcguggugucagaucccauccugcuccucuccagcauuuccucucaccuccgugu

SEQ ID NO: 235956 - RNA, 64 nt, Homo Sapiens
ucggggagugcguggugucagaucccauccugcuccucuccagaguuuccucucaccuccgugu

SEQ ID NO: 235957 - RNA, 64 nt, Homo Sapiens
ccggaccccuccccggguuggcucucccuggagaccucuccaucauucccgaaaaguggaugga

SEQ ID NO: 235958 - RNA, 64 nt, Homo Sapiens
cucccacccagcccuuggugugcccacccagccuccucuccagcaccuugcugugcugcccucu

SEQ ID NO: 235959 - RNA, 64 nt, Homo Sapiens
ccccuuccuguucucaccugcccucuccacucucccucuccacugaagccuaugggagucagga

SEQ ID NO: 235960 - RNA, 64 nt, Homo Sapiens
cucccucuccacuccccuucaugggagucaggacccucuccacuggccagcccagaugaagccu

SEQ ID NO: 235961 - RNA, 64 nt, Homo Sapiens
uggccaaagauuuccuuucuguggugagggagaaccucuccaaagaggaagcaggcauaugagu

SEQ ID NO: 235962 - RNA, 64 nt, Homo Sapiens
uccaccccaggaaucucuguuccuucucugucugccucuccacagcccgugauccccugcuucu

SEQ ID NO: 235963 - RNA, 64 nt, Homo Sapiens
cuccuaccacccagcccuauccauucucuccuucccucuccagccugcuguauaaguaacaugu

SEQ ID NO: 235964 - RNA, 64 nt, Homo Sapiens
ggaccaugcugagacaucccucaucuagucuugaccucuccagcaucccagccucagaagccuu

SEQ ID NO: 235965 - RNA, 64 nt, Homo Sapiens
ucaugccccgccauggucacccucaggaacccacccucuccacacccagccugucccacuggcu

SEQ ID NO: 235966 - RNA, 64 nt, Homo Sapiens
uucucauucaugaugaccucucagugugccaagaccucuccagcaagguaaagguuuuggcugg

SEQ ID NO: 235967 - RNA, 64 nt, Homo Sapiens
uucccuggugugacccuucuuucucaaggggaacccucuccagcaacauagauucucugcagcu

SEQ ID NO: 235968 - RNA, 64 nt, Homo Sapiens
ccugagggccuccuaaaagguuuaaauguccacgccucuccaguugcugaaguagggucugaga

SEQ ID NO: 235969 - RNA, 64 nt, Homo Sapiens
cagggcggugggcaguccugguguagagcacaagccucuccacccuagagaaaugccucuguac

SEQ ID NO: 235970 - RNA, 64 nt, Homo Sapiens
ggccaugcuggucaucggcuugcccaggcuccagccucuccagauucugaggggucucagccca

SEQ ID NO: 235971 - RNA, 64 nt, Homo Sapiens
guaaacguauccucuguauucaguaaacaggcugccucuccagggagggcugccauucauucca

SEQ ID NO: 235972 - RNA, 64 nt, Homo Sapiens
agccagaaaucagaccaccgaagcucacucccuuccucuccaucucucccucucuccaagacuc

SEQ ID NO: 235973 - RNA, 64 nt, Homo Sapiens
uuuccaaaagcaaggcagccgugcuguucuaguuccucuccauccgccaccuccccucccgcug

SEQ ID NO: 235974 - RNA, 64 nt, Homo Sapiens
agaagggcaugggcacccccucaccccucggcccccucuccaaauacggguaaggccuaaaagg

SEQ ID NO: 235975 - RNA, 58 nt, Homo Sapiens
uucagcuucuucaucuucacccccgcgaccucuccaucucccgcacgcacaaucguga

SEQ ID NO: 235976 - RNA, 64 nt, Homo Sapiens
ucuuucccugacucuuggaucccagccagggcagccucuccacacaccuucacccucuuccuuc

SEQ ID NO: 235977 - RNA, 64 nt, Homo Sapiens
uucagagugagauucugcauuggggacuccacagccucuccaagaaugggcaggacccugagga

SEQ ID NO: 235978 - RNA, 64 nt, Homo Sapiens
ggggugggagguaggcuguggggugggcuggaguccucuccagagaggcucaacaaggaaaaau

SEQ ID NO: 235979 - RNA, 64 nt, Homo Sapiens
acgccaacuucucccaccccuuggccccucacauccucuccaggaagggagugaggggcuguga

SEQ ID NO: 235980 - RNA, 64 nt, Homo Sapiens
ugcagccccaucuccucagccaccccaacagcacccucuccagaacccucuccagaugagagua

SEQ ID NO: 235981 - RNA, 64 nt, Homo Sapiens
ugagaguacaccccaacagccaccccaacagcacccucuccagaacccucuccagaugagagua

SEQ ID NO: 235982 - RNA, 64 nt, Homo Sapiens; identical to SEQ ID NO: 235981

SEQ ID NO: 235983 - RNA, 64 nt, Homo Sapiens
ugagaguacaccccaacagcgcccccaacagcacccucuccagacacccucuccagaugggagu

SEQ ID NO: 235984 - RNA, 64 nt, Homo Sapiens
ugggagugcccccaacagcacaccccaacagcacccucuccagaccccugccuucccaggagua

SEQ ID NO: 235985 - RNA, 64 nt, Homo Sapiens
uuuggcacuagaacuccugauguucccacuugcaccucuccaccagcugacuuccuuagcugau

SEQ ID NO: 235986 - RNA, 64 nt, Homo Sapiens
gcgccagaaccuccuucucucacuuggcccucuuccucuccaaauugaccugaaucgggagcca

SEQ ID NO: 235987 - RNA, 64 nt, Homo Sapiens
cuccccuggcggcuccccacggcuccuacucugcccucuccaagagccugacuugguucaugga

SEQ ID NO: 235988 - RNA, 64 nt, Homo Sapiens
cguguuccccgaggagaucugaccucccuucuugccucuccagacagcuuugccccuguuugaa

SEQ ID NO: 235989 - RNA, 64 nt, Homo Sapiens
acucucaugcuuugcucaugccuucucugaacgaccucuccauuccgccucuccagguugacag

SEQ ID NO: 235990 - RNA, 64 nt, Homo Sapiens
uugacagccuucucugaacgugucuuucuucccgccucuccaggaggcuuguuuuacugccuuc

SEQ ID NO: 235991 - RNA, 64 nt, Homo Sapiens
augggcugcaguauagacagcugccucccucuccccucuccaccuccagcuccucacucagcuc

SEQ ID NO: 235992 - RNA, 64 nt, Homo Sapiens
ccuuuugcagcccuguuuaucagaaucuccgcugccucuccagcgccugaguccuucuguccgu

SEQ ID NO: 235993 - RNA, 64 nt, Homo Sapiens
ucuugugcacacagccaagauuucuucaaugggugugagcuaguugaggguuaaccuuguaggu

SEQ ID NO: 235994 - RNA, 64 nt, Homo Sapiens
ugaaggugguagaaucuuuucagccucuuagccagugagcuaaauauggcuaagcacaggucau

SEQ ID NO: 235995 - RNA, 64 nt, Homo Sapiens
uuuugcauaaaaugucuagucuuugccacagauagugagcuacccacuaaugagcccaugguuu

SEQ ID NO: 235996 - RNA, 64 nt, Homo Sapiens
ucacuguucugcaaugcucauggcaaguugaauggugagcuagcuuauaaauuaaagagcucug

SEQ ID NO: 235997 - RNA, 64 nt, Homo Sapiens
ccuuagagaaggcugucccguaucuagaaagcaggugagcuagcauuuaagccaguagauuccu

SEQ ID NO: 235998 - RNA, 64 nt, Homo Sapiens
aucaugccaucgcacuccagacacggagguugcagugagcuaaggagaaucacuugaaccuggg

SEQ ID NO: 235999 - RNA, 64 nt, Homo Sapiens; identical to SEQ ID NO: 141321

SEQ ID NO: 236000 - RNA, 64 nt, Homo Sapiens; identical to SEQ ID NO: 141322

SEQ ID NO: 236001 - RNA, 64 nt, Homo Sapiens; identical to SEQ ID NO: 141323

SEQ ID NO: 236002 - RNA, 64 nt, Homo Sapiens; identical to SEQ ID NO: 141324

SEQ ID NO: 236003 - RNA, 64 nt, Homo Sapiens; identical to SEQ ID NO: 141325

SEQ ID NO: 236004 - RNA, 64 nt, Homo Sapiens; identical to SEQ ID NO: 141326

SEQ ID NO: 236005 - RNA, 64 nt, Homo Sapiens; identical to SEQ ID NO: 141327

SEQ ID NO: 236006 - RNA, 64 nt, Homo Sapiens; identical to SEQ ID NO: 141328

SEQ ID NO: 236007 - RNA, 64 nt, Homo Sapiens; identical to SEQ ID NO: 141329

SEQ ID NO: 236008 - RNA, 64 nt, Homo Sapiens; identical to SEQ ID NO: 141330

SEQ ID NO: 236009 - RNA, 64 nt, Homo Sapiens; identical to SEQ ID NO: 141331

SEQ ID NO: 236010 - RNA, 64 nt, Homo Sapiens; identical to SEQ ID NO: 141332

SEQ ID NO: 236011 - RNA, 64 nt, Homo Sapiens; identical to SEQ ID NO: 141333

SEQ ID NO: 236012 - RNA, 64 nt, Homo Sapiens; identical to SEQ ID NO: 141334

SEQ ID NO: 236013 - RNA, 64 nt, Homo Sapiens; identical to SEQ ID NO: 141335

SEQ ID NO: 236014 - RNA, 64 nt, Homo Sapiens; identical to SEQ ID NO: 141336

SEQ ID NO: 236015 - RNA, 64 nt, Homo Sapiens; identical to SEQ ID NO: 141337

SEQ ID NO: 236016 - RNA, 64 nt, Homo Sapiens; identical to SEQ ID NO: 141338

SEQ ID NO: 236017 - RNA, 64 nt, Homo Sapiens; identical to SEQ ID NO: 141339

SEQ ID NO: 236018 - RNA, 64 nt, Homo Sapiens; identical to SEQ ID NO: 141340

SEQ ID NO: 236019 - RNA, 64 nt, Homo Sapiens; identical to SEQ ID NO: 141341

SEQ ID NO: 236020 - RNA, 64 nt, Homo Sapiens; identical to SEQ ID NO: 141342

SEQ ID NO: 236021 - RNA, 64 nt, Homo Sapiens; identical to SEQ ID NO: 141343

SEQ ID NO: 236022 - RNA, 64 nt, Homo Sapiens; identical to SEQ ID NO: 141344

SEQ ID NO: 236023 - RNA, 64 nt, Homo Sapiens; identical to SEQ ID NO: 141345

SEQ ID NO: 236024 - RNA, 64 nt, Homo Sapiens; identical to SEQ ID NO: 141346

SEQ ID NO: 236025 - RNA, 64 nt, Homo Sapiens; identical to SEQ ID NO: 141347

SEQ ID NO: 236026 - RNA, 64 nt, Homo Sapiens; identical to SEQ ID NO: 141348

SEQ ID NO: 236027 - RNA, 64 nt, Homo Sapiens; identical to SEQ ID NO: 141349

SEQ ID NO: 236028 - RNA, 64 nt, Homo Sapiens; identical to SEQ ID NO: 141350

SEQ ID NO: 236029 - RNA, 64 nt, Homo Sapiens; identical to SEQ ID NO: 141351

SEQ ID NO: 236030 - RNA, 64 nt, Homo Sapiens; identical to SEQ ID NO: 141352

SEQ ID NO: 236031 - RNA, 64 nt, Homo Sapiens; identical to SEQ ID NO: 141353

SEQ ID NO: 236032 - RNA, 64 nt, Homo Sapiens; identical to SEQ ID NO: 141354

SEQ ID NO: 236033 - RNA, 64 nt, Homo Sapiens; identical to SEQ ID NO: 141355

SEQ ID NO: 236034 - RNA, 64 nt, Homo Sapiens; identical to SEQ ID NO: 141356

SEQ ID NO: 236035 - RNA, 64 nt, Homo Sapiens; identical to SEQ ID NO: 141357

SEQ ID NO: 236036 - RNA, 64 nt, Homo Sapiens; identical to SEQ ID NO: 141358

SEQ ID NO: 236037 - RNA, 64 nt, Homo Sapiens; identical to SEQ ID NO: 141359

SEQ ID NO: 236038 - RNA, 64 nt, Homo Sapiens; identical to SEQ ID NO: 141360

SEQ ID NO: 236039 - RNA, 64 nt, Homo Sapiens; identical to SEQ ID NO: 141361

SEQ ID NO: 236040 - RNA, 64 nt, Homo Sapiens; identical to SEQ ID NO: 141362

SEQ ID NO: 236041 - RNA, 64 nt, Homo Sapiens; identical to SEQ ID NO: 141363

SEQ ID NO: 236042 - RNA, 64 nt, Homo Sapiens; identical to SEQ ID NO: 141364

SEQ ID NO: 236043 - RNA, 64 nt, Homo Sapiens; identical to SEQ ID NO: 141365

SEQ ID NO: 236044 - RNA, 64 nt, Homo Sapiens; identical to SEQ ID NO: 141366

SEQ ID NO: 236045 - RNA, 64 nt, Homo Sapiens; identical to SEQ ID NO: 141367

SEQ ID NO: 236046 - RNA, 64 nt, Homo Sapiens; identical to SEQ ID NO: 141368

SEQ ID NO: 236047 - RNA, 64 nt, Homo Sapiens; identical to SEQ ID NO: 141369

SEQ ID NO: 236048 - RNA, 64 nt, Homo Sapiens; identical to SEQ ID NO: 141370

SEQ ID NO: 236049 - RNA, 64 nt, Homo Sapiens; identical to SEQ ID NO: 141371

SEQ ID NO: 236050 - RNA, 64 nt, Homo Sapiens; identical to SEQ ID NO: 141372

SEQ ID NO: 236051 - RNA, 64 nt, Homo Sapiens; identical to SEQ ID NO: 141373

SEQ ID NO: 236052 - RNA, 64 nt, Homo Sapiens; identical to SEQ ID NO: 141374

SEQ ID NO: 236053 - RNA, 64 nt, Homo Sapiens; identical to SEQ ID NO: 141375

SEQ ID NO: 236054 - RNA, 64 nt, Homo Sapiens; identical to SEQ ID NO: 141376

SEQ ID NO: 236055 - RNA, 64 nt, Homo Sapiens; identical to SEQ ID NO: 141377

SEQ ID NO: 236056 - RNA, 64 nt, Homo Sapiens; identical to SEQ ID NO: 141378

SEQ ID NO: 236057 - RNA, 64 nt, Homo Sapiens; identical to SEQ ID NO: 141379

SEQ ID NO: 236058 - RNA, 64 nt, Homo Sapiens; identical to SEQ ID NO: 141380

SEQ ID NO: 236059 - RNA, 64 nt, Homo Sapiens; identical to SEQ ID NO: 141381

SEQ ID NO: 236060 - RNA, 64 nt, Homo Sapiens; identical to SEQ ID NO: 141382

SEQ ID NO: 236061 - RNA, 64 nt, Homo Sapiens; identical to SEQ ID NO: 215308

SEQ ID NO: 236062 - RNA, 64 nt, Homo Sapiens; identical to SEQ ID NO: 215309

SEQ ID NO: 236063 - RNA, 64 nt, Homo Sapiens; identical to SEQ ID NO: 215310

SEQ ID NO: 236064 - RNA, 64 nt, Homo Sapiens; identical to SEQ ID NO: 215311

SEQ ID NO: 236065 - RNA, 64 nt, Homo Sapiens; identical to SEQ ID NO: 215312

SEQ ID NO: 236066 - RNA, 64 nt, Homo Sapiens; identical to SEQ ID NO: 215313

SEQ ID NO: 236067 - RNA, 64 nt, Homo Sapiens; identical to SEQ ID NO: 215314

SEQ ID NO: 236068 - RNA, 64 nt, Homo Sapiens; identical to SEQ ID NO: 215315

SEQ ID NO: 236069 - RNA, 64 nt, Homo Sapiens; identical to SEQ ID NO: 215316

SEQ ID NO: 236070 - RNA, 64 nt, Homo Sapiens; identical to SEQ ID NO: 215317

SEQ ID NO: 236071 - RNA, 64 nt, Homo Sapiens; identical to SEQ ID NO: 215318

SEQ ID NO: 236072 - RNA, 64 nt, Homo Sapiens; identical to SEQ ID NO: 215319

SEQ ID NO: 236073 - RNA, 64 nt, Homo Sapiens; identical to SEQ ID NO: 215320

SEQ ID NO: 236074 - RNA, 64 nt, Homo Sapiens; identical to SEQ ID NO: 215321

SEQ ID NO: 236075 - RNA, 64 nt, Homo Sapiens; identical to SEQ ID NO: 215322

SEQ ID NO: 236076 - RNA, 64 nt, Homo Sapiens; identical to SEQ ID NO: 215323

SEQ ID NO: 236077 - RNA, 64 nt, Homo Sapiens; identical to SEQ ID NO: 215324

SEQ ID NO: 236078 - RNA, 58 nt, Homo Sapiens; identical to SEQ ID NO: 215325

SEQ ID NO: 236079 - RNA, 64 nt, Homo Sapiens; identical to SEQ ID NO: 215326

SEQ ID NO: 236080 - RNA, 64 nt, Homo Sapiens; identical to SEQ ID NO: 215327

SEQ ID NO: 236081 - RNA, 64 nt, Homo Sapiens
uaacaaugugguugacauaccuucaguugcuuuccacaucuaaaagaguuaucuuucauauaug

SEQ ID NO: 236082 - RNA, 64 nt, Homo Sapiens
guuauauuauggcagaucucuuuacguuuuuucucacaucuaucugcuaguccaggaauuuguu

SEQ ID NO: 236083 - RNA, 64 nt, Homo Sapiens
ccuuaucuaaagucaacugauuauggacuuuaaucacaucuacaaaacacuuccauggcgacag

SEQ ID NO: 236084 - RNA, 64 nt, Homo Sapiens
cagaggcacucagugggugguggggugauggauacacaucuaucaggcacagggcggagguggg

SEQ ID NO: 236085 - RNA, 64 nt, Homo Sapiens
uucuaaaagcuccuaacuuauauccaaagaauugcuuucugauucguguagucucucccacaga

SEQ ID NO: 236086 - RNA, 64 nt, Homo Sapiens
aauccacugccaauucagcuccucuggaguggagcuuucugauuucuuggagcaggaauuuuag

SEQ ID NO: 236087 - RNA, 64 nt, Homo Sapiens
acugucaggcuaacaggaauaagugguagccuugcuuucugagcaccaucuaaagaauuuuaaa

SEQ ID NO: 236088 - RNA, 64 nt, Homo Sapiens
aaaccaguuuuuaauaagaaaguuuaucuuuacucuuucugaaauuaugacuccagaaaaagaa

SEQ ID NO: 236089 - RNA, 64 nt, Homo Sapiens
acaugcuaucaguaauagucccaguuccauccaacuuucugaaauuucauuuuuuuuuuugaga

SEQ ID NO: 236090 - RNA, 64 nt, Homo Sapiens
gagauuacaggugugagccaccgcacccggccaacuuucugaaauuucaaaacugaauugaucc

SEQ ID NO: 236091 - RNA, 64 nt, Homo Sapiens
aggcugccauauuuugagcaagaauaauaauagucuuucugaugaucacaacuauuaaacuuag

SEQ ID NO: 236092 - RNA, 64 nt, Homo Sapiens
caaacugucuuuuuuuuguagagaaagcacagcacuuucugaucucucugguuucuuaacaaaa

SEQ ID NO: 236093 - RNA, 64 nt, Homo Sapiens
ucauuguaucuuuuuuuuacaaugguggaagcaacuuucugaaaguucagucuuaugcuacauc

SEQ ID NO: 236094 - RNA, 64 nt, Homo Sapiens
aguuuaguauauauauauuuuuuucuuuuugcuacuuucugaggcauuauguaaagggcucaua

SEQ ID NO: 236095 - RNA, 64 nt, Homo Sapiens
cuauuauuuauuuuuaaaugaaaguguaagaaugcuuucugauucaacaaauuuguuaucaaac

SEQ ID NO: 236096 - RNA, 64 nt, Homo Sapiens
guuauugggguuagggagguggggaagagauaaucuuucugauuaccuguuuugucuggauggc

SEQ ID NO: 236097 - RNA, 64 nt, Homo Sapiens
gcuaguaucuuggauuaacugaugccugcuagugcuuucugauuacucgcauucuguuucuugc

SEQ ID NO: 236098 - RNA, 64 nt, Homo Sapiens
auaagcaguucaaguuacugaaaaccuuuuaaaccuuucugaaguucguuaguauaaauuacuu

SEQ ID NO: 236099 - RNA, 64 nt, Homo Sapiens
acaaaaauauggagaagaguaauuugaaagccuacuuucugaagaaaauggugggauuuuuuuu

SEQ ID NO: 236100 - RNA, 64 nt, Homo Sapiens
acucucauuuuaaaaacguuuguguuuaauuuuccuuucugaaaaaaacauauauuuacuaaaa

SEQ ID NO: 236101 - RNA, 64 nt, Homo Sapiens
guucaguuuaaacagauuuuacccgacaccuuugcuuucugaugccacaaguggaaaauucccc

SEQ ID NO: 236102 - RNA, 64 nt, Homo Sapiens
agagugcauauuuaaucucuuuucuauacugcuccuuucugaugcuuauccuuucaucugugug

SEQ ID NO: 236103 - RNA, 64 nt, Homo Sapiens
gcauguaaguacgguaguaagaaaccuuugagaucuuucugacuuuucaaaauuagagaaagca

SEQ ID NO: 236104 - RNA, 64 nt, Homo Sapiens
uuugaguaucuucuguuguaaguuuacagucuuucuuucugaaucugugugaacgccaaacuaa

SEQ ID NO: 236105 - RNA, 64 nt, Homo Sapiens
agcggacaccggguuacauucuuguucagcgguucuuucugagggucaauggucaagcgugcag

SEQ ID NO: 236106 - RNA, 64 nt, Homo Sapiens
auuuaaaaagccaccacuguauaaaauguuuaaacuuucugagaaccagugguuucuucuaauu

SEQ ID NO: 236107 - RNA, 64 nt, Homo Sapiens
gugaaaagguucugucaagaaccaguaaaauuaucuuucugauauccuuaccuuuaccacuaau

SEQ ID NO: 236108 - RNA, 64 nt, Homo Sapiens
ugucucuucugugaaagggugagauguaaaauuccuuucugaaggaauguuguaaaacugucag

SEQ ID NO: 236109 - RNA, 64 nt, Homo Sapiens
gcaagcugcacugugagcugugucccugagucuccuuucugagucugugcauccugagaccuug

SEQ ID NO: 236110 - RNA, 64 nt, Homo Sapiens
cagucuccuuaugcguugaauauugccaaaugcucuuucugaaaaugcugaauugccuuuuuug

SEQ ID NO: 236111 - RNA, 64 nt, Homo Sapiens
uuuacucagcuacccaguagagcuugaagcugaccuuucugagaaguugguaugguguaacacu

SEQ ID NO: 236112 - RNA, 64 nt, Homo Sapiens
uccaaguugugugaccuuggcuaagucacuuaaccuuucugauugucauuucgcuuuuuaauaa

SEQ ID NO: 236113 - RNA, 64 nt, Homo Sapiens
gcucaaggaaauuauucacgaaggugaccacugucuuucugaccuggcacagaggaaauguugg

SEQ ID NO: 236114 - RNA, 64 nt, Homo Sapiens
aaaauaugaauaugauuggauucagaaaaauuaacuuucugaauuugaucugucuucagucuug

SEQ ID NO: 236115 - RNA, 64 nt, Homo Sapiens
aaacaguucuucucaaacauuuucauucagauagcuuucugaaaguucccuaucccucuuuacc

SEQ ID NO: 236116 - RNA, 64 nt, Homo Sapiens
caacuaaacuacagaaucagcuccuucaguugcccuuucugaggggaccaccuaacagcgcccc

SEQ ID NO: 236117 - RNA, 64 nt, Homo Sapiens
gcaggaggggcgaccagauaccccauuccugggccuuucugaggcugaagugccaaaggagccc

SEQ ID NO: 236118 - RNA, 64 nt, Homo Sapiens
cuaucuggcagcccgaugcccucccgccuguuuucuuucugacuucggaaguuuacuggcucug

SEQ ID NO: 236119 - RNA, 64 nt, Homo Sapiens
auaaaguuuugugcuuuggauuugauguccuuuccuuucugaaacugcacaggacaguccuauu

SEQ ID NO: 236120 - RNA, 64 nt, Homo Sapiens
uuaaagucagguccaauuuguaaaaacagcauugcuuucugaaauuagggcccaauuaauaauc

SEQ ID NO: 236121 - RNA, 64 nt, Homo Sapiens
cuauaaagcaacggcuccuguuaaaugguaucuccuuucugaggcuccuacuaaaagucauuug

SEQ ID NO: 236122 - RNA, 64 nt, Homo Sapiens
caaauaugucaugaccaucacagcagaggagugacuuucugacuaaugcugccacccacacaga

SEQ ID NO: 236123 - RNA, 64 nt, Homo Sapiens
acagccaaccagaaugagugggucaucuuauaaccuuucugaagcuccaugaggacauguauag

SEQ ID NO: 236124 - RNA, 64 nt, Homo Sapiens
uuccucucccaggucacuguuaauuucagagaugcuuucugauugagaaggggugacauuuuuu

SEQ ID NO: 236125 - RNA, 64 nt, Homo Sapiens
aucacuuaauucagaggaaaggaagggugauucacuuucugacacaugcuuaaagaggggaaaa

SEQ ID NO: 236126 - RNA, 64 nt, Homo Sapiens
ugucccagccugucuguuggccucacucagcucacuuucugacgccgccgccucuccagcucac

SEQ ID NO: 236127 - RNA, 64 nt, Homo Sapiens
uuagggggcuaggguggccaugacuuugucuccucuuucugagcaaggcuugaugcaccaggcc

SEQ ID NO: 236128 - RNA, 64 nt, Homo Sapiens
uuggauaugaauucccuguuaguugauuuaaauccuuucugaauaaagaucagauaaacaguaa

SEQ ID NO: 236129 - RNA, 64 nt, Homo Sapiens
ugaacuaaacucagcaguggucugguaucaagagcuuucugauguuuuacagccugaauuugga

SEQ ID NO: 236130 - RNA, 64 nt, Homo Sapiens
guagacggaacaguguggaaauauauuuuuacugcuuucugaauuggaaaguguucauugcaca

SEQ ID NO: 236131 - RNA, 64 nt, Homo Sapiens
auuuauauaacuguuguugaugacaaaguggguacuuucugaaauuccuuuuaaguggacucuc

SEQ ID NO: 236132 - RNA, 64 nt, Homo Sapiens
aacagaacacuggaauauuaauacucagaagcaacuuucugaaguucuagugaugaacaaaaug

SEQ ID NO: 236133 - RNA, 64 nt, Homo Sapiens
acaaagaaaaacagauacuauaauuugccaguuacuuucugacuuguuucuagucgucauaaug

SEQ ID NO: 236134 - RNA, 64 nt, Homo Sapiens
uaguaauaaaauagagcauaacgaaacugugaaacuuucugaagccuugucagugguuaaaagu

SEQ ID NO: 236135 - RNA, 64 nt, Homo Sapiens
gagacaauagaaauaaaaagaucuucagccaggccuuucugaaggaguuauucugcuaaaaaug

SEQ ID NO: 236136 - RNA, 64 nt, Homo Sapiens
cugcuuccucuuauaaaauaucauggccuuggcccuuucugaaguauacuuuaaaccccgcucc

SEQ ID NO: 236137 - RNA, 64 nt, Homo Sapiens
gcaagacugggauuggaucaggauucaacuuggccuuucugaagaguugcccuggcagaaaaau

SEQ ID NO: 236138 - RNA, 64 nt, Homo Sapiens
uuauuuuaccugcaauaggugugccuacaaaagucuuucugacauacacacugcagguggcagu

SEQ ID NO: 236139 - RNA, 64 nt, Homo Sapiens
aaaaggaccuaagauucucuggcucagccccagccuuucugaagaagggaaaacuagggaccca

SEQ ID NO: 236140 - RNA, 64 nt, Homo Sapiens
agcgguuugcagagaauguuagccaugacuugggcuuucugaaaguuggcuauaauuucucuau

SEQ ID NO: 236141 - RNA, 64 nt, Homo Sapiens
uacucaaagucuaacauauucaaugcaaguaagacuuucugaaaacacuugaugauguggaaau

SEQ ID NO: 236142 - RNA, 64 nt, Homo Sapiens; identical to SEQ ID NO: 138992

SEQ ID NO: 236143 - RNA, 64 nt, Homo Sapiens; identical to SEQ ID NO: 138993

SEQ ID NO: 236144 - RNA, 64 nt, Homo Sapiens; identical to SEQ ID NO: 138994

SEQ ID NO: 236145 - RNA, 64 nt, Homo Sapiens; identical to SEQ ID NO: 138995

SEQ ID NO: 236146 - RNA, 64 nt, Homo Sapiens; identical to SEQ ID NO: 138996

SEQ ID NO: 236147 - RNA, 64 nt, Homo Sapiens; identical to SEQ ID NO: 138997

SEQ ID NO: 236148 - RNA, 64 nt, Homo Sapiens; identical to SEQ ID NO: 138998

SEQ ID NO: 236149 - RNA, 64 nt, Homo Sapiens; identical to SEQ ID NO: 138999

SEQ ID NO: 236150 - RNA, 64 nt, Homo Sapiens; identical to SEQ ID NO: 139000

SEQ ID NO: 236151 - RNA, 64 nt, Homo Sapiens; identical to SEQ ID NO: 139001

SEQ ID NO: 236152 - RNA, 64 nt, Homo Sapiens; identical to SEQ ID NO: 139002

SEQ ID NO: 236153 - RNA, 64 nt, Homo Sapiens; identical to SEQ ID NO: 139003

SEQ ID NO: 236154 - RNA, 64 nt, Homo Sapiens; identical to SEQ ID NO: 139004

SEQ ID NO: 236155 - RNA, 64 nt, Homo Sapiens; identical to SEQ ID NO: 139005

SEQ ID NO: 236156 - RNA, 64 nt, Homo Sapiens; identical to SEQ ID NO: 139006

SEQ ID NO: 236157 - RNA, 64 nt, Homo Sapiens; identical to SEQ ID NO: 139007

SEQ ID NO: 236158 - RNA, 64 nt, Homo Sapiens; identical to SEQ ID NO: 139008

SEQ ID NO: 236159 - RNA, 64 nt, Homo Sapiens; identical to SEQ ID NO: 139009

SEQ ID NO: 236160 - RNA, 64 nt, Homo Sapiens; identical to SEQ ID NO: 139010

SEQ ID NO: 236161 - RNA, 64 nt, Homo Sapiens; identical to SEQ ID NO: 139011

SEQ ID NO: 236162 - RNA, 64 nt, Homo Sapiens; identical to SEQ ID NO: 139012

SEQ ID NO: 236163 - RNA, 64 nt, Homo Sapiens; identical to SEQ ID NO: 139013

SEQ ID NO: 236164 - RNA, 64 nt, Homo Sapiens; identical to SEQ ID NO: 139014

SEQ ID NO: 236165 - RNA, 64 nt, Homo Sapiens; identical to SEQ ID NO: 139015

SEQ ID NO: 236166 - RNA, 64 nt, Homo Sapiens; identical to SEQ ID NO: 139016

SEQ ID NO: 236167 - RNA, 64 nt, Homo Sapiens; identical to SEQ ID NO: 139017

SEQ ID NO: 236168 - RNA, 64 nt, Homo Sapiens; identical to SEQ ID NO: 139018

SEQ ID NO: 236169 - RNA, 64 nt, Homo Sapiens; identical to SEQ ID NO: 139019

SEQ ID NO: 236170 - RNA, 64 nt, Homo Sapiens; identical to SEQ ID NO: 139020

SEQ ID NO: 236171 - RNA, 64 nt, Homo Sapiens; identical to SEQ ID NO: 139021

SEQ ID NO: 236172 - RNA, 64 nt, Homo Sapiens; identical to SEQ ID NO: 139022

SEQ ID NO: 236173 - RNA, 64 nt, Homo Sapiens; identical to SEQ ID NO: 139023

SEQ ID NO: 236174 - RNA, 64 nt, Homo Sapiens; identical to SEQ ID NO: 139024

SEQ ID NO: 236175 - RNA, 64 nt, Homo Sapiens; identical to SEQ ID NO: 139025

SEQ ID NO: 236176 - RNA, 64 nt, Homo Sapiens; identical to SEQ ID NO: 139026

SEQ ID NO: 236177 - RNA, 64 nt, Homo Sapiens; identical to SEQ ID NO: 139027

SEQ ID NO: 236178 - RNA, 64 nt, Homo Sapiens; identical to SEQ ID NO: 139028

SEQ ID NO: 236179 - RNA, 64 nt, Homo Sapiens
cucaacacacaaagugccacgcucuguucuucuaccaacccaguccauaccagagaugugguga

SEQ ID NO: 236180 - RNA, 64 nt, Homo Sapiens
gacuuugccuccauuuucagggccaucuagguccccaacccaugggccugagcuacuugaaggg

SEQ ID NO: 236181 - RNA, 64 nt, Homo Sapiens
ccagcccagcucagcucagccagcccaacccggcccaacccagccagcacggccuagcccaacc

SEQ ID NO: 236182 - RNA, 51 nt, Homo Sapiens; identical to SEQ ID NO: 110042

SEQ ID NO: 236183 - RNA, 64 nt, Homo Sapiens
cauuaauagugaaccacaccaggagaacaaauacccaacccaguggcaucagcagucacagagc

SEQ ID NO: 236184 - RNA, 64 nt, Homo Sapiens
ggacuagacaucaaagcagcguuccaaccugaggccaacccaucucaccugacacugaauacug

SEQ ID NO: 236185 - RNA, 64 nt, Homo Sapiens
cgggccaggcgcagccaucgggaaggucauucagccaacccagaggauguagacccuguccuca

SEQ ID NO: 236186 - RNA, 64 nt, Homo Sapiens
cuucuccucacagggccuggccauauagccagcuccaacccaaagcccugcacagugccucacc

SEQ ID NO: 236187 - RNA, 64 nt, Homo Sapiens
agcccccuuagcgcccccgcggucgcugcugcagccaacccaguuccugcaccuuccucuccca

SEQ ID NO: 236188 - RNA, 64 nt, Homo Sapiens
uaccuccauuccacuugugaucugcccacccuccccaacccacaaaucuuaagccauguccuca

SEQ ID NO: 236189 - RNA, 64 nt, Homo Sapiens
ugcugggucccagccugguuugcaaagaccaccuccaacccaacccaaucccucuccacucuuc

SEQ ID NO: 236190 - RNA, 64 nt, Homo Sapiens
ggucccagccugguuugcaaagaccaccuccaacccaacccaaucccucuccacucuucucucc

SEQ ID NO: 236191 - RNA, 64 nt, Homo Sapiens
ucccagccgccagccaaagcucggcggacccaccccaacccaacagggaggcucugcucagagu

SEQ ID NO: 236192 - RNA, 64 nt, Homo Sapiens
cccgcuagaaaccugcugcgccagcugcugccucccaacccauguccgaguccugggucccagu

SEQ ID NO: 236193 - RNA, 64 nt, Homo Sapiens
uccaccccacaucccaccacauccaccuccauccccaacccauccucauccccaacuacagccc

SEQ ID NO: 236194 - RNA, 64 nt, Homo Sapiens
caacucauccucauccccaacugcagccccaaacccaacccagggccauccccaaacccauccc

SEQ ID NO: 236195 - RNA, 64 nt, Homo Sapiens
gccuugagacagcagccuaucuggggccacacagccaacccagcccuggucccugaggucugcc

SEQ ID NO: 236196 - RNA, 64 nt, Homo Sapiens
uccuugggccccuuccucugacccucguuggaccccaacccagacccccuuuucuccauguacc

SEQ ID NO: 236197 - RNA, 64 nt, Homo Sapiens
ggccaccccaagcccucugcucagccaacacuccccaacccaucaaagagaaauccugcaccca

SEQ ID NO: 236198 - RNA, 64 nt, Homo Sapiens
aucuuucuagucccuaugcucaauuauuuuauauccaacccagcuucuugaugcuuugggggcu

SEQ ID NO: 236199 - RNA, 64 nt, Homo Sapiens; identical to SEQ ID NO: 164794

SEQ ID NO: 236200 - RNA, 64 nt, Homo Sapiens; identical to SEQ ID NO: 164795

SEQ ID NO: 236201 - RNA, 64 nt, Homo Sapiens; identical to SEQ ID NO: 164796

SEQ ID NO: 236202 - RNA, 64 nt, Homo Sapiens; identical to SEQ ID NO: 164797

SEQ ID NO: 236203 - RNA, 64 nt, Homo Sapiens; identical to SEQ ID NO: 164798

SEQ ID NO: 236204 - RNA, 64 nt, Homo Sapiens; identical to SEQ ID NO: 164799

SEQ ID NO: 236205 - RNA, 64 nt, Homo Sapiens; identical to SEQ ID NO: 164800

SEQ ID NO: 236206 - RNA, 64 nt, Homo Sapiens; identical to SEQ ID NO: 164801

SEQ ID NO: 236207 - RNA, 64 nt, Homo Sapiens; identical to SEQ ID NO: 164802

SEQ ID NO: 236208 - RNA, 64 nt, Homo Sapiens; identical to SEQ ID NO: 164803

SEQ ID NO: 236209 - RNA, 64 nt, Homo Sapiens; identical to SEQ ID NO: 164804

SEQ ID NO: 236210 - RNA, 64 nt, Homo Sapiens; identical to SEQ ID NO: 164805

SEQ ID NO: 236211 - RNA, 64 nt, Homo Sapiens; identical to SEQ ID NO: 164806

SEQ ID NO: 236212 - RNA, 64 nt, Homo Sapiens; identical to SEQ ID NO: 164807

SEQ ID NO: 236213 - RNA, 64 nt, Homo Sapiens; identical to SEQ ID NO: 164808

SEQ ID NO: 236214 - RNA, 64 nt, Homo Sapiens; identical to SEQ ID NO: 164809

SEQ ID NO: 236215 - RNA, 64 nt, Homo Sapiens; identical to SEQ ID NO: 164810

SEQ ID NO: 236216 - RNA, 64 nt, Homo Sapiens; identical to SEQ ID NO: 164811

SEQ ID NO: 236217 - RNA, 64 nt, Homo Sapiens; identical to SEQ ID NO: 164812

SEQ ID NO: 236218 - RNA, 64 nt, Homo Sapiens; identical to SEQ ID NO: 164813

SEQ ID NO: 236219 - RNA, 64 nt, Homo Sapiens; identical to SEQ ID NO: 164814

SEQ ID NO: 236220 - RNA, 64 nt, Homo Sapiens; identical to SEQ ID NO: 164815

SEQ ID NO: 236221 - RNA, 64 nt, Homo Sapiens; identical to SEQ ID NO: 164816

SEQ ID NO: 236222 - RNA, 64 nt, Homo Sapiens; identical to SEQ ID NO: 164817

SEQ ID NO: 236223 - RNA, 64 nt, Homo Sapiens; identical to SEQ ID NO: 164818

SEQ ID NO: 236224 - RNA, 64 nt, Homo Sapiens; identical to SEQ ID NO: 164819

SEQ ID NO: 236225 - RNA, 64 nt, Homo Sapiens; identical to SEQ ID NO: 164820

SEQ ID NO: 236226 - RNA, 64 nt, Homo Sapiens; identical to SEQ ID NO: 164821

SEQ ID NO: 236227 - RNA, 64 nt, Homo Sapiens; identical to SEQ ID NO: 164822

SEQ ID NO: 236228 - RNA, 64 nt, Homo Sapiens; identical to SEQ ID NO: 164823

SEQ ID NO: 236229 - RNA, 64 nt, Homo Sapiens; identical to SEQ ID NO: 164824

SEQ ID NO: 236230 - RNA, 64 nt, Homo Sapiens; identical to SEQ ID NO: 164825

SEQ ID NO: 236231 - RNA, 64 nt, Homo Sapiens; identical to SEQ ID NO: 164826

SEQ ID NO: 236232 - RNA, 64 nt, Homo Sapiens; identical to SEQ ID NO: 164827

SEQ ID NO: 236233 - RNA, 64 nt, Homo Sapiens; identical to SEQ ID NO: 164828

SEQ ID NO: 236234 - RNA, 64 nt, Homo Sapiens
aaggggagcagaaaggaaacguuguuacugaugaguaccacagacucaucuuaaaaaaaacucu

SEQ ID NO: 236235 - RNA, 64 nt, Homo Sapiens
uuuaaaugguaaauauugcaaaaguuaaacaaggguaccacaauaucauuuauaauugauguca

SEQ ID NO: 236236 - RNA, 64 nt, Homo Sapiens
ggcuaaaguagaagaaaaccggcuuugucuaguaguaccacaguaaguggguucucugggcugu

SEQ ID NO: 236237 - RNA, 64 nt, Homo Sapiens
aacacagguaggggugcaggcuaaaagggcuggaguaccacaccuucguagugccagcacaguc

SEQ ID NO: 236238 - RNA, 64 nt, Homo Sapiens
uuaacuggaagaggaagcccugugucggagagauguaccacagcaaguguugucaaguacagug

SEQ ID NO: 236239 - RNA, 64 nt, Homo Sapiens
uguugucaaguacagugugucaaacaagacugauguaccacaagagggagaugaacaaaauugu

SEQ ID NO: 236240 - RNA, 64 nt, Homo Sapiens
cuagucauuaacucaacggaaucaaguagugaaagcacuauauucagaagaaaacagguuaaca

SEQ ID NO: 236241 - RNA, 64 nt, Homo Sapiens
auuugcuguacacacugaagugcugggcucagaagcacuauagauccaggggcagguaaagccc

SEQ ID NO: 236242 - RNA, 64 nt, Homo Sapiens
aauauaaaugauucuauuacaaauaugcuguaaggcacuauaagucauuuucucauuaacgaua

SEQ ID NO: 236243 - RNA, 64 nt, Homo Sapiens
uuugguucauuuucucauuaagguuucaggguuagcacuauaguacuuuguaagguucgguuua

SEQ ID NO: 236244 - RNA, 64 nt, Homo Sapiens
uaaaaccauucucuccccugccuccuccugagaugcacuauacuauaguuuucacauuuuaauu

SEQ ID NO: 236245 - RNA, 64 nt, Homo Sapiens
ucugaucugucacuguuguuagccaaugaaaacagcacuauauuuugguuggauucuucaacac

SEQ ID NO: 236246 - RNA, 64 nt, Homo Sapiens
ucucauuuucaaaagcaauucuucggugcuguguagcuggcagaaaguucuguccaguaaacgc

SEQ ID NO: 236247 - RNA, 64 nt, Homo Sapiens
cagauggaagaaauagcaggagagaggacccauuagcuggcagacccagggggaagaaaggagg

SEQ ID NO: 236248 - RNA, 64 nt, Homo Sapiens
guuucuaaaacuuucacuggacucggagacgucuagcuggcaaucaguauaucaaucaacucua

SEQ ID NO: 236249 - RNA, 64 nt, Homo Sapiens
ugcccuuaggaugccgcaugacuguccggauaagagcuggcaagguuguccaacaacagugcug

SEQ ID NO: 236250 - RNA, 64 nt, Homo Sapiens
gugcggagcugauaacauuugucucuuuggggagagcuggcaguuuccgguuggaggcucucau

SEQ ID NO: 236251 - RNA, 64 nt, Homo Sapiens
auucagacuuucagccgacuccugugugcaguggagcuggcaccgcuccccagaggucacacag

SEQ ID NO: 236252 - RNA, 64 nt, Homo Sapiens
gugucugagcagagcugggucgggcucccagaagagcuggcauuuugcuauccagcacguggac

SEQ ID NO: 236253 - RNA, 64 nt, Homo Sapiens
aggagcugcuuguucccaccaaaacaggauggggagcuggcaagccccuuguccugcagauggg

SEQ ID NO: 236254 - RNA, 64 nt, Homo Sapiens
gcccuaccugccuguucuccccccacucacagggagcuggcaaucaucuccucccaccaguggc

SEQ ID NO: 236255 - RNA, 64 nt, Homo Sapiens
cuccagugggaggacagagccugcaggaaaucagagcuggcagccugccgccuccuucuuaacu

SEQ ID NO: 236256 - RNA, 64 nt, Homo Sapiens
guuuuguggacagccguguugucugacuguauccagcuggcacuugacagggugcagucauugg

SEQ ID NO: 236257 - RNA, 64 nt, Homo Sapiens
agaugguuuaaggacaccccagaguccccagaugagcuggcauuugagcuggucuggagcagag

SEQ ID NO: 236258 - RNA, 64 nt, Homo Sapiens
uaauuuaauuuuaaaauaaaugcugcauugguaaagcuggcaguugaaaccaguuggacggccc

SEQ ID NO: 236259 - RNA, 64 nt, Homo Sapiens
uaauugacccuugcagcuacccaauagcccuuggagcuggcacugaaccaggcugcaagauuug

SEQ ID NO: 236260 - RNA, 64 nt, Homo Sapiens
agccugaccaucuggacacaagcagcaaggccccagcuggcagucccuccgcaggggacuucag

SEQ ID NO: 236261 - RNA, 64 nt, Homo Sapiens
aggccgggagggcuauucccgugucaacuccaagagcuggcacccugugucuccucccuguacc

SEQ ID NO: 236262 - RNA, 64 nt, Homo Sapiens
caguuaagcacucuuugacugcugaaggaaccccauggaugaggugcaggcuacuucacucuuu

SEQ ID NO: 236263 - RNA, 64 nt, Homo Sapiens
cgaagccaggagagguagagugaaaaucccagccauggaugaauguacuaauuugaaagccaag

SEQ ID NO: 236264 - RNA, 64 nt, Homo Sapiens
cccuuuuugucccuuuccccaagccaccaauuggauggaugaauguuugacggggaagaggaag

SEQ ID NO: 236265 - RNA, 64 nt, Homo Sapiens
uguuugacggggaagaggaaggguaggaggaugcauggaugaguggaugaguggaucgauggau

SEQ ID NO: 236266 - RNA, 64 nt, Homo Sapiens
aggcaguuucccagagaaacaagcauauugccucauggaugaaagacuuguaguucuaguuuca

SEQ ID NO: 236267 - RNA, 64 nt, Homo Sapiens
cauuggcuaaaaauguguuuuguugaguuuccaaauggaugaauuuucauuuggacauuacauc

SEQ ID NO: 236268 - RNA, 64 nt, Homo Sapiens
augacaaacaaucacugcgcugcagaauguccguauggaugaucugaucacgaaacaaucacgg

SEQ ID NO: 236269 - RNA, 64 nt, Homo Sapiens
acgaaacaaucacggugcagugcgaaauguccgcauggaugauccgaucacgaaacaaucacgg

SEQ ID NO: 236270 - RNA, 64 nt, Homo Sapiens; identical to SEQ ID NO: 153150

SEQ ID NO: 236271 - RNA, 64 nt, Homo Sapiens; identical to SEQ ID NO: 153151

SEQ ID NO: 236272 - RNA, 64 nt, Homo Sapiens; identical to SEQ ID NO: 153152

SEQ ID NO: 236273 - RNA, 64 nt, Homo Sapiens; identical to SEQ ID NO: 153153

SEQ ID NO: 236274 - RNA, 64 nt, Homo Sapiens; identical to SEQ ID NO: 153154

SEQ ID NO: 236275 - RNA, 64 nt, Homo Sapiens; identical to SEQ ID NO: 153155

SEQ ID NO: 236276 - RNA, 64 nt, Homo Sapiens; identical to SEQ ID NO: 153156

SEQ ID NO: 236277 - RNA, 64 nt, Homo Sapiens; identical to SEQ ID NO: 153157

SEQ ID NO: 236278 - RNA, 64 nt, Homo Sapiens; identical to SEQ ID NO: 153158

SEQ ID NO: 236279 - RNA, 64 nt, Homo Sapiens; identical to SEQ ID NO: 153159

SEQ ID NO: 236280 - RNA, 64 nt, Homo Sapiens; identical to SEQ ID NO: 153160

SEQ ID NO: 236281 - RNA, 64 nt, Homo Sapiens; identical to SEQ ID NO: 153161

SEQ ID NO: 236282 - RNA, 52 nt, Homo Sapiens; identical to SEQ ID NO: 153162

SEQ ID NO: 236283 - RNA, 64 nt, Homo Sapiens; identical to SEQ ID NO: 153163

SEQ ID NO: 236284 - RNA, 64 nt, Homo Sapiens
ucucagguagagauuggggcugcuauggggacuggcccuguaggguugagccacagacagcucu

SEQ ID NO: 236285 - RNA, 64 nt, Homo Sapiens
ccccaaccucucuauggcagagaggcagggaguggcccuguacauagacugcuggggauugggu

SEQ ID NO: 236286 - RNA, 64 nt, Homo Sapiens
cacguguaagauuauuuaaaucauuacguuccuggcccuguagagaaauuaaguuaacauggau

SEQ ID NO: 236287 - RNA, 64 nt, Homo Sapiens
cacuaugugaauaacugaaguuggaagagauucugcccuguagauuagugaacagaaaauugcu

SEQ ID NO: 236288 - RNA, 64 nt, Homo Sapiens
gcaaagaaugccgagcagcauuguugugggggcugcccuguacgauuuuggaccagaucguucu

SEQ ID NO: 236289 - RNA, 64 nt, Homo Sapiens
cucagggcagcuguuuccacgcaggugucagcgugcccuguaugccuuaaggaugggggaauca

SEQ ID NO: 236290 - RNA, 63 nt, Homo Sapiens
agcuuucuuucccaggggugaaggauggcgcucgggggugacuccuaagcucagcguggaagc

SEQ ID NO: 236291 - RNA, 63 nt, Homo Sapiens
uuuuuaacuuguuccucugucuacuguguguuugggggugacaucuaaauuccauuucuucuu

SEQ ID NO: 236292 - RNA, 63 nt, Homo Sapiens
aaacccuugcauuccaaaggauuauauaugucugggggugaaaguuuuuuguuuuuuaacaga

SEQ ID NO: 236293 - RNA, 63 nt, Homo Sapiens
ugggcccuaggcagacugcagcacgggaguggggggggugacaccaucucgcccuugcugggg

SEQ ID NO: 236294 - RNA, 63 nt, Homo Sapiens
aacgccagagcccuggcuggugaugugcuggcugggggugaaucccaaugagggucccucuca

SEQ ID NO: 236295 - RNA, 63 nt, Homo Sapiens
aacgccagagcccuggauggugaugcgcuggcugggggugaaucccaaugagggucccucuca

SEQ ID NO: 236296 - RNA, 63 nt, Homo Sapiens
aacgccagagcccuggcuggugacaugcuggcugggggugaauccgaaugacagugcagacgu

SEQ ID NO: 236297 - RNA, 63 nt, Homo Sapiens
ccaggacacaggaauagguugacagguucuguugggggugacagggugacaccaggagagagg

SEQ ID NO: 236298 - RNA, 63 nt, Homo Sapiens
ccaggagagagggacagguugacagguucugucgggggugacagggugacaagaggagacagg

SEQ ID NO: 236299 - RNA, 63 nt, Homo Sapiens
agaggagacagggacagguugacagguucuguugggggugacagggugacaccaggagagagg

SEQ ID NO: 236300 - RNA, 63 nt, Homo Sapiens
ccaggacacagggacagguugacagguucugucgggggugacagggugacaccaggacacagg

SEQ ID NO: 236301 - RNA, 63 nt, Homo Sapiens
ccgggcugucucgugguggcgucugcuuucugugggggugaggucuuuuuuuuuuuuuuugga

SEQ ID NO: 236302 - RNA, 63 nt, Homo Sapiens
gugugugacagucuacuggauuucucuaaguuggggggugagcgaccaugguguuucucuaug

SEQ ID NO: 236303 - RNA, 63 nt, Homo Sapiens
guaggugcuuuuuucuuaugacggggugggggcgggggugaggugacugcauuaacuuaacuu

SEQ ID NO: 236304 - RNA, 63 nt, Homo Sapiens
uuuggcagcccgagacccaggucggggcuuggugggggugacuccggacguccuacucaggcu

SEQ ID NO: 236305 - RNA, 63 nt, Homo Sapiens
gggugcacaccugcccagguaccauaauccagugggggugacucacccucucaugcuaccagc

SEQ ID NO: 236306 - RNA, 63 nt, Homo Sapiens
ccugcugugagaguucaggcagcauacaggcuugggggugagcuccaaagagagucagagcua

SEQ ID NO: 236307 - RNA, 63 nt, Homo Sapiens
uucuuccuccccucaacagugaguuagacucaagggggugacagaaccgagaagggggugaca

SEQ ID NO: 236308 - RNA, 63 nt, Homo Sapiens
gaguuagacucaagggggugacagaaccgagaagggggugacaguccuccauccacguggccu

SEQ ID NO: 236309 - RNA, 63 nt, Homo Sapiens
ucuggugcucacagccgaggcugaggugccccggggggugaucugcucaugcagacucugggg

SEQ ID NO: 236310 - RNA, 63 nt, Homo Sapiens
uggcccccgaagaauggaacgugggggcauuuggggggugaagugaggagaggacccaggagu

SEQ ID NO: 236311 - RNA, 64 nt, Homo Sapiens
cccucucacuccucuugcccucugcuuuacucucauguggcaaacgugcggcucguggugugag

SEQ ID NO: 236312 - RNA, 64 nt, Homo Sapiens
guuuggucaccgugugcaucgcaccgugcuguaaauguggcagacgcagccugcggccaggcuu

SEQ ID NO: 236313 - RNA, 64 nt, Homo Sapiens
ugguggggagaggcagggcugagguggucuacgaauguggcagguagggaaggggagaugucug

SEQ ID NO: 236314 - RNA, 64 nt, Homo Sapiens
ccaacacuucuggacauugcauccuuauucacacauguggcagcugaacgaggugcuguugugg

SEQ ID NO: 236315 - RNA, 64 nt, Homo Sapiens
uucauacuugagagaaauccuacaaauguaaagaauguggcaaaccuuuggaugauccacaaac

SEQ ID NO: 236316 - RNA, 64 nt, Homo Sapiens
auaagaaaaaucaugcuggagggaagcccuacacauguggcagaauguggcaaagcauuuaauu

SEQ ID NO: 236317 - RNA, 64 nt, Homo Sapiens
ucaugcuggagggaagcccuacacauguggcagaauguggcaaagcauuuaauugguccucaau

SEQ ID NO: 236318 - RNA, 64 nt, Homo Sapiens
uucaugcuggagcaaaaugcuucacaugcgaagaauguggcacagucuuuaccacauccucaaa

SEQ ID NO: 236319 - RNA, 64 nt, Homo Sapiens
uuuauaccagagagaaacccuacacauguaaagaauguggcaaagccuucaauagguucucaac

SEQ ID NO: 236320 - RNA, 64 nt, Homo Sapiens
cucauacuggaggaaagucuuacaaaugugaagaauguggcagucuuuaaaucuuccucagucu

SEQ ID NO: 236321 - RNA, 64 nt, Homo Sapiens
augauauuggugagaagccacaaaaauaugaaaaauguggcaaagccuucaaaugcuugucaca

SEQ ID NO: 236322 - RNA, 64 nt, Homo Sapiens
uuccuacugaagaaauccccuggaaaugcaaaaaauguggcaggauuuuuaccaaugcucaucu

SEQ ID NO: 236323 - RNA, 64 nt, Homo Sapiens
ccgcgggcggccaggcaacgugcgugucucugccauguggcagaagugcucuuuguggcagugg

SEQ ID NO: 236324 - RNA, 64 nt, Homo Sapiens
uugagacccccaagcuuccaccugucccucuccuauguggcagcuggggagcagcugagaugug

SEQ ID NO: 236325 - RNA, 64 nt, Homo Sapiens
gcugaaauuuuuauacauucaacucaugauucacauguggcaucagucccaucagccggaacua

SEQ ID NO: 236326 - RNA, 64 nt, Homo Sapiens
ggaugaggcuucagcccccauugucuuauguagaauguggcaaugccaacuggagaaagggaag

SEQ ID NO: 236327 - RNA, 64 nt, Homo Sapiens
uuuuauacuggugagaaaccuuacaauguaaagaauguggcacagcuuuuaacuaaucuucaaa

SEQ ID NO: 236328 - RNA, 64 nt, Homo Sapiens
auucguacuggagagaauccuacaaaugugaaaaauguggcaaauccuuuaacugauccucaac

SEQ ID NO: 236329 - RNA, 64 nt, Homo Sapiens
uucauacuggagaaaagccauacaaaugagaagaauguggcaaugccuuuaaucaguccucaca

SEQ ID NO: 236330 - RNA, 64 nt, Homo Sapiens
uuuauacuggagaggaacucuauaguugugaagaauguggcaaagcuuuuaaccaauccucaua

SEQ ID NO: 236331 - RNA, 64 nt, Homo Sapiens
uucauacuggagagaaagccuacaauugugaagaauguggcaaagcuuuuaaccuuccuuaacc

SEQ ID NO: 236332 - RNA, 64 nt, Homo Sapiens
uuauacuuugagagaaacccugcaaaugugaauaauguggcaauacuuuaaaccaauccucaaa

SEQ ID NO: 236333 - RNA, 64 nt, Homo Sapiens
uccauacugaagaaaacuccuggaaguguaaaaaauguggcaacacuuuuaauaaaugcucacc

SEQ ID NO: 236334 - RNA, 64 nt, Homo Sapiens
uuuacacuagagagaaagccuacaaaugugaagaauguggcaaagccuuuaaccaguuuucaac

SEQ ID NO: 236335 - RNA, 64 nt, Homo Sapiens
uucauagcggagagaaaccccacaaaugugaagaauguggcagagcuuuuaaccaguccgcaaa

SEQ ID NO: 236336 - RNA, 64 nt, Homo Sapiens
uucacaguggagaaaaacccuacaaaugugaagaauguggcaaagcuuuuaaccaguccucaca

SEQ ID NO: 236337 - RNA, 64 nt, Homo Sapiens
uucauacuggagagaaaccuuacaaaugugaggaauguggcaaagguuuuagccaacucucaaa

SEQ ID NO: 236338 - RNA, 64 nt, Homo Sapiens
uucauacuagagagaaacccuacaaaugugaagaauguggcauaucuuuuaaccaguucucaca

SEQ ID NO: 236339 - RNA, 64 nt, Homo Sapiens
uucacacuugaaugaaacccuacaaaugugaacgauguggcaguuguuuuaacuaguucucgaa

SEQ ID NO: 236340 - RNA, 64 nt, Homo Sapiens
uucaaacuggagagaaacucuacaaaugugaagaauguggcaaagcuuuuaaccaagucucaac

SEQ ID NO: 236341 - RNA, 64 nt, Homo Sapiens
aaauucacaaagagaugcccuguaaguguacuguauguggcagugacuucugccauacuucaua

SEQ ID NO: 236342 - RNA, 64 nt, Homo Sapiens
ucuauaccagugagaaaucuuacaaauguauugaauguggcaaauuuuucaugcuauuaguauu

SEQ ID NO: 236343 - RNA, 64 nt, Homo Sapiens
uggaaaaucuuuaauuauccgacguagcacugucauguggcauucaaaaugcacagccugaaug

SEQ ID NO: 236344 - RNA, 64 nt, Homo Sapiens
cuuugccauaucagcguaugcucauccaggguauauguggcagcuaauuucucgagcuguuuuu

SEQ ID NO: 236345 - RNA, 64 nt, Homo Sapiens
acuucuaaccauuucucaacuacaagugugaagaauguggcaaauucauacuggagagaaaccu

SEQ ID NO: 236346 - RNA, 64 nt, Homo Sapiens
gcuucuaccugauccucaaauacaaaugugaugaauguggcaaauucauacugaagagaaacag

SEQ ID NO: 236347 - RNA, 64 nt, Homo Sapiens
gcuuuuaaccaaucuucaacuacaaaugugaagaauguggcaaauucauacuggagagaaaccc

SEQ ID NO: 236348 - RNA, 64 nt, Homo Sapiens
agaggacugugucucauuaauuuuacagaucagaauguggcaccaaaaggugaaagguuauauu

SEQ ID NO: 236349 - RNA, 64 nt, Homo Sapiens
aggucagccuugggguuggcugucccuugcuccuauguggcaaacuucuucauaccauucuccu

SEQ ID NO: 236350 - RNA, 64 nt, Homo Sapiens
acacauguguuaucuaccucaagguaacaagaguauguggcaaaacauauaccacccauagugc

SEQ ID NO: 236351 - RNA, 64 nt, Homo Sapiens
aggcaagcaugaauaaaauuagguuaaacguagcauguggcaucgcagucucuuagaauuuguu

SEQ ID NO: 236352 - RNA, 64 nt, Homo Sapiens
uuuauaugggagugaaacccuacaaauguuaagaauguggcauaaccuuuaacuauuuucaagc

SEQ ID NO: 236353 - RNA, 64 nt, Homo Sapiens
auauaaacugaaaaaauccauacaaauauuaaaaauguggcaaauuauuuuaaacugugcucaa

SEQ ID NO: 236354 - RNA, 53 nt, Homo Sapiens
aagagacuguacaaaagugaagaauguggcaaaggccuuuacugcuccuauuc

SEQ ID NO: 236355 - RNA, 64 nt, Homo Sapiens
aaggccuuuacugcuccuauucccuuacuaaagaauguggcaaagcuuuucaccaguacuuuac

SEQ ID NO: 236356 - RNA, 64 nt, Homo Sapiens
uuaaugcuggagagaaacccuacaaaugugaagaauguggcaaagauuucuauugauucucaua

SEQ ID NO: 236357 - RNA, 64 nt, Homo Sapiens
uucauauuggagagaaauucuacagaugugaagaauguggcaaaggcuuuaauuaguucucauc

SEQ ID NO: 236358 - RNA, 64 nt, Homo Sapiens
uucauaaaggagauaaauuauacaaaugugaagaauguggcaaagcuuuuaacaaauccucauc

SEQ ID NO: 236359 - RNA, 64 nt, Homo Sapiens
uucauacuggagagaaaaccuacaaaugugaggaauguggcaaagccuuuagccugucccucca

SEQ ID NO: 236360 - RNA, 64 nt, Homo Sapiens
uuuauacuggagagaagcccuacaaaugugaaaaauguggcaaaccuuuuaaccaauccucaac

SEQ ID NO: 236361 - RNA, 64 nt, Homo Sapiens
uucaugcuggagagaaacccuacaaaugugaaaaauguggcaaagcuuuuaaccaauuuucaaa

SEQ ID NO: 236362 - RNA, 64 nt, Homo Sapiens
cucauacuggagaaaaaucuuacaaaugugaagaauguggcaaagccuuuauccaguccucaac

SEQ ID NO: 236363 - RNA, 64 nt, Homo Sapiens
uuaaugauggagagaaaccauacaacugugaagaauguggcaaagcuuuuaaccaguccucaaa

SEQ ID NO: 236364 - RNA, 64 nt, Homo Sapiens
uucauauuggaaaaauuuccuacaaguaagaacaauguggcaaaguuuuuaacuaauacaccuu

SEQ ID NO: 236365 - RNA, 50 nt, Homo Sapiens
guaccuuacagauggaaugaauguggcaaaaucuuuaguuagaauucaca

SEQ ID NO: 236366 - RNA, 64 nt, Homo Sapiens
aggacucaggagaaaaaccuuacaaauaucauaaauguggcaaagaauuuaguuugcauugaag

SEQ ID NO: 236367 - RNA, 64 nt, Homo Sapiens
auuuuuaaugaauacucacauacaagugugaagaauguggcaaaauucuuacuagaaaaacucu

SEQ ID NO: 236368 - RNA, 64 nt, Homo Sapiens
gcauuuaacuggucccuaaauacaaauguaaagaauguggcaaauucauacuagagagaaaccc

SEQ ID NO: 236369 - RNA, 64 nt, Homo Sapiens
gccuuuaacuggcucuuaauuacaaaugugauaaauguggcaaauucauacuggagagaaaucc

SEQ ID NO: 236370 - RNA, 64 nt, Homo Sapiens
cauuuaaccaauacucaugcuacuagaauaaacaauguggcacagauaauauacuggagaaaac

SEQ ID NO: 236371 - RNA, 64 nt, Homo Sapiens
gccuuuaaccaguccuuaaguauaauuguguggaauguggcaaauucauacuggagggaauucc

SEQ ID NO: 236372 - RNA, 64 nt, Homo Sapiens
ccuuuuagcuguuccucaauuacaaaugugaagaauguggcaaguuuauacaggagggaaaccc

SEQ ID NO: 236373 - RNA, 64 nt, Homo Sapiens
gcuuuuaaacaguccucaauuacaaaggugaagaauguggcaaauucauacuggagagaaaauc

SEQ ID NO: 236374 - RNA, 64 nt, Homo Sapiens
gucuucuggcacaauucucaaacaaauguaaugaauguggcaaguucuugcuggugagaaaccu

SEQ ID NO: 236375 - RNA, 64 nt, Homo Sapiens
gucuuaagguaaaaucugaguacuaauguacugaauguggcaagaccauagaggacagaaacuu

SEQ ID NO: 236376 - RNA, 64 nt, Homo Sapiens
guuuuuaaucaacagucacauacaaguguaaugaauguggcauauucguauuggagagaaaccc

SEQ ID NO: 236377 - RNA, 64 nt, Homo Sapiens
guuuuuaaucaaaaaacaacuacaaguguaaugaauguggcaaguucauacuggagagaaacuu

SEQ ID NO: 236378 - RNA, 64 nt, Homo Sapiens
uuuuucagacaucguucauguacaaguguaauaaauguggcaaaaauccacagugaagagaucu

SEQ ID NO: 236379 - RNA, 64 nt, Homo Sapiens
guuuuuaaucaaaaagcaacuacaagcauaaugaauguggcaaguucauacuggagagaaaccu

SEQ ID NO: 236380 - RNA, 64 nt, Homo Sapiens
agccagccugagcucuccugcaagacagagccugauguggcacggagugggguugcggggggug

SEQ ID NO: 236381 - RNA, 64 nt, Homo Sapiens
uuuuaucugaaagguuuuuuucucauuuaaucugauguggcauuuucgucaucugaagcaugag

SEQ ID NO: 236382 - RNA, 64 nt, Homo Sapiens; identical to SEQ ID NO: 74555

SEQ ID NO: 236383 - RNA, 64 nt, Homo Sapiens; identical to SEQ ID NO: 74556

SEQ ID NO: 236384 - RNA, 64 nt, Homo Sapiens; identical to SEQ ID NO: 74557

SEQ ID NO: 236385 - RNA, 64 nt, Homo Sapiens; identical to SEQ ID NO: 74558

SEQ ID NO: 236386 - RNA, 64 nt, Homo Sapiens; identical to SEQ ID NO: 74559

SEQ ID NO: 236387 - RNA, 64 nt, Homo Sapiens; identical to SEQ ID NO: 74560

SEQ ID NO: 236388 - RNA, 64 nt, Homo Sapiens; identical to SEQ ID NO: 236311

SEQ ID NO: 236389 - RNA, 64 nt, Homo Sapiens; identical to SEQ ID NO: 236312

SEQ ID NO: 236390 - RNA, 64 nt, Homo Sapiens; identical to SEQ ID NO: 236313

SEQ ID NO: 236391 - RNA, 64 nt, Homo Sapiens; identical to SEQ ID NO: 236314

SEQ ID NO: 236392 - RNA, 64 nt, Homo Sapiens; identical to SEQ ID NO: 236315

SEQ ID NO: 236393 - RNA, 64 nt, Homo Sapiens; identical to SEQ ID NO: 236316

SEQ ID NO: 236394 - RNA, 64 nt, Homo Sapiens; identical to SEQ ID NO: 236317

SEQ ID NO: 236395 - RNA, 64 nt, Homo Sapiens; identical to SEQ ID NO: 236318

SEQ ID NO: 236396 - RNA, 64 nt, Homo Sapiens; identical to SEQ ID NO: 236319

SEQ ID NO: 236397 - RNA, 64 nt, Homo Sapiens; identical to SEQ ID NO: 236320

SEQ ID NO: 236398 - RNA, 64 nt, Homo Sapiens; identical to SEQ ID NO: 236321

SEQ ID NO: 236399 - RNA, 64 nt, Homo Sapiens; identical to SEQ ID NO: 236322

SEQ ID NO: 236400 - RNA, 64 nt, Homo Sapiens; identical to SEQ ID NO: 236323

SEQ ID NO: 236401 - RNA, 64 nt, Homo Sapiens; identical to SEQ ID NO: 236324

SEQ ID NO: 236402 - RNA, 64 nt, Homo Sapiens; identical to SEQ ID NO: 236325

SEQ ID NO: 236403 - RNA, 64 nt, Homo Sapiens; identical to SEQ ID NO: 236326

SEQ ID NO: 236404 - RNA, 64 nt, Homo Sapiens; identical to SEQ ID NO: 236327

SEQ ID NO: 236405 - RNA, 64 nt, Homo Sapiens; identical to SEQ ID NO: 236328

SEQ ID NO: 236406 - RNA, 64 nt, Homo Sapiens; identical to SEQ ID NO: 236329

SEQ ID NO: 236407 - RNA, 64 nt, Homo Sapiens; identical to SEQ ID NO: 236330

SEQ ID NO: 236408 - RNA, 64 nt, Homo Sapiens; identical to SEQ ID NO: 236331

SEQ ID NO: 236409 - RNA, 64 nt, Homo Sapiens; identical to SEQ ID NO: 236332

SEQ ID NO: 236410 - RNA, 64 nt, Homo Sapiens; identical to SEQ ID NO: 236333

SEQ ID NO: 236411 - RNA, 64 nt, Homo Sapiens; identical to SEQ ID NO: 236334

SEQ ID NO: 236412 - RNA, 64 nt, Homo Sapiens; identical to SEQ ID NO: 236335

SEQ ID NO: 236413 - RNA, 64 nt, Homo Sapiens; identical to SEQ ID NO: 236336

SEQ ID NO: 236414 - RNA, 64 nt, Homo Sapiens; identical to SEQ ID NO: 236337

SEQ ID NO: 236415 - RNA, 64 nt, Homo Sapiens; identical to SEQ ID NO: 236338

SEQ ID NO: 236416 - RNA, 64 nt, Homo Sapiens; identical to SEQ ID NO: 236339

SEQ ID NO: 236417 - RNA, 64 nt, Homo Sapiens; identical to SEQ ID NO: 236340

SEQ ID NO: 236418 - RNA, 64 nt, Homo Sapiens; identical to SEQ ID NO: 236341

SEQ ID NO: 236419 - RNA, 64 nt, Homo Sapiens; identical to SEQ ID NO: 236342

SEQ ID NO: 236420 - RNA, 64 nt, Homo Sapiens; identical to SEQ ID NO: 236343

SEQ ID NO: 236421 - RNA, 64 nt, Homo Sapiens; identical to SEQ ID NO: 236344

SEQ ID NO: 236422 - RNA, 64 nt, Homo Sapiens; identical to SEQ ID NO: 236345

SEQ ID NO: 236423 - RNA, 64 nt, Homo Sapiens; identical to SEQ ID NO: 236346

SEQ ID NO: 236424 - RNA, 64 nt, Homo Sapiens; identical to SEQ ID NO: 236347

SEQ ID NO: 236425 - RNA, 64 nt, Homo Sapiens; identical to SEQ ID NO: 236348

SEQ ID NO: 236426 - RNA, 64 nt, Homo Sapiens; identical to SEQ ID NO: 236349

SEQ ID NO: 236427 - RNA, 64 nt, Homo Sapiens; identical to SEQ ID NO: 236350

SEQ ID NO: 236428 - RNA, 64 nt, Homo Sapiens; identical to SEQ ID NO: 236351

SEQ ID NO: 236429 - RNA, 64 nt, Homo Sapiens; identical to SEQ ID NO: 236352

SEQ ID NO: 236430 - RNA, 64 nt, Homo Sapiens; identical to SEQ ID NO: 236353

SEQ ID NO: 236431 - RNA, 53 nt, Homo Sapiens; identical to SEQ ID NO: 236354

SEQ ID NO: 236432 - RNA, 64 nt, Homo Sapiens; identical to SEQ ID NO: 236355

SEQ ID NO: 236433 - RNA, 64 nt, Homo Sapiens; identical to SEQ ID NO: 236356

SEQ ID NO: 236434 - RNA, 64 nt, Homo Sapiens; identical to SEQ ID NO: 236357

SEQ ID NO: 236435 - RNA, 64 nt, Homo Sapiens; identical to SEQ ID NO: 236358

SEQ ID NO: 236436 - RNA, 64 nt, Homo Sapiens; identical to SEQ ID NO: 236359

SEQ ID NO: 236437 - RNA, 64 nt, Homo Sapiens; identical to SEQ ID NO: 236360

SEQ ID NO: 236438 - RNA, 64 nt, Homo Sapiens; identical to SEQ ID NO: 236361

SEQ ID NO: 236439 - RNA, 64 nt, Homo Sapiens; identical to SEQ ID NO: 236362

SEQ ID NO: 236440 - RNA, 64 nt, Homo Sapiens; identical to SEQ ID NO: 236363

SEQ ID NO: 236441 - RNA, 64 nt, Homo Sapiens; identical to SEQ ID NO: 236364

SEQ ID NO: 236442 - RNA, 50 nt, Homo Sapiens; identical to SEQ ID NO: 236365

SEQ ID NO: 236443 - RNA, 64 nt, Homo Sapiens; identical to SEQ ID NO: 236366

SEQ ID NO: 236444 - RNA, 64 nt, Homo Sapiens; identical to SEQ ID NO: 236367

SEQ ID NO: 236445 - RNA, 64 nt, Homo Sapiens; identical to SEQ ID NO: 236368

SEQ ID NO: 236446 - RNA, 64 nt, Homo Sapiens; identical to SEQ ID NO: 236369

SEQ ID NO: 236447 - RNA, 64 nt, Homo Sapiens; identical to SEQ ID NO: 236370

SEQ ID NO: 236448 - RNA, 64 nt, Homo Sapiens; identical to SEQ ID NO: 236371

SEQ ID NO: 236449 - RNA, 64 nt, Homo Sapiens; identical to SEQ ID NO: 236372

SEQ ID NO: 236450 - RNA, 64 nt, Homo Sapiens; identical to SEQ ID NO: 236373

SEQ ID NO: 236451 - RNA, 64 nt, Homo Sapiens; identical to SEQ ID NO: 236374

SEQ ID NO: 236452 - RNA, 64 nt, Homo Sapiens; identical to SEQ ID NO: 236375

SEQ ID NO: 236453 - RNA, 64 nt, Homo Sapiens; identical to SEQ ID NO: 236376

SEQ ID NO: 236454 - RNA, 64 nt, Homo Sapiens; identical to SEQ ID NO: 236377

SEQ ID NO: 236455 - RNA, 64 nt, Homo Sapiens; identical to SEQ ID NO: 236378

SEQ ID NO: 236456 - RNA, 64 nt, Homo Sapiens; identical to SEQ ID NO: 236379

SEQ ID NO: 236457 - RNA, 64 nt, Homo Sapiens; identical to SEQ ID NO: 236380

SEQ ID NO: 236458 - RNA, 64 nt, Homo Sapiens; identical to SEQ ID NO: 236381

SEQ ID NO: 236459 - RNA, 64 nt, Homo Sapiens; identical to SEQ ID NO: 74555

SEQ ID NO: 236460 - RNA, 64 nt, Homo Sapiens; identical to SEQ ID NO: 74556

SEQ ID NO: 236461 - RNA, 64 nt, Homo Sapiens; identical to SEQ ID NO: 74557

SEQ ID NO: 236462 - RNA, 64 nt, Homo Sapiens; identical to SEQ ID NO: 74558

SEQ ID NO: 236463 - RNA, 64 nt, Homo Sapiens; identical to SEQ ID NO: 74559

SEQ ID NO: 236464 - RNA, 64 nt, Homo Sapiens; identical to SEQ ID NO: 74560

SEQ ID NO: 236465 - RNA, 64 nt, Homo Sapiens; identical to SEQ ID NO: 236311

SEQ ID NO: 236466 - RNA, 64 nt, Homo Sapiens; identical to SEQ ID NO: 236312

SEQ ID NO: 236467 - RNA, 64 nt, Homo Sapiens; identical to SEQ ID NO: 236313

SEQ ID NO: 236468 - RNA, 64 nt, Homo Sapiens; identical to SEQ ID NO: 236314

SEQ ID NO: 236469 - RNA, 64 nt, Homo Sapiens; identical to SEQ ID NO: 236315

SEQ ID NO: 236470 - RNA, 64 nt, Homo Sapiens; identical to SEQ ID NO: 236316

SEQ ID NO: 236471 - RNA, 64 nt, Homo Sapiens; identical to SEQ ID NO: 236317

SEQ ID NO: 236472 - RNA, 64 nt, Homo Sapiens; identical to SEQ ID NO: 236318

SEQ ID NO: 236473 - RNA, 64 nt, Homo Sapiens; identical to SEQ ID NO: 236319

SEQ ID NO: 236474 - RNA, 64 nt, Homo Sapiens; identical to SEQ ID NO: 236320

SEQ ID NO: 236475 - RNA, 64 nt, Homo Sapiens; identical to SEQ ID NO: 236321

SEQ ID NO: 236476 - RNA, 64 nt, Homo Sapiens; identical to SEQ ID NO: 236322

SEQ ID NO: 236477 - RNA, 64 nt, Homo Sapiens; identical to SEQ ID NO: 236323

SEQ ID NO: 236478 - RNA, 64 nt, Homo Sapiens; identical to SEQ ID NO: 236324

SEQ ID NO: 236479 - RNA, 64 nt, Homo Sapiens; identical to SEQ ID NO: 236325

SEQ ID NO: 236480 - RNA, 64 nt, Homo Sapiens; identical to SEQ ID NO: 236326

SEQ ID NO: 236481 - RNA, 64 nt, Homo Sapiens; identical to SEQ ID NO: 236327

SEQ ID NO: 236482 - RNA, 64 nt, Homo Sapiens; identical to SEQ ID NO: 236328

SEQ ID NO: 236483 - RNA, 64 nt, Homo Sapiens; identical to SEQ ID NO: 236329

SEQ ID NO: 236484 - RNA, 64 nt, Homo Sapiens; identical to SEQ ID NO: 236330

SEQ ID NO: 236485 - RNA, 64 nt, Homo Sapiens; identical to SEQ ID NO: 236331

SEQ ID NO: 236486 - RNA, 64 nt, Homo Sapiens; identical to SEQ ID NO: 236332

SEQ ID NO: 236487 - RNA, 64 nt, Homo Sapiens; identical to SEQ ID NO: 236333

SEQ ID NO: 236488 - RNA, 64 nt, Homo Sapiens; identical to SEQ ID NO: 236334

SEQ ID NO: 236489 - RNA, 64 nt, Homo Sapiens; identical to SEQ ID NO: 236335

SEQ ID NO: 236490 - RNA, 64 nt, Homo Sapiens; identical to SEQ ID NO: 236336

SEQ ID NO: 236491 - RNA, 64 nt, Homo Sapiens; identical to SEQ ID NO: 236337

SEQ ID NO: 236492 - RNA, 64 nt, Homo Sapiens; identical to SEQ ID NO: 236338

SEQ ID NO: 236493 - RNA, 64 nt, Homo Sapiens; identical to SEQ ID NO: 236339

SEQ ID NO: 236494 - RNA, 64 nt, Homo Sapiens; identical to SEQ ID NO: 236340

SEQ ID NO: 236495 - RNA, 64 nt, Homo Sapiens; identical to SEQ ID NO: 236341

SEQ ID NO: 236496 - RNA, 64 nt, Homo Sapiens; identical to SEQ ID NO: 236342

SEQ ID NO: 236497 - RNA, 64 nt, Homo Sapiens; identical to SEQ ID NO: 236343

SEQ ID NO: 236498 - RNA, 64 nt, Homo Sapiens; identical to SEQ ID NO: 236344

SEQ ID NO: 236499 - RNA, 64 nt, Homo Sapiens; identical to SEQ ID NO: 236345

SEQ ID NO: 236500 - RNA, 64 nt, Homo Sapiens; identical to SEQ ID NO: 236346

SEQ ID NO: 236501 - RNA, 64 nt, Homo Sapiens; identical to SEQ ID NO: 236347

SEQ ID NO: 236502 - RNA, 64 nt, Homo Sapiens; identical to SEQ ID NO: 236348

SEQ ID NO: 236503 - RNA, 64 nt, Homo Sapiens; identical to SEQ ID NO: 236349

SEQ ID NO: 236504 - RNA, 64 nt, Homo Sapiens; identical to SEQ ID NO: 236350

SEQ ID NO: 236505 - RNA, 64 nt, Homo Sapiens; identical to SEQ ID NO: 236351

SEQ ID NO: 236506 - RNA, 64 nt, Homo Sapiens; identical to SEQ ID NO: 236352

SEQ ID NO: 236507 - RNA, 64 nt, Homo Sapiens; identical to SEQ ID NO: 236353

SEQ ID NO: 236508 - RNA, 53 nt, Homo Sapiens; identical to SEQ ID NO: 236354

SEQ ID NO: 236509 - RNA, 64 nt, Homo Sapiens; identical to SEQ ID NO: 236355

SEQ ID NO: 236510 - RNA, 64 nt, Homo Sapiens; identical to SEQ ID NO: 236356

SEQ ID NO: 236511 - RNA, 64 nt, Homo Sapiens; identical to SEQ ID NO: 236357

SEQ ID NO: 236512 - RNA, 64 nt, Homo Sapiens; identical to SEQ ID NO: 236358

SEQ ID NO: 236513 - RNA, 64 nt, Homo Sapiens; identical to SEQ ID NO: 236359

SEQ ID NO: 236514 - RNA, 64 nt, Homo Sapiens; identical to SEQ ID NO: 236360

SEQ ID NO: 236515 - RNA, 64 nt, Homo Sapiens; identical to SEQ ID NO: 236361

SEQ ID NO: 236516 - RNA, 64 nt, Homo Sapiens; identical to SEQ ID NO: 236362

SEQ ID NO: 236517 - RNA, 64 nt, Homo Sapiens; identical to SEQ ID NO: 236363

SEQ ID NO: 236518 - RNA, 64 nt, Homo Sapiens; identical to SEQ ID NO: 236364

SEQ ID NO: 236519 - RNA, 50 nt, Homo Sapiens; identical to SEQ ID NO: 236365

SEQ ID NO: 236520 - RNA, 64 nt, Homo Sapiens; identical to SEQ ID NO: 236366

SEQ ID NO: 236521 - RNA, 64 nt, Homo Sapiens; identical to SEQ ID NO: 236367

SEQ ID NO: 236522 - RNA, 64 nt, Homo Sapiens; identical to SEQ ID NO: 236368

SEQ ID NO: 236523 - RNA, 64 nt, Homo Sapiens; identical to SEQ ID NO: 236369

SEQ ID NO: 236524 - RNA, 64 nt, Homo Sapiens; identical to SEQ ID NO: 236370

SEQ ID NO: 236525 - RNA, 64 nt, Homo Sapiens; identical to SEQ ID NO: 236371

SEQ ID NO: 236526 - RNA, 64 nt, Homo Sapiens; identical to SEQ ID NO: 236372

SEQ ID NO: 236527 - RNA, 64 nt, Homo Sapiens; identical to SEQ ID NO: 236373

SEQ ID NO: 236528 - RNA, 64 nt, Homo Sapiens; identical to SEQ ID NO: 236374

SEQ ID NO: 236529 - RNA, 64 nt, Homo Sapiens; identical to SEQ ID NO: 236375

SEQ ID NO: 236530 - RNA, 64 nt, Homo Sapiens; identical to SEQ ID NO: 236376

SEQ ID NO: 236531 - RNA, 64 nt, Homo Sapiens; identical to SEQ ID NO: 236377

SEQ ID NO: 236532 - RNA, 64 nt, Homo Sapiens; identical to SEQ ID NO: 236378

SEQ ID NO: 236533 - RNA, 64 nt, Homo Sapiens; identical to SEQ ID NO: 236379

SEQ ID NO: 236534 - RNA, 64 nt, Homo Sapiens; identical to SEQ ID NO: 236380

SEQ ID NO: 236535 - RNA, 64 nt, Homo Sapiens; identical to SEQ ID NO: 236381

SEQ ID NO: 236536 - RNA, 64 nt, Homo Sapiens; identical to SEQ ID NO: 74555

SEQ ID NO: 236537 - RNA, 64 nt, Homo Sapiens; identical to SEQ ID NO: 74556

SEQ ID NO: 236538 - RNA, 64 nt, Homo Sapiens; identical to SEQ ID NO: 74557

SEQ ID NO: 236539 - RNA, 64 nt, Homo Sapiens; identical to SEQ ID NO: 74558

SEQ ID NO: 236540 - RNA, 64 nt, Homo Sapiens; identical to SEQ ID NO: 74559

SEQ ID NO: 236541 - RNA, 64 nt, Homo Sapiens; identical to SEQ ID NO: 74560

SEQ ID NO: 236542 - RNA, 64 nt, Homo Sapiens
ggagagacagcauaccugaaaccugcaaggaaccgguuuauaaaacaacagaacagccaggaaa

SEQ ID NO: 236543 - RNA, 64 nt, Homo Sapiens
gccuuuccugggaagggcaguuugcagaaccagggguuuauauugcagggaguguauuuucuga

SEQ ID NO: 236544 - RNA, 64 nt, Homo Sapiens
ccacauccggugacaucaugagacaugcuucuuugguuuauaaugagauguuuacaguuaaaua

SEQ ID NO: 236545 - RNA, 64 nt, Homo Sapiens
agaacaguaagaagacuuuaccauugcaugccaugguuuauaaucuaagauaggcaauagugua

SEQ ID NO: 236546 - RNA, 64 nt, Homo Sapiens
ugggguugaugugaacauuuuauguuacucauuugguuuauacuuuuuuuuuuuuuuuuuuaac

SEQ ID NO: 236547 - RNA, 64 nt, Homo Sapiens
uucucuuguuacauuugaagcaguugauauaauggguuuauacuuuaaaagauagacauggugc

SEQ ID NO: 236548 - RNA, 64 nt, Homo Sapiens
augguagcagucuuaguccugugaaggcuuuugagguuuauaaauggaaaaaaacauuucagaa

SEQ ID NO: 236549 - RNA, 64 nt, Homo Sapiens
cguuuacucuggaggcacaaauuugcaagaaguugguuuauagacuaucuguguucagggaaug

SEQ ID NO: 236550 - RNA, 64 nt, Homo Sapiens
augcacugcccuugucuaaaguucuuauugcacugguuuauauguguauguguguuuuauugug

SEQ ID NO: 236551 - RNA, 64 nt, Homo Sapiens
cccucagaacugaagagguucagagaacuuuccagguuuauacuauaccucaagaccacauaga

SEQ ID NO: 236552 - RNA, 51 nt, Homo Sapiens
gcuuucucaaacggccuuaaagguuuauaguuugggaaauuauauauauua

SEQ ID NO: 236553 - RNA, 64 nt, Homo Sapiens
gggugguuaauuaaaaugaaccagauaucagggugguuuauaaagccuguaaacacaccuaaga

SEQ ID NO: 236554 - RNA, 64 nt, Homo Sapiens
uauaacuucgucucacaaauaguguagguaucuggguuuauauacuaaaauuaaggguggagaa

SEQ ID NO: 236555 - RNA, 64 nt, Homo Sapiens
uaacuuaaugucuugucaaauacuuuuauugauugguuuauaugccauucuuguuauagaagaa

SEQ ID NO: 236556 - RNA, 64 nt, Homo Sapiens
ugcuuuuguaccuagcuagguguguaauauaaaugguuuauaacaauggagaccugaauaauuc

SEQ ID NO: 236557 - RNA, 64 nt, Homo Sapiens
accuauuuauaacacuuuuuuauauaauaucuccgguuuauaaaguugcuguugauugaagaug

SEQ ID NO: 236558 - RNA, 64 nt, Homo Sapiens
uugaaaaacugcuguggccucucuacuuuuaaaggguuuauaugugucuauccuucauagugcc

SEQ ID NO: 236559 - RNA, 64 nt, Homo Sapiens
aacguauagaauacuuggaaacaaaucucaaagagguuuauaaauuggcacaccuaggcuguua

SEQ ID NO: 236560 - RNA, 64 nt, Homo Sapiens
gacuuaaaauaugcuuugguagcaaaguaucaauaaagcuuauaaaugcauugugaacuguaaa

SEQ ID NO: 236561 - RNA, 64 nt, Homo Sapiens
ccuuuaccuuccagccacccguauaguguuucacaaagcuuagaaguaaauauagauuauauau

SEQ ID NO: 236562 - RNA, 64 nt, Homo Sapiens
uucugcauggugucuuuucaccgcacaucagaggaaagcuuauuaaauagcauugaagaaaaua

SEQ ID NO: 236563 - RNA, 64 nt, Homo Sapiens
cuuguccuuggcagaacuggcauggcuuuuucucaaagcuuaguaguuauccaaucaccaaauc

SEQ ID NO: 236564 - RNA, 64 nt, Homo Sapiens
ccauuguuaucacugucauuuacaagaauacuguaaagcuuaagacuaagugguacuagggaac

SEQ ID NO: 236565 - RNA, 64 nt, Homo Sapiens
gcccaagcagauaaaaauaacacuugaaugaaggaaagcuuaaaccgucaaaggcagaaucugu

SEQ ID NO: 236566 - RNA, 64 nt, Homo Sapiens
cauuauuauuaaaauaaauuaacacauuaaccagaaagcuuaaaucuuaauuguuaauuugaag

SEQ ID NO: 236567 - RNA, 64 nt, Homo Sapiens
auaaauuauuucaugaauguaguacuuguacaaaaaagcuuaucuauguauauauuuaauaaag

SEQ ID NO: 236568 - RNA, 64 nt, Homo Sapiens
uucuuuuaucugggcaaaaauugagagugugugcaaagcuuauuguuugccugcaaguaaagaa

SEQ ID NO: 236569 - RNA, 64 nt, Homo Sapiens
aaaauuacugugaauuguuuuuuucuggaguggaaaagcuuaaacaucugcaacaaaaagucau

SEQ ID NO: 236570 - RNA, 64 nt, Homo Sapiens
acaaaugcuuagucucagcagccuccgggggaaaaaagcuuagccuagcagucagugacuuacu

SEQ ID NO: 236571 - RNA, 64 nt, Homo Sapiens
gcaagaaaggcacuucagugaauaugugacuaguaaagcuuaaauauguuuggaucuaauagag

SEQ ID NO: 236572 - RNA, 64 nt, Homo Sapiens
uugcagagcuucccaaaguguugcuuugcuaguuaaagcuuacugaacauuagccuagaaguuu

SEQ ID NO: 236573 - RNA, 64 nt, Homo Sapiens
uuuuuccuuaaaaggaaaacuucaagauguugcaaaagcuuacauauuuuaucacaagcaacuc

SEQ ID NO: 236574 - RNA, 64 nt, Homo Sapiens
ugacaugguuggggaaacagcuacuuugugagccaaagcuuaugguggagaggcgagaggugag

SEQ ID NO: 236575 - RNA, 64 nt, Homo Sapiens
acccaauacagucuaguuucgcuuuguccaaaggaaagcuuaaagacaccacacauuuaauuca

SEQ ID NO: 236576 - RNA, 64 nt, Homo Sapiens
caacaccaguuaagccauggauguuuuauaauauaaagcuuaccgugaaaccuuugccaucuuc

SEQ ID NO: 236577 - RNA, 64 nt, Homo Sapiens
auuugauuuacagggaccuuuaagauuuuuauguaaagcuuagagguauuguauuuuuuauaaa

SEQ ID NO: 236578 - RNA, 64 nt, Homo Sapiens
aauacuaaaaagaagugcugauugaaagugggcaaaagcuuacaaccacgcuagggcuggcuca

SEQ ID NO: 236579 - RNA, 64 nt, Homo Sapiens
uuuagaaacagugcaacacuaaaauaaauaaggaaaagcuuagccaagucacuuagguaguacc

SEQ ID NO: 236580 - RNA, 64 nt, Homo Sapiens
cuugccucuuguccugcuggaaagauagcaguguucuccugacuucgcccuacugcaugcagcc

SEQ ID NO: 236581 - RNA, 64 nt, Homo Sapiens
uggaguuucaccauguuggccaggguggucucaaucuccugaccucgugauccacccaccucga

SEQ ID NO: 236582 - RNA, 64 nt, Homo Sapiens
cccagaccucuuuaguuugggggauccuccucacucuccugaagugucucaaguauaccagugg

SEQ ID NO: 236583 - RNA, 64 nt, Homo Sapiens
cuaagcuugagauagggggcugugguccuuccuuucuccugaggagaaaguccuugcucuggug

SEQ ID NO: 236584 - RNA, 64 nt, Homo Sapiens
cgggguuucaccauguuggccaggauggucucgaucuccugaccucgugauccacccgacucgg

SEQ ID NO: 236585 - RNA, 64 nt, Homo Sapiens
agcccuaaacaucauucuugagagcauugggauaucuccugaaaagguuuaugaaaaagaagaa

SEQ ID NO: 236586 - RNA, 64 nt, Homo Sapiens
auuaaugacaacuggugggaaaccuagcauuuccucuccugaagaauaaauguauaaauguuau

SEQ ID NO: 236587 - RNA, 64 nt, Homo Sapiens
ucuuguguagcuggucagggacuuuuuuuucuuuucuccugaacuacaugauucuaauuggaau

SEQ ID NO: 236588 - RNA, 64 nt, Homo Sapiens
ucacaacaucugcucuucggguuccaccaaagagucuccugagcccugagggauggaugucucc

SEQ ID NO: 236589 - RNA, 64 nt, Homo Sapiens
accaaagagucuccugagcccugagggauggaugucuccugacccuuccaccccgccucacucc

SEQ ID NO: 236590 - RNA, 64 nt, Homo Sapiens
gucuuucugcucuccuuaucgagugucuuucuacucuccugagcaggaucucuuguucucuccu

SEQ ID NO: 236591 - RNA, 64 nt, Homo Sapiens
gucuuucuacucuccugagcaggaucucuuguucucuccugaguuccucauaauaagaaugggc

SEQ ID NO: 236592 - RNA, 64 nt, Homo Sapiens
uuagaaccuggagcugcagacacuugucugaagcucuccugauccucuuuauaucugguuuucc

SEQ ID NO: 236593 - RNA, 64 nt, Homo Sapiens
ucgugauccgcccaccuuggcaggauggucucgaucuccugaccugggguuucacuguguuagc

SEQ ID NO: 236594 - RNA, 64 nt, Homo Sapiens
agcuuuccucuguuucacuuauaucccgcagucaucuccugagcuuuuucaaggauucuaauaa

SEQ ID NO: 236595 - RNA, 64 nt, Homo Sapiens
aaaaggcuuacuauccaugguucugaauucugagucuccugaacuauucaguauuauucuuguu

SEQ ID NO: 236596 - RNA, 64 nt, Homo Sapiens
cauauucagguaccaccuuugacguguggcucuuucuccugaccaucaugggaagugucugcug

SEQ ID NO: 236597 - RNA, 64 nt, Homo Sapiens
auguuccugaauuucaaauaccucaugcaaaaugucuccugaaauaagggaaaaaaaaaaaacc

SEQ ID NO: 236598 - RNA, 64 nt, Homo Sapiens
ccuugugaagaaggugcuuuaacuccucacucuuucuccugaagauaaagggcucugccccuuu

SEQ ID NO: 236599 - RNA, 64 nt, Homo Sapiens
gugggugaguucucacaagauuccccuacgauguucuccugauagauuggaucauggggguggu

SEQ ID NO: 236600 - RNA, 64 nt, Homo Sapiens
ucccaccacauggacaugccuuacacuggcguccucuccugagucccuccgcacucuccaucag

SEQ ID NO: 236601 - RNA, 64 nt, Homo Sapiens
gccccugccccagcuccucucugcaacccagcccucuccugagcucuaggcugggauuacaccc

SEQ ID NO: 236602 - RNA, 64 nt, Homo Sapiens
auuguucacauuucuauucuaaaaucucagguuaucuccugaacacuuuugggcagaugaaguu

SEQ ID NO: 236603 - RNA, 64 nt, Homo Sapiens
ugaaguuucaccguguuggccaggauggucuugaucuccugaccgcauaauccacccaccucgg

SEQ ID NO: 236604 - RNA, 64 nt, Homo Sapiens
cucagaucaccaggucaagcaccuaggccuggcuucuccugagacagaggacucagaaguggcc

SEQ ID NO: 236605 - RNA, 64 nt, Homo Sapiens
acaggauuuacuggggugggcugguccagguagcucuccugaaccuccuccuuccccaagcuga

SEQ ID NO: 236606 - RNA, 64 nt, Homo Sapiens
ggaugacaggucuucauucugcccugguucagugucuccugaguaguggccguguugucccagu

SEQ ID NO: 236607 - RNA, 64 nt, Homo Sapiens
aaggcaaaaaaaaaaagcuuuguuccucgaauaaucuccugacuuccuuaguucaguucuuuac

SEQ ID NO: 236608 - RNA, 64 nt, Homo Sapiens
uucggccucagcuccuagagacuggauuucuuuuucuccugauuccuuuuuuuuuuuuuuuuuu

SEQ ID NO: 236609 - RNA, 64 nt, Homo Sapiens
uugugaucugcccgccuuggcaggauggucuccaucuccugagucgggguuucaccauguuaga

SEQ ID NO: 236610 - RNA, 64 nt, Homo Sapiens
uugugauccacccaccucggcaggauggucucaaucuccugaccugggguuucaccauguugac

SEQ ID NO: 236611 - RNA, 64 nt, Homo Sapiens
ucgugauccgcccuccucggcaggauagucuugaucuccugacccgggguuucaccguguuagc

SEQ ID NO: 236612 - RNA, 64 nt, Homo Sapiens
ucgugaucugcccaccucggcaggauggucucgaucuccugacccgggguuucaucguguuaac

SEQ ID NO: 236613 - RNA, 64 nt, Homo Sapiens
uugucauccaccugucuuggcaggauggucucgaucuccugacccaggguuucaccauguuggc

SEQ ID NO: 236614 - RNA, 64 nt, Homo Sapiens
uuguggauuuaaauguccaagugcauuuauuguuucuccugauuaaguauaugcaccagcccuu

SEQ ID NO: 236615 - RNA, 64 nt, Homo Sapiens
guccucugaauauuuauaguuagacauacgcuugucuccugaauuauaugcugauauuguacuu

SEQ ID NO: 236616 - RNA, 64 nt, Homo Sapiens
cuagguuggggcccacccuguaguugcuuuucucucuccugauguuccccucugcuggggacgg

SEQ ID NO: 236617 - RNA, 64 nt, Homo Sapiens
agcagguggcucgaggcgguaaggacgggcagggucuccugagcuguggccccaugcagaugaa

SEQ ID NO: 236618 - RNA, 64 nt, Homo Sapiens
aaaggaauggaggcucuaauugaauuuucaagcaucuccugaggaucagaaaguaauuucuucu

SEQ ID NO: 236619 - RNA, 64 nt, Homo Sapiens
guguuaagaguuagguuuaacauaaagguuauuuucuccugauauagaucacauaacagaaugc

SEQ ID NO: 236620 - RNA, 64 nt, Homo Sapiens; identical to SEQ ID NO: 126132

SEQ ID NO: 236621 - RNA, 64 nt, Homo Sapiens; identical to SEQ ID NO: 126133

SEQ ID NO: 236622 - RNA, 64 nt, Homo Sapiens; identical to SEQ ID NO: 126134

SEQ ID NO: 236623 - RNA, 64 nt, Homo Sapiens; identical to SEQ ID NO: 126135

SEQ ID NO: 236624 - RNA, 64 nt, Homo Sapiens; identical to SEQ ID NO: 126136

SEQ ID NO: 236625 - RNA, 64 nt, Homo Sapiens; identical to SEQ ID NO: 126137

SEQ ID NO: 236626 - RNA, 64 nt, Homo Sapiens; identical to SEQ ID NO: 126138

SEQ ID NO: 236627 - RNA, 64 nt, Homo Sapiens; identical to SEQ ID NO: 126139

SEQ ID NO: 236628 - RNA, 64 nt, Homo Sapiens; identical to SEQ ID NO: 126140

SEQ ID NO: 236629 - RNA, 64 nt, Homo Sapiens; identical to SEQ ID NO: 126141

SEQ ID NO: 236630 - RNA, 64 nt, Homo Sapiens; identical to SEQ ID NO: 126142

SEQ ID NO: 236631 - RNA, 64 nt, Homo Sapiens; identical to SEQ ID NO: 126143

SEQ ID NO: 236632 - RNA, 64 nt, Homo Sapiens; identical to SEQ ID NO: 126144

SEQ ID NO: 236633 - RNA, 64 nt, Homo Sapiens; identical to SEQ ID NO: 126145

SEQ ID NO: 236634 - RNA, 64 nt, Homo Sapiens; identical to SEQ ID NO: 126146

SEQ ID NO: 236635 - RNA, 64 nt, Homo Sapiens; identical to SEQ ID NO: 126147

SEQ ID NO: 236636 - RNA, 64 nt, Homo Sapiens; identical to SEQ ID NO: 126148

SEQ ID NO: 236637 - RNA, 64 nt, Homo Sapiens; identical to SEQ ID NO: 126149

SEQ ID NO: 236638 - RNA, 64 nt, Homo Sapiens; identical to SEQ ID NO: 126150

SEQ ID NO: 236639 - RNA, 64 nt, Homo Sapiens; identical to SEQ ID NO: 126151

SEQ ID NO: 236640 - RNA, 64 nt, Homo Sapiens; identical to SEQ ID NO: 126152

SEQ ID NO: 236641 - RNA, 64 nt, Homo Sapiens; identical to SEQ ID NO: 126153

SEQ ID NO: 236642 - RNA, 64 nt, Homo Sapiens
ggcuuaugacuucuaaaaagugaauuuaucuccaacuuccuaaaaggagaaaauagauaagcaa

SEQ ID NO: 236643 - RNA, 64 nt, Homo Sapiens
ugguuuuucccaguaaaugaugucccuaaagaccacuuccuaucuguaacuuuccaaguaaagg

SEQ ID NO: 236644 - RNA, 64 nt, Homo Sapiens
cugugcuaagagaugucaugccuagggggcuaagacuuccuagacacguggccaagagaaacuu

SEQ ID NO: 236645 - RNA, 64 nt, Homo Sapiens
gggcuaagacuuccuagacucguggccaagagaaacuuccuagggaaugcgaaauucaccaaca

SEQ ID NO: 236646 - RNA, 64 nt, Homo Sapiens
gcaucguggugggggaggagccucuggcuucccuaaacugcagccucucuggcuggucuucacu

SEQ ID NO: 236647 - RNA, 64 nt, Homo Sapiens
uguggaguuugacaccuuagagaagcuaccccucaaacugcacaucuacacacaaacaaacaau

SEQ ID NO: 236648 - RNA, 64 nt, Homo Sapiens
gccuuagaccugaggugucaaagaaaaaauaaagaaacugcagccaagaccccaucucuauaaa

SEQ ID NO: 236649 - RNA, 64 nt, Homo Sapiens
gggcugggcacggugguuuaugaaccucuuuuagaaacugcagaaugcugagaauuuguauuga

SEQ ID NO: 236650 - RNA, 64 nt, Homo Sapiens
caucuaucaccucuagaagguuccagagacagugaaacugcaagaugcucucaacaggauuaug

SEQ ID NO: 236651 - RNA, 64 nt, Homo Sapiens
uguaaaaggcaggagacaugugauuaugaucaggaaacugcacaaaauuauuguuuucagcccc

SEQ ID NO: 236652 - RNA, 64 nt, Homo Sapiens
gauccccagccugguguugugggaaauaagcaaaaaacugcaucuucgagcaggacuaacaacu

SEQ ID NO: 236653 - RNA, 64 nt, Homo Sapiens
uuuaacuuuuucuaagcuguagaaaggaacuuuuaaacugcaguucucuuugccaagggagggg

SEQ ID NO: 236654 - RNA, 64 nt, Homo Sapiens
gaccacagcaccacuuagguguagcauggauuuuaaacugcagucaguaucagauccuguuuga

SEQ ID NO: 236655 - RNA, 62 nt, Homo Sapiens
caaugauuuccuuccugccaaaaauaaacaugugaaacugcacucuuuuguggauugacuac

SEQ ID NO: 236656 - RNA, 64 nt, Homo Sapiens
uuuaugaaacagccaucuuaaaaaaaaaaaaaguaaacugcaaaaguacaaaaucauuuuucaa

SEQ ID NO: 236657 - RNA, 64 nt, Homo Sapiens
ccaucccagugaugccuuauuugaaacugggcuuaaacugcaaaaagaaugaaguuggauuuag

SEQ ID NO: 236658 - RNA, 64 nt, Homo Sapiens
cuaaucaaucugagucuauuuauuauucaaguugaaacugcacuacauuucacacacauauacu

SEQ ID NO: 236659 - RNA, 64 nt, Homo Sapiens
uuuuugacuugaaggaaagagaagauuuuucaagaaacugcaagucuaaauuccagauuuuaag

SEQ ID NO: 236660 - RNA, 64 nt, Homo Sapiens
ccaucucagcagggaagaacaaccuucucaaccaaaacugcaaucaggaaagcagcagcccacu

SEQ ID NO: 236661 - RNA, 64 nt, Homo Sapiens
aaagguuuucucauugcauccauacugugagaauaaacugcagacugaaagaaacaugccugca

SEQ ID NO: 236662 - RNA, 50 nt, Homo Sapiens
gcacacaacuguggaaaugaaaacugcaauacaaguuucauccagaacua

SEQ ID NO: 236663 - RNA, 64 nt, Homo Sapiens
aacauccucuuccauauggauccacuggcuggacaaacugcaccaguugcugcuucaauuuaua

SEQ ID NO: 236664 - RNA, 64 nt, Homo Sapiens
auggggaccuguguagccccaggagcuucuguggaaacugcacagcgacucucuauggaaaacg

SEQ ID NO: 236665 - RNA, 64 nt, Homo Sapiens
aacaggacaucaaguuaaugagaucaagaaugagaaacugcaucaagccugaaagcuguguuag

SEQ ID NO: 236666 - RNA, 64 nt, Homo Sapiens
gucgucaugggugaauuugcgccuacauccuugaaaacugcacauuuuuuaaaccccaaggaaa

SEQ ID NO: 236667 - RNA, 64 nt, Homo Sapiens
uuuuagaucuaauguauacucauggugugcuuagaaacugcagaaaggaucugaaagaucuaaa

SEQ ID NO: 236668 - RNA, 64 nt, Homo Sapiens
aggaucugaaagaucuaaacguagaaauaaccuaaaacugcagaauucacuuaaagguaccucu

SEQ ID NO: 236669 - RNA, 64 nt, Homo Sapiens
guuuauuugaaagauaaugucuucucaaaaucagaaacugcagugguaauuaaauuaauagaaa

SEQ ID NO: 236670 - RNA, 64 nt, Homo Sapiens
cugcagugguaauuaaauuaauagaaaagagaacaaacugcagguuuagaaaaaugguuuucau

SEQ ID NO: 236671 - RNA, 64 nt, Homo Sapiens
uuuucuucggcuugaguucaccaucucuucauucaaacugcacuuuuagccagagaugcaauau

SEQ ID NO: 236672 - RNA, 64 nt, Homo Sapiens
cauucauuuguuuuuucaauguuugaaauaguucaaacugcagcuaacccuagucaaaacuauu

SEQ ID NO: 236673 - RNA, 64 nt, Homo Sapiens
ccacauucuuuuuguauccaaauagugcugcuagaaacugcacugaaguggcugaggauagguu

SEQ ID NO: 236674 - RNA, 64 nt, Homo Sapiens
cugggcucuacauuuccuacuaguuuguguccagaaacugcaaguugacaugaauagaggacaa

SEQ ID NO: 236675 - RNA, 64 nt, Homo Sapiens
auuuuuacuugcuagagaauacaagcguauguuuaaacugcaaggucuuguaucuaaaguggau

SEQ ID NO: 236676 - RNA, 64 nt, Homo Sapiens
agucuaaaauacccauugguaagcaaacaaaaaaaaacugcaaaaggaaaaacagcaaaacaaa

SEQ ID NO: 236677 - RNA, 64 nt, Homo Sapiens
uacuaaacagaugcugugauugcucuuagcauucaaacugcagauguuuacaagaaggccacgg

SEQ ID NO: 236678 - RNA, 64 nt, Homo Sapiens
gaacaagaguuguaguguuaaccgggcacagggaaaacugcaggacacaaaucuuucacuaggc

SEQ ID NO: 236679 - RNA, 64 nt, Homo Sapiens
cagccauaaaagggacaagaguacugaacaauugaaacugcauguuuuaaaugccucaucuguu

SEQ ID NO: 236680 - RNA, 64 nt, Homo Sapiens
acuauaccugucucucuguggauucccugucacuaaacugcaccauaaacaggaucuaagacug

SEQ ID NO: 236681 - RNA, 64 nt, Homo Sapiens
ucuccuacccugggaucccacugucuuggguuuaaaacugcaagucuucccagcuggcugggga

SEQ ID NO: 236682 - RNA, 64 nt, Homo Sapiens
uuggcccuguugccugggcuucccauggauccugaaacugcaucccgugucacucugugaccug

SEQ ID NO: 236683 - RNA, 64 nt, Homo Sapiens
cuaaaaauauucauguagcaaaucugagaauugaaaacugcagauaaccggccggguaugguga

SEQ ID NO: 236684 - RNA, 64 nt, Homo Sapiens
aaaaaaaaaaaaaaaacagaaagaaagaaaaagaaaacugcagauaacccuauacauuaauacu

SEQ ID NO: 236685 - RNA, 64 nt, Homo Sapiens
aaggaggcuucauggggcagacccugaaagaucaaaacugcauuugcaaagcccuccccugucc

SEQ ID NO: 236686 - RNA, 64 nt, Homo Sapiens
uugaauccugcaagcacauuccaagacuggccugaaacugcaugagcaacaucacucgaaauaa

SEQ ID NO: 236687 - RNA, 64 nt, Homo Sapiens
gaucugcaaaauaaagauaccacaauucaucuuaaaacugcagagauuuaaugugucagggaau

SEQ ID NO: 236688 - RNA, 64 nt, Homo Sapiens
aaugaucuguuuuucaguuaugacauagaaaaccaaacugcaaguguagacuaugacaaaaaau

SEQ ID NO: 236689 - RNA, 64 nt, Homo Sapiens
uuaaacucuuccccuccugcuuuagugccaccccaaacugcauuuauaauuuugugacugagga

SEQ ID NO: 236690 - RNA, 64 nt, Homo Sapiens
auccuugaaaucacacagcuugcaaauacguacuaaacugcacaagguguguguucuauaugug

SEQ ID NO: 236691 - RNA, 64 nt, Homo Sapiens
aaauaaaaauguauauagcugugagcucaaacaaaaacugcagacaaacaaaaaagagaaaagc

SEQ ID NO: 236692 - RNA, 64 nt, Homo Sapiens
ccccaccugagcaaccacaaauaggcucuccaugaaacugcaaaggaacugauguguggcaucc

SEQ ID NO: 236693 - RNA, 64 nt, Homo Sapiens; identical to SEQ ID NO: 236642

SEQ ID NO: 236694 - RNA, 64 nt, Homo Sapiens; identical to SEQ ID NO: 236643

SEQ ID NO: 236695 - RNA, 64 nt, Homo Sapiens; identical to SEQ ID NO: 236644

SEQ ID NO: 236696 - RNA, 64 nt, Homo Sapiens; identical to SEQ ID NO: 236645

SEQ ID NO: 236697 - RNA, 64 nt, Homo Sapiens; identical to SEQ ID NO: 236646

SEQ ID NO: 236698 - RNA, 64 nt, Homo Sapiens; identical to SEQ ID NO: 236647

SEQ ID NO: 236699 - RNA, 64 nt, Homo Sapiens; identical to SEQ ID NO: 236648

SEQ ID NO: 236700 - RNA, 64 nt, Homo Sapiens; identical to SEQ ID NO: 236649

SEQ ID NO: 236701 - RNA, 64 nt, Homo Sapiens; identical to SEQ ID NO: 236650

SEQ ID NO: 236702 - RNA, 64 nt, Homo Sapiens; identical to SEQ ID NO: 236651

SEQ ID NO: 236703 - RNA, 64 nt, Homo Sapiens; identical to SEQ ID NO: 236652

SEQ ID NO: 236704 - RNA, 64 nt, Homo Sapiens; identical to SEQ ID NO: 236653

SEQ ID NO: 236705 - RNA, 64 nt, Homo Sapiens; identical to SEQ ID NO: 236654

SEQ ID NO: 236706 - RNA, 62 nt, Homo Sapiens; identical to SEQ ID NO: 236655

SEQ ID NO: 236707 - RNA, 64 nt, Homo Sapiens; identical to SEQ ID NO: 236656

SEQ ID NO: 236708 - RNA, 64 nt, Homo Sapiens; identical to SEQ ID NO: 236657

SEQ ID NO: 236709 - RNA, 64 nt, Homo Sapiens; identical to SEQ ID NO: 236658

SEQ ID NO: 236710 - RNA, 64 nt, Homo Sapiens; identical to SEQ ID NO: 236659

SEQ ID NO: 236711 - RNA, 64 nt, Homo Sapiens; identical to SEQ ID NO: 236660

SEQ ID NO: 236712 - RNA, 64 nt, Homo Sapiens; identical to SEQ ID NO: 236661

SEQ ID NO: 236713 - RNA, 50 nt, Homo Sapiens; identical to SEQ ID NO: 236662

SEQ ID NO: 236714 - RNA, 64 nt, Homo Sapiens; identical to SEQ ID NO: 236663

SEQ ID NO: 236715 - RNA, 64 nt, Homo Sapiens; identical to SEQ ID NO: 236664

SEQ ID NO: 236716 - RNA, 64 nt, Homo Sapiens; identical to SEQ ID NO: 236665

SEQ ID NO: 236717 - RNA, 64 nt, Homo Sapiens; identical to SEQ ID NO: 236666

SEQ ID NO: 236718 - RNA, 64 nt, Homo Sapiens; identical to SEQ ID NO: 236667

SEQ ID NO: 236719 - RNA, 64 nt, Homo Sapiens; identical to SEQ ID NO: 236668

SEQ ID NO: 236720 - RNA, 64 nt, Homo Sapiens; identical to SEQ ID NO: 236669

SEQ ID NO: 236721 - RNA, 64 nt, Homo Sapiens; identical to SEQ ID NO: 236670

SEQ ID NO: 236722 - RNA, 64 nt, Homo Sapiens; identical to SEQ ID NO: 236671

SEQ ID NO: 236723 - RNA, 64 nt, Homo Sapiens; identical to SEQ ID NO: 236672

SEQ ID NO: 236724 - RNA, 64 nt, Homo Sapiens; identical to SEQ ID NO: 236673

SEQ ID NO: 236725 - RNA, 64 nt, Homo Sapiens; identical to SEQ ID NO: 236674

SEQ ID NO: 236726 - RNA, 64 nt, Homo Sapiens; identical to SEQ ID NO: 236675

SEQ ID NO: 236727 - RNA, 64 nt, Homo Sapiens; identical to SEQ ID NO: 236676

SEQ ID NO: 236728 - RNA, 64 nt, Homo Sapiens; identical to SEQ ID NO: 236677

SEQ ID NO: 236729 - RNA, 64 nt, Homo Sapiens; identical to SEQ ID NO: 236678

SEQ ID NO: 236730 - RNA, 64 nt, Homo Sapiens; identical to SEQ ID NO: 236679

SEQ ID NO: 236731 - RNA, 64 nt, Homo Sapiens; identical to SEQ ID NO: 236680

SEQ ID NO: 236732 - RNA, 64 nt, Homo Sapiens; identical to SEQ ID NO: 236681

SEQ ID NO: 236733 - RNA, 64 nt, Homo Sapiens; identical to SEQ ID NO: 236682

SEQ ID NO: 236734 - RNA, 64 nt, Homo Sapiens; identical to SEQ ID NO: 236683

SEQ ID NO: 236735 - RNA, 64 nt, Homo Sapiens; identical to SEQ ID NO: 236684

SEQ ID NO: 236736 - RNA, 64 nt, Homo Sapiens; identical to SEQ ID NO: 236685

SEQ ID NO: 236737 - RNA, 64 nt, Homo Sapiens; identical to SEQ ID NO: 236686

SEQ ID NO: 236738 - RNA, 64 nt, Homo Sapiens; identical to SEQ ID NO: 236687

SEQ ID NO: 236739 - RNA, 64 nt, Homo Sapiens; identical to SEQ ID NO: 236688

SEQ ID NO: 236740 - RNA, 64 nt, Homo Sapiens; identical to SEQ ID NO: 236689

SEQ ID NO: 236741 - RNA, 64 nt, Homo Sapiens; identical to SEQ ID NO: 236690

SEQ ID NO: 236742 - RNA, 64 nt, Homo Sapiens; identical to SEQ ID NO: 236691

SEQ ID NO: 236743 - RNA, 64 nt, Homo Sapiens; identical to SEQ ID NO: 236692

SEQ ID NO: 236744 - RNA, 64 nt, Homo Sapiens
ucuugugcuuuauccugccccgcuccccaucgccugcccgcagcagcgacgaaacguccaucug

SEQ ID NO: 236745 - RNA, 64 nt, Homo Sapiens
ggugaggggccagggcaaagggugugccucguccugcccgcacugccucucccaggaacuggaa

SEQ ID NO: 236746 - RNA, 64 nt, Homo Sapiens
cccucacucugccagggcaguccaugcuccucacugcccgcacacccugcaguguucgcuuggc

SEQ ID NO: 236747 - RNA, 60 nt, Homo Sapiens
gcagccugcuucccaccucccucugcugccugcccgcacaugaagauccuccacugcuga

SEQ ID NO: 236748 - RNA, 64 nt, Homo Sapiens
agguucuagggggcggugcuacuggcggccgccaugcccgcaguccugagccgggagacccagg

SEQ ID NO: 236749 - RNA, 64 nt, Homo Sapiens
uuccuggcacuaccugagccacagcuguccgccaugcccgcagcauggcgccuccagaccgagg

SEQ ID NO: 236750 - RNA, 64 nt, Homo Sapiens
gaguucuccuagcuguggcuucucuagguucuaggggugcaagccucuguguguuuguuugugu

SEQ ID NO: 236751 - RNA, 64 nt, Homo Sapiens
uuugugugugucugugugugcguauccacacuaggggugcaagccucugggugugugugugugu

SEQ ID NO: 236752 - RNA, 64 nt, Homo Sapiens
uaguaguuacuuuguacugagagaacuugcuuuggggugcaauuaauaaacugauuuuauuugg

SEQ ID NO: 236753 - RNA, 64 nt, Homo Sapiens
agaauuggucuccagcugccuuugaucaagauucgggugcaaguggagcaggagccauauaccu

SEQ ID NO: 236754 - RNA, 64 nt, Homo Sapiens
acauacaugcauauagacgcaucuauuggaaaugcaguuccacaggugagcauguucuuucugg

SEQ ID NO: 236755 - RNA, 64 nt, Homo Sapiens
ucauacaagcauagacuggauuaaagaaguuuuccaguuccaaaaauuaaaggaauauauccuu

SEQ ID NO: 236756 - RNA, 64 nt, Homo Sapiens
gauagaaaacccacacaauauuuuaaauuuuucucaguuccagucucugugcugaugcagguag

SEQ ID NO: 236757 - RNA, 64 nt, Homo Sapiens
cuucuggacaaggccugggcccagaucccucucucaguuccagcggagacuggcucauaccuug

SEQ ID NO: 236758 - RNA, 64 nt, Homo Sapiens
uaacauuccaacugguugcuuaugaaauuuacuacaguuccauuaugccaauaugugacauuag

SEQ ID NO: 236759 - RNA, 64 nt, Homo Sapiens
uggcuggggaggccucacaaguuuaauggacucacaguuccauggguaauuuguaaagaaaaag

SEQ ID NO: 236760 - RNA, 64 nt, Homo Sapiens
gucacuuccacauuuugggucucugccuguuacccaguuccaaagcccuccaaacuguuccagc

SEQ ID NO: 236761 - RNA, 64 nt, Homo Sapiens
uggcuggggaggccucagaauuuacuuggacuuacaguuccacaagacugggaagaaaaagagg

SEQ ID NO: 236762 - RNA, 64 nt, Homo Sapiens
ggccacacuguaggcagcagugacuaagcacuggcaguuccagaacauuuacccagguauaugu

SEQ ID NO: 236763 - RNA, 64 nt, Homo Sapiens
acauuauaaguuacuguucuaagaaaaguaaauacaguuccagauggguuauugcagauuaaca

SEQ ID NO: 236764 - RNA, 57 nt, Homo Sapiens
acaaugaaaaugaugaauaaccaguaccaguuccaguucaaguguuuaaaacuuuug

SEQ ID NO: 236765 - RNA, 64 nt, Homo Sapiens
aaccuacugggaggguucuugccagacagaacuacaguuccauugucucguggucuuguaaugc

SEQ ID NO: 236766 - RNA, 64 nt, Homo Sapiens
agucuucugucaccaugucauauugugguucuuucaguuccaugauauguuuggcucugcaugc

SEQ ID NO: 236767 - RNA, 64 nt, Homo Sapiens
aagaaagccaguuguuuggcaugugaguuaaaggcaguuccaaugccugaugguucccagaucu

SEQ ID NO: 236768 - RNA, 64 nt, Homo Sapiens
agaccaggaagaaaaagagguuuaauuggacuuacaguuccacaugacuggggaggccucagaa

SEQ ID NO: 236769 - RNA, 64 nt, Homo Sapiens
gcccuucaaacuguuccaaccucugccuguuacccaguuccaaacuugcuuucauauuuuuggc

SEQ ID NO: 236770 - RNA, 64 nt, Homo Sapiens
agauugugaagaaaaagagguuuaauuggacuuacaguuccacauggccggggaggccucagaa

SEQ ID NO: 236771 - RNA, 64 nt, Homo Sapiens
cagauuuaaauccagcugaggcucccuuuguuuucaguuccauguaacaaucuggaaggaaacu

SEQ ID NO: 236772 - RNA, 64 nt, Homo Sapiens
aggaagagcaccagccgcugagucaggauccugucaguuccaugagcuauuccucuuugguuug

SEQ ID NO: 236773 - RNA, 64 nt, Homo Sapiens
ggguaguugaauaaaauugggcagcuaaauuuuucaguuccaugugccucccaaauaaaaaaca

SEQ ID NO: 236774 - RNA, 64 nt, Homo Sapiens
gauacuuucugcacuaguaucacuuuuauuauugcaguuccauuuaaaagcauaacuggcuaag

SEQ ID NO: 236775 - RNA, 64 nt, Homo Sapiens
agaaaggucgggguagguucacaccaacagguuucaguuccaacgcagccauggcuucucauuu

SEQ ID NO: 236776 - RNA, 64 nt, Homo Sapiens
gagguggcaggucuugcccucaaggcaggcccugcaguuccacaggagcuggggaaccuggucu

SEQ ID NO: 236777 - RNA, 64 nt, Homo Sapiens
uuucucaaccagguacuuccucagucuggugcuccaguuccaguuccacgaaacacugugcaaa

SEQ ID NO: 236778 - RNA, 64 nt, Homo Sapiens
aaccagguacuuccucagucuggugcuccaguuccaguuccacgaaacacugugcaaagccucg

SEQ ID NO: 236779 - RNA, 64 nt, Homo Sapiens
cacugaccaaagcuguacuuuuaaaacacaaccccugggcuagugaugucucuacuugcucuau

SEQ ID NO: 236780 - RNA, 64 nt, Homo Sapiens
aaguguaagcuaaauaaaaugcuuggaguuuugccugggcuagugagaguuggugcaaauucuu

SEQ ID NO: 236781 - RNA, 64 nt, Homo Sapiens
gcaggggaggagggagagcaccuagacucugucccugggcuaggcagcucugccccaggcuccu

SEQ ID NO: 236782 - RNA, 64 nt, Homo Sapiens
ggaaaugauuugaauaauggagaacagagaggagcugggcuaugaaagaauugguaguaggggg

SEQ ID NO: 236783 - RNA, 64 nt, Homo Sapiens
ugcuuugaaaacaaaacuuuucaacaugggcauacugggcuacauggaaaaugacaucacccag

SEQ ID NO: 236784 - RNA, 64 nt, Homo Sapiens
gucucacuauguugcccagucuagucuugaacuccugggcuacaguuacccuccuaccucggcu

SEQ ID NO: 236785 - RNA, 64 nt, Homo Sapiens
ggcuguugucugccuggccuucaaugacagugugcugggcuagccugugaccccucgggacugc

SEQ ID NO: 236786 - RNA, 64 nt, Homo Sapiens
gagcucgacccaagccaggcugcacacuccuggacugggcuagccugcacugccugggaaaguc

SEQ ID NO: 236787 - RNA, 64 nt, Homo Sapiens
ucucagucuaugagaaacuugcccugaggggcaccugggcuaggggcuugggacuggaagacca

SEQ ID NO: 236788 - RNA, 64 nt, Homo Sapiens
gccauucccuccuuuuccgcaugccuccugccuccugggcuauuccucuccacccagaaggcug

SEQ ID NO: 236789 - RNA, 64 nt, Homo Sapiens
cggagaccgggcacugccugcagacagcuuccaccugggcuacaccugcaguuuguccugggca

SEQ ID NO: 236790 - RNA, 64 nt, Homo Sapiens
uguauccgccuucuauccagaacuugaccaggaucugggcuaugagaugcauggcaagaccagc

SEQ ID NO: 236791 - RNA, 64 nt, Homo Sapiens
ucuuguggcaagcuauaccggaaaagcggcaugucaaaaauacuuuagguucuacauagaucuc

SEQ ID NO: 236792 - RNA, 64 nt, Homo Sapiens
ggucuaaaauauuuguaauguauauuaaaagguucaaaaauauuuguauaaaucuaaguuauuu

SEQ ID NO: 236793 - RNA, 64 nt, Homo Sapiens
acauugacaaguuuaacauugagaagaaucuuaacaaaaauauggauaugaauucaguagauau

SEQ ID NO: 236794 - RNA, 64 nt, Homo Sapiens
agaagaaaaccagcaaacuaaaacuucugggcagcaaaaauauauaaaugcuucagaugucaaa

SEQ ID NO: 236795 - RNA, 64 nt, Homo Sapiens
cagccugggcuacaugacgaaacuccaucucuaucaaaaauacaaaaaauuaacuagguguggu

SEQ ID NO: 236796 - RNA, 64 nt, Homo Sapiens
uuuaccuugugucuucucuuguaaaaaugaaacucaaaaauaaaauaaaugugucaaauuuuga

SEQ ID NO: 236797 - RNA, 64 nt, Homo Sapiens
acuccacccugggcaacagagcaagaccccaucucaaaaauaaauaaauauauauaaaaaauaa

SEQ ID NO: 236798 - RNA, 64 nt, Homo Sapiens
acuuggguaccgggggaacuuuaaaauuucaucucaaaaauaauuuuuaaaaagccugagguau

SEQ ID NO: 236799 - RNA, 64 nt, Homo Sapiens
guucuuuuuaugcaaaucccauauauacacagaacaaaaauaauuuaaggaaacaaaaauacuu

SEQ ID NO: 236800 - RNA, 64 nt, Homo Sapiens
uauauauacacagaacaaaaacaaguuaaggaaacaaaaauacuguugugugugggcaacagaa

SEQ ID NO: 236801 - RNA, 64 nt, Homo Sapiens
auaggguaguucuggagagaugguaugcagcauacaaaaauauauuaaaaauauaaacaauguu

SEQ ID NO: 236802 - RNA, 64 nt, Homo Sapiens
agucugaauuguugaaacuaaagcacuucuuuuccaaaaauacuucugcaacucaugaacaaaa

SEQ ID NO: 236803 - RNA, 64 nt, Homo Sapiens
uuuuaaaggaaaaaguacagaccuuguaaagucacaaaaauagucacauauuuuguaaauuuuu

SEQ ID NO: 236804 - RNA, 64 nt, Homo Sapiens
aagcugucacauauuuuguaugauguaacuguaucaaaaauaaaaagcacagaaugccuguaua

SEQ ID NO: 236805 - RNA, 64 nt, Homo Sapiens
aauaaucucaauuauauucaacacauugagacuacaaaaauauguuaaagagacaaccaaggga

SEQ ID NO: 236806 - RNA, 64 nt, Homo Sapiens
gcacaacagaaauaucuaaauucuuacuaacauacaaaaauaauguaaauggaaauacaaagga

SEQ ID NO: 236807 - RNA, 64 nt, Homo Sapiens
guaaauaaguuacuaugaucaaguuuucuuauggcaaaaauaauagagcugacuguugcuuaag

SEQ ID NO: 236808 - RNA, 64 nt, Homo Sapiens
augcacaccaaaauguauacgauaugauuccagucaaaaauaaaucacaauuucccuucauaug

SEQ ID NO: 236809 - RNA, 64 nt, Homo Sapiens
uguauuaaaauuaaauucauuauuaagaaucacacaaaaauaaaagaauguuuugaaaguguuu

SEQ ID NO: 236810 - RNA, 64 nt, Homo Sapiens
aacuuauauaaugcuguuuauacuuuauaacucacaaaaauauauuaaugagaauauaucaaag

SEQ ID NO: 236811 - RNA, 64 nt, Homo Sapiens
ugcuuuauuauuaccacuuauuuuuaaauggggacaaaaauaucuuaagcauuaauuucuucau

SEQ ID NO: 236812 - RNA, 64 nt, Homo Sapiens
uuuaaaauuauacaugagcaucgagugagccaugcaaaaauagcuuuuagggucuaaguugacc

SEQ ID NO: 236813 - RNA, 64 nt, Homo Sapiens
gaauuuaguauacacauaccucauuuauuguagacaaaaauaauuauagggugguguuuuuauu

SEQ ID NO: 236814 - RNA, 64 nt, Homo Sapiens
aaaaaaaaaagauguuauacaaccaucaaaguggcaaaaauaaaaaaaaucaaguauuggcaaa

SEQ ID NO: 236815 - RNA, 64 nt, Homo Sapiens
agaauaaaaaugacaacaaaguaaaaggguaucccaaaaauaaaacuauccuuuuggaaaaaaa

SEQ ID NO: 236816 - RNA, 64 nt, Homo Sapiens
uggggguauauucaagguuauaugucuuagaaaacaaaaauacuuguuuggguucaguuuugga

SEQ ID NO: 236817 - RNA, 64 nt, Homo Sapiens
uaagauuuucugggccuaaaggauagaucaaagucaaaaauagcaaugccucccuaucccucac

SEQ ID NO: 236818 - RNA, 64 nt, Homo Sapiens
uuccuaaucagaaauuuuuaucaguuuccagucucaaaaauacaaaauaaaaacaaacguuuuu

SEQ ID NO: 236819 - RNA, 64 nt, Homo Sapiens
aauucuaaaauaaaauauuggcacaaagagauuucaaaaauaucacugcauccuauagaagaua

SEQ ID NO: 236820 - RNA, 64 nt, Homo Sapiens
uaauaaaauauucucuauaauugcuucuagauuacaaaaauaugacaaucuuguaaguagcaga

SEQ ID NO: 236821 - RNA, 64 nt, Homo Sapiens
uaaaaagguuagaaucuaaggacaaagaaugauccaaaaauacuaaggaaaaagaacaauuuuc

SEQ ID NO: 236822 - RNA, 64 nt, Homo Sapiens
cuuugcuuaauguaaucauucauauacuuugcuacaaaaauauuaauauauuucauuacugaau

SEQ ID NO: 236823 - RNA, 64 nt, Homo Sapiens
cuuggcacccagaagaauucaacugcgcucacugcaaaaauacaauggccuacauuggauuugu

SEQ ID NO: 236824 - RNA, 64 nt, Homo Sapiens
agauguuauauucuuuucucauuucuuccccacccaaaaauaagcuaccauauagcuuauaagu

SEQ ID NO: 236825 - RNA, 64 nt, Homo Sapiens
ugggacagaccauaaaugauggaaaaugucaacacaaaaauagcugaaagccagguacaacuac

SEQ ID NO: 236826 - RNA, 64 nt, Homo Sapiens
aacuacugcauuuauauauguaaguuuuguauaucaaaaauaauuggucuaaauuuccuagacu

SEQ ID NO: 236827 - RNA, 64 nt, Homo Sapiens
auguuauaccaacuauucagaggaacucauacuucaaaaauauuaggaaaaucugucuuauagu

SEQ ID NO: 236828 - RNA, 64 nt, Homo Sapiens
gaaaguuuuaaucaaagcaguuuaauuaagguaucaaaaauaucuuugcuuacuaucaagaagu

SEQ ID NO: 236829 - RNA, 64 nt, Homo Sapiens
aaguuauuaauagccauuugacugacacaaaggacaaaaauauaauaagcaacaugaauuaaga

SEQ ID NO: 236830 - RNA, 64 nt, Homo Sapiens
uuauuuuuaucccaucucacacguuaucucauugcaaaaauauuauggugagaauuaaaauaaa

SEQ ID NO: 236831 - RNA, 64 nt, Homo Sapiens
uagaggugagaaauuuaaacuauaagcaagaaggcaaaaauaguuuggauauguaaaacauuua

SEQ ID NO: 236832 - RNA, 64 nt, Homo Sapiens
cuauuucacaacagccugacaacauuucuauagccaaaaauagcuaaauaccucaaucagucuc

SEQ ID NO: 236833 - RNA, 64 nt, Homo Sapiens
gcacuccagccugggcgacagagugagacuaucucaaaaauaaauaaauaaauaaauaaauagu

SEQ ID NO: 236834 - RNA, 64 nt, Homo Sapiens
gguuucaaacccacagauuaaaccaaccacagaucaaaaauagaaaaaaaaaaaaaaagaaaaa

SEQ ID NO: 236835 - RNA, 64 nt, Homo Sapiens
cugguguuuuaacuaguauugcaauaagcaaaugcaaaaauauucaauagaugcacuauucuug

SEQ ID NO: 236836 - RNA, 64 nt, Homo Sapiens
agugaguagaaugacaugcuuacuauacagaaggcaaaaauaggacucucagguaauaguuuaa

SEQ ID NO: 236837 - RNA, 64 nt, Homo Sapiens
uuagucuacuuguauuguuuauaagaaacccaagcaaaaauauauagcaauuguuaccuuguua

SEQ ID NO: 236838 - RNA, 64 nt, Homo Sapiens
gagaaagaucagaauggccuugagaauagagccacaaaaauaacuaugaaaaugccaguaacgu

SEQ ID NO: 236839 - RNA, 64 nt, Homo Sapiens
uucuguaugaacaccuggaagcaaaaucauagugcaaaaauacauuuaagguguggucaaaaau

SEQ ID NO: 236840 - RNA, 64 nt, Homo Sapiens
aaaucauagugcaaaaauacauuuaagguguggucaaaaauaagucuuuaauugguaaauaaua

SEQ ID NO: 236841 - RNA, 64 nt, Homo Sapiens
uuuccaaauauucuaaaaaagauacuguauaugucaaaaauauuuuuaugugaagguguuucaa

SEQ ID NO: 236842 - RNA, 64 nt, Homo Sapiens
cuuaauucucauuaugaagauguuuuuagaggggcaaaaauauuuugcaagcucuggaauuguu

SEQ ID NO: 236843 - RNA, 64 nt, Homo Sapiens
uaaaagcuuuagauugaaauuuaugacuagcaaacaaaaauagaauauauaaacgauauaugua

SEQ ID NO: 236844 - RNA, 64 nt, Homo Sapiens
agccgggcgugguggugcaucucuacuaaaaauacaaaaauauuccaacauggagaaaccccgu

SEQ ID NO: 236845 - RNA, 64 nt, Homo Sapiens
aagguugaaucuguggcggcguucuguaaaguuacaaaaauagauuccacauguaacugguuau

SEQ ID NO: 236846 - RNA, 64 nt, Homo Sapiens
auuauuagucuuaacuaaaaauuuuuaaagugcacaaaaauauucuuacaagauuacacuaacc

SEQ ID NO: 236847 - RNA, 64 nt, Homo Sapiens
auaccuaauuuuuauagugcaaagugcuuugugccaaaaauauccaaaaugagcuuggguuuaa

SEQ ID NO: 236848 - RNA, 64 nt, Homo Sapiens
uucuaguuuaugguuaaaaguuuuugaagugucucaaaaauauuuuacuaacuguaacccuaaa

SEQ ID NO: 236849 - RNA, 64 nt, Homo Sapiens
cuccuaugcaucauaagcauguuuguaauauuuucaaaaauaguucuacugaugcuacaggaau

SEQ ID NO: 236850 - RNA, 64 nt, Homo Sapiens
cacugcuaaaaguuauuguuuugguuucuuuuaacaaaaauaaaugucuugaccuucaauucaa

SEQ ID NO: 236851 - RNA, 64 nt, Homo Sapiens
cccuguagcucuuuacggucgugacauuucacuucaaaaauaaggaaagagaaugaaagacccu

SEQ ID NO: 236852 - RNA, 64 nt, Homo Sapiens
ggauaaagcuacuuaaugugucuccuccacugaucaaaaauauuccauauagucuuggugagga

SEQ ID NO: 236853 - RNA, 64 nt, Homo Sapiens
uugguucuguauuauaaauugcaccuuaauagaccaaaaauaucuauacagcacugauuuccuu

SEQ ID NO: 236854 - RNA, 64 nt, Homo Sapiens
auaucuuucaugacuauuuuauuaccucauuaugcaaaaauaacugagugcccgccccugauau

SEQ ID NO: 236855 - RNA, 64 nt, Homo Sapiens
aguauaggaacugcuggcuuuacaagcaaacaaacaaaaauagguacaucucucuaugcuguuc

SEQ ID NO: 236856 - RNA, 64 nt, Homo Sapiens
aauccuuaccccuucaauucuuacuuagaaaccacaaaaauaggauacuuuuguauuuaauaga

SEQ ID NO: 236857 - RNA, 64 nt, Homo Sapiens
aaaguauacauuuuugcugugaacuuuaaaaguucaaaaauaaguugauucaaagaccaaacua

SEQ ID NO: 236858 - RNA, 64 nt, Homo Sapiens
cuucaggaaaaagaaaaucauaccaugguuucuacaaaaauaacaaagguuucuuuucccuuuu

SEQ ID NO: 236859 - RNA, 64 nt, Homo Sapiens
ucugaguuugauauucaaguuuuugccucuuucacaaaaauaaccugaagcagcucaagaccaa

SEQ ID NO: 236860 - RNA, 64 nt, Homo Sapiens
cugauuacuuuagccuuaugaaucaguagcaaugcaaaaauauucucauuuuuaaauaauucaa

SEQ ID NO: 236861 - RNA, 64 nt, Homo Sapiens
aaaaaauagcucuaaauaucagcuguuuucaacccaaaaauaagcaauaaguuuauguuaguag

SEQ ID NO: 236862 - RNA, 64 nt, Homo Sapiens
aggcgugccaacucuugcuggguaaauagucuuucaaaaauaucucuaaaugcacaccuccuaa

SEQ ID NO: 236863 - RNA, 64 nt, Homo Sapiens
agaaaaguuggccaugguaagaagaugagagauucaaaaauaucauuuaauacuuauuuaaaaa

SEQ ID NO: 236864 - RNA, 64 nt, Homo Sapiens
auuccagccugggcgacagagcaagacuccaucucaaaaauaaaauaaaaaaagaaagaaagaa

SEQ ID NO: 236865 - RNA, 64 nt, Homo Sapiens
ccagccuggccaacauggcaaaaccccgucucuacaaaaauacaaaagaaauuagccagacaug

SEQ ID NO: 236866 - RNA, 64 nt, Homo Sapiens
uuuuaauaaaacaugcugcaaccaugguauacaacaaaaauacauuucuuuggugauugaaauu

SEQ ID NO: 236867 - RNA, 64 nt, Homo Sapiens
cuggcuuuuaauuuugccagcuaaggacauaaaacaaaaauaaacaaacaaaaacaaauagcca

SEQ ID NO: 236868 - RNA, 64 nt, Homo Sapiens
aauucaauguaauuuauaauuuucuaugucaauacaaaaauacaucacagccuucucaaacagc

SEQ ID NO: 236869 - RNA, 64 nt, Homo Sapiens
gaugucuacaauacaauaccuguauucaaaauaacaaaaauaaagccugauucuuuguuucuag

SEQ ID NO: 236870 - RNA, 64 nt, Homo Sapiens
uuaauguacaaguguaaauaaugacuuuccuuuucaaaaauacuacauuauuuuaaucauauau

SEQ ID NO: 236871 - RNA, 64 nt, Homo Sapiens
uuuaaaaucuuugaaagaaguaucaauacccuuucaaaaauauacaaaucugcuuuucaaaguu

SEQ ID NO: 236872 - RNA, 64 nt, Homo Sapiens
uaaauaaaacacgaaagaaacacaauuuugcugccaaaaauauacagguuuuuuuuuuaauaaa

SEQ ID NO: 236873 - RNA, 64 nt, Homo Sapiens
uucauacuuccucauccccuagaugaaaagacaacaaaaauauccauuacuuaacacaguauaa

SEQ ID NO: 236874 - RNA, 64 nt, Homo Sapiens
cauguauagccaauugauugcuguaagagaaugacaaaaauauuuuggugcuauuucauuccug

SEQ ID NO: 236875 - RNA, 64 nt, Homo Sapiens
aaaaaaagaaacaaccuugggaagaaauauuaaacaaaaauaacuucagcaauugacaaaauuu

SEQ ID NO: 236876 - RNA, 64 nt, Homo Sapiens
cugccacucucauccccgucccaaccaucucugucaaaaauauaccuuuuucauaugauauucu

SEQ ID NO: 236877 - RNA, 64 nt, Homo Sapiens
uuggaucaccaaauuaucuuagguacuaaggccucaaaaauaagaaaaacuuuauuauuucucc

SEQ ID NO: 236878 - RNA, 64 nt, Homo Sapiens
ggcauuugcuuuuuagaaauguccacugcaauggcaaaaauauuuccaguugcacuguaucucu

SEQ ID NO: 236879 - RNA, 64 nt, Homo Sapiens
ugaaaucugugguauuuauuuacaaacaugucuacaaaaauagauuacagcuuauuuuauuuuu

SEQ ID NO: 236880 - RNA, 64 nt, Homo Sapiens
guggcaagcugacauucugcacgcuagcacuuuacaaaaauauugugcaagaccuaccucccac

SEQ ID NO: 236881 - RNA, 64 nt, Homo Sapiens
gauaggguuacauccugauaaaauaaucauaagucaaaaauauugucaguugaaaauacauuua

SEQ ID NO: 236882 - RNA, 64 nt, Homo Sapiens
uuuuguaacaguuauuuuccccauuacaaaaauacaaaaauauuccauuguuauagguaaaauc

SEQ ID NO: 236883 - RNA, 64 nt, Homo Sapiens
aaaauauuuuuuguaacaguguaaaaucccauuacaaaaauacaagcuuuuaccauuguuauag

SEQ ID NO: 236884 - RNA, 64 nt, Homo Sapiens
aaguggaaaaagguaucuucaucuaaaaaguauacaaaaauaaaauauauuuacauuuucacuc

SEQ ID NO: 236885 - RNA, 64 nt, Homo Sapiens
gcuuauagcuaaacugccugucauagagcaacaacaaaaauaauagagaggggcuuuauuucaa

SEQ ID NO: 236886 - RNA, 64 nt, Homo Sapiens
ugaaguucauuuaaaaaaauaauuugaaagaauacaaaaauauguucuuuuauauauagcaaac

SEQ ID NO: 236887 - RNA, 64 nt, Homo Sapiens
ugaauggcaauagauuuuaauauacguuuuugugcaaaaauaaaagaaaagcuggugacauauu

SEQ ID NO: 236888 - RNA, 64 nt, Homo Sapiens
aauagacuguaguauccuuucauuggagaauuuacaaaaauaucaucuacagcucaaaaguccc

SEQ ID NO: 236889 - RNA, 64 nt, Homo Sapiens
aggucuuguugauauuauauaguaaaaauaaaaccaaaaauaaauauuauucaaguggcucuuc

SEQ ID NO: 236890 - RNA, 64 nt, Homo Sapiens
auuuuaguaugaagcaaugauccuugugauuagucaaaaauaccacuauaugguaguuuaaguu

SEQ ID NO: 236891 - RNA, 64 nt, Homo Sapiens
aguaguacagauucuccucuucauggaauuuaugcaaaaauaugauuuuggguuuauguauaaa

SEQ ID NO: 236892 - RNA, 64 nt, Homo Sapiens
auaauuauaaauggucauauaguaggagaaaaagcaaaaauaaacccuucggagcuuauauucc

SEQ ID NO: 236893 - RNA, 64 nt, Homo Sapiens
cgcuacacagguucacaucauacucauugaagcacaaaaauauccuaucacugagaaguuuuac

SEQ ID NO: 236894 - RNA, 64 nt, Homo Sapiens
uaccuaccucacuucaaauuauguuuggacuugacaaaaauaggugcaaaugauggggggcaau

SEQ ID NO: 236895 - RNA, 64 nt, Homo Sapiens
cagccuggccaacaugaugaaaccccgucucuaccaaaaauagaaaaaaauauagccgggccug

SEQ ID NO: 236896 - RNA, 64 nt, Homo Sapiens
uaaaaauaauaaaaccuccagcaagacucagucucaaaaauaaacacuccagccugaugacaga

SEQ ID NO: 236897 - RNA, 64 nt, Homo Sapiens
aaaauuaauugggcauggugaacccugucuguaccaaaaauacacauccuggccaacaugguga

SEQ ID NO: 236898 - RNA, 64 nt, Homo Sapiens
acaccuacaaccaucuaaucuuugacaaaguugacaaaaauacgcaauggggaaagaauucccc

SEQ ID NO: 236899 - RNA, 64 nt, Homo Sapiens
auaggaacggaaaaagauuucaugacaaagaucccaaaaauaauuguaacgaaagcaaaaauug

SEQ ID NO: 236900 - RNA, 64 nt, Homo Sapiens
uaaccaauuugagauucaugauuaauuauguacacaaaaauauuuuccuuguagaaaauaguuu

SEQ ID NO: 236901 - RNA, 64 nt, Homo Sapiens
gguugguuaguugggcaaaaucauuuauuacaugcaaaaauagaaaauuauuuguuaaauucag

SEQ ID NO: 236902 - RNA, 64 nt, Homo Sapiens
accagccugggcaauauagcaagaccccucacuacaaaaauaaaacaucaaaaacaaaaacaau

SEQ ID NO: 236903 - RNA, 64 nt, Homo Sapiens
acuccaggcuggguaacagaaugagaccuuaucucaaaaauaaacaaacuaauaaaaagcaaaa

SEQ ID NO: 236904 - RNA, 64 nt, Homo Sapiens
cagccugagcaacaugguaaaaccccaucucuaccaaaaauacaaaaauuagcugggcuuggug

SEQ ID NO: 236905 - RNA, 64 nt, Homo Sapiens
acuccagccugggcaacagagcaagaccuugucucaaaaauaaacaaacuaaaauuaaaaaaag

SEQ ID NO: 236906 - RNA, 64 nt, Homo Sapiens
cagccuggcuaacauggugaaauccuaucucuaccaaaaauacaaaaauuagccaggcguggug

SEQ ID NO: 236907 - RNA, 64 nt, Homo Sapiens
auaaaauaaaauaaacaaaugcaaaauuucaucucaaaaauaagcuccugccugggcaacaaga

SEQ ID NO: 236908 - RNA, 64 nt, Homo Sapiens
aaaauuagccaggcauaguuaacccugucucuaccaaaaauacacagcaugaccaacaugguga

SEQ ID NO: 236909 - RNA, 64 nt, Homo Sapiens
gaguuguuauguuuauguuauuuaguuguugaagcaaaaauacuuaacagaugugguuuguugc

SEQ ID NO: 236910 - RNA, 64 nt, Homo Sapiens
ggaaauuaucugggcauaguaaccccaucucuaccaaaaauacacagccuggccagcaugguga

SEQ ID NO: 236911 - RNA, 64 nt, Homo Sapiens
uuaacagcuugaguauugcauuuccuuggccaaacaaaaauagcuacaaauccacaaaaauuua

SEQ ID NO: 236912 - RNA, 64 nt, Homo Sapiens
uuugaaaaaaauacauaacuaauuuaauuuuacacaaaaauauuuaugcagauuuucagaauuu

SEQ ID NO: 236913 - RNA, 64 nt, Homo Sapiens
ggcuaaacuggucaguauuaauguguagcccuaccaaaaauagccaguaguaucugaaaaugaa

SEQ ID NO: 236914 - RNA, 64 nt, Homo Sapiens
gagauuuaaaaaacugaaaagguauaccucaacccaaaaauaaagguuuguuuugguuuguuau

SEQ ID NO: 236915 - RNA, 64 nt, Homo Sapiens
agauuuugcacaauucguguugaaccuuccaaaacaaaaauaaagaccuguccaaaaguuuuga

SEQ ID NO: 236916 - RNA, 64 nt, Homo Sapiens
aaaacaaaaauaaagaccuguccaaaaguuuugacaaaaauacugauugcucccaaauaaagug

SEQ ID NO: 236917 - RNA, 64 nt, Homo Sapiens
ccagggugacugacugaauuguagguacaguggacaaaaauagcugaggacugucccaacaaca

SEQ ID NO: 236918 - RNA, 64 nt, Homo Sapiens
gaaacuaguggauuauauauuuauucaguagcaccaaaaauagucaaaaaauacaaaccauaca

SEQ ID NO: 236919 - RNA, 64 nt, Homo Sapiens
uuaucuacugcacaccaacuguuuauagaauacacaaaaauaaaauguaauaacuguauucugu

SEQ ID NO: 236920 - RNA, 64 nt, Homo Sapiens
caguuuagaaauuagcuccagguucuuaaacuaacaaaaauaaaaccuaagcaugccacagagc

SEQ ID NO: 236921 - RNA, 64 nt, Homo Sapiens
aaauuguugaguauuacaucauuuacuugagguucaaaaauaauucauuuuaaauuaaguaguu

SEQ ID NO: 236922 - RNA, 64 nt, Homo Sapiens
cacauuucaaauaauaacaauacuuuuuguuuuucaaaaauaaaaugcaauguuauauaaagcu

SEQ ID NO: 236923 - RNA, 64 nt, Homo Sapiens
uagggauucuauuugaguugcguuuaucuguuggcaaaaauaucuuuuucaaggcaucagcucu

SEQ ID NO: 236924 - RNA, 64 nt, Homo Sapiens
auuuacaggagaaagaggugauuauggagggaaucaaaaauacugcuuucaguuaguagcuagc

SEQ ID NO: 236925 - RNA, 64 nt, Homo Sapiens
caacuugacacaagauuagacaaaaaauuccuuacaaaaauacuguguaacuauuucucaaacu

SEQ ID NO: 236926 - RNA, 64 nt, Homo Sapiens
uuagaauuuuguucaaauuauagcagaauuuaggcaaaaauaaaacagacauguauuuuuguuu

SEQ ID NO: 236927 - RNA, 64 nt, Homo Sapiens
acuaaaacaacuuuuuccauuuuuaauaaaacgccaaaaauaucacaacccaccaaaaauagau

SEQ ID NO: 236928 - RNA, 64 nt, Homo Sapiens
uuuuuaauaaaacgccaaaaauaucacaacccaccaaaaauagaugccucucccccuccagccc

SEQ ID NO: 236929 - RNA, 64 nt, Homo Sapiens
gucaucaaauacaggugguuaaaauugagcucaucaaaaauauuuaauaguauugacuguuuaa

SEQ ID NO: 236930 - RNA, 64 nt, Homo Sapiens
guuauaauuuuuugaauuuuauuauucaaaugaucaaaaauauaggauuuuaauaagcuccagu

SEQ ID NO: 236931 - RNA, 64 nt, Homo Sapiens
aaacaaucuucauuugaaaagaauuuuugaguggcaaaaauagaaugaaauuaccugguucuaa

SEQ ID NO: 236932 - RNA, 64 nt, Homo Sapiens
uuauuaggcccccaaaauuugacaguugaauaaucaaaaauauuagugggauuugugauuuaau

SEQ ID NO: 236933 - RNA, 64 nt, Homo Sapiens
aauguuaauaugauuaauuuuuauuucauguugucaaaaauaccugcaguuucccuuaaauugg

SEQ ID NO: 236934 - RNA, 64 nt, Homo Sapiens
uugccuuaggucacgccuuauaagaauauuccgucaaaaauaguaaauauuucaaauucaugaa

SEQ ID NO: 236935 - RNA, 64 nt, Homo Sapiens; identical to SEQ ID NO: 156143

SEQ ID NO: 236936 - RNA, 64 nt, Homo Sapiens; identical to SEQ ID NO: 156144

SEQ ID NO: 236937 - RNA, 64 nt, Homo Sapiens; identical to SEQ ID NO: 156145

SEQ ID NO: 236938 - RNA, 64 nt, Homo Sapiens; identical to SEQ ID NO: 156146

SEQ ID NO: 236939 - RNA, 64 nt, Homo Sapiens; identical to SEQ ID NO: 156147

SEQ ID NO: 236940 - RNA, 64 nt, Homo Sapiens; identical to SEQ ID NO: 156148

SEQ ID NO: 236941 - RNA, 64 nt, Homo Sapiens; identical to SEQ ID NO: 156149

SEQ ID NO: 236942 - RNA, 64 nt, Homo Sapiens; identical to SEQ ID NO: 156150

SEQ ID NO: 236943 - RNA, 64 nt, Homo Sapiens; identical to SEQ ID NO: 156151

SEQ ID NO: 236944 - RNA, 64 nt, Homo Sapiens; identical to SEQ ID NO: 156152

SEQ ID NO: 236945 - RNA, 64 nt, Homo Sapiens; identical to SEQ ID NO: 156153

SEQ ID NO: 236946 - RNA, 64 nt, Homo Sapiens; identical to SEQ ID NO: 156154

SEQ ID NO: 236947 - RNA, 64 nt, Homo Sapiens; identical to SEQ ID NO: 156155

SEQ ID NO: 236948 - RNA, 64 nt, Homo Sapiens; identical to SEQ ID NO: 156156

SEQ ID NO: 236949 - RNA, 64 nt, Homo Sapiens; identical to SEQ ID NO: 156157

SEQ ID NO: 236950 - RNA, 64 nt, Homo Sapiens; identical to SEQ ID NO: 156158

SEQ ID NO: 236951 - RNA, 64 nt, Homo Sapiens; identical to SEQ ID NO: 156159

SEQ ID NO: 236952 - RNA, 64 nt, Homo Sapiens; identical to SEQ ID NO: 156160

SEQ ID NO: 236953 - RNA, 64 nt, Homo Sapiens; identical to SEQ ID NO: 156161

SEQ ID NO: 236954 - RNA, 64 nt, Homo Sapiens; identical to SEQ ID NO: 156162

SEQ ID NO: 236955 - RNA, 64 nt, Homo Sapiens; identical to SEQ ID NO: 156163

SEQ ID NO: 236956 - RNA, 64 nt, Homo Sapiens; identical to SEQ ID NO: 156164

SEQ ID NO: 236957 - RNA, 64 nt, Homo Sapiens; identical to SEQ ID NO: 156165

SEQ ID NO: 236958 - RNA, 64 nt, Homo Sapiens; identical to SEQ ID NO: 156166

SEQ ID NO: 236959 - RNA, 64 nt, Homo Sapiens; identical to SEQ ID NO: 156167

SEQ ID NO: 236960 - RNA, 64 nt, Homo Sapiens; identical to SEQ ID NO: 156168

SEQ ID NO: 236961 - RNA, 64 nt, Homo Sapiens; identical to SEQ ID NO: 156169

SEQ ID NO: 236962 - RNA, 64 nt, Homo Sapiens; identical to SEQ ID NO: 156170

SEQ ID NO: 236963 - RNA, 64 nt, Homo Sapiens; identical to SEQ ID NO: 156171

SEQ ID NO: 236964 - RNA, 64 nt, Homo Sapiens; identical to SEQ ID NO: 156172

SEQ ID NO: 236965 - RNA, 64 nt, Homo Sapiens; identical to SEQ ID NO: 156173

SEQ ID NO: 236966 - RNA, 64 nt, Homo Sapiens; identical to SEQ ID NO: 156174

SEQ ID NO: 236967 - RNA, 64 nt, Homo Sapiens; identical to SEQ ID NO: 156175

SEQ ID NO: 236968 - RNA, 64 nt, Homo Sapiens; identical to SEQ ID NO: 156176

SEQ ID NO: 236969 - RNA, 64 nt, Homo Sapiens; identical to SEQ ID NO: 156177

SEQ ID NO: 236970 - RNA, 64 nt, Homo Sapiens; identical to SEQ ID NO: 156178

SEQ ID NO: 236971 - RNA, 64 nt, Homo Sapiens; identical to SEQ ID NO: 156179

SEQ ID NO: 236972 - RNA, 64 nt, Homo Sapiens; identical to SEQ ID NO: 156180

SEQ ID NO: 236973 - RNA, 64 nt, Homo Sapiens; identical to SEQ ID NO: 156181

SEQ ID NO: 236974 - RNA, 64 nt, Homo Sapiens; identical to SEQ ID NO: 156182

SEQ ID NO: 236975 - RNA, 64 nt, Homo Sapiens; identical to SEQ ID NO: 156183

SEQ ID NO: 236976 - RNA, 64 nt, Homo Sapiens; identical to SEQ ID NO: 156184

SEQ ID NO: 236977 - RNA, 64 nt, Homo Sapiens; identical to SEQ ID NO: 156185

SEQ ID NO: 236978 - RNA, 64 nt, Homo Sapiens; identical to SEQ ID NO: 156186

SEQ ID NO: 236979 - RNA, 64 nt, Homo Sapiens; identical to SEQ ID NO: 156187

SEQ ID NO: 236980 - RNA, 64 nt, Homo Sapiens; identical to SEQ ID NO: 156188

SEQ ID NO: 236981 - RNA, 64 nt, Homo Sapiens; identical to SEQ ID NO: 156189

SEQ ID NO: 236982 - RNA, 64 nt, Homo Sapiens; identical to SEQ ID NO: 156190

SEQ ID NO: 236983 - RNA, 64 nt, Homo Sapiens; identical to SEQ ID NO: 156191

SEQ ID NO: 236984 - RNA, 64 nt, Homo Sapiens; identical to SEQ ID NO: 156192

SEQ ID NO: 236985 - RNA, 64 nt, Homo Sapiens; identical to SEQ ID NO: 156193

SEQ ID NO: 236986 - RNA, 64 nt, Homo Sapiens; identical to SEQ ID NO: 156194

SEQ ID NO: 236987 - RNA, 64 nt, Homo Sapiens; identical to SEQ ID NO: 156195

SEQ ID NO: 236988 - RNA, 64 nt, Homo Sapiens; identical to SEQ ID NO: 156196

SEQ ID NO: 236989 - RNA, 64 nt, Homo Sapiens; identical to SEQ ID NO: 156197

SEQ ID NO: 236990 - RNA, 64 nt, Homo Sapiens; identical to SEQ ID NO: 156198

SEQ ID NO: 236991 - RNA, 64 nt, Homo Sapiens; identical to SEQ ID NO: 156199

SEQ ID NO: 236992 - RNA, 64 nt, Homo Sapiens; identical to SEQ ID NO: 156200

SEQ ID NO: 236993 - RNA, 64 nt, Homo Sapiens; identical to SEQ ID NO: 156201

SEQ ID NO: 236994 - RNA, 64 nt, Homo Sapiens; identical to SEQ ID NO: 156202

SEQ ID NO: 236995 - RNA, 64 nt, Homo Sapiens; identical to SEQ ID NO: 156203

SEQ ID NO: 236996 - RNA, 64 nt, Homo Sapiens; identical to SEQ ID NO: 156204

SEQ ID NO: 236997 - RNA, 64 nt, Homo Sapiens; identical to SEQ ID NO: 156205

SEQ ID NO: 236998 - RNA, 64 nt, Homo Sapiens; identical to SEQ ID NO: 156206

SEQ ID NO: 236999 - RNA, 64 nt, Homo Sapiens; identical to SEQ ID NO: 156207

SEQ ID NO: 237000 - RNA, 64 nt, Homo Sapiens; identical to SEQ ID NO: 156208

SEQ ID NO: 237001 - RNA, 64 nt, Homo Sapiens; identical to SEQ ID NO: 156209

SEQ ID NO: 237002 - RNA, 53 nt, Homo Sapiens; identical to SEQ ID NO: 156210

SEQ ID NO: 237003 - RNA, 64 nt, Homo Sapiens; identical to SEQ ID NO: 156211

SEQ ID NO: 237004 - RNA, 64 nt, Homo Sapiens; identical to SEQ ID NO: 156212

SEQ ID NO: 237005 - RNA, 64 nt, Homo Sapiens; identical to SEQ ID NO: 156213

SEQ ID NO: 237006 - RNA, 64 nt, Homo Sapiens; identical to SEQ ID NO: 156214

SEQ ID NO: 237007 - RNA, 64 nt, Homo Sapiens; identical to SEQ ID NO: 156215

SEQ ID NO: 237008 - RNA, 64 nt, Homo Sapiens; identical to SEQ ID NO: 156216

SEQ ID NO: 237009 - RNA, 64 nt, Homo Sapiens; identical to SEQ ID NO: 156217

SEQ ID NO: 237010 - RNA, 64 nt, Homo Sapiens; identical to SEQ ID NO: 156218

SEQ ID NO: 237011 - RNA, 64 nt, Homo Sapiens; identical to SEQ ID NO: 156219

SEQ ID NO: 237012 - RNA, 64 nt, Homo Sapiens; identical to SEQ ID NO: 156220

SEQ ID NO: 237013 - RNA, 64 nt, Homo Sapiens; identical to SEQ ID NO: 156221

SEQ ID NO: 237014 - RNA, 64 nt, Homo Sapiens; identical to SEQ ID NO: 156222

SEQ ID NO: 237015 - RNA, 64 nt, Homo Sapiens; identical to SEQ ID NO: 156223

SEQ ID NO: 237016 - RNA, 64 nt, Homo Sapiens; identical to SEQ ID NO: 156224

SEQ ID NO: 237017 - RNA, 64 nt, Homo Sapiens; identical to SEQ ID NO: 156225

SEQ ID NO: 237018 - RNA, 64 nt, Homo Sapiens; identical to SEQ ID NO: 156226

SEQ ID NO: 237019 - RNA, 64 nt, Homo Sapiens; identical to SEQ ID NO: 156227

SEQ ID NO: 237020 - RNA, 64 nt, Homo Sapiens; identical to SEQ ID NO: 156228

SEQ ID NO: 237021 - RNA, 64 nt, Homo Sapiens; identical to SEQ ID NO: 156229

SEQ ID NO: 237022 - RNA, 64 nt, Homo Sapiens; identical to SEQ ID NO: 156230

SEQ ID NO: 237023 - RNA, 64 nt, Homo Sapiens; identical to SEQ ID NO: 156231

SEQ ID NO: 237024 - RNA, 64 nt, Homo Sapiens; identical to SEQ ID NO: 156232

SEQ ID NO: 237025 - RNA, 64 nt, Homo Sapiens; identical to SEQ ID NO: 156233

SEQ ID NO: 237026 - RNA, 64 nt, Homo Sapiens; identical to SEQ ID NO: 156234

SEQ ID NO: 237027 - RNA, 64 nt, Homo Sapiens; identical to SEQ ID NO: 156235

SEQ ID NO: 237028 - RNA, 64 nt, Homo Sapiens; identical to SEQ ID NO: 156236

SEQ ID NO: 237029 - RNA, 64 nt, Homo Sapiens; identical to SEQ ID NO: 156237

SEQ ID NO: 237030 - RNA, 64 nt, Homo Sapiens; identical to SEQ ID NO: 156238

SEQ ID NO: 237031 - RNA, 64 nt, Homo Sapiens; identical to SEQ ID NO: 156239

SEQ ID NO: 237032 - RNA, 64 nt, Homo Sapiens; identical to SEQ ID NO: 156240

SEQ ID NO: 237033 - RNA, 64 nt, Homo Sapiens; identical to SEQ ID NO: 156241

SEQ ID NO: 237034 - RNA, 64 nt, Homo Sapiens; identical to SEQ ID NO: 156242

SEQ ID NO: 237035 - RNA, 64 nt, Homo Sapiens; identical to SEQ ID NO: 156243

SEQ ID NO: 237036 - RNA, 64 nt, Homo Sapiens; identical to SEQ ID NO: 156244

SEQ ID NO: 237037 - RNA, 64 nt, Homo Sapiens; identical to SEQ ID NO: 156245

SEQ ID NO: 237038 - RNA, 64 nt, Homo Sapiens; identical to SEQ ID NO: 156246

SEQ ID NO: 237039 - RNA, 64 nt, Homo Sapiens; identical to SEQ ID NO: 156247

SEQ ID NO: 237040 - RNA, 64 nt, Homo Sapiens; identical to SEQ ID NO: 156248

SEQ ID NO: 237041 - RNA, 64 nt, Homo Sapiens; identical to SEQ ID NO: 156249

SEQ ID NO: 237042 - RNA, 64 nt, Homo Sapiens; identical to SEQ ID NO: 156250

SEQ ID NO: 237043 - RNA, 64 nt, Homo Sapiens; identical to SEQ ID NO: 156251

SEQ ID NO: 237044 - RNA, 64 nt, Homo Sapiens; identical to SEQ ID NO: 156252

SEQ ID NO: 237045 - RNA, 64 nt, Homo Sapiens; identical to SEQ ID NO: 156253

SEQ ID NO: 237046 - RNA, 64 nt, Homo Sapiens; identical to SEQ ID NO: 156254

SEQ ID NO: 237047 - RNA, 64 nt, Homo Sapiens; identical to SEQ ID NO: 156255

SEQ ID NO: 237048 - RNA, 64 nt, Homo Sapiens; identical to SEQ ID NO: 156256

SEQ ID NO: 237049 - RNA, 64 nt, Homo Sapiens; identical to SEQ ID NO: 156257

SEQ ID NO: 237050 - RNA, 64 nt, Homo Sapiens; identical to SEQ ID NO: 156258

SEQ ID NO: 237051 - RNA, 64 nt, Homo Sapiens; identical to SEQ ID NO: 156259

SEQ ID NO: 237052 - RNA, 64 nt, Homo Sapiens; identical to SEQ ID NO: 156260

SEQ ID NO: 237053 - RNA, 64 nt, Homo Sapiens; identical to SEQ ID NO: 156261

SEQ ID NO: 237054 - RNA, 64 nt, Homo Sapiens; identical to SEQ ID NO: 156262

SEQ ID NO: 237055 - RNA, 64 nt, Homo Sapiens; identical to SEQ ID NO: 156263

SEQ ID NO: 237056 - RNA, 64 nt, Homo Sapiens; identical to SEQ ID NO: 156264

SEQ ID NO: 237057 - RNA, 64 nt, Homo Sapiens; identical to SEQ ID NO: 156265

SEQ ID NO: 237058 - RNA, 64 nt, Homo Sapiens; identical to SEQ ID NO: 156266

SEQ ID NO: 237059 - RNA, 64 nt, Homo Sapiens; identical to SEQ ID NO: 156267

SEQ ID NO: 237060 - RNA, 64 nt, Homo Sapiens; identical to SEQ ID NO: 156268

SEQ ID NO: 237061 - RNA, 64 nt, Homo Sapiens; identical to SEQ ID NO: 156269

SEQ ID NO: 237062 - RNA, 64 nt, Homo Sapiens; identical to SEQ ID NO: 156270

SEQ ID NO: 237063 - RNA, 64 nt, Homo Sapiens; identical to SEQ ID NO: 156271

SEQ ID NO: 237064 - RNA, 64 nt, Homo Sapiens; identical to SEQ ID NO: 156272

SEQ ID NO: 237065 - RNA, 64 nt, Homo Sapiens; identical to SEQ ID NO: 156273

SEQ ID NO: 237066 - RNA, 64 nt, Homo Sapiens; identical to SEQ ID NO: 156274

SEQ ID NO: 237067 - RNA, 64 nt, Homo Sapiens; identical to SEQ ID NO: 156275

SEQ ID NO: 237068 - RNA, 64 nt, Homo Sapiens; identical to SEQ ID NO: 156276

SEQ ID NO: 237069 - RNA, 64 nt, Homo Sapiens; identical to SEQ ID NO: 156277

SEQ ID NO: 237070 - RNA, 64 nt, Homo Sapiens; identical to SEQ ID NO: 156278

SEQ ID NO: 237071 - RNA, 64 nt, Homo Sapiens; identical to SEQ ID NO: 156279

SEQ ID NO: 237072 - RNA, 64 nt, Homo Sapiens; identical to SEQ ID NO: 156280

SEQ ID NO: 237073 - RNA, 64 nt, Homo Sapiens; identical to SEQ ID NO: 156281

SEQ ID NO: 237074 - RNA, 64 nt, Homo Sapiens; identical to SEQ ID NO: 156282

SEQ ID NO: 237075 - RNA, 64 nt, Homo Sapiens; identical to SEQ ID NO: 156283

SEQ ID NO: 237076 - RNA, 64 nt, Homo Sapiens; identical to SEQ ID NO: 156284

SEQ ID NO: 237077 - RNA, 64 nt, Homo Sapiens; identical to SEQ ID NO: 156285

SEQ ID NO: 237078 - RNA, 64 nt, Homo Sapiens; identical to SEQ ID NO: 156286

SEQ ID NO: 237079 - RNA, 64 nt, Homo Sapiens; identical to SEQ ID NO: 156287

SEQ ID NO: 237080 - RNA, 64 nt, Homo Sapiens; identical to SEQ ID NO: 229078

SEQ ID NO: 237081 - RNA, 64 nt, Homo Sapiens; identical to SEQ ID NO: 229079

SEQ ID NO: 237082 - RNA, 64 nt, Homo Sapiens
ccuggacaggcauggaccugucuccagagagaggagccugaaguucguggggcgggacagcguc

SEQ ID NO: 237083 - RNA, 64 nt, Homo Sapiens
gaggaggccucuggaccugcuggucugcacugacagccugaagggucuacacccucggcucacc

SEQ ID NO: 237084 - RNA, 64 nt, Homo Sapiens
cuugcaggacucacuggauggcuggagguaguagagccugaaguuccaggcucagcagggagcu

SEQ ID NO: 237085 - RNA, 64 nt, Homo Sapiens
cuugcaggacucacuggauagcuggcugagaaagagccugaaguuccaggcucagcagggagcu

SEQ ID NO: 237086 - RNA, 55 nt, Homo Sapiens
cuugcaggacucacuggauagaaagagccugaaguagcagggagcugcuggauga

SEQ ID NO: 237087 - RNA, 64 nt, Homo Sapiens
aucuauggguuagaaaagcaagaggaaauacagaagccugaauacggaaagacagcuaucagga

SEQ ID NO: 237088 - RNA, 64 nt, Homo Sapiens
caaaugggagcauagcagugaggauuaguaauauagccugaaaauugagaugcagauauagcaa

SEQ ID NO: 237089 - RNA, 64 nt, Homo Sapiens
gaggauacugcaauuuucggauaaauggcaaguaagccugaaguuuuaaaagcagucagauucu

SEQ ID NO: 237090 - RNA, 64 nt, Homo Sapiens
uggacguugaaacauaucacuugacuuuucucuuagccugaauguuauuugaguaagccucuag

SEQ ID NO: 237091 - RNA, 54 nt, Homo Sapiens
cagaguccgaggagcuguagcccuagccugaaucuucaguuccccagucucggg

SEQ ID NO: 237092 - RNA, 64 nt, Homo Sapiens
cugcuaagaugucacugggggucacuaaagcugaagccugaaggaaagccucucauugcuguag

SEQ ID NO: 237093 - RNA, 64 nt, Homo Sapiens
auugcaccuggccaagaagagacaucuugacuugagccugaagacuauguacagagacugaccu

SEQ ID NO: 237094 - RNA, 64 nt, Homo Sapiens
uauaucugucauuauugcccugaucacaaacaaaagccugaauguacuauguuuaaaagacaaa

SEQ ID NO: 237095 - RNA, 64 nt, Homo Sapiens
uauggaaaugcugcuaaaauacgacuaauguuggagccugaaacgauagcgggagggaggaagu

SEQ ID NO: 237096 - RNA, 64 nt, Homo Sapiens
acggauccuugucuccaaugccaauucucccugcagccugaagaguccagagucaguuucuauc

SEQ ID NO: 237097 - RNA, 64 nt, Homo Sapiens
aaauuuccagaugucucaugcugcauagggcaggagccugaaaagcuaauuugagaagauaaua

SEQ ID NO: 237098 - RNA, 64 nt, Homo Sapiens
auuccuagucagagauugggagaaauacaagaugagccugaaucaucucauguaccugacagua

SEQ ID NO: 237099 - RNA, 64 nt, Homo Sapiens
uucaccuccccgguucaagcaauucuccugccucagccugaagucgugaucugcccgccucggc

SEQ ID NO: 237100 - RNA, 64 nt, Homo Sapiens
uuguuguguuucugaaaagugaaauuuaaaaagcagccugaaaaauaaaaauuuauaauuugcc

SEQ ID NO: 237101 - RNA, 64 nt, Homo Sapiens
ccuugcagagaagccagauugauugaguuugacaagccugaaguuucuucucugacuuucaggu

SEQ ID NO: 237102 - RNA, 64 nt, Homo Sapiens
ugaacauacaaagugggcagcccuuguucucgacagccugaacugagauacagagacaacaccc

SEQ ID NO: 237103 - RNA, 64 nt, Homo Sapiens
gagccucacauccuuuuccuugacuucucaacccagccugaaguccauugcgguuccgucacuc

SEQ ID NO: 237104 - RNA, 64 nt, Homo Sapiens
uaaucacuaacuccuuccuuuuccucugcaugccagccugaaaauuccaaaucuagccucugaa

SEQ ID NO: 237105 - RNA, 64 nt, Homo Sapiens
gccaggagcagaagcaaagagcagacacacauacagccugaaacagaccuggacagacagacac

SEQ ID NO: 237106 - RNA, 64 nt, Homo Sapiens
auacagccugaaacagaccuggacagacagacacagccugaaacagacccggacagacagacac

SEQ ID NO: 237107 - RNA, 64 nt, Homo Sapiens
acacagccugaaacagacccggacagacagacacagccugaaacagacccagacaaacagacag

SEQ ID NO: 237108 - RNA, 64 nt, Homo Sapiens
ugaaacagacccagacaaacagacagacagacacagccugaaacagacccagacagacagacag

SEQ ID NO: 237109 - RNA, 64 nt, Homo Sapiens
acagccugaaacagacccagacagacagacagacagccugaaacagacccagacacagccugaa

SEQ ID NO: 237110 - RNA, 64 nt, Homo Sapiens
agacagacagacagccugaaacagacccagacacagccugaaacagauccggacagacagacag

SEQ ID NO: 237111 - RNA, 64 nt, Homo Sapiens
agccugaaacagauccggacagacagacagaaacagccugaaacagacccagacagacagacag

SEQ ID NO: 237112 - RNA, 64 nt, Homo Sapiens
agccugaaacagacccagacagacagacagacacagccugaaacagacccggacagacagacag

SEQ ID NO: 237113 - RNA, 64 nt, Homo Sapiens
agccugaaacagacccggacagacagacagacacagccugaaacagacccggacagacagacag

SEQ ID NO: 237114 - RNA, 64 nt, Homo Sapiens; identical to SEQ ID NO: 237113

SEQ ID NO: 237115 - RNA, 64 nt, Homo Sapiens
agccugaaacagacccggacagacagacagacacagccugaaacagaccuagacagacagacac

SEQ ID NO: 237116 - RNA, 64 nt, Homo Sapiens
agauugaaacagacccagacaaacagacagacacagccugaaacagacccagacacagccugaa

SEQ ID NO: 237117 - RNA, 64 nt, Homo Sapiens
acagacagacacagccugaaacagacccagacacagccugaaacagacccggacagacagacag

SEQ ID NO: 237118 - RNA, 64 nt, Homo Sapiens
agccugaaacagacccggacagacagacagacacagccugaaacagacccagacagacagacag

SEQ ID NO: 237119 - RNA, 64 nt, Homo Sapiens
agccugaaacagacccagacagacagacagacacagccugaaacagacccagacagacagaccg

SEQ ID NO: 237120 - RNA, 64 nt, Homo Sapiens
agccugaaacagacccagacagacagaccgacgcagccugaaagagacccagacagagagacag

SEQ ID NO: 237121 - RNA, 64 nt, Homo Sapiens
ccuacuaauuuaaacuaagacaguuuaaaaaggaagccugaaaaagacucauacuacaaauaau

SEQ ID NO: 237122 - RNA, 64 nt, Homo Sapiens
gugguccuuggccgccuccugcuccugcucugcaagccugaaacuggcuugucuggagccagga

SEQ ID NO: 237123 - RNA, 64 nt, Homo Sapiens
aagcagcccccuguggcggccuuccgggucucgcagccugaagccuggauuccagcagugaaug

SEQ ID NO: 237124 - RNA, 64 nt, Homo Sapiens
aagggcacauugcccauggcugggaacaugacccagccugaaagauacaggggaucauguuaaa

SEQ ID NO: 237125 - RNA, 64 nt, Homo Sapiens
cuguuguuacaaaccaccaaauaauacaguugugagccugaauacaggacugaacuccuauaca

SEQ ID NO: 237126 - RNA, 64 nt, Homo Sapiens
aauguaguguagcucauuauugagaauuuaggaaagccugaauccauuaauuaaggaaauaaau

SEQ ID NO: 237127 - RNA, 64 nt, Homo Sapiens
acugcucuguuuuaaaaacucagaggcaauuuuuacauaucaguaauuguuuuuauaauuugug

SEQ ID NO: 237128 - RNA, 64 nt, Homo Sapiens
gaaauugaaucuguccaucuguuuauaaucaagaacauaucagaaauauauaggucccagguaa

SEQ ID NO: 237129 - RNA, 64 nt, Homo Sapiens
ucaacacauuacuugcacaacauucccuaucaaaacauaucaaugaagaaaaaauuaagagaua

SEQ ID NO: 237130 - RNA, 64 nt, Homo Sapiens
aaaguagaauuauaucuaauucaucaauuuuuauacauaucagauauuuuaaaaccaugcagcu

SEQ ID NO: 237131 - RNA, 64 nt, Homo Sapiens
gaacuguaacaccucuaaucaauucaggagaaacacauaucauuuaaagcaacauaggcuaacc

SEQ ID NO: 237132 - RNA, 64 nt, Homo Sapiens
aaagcuauuuacuuugguuuucuagaaaguuguuacauaucauggcugguuaacuuuuauuucu

SEQ ID NO: 237133 - RNA, 64 nt, Homo Sapiens
aacaagagaaaagacacgagauuuaaaaauagaaacauaucaaauuuuaaggaaaacuaccugu

SEQ ID NO: 237134 - RNA, 64 nt, Homo Sapiens
uguggacugaccuuguaaaaugucacgaauauggacauaucaucaaugaggaggaugcuaaaaa

SEQ ID NO: 237135 - RNA, 64 nt, Homo Sapiens
agcuggcccagaggcucucguccagacguccaccucagugcacgagagagccgccaaacauucc

SEQ ID NO: 237136 - RNA, 64 nt, Homo Sapiens
gaagguaggugugaggaccaccacgcagucugcuucagugcagugucuuggcugccgcccugcu

SEQ ID NO: 237137 - RNA, 64 nt, Homo Sapiens
gacuucagaccaauucuuugagacuauauggccuucagugcaaaucuuacuucccugaagcaag

SEQ ID NO: 237138 - RNA, 64 nt, Homo Sapiens
agaauugggcugguuaggccuggggaaaaaaaaaucagugcacaaaauuuuaaaacccgagaaa

SEQ ID NO: 237139 - RNA, 64 nt, Homo Sapiens
aguguuaaccagucauggugagcagcccuaaaugucagugcagcggagcccuaaaugucagugc

SEQ ID NO: 237140 - RNA, 64 nt, Homo Sapiens
agcccuaaaugucagugcagaggagcccuaaaugucagugcagcuuuuaaugauuaaaaagugc

SEQ ID NO: 237141 - RNA, 64 nt, Homo Sapiens
uacagacgguuggcauacguuauagacuguauacucagugcaaauauagcugcauuuauaccuc

SEQ ID NO: 237142 - RNA, 64 nt, Homo Sapiens
uucucugguccuucccuauuuucuguucuggaugucagugcagugcacugcuacuguuuuaucc

SEQ ID NO: 237143 - RNA, 64 nt, Homo Sapiens
acgggagugacccagcuacuggaguucuaggaacucagugcaauaucugugugcguggcuauca

SEQ ID NO: 237144 - RNA, 64 nt, Homo Sapiens
ugccucagcuaccuaaugaucaacaaaaccgcauucagugcaccuccgaaagaagacacagaac

SEQ ID NO: 237145 - RNA, 64 nt, Homo Sapiens
cccagggcacagaugcugagacagccucuccuucucagugcagggacgucaccccugccaggca

SEQ ID NO: 237146 - RNA, 64 nt, Homo Sapiens
cccagggcauagaugcugagacagccucucccucucagugcagggacgucaccccugccaggca

SEQ ID NO: 237147 - RNA, 64 nt, Homo Sapiens
acucccauugccauggggucccccgaaaccuggcucagugcaauaucccgacacguccccguuc

SEQ ID NO: 237148 - RNA, 64 nt, Homo Sapiens
acaucuggccugaacaucgauggguuugggggccucagugcaggggacccuccugcccucagcu

SEQ ID NO: 237149 - RNA, 64 nt, Homo Sapiens
ucuugaugcugcgccguccccaaagcagaaauuuucagugcaagauccauuccacgcaguugcu

SEQ ID NO: 237150 - RNA, 64 nt, Homo Sapiens
cuccgccacccggguucaggggugcgaucucagcucagugcaacugcccaggcuggaguacaau

SEQ ID NO: 237151 - RNA, 64 nt, Homo Sapiens; identical to SEQ ID NO: 44795

SEQ ID NO: 237152 - RNA, 64 nt, Homo Sapiens; identical to SEQ ID NO: 44796

SEQ ID NO: 237153 - RNA, 64 nt, Homo Sapiens; identical to SEQ ID NO: 44797

SEQ ID NO: 237154 - RNA, 64 nt, Homo Sapiens; identical to SEQ ID NO: 44798

SEQ ID NO: 237155 - RNA, 64 nt, Homo Sapiens; identical to SEQ ID NO: 44799

SEQ ID NO: 237156 - RNA, 64 nt, Homo Sapiens; identical to SEQ ID NO: 44800

SEQ ID NO: 237157 - RNA, 64 nt, Homo Sapiens; identical to SEQ ID NO: 44801

SEQ ID NO: 237158 - RNA, 64 nt, Homo Sapiens; identical to SEQ ID NO: 44802

SEQ ID NO: 237159 - RNA, 64 nt, Homo Sapiens; identical to SEQ ID NO: 44803

SEQ ID NO: 237160 - RNA, 64 nt, Homo Sapiens; identical to SEQ ID NO: 44804

SEQ ID NO: 237161 - RNA, 64 nt, Homo Sapiens; identical to SEQ ID NO: 44805

SEQ ID NO: 237162 - RNA, 64 nt, Homo Sapiens; identical to SEQ ID NO: 44806

SEQ ID NO: 237163 - RNA, 64 nt, Homo Sapiens; identical to SEQ ID NO: 44807

SEQ ID NO: 237164 - RNA, 64 nt, Homo Sapiens; identical to SEQ ID NO: 44808

SEQ ID NO: 237165 - RNA, 64 nt, Homo Sapiens; identical to SEQ ID NO: 44809

SEQ ID NO: 237166 - RNA, 64 nt, Homo Sapiens; identical to SEQ ID NO: 44810

SEQ ID NO: 237167 - RNA, 64 nt, Homo Sapiens; identical to SEQ ID NO: 44811

SEQ ID NO: 237168 - RNA, 64 nt, Homo Sapiens; identical to SEQ ID NO: 44812

SEQ ID NO: 237169 - RNA, 64 nt, Homo Sapiens; identical to SEQ ID NO: 44813

SEQ ID NO: 237170 - RNA, 64 nt, Homo Sapiens; identical to SEQ ID NO: 44814

SEQ ID NO: 237171 - RNA, 64 nt, Homo Sapiens; identical to SEQ ID NO: 44815

SEQ ID NO: 237172 - RNA, 64 nt, Homo Sapiens; identical to SEQ ID NO: 44816

SEQ ID NO: 237173 - RNA, 64 nt, Homo Sapiens; identical to SEQ ID NO: 44817

SEQ ID NO: 237174 - RNA, 64 nt, Homo Sapiens; identical to SEQ ID NO: 44818

SEQ ID NO: 237175 - RNA, 64 nt, Homo Sapiens; identical to SEQ ID NO: 44819

SEQ ID NO: 237176 - RNA, 64 nt, Homo Sapiens; identical to SEQ ID NO: 44820

SEQ ID NO: 237177 - RNA, 64 nt, Homo Sapiens; identical to SEQ ID NO: 44821

SEQ ID NO: 237178 - RNA, 64 nt, Homo Sapiens; identical to SEQ ID NO: 44822

SEQ ID NO: 237179 - RNA, 64 nt, Homo Sapiens; identical to SEQ ID NO: 44823

SEQ ID NO: 237180 - RNA, 64 nt, Homo Sapiens; identical to SEQ ID NO: 44824

SEQ ID NO: 237181 - RNA, 64 nt, Homo Sapiens; identical to SEQ ID NO: 44825

SEQ ID NO: 237182 - RNA, 64 nt, Homo Sapiens; identical to SEQ ID NO: 44826

SEQ ID NO: 237183 - RNA, 64 nt, Homo Sapiens; identical to SEQ ID NO: 44827

SEQ ID NO: 237184 - RNA, 64 nt, Homo Sapiens; identical to SEQ ID NO: 44828

SEQ ID NO: 237185 - RNA, 64 nt, Homo Sapiens; identical to SEQ ID NO: 44829

SEQ ID NO: 237186 - RNA, 64 nt, Homo Sapiens; identical to SEQ ID NO: 44830

SEQ ID NO: 237187 - RNA, 64 nt, Homo Sapiens; identical to SEQ ID NO: 44831

SEQ ID NO: 237188 - RNA, 64 nt, Homo Sapiens; identical to SEQ ID NO: 44832

SEQ ID NO: 237189 - RNA, 64 nt, Homo Sapiens; identical to SEQ ID NO: 44833

SEQ ID NO: 237190 - RNA, 64 nt, Homo Sapiens; identical to SEQ ID NO: 44834

SEQ ID NO: 237191 - RNA, 64 nt, Homo Sapiens; identical to SEQ ID NO: 44835

SEQ ID NO: 237192 - RNA, 64 nt, Homo Sapiens; identical to SEQ ID NO: 44836

SEQ ID NO: 237193 - RNA, 64 nt, Homo Sapiens; identical to SEQ ID NO: 44837

SEQ ID NO: 237194 - RNA, 64 nt, Homo Sapiens; identical to SEQ ID NO: 44838

SEQ ID NO: 237195 - RNA, 64 nt, Homo Sapiens; identical to SEQ ID NO: 44839

SEQ ID NO: 237196 - RNA, 64 nt, Homo Sapiens; identical to SEQ ID NO: 44840

SEQ ID NO: 237197 - RNA, 59 nt, Homo Sapiens; identical to SEQ ID NO: 44841

SEQ ID NO: 237198 - RNA, 64 nt, Homo Sapiens; identical to SEQ ID NO: 44842

SEQ ID NO: 237199 - RNA, 64 nt, Homo Sapiens; identical to SEQ ID NO: 44843

SEQ ID NO: 237200 - RNA, 64 nt, Homo Sapiens; identical to SEQ ID NO: 44844

SEQ ID NO: 237201 - RNA, 64 nt, Homo Sapiens; identical to SEQ ID NO: 44845

SEQ ID NO: 237202 - RNA, 64 nt, Homo Sapiens; identical to SEQ ID NO: 44846

SEQ ID NO: 237203 - RNA, 64 nt, Homo Sapiens; identical to SEQ ID NO: 44847

SEQ ID NO: 237204 - RNA, 64 nt, Homo Sapiens; identical to SEQ ID NO: 44848

SEQ ID NO: 237205 - RNA, 64 nt, Homo Sapiens; identical to SEQ ID NO: 44849

SEQ ID NO: 237206 - RNA, 64 nt, Homo Sapiens; identical to SEQ ID NO: 44850

SEQ ID NO: 237207 - RNA, 64 nt, Homo Sapiens; identical to SEQ ID NO: 44851

SEQ ID NO: 237208 - RNA, 64 nt, Homo Sapiens; identical to SEQ ID NO: 44852

SEQ ID NO: 237209 - RNA, 64 nt, Homo Sapiens; identical to SEQ ID NO: 44853

SEQ ID NO: 237210 - RNA, 64 nt, Homo Sapiens; identical to SEQ ID NO: 44854

SEQ ID NO: 237211 - RNA, 64 nt, Homo Sapiens; identical to SEQ ID NO: 44855

SEQ ID NO: 237212 - RNA, 64 nt, Homo Sapiens; identical to SEQ ID NO: 44856

SEQ ID NO: 237213 - RNA, 64 nt, Homo Sapiens; identical to SEQ ID NO: 44857

SEQ ID NO: 237214 - RNA, 64 nt, Homo Sapiens; identical to SEQ ID NO: 44858

SEQ ID NO: 237215 - RNA, 64 nt, Homo Sapiens; identical to SEQ ID NO: 44859

SEQ ID NO: 237216 - RNA, 64 nt, Homo Sapiens; identical to SEQ ID NO: 44860

SEQ ID NO: 237217 - RNA, 64 nt, Homo Sapiens; identical to SEQ ID NO: 44861

SEQ ID NO: 237218 - RNA, 64 nt, Homo Sapiens; identical to SEQ ID NO: 44862

SEQ ID NO: 237219 - RNA, 64 nt, Homo Sapiens; identical to SEQ ID NO: 44863

SEQ ID NO: 237220 - RNA, 64 nt, Homo Sapiens; identical to SEQ ID NO: 44864

SEQ ID NO: 237221 - RNA, 64 nt, Homo Sapiens
cccacccacucuguccugggaaaugaagaagcaucuuccuuaggucugcccugcuugcaaaucc

SEQ ID NO: 237222 - RNA, 64 nt, Homo Sapiens
gggagggauugacauguuucaacaaaauaaugcacuuccuuaccuaguggcccuucacacaacu

SEQ ID NO: 237223 - RNA, 64 nt, Homo Sapiens
uaucugcaaaaggauggaaacaaagguguacuuacuuccuuauucagagugccagaguuuuagc

SEQ ID NO: 237224 - RNA, 64 nt, Homo Sapiens
ccugggcuguuuggaaguccuucauaaagccgcucuuccuuaggucaccugucuuggaaacucc

SEQ ID NO: 237225 - RNA, 64 nt, Homo Sapiens
uugaguaccgguagcuugugaucaaaggcauauacuuccuuaugagauuucuuuacuaaagcaa

SEQ ID NO: 237226 - RNA, 64 nt, Homo Sapiens
gcaauuuugauucccauguaucacaugaauuacacuuccuuaaauaaauuacaguuuauggcug

SEQ ID NO: 237227 - RNA, 64 nt, Homo Sapiens
uuauagagacuaggaguuaaacugggacaacccccuuccuuauuauggggacauuagacugaaa

SEQ ID NO: 237228 - RNA, 64 nt, Homo Sapiens
ugucaauaacaaugguggccgugcauuuccagugcuuccuuaccguguggggauggagaggaug

SEQ ID NO: 237229 - RNA, 64 nt, Homo Sapiens
aaaguagggagauuaaaaaaaaagaaagaaaaugcuuccuuaucuggaagccuuucuggauuaa

SEQ ID NO: 237230 - RNA, 64 nt, Homo Sapiens
acuguuugguccagcuuuagaacugugguuuugacuuccuuaucucuugggagaagcuucuguu

SEQ ID NO: 237231 - RNA, 64 nt, Homo Sapiens
aaagagaccacuugaaauaaguuccuuuuaccuccuuccuuaauuuuuauugcgcucagguuau

SEQ ID NO: 237232 - RNA, 64 nt, Homo Sapiens
uuuucguuuauuuagcucuauccccguucucuaacuuccuuacggaaaaaucuuuaagucuuug

SEQ ID NO: 237233 - RNA, 64 nt, Homo Sapiens
uaaugacuuaucuccuuccacugccacagggccccuuccuuaagcacacaucuccuccauguuc

SEQ ID NO: 237234 - RNA, 64 nt, Homo Sapiens
cuacccuggacaccgcugagaccuguuggccagccuuccuuaaaaacucuccuacgaaccuccu

SEQ ID NO: 237235 - RNA, 64 nt, Homo Sapiens
ccauaggcugggagagaaacccccuuccucaccucuuccuuauuuuucuugcucccagcacccg

SEQ ID NO: 237236 - RNA, 64 nt, Homo Sapiens
gccccggaugcagauuuuaggcuugaacacggggcuuccuuacaagaagggagaagagaugggg

SEQ ID NO: 237237 - RNA, 64 nt, Homo Sapiens
uacaguugauucagaaaucuuucaacaucauuugcuuccuuaucuuuuaaauuaaugggcaccu

SEQ ID NO: 237238 - RNA, 64 nt, Homo Sapiens
uuuucauaguugucugacauuucaguucaacaugcuuccuuagcuaauuuaccaaagccagacc

SEQ ID NO: 237239 - RNA, 64 nt, Homo Sapiens
uugucuccccacucccucccucuuuguuuccuuccuuccuuauuuccuuuaguuuccuuccuua

SEQ ID NO: 237240 - RNA, 64 nt, Homo Sapiens
uuuguuuccuuccuuccuuauuuccuuuaguuuccuuccuuagccguuuugaguggugggaauc

SEQ ID NO: 237241 - RNA, 64 nt, Homo Sapiens
uaguuuuacauugccacagugggggauauuuuuccuuccuuaagucucaguaccuggcugggga

SEQ ID NO: 237242 - RNA, 64 nt, Homo Sapiens
cugagagugcccccaggcugcucggcuguaggggcuuccuuagguaagucauuagggcugaggg

SEQ ID NO: 237243 - RNA, 64 nt, Homo Sapiens
cuagguccuauuacuaaucuucuaugucugcaaacauuacuaauugugcagaccauuacuaagg

SEQ ID NO: 237244 - RNA, 64 nt, Homo Sapiens
gucuaugucugcaaacauuaucagaugugcagaccauuacuaagccucaaaccugucacuuugg

SEQ ID NO: 237245 - RNA, 64 nt, Homo Sapiens
gguagacaugugcuuugacauagcgugagcagcacauuacuaaagcaauuacaugcauguugca

SEQ ID NO: 237246 - RNA, 64 nt, Homo Sapiens
gguagaacugauucuuaaggcaggccugaaaggccauuacuaauagaaacacagccuuuccaau

SEQ ID NO: 237247 - RNA, 64 nt, Homo Sapiens
uucugaugaaaauaaaguugaacaaauuuauaaacauuacuaauauaauuuacaaacuacuaua

SEQ ID NO: 237248 - RNA, 64 nt, Homo Sapiens
ucugauaauaauuuacaaacaagugguuuauagacauuacuauuuccugauugucucuuaaagu

SEQ ID NO: 237249 - RNA, 64 nt, Homo Sapiens
aacaggacccaauuuauauuguucauuauguaaaacuaauuauacaugaaaaggcaaucuuaaa

SEQ ID NO: 237250 - RNA, 64 nt, Homo Sapiens
ggggguuuuccuuggauuuuaauuuggagauaagacuaauuauuagauauaggagacuucaugc

SEQ ID NO: 237251 - RNA, 64 nt, Homo Sapiens
aaaauccaucugcuuauucuaacuucccaacgccacuaauuauuucaauaaauggaauugacug

SEQ ID NO: 237252 - RNA, 64 nt, Homo Sapiens
guacuaaauccuauguuuacuaaacugucauuguacuaauuaaucaacuguuuuaaacuagcau

SEQ ID NO: 237253 - RNA, 64 nt, Homo Sapiens
ugcucuguggccuucuuacacuucucagagggcagaguggcagccgggcacccuacagaaacuc

SEQ ID NO: 237254 - RNA, 64 nt, Homo Sapiens
ggcagccgggcacccuacagaaacucagagggcagaguggcagccaggcccacaugucucucaa

SEQ ID NO: 237255 - RNA, 64 nt, Homo Sapiens
cuccuugggcccgccuccccaggagguagaaaaugaguggcaggcuagagauuucacccauuuu

SEQ ID NO: 237256 - RNA, 64 nt, Homo Sapiens
uguguccacaagcagaggcccccucgaugggagggaguggcaggcaggagaagguggcgcugcc

SEQ ID NO: 237257 - RNA, 64 nt, Homo Sapiens
uggguugugauauugaccauauauuucuucaagugaguggcaugguuugauagugcuucuugua

SEQ ID NO: 237258 - RNA, 64 nt, Homo Sapiens
agucugaggcaccugcauauagucauguacuggagaguggcaaaauucauaauuuuaucuaccc

SEQ ID NO: 237259 - RNA, 64 nt, Homo Sapiens
ucaaaauaugcagcaaaaaccaauacaacaaaacgaguggcacgauuuauuucaaacuaggcca

SEQ ID NO: 237260 - RNA, 64 nt, Homo Sapiens
gaucugucucucugcuccaaagaaauuuuggagugaguggcaguccugcgccagccucgcggga

SEQ ID NO: 237261 - RNA, 64 nt, Homo Sapiens; identical to SEQ ID NO: 105003

SEQ ID NO: 237262 - RNA, 64 nt, Homo Sapiens; identical to SEQ ID NO: 105004

SEQ ID NO: 237263 - RNA, 64 nt, Homo Sapiens; identical to SEQ ID NO: 105005

SEQ ID NO: 237264 - RNA, 64 nt, Homo Sapiens; identical to SEQ ID NO: 105006

SEQ ID NO: 237265 - RNA, 64 nt, Homo Sapiens; identical to SEQ ID NO: 105007

SEQ ID NO: 237266 - RNA, 54 nt, Homo Sapiens; identical to SEQ ID NO: 100148

SEQ ID NO: 237267 - RNA, 64 nt, Homo Sapiens; identical to SEQ ID NO: 105009

SEQ ID NO: 237268 - RNA, 64 nt, Homo Sapiens; identical to SEQ ID NO: 105010

SEQ ID NO: 237269 - RNA, 64 nt, Homo Sapiens; identical to SEQ ID NO: 105011

SEQ ID NO: 237270 - RNA, 64 nt, Homo Sapiens; identical to SEQ ID NO: 105012

SEQ ID NO: 237271 - RNA, 64 nt, Homo Sapiens; identical to SEQ ID NO: 105013

SEQ ID NO: 237272 - RNA, 64 nt, Homo Sapiens; identical to SEQ ID NO: 105014

SEQ ID NO: 237273 - RNA, 64 nt, Homo Sapiens; identical to SEQ ID NO: 105015

SEQ ID NO: 237274 - RNA, 64 nt, Homo Sapiens
aguaacuuccaugaugacacugacgccuauaccugagcucuaggcugccuggagggaaggaaca

SEQ ID NO: 237275 - RNA, 64 nt, Homo Sapiens
aagcuccgagccuguuuucuguaguuuauaguuagagcucuauuuuguuaugguuuuuuaaacu

SEQ ID NO: 237276 - RNA, 64 nt, Homo Sapiens
gagaaccuacaugucagguucuggaguuggcccugagcucuauccaccaagccagcaccccacc

SEQ ID NO: 237277 - RNA, 64 nt, Homo Sapiens
gccccagcuccucucugcaacccagcccucuccugagcucuaggcugggauuacacccgcugga

SEQ ID NO: 237278 - RNA, 64 nt, Homo Sapiens; identical to SEQ ID NO: 213296

SEQ ID NO: 237279 - RNA, 64 nt, Homo Sapiens; identical to SEQ ID NO: 213297

SEQ ID NO: 237280 - RNA, 64 nt, Homo Sapiens; identical to SEQ ID NO: 213298

SEQ ID NO: 237281 - RNA, 64 nt, Homo Sapiens; identical to SEQ ID NO: 213299

SEQ ID NO: 237282 - RNA, 64 nt, Homo Sapiens; identical to SEQ ID NO: 213300

SEQ ID NO: 237283 - RNA, 64 nt, Homo Sapiens; identical to SEQ ID NO: 213301

SEQ ID NO: 237284 - RNA, 64 nt, Homo Sapiens; identical to SEQ ID NO: 213302

SEQ ID NO: 237285 - RNA, 64 nt, Homo Sapiens; identical to SEQ ID NO: 213303

SEQ ID NO: 237286 - RNA, 64 nt, Homo Sapiens; identical to SEQ ID NO: 213304

SEQ ID NO: 237287 - RNA, 64 nt, Homo Sapiens; identical to SEQ ID NO: 213305

SEQ ID NO: 237288 - RNA, 64 nt, Homo Sapiens; identical to SEQ ID NO: 213306

SEQ ID NO: 237289 - RNA, 64 nt, Homo Sapiens; identical to SEQ ID NO: 213307

SEQ ID NO: 237290 - RNA, 64 nt, Homo Sapiens; identical to SEQ ID NO: 88803

SEQ ID NO: 237291 - RNA, 64 nt, Homo Sapiens; identical to SEQ ID NO: 88804

SEQ ID NO: 237292 - RNA, 64 nt, Homo Sapiens; identical to SEQ ID NO: 88805

SEQ ID NO: 237293 - RNA, 64 nt, Homo Sapiens; identical to SEQ ID NO: 88806

SEQ ID NO: 237294 - RNA, 64 nt, Homo Sapiens; identical to SEQ ID NO: 88807

SEQ ID NO: 237295 - RNA, 64 nt, Homo Sapiens; identical to SEQ ID NO: 88808

SEQ ID NO: 237296 - RNA, 64 nt, Homo Sapiens; identical to SEQ ID NO: 88809

SEQ ID NO: 237297 - RNA, 64 nt, Homo Sapiens; identical to SEQ ID NO: 88810

SEQ ID NO: 237298 - RNA, 64 nt, Homo Sapiens; identical to SEQ ID NO: 88811

SEQ ID NO: 237299 - RNA, 52 nt, Homo Sapiens; identical to SEQ ID NO: 88812

SEQ ID NO: 237300 - RNA, 64 nt, Homo Sapiens; identical to SEQ ID NO: 88813

SEQ ID NO: 237301 - RNA, 64 nt, Homo Sapiens; identical to SEQ ID NO: 88814

SEQ ID NO: 237302 - RNA, 64 nt, Homo Sapiens; identical to SEQ ID NO: 88815

SEQ ID NO: 237303 - RNA, 54 nt, Homo Sapiens; identical to SEQ ID NO: 88816

SEQ ID NO: 237304 - RNA, 64 nt, Homo Sapiens; identical to SEQ ID NO: 88817

SEQ ID NO: 237305 - RNA, 64 nt, Homo Sapiens; identical to SEQ ID NO: 88818

SEQ ID NO: 237306 - RNA, 64 nt, Homo Sapiens; identical to SEQ ID NO: 88819

SEQ ID NO: 237307 - RNA, 64 nt, Homo Sapiens; identical to SEQ ID NO: 88820

SEQ ID NO: 237308 - RNA, 64 nt, Homo Sapiens; identical to SEQ ID NO: 88821

SEQ ID NO: 237309 - RNA, 64 nt, Homo Sapiens; identical to SEQ ID NO: 88822

SEQ ID NO: 237310 - RNA, 64 nt, Homo Sapiens; identical to SEQ ID NO: 88823

SEQ ID NO: 237311 - RNA, 64 nt, Homo Sapiens; identical to SEQ ID NO: 88824

SEQ ID NO: 237312 - RNA, 64 nt, Homo Sapiens; identical to SEQ ID NO: 88825

SEQ ID NO: 237313 - RNA, 64 nt, Homo Sapiens; identical to SEQ ID NO: 88826

SEQ ID NO: 237314 - RNA, 64 nt, Homo Sapiens; identical to SEQ ID NO: 88827

SEQ ID NO: 237315 - RNA, 64 nt, Homo Sapiens; identical to SEQ ID NO: 88828

SEQ ID NO: 237316 - RNA, 64 nt, Homo Sapiens; identical to SEQ ID NO: 88829

SEQ ID NO: 237317 - RNA, 64 nt, Homo Sapiens; identical to SEQ ID NO: 88830

SEQ ID NO: 237318 - RNA, 64 nt, Homo Sapiens; identical to SEQ ID NO: 88831

SEQ ID NO: 237319 - RNA, 64 nt, Homo Sapiens; identical to SEQ ID NO: 88832

SEQ ID NO: 237320 - RNA, 64 nt, Homo Sapiens; identical to SEQ ID NO: 88833

SEQ ID NO: 237321 - RNA, 64 nt, Homo Sapiens; identical to SEQ ID NO: 88834

SEQ ID NO: 237322 - RNA, 64 nt, Homo Sapiens; identical to SEQ ID NO: 88835

SEQ ID NO: 237323 - RNA, 64 nt, Homo Sapiens; identical to SEQ ID NO: 88836

SEQ ID NO: 237324 - RNA, 64 nt, Homo Sapiens; identical to SEQ ID NO: 88837

SEQ ID NO: 237325 - RNA, 64 nt, Homo Sapiens; identical to SEQ ID NO: 88838

SEQ ID NO: 237326 - RNA, 64 nt, Homo Sapiens; identical to SEQ ID NO: 88839

SEQ ID NO: 237327 - RNA, 64 nt, Homo Sapiens; identical to SEQ ID NO: 88840

SEQ ID NO: 237328 - RNA, 64 nt, Homo Sapiens; identical to SEQ ID NO: 88841

SEQ ID NO: 237329 - RNA, 62 nt, Homo Sapiens; identical to SEQ ID NO: 88842

SEQ ID NO: 237330 - RNA, 64 nt, Homo Sapiens; identical to SEQ ID NO: 88843

SEQ ID NO: 237331 - RNA, 64 nt, Homo Sapiens; identical to SEQ ID NO: 88844

SEQ ID NO: 237332 - RNA, 64 nt, Homo Sapiens; identical to SEQ ID NO: 88845

SEQ ID NO: 237333 - RNA, 64 nt, Homo Sapiens; identical to SEQ ID NO: 88846

SEQ ID NO: 237334 - RNA, 64 nt, Homo Sapiens; identical to SEQ ID NO: 88847

SEQ ID NO: 237335 - RNA, 64 nt, Homo Sapiens; identical to SEQ ID NO: 88848

SEQ ID NO: 237336 - RNA, 64 nt, Homo Sapiens; identical to SEQ ID NO: 88849

SEQ ID NO: 237337 - RNA, 64 nt, Homo Sapiens; identical to SEQ ID NO: 88850

SEQ ID NO: 237338 - RNA, 64 nt, Homo Sapiens; identical to SEQ ID NO: 88851

SEQ ID NO: 237339 - RNA, 64 nt, Homo Sapiens; identical to SEQ ID NO: 88852

SEQ ID NO: 237340 - RNA, 64 nt, Homo Sapiens; identical to SEQ ID NO: 88853

SEQ ID NO: 237341 - RNA, 64 nt, Homo Sapiens; identical to SEQ ID NO: 88854

SEQ ID NO: 237342 - RNA, 64 nt, Homo Sapiens
gcauguccccucaggucuccagucaguccagguugacccucaguucuggacguguguauauagc

SEQ ID NO: 237343 - RNA, 64 nt, Homo Sapiens
ucugagcaggccaggggcugacagcuaaugucaggacccucagcgguggagccugcugggggga

SEQ ID NO: 237344 - RNA, 64 nt, Homo Sapiens
ccaccacugcaccauuuccaggagggagaguggggacccucagccgcccccuuuuccuucccau

SEQ ID NO: 237345 - RNA, 64 nt, Homo Sapiens
ucugccucaucguuccccugagcacugggggacagacccucacccccacccuggggguguggca

SEQ ID NO: 237346 - RNA, 64 nt, Homo Sapiens
cgcgcggcugaacaugggcauccuaggcuccuacgacccucagcagaucuucaagugcaaaggg

SEQ ID NO: 237347 - RNA, 64 nt, Homo Sapiens
aggugugggacauugaguccaaggagcaggugcggacccucacgggccacgugggcaccgugua

SEQ ID NO: 237348 - RNA, 64 nt, Homo Sapiens
gaauccaucagggccaugagugucacccagaccugacccucaccaauuccagcccugacccuca

SEQ ID NO: 237349 - RNA, 64 nt, Homo Sapiens
ucacccagaccugacccucaccaauuccagcccugacccucaggacgcuggaugccagcuccca

SEQ ID NO: 237350 - RNA, 64 nt, Homo Sapiens
guccaccaguaucuggggugggcacguggucggggacccucagcagcaggggcucugucucccu

SEQ ID NO: 237351 - RNA, 64 nt, Homo Sapiens
accgucuguacucagagcgacggaugcccccugggacccucacugccuccgucuguucaucacc

SEQ ID NO: 237352 - RNA, 64 nt, Homo Sapiens
gggaggugagcucagcugccgcccucacagcccagacccucacucaccccugccugccaccugg

SEQ ID NO: 237353 - RNA, 64 nt, Homo Sapiens
gcccuggagacugccaggugcucccaucggaggggacccucagaggaucugggaauggaaggug

SEQ ID NO: 237354 - RNA, 64 nt, Homo Sapiens
ccacccugagaaccccucugggaaaaucuauuccugccaccacugggcaaacagaagaauuuuu

SEQ ID NO: 237355 - RNA, 64 nt, Homo Sapiens
acgguuuucauugacacucuucccuccucccaccugccaccaggccucaccaaagcccacugcc

SEQ ID NO: 237356 - RNA, 64 nt, Homo Sapiens
cccagccucccauauagcugggauuauaggugccugccaccaugcccagcuaauuuuuguguuu

SEQ ID NO: 237357 - RNA, 64 nt, Homo Sapiens
aucagccucccaaguagcugggauuauaggcaugugccaccaugcccagcaaauuuuguauuuu

SEQ ID NO: 237358 - RNA, 64 nt, Homo Sapiens
auacaucuugggcaacuaguuaccaaaugaauugugccaccauaacugauuuuaauuuugcauu

SEQ ID NO: 237359 - RNA, 64 nt, Homo Sapiens
aggcacugauuucuauaauagagcucuaaaaacaugccaccaguguaugaauaagggaaagauu

SEQ ID NO: 237360 - RNA, 64 nt, Homo Sapiens
cucagccucccaaguagccaggacuauaggcaccugccaccaugccuggcuaauuuuuguauuu

SEQ ID NO: 237361 - RNA, 64 nt, Homo Sapiens
cucagccuccugaguagcuggaacuacaugcgcgugccaccacgcacagcuaauuuuuauaauu

SEQ ID NO: 237362 - RNA, 64 nt, Homo Sapiens
ccuuguugggagggagaacccucuccagaaacccugccaccauggugucuugccguacuuccca

SEQ ID NO: 237363 - RNA, 64 nt, Homo Sapiens
cucccagcccguggguggcagcgugcuagcacacugccaccaucucaaagccaucccccuagcc

SEQ ID NO: 237364 - RNA, 64 nt, Homo Sapiens
aguauuuuugggcuauugcauaaggagccacugcugccaccacuuuuggauuuuaugggaggcu

SEQ ID NO: 237365 - RNA, 64 nt, Homo Sapiens
cucagccuccugagcagcugggacuacaggcgcaugccaccaugcccagcuaauuuuuguauuu

SEQ ID NO: 237366 - RNA, 64 nt, Homo Sapiens
caaacuauacugaacauuccuguccuagcgucccugccaccaggcccaaugcaucugauccuug

SEQ ID NO: 237367 - RNA, 64 nt, Homo Sapiens
acuaaagaacacuuucagaaccacuucuugauucugccaccacuugaucccauaacaggcuacc

SEQ ID NO: 237368 - RNA, 64 nt, Homo Sapiens
cucagccucccaaguagcugggauuacaggugccugccaccaugccuggcuaauuuuuuuguau

SEQ ID NO: 237369 - RNA, 64 nt, Homo Sapiens
cucagccuccugaguagcugggacuacaggcgccugccaccacgcccagcuaauuuuuguauuu

SEQ ID NO: 237370 - RNA, 64 nt, Homo Sapiens
cccuuccuauggcggcccugagugugaguaucccugccaccaagagagcaaugggcagggaagg

SEQ ID NO: 237371 - RNA, 64 nt, Homo Sapiens
uagggcuggcaccaguggaaacacauacugaagcugccaccacaauagcuugugagguuuuauc

SEQ ID NO: 237372 - RNA, 64 nt, Homo Sapiens
cagccugccugguagcugagacuuaacaggcaucugccaccaugcuugacuaauuuuugugauu

SEQ ID NO: 237373 - RNA, 64 nt, Homo Sapiens
cucagccucccaaguagcugggauuacaggugucugccaccaugccaggcuaauuuuuguauuu

SEQ ID NO: 237374 - RNA, 64 nt, Homo Sapiens
cccagcuaauuuuuguauuuggauuacaggcaccugccaccacgcucagccucccaauuuacug

SEQ ID NO: 237375 - RNA, 64 nt, Homo Sapiens
cccagcuaauuuuguuuuuuggauuacaggcaugugccaccaugcucagccucccaaguagcug

SEQ ID NO: 237376 - RNA, 64 nt, Homo Sapiens
gcggaaacauagacgugggggcauaggcucccacugccaccaccgccaucgccucaccugcagc

SEQ ID NO: 237377 - RNA, 64 nt, Homo Sapiens
ugcaggaccuccucuuggccacuuggccugggccugccaccaccacguccugcagaacgagccc

SEQ ID NO: 237378 - RNA, 64 nt, Homo Sapiens
auuugaggccuauagauuuaaauuguacaguuuaugccaccauaaaguguacucaaaauaucau

SEQ ID NO: 237379 - RNA, 64 nt, Homo Sapiens
ccuggcuaauuuuguauuuugaauuacaggcaccugccaccacgcucagccucccgaguagcug

SEQ ID NO: 237380 - RNA, 64 nt, Homo Sapiens
guuuagaaauuugcaagggcuucuuuuccgcaaaugccaccagcagauuauaauuuugucagca

SEQ ID NO: 237381 - RNA, 64 nt, Homo Sapiens
uaauuuugucagcaaugcuauuaucucuaauuagugccaccagacuagaccuguaucauucaug

SEQ ID NO: 237382 - RNA, 64 nt, Homo Sapiens
ccucaacccacaaguagcuacgacugcaagcaccugccaccauaaagggcugcauuuugccacc

SEQ ID NO: 237383 - RNA, 64 nt, Homo Sapiens
cugcaagcaccugccaccauaaagggcugcauuuugccaccauaaagggcugcauuuuuuuaaa

SEQ ID NO: 237384 - RNA, 64 nt, Homo Sapiens
cuuagccuccugaaaagcugggauuacagggcccugccaccaagcccagcuaauuguauuuuua

SEQ ID NO: 237385 - RNA, 64 nt, Homo Sapiens
agccuguuccaggcgcuggucagugcguguucuuugccaccagccugucacuccaguggcagcu

SEQ ID NO: 237386 - RNA, 64 nt, Homo Sapiens
ugacagaggccuagggcuguaucucucccugggcugccaccagagaaggugcuugguguucgcc

SEQ ID NO: 237387 - RNA, 64 nt, Homo Sapiens
ggcagagaggugccaucaguucgccuccauuccuugccaccaugaccagccucucccugaacuc

SEQ ID NO: 237388 - RNA, 64 nt, Homo Sapiens
uauucauccagaguucuuaagugucauggacuguugccaccauguccacaaaugauguuuucag

SEQ ID NO: 237389 - RNA, 64 nt, Homo Sapiens
agugcuccccaaaaggaaggcacaccagccuuggugccaccaaacagugcucucuccacuaccc

SEQ ID NO: 237390 - RNA, 64 nt, Homo Sapiens
ggacuaaagaggacgccguccuuaaaaccugacgugccaccaaagccuuccuuuguuccucaaa

SEQ ID NO: 237391 - RNA, 64 nt, Homo Sapiens
uagcauuuuuuuuucauguguggcaucuuuuucaugccaccaacaaacuuguugugugugugcg

SEQ ID NO: 237392 - RNA, 64 nt, Homo Sapiens
gucagccaccagaguagcugagacuacagggguaugccaccaugcccagcuggcauuuguuaau

SEQ ID NO: 237393 - RNA, 64 nt, Homo Sapiens
cucagccuccugaguagcugagaccacaggcgugugccaccacgccuagcuaauuuuuuauacc

SEQ ID NO: 237394 - RNA, 64 nt, Homo Sapiens
ccuggcuuaugaugaauauuggauuacagguguaugccaccacgcucagccuccugaguagcug

SEQ ID NO: 237395 - RNA, 64 nt, Homo Sapiens
ccuaugugcccaagagcugcagcccuggcauagcugccaccaugcugaagaaggcaugggaugg

SEQ ID NO: 237396 - RNA, 64 nt, Homo Sapiens
cuaagccaccugagcagcugggauuacaggugcaugccaccaugccuggcuaauuuugguauuu

SEQ ID NO: 237397 - RNA, 64 nt, Homo Sapiens
gucagccuccagaguagcugggaccgcaggcacuugccaccacgccccacuaaaaauuuuuuaa

SEQ ID NO: 237398 - RNA, 64 nt, Homo Sapiens
accagcuaaauuuuuuuguaggacuauaggcgcgugccaccacacucagccuccugaguagcug

SEQ ID NO: 237399 - RNA, 64 nt, Homo Sapiens
cccaacuaauuuuuauauuugcauuacaggcacaugccaccacgcucaggcccccuaguagcug

SEQ ID NO: 237400 - RNA, 64 nt, Homo Sapiens
aagcuguccggcucucuggugagccacccuggguugccaccauccauccaccaaccaccugggc

SEQ ID NO: 237401 - RNA, 64 nt, Homo Sapiens
agccacgccaucgccgccugccugcaaguguuacugccaccaccccaggugcuuaacuccuguc

SEQ ID NO: 237402 - RNA, 64 nt, Homo Sapiens
uugaguggaucaucucuuggaaaugcagaacuucugccaccacuuggcuauuugcacagucauc

SEQ ID NO: 237403 - RNA, 64 nt, Homo Sapiens
guuagaaaugucugucuggaaacaggacacaucuugccaccacaaguccacaccuggccuuggc

SEQ ID NO: 237404 - RNA, 64 nt, Homo Sapiens
ugguccugaaaguuaacaggagggcuggggucccugccaccaguuuucaccuagccagucuuga

SEQ ID NO: 237405 - RNA, 64 nt, Homo Sapiens
cauccuggguuugcuucugaccuugucaugugugugccaccaaacacguuauuggcaccuuuuu

SEQ ID NO: 237406 - RNA, 64 nt, Homo Sapiens
cggagcgaagagccaagcagaagcuccuggagauugccaccaagcccacguacccggugagccu

SEQ ID NO: 237407 - RNA, 64 nt, Homo Sapiens
cucagccucccgaguagcugggacuacaggcgugugccaccaugccuggcuaauuuuuguauuu

SEQ ID NO: 237408 - RNA, 64 nt, Homo Sapiens
caccucugccucccaaguaacugggacuauagcaugccaccacacccagcugauuaucauauuu

SEQ ID NO: 237409 - RNA, 64 nt, Homo Sapiens
cacuucugccucccaaguaacugggacuauagcaugccaccacacccagcugauuaucauauuu

SEQ ID NO: 237410 - RNA, 64 nt, Homo Sapiens; identical to SEQ ID NO: 189120

SEQ ID NO: 237411 - RNA, 64 nt, Homo Sapiens; identical to SEQ ID NO: 189121

SEQ ID NO: 237412 - RNA, 64 nt, Homo Sapiens; identical to SEQ ID NO: 189122

SEQ ID NO: 237413 - RNA, 64 nt, Homo Sapiens; identical to SEQ ID NO: 189123

SEQ ID NO: 237414 - RNA, 64 nt, Homo Sapiens; identical to SEQ ID NO: 189124

SEQ ID NO: 237415 - RNA, 64 nt, Homo Sapiens; identical to SEQ ID NO: 189125

SEQ ID NO: 237416 - RNA, 64 nt, Homo Sapiens; identical to SEQ ID NO: 189126

SEQ ID NO: 237417 - RNA, 64 nt, Homo Sapiens; identical to SEQ ID NO: 189127

SEQ ID NO: 237418 - RNA, 64 nt, Homo Sapiens; identical to SEQ ID NO: 189128

SEQ ID NO: 237419 - RNA, 64 nt, Homo Sapiens; identical to SEQ ID NO: 189129

SEQ ID NO: 237420 - RNA, 64 nt, Homo Sapiens; identical to SEQ ID NO: 189130

SEQ ID NO: 237421 - RNA, 64 nt, Homo Sapiens; identical to SEQ ID NO: 189131

SEQ ID NO: 237422 - RNA, 64 nt, Homo Sapiens; identical to SEQ ID NO: 189132

SEQ ID NO: 237423 - RNA, 64 nt, Homo Sapiens; identical to SEQ ID NO: 189133

SEQ ID NO: 237424 - RNA, 64 nt, Homo Sapiens; identical to SEQ ID NO: 189134

SEQ ID NO: 237425 - RNA, 64 nt, Homo Sapiens; identical to SEQ ID NO: 189135

SEQ ID NO: 237426 - RNA, 64 nt, Homo Sapiens; identical to SEQ ID NO: 189136

SEQ ID NO: 237427 - RNA, 64 nt, Homo Sapiens; identical to SEQ ID NO: 189137

SEQ ID NO: 237428 - RNA, 64 nt, Homo Sapiens; identical to SEQ ID NO: 189138

SEQ ID NO: 237429 - RNA, 64 nt, Homo Sapiens; identical to SEQ ID NO: 189139

SEQ ID NO: 237430 - RNA, 64 nt, Homo Sapiens; identical to SEQ ID NO: 189140

SEQ ID NO: 237431 - RNA, 64 nt, Homo Sapiens; identical to SEQ ID NO: 189141

SEQ ID NO: 237432 - RNA, 64 nt, Homo Sapiens; identical to SEQ ID NO: 189142

SEQ ID NO: 237433 - RNA, 64 nt, Homo Sapiens; identical to SEQ ID NO: 189143

SEQ ID NO: 237434 - RNA, 64 nt, Homo Sapiens; identical to SEQ ID NO: 189144

SEQ ID NO: 237435 - RNA, 64 nt, Homo Sapiens; identical to SEQ ID NO: 189145

SEQ ID NO: 237436 - RNA, 64 nt, Homo Sapiens; identical to SEQ ID NO: 189146

SEQ ID NO: 237437 - RNA, 64 nt, Homo Sapiens; identical to SEQ ID NO: 189147

SEQ ID NO: 237438 - RNA, 64 nt, Homo Sapiens; identical to SEQ ID NO: 189148

SEQ ID NO: 237439 - RNA, 64 nt, Homo Sapiens; identical to SEQ ID NO: 189149

SEQ ID NO: 237440 - RNA, 64 nt, Homo Sapiens; identical to SEQ ID NO: 189150

SEQ ID NO: 237441 - RNA, 64 nt, Homo Sapiens; identical to SEQ ID NO: 189151

SEQ ID NO: 237442 - RNA, 64 nt, Homo Sapiens; identical to SEQ ID NO: 189152

SEQ ID NO: 237443 - RNA, 64 nt, Homo Sapiens; identical to SEQ ID NO: 189153

SEQ ID NO: 237444 - RNA, 64 nt, Homo Sapiens; identical to SEQ ID NO: 189154

SEQ ID NO: 237445 - RNA, 64 nt, Homo Sapiens; identical to SEQ ID NO: 189155

SEQ ID NO: 237446 - RNA, 64 nt, Homo Sapiens; identical to SEQ ID NO: 189156

SEQ ID NO: 237447 - RNA, 64 nt, Homo Sapiens; identical to SEQ ID NO: 189157

SEQ ID NO: 237448 - RNA, 64 nt, Homo Sapiens; identical to SEQ ID NO: 189158

SEQ ID NO: 237449 - RNA, 64 nt, Homo Sapiens; identical to SEQ ID NO: 189159

SEQ ID NO: 237450 - RNA, 64 nt, Homo Sapiens; identical to SEQ ID NO: 189160

SEQ ID NO: 237451 - RNA, 64 nt, Homo Sapiens; identical to SEQ ID NO: 189161

SEQ ID NO: 237452 - RNA, 64 nt, Homo Sapiens; identical to SEQ ID NO: 189162

SEQ ID NO: 237453 - RNA, 64 nt, Homo Sapiens; identical to SEQ ID NO: 189163

SEQ ID NO: 237454 - RNA, 64 nt, Homo Sapiens; identical to SEQ ID NO: 189164

SEQ ID NO: 237455 - RNA, 64 nt, Homo Sapiens; identical to SEQ ID NO: 189165

SEQ ID NO: 237456 - RNA, 64 nt, Homo Sapiens; identical to SEQ ID NO: 189166

SEQ ID NO: 237457 - RNA, 64 nt, Homo Sapiens; identical to SEQ ID NO: 189167

SEQ ID NO: 237458 - RNA, 64 nt, Homo Sapiens; identical to SEQ ID NO: 189168

SEQ ID NO: 237459 - RNA, 64 nt, Homo Sapiens; identical to SEQ ID NO: 189169

SEQ ID NO: 237460 - RNA, 64 nt, Homo Sapiens; identical to SEQ ID NO: 189170

SEQ ID NO: 237461 - RNA, 64 nt, Homo Sapiens; identical to SEQ ID NO: 189171

SEQ ID NO: 237462 - RNA, 64 nt, Homo Sapiens; identical to SEQ ID NO: 189172

SEQ ID NO: 237463 - RNA, 64 nt, Homo Sapiens; identical to SEQ ID NO: 189173

SEQ ID NO: 237464 - RNA, 64 nt, Homo Sapiens; identical to SEQ ID NO: 189174

SEQ ID NO: 237465 - RNA, 64 nt, Homo Sapiens; identical to SEQ ID NO: 189175

SEQ ID NO: 237466 - RNA, 64 nt, Homo Sapiens; identical to SEQ ID NO: 189176

SEQ ID NO: 237467 - RNA, 64 nt, Homo Sapiens; identical to SEQ ID NO: 189177

SEQ ID NO: 237468 - RNA, 64 nt, Homo Sapiens; identical to SEQ ID NO: 189178

SEQ ID NO: 237469 - RNA, 64 nt, Homo Sapiens; identical to SEQ ID NO: 189179

SEQ ID NO: 237470 - RNA, 64 nt, Homo Sapiens; identical to SEQ ID NO: 189180

SEQ ID NO: 237471 - RNA, 64 nt, Homo Sapiens; identical to SEQ ID NO: 189181

SEQ ID NO: 237472 - RNA, 64 nt, Homo Sapiens; identical to SEQ ID NO: 189182

SEQ ID NO: 237473 - RNA, 64 nt, Homo Sapiens; identical to SEQ ID NO: 189183

SEQ ID NO: 237474 - RNA, 64 nt, Homo Sapiens; identical to SEQ ID NO: 189184

SEQ ID NO: 237475 - RNA, 64 nt, Homo Sapiens; identical to SEQ ID NO: 51693

SEQ ID NO: 237476 - RNA, 64 nt, Homo Sapiens; identical to SEQ ID NO: 51694

SEQ ID NO: 237477 - RNA, 64 nt, Homo Sapiens; identical to SEQ ID NO: 51695

SEQ ID NO: 237478 - RNA, 64 nt, Homo Sapiens; identical to SEQ ID NO: 51696

SEQ ID NO: 237479 - RNA, 64 nt, Homo Sapiens; identical to SEQ ID NO: 51697

SEQ ID NO: 237480 - RNA, 64 nt, Homo Sapiens; identical to SEQ ID NO: 51698

SEQ ID NO: 237481 - RNA, 64 nt, Homo Sapiens; identical to SEQ ID NO: 51699

SEQ ID NO: 237482 - RNA, 64 nt, Homo Sapiens; identical to SEQ ID NO: 51700

SEQ ID NO: 237483 - RNA, 64 nt, Homo Sapiens; identical to SEQ ID NO: 51701

SEQ ID NO: 237484 - RNA, 64 nt, Homo Sapiens; identical to SEQ ID NO: 51702

SEQ ID NO: 237485 - RNA, 64 nt, Homo Sapiens; identical to SEQ ID NO: 51703

SEQ ID NO: 237486 - RNA, 64 nt, Homo Sapiens; identical to SEQ ID NO: 51704

SEQ ID NO: 237487 - RNA, 64 nt, Homo Sapiens; identical to SEQ ID NO: 51705

SEQ ID NO: 237488 - RNA, 64 nt, Homo Sapiens; identical to SEQ ID NO: 235935

SEQ ID NO: 237489 - RNA, 64 nt, Homo Sapiens; identical to SEQ ID NO: 235936

SEQ ID NO: 237490 - RNA, 64 nt, Homo Sapiens; identical to SEQ ID NO: 235937

SEQ ID NO: 237491 - RNA, 64 nt, Homo Sapiens; identical to SEQ ID NO: 235938

SEQ ID NO: 237492 - RNA, 64 nt, Homo Sapiens; identical to SEQ ID NO: 235939

SEQ ID NO: 237493 - RNA, 64 nt, Homo Sapiens; identical to SEQ ID NO: 235940

SEQ ID NO: 237494 - RNA, 64 nt, Homo Sapiens; identical to SEQ ID NO: 235941

SEQ ID NO: 237495 - RNA, 64 nt, Homo Sapiens; identical to SEQ ID NO: 235942

SEQ ID NO: 237496 - RNA, 64 nt, Homo Sapiens; identical to SEQ ID NO: 235943

SEQ ID NO: 237497 - RNA, 64 nt, Homo Sapiens; identical to SEQ ID NO: 235944

SEQ ID NO: 237498 - RNA, 64 nt, Homo Sapiens; identical to SEQ ID NO: 235945

SEQ ID NO: 237499 - RNA, 64 nt, Homo Sapiens; identical to SEQ ID NO: 235946

SEQ ID NO: 237500 - RNA, 64 nt, Homo Sapiens; identical to SEQ ID NO: 235947

SEQ ID NO: 237501 - RNA, 64 nt, Homo Sapiens; identical to SEQ ID NO: 235948

SEQ ID NO: 237502 - RNA, 64 nt, Homo Sapiens; identical to SEQ ID NO: 235949

SEQ ID NO: 237503 - RNA, 64 nt, Homo Sapiens; identical to SEQ ID NO: 235950

SEQ ID NO: 237504 - RNA, 64 nt, Homo Sapiens; identical to SEQ ID NO: 235951

SEQ ID NO: 237505 - RNA, 64 nt, Homo Sapiens; identical to SEQ ID NO: 235952

SEQ ID NO: 237506 - RNA, 64 nt, Homo Sapiens; identical to SEQ ID NO: 235953

SEQ ID NO: 237507 - RNA, 64 nt, Homo Sapiens; identical to SEQ ID NO: 235954

SEQ ID NO: 237508 - RNA, 64 nt, Homo Sapiens; identical to SEQ ID NO: 235955

SEQ ID NO: 237509 - RNA, 64 nt, Homo Sapiens; identical to SEQ ID NO: 235956

SEQ ID NO: 237510 - RNA, 64 nt, Homo Sapiens; identical to SEQ ID NO: 235957

SEQ ID NO: 237511 - RNA, 64 nt, Homo Sapiens; identical to SEQ ID NO: 235958

SEQ ID NO: 237512 - RNA, 64 nt, Homo Sapiens; identical to SEQ ID NO: 235959

SEQ ID NO: 237513 - RNA, 64 nt, Homo Sapiens; identical to SEQ ID NO: 235960

SEQ ID NO: 237514 - RNA, 64 nt, Homo Sapiens; identical to SEQ ID NO: 235961

SEQ ID NO: 237515 - RNA, 64 nt, Homo Sapiens; identical to SEQ ID NO: 235962

SEQ ID NO: 237516 - RNA, 64 nt, Homo Sapiens; identical to SEQ ID NO: 235963

SEQ ID NO: 237517 - RNA, 64 nt, Homo Sapiens; identical to SEQ ID NO: 235964

SEQ ID NO: 237518 - RNA, 64 nt, Homo Sapiens; identical to SEQ ID NO: 235965

SEQ ID NO: 237519 - RNA, 64 nt, Homo Sapiens; identical to SEQ ID NO: 235966

SEQ ID NO: 237520 - RNA, 64 nt, Homo Sapiens; identical to SEQ ID NO: 235967

SEQ ID NO: 237521 - RNA, 64 nt, Homo Sapiens; identical to SEQ ID NO: 235968

SEQ ID NO: 237522 - RNA, 64 nt, Homo Sapiens; identical to SEQ ID NO: 235969

SEQ ID NO: 237523 - RNA, 64 nt, Homo Sapiens; identical to SEQ ID NO: 235970

SEQ ID NO: 237524 - RNA, 64 nt, Homo Sapiens; identical to SEQ ID NO: 235971

SEQ ID NO: 237525 - RNA, 64 nt, Homo Sapiens; identical to SEQ ID NO: 235972

SEQ ID NO: 237526 - RNA, 64 nt, Homo Sapiens; identical to SEQ ID NO: 235973

SEQ ID NO: 237527 - RNA, 64 nt, Homo Sapiens; identical to SEQ ID NO: 235974

SEQ ID NO: 237528 - RNA, 58 nt, Homo Sapiens; identical to SEQ ID NO: 235975

SEQ ID NO: 237529 - RNA, 64 nt, Homo Sapiens; identical to SEQ ID NO: 235976

SEQ ID NO: 237530 - RNA, 64 nt, Homo Sapiens; identical to SEQ ID NO: 235977

SEQ ID NO: 237531 - RNA, 64 nt, Homo Sapiens; identical to SEQ ID NO: 235978

SEQ ID NO: 237532 - RNA, 64 nt, Homo Sapiens; identical to SEQ ID NO: 235979

SEQ ID NO: 237533 - RNA, 64 nt, Homo Sapiens; identical to SEQ ID NO: 235980

SEQ ID NO: 237534 - RNA, 64 nt, Homo Sapiens; identical to SEQ ID NO: 235981

SEQ ID NO: 237535 - RNA, 64 nt, Homo Sapiens; identical to SEQ ID NO: 235981

SEQ ID NO: 237536 - RNA, 64 nt, Homo Sapiens; identical to SEQ ID NO: 235983

SEQ ID NO: 237537 - RNA, 64 nt, Homo Sapiens; identical to SEQ ID NO: 235984

SEQ ID NO: 237538 - RNA, 64 nt, Homo Sapiens; identical to SEQ ID NO: 235985

SEQ ID NO: 237539 - RNA, 64 nt, Homo Sapiens; identical to SEQ ID NO: 235986

SEQ ID NO: 237540 - RNA, 64 nt, Homo Sapiens; identical to SEQ ID NO: 235987

SEQ ID NO: 237541 - RNA, 64 nt, Homo Sapiens; identical to SEQ ID NO: 235988

SEQ ID NO: 237542 - RNA, 64 nt, Homo Sapiens; identical to SEQ ID NO: 235989

SEQ ID NO: 237543 - RNA, 64 nt, Homo Sapiens; identical to SEQ ID NO: 235990

SEQ ID NO: 237544 - RNA, 64 nt, Homo Sapiens; identical to SEQ ID NO: 235991

SEQ ID NO: 237545 - RNA, 64 nt, Homo Sapiens; identical to SEQ ID NO: 235992

SEQ ID NO: 237546 - RNA, 64 nt, Homo Sapiens
auuccuauaaaaauguaaaugcaaggucacacauauuaaugacagccuguuguauuaaugaugg

SEQ ID NO: 237547 - RNA, 64 nt, Homo Sapiens
ugcaaggucacacauauuaaugacagccuguuguauuaaugauggcuccaggucagugucugga

SEQ ID NO: 237548 - RNA, 64 nt, Homo Sapiens
ugaaauuuguauucauuuuccagauggcuaguuuauuaaugauuucccaaaagccauaccuuaa

SEQ ID NO: 237549 - RNA, 64 nt, Homo Sapiens
cuugguucaucacauuauaagauaaauaaauuaaauuaaugaaaaugugacuuagaguaggggu

SEQ ID NO: 237550 - RNA, 64 nt, Homo Sapiens
gagucuguaguuacuaaacccuaauggaauaauuauuaaugaaagauuuuugaaauauaaaaaa

SEQ ID NO: 237551 - RNA, 64 nt, Homo Sapiens
gcaaagguaaucucucauuuuaaaauuggacaguauuaaugaaggggaaauauacaauuuauuu

SEQ ID NO: 237552 - RNA, 64 nt, Homo Sapiens
uauaggaacacaguuuauucucucugauagagcuauuaaugacuuaguuucuguaaaagaaaug

SEQ ID NO: 237553 - RNA, 64 nt, Homo Sapiens
aauacacugguuaugaaauuguauuuuuuuaaguauuaaugaaaaaagagccauaagcauucca

SEQ ID NO: 237554 - RNA, 64 nt, Homo Sapiens
ugaaagcauuauuuuuuguugaauaggaaauaaaauuaaugaagacagaggcuagaaagcaucc

SEQ ID NO: 237555 - RNA, 64 nt, Homo Sapiens
auuaaugaagacagaggcuagaaagcauccauuaauuaaugagacacacuuaacuacuuaucuc

SEQ ID NO: 237556 - RNA, 64 nt, Homo Sapiens
uucuuaaacuucuauuuaggaaauuacauuaaguauuaaugaggggaaaggaaaugagcucuac

SEQ ID NO: 237557 - RNA, 64 nt, Homo Sapiens
ucuacaagcuggaaagcagcuucuuagcugccuaauuaaugaaagaugaaaauaggaagugccc

SEQ ID NO: 237558 - RNA, 64 nt, Homo Sapiens
uacugacuucugcaaaguauuagugguugaauuuauuaaugaaauuuguccugagucuggaggg

SEQ ID NO: 237559 - RNA, 64 nt, Homo Sapiens
uucuguucuuccuuacaccuaaauaauacaagagauuaaugaauagugguuagaaguaguugag

SEQ ID NO: 237560 - RNA, 64 nt, Homo Sapiens
aaaauaaugcauuuguauuguuaaugauuaaacuauuaaugauaugcauugacuuaugagauaa

SEQ ID NO: 237561 - RNA, 64 nt, Homo Sapiens
aaacuauuaaugauaaaaauugacuuaugagauaauuaaugauuaguaauuucacucucugcau

SEQ ID NO: 237562 - RNA, 64 nt, Homo Sapiens
uggucaaagccccaggaaaccuaccaaagcuagaauuaaugacaacuggugggaaaccuagcau

SEQ ID NO: 237563 - RNA, 64 nt, Homo Sapiens
uauaauuuaagaaauagucuauguaaagucacaaauuaaugaaaaaaauucgcaugaaaaugac

SEQ ID NO: 237564 - RNA, 64 nt, Homo Sapiens
uucagggucuuugcagugggguaaguuauuuuggauuaaugacaugaaauggcaggugggcucu

SEQ ID NO: 237565 - RNA, 64 nt, Homo Sapiens
aucauuuuauuuuucaucucuugaaagaacugauauuaaugauauuuuuauguuauugaaaaua

SEQ ID NO: 237566 - RNA, 64 nt, Homo Sapiens
gaaaucuuuauauucuguauccuucacauggaagauuaaugagguuccuccaggcuuguaauac

SEQ ID NO: 237567 - RNA, 64 nt, Homo Sapiens
gauaagcaccagugaagaaggcaaaaacgugacuauuaaugauucugaaauuuggcaagaaggg

SEQ ID NO: 237568 - RNA, 64 nt, Homo Sapiens
ucauuuuuuagcuugaauuuucauaccucuugacauuaaugacuuuugaaaucccaaggugccc

SEQ ID NO: 237569 - RNA, 64 nt, Homo Sapiens
aaauuuucaaguuaaaauacuuagguggcuaggaauuaaugaaagagcauucuuacucauuaau

SEQ ID NO: 237570 - RNA, 64 nt, Homo Sapiens
auuuaacauacuaugaaaacaccaggagucaaugauuaaugaaaggugacucaucugucccuuu

SEQ ID NO: 237571 - RNA, 64 nt, Homo Sapiens
ucuaugcaaaucuugaaagacgaaaucaaagcccauuaaugauucagaaucagugcuugaccuc

SEQ ID NO: 237572 - RNA, 64 nt, Homo Sapiens
acauuuuuucucaacauuguagacauguguucauauuaaugaacaucguguaaaucaucucugu

SEQ ID NO: 237573 - RNA, 64 nt, Homo Sapiens
aacacugaacuaguuggaaauagguagauuccauauuaaugaggccagaaagaguguuggugug

SEQ ID NO: 237574 - RNA, 64 nt, Homo Sapiens
uagguuccagugaugaaaacaagugggcuccaguauuaaugaaaaguagguuccaguacuaaug

SEQ ID NO: 237575 - RNA, 64 nt, Homo Sapiens
uagguuccaguacuaaugaaccagcucaagcaauauuaaugaagagaaaauguuuuuaaagaag

SEQ ID NO: 237576 - RNA, 64 nt, Homo Sapiens
uuaacauacaguuuaggguccuagcgcagaguccuuguuuaaaggucauugacucaucaucugu

SEQ ID NO: 237577 - RNA, 64 nt, Homo Sapiens
uuguaaauauuuugcacgucauuauuuuucuuuuuuguuuaagcaguguuuggccuggaagagu

SEQ ID NO: 237578 - RNA, 64 nt, Homo Sapiens
auaaauauugacaaaaauaauuuucuuccagagauuguuuaaaagccuuuuguuuuuaaauuuc

SEQ ID NO: 237579 - RNA, 64 nt, Homo Sapiens
guauuuaagcauugugcaauuuauugcaucuuuuuuguuuaauuuaauguugcaggauuauacu

SEQ ID NO: 237580 - RNA, 64 nt, Homo Sapiens
gaaguuuugugacagaaaaauaugccaaaauuaguuguuuaaguuauuguccaguugaaaacug

SEQ ID NO: 237581 - RNA, 64 nt, Homo Sapiens
uggauauaguuuuagauuugucuauuaaagguguuuguuuaaaaaauuauaguuuuauaaccag

SEQ ID NO: 237582 - RNA, 64 nt, Homo Sapiens
aacauuaugggauugcaaccuggagaaaaggaauuuguuuaaaucuuguuuuauagaaaaugca

SEQ ID NO: 237583 - RNA, 64 nt, Homo Sapiens
gugaguggcugcacaggcacucacuugcaucaguuuguuuaacuaccauugucucacuggagac

SEQ ID NO: 237584 - RNA, 64 nt, Homo Sapiens
cuuugugugcccuaaaaacaaauccuguucauguuuguuuaaaguuuuuacuuuuugugguugu

SEQ ID NO: 237585 - RNA, 64 nt, Homo Sapiens
guucauguuuguuuaaaguuuuuacuuuuugugguuguuuaaaauuuuuucaauuguuaaauau

SEQ ID NO: 237586 - RNA, 64 nt, Homo Sapiens
acuuuaagccuccuuuuagagauauuuuuaaaacuuguuuaaaauuuuugugcaauucauauau

SEQ ID NO: 237587 - RNA, 64 nt, Homo Sapiens
caaaaaaagaaaguuauucuuaguaaggaacuucuuguuuaauagcauuuuuguuuauuuuaaa

SEQ ID NO: 237588 - RNA, 64 nt, Homo Sapiens
gauuauagugcugcauugucuaaaacaaauugcguuguuuaaagcuagaagaaaagauaaugag

SEQ ID NO: 237589 - RNA, 64 nt, Homo Sapiens
uuuuguuuuggucaucuuuagaaauauccuuccauuguuuaagcuuguauaagaaauuuucugu

SEQ ID NO: 237590 - RNA, 64 nt, Homo Sapiens
uuaccauuacuuguuuuuuauauuuuacaugguuuuguuuaaaaaaaaaauauuuccacuuaga

SEQ ID NO: 237591 - RNA, 64 nt, Homo Sapiens
aacaaaaaaggcaagaugggagugcagaaaccucuuguuuaaaagagucuggaagauggaagcu

SEQ ID NO: 237592 - RNA, 64 nt, Homo Sapiens
auuuauguaaagucccucuaagacuacauacuuuuuguuuaaaacaaaauuggaauuuguuuuc

SEQ ID NO: 237593 - RNA, 64 nt, Homo Sapiens
gaguagugcguuuuauuuuauaugccaaucuacuuuguuuaaaaaaggucugaaucaggacuug

SEQ ID NO: 237594 - RNA, 64 nt, Homo Sapiens
caucuuuggcaaaaucuuugguucaggguacuaguuguuuaaaaguugauucauauucuuaccu

SEQ ID NO: 237595 - RNA, 64 nt, Homo Sapiens
augacgugugagcagaaugccuuauuuuguaaucuuguuuaacuuguugcuacugggacuugau

SEQ ID NO: 237596 - RNA, 64 nt, Homo Sapiens
uuaaugucacuuuaaauuaaaagugguuuauuacuuguuuaaugacauaacuacacaguuaguu

SEQ ID NO: 237597 - RNA, 64 nt, Homo Sapiens
acuuucacuggcucuguuuguacauugagauuguuuguuuaacaaugcuuucuauguucauaua

SEQ ID NO: 237598 - RNA, 64 nt, Homo Sapiens
cauuauagaugagagcgugcaugcacagucauuuuuguuuaagaguaauauuuuuaauguaaua

SEQ ID NO: 237599 - RNA, 64 nt, Homo Sapiens
auuuucuacuguauccauuucaaauguuaaaauauuguuuaauauuuuugaaaucccugaguau

SEQ ID NO: 237600 - RNA, 64 nt, Homo Sapiens
agcacucaaaaaugcaaaaugugauaaugggcacuuguuuaaaagaauuaguguauccagccuu

SEQ ID NO: 237601 - RNA, 64 nt, Homo Sapiens
aaagaagaaaauuauucaaauuuggacauuuuaauuguuuaaaaauuguacaaaaggaaaaaau

SEQ ID NO: 237602 - RNA, 64 nt, Homo Sapiens
uuagaauaaguacuggcgaaccaucucuguggucuuguuuaaaaagggcaaaaguuuuagacug

SEQ ID NO: 237603 - RNA, 64 nt, Homo Sapiens
aauguuuucuccugcugcagaagaaaaaaaaauguuguuuaaaaaacaaguucauacauuugaa

SEQ ID NO: 237604 - RNA, 64 nt, Homo Sapiens
acugugcugugaucacuguaauuguaugccacuuuuguuuaagaagaaaaagagauauuuuuag

SEQ ID NO: 237605 - RNA, 64 nt, Homo Sapiens
aaugucucuuuguuuuguacguaaguuuggcaaguuguuuaaaauuuuuaaaacacacucauaa

SEQ ID NO: 237606 - RNA, 64 nt, Homo Sapiens
guaacuugcugugucugagguaguacuacacucauuguuuaaauuuuuuuccauuuuaguuaag

SEQ ID NO: 237607 - RNA, 64 nt, Homo Sapiens
uuuuguugguugguugguugguuuuuguuugguuuuguuuaaaugggcaagaaguaaauaaugu

SEQ ID NO: 237608 - RNA, 64 nt, Homo Sapiens
cuaaaauacauucagguuccaagccugaccauccuuguuuaaucuaucauacucuuccagguuu

SEQ ID NO: 237609 - RNA, 64 nt, Homo Sapiens
guacauugaagaauauuuuucuuccuagauuuuguuguuuaaauuauggggccuaaccugccac

SEQ ID NO: 237610 - RNA, 64 nt, Homo Sapiens
uccuuuuuucuuuaugcauggaagcaucaauaaauuguuuaaaaaccauguauaguaaauucag

SEQ ID NO: 237611 - RNA, 64 nt, Homo Sapiens
auuacagguaagggcauguuaugguuauuuaucauuguuuaaugaauaguagaggugucaaggg

SEQ ID NO: 237612 - RNA, 64 nt, Homo Sapiens
ucugcacaaaagacaggcuagacucuugucuagauuguuuaaaagaaacuuuucaaauugguua

SEQ ID NO: 237613 - RNA, 64 nt, Homo Sapiens
gcuuuaaauucauauacguauuuaaucucaaauguuguuuaacuuuacaauuuuuuuuuaccaa

SEQ ID NO: 237614 - RNA, 64 nt, Homo Sapiens
aucaaagagacaaccacuuuaauaggggccaguuuuguuuaaggaagugaucaaguacagacac

SEQ ID NO: 237615 - RNA, 64 nt, Homo Sapiens
cucaaugaacuaccaauugacugucuucagucuuuuguuuaaccaacaucucuugcaccaaauc

SEQ ID NO: 237616 - RNA, 64 nt, Homo Sapiens
uuacaacuuaacuuuccaaguugcacuuaauccauuguuuaaauaugaagcguuuuacaauaca

SEQ ID NO: 237617 - RNA, 64 nt, Homo Sapiens
aguucuuauugaugacuuuuuaaugcagaguaaguuguuuaagaaaggccugaauauaucagaa

SEQ ID NO: 237618 - RNA, 64 nt, Homo Sapiens
auguucuaaauuuggaaggacuuaaaaaaaaaacuuguuuaaauuuccaucuguuuuguaauau

SEQ ID NO: 237619 - RNA, 64 nt, Homo Sapiens
agaauauuaaacccuacccugucaucuauuauuauuguuuaauuacagugccuugcauagugua

SEQ ID NO: 237620 - RNA, 64 nt, Homo Sapiens
uuaauuuucauugucaauauauccccauuacaacuuguuuaauuuuaaaaaaaauguuguuucu

SEQ ID NO: 237621 - RNA, 64 nt, Homo Sapiens
cuuaagauuauuugugaucuuuuguguuucuuaauuguuuaacugguagaucuaugugguauuc

SEQ ID NO: 237622 - RNA, 64 nt, Homo Sapiens
uugcuuauaguuaguuuaagcacucauggcacauuuguuuaauauuauacuugaaggcccagaa

SEQ ID NO: 237623 - RNA, 64 nt, Homo Sapiens
uuagaacuuuucagaaugcccagaaaguccauuuuuguuuaaaaucauaugcugagaaauuuuu

SEQ ID NO: 237624 - RNA, 64 nt, Homo Sapiens
acuugcuuaagacaauugcaagcugcgaaacaauuuguuuaaaauacuggcagaauggcagagu

SEQ ID NO: 237625 - RNA, 64 nt, Homo Sapiens
cuuuacguguuaauucuuuauuuuuaagggauauuuguuuaagauaggauccauuccguaccgu

SEQ ID NO: 237626 - RNA, 64 nt, Homo Sapiens
gaacagauuuuauuaaucacggcuuuuggugaauuuguuuaagguuaauuaugguagcaaauuu

SEQ ID NO: 237627 - RNA, 64 nt, Homo Sapiens
uuuauauucuguggaaaaauaaaggaaauucagauuguuuaaaugccuaaaaguuuugagauaa

SEQ ID NO: 237628 - RNA, 64 nt, Homo Sapiens
auaccucggcuugacauuuggacagauccugucauuguuuaagcugagcaaaaaaccacacaaa

SEQ ID NO: 237629 - RNA, 64 nt, Homo Sapiens
cugaggggucugagguuguuuuuacuuuauuguguuguuuaaauauuuuaaaaauaucuuuagc

SEQ ID NO: 237630 - RNA, 64 nt, Homo Sapiens
gauauguuuaagaacauaauucuuuuguugcuguuuguuuaagaagcaccuuaguuuguuuaag

SEQ ID NO: 237631 - RNA, 64 nt, Homo Sapiens
cuuuuguugcuguuuguuuaagaagcaccuuaguuuguuuaagaagcaccuuauauaguauaau

SEQ ID NO: 237632 - RNA, 64 nt, Homo Sapiens
auaauagacugcuuaucauaguguuuagaaccucuuguuuaaaaucugcuuagaaucuaaagau

SEQ ID NO: 237633 - RNA, 64 nt, Homo Sapiens
uaaaucuaauaguacuuguauugauagagguaacuuguuuaauggcauaagagaaucgagaaau

SEQ ID NO: 237634 - RNA, 64 nt, Homo Sapiens
caacauagcaugaaacaccacaaacuuguuuaauuuguuuaaauuagaaaagaaaucuguucaa

SEQ ID NO: 237635 - RNA, 64 nt, Homo Sapiens
uguuuaaaucaacauagcauucuguucaacaaacuuguuuaauuucauuauauuagaaaagaaa

SEQ ID NO: 237636 - RNA, 64 nt, Homo Sapiens
uaaaaaaaaacacacacgaaaaacaaaaguuugcuuguuuaaaaugacaguugugauguaaaaa

SEQ ID NO: 237637 - RNA, 64 nt, Homo Sapiens
uugaacuguuuaugauaccaaaaaaauuacaguuuuguuuaaaaggaaauguugauguuuucaa

SEQ ID NO: 237638 - RNA, 64 nt, Homo Sapiens
caucuuacuuagugaaagagagcugcaguugaaauuguuuaaaaaguagcagguacaaugaaua

SEQ ID NO: 237639 - RNA, 64 nt, Homo Sapiens
uguaacagacaugguaaauauuuguuuacagucuuuguuuaacaaaccaugcauuuaaguuuaa

SEQ ID NO: 237640 - RNA, 64 nt, Homo Sapiens
uuucaaagagcuguuuugauuaaaauuuauauucuuguuuaauaagcuuauuuuuaaacaauuu

SEQ ID NO: 237641 - RNA, 64 nt, Homo Sapiens
guuaucacaccaaaacuaugcaauugguacaugguuguuuaagaagaaaccguauuuuuccaug

SEQ ID NO: 237642 - RNA, 64 nt, Homo Sapiens
uuccuuuguauaaauuaguguuugucuagcauguuuguuuaauccuuugaaauauuugaaacau

SEQ ID NO: 237643 - RNA, 64 nt, Homo Sapiens
uaguuccagagugcaaauuacagaaggaagcuacuuguuuaaaauuccauacacguuugcaguu

SEQ ID NO: 237644 - RNA, 64 nt, Homo Sapiens
gaacacaugcaaaauaauuuuuuaaauuauguuauuguuuaaauuugacuuaugggagaucagu

SEQ ID NO: 237645 - RNA, 64 nt, Homo Sapiens
aaaucacaagugcaaauaaaaagucauuuaucauuuguuuaacuaaacugucaugguuuaguuu

SEQ ID NO: 237646 - RNA, 64 nt, Homo Sapiens
aggaacauggcaguauguuuacaugucagaaguuuuguuuaauucuaugguauuucuaaauuga

SEQ ID NO: 237647 - RNA, 64 nt, Homo Sapiens
guuuuguuuaauucuaugguauuucuaaauugacuuguuuaaauaaauucagcaaauggauagc

SEQ ID NO: 237648 - RNA, 64 nt, Homo Sapiens
aauaacuuuuuaaguugaucuaguuguguuuaacuuguuuaauauggaccucuaaauauacuuu

SEQ ID NO: 237649 - RNA, 64 nt, Homo Sapiens
auauuuuuuauaucuguucaaugugcuuuaauauuuguuuaagauuuuuauuucugaauuuucc

SEQ ID NO: 237650 - RNA, 64 nt, Homo Sapiens
acaauggcaagggggguauucuuuauauguugccuuguuuaacuacaguucuuuucauuccauc

SEQ ID NO: 237651 - RNA, 64 nt, Homo Sapiens
aggucucuaaaauuaaagaacaagaugugguuuuuuguuuaagacguuuuuaguuuauuuguug

SEQ ID NO: 237652 - RNA, 64 nt, Homo Sapiens
acgucuugccuauaagcuaauaucauaaauaagguuguuuaagacgugcuucaaauauccauau

SEQ ID NO: 237653 - RNA, 64 nt, Homo Sapiens
guaaugacugucaugaaagcagcauugaaauaauuuguuuaaagggggcacucuuuuaaacggg

SEQ ID NO: 237654 - RNA, 64 nt, Homo Sapiens
uuuacaguuacauccagcugguuguuuaacuuuuuuguuuaauuguaaaacaauuguauugaug

SEQ ID NO: 237655 - RNA, 64 nt, Homo Sapiens
uuuuuguuuaauuuuuacagaauuguauugaugguuguuuaacuaggggccauugauguaaaac

SEQ ID NO: 237656 - RNA, 64 nt, Homo Sapiens
uagauuuuuuuuaaaacuuuaacaagguaacuuuuuguuuaaccaacaagguaacuuuuuguuu

SEQ ID NO: 237657 - RNA, 64 nt, Homo Sapiens
agguaacuuuuuguuuaaccaacaagguaacuuuuuguuuaacaucuuugucucuuuuuuguuu

SEQ ID NO: 237658 - RNA, 64 nt, Homo Sapiens
agguaacuuuuuguuuaacaucuuugucucuuuuuuguuuaacacaguaagaugccccugcuug

SEQ ID NO: 237659 - RNA, 64 nt, Homo Sapiens
gggugagccaccgcacccaguccccaccagggucuuguuuaaagcggugguuagauuuuuuuuu

SEQ ID NO: 237660 - RNA, 64 nt, Homo Sapiens
acuacuuauaauuaaucacuuauguccaauuggauuguuuaaaaaaaguauugugaauacaaug

SEQ ID NO: 237661 - RNA, 64 nt, Homo Sapiens
accaggaaauuucuacaaucuucucacugaguuuuuguuuaaaaaugugagagggcagucauuc

SEQ ID NO: 237662 - RNA, 64 nt, Homo Sapiens
aagaguaauggucaaucuuaacauuuuguuuuaauuguuuaauaaagcugcugggcaguggugc

SEQ ID NO: 237663 - RNA, 64 nt, Homo Sapiens
auuuuuuucuuuugcaagacaccuguuuaucaucuuguuuaaauguaaauguccccuuaugcuu

SEQ ID NO: 237664 - RNA, 64 nt, Homo Sapiens
aauccuguggcaccaaccaguggugcucauucuauuguuuaaaaauggccuucuuggcugggcg

SEQ ID NO: 237665 - RNA, 64 nt, Homo Sapiens
cugguccuauagcaucuuuacuacugauuuuuuuuuguuuaauuugaaaaugcaaagaauuguu

SEQ ID NO: 237666 - RNA, 64 nt, Homo Sapiens
ggacugagacuuugaaaauaacuuuuacauacuuuuguuuaagccccuuugaaauguauaaaaa

SEQ ID NO: 237667 - RNA, 64 nt, Homo Sapiens
uguuuuuaagccuucuaucuuuuuaggacacaguuuguuuaagcaauauguuuuggucuuguga

SEQ ID NO: 237668 - RNA, 64 nt, Homo Sapiens
auagggcccccaaugcuauuuuuuuuuuuuaaguuuguuuaauuauuuguuaagauugucuaag

SEQ ID NO: 237669 - RNA, 64 nt, Homo Sapiens
uacagacuuguacuaacacaccguaauuuggcauuuguuuaaccucauuuauaaaagcuucaaa

SEQ ID NO: 237670 - RNA, 64 nt, Homo Sapiens
cugugaaguuuuaaggaauaucacagauggaaucuuguuuaaggaaggauggcucuguacaacu

SEQ ID NO: 237671 - RNA, 64 nt, Homo Sapiens
caaaagauuauuuuuugguuguauguguuuugcuuuguuuaaccaaaucaaaugagauuauuug

SEQ ID NO: 237672 - RNA, 64 nt, Homo Sapiens
uguauuugcaauaaacaacaacacuaaaaaaaacuuguuuaaauaauugacaaauuguguacaa

SEQ ID NO: 237673 - RNA, 64 nt, Homo Sapiens
uggauauuuuaugauuuuacgcuuggcugugucauuguuuaacuuaacuuuuaucaagccacau

SEQ ID NO: 237674 - RNA, 64 nt, Homo Sapiens
uugcaucccaaauguuuuuacucuaaccaaaaaauuguuuaauuaucacuuuuucucuuuuauc

SEQ ID NO: 237675 - RNA, 64 nt, Homo Sapiens
caggacaucaacuacauaaucagaauuuaguagauuguuuaaugcuugcuaauaaccuuuuguu

SEQ ID NO: 237676 - RNA, 64 nt, Homo Sapiens
aaacgaaaaaaacaaaacaaauaacacuaaugcuuuguuuaaaauaauacuaauagccaaauag

SEQ ID NO: 237677 - RNA, 64 nt, Homo Sapiens
uuucccauugucacggaaaaccaccuuuguacaguuguuuaaaggaagcuucaugguguuggag

SEQ ID NO: 237678 - RNA, 64 nt, Homo Sapiens
uauuagcaucuuaauguaccuaaauguuuauaaauuguuuaauuuuguaagauaucuauaauuu

SEQ ID NO: 237679 - RNA, 64 nt, Homo Sapiens
cagugagguuaucuugcugcacucuguagcaaauuuguuuaaucuacauuauaauaaaauuucu

SEQ ID NO: 237680 - RNA, 64 nt, Homo Sapiens
uguccacuuguaagaaugucaggaauuuaagaauuuguuuaaauuaggcauaucucugccauca

SEQ ID NO: 237681 - RNA, 64 nt, Homo Sapiens
guuacuugugcaguguuaaaaguaauccacuuucuuguuuaauauaccagauacauagcaaaag

SEQ ID NO: 237682 - RNA, 64 nt, Homo Sapiens
auuauuugcaauuaauuguucuuuuaucuuacaauuguuuaagccugugaucuuucuucuccca

SEQ ID NO: 237683 - RNA, 64 nt, Homo Sapiens
uagccuauacaguaccuacauaguuuuuaaauuauuguuuaaaaaacaaaacagcuguuauaaa

SEQ ID NO: 237684 - RNA, 64 nt, Homo Sapiens
gaagucugacuaugaugaauaaaucuuaaaugcuuuguuuaauuaaaaaacaaaaaucaccaau

SEQ ID NO: 237685 - RNA, 64 nt, Homo Sapiens
accgucucauucauguuuucgauuaggucaauaauuguuuaagcgugguaauuuuaaaggucuu

SEQ ID NO: 237686 - RNA, 64 nt, Homo Sapiens
guaaucauguuauuuuauucucaaauggucagcguuguuuaaauaacauuaaauguaaaugguu

SEQ ID NO: 237687 - RNA, 64 nt, Homo Sapiens
ucugauccucagccccuccagucguuauuucuguuuguuuaagcugagccacggauaccgccac

SEQ ID NO: 237688 - RNA, 64 nt, Homo Sapiens
cugccuuucaagcggugccuaagaaguuauuuucuuguuuaacauauauauuuauuaauuuauu

SEQ ID NO: 237689 - RNA, 64 nt, Homo Sapiens
cauaguaggcacuaaauacauguuuguugguugauuguuuaagccagaguguauuacaacaauc

SEQ ID NO: 237690 - RNA, 64 nt, Homo Sapiens
uacuaauaaauccauuuuucuagugauacacaaauuguuuaagguuauacacucgagcuuaaau

SEQ ID NO: 237691 - RNA, 64 nt, Homo Sapiens
uggaaaguagauacauaaagacuugagaagggaauuguuuaagggaaaagaaaagaguaauaau

SEQ ID NO: 237692 - RNA, 64 nt, Homo Sapiens
auguuuaaaucaagguauucauguuaaaacacuguuguuuaagcaaaacauuguuuaaaacaga

SEQ ID NO: 237693 - RNA, 64 nt, Homo Sapiens
cagaauguuaaaacacuguugguauuuuaaaacauuguuuaaaauugcuguaagauaauaaaua

SEQ ID NO: 237694 - RNA, 64 nt, Homo Sapiens
guguguugcuaaauuuuuuaaguuaaacauacucuuguuuaaguguuuacuaaaugccuagugc

SEQ ID NO: 237695 - RNA, 64 nt, Homo Sapiens
gacuucuaaaauguucaaauuugguugacuguuuuuguuuaauucaauuauauuaggaaaaaag

SEQ ID NO: 237696 - RNA, 64 nt, Homo Sapiens
agaaggugcauuuguuccucuaaaggacagucuauuguuuaaaguagcucuuaguuaaaucuag

SEQ ID NO: 237697 - RNA, 64 nt, Homo Sapiens
auguuguaagccguggcuauuuucuguaagaagcuuguuuaauauuaaaaguaaauauuuuugg

SEQ ID NO: 237698 - RNA, 64 nt, Homo Sapiens
uguaaacaaaaguguuaaauuaauauauacacauuuguuuaacaauugcauauuuaauguaguc

SEQ ID NO: 237699 - RNA, 64 nt, Homo Sapiens
aaauauuuuauucuugcauuauuuucaagguucauuguuuaauguuucuuaauguuuauauuuu

SEQ ID NO: 237700 - RNA, 64 nt, Homo Sapiens
agaauuuauuguuugagggaaauacgagguuucauuguuuaaaaucaagaguguauuguuuacu

SEQ ID NO: 237701 - RNA, 64 nt, Homo Sapiens
agcauuagguuuaaguugagggcuaagaacugguuuguuuaaagguuuaaauuguuggaaaaga

SEQ ID NO: 237702 - RNA, 64 nt, Homo Sapiens
gcguuucugagucauuugggaccaacugcagugguuguuuaaaaugcugguuccugcacacaau

SEQ ID NO: 237703 - RNA, 64 nt, Homo Sapiens
uacuuggcauuuuaggacauuaguaaauuaaaaguuguuuaauuugauacuuuuaauuuacacu

SEQ ID NO: 237704 - RNA, 64 nt, Homo Sapiens
gucugaugaucacacacaaaggaaaauucaaggauuguuuaaaguuaacaacuucugauaacau

SEQ ID NO: 237705 - RNA, 64 nt, Homo Sapiens
uauuuuacuugauuguauacaaggcacaauggacuuguuuaaaauuggauuuuguaauuuaacu

SEQ ID NO: 237706 - RNA, 64 nt, Homo Sapiens
cugagcaugcaucuuuaaacuauuuggaguaaguuuguuuaaaucccucauccaggcaguuuga

SEQ ID NO: 237707 - RNA, 64 nt, Homo Sapiens
uuguuuugcuuuuugaugguuggcuagugucauuuuguuuaauugugaugguuguaauggugaa

SEQ ID NO: 237708 - RNA, 64 nt, Homo Sapiens
ggagacuuccaaucaccagcgaugguggcuguaguuguuuaaauaggaaucuguacaauauguu

SEQ ID NO: 237709 - RNA, 64 nt, Homo Sapiens
uuuugagcaauaagauaugcguuuguauacagccuuguuuaaugcuguguauguuugugugugu

SEQ ID NO: 237710 - RNA, 64 nt, Homo Sapiens
auaaauuuuuaaaauuugugucaucccacugcauuuguuuaaaaaaggcugcagagagcuauga

SEQ ID NO: 237711 - RNA, 64 nt, Homo Sapiens
ggccuuuaccuauuccugcaaacuaacuccauuuuuguuuaaggaacagcagaagaacuaacau

SEQ ID NO: 237712 - RNA, 64 nt, Homo Sapiens
uaguaaaucaguaagucacugggaaaggggggguuuguuuaaaauagaugguaaacauuuaaag

SEQ ID NO: 237713 - RNA, 64 nt, Homo Sapiens
uuaguuaacuccauacucuuugucauagacaggauuguuuaaauauaaauuguauuuuaaguga

SEQ ID NO: 237714 - RNA, 64 nt, Homo Sapiens
ugagcuguuuucuuuauucuuuuaaauaaacuucuuguuuaaaaucaagucaagcgucuuguug

SEQ ID NO: 237715 - RNA, 64 nt, Homo Sapiens
aaacuucuuguuuaaaaugaagucaagcgucuuguuguuuaaauccuagauaguuuucccuuca

SEQ ID NO: 237716 - RNA, 64 nt, Homo Sapiens
gacaagcaauaggggguugaaguguuuaucugauuuguuuaaaauuuuguauaucaccaaauuu

SEQ ID NO: 237717 - RNA, 64 nt, Homo Sapiens
gcuuuuaucugagaauuucucaguaugaaaaugauuguuuaaaauuuccccucuuuuugucagu

SEQ ID NO: 237718 - RNA, 64 nt, Homo Sapiens
gagucccucuugcugaaagugugagucuuuuuccuuguuuaaagggguacauaggcuaauuaau

SEQ ID NO: 237719 - RNA, 64 nt, Homo Sapiens
aguuuauuuaucuacaguaguugauaaggacuaauuguuuaauggcuucccccagcuuaaauag

SEQ ID NO: 237720 - RNA, 64 nt, Homo Sapiens
uaucuugauauuuucacaaaagcaauuauaaagauuguuuaaaaaguauucuuuuuugaaaauu

SEQ ID NO: 237721 - RNA, 64 nt, Homo Sapiens
auuagauguguugcaguuuuuuaaugugugcaaauuguuuaaaauuguauauaugugauauaaa

SEQ ID NO: 237722 - RNA, 64 nt, Homo Sapiens
ggaucugcuugcaguuauuuaaacauuguuuaaauuguuuaaaugugagucuuacugaccuaag

SEQ ID NO: 237723 - RNA, 64 nt, Homo Sapiens
uguuuaaauggaucugcuugugaccuaagaaacauuguuuaaauauuuuuuuugugagucuuac

SEQ ID NO: 237724 - RNA, 64 nt, Homo Sapiens
acuucagagauguaucucucuguucuguacauuauuguuuaauauaagaaaccuacuagcauuc

SEQ ID NO: 237725 - RNA, 64 nt, Homo Sapiens
cagugaguuuucauuuugguuuuguauuuuccaguuguuuaauuuccauuggguggguucuuuu

SEQ ID NO: 237726 - RNA, 64 nt, Homo Sapiens
augaaaguuaaacauuuuauaauacuuuuuuuauuuguuuaauaaacuugaauauuguuuaaaa

SEQ ID NO: 237727 - RNA, 64 nt, Homo Sapiens
aauacuuuuuuuauuuguuuaauaaacuugaauauuguuuaaaaugauaauuuuccuucuucaa

SEQ ID NO: 237728 - RNA, 64 nt, Homo Sapiens
auauuuuuaagauaaaggcauauuaucuuuguuuuuguuuaaauaaguuuaugggaaaauucaa

SEQ ID NO: 237729 - RNA, 64 nt, Homo Sapiens
gacuugacagugguagugcuaagaguaaaucuacuuguuuaaaugaugugauaugucagaacug

SEQ ID NO: 237730 - RNA, 64 nt, Homo Sapiens
aaucuucuggucugaccacuuaguuuguuucuacuuguuuaaaguugaguccucugguuuuaag

SEQ ID NO: 237731 - RNA, 64 nt, Homo Sapiens
ucgccaagucuguguugcugagacggccuguguauuguuuaagcaauuuuguugcauaugagcc

SEQ ID NO: 237732 - RNA, 64 nt, Homo Sapiens
aacugauggaaauucuuuuucgccuuaguggugauuguuuaaacucucacagucuuaaaccgug

SEQ ID NO: 237733 - RNA, 64 nt, Homo Sapiens
aagacucuccuuucuuuaucucuaucucagaugguuguuuaacugcgaguuuaaauguguuugu

SEQ ID NO: 237734 - RNA, 64 nt, Homo Sapiens
uuauugucuugucucuugucaguagaccuucaguacacaguaugugggauaugucagucaaguu

SEQ ID NO: 237735 - RNA, 64 nt, Homo Sapiens
gaugugcuguaauuugauuuacaugcauuagagcacacaguagaaaaacuuuagcuucauuagu

SEQ ID NO: 237736 - RNA, 64 nt, Homo Sapiens
ugaggcugagagaguuaagugaaugucuaaggucacacaguauuaagugacagugcuagaaauc

SEQ ID NO: 237737 - RNA, 64 nt, Homo Sapiens
gccuuccgcaguguaggcuuuacccucaggugcuacacaguauaguucuaggguuucccucccg

SEQ ID NO: 237738 - RNA, 64 nt, Homo Sapiens
aaaaguauggagcaagaccuguagugacaaaauuacacaguagugguuaguccacugagaaugu

SEQ ID NO: 237739 - RNA, 64 nt, Homo Sapiens
cagcauggcaucacuuuuuuuuauaacucauuaaacacaguaaaauuuuaaucauuuuuguuuu

SEQ ID NO: 237740 - RNA, 64 nt, Homo Sapiens
ucuuuuucucacaucuuugcuucugauaucuaguacacaguauuacuuuucuuucaccauuacu

SEQ ID NO: 237741 - RNA, 64 nt, Homo Sapiens
cuuaugugucauuucacaagcuuugccuguaugcacacaguauguuuuugccucccucucuucu

SEQ ID NO: 237742 - RNA, 64 nt, Homo Sapiens
ccucugauuagaugaaacuguuaccuuacccuaaacacaguauuucuuuuuaacuuuuuuauuu

SEQ ID NO: 237743 - RNA, 64 nt, Homo Sapiens
uugugacaaagucaaauaaacccccaaggacgacacacaguauggaucacauauuguuugacau

SEQ ID NO: 237744 - RNA, 64 nt, Homo Sapiens
ccucugaaauaucaauaaggcuaaauauuacuuuacacaguaagaugugaaauucacaaaaagu

SEQ ID NO: 237745 - RNA, 64 nt, Homo Sapiens
gauggaugguuuuuauaguuuguugauaaaguggacacaguauugucugagcaguuauauuuua

SEQ ID NO: 237746 - RNA, 64 nt, Homo Sapiens
ugcuugauaauaguuacuaggugaaaaguacaugacacaguaguguuuuuaauuaaaagaaugu

SEQ ID NO: 237747 - RNA, 64 nt, Homo Sapiens
cacucuguacacacugggauaacugccaacaaacacacaguaaucuagccuucuuuuuagaguc

SEQ ID NO: 237748 - RNA, 64 nt, Homo Sapiens
caguggcagauuguacacugcuagcacugcuagcacacaguagcaaagcaaacagcuacauuau

SEQ ID NO: 237749 - RNA, 64 nt, Homo Sapiens
ggcauguagccauauuuucauauagugguauacaacacaguaucauugcaaaugcaguuuacag

SEQ ID NO: 237750 - RNA, 64 nt, Homo Sapiens
gauuuuuguaucugccacaguaaauuaaagcauuacacaguauuuaucaguauuuuuuaaacau

SEQ ID NO: 237751 - RNA, 64 nt, Homo Sapiens
augccugaguuauaaauauuccaauuuguaaguaacacaguauuuuuauuuaaaauuucguugu

SEQ ID NO: 237752 - RNA, 64 nt, Homo Sapiens
caccagaagaugugaaauucuauuuuaagguugcacacaguacagaaagauuuuuacuaauaua

SEQ ID NO: 237753 - RNA, 64 nt, Homo Sapiens
gaacugucucaaaaacgaaagcacaccacccaagacacaguacccagucaugguuuccccaucc

SEQ ID NO: 237754 - RNA, 64 nt, Homo Sapiens
cuuugaaaacuuacuuucagauuauucucaaagaacacaguagcaccuaaaucuguuuucaauu

SEQ ID NO: 237755 - RNA, 64 nt, Homo Sapiens
uaaauuuguauccacacaaauucagucucugaauacacaguauucagagucucugauacacagu

SEQ ID NO: 237756 - RNA, 64 nt, Homo Sapiens
agucucugaauacacaguauucagagucucugauacacaguaauugugacaauagggcuaaaug

SEQ ID NO: 237757 - RNA, 64 nt, Homo Sapiens
gaguggagaaagacugugguuugaguuuauuuuuacacaguaaaugcugaaaugacaugaauug

SEQ ID NO: 237758 - RNA, 64 nt, Homo Sapiens
auuucucuuacuguagaagaucuugcuuuugauaacacaguauucccacuugagucguaagccu

SEQ ID NO: 237759 - RNA, 64 nt, Homo Sapiens
uuuacauucuugcucugcucaucuacacauauaaacacaguaagauagguucugcuuucugaua

SEQ ID NO: 237760 - RNA, 64 nt, Homo Sapiens
ugaauuucuaaaacccuuggucuguguucucaacacacaguauagauaaauccaauagucugcc

SEQ ID NO: 237761 - RNA, 64 nt, Homo Sapiens; identical to SEQ ID NO: 87537

SEQ ID NO: 237762 - RNA, 64 nt, Homo Sapiens; identical to SEQ ID NO: 87538

SEQ ID NO: 237763 - RNA, 64 nt, Homo Sapiens; identical to SEQ ID NO: 87539

SEQ ID NO: 237764 - RNA, 64 nt, Homo Sapiens; identical to SEQ ID NO: 87540

SEQ ID NO: 237765 - RNA, 64 nt, Homo Sapiens; identical to SEQ ID NO: 87541

SEQ ID NO: 237766 - RNA, 64 nt, Homo Sapiens; identical to SEQ ID NO: 87542

SEQ ID NO: 237767 - RNA, 64 nt, Homo Sapiens; identical to SEQ ID NO: 87543

SEQ ID NO: 237768 - RNA, 64 nt, Homo Sapiens; identical to SEQ ID NO: 87544

SEQ ID NO: 237769 - RNA, 64 nt, Homo Sapiens; identical to SEQ ID NO: 87545

SEQ ID NO: 237770 - RNA, 64 nt, Homo Sapiens; identical to SEQ ID NO: 87546

SEQ ID NO: 237771 - RNA, 64 nt, Homo Sapiens; identical to SEQ ID NO: 87547

SEQ ID NO: 237772 - RNA, 64 nt, Homo Sapiens; identical to SEQ ID NO: 87548

SEQ ID NO: 237773 - RNA, 64 nt, Homo Sapiens; identical to SEQ ID NO: 87549

SEQ ID NO: 237774 - RNA, 64 nt, Homo Sapiens; identical to SEQ ID NO: 87550

SEQ ID NO: 237775 - RNA, 64 nt, Homo Sapiens; identical to SEQ ID NO: 87551

SEQ ID NO: 237776 - RNA, 64 nt, Homo Sapiens; identical to SEQ ID NO: 87552

SEQ ID NO: 237777 - RNA, 64 nt, Homo Sapiens; identical to SEQ ID NO: 87553

SEQ ID NO: 237778 - RNA, 64 nt, Homo Sapiens; identical to SEQ ID NO: 87554

SEQ ID NO: 237779 - RNA, 64 nt, Homo Sapiens; identical to SEQ ID NO: 87555

SEQ ID NO: 237780 - RNA, 64 nt, Homo Sapiens; identical to SEQ ID NO: 87556

SEQ ID NO: 237781 - RNA, 64 nt, Homo Sapiens; identical to SEQ ID NO: 87557

SEQ ID NO: 237782 - RNA, 64 nt, Homo Sapiens; identical to SEQ ID NO: 87558

SEQ ID NO: 237783 - RNA, 64 nt, Homo Sapiens; identical to SEQ ID NO: 87559

SEQ ID NO: 237784 - RNA, 64 nt, Homo Sapiens; identical to SEQ ID NO: 87560

SEQ ID NO: 237785 - RNA, 64 nt, Homo Sapiens; identical to SEQ ID NO: 87561

SEQ ID NO: 237786 - RNA, 64 nt, Homo Sapiens; identical to SEQ ID NO: 87562

SEQ ID NO: 237787 - RNA, 64 nt, Homo Sapiens; identical to SEQ ID NO: 87563

SEQ ID NO: 237788 - RNA, 64 nt, Homo Sapiens; identical to SEQ ID NO: 87564

SEQ ID NO: 237789 - RNA, 64 nt, Homo Sapiens; identical to SEQ ID NO: 87565

SEQ ID NO: 237790 - RNA, 64 nt, Homo Sapiens; identical to SEQ ID NO: 87566

SEQ ID NO: 237791 - RNA, 64 nt, Homo Sapiens; identical to SEQ ID NO: 87567

SEQ ID NO: 237792 - RNA, 64 nt, Homo Sapiens; identical to SEQ ID NO: 87568

SEQ ID NO: 237793 - RNA, 64 nt, Homo Sapiens; identical to SEQ ID NO: 87569

SEQ ID NO: 237794 - RNA, 64 nt, Homo Sapiens; identical to SEQ ID NO: 87570

SEQ ID NO: 237795 - RNA, 64 nt, Homo Sapiens; identical to SEQ ID NO: 87571

SEQ ID NO: 237796 - RNA, 64 nt, Homo Sapiens; identical to SEQ ID NO: 87572

SEQ ID NO: 237797 - RNA, 64 nt, Homo Sapiens; identical to SEQ ID NO: 87573

SEQ ID NO: 237798 - RNA, 64 nt, Homo Sapiens; identical to SEQ ID NO: 87574

SEQ ID NO: 237799 - RNA, 64 nt, Homo Sapiens; identical to SEQ ID NO: 87575

SEQ ID NO: 237800 - RNA, 64 nt, Homo Sapiens; identical to SEQ ID NO: 87576

SEQ ID NO: 237801 - RNA, 64 nt, Homo Sapiens; identical to SEQ ID NO: 87577

SEQ ID NO: 237802 - RNA, 64 nt, Homo Sapiens; identical to SEQ ID NO: 87578

SEQ ID NO: 237803 - RNA, 64 nt, Homo Sapiens; identical to SEQ ID NO: 87579

SEQ ID NO: 237804 - RNA, 64 nt, Homo Sapiens; identical to SEQ ID NO: 87580

SEQ ID NO: 237805 - RNA, 62 nt, Homo Sapiens; identical to SEQ ID NO: 87581

SEQ ID NO: 237806 - RNA, 64 nt, Homo Sapiens; identical to SEQ ID NO: 87582

SEQ ID NO: 237807 - RNA, 64 nt, Homo Sapiens; identical to SEQ ID NO: 87583

SEQ ID NO: 237808 - RNA, 64 nt, Homo Sapiens; identical to SEQ ID NO: 87584

SEQ ID NO: 237809 - RNA, 64 nt, Homo Sapiens; identical to SEQ ID NO: 87585

SEQ ID NO: 237810 - RNA, 64 nt, Homo Sapiens; identical to SEQ ID NO: 87586

SEQ ID NO: 237811 - RNA, 64 nt, Homo Sapiens; identical to SEQ ID NO: 87587

SEQ ID NO: 237812 - RNA, 64 nt, Homo Sapiens; identical to SEQ ID NO: 87588

SEQ ID NO: 237813 - RNA, 64 nt, Homo Sapiens; identical to SEQ ID NO: 87589

SEQ ID NO: 237814 - RNA, 64 nt, Homo Sapiens; identical to SEQ ID NO: 87590

SEQ ID NO: 237815 - RNA, 64 nt, Homo Sapiens; identical to SEQ ID NO: 87591

SEQ ID NO: 237816 - RNA, 64 nt, Homo Sapiens; identical to SEQ ID NO: 87592

SEQ ID NO: 237817 - RNA, 64 nt, Homo Sapiens; identical to SEQ ID NO: 87593

SEQ ID NO: 237818 - RNA, 64 nt, Homo Sapiens; identical to SEQ ID NO: 87594

SEQ ID NO: 237819 - RNA, 64 nt, Homo Sapiens; identical to SEQ ID NO: 87595

SEQ ID NO: 237820 - RNA, 64 nt, Homo Sapiens; identical to SEQ ID NO: 87596

SEQ ID NO: 237821 - RNA, 64 nt, Homo Sapiens; identical to SEQ ID NO: 87597

SEQ ID NO: 237822 - RNA, 64 nt, Homo Sapiens; identical to SEQ ID NO: 87598

SEQ ID NO: 237823 - RNA, 50 nt, Homo Sapiens; identical to SEQ ID NO: 87599

SEQ ID NO: 237824 - RNA, 64 nt, Homo Sapiens; identical to SEQ ID NO: 87600

SEQ ID NO: 237825 - RNA, 64 nt, Homo Sapiens; identical to SEQ ID NO: 87601

SEQ ID NO: 237826 - RNA, 64 nt, Homo Sapiens; identical to SEQ ID NO: 87602

SEQ ID NO: 237827 - RNA, 64 nt, Homo Sapiens; identical to SEQ ID NO: 87603

SEQ ID NO: 237828 - RNA, 64 nt, Homo Sapiens; identical to SEQ ID NO: 87604

SEQ ID NO: 237829 - RNA, 64 nt, Homo Sapiens; identical to SEQ ID NO: 87605

SEQ ID NO: 237830 - RNA, 56 nt, Homo Sapiens; identical to SEQ ID NO: 87606

SEQ ID NO: 237831 - RNA, 64 nt, Homo Sapiens; identical to SEQ ID NO: 87607

SEQ ID NO: 237832 - RNA, 64 nt, Homo Sapiens; identical to SEQ ID NO: 87608

SEQ ID NO: 237833 - RNA, 64 nt, Homo Sapiens; identical to SEQ ID NO: 87609

SEQ ID NO: 237834 - RNA, 64 nt, Homo Sapiens; identical to SEQ ID NO: 87610

SEQ ID NO: 237835 - RNA, 64 nt, Homo Sapiens; identical to SEQ ID NO: 87611

SEQ ID NO: 237836 - RNA, 64 nt, Homo Sapiens; identical to SEQ ID NO: 87612

SEQ ID NO: 237837 - RNA, 55 nt, Homo Sapiens; identical to SEQ ID NO: 87613

SEQ ID NO: 237838 - RNA, 64 nt, Homo Sapiens; identical to SEQ ID NO: 87614

SEQ ID NO: 237839 - RNA, 64 nt, Homo Sapiens; identical to SEQ ID NO: 87615

SEQ ID NO: 237840 - RNA, 64 nt, Homo Sapiens; identical to SEQ ID NO: 87616

SEQ ID NO: 237841 - RNA, 64 nt, Homo Sapiens; identical to SEQ ID NO: 87617

SEQ ID NO: 237842 - RNA, 64 nt, Homo Sapiens; identical to SEQ ID NO: 87618

SEQ ID NO: 237843 - RNA, 64 nt, Homo Sapiens; identical to SEQ ID NO: 87619

SEQ ID NO: 237844 - RNA, 64 nt, Homo Sapiens; identical to SEQ ID NO: 87620

SEQ ID NO: 237845 - RNA, 64 nt, Homo Sapiens; identical to SEQ ID NO: 87621

SEQ ID NO: 237846 - RNA, 64 nt, Homo Sapiens; identical to SEQ ID NO: 87622

SEQ ID NO: 237847 - RNA, 64 nt, Homo Sapiens; identical to SEQ ID NO: 87623

SEQ ID NO: 237848 - RNA, 64 nt, Homo Sapiens; identical to SEQ ID NO: 87624

SEQ ID NO: 237849 - RNA, 64 nt, Homo Sapiens; identical to SEQ ID NO: 87625

SEQ ID NO: 237850 - RNA, 64 nt, Homo Sapiens; identical to SEQ ID NO: 87626

SEQ ID NO: 237851 - RNA, 64 nt, Homo Sapiens; identical to SEQ ID NO: 87627

SEQ ID NO: 237852 - RNA, 64 nt, Homo Sapiens; identical to SEQ ID NO: 87628

SEQ ID NO: 237853 - RNA, 64 nt, Homo Sapiens; identical to SEQ ID NO: 87629

SEQ ID NO: 237854 - RNA, 64 nt, Homo Sapiens; identical to SEQ ID NO: 87630

SEQ ID NO: 237855 - RNA, 64 nt, Homo Sapiens; identical to SEQ ID NO: 87631

SEQ ID NO: 237856 - RNA, 64 nt, Homo Sapiens; identical to SEQ ID NO: 87632

SEQ ID NO: 237857 - RNA, 64 nt, Homo Sapiens; identical to SEQ ID NO: 87633

SEQ ID NO: 237858 - RNA, 64 nt, Homo Sapiens; identical to SEQ ID NO: 87634

SEQ ID NO: 237859 - RNA, 64 nt, Homo Sapiens; identical to SEQ ID NO: 87635

SEQ ID NO: 237860 - RNA, 64 nt, Homo Sapiens; identical to SEQ ID NO: 87636

SEQ ID NO: 237861 - RNA, 64 nt, Homo Sapiens; identical to SEQ ID NO: 87637

SEQ ID NO: 237862 - RNA, 64 nt, Homo Sapiens; identical to SEQ ID NO: 87638

SEQ ID NO: 237863 - RNA, 64 nt, Homo Sapiens; identical to SEQ ID NO: 87639

SEQ ID NO: 237864 - RNA, 64 nt, Homo Sapiens; identical to SEQ ID NO: 87640

SEQ ID NO: 237865 - RNA, 64 nt, Homo Sapiens; identical to SEQ ID NO: 87641

SEQ ID NO: 237866 - RNA, 64 nt, Homo Sapiens; identical to SEQ ID NO: 87642

SEQ ID NO: 237867 - RNA, 64 nt, Homo Sapiens; identical to SEQ ID NO: 87643

SEQ ID NO: 237868 - RNA, 64 nt, Homo Sapiens; identical to SEQ ID NO: 87644

SEQ ID NO: 237869 - RNA, 64 nt, Homo Sapiens; identical to SEQ ID NO: 87645

SEQ ID NO: 237870 - RNA, 64 nt, Homo Sapiens; identical to SEQ ID NO: 87646

SEQ ID NO: 237871 - RNA, 64 nt, Homo Sapiens; identical to SEQ ID NO: 87647

SEQ ID NO: 237872 - RNA, 64 nt, Homo Sapiens; identical to SEQ ID NO: 87648

SEQ ID NO: 237873 - RNA, 64 nt, Homo Sapiens; identical to SEQ ID NO: 87649

SEQ ID NO: 237874 - RNA, 64 nt, Homo Sapiens; identical to SEQ ID NO: 87650

SEQ ID NO: 237875 - RNA, 64 nt, Homo Sapiens; identical to SEQ ID NO: 87651

SEQ ID NO: 237876 - RNA, 64 nt, Homo Sapiens; identical to SEQ ID NO: 87652

SEQ ID NO: 237877 - RNA, 64 nt, Homo Sapiens; identical to SEQ ID NO: 87653

SEQ ID NO: 237878 - RNA, 64 nt, Homo Sapiens; identical to SEQ ID NO: 87654

SEQ ID NO: 237879 - RNA, 64 nt, Homo Sapiens; identical to SEQ ID NO: 87655

SEQ ID NO: 237880 - RNA, 64 nt, Homo Sapiens; identical to SEQ ID NO: 87656

SEQ ID NO: 237881 - RNA, 64 nt, Homo Sapiens; identical to SEQ ID NO: 87657

SEQ ID NO: 237882 - RNA, 64 nt, Homo Sapiens; identical to SEQ ID NO: 87658

SEQ ID NO: 237883 - RNA, 64 nt, Homo Sapiens; identical to SEQ ID NO: 87659

SEQ ID NO: 237884 - RNA, 64 nt, Homo Sapiens; identical to SEQ ID NO: 87659

SEQ ID NO: 237885 - RNA, 64 nt, Homo Sapiens; identical to SEQ ID NO: 87661

SEQ ID NO: 237886 - RNA, 64 nt, Homo Sapiens; identical to SEQ ID NO: 87662

SEQ ID NO: 237887 - RNA, 64 nt, Homo Sapiens; identical to SEQ ID NO: 87661

SEQ ID NO: 237888 - RNA, 64 nt, Homo Sapiens; identical to SEQ ID NO: 87659

SEQ ID NO: 237889 - RNA, 64 nt, Homo Sapiens; identical to SEQ ID NO: 87665

SEQ ID NO: 237890 - RNA, 64 nt, Homo Sapiens; identical to SEQ ID NO: 87666

SEQ ID NO: 237891 - RNA, 64 nt, Homo Sapiens; identical to SEQ ID NO: 87667

SEQ ID NO: 237892 - RNA, 64 nt, Homo Sapiens; identical to SEQ ID NO: 87668

SEQ ID NO: 237893 - RNA, 64 nt, Homo Sapiens; identical to SEQ ID NO: 87669

SEQ ID NO: 237894 - RNA, 63 nt, Homo Sapiens; identical to SEQ ID NO: 87670

SEQ ID NO: 237895 - RNA, 64 nt, Homo Sapiens; identical to SEQ ID NO: 87671

SEQ ID NO: 237896 - RNA, 64 nt, Homo Sapiens; identical to SEQ ID NO: 87672

SEQ ID NO: 237897 - RNA, 64 nt, Homo Sapiens; identical to SEQ ID NO: 87673

SEQ ID NO: 237898 - RNA, 64 nt, Homo Sapiens; identical to SEQ ID NO: 87674

SEQ ID NO: 237899 - RNA, 64 nt, Homo Sapiens; identical to SEQ ID NO: 87675

SEQ ID NO: 237900 - RNA, 64 nt, Homo Sapiens; identical to SEQ ID NO: 87676

SEQ ID NO: 237901 - RNA, 64 nt, Homo Sapiens; identical to SEQ ID NO: 87677

SEQ ID NO: 237902 - RNA, 64 nt, Homo Sapiens; identical to SEQ ID NO: 87678

SEQ ID NO: 237903 - RNA, 64 nt, Homo Sapiens; identical to SEQ ID NO: 87679

SEQ ID NO: 237904 - RNA, 64 nt, Homo Sapiens; identical to SEQ ID NO: 87680

SEQ ID NO: 237905 - RNA, 64 nt, Homo Sapiens
auuaaaggaaugaaacaauguauuacuaaucuaugucugcaaacaacauuacuaaucuaggucc

SEQ ID NO: 237906 - RNA, 64 nt, Homo Sapiens
auuacuaaucuagguccuauuuacuaaggucuaugucugcaaacuuggucagaugugcagacca

SEQ ID NO: 237907 - RNA, 63 nt, Homo Sapiens
gggcauuaauauucuuuuguacauaaaacguauagucaauaugaaagcuuacccuugguuugc

SEQ ID NO: 237908 - RNA, 63 nt, Homo Sapiens
ucugauuuugauauuuucacaaaagccauaucuagucaauaacuguuccuguuccucgggaug

SEQ ID NO: 237909 - RNA, 63 nt, Homo Sapiens
aauuauuuuagaaauaguaggaaguauugcagaagucaauacacaaaugugccaggcagaggu

SEQ ID NO: 237910 - RNA, 63 nt, Homo Sapiens
cuaggugauaggcaucuaauugagacaugugugagucaauagccaucgggguccuuuuuggug

SEQ ID NO: 237911 - RNA, 63 nt, Homo Sapiens
cuuuguauucaguaucguaagugagguuaauaaagucaauacuuucuaccauauauuacguuu

SEQ ID NO: 237912 - RNA, 63 nt, Homo Sapiens
uauuaaaaaacuucauuggccacuagugaaguuagucaauaaaagacuuguuuuucugauuuu

SEQ ID NO: 237913 - RNA, 63 nt, Homo Sapiens
cagauaccagaauaaaucuacagcuagacccuuagucaauaguuaaccaaaaaauugcaauuu

SEQ ID NO: 237914 - RNA, 63 nt, Homo Sapiens
auguuuaaugggggcgguuggggugggggggggagucaauaucuccuauugauuaacuuagac

SEQ ID NO: 237915 - RNA, 63 nt, Homo Sapiens; identical to SEQ ID NO: 237913

SEQ ID NO: 237916 - RNA, 63 nt, Homo Sapiens
gauguuuaaugggggcgguugggguugggggggagucaauaucuccuauugauuaacuuagac

SEQ ID NO: 237917 - RNA, 64 nt, Homo Sapiens
aaucacuugaccccaggugguggagguugcagugagccaagauugcaccauugcacuccagccu

SEQ ID NO: 237918 - RNA, 64 nt, Homo Sapiens
aaucgcuugaaccugggaggcagagguugcaguaagccaagaucgugccauugcacuccagccu

SEQ ID NO: 237919 - RNA, 64 nt, Homo Sapiens
gcucuuugaccucaaggucuagaggucugcaguaagccaagaaacaaaggugggguggaugagg

SEQ ID NO: 237920 - RNA, 64 nt, Homo Sapiens
uuauuccuucuuucaguucaucucacuggagcacagccaagauggacauguuuauggacagugc

SEQ ID NO: 237921 - RNA, 64 nt, Homo Sapiens
uuaaccuagaucucccuaaccugcucccagcaagagccaagauugggauuacaggugcgagcua

SEQ ID NO: 237922 - RNA, 64 nt, Homo Sapiens
uuuuuuaauauagagacaggcuaguaaguagcagagccaagauuaacuuaucugugguuacaag

SEQ ID NO: 237923 - RNA, 64 nt, Homo Sapiens
gauugcuugaacccaagaggucgaggcugcagugagccaagauugugccacugcacuccagccu

SEQ ID NO: 237924 - RNA, 64 nt, Homo Sapiens
gagaaucuccugagccuggaagguccaggcagugagccaagauugugccaccacacuccagccu

SEQ ID NO: 237925 - RNA, 64 nt, Homo Sapiens
caucugaagccaccucucugaggccuagaguggcagccaagagcugcucauuguauaagccccg

SEQ ID NO: 237926 - RNA, 64 nt, Homo Sapiens
aucucucccuccuggugaagauuaaagugccuucagccaagaccggcacuggguuugcucccug

SEQ ID NO: 237927 - RNA, 64 nt, Homo Sapiens
ggagagaaacuuccagaccagccccucauaccacagccaagaggggccuuucucaccuggagag

SEQ ID NO: 237928 - RNA, 64 nt, Homo Sapiens
guagagaaacuuccagaccagccccucacaccacagccaagagaagccuuuccagccuggagag

SEQ ID NO: 237929 - RNA, 64 nt, Homo Sapiens; identical to SEQ ID NO: 237927

SEQ ID NO: 237930 - RNA, 64 nt, Homo Sapiens
guggaucaugaggucaggaguucaagaccagccuagccaagauggugaaaccccgucucuagua

SEQ ID NO: 237931 - RNA, 64 nt, Homo Sapiens
aaucgcuuaaacccaggcggcagagguugcagugagccaagaucgcgccacugcacuccagccu

SEQ ID NO: 237932 - RNA, 64 nt, Homo Sapiens
ugguuuucagguuucugcaaauuacagaagagccagccaagaucacccaggagcuugugccccc

SEQ ID NO: 237933 - RNA, 64 nt, Homo Sapiens
aguugcucaaacccgggaggcggagauugcagugagccaagaucgcaccgcugcacuccagccu

SEQ ID NO: 237934 - RNA, 64 nt, Homo Sapiens
aaucacuugaaccuaggaggcggagguugcagugagccaagauggcgccauugcacuccagccu

SEQ ID NO: 237935 - RNA, 64 nt, Homo Sapiens
aaucgcuugaacccaggaggcggagguugcagugagccaagauggcgccauugcacuccagccu

SEQ ID NO: 237936 - RNA, 64 nt, Homo Sapiens
acauuauugucauuaaagaggcacaugucaugcuagccaagaggauuuuacauggaggaaguga

SEQ ID NO: 237937 - RNA, 64 nt, Homo Sapiens
uaccacucagguaacuuuuucccuacacuugcuuagccaagagaagaacaaugaaacauacucu

SEQ ID NO: 237938 - RNA, 64 nt, Homo Sapiens
gccucuuguggaccccgccucugggcucccuuuaagccaagagaaacaccugaucuggcccaag

SEQ ID NO: 237939 - RNA, 64 nt, Homo Sapiens
gcgccacugcacuccagccuuggagcuugcaaugagccaagauuaauggcgugaacccgggagg

SEQ ID NO: 237940 - RNA, 64 nt, Homo Sapiens
cccagaggaaccagugggauugaaaaccagcagaagccaagacaggaugcacagcugaauugga

SEQ ID NO: 237941 - RNA, 64 nt, Homo Sapiens
ccaguagcaacuagaucucuuuuaccucuucuuuagccaagaagcaagaucugucacccacaac

SEQ ID NO: 237942 - RNA, 64 nt, Homo Sapiens
ugcuguucucugcugugugggcccuuaaagucuuagccaagagccaagacauagcccugugaca

SEQ ID NO: 237943 - RNA, 64 nt, Homo Sapiens
cucugcugugugggcccuuaaagucuuagccaagagccaagacauagcccugugacaaggugaa

SEQ ID NO: 237944 - RNA, 64 nt, Homo Sapiens
uuaguaaacgaagaauuaaauaaaguuaaugucuagccaagaguauaaggggaaauaguaucuu

SEQ ID NO: 237945 - RNA, 64 nt, Homo Sapiens
ugcuaugauuuaagacuaagaauacaguuuauaaagccaagaauaguuuauaggagaacguauc

SEQ ID NO: 237946 - RNA, 64 nt, Homo Sapiens
acaggguuucacugucccuuaagaccauccuguuagccaagauggucuugaucuccugaccucg

SEQ ID NO: 237947 - RNA, 64 nt, Homo Sapiens
ucucuaguugaucucuuaaacccauaccugcuacagccaagaccugcucuuguggagguacauu

SEQ ID NO: 237948 - RNA, 64 nt, Homo Sapiens
uggagcaucucugcuaagaaucaauuucucugacagccaagacaggugagggcaauuuguaagc

SEQ ID NO: 237949 - RNA, 64 nt, Homo Sapiens
ucucugaauggcccugcugggcaacguucuuuugagccaagacuaccuacuugaaagccugugg

SEQ ID NO: 237950 - RNA, 64 nt, Homo Sapiens
guugauugcugccaauguugauugcugaggccuuagccaagauuucaggcaucauuugcuccag

SEQ ID NO: 237951 - RNA, 64 nt, Homo Sapiens
aaucacuugaacccgggaggcagagguugcagugagccaagaucgcaccacugcacuccagccc

SEQ ID NO: 237952 - RNA, 64 nt, Homo Sapiens
accauaguauaaaucuuuuuuucuaauggcuuaaagccaagaaaucucgguugcuuuugucuaa

SEQ ID NO: 237953 - RNA, 64 nt, Homo Sapiens
auacuacugcacuccagccuuagaaguugcagugagccaagaucaaucacuugaacccuggagg

SEQ ID NO: 237954 - RNA, 64 nt, Homo Sapiens
uugcaggcucauagggaagaccugcugagggaccagccaagagggcugcaaaagugagggcuug

SEQ ID NO: 237955 - RNA, 64 nt, Homo Sapiens
aauugcuugaaccugggagguggagguugcagugagccaagauugcgccauugcacuccagccu

SEQ ID NO: 237956 - RNA, 64 nt, Homo Sapiens
augccacuacacuccagccucagaggcugcagugagccaagacaaauugcuugaaccugggagg

SEQ ID NO: 237957 - RNA, 64 nt, Homo Sapiens
acagcacugcacugcugccucggagguugcagugagccaagaucaauuguuugaaccuggaagg

SEQ ID NO: 237958 - RNA, 64 nt, Homo Sapiens
uucuggacaacauccagcuacaggggucugguacagccaagaugguggcugcuggccuggaccc

SEQ ID NO: 237959 - RNA, 64 nt, Homo Sapiens
aggccaggguggggaccccccaguccugcuucagagccaagacucagccccagucagcucaacc

SEQ ID NO: 237960 - RNA, 64 nt, Homo Sapiens
aauggcgugaacccaggaggcggagcuugcagugagccaagaucgcgccacugcacuccagccu

SEQ ID NO: 237961 - RNA, 64 nt, Homo Sapiens
aaucgcuugagcccgagagguggagacugcaguaagccaagaucaugccauugcacuccagccu

SEQ ID NO: 237962 - RNA, 64 nt, Homo Sapiens
gucccacaacgaugacucugccucuugucagcccagccaagagcccagacgaccccucuguccu

SEQ ID NO: 237963 - RNA, 64 nt, Homo Sapiens
acccacagagggaggaucuuuaagaggagaaaaaagccaagagggaaagccagaguucccuguu

SEQ ID NO: 237964 - RNA, 64 nt, Homo Sapiens
gcgccacugcacuccagccucggagguugcggugagccaagaucaaucacuugaauccgggagg

SEQ ID NO: 237965 - RNA, 64 nt, Homo Sapiens
cacugcaccccagccugggcuggggguugcagugagccaagauggaucucuugagcccaagggg

SEQ ID NO: 237966 - RNA, 64 nt, Homo Sapiens
gugugguuuaucuaaauguccccuaagaguacaaagccaagagacacagaagcuuuaaauuuuc

SEQ ID NO: 237967 - RNA, 64 nt, Homo Sapiens
acaccauugcacuccagccuuggugguugcagugagccaagaucaaucgcuugaaccugggagg

SEQ ID NO: 237968 - RNA, 64 nt, Homo Sapiens
uuggcuguccccuccaucuggggauggagaaugccagcccaaagcuggagccaauggugagggc

SEQ ID NO: 237969 - RNA, 64 nt, Homo Sapiens
ugccggccuuggccuuggggccagacuggcugcacagcccaaccaggaggggucugccucccac

SEQ ID NO: 237970 - RNA, 64 nt, Homo Sapiens
cucaagccuccaaaccugccagcccagcucccugcagcccaaguuggcucgggucagcgcagcc

SEQ ID NO: 237971 - RNA, 64 nt, Homo Sapiens
acaucaaacuugcuaagcggcuguccaccagccacagcccaaaccauugaaaauaucucugugu

SEQ ID NO: 237972 - RNA, 64 nt, Homo Sapiens
ccaggggcccaccccgccccgggcugcuggagggcagcccaaagucaccgccuguguccuucag

SEQ ID NO: 237973 - RNA, 64 nt, Homo Sapiens
ucaggacaaggaggccucccuggaacagagaccucagcccaagcacaaaaccagcaucuguuac

SEQ ID NO: 237974 - RNA, 64 nt, Homo Sapiens
guaucacauuuccuuucugccagagggcaaaacacagcccaauauuccccaagcaggauuacuc

SEQ ID NO: 237975 - RNA, 64 nt, Homo Sapiens
cugccuaauuuaacagggauaggcacacguccuccagcccaagauugugaggcacuggggaggc

SEQ ID NO: 237976 - RNA, 64 nt, Homo Sapiens
auaaguuggauguuccauuacauagaggaacacaaaauuccaggguuuuuggaggaagggauua

SEQ ID NO: 237977 - RNA, 64 nt, Homo Sapiens
auuuuuaauuagauucuuuccccugcugaguuggaaauuccagugcagcacugauugaccacag

SEQ ID NO: 237978 - RNA, 64 nt, Homo Sapiens
uucuucaucuuguuuuuuagguauuuucgacugaaaauuccacuuacgaucuugugaaaacacu

SEQ ID NO: 237979 - RNA, 64 nt, Homo Sapiens
uuugggaacuuuugauacgauuuccaauuacuggaaauuccaaauauuauuuuauuuuuguuuu

SEQ ID NO: 237980 - RNA, 64 nt, Homo Sapiens
uugauguuugucucuaguugauauuccuauauuaaaauuccagucccuuacucaugauucauca

SEQ ID NO: 237981 - RNA, 64 nt, Homo Sapiens
agaaagacuagaacaaauugaacauuguagcagaaaauuccaaaggguaaguuaagcacuucuu

SEQ ID NO: 237982 - RNA, 64 nt, Homo Sapiens
acccacuaugaccacagcaucugcauuuucuaaaaaauuccaugcagguguuuuggggagaggu

SEQ ID NO: 237983 - RNA, 64 nt, Homo Sapiens
cuucucuguaugucaaacucaucccuggcacaagaaauuccagucaugugaagcaaacugcccu

SEQ ID NO: 237984 - RNA, 64 nt, Homo Sapiens
gaguuuugaaaaauaauaguggcccugaaggaauaaauuccagcuuuaaaaaccaagucugagg

SEQ ID NO: 237985 - RNA, 64 nt, Homo Sapiens
auucauuguguaugcuucaucaccuauauuaggcaaauuccauuuuuuucccuugugcuaaggu

SEQ ID NO: 237986 - RNA, 64 nt, Homo Sapiens
uacugguuaguugucauuaaguaagauccaggucaaauuccauuugacaaaucccagggacuau

SEQ ID NO: 237987 - RNA, 64 nt, Homo Sapiens
aaucacauauuuuauauucagcauaaaggagaauaaauuccagaaaacacauauucugaaaaug

SEQ ID NO: 237988 - RNA, 64 nt, Homo Sapiens
ugagauaaucuuuauuuuuggaaguaucuuacugaaauuccauauuggaauuuuccaaguaaua

SEQ ID NO: 237989 - RNA, 64 nt, Homo Sapiens
augucaucaaacauaaaguuggagcaagcaaaacaaauuccauauaguagguucaagaaacaca

SEQ ID NO: 237990 - RNA, 64 nt, Homo Sapiens
auuuuaaauacugaauucauaguuguuguuuuuuaaauuccaacaguaacagcugaaugguuua

SEQ ID NO: 237991 - RNA, 64 nt, Homo Sapiens
augaaagauuccaacuaguugucagugcuucuugaaauuccaaacagaaagauacauuggucaa

SEQ ID NO: 237992 - RNA, 64 nt, Homo Sapiens
aaccaaaaagagcaucccuaucacauccaacuggaaauuccaggccuauacugaaagaucucug

SEQ ID NO: 237993 - RNA, 64 nt, Homo Sapiens
ggacucugcuuaaacaaagcaauguacuguacauaaauuccagaaauauaaauagcugaaaacu

SEQ ID NO: 237994 - RNA, 64 nt, Homo Sapiens
gauguuauugcuuccauuuuauuagaagagaaacaaauuccaugcuuuauggaauuuauguaga

SEQ ID NO: 237995 - RNA, 64 nt, Homo Sapiens
cuauuccacccaaacaauauguuguaguuucuggaaauuccauacucagauaucagucugcuag

SEQ ID NO: 237996 - RNA, 64 nt, Homo Sapiens
ggaagucaaccagaccaaugauggaauuaaauguaaauuccaagagggcuuucacaguccacag

SEQ ID NO: 237997 - RNA, 64 nt, Homo Sapiens
uuggaauuguuuuguuacuccaacuguaccaauaaaauuccaaacugauuaacagaauuuuaua

SEQ ID NO: 237998 - RNA, 64 nt, Homo Sapiens
auuuucuggguuuuaggacgguaguauuaccuacaaauuccagaaaagauaaauuauugaauga

SEQ ID NO: 237999 - RNA, 64 nt, Homo Sapiens
uuuuguuuggguuacaguaugcuugcucuaagucaaauuccaaggaacuaauuucuucuccugg

SEQ ID NO: 238000 - RNA, 64 nt, Homo Sapiens
aauuuugaauguguuguuauuuuaccuagauguaaaauuccacauguauuaaaauguacaaaau

SEQ ID NO: 238001 - RNA, 64 nt, Homo Sapiens
auaaacauuuuuauaauauauuauuuuacugcuuaaauuccaaguccugaaguagaugguugag

SEQ ID NO: 238002 - RNA, 64 nt, Homo Sapiens
agggaggugaagaggcugcuucucuacagaggugaaauuccagaugagucagucucuugggaag

SEQ ID NO: 238003 - RNA, 64 nt, Homo Sapiens
gugccuccuacaagggcacaaagcuuucaucaacaaauuccaaauuacaaacuaaauuccaugu

SEQ ID NO: 238004 - RNA, 64 nt, Homo Sapiens
uaagcuuucaucaacaaauuagcuguuacaaacuaaauuccaugguaguggcuuaucucugauc

SEQ ID NO: 238005 - RNA, 64 nt, Homo Sapiens
caaaaagaauuuggauguuuggguucuuuuagccaaauuccauauacagugugguuugagcacu

SEQ ID NO: 238006 - RNA, 64 nt, Homo Sapiens
aacagaacugacguuaaaauaggaaaacagacccaaauuccauauucaaguacacuuccacacc

SEQ ID NO: 238007 - RNA, 64 nt, Homo Sapiens
ggaugauuuucugggagcuacaagugccuagggaaaauuccaauggcuauuuaagguucaaaau

SEQ ID NO: 238008 - RNA, 64 nt, Homo Sapiens
aaauaaugucauugguauuuaagcaguuaucaauaaauuccauacuuuuuugaacuuuauucag

SEQ ID NO: 238009 - RNA, 64 nt, Homo Sapiens
acacagagaucccagccccuuauuuccauuuuccaaauuccagccaccauuuagccuguagauu

SEQ ID NO: 238010 - RNA, 64 nt, Homo Sapiens
gcuggaugaaugcagaucuauaguauuuagcauaaaauuccagcaccaagaagaaaaaggaccu

SEQ ID NO: 238011 - RNA, 64 nt, Homo Sapiens
ccuuuuauagaaacucugagcuguuacuuuggggaaauuccacaauguauuagcagccacaaau

SEQ ID NO: 238012 - RNA, 64 nt, Homo Sapiens
uaacuguugaacaaagggaagauuugaacaguguaaauuccagaguugagaaagcauuuagcau

SEQ ID NO: 238013 - RNA, 64 nt, Homo Sapiens
acaaauguggcaaguaggacuccuaucgguauacaaauuccauuucuuuuuauaagaaaaacac

SEQ ID NO: 238014 - RNA, 64 nt, Homo Sapiens
augucugaguuuugaauaguagguuacuaugcugaaauuccaaaacauacgaagaaaacuucuc

SEQ ID NO: 238015 - RNA, 64 nt, Homo Sapiens
uaucugcuugcauuggugaaacuucauauuuuaaaaauuccaacugaaauuuguaauaaaauca

SEQ ID NO: 238016 - RNA, 64 nt, Homo Sapiens
ucugaaauggaguucucacauuaaucuggggagcaaauuccagcgggccuaucaguggcaggau

SEQ ID NO: 238017 - RNA, 64 nt, Homo Sapiens
aguuucuuggcugccucccgaucuuggcuuccacaaauuccagagugccggcagcaccggugcc

SEQ ID NO: 238018 - RNA, 64 nt, Homo Sapiens
aguuaauuugaacauuuauuuauuuaucuguaugaaauuccaguaaguaauguaauuuuuaccu

SEQ ID NO: 238019 - RNA, 64 nt, Homo Sapiens
uguuugcugagguguaaaggcagagcagugugugaaauuccauggugcucgucacuggguucau

SEQ ID NO: 238020 - RNA, 64 nt, Homo Sapiens
gcacuccuaccuuaauuauugcacuagagaaaauaaauuccaaauuaggaaguguuuccuagga

SEQ ID NO: 238021 - RNA, 64 nt, Homo Sapiens
uaaauuccaaauuaggaaguguuuccuaggaggaaaauuccauuagagaguggcaauaggauga

SEQ ID NO: 238022 - RNA, 64 nt, Homo Sapiens
agaggacagaagaauggagaugggaaaauccaccaaauuccaacccaaacccaacuuucuuucu

SEQ ID NO: 238023 - RNA, 64 nt, Homo Sapiens
uaagggggacaggauacuugucacauauuugaagaaauuccauacagugaaggaaauuugaguc

SEQ ID NO: 238024 - RNA, 64 nt, Homo Sapiens
ccgauuucuuugugugucagagagggguuuggaaaaauuccaguugauaaccuagugccuccau

SEQ ID NO: 238025 - RNA, 64 nt, Homo Sapiens
gucuguauacaggagcacuuggguucaaaaaaaaaaauuccagugcagcugagcuuucagagcu

SEQ ID NO: 238026 - RNA, 64 nt, Homo Sapiens
aaggcuaguaugagcgagaaaaggagagagcgcgugcagagacuugguggugcauaauggauau

SEQ ID NO: 238027 - RNA, 64 nt, Homo Sapiens
ugucucucaauccuguggcuuuggugagagagugugcagagagcaaugauagcaaauaauguac

SEQ ID NO: 238028 - RNA, 64 nt, Homo Sapiens
ggaaaucagacaguaagagaaagccaaaaagcaaugcagagaaagguguccaagcugucuucag

SEQ ID NO: 238029 - RNA, 64 nt, Homo Sapiens
aauuagucaaaaaauuccaacaaguagccaggacugcagagacacuccagugcagagggagaag

SEQ ID NO: 238030 - RNA, 64 nt, Homo Sapiens
aagagguguggaaggaaaagcagagggaaaccugugcagagaccaauaggaagggcauuccagg

SEQ ID NO: 238031 - RNA, 64 nt, Homo Sapiens
ccccaaagguaguagauuguacaaguguuggagcugcagagagacugucccuugaagcccagcc

SEQ ID NO: 238032 - RNA, 64 nt, Homo Sapiens
uuuuauucucuaaauaccaucaauaagcacuccuugcagagaggaauaauuaccaaccccuuag

SEQ ID NO: 238033 - RNA, 64 nt, Homo Sapiens
aaaaagacugggugaccuggggugaauugggauuugcagagaugaaaacagaagcacaaauuuu

SEQ ID NO: 238034 - RNA, 64 nt, Homo Sapiens
aaugauuauuuuuuucuuuauaaugcaaauuaaaugcagagagauaaaaucugcaaaugcacau

SEQ ID NO: 238035 - RNA, 64 nt, Homo Sapiens
ccaaugguuaaaaugugaauguuuaaauuuaaaaugcagagagauugugcuucaguaacuugaa

SEQ ID NO: 238036 - RNA, 64 nt, Homo Sapiens
gaaagggaaacuggcugaggacugagugugggagugcagagaaaaaauucauguggaucugggg

SEQ ID NO: 238037 - RNA, 64 nt, Homo Sapiens
aauugguuuguuggccucaaauauccaagaagcaugcagagaagagaaccauuacaacaccuau

SEQ ID NO: 238038 - RNA, 64 nt, Homo Sapiens
gcagccucaaacuggcauccaggcacugggcccaugcagagaaggcaccugcagagagcagggc

SEQ ID NO: 238039 - RNA, 64 nt, Homo Sapiens
cauccaggcacugggcccaugcagagaaggcaccugcagagagcagggcagcccggcgcagggg

SEQ ID NO: 238040 - RNA, 64 nt, Homo Sapiens
aagaugugucuuaugagucucuggguguuuuauuugcagagaaccccagugguuucagaaaugu

SEQ ID NO: 238041 - RNA, 64 nt, Homo Sapiens
cuuucucccagcuuugccgcagcauuuuggaaccugcagagagcccuagagcccaucccgcacc

SEQ ID NO: 238042 - RNA, 64 nt, Homo Sapiens
cuuuuuuguuuuauucuucaaacuuuuuuuucuuugcagagaacuauacugaguacccuaggcc

SEQ ID NO: 238043 - RNA, 64 nt, Homo Sapiens
cccacuuagaaaguuaacugacuuaguauauaggugcagagacauaugguccccugaaauuuug

SEQ ID NO: 238044 - RNA, 64 nt, Homo Sapiens
ugaggacauuauuuuuauuuaaggagcacucaauugcagagauuuaaagguuaaagagggcaua

SEQ ID NO: 238045 - RNA, 64 nt, Homo Sapiens
uggcuugagaguaguuauuauucaaggguuagguugcagagagcauaaucaacaaaagauacaa

SEQ ID NO: 238046 - RNA, 64 nt, Homo Sapiens
gggcuggcaggggggcuaugucgggguagguucgugcagagauguuucaguuccaacagaaagg

SEQ ID NO: 238047 - RNA, 64 nt, Homo Sapiens
gcacugcggucccucccccaggcacccaguccacugcagagacuaaagaaacgcugcugcuaau

SEQ ID NO: 238048 - RNA, 64 nt, Homo Sapiens
ucucuaccccguaugguauuccaaaagucaguguugcagagauuuuaggacucugauucacuga

SEQ ID NO: 238049 - RNA, 64 nt, Homo Sapiens
ucagcaccaagggcugccuauucaaaugacgagcugcagagaacuugaaguuaaguggaauccu

SEQ ID NO: 238050 - RNA, 64 nt, Homo Sapiens
augauuagauauacacaacaccaagugguacaucugcagagauaauucaaaauuccugcuuuug

SEQ ID NO: 238051 - RNA, 64 nt, Homo Sapiens
caaagucaggucccgcccacccugccuaaggaacugcagagagguggcaaaucagcaaaaagga

SEQ ID NO: 238052 - RNA, 64 nt, Homo Sapiens
gggcuaccugggugguugaggaagagagagucucugcagagacacaggacccaacccagccacu

SEQ ID NO: 238053 - RNA, 64 nt, Homo Sapiens
ccugugagauauuugcuuucccagaggcaagaucugcagagaugccugguugugauugcuggac

SEQ ID NO: 238054 - RNA, 64 nt, Homo Sapiens
augacucagcaccgccccucaacaggcaugacucugcagagaugacucagcacugucccuuagc

SEQ ID NO: 238055 - RNA, 64 nt, Homo Sapiens
augacucagcaccgccccucaacaggcaugacucugcagagaugacuuaguacugccccucagc

SEQ ID NO: 238056 - RNA, 64 nt, Homo Sapiens
augacucagcaccgccccucaacaggcaugacucugcagagaugacucagcacugccccucagc

SEQ ID NO: 238057 - RNA, 64 nt, Homo Sapiens
gugagcggggcuuuagccggagaagccuuaugucugcagagaguccagaggacacacacagggg

SEQ ID NO: 238058 - RNA, 64 nt, Homo Sapiens
gugggagggcuuuagccggaggaagcccuacgucugcagagaguccaaaggacacacacagggg

SEQ ID NO: 238059 - RNA, 64 nt, Homo Sapiens
gaccucagcauuaucuauauaguaccuuugcucuugcagagaagccuugguacuaggcaguuag

SEQ ID NO: 238060 - RNA, 64 nt, Homo Sapiens
ugguacuaggcaguuagagaugccucccugacccugcagagaugcgguggcuaaaggucccaag

SEQ ID NO: 238061 - RNA, 64 nt, Homo Sapiens
uauauacauuccauagucaucaaggaauauauugugcagagagaguauccuugacugcuuaagu

SEQ ID NO: 238062 - RNA, 64 nt, Homo Sapiens
ugcacuccagacggcuuucucaguuccaagauuuugcagagagaaggagcaaaccuuuucauug

SEQ ID NO: 238063 - RNA, 64 nt, Homo Sapiens
ucuccuggacccccagcggugcccccagguucucugcagagauccucucggcccccucgcccug

SEQ ID NO: 238064 - RNA, 64 nt, Homo Sapiens
ugcccccacccccacccucgucggcuaaaaagaaugcagagauggaagguuuuuguuucuuuuu

SEQ ID NO: 238065 - RNA, 64 nt, Homo Sapiens
ucuuacaaaugugaagacugcauagucuucauacugcagagaaaagucacaccuugcaagucau

SEQ ID NO: 238066 - RNA, 64 nt, Homo Sapiens
cuuuacaaauaggaagaaugcauagaauucauacugcagagaaaaaacaacccuugcacgucau

SEQ ID NO: 238067 - RNA, 64 nt, Homo Sapiens
auuugccuucugagagaagagacuagcaaaaagcugcagagaggauucggcccaaacucagaac

SEQ ID NO: 238068 - RNA, 64 nt, Homo Sapiens
auugguauagagagcagaagaguagcuaggcagaugcagagauggagacaugagacucagugca

SEQ ID NO: 238069 - RNA, 64 nt, Homo Sapiens
ucaguacagguuaucccgaacuuugaaaagguccugcagagaaauuucucucuugaagaggauu

SEQ ID NO: 238070 - RNA, 64 nt, Homo Sapiens
ccuuggccaggagcggcggggcccccguggagucugcagagaggcgccugacggcagaggguga

SEQ ID NO: 238071 - RNA, 64 nt, Homo Sapiens
aguugcaugugaucgcaauguuugaguuauuacuugcagagauaggagcaaaaauuacaaaaac

SEQ ID NO: 238072 - RNA, 64 nt, Homo Sapiens
guggucguguagagguccuucuccuuucacauggugcagagagcgaggaccucuccuccucguu

SEQ ID NO: 238073 - RNA, 64 nt, Homo Sapiens
augggacaccuguaauguaacccacacagcgguuugcagagaauguuagccaugacuugggcuu

SEQ ID NO: 238074 - RNA, 64 nt, Homo Sapiens
ucaacuuucuuagcucaagagagaggcugagaaaugcagagaagaauaagacauaaaauagcuc

SEQ ID NO: 238075 - RNA, 64 nt, Homo Sapiens
uuuguuuagaaggcucuaucuuccacuguggcccugcagagauccccugagccaagccgaggca

SEQ ID NO: 238076 - RNA, 64 nt, Homo Sapiens
ugcaaaauaaagauaccacaauucaucuuaaaacugcagagauuuaaugugucagggaauagau

SEQ ID NO: 238077 - RNA, 64 nt, Homo Sapiens
uccuuguucugugucuuuauaggcuugagacaggguuauggauuguauuuuccugguucugagg

SEQ ID NO: 238078 - RNA, 64 nt, Homo Sapiens
uccagagcucuuccauguagaggcuugagacaggguuauggauuugguaugaaccaaugugagg

SEQ ID NO: 238079 - RNA, 64 nt, Homo Sapiens
uaggugggaggugauaaaauuuguucccuuuauaguuauggaaguggcuuaggugaauugagua

SEQ ID NO: 238080 - RNA, 64 nt, Homo Sapiens
guccucacaagccgugcugcuuaguugcucggugguuauggauaaacuuugcccagcaugauuu

SEQ ID NO: 238081 - RNA, 64 nt, Homo Sapiens
ugcaugcugauuuaccacuuaauacuauauugcuguaugguauaaucagugccuauggguuguu

SEQ ID NO: 238082 - RNA, 64 nt, Homo Sapiens
uguaugcugauuuacuacuuaauacuguauugcuguaugguauaaucagugccucuggguuguu

SEQ ID NO: 238083 - RNA, 64 nt, Homo Sapiens
augaccagauaacugacuagaaagaaguaguugacagugcuauuuugugcccacugucucuccu

SEQ ID NO: 238084 - RNA, 64 nt, Homo Sapiens
aagugaaugucuaaggucacacaguauuaagugacagugcuagaaaucaaacccagagcugugg

SEQ ID NO: 238085 - RNA, 64 nt, Homo Sapiens
augguaauggacagaguuauccccugugguccggcagugcuaccuucagcaccaacugagcaaa

SEQ ID NO: 238086 - RNA, 64 nt, Homo Sapiens
acgguaauggacagaguuauggccuugggagcagcagugcuaccuucagcaccaacagagccaa

SEQ ID NO: 238087 - RNA, 64 nt, Homo Sapiens
uguagucccuccgacuucucuagacaucuagucucagugcuagcuuauuuguauuuuuccucuu

SEQ ID NO: 238088 - RNA, 64 nt, Homo Sapiens
uuggugccuaauguuccaugucugaaguuugccccagugcuacacguuggaguauaccuaugug

SEQ ID NO: 238089 - RNA, 64 nt, Homo Sapiens
ccuccccccucccccgacccuuagguauaucucccagugcuauccacuaaugugucaucuagca

SEQ ID NO: 238090 - RNA, 64 nt, Homo Sapiens
gaaaggcaguagucauuuucagaugcauuuggaacagugcuacuucaugugcaaacccacucag

SEQ ID NO: 238091 - RNA, 64 nt, Homo Sapiens
cagccgacaacuauuucggcaacaaagggcacagcaucuguaguuuuauucuuuuccaaaauaa

SEQ ID NO: 238092 - RNA, 64 nt, Homo Sapiens
aaggggaaagaacauaaaggcauuccaagaauagcaucuguacauacccaugaaaaacuggcaa

SEQ ID NO: 238093 - RNA, 64 nt, Homo Sapiens
auuuauauucaccagucacuucauaugucuugaacaucuguaucuguaaacaugaaucaccgug

SEQ ID NO: 238094 - RNA, 64 nt, Homo Sapiens
uuuguaauuuuaggucagucuuguuccuuggcaacaucuguaguauuauuaaucuucugacauu

SEQ ID NO: 238095 - RNA, 64 nt, Homo Sapiens
guaucaccuucacugacuccauugagucauugagcaucuguacauauccuucaccacccccagu

SEQ ID NO: 238096 - RNA, 64 nt, Homo Sapiens
acagguuuucauucuuuugaacucuggugcacuccaucuguaauccaugucuauaaucuaccaa

SEQ ID NO: 238097 - RNA, 64 nt, Homo Sapiens
accaucuaugacaugaguuuaucuguaaaaccaucaucuguaaauuuuaaacagcauugacauc

SEQ ID NO: 238098 - RNA, 64 nt, Homo Sapiens
accaucaucuguaaaaccauaacagcauugacaucaucuguaaacucagucuucagugauuuua

SEQ ID NO: 238099 - RNA, 64 nt, Homo Sapiens
ucugucaucauugugacuucuuuguccaaauguacaucuguacguucuuuguacaucuguacau

SEQ ID NO: 238100 - RNA, 64 nt, Homo Sapiens
uuuuguccaaauguacaucuuacauuucuuuguacaucuguacagaucuaucaauuuucaucuu

SEQ ID NO: 238101 - RNA, 64 nt, Homo Sapiens
uauucuacauuuucuugaaaaugcuaauuauauacaucuguaguaaguauuuguggacaguuaa

SEQ ID NO: 238102 - RNA, 64 nt, Homo Sapiens
uauucuacauuuucuugaaaugcuaauuaauauacaucuguaguaguauuuguggacaguuaaa

SEQ ID NO: 238103 - RNA, 64 nt, Homo Sapiens
uuucuuauaaaauccagccccgguuacauauaaucaucuguaucuuaucaugauuccuguaggu

SEQ ID NO: 238104 - RNA, 64 nt, Homo Sapiens
gagaacgguaaugcgacaagauacacauugccuucaucuguacauucugugauaccaggcaaau

SEQ ID NO: 238105 - RNA, 64 nt, Homo Sapiens
gaccuccagccggucacucacccucucuggaccucaucuguaagaggagccagcuggauaagau

SEQ ID NO: 238106 - RNA, 64 nt, Homo Sapiens
ccuuaccauuaaucucucugggucucaguuuucucaucuguauuggagguagcagugcuagcuc

SEQ ID NO: 238107 - RNA, 64 nt, Homo Sapiens
aggagauaauaaacaccuacagccuaaguuuccacaucuguaaaugcaaguuacuucaccucug

SEQ ID NO: 238108 - RNA, 64 nt, Homo Sapiens
auggggcuaacaauauuaccugccucaguuuccucaucuguaaagcaagucauuugaccuucug

SEQ ID NO: 238109 - RNA, 64 nt, Homo Sapiens; identical to SEQ ID NO: 141261

SEQ ID NO: 238110 - RNA, 64 nt, Homo Sapiens; identical to SEQ ID NO: 141262

SEQ ID NO: 238111 - RNA, 64 nt, Homo Sapiens; identical to SEQ ID NO: 141263

SEQ ID NO: 238112 - RNA, 64 nt, Homo Sapiens; identical to SEQ ID NO: 141264

SEQ ID NO: 238113 - RNA, 64 nt, Homo Sapiens; identical to SEQ ID NO: 141265

SEQ ID NO: 238114 - RNA, 64 nt, Homo Sapiens; identical to SEQ ID NO: 141266

SEQ ID NO: 238115 - RNA, 64 nt, Homo Sapiens; identical to SEQ ID NO: 141267

SEQ ID NO: 238116 - RNA, 64 nt, Homo Sapiens; identical to SEQ ID NO: 141268

SEQ ID NO: 238117 - RNA, 64 nt, Homo Sapiens; identical to SEQ ID NO: 141269

SEQ ID NO: 238118 - RNA, 64 nt, Homo Sapiens; identical to SEQ ID NO: 141270

SEQ ID NO: 238119 - RNA, 64 nt, Homo Sapiens; identical to SEQ ID NO: 141271

SEQ ID NO: 238120 - RNA, 64 nt, Homo Sapiens; identical to SEQ ID NO: 141272

SEQ ID NO: 238121 - RNA, 64 nt, Homo Sapiens; identical to SEQ ID NO: 141273

SEQ ID NO: 238122 - RNA, 64 nt, Homo Sapiens; identical to SEQ ID NO: 141274

SEQ ID NO: 238123 - RNA, 64 nt, Homo Sapiens; identical to SEQ ID NO: 141275

SEQ ID NO: 238124 - RNA, 64 nt, Homo Sapiens; identical to SEQ ID NO: 141276

SEQ ID NO: 238125 - RNA, 64 nt, Homo Sapiens; identical to SEQ ID NO: 141277

SEQ ID NO: 238126 - RNA, 64 nt, Homo Sapiens; identical to SEQ ID NO: 141278

SEQ ID NO: 238127 - RNA, 64 nt, Homo Sapiens; identical to SEQ ID NO: 141279

SEQ ID NO: 238128 - RNA, 56 nt, Homo Sapiens; identical to SEQ ID NO: 141280

SEQ ID NO: 238129 - RNA, 64 nt, Homo Sapiens; identical to SEQ ID NO: 141281

SEQ ID NO: 238130 - RNA, 64 nt, Homo Sapiens; identical to SEQ ID NO: 141282

SEQ ID NO: 238131 - RNA, 64 nt, Homo Sapiens; identical to SEQ ID NO: 141283

SEQ ID NO: 238132 - RNA, 64 nt, Homo Sapiens; identical to SEQ ID NO: 141284

SEQ ID NO: 238133 - RNA, 64 nt, Homo Sapiens; identical to SEQ ID NO: 141285

SEQ ID NO: 238134 - RNA, 64 nt, Homo Sapiens; identical to SEQ ID NO: 141286

SEQ ID NO: 238135 - RNA, 64 nt, Homo Sapiens; identical to SEQ ID NO: 141287

SEQ ID NO: 238136 - RNA, 64 nt, Homo Sapiens; identical to SEQ ID NO: 141288

SEQ ID NO: 238137 - RNA, 64 nt, Homo Sapiens; identical to SEQ ID NO: 141289

SEQ ID NO: 238138 - RNA, 64 nt, Homo Sapiens; identical to SEQ ID NO: 141290

SEQ ID NO: 238139 - RNA, 64 nt, Homo Sapiens; identical to SEQ ID NO: 141291

SEQ ID NO: 238140 - RNA, 64 nt, Homo Sapiens; identical to SEQ ID NO: 141292

SEQ ID NO: 238141 - RNA, 64 nt, Homo Sapiens; identical to SEQ ID NO: 141293

SEQ ID NO: 238142 - RNA, 64 nt, Homo Sapiens; identical to SEQ ID NO: 141294

SEQ ID NO: 238143 - RNA, 64 nt, Homo Sapiens; identical to SEQ ID NO: 141295

SEQ ID NO: 238144 - RNA, 64 nt, Homo Sapiens; identical to SEQ ID NO: 141296

SEQ ID NO: 238145 - RNA, 64 nt, Homo Sapiens; identical to SEQ ID NO: 141297

SEQ ID NO: 238146 - RNA, 64 nt, Homo Sapiens; identical to SEQ ID NO: 141298

SEQ ID NO: 238147 - RNA, 64 nt, Homo Sapiens; identical to SEQ ID NO: 141299

SEQ ID NO: 238148 - RNA, 50 nt, Homo Sapiens; identical to SEQ ID NO: 141300

SEQ ID NO: 238149 - RNA, 64 nt, Homo Sapiens; identical to SEQ ID NO: 141301

SEQ ID NO: 238150 - RNA, 64 nt, Homo Sapiens; identical to SEQ ID NO: 141302

SEQ ID NO: 238151 - RNA, 64 nt, Homo Sapiens; identical to SEQ ID NO: 141303

SEQ ID NO: 238152 - RNA, 64 nt, Homo Sapiens; identical to SEQ ID NO: 141304

SEQ ID NO: 238153 - RNA, 64 nt, Homo Sapiens; identical to SEQ ID NO: 141305

SEQ ID NO: 238154 - RNA, 64 nt, Homo Sapiens; identical to SEQ ID NO: 141306

SEQ ID NO: 238155 - RNA, 64 nt, Homo Sapiens; identical to SEQ ID NO: 141307

SEQ ID NO: 238156 - RNA, 64 nt, Homo Sapiens; identical to SEQ ID NO: 141308

SEQ ID NO: 238157 - RNA, 64 nt, Homo Sapiens; identical to SEQ ID NO: 141309

SEQ ID NO: 238158 - RNA, 64 nt, Homo Sapiens; identical to SEQ ID NO: 141310

SEQ ID NO: 238159 - RNA, 64 nt, Homo Sapiens; identical to SEQ ID NO: 141311

SEQ ID NO: 238160 - RNA, 64 nt, Homo Sapiens; identical to SEQ ID NO: 141312

SEQ ID NO: 238161 - RNA, 64 nt, Homo Sapiens; identical to SEQ ID NO: 141313

SEQ ID NO: 238162 - RNA, 64 nt, Homo Sapiens; identical to SEQ ID NO: 141314

SEQ ID NO: 238163 - RNA, 64 nt, Homo Sapiens; identical to SEQ ID NO: 141315

SEQ ID NO: 238164 - RNA, 64 nt, Homo Sapiens; identical to SEQ ID NO: 141316

SEQ ID NO: 238165 - RNA, 64 nt, Homo Sapiens; identical to SEQ ID NO: 141317

SEQ ID NO: 238166 - RNA, 64 nt, Homo Sapiens; identical to SEQ ID NO: 141318

SEQ ID NO: 238167 - RNA, 64 nt, Homo Sapiens; identical to SEQ ID NO: 141319

SEQ ID NO: 238168 - RNA, 64 nt, Homo Sapiens; identical to SEQ ID NO: 141320

SEQ ID NO: 238169 - RNA, 64 nt, Homo Sapiens
ccuccuggggugcugccugcgucagccucggcaggagucccacuuuggcagccuugaaguuggg

SEQ ID NO: 238170 - RNA, 64 nt, Homo Sapiens
ccuccagggcucugcucguccagccucagggcaggagucccacuggcagccccaaaacuggggu

SEQ ID NO: 238171 - RNA, 64 nt, Homo Sapiens
cacagugcauucagaaagcaggaagugggaacuggagucccaccugagucccacucuucauccu

SEQ ID NO: 238172 - RNA, 64 nt, Homo Sapiens
cuucauccuggaagugggaacugguaaaccauuugagucccacucauggugaccccacauugca

SEQ ID NO: 238173 - RNA, 64 nt, Homo Sapiens
acaggguucucugucauuuuccuguuuucuuccagagucccaauccuuugcccuaguucuuuca

SEQ ID NO: 238174 - RNA, 64 nt, Homo Sapiens
accuucuggacacucccuccuugagggcagaaaggagucccaggccugucccuagggacaaggc

SEQ ID NO: 238175 - RNA, 64 nt, Homo Sapiens
ucaccacccacacucuuuuuagguguaaaagauggagucccacggaggaggggcagagccagga

SEQ ID NO: 238176 - RNA, 64 nt, Homo Sapiens
caagccugaaaacagaggggagggaggaaggaaggagucccagcaggagcacagcccugguuuc

SEQ ID NO: 238177 - RNA, 64 nt, Homo Sapiens
ccaucugcucaacgcucuguucugccaggucugggagucccaggggcgggcccuaauaaaaccc

SEQ ID NO: 238178 - RNA, 64 nt, Homo Sapiens
ccuacuagcauuuugcaacuaagagaaaguugaagagucccagaccgagucuacuuggcccuag

SEQ ID NO: 238179 - RNA, 64 nt, Homo Sapiens
cccagccccacucccaccauucacuccauccugugagucccacuaagacuaugcccagccccau

SEQ ID NO: 238180 - RNA, 64 nt, Homo Sapiens
cccagccccacucccaccauucacuccauccugugagucccacuaagacugugcccagccccac

SEQ ID NO: 238181 - RNA, 64 nt, Homo Sapiens
cccucuggaggcacagcuguucagaaacaguaccgagucccacccuccugggugcauuuccgug

SEQ ID NO: 238182 - RNA, 64 nt, Homo Sapiens
accggggguggagaggagccgcauaguccuuacagagucccaggggggccuguucuuagcucau

SEQ ID NO: 238183 - RNA, 64 nt, Homo Sapiens
uacuccggaggcugagggagguggcgggcaccuggagucccagccaaaaaauuagccgggcguu

SEQ ID NO: 238184 - RNA, 64 nt, Homo Sapiens
aaaauucauaucaaaacauaugguuugaauguuugagucccaacuccaucauggcuaccugcug

SEQ ID NO: 238185 - RNA, 64 nt, Homo Sapiens
auaauacuucuuuuccacauuucucagcaauaauaauaaugacgaccaaaugauaucuaaguag

SEQ ID NO: 238186 - RNA, 64 nt, Homo Sapiens
uguuuucucagauuuucuguccaagcugugcuugaauaaugauagcuaugagguuaaugaagua

SEQ ID NO: 238187 - RNA, 64 nt, Homo Sapiens
caucuuucauuggauuuuggucuguguauuugaaaauaaugagauguuucuuaaaccuagcacc

SEQ ID NO: 238188 - RNA, 64 nt, Homo Sapiens
gaaguaauggcaaggccuuuguguccuacuauuuaauaaugagaagucaauauccagguuuauu

SEQ ID NO: 238189 - RNA, 64 nt, Homo Sapiens
uagaaaccagcaagugaaaguuaaugacaaagggaauaaugaacauuugucuagcauuaucauc

SEQ ID NO: 238190 - RNA, 64 nt, Homo Sapiens
caguauuugucccauuuuugcucaccuuuggaggaauaaugaccaagccucuucauaauaccag

SEQ ID NO: 238191 - RNA, 64 nt, Homo Sapiens
aauuuuggcugagaaugguagguuaucuaugaauaauaaugaauuuaggggcacccaaaguucu

SEQ ID NO: 238192 - RNA, 64 nt, Homo Sapiens
auaauaauaauaauaauaauuugcacacaaugauaauaaugaugauuaaaauaaauuauuucau

SEQ ID NO: 238193 - RNA, 64 nt, Homo Sapiens
acuaucuuuauugagcaucuuuuaacuuuuaaauaauaaugauaaauuaaaacaccaucucagc

SEQ ID NO: 238194 - RNA, 64 nt, Homo Sapiens
acuaucaauuguucacaauggaauguuuauuugaaauaaugauagaagaaaauauuuuguaaaa

SEQ ID NO: 238195 - RNA, 64 nt, Homo Sapiens
caaacucaccuuaaaauacagauguuaugucacuaauaaugaguaguaacccaauuuagcuuua

SEQ ID NO: 238196 - RNA, 64 nt, Homo Sapiens
ugacuaauauucagauuccauuuucaauaagguaaauaaugaaagaucucacaaaggaaucauu

SEQ ID NO: 238197 - RNA, 64 nt, Homo Sapiens
caguuaaaaugcuuuuuacucugguguauuauagaauaaugaacacauuuuuauauauguuaaa

SEQ ID NO: 238198 - RNA, 64 nt, Homo Sapiens
caguuauugacuuuauauucaauuauuuacaucaaauaaugaaauaacugaaauguacaaaugu

SEQ ID NO: 238199 - RNA, 64 nt, Homo Sapiens
ugaauauuguauguugcauuccacuucauuugaaaauaaugaaaccauguaccacuguuuacau

SEQ ID NO: 238200 - RNA, 64 nt, Homo Sapiens
ugucauuuuuugauaaucuuaaugagcaucugugaauaaugaggaaagauuaaaauggggaaau

SEQ ID NO: 238201 - RNA, 64 nt, Homo Sapiens
aucugugaauaaugaggugugauuaaaauggggaaauaaugagcuguguuguauauaauguaaa

SEQ ID NO: 238202 - RNA, 64 nt, Homo Sapiens
uuguauucuuuuaucagcugauuuugaaacauauaauaaugauuuucuuguucccuucuuuaac

SEQ ID NO: 238203 - RNA, 64 nt, Homo Sapiens
cauauaauauauaugcuaaaguauaaagaguaauaauaaugacaauaaacaaaccccugugugc

SEQ ID NO: 238204 - RNA, 64 nt, Homo Sapiens
acaccaugaauauacuuuuuacugugauuuucauaauaaugaagauuuccugaugagucauauu

SEQ ID NO: 238205 - RNA, 64 nt, Homo Sapiens
guagaaaucuaucuccauaauucuaauaaucccgaauaaugaacuuguucaaacugaaggaaau

SEQ ID NO: 238206 - RNA, 64 nt, Homo Sapiens
guagguauguauuauggauuaauaaugauguugaaauaaugauaagauguacuccguaucaaau

SEQ ID NO: 238207 - RNA, 64 nt, Homo Sapiens
uugaaauaaugauaguagguacuccguaucaaauaauaaugauggggguagguggggaagaugu

SEQ ID NO: 238208 - RNA, 64 nt, Homo Sapiens
ugccuuacaauggauugugugucuugggagauagaauaaugaugaucuaaagauuuuuuuuccu

SEQ ID NO: 238209 - RNA, 64 nt, Homo Sapiens
augacgcacucggaagcuugcguuuccuguggccaauaaugaagagucacuuacuccaagaagu

SEQ ID NO: 238210 - RNA, 64 nt, Homo Sapiens
aaacacaagcuuuccauggaauccugggaaaauuaauaaugauugugagaauuauaaauacaga

SEQ ID NO: 238211 - RNA, 64 nt, Homo Sapiens
cauaucaagucaauuaguuugguuucacacuaauaauaaugacaaaaagcacaugcagaguaau

SEQ ID NO: 238212 - RNA, 64 nt, Homo Sapiens
gcauauguaugugugguuacuuuuuauaaugugaaauaaugaauaaugaauuuacucaaaauaa

SEQ ID NO: 238213 - RNA, 64 nt, Homo Sapiens
uaugugugguuacuuuuuauaaugugaaauaaugaauaaugaauuuacucaaaauaaaacauag

SEQ ID NO: 238214 - RNA, 64 nt, Homo Sapiens
uguucacucgaacuaagaacaaugguuaaggcagaauaaugacuaaaauauguucauauauuau

SEQ ID NO: 238215 - RNA, 64 nt, Homo Sapiens
uacuaccugaacuggcuuuucugagagaugaaucaauaaugaaacaugucuguuuuaaaaacua

SEQ ID NO: 238216 - RNA, 64 nt, Homo Sapiens
ucauacuauuaaauuuugcccuaaaagaccucuuaauaaugauuguugccagugacugauuaau

SEQ ID NO: 238217 - RNA, 64 nt, Homo Sapiens
cucuuaaagauugcugcuuuuuuuugauauugucaauaaugaaacccaauuguaaaacagucac

SEQ ID NO: 238218 - RNA, 64 nt, Homo Sapiens
cagggcagaaaggagggaggauucgucccauuacaauaaugaaauaaugauauucuaauuuuuu

SEQ ID NO: 238219 - RNA, 64 nt, Homo Sapiens
aaaggagggaggauucgucccauuacaauaaugaaauaaugauauucuaauuuuuuuaaauaaa

SEQ ID NO: 238220 - RNA, 64 nt, Homo Sapiens
ugcucauaacagguaucauuacuuuauacauagaaauaaugauugauugaagccuuuggcugaa

SEQ ID NO: 238221 - RNA, 64 nt, Homo Sapiens
gugccauuuggcugcuccuugcugcgaucuuagaaauaaugaaguaugaaaauuaaguacagag

SEQ ID NO: 238222 - RNA, 64 nt, Homo Sapiens
uuauggcuucacauucauugggguauuuguucaaaauaaugaagauuuuucuuacacacuaaau

SEQ ID NO: 238223 - RNA, 64 nt, Homo Sapiens
guaacuagaaagugaguuaaagaguuugacuuagaauaaugaagucacuucaguccuuuucuga

SEQ ID NO: 238224 - RNA, 64 nt, Homo Sapiens
guagaaauuauaacacuaggauaaacaguuguaaaauaaugaagaaaagcauacagucuaaaua

SEQ ID NO: 238225 - RNA, 64 nt, Homo Sapiens
uaccugauucauugucccuuguauuacuucuccaaauaaugaacccaugugauguuuauagucu

SEQ ID NO: 238226 - RNA, 64 nt, Homo Sapiens
uaggauaaacauuuauuuucguggauuuguacucaauaaugacuuaaaaacacauuguuaagcu

SEQ ID NO: 238227 - RNA, 64 nt, Homo Sapiens
auacuuuggaaauaauauacuauuugaguagauuaauaaugaaauugauuaaacuguuuguaau

SEQ ID NO: 238228 - RNA, 64 nt, Homo Sapiens
ugauaguuuguuaucauguuauacguacacuuagaauaaugauccagccaucucauucuaacag

SEQ ID NO: 238229 - RNA, 64 nt, Homo Sapiens
uucugugaaucuauagaucaaucugaggagacuuaauaaugauauugauucucccaauucauga

SEQ ID NO: 238230 - RNA, 54 nt, Homo Sapiens
cagcucuaaacacaaauuagguggaauaaugacucgagcaggaaagcaguagaa

SEQ ID NO: 238231 - RNA, 64 nt, Homo Sapiens
ccuuggcuuuaguuuuauaucauauuuagaaaauaauaaugaaaagcauccccaaaauuucaau

SEQ ID NO: 238232 - RNA, 64 nt, Homo Sapiens
gugucuaccaagaacaauugaguuuucuaaaaguaauaaugaagauuaugcaauucuaacugua

SEQ ID NO: 238233 - RNA, 64 nt, Homo Sapiens
uuagccuucagggagucguauugcuaaaaauacuaauaaugaucaauuauauaaaaauacuuua

SEQ ID NO: 238234 - RNA, 64 nt, Homo Sapiens
aaaaaauggagaaaaaguagaaaaaaccggauagaauaaugaccaacaacaaaacaaaacaaaa

SEQ ID NO: 238235 - RNA, 64 nt, Homo Sapiens
ucacuguauccuaguuauguuuacagcacaaauaaauaaugacugucauacauccagaggagac

SEQ ID NO: 238236 - RNA, 64 nt, Homo Sapiens
cuuaauugaaacauauaauuugcuuaauuacgugaauaaugaaauguaaaauccggguccauaa

SEQ ID NO: 238237 - RNA, 64 nt, Homo Sapiens
guggaaagguggcuuuuagcauucuguguuuccaaauaaugaauuugaacaccagguuggguua

SEQ ID NO: 238238 - RNA, 64 nt, Homo Sapiens
ugcugcagggucacuuuuggcuggucagagaaggaauaaugauaucaccuucuucccccccucc

SEQ ID NO: 238239 - RNA, 64 nt, Homo Sapiens
uaugguaaaggaauccuuucagcugccaguuuugaauaaugaauaucauauuguaucaucaaug

SEQ ID NO: 238240 - RNA, 64 nt, Homo Sapiens
ccagauagaaacaguaguuaucuuuggguagaagaauaaugagugaucuuuacuuuuuuacuuu

SEQ ID NO: 238241 - RNA, 64 nt, Homo Sapiens
ugauguaggucuuauuccuuuaguauggacuuaaaguacuuauucauauaccuuguaacuaaaa

SEQ ID NO: 238242 - RNA, 64 nt, Homo Sapiens
ccuuauuauucauuacugcauccccaguaaugaaaguacuuagaaaauaauuauugaaugaaug

SEQ ID NO: 238243 - RNA, 64 nt, Homo Sapiens
uaagaauacuuaaaaugccugggauaguucuugggacuaacaacaugaucuucuuugaguuaaa

SEQ ID NO: 238244 - RNA, 64 nt, Homo Sapiens
ggaucgccugaggucaggaguucaagaccaaccugacuaacauggugaaaccccaucucuacua

SEQ ID NO: 238245 - RNA, 64 nt, Homo Sapiens
cuuuuuuuguggggcuggguggggggagaagaccgacuaacagcugaaguaaugacagauuguu

SEQ ID NO: 238246 - RNA, 64 nt, Homo Sapiens
cauuuucuccagggaaacgaggcuugcccagauagacuaacaacccuuuagugcuccaagaagu

SEQ ID NO: 238247 - RNA, 64 nt, Homo Sapiens
caguguagucucaauuauaucugaaaguaauugugacuaacaaguaugcuuugccuuauuucca

SEQ ID NO: 238248 - RNA, 64 nt, Homo Sapiens
ucuggauuugugaagaagggauucaaccugccaggacuaacauuacaaccuuggcucuguggcc

SEQ ID NO: 238249 - RNA, 64 nt, Homo Sapiens
ucccugcacacagcuggccucccacccucucacugacuaacaggccuccucccagcagcagaca

SEQ ID NO: 238250 - RNA, 64 nt, Homo Sapiens
acaggucacuacacgggugcgauacucagcacuagacuaacauaugcagauggucccaguaaua

SEQ ID NO: 238251 - RNA, 64 nt, Homo Sapiens
augcacauaaccaaaugggggaauggcuacugcugacuaacaugcuacccaugaggaauucgug

SEQ ID NO: 238252 - RNA, 64 nt, Homo Sapiens
uuccugugaaguucugugcauuucuaaagcauuagacuaacagaucuuucgggcuugcuaagca

SEQ ID NO: 238253 - RNA, 64 nt, Homo Sapiens
uacaugaaaguccacgcuuuuaccccuucauggugacuaacagucaucucgugccagggcaggc

SEQ ID NO: 238254 - RNA, 64 nt, Homo Sapiens
aguuguuaucuaaaccuuuacuucaauuuggagugacuaacacaucuauccuggauucugaacu

SEQ ID NO: 238255 - RNA, 64 nt, Homo Sapiens
gacucucagucccaaaaucucacuaguugggucagacuaacaggauucauggauaugagcuauu

SEQ ID NO: 238256 - RNA, 64 nt, Homo Sapiens
auuuaauggcccuacugauauucacaucgaaggugacuaacaaugacaaaggccuuaugaacug

SEQ ID NO: 238257 - RNA, 64 nt, Homo Sapiens
ccuggccucaaucuccaucuuuagggucuccacagacuaacauugaagucuuccagaaaccucg

SEQ ID NO: 238258 - RNA, 64 nt, Homo Sapiens
uacuuauaaguagcagaacauaaaauguauuucugacuaacacaaaugguccuuucacaugugc

SEQ ID NO: 238259 - RNA, 64 nt, Homo Sapiens
aaauauuacaaaacauccaacacuagaaagcaaugacuaacauuuaauuuguuuacaaaaaugu

SEQ ID NO: 238260 - RNA, 64 nt, Homo Sapiens
auuuuuucuuuucuuuacaaaccauuuuguuauugacuaacaggccaaagagucuccaguuuac

SEQ ID NO: 238261 - RNA, 64 nt, Homo Sapiens
gacuuauccaacuuauaaauaacauauuucuucagacuaacaucuuaaaacacugaccucuaug

SEQ ID NO: 238262 - RNA, 64 nt, Homo Sapiens
cacguaucaaacuaauauaacaaaaauuaaguuggacuaacauuuuuucauuuuguuucuccuu

SEQ ID NO: 238263 - RNA, 64 nt, Homo Sapiens
aacuccaucacuugagaaguggacauuacaauaugacuaacagcugaauguaccaaaggugaag

SEQ ID NO: 238264 - RNA, 64 nt, Homo Sapiens
ugggaaauaagcaaaaaacuguguuuucgagcaggacuaacaacggaaguuuugcaugcaggcu

SEQ ID NO: 238265 - RNA, 64 nt, Homo Sapiens
uaauuauaaaaggaaauuuuuuacaacuguguuagacuaacaagguaauauacuguauggaaag

SEQ ID NO: 238266 - RNA, 64 nt, Homo Sapiens
gugccaaaaauauuaaaaaugccuuuuuuggaaggacuaacagaaagcaccugauuugcacuug

SEQ ID NO: 238267 - RNA, 64 nt, Homo Sapiens
gguguacagagaccagaggagagagacacacuaggacuaacaauguccuaacaaaaugguacuu

SEQ ID NO: 238268 - RNA, 64 nt, Homo Sapiens
guuaagaucccagguuccagcaacugaugccacugacuaacaacuagccacuugucagaggaag

SEQ ID NO: 238269 - RNA, 64 nt, Homo Sapiens
gguaucgggggauauggccaguaaaguauugagagacuaacaaauggugaccuaauguuuuguc

SEQ ID NO: 238270 - RNA, 64 nt, Homo Sapiens
ggaaaggucaccacacuuagggauuuuagaccuugacuaacaagcuccagguguagaaaaauuc

SEQ ID NO: 238271 - RNA, 64 nt, Homo Sapiens
gcggaucacgaggucaggagauugagaccagccugacuaacauggugaaaucccgucucuacua

SEQ ID NO: 238272 - RNA, 64 nt, Homo Sapiens
auauuaagucuaaauuaaguuuucuacucauuaagacuaacaucuccccacuccauccccacug

SEQ ID NO: 238273 - RNA, 64 nt, Homo Sapiens
gacagcuguuuagggucuucgccaggugggcggggacuaacaaagccuuguugcuggcaucccg

SEQ ID NO: 238274 - RNA, 64 nt, Homo Sapiens
cugggcucaagcaguucucccaccucagccucucgacuaacagggacuauaaucuugcagcacc

SEQ ID NO: 238275 - RNA, 64 nt, Homo Sapiens
agucuauuuugucuauaggugacaaacaucuccagacuaacaugucaguuuuaucaauuauauu

SEQ ID NO: 238276 - RNA, 64 nt, Homo Sapiens
cuucacuuuuaugaacaacuaaaaagaagaaaaggacuaacaagagcauguugauuuggucacu

SEQ ID NO: 238277 - RNA, 64 nt, Homo Sapiens
uuaaguuuaacauauuaaauuaauuuaacauuuagacuaacauuaacauuuaaauuaauauguu

SEQ ID NO: 238278 - RNA, 64 nt, Homo Sapiens
uucugaacuggaacaugggcauuggguucuaaaggacuaacauaaaaucugugaauuaaaaaag

SEQ ID NO: 238279 - RNA, 64 nt, Homo Sapiens
ggaggggaccgcucccccuuucucuguggggguggacuaacacaauuaaaaugaacauccugcu

SEQ ID NO: 238280 - RNA, 64 nt, Homo Sapiens
ugacugaccaaagcagccccggcaagagccccaggacuaacagcgaugcuacccccacagagga

SEQ ID NO: 238281 - RNA, 64 nt, Homo Sapiens
gacaaaggccuuaugaacuguucacaucuaaguugacuaacaauauuuaauggcccuacugaua

SEQ ID NO: 238282 - RNA, 64 nt, Homo Sapiens
gacuuugaaucuuugccuguuugucuaaacauuugacuaacauucuguuugaauuuggaaguau

SEQ ID NO: 238283 - RNA, 64 nt, Homo Sapiens
acguuucacucaaguucuccuacugaggacucuugacuaacagcauacuggcaguuucaccuua

SEQ ID NO: 238284 - RNA, 64 nt, Homo Sapiens
aacuuaaugauuaaaagugauuguuuuuaauaaagacuaacacaucugaaauuuuaguuauuuu

SEQ ID NO: 238285 - RNA, 64 nt, Homo Sapiens
gacuaaugugcacauuaacacauuuagugaacgugacuaacaaaaaguauauguaagguuaaug

SEQ ID NO: 238286 - RNA, 64 nt, Homo Sapiens
uuggauagaauauaauugauugguuuguuacuuggacuaacaaggcaguagauuugccugugug

SEQ ID NO: 238287 - RNA, 64 nt, Homo Sapiens
agaugauagcaauauauuauuugguuacauaguggacuaacauuuuuaguaaucucuuuugcca

SEQ ID NO: 238288 - RNA, 64 nt, Homo Sapiens
uagaauauuaagugcuacuugagguacauguucagacuaacauucuuuugcaguauagugagaa

SEQ ID NO: 238289 - RNA, 64 nt, Homo Sapiens
gccagauuuauaguauuccaucuuuaauaugugggacuaacagcaguguagauuguuaccuuaa

SEQ ID NO: 238290 - RNA, 64 nt, Homo Sapiens
uagaugacugaccaagggcuuaaucaaauaaaaugacuaacagcaucuaucauaaagccacaca

SEQ ID NO: 238291 - RNA, 64 nt, Homo Sapiens
uucagaaauagcaagguguguuaauuuuuaucaggacuaacauuuguuaccucuuuuaugguuu

SEQ ID NO: 238292 - RNA, 64 nt, Homo Sapiens
gagaaaccccaucucuacuacaggagaccagccugacuaacaugggcaggcaaucaccugaggg

SEQ ID NO: 238293 - RNA, 64 nt, Homo Sapiens
guuuucaugugcucagaauuguucaugaaucggagacuaacaaauauauuuuauuaauaaaaug

SEQ ID NO: 238294 - RNA, 64 nt, Homo Sapiens
uccuccaauaaaccccaaauugauguggagaaaggacuaacauccaggguacuaaaagaaacua

SEQ ID NO: 238295 - RNA, 64 nt, Homo Sapiens
acaacuuuucuuagacuuaacacuuaugauaaaugacuaacauaguaacagaaucuuuaugaaa

SEQ ID NO: 238296 - RNA, 64 nt, Homo Sapiens
ucacugaaccagacacagcauugcugacacaugagacuaacacgugcaauuauuuaaaaagauu

SEQ ID NO: 238297 - RNA, 64 nt, Homo Sapiens
cauucaaauuuguauuauuuggagaugaagauuugacuaacagugagccuuauuaagaacacua

SEQ ID NO: 238298 - RNA, 64 nt, Homo Sapiens
ccaugauugauucagucaugaggaguuuacaauugacuaacacuauuuccuagucuuaacuuuc

SEQ ID NO: 238299 - RNA, 64 nt, Homo Sapiens
aguuccugccaaccucuguugauuuugguguuuugacuaacaccguagaggggcucucccccag

SEQ ID NO: 238300 - RNA, 64 nt, Homo Sapiens
ugauccaaaagaucaacagcaaucugaagacucugacuaacaugcagaaucuacccaauaccac

SEQ ID NO: 238301 - RNA, 64 nt, Homo Sapiens
ggccuggacugcacucacagaggcaaguguuguagacuaacaaagauacuccaaaauacaaugg

SEQ ID NO: 238302 - RNA, 64 nt, Homo Sapiens
uuaauuucuguguguuggccauacugaauuaugagacuaacagaugucuacaauacaauaccug

SEQ ID NO: 238303 - RNA, 64 nt, Homo Sapiens
auuaauaaaaaggaauaacuguuccaaagacucagacuaacauacaggacaguccagcuggaug

SEQ ID NO: 238304 - RNA, 64 nt, Homo Sapiens
cuaagcaucagaccuggaauagaauuugcuuaaugacuaacaccucuguaauugguuaucagga

SEQ ID NO: 238305 - RNA, 64 nt, Homo Sapiens
cucucuggagcuuaguacucgauccugaagcauggacuaacaugagguucuccagugacagaaa

SEQ ID NO: 238306 - RNA, 64 nt, Homo Sapiens
agcucacagcaaaauagagcuaggcacaguaagagacuaacaacauaaaguucaguuuauaagu

SEQ ID NO: 238307 - RNA, 64 nt, Homo Sapiens
uacaccuucuggguagggaaacaaccaacuaauugacuaacaccaccaacaacaaaaaacaaac

SEQ ID NO: 238308 - RNA, 64 nt, Homo Sapiens
ccaggaauggagaccauccgucggcccugcuaaggacuaacacuuagccaucguuuuucacagg

SEQ ID NO: 238309 - RNA, 64 nt, Homo Sapiens
gaggcacaccagguagagcaaacuuagcagcucugacuaacaggcugcaaagugcaaguucaga

SEQ ID NO: 238310 - RNA, 64 nt, Homo Sapiens
gaccccagggcacaggagcuaccuguguggacaggacuaacacucagaagccugggggccuggc

SEQ ID NO: 238311 - RNA, 64 nt, Homo Sapiens
agaaugcacaguggguggagggucaggaggaaaagacuaacaggccuauccccaccuacuccug

SEQ ID NO: 238312 - RNA, 64 nt, Homo Sapiens
acacaaucaugauauucuaacaaaaucauuuaaagacuaacaaaauuuaguuaucuaucagacu

SEQ ID NO: 238313 - RNA, 64 nt, Homo Sapiens
aauguaacuccagauagagagcuuuuuuuuuuuugacuaacaaguuugugauuuuuuuaauagu

SEQ ID NO: 238314 - RNA, 64 nt, Homo Sapiens
ugaaucauugcuguuggagggaaugauguaaucagacuaacagugauauacuuggugauaaugu

SEQ ID NO: 238315 - RNA, 64 nt, Homo Sapiens
uuuugagaaguaaaauugaccaggucuuuuauuagacuaacauuuuuaguugggaaauagauuu

SEQ ID NO: 238316 - RNA, 64 nt, Homo Sapiens
gcagcucuccuguuguauucagguguuguuuacagacuaacaaauguguuggcaaaucccuggu

SEQ ID NO: 238317 - RNA, 64 nt, Homo Sapiens
gcggaucacgaggucaggagaucgagaccaucgugacuaacacagugaaaccccgucucuaaua

SEQ ID NO: 238318 - RNA, 64 nt, Homo Sapiens
cucuggacuuuauuguccuguuucuaucaaauuggacuaacaaaaauugauauaauacauucau

SEQ ID NO: 238319 - RNA, 64 nt, Homo Sapiens
gcucacaucugggagauuaacauaauuuguuggugacuaacaaaagacagcaguucagucagua

SEQ ID NO: 238320 - RNA, 64 nt, Homo Sapiens
uuuagaaagugaaaaaaguuaggggucaaaaccagacuaacaguaagccacagaagauaaauac

SEQ ID NO: 238321 - RNA, 64 nt, Homo Sapiens
ucacaugcacauuucaaaacuuuacagagguucggacuaacauucuacauacgcaaaaacuucc

SEQ ID NO: 238322 - RNA, 64 nt, Homo Sapiens
gcccuguucucaccucaugcugcuccccagaguagacuaacaggcucaguccccuguuguccuu

SEQ ID NO: 238323 - RNA, 64 nt, Homo Sapiens
ucugagcacgcuaccaaaucucaaaauauccuaagacuaacaaaggcagcugugucugagccca

SEQ ID NO: 238324 - RNA, 64 nt, Homo Sapiens
aaauuuugcuugcaugugcuaauaugaaauaacagacuaacauuuuaggggaaaaauaaauaca

SEQ ID NO: 238325 - RNA, 64 nt, Homo Sapiens
ggaucaccugagguggggaguaugagaccacccugacuaacauggagagacccugucucuacua

SEQ ID NO: 238326 - RNA, 64 nt, Homo Sapiens
auuaaaagcgcaggcagauuuaauuugcuaaauagacuaacaggaggaaaaaaacaaacagccu

SEQ ID NO: 238327 - RNA, 64 nt, Homo Sapiens
ggaagacguuugcaaccgcgacaaaauaacucuugacuaacagccgcagagcagccgguccugg

SEQ ID NO: 238328 - RNA, 64 nt, Homo Sapiens
auucuaaucuuaaaggaauaaagcacugaauugggacuaacauucugauagguugcacccuuaa

SEQ ID NO: 238329 - RNA, 64 nt, Homo Sapiens
gaugcuguuauucaggcgaacuugcucauggguggacuaacaccugguuugguacagagacuga

SEQ ID NO: 238330 - RNA, 64 nt, Homo Sapiens
ccccacccccaccaaccaggggagccacuaagcugacuaacaacuguccccucacccaccagcu

SEQ ID NO: 238331 - RNA, 64 nt, Homo Sapiens
gcaaguaaacauuccucugcucaccucccaacaagacuaacagucuuuuuagaaguaaauauau

SEQ ID NO: 238332 - RNA, 64 nt, Homo Sapiens
ugagcacugugcuaccuucacugcuccaaagccagacuaacagcucuccaagcccuugggguga

SEQ ID NO: 238333 - RNA, 64 nt, Homo Sapiens
uuuaaguuacucagcucuauucuuugugaccaaggacuaacauucuuuauuaauuaccaaauag

SEQ ID NO: 238334 - RNA, 64 nt, Homo Sapiens
cacagugaaaccccgucucuaucaagaccauccugacuaacaaaaucgugugcgaggccaggag

SEQ ID NO: 238335 - RNA, 64 nt, Homo Sapiens
auguugcauaauauaugcuuauguagcuuuccaggacuaacagauaaauguguaaugaacaaag

SEQ ID NO: 238336 - RNA, 64 nt, Homo Sapiens
gagcauuaagaaguuaaaucgaacaaaguggguagacuaacagagaacuuggugauagcaaugg

SEQ ID NO: 238337 - RNA, 64 nt, Homo Sapiens
uugggguccagcugccuucagccccccucccccagacuaacagacccuuggaggcaggggcugu

SEQ ID NO: 238338 - RNA, 64 nt, Homo Sapiens
agaaucuaccucccaacugcugugugucaaaggggacuaacagccugcccauucuccauuucug

SEQ ID NO: 238339 - RNA, 64 nt, Homo Sapiens
guuguuacccaauguauuucaggauccacauccagacuaacauaucugaaggcucaacugggga

SEQ ID NO: 238340 - RNA, 64 nt, Homo Sapiens
gucaucugcuguuuggggaacagucuguccuugagacuaacaaaggagcagagguccgcugagg

SEQ ID NO: 238341 - RNA, 64 nt, Homo Sapiens
uucacuguuaccaggcauguaacagaaggaggaagacuaacacacacccccugccccaucccau

SEQ ID NO: 238342 - RNA, 64 nt, Homo Sapiens
caacauacauucaccgcugggcauguagauucuggacuaacagaagggaucccuaacgugccca

SEQ ID NO: 238343 - RNA, 64 nt, Homo Sapiens
gcuccagacagcaagagcccaagcuuugaaauuagacuaacaaaauccagguaagaccggauug

SEQ ID NO: 238344 - RNA, 64 nt, Homo Sapiens
uccuaggagggaaaguccagacaaaagcaggaaugacuaacacaccacguaacuuacccuaugg

SEQ ID NO: 238345 - RNA, 64 nt, Homo Sapiens
aaagauauaaaaggcaauaaaaugcugacuaguagacuaacauauggcuuuccauuuugggcag

SEQ ID NO: 238346 - RNA, 64 nt, Homo Sapiens
aaugaaaugaaaugauaauuuggcuucauaucuagacuaacacaaaauuaagaaucuuccauaa

SEQ ID NO: 238347 - RNA, 64 nt, Homo Sapiens
ugcuacccaccccuuccauggacugaauaagauggacuaacaggccuguguuuuuguguuuauu

SEQ ID NO: 238348 - RNA, 64 nt, Homo Sapiens
cucagcacauccgacaccucaaaucucagucccugacuaacagcccuugccuuucuguuucagc

SEQ ID NO: 238349 - RNA, 64 nt, Homo Sapiens
cugaaaccccaugucuacuauucaagaccagccugacuaacaugggaucaccugagaucaggag

SEQ ID NO: 238350 - RNA, 64 nt, Homo Sapiens
ugaagucucucauuugcuuguuaauuuggcauaagacuaacagagaaauugcuaccaaacucau

SEQ ID NO: 238351 - RNA, 64 nt, Homo Sapiens
cugucucuugcuuaccucaacuucuauaaaaugagacuaacaauaccucugagccuccuuucuu

SEQ ID NO: 238352 - RNA, 64 nt, Homo Sapiens
ugccuugggaaucccuuccuugucccaggccaaagacuaacaacaaggccauggccauaucugu

SEQ ID NO: 238353 - RNA, 64 nt, Homo Sapiens
aauggcuuacacuugcagacuuugcaaaucuuaagacuaacaaauccuugaaaucacacagcuu

SEQ ID NO: 238354 - RNA, 64 nt, Homo Sapiens; identical to SEQ ID NO: 24683

SEQ ID NO: 238355 - RNA, 64 nt, Homo Sapiens; identical to SEQ ID NO: 24684

SEQ ID NO: 238356 - RNA, 64 nt, Homo Sapiens; identical to SEQ ID NO: 24685

SEQ ID NO: 238357 - RNA, 64 nt, Homo Sapiens; identical to SEQ ID NO: 24686

SEQ ID NO: 238358 - RNA, 64 nt, Homo Sapiens; identical to SEQ ID NO: 24687

SEQ ID NO: 238359 - RNA, 64 nt, Homo Sapiens; identical to SEQ ID NO: 24688

SEQ ID NO: 238360 - RNA, 64 nt, Homo Sapiens; identical to SEQ ID NO: 24689

SEQ ID NO: 238361 - RNA, 64 nt, Homo Sapiens; identical to SEQ ID NO: 24690

SEQ ID NO: 238362 - RNA, 64 nt, Homo Sapiens; identical to SEQ ID NO: 24691

SEQ ID NO: 238363 - RNA, 64 nt, Homo Sapiens; identical to SEQ ID NO: 24692

SEQ ID NO: 238364 - RNA, 64 nt, Homo Sapiens; identical to SEQ ID NO: 24693

SEQ ID NO: 238365 - RNA, 64 nt, Homo Sapiens; identical to SEQ ID NO: 24694

SEQ ID NO: 238366 - RNA, 64 nt, Homo Sapiens; identical to SEQ ID NO: 24695

SEQ ID NO: 238367 - RNA, 64 nt, Homo Sapiens; identical to SEQ ID NO: 24696

SEQ ID NO: 238368 - RNA, 64 nt, Homo Sapiens; identical to SEQ ID NO: 24697

SEQ ID NO: 238369 - RNA, 64 nt, Homo Sapiens; identical to SEQ ID NO: 24698

SEQ ID NO: 238370 - RNA, 64 nt, Homo Sapiens; identical to SEQ ID NO: 24699

SEQ ID NO: 238371 - RNA, 64 nt, Homo Sapiens; identical to SEQ ID NO: 24700

SEQ ID NO: 238372 - RNA, 64 nt, Homo Sapiens; identical to SEQ ID NO: 24701

SEQ ID NO: 238373 - RNA, 64 nt, Homo Sapiens; identical to SEQ ID NO: 24702

SEQ ID NO: 238374 - RNA, 64 nt, Homo Sapiens; identical to SEQ ID NO: 24703

SEQ ID NO: 238375 - RNA, 64 nt, Homo Sapiens; identical to SEQ ID NO: 24704

SEQ ID NO: 238376 - RNA, 64 nt, Homo Sapiens; identical to SEQ ID NO: 24705

SEQ ID NO: 238377 - RNA, 64 nt, Homo Sapiens; identical to SEQ ID NO: 24706

SEQ ID NO: 238378 - RNA, 64 nt, Homo Sapiens; identical to SEQ ID NO: 24707

SEQ ID NO: 238379 - RNA, 64 nt, Homo Sapiens; identical to SEQ ID NO: 24708

SEQ ID NO: 238380 - RNA, 64 nt, Homo Sapiens; identical to SEQ ID NO: 24709

SEQ ID NO: 238381 - RNA, 64 nt, Homo Sapiens; identical to SEQ ID NO: 24710

SEQ ID NO: 238382 - RNA, 64 nt, Homo Sapiens; identical to SEQ ID NO: 24711

SEQ ID NO: 238383 - RNA, 64 nt, Homo Sapiens; identical to SEQ ID NO: 24712

SEQ ID NO: 238384 - RNA, 64 nt, Homo Sapiens; identical to SEQ ID NO: 24713

SEQ ID NO: 238385 - RNA, 64 nt, Homo Sapiens; identical to SEQ ID NO: 24714

SEQ ID NO: 238386 - RNA, 64 nt, Homo Sapiens; identical to SEQ ID NO: 24715

SEQ ID NO: 238387 - RNA, 64 nt, Homo Sapiens; identical to SEQ ID NO: 24716

SEQ ID NO: 238388 - RNA, 64 nt, Homo Sapiens; identical to SEQ ID NO: 24717

SEQ ID NO: 238389 - RNA, 64 nt, Homo Sapiens; identical to SEQ ID NO: 24718

SEQ ID NO: 238390 - RNA, 64 nt, Homo Sapiens; identical to SEQ ID NO: 24719

SEQ ID NO: 238391 - RNA, 64 nt, Homo Sapiens; identical to SEQ ID NO: 24720

SEQ ID NO: 238392 - RNA, 50 nt, Homo Sapiens; identical to SEQ ID NO: 24721

SEQ ID NO: 238393 - RNA, 64 nt, Homo Sapiens; identical to SEQ ID NO: 24722

SEQ ID NO: 238394 - RNA, 64 nt, Homo Sapiens; identical to SEQ ID NO: 24723

SEQ ID NO: 238395 - RNA, 64 nt, Homo Sapiens; identical to SEQ ID NO: 24724

SEQ ID NO: 238396 - RNA, 64 nt, Homo Sapiens; identical to SEQ ID NO: 24725

SEQ ID NO: 238397 - RNA, 64 nt, Homo Sapiens; identical to SEQ ID NO: 24726

SEQ ID NO: 238398 - RNA, 64 nt, Homo Sapiens; identical to SEQ ID NO: 24727

SEQ ID NO: 238399 - RNA, 64 nt, Homo Sapiens
ucugaaagaaguauggccaaaagcacuuuaaugcugcugacauuguuguuuuuauguucauuug

SEQ ID NO: 238400 - RNA, 64 nt, Homo Sapiens
uuguuuuuauguucauuugcuggagcgcaagacgugcugacacagugaguuuucucugauguau

SEQ ID NO: 238401 - RNA, 64 nt, Homo Sapiens
ucucuugaugacgcagcugucauuuggcugugcgugcugacaguuuugcaacaggcagagcugu

SEQ ID NO: 238402 - RNA, 64 nt, Homo Sapiens
uaaauauauuuuaaauauuguuugggaggcauagugcugacauauauucagaguguuguaguuu

SEQ ID NO: 238403 - RNA, 64 nt, Homo Sapiens
ccuagaccuuggaaccaguuuccugguagggaacugcugacaguuucaaugcugacaguuggag

SEQ ID NO: 238404 - RNA, 64 nt, Homo Sapiens
caguuuccugguagggaacugcugacaguuucaaugcugacaguuggagccaaugccucauagu

SEQ ID NO: 238405 - RNA, 64 nt, Homo Sapiens
aggccccacagggagcagagacugcuuuaaucccugcugacaucacggaaaagcaacagagccu

SEQ ID NO: 238406 - RNA, 64 nt, Homo Sapiens
ugcucaauaaaacucagccaggagcauauggagaugcugacagccagguaaugggugagacugu

SEQ ID NO: 238407 - RNA, 64 nt, Homo Sapiens
uucuuccucuuccuaccguguguuuccuaacuuaugcugacaagcagcagccauuucccuaccc

SEQ ID NO: 238408 - RNA, 64 nt, Homo Sapiens
gcucccucaggagggccuugggagggcuuuccugugcugacagcagagaggaccugguggggag

SEQ ID NO: 238409 - RNA, 64 nt, Homo Sapiens
acuuguuucuucaacuggaggaggucccugccuaugcugacauuccauuguagaaaaauggggc

SEQ ID NO: 238410 - RNA, 64 nt, Homo Sapiens
uuuacuggaaucuauuggugcugcugcaugagucugcugacaaccugacugcacaaggacuggg

SEQ ID NO: 238411 - RNA, 64 nt, Homo Sapiens
aucugcauaucuucagcuuacuaggugacccggaugcugacaucugcugcugcagaaaggaaga

SEQ ID NO: 238412 - RNA, 64 nt, Homo Sapiens
uugcccugcugugacuccaaagaaaggagcuucuugcugacagugcccuguggagcaaggcugu

SEQ ID NO: 238413 - RNA, 64 nt, Homo Sapiens
ccugcccggcugcggaaugaaccacaucuugcucugcugacagacacaggcccggcuccaggcu

SEQ ID NO: 238414 - RNA, 64 nt, Homo Sapiens
aauaguucagguaacaggcagauacaggaaaagcugcugacaguguuguaugagguuugaggau

SEQ ID NO: 238415 - RNA, 64 nt, Homo Sapiens
caacauuuuuggggugcuuugaagaaaauuaaccugcugacaggaucuacuucuuuuaaaguua

SEQ ID NO: 238416 - RNA, 64 nt, Homo Sapiens
cuucaacugauuuuuaaaugaaccuagaagcaccugcugacacuccugggggcucacagcacag

SEQ ID NO: 238417 - RNA, 64 nt, Homo Sapiens
auccaaugucuagaaucaggcccuuuggacauccugcugacacuugggccccuuaacaccuugg

SEQ ID NO: 238418 - RNA, 64 nt, Homo Sapiens
uccugacucucagcccuacagaguagggaguugaugcugacaggaugaagauuuaggaauaaau

SEQ ID NO: 238419 - RNA, 64 nt, Homo Sapiens
gcuaugaauccuuuuaaaaaaaucuuuggauaaaugcugacagauuuccaagaacuaccaagaa

SEQ ID NO: 238420 - RNA, 64 nt, Homo Sapiens
gugaauuugaaaaaugauggccaguuuucagaagugcugacaaauucauauugguaugcaaaag

SEQ ID NO: 238421 - RNA, 60 nt, Homo Sapiens
agagaaaaaaugguaaugugugccuuuauugaacuugaaugacagaacuugaaauuuuua

SEQ ID NO: 238422 - RNA, 60 nt, Homo Sapiens
aaugugugccuuuauugaacuugaaugacagaacuugaaauuuuuaacacauccuucuug

SEQ ID NO: 238423 - RNA, 60 nt, Homo Sapiens
agcuguuguuacauguaauauuuuaguucagaacuugaccugaaggaagggaagaaaagu

SEQ ID NO: 238424 - RNA, 60 nt, Homo Sapiens
aggucgucagcagugugguauuaucuaugagaacuugagcgacagaguauuucuugauga

SEQ ID NO: 238425 - RNA, 60 nt, Homo Sapiens
cuuugccacugauaggaaugacuuccggaggaacuugauacuaaauuugggacucuuugc

SEQ ID NO: 238426 - RNA, 60 nt, Homo Sapiens
acucuuugcugcgggaguuuggcuggccaggaacuugagugacauugaccucauggcacc

SEQ ID NO: 238427 - RNA, 60 nt, Homo Sapiens
cugagcugaccagccgugagagacaagccagaacuugaccaggauagagacuggaacacu

SEQ ID NO: 238428 - RNA, 60 nt, Homo Sapiens
uauccugcuugaugggauucguauuuuagugaacuugaaagaaggcuuguugugcuuuua

SEQ ID NO: 238429 - RNA, 60 nt, Homo Sapiens
ugcugaaauuaugauaguuaagauuccuaagaacuugacaaugcuccccuggcuugcagg

SEQ ID NO: 238430 - RNA, 60 nt, Homo Sapiens
aguugguagguggacaccacuuucauaagugaacuugagcucacuacucaauugugcagc

SEQ ID NO: 238431 - RNA, 60 nt, Homo Sapiens
ugcuuuuuguauuuggagagagugacuauugaacuugaaaccuuuuauuccgggcgucuu

SEQ ID NO: 238432 - RNA, 60 nt, Homo Sapiens
aaggggagguuggggggcuccuucccuucagaacuugaaguuucucccacugccuccucu

SEQ ID NO: 238433 - RNA, 60 nt, Homo Sapiens
auuacauaaaagugcagaaauuuccaagaugaacuugaagucaaagaggacauaugauuc

SEQ ID NO: 238434 - RNA, 60 nt, Homo Sapiens
auuacaucaaaguacagaaauuuccaagaugaacuugaagucaaagaagacauaugacuc

SEQ ID NO: 238435 - RNA, 64 nt, Homo Sapiens
cgggaggugaggggcgccucugcccagcugccccuacugggaagugaggagccccucugccccg

SEQ ID NO: 238436 - RNA, 64 nt, Homo Sapiens
cgggaggcgaggggcgccucugcccggcugccccuacugggaagugaggagccccucugcccgg

SEQ ID NO: 238437 - RNA, 64 nt, Homo Sapiens
cgggagguuaggggcgccucugcccggccgccccuacugggaagugaggagccccucugcccgg

SEQ ID NO: 238438 - RNA, 64 nt, Homo Sapiens
ugcuaccaagaaaccaacccuguuauucauguauuacugggagaauuguaucaugguuucagua

SEQ ID NO: 238439 - RNA, 64 nt, Homo Sapiens
uuuaaaucuagcuauagaguuguuuacaaaauuuuacugggacuugccuuuucuuauaugauuu

SEQ ID NO: 238440 - RNA, 64 nt, Homo Sapiens
ccccagaccuggauucugagaaaugggagcauaguacugggaaaaaugggagcacaguacuggg

SEQ ID NO: 238441 - RNA, 64 nt, Homo Sapiens
ugggagcauaguacugggaaaaaugggagcacaguacugggaaaaaugggagcauaguacuggg

SEQ ID NO: 238442 - RNA, 64 nt, Homo Sapiens
ugggagcacaguacugggaaaaaugggagcauaguacugggaaaggggaguucacaguacucgg

SEQ ID NO: 238443 - RNA, 64 nt, Homo Sapiens
ggggaguucacaguacucggaugggagcccacaguacugggaaaugggagcacaguacugggaa

SEQ ID NO: 238444 - RNA, 64 nt, Homo Sapiens
ugggagcccacaguacugggaaaugggagcacaguacugggaaaugggagcacacaguacuggg

SEQ ID NO: 238445 - RNA, 64 nt, Homo Sapiens
ugggagcacaguacugggaaaugggagcacacaguacugggaaaugggcauacaguacugagaa

SEQ ID NO: 238446 - RNA, 64 nt, Homo Sapiens
ugggcauacaguacugagaaaaaugggagcacaguacugggaaaaaugggaguacacuacugag

SEQ ID NO: 238447 - RNA, 64 nt, Homo Sapiens
ugggagcacaguacugagaaaaaugggagcacaguacugggaagaaugggagcacaguauuggg

SEQ ID NO: 238448 - RNA, 64 nt, Homo Sapiens
ugggggcucacagcacugcaaaaugggagcacaguacugggaaaaaugggagcacaguacuggg

SEQ ID NO: 238449 - RNA, 64 nt, Homo Sapiens
ugggagcacaguacugggaaaaaugggagcacaguacugggaaaaaugggagcacaguacuagg

SEQ ID NO: 238450 - RNA, 64 nt, Homo Sapiens
ugggagcacaguacuaggaaaccugugagcacaguacugggaaaggccgggcauguuggcucac

SEQ ID NO: 238451 - RNA, 64 nt, Homo Sapiens
ucaggaaaugauacaggguuacagucagaaagcuuacugggaugaucaggacuauaccucauuu

SEQ ID NO: 238452 - RNA, 64 nt, Homo Sapiens
acaggcaugagccacugcacuccaccucccaaaguacugggauugaccucgugauccacccucc

SEQ ID NO: 238453 - RNA, 64 nt, Homo Sapiens
acaggcgugagccaccucgcugggucuccuaaaguacugggauuccucaggcaaucugcccgcc

SEQ ID NO: 238454 - RNA, 64 nt, Homo Sapiens
ggggccucaaaugcaccauggacucagguggcccuacugggagaaggccuugcggcuccucagg

SEQ ID NO: 238455 - RNA, 64 nt, Homo Sapiens
uuaucaaaaaguacaauaauaaauccucagguaguacugggaauggaaggcuuugccaugggcc

SEQ ID NO: 238456 - RNA, 64 nt, Homo Sapiens
aaggcuuugccaugggccugcugcgucagaccaguacugggaaggaggacgguuguaagcaguu

SEQ ID NO: 238457 - RNA, 64 nt, Homo Sapiens
cccaccuguuuuccaguguuuucuuuucauugacaacaccuacauaauuuacaaaggauaaucu

SEQ ID NO: 238458 - RNA, 64 nt, Homo Sapiens
auucccagcacuuugggaggugggcgcgguggcuaacaccuauacuaaaagccugcuucagggc

SEQ ID NO: 238459 - RNA, 64 nt, Homo Sapiens
uuuuuauguuucuuggcucacacgcuuggcuaagaacaccuaaaggauuacaggcaugagccac

SEQ ID NO: 238460 - RNA, 64 nt, Homo Sapiens
uguuuuuauuuuugagaaguucuucacuguugagaacaccuaaaaaaucaaaucuauucagguu

SEQ ID NO: 238461 - RNA, 64 nt, Homo Sapiens
uagucuggucauuuuguuuagguugaaauggccaggcacaaauuuuugaauggcuauggcguua

SEQ ID NO: 238462 - RNA, 64 nt, Homo Sapiens
accaaauauugguuaugauguccuguggccacauggcacaaaacccaugaugugaaacugacaa

SEQ ID NO: 238463 - RNA, 64 nt, Homo Sapiens
cucagcaauuuuuuucccucuauuuugagacagaggcacaaagaucuauauauuucucucaccc

SEQ ID NO: 238464 - RNA, 64 nt, Homo Sapiens
auuugacaguacaagucaaacuccaugaagccagggcacaaagaaaugaaacuauuuucuucuu

SEQ ID NO: 238465 - RNA, 64 nt, Homo Sapiens
uuauaauuuuuuaaaugaaagcugggaggcagagggcacaaacccucacccaggcucugcucag

SEQ ID NO: 238466 - RNA, 64 nt, Homo Sapiens
ggcccggccuuuggcagaggccugaauaacacguggcacaaaugcaaacaaggagucccuccag

SEQ ID NO: 238467 - RNA, 64 nt, Homo Sapiens
ucaugugagucugggauauucuuuagcuuaccugggcacaaacagaauuuuccauuuauuaagc

SEQ ID NO: 238468 - RNA, 64 nt, Homo Sapiens
cucugccaguuacuugggcuucaacagccaagcuggcacaaaagacagcuggcggaggcugcuc

SEQ ID NO: 238469 - RNA, 59 nt, Homo Sapiens
auuagaaagcaaagauuauuuucauuuauccagaugaccauuuucugccacagguaaca

SEQ ID NO: 238470 - RNA, 59 nt, Homo Sapiens
cuuugcagucaguucaucccuacccuggcccagaugaucacugaucuugucauuauaga

SEQ ID NO: 238471 - RNA, 59 nt, Homo Sapiens
cuugcacagacaaccuaccuucccagcuuccagaugauccguaucugagaguuccagau

SEQ ID NO: 238472 - RNA, 59 nt, Homo Sapiens
gaaaggaagaccucaagaaaccacuucauccagaugaagugacacaggagggcugggcu

SEQ ID NO: 238473 - RNA, 59 nt, Homo Sapiens
guacaccccaacagcacccugcacccucuccagaugagagaugagaguacaccccaaca

SEQ ID NO: 238474 - RNA, 59 nt, Homo Sapiens; identical to SEQ ID NO: 238473

SEQ ID NO: 238475 - RNA, 59 nt, Homo Sapiens
guacaccccaacagcacccugcacccucuccagaugagaagaugggagugcccccaaca

SEQ ID NO: 238476 - RNA, 64 nt, Homo Sapiens
cucgaguggugcuguacuuguuaugagugaggcagcagcacaguguguggcauuuacaugguac

SEQ ID NO: 238477 - RNA, 64 nt, Homo Sapiens
auuuuacucuugccugugaaccucaugcaugaaagcagcacauuaaauuguaaaaauacaaaca

SEQ ID NO: 238478 - RNA, 53 nt, Homo Sapiens
uaucaaacagcaagcacugacaagcagcacauucucaagagcacacagguaag

SEQ ID NO: 238479 - RNA, 64 nt, Homo Sapiens
gucuuuuguguuugauuuuguuugauuucccucugcagcacagcgucucuguaaagguuuuuau

SEQ ID NO: 238480 - RNA, 64 nt, Homo Sapiens
gcguuuccuucuuucagaaacucacacacaguuggcagcacauaaucuuccugcaagucaucug

SEQ ID NO: 238481 - RNA, 64 nt, Homo Sapiens
acggagugagacaggaugcccugccccaugcccagcagcacaaccaggcucagcccuucccacc

SEQ ID NO: 238482 - RNA, 64 nt, Homo Sapiens
cuuaugcuucccguagccgugugcacaugccguugcagcacaagggccaggagcagcaggucau

SEQ ID NO: 238483 - RNA, 64 nt, Homo Sapiens
caucacaggauuccuugugugcucuccccacacagcagcacagccauggaugucccaggaggca

SEQ ID NO: 238484 - RNA, 64 nt, Homo Sapiens
cucaggacauggaggugccgugugcucuccugacgcagcacaagggcugcaugagcugcaagug

SEQ ID NO: 238485 - RNA, 64 nt, Homo Sapiens
cugcggaagcugaacccuccgugcgugagauccggcagcacaagaggaugccuucuacacguug

SEQ ID NO: 238486 - RNA, 64 nt, Homo Sapiens
uuucauaaaacuaaccgaaguuuuguuuacugaugcagcacaagagauguaaaaaaaaaaaaaa

SEQ ID NO: 238487 - RNA, 64 nt, Homo Sapiens
cccaaacaaaccaaaauuuaaaugaucagaauuggcagcacaaagaaaacgcccucuccugacu

SEQ ID NO: 238488 - RNA, 64 nt, Homo Sapiens
ccaggaggccacaguguaagacagggccagcugagcagcacaggugugguucccauguucucua

SEQ ID NO: 238489 - RNA, 64 nt, Homo Sapiens
ggaagggcccggcacccuuuggggcccuguagcugcagcacaggaacgcuccuucugaagaaau

SEQ ID NO: 238490 - RNA, 61 nt, Homo Sapiens
ccauauuagguaaaauauugaaaguugcgaaagagcacaaaauuugagcauuugaagauuc

SEQ ID NO: 238491 - RNA, 61 nt, Homo Sapiens
caucuuuuagauuugagcaucgcauaauaacagagcacaagcaauguuuucuuucugguag

SEQ ID NO: 238492 - RNA, 61 nt, Homo Sapiens
caauuccuacuggugaaauuuacuuguauugagagcacacgaauugaaggaguggcaaacu

SEQ ID NO: 238493 - RNA, 56 nt, Homo Sapiens
ugcccaaauacaaaguucuucaugacagagcacagcacuccuguccagcagccuga

SEQ ID NO: 238494 - RNA, 61 nt, Homo Sapiens
uggauuuccgcaccugccugucuccucucccagagcacaguauuugggagacuuugacuau

SEQ ID NO: 238495 - RNA, 61 nt, Homo Sapiens
ugcccucuccuugaccuugagaugaaggucaagagcacagggaccaggccuugguuaggcu

SEQ ID NO: 238496 - RNA, 61 nt, Homo Sapiens
ugcacaacuuugacaucuggucuugcuccauagagcacaacucaagauagaccaugagaca

SEQ ID NO: 238497 - RNA, 61 nt, Homo Sapiens
auggugccgccuuccugaauuggcaguggucagagcacaccugaacccuauccugggcugg

SEQ ID NO: 238498 - RNA, 61 nt, Homo Sapiens
uagggggguguccccccagagacaaagcugcagagcacauuccaugccagacgcucuggcc

SEQ ID NO: 238499 - RNA, 61 nt, Homo Sapiens
ccacacacggcgcaggcugcccgccuccuggagagcacacuucagcugaaacaguaaagcc

SEQ ID NO: 238500 - RNA, 61 nt, Homo Sapiens
aagccacccugccugcugggcaucaccagccagagcacaggucagagcagggcgauuggga

SEQ ID NO: 238501 - RNA, 61 nt, Homo Sapiens
agaaaaacuaaauuauugaacuaaaaaaaaaagagcacaaagacaacuguuccugcuucua

SEQ ID NO: 238502 - RNA, 61 nt, Homo Sapiens
cuucuguaaggagaaaggcauucucccuuuaagagcacauucaauuuuuuguauuugcuuu

SEQ ID NO: 238503 - RNA, 61 nt, Homo Sapiens
ucuagcccucagcaagacagcaccauucuucagagcacacgguggucuucugaaaauggaa

SEQ ID NO: 238504 - RNA, 64 nt, Homo Sapiens; identical to SEQ ID NO: 182536

SEQ ID NO: 238505 - RNA, 64 nt, Homo Sapiens; identical to SEQ ID NO: 182537

SEQ ID NO: 238506 - RNA, 64 nt, Homo Sapiens; identical to SEQ ID NO: 182538

SEQ ID NO: 238507 - RNA, 64 nt, Homo Sapiens; identical to SEQ ID NO: 182539

SEQ ID NO: 238508 - RNA, 64 nt, Homo Sapiens; identical to SEQ ID NO: 182540

SEQ ID NO: 238509 - RNA, 64 nt, Homo Sapiens; identical to SEQ ID NO: 182541

SEQ ID NO: 238510 - RNA, 64 nt, Homo Sapiens; identical to SEQ ID NO: 182542

SEQ ID NO: 238511 - RNA, 64 nt, Homo Sapiens; identical to SEQ ID NO: 182543

SEQ ID NO: 238512 - RNA, 64 nt, Homo Sapiens; identical to SEQ ID NO: 182544

SEQ ID NO: 238513 - RNA, 64 nt, Homo Sapiens; identical to SEQ ID NO: 182545

SEQ ID NO: 238514 - RNA, 64 nt, Homo Sapiens; identical to SEQ ID NO: 182546

SEQ ID NO: 238515 - RNA, 64 nt, Homo Sapiens; identical to SEQ ID NO: 182547

SEQ ID NO: 238516 - RNA, 64 nt, Homo Sapiens; identical to SEQ ID NO: 182548

SEQ ID NO: 238517 - RNA, 64 nt, Homo Sapiens; identical to SEQ ID NO: 182549

SEQ ID NO: 238518 - RNA, 64 nt, Homo Sapiens; identical to SEQ ID NO: 182550

SEQ ID NO: 238519 - RNA, 64 nt, Homo Sapiens; identical to SEQ ID NO: 182551

SEQ ID NO: 238520 - RNA, 64 nt, Homo Sapiens; identical to SEQ ID NO: 182552

SEQ ID NO: 238521 - RNA, 64 nt, Homo Sapiens; identical to SEQ ID NO: 182553

SEQ ID NO: 238522 - RNA, 64 nt, Homo Sapiens; identical to SEQ ID NO: 182554

SEQ ID NO: 238523 - RNA, 64 nt, Homo Sapiens; identical to SEQ ID NO: 182555

SEQ ID NO: 238524 - RNA, 64 nt, Homo Sapiens; identical to SEQ ID NO: 182556

SEQ ID NO: 238525 - RNA, 64 nt, Homo Sapiens; identical to SEQ ID NO: 182557

SEQ ID NO: 238526 - RNA, 64 nt, Homo Sapiens; identical to SEQ ID NO: 182558

SEQ ID NO: 238527 - RNA, 64 nt, Homo Sapiens; identical to SEQ ID NO: 182559

SEQ ID NO: 238528 - RNA, 64 nt, Homo Sapiens; identical to SEQ ID NO: 182560

SEQ ID NO: 238529 - RNA, 64 nt, Homo Sapiens; identical to SEQ ID NO: 182561

SEQ ID NO: 238530 - RNA, 64 nt, Homo Sapiens; identical to SEQ ID NO: 182562

SEQ ID NO: 238531 - RNA, 64 nt, Homo Sapiens; identical to SEQ ID NO: 182563

SEQ ID NO: 238532 - RNA, 64 nt, Homo Sapiens; identical to SEQ ID NO: 182564

SEQ ID NO: 238533 - RNA, 64 nt, Homo Sapiens; identical to SEQ ID NO: 182565

SEQ ID NO: 238534 - RNA, 64 nt, Homo Sapiens; identical to SEQ ID NO: 182566

SEQ ID NO: 238535 - RNA, 64 nt, Homo Sapiens; identical to SEQ ID NO: 182567

SEQ ID NO: 238536 - RNA, 64 nt, Homo Sapiens; identical to SEQ ID NO: 182568

SEQ ID NO: 238537 - RNA, 64 nt, Homo Sapiens; identical to SEQ ID NO: 182569

SEQ ID NO: 238538 - RNA, 64 nt, Homo Sapiens; identical to SEQ ID NO: 182570

SEQ ID NO: 238539 - RNA, 64 nt, Homo Sapiens; identical to SEQ ID NO: 182571

SEQ ID NO: 238540 - RNA, 64 nt, Homo Sapiens; identical to SEQ ID NO: 182572

SEQ ID NO: 238541 - RNA, 64 nt, Homo Sapiens; identical to SEQ ID NO: 182573

SEQ ID NO: 238542 - RNA, 64 nt, Homo Sapiens; identical to SEQ ID NO: 182574

SEQ ID NO: 238543 - RNA, 64 nt, Homo Sapiens; identical to SEQ ID NO: 182575

SEQ ID NO: 238544 - RNA, 64 nt, Homo Sapiens; identical to SEQ ID NO: 182576

SEQ ID NO: 238545 - RNA, 64 nt, Homo Sapiens; identical to SEQ ID NO: 182577

SEQ ID NO: 238546 - RNA, 64 nt, Homo Sapiens; identical to SEQ ID NO: 182578

SEQ ID NO: 238547 - RNA, 64 nt, Homo Sapiens; identical to SEQ ID NO: 182579

SEQ ID NO: 238548 - RNA, 64 nt, Homo Sapiens; identical to SEQ ID NO: 182580

SEQ ID NO: 238549 - RNA, 64 nt, Homo Sapiens; identical to SEQ ID NO: 182581

SEQ ID NO: 238550 - RNA, 64 nt, Homo Sapiens; identical to SEQ ID NO: 182582

SEQ ID NO: 238551 - RNA, 64 nt, Homo Sapiens; identical to SEQ ID NO: 182579

SEQ ID NO: 238552 - RNA, 64 nt, Homo Sapiens; identical to SEQ ID NO: 182584

SEQ ID NO: 238553 - RNA, 64 nt, Homo Sapiens
uggcagccaucaguugcucuggccugucucucggggccuggaaggcugcaguaaaguuacguga

SEQ ID NO: 238554 - RNA, 64 nt, Homo Sapiens
ucggcugcaguaaaguuacgaggacccccuccacggccuggaccaugcagaaugcagcggagcu

SEQ ID NO: 238555 - RNA, 64 nt, Homo Sapiens
guucaaguagcucacucuaagaugaggaaauggaggccuggagauuuguuagcucaaauuuaca

SEQ ID NO: 238556 - RNA, 64 nt, Homo Sapiens
caaagcgaucuccuuguuucgggcuccuccgguuggccuggaucccacucuuccccgccucaca

SEQ ID NO: 238557 - RNA, 61 nt, Homo Sapiens
agcgcaggagcuccgugugacugccccgaggggccuggagcaccugggggcgcgggcgggg

SEQ ID NO: 238558 - RNA, 64 nt, Homo Sapiens
guucucacucccauuuuacagaugagaauacugaggccuggacaggugaagugaccagagagca

SEQ ID NO: 238559 - RNA, 64 nt, Homo Sapiens
ggacaucucucuggcuucugaagagccugaagcuggccuggaccauuccugucccuuuguuacc

SEQ ID NO: 238560 - RNA, 64 nt, Homo Sapiens
gggugacgccacccacagagauuuaaugagcgugggccuggaccuuccccagaugcugccaggc

SEQ ID NO: 238561 - RNA, 64 nt, Homo Sapiens
gugagcauggaggggcagggccaucccuggcuggggccuggagcuggcccuuccucuacuuuuc

SEQ ID NO: 238562 - RNA, 64 nt, Homo Sapiens
gggccugguucccaggcagcaggugggaacccugggccuggaugugaggggcggucaggaaggg

SEQ ID NO: 238563 - RNA, 64 nt, Homo Sapiens
acuagcugccgagcugcacccgugcacccgcuggggccuggagucagggcccacuccaggaggg

SEQ ID NO: 238564 - RNA, 64 nt, Homo Sapiens
aucuggacuucucagccuguuuggcuagaacucaggccuggagucugggucugcccccuccccg

SEQ ID NO: 238565 - RNA, 64 nt, Homo Sapiens
cgcaagcgccuggguggaggcaggguagggcaggggccuggagacgacaugguguugucugugg

SEQ ID NO: 238566 - RNA, 64 nt, Homo Sapiens
agccgacaccugaccuagcacacacugacacaggggccuggacaagcccgcccucucugguccu

SEQ ID NO: 238567 - RNA, 64 nt, Homo Sapiens
uggggugaacagggcuucagucggaccccugcagggccuggacugccuccuccagcagagaccc

SEQ ID NO: 238568 - RNA, 64 nt, Homo Sapiens
ggcaggcucaccugggacuccacuccaagggcuuggccuggaaacccccaggcaggagcacccu

SEQ ID NO: 238569 - RNA, 64 nt, Homo Sapiens
ggguuuccucugcugagacuagaggcaggguuggggccuggacaagcagugccacggugaccca

SEQ ID NO: 238570 - RNA, 64 nt, Homo Sapiens
auaaccaaaauguguaucauucuacaaaaaaauaggccuggacuauuuaaggagugagugucac

SEQ ID NO: 238571 - RNA, 64 nt, Homo Sapiens
aaguucauuuauugggcaggcaaaguccucugcaggccuggaaacccuccgagacaauuacuug

SEQ ID NO: 238572 - RNA, 64 nt, Homo Sapiens
uaggccuugcuguuccucuucgucccacuguccuggccuggagcgggacagacuguugugggaa

SEQ ID NO: 238573 - RNA, 64 nt, Homo Sapiens
gcgcagugcaugcugggugcccacaggaaaagagggccuggaaacucacucugauucuccugug

SEQ ID NO: 238574 - RNA, 64 nt, Homo Sapiens
aaccgcugccuuuaucuugaagucagccacacugggccuggagcccugggcggaguccccgggg

SEQ ID NO: 238575 - RNA, 64 nt, Homo Sapiens
gcaaccagaaagggaugaacuuggcccucuugcgggccuggacaaggucucuuccuuacccuuu

SEQ ID NO: 238576 - RNA, 64 nt, Homo Sapiens
gucgacgugaguuccugggagucuccagagauggggccuggaggccuggaggaaggggccaggc

SEQ ID NO: 238577 - RNA, 64 nt, Homo Sapiens
gaguuccugggagucuccagagauggggccuggaggccuggaggaaggggccaggccucacauu

SEQ ID NO: 238578 - RNA, 64 nt, Homo Sapiens
cuuggggagagguguggagagggaugagucaggaggccuggaggguguggccagcugucucucu

SEQ ID NO: 238579 - RNA, 64 nt, Homo Sapiens
ccuuccuucuauaaauagucggcuucccacuccaggccuggauccugcugagcugggucucugg

SEQ ID NO: 238580 - RNA, 64 nt, Homo Sapiens
uggguccccucccugguucaucccagagccuuugggccuggaguccgccuuguccuuuuucucu

SEQ ID NO: 238581 - RNA, 64 nt, Homo Sapiens
uugcuuuuggcaaaagguacuucaaacaagggagggccuggacugagggggaccaggucuucuu

SEQ ID NO: 238582 - RNA, 64 nt, Homo Sapiens
ggccccggagcccagccagcucugccucucucagggccuggaguccugggggagcucagccagc

SEQ ID NO: 238583 - RNA, 64 nt, Homo Sapiens
ccugggggagcucagccagcucugccuuucucagggccuggaguccuggaugaauccugcaggu

SEQ ID NO: 238584 - RNA, 64 nt, Homo Sapiens
gguggccuguugguuucccucagagggggcagguggccuggagagagaggggcucaggaacugg

SEQ ID NO: 238585 - RNA, 64 nt, Homo Sapiens
acugggagccucguggguggggcagaugcuccgcggccuggaguggcucugccggggcauuggu

SEQ ID NO: 238586 - RNA, 64 nt, Homo Sapiens
acucuguggggucagcacugcugcugcuccugcuggccuggaagagggagccgggaaucggggc

SEQ ID NO: 238587 - RNA, 64 nt, Homo Sapiens
gccaggagucccagacucacucugggagaggaggggccuggaggccacaagcugcaucaggcuc

SEQ ID NO: 238588 - RNA, 64 nt, Homo Sapiens
cagggcauagaaucaguucuccaagacacucucaggccuggaggucuggccuucuaggaucugu

SEQ ID NO: 238589 - RNA, 64 nt, Homo Sapiens
ucaagauuccuggaaagaaggagcccugggguaaggccuggaccgccauccagccuuugccuuu

SEQ ID NO: 238590 - RNA, 64 nt, Homo Sapiens
ccuuucugcacuccgugggcccugggugcgcugaggccuggaggcgucuacacuggcuccacau

SEQ ID NO: 238591 - RNA, 64 nt, Homo Sapiens
uggggucagagaucacugagcugccccucaagggggccuggaacccgggugcuggggucaugcu

SEQ ID NO: 238592 - RNA, 64 nt, Homo Sapiens
agccguccucugagcagggcccaaggcagccaggggccuggaggggccagaggagggugggguc

SEQ ID NO: 238593 - RNA, 64 nt, Homo Sapiens
auucuggcccccggcuccccacacagcugggacuggccuggauggcuguccugggagccccugc

SEQ ID NO: 238594 - RNA, 51 nt, Homo Sapiens
aggaucuaucugaggccuagaggccuggagcuuggggugaggaagagggag

SEQ ID NO: 238595 - RNA, 64 nt, Homo Sapiens
caaagaacagagugaugggaaagugacaugagaaggccuggaggcugauucugauauagacuca

SEQ ID NO: 238596 - RNA, 64 nt, Homo Sapiens
gcacccgccagugagagcugaucauucugggcuuggccuggacaggcugagcuccuuccucugc

SEQ ID NO: 238597 - RNA, 64 nt, Homo Sapiens
gaguucacuguagacccgucuggaaccagggggaggccuggaagggccuuggguccccauccuc

SEQ ID NO: 238598 - RNA, 64 nt, Homo Sapiens
ucacggcaagaccccccucuuccugggacagacgggccuggacugagccagcaccacacgucca

SEQ ID NO: 238599 - RNA, 64 nt, Homo Sapiens
cagcccugagccagaggcagcacagggagacgggggccuggagccaccccagaacaagccgaca

SEQ ID NO: 238600 - RNA, 64 nt, Homo Sapiens
cugcugccacgugccauaguuggccuggauucguggccuggauugcgaggggugauggcaacgg

SEQ ID NO: 238601 - RNA, 64 nt, Homo Sapiens
cguggccuggauucugcugcgugauggcaacgguggccuggauuucaaggcagccaggcgaggg

SEQ ID NO: 238602 - RNA, 64 nt, Homo Sapiens
ccucuaucugacucucgcugugggacagggaccgggccuggaaagggggugaagggaagugucu

SEQ ID NO: 238603 - RNA, 64 nt, Homo Sapiens
agggagaugggauugggcaccucccccgugcuggggccuggauuuuuguaaauaaauuucccaa

SEQ ID NO: 238604 - RNA, 64 nt, Homo Sapiens
aagcagguccgaccccuccugugcauuugcgucuggccuggaguucuuaccugggcuucucugu

SEQ ID NO: 238605 - RNA, 64 nt, Homo Sapiens
gcuggugggcagcacugucaggguucaggggcauggccuggagguagagggggagggacugucu

SEQ ID NO: 238606 - RNA, 64 nt, Homo Sapiens
agcggugugaagcauccgguccuuugaacagaagggccuggaaggccccuggggcugagaaagg

SEQ ID NO: 238607 - RNA, 64 nt, Homo Sapiens
aaggccccuggggcugagaaaggguccgcccgguggccuggaggcaggcgccgggagcgcagua

SEQ ID NO: 238608 - RNA, 64 nt, Homo Sapiens
gugagguccuggugccuaucugccuggaggcaaaggccuggacagcuugacuuguggggcagga

SEQ ID NO: 238609 - RNA, 64 nt, Homo Sapiens
gagggccaccuccacacccacccccucuggagaaggccuggaagagcugagaccuugcuuugag

SEQ ID NO: 238610 - RNA, 64 nt, Homo Sapiens
caggggcagaggugacgacagagagacugaggaaggccuggaggucuauacagcggaaccacaa

SEQ ID NO: 238611 - RNA, 64 nt, Homo Sapiens
agaccauugugauaccugacucuuuguggcccagggccuggaccugcuuccuagcacauuccau

SEQ ID NO: 238612 - RNA, 64 nt, Homo Sapiens
uagugugauuagaacacugacaccauuuggcuucggccuggaaagagugucauguuagcugagu

SEQ ID NO: 238613 - RNA, 64 nt, Homo Sapiens
ggccacgauggcugcugaaugggccucagggacaggccuggaaaaaggccaggggaaacugggg

SEQ ID NO: 238614 - RNA, 64 nt, Homo Sapiens
ccccucgaaggagagggcgcccuggacaccccucggccuggacaccucgggagcagaagcccgg

SEQ ID NO: 238615 - RNA, 64 nt, Homo Sapiens
ccccucggccuggacaccccgggagcagaagcccggccuggacagcccugccuccacccaccuc

SEQ ID NO: 238616 - RNA, 64 nt, Homo Sapiens
aauucucuuguccaaauaguggauugggcagacuggccuggaggaaaugcuagaacagagggaa

SEQ ID NO: 238617 - RNA, 64 nt, Homo Sapiens
aggucugugaaauaauccaggagaacaaugaugaggccuggauuggauucgguaaaaagagggg

SEQ ID NO: 238618 - RNA, 64 nt, Homo Sapiens
acuccagccuggaagacaccaugacacacagugaggccuggauggggaaagaguccugcuguug

SEQ ID NO: 238619 - RNA, 64 nt, Homo Sapiens
uauuccagcuuuauucacacaaaucaugucuguuggccuggaaauuggaaaaccaguuaaacca

SEQ ID NO: 238620 - RNA, 64 nt, Homo Sapiens
gccauggucguggcuguggccaugggagaggaggggccuggaguugccgaggaagucacagaaa

SEQ ID NO: 238621 - RNA, 64 nt, Homo Sapiens
gccgaggaagucacagaaaaugaccaacugauggggccuggagugcaggaggggcagcuccucu

SEQ ID NO: 238622 - RNA, 64 nt, Homo Sapiens
ucggccccgucuccugaggguccugcuggugaccggccuggaccuuggcccuacagcccuggag

SEQ ID NO: 238623 - RNA, 64 nt, Homo Sapiens
aaccccgucugcuccucccucccgcagagacuggggccuggacuggacaugagagccccuuggu

SEQ ID NO: 238624 - RNA, 64 nt, Homo Sapiens
aaggucccaguccaucuccuggaggcggacagauggccuggaaaccucuggcuaaucgggccau

SEQ ID NO: 238625 - RNA, 64 nt, Homo Sapiens
ccaagagacagcgacccaaagccgaaggacagguggccuggaaagaucccgcccaggucuggga

SEQ ID NO: 238626 - RNA, 64 nt, Homo Sapiens
aggauguugauggggucuguccacgggggaacaaggccuggaugacagagaggaaacaagcuuc

SEQ ID NO: 238627 - RNA, 64 nt, Homo Sapiens
accccagaucccacaucccccauguggaauccauggccuggaccugaaagaaaacgccacuggc

SEQ ID NO: 238628 - RNA, 64 nt, Homo Sapiens
gcccggcacggccucaggcccccgagggacagucggccuggaccggaccucuccuuucgccccc

SEQ ID NO: 238629 - RNA, 64 nt, Homo Sapiens
cccagcuccugcugcugucccagucuugggcuggggccuggaaagaggaagaggcugccugggg

SEQ ID NO: 238630 - RNA, 64 nt, Homo Sapiens
gucaacaugugugaucuuugugucuccuuuuugccaagcacauucugauuuucuuguuggaaca

SEQ ID NO: 238631 - RNA, 64 nt, Homo Sapiens
cuagaggggcuaagcuugacugcccuuagccaggcaagcacaguaauguguguuuuguucagca

SEQ ID NO: 238632 - RNA, 64 nt, Homo Sapiens
ggugcaggcaccuggccaugcuggcugggcggcccaagcacagcccugacuaggaugacagcag

SEQ ID NO: 238633 - RNA, 64 nt, Homo Sapiens
agcagucugccuccccuaugggacucccuucuaccaagcacaugagcucucuaacagggugggg

SEQ ID NO: 238634 - RNA, 64 nt, Homo Sapiens
aucuugacaucuuacauuccaauacauuaucaagcaagcacaaguaugcugguaguagccucuu

SEQ ID NO: 238635 - RNA, 64 nt, Homo Sapiens
ggcacaggcgaagccauuggaagcacuucaggaacaagcacacagcugugggacuugaacaugc

SEQ ID NO: 238636 - RNA, 64 nt, Homo Sapiens
guauguucaguagguugaacauaacauucugaaucaagcacacuaaaauuuuaauuucuacaaa

SEQ ID NO: 238637 - RNA, 64 nt, Homo Sapiens
uugucaacaugcauugccaucugcaagcgagguccaagcacauccugcuacccacugccagaug

SEQ ID NO: 238638 - RNA, 64 nt, Homo Sapiens
guugacauuggccaacggggaacgcauccggcuccaagcacacugugcccugcucuuugaggca

SEQ ID NO: 238639 - RNA, 64 nt, Homo Sapiens
uggagaaugucagaucaaguuagaaagucaaauacaagcacauccugugaacggugaugugugu

SEQ ID NO: 238640 - RNA, 64 nt, Homo Sapiens
gcugccuguugugaauguccggagcgggugcucacaagcacagaggcggugggggguggugggg

SEQ ID NO: 238641 - RNA, 64 nt, Homo Sapiens
aaguccuggagucuuuggaaggugucucuucucccaagcacaaguggaauaaaccuguuuucca

SEQ ID NO: 238642 - RNA, 64 nt, Homo Sapiens
ccuucugagccauuugacguagaggaaaagccugcaagcacauuuuguggaaagaggaguuggu

SEQ ID NO: 238643 - RNA, 64 nt, Homo Sapiens
gugcaaguauucuuaacucuuuacgccuaaugaacaagcacaguuuuucaauggugaagaaaaa

SEQ ID NO: 238644 - RNA, 64 nt, Homo Sapiens
auugagauaaauaagaugcuucuauccauuuauucaagcacauauuggucaccuacugugugcc

SEQ ID NO: 238645 - RNA, 64 nt, Homo Sapiens
ccaagagggaggguagcucuuccgccaccaggggcaagcacagguccugguggccccacgccac

SEQ ID NO: 238646 - RNA, 64 nt, Homo Sapiens
aaaguacucacacuggagaucuccuuuagguuuucaagcacauggugugggaaaacuuacuugu

SEQ ID NO: 238647 - RNA, 64 nt, Homo Sapiens
aaagaacucacacuggagaacuucuguagguuuucaagcacaugauguggaaaaaccuacauau

SEQ ID NO: 238648 - RNA, 64 nt, Homo Sapiens
gcuggacccugcaggguggcucccuccuccccaucaagcacaagagagggcccaggaaaaaagg

SEQ ID NO: 238649 - RNA, 64 nt, Homo Sapiens
gucugggguagggagacagcgacuuguccaaggucaagcacagagggagagguucaggagucag

SEQ ID NO: 238650 - RNA, 64 nt, Homo Sapiens
uuacaccuguguugccacaaagaacgacuuuagacaagcacauguuccacauauccacaaacac

SEQ ID NO: 238651 - RNA, 64 nt, Homo Sapiens
uaacuagauuuagugccugcuucuuuuucuacugcaagcacaugccucuauuaagaucaguguc

SEQ ID NO: 238652 - RNA, 64 nt, Homo Sapiens
augccugaaaucccacuacuuugggaggcugaggcuggagaauugcuugaggcuagugagcugu

SEQ ID NO: 238653 - RNA, 64 nt, Homo Sapiens
caguuuauacucuuaauuuaauuuucuuucugagcuggagaacuggcuuugcacuuugguuaca

SEQ ID NO: 238654 - RNA, 64 nt, Homo Sapiens
aaacaauaaagacuuuaccugucuaauggaaaaccuggagaagucgucaggaaccagacuacag

SEQ ID NO: 238655 - RNA, 64 nt, Homo Sapiens
ggagaagucgucaggaaccagacuacaguggacccuggagaaccuugaagaacauuuuuccuuu

SEQ ID NO: 238656 - RNA, 64 nt, Homo Sapiens
aacuagaauauccucagcagguggccuggccacucuggagaaagaaacccaaggaaagugagca

SEQ ID NO: 238657 - RNA, 64 nt, Homo Sapiens
accucggcaagaucaccagcacugaggggcccagcuggagaaugauucugcuacaaaaggagac

SEQ ID NO: 238658 - RNA, 64 nt, Homo Sapiens
gaagaauugugccuugcauaugauuuuucuaaagcuggagaaagucagggcugggccauguggu

SEQ ID NO: 238659 - RNA, 64 nt, Homo Sapiens
caggagcucacccagggcuggggugagcgagaggcuggagaacaggccaggauagccaagcccu

SEQ ID NO: 238660 - RNA, 64 nt, Homo Sapiens
ccauguacuuuggaaucucccaacugauaaagagcuggagaacuggccacgaugaaacagauuu

SEQ ID NO: 238661 - RNA, 64 nt, Homo Sapiens
cggggucucugaagguccucgucuggccaggaggcuggagaauggaucaagcucaucgacuuug

SEQ ID NO: 238662 - RNA, 64 nt, Homo Sapiens
gauucuggucaacugguggagauuggcugacacccuggagaagccgaaaccagagagccuuuug

SEQ ID NO: 238663 - RNA, 64 nt, Homo Sapiens
uguggaugggccgaccuggcugggacucgugaaucuggagaagagcuggagaauggauaguauu

SEQ ID NO: 238664 - RNA, 64 nt, Homo Sapiens
cgaccuggcugggacucgugaaucuggagaagagcuggagaauggauaguauugucuguauuug

SEQ ID NO: 238665 - RNA, 64 nt, Homo Sapiens
cugcacccuacaggcaaccacaaguggagaaaugcuggagaaagcaaagcaaaagcuagagaag

SEQ ID NO: 238666 - RNA, 64 nt, Homo Sapiens
ugugguugcagcccacuggagguuucagaauucacuggagaaggcaaggaaaggcaggaaugag

SEQ ID NO: 238667 - RNA, 64 nt, Homo Sapiens
aaggagguuagaauguaauuaaggcucuguuugccuggagaagcccaguuaguuggaguuuuua

SEQ ID NO: 238668 - RNA, 64 nt, Homo Sapiens
gucucauaccuugcagucuggggaagucuugugucuggagaauagaaauuucuggcauaagcag

SEQ ID NO: 238669 - RNA, 64 nt, Homo Sapiens
agcaaguuguggggagccagugagaggggcagggcuggagaaggaaagaaagcauuguuuuaau

SEQ ID NO: 238670 - RNA, 64 nt, Homo Sapiens
gugugaacccaggaggcggauugggaggcugaggcuggagaauggcgccuguagucccagcagc

SEQ ID NO: 238671 - RNA, 64 nt, Homo Sapiens
cagcaggagccucucaguuccuuccaagguuuuucuggagaagagacgccugaagucacagcuc

SEQ ID NO: 238672 - RNA, 64 nt, Homo Sapiens
uuccauccauucuguuacacuuuguauuuucuaacuggagaaaagagugaggaacagaauguuu

SEQ ID NO: 238673 - RNA, 64 nt, Homo Sapiens
agggaccuuggaggaugaaggcgaguaugugacacuggagaaaaguggaccaggcaugucuuuu

SEQ ID NO: 238674 - RNA, 64 nt, Homo Sapiens
gagaaguuucuggcccuggcugaccccaaagagccuggagaagcugaugcuuugcuucaaaucc

SEQ ID NO: 238675 - RNA, 64 nt, Homo Sapiens
cugcuucaugcucagcccugacuggugcuauaggcuggagaagcucacccaauaaacauuaaga

SEQ ID NO: 238676 - RNA, 64 nt, Homo Sapiens
uggagcagcucauuucuugggaggcugcugugcucuggagaagccagaugcugacaggcccugg

SEQ ID NO: 238677 - RNA, 64 nt, Homo Sapiens
cuacaaauggccuaugucucagugaauuggagcacuggagaauccugagccauuaggagacauu

SEQ ID NO: 238678 - RNA, 64 nt, Homo Sapiens
uggacucugcucauuauucuuugacccagaaagacuggagaagguaugugcuuuaagugcugcu

SEQ ID NO: 238679 - RNA, 64 nt, Homo Sapiens
auggacuuugaucugccauacggagguucggaaccuggagaacggcugugauaaguagguuuug

SEQ ID NO: 238680 - RNA, 64 nt, Homo Sapiens
cucugcucagcccugagaguaguguucgcucgcgcuggagaaggugccugccgaggcgggacag

SEQ ID NO: 238681 - RNA, 64 nt, Homo Sapiens
guccugcuuucucuggagucagcagguguccgggcuggagaagagugauugaaagccauugagg

SEQ ID NO: 238682 - RNA, 64 nt, Homo Sapiens
ucuuauuccuauaagcuauguguucagacugaaacuggagaaauuaugacuauuuuauuuauag

SEQ ID NO: 238683 - RNA, 64 nt, Homo Sapiens
accuuaugaaugaauuguguuucucuguccugagcuggagaagggaaugagcaggcugacacgu

SEQ ID NO: 238684 - RNA, 64 nt, Homo Sapiens
ggugacauuuuuuuaauuucacuugggccugaaacuggagaagguguugcugaacuggcaacuu

SEQ ID NO: 238685 - RNA, 64 nt, Homo Sapiens
cccuuaggaagacuaugagacuucgugacagucucuggagaaauaacagaaagcaucagcucug

SEQ ID NO: 238686 - RNA, 64 nt, Homo Sapiens
aacgucauugcgauuuaucuauuguucaucgcugcuggagaaugaacuacuuuuuggucaugaa

SEQ ID NO: 238687 - RNA, 64 nt, Homo Sapiens
acuuccuugcaggagugacuucucagaaccacuccuggagaaaggcacagcacuccuguaacug

SEQ ID NO: 238688 - RNA, 64 nt, Homo Sapiens
accaccacuguccucgaugugcagggggucaccgcuggagaagaugggcuccuccuugccuaau

SEQ ID NO: 238689 - RNA, 64 nt, Homo Sapiens
cuuagggauugugaaaauaguguucuccagaggccuggagaacagggaucuuacaacuuuacuu

SEQ ID NO: 238690 - RNA, 64 nt, Homo Sapiens
uggggagaugcgguucacaaauucuuggaaaagccuggagaagcaacaggcuacagugucccug

SEQ ID NO: 238691 - RNA, 64 nt, Homo Sapiens
ugauuaaagauacggaguccagcaggaagauagccuggagaagggcuucccuuucuacuccagc

SEQ ID NO: 238692 - RNA, 64 nt, Homo Sapiens
agggaaugguucauuuacucuuaaucuuuaugcccuggagaagaccuacuugaacagggcauau

SEQ ID NO: 238693 - RNA, 64 nt, Homo Sapiens
uagagcccugauuaacuucaaggacaaacacuggcuggagaaagccagacugaugggaaugaga

SEQ ID NO: 238694 - RNA, 64 nt, Homo Sapiens
cugguuggagagcuagaaccuggagagcuagaaccuggagaacuagaaccuggagggcuagaac

SEQ ID NO: 238695 - RNA, 64 nt, Homo Sapiens
gaaccuggagggaaugaaccuggagggcuagaaccuggagaaugagaaaaauuuacauggcaaa

SEQ ID NO: 238696 - RNA, 64 nt, Homo Sapiens
agcugccuggaugagaaacagagugggccccgggcuggagaaagcccccuaagagacacauaca

SEQ ID NO: 238697 - RNA, 64 nt, Homo Sapiens
gugguugccugggggcuuuucagaacauucagcucuggagaacacccccucuucuucugaagau

SEQ ID NO: 238698 - RNA, 64 nt, Homo Sapiens
gggaccagagagucugccccacugucagcaaagccuggagaaaucaaucaucuaaaagccagcc

SEQ ID NO: 238699 - RNA, 64 nt, Homo Sapiens
ugacaggacagcuuuaagccaccugcggaaggagcuggagaaucgcuacaagcagaggcugaac

SEQ ID NO: 238700 - RNA, 64 nt, Homo Sapiens
uggcaggacagcuuuaagccaccugcggaaggagcuggagaaucgcuacaagcagaggcugaac

SEQ ID NO: 238701 - RNA, 64 nt, Homo Sapiens
ugaaaauucugauuaagccucugggcccuacagccuggagaaccuggagaauccuacacccaca

SEQ ID NO: 238702 - RNA, 64 nt, Homo Sapiens
ugauuaagccucugggcccuacagccuggagaaccuggagaauccuacacccacagaacccggc

SEQ ID NO: 238703 - RNA, 64 nt, Homo Sapiens
caucgaccugagggggcccaucccugcccaccuccuggagaacacguuggcucaguccuggguc

SEQ ID NO: 238704 - RNA, 64 nt, Homo Sapiens
agaggaugaggucaauuuccugaugcauauugcccuggagaagaucgccuucauccccuuuggc

SEQ ID NO: 238705 - RNA, 64 nt, Homo Sapiens
uauucuuagagcuuucuaaauuucucagugcacacuggagaagguaaccuggaagaauacagcc

SEQ ID NO: 238706 - RNA, 64 nt, Homo Sapiens
caagucuuugccauggcacgagugacaugggccucuggagaaugcugaaaugcagacagcugug

SEQ ID NO: 238707 - RNA, 64 nt, Homo Sapiens
guucuccugcguggcaguccugauuuccaugcuucuggagaauccauuucguuaacacugaaag

SEQ ID NO: 238708 - RNA, 64 nt, Homo Sapiens
cagccuuuguauggaggcccaaccgcgcucccgucuggagaagcggcuuccgggguguggcugc

SEQ ID NO: 238709 - RNA, 64 nt, Homo Sapiens
agcuguacacugaagagucaucagagaguucacacuggagaaagaccuuuugaaugcagcauuu

SEQ ID NO: 238710 - RNA, 64 nt, Homo Sapiens
agcuccacacucauuagucaugagagaguucauacuggagaaaagccuuaugagugcagugaau

SEQ ID NO: 238711 - RNA, 64 nt, Homo Sapiens
agguccaaccucauucaccaucagcgaguucauacuggagaaaggcaugagugcgggcagugug

SEQ ID NO: 238712 - RNA, 64 nt, Homo Sapiens
aaaucuagccuuauuauacaucugagaguucacacuggagaaaggccuuaugagugcagugacu

SEQ ID NO: 238713 - RNA, 64 nt, Homo Sapiens
aacuccagccuuauuaaacacuugagaguucacacuggagaaaggccauaugaaugcauugauu

SEQ ID NO: 238714 - RNA, 64 nt, Homo Sapiens
gucuggucauguggaggugggguuuauugggaugcuggagaagagcugccaggaaguguuuuuu

SEQ ID NO: 238715 - RNA, 64 nt, Homo Sapiens
cuggcucugucaagcugggucaggggccuugaaacuggagaaguggaagucuaugguuggucug

SEQ ID NO: 238716 - RNA, 64 nt, Homo Sapiens
uggaguagucagaaaacuuuaagggcagagaguccuggagaaggacagaggguguuagaaaaca

SEQ ID NO: 238717 - RNA, 64 nt, Homo Sapiens
ggucagagccauaucaaguuaaaugcacaagcugcuggagaaggcagaccuggggacagaggug

SEQ ID NO: 238718 - RNA, 64 nt, Homo Sapiens
guguccccaccagcccauacgucuggagaaaccccuggagaagggggcaggccgcugaccugag

SEQ ID NO: 238719 - RNA, 64 nt, Homo Sapiens
cccuggagaagggugucccccgcugaccugaggucuggagaaacagccggaggaacgggcaggc

SEQ ID NO: 238720 - RNA, 64 nt, Homo Sapiens; identical to SEQ ID NO: 95053

SEQ ID NO: 238721 - RNA, 64 nt, Homo Sapiens; identical to SEQ ID NO: 95054

SEQ ID NO: 238722 - RNA, 64 nt, Homo Sapiens; identical to SEQ ID NO: 95055

SEQ ID NO: 238723 - RNA, 64 nt, Homo Sapiens; identical to SEQ ID NO: 95056

SEQ ID NO: 238724 - RNA, 64 nt, Homo Sapiens; identical to SEQ ID NO: 95057

SEQ ID NO: 238725 - RNA, 64 nt, Homo Sapiens; identical to SEQ ID NO: 95058

SEQ ID NO: 238726 - RNA, 64 nt, Homo Sapiens; identical to SEQ ID NO: 95059

SEQ ID NO: 238727 - RNA, 64 nt, Homo Sapiens; identical to SEQ ID NO: 95060

SEQ ID NO: 238728 - RNA, 64 nt, Homo Sapiens; identical to SEQ ID NO: 95061

SEQ ID NO: 238729 - RNA, 64 nt, Homo Sapiens; identical to SEQ ID NO: 95062

SEQ ID NO: 238730 - RNA, 64 nt, Homo Sapiens; identical to SEQ ID NO: 95063

SEQ ID NO: 238731 - RNA, 64 nt, Homo Sapiens; identical to SEQ ID NO: 95064

SEQ ID NO: 238732 - RNA, 64 nt, Homo Sapiens; identical to SEQ ID NO: 95065

SEQ ID NO: 238733 - RNA, 64 nt, Homo Sapiens; identical to SEQ ID NO: 95066

SEQ ID NO: 238734 - RNA, 64 nt, Homo Sapiens; identical to SEQ ID NO: 95067

SEQ ID NO: 238735 - RNA, 64 nt, Homo Sapiens; identical to SEQ ID NO: 95068

SEQ ID NO: 238736 - RNA, 64 nt, Homo Sapiens; identical to SEQ ID NO: 95069

SEQ ID NO: 238737 - RNA, 64 nt, Homo Sapiens; identical to SEQ ID NO: 95070

SEQ ID NO: 238738 - RNA, 64 nt, Homo Sapiens; identical to SEQ ID NO: 95071

SEQ ID NO: 238739 - RNA, 64 nt, Homo Sapiens; identical to SEQ ID NO: 95072

SEQ ID NO: 238740 - RNA, 64 nt, Homo Sapiens; identical to SEQ ID NO: 95073

SEQ ID NO: 238741 - RNA, 64 nt, Homo Sapiens; identical to SEQ ID NO: 95074

SEQ ID NO: 238742 - RNA, 64 nt, Homo Sapiens; identical to SEQ ID NO: 95075

SEQ ID NO: 238743 - RNA, 64 nt, Homo Sapiens; identical to SEQ ID NO: 95076

SEQ ID NO: 238744 - RNA, 64 nt, Homo Sapiens; identical to SEQ ID NO: 95077

SEQ ID NO: 238745 - RNA, 64 nt, Homo Sapiens; identical to SEQ ID NO: 95078

SEQ ID NO: 238746 - RNA, 64 nt, Homo Sapiens; identical to SEQ ID NO: 95079

SEQ ID NO: 238747 - RNA, 64 nt, Homo Sapiens
auucuuccuugaggcucacaucaugugucccuaucacucuuacuacucuggucagucuccagcu

SEQ ID NO: 238748 - RNA, 64 nt, Homo Sapiens
cucugcuucauuugugccucccucaccaugaccccacucuuaccauaguggcuacauuacuuca

SEQ ID NO: 238749 - RNA, 64 nt, Homo Sapiens
caaucaccauucugauagaaagugcuuaaaccaccacucuuaggucugcucacucuuagaacac

SEQ ID NO: 238750 - RNA, 64 nt, Homo Sapiens
agaaagugcuuaaaccaccacucuuaggucugcucacucuuagaacacacaauggaagaggaag

SEQ ID NO: 238751 - RNA, 64 nt, Homo Sapiens
gaagcugcaacagacuuucucugcucaugauuugcacucuuaggguuuuguuagcccuuuugua

SEQ ID NO: 238752 - RNA, 64 nt, Homo Sapiens
aggacgccaugugagcauuaggaaaaaaaauacucacucuuacuaacaauuuuuauacagaaaa

SEQ ID NO: 238753 - RNA, 64 nt, Homo Sapiens
uuccauacuacuauauucuuccaaauauuuggaacacucuuagaauucccauuuaauaaaccau

SEQ ID NO: 238754 - RNA, 64 nt, Homo Sapiens
acaucacuagaaaucauucuuugucucaaguucacacucuuagcauagaauauuauugacuagg

SEQ ID NO: 238755 - RNA, 64 nt, Homo Sapiens; identical to SEQ ID NO: 87097

SEQ ID NO: 238756 - RNA, 64 nt, Homo Sapiens; identical to SEQ ID NO: 87098

SEQ ID NO: 238757 - RNA, 64 nt, Homo Sapiens; identical to SEQ ID NO: 87099

SEQ ID NO: 238758 - RNA, 64 nt, Homo Sapiens; identical to SEQ ID NO: 87100

SEQ ID NO: 238759 - RNA, 64 nt, Homo Sapiens; identical to SEQ ID NO: 87101

SEQ ID NO: 238760 - RNA, 64 nt, Homo Sapiens; identical to SEQ ID NO: 87102

SEQ ID NO: 238761 - RNA, 64 nt, Homo Sapiens; identical to SEQ ID NO: 87103

SEQ ID NO: 238762 - RNA, 64 nt, Homo Sapiens; identical to SEQ ID NO: 87104

SEQ ID NO: 238763 - RNA, 64 nt, Homo Sapiens; identical to SEQ ID NO: 87105

SEQ ID NO: 238764 - RNA, 64 nt, Homo Sapiens; identical to SEQ ID NO: 87106

SEQ ID NO: 238765 - RNA, 64 nt, Homo Sapiens; identical to SEQ ID NO: 87107

SEQ ID NO: 238766 - RNA, 64 nt, Homo Sapiens; identical to SEQ ID NO: 87108

SEQ ID NO: 238767 - RNA, 64 nt, Homo Sapiens; identical to SEQ ID NO: 87109

SEQ ID NO: 238768 - RNA, 64 nt, Homo Sapiens; identical to SEQ ID NO: 87110

SEQ ID NO: 238769 - RNA, 64 nt, Homo Sapiens; identical to SEQ ID NO: 87111

SEQ ID NO: 238770 - RNA, 64 nt, Homo Sapiens; identical to SEQ ID NO: 87112

SEQ ID NO: 238771 - RNA, 64 nt, Homo Sapiens; identical to SEQ ID NO: 87113

SEQ ID NO: 238772 - RNA, 64 nt, Homo Sapiens; identical to SEQ ID NO: 87114

SEQ ID NO: 238773 - RNA, 64 nt, Homo Sapiens; identical to SEQ ID NO: 87115

SEQ ID NO: 238774 - RNA, 64 nt, Homo Sapiens; identical to SEQ ID NO: 87116

SEQ ID NO: 238775 - RNA, 64 nt, Homo Sapiens; identical to SEQ ID NO: 87117

SEQ ID NO: 238776 - RNA, 64 nt, Homo Sapiens; identical to SEQ ID NO: 87118

SEQ ID NO: 238777 - RNA, 64 nt, Homo Sapiens; identical to SEQ ID NO: 87119

SEQ ID NO: 238778 - RNA, 64 nt, Homo Sapiens; identical to SEQ ID NO: 87120

SEQ ID NO: 238779 - RNA, 64 nt, Homo Sapiens; identical to SEQ ID NO: 87121

SEQ ID NO: 238780 - RNA, 64 nt, Homo Sapiens; identical to SEQ ID NO: 87122

SEQ ID NO: 238781 - RNA, 64 nt, Homo Sapiens; identical to SEQ ID NO: 87123

SEQ ID NO: 238782 - RNA, 64 nt, Homo Sapiens; identical to SEQ ID NO: 87124

SEQ ID NO: 238783 - RNA, 64 nt, Homo Sapiens; identical to SEQ ID NO: 87125

SEQ ID NO: 238784 - RNA, 64 nt, Homo Sapiens; identical to SEQ ID NO: 87126

SEQ ID NO: 238785 - RNA, 64 nt, Homo Sapiens; identical to SEQ ID NO: 87127

SEQ ID NO: 238786 - RNA, 64 nt, Homo Sapiens; identical to SEQ ID NO: 87128

SEQ ID NO: 238787 - RNA, 64 nt, Homo Sapiens; identical to SEQ ID NO: 87129

SEQ ID NO: 238788 - RNA, 64 nt, Homo Sapiens; identical to SEQ ID NO: 87130

SEQ ID NO: 238789 - RNA, 64 nt, Homo Sapiens; identical to SEQ ID NO: 87131

SEQ ID NO: 238790 - RNA, 64 nt, Homo Sapiens; identical to SEQ ID NO: 87132

SEQ ID NO: 238791 - RNA, 64 nt, Homo Sapiens; identical to SEQ ID NO: 87133

SEQ ID NO: 238792 - RNA, 64 nt, Homo Sapiens; identical to SEQ ID NO: 87134

SEQ ID NO: 238793 - RNA, 64 nt, Homo Sapiens; identical to SEQ ID NO: 87135

SEQ ID NO: 238794 - RNA, 64 nt, Homo Sapiens; identical to SEQ ID NO: 87136

SEQ ID NO: 238795 - RNA, 64 nt, Homo Sapiens
aaaugaaauuaagugauccaaagcugcugaaguauguuugaacucuccagugcccuauagcugc

SEQ ID NO: 238796 - RNA, 64 nt, Homo Sapiens
acaaucugauauaaaucugaauacaggauuauucuguuugaaaacuuugcuaugugugaacugu

SEQ ID NO: 238797 - RNA, 64 nt, Homo Sapiens
caaagcugugcagucaggcacagagugagucagcuguuugaaccuccugggaccauaauaggcu

SEQ ID NO: 238798 - RNA, 64 nt, Homo Sapiens
cuuuguaacuuguuuguaugaaagaaugaucuguuguuugaaacguaugguguuuccuuagccu

SEQ ID NO: 238799 - RNA, 64 nt, Homo Sapiens
uuuaaaguacuuuugguuauuuagaaguaacuaauguuugaaauaaugcaucuuccaugaugca

SEQ ID NO: 238800 - RNA, 64 nt, Homo Sapiens
cuuaaacacugucacaagauaacgaaaguaaagauguuugaauaauuucaacuuauauuauaag

SEQ ID NO: 238801 - RNA, 64 nt, Homo Sapiens
cauguauuuugaaaaauaucuuuugcauuuaaguuguuugaagguauuauuaagaaugaaugau

SEQ ID NO: 238802 - RNA, 64 nt, Homo Sapiens
ugugcaguuuucaacauuuuuccuaugggaacuauguuugaauagagagcugaggaauaugugu

SEQ ID NO: 238803 - RNA, 64 nt, Homo Sapiens
ugcuuggacuaccuauaaauggacuugcuucuuguguuugaaacacucgugugcaugagaaugu

SEQ ID NO: 238804 - RNA, 64 nt, Homo Sapiens
ucgaaaguaaaaaagauggaaguguauugguuucuguuugaauuuucaaaggcuuccaaugugg

SEQ ID NO: 238805 - RNA, 64 nt, Homo Sapiens
aggaaagaguagacccaaagauguuauuuucugcuguuugaauuuugucuccccacccccaacu

SEQ ID NO: 238806 - RNA, 64 nt, Homo Sapiens
uuuuaauuagcgcauucucuauccaacauuuaauuguuugaaagccuccauauaguuagauugu

SEQ ID NO: 238807 - RNA, 64 nt, Homo Sapiens
ccacagacagguucccuccauuggcagcccauuguguuugaaauuccaugucggguuuacuugg

SEQ ID NO: 238808 - RNA, 64 nt, Homo Sapiens
ucgugaaacgagugaugccugaagaucucagugauguuugaaccuucuguguaacuuuuuauua

SEQ ID NO: 238809 - RNA, 64 nt, Homo Sapiens
uuuaagagagauguuuuuggucaaguaauauaccuguuugaagccacagagaauauacuuuucc

SEQ ID NO: 238810 - RNA, 64 nt, Homo Sapiens
aaaagacauagaugguagacauuuuguuucaaaauguuugaaacucauugaagaaucaauacau

SEQ ID NO: 238811 - RNA, 64 nt, Homo Sapiens
auauaauagcacuggagauuaugcaaacaaguaauguuugaaauugucucaguguuugguuauu

SEQ ID NO: 238812 - RNA, 64 nt, Homo Sapiens
augugauaguaccugguuguuccagccacugugauguuugaaauucuguuccugcccuguugcu

SEQ ID NO: 238813 - RNA, 64 nt, Homo Sapiens
uauaaaugugugucuauaugcuuuccuuuaaauauguuugaaaagauguuugaaacuugauuau

SEQ ID NO: 238814 - RNA, 64 nt, Homo Sapiens
ucuauaugcuuuccuuuaaauauguuugaaaagauguuugaaacuugauuauacuauuuauaau

SEQ ID NO: 238815 - RNA, 64 nt, Homo Sapiens
agugaaaugccacuuaguucucaauugaugacaguguuugaaucaucauaaaaaaaauaccugc

SEQ ID NO: 238816 - RNA, 64 nt, Homo Sapiens
uucaaggcucugcuauagcggaaauucuuaauaauguuugaagaagggccccaugauuucauuu

SEQ ID NO: 238817 - RNA, 64 nt, Homo Sapiens
uaccuuucuggguguuucuuguaaacuauacuccuguuugaauguuaaacuuuguugcuaaagu

SEQ ID NO: 238818 - RNA, 64 nt, Homo Sapiens
uguuaaacuuuguugcuaaaguuuaauuuuaagauguuugaauguucaguuuauguauuugaac

SEQ ID NO: 238819 - RNA, 64 nt, Homo Sapiens
uaauggcucagaauacauauuucccagauauuuauguuugaacacuuguugcagcaguuugaau

SEQ ID NO: 238820 - RNA, 64 nt, Homo Sapiens
ccagcuacuccuuaauauuuuuaacuuuuuacgguguuugaagagugaacauguuuucaacccu

SEQ ID NO: 238821 - RNA, 64 nt, Homo Sapiens
gaaaaugccucuuucuuccuuucuccaugaaauguguuugaaacaaauccugacuuaaggccca

SEQ ID NO: 238822 - RNA, 64 nt, Homo Sapiens
uaaggcccagggacuuccuuaaaggaaaguuggguguuugaagcuacuguuuucucuuuuguuc

SEQ ID NO: 238823 - RNA, 64 nt, Homo Sapiens
uuuggaaaaucaaugauuuuaaugcauagcaguauguuugaaaaauagaccauucuaaaaagcc

SEQ ID NO: 238824 - RNA, 64 nt, Homo Sapiens
caaguuucaguucuauaugaaguauuugauguuuuguuugaaacaauacagcauuaaagaacca

SEQ ID NO: 238825 - RNA, 64 nt, Homo Sapiens
cuucuagaacauguagacacuugagaaauguuucuguuugaagaaaauagagggagaaacagaa

SEQ ID NO: 238826 - RNA, 64 nt, Homo Sapiens
caugaaggugugguaucaaacuucagguugaaacuguuugaagcauuauaaacauucauuucac

SEQ ID NO: 238827 - RNA, 64 nt, Homo Sapiens
cuuuaagcauccugguaaaugcgcccggccgaaguguuugaaaugauuacaggcgugagccacu

SEQ ID NO: 238828 - RNA, 64 nt, Homo Sapiens
cuuuuuuuguugguuuguuuuaauuagguugaaguguuugaaauuuagauuuccagguauggaa

SEQ ID NO: 238829 - RNA, 64 nt, Homo Sapiens
cuggcuuguuuguucccuaccaauauucuguugcuguuugaaguagugccaggguccccuggga

SEQ ID NO: 238830 - RNA, 64 nt, Homo Sapiens
aaagcuaaauauuauauauuuuauuuuucauacauguuugaagugcaaaucuguggauauucca

SEQ ID NO: 238831 - RNA, 64 nt, Homo Sapiens
uuauagaauaugggaucccguguguguguguguguguuugaaugaaaaaugcuuauguauugac

SEQ ID NO: 238832 - RNA, 64 nt, Homo Sapiens
guggggaaugccuucuacguacacacuguucuacuguuugaauuuuuuaauaugagcccaaauu

SEQ ID NO: 238833 - RNA, 64 nt, Homo Sapiens
cgcugcauucucguguucagugaugcccucuucuuguuugaaacaaaagaaaauaaugcauugu

SEQ ID NO: 238834 - RNA, 64 nt, Homo Sapiens
aaacuuguuuaccuuaaaauuaucagaaucucaguguuugaaaguacugaagcacaaacauaua

SEQ ID NO: 238835 - RNA, 64 nt, Homo Sapiens
auuaacugcuaagucuuauaguaacuuuaaacaauguuugaauauaaguuuccauaugcaggga

SEQ ID NO: 238836 - RNA, 64 nt, Homo Sapiens
gcuauggaagagguuacaguuguuugucuugaacuguuugaaaauguucaacgacuaagugauu

SEQ ID NO: 238837 - RNA, 64 nt, Homo Sapiens
gacaugaguucuggaaggaggaacugaaagcuucuguuugaagaaugcacacccuucuugguug

SEQ ID NO: 238838 - RNA, 64 nt, Homo Sapiens
gaaauugugucauauuggugcagugucuuucuccuguuugaaaaauaagccauaugaugacaca

SEQ ID NO: 238839 - RNA, 64 nt, Homo Sapiens
uuaaagugaugauauauuauuuugugaaacuuuguguuugaaaauguuuauuucuguuuauggu

SEQ ID NO: 238840 - RNA, 64 nt, Homo Sapiens
aguucuagaaguucuuauuuuguuuuuguuguaauguuugaauacuauuuaauauccgguuuua

SEQ ID NO: 238841 - RNA, 64 nt, Homo Sapiens
gaaguuucguuuuaauuuugaaccaggauucuacuguuugaaaacauugacaguaaaaacaaca

SEQ ID NO: 238842 - RNA, 64 nt, Homo Sapiens
acgaagguaauuuaauguuauuuagaaaaaguaauguuugaaauuugauuaacuucugguuugg

SEQ ID NO: 238843 - RNA, 64 nt, Homo Sapiens
aagauucacgcuucugcaucgucugaucuuaaguuguuugaaaauuuaagaaucccuuuucaug

SEQ ID NO: 238844 - RNA, 64 nt, Homo Sapiens
caguuauuuggugacuagaaugcuccccuuuucuuguuugaaaaaguaccacaauuaaagauua

SEQ ID NO: 238845 - RNA, 64 nt, Homo Sapiens
cugaaauaauuuaggacucucaucagaauucaucuguuugaagcuggucucagacuaaguaaug

SEQ ID NO: 238846 - RNA, 64 nt, Homo Sapiens
uaaguggaauccuuucaaauacuuucaugcaguuuguuugaaguccugaaaaccugaaaaugcc

SEQ ID NO: 238847 - RNA, 64 nt, Homo Sapiens
auugcuaugaccuaauucccuuaugggcaguuguuguuugaagcuuuugcaaggauuuguaggg

SEQ ID NO: 238848 - RNA, 64 nt, Homo Sapiens
auccagccaucguagugcuuaaguacugcuuauuuguuugaagaucuagucuccauaaccccca

SEQ ID NO: 238849 - RNA, 64 nt, Homo Sapiens
uauuagagugguagguucugugccauaauagagauguuugaauucgcuacaaucugaugaacuc

SEQ ID NO: 238850 - RNA, 64 nt, Homo Sapiens
aguagugaaagcauuucucaaaugaaaaguuuuuuguuugaaccgaguuuuacaaccgcuacau

SEQ ID NO: 238851 - RNA, 64 nt, Homo Sapiens
aaacaaaggaaggugcuggucauuccauuucuuuuguuugaagcuaaagagauguguagcucac

SEQ ID NO: 238852 - RNA, 64 nt, Homo Sapiens
ugauaaacacuacucaguccaccaacaacaaacguguuugaauucaccuuaccaauauuaaucc

SEQ ID NO: 238853 - RNA, 64 nt, Homo Sapiens
uuuuugugagggcaaaggggaggaaaugggguucuguuugaaaaaaaugaggggaucuuagaug

SEQ ID NO: 238854 - RNA, 64 nt, Homo Sapiens
cccucaugugcuucuucugaauacugaaugugacuguuugaaagcugguagaauucaucccucu

SEQ ID NO: 238855 - RNA, 64 nt, Homo Sapiens
cuuuuguugugguucaaguguuaguugucuacuuuguuugaacagggggaaagagauguuuuuc

SEQ ID NO: 238856 - RNA, 64 nt, Homo Sapiens
uucccuucuguguuccaguuuagaaaguugaggauguuugaagcgguuccauuuaggagcuuuc

SEQ ID NO: 238857 - RNA, 64 nt, Homo Sapiens
uuucagggauaacauaccuggucauuguagcaguuguuugaaguauuuugacuuaaacaguguu

SEQ ID NO: 238858 - RNA, 64 nt, Homo Sapiens
gccacauacaccaugccugaaagacugaagauaauguuugaacaugagaauuggagagcaguaa

SEQ ID NO: 238859 - RNA, 64 nt, Homo Sapiens
augguaauggguggaagagggcccauaacuugccuguuugaacuaaauuuuaaagugcuccuaa

SEQ ID NO: 238860 - RNA, 64 nt, Homo Sapiens
aggcauuaggcuccugguagacugguucccccaauguuugaaagagggagcccugccuuuuucu

SEQ ID NO: 238861 - RNA, 64 nt, Homo Sapiens
auguuuggggaucgaugugcucagccaaauuuccuguuugaaauaucauguuaaauuagaauga

SEQ ID NO: 238862 - RNA, 64 nt, Homo Sapiens
ucuuggagcuuuggaauauuuuauccuguauucuuguuugaauuccuccucuauuuaagauaua

SEQ ID NO: 238863 - RNA, 64 nt, Homo Sapiens
cgugaaaucaugccuguaaacaguguuaauuucuuguuugaaucgucaugagaaggcuaaauau

SEQ ID NO: 238864 - RNA, 64 nt, Homo Sapiens
guucuacaucuagugcuucuguaucauucaugcguguuugaauaugcauguucgugguaucaug

SEQ ID NO: 238865 - RNA, 64 nt, Homo Sapiens
cuaggggaagagaauuaacuagaauuaaauuuaauguuugaaucuaaaucauugggcaaacuuc

SEQ ID NO: 238866 - RNA, 64 nt, Homo Sapiens
uccuuuucagauucccugucugcucaauuaaagauguuugaauccaaaggaagucaaggaagaa

SEQ ID NO: 238867 - RNA, 64 nt, Homo Sapiens
gccuucuagcuaaaaaauucuauguggucuccgcuguuugaacaguucaggaacauucucauug

SEQ ID NO: 238868 - RNA, 64 nt, Homo Sapiens
cccacaauguuagaccaaucccgacauguucaaauguuugaaauuuuuauacucugggaugcaa

SEQ ID NO: 238869 - RNA, 64 nt, Homo Sapiens
uuuuaaauuauuguuuccagcuuuaucaaagacauguuugaaaaauaaaaagcauccaagugag

SEQ ID NO: 238870 - RNA, 64 nt, Homo Sapiens
ucucuggcagcacugucugcacuuucuuguuuacuguuugaagggacgaguaccaagccacaag

SEQ ID NO: 238871 - RNA, 64 nt, Homo Sapiens
acaucagccuccagguugacuaagggucaggucauguuugaaaccaugcuuggcuggaccggga

SEQ ID NO: 238872 - RNA, 64 nt, Homo Sapiens
cuuggcaacagacucaugacaaaggauucaagauuguuugaaaaaaaaaaaaggggagcaggga

SEQ ID NO: 238873 - RNA, 64 nt, Homo Sapiens
cuacauaguugaagacagcaacaucuucacugaauguuugaauagaaaccucuacuaaauuauu

SEQ ID NO: 238874 - RNA, 64 nt, Homo Sapiens
cauuaauuuuucuauaaauuggaagauuuauaaauguuugaaauuguacacauugauauuuaau

SEQ ID NO: 238875 - RNA, 64 nt, Homo Sapiens
auuuuucaaaagcucaguauaugaaucaucauacuguuugaaauugcuaaugacagaguaagua

SEQ ID NO: 238876 - RNA, 64 nt, Homo Sapiens
uguaacuauaaauuuugugaaugcauuuuccugguguuugaaaaagaagggggggagaauucca

SEQ ID NO: 238877 - RNA, 64 nt, Homo Sapiens
ccaagaauaaugguucuuaccacagaaaauaaaauguuugaaauauacagugcuauaagcuaug

SEQ ID NO: 238878 - RNA, 64 nt, Homo Sapiens
uugcauauuugauauaguucuauuuuacuaagaauguuugaacuauauauagauccuuucauau

SEQ ID NO: 238879 - RNA, 64 nt, Homo Sapiens
gcaaccagucaaaaccagagcgagaacccucaacugacaugaaauacuuuaaaaugcacacgua

SEQ ID NO: 238880 - RNA, 64 nt, Homo Sapiens
caaugaccguuugacuguuuguggcuugggccucugacaugacuuauguguguguguguuuuug

SEQ ID NO: 238881 - RNA, 64 nt, Homo Sapiens
ggaauacuugguuucuuuucuugcccuggauuguugacaugaguuuuuaaauacauucuccuuu

SEQ ID NO: 238882 - RNA, 64 nt, Homo Sapiens
uuucuggaagacaugauacagauuacuguuuggcugacaugacuaaguuucuaaauugagauuc

SEQ ID NO: 238883 - RNA, 64 nt, Homo Sapiens
uuucaaauuguccagaguggaaaagccuucaagaugacaugaugaauuacucaguucaucugau

SEQ ID NO: 238884 - RNA, 64 nt, Homo Sapiens
gaccagugccaaucugaacauuguuaauggccugugacaugaugagcacaggaacaggcaugaa

SEQ ID NO: 238885 - RNA, 64 nt, Homo Sapiens
ugccagacccaggguuagacacaaggaccugaagugacaugacggcgggacaggggaaauguga

SEQ ID NO: 238886 - RNA, 64 nt, Homo Sapiens
uuggucuuaaggaaaauacuaacauugaacucacugacaugaucuuagcuucuuuaaucagacu

SEQ ID NO: 238887 - RNA, 64 nt, Homo Sapiens
uaauaugcucaguuuggaccuuuuuuucaguuaaaugcuaaauauaugaaaauuacuauaccuc

SEQ ID NO: 238888 - RNA, 64 nt, Homo Sapiens
gaaccuucuuaaucucuucugugggauuuucaaaaugcuaaagacucacacugcagcaaucauc

SEQ ID NO: 238889 - RNA, 64 nt, Homo Sapiens
ugugaguuagcaagacccuguuuuugcagcauguaugcuaaauuuugggacuccaggagagagg

SEQ ID NO: 238890 - RNA, 64 nt, Homo Sapiens
aagaaaucuagcugggauaugaagacacuaccauaugcuaaagguacacauuguacaaaauauc

SEQ ID NO: 238891 - RNA, 64 nt, Homo Sapiens
aguuuguuuuaaaagagguuuccuaauuuuagggaugcuaaaauuauuuaacucacggcuacug

SEQ ID NO: 238892 - RNA, 64 nt, Homo Sapiens
gaaagcccucugcaauauauagugcucccccaguaugcuaaauauuccuacugacuuccaauuu

SEQ ID NO: 238893 - RNA, 64 nt, Homo Sapiens
auguacuuaugcuuuaguaggugauuuagcaguuaugcuaaaauauaaaccuuuuuauuacauu

SEQ ID NO: 238894 - RNA, 64 nt, Homo Sapiens
cuggcccuuaacucacauucaauccuggaugugaaugcuaaacaaagucaacugagauccagag

SEQ ID NO: 238895 - RNA, 64 nt, Homo Sapiens
auuaugauuauaguaaacagacuaguggguaguaaugcuaaauuaccaucacaguuaugugcca

SEQ ID NO: 238896 - RNA, 64 nt, Homo Sapiens
ggaauauagauauguauauacacauauaauauauaugcuaaaguauaaagaguaauaauaauga

SEQ ID NO: 238897 - RNA, 64 nt, Homo Sapiens
auuaauuugauaauuucauguaugaugugcauauaugcuaaaagaaugcagaaaaucauuuuau

SEQ ID NO: 238898 - RNA, 64 nt, Homo Sapiens
aauuggguaaaguuuacucuuggacauuauuucgaugcuaaaguaaggauucuguggauguuac

SEQ ID NO: 238899 - RNA, 64 nt, Homo Sapiens
ugaaauguuaacccucuaaaaguuguuaaacaacaugcuaaauggucaggguuggcuugugaaa

SEQ ID NO: 238900 - RNA, 64 nt, Homo Sapiens
agauaaagccaaggugaaggaaagacugaaggggaugcuaaagggccgccgccaugcccaagag

SEQ ID NO: 238901 - RNA, 64 nt, Homo Sapiens
gcaaauuucaagggaagaaaauuaaaauaaugacaugcuaaaagcuaauuuucaguaagaagug

SEQ ID NO: 238902 - RNA, 64 nt, Homo Sapiens
uacugauguguaaaucaccuagauuauccaccaaaugcuaaaaaugaagguuaaagauaaauua

SEQ ID NO: 238903 - RNA, 64 nt, Homo Sapiens
agacuugacagcugcagagccaacuugccaccagaugcuaaaugccagagaggacaaaaaagcc

SEQ ID NO: 238904 - RNA, 64 nt, Homo Sapiens
auacacuuuuguguauuagcaaugguuuuuacuaaugcuaaaacuuuuaaaguuuauuuuuuaa

SEQ ID NO: 238905 - RNA, 64 nt, Homo Sapiens
cucuucugcuuccugauaagaaaagguauaugcaaugcuaaaacuguagaagcccaaucaccag

SEQ ID NO: 238906 - RNA, 64 nt, Homo Sapiens
gagaaccuucuuuuucucuugacuuugacagcacaugcuaaaaaucucuuccaagaaguaugcu

SEQ ID NO: 238907 - RNA, 64 nt, Homo Sapiens
ugacagcacaugcuaaaaaucucuuccaagaaguaugcuaaagcuuuucauuugguuccuguua

SEQ ID NO: 238908 - RNA, 64 nt, Homo Sapiens; identical to SEQ ID NO: 73636

SEQ ID NO: 238909 - RNA, 64 nt, Homo Sapiens; identical to SEQ ID NO: 73637

SEQ ID NO: 238910 - RNA, 64 nt, Homo Sapiens; identical to SEQ ID NO: 73638

SEQ ID NO: 238911 - RNA, 64 nt, Homo Sapiens; identical to SEQ ID NO: 73639

SEQ ID NO: 238912 - RNA, 64 nt, Homo Sapiens; identical to SEQ ID NO: 73640

SEQ ID NO: 238913 - RNA, 64 nt, Homo Sapiens; identical to SEQ ID NO: 73641

SEQ ID NO: 238914 - RNA, 64 nt, Homo Sapiens; identical to SEQ ID NO: 73642

SEQ ID NO: 238915 - RNA, 64 nt, Homo Sapiens; identical to SEQ ID NO: 73643

SEQ ID NO: 238916 - RNA, 64 nt, Homo Sapiens; identical to SEQ ID NO: 73644

SEQ ID NO: 238917 - RNA, 64 nt, Homo Sapiens; identical to SEQ ID NO: 73645

SEQ ID NO: 238918 - RNA, 64 nt, Homo Sapiens; identical to SEQ ID NO: 73646

SEQ ID NO: 238919 - RNA, 64 nt, Homo Sapiens; identical to SEQ ID NO: 73647

SEQ ID NO: 238920 - RNA, 64 nt, Homo Sapiens; identical to SEQ ID NO: 73648

SEQ ID NO: 238921 - RNA, 64 nt, Homo Sapiens; identical to SEQ ID NO: 73649

SEQ ID NO: 238922 - RNA, 64 nt, Homo Sapiens; identical to SEQ ID NO: 73650

SEQ ID NO: 238923 - RNA, 64 nt, Homo Sapiens; identical to SEQ ID NO: 73651

SEQ ID NO: 238924 - RNA, 64 nt, Homo Sapiens; identical to SEQ ID NO: 73652

SEQ ID NO: 238925 - RNA, 64 nt, Homo Sapiens; identical to SEQ ID NO: 73653

SEQ ID NO: 238926 - RNA, 64 nt, Homo Sapiens; identical to SEQ ID NO: 73654

SEQ ID NO: 238927 - RNA, 64 nt, Homo Sapiens; identical to SEQ ID NO: 73655

SEQ ID NO: 238928 - RNA, 64 nt, Homo Sapiens; identical to SEQ ID NO: 73656

SEQ ID NO: 238929 - RNA, 64 nt, Homo Sapiens; identical to SEQ ID NO: 73657

SEQ ID NO: 238930 - RNA, 64 nt, Homo Sapiens; identical to SEQ ID NO: 73658

SEQ ID NO: 238931 - RNA, 64 nt, Homo Sapiens; identical to SEQ ID NO: 73659

SEQ ID NO: 238932 - RNA, 64 nt, Homo Sapiens; identical to SEQ ID NO: 73660

SEQ ID NO: 238933 - RNA, 64 nt, Homo Sapiens; identical to SEQ ID NO: 73661

SEQ ID NO: 238934 - RNA, 64 nt, Homo Sapiens; identical to SEQ ID NO: 73662

SEQ ID NO: 238935 - RNA, 64 nt, Homo Sapiens; identical to SEQ ID NO: 73663

SEQ ID NO: 238936 - RNA, 63 nt, Homo Sapiens; identical to SEQ ID NO: 73664

SEQ ID NO: 238937 - RNA, 64 nt, Homo Sapiens; identical to SEQ ID NO: 73665

SEQ ID NO: 238938 - RNA, 64 nt, Homo Sapiens; identical to SEQ ID NO: 73666

SEQ ID NO: 238939 - RNA, 64 nt, Homo Sapiens; identical to SEQ ID NO: 73667

SEQ ID NO: 238940 - RNA, 64 nt, Homo Sapiens; identical to SEQ ID NO: 73668

SEQ ID NO: 238941 - RNA, 64 nt, Homo Sapiens; identical to SEQ ID NO: 73669

SEQ ID NO: 238942 - RNA, 64 nt, Homo Sapiens; identical to SEQ ID NO: 73670

SEQ ID NO: 238943 - RNA, 64 nt, Homo Sapiens; identical to SEQ ID NO: 73671

SEQ ID NO: 238944 - RNA, 64 nt, Homo Sapiens; identical to SEQ ID NO: 73672

SEQ ID NO: 238945 - RNA, 64 nt, Homo Sapiens; identical to SEQ ID NO: 73673

SEQ ID NO: 238946 - RNA, 64 nt, Homo Sapiens; identical to SEQ ID NO: 73674

SEQ ID NO: 238947 - RNA, 64 nt, Homo Sapiens; identical to SEQ ID NO: 73675

SEQ ID NO: 238948 - RNA, 64 nt, Homo Sapiens; identical to SEQ ID NO: 73676

SEQ ID NO: 238949 - RNA, 64 nt, Homo Sapiens; identical to SEQ ID NO: 73677

SEQ ID NO: 238950 - RNA, 64 nt, Homo Sapiens; identical to SEQ ID NO: 73678

SEQ ID NO: 238951 - RNA, 64 nt, Homo Sapiens; identical to SEQ ID NO: 73679

SEQ ID NO: 238952 - RNA, 64 nt, Homo Sapiens; identical to SEQ ID NO: 73680

SEQ ID NO: 238953 - RNA, 64 nt, Homo Sapiens; identical to SEQ ID NO: 73681

SEQ ID NO: 238954 - RNA, 64 nt, Homo Sapiens; identical to SEQ ID NO: 73682

SEQ ID NO: 238955 - RNA, 64 nt, Homo Sapiens; identical to SEQ ID NO: 73683

SEQ ID NO: 238956 - RNA, 64 nt, Homo Sapiens; identical to SEQ ID NO: 73684

SEQ ID NO: 238957 - RNA, 64 nt, Homo Sapiens; identical to SEQ ID NO: 73685

SEQ ID NO: 238958 - RNA, 64 nt, Homo Sapiens; identical to SEQ ID NO: 73686

SEQ ID NO: 238959 - RNA, 64 nt, Homo Sapiens; identical to SEQ ID NO: 73687

SEQ ID NO: 238960 - RNA, 64 nt, Homo Sapiens; identical to SEQ ID NO: 73688

SEQ ID NO: 238961 - RNA, 64 nt, Homo Sapiens; identical to SEQ ID NO: 73689

SEQ ID NO: 238962 - RNA, 64 nt, Homo Sapiens; identical to SEQ ID NO: 73690

SEQ ID NO: 238963 - RNA, 64 nt, Homo Sapiens; identical to SEQ ID NO: 73691

SEQ ID NO: 238964 - RNA, 64 nt, Homo Sapiens; identical to SEQ ID NO: 73692

SEQ ID NO: 238965 - RNA, 64 nt, Homo Sapiens; identical to SEQ ID NO: 73693

SEQ ID NO: 238966 - RNA, 64 nt, Homo Sapiens; identical to SEQ ID NO: 73694

SEQ ID NO: 238967 - RNA, 64 nt, Homo Sapiens; identical to SEQ ID NO: 73695

SEQ ID NO: 238968 - RNA, 64 nt, Homo Sapiens; identical to SEQ ID NO: 73696

SEQ ID NO: 238969 - RNA, 64 nt, Homo Sapiens; identical to SEQ ID NO: 73697

SEQ ID NO: 238970 - RNA, 64 nt, Homo Sapiens; identical to SEQ ID NO: 73698

SEQ ID NO: 238971 - RNA, 64 nt, Homo Sapiens; identical to SEQ ID NO: 73699

SEQ ID NO: 238972 - RNA, 64 nt, Homo Sapiens; identical to SEQ ID NO: 73700

SEQ ID NO: 238973 - RNA, 64 nt, Homo Sapiens; identical to SEQ ID NO: 73701

SEQ ID NO: 238974 - RNA, 64 nt, Homo Sapiens; identical to SEQ ID NO: 73702

SEQ ID NO: 238975 - RNA, 64 nt, Homo Sapiens; identical to SEQ ID NO: 73703

SEQ ID NO: 238976 - RNA, 64 nt, Homo Sapiens; identical to SEQ ID NO: 73704

SEQ ID NO: 238977 - RNA, 64 nt, Homo Sapiens; identical to SEQ ID NO: 73705

SEQ ID NO: 238978 - RNA, 64 nt, Homo Sapiens; identical to SEQ ID NO: 73706

SEQ ID NO: 238979 - RNA, 64 nt, Homo Sapiens; identical to SEQ ID NO: 73707

SEQ ID NO: 238980 - RNA, 63 nt, Homo Sapiens
agaauugaagucugaaacaaacaaaagcaauucaaugucaauagacauuaagcaacauaauag

SEQ ID NO: 238981 - RNA, 63 nt, Homo Sapiens
gcaguuuacaauuuuuguucuucuccuguaaagaaugucaaugguuaucaccuucaauaguuu

SEQ ID NO: 238982 - RNA, 63 nt, Homo Sapiens
uuacauugcuuagauaauuuagaauuuuuaacuaaugucaaaacuacagugucaaacauucua

SEQ ID NO: 238983 - RNA, 63 nt, Homo Sapiens
uuggugcuccaguguagggcuaucuuuuuaaaaaaugucaacaaagggaaaauaaacuaucag

SEQ ID NO: 238984 - RNA, 63 nt, Homo Sapiens
cagggaaggaugacaaaauggguggauuuuuaaaaugucaagauggaggguggguuggggagg

SEQ ID NO: 238985 - RNA, 63 nt, Homo Sapiens
uuaaucagccccucaaagggguaauuguggauuaaugucaaugugugaucuaguccuugucuu

SEQ ID NO: 238986 - RNA, 63 nt, Homo Sapiens
aaucgaguauggguauuauguaaauugcuaaguaaugucaauaaaaguuugacuuuuguccag

SEQ ID NO: 238987 - RNA, 63 nt, Homo Sapiens
acauuuuaaaggaccaauaaccaaagaucaaggaaugucaauauuugcccuucgccauuguuu

SEQ ID NO: 238988 - RNA, 63 nt, Homo Sapiens
uaagagcuuuuucacucuaaaaaucuuggcaauaaugucaacaccagaaagccuccucuggag

SEQ ID NO: 238989 - RNA, 63 nt, Homo Sapiens
aauuuuauuuuuuuucuguaacugugcuuguugaaugucaaucauauuuaaagggaaugacuu

SEQ ID NO: 238990 - RNA, 63 nt, Homo Sapiens
uguauaugugcgaucguaaaauuugugcaauguaaugucaaauugacuggucaaugucaaccu

SEQ ID NO: 238991 - RNA, 63 nt, Homo Sapiens
aauuugugcaauguaaugucaaauugacuggucaaugucaaccuaguagucaaucuaacugca

SEQ ID NO: 238992 - RNA, 63 nt, Homo Sapiens
ucaagugauaugugccuaauuuuucaucauuaaaaugucaaguuuuuugcuucuuaaauuugc

SEQ ID NO: 238993 - RNA, 63 nt, Homo Sapiens
aaaaagcagccuaaaugcaaaguaauuugggaaaaugucaacagcacaauucagaauggcaga

SEQ ID NO: 238994 - RNA, 63 nt, Homo Sapiens
guuguuuuuuaaaauccaaauuauuuuuauuuaaaugucaauauccagcucuaacaaaauggu

SEQ ID NO: 238995 - RNA, 60 nt, Homo Sapiens
ccguuccgaaggcauuuuccauccaaccaaaaugucaaguuuuucgagacagcacuguga

SEQ ID NO: 238996 - RNA, 63 nt, Homo Sapiens
auucuguuuuugggguuuuuauuuugaauuguaaaugucaaguuuuaauauuccgcuaauuug

SEQ ID NO: 238997 - RNA, 63 nt, Homo Sapiens
uaaugagaacugacacaacuguaaacacuacaaaaugucaaaauuacguugaucucuuaaauu

SEQ ID NO: 238998 - RNA, 63 nt, Homo Sapiens
gaaaguaacaccuuuuccaaggacaauggcaacaaugucaaugucaacacugagucuaauuuu

SEQ ID NO: 238999 - RNA, 63 nt, Homo Sapiens
aacaccuuuuccaaggacaauggcaacaaugucaaugucaacacugagucuaauuuugaccac

SEQ ID NO: 239000 - RNA, 63 nt, Homo Sapiens
ggcagccaguuguguuuuuuaucacagggugauaaugucaauuaugguauguagaagccuagg

SEQ ID NO: 239001 - RNA, 63 nt, Homo Sapiens
ggcacuucuuuauuaauuacuuaauugcagucuaaugucaagaagcugccccccaccccucag

SEQ ID NO: 239002 - RNA, 63 nt, Homo Sapiens
aacacaggaggacuuaauggcagcuuggcauuuaaugucaaaauccaagccguggcauuuaau

SEQ ID NO: 239003 - RNA, 63 nt, Homo Sapiens
gcauuuaaugucaaaauccaagccguggcauuuaaugucaaaaugacuucagaccacuucuag

SEQ ID NO: 239004 - RNA, 63 nt, Homo Sapiens
uguggaccaacauauauagcgguauguuucauaaaugucaagcacugcaauguaauacuagcu

SEQ ID NO: 239005 - RNA, 63 nt, Homo Sapiens
uguguaagugaagaccuggguagggucagagacaaugucaaacaugucuagaugaguccccug

SEQ ID NO: 239006 - RNA, 64 nt, Homo Sapiens; identical to SEQ ID NO: 61625

SEQ ID NO: 239007 - RNA, 64 nt, Homo Sapiens; identical to SEQ ID NO: 61626

SEQ ID NO: 239008 - RNA, 64 nt, Homo Sapiens; identical to SEQ ID NO: 61627

SEQ ID NO: 239009 - RNA, 64 nt, Homo Sapiens; identical to SEQ ID NO: 61628

SEQ ID NO: 239010 - RNA, 64 nt, Homo Sapiens; identical to SEQ ID NO: 61629

SEQ ID NO: 239011 - RNA, 64 nt, Homo Sapiens; identical to SEQ ID NO: 61630

SEQ ID NO: 239012 - RNA, 64 nt, Homo Sapiens; identical to SEQ ID NO: 61631

SEQ ID NO: 239013 - RNA, 64 nt, Homo Sapiens; identical to SEQ ID NO: 61632

SEQ ID NO: 239014 - RNA, 64 nt, Homo Sapiens; identical to SEQ ID NO: 61633

SEQ ID NO: 239015 - RNA, 64 nt, Homo Sapiens; identical to SEQ ID NO: 61634

SEQ ID NO: 239016 - RNA, 64 nt, Homo Sapiens; identical to SEQ ID NO: 61635

SEQ ID NO: 239017 - RNA, 64 nt, Homo Sapiens; identical to SEQ ID NO: 61636

SEQ ID NO: 239018 - RNA, 64 nt, Homo Sapiens; identical to SEQ ID NO: 61637

SEQ ID NO: 239019 - RNA, 64 nt, Homo Sapiens; identical to SEQ ID NO: 61638

SEQ ID NO: 239020 - RNA, 64 nt, Homo Sapiens; identical to SEQ ID NO: 61639

SEQ ID NO: 239021 - RNA, 64 nt, Homo Sapiens; identical to SEQ ID NO: 61640

SEQ ID NO: 239022 - RNA, 64 nt, Homo Sapiens; identical to SEQ ID NO: 61641

SEQ ID NO: 239023 - RNA, 64 nt, Homo Sapiens; identical to SEQ ID NO: 61642

SEQ ID NO: 239024 - RNA, 64 nt, Homo Sapiens; identical to SEQ ID NO: 61643

SEQ ID NO: 239025 - RNA, 64 nt, Homo Sapiens; identical to SEQ ID NO: 61644

SEQ ID NO: 239026 - RNA, 64 nt, Homo Sapiens; identical to SEQ ID NO: 61645

SEQ ID NO: 239027 - RNA, 64 nt, Homo Sapiens; identical to SEQ ID NO: 61646

SEQ ID NO: 239028 - RNA, 64 nt, Homo Sapiens; identical to SEQ ID NO: 61647

SEQ ID NO: 239029 - RNA, 64 nt, Homo Sapiens; identical to SEQ ID NO: 61648

SEQ ID NO: 239030 - RNA, 64 nt, Homo Sapiens; identical to SEQ ID NO: 61649

SEQ ID NO: 239031 - RNA, 64 nt, Homo Sapiens; identical to SEQ ID NO: 61650

SEQ ID NO: 239032 - RNA, 64 nt, Homo Sapiens; identical to SEQ ID NO: 61651

SEQ ID NO: 239033 - RNA, 64 nt, Homo Sapiens; identical to SEQ ID NO: 61652

SEQ ID NO: 239034 - RNA, 64 nt, Homo Sapiens; identical to SEQ ID NO: 61653

SEQ ID NO: 239035 - RNA, 64 nt, Homo Sapiens; identical to SEQ ID NO: 61654

SEQ ID NO: 239036 - RNA, 64 nt, Homo Sapiens; identical to SEQ ID NO: 61655

SEQ ID NO: 239037 - RNA, 64 nt, Homo Sapiens; identical to SEQ ID NO: 61656

SEQ ID NO: 239038 - RNA, 64 nt, Homo Sapiens; identical to SEQ ID NO: 61657

SEQ ID NO: 239039 - RNA, 64 nt, Homo Sapiens; identical to SEQ ID NO: 61658

SEQ ID NO: 239040 - RNA, 64 nt, Homo Sapiens; identical to SEQ ID NO: 61659

SEQ ID NO: 239041 - RNA, 64 nt, Homo Sapiens; identical to SEQ ID NO: 61660

SEQ ID NO: 239042 - RNA, 64 nt, Homo Sapiens; identical to SEQ ID NO: 61661

SEQ ID NO: 239043 - RNA, 64 nt, Homo Sapiens; identical to SEQ ID NO: 61662

SEQ ID NO: 239044 - RNA, 64 nt, Homo Sapiens; identical to SEQ ID NO: 61663

SEQ ID NO: 239045 - RNA, 64 nt, Homo Sapiens; identical to SEQ ID NO: 61664

SEQ ID NO: 239046 - RNA, 64 nt, Homo Sapiens; identical to SEQ ID NO: 61665

SEQ ID NO: 239047 - RNA, 64 nt, Homo Sapiens; identical to SEQ ID NO: 61666

SEQ ID NO: 239048 - RNA, 64 nt, Homo Sapiens; identical to SEQ ID NO: 61667

SEQ ID NO: 239049 - RNA, 64 nt, Homo Sapiens; identical to SEQ ID NO: 61668

SEQ ID NO: 239050 - RNA, 64 nt, Homo Sapiens; identical to SEQ ID NO: 61669

SEQ ID NO: 239051 - RNA, 64 nt, Homo Sapiens; identical to SEQ ID NO: 61670

SEQ ID NO: 239052 - RNA, 64 nt, Homo Sapiens; identical to SEQ ID NO: 61671

SEQ ID NO: 239053 - RNA, 64 nt, Homo Sapiens; identical to SEQ ID NO: 61672

SEQ ID NO: 239054 - RNA, 64 nt, Homo Sapiens; identical to SEQ ID NO: 61673

SEQ ID NO: 239055 - RNA, 64 nt, Homo Sapiens; identical to SEQ ID NO: 61674

SEQ ID NO: 239056 - RNA, 64 nt, Homo Sapiens; identical to SEQ ID NO: 61675

SEQ ID NO: 239057 - RNA, 64 nt, Homo Sapiens; identical to SEQ ID NO: 61676

SEQ ID NO: 239058 - RNA, 64 nt, Homo Sapiens; identical to SEQ ID NO: 61677

SEQ ID NO: 239059 - RNA, 64 nt, Homo Sapiens; identical to SEQ ID NO: 61678

SEQ ID NO: 239060 - RNA, 64 nt, Homo Sapiens; identical to SEQ ID NO: 61679

SEQ ID NO: 239061 - RNA, 64 nt, Homo Sapiens; identical to SEQ ID NO: 61680

SEQ ID NO: 239062 - RNA, 64 nt, Homo Sapiens; identical to SEQ ID NO: 61681

SEQ ID NO: 239063 - RNA, 64 nt, Homo Sapiens; identical to SEQ ID NO: 61682

SEQ ID NO: 239064 - RNA, 64 nt, Homo Sapiens; identical to SEQ ID NO: 61683

SEQ ID NO: 239065 - RNA, 64 nt, Homo Sapiens; identical to SEQ ID NO: 61684

SEQ ID NO: 239066 - RNA, 64 nt, Homo Sapiens; identical to SEQ ID NO: 61685

SEQ ID NO: 239067 - RNA, 64 nt, Homo Sapiens; identical to SEQ ID NO: 61686

SEQ ID NO: 239068 - RNA, 64 nt, Homo Sapiens; identical to SEQ ID NO: 61687

SEQ ID NO: 239069 - RNA, 64 nt, Homo Sapiens; identical to SEQ ID NO: 61688

SEQ ID NO: 239070 - RNA, 64 nt, Homo Sapiens; identical to SEQ ID NO: 61689

SEQ ID NO: 239071 - RNA, 64 nt, Homo Sapiens; identical to SEQ ID NO: 61690

SEQ ID NO: 239072 - RNA, 64 nt, Homo Sapiens; identical to SEQ ID NO: 61691

SEQ ID NO: 239073 - RNA, 64 nt, Homo Sapiens; identical to SEQ ID NO: 61692

SEQ ID NO: 239074 - RNA, 64 nt, Homo Sapiens; identical to SEQ ID NO: 61693

SEQ ID NO: 239075 - RNA, 64 nt, Homo Sapiens; identical to SEQ ID NO: 61694

SEQ ID NO: 239076 - RNA, 64 nt, Homo Sapiens; identical to SEQ ID NO: 61695

SEQ ID NO: 239077 - RNA, 64 nt, Homo Sapiens; identical to SEQ ID NO: 61696

SEQ ID NO: 239078 - RNA, 64 nt, Homo Sapiens; identical to SEQ ID NO: 61697

SEQ ID NO: 239079 - RNA, 64 nt, Homo Sapiens; identical to SEQ ID NO: 61698

SEQ ID NO: 239080 - RNA, 64 nt, Homo Sapiens; identical to SEQ ID NO: 61699

SEQ ID NO: 239081 - RNA, 64 nt, Homo Sapiens; identical to SEQ ID NO: 61700

SEQ ID NO: 239082 - RNA, 64 nt, Homo Sapiens; identical to SEQ ID NO: 61701

SEQ ID NO: 239083 - RNA, 64 nt, Homo Sapiens; identical to SEQ ID NO: 61702

SEQ ID NO: 239084 - RNA, 64 nt, Homo Sapiens; identical to SEQ ID NO: 61703

SEQ ID NO: 239085 - RNA, 64 nt, Homo Sapiens; identical to SEQ ID NO: 61704

SEQ ID NO: 239086 - RNA, 64 nt, Homo Sapiens; identical to SEQ ID NO: 61705

SEQ ID NO: 239087 - RNA, 64 nt, Homo Sapiens; identical to SEQ ID NO: 61706

SEQ ID NO: 239088 - RNA, 64 nt, Homo Sapiens; identical to SEQ ID NO: 61707

SEQ ID NO: 239089 - RNA, 64 nt, Homo Sapiens; identical to SEQ ID NO: 61708

SEQ ID NO: 239090 - RNA, 64 nt, Homo Sapiens; identical to SEQ ID NO: 61709

SEQ ID NO: 239091 - RNA, 64 nt, Homo Sapiens; identical to SEQ ID NO: 61710

SEQ ID NO: 239092 - RNA, 64 nt, Homo Sapiens; identical to SEQ ID NO: 61711

SEQ ID NO: 239093 - RNA, 64 nt, Homo Sapiens; identical to SEQ ID NO: 61712

SEQ ID NO: 239094 - RNA, 64 nt, Homo Sapiens; identical to SEQ ID NO: 61713

SEQ ID NO: 239095 - RNA, 64 nt, Homo Sapiens; identical to SEQ ID NO: 61714

SEQ ID NO: 239096 - RNA, 64 nt, Homo Sapiens; identical to SEQ ID NO: 61715

SEQ ID NO: 239097 - RNA, 64 nt, Homo Sapiens; identical to SEQ ID NO: 61716

SEQ ID NO: 239098 - RNA, 64 nt, Homo Sapiens; identical to SEQ ID NO: 61717

SEQ ID NO: 239099 - RNA, 64 nt, Homo Sapiens; identical to SEQ ID NO: 61718

SEQ ID NO: 239100 - RNA, 64 nt, Homo Sapiens; identical to SEQ ID NO: 61719

SEQ ID NO: 239101 - RNA, 64 nt, Homo Sapiens; identical to SEQ ID NO: 61720

SEQ ID NO: 239102 - RNA, 64 nt, Homo Sapiens; identical to SEQ ID NO: 61721

SEQ ID NO: 239103 - RNA, 64 nt, Homo Sapiens; identical to SEQ ID NO: 61722

SEQ ID NO: 239104 - RNA, 64 nt, Homo Sapiens; identical to SEQ ID NO: 61723

SEQ ID NO: 239105 - RNA, 64 nt, Homo Sapiens; identical to SEQ ID NO: 61724

SEQ ID NO: 239106 - RNA, 64 nt, Homo Sapiens; identical to SEQ ID NO: 61725

SEQ ID NO: 239107 - RNA, 64 nt, Homo Sapiens; identical to SEQ ID NO: 61726

SEQ ID NO: 239108 - RNA, 64 nt, Homo Sapiens; identical to SEQ ID NO: 61727

SEQ ID NO: 239109 - RNA, 64 nt, Homo Sapiens; identical to SEQ ID NO: 61728

SEQ ID NO: 239110 - RNA, 64 nt, Homo Sapiens
uuuauaaugccacuggaagaggagggauaacuuuuucuguuauuugauuucuuuuauaacuuug

SEQ ID NO: 239111 - RNA, 64 nt, Homo Sapiens
uggaaaugaacacuuaauggaauuuuuaagucuguucuguuagguagauggugaugcucuuguu

SEQ ID NO: 239112 - RNA, 64 nt, Homo Sapiens
uugcuaacuauauacccaucguaaaauguugccauucuguuagauggaccguuuagaaugcuau

SEQ ID NO: 239113 - RNA, 64 nt, Homo Sapiens
auacuuuaauuguacaucuguucauuguuguuauuucuguuauauccagaagccuauuucuccu

SEQ ID NO: 239114 - RNA, 64 nt, Homo Sapiens
gggaauuuaacauauuuaagaugcuuagauuauguucuguuaauuugcuuagcuguuuguuuug

SEQ ID NO: 239115 - RNA, 64 nt, Homo Sapiens
ggucauucuuuuacuaggcuaaaugauucugucauucuguuacacacacagcucaacgguugau

SEQ ID NO: 239116 - RNA, 64 nt, Homo Sapiens
guaggaaaugaaucauagggaacuguuucaucauuucuguuagggaagaaaaggaagaaagaaa

SEQ ID NO: 239117 - RNA, 64 nt, Homo Sapiens
auaucccucaugacaguugcgauuaauuggcacauucuguuaaggcuacugcucuccuggcaag

SEQ ID NO: 239118 - RNA, 64 nt, Homo Sapiens
agugagguugauaaaguauucagauaauuuacaguucuguuaacucuccacacaccccaucacc

SEQ ID NO: 239119 - RNA, 64 nt, Homo Sapiens
cuaaucaaguuugcuguuaguaauuaagacagaguucuguuaauuagugugauauauaaaggug

SEQ ID NO: 239120 - RNA, 54 nt, Homo Sapiens
ucaauaguaucucagauugaccauuucuguuacuugucauuucuacuuucagaa

SEQ ID NO: 239121 - RNA, 64 nt, Homo Sapiens
uuuuucacuuguuaggaagcuuuuguuauguauuuucuguuaauaguaccuaaaauugcaacuu

SEQ ID NO: 239122 - RNA, 64 nt, Homo Sapiens
acuccagcuauguaauaaaaaacuauacucuguguucuguuaaugccucugaguguccuaccuc

SEQ ID NO: 239123 - RNA, 64 nt, Homo Sapiens
agggaaagauguggccuuuugugaugguuuuauuuucuguuaacacuguguccugggggggcug

SEQ ID NO: 239124 - RNA, 64 nt, Homo Sapiens
cagaauugaagaaagaguauuuugguuacuuuuauucuguuaaaucaaaugcauugcuuuaacc

SEQ ID NO: 239125 - RNA, 64 nt, Homo Sapiens
guaaacuuuugaagaucuuaggagcuaaugcuuauucuguuaauguuguguguguguguuaaaa

SEQ ID NO: 239126 - RNA, 64 nt, Homo Sapiens
uuucguauuaugaucuuguucacuuucuguaauuuucuguuaagcuccauuugccaguuuaagg

SEQ ID NO: 239127 - RNA, 64 nt, Homo Sapiens
uugaaauugaaaucguauuguguggcucuguauauucuguuaaaaaauuaaaggacagaaaccu

SEQ ID NO: 239128 - RNA, 64 nt, Homo Sapiens
aaauaauuuuccacuuaauaacuguaaaguuuuuuucuguuaauuuaggcauauagaauauuaa

SEQ ID NO: 239129 - RNA, 64 nt, Homo Sapiens
auaaaugcauaauaugaggucaguggacgccauuuucuguuauaaucauuuuuguuaucuaauu

SEQ ID NO: 239130 - RNA, 64 nt, Homo Sapiens
ugaagauuuaaauauuuuauugccuaaauucucauucuguuaugugauauuggaauuauucaga

SEQ ID NO: 239131 - RNA, 64 nt, Homo Sapiens
aaaaccuauuuaauuccacuuacuucuaaaaauuuucuguuaugccuacaucuccuucuacuaa

SEQ ID NO: 239132 - RNA, 64 nt, Homo Sapiens
acgugccacuguuugaaaucuggucuguuugcauuucuguuaugacagagagaugauguuugca

SEQ ID NO: 239133 - RNA, 64 nt, Homo Sapiens
cauuucuguuaugacagagagaugauguuugcauuucuguuaugacagagagaugaugaaagua

SEQ ID NO: 239134 - RNA, 64 nt, Homo Sapiens
acuucuaugaaccccuaaagaccauguuucccauuucuguuaaugucuuuauaguuguaauauc

SEQ ID NO: 239135 - RNA, 64 nt, Homo Sapiens
aggauugauuugcuuuuauauaacuguguucuuguucuguuaaauguuaaugugguagcaccug

SEQ ID NO: 239136 - RNA, 64 nt, Homo Sapiens
ugauugugguaaacaauguuaauguuacaguaauuucuguuagcuuuaugaagucaucgugacc

SEQ ID NO: 239137 - RNA, 64 nt, Homo Sapiens
guugacuaaagaaucugguaagcugaaaugugaauucuguuaguauuuauaugcuuuguugacu

SEQ ID NO: 239138 - RNA, 64 nt, Homo Sapiens
gcuuuuaugugaguagcauuucccuaucuugcaguucuguuaacaugaaaauggcauuuuucca

SEQ ID NO: 239139 - RNA, 64 nt, Homo Sapiens
cagaaaaaccuaagggaugacuagcuuacaaauauucuguuaagggguaguuuuauaaagaaaa

SEQ ID NO: 239140 - RNA, 64 nt, Homo Sapiens
uccugcuauuuagacaaaaacaacugaucagugguucuguuaugucagcugacuuuguuaguau

SEQ ID NO: 239141 - RNA, 64 nt, Homo Sapiens
aaaugaugguacuuugacuuuugaggguuuuuauuucuguuauucacaaaauacucauucucau

SEQ ID NO: 239142 - RNA, 64 nt, Homo Sapiens
ggcuuugcuagaauucauauaauugguuguuaauuucuguuacuuacauugauauuggaauugg

SEQ ID NO: 239143 - RNA, 64 nt, Homo Sapiens
uuugaugucaggucaacauucaauuuauuaauacuucuguuaaauugagucuaacauauggucc

SEQ ID NO: 239144 - RNA, 64 nt, Homo Sapiens
auaccagccuuauaagguucguauugcuauguucuucuguuauuuauuucagcauggacuguuc

SEQ ID NO: 239145 - RNA, 64 nt, Homo Sapiens
aauuccuagaaaaguuuguuuuacuuuguuuuuauucuguuaaugcauucuuucuucucuuuac

SEQ ID NO: 239146 - RNA, 64 nt, Homo Sapiens
uggauauuacaguauuuuuaauugaaaguccuaauucuguuaaggaaaggaguugauuaaauuu

SEQ ID NO: 239147 - RNA, 64 nt, Homo Sapiens
aggagaugcucugauuguauaggugagacucuguuucuguuauuuuuaauugcuguaugaaaug

SEQ ID NO: 239148 - RNA, 64 nt, Homo Sapiens
gaaaggcagggaaugugccucuucuguggccagauucuguuauuugcaauuaaagcaaguuuuu

SEQ ID NO: 239149 - RNA, 64 nt, Homo Sapiens
agauaugucagcuugcuuucaaugagccuugggcuucuguuauugcuugagcauuuggaacucg

SEQ ID NO: 239150 - RNA, 64 nt, Homo Sapiens
guuuugcuaauuuaucagaaguauuuuuuacuuuuucuguuacauuuuguugucacaauuuacu

SEQ ID NO: 239151 - RNA, 64 nt, Homo Sapiens
caguucauuccagcaaucaugcacagaauucucauucuguuaucuugucuaccuagucuaggag

SEQ ID NO: 239152 - RNA, 64 nt, Homo Sapiens
ccucucuccccaccuucccucucccggcaacaucucugggaaucaacagcauauugacacguug

SEQ ID NO: 239153 - RNA, 64 nt, Homo Sapiens
aaaccuggcaagucaccugcagcccauggugagcucugggaagugugguugaggccuugggguc

SEQ ID NO: 239154 - RNA, 64 nt, Homo Sapiens
aaucggagacaaaagcaguuucucuccaacucccucugggaaggugaccuggccagagccaaga

SEQ ID NO: 239155 - RNA, 64 nt, Homo Sapiens
ggacagauggacagacagccacccugagaaccccucugggaaaaucuauuccugccaccacugg

SEQ ID NO: 239156 - RNA, 64 nt, Homo Sapiens
caugaagcuugaugcaagaacccuugaguaaaugucugggaaagcuccuccuccucuccacguu

SEQ ID NO: 239157 - RNA, 64 nt, Homo Sapiens
uagaaaaaguggggugaucuuacauucuuuuaauucugggaaauccaugguaauacagauaaaa

SEQ ID NO: 239158 - RNA, 64 nt, Homo Sapiens
gucauacugacaaaccaauugcaaaagaaaauacucugggaauauuauauguauaaaaauagga

SEQ ID NO: 239159 - RNA, 64 nt, Homo Sapiens
agaaccuagauauuuuguguuggcugauagaaacucugggaaacuacuuuugauuucauuuacu

SEQ ID NO: 239160 - RNA, 64 nt, Homo Sapiens
augauggggcuucaagggaguaacuuacuguccuucugggaacuaaguacucuauucucugcac

SEQ ID NO: 239161 - RNA, 64 nt, Homo Sapiens
uucccugaaaggugggaggcccugugugcuagugucugggaaguuucugugugugccccucacc

SEQ ID NO: 239162 - RNA, 64 nt, Homo Sapiens
ccaagagugcagccucugcccggccgccaccccgucugggaagugaggagcgucucugccuggc

SEQ ID NO: 239163 - RNA, 64 nt, Homo Sapiens
aagugaggagccccucugcccagcagccacccugucugggaagugaggagcgucuccgcccggc

SEQ ID NO: 239164 - RNA, 64 nt, Homo Sapiens
gaagauccauuugucuuuguggugucccugguccucugggaauaauucugaagagggagguuuu

SEQ ID NO: 239165 - RNA, 64 nt, Homo Sapiens
agauaauggcuucugauucaauggaagugcauccucugggaaaaggaucaugccagaaauaggg

SEQ ID NO: 239166 - RNA, 64 nt, Homo Sapiens
uggaugaguuaggauuuguaaugcuguugaaguuucugggaacacauaauauguagccaguuua

SEQ ID NO: 239167 - RNA, 64 nt, Homo Sapiens
ccauucauucugaagauugcauggaggaugaacaucugggaauccuguuaaugagaaggcugaa

SEQ ID NO: 239168 - RNA, 64 nt, Homo Sapiens
uuuguaccucuuuugcaggagggcccuguggcccucugggaagcaagaggcuugacucuggucu

SEQ ID NO: 239169 - RNA, 64 nt, Homo Sapiens
cauucacacgcccauugcagauuccccacucauuucugggaacaagcugcuuuuugggggugga

SEQ ID NO: 239170 - RNA, 64 nt, Homo Sapiens
acauauuugaacagugaugaguuuggggcugguuucugggaagggaacguuuauuuaguaaaga

SEQ ID NO: 239171 - RNA, 64 nt, Homo Sapiens
ucugcucccacugcagcucccggugcucucguguucugggaaggccugggugugugcacaagga

SEQ ID NO: 239172 - RNA, 64 nt, Homo Sapiens
gcagaaggccuuucccaccuuaagcuuccggggaucugggaauuuuacccccauucucuucugu

SEQ ID NO: 239173 - RNA, 64 nt, Homo Sapiens
aucuagacaguggaaaaagccauggugugugguuucugggaaccaccaacacuugcagguuuag

SEQ ID NO: 239174 - RNA, 64 nt, Homo Sapiens
acccaccaccacccaccacagaaaagcacaaaccucugggaaagacaacgucucucgggggcca

SEQ ID NO: 239175 - RNA, 64 nt, Homo Sapiens
ggccuggcaaguggccacgcccugugucagaccaucugggaauuaagcuccagacagacuuaca

SEQ ID NO: 239176 - RNA, 64 nt, Homo Sapiens
aggaacaagacuuuuucuaagagcuugacaacacucugggaauguuccuuauccucuccaugcu

SEQ ID NO: 239177 - RNA, 64 nt, Homo Sapiens
guauuuuuguagacuuuaauggcuauugaacccuucugggaaauguucaugguuuccuuugauu

SEQ ID NO: 239178 - RNA, 64 nt, Homo Sapiens
gaaauggagaauaagcagcaggguggagagagaaucugggaagagcccaggugggcacagagaa

SEQ ID NO: 239179 - RNA, 64 nt, Homo Sapiens
aucuccuugauacaacauuguauuguguaguacuucugggaaaggcaaugagauguuugggaag

SEQ ID NO: 239180 - RNA, 64 nt, Homo Sapiens
gacaguuucuuugacauauuugggaaaugacuuuucugggaaauguagaagucauggacuuuuc

SEQ ID NO: 239181 - RNA, 64 nt, Homo Sapiens
gacuuuucugggaaaugacaaagucauggacuuuucugggaaauaguugguagaauccauguag

SEQ ID NO: 239182 - RNA, 64 nt, Homo Sapiens
ggaugcuauucuauucugcuaaaggcagucuuucucugggaaaugcuaaaagcaugggaaaugu

SEQ ID NO: 239183 - RNA, 64 nt, Homo Sapiens
ugagaacuuguuuccagacccaaaagaucacauuucugggaagacuccagccagcugcugcaga

SEQ ID NO: 239184 - RNA, 64 nt, Homo Sapiens
aagaagaguaaacaggaaaccgcacccccucccuucugggaaacucccuccuccuguccucccc

SEQ ID NO: 239185 - RNA, 64 nt, Homo Sapiens
acaacaucauuccaaaaagaauuggacagcuacuucugggaaaacucagcgcuuaaaaaaacaa

SEQ ID NO: 239186 - RNA, 64 nt, Homo Sapiens
agugccugagucacagcugucuggguucuagaucucugggaaccgucuaggccucggugcuggc

SEQ ID NO: 239187 - RNA, 64 nt, Homo Sapiens
agcaccugagucacagcugucuggguucuagaccucugggaaccaucaguggugagugacuggc

SEQ ID NO: 239188 - RNA, 64 nt, Homo Sapiens
gcuuccaauggcaugggaguaaaucucgacgcuuucugggaacaggacagaggcaucuggauga

SEQ ID NO: 239189 - RNA, 64 nt, Homo Sapiens
ccuggcugguaagggccaagucccaccgguugcuucugggaagggguuucuaacacuagucugu

SEQ ID NO: 239190 - RNA, 64 nt, Homo Sapiens
cugccuaagaggcaaugaguguguuggcuugugaucugggaacucccaagaacagcaggcccac

SEQ ID NO: 239191 - RNA, 64 nt, Homo Sapiens
agucccgcgugcaaaggaaaugcgugcgcgcgcuucugggaaacaugcagaucugcguggcugg

SEQ ID NO: 239192 - RNA, 64 nt, Homo Sapiens
ccuagccccucacuuccagcugcccuguaauuuuucugggaaguccccagucaagcuccuagua

SEQ ID NO: 239193 - RNA, 64 nt, Homo Sapiens
ccaaggaggccuuggaaacgauucccccagucauucugggaacauguuguaagcacugacuggg

SEQ ID NO: 239194 - RNA, 64 nt, Homo Sapiens
ucccuucuacagccucagaaaccagacucguucuucugggaacccugcccacucccaggaccaa

SEQ ID NO: 239195 - RNA, 64 nt, Homo Sapiens
ggccagcgguauugcugaaggaaaggggcagcucucugggaagugggcccucagagauuacucu

SEQ ID NO: 239196 - RNA, 64 nt, Homo Sapiens
acugugaagauaguuuauuuuuauuccuugccaaucugggaauaugccuuuuuuguguguuugu

SEQ ID NO: 239197 - RNA, 64 nt, Homo Sapiens
gcuuccacugggacaaaacaacuaauugccuaagucugggaacuguaagauuaacaaauaggua

SEQ ID NO: 239198 - RNA, 64 nt, Homo Sapiens
cuucccauucuuagucaaccaagcaaagccuggcucugggaaaaugcucuaggggacgagcucc

SEQ ID NO: 239199 - RNA, 64 nt, Homo Sapiens
cauccaucaucugcugcacauagcagacuagaauucugggaacccugugcaauucagucugcuc

SEQ ID NO: 239200 - RNA, 64 nt, Homo Sapiens
cucagcucagcuucgugccuggguuccccacuggucugggaagacuguugugcuccauagagca

SEQ ID NO: 239201 - RNA, 64 nt, Homo Sapiens
caccugccuuuuguguaaugccaucuuuaauuuuucugggaacacauuuguacuucuuguaaga

SEQ ID NO: 239202 - RNA, 64 nt, Homo Sapiens
ggggacuacuuuggggcuuuuuuauucuuugggcucugggaacagggucuuguucucccaucug

SEQ ID NO: 239203 - RNA, 64 nt, Homo Sapiens
ccuugagaagauucuucccauucuccauuuguuaucugggaacuuauuaaauggaaacugaaac

SEQ ID NO: 239204 - RNA, 64 nt, Homo Sapiens
aaugagauuaauuccuuuccagguauuuuauaauucugggaagcaaaacccaugccucccccua

SEQ ID NO: 239205 - RNA, 64 nt, Homo Sapiens
uaggugcaguggcuuguuccuguagucccagcacucugggaaccuggguugggaggauugcuua

SEQ ID NO: 239206 - RNA, 64 nt, Homo Sapiens
uuccuugcuauuggagcuguuuuuccaagcaauaucugggaagagauuucucccucuagcacuu

SEQ ID NO: 239207 - RNA, 64 nt, Homo Sapiens
agaggauugcuugagcccaggaguucaauaccugucugggaaacaccucaucucuacaaaauac

SEQ ID NO: 239208 - RNA, 53 nt, Homo Sapiens
acgacccguuacccaccuagaggaagcgcgaugcuggaacacaucccugccuc

SEQ ID NO: 239209 - RNA, 64 nt, Homo Sapiens
cccuaauccgcccacaggaagccugcaguccuggaagcgcgagggccucaaaggcccgcucuac

SEQ ID NO: 239210 - RNA, 64 nt, Homo Sapiens
ggcgacuccugguguucgccccggacaagcgguuaagcgcgacccaggcacugcagcaccccua

SEQ ID NO: 239211 - RNA, 64 nt, Homo Sapiens
gcugccccucggacuccucgagggguugggugcuaagcgcgagccucgccgucccugcuggagc

SEQ ID NO: 239212 - RNA, 63 nt, Homo Sapiens
augaagaucagcuuggauaaaucugaaucaaagaagcgcgacaauucuggacagucaacuucc

SEQ ID NO: 239213 - RNA, 64 nt, Homo Sapiens
cagcaggcaggcucagaagaccagggauugacccaagcgcgauggcugcagaugcuuagcuggg

SEQ ID NO: 239214 - RNA, 64 nt, Homo Sapiens
cuggcuuccccagccugcggccgcaagcaaaaccaagcgcgagaugcagcuagcacccuucaua

SEQ ID NO: 239215 - RNA, 64 nt, Homo Sapiens; identical to SEQ ID NO: 226314

SEQ ID NO: 239216 - RNA, 64 nt, Homo Sapiens; identical to SEQ ID NO: 226315

SEQ ID NO: 239217 - RNA, 64 nt, Homo Sapiens; identical to SEQ ID NO: 226316

SEQ ID NO: 239218 - RNA, 64 nt, Homo Sapiens; identical to SEQ ID NO: 226317

SEQ ID NO: 239219 - RNA, 64 nt, Homo Sapiens; identical to SEQ ID NO: 226318

SEQ ID NO: 239220 - RNA, 64 nt, Homo Sapiens; identical to SEQ ID NO: 226319

SEQ ID NO: 239221 - RNA, 64 nt, Homo Sapiens; identical to SEQ ID NO: 226320

SEQ ID NO: 239222 - RNA, 64 nt, Homo Sapiens; identical to SEQ ID NO: 226321

SEQ ID NO: 239223 - RNA, 64 nt, Homo Sapiens; identical to SEQ ID NO: 226322

SEQ ID NO: 239224 - RNA, 64 nt, Homo Sapiens; identical to SEQ ID NO: 226323

SEQ ID NO: 239225 - RNA, 64 nt, Homo Sapiens; identical to SEQ ID NO: 226324

SEQ ID NO: 239226 - RNA, 64 nt, Homo Sapiens; identical to SEQ ID NO: 226325

SEQ ID NO: 239227 - RNA, 64 nt, Homo Sapiens; identical to SEQ ID NO: 226326

SEQ ID NO: 239228 - RNA, 64 nt, Homo Sapiens; identical to SEQ ID NO: 226327

SEQ ID NO: 239229 - RNA, 64 nt, Homo Sapiens; identical to SEQ ID NO: 226328

SEQ ID NO: 239230 - RNA, 64 nt, Homo Sapiens; identical to SEQ ID NO: 226329

SEQ ID NO: 239231 - RNA, 64 nt, Homo Sapiens; identical to SEQ ID NO: 226330

SEQ ID NO: 239232 - RNA, 64 nt, Homo Sapiens; identical to SEQ ID NO: 226331

SEQ ID NO: 239233 - RNA, 64 nt, Homo Sapiens; identical to SEQ ID NO: 226332

SEQ ID NO: 239234 - RNA, 64 nt, Homo Sapiens; identical to SEQ ID NO: 226333

SEQ ID NO: 239235 - RNA, 64 nt, Homo Sapiens; identical to SEQ ID NO: 226334

SEQ ID NO: 239236 - RNA, 64 nt, Homo Sapiens; identical to SEQ ID NO: 226335

SEQ ID NO: 239237 - RNA, 64 nt, Homo Sapiens; identical to SEQ ID NO: 226336

SEQ ID NO: 239238 - RNA, 64 nt, Homo Sapiens; identical to SEQ ID NO: 226337

SEQ ID NO: 239239 - RNA, 64 nt, Homo Sapiens; identical to SEQ ID NO: 226338

SEQ ID NO: 239240 - RNA, 64 nt, Homo Sapiens; identical to SEQ ID NO: 226339

SEQ ID NO: 239241 - RNA, 64 nt, Homo Sapiens; identical to SEQ ID NO: 226340

SEQ ID NO: 239242 - RNA, 64 nt, Homo Sapiens; identical to SEQ ID NO: 226341

SEQ ID NO: 239243 - RNA, 64 nt, Homo Sapiens
uuugcuucaaauaaacuuauuugaaaaguugucucaagucaaauggauucaucaccugucaugc

SEQ ID NO: 239244 - RNA, 64 nt, Homo Sapiens
cccacugugauuggcacaucgacaagggcugucccaagucaauggaaagggaaagggugggggu

SEQ ID NO: 239245 - RNA, 64 nt, Homo Sapiens
aguccugaagucuggaggcuagacuuccugaaagcaagucaagaauauagagcaccuugcagga

SEQ ID NO: 239246 - RNA, 64 nt, Homo Sapiens
ugaggccuacucuaaagaauucuugaaaaacuuacaagucaagccuagccugauaauccuauua

SEQ ID NO: 239247 - RNA, 64 nt, Homo Sapiens
uucucaaagaaaaucuuugaaagaaucaggaggucaagucaagaacaugaaaauuuauauuuua

SEQ ID NO: 239248 - RNA, 64 nt, Homo Sapiens
gggggaagcaccauaacuuuguuuagcccaaaaccaagucaagugaaaaaggaggaagagaaaa

SEQ ID NO: 239249 - RNA, 64 nt, Homo Sapiens
acagacugaagacagaggucguuugauuucaaagcaagucaaccugcuuuuuucuguuuuuaca

SEQ ID NO: 239250 - RNA, 64 nt, Homo Sapiens
uguauuuccucuccccauuuccaagugcuuccuccaagucaacaugaagcaaccaaagauauau

SEQ ID NO: 239251 - RNA, 64 nt, Homo Sapiens
aguaauaacugcucacuagugaaauauauuccaucaagucaaagaaagugucaguucuaauggg

SEQ ID NO: 239252 - RNA, 64 nt, Homo Sapiens
ugguauugaucuguguuaauauucucugggucaacaagucaagggcaccuaaaaucuaauuaga

SEQ ID NO: 239253 - RNA, 64 nt, Homo Sapiens
uugggcucucaaagcccugcgcuuucucucacuacaagucaagcccuaucgggcucccugcggg

SEQ ID NO: 239254 - RNA, 64 nt, Homo Sapiens
uaccuauuaaauauuccucuauaaaggcaagaagcaagucaacuuguccucaguauccaggaac

SEQ ID NO: 239255 - RNA, 64 nt, Homo Sapiens
uucacagcuggggaaguugaucuucuuuguuuagcaagucaaacacuggggaaaagcuguagua

SEQ ID NO: 239256 - RNA, 64 nt, Homo Sapiens
ccaggaggaccaggggugcacagaaguaacccagcaagucaaggccaaguucuucccauccuaa

SEQ ID NO: 239257 - RNA, 64 nt, Homo Sapiens
uuggauguaucaagguaaaaaauauauuaaaaagcaagucaaacggccuaauuuuauaucuaua

SEQ ID NO: 239258 - RNA, 60 nt, Homo Sapiens
uguacuugauccugcugaaaaggguuaacucaagucaaauaggugcuagaauugguauga

SEQ ID NO: 239259 - RNA, 64 nt, Homo Sapiens
uuaacuaaaaacuaagauaaacuuuccauauuuucaagucaauuaaauaccuuuaaagacaugc

SEQ ID NO: 239260 - RNA, 64 nt, Homo Sapiens
aggaaggagggagauggaaagcaggacacauuggcaagucaagcaguggaaggagggggaagca

SEQ ID NO: 239261 - RNA, 64 nt, Homo Sapiens
aagcugggcugggcaguaucaaacuaagagcucucaagucaagguggagauuggcaugccauug

SEQ ID NO: 239262 - RNA, 64 nt, Homo Sapiens
gcaaacaaacugaauguacaauguaaauggcucacaagucaauuacaagucuguacuauccacu

SEQ ID NO: 239263 - RNA, 64 nt, Homo Sapiens
auuugggggaaaaagaaugcaggagugaaauaaccaagucaaaaccauguacuaucuccuuggg

SEQ ID NO: 239264 - RNA, 64 nt, Homo Sapiens
guguuuagauuuaugguuguuaaaaaugucaucucaagucaagucacuggucuguuugcauuug

SEQ ID NO: 239265 - RNA, 64 nt, Homo Sapiens
uagcauccaguuacuauauauuuuuaaugaaaaacaagucaagcuaaauauauguuuguuuguu

SEQ ID NO: 239266 - RNA, 64 nt, Homo Sapiens
ugaaauuggaaugcaaaauugccaucguagguaucaagucaacaaaaagccuuuaaaacaaaaa

SEQ ID NO: 239267 - RNA, 64 nt, Homo Sapiens
ugagguaccuuuacagauuuagugaaaaugaaaccaagucaauauuccgcuuucaugggacaug

SEQ ID NO: 239268 - RNA, 64 nt, Homo Sapiens
aaaucuuaaagacacaaugcacauuaaaaugauacaagucaaaugaagugaaaacaaucagggc

SEQ ID NO: 239269 - RNA, 64 nt, Homo Sapiens
cuucuagaaguuguacagaaggacuaaagcuuaucaagucaacaaagaacuuaccuuggaggau

SEQ ID NO: 239270 - RNA, 64 nt, Homo Sapiens
gugcaacaguagcauaggacccuacccucugggccaagucaaagacauucugacaucuuaguau

SEQ ID NO: 239271 - RNA, 64 nt, Homo Sapiens
auuuaaaaaaaaaaaaaaaaagcaggaaagaucccaagucaaacaguguggcuuaaacauuuuu

SEQ ID NO: 239272 - RNA, 64 nt, Homo Sapiens
ucuuaaauaaugacuguguuuuauuguuuugauccaagucaaguguagccucucagccuuuugg

SEQ ID NO: 239273 - RNA, 64 nt, Homo Sapiens
cucacugccucaguuuggguaaaggaugagcagacaagucaacuaaagaaaaaagaaaagcaag

SEQ ID NO: 239274 - RNA, 64 nt, Homo Sapiens
uucuuccuuuuuucccucuguuuauauugcacaucaagucaaaaacauguuugggaaagauggu

SEQ ID NO: 239275 - RNA, 64 nt, Homo Sapiens
ggguguggagggaggaagggggucuaaggucuaucaagucaaucauuucucacuguguacauaa

SEQ ID NO: 239276 - RNA, 64 nt, Homo Sapiens
guuuuaaagaagaacuguaaaugacggugcuauacaagucaaaaaauacaugccugccucguag

SEQ ID NO: 239277 - RNA, 64 nt, Homo Sapiens
uuaggguucaguuuaucacuggacauucaggaggcaagucaaucuuuuuuauuuccuuauaaaa

SEQ ID NO: 239278 - RNA, 64 nt, Homo Sapiens
ucacaaugagauuccaguuuucauuagggaaaugcaagucaaaaaaaauacucaacauuauuau

SEQ ID NO: 239279 - RNA, 64 nt, Homo Sapiens
aaccucugcaucaauuuccuggauugaucuugagcaagucaauguggugugccuuuucuuggca

SEQ ID NO: 239280 - RNA, 64 nt, Homo Sapiens
uuuauuguuaggcuugcugcccuguuucuaaaugcaagucaagcggacagguuuacuuagaaau

SEQ ID NO: 239281 - RNA, 64 nt, Homo Sapiens
uuuaguaggaguguaaagugacauucuuaugaaacaagucaaaaaaguuuuuuucaggccaguu

SEQ ID NO: 239282 - RNA, 64 nt, Homo Sapiens
cuucaaacauaggugaaaaaaacacugccauucacaagucaaggaacccagggccagcuggaag

SEQ ID NO: 239283 - RNA, 64 nt, Homo Sapiens
guccagagucuaggcaauuuuuacaaccugaguucaagucaaauucugagccugggggguccuc

SEQ ID NO: 239284 - RNA, 64 nt, Homo Sapiens
uuuguuuuaguaccuguuuaaaaacuuaccuugucaagucaaaacuugugacaaaacaucuuuc

SEQ ID NO: 239285 - RNA, 64 nt, Homo Sapiens
gagauccagagaauccuggauuugauguauaggacaagucaacuugauugaaaaauugccauau

SEQ ID NO: 239286 - RNA, 64 nt, Homo Sapiens
acaggaagagaucagagugagcuaaaguaauuuacaagucaaagagggugagauuaaccuuuuu

SEQ ID NO: 239287 - RNA, 64 nt, Homo Sapiens
guuucugcuuucuugccuaaaucaaagacuauuucaagucaacaacacugaaaacugcuuuucg

SEQ ID NO: 239288 - RNA, 64 nt, Homo Sapiens
uauuagugagaugggaggauuuacagaagaaaagcaagucaaaaauauuuccuuuuugauguaa

SEQ ID NO: 239289 - RNA, 64 nt, Homo Sapiens
gaaaaauauuuaugaagcaucucaacuugaagaucaagucaaaguuauaacucaggaucugagg

SEQ ID NO: 239290 - RNA, 64 nt, Homo Sapiens
guaguauuuuugaucacuucaaauacauacucuucaagucaagaaauaaauuucuuuacauaga

SEQ ID NO: 239291 - RNA, 64 nt, Homo Sapiens
auagucugacuuugcuuuugaacaacagacauugcaagucaaaauuguugucaaauuuacauau

SEQ ID NO: 239292 - RNA, 64 nt, Homo Sapiens
gaacaacaccagggaaugccaaaaaaacaaagggcaagucaaccaaggcauuuugagaacauga

SEQ ID NO: 239293 - RNA, 64 nt, Homo Sapiens
auauaaaacauaugaauauaaagaaagaaagagacaagucaaauguaguaaaaugacaacacuu

SEQ ID NO: 239294 - RNA, 64 nt, Homo Sapiens
gguucuccugccucagccuucuaauuccugggcucaagucaaguauccuggcucacugcagccu

SEQ ID NO: 239295 - RNA, 64 nt, Homo Sapiens
ucuggaaucacauccaccuacccaguuucuugggcaagucaaauaauggcaauuaaaugugaaa

SEQ ID NO: 239296 - RNA, 64 nt, Homo Sapiens
auuuuuuuaacauuucauguuaggaaacaguuuucaagucaauaagauuggcuaaauauuuuau

SEQ ID NO: 239297 - RNA, 64 nt, Homo Sapiens
guauuagcagaauauuguccgacaaaugcagcagcaagucaauuuuaauauuagacaaacagua

SEQ ID NO: 239298 - RNA, 64 nt, Homo Sapiens
uggcugugccauguuuguagcaacugaggccuugcaagucaagcuguauguacaugggguccuu

SEQ ID NO: 239299 - RNA, 64 nt, Homo Sapiens
ccuuggcuccagcaugaaaauaaaaauccaaacccaagucaaaaaauaauaauaaauaaauaaa

SEQ ID NO: 239300 - RNA, 64 nt, Homo Sapiens
ucaccgacagugaugaggagcuucuagcauccagcaagucaaugcacagccccgacaucaacuc

SEQ ID NO: 239301 - RNA, 64 nt, Homo Sapiens
ccacugugccuagucacuuuaauugagauauuggcaagucaacugccaugcagagcccagggca

SEQ ID NO: 239302 - RNA, 64 nt, Homo Sapiens
gagagauucuuggcauguaauauauaucacugcucaagucaagccuccuaaaaccacagaccug

SEQ ID NO: 239303 - RNA, 64 nt, Homo Sapiens
uauauggcugaucaauuuucauacauugagaaaccaagucaaucaagcaggaaucauuuaaaaa

SEQ ID NO: 239304 - RNA, 64 nt, Homo Sapiens
auuucuagauucuccuuuguacagagucacuucacaagucaagcuacuguuuuacaggugcucc

SEQ ID NO: 239305 - RNA, 64 nt, Homo Sapiens
cauauacagcucucugcuccguguccccugggcucaagucaagcagucggugacagauuucauu

SEQ ID NO: 239306 - RNA, 64 nt, Homo Sapiens
uucucuuggcuggacaucauacuucaauaguaaccaagucaaggucaagcccaauggcuugaug

SEQ ID NO: 239307 - RNA, 64 nt, Homo Sapiens
gccuaccaaggcaauuggauaauguauaaaaccccaagucaaggggaaaccccggaacaaugcc

SEQ ID NO: 239308 - RNA, 64 nt, Homo Sapiens
aauguuggaagugguauuuaaguuaauuuuuuuacaagucaaaccuccaaaaguguuauuugua

SEQ ID NO: 239309 - RNA, 64 nt, Homo Sapiens
ucuuaagaaauacaaggacuaaacugugauuugacaagucaagccuugguuucagaaagaagau

SEQ ID NO: 239310 - RNA, 64 nt, Homo Sapiens
aaaacacaguaacaggaugaauauuaucugauaucaagucaaaaucaguuugaaaagaaggugu

SEQ ID NO: 239311 - RNA, 64 nt, Homo Sapiens
augcaaauuucagaggcuucuuuugaagauuccccaagucaagcaggcaagaugccuagaucuu

SEQ ID NO: 239312 - RNA, 64 nt, Homo Sapiens
caguuucaucagcauuacuugggaaaacguguugcaagucaaccagucacuaggauauuucuac

SEQ ID NO: 239313 - RNA, 64 nt, Homo Sapiens
cuggcccaaggggagugccuccuucgucaagcuccaagucaaggucccucugugugccugugcc

SEQ ID NO: 239314 - RNA, 64 nt, Homo Sapiens
uccaaaggagacauuggaccaguuaauucccauacaagucaagguaacagaacaaaagggaauc

SEQ ID NO: 239315 - RNA, 64 nt, Homo Sapiens
cauuuaaugugccaagaggucuaacucccauaugcaagucaauuuguguucucuaagaguuugg

SEQ ID NO: 239316 - RNA, 64 nt, Homo Sapiens
gggugagaugcgugcaggccaagccauggaaauacaagucaaagagggggcagguggggagggg

SEQ ID NO: 239317 - RNA, 64 nt, Homo Sapiens
aagcauugucccccgucucucaguucauaggugccaagucaauacccugggggccuguagccac

SEQ ID NO: 239318 - RNA, 64 nt, Homo Sapiens
augaagauuuugcagcacuggauaauuuaucucacaagucaaaaauaugaaaguauuguuuaua

SEQ ID NO: 239319 - RNA, 64 nt, Homo Sapiens
aaguguggguagcaaaaacaauucuaaaaauuugcaagucaaguuucugacuuuuagaaacaaa

SEQ ID NO: 239320 - RNA, 64 nt, Homo Sapiens
uaaauucuacagaaaauagugaagcaauagucuccaagucaauaucuuugccuucuccaaacaa

SEQ ID NO: 239321 - RNA, 64 nt, Homo Sapiens
uucaaaccagaugccuguacuaguuuuuagaccccaagucaaccuuucugagccacagcuuccc

SEQ ID NO: 239322 - RNA, 64 nt, Homo Sapiens
cgucccacacugccccccauuugaguacaccgcacaagucaaacgcuaggaaguuugaauaaaa

SEQ ID NO: 239323 - RNA, 64 nt, Homo Sapiens
gcauucuaacacuuuuauucccacagaaaaauuccaagucaaauuaucaaaucaaauacaaaaa

SEQ ID NO: 239324 - RNA, 64 nt, Homo Sapiens
acuuguggaaaauaggaaguauuuaguaaauaaacaagucaaagcugcaucccacguucuguua

SEQ ID NO: 239325 - RNA, 64 nt, Homo Sapiens
augccccauuccuugcgccugcacaguccagacccaagucaaagagggcaguacccuccauugg

SEQ ID NO: 239326 - RNA, 64 nt, Homo Sapiens
cauaaccaaguuuuugaacggcucuguccaccuucaagucaauugauaauuuuuccagucuuaa

SEQ ID NO: 239327 - RNA, 64 nt, Homo Sapiens
uuauguaucaguuauacagguaucccaccaaguucaagucaaaagaaauuccuaacuuuguaua

SEQ ID NO: 239328 - RNA, 64 nt, Homo Sapiens
aggucuaaaagucuuuauauuauauacucuguaucaagucaaaauaucuuuggccauuuugcua

SEQ ID NO: 239329 - RNA, 64 nt, Homo Sapiens
aaagauccuuaauauuguuagccauagggaaaugcaagucaaacucaaaucagaaugaaauauc

SEQ ID NO: 239330 - RNA, 64 nt, Homo Sapiens
aaaauccacccaccagucuuacuaugacagucuucaagucaauuacagguuuuaugauaauaga

SEQ ID NO: 239331 - RNA, 64 nt, Homo Sapiens
ugguguagccgguuccccggcccaaaacuuuuuccaagucaacuagggaugguuggggauacuu

SEQ ID NO: 239332 - RNA, 64 nt, Homo Sapiens
uugaguuuuauacuuguguuaaacugauaaauuacaagucaacaccauuuugucauuuuuguuu

SEQ ID NO: 239333 - RNA, 64 nt, Homo Sapiens
ugcacaucuauuauuuaaaauucuaguuuuuacccaagucaagcgccugggugggagaacaggu

SEQ ID NO: 239334 - RNA, 64 nt, Homo Sapiens
ccccauccucacacccacucucuguauagaaaaucaagucaaucucugcccugcacuuugcaua

SEQ ID NO: 239335 - RNA, 64 nt, Homo Sapiens
gagcauaguggggaaagaaauauagggggaagagcaagucaaaucugaaugacucaggguaccc

SEQ ID NO: 239336 - RNA, 64 nt, Homo Sapiens
ggaccacucuccacuccacgacuucugaccucaccaagucaagugacgacagggaucuucagga

SEQ ID NO: 239337 - RNA, 64 nt, Homo Sapiens
agacgacccaucucagaaugguggaucaaagcagcaagucaauuugccuuguaugcaacuuaug

SEQ ID NO: 239338 - RNA, 64 nt, Homo Sapiens
uguaguuucuugaggccaaacacacuguauuuuacaagucaaaauauaauuuacauuaaucacu

SEQ ID NO: 239339 - RNA, 64 nt, Homo Sapiens
auggauuuaacagcaccucaaagucaacaugccccaagucaaagucuucuuuacccauggaaua

SEQ ID NO: 239340 - RNA, 64 nt, Homo Sapiens
aauucccuacuaucaucacaugccuccccaaccccaagucaaaaacaagaggaaugguacuaca

SEQ ID NO: 239341 - RNA, 64 nt, Homo Sapiens
caaaguccagccgagucaaaggaaagagaaaagacaagucaagagagaaagugggaccaggggg

SEQ ID NO: 239342 - RNA, 64 nt, Homo Sapiens
uacugaauuccuuuuuuaaagcaaugguuauuuacaagucaaucuuuuugcagauucaaaaucu

SEQ ID NO: 239343 - RNA, 64 nt, Homo Sapiens
caagucagcccguuaaggaggauaccauucucaacaagucaauccuccugacucauuaauaaug

SEQ ID NO: 239344 - RNA, 64 nt, Homo Sapiens
auuaugucaugugaaaaugugagcuguguaccaccaagucaauguaucagugaaagcuggacuu

SEQ ID NO: 239345 - RNA, 64 nt, Homo Sapiens
agugacuagcuuccuguagcaucgccuuguggaacaagucaaucuuauaaguuauguaagaauc

SEQ ID NO: 239346 - RNA, 64 nt, Homo Sapiens
ccaggcacggcggcucacgcucacuucagaaucucaagucaaggcacaaucagugugaauaaau

SEQ ID NO: 239347 - RNA, 64 nt, Homo Sapiens
aagcaucugccuccaggaccauucaggcuguugacaagucaacuccucauggcuguaggacuga

SEQ ID NO: 239348 - RNA, 64 nt, Homo Sapiens
ugacuucauaaaagccaucucagagccauugauacaagucaaucuuacuauauguaacuucaga

SEQ ID NO: 239349 - RNA, 64 nt, Homo Sapiens
gaguaauaaauucacaugaaaaggagacaauaaucaagucaaaagaauaaaugcuuacuaauca

SEQ ID NO: 239350 - RNA, 64 nt, Homo Sapiens
uuuaauuucucuugaaaauaauuuccucaaagcccaagucaauaaauguuaucagccagucuuc

SEQ ID NO: 239351 - RNA, 64 nt, Homo Sapiens
uuaauguccauucccuccuaacaaauucucuucccaagucaacugcaacugcggcugaaucacc

SEQ ID NO: 239352 - RNA, 64 nt, Homo Sapiens
aaagagccuauauuccucuuuuucccacaccgaucaagucaacucaguacucacgggagaaaaa

SEQ ID NO: 239353 - RNA, 64 nt, Homo Sapiens
cugccaagguaccuagguuggaguccagccuaaucaagucaaauggagaaacaggcccagagag

SEQ ID NO: 239354 - RNA, 64 nt, Homo Sapiens
gcaauugcagcugaaucaccacaaauucucuccccaagucaacuaauguccauugucucuccua

SEQ ID NO: 239355 - RNA, 64 nt, Homo Sapiens
gagcuggggccaggcagcugcaccagaacccuaucaagucaaaaacaagcucagucuaaucaaa

SEQ ID NO: 239356 - RNA, 64 nt, Homo Sapiens
uugcagaacccuguaucuccuuuuuaauuaaauucaagucaaaugucguuuuuuuuaaaaaaau

SEQ ID NO: 239357 - RNA, 64 nt, Homo Sapiens
cauacuuggccucucccugacuucauuccuucaacaagucaagucuggacaagauggguaaggg

SEQ ID NO: 239358 - RNA, 64 nt, Homo Sapiens
ugguguugcccaaaucgcaguugaucccuaugaccaagucaaguaaccagagggugcacaugac

SEQ ID NO: 239359 - RNA, 64 nt, Homo Sapiens
acuggcuuucaccuugcccuaacaaacuagcugucaagucaagguuaaaauaaaaggggagaag

SEQ ID NO: 239360 - RNA, 64 nt, Homo Sapiens
uuggauacuuggauuuaguuuuauuucuuccuaccaagucaaacuuuguuuguuuguuuaauuu

SEQ ID NO: 239361 - RNA, 64 nt, Homo Sapiens
cccccaccccacaaaauaugagaauuugacaguacaagucaaauuccaugaagccagggcacaa

SEQ ID NO: 239362 - RNA, 64 nt, Homo Sapiens
aaccaaaaaagggggaggcaaacacuaaauuuugcaagucaaguuggggcuaugcaugaaaccc

SEQ ID NO: 239363 - RNA, 64 nt, Homo Sapiens
ucccccauucucuaaucaccauuauuaaucauaucaagucaauuaguuugguuucacacuaaua

SEQ ID NO: 239364 - RNA, 64 nt, Homo Sapiens
ucacuucacacagaccuuuugccuuuuuuagcugcaagucaaggacuagguugaugaugcccau

SEQ ID NO: 239365 - RNA, 64 nt, Homo Sapiens
uguuuuaguaguaagguuuucuuuuucuauuguacaagucaaugaaauaugaucacgcaacuua

SEQ ID NO: 239366 - RNA, 64 nt, Homo Sapiens
uguguuuaauuuuuaaaaaguuuuuauugagauacaagucaauaccauaaagcucucacccuuc

SEQ ID NO: 239367 - RNA, 64 nt, Homo Sapiens
gccauuauuuguauugaaguaugcaaaaucauuucaagucaauuuguagggccuguacaaauaa

SEQ ID NO: 239368 - RNA, 64 nt, Homo Sapiens
aacaacuuaacuauugcugcuaguuauauguauacaagucaaaguuugagaauugugaaacaga

SEQ ID NO: 239369 - RNA, 64 nt, Homo Sapiens
aauguagaaagcuuugcuuaugccagaaguuugucaagucaaccuuccaaagagaaaaaaaguu

SEQ ID NO: 239370 - RNA, 64 nt, Homo Sapiens
guuaucagcacucagacaugcuguugcuuaccaucaagucaacaauaccuguuccacugagcuc

SEQ ID NO: 239371 - RNA, 64 nt, Homo Sapiens
aaugcuuugucugucacuaccugggcucccuuuccaagucaagacgucuccucccucuccuucc

SEQ ID NO: 239372 - RNA, 63 nt, Homo Sapiens
ccaaggacccaacugcagcaggagcuucaguugcaagucaauguuccuccuaccaacuccuga

SEQ ID NO: 239373 - RNA, 64 nt, Homo Sapiens
cuuugguucuugaauagcuuaguuucuuuaauaacaagucaaacuuuauuacaacaauaacuga

SEQ ID NO: 239374 - RNA, 64 nt, Homo Sapiens
ugaauaucauagccuuuacuaucacuacagaccccaagucaagauaccucucgcucccaugccc

SEQ ID NO: 239375 - RNA, 64 nt, Homo Sapiens
cucuuacaagacuuaguggaaagaagugguucuucaagucaaccuaucuacuauauaugacugg

SEQ ID NO: 239376 - RNA, 64 nt, Homo Sapiens
aaacccaaaggggcuucacugaagagcccacuuccaagucaauaaaaagcaacuccugccuccc

SEQ ID NO: 239377 - RNA, 64 nt, Homo Sapiens
aacuuacuaauagggauguuaaaaguaacaaaaccaagucaaacuugguguauuuuuauuuuaa

SEQ ID NO: 239378 - RNA, 64 nt, Homo Sapiens
uuuaaaugagacuuguuuuccccucucuuugagucaagucaaauauguagauugccuuuggcaa

SEQ ID NO: 239379 - RNA, 64 nt, Homo Sapiens
ccuaauuaaccaaagcacucguaaugccaaaaaccaagucaaagggaaugauauaauuauacaa

SEQ ID NO: 239380 - RNA, 64 nt, Homo Sapiens
ugaaucauuuaguugacucuaaggugaaauguaucaagucaaagaauagauggagacaaaggac

SEQ ID NO: 239381 - RNA, 64 nt, Homo Sapiens
ugucaguagcuucuucuggcaccuaacauaaggacaagucaauuccucucccccucauaacccc

SEQ ID NO: 239382 - RNA, 64 nt, Homo Sapiens
agggacuucuuuuuaauuugccaccuacacccaacaagucaauggugugggaggacauggggua

SEQ ID NO: 239383 - RNA, 64 nt, Homo Sapiens
aauaacgaugaaugucuuuuugguuguaauuuaacaagucaaauaaaauaaucauugcugagca

SEQ ID NO: 239384 - RNA, 64 nt, Homo Sapiens
acguauucagcauuaaagaucugaagaaaaaaagcaagucaaguaagggaugcuagaaauucaa

SEQ ID NO: 239385 - RNA, 64 nt, Homo Sapiens
ucuaauguguguacuucauaagaggcaaacuaagcaagucaaauugauaaagguagaggcacaa

SEQ ID NO: 239386 - RNA, 64 nt, Homo Sapiens
agccauucuuagaacuagagucuaaacuuaaagacaagucaaaagcauugcacacuuuuuccuu

SEQ ID NO: 239387 - RNA, 64 nt, Homo Sapiens
caggcaauacagaggagaagaaggaaauguaauacaagucaaaccuagcaguccaugacuuuuu

SEQ ID NO: 239388 - RNA, 64 nt, Homo Sapiens
uacaucacuuguaucuccaguguuuuguauugcccaagucaaaccauuuaauuccuaugacuuu

SEQ ID NO: 239389 - RNA, 64 nt, Homo Sapiens
accccacucccaaugaugaggggcauuuucauugcaagucaaaggcaagacaggcuuccauaaa

SEQ ID NO: 239390 - RNA, 64 nt, Homo Sapiens
uguuguuuagguuagugucacagccauuacagcacaagucaaagucgccaguugaauuuucauu

SEQ ID NO: 239391 - RNA, 64 nt, Homo Sapiens
uaucuuuauuaaucacuauuguuccagcaguuuucaagucaaauuaauaaucuuauuagggaga

SEQ ID NO: 239392 - RNA, 64 nt, Homo Sapiens
ccacuuuaauuuaaaaguucaugucauuuaaaaacaagucaagaaauuaaaauuguaucagagg

SEQ ID NO: 239393 - RNA, 64 nt, Homo Sapiens
uguccugcggaccccagagcccccgggaagggcgcaagucaaagagcacuggaggcaccgccgg

SEQ ID NO: 239394 - RNA, 64 nt, Homo Sapiens
gguccaguacccuucaaccaugcugugaucggugcaagucaagaacucuuaacuggaagaaauu

SEQ ID NO: 239395 - RNA, 64 nt, Homo Sapiens
auauacacauuuguguauguggaaaugugcugggcaagucaaaacuauagaagaguugccuccu

SEQ ID NO: 239396 - RNA, 64 nt, Homo Sapiens
cuuuuuuugcacuguugaaauugggcuuggcacucaagucaaagaugaacaucggaauaacaaa

SEQ ID NO: 239397 - RNA, 64 nt, Homo Sapiens
gccuggauggagcuccagggcuggggaacguccgcaagucaaugcucagagaugcccggagcug

SEQ ID NO: 239398 - RNA, 64 nt, Homo Sapiens
ucuugcuuagaaaguccuucugguggcaacuuuccaagucaagguucucacagagcuggggagu

SEQ ID NO: 239399 - RNA, 64 nt, Homo Sapiens
ccacagccuguccugugucucaggcucaauaaagcaagucaaaggcuugcucccugcucccaca

SEQ ID NO: 239400 - RNA, 64 nt, Homo Sapiens
cgccccuuguagaaaaauccccaccuugcacccgcaagucaagcucaacucucuucggucguau

SEQ ID NO: 239401 - RNA, 64 nt, Homo Sapiens
agaaccacaacagguuggucugagaccccccccccaagucaaucccucuuggagaagcuguugc

SEQ ID NO: 239402 - RNA, 64 nt, Homo Sapiens
uuucaccuccugaguuuauuaaacaccaagaaaccaagucaacucacugccugccagaaaacaa

SEQ ID NO: 239403 - RNA, 64 nt, Homo Sapiens
gucuuguuguuuaaauaaacgauaguuuucccuucaagucaagcuaaaacaaaaaagaauccua

SEQ ID NO: 239404 - RNA, 64 nt, Homo Sapiens
gugaaucauuuuucacuacuucauuagaagaggacaagucaaaaagcaagcagguuucacugcu

SEQ ID NO: 239405 - RNA, 64 nt, Homo Sapiens
uuugcacauauuuauauuuaacaaaaucccaauccaagucaaacggagaugcuugaagaacuca

SEQ ID NO: 239406 - RNA, 64 nt, Homo Sapiens
guguuggaggaggucaagagaauggcuggguaagcaagucaaggccacccguguagcuacugaa

SEQ ID NO: 239407 - RNA, 64 nt, Homo Sapiens
uuauagcaguccccacaacaucaaagaaccaccacaagucaauagauuugaguuuaauuggaaa

SEQ ID NO: 239408 - RNA, 64 nt, Homo Sapiens
agaaauguacaaaucgagauggagcaaaaauuugcaagucaaauaccaaacgagaaaauuuaaa

SEQ ID NO: 239409 - RNA, 64 nt, Homo Sapiens
aguucauauggaaccaaaaaagagcccacauugccaagucaauccuaagccaaaugaauaaagc

SEQ ID NO: 239410 - RNA, 64 nt, Homo Sapiens
agcaugcagggggccuuccuagccaguucugcugcaagucaaccuccugggaagaagaagcucc

SEQ ID NO: 239411 - RNA, 64 nt, Homo Sapiens
ccaacccccuuguuaccuugaugucagacacacccaagucaaucacuaaauuucuuucucaauu

SEQ ID NO: 239412 - RNA, 64 nt, Homo Sapiens
cugaggaugaagagggagaauaaacagcgaucuccaagucaagacgcaauucuaaguuucuaga

SEQ ID NO: 239413 - RNA, 64 nt, Homo Sapiens
aaguucucucuugucacugacaaggaagaaguaccaagucaaccauacugaggaguugaaagaa

SEQ ID NO: 239414 - RNA, 64 nt, Homo Sapiens
uucaugcagcagaauccccaagaaaaucuucagccaagucaaacuuauggaaguggucuuugug

SEQ ID NO: 239415 - RNA, 64 nt, Homo Sapiens
uuucuucuaacugccccucaacuaccauuaucuucaagucaacaugcauauuacauuuucaucc

SEQ ID NO: 239416 - RNA, 64 nt, Homo Sapiens
cgccccccaccuuugggaucagccuccgccauuccaagucaacacucuucuugagcagaccgug

SEQ ID NO: 239417 - RNA, 64 nt, Homo Sapiens
uugcauacuaugguuugacuugcuuuggaauuuucaagucaaagucccaacccuuugccucucc

SEQ ID NO: 239418 - RNA, 64 nt, Homo Sapiens
aaaaacacaaugucccuaccguguaaauagaauccaagucaauugugacugcaauuccaaguua

SEQ ID NO: 239419 - RNA, 64 nt, Homo Sapiens
uuauuuucucuucuuccucaucgaaacuacauugcaagucaacaaauuccaaauuaucaguuaa

SEQ ID NO: 239420 - RNA, 64 nt, Homo Sapiens
accuccuggccaaguccugccagucucaucccagcaagucaaagaauuucucccugcaagcgcu

SEQ ID NO: 239421 - RNA, 64 nt, Homo Sapiens
uuuuucccccuuuuuauauacagaaugaaguauacaagucaaugcgcgaacgcugugcguuugu

SEQ ID NO: 239422 - RNA, 64 nt, Homo Sapiens
uucuccaaggccugagggcaagacucaugaugagcaagucaaccccaaucuggaacaauguccc

SEQ ID NO: 239423 - RNA, 64 nt, Homo Sapiens
gagaaccagggaagcugugauccacuggccaggacaagucaacaugggugaggguugggcaaag

SEQ ID NO: 239424 - RNA, 64 nt, Homo Sapiens
uuuaaaaaaaaaaaaaaacugccuuucuuccccucaagucaacuuuugugcuccagaaaauuuu

SEQ ID NO: 239425 - RNA, 64 nt, Homo Sapiens
gacugggcaccugccucugaacaauucagagaagcaagucaaagacaauuccagcacaauuaug

SEQ ID NO: 239426 - RNA, 64 nt, Homo Sapiens
uaguucucacuacaauguucacauugaugauucccaagucaauaagcuugccaacauaauggac

SEQ ID NO: 239427 - RNA, 64 nt, Homo Sapiens
uccaaacaauuuaaaaaugagugugaagggggaacaagucaaaauauuuuuaaaagaucuucaa

SEQ ID NO: 239428 - RNA, 64 nt, Homo Sapiens
uggaggcagagggcaagggaggggugguauuaaacaagucaauucugugugguauauuguuuaa

SEQ ID NO: 239429 - RNA, 64 nt, Homo Sapiens
cuccugacucauuacuaauggauaccauucucaacaagucaauccaaaucagcccguuaaggag

SEQ ID NO: 239430 - RNA, 64 nt, Homo Sapiens
cugcuugugaugagagccuccacacuguacuguucaagucaauguuaauaaagcauuucaaaac

SEQ ID NO: 239431 - RNA, 64 nt, Homo Sapiens
aaaucugaguggcuucucuaagcaucugcugguacaagucaauguggcaccaugagcuucaugg

SEQ ID NO: 239432 - RNA, 64 nt, Homo Sapiens
ggaauaacuugucuucaaacacacccuucuuacccaagucaauuaagggucagaaauaccauuc

SEQ ID NO: 239433 - RNA, 64 nt, Homo Sapiens
accacaugauuuuacucauauguguuuuaaaaggcaagucaaauaaguaagacagauucuucac

SEQ ID NO: 239434 - RNA, 64 nt, Homo Sapiens
gcacguggcugcccugcccuacugugggcauagcgcccgccaugacagugaguguccuuagggg

SEQ ID NO: 239435 - RNA, 64 nt, Homo Sapiens
cgccgccuguggugccuggucucccggcccuagcgcccgccaaaccuggugguccugggcggcc

SEQ ID NO: 239436 - RNA, 64 nt, Homo Sapiens
uguguuuauuucuaauguccaaaaacucuacauggucgcaaaaauauuuaauucuuuaaaaagu

SEQ ID NO: 239437 - RNA, 64 nt, Homo Sapiens
ugaucagagucacagaguaguuaauagauuaacugucgcaaauuaaaucagggcaauauaagac

SEQ ID NO: 239438 - RNA, 64 nt, Homo Sapiens
cuuuggggucuugcggcugaugggaggaacaugcgucgcaaacuuucaaccgcggcuucaaggc

SEQ ID NO: 239439 - RNA, 64 nt, Homo Sapiens
acucaguaaaggaaauuaaagggucugcugccacgucgcaaaccuaaccaggcucgcacacaca

SEQ ID NO: 239440 - RNA, 64 nt, Homo Sapiens
acccuugcguuuuguugggacauguggaccgugagucgcaaacacucuggagaaggcugagaug

SEQ ID NO: 239441 - RNA, 64 nt, Homo Sapiens
ggauaaucugggaaagacacuuuuugcuuguguugucgcaaaggaugccuuaccuuuguaaaua

SEQ ID NO: 239442 - RNA, 64 nt, Homo Sapiens
auaauuaguuaugacagccauuuguaaugaauuugucgcaaagacguaauaaaauuaacuggug

SEQ ID NO: 239443 - RNA, 64 nt, Homo Sapiens
uccucuaggucucguagccgaucccguucccguagucgcaaaucuuacagccggucaagaagca

SEQ ID NO: 239444 - RNA, 64 nt, Homo Sapiens
cacugcgccaggagccgccugcgaccgcccgggcgucgcaaaccgcccgccugcucucugauuu

SEQ ID NO: 239445 - RNA, 64 nt, Homo Sapiens
gaaccaaacuucuggcuagggaccccucaaacaugucgcaaaaugaggguugaguuucucuaag

SEQ ID NO: 239446 - RNA, 64 nt, Homo Sapiens
gcuggggagguaaccgugacuacugcucacaaacgucgcaaagcagaaacugaaaacugguagg

SEQ ID NO: 239447 - RNA, 64 nt, Homo Sapiens
aauuguuucuaguuaggccacgcuccucuguucagucgcaaaggugaacacucaugcggcccag

SEQ ID NO: 239448 - RNA, 64 nt, Homo Sapiens
aacuagcugggaaaagacgaacaguuuuccacaaggacuuuaauuguucacuguacaaaagcuu

SEQ ID NO: 239449 - RNA, 64 nt, Homo Sapiens
gaauuuaagaaauacauuuuugccucauguuggaggacuuuaugcuuuuuagacguuaucauuu

SEQ ID NO: 239450 - RNA, 64 nt, Homo Sapiens
aagaauaaguauuugagaaagugcaaauuucaugggacuuuaaauuuaugcaacaagcauguuu

SEQ ID NO: 239451 - RNA, 64 nt, Homo Sapiens
uucacauguuaaaugcuggaauccuaauguucugggacuuuauuuugaacuaaucaaggaauaa

SEQ ID NO: 239452 - RNA, 64 nt, Homo Sapiens
cauuuggauugauuuuuauacacauagauuuucaggacuuuaccuuuuguuuuguuuuuuuccu

SEQ ID NO: 239453 - RNA, 64 nt, Homo Sapiens
ggcuugaacuuaaaucucagcucagucaccugcaggacuuuaggcaccagugauuucacccuuc

SEQ ID NO: 239454 - RNA, 64 nt, Homo Sapiens
auaccuucuugacaaaaaucaaaacaaaaaggagggacuuuaaacugcagcagaaaucgaauuu

SEQ ID NO: 239455 - RNA, 64 nt, Homo Sapiens
uuguaacauaucaauuauaauugcaguugcuaagggacuuuauuacuuacuuucccaugaacac

SEQ ID NO: 239456 - RNA, 64 nt, Homo Sapiens; identical to SEQ ID NO: 160506

SEQ ID NO: 239457 - RNA, 64 nt, Homo Sapiens; identical to SEQ ID NO: 160507

SEQ ID NO: 239458 - RNA, 64 nt, Homo Sapiens; identical to SEQ ID NO: 160508

SEQ ID NO: 239459 - RNA, 64 nt, Homo Sapiens; identical to SEQ ID NO: 160509

SEQ ID NO: 239460 - RNA, 64 nt, Homo Sapiens; identical to SEQ ID NO: 160510

SEQ ID NO: 239461 - RNA, 64 nt, Homo Sapiens; identical to SEQ ID NO: 160511

SEQ ID NO: 239462 - RNA, 64 nt, Homo Sapiens; identical to SEQ ID NO: 160512

SEQ ID NO: 239463 - RNA, 64 nt, Homo Sapiens; identical to SEQ ID NO: 160513

SEQ ID NO: 239464 - RNA, 64 nt, Homo Sapiens; identical to SEQ ID NO: 160514

SEQ ID NO: 239465 - RNA, 64 nt, Homo Sapiens; identical to SEQ ID NO: 160515

SEQ ID NO: 239466 - RNA, 64 nt, Homo Sapiens; identical to SEQ ID NO: 160516

SEQ ID NO: 239467 - RNA, 64 nt, Homo Sapiens; identical to SEQ ID NO: 160517

SEQ ID NO: 239468 - RNA, 64 nt, Homo Sapiens
cagaagcaggguggaggggaacucuugguuucgucucccacauaaaugccugcugcccccaaug

SEQ ID NO: 239469 - RNA, 64 nt, Homo Sapiens
ccuguguucuuggggcugcugcugguccuucucccucccacaggcaagugggguuggggguggg

SEQ ID NO: 239470 - RNA, 64 nt, Homo Sapiens
gccagggccaggcuccccauuccuucucucugcacucccacaaagcuugauuuccccucugccu

SEQ ID NO: 239471 - RNA, 64 nt, Homo Sapiens
caccccaauauuacaagcacugucugcuacugcccucccacaguugggaaagccauuacucuug

SEQ ID NO: 239472 - RNA, 64 nt, Homo Sapiens
cgacaaagucacagacauccgagaaaggucauuucucccacacacuauuauauucccacauccu

SEQ ID NO: 239473 - RNA, 64 nt, Homo Sapiens
cggccaaguuaugucuuauuacggcugaugaggacucccacaacgggugaggacuuggucuguc

SEQ ID NO: 239474 - RNA, 64 nt, Homo Sapiens
acauuucccuucugcacugcacucugugugggggcucccacaccuaggcagugccccaguaggg

SEQ ID NO: 239475 - RNA, 64 nt, Homo Sapiens
acgugggaauucugguagaucuccccuugggucucucccacaacggcccccaugauucaauuac

SEQ ID NO: 239476 - RNA, 64 nt, Homo Sapiens
cugcuagccuugaggcgcggacccucccccauaccucccacaguaucccagcgccucaugcccc

SEQ ID NO: 239477 - RNA, 64 nt, Homo Sapiens
ccucccaguauuucaucaaggacagggaauaucccucccacacacaggccagcugcucacccug

SEQ ID NO: 239478 - RNA, 64 nt, Homo Sapiens
ggaaucucuucucugauccuucuuccuuaauucacucccacacccaagaagaaaugcuuuccaa

SEQ ID NO: 239479 - RNA, 64 nt, Homo Sapiens
caguaugaaccuaacuccccaccccaacaucucccucccacauugucaccauuucaaagggccc

SEQ ID NO: 239480 - RNA, 64 nt, Homo Sapiens
ggauuuuguuucauuuaaccucucuuugcacccucucccacaacaaauaccaagcaucaaaagc

SEQ ID NO: 239481 - RNA, 64 nt, Homo Sapiens
ggaaagcuacaugauaguauuuuuaugcacucuucucccacacauacacacacgugcauguauc

SEQ ID NO: 239482 - RNA, 64 nt, Homo Sapiens
cuuauaaauuauaagucuuauauaauuuauaagucucccacaaucuuccaguucuuacccagug

SEQ ID NO: 239483 - RNA, 64 nt, Homo Sapiens
ccaccgucucaccccugcggaggagcgcucccgucucccacaggugccuuaccgcguucccucc

SEQ ID NO: 239484 - RNA, 64 nt, Homo Sapiens
uugugcccuccacagugugggugucuuccaggcccucccacagcacugggagaaucucugaggc

SEQ ID NO: 239485 - RNA, 64 nt, Homo Sapiens
guggcaggacugggagaaucuuccuuugaagugucucccacaggcuggucacaugaguuuacga

SEQ ID NO: 239486 - RNA, 64 nt, Homo Sapiens
ccccgccuccuccugccgccuccgccagcccucccucccacacugccccagcagggcuggcccg

SEQ ID NO: 239487 - RNA, 64 nt, Homo Sapiens
uaagcagugagggcggcugcaggagaggaaggggcucccacagcccccacugaugccgcugcag

SEQ ID NO: 239488 - RNA, 64 nt, Homo Sapiens
uggcccccaugauucaauuaccucccccgggucccucccacaacacaugggaauucugagagau

SEQ ID NO: 239489 - RNA, 64 nt, Homo Sapiens
ggccccccugauucgaugaccucccccugggucccucccacaacaugugggaauuccagaagau

SEQ ID NO: 239490 - RNA, 64 nt, Homo Sapiens
cucaggucccagggcacagaacccaucugcccugcucccacaugccaaccccuggccuccugcc

SEQ ID NO: 239491 - RNA, 64 nt, Homo Sapiens
cucccucggaggcaugccaugccagcuuggccuccucccacagcagggcaaagaacccgagccu

SEQ ID NO: 239492 - RNA, 64 nt, Homo Sapiens
cuuugaggugaauuacaaaagaguugaguuggcucucccacaguauaugcacagacuauacagu

SEQ ID NO: 239493 - RNA, 64 nt, Homo Sapiens
cucugaagccagugucuagcguugauuucccccacucccacaaaucuagaguaguuuugaaugg

SEQ ID NO: 239494 - RNA, 64 nt, Homo Sapiens
aaaacguggguuaagagaacgucaauggccaucccucccacaaacauauuuuaauuuaaucucu

SEQ ID NO: 239495 - RNA, 64 nt, Homo Sapiens
ucucacaucauggggaggccaaugucccucuuuucucccacacaccaccgugugcaugugcauc

SEQ ID NO: 239496 - RNA, 64 nt, Homo Sapiens
guaaacacacgugcacacaucguacacaugugagcucccacacguacacacagaugcacaugga

SEQ ID NO: 239497 - RNA, 64 nt, Homo Sapiens
ccacaaacgagcucccagacauguaaacacacgucucccacacgugagcucccacacguacaca

SEQ ID NO: 239498 - RNA, 64 nt, Homo Sapiens
ccagacauguaaacacacgucucccacacgugagcucccacacguacacaugcacauguacgca

SEQ ID NO: 239499 - RNA, 64 nt, Homo Sapiens
ccuacccacguuugagcuggcccacauucuuauucucccacaucccacuuuuucucuugguucu

SEQ ID NO: 239500 - RNA, 64 nt, Homo Sapiens
cuuauucucccacaucccuauuuuucucuugguucucccacauucuccacucucccagccccac

SEQ ID NO: 239501 - RNA, 64 nt, Homo Sapiens
ucaagcuccuccucuuagaggaagcagcuccuuccucccacaggagccccaagggagcacucac

SEQ ID NO: 239502 - RNA, 64 nt, Homo Sapiens
aauccaucccccuguuuucagggaccucugccuucucccacaccccuuacacuagugaggacuc

SEQ ID NO: 239503 - RNA, 64 nt, Homo Sapiens
gcuuuggugcuguuaccuugucccugagaagcuucucccacaguaaacuguaggaagggugcuc

SEQ ID NO: 239504 - RNA, 64 nt, Homo Sapiens
uacagccagaaucaacauucgcacuucuccaccccucccacauucuuccucuucuccuuuuucc

SEQ ID NO: 239505 - RNA, 64 nt, Homo Sapiens
ccucucuucaagaagggcccuuugucuuucuccacucccacacaccuuucccaccaagccuuga

SEQ ID NO: 239506 - RNA, 64 nt, Homo Sapiens
gggagauggcuggcagggucuuccaaguaccuuccucccacacugccaaguauacacaacuucc

SEQ ID NO: 239507 - RNA, 64 nt, Homo Sapiens
ugcccauagcuagcauucaaccccuggagucucacucccacacagauucccgcuucugaaacuc

SEQ ID NO: 239508 - RNA, 64 nt, Homo Sapiens
aucccagauccucaggaaaaagaggaccuccuuucucccacagaaaaagucggccuggugccag

SEQ ID NO: 239509 - RNA, 64 nt, Homo Sapiens
aacgcuucuaccccuuccagucaccaugcuccaacucccacacaaggagagccucccacagcug

SEQ ID NO: 239510 - RNA, 64 nt, Homo Sapiens
ugucaccaugcuccaacuccccugcaaggagagccucccacagcgagaccaacgaccaaguguu

SEQ ID NO: 239511 - RNA, 64 nt, Homo Sapiens
gguaguugccgguggacagcauggccgugccagccucccacacugaggccaggucuacccccca

SEQ ID NO: 239512 - RNA, 64 nt, Homo Sapiens
cagacuggcugggccccacccccugcguguggcccucccacaguauuuugugcaaugaagcccu

SEQ ID NO: 239513 - RNA, 64 nt, Homo Sapiens
gaccucuauauccuggugccuaagaaacuucugccucccacagacaacuaagugcuuauucaaa

SEQ ID NO: 239514 - RNA, 64 nt, Homo Sapiens
aacuccugaccucaagugauccgccugccucagccucccacagugcugggauuacaggcgugag

SEQ ID NO: 239515 - RNA, 64 nt, Homo Sapiens
uccucugaagcagugaagucugugccuaugccgagcgcgcuaagaagucucccuuccagcuguu

SEQ ID NO: 239516 - RNA, 64 nt, Homo Sapiens
ggcugagcuggggcugugugcuugcuaggugugggcgcgcuagugcucguuguagccuuuugcu

SEQ ID NO: 239517 - RNA, 64 nt, Homo Sapiens
aauccgagcaguggagucauucagcgggagcacugcgcgcuauccccucacauucucuauguac

SEQ ID NO: 239518 - RNA, 64 nt, Homo Sapiens
gggcagaguagacaucuagccucccuaaggguaugcgcgcuaaagcccagcucucgaucucacc

SEQ ID NO: 239519 - RNA, 64 nt, Homo Sapiens
gugugugugugugcgcgcgcgcgcgcgcgcgcgcgcgcgcuagagggguguggcugguggggga

SEQ ID NO: 239520 - RNA, 64 nt, Homo Sapiens
ggcaugaccuucagcucacggaaagacacaggaugcacagaauggacauccaaguuuaccagua

SEQ ID NO: 239521 - RNA, 64 nt, Homo Sapiens
acuuggaugaaauaagaccaggacaauuuccagugcacagaaucaaugaaagggaggaacggaa

SEQ ID NO: 239522 - RNA, 64 nt, Homo Sapiens
uuuuugacauagauaauuuaaaauuccacgccaggcacagaauuuuguaacacuugauggagug

SEQ ID NO: 239523 - RNA, 64 nt, Homo Sapiens
uaacaggaugaaacaguuuccuagagggagccacgcacagaaugggcagcaucagagugccuuu

SEQ ID NO: 239524 - RNA, 64 nt, Homo Sapiens
ggcacagcaccccuccccggcaucugccagcucagcacagaagacaccgaaugugcaucuggag

SEQ ID NO: 239525 - RNA, 64 nt, Homo Sapiens
guuugagugaacccucuuucaaagacaauaaauagcacagaauuguccgugcuucugugaggca

SEQ ID NO: 239526 - RNA, 64 nt, Homo Sapiens
ugguauaacaugccuucaguacuuuuagcaugcugcacagaaacgcaccagugaagaaguucua

SEQ ID NO: 239527 - RNA, 64 nt, Homo Sapiens
aacguugucuucacauguuucuggucauccucuggcacagaacgauuuuuuauucucagggucg

SEQ ID NO: 239528 - RNA, 64 nt, Homo Sapiens
ggaaaaugugauaaggccagagcuugugugcugggcacagaaaucaccugcugcauccugugcu

SEQ ID NO: 239529 - RNA, 64 nt, Homo Sapiens
agccucugcccgcagguuucuaugcuguuucuuagcacagaauccagccuagccuuagccgcag

SEQ ID NO: 239530 - RNA, 51 nt, Homo Sapiens
uggugggcagcgaccccugaggcacagaagaacaagagcaaagaccaugaa

SEQ ID NO: 239531 - RNA, 64 nt, Homo Sapiens
ucagcugcccuggccuugcaccccucugcaugcagcacagaagggugugaccaugcccucagca

SEQ ID NO: 239532 - RNA, 64 nt, Homo Sapiens
cugcacucaaaaguuuugaaagaaacuaaucacagcacagaaguaccuugauuuaauuuuuuaa

SEQ ID NO: 239533 - RNA, 64 nt, Homo Sapiens
ucuaaauuugauuauauucucugaugaucccuuugcacagaacuaugcuuaucucauguuuguc

SEQ ID NO: 239534 - RNA, 64 nt, Homo Sapiens
cuguacauauuuuuguaccuuuuauguaaauuuugcacagaaauuuuuggcauaaguuuauuuu

SEQ ID NO: 239535 - RNA, 64 nt, Homo Sapiens
gacuuucuucucggcucccucaacccuggcucaggcacagaagguguuuugcuacguuuuuuug

SEQ ID NO: 239536 - RNA, 64 nt, Homo Sapiens
uccaccgucagcaccauucagcugcaucccuugugcacagaacuguuugccagcguuggguggg

SEQ ID NO: 239537 - RNA, 64 nt, Homo Sapiens
auauucuuaaaaccuuuugugaauauaauuugaggcacagaagauauauguauauuuaaaaagu

SEQ ID NO: 239538 - RNA, 64 nt, Homo Sapiens
gggaaauaacuaauuuuaaaaaaugggaauuauugcacagaaauuaugaaucuaauuaaaacag

SEQ ID NO: 239539 - RNA, 64 nt, Homo Sapiens
uacauucuucaacagcauuacaccucuuaccacagcacagaacagaugauuugggcauuacgau

SEQ ID NO: 239540 - RNA, 64 nt, Homo Sapiens
uagaagcaccugcugacacuccugggggcucacagcacagaacccagagcccuacacuccacga

SEQ ID NO: 239541 - RNA, 64 nt, Homo Sapiens
uguuuauuuaauaagugggcagguugcaagcguugcacagaaauucugagauuuuacugccuuu

SEQ ID NO: 239542 - RNA, 64 nt, Homo Sapiens
ggaaauggugucccugucccucccaaagcacagagcacagaaaugaggccguuuacauggcgag

SEQ ID NO: 239543 - RNA, 64 nt, Homo Sapiens
aggaagugcuggugcauauucagggaaccaaaaagcacagaaaaguugcacaggaagaauguca

SEQ ID NO: 239544 - RNA, 64 nt, Homo Sapiens
cucauucuguuauccaguucaccuagucuaggaggcacagaauuucauuagauaaguguugucu

SEQ ID NO: 239545 - RNA, 64 nt, Homo Sapiens; identical to SEQ ID NO: 107849

SEQ ID NO: 239546 - RNA, 64 nt, Homo Sapiens; identical to SEQ ID NO: 107850

SEQ ID NO: 239547 - RNA, 64 nt, Homo Sapiens; identical to SEQ ID NO: 107851

SEQ ID NO: 239548 - RNA, 64 nt, Homo Sapiens; identical to SEQ ID NO: 107852

SEQ ID NO: 239549 - RNA, 64 nt, Homo Sapiens; identical to SEQ ID NO: 107853

SEQ ID NO: 239550 - RNA, 64 nt, Homo Sapiens; identical to SEQ ID NO: 107854

SEQ ID NO: 239551 - RNA, 64 nt, Homo Sapiens; identical to SEQ ID NO: 107855

SEQ ID NO: 239552 - RNA, 64 nt, Homo Sapiens; identical to SEQ ID NO: 107856

SEQ ID NO: 239553 - RNA, 64 nt, Homo Sapiens; identical to SEQ ID NO: 107857

SEQ ID NO: 239554 - RNA, 64 nt, Homo Sapiens; identical to SEQ ID NO: 107858

SEQ ID NO: 239555 - RNA, 64 nt, Homo Sapiens; identical to SEQ ID NO: 107859

SEQ ID NO: 239556 - RNA, 64 nt, Homo Sapiens; identical to SEQ ID NO: 107860

SEQ ID NO: 239557 - RNA, 64 nt, Homo Sapiens; identical to SEQ ID NO: 107861

SEQ ID NO: 239558 - RNA, 64 nt, Homo Sapiens; identical to SEQ ID NO: 107862

SEQ ID NO: 239559 - RNA, 64 nt, Homo Sapiens; identical to SEQ ID NO: 107863

SEQ ID NO: 239560 - RNA, 63 nt, Homo Sapiens; identical to SEQ ID NO: 107864

SEQ ID NO: 239561 - RNA, 64 nt, Homo Sapiens; identical to SEQ ID NO: 107865

SEQ ID NO: 239562 - RNA, 64 nt, Homo Sapiens; identical to SEQ ID NO: 107866

SEQ ID NO: 239563 - RNA, 64 nt, Homo Sapiens; identical to SEQ ID NO: 107867

SEQ ID NO: 239564 - RNA, 64 nt, Homo Sapiens; identical to SEQ ID NO: 107868

SEQ ID NO: 239565 - RNA, 64 nt, Homo Sapiens; identical to SEQ ID NO: 107869

SEQ ID NO: 239566 - RNA, 64 nt, Homo Sapiens; identical to SEQ ID NO: 107870

SEQ ID NO: 239567 - RNA, 64 nt, Homo Sapiens; identical to SEQ ID NO: 107871

SEQ ID NO: 239568 - RNA, 64 nt, Homo Sapiens; identical to SEQ ID NO: 107872

SEQ ID NO: 239569 - RNA, 64 nt, Homo Sapiens; identical to SEQ ID NO: 107873

SEQ ID NO: 239570 - RNA, 64 nt, Homo Sapiens; identical to SEQ ID NO: 107874

SEQ ID NO: 239571 - RNA, 64 nt, Homo Sapiens; identical to SEQ ID NO: 107875

SEQ ID NO: 239572 - RNA, 64 nt, Homo Sapiens; identical to SEQ ID NO: 107876

SEQ ID NO: 239573 - RNA, 64 nt, Homo Sapiens; identical to SEQ ID NO: 107877

SEQ ID NO: 239574 - RNA, 64 nt, Homo Sapiens; identical to SEQ ID NO: 107878

SEQ ID NO: 239575 - RNA, 64 nt, Homo Sapiens; identical to SEQ ID NO: 107879

SEQ ID NO: 239576 - RNA, 64 nt, Homo Sapiens; identical to SEQ ID NO: 107880

SEQ ID NO: 239577 - RNA, 64 nt, Homo Sapiens; identical to SEQ ID NO: 107881

SEQ ID NO: 239578 - RNA, 64 nt, Homo Sapiens; identical to SEQ ID NO: 107882

SEQ ID NO: 239579 - RNA, 64 nt, Homo Sapiens; identical to SEQ ID NO: 107883

SEQ ID NO: 239580 - RNA, 64 nt, Homo Sapiens; identical to SEQ ID NO: 107884

SEQ ID NO: 239581 - RNA, 64 nt, Homo Sapiens; identical to SEQ ID NO: 107885

SEQ ID NO: 239582 - RNA, 64 nt, Homo Sapiens; identical to SEQ ID NO: 107886

SEQ ID NO: 239583 - RNA, 64 nt, Homo Sapiens; identical to SEQ ID NO: 107887

SEQ ID NO: 239584 - RNA, 64 nt, Homo Sapiens; identical to SEQ ID NO: 107888

SEQ ID NO: 239585 - RNA, 64 nt, Homo Sapiens; identical to SEQ ID NO: 107889

SEQ ID NO: 239586 - RNA, 64 nt, Homo Sapiens; identical to SEQ ID NO: 107890

SEQ ID NO: 239587 - RNA, 64 nt, Homo Sapiens; identical to SEQ ID NO: 107891

SEQ ID NO: 239588 - RNA, 64 nt, Homo Sapiens; identical to SEQ ID NO: 107892

SEQ ID NO: 239589 - RNA, 64 nt, Homo Sapiens; identical to SEQ ID NO: 107893

SEQ ID NO: 239590 - RNA, 64 nt, Homo Sapiens; identical to SEQ ID NO: 107894

SEQ ID NO: 239591 - RNA, 64 nt, Homo Sapiens; identical to SEQ ID NO: 107895

SEQ ID NO: 239592 - RNA, 64 nt, Homo Sapiens; identical to SEQ ID NO: 107896

SEQ ID NO: 239593 - RNA, 64 nt, Homo Sapiens; identical to SEQ ID NO: 107897

SEQ ID NO: 239594 - RNA, 64 nt, Homo Sapiens; identical to SEQ ID NO: 107898

SEQ ID NO: 239595 - RNA, 64 nt, Homo Sapiens; identical to SEQ ID NO: 107899

SEQ ID NO: 239596 - RNA, 64 nt, Homo Sapiens; identical to SEQ ID NO: 107900

SEQ ID NO: 239597 - RNA, 64 nt, Homo Sapiens; identical to SEQ ID NO: 107901

SEQ ID NO: 239598 - RNA, 64 nt, Homo Sapiens; identical to SEQ ID NO: 107902

SEQ ID NO: 239599 - RNA, 64 nt, Homo Sapiens; identical to SEQ ID NO: 107903

SEQ ID NO: 239600 - RNA, 64 nt, Homo Sapiens; identical to SEQ ID NO: 107904

SEQ ID NO: 239601 - RNA, 64 nt, Homo Sapiens; identical to SEQ ID NO: 107905

SEQ ID NO: 239602 - RNA, 64 nt, Homo Sapiens; identical to SEQ ID NO: 107906

SEQ ID NO: 239603 - RNA, 64 nt, Homo Sapiens; identical to SEQ ID NO: 107907

SEQ ID NO: 239604 - RNA, 64 nt, Homo Sapiens; identical to SEQ ID NO: 107908

SEQ ID NO: 239605 - RNA, 64 nt, Homo Sapiens; identical to SEQ ID NO: 107909

SEQ ID NO: 239606 - RNA, 64 nt, Homo Sapiens; identical to SEQ ID NO: 107910

SEQ ID NO: 239607 - RNA, 64 nt, Homo Sapiens; identical to SEQ ID NO: 107911

SEQ ID NO: 239608 - RNA, 64 nt, Homo Sapiens; identical to SEQ ID NO: 107912

SEQ ID NO: 239609 - RNA, 64 nt, Homo Sapiens; identical to SEQ ID NO: 107913

SEQ ID NO: 239610 - RNA, 64 nt, Homo Sapiens; identical to SEQ ID NO: 107914

SEQ ID NO: 239611 - RNA, 64 nt, Homo Sapiens; identical to SEQ ID NO: 107915

SEQ ID NO: 239612 - RNA, 64 nt, Homo Sapiens; identical to SEQ ID NO: 107916

SEQ ID NO: 239613 - RNA, 64 nt, Homo Sapiens; identical to SEQ ID NO: 107917

SEQ ID NO: 239614 - RNA, 64 nt, Homo Sapiens; identical to SEQ ID NO: 107918

SEQ ID NO: 239615 - RNA, 64 nt, Homo Sapiens; identical to SEQ ID NO: 107919

SEQ ID NO: 239616 - RNA, 64 nt, Homo Sapiens; identical to SEQ ID NO: 107920

SEQ ID NO: 239617 - RNA, 64 nt, Homo Sapiens; identical to SEQ ID NO: 107921

SEQ ID NO: 239618 - RNA, 64 nt, Homo Sapiens; identical to SEQ ID NO: 107922

SEQ ID NO: 239619 - RNA, 64 nt, Homo Sapiens; identical to SEQ ID NO: 107923

SEQ ID NO: 239620 - RNA, 64 nt, Homo Sapiens; identical to SEQ ID NO: 107924

SEQ ID NO: 239621 - RNA, 64 nt, Homo Sapiens; identical to SEQ ID NO: 107925

SEQ ID NO: 239622 - RNA, 64 nt, Homo Sapiens; identical to SEQ ID NO: 107926

SEQ ID NO: 239623 - RNA, 64 nt, Homo Sapiens; identical to SEQ ID NO: 107927

SEQ ID NO: 239624 - RNA, 64 nt, Homo Sapiens; identical to SEQ ID NO: 107928

SEQ ID NO: 239625 - RNA, 64 nt, Homo Sapiens; identical to SEQ ID NO: 107929

SEQ ID NO: 239626 - RNA, 64 nt, Homo Sapiens; identical to SEQ ID NO: 107930

SEQ ID NO: 239627 - RNA, 64 nt, Homo Sapiens; identical to SEQ ID NO: 107931

SEQ ID NO: 239628 - RNA, 64 nt, Homo Sapiens; identical to SEQ ID NO: 107932

SEQ ID NO: 239629 - RNA, 64 nt, Homo Sapiens; identical to SEQ ID NO: 107933

SEQ ID NO: 239630 - RNA, 64 nt, Homo Sapiens
gccuggccuugcccaccugcguugggacugacuccuggaagacaaccccuuuuugcugaugagu

SEQ ID NO: 239631 - RNA, 64 nt, Homo Sapiens
gagaggggucuuggcacucuaaucaguucacucccuggaagagauuuaaacaacucaagucaga

SEQ ID NO: 239632 - RNA, 64 nt, Homo Sapiens
aaauauauauauaaaauuuugaaaagacuguuaacuggaagaaauuuggucuacccacccaaga

SEQ ID NO: 239633 - RNA, 64 nt, Homo Sapiens
gcaaggacacuuccauuccuccccugccccgagucuggaagagggcccaucuccccgcugucuc

SEQ ID NO: 239634 - RNA, 64 nt, Homo Sapiens
uguccccauggcuguggggcacugugucuacugucuggaagacaaggcucuuacagccacaggc

SEQ ID NO: 239635 - RNA, 64 nt, Homo Sapiens
agagcaucgacuugauuucuuucucaccguggggcuggaagaaaacccucauguuucuguagga

SEQ ID NO: 239636 - RNA, 64 nt, Homo Sapiens
ggagugaccacugagaugcugggggucacugggccuggaagaccaucccagccucugaguucuc

SEQ ID NO: 239637 - RNA, 64 nt, Homo Sapiens
ggaguuaccacugagaugccaaagguugcugggucuggaagacuguuguggccucucaguucuc

SEQ ID NO: 239638 - RNA, 64 nt, Homo Sapiens
caccgggcaagcacuggccuccccuggcuccugccuggaagaauuccgagccagcccauuucua

SEQ ID NO: 239639 - RNA, 64 nt, Homo Sapiens
ccucuguaggccaguaguucucaaaguguggucucuggaagagcaguaucagcaucaucuggga

SEQ ID NO: 239640 - RNA, 64 nt, Homo Sapiens
gggccccggcuggacacacgcagccaacccugaucuggaagacacuacauggaaagauagacag

SEQ ID NO: 239641 - RNA, 64 nt, Homo Sapiens
aauuucuaugaauuuucucuucuucuuccuuggucuggaagaacgaauuuugucuuccccuaau

SEQ ID NO: 239642 - RNA, 64 nt, Homo Sapiens
ucacugucauugagcagcaccucaucaucugugccuggaagaguaagucugagagcaacagacc

SEQ ID NO: 239643 - RNA, 64 nt, Homo Sapiens
ucauggaugccauggauuagaaaucaagagaagccuggaagacauuggcuaaagguugguguaa

SEQ ID NO: 239644 - RNA, 64 nt, Homo Sapiens
uaaaccucuaugucugaaaaaaaaaaugacacuccuggaagauggcuaggguuccccaguuuga

SEQ ID NO: 239645 - RNA, 64 nt, Homo Sapiens
aaaaagguugguugauagcagcuuggagugcuaacuggaagaucaaaaucaugucucuugcuga

SEQ ID NO: 239646 - RNA, 64 nt, Homo Sapiens
ccccuaauuuucacaacuagaugauuacuuccuucuggaagacuauccuucagacugcaucuua

SEQ ID NO: 239647 - RNA, 64 nt, Homo Sapiens
agacuccagcagagcccugacuggagacggcuuccuggaagaggucucagaggacuggcauugu

SEQ ID NO: 239648 - RNA, 64 nt, Homo Sapiens
ggguaauauggugaaagcaaucugggagaaguggcuggaagaagacaggcuaaaaguuuaguau

SEQ ID NO: 239649 - RNA, 64 nt, Homo Sapiens
aagauuauaacuguuuauuucugauuaaugggcccuggaagaugaagaauucuauaagcaauag

SEQ ID NO: 239650 - RNA, 64 nt, Homo Sapiens
ugaaagggaagcaucuaaaaaauugaacuaggggcuggaagaagaaauccagaaagcauuuaag

SEQ ID NO: 239651 - RNA, 64 nt, Homo Sapiens
uagucaugcuucuuuauuaugugggucacccacucuggaagaaaacuuaggaccauuugagcuu

SEQ ID NO: 239652 - RNA, 64 nt, Homo Sapiens
ccuaacucugagaaguuaacccuuaaacaguuuucuggaagagacugaauuucuggguccuugc

SEQ ID NO: 239653 - RNA, 64 nt, Homo Sapiens
gcuugaccacgccggaagaguccuggagcuaaagcuggaagacacucagcucucuaagcagggg

SEQ ID NO: 239654 - RNA, 64 nt, Homo Sapiens
cugacucaggaauccagaacgagguuguggacaacuggaagauuucucgcuucucuggccuugu

SEQ ID NO: 239655 - RNA, 64 nt, Homo Sapiens
aagugcguuccuuaaagacagagacaaucaaaaccuggaagacagcuuggccaggcggcagaga

SEQ ID NO: 239656 - RNA, 64 nt, Homo Sapiens
agugagcccaugagccccaccacuacacuccagccuggaagacaccaugacacacagugaggcc

SEQ ID NO: 239657 - RNA, 64 nt, Homo Sapiens
uguacacaaacuaaugcucguguuucccaagcaccuggaagacaugccagauccaugugcagua

SEQ ID NO: 239658 - RNA, 64 nt, Homo Sapiens
ucaauuacuuacguuaauguauagucucuuuuaacuggaagauuuguauuuugaacccauucug

SEQ ID NO: 239659 - RNA, 64 nt, Homo Sapiens
gaauccagcguucucauugggucaguuagguagucuggaagagacagcagaauuuguaaaauga

SEQ ID NO: 239660 - RNA, 64 nt, Homo Sapiens
gcagcuccugaacugguggccagcccacgggguacuggaagacagugguucugauggguucagc

SEQ ID NO: 239661 - RNA, 64 nt, Homo Sapiens
aaauauauaaaauauauaaaugcauaaaaaaauccuggaagacacagcaaaauguuaacagugg

SEQ ID NO: 239662 - RNA, 64 nt, Homo Sapiens
ucgcagccucaguguaugggagccugaggcuccacuggaagaucgguggucugauucauacccu

SEQ ID NO: 239663 - RNA, 64 nt, Homo Sapiens
uuuccgccucuuugugaugcuuggugagaucuuucuggaagaguuuuguuagggaggcaugauu

SEQ ID NO: 239664 - RNA, 64 nt, Homo Sapiens
cgccugauccgcaucaagguucugggaucaacuccuggaagaaacccugaaacacgucuaccug

SEQ ID NO: 239665 - RNA, 64 nt, Homo Sapiens
auuugcugguagaagucaguaggagcagagaaaacuggaagaagaggugagacccucucccaag

SEQ ID NO: 239666 - RNA, 64 nt, Homo Sapiens
uggauuuucuggaagcucagaagacauggauugucuggaagaugggaagacauggauuguccgg

SEQ ID NO: 239667 - RNA, 64 nt, Homo Sapiens
uggagcuucuuggaagacaugaagacuugauuuacuggaagacucuggaagacuggauuugcug

SEQ ID NO: 239668 - RNA, 64 nt, Homo Sapiens
ugauuuacuggaagacuugggaagacuggauuugcuggaagacuuggaagaccaguaauugcug

SEQ ID NO: 239669 - RNA, 64 nt, Homo Sapiens
ggauuugcuggaagacuugaaagaccaguaauugcuggaagacuggaagaucuggauuuggugg

SEQ ID NO: 239670 - RNA, 64 nt, Homo Sapiens
uggauuugguggaagaccagagacguggauuuuccuggaagaucgaagacauggauuuccugga

SEQ ID NO: 239671 - RNA, 64 nt, Homo Sapiens
uggauuuuccuggaagaucuaagacauggauuuccuggaagacggaagaccuugaaauuauugg

SEQ ID NO: 239672 - RNA, 64 nt, Homo Sapiens
uguauuugauggaagaccuuaagacauggauuagcuggaagaucgaagacacagauuuuucugg

SEQ ID NO: 239673 - RNA, 64 nt, Homo Sapiens
uggauuagcuggaagaucugagacacagauuuuucuggaagacagaagacuuggauuuggugga

SEQ ID NO: 239674 - RNA, 64 nt, Homo Sapiens
uggauuugguggaagacacaaagaacuagauuuacuggaagacugaagaucuagauuuuucugg

SEQ ID NO: 239675 - RNA, 56 nt, Homo Sapiens
uagauuuacuggaagacuugauuuuucuggaagaacugauugacuggaagaucuag

SEQ ID NO: 239676 - RNA, 64 nt, Homo Sapiens
uggaaaaauagccugccucuucucuacucuagggaaaaaccagcgugugacuacucccccaggu

SEQ ID NO: 239677 - RNA, 64 nt, Homo Sapiens
accacaaaacuuuucuaauacucuacccucuuagaaaaaccaccaccaucaccagacaggugcg

SEQ ID NO: 239678 - RNA, 64 nt, Homo Sapiens
uaaggagcugguagccuaccuacacagcugcuacaaaaaccaaaauacagaauggcuucuguga

SEQ ID NO: 239679 - RNA, 64 nt, Homo Sapiens
auuggcaugacaucugagcacagaaauuaaggcaaaaaaccaaagcaaaacaaauacauggugc

SEQ ID NO: 239680 - RNA, 64 nt, Homo Sapiens
ugccagauuucagggacuguucccuguggccucuaaaaaccaccccaggaugacuaaggcaagc

SEQ ID NO: 239681 - RNA, 64 nt, Homo Sapiens
ucugucccauuucaccaggagguggccauauuccaaaaaccacugcuagcaagaaacaggaggc

SEQ ID NO: 239682 - RNA, 64 nt, Homo Sapiens
guugaaucaugcuauauuucaaaaaaaaaaaaaaaaaaaccaguauguauguguaaacugacaa

SEQ ID NO: 239683 - RNA, 64 nt, Homo Sapiens
cuacucugaaagccuucagaaaacagaaggagggaaaaaccaacuguaagaagaaaauggagac

SEQ ID NO: 239684 - RNA, 64 nt, Homo Sapiens
ccuuucagcaaccucaaagcaaaaaaaaaaaaaaaaaaaccaguuagcugcuauauaaacacua

SEQ ID NO: 239685 - RNA, 64 nt, Homo Sapiens
aacacagugaaaacccaucucaaaaaaaaaaaaaaaaaaccaaaaaaacuguccagcuguggac

SEQ ID NO: 239686 - RNA, 64 nt, Homo Sapiens
gauggagaaaaaucuaggacagugucuucucggaaaaaaccagccuugaagguaaugaaacucu

SEQ ID NO: 239687 - RNA, 64 nt, Homo Sapiens
ugagaaaccaccaggcuugaagugucuucucggaaaaaaccauccuuggagguaaugaaacucu

SEQ ID NO: 239688 - RNA, 64 nt, Homo Sapiens
gucuguguuuuuuuggcaguuuaaguucuauuggaaaaaccacuguauuuguuucuggucuuug

SEQ ID NO: 239689 - RNA, 64 nt, Homo Sapiens
guuuugcaguuuuuuucauuaaggaaaaaaaaaaaaaaaccaauaaaagaaagaaagaaaaaaa

SEQ ID NO: 239690 - RNA, 64 nt, Homo Sapiens
uaaacaaaguuuagguaaaugaauuaucgcagagaaaaaccacaugagaaaauuuuuguacucc

SEQ ID NO: 239691 - RNA, 64 nt, Homo Sapiens
gugccaaauaagugcaaagauuuaauuuacuauuaaaaaccauaagcauauguuauaguuccag

SEQ ID NO: 239692 - RNA, 64 nt, Homo Sapiens
ggcauuuaacuaagugcaccugugaucuuggccaaaaaaccauugcaacucacaguaagagacu

SEQ ID NO: 239693 - RNA, 64 nt, Homo Sapiens
uauuguguacugacuccaucugccccgucaaauaaaaaaccacaagguucgagccgccgggccc

SEQ ID NO: 239694 - RNA, 64 nt, Homo Sapiens
ccugggcaacagugagugagacucggucucaaacaaaaaccaaauugggaaauucuucuugagu

SEQ ID NO: 239695 - RNA, 64 nt, Homo Sapiens
uugaauggaaaauuacucaguguauagaaaggaaaaaaaccagaaauuuaaaauagauacagaa

SEQ ID NO: 239696 - RNA, 64 nt, Homo Sapiens
ucaguauuggaaauuuucuacaauacugugacuuaaaaaccaacucuccaucucuuauauauaa

SEQ ID NO: 239697 - RNA, 64 nt, Homo Sapiens
aaacaugacuguucuuuccgugauguugcucuagaaaaaccacccuccuccagauaccaacugc

SEQ ID NO: 239698 - RNA, 64 nt, Homo Sapiens
aaaaaauccaagugugccuuuuaaaaagcaaacaaaaaaccaacggaguauaaguuuuccguug

SEQ ID NO: 239699 - RNA, 64 nt, Homo Sapiens
gaguuguauauuuuaaguggcauaacaauauauuaaaaaccauuacuuauugugguaaugguca

SEQ ID NO: 239700 - RNA, 64 nt, Homo Sapiens
uaauaguggcccugaaggaauaaauuccagcuuuaaaaaccaagucugaggaaauauuuggcuu

SEQ ID NO: 239701 - RNA, 64 nt, Homo Sapiens
uuccuguauuuuaugcccauaaaauaagcuuuauaaaaaccaauuuccugauggacuauuaaau

SEQ ID NO: 239702 - RNA, 64 nt, Homo Sapiens
uuugcagcaaagauuuacaaguuuuuagaguuguaaaaaccauacaugagguuuuccaaaagau

SEQ ID NO: 239703 - RNA, 64 nt, Homo Sapiens
aauuacgaagcaccuuaguacauuucauuaaaaaaaaaaccauguuguagauguuugucugaug

SEQ ID NO: 239704 - RNA, 64 nt, Homo Sapiens
cuuuuuauaggguggggcaaaauuagcaaaaaacaaaaaccaaugacaaccaaacugaaaccga

SEQ ID NO: 239705 - RNA, 64 nt, Homo Sapiens
ucacaggaggaggggagguuggggggcgggagacaaaaaccacaccucuuuuuauauaagguuu

SEQ ID NO: 239706 - RNA, 64 nt, Homo Sapiens
ccaugaaaucuuaggagucucuggaggacagauuaaaaaccagugaucuguaauuuguagcucu

SEQ ID NO: 239707 - RNA, 64 nt, Homo Sapiens
uaaaucucggccccacucuucauuggcuuaaccuaaaaaccagaggugcuuuuccuugucugug

SEQ ID NO: 239708 - RNA, 64 nt, Homo Sapiens
auuccuuuugcuggauaugcagaaaugauaggaaaaaaaccaauggugaaauuucaaguuucaa

SEQ ID NO: 239709 - RNA, 64 nt, Homo Sapiens
uaggaaaaaaaccaauggugaaauuucaaguuucaaaaaccaaccuuucauuaccaaucccagg

SEQ ID NO: 239710 - RNA, 64 nt, Homo Sapiens
auccuugaccucauuugaaauuacuuccauuuucaaaaaccaucauguuuuguagauacauuuu

SEQ ID NO: 239711 - RNA, 64 nt, Homo Sapiens
caaaaaccaucauguuuuguagauacauuuugagaaaaaccaucauguuuugaggauacauuug

SEQ ID NO: 239712 - RNA, 64 nt, Homo Sapiens
ucaaguuggugagaggagagcucauuguuugaagaaaaaccaaaacauuuuauggcuaguaaua

SEQ ID NO: 239713 - RNA, 64 nt, Homo Sapiens
auguaauugccaagauuuuacuauuuuaacuuagaaaaaccaucguuucauaugauucacccua

SEQ ID NO: 239714 - RNA, 64 nt, Homo Sapiens
uugguaaaaauucauuuucucaccucccccccaaaaaaaccaaaagggcuccuugauucauaag

SEQ ID NO: 239715 - RNA, 64 nt, Homo Sapiens
aaauuucuacaaucauggagcugaguuuuuguuuaaaaaccagggagggcagucauucuucuca

SEQ ID NO: 239716 - RNA, 64 nt, Homo Sapiens
uaaagcuaacugggucuuagagguaagucuuucuaaaaaccauucaaauuaaccacuuuugacu

SEQ ID NO: 239717 - RNA, 64 nt, Homo Sapiens
aagcaaaaaacaaaaacaagcauucauggccaaaaaaaaccaaaauuuugcauaggggccauau

SEQ ID NO: 239718 - RNA, 64 nt, Homo Sapiens
uccucacuaucggaaauucauuuugauucagaauaaaaaccaaauguauagagcuuugggugua

SEQ ID NO: 239719 - RNA, 64 nt, Homo Sapiens
uuggaacuuucuguaucucuuaggaggaacaaguaaaaaccaaaugguuacauugugcugcuag

SEQ ID NO: 239720 - RNA, 64 nt, Homo Sapiens
gcaaauuucuugaugaaaauaaaccaaaagcauaaaaaaccacaggaaaaaaaaaaaaaggaaa

SEQ ID NO: 239721 - RNA, 64 nt, Homo Sapiens
agcauaaaaaaccacagcaaaaaaaaaaaaaggaaaaaaccaaacuaaaugaaauaaaguggaa

SEQ ID NO: 239722 - RNA, 64 nt, Homo Sapiens
cccaguccccagcccuucacuuuguuguaaaaagaaaaaccacuguuuuuaguaaucuguacau

SEQ ID NO: 239723 - RNA, 64 nt, Homo Sapiens
aaggccaaacugcuggacguagaccaaggaacaaaaaaaccacauuaacaaccuggccgcguuu

SEQ ID NO: 239724 - RNA, 64 nt, Homo Sapiens
uguuuauuuucuacguuucuaaaccaccaaaaacaaaaaccaaauuucuuuauuuuguguaaaa

SEQ ID NO: 239725 - RNA, 64 nt, Homo Sapiens
aaaaacaaaaaccaaauguuuuuauuuuguguaaaaaaaccaccgaggccaugugcauaguuuc

SEQ ID NO: 239726 - RNA, 64 nt, Homo Sapiens
gggugaucucugcuucauuagucauggguggaagaaaaaccacaccccccgcaccccuccguuc

SEQ ID NO: 239727 - RNA, 64 nt, Homo Sapiens
aggcaccuccucuggccucacccaagccucuucuaaaaaccauguugaaugaauccacguucug

SEQ ID NO: 239728 - RNA, 64 nt, Homo Sapiens
gccugcagaccggccacucugugacaacucuaccaaaaaccaacaagccauucaagcuuuuaca

SEQ ID NO: 239729 - RNA, 64 nt, Homo Sapiens
aauguagaauaucucuuaagauuuccguuaugguaaaaaccauaugcaauaaauaccucauugu

SEQ ID NO: 239730 - RNA, 64 nt, Homo Sapiens
ucccacaggccuucagcccuuuaacgucucugccaaaaaccagcacaaggagacaaagcagagc

SEQ ID NO: 239731 - RNA, 64 nt, Homo Sapiens
ccagacugaccacuugcuuggagugugugcuugaaaaaaccagagcaauacuguuggguauugu

SEQ ID NO: 239732 - RNA, 64 nt, Homo Sapiens
acccuccagccugggcaacgcacacaaggaauauaaaaaccacccaaauaucacagacaccccu

SEQ ID NO: 239733 - RNA, 64 nt, Homo Sapiens
acaaacaaacaaaaaaaaccacggcaagaaaaccaaaaaccaaaacuuucuacaguuuugcacc

SEQ ID NO: 239734 - RNA, 64 nt, Homo Sapiens
auagaguaucuauuagaguuucuuuuaccuuuuuaaaaaccaagaaguagcuaauccaguguaa

SEQ ID NO: 239735 - RNA, 64 nt, Homo Sapiens
ccaucguucccuacuccuccugaaaugaagggaaaaaaaccaccacaguagaagaacuuacuuc

SEQ ID NO: 239736 - RNA, 64 nt, Homo Sapiens
guuuuaagcuuaauagccuuugcacuuuuaaaauaaaaaccaaguaugcaaaucaaagauauuu

SEQ ID NO: 239737 - RNA, 64 nt, Homo Sapiens
aaggaaauuggaugggauacuguggcaaaucauaaaaaaccagauaauugaacuuugaaguuau

SEQ ID NO: 239738 - RNA, 64 nt, Homo Sapiens
gagcgagacuccgucucaaaaaaaaaaaacaaaaaaaaaccaugcauggugcaucagcagccca

SEQ ID NO: 239739 - RNA, 64 nt, Homo Sapiens
aggccugagcaacaaagcgagaucccaucucuacaaaaaccaaaaaguuaaaaaucagcugggu

SEQ ID NO: 239740 - RNA, 64 nt, Homo Sapiens
gugcauuguacgcccuuugguuuuuuuuucaacaaaaaaccaaacuuuucuguugccaugauuu

SEQ ID NO: 239741 - RNA, 64 nt, Homo Sapiens
ucacuuuucuguugccaugagcuguuacuuguugaaaaaccauaagcuuccuacugaauuguga

SEQ ID NO: 239742 - RNA, 64 nt, Homo Sapiens
auuauaggauuuuuuuuucuguaaaaaccuguauaaaaaccaaauaggauuuuuuucuuuuuua

SEQ ID NO: 239743 - RNA, 64 nt, Homo Sapiens
auuauaggauuuuuucuuuuguaaaaaccuauauaaaaaccaaauaggauuuuuuucuuuuuua

SEQ ID NO: 239744 - RNA, 64 nt, Homo Sapiens
auuauaggauuuuuucuuuuguaaaaaccuauauaaaaaccaaagguaauagagccacugguga

SEQ ID NO: 239745 - RNA, 64 nt, Homo Sapiens
gggguagaaaaaaaacaaacaaacaaacagaaaaaaaaaccaaaaaaaaccacccugaguuucu

SEQ ID NO: 239746 - RNA, 64 nt, Homo Sapiens
aaaaacaaacaaacaaacagaaaaaaaaaccaaaaaaaaccacccugaguuucucuggugacgc

SEQ ID NO: 239747 - RNA, 64 nt, Homo Sapiens; identical to SEQ ID NO: 168029

SEQ ID NO: 239748 - RNA, 64 nt, Homo Sapiens; identical to SEQ ID NO: 168030

SEQ ID NO: 239749 - RNA, 64 nt, Homo Sapiens; identical to SEQ ID NO: 168031

SEQ ID NO: 239750 - RNA, 64 nt, Homo Sapiens; identical to SEQ ID NO: 168032

SEQ ID NO: 239751 - RNA, 64 nt, Homo Sapiens; identical to SEQ ID NO: 168033

SEQ ID NO: 239752 - RNA, 64 nt, Homo Sapiens; identical to SEQ ID NO: 168034

SEQ ID NO: 239753 - RNA, 64 nt, Homo Sapiens; identical to SEQ ID NO: 168035

SEQ ID NO: 239754 - RNA, 64 nt, Homo Sapiens; identical to SEQ ID NO: 168036

SEQ ID NO: 239755 - RNA, 64 nt, Homo Sapiens; identical to SEQ ID NO: 168037

SEQ ID NO: 239756 - RNA, 64 nt, Homo Sapiens; identical to SEQ ID NO: 168038

SEQ ID NO: 239757 - RNA, 64 nt, Homo Sapiens; identical to SEQ ID NO: 168039

SEQ ID NO: 239758 - RNA, 64 nt, Homo Sapiens; identical to SEQ ID NO: 168040

SEQ ID NO: 239759 - RNA, 64 nt, Homo Sapiens; identical to SEQ ID NO: 168041

SEQ ID NO: 239760 - RNA, 64 nt, Homo Sapiens; identical to SEQ ID NO: 168042

SEQ ID NO: 239761 - RNA, 64 nt, Homo Sapiens; identical to SEQ ID NO: 168043

SEQ ID NO: 239762 - RNA, 64 nt, Homo Sapiens; identical to SEQ ID NO: 168044

SEQ ID NO: 239763 - RNA, 64 nt, Homo Sapiens; identical to SEQ ID NO: 168045

SEQ ID NO: 239764 - RNA, 64 nt, Homo Sapiens; identical to SEQ ID NO: 168046

SEQ ID NO: 239765 - RNA, 64 nt, Homo Sapiens; identical to SEQ ID NO: 168047

SEQ ID NO: 239766 - RNA, 64 nt, Homo Sapiens; identical to SEQ ID NO: 168048

SEQ ID NO: 239767 - RNA, 64 nt, Homo Sapiens; identical to SEQ ID NO: 168049

SEQ ID NO: 239768 - RNA, 64 nt, Homo Sapiens; identical to SEQ ID NO: 168050

SEQ ID NO: 239769 - RNA, 64 nt, Homo Sapiens; identical to SEQ ID NO: 168051

SEQ ID NO: 239770 - RNA, 64 nt, Homo Sapiens; identical to SEQ ID NO: 168052

SEQ ID NO: 239771 - RNA, 64 nt, Homo Sapiens; identical to SEQ ID NO: 168053

SEQ ID NO: 239772 - RNA, 64 nt, Homo Sapiens; identical to SEQ ID NO: 168054

SEQ ID NO: 239773 - RNA, 64 nt, Homo Sapiens; identical to SEQ ID NO: 168055

SEQ ID NO: 239774 - RNA, 64 nt, Homo Sapiens; identical to SEQ ID NO: 168056

SEQ ID NO: 239775 - RNA, 64 nt, Homo Sapiens; identical to SEQ ID NO: 168057

SEQ ID NO: 239776 - RNA, 64 nt, Homo Sapiens; identical to SEQ ID NO: 168058

SEQ ID NO: 239777 - RNA, 64 nt, Homo Sapiens; identical to SEQ ID NO: 168059

SEQ ID NO: 239778 - RNA, 64 nt, Homo Sapiens; identical to SEQ ID NO: 168060

SEQ ID NO: 239779 - RNA, 64 nt, Homo Sapiens; identical to SEQ ID NO: 168061

SEQ ID NO: 239780 - RNA, 64 nt, Homo Sapiens; identical to SEQ ID NO: 168062

SEQ ID NO: 239781 - RNA, 64 nt, Homo Sapiens; identical to SEQ ID NO: 168063

SEQ ID NO: 239782 - RNA, 64 nt, Homo Sapiens; identical to SEQ ID NO: 168064

SEQ ID NO: 239783 - RNA, 64 nt, Homo Sapiens; identical to SEQ ID NO: 168065

SEQ ID NO: 239784 - RNA, 64 nt, Homo Sapiens; identical to SEQ ID NO: 168066

SEQ ID NO: 239785 - RNA, 64 nt, Homo Sapiens; identical to SEQ ID NO: 133550

SEQ ID NO: 239786 - RNA, 64 nt, Homo Sapiens; identical to SEQ ID NO: 133551

SEQ ID NO: 239787 - RNA, 64 nt, Homo Sapiens; identical to SEQ ID NO: 133552

SEQ ID NO: 239788 - RNA, 64 nt, Homo Sapiens; identical to SEQ ID NO: 133553

SEQ ID NO: 239789 - RNA, 64 nt, Homo Sapiens; identical to SEQ ID NO: 133554

SEQ ID NO: 239790 - RNA, 64 nt, Homo Sapiens; identical to SEQ ID NO: 133555

SEQ ID NO: 239791 - RNA, 64 nt, Homo Sapiens; identical to SEQ ID NO: 133556

SEQ ID NO: 239792 - RNA, 64 nt, Homo Sapiens; identical to SEQ ID NO: 133557

SEQ ID NO: 239793 - RNA, 64 nt, Homo Sapiens; identical to SEQ ID NO: 133558

SEQ ID NO: 239794 - RNA, 64 nt, Homo Sapiens; identical to SEQ ID NO: 133559

SEQ ID NO: 239795 - RNA, 64 nt, Homo Sapiens; identical to SEQ ID NO: 133560

SEQ ID NO: 239796 - RNA, 64 nt, Homo Sapiens; identical to SEQ ID NO: 133561

SEQ ID NO: 239797 - RNA, 64 nt, Homo Sapiens; identical to SEQ ID NO: 133562

SEQ ID NO: 239798 - RNA, 64 nt, Homo Sapiens; identical to SEQ ID NO: 133563

SEQ ID NO: 239799 - RNA, 64 nt, Homo Sapiens; identical to SEQ ID NO: 133564

SEQ ID NO: 239800 - RNA, 64 nt, Homo Sapiens; identical to SEQ ID NO: 133565

SEQ ID NO: 239801 - RNA, 64 nt, Homo Sapiens; identical to SEQ ID NO: 133566

SEQ ID NO: 239802 - RNA, 64 nt, Homo Sapiens; identical to SEQ ID NO: 133567

SEQ ID NO: 239803 - RNA, 64 nt, Homo Sapiens; identical to SEQ ID NO: 133568

SEQ ID NO: 239804 - RNA, 64 nt, Homo Sapiens; identical to SEQ ID NO: 133569

SEQ ID NO: 239805 - RNA, 64 nt, Homo Sapiens; identical to SEQ ID NO: 133570

SEQ ID NO: 239806 - RNA, 64 nt, Homo Sapiens; identical to SEQ ID NO: 133571

SEQ ID NO: 239807 - RNA, 64 nt, Homo Sapiens; identical to SEQ ID NO: 133572

SEQ ID NO: 239808 - RNA, 64 nt, Homo Sapiens; identical to SEQ ID NO: 133573

SEQ ID NO: 239809 - RNA, 64 nt, Homo Sapiens; identical to SEQ ID NO: 133574

SEQ ID NO: 239810 - RNA, 64 nt, Homo Sapiens; identical to SEQ ID NO: 133575

SEQ ID NO: 239811 - RNA, 64 nt, Homo Sapiens; identical to SEQ ID NO: 133576

SEQ ID NO: 239812 - RNA, 64 nt, Homo Sapiens; identical to SEQ ID NO: 133577

SEQ ID NO: 239813 - RNA, 64 nt, Homo Sapiens; identical to SEQ ID NO: 133578

SEQ ID NO: 239814 - RNA, 64 nt, Homo Sapiens; identical to SEQ ID NO: 133579

SEQ ID NO: 239815 - RNA, 64 nt, Homo Sapiens; identical to SEQ ID NO: 133580

SEQ ID NO: 239816 - RNA, 64 nt, Homo Sapiens; identical to SEQ ID NO: 133581

SEQ ID NO: 239817 - RNA, 64 nt, Homo Sapiens; identical to SEQ ID NO: 133582

SEQ ID NO: 239818 - RNA, 64 nt, Homo Sapiens; identical to SEQ ID NO: 133583

SEQ ID NO: 239819 - RNA, 64 nt, Homo Sapiens; identical to SEQ ID NO: 133584

SEQ ID NO: 239820 - RNA, 64 nt, Homo Sapiens; identical to SEQ ID NO: 133585

SEQ ID NO: 239821 - RNA, 64 nt, Homo Sapiens; identical to SEQ ID NO: 133586

SEQ ID NO: 239822 - RNA, 64 nt, Homo Sapiens; identical to SEQ ID NO: 133587

SEQ ID NO: 239823 - RNA, 64 nt, Homo Sapiens; identical to SEQ ID NO: 133588

SEQ ID NO: 239824 - RNA, 64 nt, Homo Sapiens; identical to SEQ ID NO: 133589

SEQ ID NO: 239825 - RNA, 64 nt, Homo Sapiens; identical to SEQ ID NO: 133590

SEQ ID NO: 239826 - RNA, 64 nt, Homo Sapiens; identical to SEQ ID NO: 133591

SEQ ID NO: 239827 - RNA, 64 nt, Homo Sapiens; identical to SEQ ID NO: 133592

SEQ ID NO: 239828 - RNA, 64 nt, Homo Sapiens; identical to SEQ ID NO: 133593

SEQ ID NO: 239829 - RNA, 64 nt, Homo Sapiens; identical to SEQ ID NO: 133594

SEQ ID NO: 239830 - RNA, 64 nt, Homo Sapiens; identical to SEQ ID NO: 133595

SEQ ID NO: 239831 - RNA, 64 nt, Homo Sapiens; identical to SEQ ID NO: 133596

SEQ ID NO: 239832 - RNA, 64 nt, Homo Sapiens; identical to SEQ ID NO: 133597

SEQ ID NO: 239833 - RNA, 64 nt, Homo Sapiens; identical to SEQ ID NO: 133598

SEQ ID NO: 239834 - RNA, 64 nt, Homo Sapiens; identical to SEQ ID NO: 133599

SEQ ID NO: 239835 - RNA, 64 nt, Homo Sapiens; identical to SEQ ID NO: 133600

SEQ ID NO: 239836 - RNA, 64 nt, Homo Sapiens; identical to SEQ ID NO: 133601

SEQ ID NO: 239837 - RNA, 64 nt, Homo Sapiens; identical to SEQ ID NO: 133602

SEQ ID NO: 239838 - RNA, 64 nt, Homo Sapiens; identical to SEQ ID NO: 133603

SEQ ID NO: 239839 - RNA, 64 nt, Homo Sapiens; identical to SEQ ID NO: 133604

SEQ ID NO: 239840 - RNA, 64 nt, Homo Sapiens; identical to SEQ ID NO: 133605

SEQ ID NO: 239841 - RNA, 64 nt, Homo Sapiens; identical to SEQ ID NO: 133606

SEQ ID NO: 239842 - RNA, 64 nt, Homo Sapiens; identical to SEQ ID NO: 133607

SEQ ID NO: 239843 - RNA, 64 nt, Homo Sapiens; identical to SEQ ID NO: 133608

SEQ ID NO: 239844 - RNA, 64 nt, Homo Sapiens; identical to SEQ ID NO: 133609

SEQ ID NO: 239845 - RNA, 64 nt, Homo Sapiens; identical to SEQ ID NO: 133610

SEQ ID NO: 239846 - RNA, 52 nt, Homo Sapiens; identical to SEQ ID NO: 133611

SEQ ID NO: 239847 - RNA, 55 nt, Homo Sapiens; identical to SEQ ID NO: 133612

SEQ ID NO: 239848 - RNA, 64 nt, Homo Sapiens; identical to SEQ ID NO: 133613

SEQ ID NO: 239849 - RNA, 64 nt, Homo Sapiens; identical to SEQ ID NO: 133614

SEQ ID NO: 239850 - RNA, 64 nt, Homo Sapiens; identical to SEQ ID NO: 133615

SEQ ID NO: 239851 - RNA, 64 nt, Homo Sapiens; identical to SEQ ID NO: 133616

SEQ ID NO: 239852 - RNA, 64 nt, Homo Sapiens; identical to SEQ ID NO: 133617

SEQ ID NO: 239853 - RNA, 64 nt, Homo Sapiens; identical to SEQ ID NO: 133618

SEQ ID NO: 239854 - RNA, 64 nt, Homo Sapiens; identical to SEQ ID NO: 133619

SEQ ID NO: 239855 - RNA, 64 nt, Homo Sapiens; identical to SEQ ID NO: 133620

SEQ ID NO: 239856 - RNA, 64 nt, Homo Sapiens; identical to SEQ ID NO: 133621

SEQ ID NO: 239857 - RNA, 64 nt, Homo Sapiens; identical to SEQ ID NO: 133622

SEQ ID NO: 239858 - RNA, 64 nt, Homo Sapiens; identical to SEQ ID NO: 133623

SEQ ID NO: 239859 - RNA, 64 nt, Homo Sapiens; identical to SEQ ID NO: 133624

SEQ ID NO: 239860 - RNA, 64 nt, Homo Sapiens; identical to SEQ ID NO: 133625

SEQ ID NO: 239861 - RNA, 64 nt, Homo Sapiens; identical to SEQ ID NO: 133626

SEQ ID NO: 239862 - RNA, 64 nt, Homo Sapiens; identical to SEQ ID NO: 133627

SEQ ID NO: 239863 - RNA, 64 nt, Homo Sapiens; identical to SEQ ID NO: 133628

SEQ ID NO: 239864 - RNA, 64 nt, Homo Sapiens; identical to SEQ ID NO: 133629

SEQ ID NO: 239865 - RNA, 64 nt, Homo Sapiens; identical to SEQ ID NO: 133630

SEQ ID NO: 239866 - RNA, 64 nt, Homo Sapiens; identical to SEQ ID NO: 133631

SEQ ID NO: 239867 - RNA, 64 nt, Homo Sapiens; identical to SEQ ID NO: 133632

SEQ ID NO: 239868 - RNA, 64 nt, Homo Sapiens; identical to SEQ ID NO: 133633

SEQ ID NO: 239869 - RNA, 64 nt, Homo Sapiens; identical to SEQ ID NO: 133634

SEQ ID NO: 239870 - RNA, 64 nt, Homo Sapiens; identical to SEQ ID NO: 133635

SEQ ID NO: 239871 - RNA, 64 nt, Homo Sapiens; identical to SEQ ID NO: 133636

SEQ ID NO: 239872 - RNA, 64 nt, Homo Sapiens; identical to SEQ ID NO: 133637

SEQ ID NO: 239873 - RNA, 64 nt, Homo Sapiens; identical to SEQ ID NO: 133638

SEQ ID NO: 239874 - RNA, 63 nt, Homo Sapiens; identical to SEQ ID NO: 133639

SEQ ID NO: 239875 - RNA, 51 nt, Homo Sapiens; identical to SEQ ID NO: 133640

SEQ ID NO: 239876 - RNA, 64 nt, Homo Sapiens; identical to SEQ ID NO: 133641

SEQ ID NO: 239877 - RNA, 64 nt, Homo Sapiens; identical to SEQ ID NO: 133642

SEQ ID NO: 239878 - RNA, 64 nt, Homo Sapiens; identical to SEQ ID NO: 133643

SEQ ID NO: 239879 - RNA, 64 nt, Homo Sapiens; identical to SEQ ID NO: 133644

SEQ ID NO: 239880 - RNA, 64 nt, Homo Sapiens; identical to SEQ ID NO: 133645

SEQ ID NO: 239881 - RNA, 64 nt, Homo Sapiens; identical to SEQ ID NO: 133646

SEQ ID NO: 239882 - RNA, 64 nt, Homo Sapiens; identical to SEQ ID NO: 133647

SEQ ID NO: 239883 - RNA, 64 nt, Homo Sapiens; identical to SEQ ID NO: 133648

SEQ ID NO: 239884 - RNA, 64 nt, Homo Sapiens; identical to SEQ ID NO: 133649

SEQ ID NO: 239885 - RNA, 64 nt, Homo Sapiens; identical to SEQ ID NO: 133650

SEQ ID NO: 239886 - RNA, 64 nt, Homo Sapiens; identical to SEQ ID NO: 133651

SEQ ID NO: 239887 - RNA, 64 nt, Homo Sapiens; identical to SEQ ID NO: 133652

SEQ ID NO: 239888 - RNA, 64 nt, Homo Sapiens; identical to SEQ ID NO: 133653

SEQ ID NO: 239889 - RNA, 64 nt, Homo Sapiens; identical to SEQ ID NO: 133654

SEQ ID NO: 239890 - RNA, 64 nt, Homo Sapiens; identical to SEQ ID NO: 133655

SEQ ID NO: 239891 - RNA, 64 nt, Homo Sapiens; identical to SEQ ID NO: 133656

SEQ ID NO: 239892 - RNA, 64 nt, Homo Sapiens; identical to SEQ ID NO: 133657

SEQ ID NO: 239893 - RNA, 64 nt, Homo Sapiens; identical to SEQ ID NO: 133658

SEQ ID NO: 239894 - RNA, 64 nt, Homo Sapiens; identical to SEQ ID NO: 133659

SEQ ID NO: 239895 - RNA, 64 nt, Homo Sapiens; identical to SEQ ID NO: 133660

SEQ ID NO: 239896 - RNA, 64 nt, Homo Sapiens; identical to SEQ ID NO: 133661

SEQ ID NO: 239897 - RNA, 64 nt, Homo Sapiens; identical to SEQ ID NO: 133662

SEQ ID NO: 239898 - RNA, 64 nt, Homo Sapiens; identical to SEQ ID NO: 133663

SEQ ID NO: 239899 - RNA, 64 nt, Homo Sapiens; identical to SEQ ID NO: 133664

SEQ ID NO: 239900 - RNA, 64 nt, Homo Sapiens; identical to SEQ ID NO: 133665

SEQ ID NO: 239901 - RNA, 64 nt, Homo Sapiens; identical to SEQ ID NO: 133666

SEQ ID NO: 239902 - RNA, 64 nt, Homo Sapiens; identical to SEQ ID NO: 133667

SEQ ID NO: 239903 - RNA, 64 nt, Homo Sapiens; identical to SEQ ID NO: 133668

SEQ ID NO: 239904 - RNA, 64 nt, Homo Sapiens; identical to SEQ ID NO: 133669

SEQ ID NO: 239905 - RNA, 64 nt, Homo Sapiens; identical to SEQ ID NO: 133670

SEQ ID NO: 239906 - RNA, 64 nt, Homo Sapiens; identical to SEQ ID NO: 133671

SEQ ID NO: 239907 - RNA, 64 nt, Homo Sapiens; identical to SEQ ID NO: 133672

SEQ ID NO: 239908 - RNA, 64 nt, Homo Sapiens; identical to SEQ ID NO: 133673

SEQ ID NO: 239909 - RNA, 64 nt, Homo Sapiens; identical to SEQ ID NO: 133674

SEQ ID NO: 239910 - RNA, 64 nt, Homo Sapiens; identical to SEQ ID NO: 133675

SEQ ID NO: 239911 - RNA, 64 nt, Homo Sapiens; identical to SEQ ID NO: 133676

SEQ ID NO: 239912 - RNA, 50 nt, Homo Sapiens; identical to SEQ ID NO: 133677

SEQ ID NO: 239913 - RNA, 64 nt, Homo Sapiens; identical to SEQ ID NO: 133678

SEQ ID NO: 239914 - RNA, 64 nt, Homo Sapiens; identical to SEQ ID NO: 133679

SEQ ID NO: 239915 - RNA, 64 nt, Homo Sapiens; identical to SEQ ID NO: 133680

SEQ ID NO: 239916 - RNA, 64 nt, Homo Sapiens; identical to SEQ ID NO: 133681

SEQ ID NO: 239917 - RNA, 64 nt, Homo Sapiens; identical to SEQ ID NO: 133682

SEQ ID NO: 239918 - RNA, 64 nt, Homo Sapiens; identical to SEQ ID NO: 133683

SEQ ID NO: 239919 - RNA, 64 nt, Homo Sapiens; identical to SEQ ID NO: 133684

SEQ ID NO: 239920 - RNA, 64 nt, Homo Sapiens; identical to SEQ ID NO: 133685

SEQ ID NO: 239921 - RNA, 64 nt, Homo Sapiens; identical to SEQ ID NO: 133686

SEQ ID NO: 239922 - RNA, 64 nt, Homo Sapiens; identical to SEQ ID NO: 133687

SEQ ID NO: 239923 - RNA, 64 nt, Homo Sapiens; identical to SEQ ID NO: 133688

SEQ ID NO: 239924 - RNA, 64 nt, Homo Sapiens; identical to SEQ ID NO: 133689

SEQ ID NO: 239925 - RNA, 64 nt, Homo Sapiens; identical to SEQ ID NO: 133690

SEQ ID NO: 239926 - RNA, 64 nt, Homo Sapiens; identical to SEQ ID NO: 133691

SEQ ID NO: 239927 - RNA, 64 nt, Homo Sapiens; identical to SEQ ID NO: 133692

SEQ ID NO: 239928 - RNA, 64 nt, Homo Sapiens; identical to SEQ ID NO: 133693

SEQ ID NO: 239929 - RNA, 64 nt, Homo Sapiens; identical to SEQ ID NO: 133694

SEQ ID NO: 239930 - RNA, 64 nt, Homo Sapiens; identical to SEQ ID NO: 133695

SEQ ID NO: 239931 - RNA, 64 nt, Homo Sapiens; identical to SEQ ID NO: 133696

SEQ ID NO: 239932 - RNA, 64 nt, Homo Sapiens; identical to SEQ ID NO: 133697

SEQ ID NO: 239933 - RNA, 64 nt, Homo Sapiens; identical to SEQ ID NO: 133698

SEQ ID NO: 239934 - RNA, 64 nt, Homo Sapiens; identical to SEQ ID NO: 133699

SEQ ID NO: 239935 - RNA, 64 nt, Homo Sapiens; identical to SEQ ID NO: 133700

SEQ ID NO: 239936 - RNA, 64 nt, Homo Sapiens; identical to SEQ ID NO: 133701

SEQ ID NO: 239937 - RNA, 64 nt, Homo Sapiens; identical to SEQ ID NO: 133702

SEQ ID NO: 239938 - RNA, 64 nt, Homo Sapiens; identical to SEQ ID NO: 133703

SEQ ID NO: 239939 - RNA, 64 nt, Homo Sapiens; identical to SEQ ID NO: 133704

SEQ ID NO: 239940 - RNA, 64 nt, Homo Sapiens; identical to SEQ ID NO: 133705

SEQ ID NO: 239941 - RNA, 64 nt, Homo Sapiens; identical to SEQ ID NO: 133706

SEQ ID NO: 239942 - RNA, 64 nt, Homo Sapiens; identical to SEQ ID NO: 133707

SEQ ID NO: 239943 - RNA, 64 nt, Homo Sapiens; identical to SEQ ID NO: 133708

SEQ ID NO: 239944 - RNA, 64 nt, Homo Sapiens; identical to SEQ ID NO: 133709

SEQ ID NO: 239945 - RNA, 64 nt, Homo Sapiens; identical to SEQ ID NO: 133710

SEQ ID NO: 239946 - RNA, 64 nt, Homo Sapiens; identical to SEQ ID NO: 133711

SEQ ID NO: 239947 - RNA, 64 nt, Homo Sapiens; identical to SEQ ID NO: 133712

SEQ ID NO: 239948 - RNA, 64 nt, Homo Sapiens; identical to SEQ ID NO: 133713

SEQ ID NO: 239949 - RNA, 64 nt, Homo Sapiens; identical to SEQ ID NO: 133714

SEQ ID NO: 239950 - RNA, 64 nt, Homo Sapiens; identical to SEQ ID NO: 133715

SEQ ID NO: 239951 - RNA, 64 nt, Homo Sapiens; identical to SEQ ID NO: 133716

SEQ ID NO: 239952 - RNA, 64 nt, Homo Sapiens; identical to SEQ ID NO: 133717

SEQ ID NO: 239953 - RNA, 64 nt, Homo Sapiens; identical to SEQ ID NO: 133718

SEQ ID NO: 239954 - RNA, 64 nt, Homo Sapiens; identical to SEQ ID NO: 133719

SEQ ID NO: 239955 - RNA, 64 nt, Homo Sapiens; identical to SEQ ID NO: 133720

SEQ ID NO: 239956 - RNA, 64 nt, Homo Sapiens; identical to SEQ ID NO: 133721

SEQ ID NO: 239957 - RNA, 64 nt, Homo Sapiens; identical to SEQ ID NO: 133722

SEQ ID NO: 239958 - RNA, 64 nt, Homo Sapiens; identical to SEQ ID NO: 133723

SEQ ID NO: 239959 - RNA, 64 nt, Homo Sapiens; identical to SEQ ID NO: 133724

SEQ ID NO: 239960 - RNA, 64 nt, Homo Sapiens; identical to SEQ ID NO: 133725

SEQ ID NO: 239961 - RNA, 64 nt, Homo Sapiens; identical to SEQ ID NO: 133726

SEQ ID NO: 239962 - RNA, 64 nt, Homo Sapiens; identical to SEQ ID NO: 133727

SEQ ID NO: 239963 - RNA, 64 nt, Homo Sapiens; identical to SEQ ID NO: 133728

SEQ ID NO: 239964 - RNA, 64 nt, Homo Sapiens; identical to SEQ ID NO: 133729

SEQ ID NO: 239965 - RNA, 64 nt, Homo Sapiens; identical to SEQ ID NO: 133730

SEQ ID NO: 239966 - RNA, 64 nt, Homo Sapiens; identical to SEQ ID NO: 133731

SEQ ID NO: 239967 - RNA, 64 nt, Homo Sapiens; identical to SEQ ID NO: 133732

SEQ ID NO: 239968 - RNA, 64 nt, Homo Sapiens; identical to SEQ ID NO: 133733

SEQ ID NO: 239969 - RNA, 64 nt, Homo Sapiens; identical to SEQ ID NO: 133734

SEQ ID NO: 239970 - RNA, 64 nt, Homo Sapiens; identical to SEQ ID NO: 133735

SEQ ID NO: 239971 - RNA, 64 nt, Homo Sapiens; identical to SEQ ID NO: 133736

SEQ ID NO: 239972 - RNA, 64 nt, Homo Sapiens; identical to SEQ ID NO: 133737

SEQ ID NO: 239973 - RNA, 64 nt, Homo Sapiens; identical to SEQ ID NO: 133738

SEQ ID NO: 239974 - RNA, 64 nt, Homo Sapiens; identical to SEQ ID NO: 133739

SEQ ID NO: 239975 - RNA, 64 nt, Homo Sapiens; identical to SEQ ID NO: 133740

SEQ ID NO: 239976 - RNA, 64 nt, Homo Sapiens; identical to SEQ ID NO: 133741

SEQ ID NO: 239977 - RNA, 64 nt, Homo Sapiens; identical to SEQ ID NO: 133742

SEQ ID NO: 239978 - RNA, 64 nt, Homo Sapiens; identical to SEQ ID NO: 133743

SEQ ID NO: 239979 - RNA, 64 nt, Homo Sapiens; identical to SEQ ID NO: 133744

SEQ ID NO: 239980 - RNA, 64 nt, Homo Sapiens; identical to SEQ ID NO: 133745

SEQ ID NO: 239981 - RNA, 64 nt, Homo Sapiens; identical to SEQ ID NO: 133746

SEQ ID NO: 239982 - RNA, 64 nt, Homo Sapiens; identical to SEQ ID NO: 133747

SEQ ID NO: 239983 - RNA, 64 nt, Homo Sapiens; identical to SEQ ID NO: 133748

SEQ ID NO: 239984 - RNA, 64 nt, Homo Sapiens; identical to SEQ ID NO: 133749

SEQ ID NO: 239985 - RNA, 64 nt, Homo Sapiens; identical to SEQ ID NO: 133750

SEQ ID NO: 239986 - RNA, 64 nt, Homo Sapiens; identical to SEQ ID NO: 133751

SEQ ID NO: 239987 - RNA, 64 nt, Homo Sapiens; identical to SEQ ID NO: 133752

SEQ ID NO: 239988 - RNA, 64 nt, Homo Sapiens; identical to SEQ ID NO: 133753

SEQ ID NO: 239989 - RNA, 64 nt, Homo Sapiens; identical to SEQ ID NO: 133754

SEQ ID NO: 239990 - RNA, 64 nt, Homo Sapiens; identical to SEQ ID NO: 133755

SEQ ID NO: 239991 - RNA, 64 nt, Homo Sapiens; identical to SEQ ID NO: 133756

SEQ ID NO: 239992 - RNA, 64 nt, Homo Sapiens; identical to SEQ ID NO: 133757

SEQ ID NO: 239993 - RNA, 64 nt, Homo Sapiens; identical to SEQ ID NO: 133758

SEQ ID NO: 239994 - RNA, 64 nt, Homo Sapiens; identical to SEQ ID NO: 133759

SEQ ID NO: 239995 - RNA, 64 nt, Homo Sapiens; identical to SEQ ID NO: 133760

SEQ ID NO: 239996 - RNA, 64 nt, Homo Sapiens; identical to SEQ ID NO: 133761

SEQ ID NO: 239997 - RNA, 64 nt, Homo Sapiens; identical to SEQ ID NO: 133762

SEQ ID NO: 239998 - RNA, 64 nt, Homo Sapiens; identical to SEQ ID NO: 133763

SEQ ID NO: 239999 - RNA, 64 nt, Homo Sapiens; identical to SEQ ID NO: 133764

SEQ ID NO: 240000 - RNA, 64 nt, Homo Sapiens; identical to SEQ ID NO: 133765

SEQ ID NO: 240001 - RNA, 60 nt, Homo Sapiens; identical to SEQ ID NO: 133766

SEQ ID NO: 240002 - RNA, 57 nt, Homo Sapiens; identical to SEQ ID NO: 133767

SEQ ID NO: 240003 - RNA, 64 nt, Homo Sapiens; identical to SEQ ID NO: 133768

SEQ ID NO: 240004 - RNA, 64 nt, Homo Sapiens; identical to SEQ ID NO: 133769

SEQ ID NO: 240005 - RNA, 64 nt, Homo Sapiens; identical to SEQ ID NO: 133770

SEQ ID NO: 240006 - RNA, 64 nt, Homo Sapiens; identical to SEQ ID NO: 133771

SEQ ID NO: 240007 - RNA, 64 nt, Homo Sapiens; identical to SEQ ID NO: 133772

SEQ ID NO: 240008 - RNA, 64 nt, Homo Sapiens; identical to SEQ ID NO: 133773

SEQ ID NO: 240009 - RNA, 64 nt, Homo Sapiens; identical to SEQ ID NO: 133774

SEQ ID NO: 240010 - RNA, 64 nt, Homo Sapiens; identical to SEQ ID NO: 133775

SEQ ID NO: 240011 - RNA, 64 nt, Homo Sapiens; identical to SEQ ID NO: 133776

SEQ ID NO: 240012 - RNA, 64 nt, Homo Sapiens; identical to SEQ ID NO: 133777

SEQ ID NO: 240013 - RNA, 64 nt, Homo Sapiens; identical to SEQ ID NO: 133778

SEQ ID NO: 240014 - RNA, 64 nt, Homo Sapiens; identical to SEQ ID NO: 133779

SEQ ID NO: 240015 - RNA, 64 nt, Homo Sapiens; identical to SEQ ID NO: 133780

SEQ ID NO: 240016 - RNA, 64 nt, Homo Sapiens; identical to SEQ ID NO: 133781

SEQ ID NO: 240017 - RNA, 64 nt, Homo Sapiens; identical to SEQ ID NO: 133782

SEQ ID NO: 240018 - RNA, 64 nt, Homo Sapiens; identical to SEQ ID NO: 133783

SEQ ID NO: 240019 - RNA, 64 nt, Homo Sapiens; identical to SEQ ID NO: 133784

SEQ ID NO: 240020 - RNA, 64 nt, Homo Sapiens; identical to SEQ ID NO: 133785

SEQ ID NO: 240021 - RNA, 64 nt, Homo Sapiens; identical to SEQ ID NO: 133786

SEQ ID NO: 240022 - RNA, 64 nt, Homo Sapiens; identical to SEQ ID NO: 133787

SEQ ID NO: 240023 - RNA, 64 nt, Homo Sapiens; identical to SEQ ID NO: 133788

SEQ ID NO: 240024 - RNA, 64 nt, Homo Sapiens; identical to SEQ ID NO: 133789

SEQ ID NO: 240025 - RNA, 64 nt, Homo Sapiens; identical to SEQ ID NO: 133790

SEQ ID NO: 240026 - RNA, 64 nt, Homo Sapiens; identical to SEQ ID NO: 133791

SEQ ID NO: 240027 - RNA, 64 nt, Homo Sapiens; identical to SEQ ID NO: 133792

SEQ ID NO: 240028 - RNA, 64 nt, Homo Sapiens; identical to SEQ ID NO: 133793

SEQ ID NO: 240029 - RNA, 64 nt, Homo Sapiens; identical to SEQ ID NO: 133794

SEQ ID NO: 240030 - RNA, 64 nt, Homo Sapiens; identical to SEQ ID NO: 133795

SEQ ID NO: 240031 - RNA, 64 nt, Homo Sapiens; identical to SEQ ID NO: 133796

SEQ ID NO: 240032 - RNA, 64 nt, Homo Sapiens; identical to SEQ ID NO: 133797

SEQ ID NO: 240033 - RNA, 64 nt, Homo Sapiens; identical to SEQ ID NO: 133798

SEQ ID NO: 240034 - RNA, 64 nt, Homo Sapiens; identical to SEQ ID NO: 133799

SEQ ID NO: 240035 - RNA, 64 nt, Homo Sapiens; identical to SEQ ID NO: 133800

SEQ ID NO: 240036 - RNA, 64 nt, Homo Sapiens; identical to SEQ ID NO: 133801

SEQ ID NO: 240037 - RNA, 64 nt, Homo Sapiens; identical to SEQ ID NO: 133802

SEQ ID NO: 240038 - RNA, 64 nt, Homo Sapiens; identical to SEQ ID NO: 133803

SEQ ID NO: 240039 - RNA, 64 nt, Homo Sapiens; identical to SEQ ID NO: 133804

SEQ ID NO: 240040 - RNA, 64 nt, Homo Sapiens; identical to SEQ ID NO: 133805

SEQ ID NO: 240041 - RNA, 64 nt, Homo Sapiens; identical to SEQ ID NO: 133806

SEQ ID NO: 240042 - RNA, 64 nt, Homo Sapiens; identical to SEQ ID NO: 133807

SEQ ID NO: 240043 - RNA, 64 nt, Homo Sapiens; identical to SEQ ID NO: 133808

SEQ ID NO: 240044 - RNA, 64 nt, Homo Sapiens; identical to SEQ ID NO: 133809

SEQ ID NO: 240045 - RNA, 64 nt, Homo Sapiens; identical to SEQ ID NO: 133810

SEQ ID NO: 240046 - RNA, 64 nt, Homo Sapiens; identical to SEQ ID NO: 133811

SEQ ID NO: 240047 - RNA, 64 nt, Homo Sapiens; identical to SEQ ID NO: 133812

SEQ ID NO: 240048 - RNA, 64 nt, Homo Sapiens; identical to SEQ ID NO: 133813

SEQ ID NO: 240049 - RNA, 64 nt, Homo Sapiens; identical to SEQ ID NO: 133814

SEQ ID NO: 240050 - RNA, 64 nt, Homo Sapiens; identical to SEQ ID NO: 133815

SEQ ID NO: 240051 - RNA, 64 nt, Homo Sapiens; identical to SEQ ID NO: 133816

SEQ ID NO: 240052 - RNA, 64 nt, Homo Sapiens; identical to SEQ ID NO: 133817

SEQ ID NO: 240053 - RNA, 64 nt, Homo Sapiens; identical to SEQ ID NO: 133818

SEQ ID NO: 240054 - RNA, 64 nt, Homo Sapiens; identical to SEQ ID NO: 133819

SEQ ID NO: 240055 - RNA, 64 nt, Homo Sapiens; identical to SEQ ID NO: 133820

SEQ ID NO: 240056 - RNA, 64 nt, Homo Sapiens; identical to SEQ ID NO: 133821

SEQ ID NO: 240057 - RNA, 64 nt, Homo Sapiens; identical to SEQ ID NO: 133822

SEQ ID NO: 240058 - RNA, 64 nt, Homo Sapiens; identical to SEQ ID NO: 133823

SEQ ID NO: 240059 - RNA, 64 nt, Homo Sapiens; identical to SEQ ID NO: 133824

SEQ ID NO: 240060 - RNA, 64 nt, Homo Sapiens; identical to SEQ ID NO: 133825

SEQ ID NO: 240061 - RNA, 64 nt, Homo Sapiens; identical to SEQ ID NO: 133826

SEQ ID NO: 240062 - RNA, 64 nt, Homo Sapiens; identical to SEQ ID NO: 133827

SEQ ID NO: 240063 - RNA, 64 nt, Homo Sapiens; identical to SEQ ID NO: 133828

SEQ ID NO: 240064 - RNA, 64 nt, Homo Sapiens; identical to SEQ ID NO: 133829

SEQ ID NO: 240065 - RNA, 64 nt, Homo Sapiens
gaggguggggagagcuggcaggcccagggcuuguccugcugaccccagcagacccuccuguugg

SEQ ID NO: 240066 - RNA, 64 nt, Homo Sapiens
aaggaucuggccuuguggucacuggcaucugagcccugcugauggcuggggcucucgggcaugc

SEQ ID NO: 240067 - RNA, 64 nt, Homo Sapiens
uguuucuggaggcagcuggucccccacaccgcguccugcugagccugcccccuggauuggcugu

SEQ ID NO: 240068 - RNA, 64 nt, Homo Sapiens
uuuucggaucuucugucccagauccugcucccucccugcugagccugggguuccccuggcauug

SEQ ID NO: 240069 - RNA, 64 nt, Homo Sapiens
gcuggaugucacacaugaaggagacugacuucuuccugcugacacggagacuguggaggcagug

SEQ ID NO: 240070 - RNA, 64 nt, Homo Sapiens
cugugccagacuccauugcuuuacucuuccuccaccugcugagcccugcugcuuuccugacagc

SEQ ID NO: 240071 - RNA, 61 nt, Homo Sapiens
uucugccggugucugagugaaggaccgcgcuccugcugaagaguuuagaaugaggcagcgg

SEQ ID NO: 240072 - RNA, 64 nt, Homo Sapiens
gcuggugguaggugggaagcaugguguccaccugccugcugaccacuggacgcugcuccaugcu

SEQ ID NO: 240073 - RNA, 64 nt, Homo Sapiens
gauuuccaaagagaaaaaaaggauguaaacagugccugcugaaucuagagauauggcagcgaaa

SEQ ID NO: 240074 - RNA, 64 nt, Homo Sapiens
gacccaaggaggaaaaacagcaggcacgaacccaccugcugagaucuucccaucacuggagcac

SEQ ID NO: 240075 - RNA, 64 nt, Homo Sapiens
acccaaacguggucucccguuggccgcaccccuuccugcugauccccugggguauccgggagga

SEQ ID NO: 240076 - RNA, 64 nt, Homo Sapiens
uuaguuuugggaagcgcuucagaugauugcuuugccugcugagggugccugggcuucuuuggcg

SEQ ID NO: 240077 - RNA, 64 nt, Homo Sapiens
caggggaccucugcccgagaucuuccaaucaggcccugcugaggagcucaaggccaucgucucc

SEQ ID NO: 240078 - RNA, 64 nt, Homo Sapiens
ggcgucaggccaggcuugacgcuggcccagggccccugcugagggguucugaugaaaacugacu

SEQ ID NO: 240079 - RNA, 64 nt, Homo Sapiens
ggcaacauuuuuggggugcuuagaagaaaauuaaccugcugacaauaucuacuucuuuuaaagu

SEQ ID NO: 240080 - RNA, 64 nt, Homo Sapiens
cucuucaacugauuuuuaaaagaaccuagaagcaccugcugacagaccugggggcucacagcac

SEQ ID NO: 240081 - RNA, 64 nt, Homo Sapiens
uauugguacuagcaacuuaacuuucauucauaucccugcugaaacaugagcuaaguuguuauuu

SEQ ID NO: 240082 - RNA, 64 nt, Homo Sapiens
cugguacuuucugcacagccccugacuagaugccccugcugaauguggggagcaaagagggcag

SEQ ID NO: 240083 - RNA, 64 nt, Homo Sapiens
uggcccugacaggcagccgugaugggaugcucugccugcugaugaccuagugccugaguuuggg

SEQ ID NO: 240084 - RNA, 64 nt, Homo Sapiens
acagacaugcagcagcgggccgggucugccuccuccugcugaagagcucccccaugcgaggauc

SEQ ID NO: 240085 - RNA, 64 nt, Homo Sapiens
cacauggccggcucugugcacucaagcgcacagcccugcugagcucaaggacgucugcuuccac

SEQ ID NO: 240086 - RNA, 64 nt, Homo Sapiens
gaggacggcgaguucgcccagcacugcggcacuuccugcugaugaccuggaggcgcacuaugag

SEQ ID NO: 240087 - RNA, 64 nt, Homo Sapiens; identical to SEQ ID NO: 110959

SEQ ID NO: 240088 - RNA, 64 nt, Homo Sapiens; identical to SEQ ID NO: 110960

SEQ ID NO: 240089 - RNA, 64 nt, Homo Sapiens; identical to SEQ ID NO: 110961

SEQ ID NO: 240090 - RNA, 64 nt, Homo Sapiens; identical to SEQ ID NO: 110962

SEQ ID NO: 240091 - RNA, 64 nt, Homo Sapiens; identical to SEQ ID NO: 110963

SEQ ID NO: 240092 - RNA, 64 nt, Homo Sapiens; identical to SEQ ID NO: 110964

SEQ ID NO: 240093 - RNA, 64 nt, Homo Sapiens; identical to SEQ ID NO: 110965

SEQ ID NO: 240094 - RNA, 64 nt, Homo Sapiens; identical to SEQ ID NO: 110966

SEQ ID NO: 240095 - RNA, 64 nt, Homo Sapiens; identical to SEQ ID NO: 110967

SEQ ID NO: 240096 - RNA, 64 nt, Homo Sapiens; identical to SEQ ID NO: 110968

SEQ ID NO: 240097 - RNA, 64 nt, Homo Sapiens; identical to SEQ ID NO: 110969

SEQ ID NO: 240098 - RNA, 64 nt, Homo Sapiens; identical to SEQ ID NO: 110970

SEQ ID NO: 240099 - RNA, 64 nt, Homo Sapiens; identical to SEQ ID NO: 110971

SEQ ID NO: 240100 - RNA, 64 nt, Homo Sapiens; identical to SEQ ID NO: 110972

SEQ ID NO: 240101 - RNA, 64 nt, Homo Sapiens; identical to SEQ ID NO: 110973

SEQ ID NO: 240102 - RNA, 64 nt, Homo Sapiens; identical to SEQ ID NO: 110974

SEQ ID NO: 240103 - RNA, 64 nt, Homo Sapiens; identical to SEQ ID NO: 110975

SEQ ID NO: 240104 - RNA, 64 nt, Homo Sapiens; identical to SEQ ID NO: 110976

SEQ ID NO: 240105 - RNA, 64 nt, Homo Sapiens; identical to SEQ ID NO: 110977

SEQ ID NO: 240106 - RNA, 64 nt, Homo Sapiens; identical to SEQ ID NO: 110978

SEQ ID NO: 240107 - RNA, 64 nt, Homo Sapiens; identical to SEQ ID NO: 110979

SEQ ID NO: 240108 - RNA, 64 nt, Homo Sapiens; identical to SEQ ID NO: 110980

SEQ ID NO: 240109 - RNA, 64 nt, Homo Sapiens; identical to SEQ ID NO: 91418

SEQ ID NO: 240110 - RNA, 64 nt, Homo Sapiens; identical to SEQ ID NO: 91419

SEQ ID NO: 240111 - RNA, 56 nt, Homo Sapiens; identical to SEQ ID NO: 91420

SEQ ID NO: 240112 - RNA, 64 nt, Homo Sapiens; identical to SEQ ID NO: 91421

SEQ ID NO: 240113 - RNA, 64 nt, Homo Sapiens; identical to SEQ ID NO: 91422

SEQ ID NO: 240114 - RNA, 64 nt, Homo Sapiens; identical to SEQ ID NO: 91423

SEQ ID NO: 240115 - RNA, 64 nt, Homo Sapiens; identical to SEQ ID NO: 91424

SEQ ID NO: 240116 - RNA, 64 nt, Homo Sapiens; identical to SEQ ID NO: 91425

SEQ ID NO: 240117 - RNA, 64 nt, Homo Sapiens; identical to SEQ ID NO: 91426

SEQ ID NO: 240118 - RNA, 64 nt, Homo Sapiens; identical to SEQ ID NO: 91427

SEQ ID NO: 240119 - RNA, 64 nt, Homo Sapiens; identical to SEQ ID NO: 91428

SEQ ID NO: 240120 - RNA, 64 nt, Homo Sapiens; identical to SEQ ID NO: 91429

SEQ ID NO: 240121 - RNA, 64 nt, Homo Sapiens; identical to SEQ ID NO: 91430

SEQ ID NO: 240122 - RNA, 64 nt, Homo Sapiens; identical to SEQ ID NO: 91431

SEQ ID NO: 240123 - RNA, 64 nt, Homo Sapiens; identical to SEQ ID NO: 91432

SEQ ID NO: 240124 - RNA, 64 nt, Homo Sapiens; identical to SEQ ID NO: 91433

SEQ ID NO: 240125 - RNA, 64 nt, Homo Sapiens; identical to SEQ ID NO: 91434

SEQ ID NO: 240126 - RNA, 64 nt, Homo Sapiens; identical to SEQ ID NO: 91435

SEQ ID NO: 240127 - RNA, 64 nt, Homo Sapiens; identical to SEQ ID NO: 91436

SEQ ID NO: 240128 - RNA, 64 nt, Homo Sapiens; identical to SEQ ID NO: 217395

SEQ ID NO: 240129 - RNA, 64 nt, Homo Sapiens; identical to SEQ ID NO: 217396

SEQ ID NO: 240130 - RNA, 64 nt, Homo Sapiens; identical to SEQ ID NO: 217397

SEQ ID NO: 240131 - RNA, 64 nt, Homo Sapiens; identical to SEQ ID NO: 217398

SEQ ID NO: 240132 - RNA, 64 nt, Homo Sapiens; identical to SEQ ID NO: 217399

SEQ ID NO: 240133 - RNA, 64 nt, Homo Sapiens; identical to SEQ ID NO: 217400

SEQ ID NO: 240134 - RNA, 64 nt, Homo Sapiens; identical to SEQ ID NO: 217401

SEQ ID NO: 240135 - RNA, 64 nt, Homo Sapiens; identical to SEQ ID NO: 217402

SEQ ID NO: 240136 - RNA, 64 nt, Homo Sapiens; identical to SEQ ID NO: 217403

SEQ ID NO: 240137 - RNA, 64 nt, Homo Sapiens; identical to SEQ ID NO: 217404

SEQ ID NO: 240138 - RNA, 64 nt, Homo Sapiens; identical to SEQ ID NO: 217405

SEQ ID NO: 240139 - RNA, 64 nt, Homo Sapiens; identical to SEQ ID NO: 217406

SEQ ID NO: 240140 - RNA, 64 nt, Homo Sapiens; identical to SEQ ID NO: 217407

SEQ ID NO: 240141 - RNA, 64 nt, Homo Sapiens; identical to SEQ ID NO: 217408

SEQ ID NO: 240142 - RNA, 64 nt, Homo Sapiens; identical to SEQ ID NO: 217409

SEQ ID NO: 240143 - RNA, 64 nt, Homo Sapiens; identical to SEQ ID NO: 217410

SEQ ID NO: 240144 - RNA, 64 nt, Homo Sapiens; identical to SEQ ID NO: 217411

SEQ ID NO: 240145 - RNA, 64 nt, Homo Sapiens; identical to SEQ ID NO: 217412

SEQ ID NO: 240146 - RNA, 64 nt, Homo Sapiens; identical to SEQ ID NO: 217413

SEQ ID NO: 240147 - RNA, 64 nt, Homo Sapiens; identical to SEQ ID NO: 217414

SEQ ID NO: 240148 - RNA, 64 nt, Homo Sapiens; identical to SEQ ID NO: 217415

SEQ ID NO: 240149 - RNA, 64 nt, Homo Sapiens; identical to SEQ ID NO: 217416

SEQ ID NO: 240150 - RNA, 64 nt, Homo Sapiens; identical to SEQ ID NO: 98672

SEQ ID NO: 240151 - RNA, 64 nt, Homo Sapiens; identical to SEQ ID NO: 98673

SEQ ID NO: 240152 - RNA, 64 nt, Homo Sapiens; identical to SEQ ID NO: 98674

SEQ ID NO: 240153 - RNA, 64 nt, Homo Sapiens; identical to SEQ ID NO: 98675

SEQ ID NO: 240154 - RNA, 64 nt, Homo Sapiens; identical to SEQ ID NO: 98676

SEQ ID NO: 240155 - RNA, 64 nt, Homo Sapiens; identical to SEQ ID NO: 98677

SEQ ID NO: 240156 - RNA, 64 nt, Homo Sapiens; identical to SEQ ID NO: 98678

SEQ ID NO: 240157 - RNA, 64 nt, Homo Sapiens; identical to SEQ ID NO: 98679

SEQ ID NO: 240158 - RNA, 64 nt, Homo Sapiens; identical to SEQ ID NO: 98680

SEQ ID NO: 240159 - RNA, 64 nt, Homo Sapiens; identical to SEQ ID NO: 98681

SEQ ID NO: 240160 - RNA, 64 nt, Homo Sapiens; identical to SEQ ID NO: 98682

SEQ ID NO: 240161 - RNA, 64 nt, Homo Sapiens; identical to SEQ ID NO: 98683

SEQ ID NO: 240162 - RNA, 64 nt, Homo Sapiens; identical to SEQ ID NO: 98684

SEQ ID NO: 240163 - RNA, 64 nt, Homo Sapiens; identical to SEQ ID NO: 98685

SEQ ID NO: 240164 - RNA, 64 nt, Homo Sapiens; identical to SEQ ID NO: 98686

SEQ ID NO: 240165 - RNA, 64 nt, Homo Sapiens; identical to SEQ ID NO: 98687

SEQ ID NO: 240166 - RNA, 64 nt, Homo Sapiens; identical to SEQ ID NO: 98688

SEQ ID NO: 240167 - RNA, 64 nt, Homo Sapiens; identical to SEQ ID NO: 98689

SEQ ID NO: 240168 - RNA, 64 nt, Homo Sapiens; identical to SEQ ID NO: 98690

SEQ ID NO: 240169 - RNA, 64 nt, Homo Sapiens; identical to SEQ ID NO: 98691

SEQ ID NO: 240170 - RNA, 64 nt, Homo Sapiens; identical to SEQ ID NO: 98692

SEQ ID NO: 240171 - RNA, 64 nt, Homo Sapiens; identical to SEQ ID NO: 98693

SEQ ID NO: 240172 - RNA, 64 nt, Homo Sapiens; identical to SEQ ID NO: 98694

SEQ ID NO: 240173 - RNA, 64 nt, Homo Sapiens; identical to SEQ ID NO: 98695

SEQ ID NO: 240174 - RNA, 64 nt, Homo Sapiens; identical to SEQ ID NO: 98696

SEQ ID NO: 240175 - RNA, 60 nt, Homo Sapiens; identical to SEQ ID NO: 98697

SEQ ID NO: 240176 - RNA, 64 nt, Homo Sapiens; identical to SEQ ID NO: 98698

SEQ ID NO: 240177 - RNA, 64 nt, Homo Sapiens; identical to SEQ ID NO: 98699

SEQ ID NO: 240178 - RNA, 64 nt, Homo Sapiens; identical to SEQ ID NO: 98700

SEQ ID NO: 240179 - RNA, 64 nt, Homo Sapiens; identical to SEQ ID NO: 98701

SEQ ID NO: 240180 - RNA, 64 nt, Homo Sapiens; identical to SEQ ID NO: 98702

SEQ ID NO: 240181 - RNA, 64 nt, Homo Sapiens; identical to SEQ ID NO: 98703

SEQ ID NO: 240182 - RNA, 64 nt, Homo Sapiens; identical to SEQ ID NO: 98704

SEQ ID NO: 240183 - RNA, 64 nt, Homo Sapiens; identical to SEQ ID NO: 98705

SEQ ID NO: 240184 - RNA, 64 nt, Homo Sapiens; identical to SEQ ID NO: 98706

SEQ ID NO: 240185 - RNA, 64 nt, Homo Sapiens; identical to SEQ ID NO: 98707

SEQ ID NO: 240186 - RNA, 64 nt, Homo Sapiens; identical to SEQ ID NO: 98708

SEQ ID NO: 240187 - RNA, 64 nt, Homo Sapiens; identical to SEQ ID NO: 98709

SEQ ID NO: 240188 - RNA, 64 nt, Homo Sapiens; identical to SEQ ID NO: 98710

SEQ ID NO: 240189 - RNA, 64 nt, Homo Sapiens; identical to SEQ ID NO: 98711

SEQ ID NO: 240190 - RNA, 64 nt, Homo Sapiens; identical to SEQ ID NO: 98712

SEQ ID NO: 240191 - RNA, 64 nt, Homo Sapiens; identical to SEQ ID NO: 98713

SEQ ID NO: 240192 - RNA, 64 nt, Homo Sapiens; identical to SEQ ID NO: 98714

SEQ ID NO: 240193 - RNA, 64 nt, Homo Sapiens; identical to SEQ ID NO: 98715

SEQ ID NO: 240194 - RNA, 64 nt, Homo Sapiens; identical to SEQ ID NO: 98716

SEQ ID NO: 240195 - RNA, 64 nt, Homo Sapiens; identical to SEQ ID NO: 98717

SEQ ID NO: 240196 - RNA, 64 nt, Homo Sapiens; identical to SEQ ID NO: 98718

SEQ ID NO: 240197 - RNA, 64 nt, Homo Sapiens; identical to SEQ ID NO: 98719

SEQ ID NO: 240198 - RNA, 64 nt, Homo Sapiens; identical to SEQ ID NO: 98720

SEQ ID NO: 240199 - RNA, 64 nt, Homo Sapiens; identical to SEQ ID NO: 98721

SEQ ID NO: 240200 - RNA, 64 nt, Homo Sapiens; identical to SEQ ID NO: 98722

SEQ ID NO: 240201 - RNA, 64 nt, Homo Sapiens; identical to SEQ ID NO: 98723

SEQ ID NO: 240202 - RNA, 64 nt, Homo Sapiens; identical to SEQ ID NO: 98724

SEQ ID NO: 240203 - RNA, 64 nt, Homo Sapiens; identical to SEQ ID NO: 98725

SEQ ID NO: 240204 - RNA, 64 nt, Homo Sapiens; identical to SEQ ID NO: 98726

SEQ ID NO: 240205 - RNA, 64 nt, Homo Sapiens; identical to SEQ ID NO: 98727

SEQ ID NO: 240206 - RNA, 64 nt, Homo Sapiens; identical to SEQ ID NO: 98728

SEQ ID NO: 240207 - RNA, 64 nt, Homo Sapiens; identical to SEQ ID NO: 98729

SEQ ID NO: 240208 - RNA, 64 nt, Homo Sapiens; identical to SEQ ID NO: 98730

SEQ ID NO: 240209 - RNA, 64 nt, Homo Sapiens; identical to SEQ ID NO: 98731

SEQ ID NO: 240210 - RNA, 64 nt, Homo Sapiens; identical to SEQ ID NO: 98732

SEQ ID NO: 240211 - RNA, 64 nt, Homo Sapiens; identical to SEQ ID NO: 98733

SEQ ID NO: 240212 - RNA, 64 nt, Homo Sapiens; identical to SEQ ID NO: 98734

SEQ ID NO: 240213 - RNA, 64 nt, Homo Sapiens; identical to SEQ ID NO: 98735

SEQ ID NO: 240214 - RNA, 64 nt, Homo Sapiens; identical to SEQ ID NO: 98736

SEQ ID NO: 240215 - RNA, 64 nt, Homo Sapiens; identical to SEQ ID NO: 98737

SEQ ID NO: 240216 - RNA, 64 nt, Homo Sapiens; identical to SEQ ID NO: 98738

SEQ ID NO: 240217 - RNA, 64 nt, Homo Sapiens; identical to SEQ ID NO: 98739

SEQ ID NO: 240218 - RNA, 64 nt, Homo Sapiens; identical to SEQ ID NO: 98740

SEQ ID NO: 240219 - RNA, 64 nt, Homo Sapiens; identical to SEQ ID NO: 98741

SEQ ID NO: 240220 - RNA, 64 nt, Homo Sapiens; identical to SEQ ID NO: 98742

SEQ ID NO: 240221 - RNA, 64 nt, Homo Sapiens; identical to SEQ ID NO: 98743

SEQ ID NO: 240222 - RNA, 64 nt, Homo Sapiens; identical to SEQ ID NO: 98744

SEQ ID NO: 240223 - RNA, 64 nt, Homo Sapiens; identical to SEQ ID NO: 98745

SEQ ID NO: 240224 - RNA, 64 nt, Homo Sapiens; identical to SEQ ID NO: 98746

SEQ ID NO: 240225 - RNA, 64 nt, Homo Sapiens; identical to SEQ ID NO: 98747

SEQ ID NO: 240226 - RNA, 64 nt, Homo Sapiens; identical to SEQ ID NO: 98748

SEQ ID NO: 240227 - RNA, 64 nt, Homo Sapiens; identical to SEQ ID NO: 98749

SEQ ID NO: 240228 - RNA, 64 nt, Homo Sapiens; identical to SEQ ID NO: 98750

SEQ ID NO: 240229 - RNA, 64 nt, Homo Sapiens; identical to SEQ ID NO: 98751

SEQ ID NO: 240230 - RNA, 64 nt, Homo Sapiens; identical to SEQ ID NO: 98752

SEQ ID NO: 240231 - RNA, 64 nt, Homo Sapiens; identical to SEQ ID NO: 98753

SEQ ID NO: 240232 - RNA, 64 nt, Homo Sapiens; identical to SEQ ID NO: 98754

SEQ ID NO: 240233 - RNA, 64 nt, Homo Sapiens; identical to SEQ ID NO: 98755

SEQ ID NO: 240234 - RNA, 64 nt, Homo Sapiens; identical to SEQ ID NO: 98756

SEQ ID NO: 240235 - RNA, 64 nt, Homo Sapiens; identical to SEQ ID NO: 98757

SEQ ID NO: 240236 - RNA, 64 nt, Homo Sapiens; identical to SEQ ID NO: 98758

SEQ ID NO: 240237 - RNA, 64 nt, Homo Sapiens; identical to SEQ ID NO: 98759

SEQ ID NO: 240238 - RNA, 64 nt, Homo Sapiens; identical to SEQ ID NO: 98760

SEQ ID NO: 240239 - RNA, 64 nt, Homo Sapiens; identical to SEQ ID NO: 98761

SEQ ID NO: 240240 - RNA, 64 nt, Homo Sapiens; identical to SEQ ID NO: 98762

SEQ ID NO: 240241 - RNA, 64 nt, Homo Sapiens; identical to SEQ ID NO: 98763

SEQ ID NO: 240242 - RNA, 64 nt, Homo Sapiens; identical to SEQ ID NO: 98764

SEQ ID NO: 240243 - RNA, 64 nt, Homo Sapiens; identical to SEQ ID NO: 98765

SEQ ID NO: 240244 - RNA, 64 nt, Homo Sapiens; identical to SEQ ID NO: 98766

SEQ ID NO: 240245 - RNA, 64 nt, Homo Sapiens; identical to SEQ ID NO: 98767

SEQ ID NO: 240246 - RNA, 64 nt, Homo Sapiens; identical to SEQ ID NO: 98768

SEQ ID NO: 240247 - RNA, 64 nt, Homo Sapiens; identical to SEQ ID NO: 98769

SEQ ID NO: 240248 - RNA, 64 nt, Homo Sapiens; identical to SEQ ID NO: 98770

SEQ ID NO: 240249 - RNA, 64 nt, Homo Sapiens; identical to SEQ ID NO: 98771

SEQ ID NO: 240250 - RNA, 64 nt, Homo Sapiens; identical to SEQ ID NO: 98772

SEQ ID NO: 240251 - RNA, 64 nt, Homo Sapiens; identical to SEQ ID NO: 98773

SEQ ID NO: 240252 - RNA, 64 nt, Homo Sapiens; identical to SEQ ID NO: 98774

SEQ ID NO: 240253 - RNA, 64 nt, Homo Sapiens; identical to SEQ ID NO: 98775

SEQ ID NO: 240254 - RNA, 64 nt, Homo Sapiens; identical to SEQ ID NO: 98776

SEQ ID NO: 240255 - RNA, 64 nt, Homo Sapiens; identical to SEQ ID NO: 98777

SEQ ID NO: 240256 - RNA, 64 nt, Homo Sapiens; identical to SEQ ID NO: 98778

SEQ ID NO: 240257 - RNA, 64 nt, Homo Sapiens; identical to SEQ ID NO: 98779

SEQ ID NO: 240258 - RNA, 64 nt, Homo Sapiens; identical to SEQ ID NO: 98780

SEQ ID NO: 240259 - RNA, 64 nt, Homo Sapiens; identical to SEQ ID NO: 98781

SEQ ID NO: 240260 - RNA, 64 nt, Homo Sapiens; identical to SEQ ID NO: 98782

SEQ ID NO: 240261 - RNA, 64 nt, Homo Sapiens; identical to SEQ ID NO: 98783

SEQ ID NO: 240262 - RNA, 64 nt, Homo Sapiens; identical to SEQ ID NO: 98784

SEQ ID NO: 240263 - RNA, 64 nt, Homo Sapiens; identical to SEQ ID NO: 98785

SEQ ID NO: 240264 - RNA, 64 nt, Homo Sapiens
cauaguagcuugaaaucuagcaugguuacauguucuacaucaugaaagguagcugaugagguua

SEQ ID NO: 240265 - RNA, 64 nt, Homo Sapiens
aguuacugucaugcaccacaaagggcccaugugucuacaucaucgaaaaaaauaucagcuccca

SEQ ID NO: 240266 - RNA, 64 nt, Homo Sapiens
uuagacugcuguucugauugcauuuaucuuuuuccuacaucauuuagaauuuuauuucccugau

SEQ ID NO: 240267 - RNA, 64 nt, Homo Sapiens
guaaagcacagguggauuucucuauuuuugaauacuacaucagauuuagaugcacgacuaccug

SEQ ID NO: 240268 - RNA, 64 nt, Homo Sapiens
ugcucaagcccugaguugccccauagcaacuccccuacaucaaaccaagaaacaccgagugagg

SEQ ID NO: 240269 - RNA, 64 nt, Homo Sapiens
ugcucaagcccccagcuggaccauagcaauuccccuacaucaaagcccgaaacaccaagugagg

SEQ ID NO: 240270 - RNA, 64 nt, Homo Sapiens
augcaucccgcauccagacucggucccccacucccuacaucagagguggcuucuugaugcugcg

SEQ ID NO: 240271 - RNA, 64 nt, Homo Sapiens
acgcaucccucaucuggacuccgucccccacucccuacaucagagugcaagucuugaugcugcg

SEQ ID NO: 240272 - RNA, 64 nt, Homo Sapiens; identical to SEQ ID NO: 147473

SEQ ID NO: 240273 - RNA, 64 nt, Homo Sapiens; identical to SEQ ID NO: 147474

SEQ ID NO: 240274 - RNA, 64 nt, Homo Sapiens; identical to SEQ ID NO: 147475

SEQ ID NO: 240275 - RNA, 64 nt, Homo Sapiens; identical to SEQ ID NO: 147476

SEQ ID NO: 240276 - RNA, 64 nt, Homo Sapiens; identical to SEQ ID NO: 147477

SEQ ID NO: 240277 - RNA, 64 nt, Homo Sapiens; identical to SEQ ID NO: 147478

SEQ ID NO: 240278 - RNA, 64 nt, Homo Sapiens; identical to SEQ ID NO: 147479

SEQ ID NO: 240279 - RNA, 64 nt, Homo Sapiens; identical to SEQ ID NO: 147480

SEQ ID NO: 240280 - RNA, 64 nt, Homo Sapiens; identical to SEQ ID NO: 147481

SEQ ID NO: 240281 - RNA, 64 nt, Homo Sapiens; identical to SEQ ID NO: 147482

SEQ ID NO: 240282 - RNA, 64 nt, Homo Sapiens; identical to SEQ ID NO: 110487

SEQ ID NO: 240283 - RNA, 64 nt, Homo Sapiens; identical to SEQ ID NO: 110488

SEQ ID NO: 240284 - RNA, 64 nt, Homo Sapiens; identical to SEQ ID NO: 110489

SEQ ID NO: 240285 - RNA, 64 nt, Homo Sapiens; identical to SEQ ID NO: 110490

SEQ ID NO: 240286 - RNA, 64 nt, Homo Sapiens; identical to SEQ ID NO: 110491

SEQ ID NO: 240287 - RNA, 64 nt, Homo Sapiens; identical to SEQ ID NO: 110492

SEQ ID NO: 240288 - RNA, 64 nt, Homo Sapiens; identical to SEQ ID NO: 110493

SEQ ID NO: 240289 - RNA, 64 nt, Homo Sapiens; identical to SEQ ID NO: 110494

SEQ ID NO: 240290 - RNA, 64 nt, Homo Sapiens; identical to SEQ ID NO: 110495

SEQ ID NO: 240291 - RNA, 64 nt, Homo Sapiens; identical to SEQ ID NO: 110496

SEQ ID NO: 240292 - RNA, 64 nt, Homo Sapiens; identical to SEQ ID NO: 110497

SEQ ID NO: 240293 - RNA, 64 nt, Homo Sapiens; identical to SEQ ID NO: 110498

SEQ ID NO: 240294 - RNA, 64 nt, Homo Sapiens; identical to SEQ ID NO: 110499

SEQ ID NO: 240295 - RNA, 64 nt, Homo Sapiens; identical to SEQ ID NO: 110500

SEQ ID NO: 240296 - RNA, 64 nt, Homo Sapiens; identical to SEQ ID NO: 110501

SEQ ID NO: 240297 - RNA, 64 nt, Homo Sapiens; identical to SEQ ID NO: 110502

SEQ ID NO: 240298 - RNA, 56 nt, Homo Sapiens; identical to SEQ ID NO: 110503

SEQ ID NO: 240299 - RNA, 64 nt, Homo Sapiens; identical to SEQ ID NO: 110504

SEQ ID NO: 240300 - RNA, 64 nt, Homo Sapiens; identical to SEQ ID NO: 110505

SEQ ID NO: 240301 - RNA, 64 nt, Homo Sapiens; identical to SEQ ID NO: 110506

SEQ ID NO: 240302 - RNA, 64 nt, Homo Sapiens; identical to SEQ ID NO: 110507

SEQ ID NO: 240303 - RNA, 64 nt, Homo Sapiens; identical to SEQ ID NO: 110508

SEQ ID NO: 240304 - RNA, 64 nt, Homo Sapiens; identical to SEQ ID NO: 110509

SEQ ID NO: 240305 - RNA, 64 nt, Homo Sapiens; identical to SEQ ID NO: 110510

SEQ ID NO: 240306 - RNA, 64 nt, Homo Sapiens; identical to SEQ ID NO: 110511

SEQ ID NO: 240307 - RNA, 64 nt, Homo Sapiens; identical to SEQ ID NO: 110512

SEQ ID NO: 240308 - RNA, 64 nt, Homo Sapiens; identical to SEQ ID NO: 110513

SEQ ID NO: 240309 - RNA, 64 nt, Homo Sapiens; identical to SEQ ID NO: 110514

SEQ ID NO: 240310 - RNA, 64 nt, Homo Sapiens; identical to SEQ ID NO: 110515

SEQ ID NO: 240311 - RNA, 64 nt, Homo Sapiens; identical to SEQ ID NO: 110516

SEQ ID NO: 240312 - RNA, 64 nt, Homo Sapiens; identical to SEQ ID NO: 110517

SEQ ID NO: 240313 - RNA, 64 nt, Homo Sapiens; identical to SEQ ID NO: 110518

SEQ ID NO: 240314 - RNA, 64 nt, Homo Sapiens; identical to SEQ ID NO: 110519

SEQ ID NO: 240315 - RNA, 64 nt, Homo Sapiens; identical to SEQ ID NO: 110520

SEQ ID NO: 240316 - RNA, 64 nt, Homo Sapiens; identical to SEQ ID NO: 110521

SEQ ID NO: 240317 - RNA, 64 nt, Homo Sapiens; identical to SEQ ID NO: 110522

SEQ ID NO: 240318 - RNA, 64 nt, Homo Sapiens; identical to SEQ ID NO: 110523

SEQ ID NO: 240319 - RNA, 64 nt, Homo Sapiens
cgaaggguguguggccaggcaacccugaggaguggagucauacgucucuguacacagccccgug

SEQ ID NO: 240320 - RNA, 64 nt, Homo Sapiens
cgaagggcguguggccaucgaacccugaggaguggagucauacaucucuguacacagccccgug

SEQ ID NO: 240321 - RNA, 64 nt, Homo Sapiens
cgaaggccauauggccaucgaacccugaggaguggagucauacgcagagucuccaagccccacg

SEQ ID NO: 240322 - RNA, 64 nt, Homo Sapiens
gagcauuuuuaacauacuccauagucuuuuccugugguguuaggucuuuauuuuuauuuuuuuc

SEQ ID NO: 240323 - RNA, 64 nt, Homo Sapiens
aacuuuauaaaaagcaaugcaguaccccauagacugguguuaaauguugucuacagugcaaaau

SEQ ID NO: 240324 - RNA, 64 nt, Homo Sapiens
uuucaugaagcugauccuuuugugugugugcuccugguguuaggagagaaaaaagcucuaugaa

SEQ ID NO: 240325 - RNA, 64 nt, Homo Sapiens
cagauucccuugcaaucgauuucucuuuagucguugguguuagaaguaccagcacaauuugagc

SEQ ID NO: 240326 - RNA, 64 nt, Homo Sapiens
caacugauccgugugugaggcugggaaacaacccugguguuacacuacugcaggaauccagauu

SEQ ID NO: 240327 - RNA, 64 nt, Homo Sapiens
cgauggaucccaaagucagacuguggaaggcccuugguguuacacuacugcaggaauccagauc

SEQ ID NO: 240328 - RNA, 64 nt, Homo Sapiens
caacggaucccaaagucaggguucggcaggcccuugguguuauacuacugcaggaauccggauu

SEQ ID NO: 240329 - RNA, 64 nt, Homo Sapiens
uuaaguuaccugggauguuugguuuucucaaaacugguguuaaugugguaaugauaauaaaaau

SEQ ID NO: 240330 - RNA, 64 nt, Homo Sapiens
guuguaaucagguuaaaccccagaucagugauacugguguuaguauacaaauuuuuguaaauau

SEQ ID NO: 240331 - RNA, 64 nt, Homo Sapiens
uuuccuaaaccaaguuaaaauuacauguauauuuugguguuaagguugauuuuuaagauacuuc

SEQ ID NO: 240332 - RNA, 64 nt, Homo Sapiens
ugacaauaucuguuggauauuugauauaauuuaaugguguuauaaaaccuuuaagaggauucau

SEQ ID NO: 240333 - RNA, 64 nt, Homo Sapiens
aggguuaagccuguaauuauuauguagaaugucuugguguuaucaaagcucaggaauccuacgc

SEQ ID NO: 240334 - RNA, 64 nt, Homo Sapiens
guuagaccuuauguuagaguaugugguuagacguugguguuaagcaaguccuugaacccaggcc

SEQ ID NO: 240335 - RNA, 64 nt, Homo Sapiens; identical to SEQ ID NO: 147132

SEQ ID NO: 240336 - RNA, 64 nt, Homo Sapiens; identical to SEQ ID NO: 147133

SEQ ID NO: 240337 - RNA, 64 nt, Homo Sapiens; identical to SEQ ID NO: 147134

SEQ ID NO: 240338 - RNA, 64 nt, Homo Sapiens; identical to SEQ ID NO: 147135

SEQ ID NO: 240339 - RNA, 64 nt, Homo Sapiens; identical to SEQ ID NO: 147136

SEQ ID NO: 240340 - RNA, 64 nt, Homo Sapiens; identical to SEQ ID NO: 147137

SEQ ID NO: 240341 - RNA, 64 nt, Homo Sapiens; identical to SEQ ID NO: 147138

SEQ ID NO: 240342 - RNA, 64 nt, Homo Sapiens; identical to SEQ ID NO: 147139

SEQ ID NO: 240343 - RNA, 64 nt, Homo Sapiens; identical to SEQ ID NO: 147140

SEQ ID NO: 240344 - RNA, 64 nt, Homo Sapiens; identical to SEQ ID NO: 147141

SEQ ID NO: 240345 - RNA, 64 nt, Homo Sapiens; identical to SEQ ID NO: 147142

SEQ ID NO: 240346 - RNA, 64 nt, Homo Sapiens; identical to SEQ ID NO: 147143

SEQ ID NO: 240347 - RNA, 64 nt, Homo Sapiens; identical to SEQ ID NO: 147144

SEQ ID NO: 240348 - RNA, 64 nt, Homo Sapiens; identical to SEQ ID NO: 147145

SEQ ID NO: 240349 - RNA, 64 nt, Homo Sapiens; identical to SEQ ID NO: 147146

SEQ ID NO: 240350 - RNA, 64 nt, Homo Sapiens; identical to SEQ ID NO: 147147

SEQ ID NO: 240351 - RNA, 64 nt, Homo Sapiens; identical to SEQ ID NO: 147148

SEQ ID NO: 240352 - RNA, 64 nt, Homo Sapiens; identical to SEQ ID NO: 147149

SEQ ID NO: 240353 - RNA, 64 nt, Homo Sapiens; identical to SEQ ID NO: 147150

SEQ ID NO: 240354 - RNA, 64 nt, Homo Sapiens; identical to SEQ ID NO: 147151

SEQ ID NO: 240355 - RNA, 64 nt, Homo Sapiens; identical to SEQ ID NO: 147152

SEQ ID NO: 240356 - RNA, 64 nt, Homo Sapiens; identical to SEQ ID NO: 147153

SEQ ID NO: 240357 - RNA, 64 nt, Homo Sapiens; identical to SEQ ID NO: 147154

SEQ ID NO: 240358 - RNA, 64 nt, Homo Sapiens; identical to SEQ ID NO: 147155

SEQ ID NO: 240359 - RNA, 64 nt, Homo Sapiens; identical to SEQ ID NO: 147156

SEQ ID NO: 240360 - RNA, 64 nt, Homo Sapiens; identical to SEQ ID NO: 147157

SEQ ID NO: 240361 - RNA, 64 nt, Homo Sapiens; identical to SEQ ID NO: 147158

SEQ ID NO: 240362 - RNA, 64 nt, Homo Sapiens; identical to SEQ ID NO: 147159

SEQ ID NO: 240363 - RNA, 64 nt, Homo Sapiens; identical to SEQ ID NO: 147160

SEQ ID NO: 240364 - RNA, 64 nt, Homo Sapiens; identical to SEQ ID NO: 147161

SEQ ID NO: 240365 - RNA, 64 nt, Homo Sapiens; identical to SEQ ID NO: 147162

SEQ ID NO: 240366 - RNA, 64 nt, Homo Sapiens; identical to SEQ ID NO: 147163

SEQ ID NO: 240367 - RNA, 64 nt, Homo Sapiens; identical to SEQ ID NO: 147164

SEQ ID NO: 240368 - RNA, 64 nt, Homo Sapiens; identical to SEQ ID NO: 147165

SEQ ID NO: 240369 - RNA, 64 nt, Homo Sapiens; identical to SEQ ID NO: 147166

SEQ ID NO: 240370 - RNA, 64 nt, Homo Sapiens; identical to SEQ ID NO: 147167

SEQ ID NO: 240371 - RNA, 64 nt, Homo Sapiens; identical to SEQ ID NO: 68831

SEQ ID NO: 240372 - RNA, 64 nt, Homo Sapiens; identical to SEQ ID NO: 68832

SEQ ID NO: 240373 - RNA, 64 nt, Homo Sapiens; identical to SEQ ID NO: 68833

SEQ ID NO: 240374 - RNA, 64 nt, Homo Sapiens; identical to SEQ ID NO: 68834

SEQ ID NO: 240375 - RNA, 64 nt, Homo Sapiens; identical to SEQ ID NO: 68835

SEQ ID NO: 240376 - RNA, 64 nt, Homo Sapiens; identical to SEQ ID NO: 68836

SEQ ID NO: 240377 - RNA, 64 nt, Homo Sapiens; identical to SEQ ID NO: 68837

SEQ ID NO: 240378 - RNA, 64 nt, Homo Sapiens; identical to SEQ ID NO: 68838

SEQ ID NO: 240379 - RNA, 64 nt, Homo Sapiens; identical to SEQ ID NO: 68839

SEQ ID NO: 240380 - RNA, 64 nt, Homo Sapiens; identical to SEQ ID NO: 68840

SEQ ID NO: 240381 - RNA, 64 nt, Homo Sapiens; identical to SEQ ID NO: 68841

SEQ ID NO: 240382 - RNA, 64 nt, Homo Sapiens; identical to SEQ ID NO: 68842

SEQ ID NO: 240383 - RNA, 64 nt, Homo Sapiens; identical to SEQ ID NO: 68843

SEQ ID NO: 240384 - RNA, 64 nt, Homo Sapiens; identical to SEQ ID NO: 68844

SEQ ID NO: 240385 - RNA, 64 nt, Homo Sapiens; identical to SEQ ID NO: 68845

SEQ ID NO: 240386 - RNA, 64 nt, Homo Sapiens; identical to SEQ ID NO: 68846

SEQ ID NO: 240387 - RNA, 64 nt, Homo Sapiens; identical to SEQ ID NO: 68847

SEQ ID NO: 240388 - RNA, 64 nt, Homo Sapiens; identical to SEQ ID NO: 68848

SEQ ID NO: 240389 - RNA, 64 nt, Homo Sapiens; identical to SEQ ID NO: 68849

SEQ ID NO: 240390 - RNA, 64 nt, Homo Sapiens; identical to SEQ ID NO: 68850

SEQ ID NO: 240391 - RNA, 64 nt, Homo Sapiens; identical to SEQ ID NO: 68851

SEQ ID NO: 240392 - RNA, 64 nt, Homo Sapiens; identical to SEQ ID NO: 68852

SEQ ID NO: 240393 - RNA, 64 nt, Homo Sapiens; identical to SEQ ID NO: 68853

SEQ ID NO: 240394 - RNA, 64 nt, Homo Sapiens; identical to SEQ ID NO: 68854

SEQ ID NO: 240395 - RNA, 64 nt, Homo Sapiens; identical to SEQ ID NO: 68855

SEQ ID NO: 240396 - RNA, 64 nt, Homo Sapiens; identical to SEQ ID NO: 68856

SEQ ID NO: 240397 - RNA, 64 nt, Homo Sapiens; identical to SEQ ID NO: 68857

SEQ ID NO: 240398 - RNA, 64 nt, Homo Sapiens; identical to SEQ ID NO: 68858

SEQ ID NO: 240399 - RNA, 64 nt, Homo Sapiens; identical to SEQ ID NO: 68859

SEQ ID NO: 240400 - RNA, 64 nt, Homo Sapiens; identical to SEQ ID NO: 68860

SEQ ID NO: 240401 - RNA, 64 nt, Homo Sapiens; identical to SEQ ID NO: 68861

SEQ ID NO: 240402 - RNA, 64 nt, Homo Sapiens; identical to SEQ ID NO: 68862

SEQ ID NO: 240403 - RNA, 64 nt, Homo Sapiens; identical to SEQ ID NO: 68863

SEQ ID NO: 240404 - RNA, 64 nt, Homo Sapiens; identical to SEQ ID NO: 68864

SEQ ID NO: 240405 - RNA, 64 nt, Homo Sapiens; identical to SEQ ID NO: 68865

SEQ ID NO: 240406 - RNA, 64 nt, Homo Sapiens; identical to SEQ ID NO: 68866

SEQ ID NO: 240407 - RNA, 64 nt, Homo Sapiens; identical to SEQ ID NO: 68867

SEQ ID NO: 240408 - RNA, 64 nt, Homo Sapiens; identical to SEQ ID NO: 68868

SEQ ID NO: 240409 - RNA, 64 nt, Homo Sapiens; identical to SEQ ID NO: 68869

SEQ ID NO: 240410 - RNA, 64 nt, Homo Sapiens; identical to SEQ ID NO: 68870

SEQ ID NO: 240411 - RNA, 64 nt, Homo Sapiens; identical to SEQ ID NO: 68871

SEQ ID NO: 240412 - RNA, 64 nt, Homo Sapiens; identical to SEQ ID NO: 68872

SEQ ID NO: 240413 - RNA, 64 nt, Homo Sapiens; identical to SEQ ID NO: 68873

SEQ ID NO: 240414 - RNA, 64 nt, Homo Sapiens; identical to SEQ ID NO: 68874

SEQ ID NO: 240415 - RNA, 64 nt, Homo Sapiens; identical to SEQ ID NO: 68875

SEQ ID NO: 240416 - RNA, 64 nt, Homo Sapiens; identical to SEQ ID NO: 68876

SEQ ID NO: 240417 - RNA, 64 nt, Homo Sapiens; identical to SEQ ID NO: 68877

SEQ ID NO: 240418 - RNA, 64 nt, Homo Sapiens; identical to SEQ ID NO: 68877

SEQ ID NO: 240419 - RNA, 64 nt, Homo Sapiens; identical to SEQ ID NO: 68879

SEQ ID NO: 240420 - RNA, 64 nt, Homo Sapiens; identical to SEQ ID NO: 68880

SEQ ID NO: 240421 - RNA, 64 nt, Homo Sapiens; identical to SEQ ID NO: 68881

SEQ ID NO: 240422 - RNA, 64 nt, Homo Sapiens; identical to SEQ ID NO: 68882

SEQ ID NO: 240423 - RNA, 64 nt, Homo Sapiens; identical to SEQ ID NO: 68883

SEQ ID NO: 240424 - RNA, 64 nt, Homo Sapiens; identical to SEQ ID NO: 68884

SEQ ID NO: 240425 - RNA, 64 nt, Homo Sapiens; identical to SEQ ID NO: 68885

SEQ ID NO: 240426 - RNA, 64 nt, Homo Sapiens; identical to SEQ ID NO: 68886

SEQ ID NO: 240427 - RNA, 64 nt, Homo Sapiens; identical to SEQ ID NO: 68887

SEQ ID NO: 240428 - RNA, 64 nt, Homo Sapiens; identical to SEQ ID NO: 68888

SEQ ID NO: 240429 - RNA, 64 nt, Homo Sapiens; identical to SEQ ID NO: 68889

SEQ ID NO: 240430 - RNA, 64 nt, Homo Sapiens; identical to SEQ ID NO: 68890

SEQ ID NO: 240431 - RNA, 64 nt, Homo Sapiens; identical to SEQ ID NO: 68891

SEQ ID NO: 240432 - RNA, 64 nt, Homo Sapiens; identical to SEQ ID NO: 68892

SEQ ID NO: 240433 - RNA, 64 nt, Homo Sapiens; identical to SEQ ID NO: 68893

SEQ ID NO: 240434 - RNA, 64 nt, Homo Sapiens; identical to SEQ ID NO: 68894

SEQ ID NO: 240435 - RNA, 64 nt, Homo Sapiens; identical to SEQ ID NO: 68895

SEQ ID NO: 240436 - RNA, 64 nt, Homo Sapiens; identical to SEQ ID NO: 68896

SEQ ID NO: 240437 - RNA, 64 nt, Homo Sapiens; identical to SEQ ID NO: 68897

SEQ ID NO: 240438 - RNA, 64 nt, Homo Sapiens; identical to SEQ ID NO: 68898

SEQ ID NO: 240439 - RNA, 64 nt, Homo Sapiens; identical to SEQ ID NO: 68899

SEQ ID NO: 240440 - RNA, 64 nt, Homo Sapiens; identical to SEQ ID NO: 68900

SEQ ID NO: 240441 - RNA, 64 nt, Homo Sapiens; identical to SEQ ID NO: 68901

SEQ ID NO: 240442 - RNA, 64 nt, Homo Sapiens; identical to SEQ ID NO: 68902

SEQ ID NO: 240443 - RNA, 64 nt, Homo Sapiens; identical to SEQ ID NO: 68903

SEQ ID NO: 240444 - RNA, 64 nt, Homo Sapiens; identical to SEQ ID NO: 68904

SEQ ID NO: 240445 - RNA, 64 nt, Homo Sapiens; identical to SEQ ID NO: 68905

SEQ ID NO: 240446 - RNA, 64 nt, Homo Sapiens; identical to SEQ ID NO: 68906

SEQ ID NO: 240447 - RNA, 64 nt, Homo Sapiens; identical to SEQ ID NO: 68907

SEQ ID NO: 240448 - RNA, 64 nt, Homo Sapiens; identical to SEQ ID NO: 68908

SEQ ID NO: 240449 - RNA, 64 nt, Homo Sapiens; identical to SEQ ID NO: 68909

SEQ ID NO: 240450 - RNA, 64 nt, Homo Sapiens; identical to SEQ ID NO: 68910

SEQ ID NO: 240451 - RNA, 64 nt, Homo Sapiens; identical to SEQ ID NO: 68911

SEQ ID NO: 240452 - RNA, 64 nt, Homo Sapiens; identical to SEQ ID NO: 68912

SEQ ID NO: 240453 - RNA, 64 nt, Homo Sapiens; identical to SEQ ID NO: 68913

SEQ ID NO: 240454 - RNA, 64 nt, Homo Sapiens; identical to SEQ ID NO: 68914

SEQ ID NO: 240455 - RNA, 64 nt, Homo Sapiens; identical to SEQ ID NO: 68915

SEQ ID NO: 240456 - RNA, 64 nt, Homo Sapiens; identical to SEQ ID NO: 68916

SEQ ID NO: 240457 - RNA, 64 nt, Homo Sapiens; identical to SEQ ID NO: 68917

SEQ ID NO: 240458 - RNA, 64 nt, Homo Sapiens; identical to SEQ ID NO: 68918

SEQ ID NO: 240459 - RNA, 64 nt, Homo Sapiens; identical to SEQ ID NO: 68919

SEQ ID NO: 240460 - RNA, 64 nt, Homo Sapiens; identical to SEQ ID NO: 68920

SEQ ID NO: 240461 - RNA, 64 nt, Homo Sapiens; identical to SEQ ID NO: 68921

SEQ ID NO: 240462 - RNA, 64 nt, Homo Sapiens; identical to SEQ ID NO: 68922

SEQ ID NO: 240463 - RNA, 64 nt, Homo Sapiens; identical to SEQ ID NO: 68923

SEQ ID NO: 240464 - RNA, 64 nt, Homo Sapiens; identical to SEQ ID NO: 68924

SEQ ID NO: 240465 - RNA, 64 nt, Homo Sapiens; identical to SEQ ID NO: 68925

SEQ ID NO: 240466 - RNA, 64 nt, Homo Sapiens; identical to SEQ ID NO: 68926

SEQ ID NO: 240467 - RNA, 64 nt, Homo Sapiens; identical to SEQ ID NO: 68927

SEQ ID NO: 240468 - RNA, 64 nt, Homo Sapiens; identical to SEQ ID NO: 68928

SEQ ID NO: 240469 - RNA, 64 nt, Homo Sapiens; identical to SEQ ID NO: 68929

SEQ ID NO: 240470 - RNA, 64 nt, Homo Sapiens; identical to SEQ ID NO: 68930

SEQ ID NO: 240471 - RNA, 64 nt, Homo Sapiens; identical to SEQ ID NO: 68931

SEQ ID NO: 240472 - RNA, 64 nt, Homo Sapiens; identical to SEQ ID NO: 68932

SEQ ID NO: 240473 - RNA, 64 nt, Homo Sapiens; identical to SEQ ID NO: 68933

SEQ ID NO: 240474 - RNA, 64 nt, Homo Sapiens; identical to SEQ ID NO: 68934

SEQ ID NO: 240475 - RNA, 64 nt, Homo Sapiens; identical to SEQ ID NO: 68935

SEQ ID NO: 240476 - RNA, 64 nt, Homo Sapiens; identical to SEQ ID NO: 44795

SEQ ID NO: 240477 - RNA, 64 nt, Homo Sapiens; identical to SEQ ID NO: 44796

SEQ ID NO: 240478 - RNA, 64 nt, Homo Sapiens; identical to SEQ ID NO: 44797

SEQ ID NO: 240479 - RNA, 64 nt, Homo Sapiens; identical to SEQ ID NO: 44798

SEQ ID NO: 240480 - RNA, 64 nt, Homo Sapiens; identical to SEQ ID NO: 44799

SEQ ID NO: 240481 - RNA, 64 nt, Homo Sapiens; identical to SEQ ID NO: 44800

SEQ ID NO: 240482 - RNA, 64 nt, Homo Sapiens; identical to SEQ ID NO: 44801

SEQ ID NO: 240483 - RNA, 64 nt, Homo Sapiens; identical to SEQ ID NO: 44802

SEQ ID NO: 240484 - RNA, 64 nt, Homo Sapiens; identical to SEQ ID NO: 44803

SEQ ID NO: 240485 - RNA, 64 nt, Homo Sapiens; identical to SEQ ID NO: 44804

SEQ ID NO: 240486 - RNA, 64 nt, Homo Sapiens; identical to SEQ ID NO: 44805

SEQ ID NO: 240487 - RNA, 64 nt, Homo Sapiens; identical to SEQ ID NO: 44806

SEQ ID NO: 240488 - RNA, 64 nt, Homo Sapiens; identical to SEQ ID NO: 44807

SEQ ID NO: 240489 - RNA, 64 nt, Homo Sapiens; identical to SEQ ID NO: 44808

SEQ ID NO: 240490 - RNA, 64 nt, Homo Sapiens; identical to SEQ ID NO: 44809

SEQ ID NO: 240491 - RNA, 64 nt, Homo Sapiens; identical to SEQ ID NO: 44810

SEQ ID NO: 240492 - RNA, 64 nt, Homo Sapiens; identical to SEQ ID NO: 44811

SEQ ID NO: 240493 - RNA, 64 nt, Homo Sapiens; identical to SEQ ID NO: 44812

SEQ ID NO: 240494 - RNA, 64 nt, Homo Sapiens; identical to SEQ ID NO: 44813

SEQ ID NO: 240495 - RNA, 64 nt, Homo Sapiens; identical to SEQ ID NO: 44814

SEQ ID NO: 240496 - RNA, 64 nt, Homo Sapiens; identical to SEQ ID NO: 44815

SEQ ID NO: 240497 - RNA, 64 nt, Homo Sapiens; identical to SEQ ID NO: 44816

SEQ ID NO: 240498 - RNA, 64 nt, Homo Sapiens; identical to SEQ ID NO: 44817

SEQ ID NO: 240499 - RNA, 64 nt, Homo Sapiens; identical to SEQ ID NO: 44818

SEQ ID NO: 240500 - RNA, 64 nt, Homo Sapiens; identical to SEQ ID NO: 44819

SEQ ID NO: 240501 - RNA, 64 nt, Homo Sapiens; identical to SEQ ID NO: 44820

SEQ ID NO: 240502 - RNA, 64 nt, Homo Sapiens; identical to SEQ ID NO: 44821

SEQ ID NO: 240503 - RNA, 64 nt, Homo Sapiens; identical to SEQ ID NO: 44822

SEQ ID NO: 240504 - RNA, 64 nt, Homo Sapiens; identical to SEQ ID NO: 44823

SEQ ID NO: 240505 - RNA, 64 nt, Homo Sapiens; identical to SEQ ID NO: 44824

SEQ ID NO: 240506 - RNA, 64 nt, Homo Sapiens; identical to SEQ ID NO: 44825

SEQ ID NO: 240507 - RNA, 64 nt, Homo Sapiens; identical to SEQ ID NO: 44826

SEQ ID NO: 240508 - RNA, 64 nt, Homo Sapiens; identical to SEQ ID NO: 44827

SEQ ID NO: 240509 - RNA, 64 nt, Homo Sapiens; identical to SEQ ID NO: 44828

SEQ ID NO: 240510 - RNA, 64 nt, Homo Sapiens; identical to SEQ ID NO: 44829

SEQ ID NO: 240511 - RNA, 64 nt, Homo Sapiens; identical to SEQ ID NO: 44830

SEQ ID NO: 240512 - RNA, 64 nt, Homo Sapiens; identical to SEQ ID NO: 44831

SEQ ID NO: 240513 - RNA, 64 nt, Homo Sapiens; identical to SEQ ID NO: 44832

SEQ ID NO: 240514 - RNA, 64 nt, Homo Sapiens; identical to SEQ ID NO: 44833

SEQ ID NO: 240515 - RNA, 64 nt, Homo Sapiens; identical to SEQ ID NO: 44834

SEQ ID NO: 240516 - RNA, 64 nt, Homo Sapiens; identical to SEQ ID NO: 44835

SEQ ID NO: 240517 - RNA, 64 nt, Homo Sapiens; identical to SEQ ID NO: 44836

SEQ ID NO: 240518 - RNA, 64 nt, Homo Sapiens; identical to SEQ ID NO: 44837

SEQ ID NO: 240519 - RNA, 64 nt, Homo Sapiens; identical to SEQ ID NO: 44838

SEQ ID NO: 240520 - RNA, 64 nt, Homo Sapiens; identical to SEQ ID NO: 44839

SEQ ID NO: 240521 - RNA, 64 nt, Homo Sapiens; identical to SEQ ID NO: 44840

SEQ ID NO: 240522 - RNA, 59 nt, Homo Sapiens; identical to SEQ ID NO: 44841

SEQ ID NO: 240523 - RNA, 64 nt, Homo Sapiens; identical to SEQ ID NO: 44842

SEQ ID NO: 240524 - RNA, 64 nt, Homo Sapiens; identical to SEQ ID NO: 44843

SEQ ID NO: 240525 - RNA, 64 nt, Homo Sapiens; identical to SEQ ID NO: 44844

SEQ ID NO: 240526 - RNA, 64 nt, Homo Sapiens; identical to SEQ ID NO: 44845

SEQ ID NO: 240527 - RNA, 64 nt, Homo Sapiens; identical to SEQ ID NO: 44846

SEQ ID NO: 240528 - RNA, 64 nt, Homo Sapiens; identical to SEQ ID NO: 44847

SEQ ID NO: 240529 - RNA, 64 nt, Homo Sapiens; identical to SEQ ID NO: 44848

SEQ ID NO: 240530 - RNA, 64 nt, Homo Sapiens; identical to SEQ ID NO: 44849

SEQ ID NO: 240531 - RNA, 64 nt, Homo Sapiens; identical to SEQ ID NO: 44850

SEQ ID NO: 240532 - RNA, 64 nt, Homo Sapiens; identical to SEQ ID NO: 44851

SEQ ID NO: 240533 - RNA, 64 nt, Homo Sapiens; identical to SEQ ID NO: 44852

SEQ ID NO: 240534 - RNA, 64 nt, Homo Sapiens; identical to SEQ ID NO: 44853

SEQ ID NO: 240535 - RNA, 64 nt, Homo Sapiens; identical to SEQ ID NO: 44854

SEQ ID NO: 240536 - RNA, 64 nt, Homo Sapiens; identical to SEQ ID NO: 44855

SEQ ID NO: 240537 - RNA, 64 nt, Homo Sapiens; identical to SEQ ID NO: 44856

SEQ ID NO: 240538 - RNA, 64 nt, Homo Sapiens; identical to SEQ ID NO: 44857

SEQ ID NO: 240539 - RNA, 64 nt, Homo Sapiens; identical to SEQ ID NO: 44858

SEQ ID NO: 240540 - RNA, 64 nt, Homo Sapiens; identical to SEQ ID NO: 44859

SEQ ID NO: 240541 - RNA, 64 nt, Homo Sapiens; identical to SEQ ID NO: 44860

SEQ ID NO: 240542 - RNA, 64 nt, Homo Sapiens; identical to SEQ ID NO: 44861

SEQ ID NO: 240543 - RNA, 64 nt, Homo Sapiens; identical to SEQ ID NO: 44862

SEQ ID NO: 240544 - RNA, 64 nt, Homo Sapiens; identical to SEQ ID NO: 44863

SEQ ID NO: 240545 - RNA, 64 nt, Homo Sapiens; identical to SEQ ID NO: 44864

SEQ ID NO: 240546 - RNA, 64 nt, Homo Sapiens; identical to SEQ ID NO: 236262

SEQ ID NO: 240547 - RNA, 64 nt, Homo Sapiens; identical to SEQ ID NO: 236263

SEQ ID NO: 240548 - RNA, 64 nt, Homo Sapiens; identical to SEQ ID NO: 236264

SEQ ID NO: 240549 - RNA, 64 nt, Homo Sapiens; identical to SEQ ID NO: 236265

SEQ ID NO: 240550 - RNA, 64 nt, Homo Sapiens; identical to SEQ ID NO: 236266

SEQ ID NO: 240551 - RNA, 64 nt, Homo Sapiens; identical to SEQ ID NO: 236267

SEQ ID NO: 240552 - RNA, 64 nt, Homo Sapiens; identical to SEQ ID NO: 236268

SEQ ID NO: 240553 - RNA, 64 nt, Homo Sapiens; identical to SEQ ID NO: 236269

SEQ ID NO: 240554 - RNA, 65 nt, Homo Sapiens
ucucggccccgccaccugcccagcgugcccuggcucuccagaaccuucuaucccacagucaggcc

SEQ ID NO: 240555 - RNA, 65 nt, Homo Sapiens
ugagaaagucuuaagcaaaauacucccaggucucacuccagaacauaaaaauggugugugaucaa

SEQ ID NO: 240556 - RNA, 65 nt, Homo Sapiens
gaaaacccaguguccaucuuuccacccucccugaucuccagaaccuucgacugacccccuugucu

SEQ ID NO: 240557 - RNA, 65 nt, Homo Sapiens
aggaccugcacgggacuuguggaugggccuggacucuccagaaacuacuugggcagagcaaagga

SEQ ID NO: 240558 - RNA, 65 nt, Homo Sapiens
gacaacagaccaggaggggcccccaccugauggaccuccagaaaaacggaucacagccacuaugg

SEQ ID NO: 240559 - RNA, 65 nt, Homo Sapiens
gauggggagggagugggccuggaucugggaccucccuccagaauuuccuccagaugggggcagug

SEQ ID NO: 240560 - RNA, 65 nt, Homo Sapiens
gccuuccuggugcccaccaggcacuacggcuuccucuccagaauguggcuuugccugagcacaga

SEQ ID NO: 240561 - RNA, 65 nt, Homo Sapiens
auauugaauaacuagaacacaagccacuguuucagcuccagaaaaaagaaagggcuuuaacguuu

SEQ ID NO: 240562 - RNA, 65 nt, Homo Sapiens
ucacagggauuccuccuuucccccccaaauauuaacuccagaaacuaggccugacuggggacacc

SEQ ID NO: 240563 - RNA, 65 nt, Homo Sapiens
acagcacacaauuucaagccauuuucagaucagaacuccagaaguguugacaagaugccuauucg

SEQ ID NO: 240564 - RNA, 65 nt, Homo Sapiens
gagaggauccuucaguucuggccauuccagggacccuccagaaacacaguguuucaagagacccu

SEQ ID NO: 240565 - RNA, 65 nt, Homo Sapiens
ugggguccccaucaucccagcugcucccaaauaaacuccagaagaggaaucugugggccugugag

SEQ ID NO: 240566 - RNA, 65 nt, Homo Sapiens
caaaaucaccuauucacugcuuaugcagucggaagcuccagaagaacaaagagcccaauuaccag

SEQ ID NO: 240567 - RNA, 65 nt, Homo Sapiens
cgacucugucguugccuugaucuugaacuuccagccuccagaacuaugagaaauaaaauucuguu

SEQ ID NO: 240568 - RNA, 65 nt, Homo Sapiens
acaguugcaguauuucaaagucccuauccaggucacuccagaaaaggguauugaaacguugaaau

SEQ ID NO: 240569 - RNA, 65 nt, Homo Sapiens
acugcugcauuuaggccaggucuccaauugcuuuccuccagaaaguguguucccgucuagugagg

SEQ ID NO: 240570 - RNA, 65 nt, Homo Sapiens
cacccaaacuccuggccuucugugguuucccuuugcuccagaaacacagaugugucuaaagacuu

SEQ ID NO: 240571 - RNA, 65 nt, Homo Sapiens
gagaaacguacacuaucauugcuaaacuaacaguccuccagaaauuuaauaagauguuuuugauu

SEQ ID NO: 240572 - RNA, 65 nt, Homo Sapiens
guuuaagugaccuccuucaucacauccugcaguaucuccagaagcagcacuaggguuugaguuuc

SEQ ID NO: 240573 - RNA, 65 nt, Homo Sapiens
gcccacguguauuguccgggcucagaaugggaggacuccagaagaugagagaaaccucuuuaucc

SEQ ID NO: 240574 - RNA, 65 nt, Homo Sapiens
uuuuagccuuaccaccuuuuaaaaaauuuguuauucuccagaaacaguaaauaggugaguagggg

SEQ ID NO: 240575 - RNA, 65 nt, Homo Sapiens
aacucagucagugauuuuuugaugcuucucuuauccuccagaauagagaccuaaggacacgugga

SEQ ID NO: 240576 - RNA, 65 nt, Homo Sapiens
accccuguccccagucagagauaacauccaacuaacuccagaagcggaagaggauauauuuaaca

SEQ ID NO: 240577 - RNA, 65 nt, Homo Sapiens
cucuggccuugguggccccagauucuacaccaucucuccagaacuagggauggagcgggucuccu

SEQ ID NO: 240578 - RNA, 65 nt, Homo Sapiens
gccaugccagcugggcucgucacuggccccucgcacuccagaaaagucuccccccggggagagga

SEQ ID NO: 240579 - RNA, 65 nt, Homo Sapiens
ugcuguugccauagccccaugaaaagacccugagacuccagaauccccuguaacuuaucuagaaa

SEQ ID NO: 240580 - RNA, 65 nt, Homo Sapiens
uacucccucaguaaagcauuuucccucacagguuucuccagaaagggccuauccaguuuuccugg

SEQ ID NO: 240581 - RNA, 65 nt, Homo Sapiens
caggugcuggcgcccguucugccguguccugacaccuccagaacggagcuuuugccacugacucg

SEQ ID NO: 240582 - RNA, 65 nt, Homo Sapiens
gugcaggaugugcauuagcaaaguuuauuauaauucuccagaaauggccugcuucacuugcagau

SEQ ID NO: 240583 - RNA, 65 nt, Homo Sapiens
auauggcugggccaacucugcaggggauucagagucuccagaaagcuguugcccugagagugucc

SEQ ID NO: 240584 - RNA, 65 nt, Homo Sapiens
acccuuccucaucugugccuaacucccuccucacacuccagaauucugaacagugcucugccucu

SEQ ID NO: 240585 - RNA, 65 nt, Homo Sapiens
ugcugccuuuuuaaguuuugaaggacuggccguggcuccagaaugucaggggaagcugcuagggg

SEQ ID NO: 240586 - RNA, 65 nt, Homo Sapiens
accucaacaaugucaguggccuuauuaacucccaucuccagaagcggcgcacuuuccugaagccu

SEQ ID NO: 240587 - RNA, 65 nt, Homo Sapiens
cagugacucuugaacauggaugugcucccucugcccuccagaacuuguuggaaucagcaggccuc

SEQ ID NO: 240588 - RNA, 65 nt, Homo Sapiens
cacccucuccccugcagucucuccccacaccuggacuccagaauugccuccaugagucaagcccc

SEQ ID NO: 240589 - RNA, 65 nt, Homo Sapiens
cucccacccuggggccaacugaaggaacaugaucccuccagaagugaggacgggggguggggaag

SEQ ID NO: 240590 - RNA, 65 nt, Homo Sapiens
acugggaucacaggugucaguucuccugccuuugccuccagaagcgaaguccuggcuucaggcaa

SEQ ID NO: 240591 - RNA, 65 nt, Homo Sapiens
agcacagcucauggaggguguuccuggacugcucucuccagaaaccugcauuuuccuacaccccu

SEQ ID NO: 240592 - RNA, 65 nt, Homo Sapiens
cccacccugacagcccaacauucaaagagaaaccccuccagaacuugcuuuccuagauccacacu

SEQ ID NO: 240593 - RNA, 65 nt, Homo Sapiens
auccccaaucacccuaaucuuguugaacauuccaacuccagaauguuaccuaacaacaucacuuu

SEQ ID NO: 240594 - RNA, 65 nt, Homo Sapiens
cagacaugauuucaacaugguuacacuuuaacuuucuccagaacuaugucagucuuuguaauuau

SEQ ID NO: 240595 - RNA, 65 nt, Homo Sapiens
ccaucacuguucuuuaaagcaaagaaaggaaagaacuccagaauccuguaucuuuggagaaggag

SEQ ID NO: 240596 - RNA, 65 nt, Homo Sapiens
cucuacaauagaaaaaaaagcaugaauuuuaucuacuccagaaguuguauuuuuuuaagcaacau

SEQ ID NO: 240597 - RNA, 65 nt, Homo Sapiens
gugcaugcagaucagcuguuuccugaaucacuggacuccagaaaugcaauggagagaagaccucu

SEQ ID NO: 240598 - RNA, 65 nt, Homo Sapiens
cagaggugacaaaugugaggccaggacucacugcccuccagaaaaguauuaccaccagacugacu

SEQ ID NO: 240599 - RNA, 65 nt, Homo Sapiens
agcaguugucccccaaauacaucucauucucgccccuccagaagaaagagcugcuggugaacucc

SEQ ID NO: 240600 - RNA, 65 nt, Homo Sapiens
cauaacccuucucuccacaccuuuucuccccacuccuccagaagguccuuuucccuaaucauucc

SEQ ID NO: 240601 - RNA, 65 nt, Homo Sapiens
ugccagagugcacuggggggcaccugccucucuggcuccagaagccucuucucauaguguacacc

SEQ ID NO: 240602 - RNA, 63 nt, Homo Sapiens
auuacccauaggucuuaagaauaaaucuccccacuccagaagccaaguucaagcaguugcuaa

SEQ ID NO: 240603 - RNA, 65 nt, Homo Sapiens
aacuugggagaugauggugcagaagcagagucauucuccagaaggucaaaauagaagaccuugca

SEQ ID NO: 240604 - RNA, 65 nt, Homo Sapiens
guggagggcuguucgcccuuaauuaucucuagaaucuccagaaagaaggaauuguacugugcuac

SEQ ID NO: 240605 - RNA, 55 nt, Homo Sapiens
uauugagcuugcagggaagcaugagcuccagaaccuccagcgagcgacaugguaa

SEQ ID NO: 240606 - RNA, 65 nt, Homo Sapiens
gcauuuuauguaguucuaaagcugaacaccaaaaucuccagaaauguguuaucuucauaugauau

SEQ ID NO: 240607 - RNA, 65 nt, Homo Sapiens
acccucccaggcaucccauaucuguaaauuuuugucuccagaaaauuauguucucaugcccucaa

SEQ ID NO: 240608 - RNA, 65 nt, Homo Sapiens
uaaucaaagaauuuucuguaauuuggcaggauguacuccagaauagucagggaggacugggcacu

SEQ ID NO: 240609 - RNA, 65 nt, Homo Sapiens
gccucuggacucaccuugagugguacccaggcccacuccagaaugcaaaaggaguacccagggcc

SEQ ID NO: 240610 - RNA, 65 nt, Homo Sapiens
guaaccaagugggaaaauaacucagaggguacaagcuccagaacacccccaaccccaucucagag

SEQ ID NO: 240611 - RNA, 65 nt, Homo Sapiens
cuaaaauuuaauuucuuuuucagagaggggcugcucuccagaaagaaagaaguguuugauggugc

SEQ ID NO: 240612 - RNA, 65 nt, Homo Sapiens
ggccauucagcaagacaacagaccggccaggccaccuccagaaaccgaggggcucaggaaaacgg

SEQ ID NO: 240613 - RNA, 65 nt, Homo Sapiens
cacaaagagaagagggcuugaugaucaugaauagacuccagaaucgccaagucuauaauauaauu

SEQ ID NO: 240614 - RNA, 65 nt, Homo Sapiens
gagccuucccuacccugacgccucccagucaucaucuccagaacucccagcggggcucccugagc

SEQ ID NO: 240615 - RNA, 65 nt, Homo Sapiens
gaauauuagauuucugacuugcaaauauguuuguacuccagaagaauuagaggaaaagcagauac

SEQ ID NO: 240616 - RNA, 65 nt, Homo Sapiens
gugcugggauuacaagugugagccaccacaccuggcuccagaaauuuuauuuuauuuuuuugagg

SEQ ID NO: 240617 - RNA, 65 nt, Homo Sapiens
acacuauguguguuguuuccauagcucuucacuuccuccagaagccuccuuacauuaaaaagccu

SEQ ID NO: 240618 - RNA, 65 nt, Homo Sapiens
auuguaguaauuucuauuugcacugugccuuucaacuccagaaacauucugaagauguacuugga

SEQ ID NO: 240619 - RNA, 65 nt, Homo Sapiens
ccuuaaucuagauaauaaaagcuuuuuggggcaaccuccagaacugugaaaaauaaauuuguuau

SEQ ID NO: 240620 - RNA, 65 nt, Homo Sapiens
gacgcuaaccgcccuucugcguuccauaaagguggcuccagaaagggcauccucuaccccaagcc

SEQ ID NO: 240621 - RNA, 65 nt, Homo Sapiens
agcaucauacuggaaagcaaacaccuuuccuccagcuccagaauuccuugucucugaaugacucu

SEQ ID NO: 240622 - RNA, 65 nt, Homo Sapiens
cugccuccucuucaacugaccagccuccaugcugccuccagaauggucuuucuaaugugugaauc

SEQ ID NO: 240623 - RNA, 65 nt, Homo Sapiens
ugaaaccugacaaagagacuguaauauuguaguugcuccagaaugucaagggcagcuuacggaga

SEQ ID NO: 240624 - RNA, 65 nt, Homo Sapiens
ggaguguggucagucugccugcugcugugcgguagcuccagaaccaccucguuccugguuuuguu

SEQ ID NO: 240625 - RNA, 65 nt, Homo Sapiens
aguuuguaagaacaaucauaaaaggacuuguuagucuccagaacaucugcuaaaaugcaaguaua

SEQ ID NO: 240626 - RNA, 65 nt, Homo Sapiens
acaugaguuuaugggaaugccuuuucccucuggcacuccagaacaaaccucuauauguugcugaa

SEQ ID NO: 240627 - RNA, 65 nt, Homo Sapiens
guaaauaccauauaugauccucgaaaugauaauaucuccagaauauuguuuucacccaaauuuga

SEQ ID NO: 240628 - RNA, 65 nt, Homo Sapiens
guaccuauuuuugaggaccuugaaaaucuuaaucucuccagaagggauacugcauugguucuucu

SEQ ID NO: 240629 - RNA, 65 nt, Homo Sapiens
uauuugccuauauucucccuacaagaauauuuuugcuccagaaagacauguucuuuucucaaauu

SEQ ID NO: 240630 - RNA, 65 nt, Homo Sapiens
accauuugguuacccucgggauggccauccacugucuccagaaagagaccacuuagagggucucu

SEQ ID NO: 240631 - RNA, 65 nt, Homo Sapiens
uuuuaaaccuucaggaacaccaguuaggaaaauagcuccagaaaauauagauauauuuuauuuuu

SEQ ID NO: 240632 - RNA, 65 nt, Homo Sapiens
cggauauaaaggaagaauauuuccuuuauguguuucuccagaauggugccuguuucucucugugu

SEQ ID NO: 240633 - RNA, 65 nt, Homo Sapiens
acagaagccacaccauuugcaccauccacgccuugcuccagaaggccuggccgccuucucccugg

SEQ ID NO: 240634 - RNA, 65 nt, Homo Sapiens
gaagguagccagugccugagcccccugucagcugccuccagaaggcagucagaucucaggcuugu

SEQ ID NO: 240635 - RNA, 65 nt, Homo Sapiens
ugugccagacuuacagaaaacuugccagagauuggcuccagaauugaccucgccuagcacucugc

SEQ ID NO: 240636 - RNA, 65 nt, Homo Sapiens
cuagcccagcagguuaaucuggcuaacaccuggaucuccagaaacuauaauugugaaggagucag

SEQ ID NO: 240637 - RNA, 65 nt, Homo Sapiens
cuggugguggacacagcuuucuaauaaacagggaucuccagaacaccagcuccacucucugguuu

SEQ ID NO: 240638 - RNA, 65 nt, Homo Sapiens
cuaauauccuaaaauacagaauuacagcuugaccucuccagaacagcccaaugagggcgaaugac

SEQ ID NO: 240639 - RNA, 57 nt, Homo Sapiens
uaaagccaguggcuugaggcauaaggacuccagaauccaggguaugaaacccaguga

SEQ ID NO: 240640 - RNA, 65 nt, Homo Sapiens
gaaagcuuggaaacuuaccccagcaauaaguuguucuccagaaaaucuucacuuucaauuauauc

SEQ ID NO: 240641 - RNA, 65 nt, Homo Sapiens
aucauuugaaacaucuuuugcuuaccauggaagugcuccagaagaccuugcuuucaaaaggacug

SEQ ID NO: 240642 - RNA, 65 nt, Homo Sapiens
gcaaccacauugaauucuugcaaaaugguaacugucuccagaacaggguuuuaguauauauagcc

SEQ ID NO: 240643 - RNA, 65 nt, Homo Sapiens
cuacuacaauggccaaguacaacugcccacaggcucuccagaaaaccauagccaucuacaauagu

SEQ ID NO: 240644 - RNA, 65 nt, Homo Sapiens
uuguucgguuauguucauguucuccauugcuacaucuccagaauaaacagagagugaacagcacc

SEQ ID NO: 240645 - RNA, 65 nt, Homo Sapiens
agagcauguucugcauguauuggaucccccauccccuccagaauagaggaaauaaagcccuguuc

SEQ ID NO: 240646 - RNA, 65 nt, Homo Sapiens
caaauguuagacuacacauuagaucaguuaauuaacuccagaaagacauaugcagugguucuuac

SEQ ID NO: 240647 - RNA, 65 nt, Homo Sapiens
uguucugaugggggagggcggucuucccacuuccucuccagaacuccagaaagagcagugugcuu

SEQ ID NO: 240648 - RNA, 65 nt, Homo Sapiens
ugggggagggcggucuucccacuuccucuccagaacuccagaaagagcagugugcuuaugcuuca

SEQ ID NO: 240649 - RNA, 65 nt, Homo Sapiens
agaaaacuucucuucugagccucuuuaacagcuuucuccagaaccagugucugaaccacccugga

SEQ ID NO: 240650 - RNA, 65 nt, Homo Sapiens
auuaguaauaaggagaggguugggggugggcagggcuccagaaagucagcagugugccugggcac

SEQ ID NO: 240651 - RNA, 65 nt, Homo Sapiens
auaaauguguauauuuaauguuuuauuguuagcuucuccagaaaauugaugcaaauucugguaau

SEQ ID NO: 240652 - RNA, 65 nt, Homo Sapiens
aagcugcucucaggcacccccuucuucauugcucucuccagaaaggguugcuagccuuaacuuca

SEQ ID NO: 240653 - RNA, 65 nt, Homo Sapiens
gguuauguuucugccuucggcgagagaacagcaagcuccagaaaguggcugcgccuucagccccg

SEQ ID NO: 240654 - RNA, 65 nt, Homo Sapiens
ggagcacaguagugcgggccugggcccugcuccaccuccagaaguggcuggauguacccugccug

SEQ ID NO: 240655 - RNA, 65 nt, Homo Sapiens
auccugcgacccucacuggccuggccuugugggggcuccagaaaagaggcuaggagaggccagag

SEQ ID NO: 240656 - RNA, 65 nt, Homo Sapiens
uucaaggcacagcccuuguugggagggagaacccucuccagaaacccugccaccauggugucuug

SEQ ID NO: 240657 - RNA, 65 nt, Homo Sapiens
cucugagcugccccuggcuuccuuuaaggaggcugcuccagaaggaaccuggguggggagggcga

SEQ ID NO: 240658 - RNA, 65 nt, Homo Sapiens
acucuguaccccaaagagaguucucaugaaauauucuccagaauguauucauuaucaagaaaaug

SEQ ID NO: 240659 - RNA, 65 nt, Homo Sapiens
ugauucucuugaugccaccuucagauccuuuuauucuccagaauaauucuuaacagugguucaaa

SEQ ID NO: 240660 - RNA, 65 nt, Homo Sapiens
ucugagcccgucucccggacagguugaggaagcugcuccagaagcgccucggaaggggagcucuc

SEQ ID NO: 240661 - RNA, 65 nt, Homo Sapiens
cagaaaauucuggaacuugaaaaaguaguaagggccuccagaauugacuuagcccuaguaauaaa

SEQ ID NO: 240662 - RNA, 65 nt, Homo Sapiens
uuuuaaauuuuuuaauuaccuguuguaggguguuccuccagaagcaaagagcaaaauuuuacugu

SEQ ID NO: 240663 - RNA, 65 nt, Homo Sapiens
gcaaacuucagucuggacuucuuuuugccagagaacuccagaaaccagucaggcucucagucagc

SEQ ID NO: 240664 - RNA, 65 nt, Homo Sapiens
uuuaguguagaugaaaaugucccuucacccacucccuccagaacaacauagcuucccuucccucc

SEQ ID NO: 240665 - RNA, 65 nt, Homo Sapiens
cguggccuuccagaacagucacagacucccacugucuccagaagugcagaaaaacacaaacaaaa

SEQ ID NO: 240666 - RNA, 65 nt, Homo Sapiens
ucagcagaucugagccaccgccuguuccugugccacuccagaaccacccagugucauuugcuccu

SEQ ID NO: 240667 - RNA, 65 nt, Homo Sapiens
auguguguggcuucccuaccccuaacugugcucugcuccagaaacgcaucugaauguuccagcag

SEQ ID NO: 240668 - RNA, 65 nt, Homo Sapiens
cagcagagccuucuagggucaguggagguuucagccuccagaagaugucacuuuaguuaugcuaa

SEQ ID NO: 240669 - RNA, 65 nt, Homo Sapiens
uuaccacaaaagcaaaauuuuugcauuuaugauuucuccagaaauaguauuuacaguauugagcu

SEQ ID NO: 240670 - RNA, 65 nt, Homo Sapiens
accuggccgccagccccuucgaaucacugugaggucuccagaaggacagcguuggucucuguuug

SEQ ID NO: 240671 - RNA, 65 nt, Homo Sapiens
cagcaguguuggaggggccuguaagcuggaggcugcuccagaacuucuugucccucacugcccca

SEQ ID NO: 240672 - RNA, 65 nt, Homo Sapiens
accccagugccuuuugacaauuccaaugcauuuggcuccagaaaguuauuccuacuggagcuuag

SEQ ID NO: 240673 - RNA, 65 nt, Homo Sapiens
acggguaucuccgcguggugcacaguaaagcuggccuccagaaacuggggacccucuuccucuag

SEQ ID NO: 240674 - RNA, 65 nt, Homo Sapiens
cuuguaaauaaaauaaauccccagccgccauccuucuccagaauuauuauuucaccaagccaaua

SEQ ID NO: 240675 - RNA, 56 nt, Homo Sapiens
gcagcaggaaagucuuuuuuauuugucuccagaacgucccuggcaugacuccauga

SEQ ID NO: 240676 - RNA, 65 nt, Homo Sapiens
ccaaguauucguguaaauuaaaguaacuaaaguagcuccagaauggcagggcuuugaucauucaa

SEQ ID NO: 240677 - RNA, 65 nt, Homo Sapiens
uagagcccaucaauauuuuuuucuacugcccgugucuccagaauguuucaagcugaaaauaauag

SEQ ID NO: 240678 - RNA, 65 nt, Homo Sapiens
ggggagcagaguccgagcuucuugccucuccccaucuccagaagaaguaugacaacacauacaca

SEQ ID NO: 240679 - RNA, 65 nt, Homo Sapiens
gacaauguccccuauucaggcuugugguucucuaacuccagaaagcagagcacagaccccagagu

SEQ ID NO: 240680 - RNA, 65 nt, Homo Sapiens
uucauguuuaugaguauuagguuuuaaauuucauacuccagaacuaauuuauauccaaaauuugu

SEQ ID NO: 240681 - RNA, 65 nt, Homo Sapiens
aaggcauuaaagaaaauagcgagauuuuagccuuucuccagaacuuguguuaaugucaauaugau

SEQ ID NO: 240682 - RNA, 65 nt, Homo Sapiens
cugcuugcccccagagagccugguucagguggggucuccagaagggcuguggucaccugaggaug

SEQ ID NO: 240683 - RNA, 65 nt, Homo Sapiens
auacuggaagccaccucugguucuuggaagacccccuccagaagcaugacccuuaagugccaccc

SEQ ID NO: 240684 - RNA, 65 nt, Homo Sapiens
auggcagagcagacaggccggaaccagcaucaagucuccagaaacauacaguaagagauaguguu

SEQ ID NO: 240685 - RNA, 65 nt, Homo Sapiens
caccaaggaaaaagcagagaccucaaccugcuguccuccagaaagggaacugacccuuccuucau

SEQ ID NO: 240686 - RNA, 65 nt, Homo Sapiens
gcuagacuaagaauuaggugucuugaugacuccugcuccagaaucaaaucagcuuauauuuuuua

SEQ ID NO: 240687 - RNA, 65 nt, Homo Sapiens
gacuguccuauaaguuguacucacccuccacaguacuccagaaagcuuacacuggaagcuuugau

SEQ ID NO: 240688 - RNA, 65 nt, Homo Sapiens
uuccagauuuguuuccuuuuggccuccugcaaagucuccagaagaaaauuugccaaucuuuccua

SEQ ID NO: 240689 - RNA, 65 nt, Homo Sapiens
gaagauguuuacuacaaaagcaugccaaaccuaggcuccagaaaccacguccaucagcugcauac

SEQ ID NO: 240690 - RNA, 65 nt, Homo Sapiens
auacuagcauugcacauauagucugcuuucuguuccuccagaauuugaguccuguuaauguagua

SEQ ID NO: 240691 - RNA, 65 nt, Homo Sapiens
uucauucuucaacagugccuugcauguaacaagcacuccagaaauguuuguugaaugaaugaaug

SEQ ID NO: 240692 - RNA, 65 nt, Homo Sapiens
ucauggcuggagagcugaucagccaggcacagaaucuccagaacaaccuagagagugaaugcuaa

SEQ ID NO: 240693 - RNA, 65 nt, Homo Sapiens
aaaucuccuggcaccuugaucuuggauuuuacagccuccagaacugugagaaaauaaauuucugu

SEQ ID NO: 240694 - RNA, 65 nt, Homo Sapiens
uuuaaugguacuuaguauuuugaucaaacuuuagucuccagaacuaaacaagucccuaaguuucc

SEQ ID NO: 240695 - RNA, 65 nt, Homo Sapiens
uacaggaaguacuggagaaaauggacguguuaugacuccagaauuucccaaagcagugcaugcug

SEQ ID NO: 240696 - RNA, 65 nt, Homo Sapiens
uuaauguuaccuuuuggcuugagaaugucuuucagcuccagaauuauuguuacucauauuuuaau

SEQ ID NO: 240697 - RNA, 52 nt, Homo Sapiens
uuauuagucugcaugguuaaaccuccagaauagugaaggugccgagcuauaa

SEQ ID NO: 240698 - RNA, 65 nt, Homo Sapiens
uugugaccacuauuguggguguugggugcugguagcuccagaauuuguauaguaauuuuguuguu

SEQ ID NO: 240699 - RNA, 65 nt, Homo Sapiens
uaggguuaugugugucauucagagcuucacagcuacuccagaaaacuccaaccucacagccucgu

SEQ ID NO: 240700 - RNA, 65 nt, Homo Sapiens
uguaacuguguuguuauguguguccaugugcuagucuccagaacucccauccaaagauguccaga

SEQ ID NO: 240701 - RNA, 65 nt, Homo Sapiens
uuuuucugucagugaaaauauaucuugauuguacucuccagaaaauguuauuucuaauaauacac

SEQ ID NO: 240702 - RNA, 65 nt, Homo Sapiens
uugggauuaucgucuucuaauacaucucauucaaucuccagaagaagucaaaagcuucagugagu

SEQ ID NO: 240703 - RNA, 65 nt, Homo Sapiens
gacguaacuuagcauggaucucaucuuauacugagcuccagaaagacccagcucauggaauuuuu

SEQ ID NO: 240704 - RNA, 65 nt, Homo Sapiens
cuuuuauuuuccugucuucuuucuccugugguuugcuccagaauuaagguuuguuuuccauccau

SEQ ID NO: 240705 - RNA, 65 nt, Homo Sapiens
uucucccuuuugacacaguuguuucagaaagagcucuccagaagccaauauugagauguaauuca

SEQ ID NO: 240706 - RNA, 65 nt, Homo Sapiens
guagaagaaaaaaaaucuuucagauaagagguguucuccagaauggaggaacuacuuggcaugua

SEQ ID NO: 240707 - RNA, 65 nt, Homo Sapiens
ugacuuaacuguaugugcaacagcaaugaaauuaacuccagaagccuuccaccugcgucacccag

SEQ ID NO: 240708 - RNA, 65 nt, Homo Sapiens
cuucaagcugcucaucuguuaguaagugauguucacuccagaacacauucaugaugagaacuuuc

SEQ ID NO: 240709 - RNA, 65 nt, Homo Sapiens
guagaagaaaaaaaaucuuucagauaagagguguucuccagaauggaagaacgacuuggcaugua

SEQ ID NO: 240710 - RNA, 65 nt, Homo Sapiens
ccucacacugcugugcagccaucaccaccauucaucuccagaauuuguucucagucccaaacuga

SEQ ID NO: 240711 - RNA, 65 nt, Homo Sapiens
cuucuauucauaaauguucuauacaguggacagcccuccagaaugguacuucagugccuagugua

SEQ ID NO: 240712 - RNA, 65 nt, Homo Sapiens
caaaauaaggaagagggcugagcugagcuucgguucuccagaauguaagaaaacaaaaucuaaaa

SEQ ID NO: 240713 - RNA, 65 nt, Homo Sapiens
gccgaccaccagcaccauccucuccucccagcagccuccagaaccaugcccaggucuccugccuc

SEQ ID NO: 240714 - RNA, 65 nt, Homo Sapiens
ucugaccucaucaugguucuaguucucauacagaacuccagaauuuuuaaagaacucuauaauug

SEQ ID NO: 240715 - RNA, 65 nt, Homo Sapiens
uuuuacugaaucugucuacccuucauucaugagaacuccagaaugaguguugaccacugaagcau

SEQ ID NO: 240716 - RNA, 65 nt, Homo Sapiens
ucccacacuaagguaaguucagacuagauugaacacuccagaauuuuuuacuacagacuguuuuu

SEQ ID NO: 240717 - RNA, 65 nt, Homo Sapiens
gcauccccauggagagacagcauugcuccccagcccuccagaaaccuugagcagauccagggauc

SEQ ID NO: 240718 - RNA, 65 nt, Homo Sapiens
ggcauugccgggguaggguggugucuucaccacagcuccagaaggcacuggugggauguggaguc

SEQ ID NO: 240719 - RNA, 65 nt, Homo Sapiens
aggaaagaaucaaauuucuugcccggucacuggcacuccagaagacagcgugccggaaccggcag

SEQ ID NO: 240720 - RNA, 65 nt, Homo Sapiens
caacuuucauagucccaaagauaggcagagaacaucuccagaaaugugugugugugugugugugu

SEQ ID NO: 240721 - RNA, 65 nt, Homo Sapiens
ccccauuccccucugagcaugacucauggcguucccuccagaacucagaagagccacagucucca

SEQ ID NO: 240722 - RNA, 65 nt, Homo Sapiens
gugcuuguggagggccugacccuagucagacgaaacuccagaacaucgaaaagccagaggguuca

SEQ ID NO: 240723 - RNA, 65 nt, Homo Sapiens
ucugaaacacauucuugaaguuaauaaacagaaaucuccagaaccccauaauuuucuucaaugag

SEQ ID NO: 240724 - RNA, 65 nt, Homo Sapiens
uagacuucagacccuuaauguaauaccugguaauucuccagaagacacuauauuacagaaugaug

SEQ ID NO: 240725 - RNA, 65 nt, Homo Sapiens
aauaaucaucuguguggcauuuaucaguugacucucuccagaauauauuaauuguaaagccaagc

SEQ ID NO: 240726 - RNA, 65 nt, Homo Sapiens
caguguggugcuguggaaggcccuggcuggaaagacuccagaauccacuguugcagcuuccucug

SEQ ID NO: 240727 - RNA, 65 nt, Homo Sapiens
gaagagaaugauggauauucgaaguguggguuugucuccagaacacccucugugaggagcugugg

SEQ ID NO: 240728 - RNA, 65 nt, Homo Sapiens
agcacuagggucccaggagaaagcugaggauagagcuccagaaacuagucccugaggguggaggg

SEQ ID NO: 240729 - RNA, 65 nt, Homo Sapiens
ggaggggggaaagagaccagccuuggucccuaagccuccagaaacgucuucuuaauccccaccuu

SEQ ID NO: 240730 - RNA, 65 nt, Homo Sapiens
gggcauauuucugugcuguggaugacauggccuuacuccagaaucccaggcccuccacugugacu

SEQ ID NO: 240731 - RNA, 65 nt, Homo Sapiens
aagugcuggcaaccacuaagaauucaaacuggggccuccagaacucacuggggccuacagcuuug

SEQ ID NO: 240732 - RNA, 65 nt, Homo Sapiens
cuucagccuuaaauacaaaaauaaaacugaaacugcuccagaaagcagcuuucuccaaaaauguc

SEQ ID NO: 240733 - RNA, 65 nt, Homo Sapiens
gugaagcccaaaagcucuuaaggagaauuguauuucuccagaagcugcagcaagagguacagcuc

SEQ ID NO: 240734 - RNA, 65 nt, Homo Sapiens
gaauuauucaauuucaugaauaacucuuguuugcacuccagaaaacaacauacauguuuaaauac

SEQ ID NO: 240735 - RNA, 65 nt, Homo Sapiens
aaaucuuuuagaauuuuuuuggagguguuuguuuucuccagaauaaagguauuacuuuagaauag

SEQ ID NO: 240736 - RNA, 65 nt, Homo Sapiens
uaguggcuguguagcauccucagugcaaaacccagcuccagaauuuucaccugguaacgaauuuc

SEQ ID NO: 240737 - RNA, 65 nt, Homo Sapiens
cuaaaaugcagcuguuguuagacaacuguugaaaacuccagaaauacaucacccaagguggcagu

SEQ ID NO: 240738 - RNA, 65 nt, Homo Sapiens
aaacccaggccuugacauuguuauucaaauggccccuccagaaaguuuaaugauuuccauuugua

SEQ ID NO: 240739 - RNA, 65 nt, Homo Sapiens
gcgugaaaccuuggcacaggacugaggauccucuccuccagaaaagcccccucgaggaaauaaau

SEQ ID NO: 240740 - RNA, 65 nt, Homo Sapiens
ggaggugucuacugaaaagggaaccugcuucuuuacuccagaacgcuguucuuuaaagaccaaga

SEQ ID NO: 240741 - RNA, 55 nt, Homo Sapiens
accaguggagaagguacuagucaaccuccagaaagaguauggagagaaaaagagg

SEQ ID NO: 240742 - RNA, 65 nt, Homo Sapiens
gcucagggccuuccccacagucuugccacuccuagcuccagaagggucaaauacuugacucccac

SEQ ID NO: 240743 - RNA, 65 nt, Homo Sapiens
uaagacaggccacaggaggggcaggcccaguccuccuccagaaaaguuuaagaugcuaggaugag

SEQ ID NO: 240744 - RNA, 65 nt, Homo Sapiens
uucugggauaacauuuggaguccccuucucccugccuccagaaugucagacucugauuagcugcc

SEQ ID NO: 240745 - RNA, 65 nt, Homo Sapiens
auuaaccaccccucucuaguaaauuccacagcugccuccagaaacggagagggggagcaaacagg

SEQ ID NO: 240746 - RNA, 65 nt, Homo Sapiens
accccgacggggggccuuauucccugggaggcaggcuccagaagcccgccagcuccucagccugc

SEQ ID NO: 240747 - RNA, 65 nt, Homo Sapiens
cucugaccccauuuguuuuuugcccugccacaugacuccagaagucagugcuacaggaguacauc

SEQ ID NO: 240748 - RNA, 65 nt, Homo Sapiens
ccuuuggaaauggugaaggacuguuccugcaaggucuccagaaccucuuggcuaaggugcuguuc

SEQ ID NO: 240749 - RNA, 65 nt, Homo Sapiens
uucuauuaccuuuaaaaaagacagaggauagcaagcuccagaaggcugucucaaauaauuauuuc

SEQ ID NO: 240750 - RNA, 65 nt, Homo Sapiens
guaaugguggcagaacccaccugcgcagcaggcaccuccagaaaguagagcgagagcagagcaaa

SEQ ID NO: 240751 - RNA, 65 nt, Homo Sapiens
ggaguuuucugugagaauaacauauugaggggcaacuccagaagugcuuuuacuuccgguuucuu

SEQ ID NO: 240752 - RNA, 65 nt, Homo Sapiens
auuaauaaaacaaaacaaaaggguagggacugggacuccagaaccuacuaaagcaaaauuuccag

SEQ ID NO: 240753 - RNA, 65 nt, Homo Sapiens
aacuugauucaucgcugcaaguauuccccaauggacuccagaagagccuucuagcugaaaaacga

SEQ ID NO: 240754 - RNA, 65 nt, Homo Sapiens
ccuagaaacaucucaucauuaaaagagcauaucuucuccagaaguauccagggcaaggacagacu

SEQ ID NO: 240755 - RNA, 65 nt, Homo Sapiens
agaaacuguuucuccaggcgugcugcugagauggacuccagaagaugaaugugggagaaaaucgc

SEQ ID NO: 240756 - RNA, 65 nt, Homo Sapiens
uaguacgcuuuauuuuuagaaauauuugaaaaacacuccagaaucauaaguggcaaauauuuuaa

SEQ ID NO: 240757 - RNA, 65 nt, Homo Sapiens
auagaagcucagccuggccuaggcacggcucauuccuccagaauuuuccccguguggcccacccc

SEQ ID NO: 240758 - RNA, 65 nt, Homo Sapiens
cagagccaccauuuuuuauaauuucuaauaaccaacuccagaacuaggagcugaucaacucuuug

SEQ ID NO: 240759 - RNA, 65 nt, Homo Sapiens
gagauguuggcaccuuugaauucuacauccuguuucuccagaaugagaauuuguguacaaagaua

SEQ ID NO: 240760 - RNA, 65 nt, Homo Sapiens
guauaccuuauaacacugagccacuucuccccacccuccagaagggguccacguugaauucugaa

SEQ ID NO: 240761 - RNA, 65 nt, Homo Sapiens
agcauugcauugugggaaucacaaagcaaauaguacuccagaaagacaaauaucagaagcuuccu

SEQ ID NO: 240762 - RNA, 65 nt, Homo Sapiens
uuuuuagacuguuagacaaaagugcucacgugcagcuccagaauauggaaacagagcaaaagaac

SEQ ID NO: 240763 - RNA, 65 nt, Homo Sapiens
ccccgccuuccccaaagcagaggggcugucugugucuccagaaaggggacaucgggggggagggg

SEQ ID NO: 240764 - RNA, 65 nt, Homo Sapiens
cugaguuugggcugcaagugcucacagcucuuguucuccagaaacuggagaauugcccucaggag

SEQ ID NO: 240765 - RNA, 65 nt, Homo Sapiens
uauuucuacccaugcaacggaagaaaaacccauuacuccagaagaguauaucuaaguaacuaaaa

SEQ ID NO: 240766 - RNA, 65 nt, Homo Sapiens
ucccuugaugaagaaguugauaugccuuuucccaacuccagaaagugacaagcucacagaccuuu

SEQ ID NO: 240767 - RNA, 65 nt, Homo Sapiens
auuugugucgguuaaaaauucgaaggcuuaugggucuccagaaacucugccagccagccucagug

SEQ ID NO: 240768 - RNA, 65 nt, Homo Sapiens
ccucccaaauaacuauuuucuuaucugcaguauuccuccagaagagcuaaccagggcagggcugg

SEQ ID NO: 240769 - RNA, 65 nt, Homo Sapiens
ugcccuuccaacgcaucacccgccucaaacugcugcuccagaacauucugaagagaacacagccu

SEQ ID NO: 240770 - RNA, 65 nt, Homo Sapiens
ugggcuaagguauaaaucaacacacugcuuccuuccuccagaaggucuuacugugaaggaaaaaa

SEQ ID NO: 240771 - RNA, 65 nt, Homo Sapiens
uuaggcuuuuguauuuuuuaucuagucaguuuugucuccagaacccaacuuggcuacacauagac

SEQ ID NO: 240772 - RNA, 65 nt, Homo Sapiens
gcagaucccucagcaggaaccugcaguauuuguaccuccagaaugguccugcggugauauucuau

SEQ ID NO: 240773 - RNA, 65 nt, Homo Sapiens
cacuuugagauacuuaaagaguaguaaaaagauuucuccagaaaaggaauaucaaguauaaugau

SEQ ID NO: 240774 - RNA, 65 nt, Homo Sapiens
cuucuggcugauuguuccgauugugcuuccucuuucuccagaagcgguaguucuguucugugggu

SEQ ID NO: 240775 - RNA, 65 nt, Homo Sapiens
augaacugcaguggagaugaagcuuuuggacagcucuccagaagcccucaaaccagcccaacccg

SEQ ID NO: 240776 - RNA, 65 nt, Homo Sapiens
ucuggacggagcugcuggcaaggcagcagucucugcuccagaaucaagauucaucugugaccucc

SEQ ID NO: 240777 - RNA, 65 nt, Homo Sapiens
uacuauccaucuugaugagaauguauaguuugacucuccagaauguguuucuuuucuauagagaa

SEQ ID NO: 240778 - RNA, 65 nt, Homo Sapiens
gugagaaauacauaccugcucccuuggacuucagccuccagaacuaggcccucaccagaacccaa

SEQ ID NO: 240779 - RNA, 65 nt, Homo Sapiens
ccuucagcucuugccuugccgacuggacccuccuucuccagaagguggaucaggguggggacaag

SEQ ID NO: 240780 - RNA, 65 nt, Homo Sapiens
augcuugugagaaucauuaaaauaguguucuuuuucuccagaaaaucaauauaaauucuacagaa

SEQ ID NO: 240781 - RNA, 65 nt, Homo Sapiens
accucuccaaccaccacacuccccgccguacaguucuccagaaucccaggcgaugacaagucuga

SEQ ID NO: 240782 - RNA, 65 nt, Homo Sapiens
gcucccaggggccggccuccucugccugguaaugacuccagaacaacaacugggaagaaacuuga

SEQ ID NO: 240783 - RNA, 65 nt, Homo Sapiens
agaaggaagcauggcccugacuucagaauuccagacuccagaacuggaagaauaaaugucuguug

SEQ ID NO: 240784 - RNA, 65 nt, Homo Sapiens
ccugcauugaauugaauaugaauuucucuaacucucuccagaaaauggauggagauaacuugucu

SEQ ID NO: 240785 - RNA, 65 nt, Homo Sapiens
ugugagauucuuuagccacuuuggggagccugucucuccagaagccuuucuuaguggugcccaca

SEQ ID NO: 240786 - RNA, 65 nt, Homo Sapiens
cuuaaaaugcacggcuaaacuauucagaguuaacacuccagaauuguuaaauuacaaguacuaug

SEQ ID NO: 240787 - RNA, 65 nt, Homo Sapiens
acugagcgccugcagaucccgcaggcuucguuugccuccagaaccuucccgucugauuguuccuc

SEQ ID NO: 240788 - RNA, 65 nt, Homo Sapiens
uaaccuuucuaaaaguuuucaucgccuugguaaagcuccagaaauggacaaugcuagugacugca

SEQ ID NO: 240789 - RNA, 65 nt, Homo Sapiens
cauauugcccggugaugaaauuccucacuucaugccuccagaaagacaucggcuucucagauggc

SEQ ID NO: 240790 - RNA, 65 nt, Homo Sapiens
gaugcagagagcuguggggcggguagcuuggcugccuccagaagacccucugggccaaagcccau

SEQ ID NO: 240791 - RNA, 65 nt, Homo Sapiens
augaaaagcaauacaacuuuggagagagggcacaucuccagaaaaugauagggauccugguggga

SEQ ID NO: 240792 - RNA, 65 nt, Homo Sapiens
gaaggggguggggauuuucucuuuagauacgaaaucuccagaaugcuucauccucgccucucagg

SEQ ID NO: 240793 - RNA, 65 nt, Homo Sapiens
ugacgacugggccaugugaccugugacacucuacccuccagaaccagucccaugggauuccccgg

SEQ ID NO: 240794 - RNA, 65 nt, Homo Sapiens
ugcucuccacuugcuuuaggcucaaaugucaccuucuccagaagcuauuuuucuugaagaggcag

SEQ ID NO: 240795 - RNA, 65 nt, Homo Sapiens
uagcaauuuccgccuggugacgcaucagcgccggccuccagaacugauccagcaggccccagucu

SEQ ID NO: 240796 - RNA, 65 nt, Homo Sapiens
uuuuaaggcuacauuuuggacauuuaucugagucucuccagaaguagaggagaggagggggaggu

SEQ ID NO: 240797 - RNA, 65 nt, Homo Sapiens
aagcacuuagcgugcuguucagugucacaaaauaacuccagaaagaagcuuuucuuuggcgauuc

SEQ ID NO: 240798 - RNA, 65 nt, Homo Sapiens
ucacuuuaaacuuuuauuaccacaguugcugccuccuccagaauuuuugaauuuuaauaaaaggc

SEQ ID NO: 240799 - RNA, 65 nt, Homo Sapiens
aacauugcgagaguagcuauuuugaaagaauaauucuccagaaguuaacaucuaauaucuaguau

SEQ ID NO: 240800 - RNA, 65 nt, Homo Sapiens
caaaaucaccagcaccuugaucuuugacuucuaaucuccagaauagugagaaauaaauuucuguu

SEQ ID NO: 240801 - RNA, 65 nt, Homo Sapiens
uguucuuugccaccagccugucacuccaguggcagcuccagaaacggaggcuguugcuuuuaucc

SEQ ID NO: 240802 - RNA, 65 nt, Homo Sapiens
acuacugcuucugucccugcuggcagccucugucccuccagaacggcuaaccagagcacacuguc

SEQ ID NO: 240803 - RNA, 57 nt, Homo Sapiens
uuuuggaacaggagggauaaggaggugcuccagaagcacgggacuguggaccuugca

SEQ ID NO: 240804 - RNA, 65 nt, Homo Sapiens
uuuaauccuugcuuugguuuggaacugccuucgggcuccagaacuuaaauugcuugguccguggc

SEQ ID NO: 240805 - RNA, 65 nt, Homo Sapiens
gggugggcugggccgcuggagccuccgccugcuuccuccagaagacacgaaucaugacucacgau

SEQ ID NO: 240806 - RNA, 65 nt, Homo Sapiens
aaucaguguuaguccucuguuucuucuccauguuucuccagaauucccugcuaagcaguuuauag

SEQ ID NO: 240807 - RNA, 65 nt, Homo Sapiens
cugcucucagcaauugcaguuuccccuggaucauacuccagaauucucagugguguggggaaacg

SEQ ID NO: 240808 - RNA, 63 nt, Homo Sapiens
cuguuccucacagucaagccucugguagccuugcuccagaagcuuuugucugcuuagcauuga

SEQ ID NO: 240809 - RNA, 65 nt, Homo Sapiens
ucccaacucgucugccgucccgccccaauuccaagcuccagaaacacuucuuggaccuccucccc

SEQ ID NO: 240810 - RNA, 65 nt, Homo Sapiens
ugcaagagcuucuuagcaguccacaucacagcucccuccagaagcccccaccgauuucagcgugu

SEQ ID NO: 240811 - RNA, 65 nt, Homo Sapiens
cccacccaagaaaauaauaguuucagcuccccaugcuccagaauacagcaguuuccuugcaacac

SEQ ID NO: 240812 - RNA, 65 nt, Homo Sapiens
auucuauagugugccagagcgguuuggauuuguaacuccagaaacgaugcucuaauuggcugguu

SEQ ID NO: 240813 - RNA, 53 nt, Homo Sapiens
acucuaugaggaagaugccaacucuccagaacauugccugccucaucucuuga

SEQ ID NO: 240814 - RNA, 65 nt, Homo Sapiens
accccggcccccugcccguuacaaguucuuggucccuccagaaccuguaguuguucguugguuau

SEQ ID NO: 240815 - RNA, 65 nt, Homo Sapiens
guagucugucuucaacuauuuuauccaaaauaaaccuccagaagaaaguaguuuucauuuacuua

SEQ ID NO: 240816 - RNA, 65 nt, Homo Sapiens
aggagaccuaucgucuuggaacuugccauucuuuccuccagaacaaaauguuaacuuucuaacac

SEQ ID NO: 240817 - RNA, 65 nt, Homo Sapiens
gcacagacagguuuucacauaaaugcagcccauuucuccagaacccauuugaggggugggggggu

SEQ ID NO: 240818 - RNA, 63 nt, Homo Sapiens
aagaauuuauagauguuuaauuccugauuuuugcuccagaauaucuuugagaaugacaacuua

SEQ ID NO: 240819 - RNA, 65 nt, Homo Sapiens
uaaggcugcuugguacugaguauacuuaaauauaacuccagaauccagggacuugguguuaaaac

SEQ ID NO: 240820 - RNA, 65 nt, Homo Sapiens
uuacgccucaacauauacuugugcucuuccuuugccuccagaagaaguuuuuccuugauugugcu

SEQ ID NO: 240821 - RNA, 65 nt, Homo Sapiens
gacugccuccaccacaggcauccugcaaaugcagacuccagaauccccagcaucagcgggaacca

SEQ ID NO: 240822 - RNA, 65 nt, Homo Sapiens
gugagaaauaaauguguuuucuuggaccucccagccuccagaacuaugucugcuggcaccuugau

SEQ ID NO: 240823 - RNA, 65 nt, Homo Sapiens
auuuuguuugcuuugacccuagggcuacacugaaccuccagaaucucauacaacauacuuaaugc

SEQ ID NO: 240824 - RNA, 65 nt, Homo Sapiens
gccguagcaguuugacgauaggaauauaaauuucgcuccagaaagauucuuucacauggcuacug

SEQ ID NO: 240825 - RNA, 65 nt, Homo Sapiens
gcacaggaacgaaauaccucuucaaaagaugaaaacuccagaaacggcucuuaugagucauuuuu

SEQ ID NO: 240826 - RNA, 65 nt, Homo Sapiens
aguccguuauuugggaaaguugaauauuagguuuccuccagaaauguuauugguaaucuuuucug

SEQ ID NO: 240827 - RNA, 65 nt, Homo Sapiens
aagaagcccuuuacauuucccuguccacaaggcaacuccagaagaggccuggguugucucaaauc

SEQ ID NO: 240828 - RNA, 65 nt, Homo Sapiens
guaucuggucagguugacccuuuaagaaugcauuccuccagaagacaaaguugcaggcacaacag

SEQ ID NO: 240829 - RNA, 52 nt, Homo Sapiens
aaauccuuauguaugaaauugacuccagaacugcucaucuaacuugcccuga

SEQ ID NO: 240830 - RNA, 65 nt, Homo Sapiens
gccauucucccaaacuaauguaucccaguuuagggcuccagaaaaauuaugaggcucugauuucc

SEQ ID NO: 240831 - RNA, 65 nt, Homo Sapiens
ccccacccaggccaggcauggcccugagccagggucuccagaaagcccuuucacaggcagccagu

SEQ ID NO: 240832 - RNA, 65 nt, Homo Sapiens
ucagguaugccucaccaauucacgcauuuguauaucuccagaaauuuugcauaugaugccagccu

SEQ ID NO: 240833 - RNA, 65 nt, Homo Sapiens
aaauuccuaaagcuuuuagggaccuuagagcaagacuccagaauguguucugugguuucuuaggu

SEQ ID NO: 240834 - RNA, 65 nt, Homo Sapiens
caauaaaguguaauauuucuaggguagauuagcugcuccagaauuuugucauuggucaauagggg

SEQ ID NO: 240835 - RNA, 65 nt, Homo Sapiens
ccagccggcuucccccaaggauuucagaggggacccuccagaagcuguguuuuucaauuguugac

SEQ ID NO: 240836 - RNA, 65 nt, Homo Sapiens
guggaggugguguucuauaccuaaaggaugaccugcuccagaaacagcaccagcacagcauguau

SEQ ID NO: 240837 - RNA, 65 nt, Homo Sapiens
aauucacacaugacuaccuuugagcuaaugacugucuccagaaaauaacugugccccaagaagug

SEQ ID NO: 240838 - RNA, 65 nt, Homo Sapiens
aaauaugccagguagacaccagcccaaguacccuccuccagaagucugugacuaccuugucacua

SEQ ID NO: 240839 - RNA, 65 nt, Homo Sapiens
cacugaaaauguuuuguuagcuuuuccuucuuucucuccagaagaaacauggauagaugauagcu

SEQ ID NO: 240840 - RNA, 65 nt, Homo Sapiens
gccugcucuaauuucuuuugcccauauaugaguaucuccagaaugucuacaaauaguuuuuguag

SEQ ID NO: 240841 - RNA, 65 nt, Homo Sapiens
agguuugaggccaccaaaagaucaacagacaaaugcuccagaaaucuaugcugacugugacacaa

SEQ ID NO: 240842 - RNA, 65 nt, Homo Sapiens
ggccaucucgggcacaggcccaccccgccccaccccuccagaacacggcucacgcuuaccucaac

SEQ ID NO: 240843 - RNA, 65 nt, Homo Sapiens
uccuauaaaguuaaacauacacuuuuacuuuaggacuccagaauuccacuucuaguuauuuauuc

SEQ ID NO: 240844 - RNA, 65 nt, Homo Sapiens
ugaccagaauucuucuguaauucugcccaugacuccuccagaauuuuaguagauacagggugggu

SEQ ID NO: 240845 - RNA, 65 nt, Homo Sapiens
uuguuuuauccaugaggaagauuuuuaacaaaagccuccagaagauuuccccucaguuuccauug

SEQ ID NO: 240846 - RNA, 65 nt, Homo Sapiens
aaaagauauggugaaggcagaacugcucacaccagcuccagaagcacguccucugacuucacugc

SEQ ID NO: 240847 - RNA, 65 nt, Homo Sapiens
cuggagcagcccaccuagagccagucuaaugagaacuccagaaaguggagcagcccgccuagaac

SEQ ID NO: 240848 - RNA, 65 nt, Homo Sapiens
guguguuucccugaugcgggccuucagccuccucacuccagaaaccagcucuccucugggcccug

SEQ ID NO: 240849 - RNA, 65 nt, Homo Sapiens
ggacagccacggccaaguggcugcagccacagcuccuccagaaaggacuaagucacagggaucug

SEQ ID NO: 240850 - RNA, 65 nt, Homo Sapiens
ucaccagagagcuuucagcuguuaggcauggggagcuccagaaggcaaaaggcagaugacgggga

SEQ ID NO: 240851 - RNA, 65 nt, Homo Sapiens
ccaggagucgacaguuuugggggaauucagccacacuccagaaaguuuuugggggcgggggggug

SEQ ID NO: 240852 - RNA, 65 nt, Homo Sapiens
agugcaauucagaaggcagcaagaauuaacuucuccuccagaacaaggacucccugacaaaagug

SEQ ID NO: 240853 - RNA, 65 nt, Homo Sapiens
aagaaucucaaccuggagggugacccccuuccuaccuccagaauacccuucccaccugagcaugc

SEQ ID NO: 240854 - RNA, 65 nt, Homo Sapiens
ccgccuguccuuccagcauguccagacaaaaggaucuccagaaagaaagccagcagcugugguac

SEQ ID NO: 240855 - RNA, 65 nt, Homo Sapiens
uggaaauccuaguuuccucuauaacuucaguccugcuccagaauuauccaagcucccugccccaa

SEQ ID NO: 240856 - RNA, 65 nt, Homo Sapiens
ucugcccaggaggcaggggaagacacacuagugcucuccagaaucuacagaguuccuucucaccc

SEQ ID NO: 240857 - RNA, 65 nt, Homo Sapiens
ugcuccuuuacccucuuggugccucugccuggggccuccagaagcccagucacugcugcaaggug

SEQ ID NO: 240858 - RNA, 65 nt, Homo Sapiens
gcagaaagcgggugcuguaggcuccucccaacaaacuccagaacacugccggaagggagcccccu

SEQ ID NO: 240859 - RNA, 65 nt, Homo Sapiens
cugcuguggacugcaucagggauugcgucuggggccuccagaacuggaagaccaagacaccuggg

SEQ ID NO: 240860 - RNA, 65 nt, Homo Sapiens
ccagccagaagccugauugguggugcuuaaugaaucuccagaauguguggccuggaguauuuaua

SEQ ID NO: 240861 - RNA, 65 nt, Homo Sapiens
gaaagaccuuacuucauuucuaguagaauuuauuacuccagaacauuuucagaauaauuauugca

SEQ ID NO: 240862 - RNA, 65 nt, Homo Sapiens
ucuccucuucaucucagcauucuccaucacuuccccuccagaaaaacggauggaaggaagcccuc

SEQ ID NO: 240863 - RNA, 65 nt, Homo Sapiens
ccccaaggagcuucagggcaguccuucuggcacugcuccagaauuccuccuucuuggugugucug

SEQ ID NO: 240864 - RNA, 65 nt, Homo Sapiens
cccuagauacuguguuaugugcaacuguagaaacccuccagaaauuuccacugcuguucuucacu

SEQ ID NO: 240865 - RNA, 50 nt, Homo Sapiens
uucaagguuguggaguguaacuccagaauuuuccuucuucagcucauuuu

SEQ ID NO: 240866 - RNA, 65 nt, Homo Sapiens
ccaccacacagacucugggccuccccgcaaaauggcuccagaauuagaguaauuaugagauggug

SEQ ID NO: 240867 - RNA, 65 nt, Homo Sapiens
ucaaauggcaacauggaauauuguccuccaugccccuccagaaggaccuaggagaguaggugagc

SEQ ID NO: 240868 - RNA, 65 nt, Homo Sapiens
acaaggcgucgaggaauuggaaagauuugcacacccuccagaaaggagagacgcaaucuccccuc

SEQ ID NO: 240869 - RNA, 65 nt, Homo Sapiens
auaaugcuuauuaugaguuuaagaagcaguucuuccuccagaaagaagggggcgauagcaugcag

SEQ ID NO: 240870 - RNA, 65 nt, Homo Sapiens
agccgcagcccuggggccaguaggaagcggacccgcuccagaaguccccacgagaagaagaagaa

SEQ ID NO: 240871 - RNA, 65 nt, Homo Sapiens
gggacuguguugacugacgagccgagggguggccgcuccagaagggugcccagucaggccgcacc

SEQ ID NO: 240872 - RNA, 65 nt, Homo Sapiens
uagaccuuugcuuaugcaaaccucugaaggguuggcuccagaacucccaucauucauucucaaga

SEQ ID NO: 240873 - RNA, 65 nt, Homo Sapiens
ccucgucugggaauucgagacagagguucucugcccuccagaagcucagcagauacaugucagug

SEQ ID NO: 240874 - RNA, 65 nt, Homo Sapiens
uguucaauaaaaugcuuuuauuugguucuaacuaccuccagaaugaccccaaucccaaauuuugu

SEQ ID NO: 240875 - RNA, 65 nt, Homo Sapiens
uagaagccugucucuguaccacccagacucucccacuccagaaugcaccaccaccgacucuccca

SEQ ID NO: 240876 - RNA, 65 nt, Homo Sapiens
auuggggucacauaugucccgaccaggagugucaucuccagaauuccauggacagagaagaaaau

SEQ ID NO: 240877 - RNA, 65 nt, Homo Sapiens
cuuuuuuccuuuuuacaaacccauugcuuuccauucuccagaacuagucuucccaacuucuuaca

SEQ ID NO: 240878 - RNA, 65 nt, Homo Sapiens
gacuggucaugaagcucaugcugaacuccugcacucuccagaagugcaaaaggggcugggacacu

SEQ ID NO: 240879 - RNA, 65 nt, Homo Sapiens
cuauccacuguauuuccacauaaagguggcuucugcuccagaacuuuacucucuauuauugggca

SEQ ID NO: 240880 - RNA, 65 nt, Homo Sapiens
gucuaaaugcugaaaaaacaguaccauuugcauggcuccagaaaugcacgugucucagacugcau

SEQ ID NO: 240881 - RNA, 65 nt, Homo Sapiens
cauccugucaaucacucugucauuucugccauguacuccagaacucucugggagacuucucugua

SEQ ID NO: 240882 - RNA, 65 nt, Homo Sapiens
gccucggccucagcuccguuaaaugugcuggugcccuccagaaaacaagugccuucugugaguuu

SEQ ID NO: 240883 - RNA, 65 nt, Homo Sapiens
aagggauguaucagggaugaucagcugaugagaggcuccagaaggauuucuagaucgcuucaagc

SEQ ID NO: 240884 - RNA, 65 nt, Homo Sapiens
uguuuaagcuagcuuuaccuaagccacuucucagccuccagaauacucucucugggguugugagu

SEQ ID NO: 240885 - RNA, 65 nt, Homo Sapiens
aguguaaacugcaguuuuccgugguuaaaaaugaucuccagaauagcuacaggggcacauuuucu

SEQ ID NO: 240886 - RNA, 65 nt, Homo Sapiens
caauaccaaccugaaaguucggagacuucugucuucuccagaaggaaaauguagcugcgucauaa

SEQ ID NO: 240887 - RNA, 65 nt, Homo Sapiens
uuggaacaccuggcaugugauguugguaaaauccucuccagaaucgaaagcugauagcuccucca

SEQ ID NO: 240888 - RNA, 65 nt, Homo Sapiens
cagcaagaacacuuggaauguuacagaauuauguccuccagaaacguagcagugguuacccagac

SEQ ID NO: 240889 - RNA, 65 nt, Homo Sapiens
agacauuggcauucaaauguucagcuccagugucucuccagaauaagugugaucauuguugaacu

SEQ ID NO: 240890 - RNA, 65 nt, Homo Sapiens
ucaaagaagggaagaaacucggccagcugcagguccuccagaaaaaauggagccugucucaggaa

SEQ ID NO: 240891 - RNA, 65 nt, Homo Sapiens
caauaguuauccccaggccuggcacgucaaagaggcuccagaaauguuugcugagugagugauga

SEQ ID NO: 240892 - RNA, 65 nt, Homo Sapiens
ugccgguacugaagaugcucuucuuccucccccugcuccagaaggaguagcaaacuguacauucc

SEQ ID NO: 240893 - RNA, 65 nt, Homo Sapiens
uccugcagacauccuacucggaaguuacuugcuaacuccagaaauagauacucucuuugccagau

SEQ ID NO: 240894 - RNA, 65 nt, Homo Sapiens
aucccgauucccgggaucugaguguuagccagcagcuccagaaaacugcccuggcucugcacaua

SEQ ID NO: 240895 - RNA, 65 nt, Homo Sapiens
acucuuuuugcauaaauaccaaaguguguucuuaacuccagaaccuugagaaauagagaaauaua

SEQ ID NO: 240896 - RNA, 65 nt, Homo Sapiens
caugcucgcuucccuuggcacaugcauguaguccacuccagaaaucaguuuacugaacuccagac

SEQ ID NO: 240897 - RNA, 63 nt, Homo Sapiens
aucccaguaaaagauaugauauuuuccauagauaccuccagaauuuuuuucagcaaauggaau

SEQ ID NO: 240898 - RNA, 65 nt, Homo Sapiens
agaggaacgguguuauggacugaauguucauguuccuccagaauucauaugcugaagccucuguc

SEQ ID NO: 240899 - RNA, 65 nt, Homo Sapiens
gcgucugcuggcaccuugaucuugaacuucccagccuccagaacugugagaaagaaaucucuaug

SEQ ID NO: 240900 - RNA, 65 nt, Homo Sapiens
cagugggaccuuguaaaaugcucccugucagagcucuccagaauaugcuuguuggagauccuuca

SEQ ID NO: 240901 - RNA, 65 nt, Homo Sapiens
uaacggugagggcugacucugaacugucucucagucuccagaaaguguucaagccuguuguguuc

SEQ ID NO: 240902 - RNA, 65 nt, Homo Sapiens
gaaaaggaauuagagggucagaaacacccagguuccuccagaaagcuccuuggagcccaacaacu

SEQ ID NO: 240903 - RNA, 65 nt, Homo Sapiens
auacguauguuuaaaaacccuuacucaagauuccccuccagaaaaguagaaagaugugagauaac

SEQ ID NO: 240904 - RNA, 65 nt, Homo Sapiens
ccuaaaauacaauuuugagggggauucuccauggacuccagaaacauguuuuaugauauggguua

SEQ ID NO: 240905 - RNA, 65 nt, Homo Sapiens
aaaccaaaauaccaugggauaaaaacagcuuuaaucuccagaagagcugcugcauuuaucccaag

SEQ ID NO: 240906 - RNA, 65 nt, Homo Sapiens
gaaaacaaaucaaauaaauaguauuuacaauaucacuccagaaaaaugagugacaaaucuuuaaa

SEQ ID NO: 240907 - RNA, 65 nt, Homo Sapiens
aaugagccuccaccaccaagcaaaaauuucagugacuccagaagaccaagcuucgaaagauaucc

SEQ ID NO: 240908 - RNA, 65 nt, Homo Sapiens
ugagaugagccagccgagccuuugaaaaccuagcucuccagaacauugaccuaaucagcuuacag

SEQ ID NO: 240909 - RNA, 65 nt, Homo Sapiens
acugcggcacgcgcuucggggucccccugcucccacuccagaagaccuccucuacccaaagcucu

SEQ ID NO: 240910 - RNA, 65 nt, Homo Sapiens
gaacucaagcugguuuuaagaauggcgccugcucccuccagaaugcuugaccucaucucccgagc

SEQ ID NO: 240911 - RNA, 65 nt, Homo Sapiens
augggaacaucugggugugcauuacaucuaaggaccuccagaagcuggcccucuuucucccagug

SEQ ID NO: 240912 - RNA, 65 nt, Homo Sapiens
gcuccccacccccccaaagacccaguccuuuccuacuccagaaaucuccgcaccccgccccaugc

SEQ ID NO: 240913 - RNA, 65 nt, Homo Sapiens
gaaccuuccaaggugucugguugcccugccucuggcuccagaacagaaagggagccucacgcugg

SEQ ID NO: 240914 - RNA, 65 nt, Homo Sapiens
cccaccaacuccuauuucccuaccaaccaaggagccuccagaaggaaaggaggaagaaauguuuu

SEQ ID NO: 240915 - RNA, 65 nt, Homo Sapiens
gaccucaaccccagggauucccaggaagcagaacucuccagaagaaggguuuugaucauuccagc

SEQ ID NO: 240916 - RNA, 65 nt, Homo Sapiens
cugcccugccucaacaggguccauugccuccucgccuccagaacuuggagcagggaagugggcac

SEQ ID NO: 240917 - RNA, 65 nt, Homo Sapiens
cuggaaagauauagcauagugguucucagcacagucuccagaacagaagcaucuguaguaccugg

SEQ ID NO: 240918 - RNA, 65 nt, Homo Sapiens
ggagacauugaccccucccuccaugugguaaaccacuccagaauggccaccaggcuucccagagu

SEQ ID NO: 240919 - RNA, 65 nt, Homo Sapiens
acuuguguuacaucuauaaagagcaaaauaacacacuccagaacuuggcaguuguagcauuaguu

SEQ ID NO: 240920 - RNA, 65 nt, Homo Sapiens
ggagcucauguuugugauccucuaucuggacagcucuccagaauccuguguugccccuguucugc

SEQ ID NO: 240921 - RNA, 65 nt, Homo Sapiens
gagaaugugccaugcaugaagcaaaggauuccaggcuccagaaaaaaugaaugaacucaccuuga

SEQ ID NO: 240922 - RNA, 65 nt, Homo Sapiens
gaagcugggcaggacaaguaggacaucccuggagccuccagaagggacuggccucugcccacacc

SEQ ID NO: 240923 - RNA, 65 nt, Homo Sapiens
aaguaugauuuguguucaauagccugaccaagaggcuccagaauacagagggagugugcgaauca

SEQ ID NO: 240924 - RNA, 65 nt, Homo Sapiens
cugaugguaucaauggauuuuuugauauugccacccuccagaaucgggaagaagacacagaagcc

SEQ ID NO: 240925 - RNA, 64 nt, Homo Sapiens
cggugcgugagguucccggcccggcguccccugccuccagaacgcgcccagcguggggcccuag

SEQ ID NO: 240926 - RNA, 65 nt, Homo Sapiens
acagcccuucuccccaagggccgucccuccccugccuccagaaucggaccuggcagcuuuucuug

SEQ ID NO: 240927 - RNA, 65 nt, Homo Sapiens
uggguucguccccagugagacugucaggggagaggcuccagaaccaagugccggugacaagcugu

SEQ ID NO: 240928 - RNA, 65 nt, Homo Sapiens
caaggcuccaggcccguguggcugccggccacugucuccagaacggcacacggcgucaaaaccaa

SEQ ID NO: 240929 - RNA, 65 nt, Homo Sapiens
guucugcugagacugagcaccuuacagauauuuuucuccagaagauggugcuggguaauaaaauc

SEQ ID NO: 240930 - RNA, 65 nt, Homo Sapiens
ccauccccuuuccuccccaccuuccccagacucagcuccagaauaccuucuucgcugcuagagaa

SEQ ID NO: 240931 - RNA, 65 nt, Homo Sapiens
cuauuauucgcuccaagaaagaugcuaagucugagcuccagaagagacugugcuggguguggcuu

SEQ ID NO: 240932 - RNA, 65 nt, Homo Sapiens
cgaggugccgccuuggccgggcccccacgugucuucuccagaaugugucugucuuugccuggugu

SEQ ID NO: 240933 - RNA, 65 nt, Homo Sapiens
cagcgacacacacacacuuauggcaccagccuggacuccagaaaaaggguguccagguauugugu

SEQ ID NO: 240934 - RNA, 65 nt, Homo Sapiens
agagcuggagcucgaucaugccugcgugacaaagccuccagaaaaauccuugaaagacaggacau

SEQ ID NO: 240935 - RNA, 65 nt, Homo Sapiens
cuugcggccacagcacuagagucacccccccaggccuccagaaccuuacuggcacuguggcacug

SEQ ID NO: 240936 - RNA, 65 nt, Homo Sapiens
aaugaucuguacuaucuagugucuaaaacacuauucuccagaaaaaucaaucauuuucuagcccu

SEQ ID NO: 240937 - RNA, 65 nt, Homo Sapiens
ggacaaugaauguaguuaacugguuccugcucacacuccagaauuaaauucuauugaaaaaggaa

SEQ ID NO: 240938 - RNA, 65 nt, Homo Sapiens
uuugcagaucacagugcuggaagcaggaacccaggcuccagaagguguugccaggggcccagaug

SEQ ID NO: 240939 - RNA, 65 nt, Homo Sapiens
ucaaagaugaacaucggaauaacaaacauuguccucuccagaaaguccuuucuuucuccauacug

SEQ ID NO: 240940 - RNA, 65 nt, Homo Sapiens
gucucaggauuuagaaagucuguaagccauccaugcuccagaaagcaccgaucuguuguaguugc

SEQ ID NO: 240941 - RNA, 65 nt, Homo Sapiens
agcguggaggcgugugcaggcuuggaagaagaacucuccagaacauggaacuuaacccucuuuug

SEQ ID NO: 240942 - RNA, 65 nt, Homo Sapiens
aacugaggccagagggaggagagaauugcucauggcuccagaacugguggcaaguuucucuggac

SEQ ID NO: 240943 - RNA, 65 nt, Homo Sapiens
uguggggagaguggggaaucgguaaacacugggaacuccagaagucuucuggauacagccuuuug

SEQ ID NO: 240944 - RNA, 65 nt, Homo Sapiens
gccccucacccuucuuccccgcccgccuacccucccuccagaauacucccccuucaccccuccuu

SEQ ID NO: 240945 - RNA, 65 nt, Homo Sapiens
agcugcuucuccccccaucccaugaccccuucucucuccagaaacgaggguaacuggggggccac

SEQ ID NO: 240946 - RNA, 65 nt, Homo Sapiens
ucagcucaauugcugugcagacgaucaaucacagucuccagaagaugccuucuucauccuuccuu

SEQ ID NO: 240947 - RNA, 65 nt, Homo Sapiens
ugacaaggcaccagcaggacgugcagcucacaccacuccagaacccagcaagggggaccgaugcu

SEQ ID NO: 240948 - RNA, 65 nt, Homo Sapiens
cccgcgccccacauaccugccucuuuugguccuggcuccagaaaacccuccuggucgugccccgu

SEQ ID NO: 240949 - RNA, 65 nt, Homo Sapiens
acuuuaugaaaugguacacucuuggcagauuuuaacuccagaagcaguguggacacuuuugacag

SEQ ID NO: 240950 - RNA, 65 nt, Homo Sapiens
gaugccaucuuccugaauguugagguuuauggagccuccagaacagcuuguuccaaguuugucaa

SEQ ID NO: 240951 - RNA, 65 nt, Homo Sapiens
uuuccaucccaaaggcagucauagaauggagggagcuccagaaaccauguuccugccccacagga

SEQ ID NO: 240952 - RNA, 65 nt, Homo Sapiens
agccccucggaggcagaggaccacacaacagugcccuccagaagccugcaaaccucacagggucc

SEQ ID NO: 240953 - RNA, 65 nt, Homo Sapiens
uuauccacuguggaugaugaagaccaucaucgaaacuccagaaaugaacucaugguuuuaaauau

SEQ ID NO: 240954 - RNA, 65 nt, Homo Sapiens
uggaaccauuucucccgcagccacccccacccagccuccagaagcaucccacacccacccccacc

SEQ ID NO: 240955 - RNA, 65 nt, Homo Sapiens
uagcuucaccccaaucccaggagugcaagccccugcuccagaagagaaaagcagcucuccccuca

SEQ ID NO: 240956 - RNA, 65 nt, Homo Sapiens
ugccagcuucucucuccaggggagugagucaccugcuccagaagagggagauggggaggagauau

SEQ ID NO: 240957 - RNA, 65 nt, Homo Sapiens
gccaagagaacccaaaccaaccugccucagccccacuccagaauaauucugcccuucacuuagca

SEQ ID NO: 240958 - RNA, 65 nt, Homo Sapiens
gcaggagaauaaauuuguguucuugagcuccuggccuccagaauucuugagcccauugaaacuga

SEQ ID NO: 240959 - RNA, 65 nt, Homo Sapiens
cuguucuuuaaagaccaagagaaccugcuucuuuacuccagaacuggaggugucuacugaaaagg

SEQ ID NO: 240960 - RNA, 65 nt, Homo Sapiens
agguacucagcuuucugggaccaguauuuccccuucuccagaagcaggaaggaaaaugaagagag

SEQ ID NO: 240961 - RNA, 65 nt, Homo Sapiens
ggaaucccccgcugcagggacacccacgcccuucucuccagaagccgggcaggcagaauccggcc

SEQ ID NO: 240962 - RNA, 65 nt, Homo Sapiens
ucgagggagaggaggggguuggggaggacccaccucuccagaauggcgacuguccccauccgccu

SEQ ID NO: 240963 - RNA, 65 nt, Homo Sapiens
ggcaucuaaguuagagcuggcaccagaacugagaccuccagaaaucuauuccaguauuuuuucca

SEQ ID NO: 240964 - RNA, 65 nt, Homo Sapiens
cccaguuucugucaucuuaaugucacuagaauguucuccagaaacuucuguccugcuuugccuuu

SEQ ID NO: 240965 - RNA, 65 nt, Homo Sapiens
uggcuuagaggagcuccaaacauaucuuagaguaucuccagaaacucauucucagaaaauccaac

SEQ ID NO: 240966 - RNA, 57 nt, Homo Sapiens
guggaggaaagauuaugaaaccauuuucuccagaagcuccagcguugcacgccauaa

SEQ ID NO: 240967 - RNA, 65 nt, Homo Sapiens
aauagcagcugacaacuuucccaguuguggcagcucuccagaaguuggugauacuccaacaccgu

SEQ ID NO: 240968 - RNA, 65 nt, Homo Sapiens
cagcaagggcucagcugggaucugcgcccggccugcuccagaacgcagcccacucgccaccggug

SEQ ID NO: 240969 - RNA, 65 nt, Homo Sapiens
ggggguuugcuggggaacuggcgccaucgccgggacuccagaaccgcagaagccuccccagcuca

SEQ ID NO: 240970 - RNA, 65 nt, Homo Sapiens
ugcccugcccucuccucacaggucuguugcagggacuccagaaaccauucugggagccguggaug

SEQ ID NO: 240971 - RNA, 65 nt, Homo Sapiens
cugguucaugaugcauaaagcgcuaggcccuagaacuccagaaacagcacagcuggggcggggac

SEQ ID NO: 240972 - RNA, 65 nt, Homo Sapiens
ggccacagccacaccucaccgcccaguccagcugucuccagaaggggacaggcaguccgcggucu

SEQ ID NO: 240973 - RNA, 65 nt, Homo Sapiens
cuuuggccaccaguucuucggccagcaccucugcccuccagaaccugcagccuggaggggugagg

SEQ ID NO: 240974 - RNA, 65 nt, Homo Sapiens
cccagcccggagcccagcccccugccccggcccugcuccagaacccagcccagaucggaggacaa

SEQ ID NO: 240975 - RNA, 65 nt, Homo Sapiens
ucuagaacccaauccaauuuggagccccagcccaacuccagaacccaacccuucucuagaaucca

SEQ ID NO: 240976 - RNA, 65 nt, Homo Sapiens
cccggcugggucugcguccuuuccugugccuuucccuccagaaugcggccucagaccuagaagcu

SEQ ID NO: 240977 - RNA, 64 nt, Homo Sapiens
cugucccagcuagcaccugagagcugggccuccucuccagaaucauguggaggggccagaggcc

SEQ ID NO: 240978 - RNA, 65 nt, Homo Sapiens
uaauuuucucggaggugauaggcuuccacacaggucuccagaagcccugcauugaauauccaucc

SEQ ID NO: 240979 - RNA, 65 nt, Homo Sapiens
acuguuccagcaucuucccuggauggcuggaggaacuccagaaaauauccaucuucuuuuugugg

SEQ ID NO: 240980 - RNA, 65 nt, Homo Sapiens
agccagcuccacugcccaggcccccaagagggcagcuccagaagcugcccagggcuccgggaccc

SEQ ID NO: 240981 - RNA, 65 nt, Homo Sapiens
cucccuuaggggcugaggaagcugcccucgaaacccuccagaagacaucuguccugcagaggccc

SEQ ID NO: 240982 - RNA, 65 nt, Homo Sapiens
uauccuuauccaaaucaauaaagagagaauccucccuccagaaggguuucuaaaaacagcccuca

SEQ ID NO: 240983 - RNA, 65 nt, Homo Sapiens
agucuaggacagauuuuacguggagaguugaacuacuccagaaacuaaagaguaauguuucuaga

SEQ ID NO: 240984 - RNA, 65 nt, Homo Sapiens
cugugagaccuccuggaacacuggcaucucugagccuccagaagggguucugggccuaguugucc

SEQ ID NO: 240985 - RNA, 65 nt, Homo Sapiens
ggccccgccuggcacucagccuugccagagauuggcuccagaauuuuugccaggcuuacagaaca

SEQ ID NO: 240986 - RNA, 65 nt, Homo Sapiens
gagagagggucucucuccuagcugcuacccaggaccuccagaaggagcccuuggaccucugggag

SEQ ID NO: 240987 - RNA, 65 nt, Homo Sapiens
cauacuaagugcuuaguaaauguuagauaaguauucuccagaauugauguaaauuauuuuuaaac

SEQ ID NO: 240988 - RNA, 65 nt, Homo Sapiens
auguuauauaaauuccacauuuuuaugcaacuaaucuccagaacauuuuuccucuuaccaagaag

SEQ ID NO: 240989 - RNA, 65 nt, Homo Sapiens
uugcaagucuaggagagugucaggcguccuuucagcuccagaaugcuggaguggcacaggugacc

SEQ ID NO: 240990 - RNA, 65 nt, Homo Sapiens
cuugccugcuagggaccucgccaggagccucuccccuccagaagacacgcugggcuucacggcug

SEQ ID NO: 240991 - RNA, 65 nt, Homo Sapiens
ucaggcucucagugacccuuauacauggcucugcccuccagaacucuagagugaggcucugucca

SEQ ID NO: 240992 - RNA, 65 nt, Homo Sapiens
gugaggcaauaaauuucucuuauugcacuuccaggcuccagaacucaacccugucuccaccuuga

SEQ ID NO: 240993 - RNA, 65 nt, Homo Sapiens
ucucuccucaaaggaaagaauguuccuccccgggacuccagaauucuauggucacagggccgucc

SEQ ID NO: 240994 - RNA, 65 nt, Homo Sapiens
ugcaggcgccucugguucucgggcaggcgagaccccuccagaaucgaucucgggcugccagcgau

SEQ ID NO: 240995 - RNA, 65 nt, Homo Sapiens
accgugagaaccaggcauucguggaaaccauugcccuccagaacauagcggacgggggucccgag

SEQ ID NO: 240996 - RNA, 65 nt, Homo Sapiens
gcugggauuacaaaugugagucuaccugccucagccuccagaaguuaaacuucuaggcucaagca

SEQ ID NO: 240997 - RNA, 65 nt, Homo Sapiens
gagccagucaugcuaaaugcgugacagccuggugacuccagaauguuagucaaacucucauuuag

SEQ ID NO: 240998 - RNA, 65 nt, Homo Sapiens
ugccagguucuccccuugagucaguuuuuccaagacuccagaagggggccgggugucuuuaggga

SEQ ID NO: 240999 - RNA, 65 nt, Homo Sapiens
ggggcucugggagggauguugguccuccauuucaacuccagaagugaagguaacugagagcagau

SEQ ID NO: 241000 - RNA, 65 nt, Homo Sapiens
ugcauaaucagcgcccuggacgugccuuucucuggcuccagaauacacuccagaauccacaaagc

SEQ ID NO: 241001 - RNA, 65 nt, Homo Sapiens
cacaaagccgugccuuucucuuccaaguuccugcacuccagaaucccacccccuccagcuccagu

SEQ ID NO: 241002 - RNA, 65 nt, Homo Sapiens
agaagccagcuccuggaguugaggcacagggugcucuccagaacggcacaggaaaccaggcagag

SEQ ID NO: 241003 - RNA, 65 nt, Homo Sapiens
accaccccauauuaugauuauugugucagaaaauacuccagaacagggagaauuagagaauuuau

SEQ ID NO: 241004 - RNA, 65 nt, Homo Sapiens
cacaggagcugcccccagugaaggagacucagagacuccagaaggccagaucucauacucaacag

SEQ ID NO: 241005 - RNA, 65 nt, Homo Sapiens
uuccucaacacuugagggcccagaaagucugaucucuccagaaugaucagcccagaggaaugcug

SEQ ID NO: 241006 - RNA, 64 nt, Homo Sapiens
uuguaaauuaggaggcucaacaauaaaacauuaugcuccagaaauuaugugagaugugcuauau

SEQ ID NO: 241007 - RNA, 65 nt, Homo Sapiens
aaaucuguaagcaccuugaucuuggacuucucagccuccagaauugugagaaauaaauuucuguu

SEQ ID NO: 241008 - RNA, 65 nt, Homo Sapiens
cggagacaagcauggugcugcugcuucugcugcuucuccagaaaaucccugggacaccuuuguuc

SEQ ID NO: 241009 - RNA, 65 nt, Homo Sapiens
cucuuugcaggcguccaauccuagaaaccaauggucuccagaacucucacacaaguguuuuucug

SEQ ID NO: 241010 - RNA, 65 nt, Homo Sapiens
acugacuggcauccugcuuuccagugccugccagccuccagaagagccaggugccugacuaguac

SEQ ID NO: 241011 - RNA, 65 nt, Homo Sapiens
gcguuguuaguuuugaagaguggaggagcuaggggcuccagaaagaaucuuacacauguguugaa

SEQ ID NO: 241012 - RNA, 65 nt, Homo Sapiens
uccuuucaugugaaguuuuuaauauuguggaaucacuccagaagaaucuuaucccuugaauuuuc

SEQ ID NO: 241013 - RNA, 65 nt, Homo Sapiens
agcagcuagaaagagaaaaagcauuggguaagggacuccagaagcuggcccaacauacgcacugg

SEQ ID NO: 241014 - RNA, 65 nt, Homo Sapiens
ucauuccagauccagagaucacucaacggggacaacuccagaaggccuucuggccccaacccuug

SEQ ID NO: 241015 - RNA, 65 nt, Homo Sapiens
uugucuuacccuccggugugucugggucugugccucuccagaauccuccugugugccccuggcuu

SEQ ID NO: 241016 - RNA, 65 nt, Homo Sapiens
agguccagccuaggcccccuccauucugggaagggcuccagaagauugguggggggaccccaaag

SEQ ID NO: 241017 - RNA, 65 nt, Homo Sapiens
gccagaagugcaauuaaccugauacuguugacauccuccagaauggcacaagucuugcuaaaugu

SEQ ID NO: 241018 - RNA, 65 nt, Homo Sapiens
cugggaaaauaaaguccucuguugaacuucccagccuccagaacugcaccuacugauguuuugau

SEQ ID NO: 241019 - RNA, 65 nt, Homo Sapiens
cucuggcuagaggccagccccccaguccaaauguccuccagaagcgacuggcuagaguccucacu

SEQ ID NO: 241020 - RNA, 65 nt, Homo Sapiens
uucuagcucuggggucuggcaccccucuccucugucuccagaagcuuuggaaacauuuaauuuau

SEQ ID NO: 241021 - RNA, 65 nt, Homo Sapiens
gcugggauuacaggcguacauucuccugccucagccuccagaauacaucuccuggauucaaacaa

SEQ ID NO: 241022 - RNA, 65 nt, Homo Sapiens
cccuugaagggccuuugggaaucuccacucuccuucuccagaaccggauaccaugggaaggagcc

SEQ ID NO: 241023 - RNA, 65 nt, Homo Sapiens
aacaagaaagccaucucuucugcugcuugaaucugcuccagaauugcaaguguucaguaaauauu

SEQ ID NO: 241024 - RNA, 65 nt, Homo Sapiens
caugaugaacugugaucugcugucuuagccgcagucuccagaaccccaucuccuaccccacaucc

SEQ ID NO: 241025 - RNA, 63 nt, Homo Sapiens
ccuccucugauugcacacuggcauugucaccuccuccagaaagcacgagggaagggacucuga

SEQ ID NO: 241026 - RNA, 65 nt, Homo Sapiens
uuucuauaacagaagugacauguguacugauuuuucuccagaaauauggaugcuguuguauucag

SEQ ID NO: 241027 - RNA, 65 nt, Homo Sapiens
uuccuaggccuuuucaugcuucauuucuuccacuucuccagaaaauggaagcuaugaagcaacau

SEQ ID NO: 241028 - RNA, 65 nt, Homo Sapiens
ucuuccuccacacaggucgccgugagucaagcugccuccagaaccucagagcuucccuggugggc

SEQ ID NO: 241029 - RNA, 65 nt, Homo Sapiens
gcugaccgggcuguucuguagacucaggaccguggcuccagaacuccugugccaggcgggaggga

SEQ ID NO: 241030 - RNA, 65 nt, Homo Sapiens
gguccggccggagaggccucccgcggacgccgucucuccagaacuccgcuuccaagagggagccu

SEQ ID NO: 241031 - RNA, 65 nt, Homo Sapiens
ugcuauccugggagaucuaccugaaggagaacuaccuccagaaccgacaguuccagcaaaagcag

SEQ ID NO: 241032 - RNA, 65 nt, Homo Sapiens
ggcgcaucccacucuaugcgaaccacaagacccuccuccagaaggcagccgcugaguucggggcu

SEQ ID NO: 241033 - RNA, 65 nt, Homo Sapiens
gggggugcagggggcugugggcauccagcgucauccuccagaaccucacaucugaacugggggca

SEQ ID NO: 241034 - RNA, 65 nt, Homo Sapiens
gauaacaaaaucaaauaguacuugguagagacacgcuccagaaggcuagauugcuuugugaagcu

SEQ ID NO: 241035 - RNA, 65 nt, Homo Sapiens
gugagucaguaccuguuguuauucaaacuuuuggccuccagaacuggaagcacagcccugcuuga

SEQ ID NO: 241036 - RNA, 65 nt, Homo Sapiens
cugacuuaagagaguaagauuguugggacagccaucuccagaaacguagacaggcuggauuccag

SEQ ID NO: 241037 - RNA, 65 nt, Homo Sapiens
gcuggaaaggaugcugccagucagcugcugacugucuccagaaggaugcugguucccggaaugaa

SEQ ID NO: 241038 - RNA, 65 nt, Homo Sapiens
auguggaaacaaagcaggaccagcaggcacagcaccuccagaacagugccccggaugaccagagg

SEQ ID NO: 241039 - RNA, 65 nt, Homo Sapiens
gucugccuucuggcugacaauccuggaaaucuguucuccagaauccaggccaaaaaguucacagu

SEQ ID NO: 241040 - RNA, 65 nt, Homo Sapiens
auccauagggagcuggcuggggguuuccgugggagcuccagaacuuuccccagcugagugaagag

SEQ ID NO: 241041 - RNA, 65 nt, Homo Sapiens
caauaggacaauuugcugaggucugagaggacucccuccagaaaaucccugaucucuuaaaauuu

SEQ ID NO: 241042 - RNA, 65 nt, Homo Sapiens
aagcugcagccuacugaggaggcagaggccaccuccuccagaaagcccucggccugggccgccgc

SEQ ID NO: 241043 - RNA, 65 nt, Homo Sapiens
aaacugccuuucuuccccucaagucaacuuuugugcuccagaaaauuuucuauucuguaagucug

SEQ ID NO: 241044 - RNA, 65 nt, Homo Sapiens
ggaagauccugcggcuggggccgucugccuacacgcuccagaagggccagcgcagagcugggaug

SEQ ID NO: 241045 - RNA, 65 nt, Homo Sapiens
ucccgugacugcugccucaucgauaccccauuuagcuccagaaagcaaagaaaacucgaguaaca

SEQ ID NO: 241046 - RNA, 65 nt, Homo Sapiens
caggggcuauagcgaugggguuugaacucccuacucuccagaaucaucaccgaggcucccgugac

SEQ ID NO: 241047 - RNA, 65 nt, Homo Sapiens
gcagcuccacagggcagggcgacuggcacacuggccuccagaaggggucuccucugcagcucagg

SEQ ID NO: 241048 - RNA, 65 nt, Homo Sapiens
cccugcccugcgaguguguccaccuguacccacaccuccagaaugcugugccucccauuuccccu

SEQ ID NO: 241049 - RNA, 65 nt, Homo Sapiens
guuaaacuggcuuacuauagacuucguaaaaauggcuccagaagaguaacaaacugaaaucuuug

SEQ ID NO: 241050 - RNA, 65 nt, Homo Sapiens
auucugucuggggacgaaggguuggacgggaugaccuccagaagucccuucaauuucuaguaccu

SEQ ID NO: 241051 - RNA, 65 nt, Homo Sapiens
ccuuagccuccagguccagacuacuacucuauguucuccagaagggugcuaagucaccuacugaa

SEQ ID NO: 241052 - RNA, 65 nt, Homo Sapiens
cugccuaugaggcaucuggccccugguagccagcucuccagaauuacuuguagguaauuccucuc

SEQ ID NO: 241053 - RNA, 60 nt, Homo Sapiens
ggguauaccauauguauuagucccccagugcuccagaacagcgggagcacugugcugugc

SEQ ID NO: 241054 - RNA, 65 nt, Homo Sapiens
ggcaaggccagagacuucaagucuaucugaaaagucuccagaagucuaaccccagauaaauagcc

SEQ ID NO: 241055 - RNA, 65 nt, Homo Sapiens
cauccauaacauaguaaagacagggacauugccagcuccagaaaaggcuauuuuccaacugaagu

SEQ ID NO: 241056 - RNA, 65 nt, Homo Sapiens
auaguauuauagagucuuuuuuaugaguggaaauucuccagaaagcuauaaagaaucauuagaaa

SEQ ID NO: 241057 - RNA, 65 nt, Homo Sapiens
auuuuaagaaaauaacaaagacuugcaucagcugccuccagaacaagguuuuuuuaaaaaagagg

SEQ ID NO: 241058 - RNA, 65 nt, Homo Sapiens
uaagucccagugucugcugucuccacaauaaaauucuccagaaaaagcugcucuccuguauuauc

SEQ ID NO: 241059 - RNA, 65 nt, Homo Sapiens
uuuaaggggucuguuucucaugugacaccaguuugcuccagaaagaggagaaggguaguuugagg

SEQ ID NO: 241060 - RNA, 65 nt, Homo Sapiens
ucgagcagcacccaccuccagagaauucugagauccuccagaaagguucaguccuagcaagaagc

SEQ ID NO: 241061 - RNA, 65 nt, Homo Sapiens
cuuccuccaaggacagaaggaagagagggugaguccuccagaacuaggaagggaaggggggucag

SEQ ID NO: 241062 - RNA, 65 nt, Homo Sapiens
gaaaaaggucaagauuucuaucacuuccccgucuucuccagaacuugugucuccagaggaguacg

SEQ ID NO: 241063 - RNA, 66 nt, Homo Sapiens
uucucggccccgccaccugcccagcgugcccuggcucuccagaaccuucuaucccacagucaggcc

SEQ ID NO: 241064 - RNA, 66 nt, Homo Sapiens
augagaaagucuuaagcaaaauacucccaggucucacuccagaacauaaaaauggugugugaucaa

SEQ ID NO: 241065 - RNA, 66 nt, Homo Sapiens
ggaaaacccaguguccaucuuuccacccucccugaucuccagaaccuucgacugacccccuugucu

SEQ ID NO: 241066 - RNA, 66 nt, Homo Sapiens
uaggaccugcacgggacuuguggaugggccuggacucuccagaaacuacuugggcagagcaaagga

SEQ ID NO: 241067 - RNA, 66 nt, Homo Sapiens
ggacaacagaccaggaggggcccccaccugauggaccuccagaaaaacggaucacagccacuaugg

SEQ ID NO: 241068 - RNA, 66 nt, Homo Sapiens
ggauggggagggagugggccuggaucugggaccucccuccagaauuuccuccagaugggggcagug

SEQ ID NO: 241069 - RNA, 66 nt, Homo Sapiens
ggccuuccuggugcccaccaggcacuacggcuuccucuccagaauguggcuuugccugagcacaga

SEQ ID NO: 241070 - RNA, 66 nt, Homo Sapiens
aauauugaauaacuagaacacaagccacuguuucagcuccagaaaaaagaaagggcuuuaacguuu

SEQ ID NO: 241071 - RNA, 66 nt, Homo Sapiens
gucacagggauuccuccuuucccccccaaauauuaacuccagaaacuaggccugacuggggacacc

SEQ ID NO: 241072 - RNA, 66 nt, Homo Sapiens
cacagcacacaauuucaagccauuuucagaucagaacuccagaaguguugacaagaugccuauucg

SEQ ID NO: 241073 - RNA, 66 nt, Homo Sapiens
ggagaggauccuucaguucuggccauuccagggacccuccagaaacacaguguuucaagagacccu

SEQ ID NO: 241074 - RNA, 66 nt, Homo Sapiens
gugggguccccaucaucccagcugcucccaaauaaacuccagaagaggaaucugugggccugugag

SEQ ID NO: 241075 - RNA, 66 nt, Homo Sapiens
acaaaaucaccuauucacugcuuaugcagucggaagcuccagaagaacaaagagcccaauuaccag

SEQ ID NO: 241076 - RNA, 66 nt, Homo Sapiens
ccgacucugucguugccuugaucuugaacuuccagccuccagaacuaugagaaauaaaauucuguu

SEQ ID NO: 241077 - RNA, 66 nt, Homo Sapiens
uacaguugcaguauuucaaagucccuauccaggucacuccagaaaaggguauugaaacguugaaau

SEQ ID NO: 241078 - RNA, 66 nt, Homo Sapiens
gacugcugcauuuaggccaggucuccaauugcuuuccuccagaaaguguguucccgucuagugagg

SEQ ID NO: 241079 - RNA, 66 nt, Homo Sapiens
acacccaaacuccuggccuucugugguuucccuuugcuccagaaacacagaugugucuaaagacuu

SEQ ID NO: 241080 - RNA, 66 nt, Homo Sapiens
ugagaaacguacacuaucauugcuaaacuaacaguccuccagaaauuuaauaagauguuuuugauu

SEQ ID NO: 241081 - RNA, 66 nt, Homo Sapiens
uguuuaagugaccuccuucaucacauccugcaguaucuccagaagcagcacuaggguuugaguuuc

SEQ ID NO: 241082 - RNA, 66 nt, Homo Sapiens
ggcccacguguauuguccgggcucagaaugggaggacuccagaagaugagagaaaccucuuuaucc

SEQ ID NO: 241083 - RNA, 66 nt, Homo Sapiens
cuuuuagccuuaccaccuuuuaaaaaauuuguuauucuccagaaacaguaaauaggugaguagggg

SEQ ID NO: 241084 - RNA, 66 nt, Homo Sapiens
caacucagucagugauuuuuugaugcuucucuuauccuccagaauagagaccuaaggacacgugga

SEQ ID NO: 241085 - RNA, 66 nt, Homo Sapiens
aaccccuguccccagucagagauaacauccaacuaacuccagaagcggaagaggauauauuuaaca

SEQ ID NO: 241086 - RNA, 66 nt, Homo Sapiens
cucuggccuugguggccccaugauucuacaccaucucuccagaacugagggauggagcgggucucc

SEQ ID NO: 241087 - RNA, 66 nt, Homo Sapiens
gccaugccagcugggcucguacacuggccccucgcacuccagaaaaagucuccccccggggagagg

SEQ ID NO: 241088 - RNA, 66 nt, Homo Sapiens
ugcuguugccauagccccauagaaaagacccugagacuccagaaucgcccuguaacuuaucuagaa

SEQ ID NO: 241089 - RNA, 66 nt, Homo Sapiens
uacucccucaguaaagcauuguucccucacagguuucuccagaaaguggccuauccaguuuuccug

SEQ ID NO: 241090 - RNA, 66 nt, Homo Sapiens
caggugcuggcgcccguucuggccguguccugacaccuccagaacgggagcuuuugccacugacuc

SEQ ID NO: 241091 - RNA, 66 nt, Homo Sapiens
gugcaggaugugcauuagcauaaguuuauuauaauucuccagaaauaggccugcuucacuugcaga

SEQ ID NO: 241092 - RNA, 66 nt, Homo Sapiens
auauggcugggccaacucugccaggggauucagagucuccagaaagucuguugcccugagaguguc

SEQ ID NO: 241093 - RNA, 66 nt, Homo Sapiens
acccuuccucaucugugccuuaacucccuccucacacuccagaauugcugaacagugcucugccuc

SEQ ID NO: 241094 - RNA, 66 nt, Homo Sapiens
ugcugccuuuuuaaguuuuggaaggacuggccguggcuccagaaugcucaggggaagcugcuaggg

SEQ ID NO: 241095 - RNA, 66 nt, Homo Sapiens
accucaacaaugucaguggcucuuauuaacucccaucuccagaagcuggcgcacuuuccugaagcc

SEQ ID NO: 241096 - RNA, 66 nt, Homo Sapiens
cagugacucuugaacauggacugugcucccucugcccuccagaacucuguuggaaucagcaggccu

SEQ ID NO: 241097 - RNA, 66 nt, Homo Sapiens
cacccucuccccugcagucuccuccccacaccuggacuccagaauuagccuccaugagucaagccc

SEQ ID NO: 241098 - RNA, 66 nt, Homo Sapiens
cucccacccuggggccaacuggaaggaacaugaucccuccagaaguugaggacgggggguggggaa

SEQ ID NO: 241099 - RNA, 66 nt, Homo Sapiens
acugggaucacaggugucagauucuccugccuuugccuccagaagcugaaguccuggcuucaggca

SEQ ID NO: 241100 - RNA, 66 nt, Homo Sapiens
agcacagcucauggaggguguuuccuggacugcucucuccagaaacacugcauuuuccuacacccc

SEQ ID NO: 241101 - RNA, 66 nt, Homo Sapiens
cccacccugacagcccaacauuucaaagagaaaccccuccagaacucugcuuuccuagauccacac

SEQ ID NO: 241102 - RNA, 66 nt, Homo Sapiens
auccccaaucacccuaaucuuuguugaacauuccaacuccagaauguuuaccuaacaacaucacuu

SEQ ID NO: 241103 - RNA, 66 nt, Homo Sapiens
cagacaugauuucaacaugguuuacacuuuaacuuucuccagaacucaugucagucuuuguaauua

SEQ ID NO: 241104 - RNA, 66 nt, Homo Sapiens
ccaucacuguucuuuaaagcgaaagaaaggaaagaacuccagaaucucuguaucuuuggagaagga

SEQ ID NO: 241105 - RNA, 66 nt, Homo Sapiens
cucuacaauagaaaaaaaagucaugaauuuuaucuacuccagaaguauguauuuuuuuaagcaaca

SEQ ID NO: 241106 - RNA, 66 nt, Homo Sapiens
gugcaugcagaucagcuguuuuccugaaucacuggacuccagaaauagcaauggagagaagaccuc

SEQ ID NO: 241107 - RNA, 66 nt, Homo Sapiens
cagaggugacaaaugugagguccaggacucacugcccuccagaaaaaguauuaccaccagacugac

SEQ ID NO: 241108 - RNA, 66 nt, Homo Sapiens
agcaguugucccccaaauaccaucucauucucgccccuccagaagaaaagagcugcuggugaacuc

SEQ ID NO: 241109 - RNA, 66 nt, Homo Sapiens
cauaacccuucucuccacacccuuuucuccccacuccuccagaagguuccuuuucccuaaucauuc

SEQ ID NO: 241110 - RNA, 66 nt, Homo Sapiens
ugccagagugcacuggggggccaccugccucucuggcuccagaagcgcucuucucauaguguacac

SEQ ID NO: 241111 - RNA, 63 nt, Homo Sapiens; identical to SEQ ID NO: 240602

SEQ ID NO: 241112 - RNA, 66 nt, Homo Sapiens
aacuugggagaugauggugcaagaagcagagucauucuccagaaggaucaaaauagaagaccuugc

SEQ ID NO: 241113 - RNA, 66 nt, Homo Sapiens
guggagggcuguucgcccuucaauuaucucuagaaucuccagaaagcaaggaauuguacugugcua

SEQ ID NO: 241114 - RNA, 55 nt, Homo Sapiens; identical to SEQ ID NO: 240605

SEQ ID NO: 241115 - RNA, 66 nt, Homo Sapiens
gcauuuuauguaguucuaaaugcugaacaccaaaaucuccagaaauaguguuaucuucauaugaua

SEQ ID NO: 241116 - RNA, 66 nt, Homo Sapiens
acccucccaggcaucccauaaucuguaaauuuuugucuccagaaaauuuauguucucaugcccuca

SEQ ID NO: 241117 - RNA, 66 nt, Homo Sapiens
uaaucaaagaauuuucuguauauuuggcaggauguacuccagaauaggucagggaggacugggcac

SEQ ID NO: 241118 - RNA, 66 nt, Homo Sapiens
gccucuggacucaccuugagcugguacccaggcccacuccagaaugccaaaaggaguacccagggc

SEQ ID NO: 241119 - RNA, 66 nt, Homo Sapiens
guaaccaagugggaaaauaagcucagaggguacaagcuccagaacaccccccaaccccaucucaga

SEQ ID NO: 241120 - RNA, 66 nt, Homo Sapiens
cuaaaauuuaauuucuuuuuccagagaggggcugcucuccagaaagcaaagaaguguuugauggug

SEQ ID NO: 241121 - RNA, 66 nt, Homo Sapiens
ggccauucagcaagacaacaggaccggccaggccaccuccagaaacccgaggggcucaggaaaacg

SEQ ID NO: 241122 - RNA, 66 nt, Homo Sapiens
cacaaagagaagagggcuuguaugaucaugaauagacuccagaaucagccaagucuauaauauaau

SEQ ID NO: 241123 - RNA, 66 nt, Homo Sapiens
agagccuucccuacccugacgccucccagucaucaucuccagaacucccagcggggcucccugagc

SEQ ID NO: 241124 - RNA, 66 nt, Homo Sapiens
agaauauuagauuucugacuugcaaauauguuuguacuccagaagaauuagaggaaaagcagauac

SEQ ID NO: 241125 - RNA, 66 nt, Homo Sapiens
agugcugggauuacaagugugagccaccacaccuggcuccagaaauuuuauuuuauuuuuuugagg

SEQ ID NO: 241126 - RNA, 66 nt, Homo Sapiens
cacacuauguguguuguuuccauagcucuucacuuccuccagaagccuccuuacauuaaaaagccu

SEQ ID NO: 241127 - RNA, 66 nt, Homo Sapiens
gauuguaguaauuucuauuugcacugugccuuucaacuccagaaacauucugaagauguacuugga

SEQ ID NO: 241128 - RNA, 66 nt, Homo Sapiens
accuuaaucuagauaauaaaagcuuuuuggggcaaccuccagaacugugaaaaauaaauuuguuau

SEQ ID NO: 241129 - RNA, 66 nt, Homo Sapiens
agacgcuaaccgcccuucugcguuccauaaagguggcuccagaaagggcauccucuaccccaagcc

SEQ ID NO: 241130 - RNA, 66 nt, Homo Sapiens
gagcaucauacuggaaagcaaacaccuuuccuccagcuccagaauuccuugucucugaaugacucu

SEQ ID NO: 241131 - RNA, 66 nt, Homo Sapiens
ucugccuccucuucaacugaccagccuccaugcugccuccagaauggucuuucuaaugugugaauc

SEQ ID NO: 241132 - RNA, 66 nt, Homo Sapiens
augaaaccugacaaagagacuguaauauuguaguugcuccagaaugucaagggcagcuuacggaga

SEQ ID NO: 241133 - RNA, 66 nt, Homo Sapiens
gggaguguggucagucugccugcugcugugcgguagcuccagaaccaccucguuccugguuuuguu

SEQ ID NO: 241134 - RNA, 66 nt, Homo Sapiens
gaguuuguaagaacaaucauaaaaggacuuguuagucuccagaacaucugcuaaaaugcaaguaua

SEQ ID NO: 241135 - RNA, 66 nt, Homo Sapiens
aacaugaguuuaugggaaugccuuuucccucuggcacuccagaacaaaccucuauauguugcugaa

SEQ ID NO: 241136 - RNA, 66 nt, Homo Sapiens
gguaaauaccauauaugauccucgaaaugauaauaucuccagaauauuguuuucacccaaauuuga

SEQ ID NO: 241137 - RNA, 66 nt, Homo Sapiens
uguaccuauuuuugaggaccuugaaaaucuuaaucucuccagaagggauacugcauugguucuucu

SEQ ID NO: 241138 - RNA, 66 nt, Homo Sapiens
auauuugccuauauucucccuacaagaauauuuuugcuccagaaagacauguucuuuucucaaauu

SEQ ID NO: 241139 - RNA, 66 nt, Homo Sapiens
gaccauuugguuacccucgggauggccauccacugucuccagaaagagaccacuuagagggucucu

SEQ ID NO: 241140 - RNA, 66 nt, Homo Sapiens
guuuuaaaccuucaggaacaccaguuaggaaaauagcuccagaaaauauagauauauuuuauuuuu

SEQ ID NO: 241141 - RNA, 66 nt, Homo Sapiens
acggauauaaaggaagaauauuuccuuuauguguuucuccagaauggugccuguuucucucugugu

SEQ ID NO: 241142 - RNA, 66 nt, Homo Sapiens
cacagaagccacaccauuugcaccauccacgccuugcuccagaaggccuggccgccuucucccugg

SEQ ID NO: 241143 - RNA, 66 nt, Homo Sapiens
gaagguagccagugccugagucccccugucagcugccuccagaaggccagucagaucucaggcuug

SEQ ID NO: 241144 - RNA, 66 nt, Homo Sapiens
ugugccagacuuacagaaaaccuugccagagauuggcuccagaauuagaccucgccuagcacucug

SEQ ID NO: 241145 - RNA, 66 nt, Homo Sapiens
cuagcccagcagguuaaucugggcuaacaccuggaucuccagaaacauauaauugugaaggaguca

SEQ ID NO: 241146 - RNA, 66 nt, Homo Sapiens
cuggugguggacacagcuuuucuaauaaacagggaucuccagaacagccagcuccacucucugguu

SEQ ID NO: 241147 - RNA, 66 nt, Homo Sapiens
cuaauauccuaaaauacagacauuacagcuugaccucuccagaacaagcccaaugagggcgaauga

SEQ ID NO: 241148 - RNA, 57 nt, Homo Sapiens; identical to SEQ ID NO: 240639

SEQ ID NO: 241149 - RNA, 66 nt, Homo Sapiens
gaaagcuuggaaacuuacccccagcaauaaguuguucuccagaaaaaucuucacuuucaauuauau

SEQ ID NO: 241150 - RNA, 66 nt, Homo Sapiens
aucauuugaaacaucuuuuggcuuaccauggaagugcuccagaagaaccuugcuuucaaaaggacu

SEQ ID NO: 241151 - RNA, 66 nt, Homo Sapiens
gcaaccacauugaauucuugccaaaaugguaacugucuccagaacauggguuuuaguauauauagc

SEQ ID NO: 241152 - RNA, 66 nt, Homo Sapiens
cuacuacaauggccaaguacuaacugcccacaggcucuccagaaaauccauagccaucuacaauag

SEQ ID NO: 241153 - RNA, 66 nt, Homo Sapiens
uuguucgguuauguucaugucucuccauugcuacaucuccagaauaaaacagagagugaacagcac

SEQ ID NO: 241154 - RNA, 66 nt, Homo Sapiens
agagcauguucugcauguaucuggaucccccauccccuccagaauaggaggaaauaaagcccuguu

SEQ ID NO: 241155 - RNA, 66 nt, Homo Sapiens
caaauguuagacuacacauucagaucaguuaauuaacuccagaaaggacauaugcagugguucuua

SEQ ID NO: 241156 - RNA, 66 nt, Homo Sapiens
cuguucugaugggggagggcggucuucccacuuccucuccagaacuccagaaagagcagugugcuu

SEQ ID NO: 241157 - RNA, 66 nt, Homo Sapiens
augggggagggcggucuucccacuuccucuccagaacuccagaaagagcagugugcuuaugcuuca

SEQ ID NO: 241158 - RNA, 66 nt, Homo Sapiens
cagaaaacuucucuucugagccucuuuaacagcuuucuccagaaccagugucugaaccacccugga

SEQ ID NO: 241159 - RNA, 66 nt, Homo Sapiens
cauuaguaauaaggagaggguugggggugggcagggcuccagaaagucagcagugugccugggcac

SEQ ID NO: 241160 - RNA, 66 nt, Homo Sapiens
aauaaauguguauauuuaauguuuuauuguuagcuucuccagaaaauugaugcaaauucugguaau

SEQ ID NO: 241161 - RNA, 66 nt, Homo Sapiens
gaagcugcucucaggcacccccuucuucauugcucucuccagaaaggguugcuagccuuaacuuca

SEQ ID NO: 241162 - RNA, 66 nt, Homo Sapiens
ugguuauguuucugccuucggcgagagaacagcaagcuccagaaaguggcugcgccuucagccccg

SEQ ID NO: 241163 - RNA, 66 nt, Homo Sapiens
gggagcacaguagugcgggccugggcccugcuccaccuccagaaguggcuggauguacccugccug

SEQ ID NO: 241164 - RNA, 66 nt, Homo Sapiens
cauccugcgacccucacuggccuggccuugugggggcuccagaaaagaggcuaggagaggccagag

SEQ ID NO: 241165 - RNA, 66 nt, Homo Sapiens
cuucaaggcacagcccuuguugggagggagaacccucuccagaaacccugccaccauggugucuug

SEQ ID NO: 241166 - RNA, 66 nt, Homo Sapiens
acucugagcugccccuggcuuccuuuaaggaggcugcuccagaaggaaccuggguggggagggcga

SEQ ID NO: 241167 - RNA, 66 nt, Homo Sapiens
cacucuguaccccaaagagaguucucaugaaauauucuccagaauguauucauuaucaagaaaaug

SEQ ID NO: 241168 - RNA, 66 nt, Homo Sapiens
gugauucucuugaugccaccuucagauccuuuuauucuccagaauaauucuuaacagugguucaaa

SEQ ID NO: 241169 - RNA, 66 nt, Homo Sapiens
uucugagcccgucucccggacagguugaggaagcugcuccagaagcgccucggaaggggagcucuc

SEQ ID NO: 241170 - RNA, 66 nt, Homo Sapiens
ucagaaaauucuggaacuugaaaaaguaguaagggccuccagaauugacuuagcccuaguaauaaa

SEQ ID NO: 241171 - RNA, 66 nt, Homo Sapiens
uuuuuaaauuuuuuaauuaccuguuguaggguguuccuccagaagcaaagagcaaaauuuuacugu

SEQ ID NO: 241172 - RNA, 66 nt, Homo Sapiens
ugcaaacuucagucuggacuucuuuuugccagagaacuccagaaaccagucaggcucucagucagc

SEQ ID NO: 241173 - RNA, 66 nt, Homo Sapiens
uuuaguguagaugaaaauguccccuucacccacucccuccagaacagacauagcuucccuucccuc

SEQ ID NO: 241174 - RNA, 66 nt, Homo Sapiens
cguggccuuccagaacagucaacagacucccacugucuccagaaguugcagaaaaacacaaacaaa

SEQ ID NO: 241175 - RNA, 66 nt, Homo Sapiens
ucagcagaucugagccaccguccuguuccugugccacuccagaaccgacccagugucauuugcucc

SEQ ID NO: 241176 - RNA, 66 nt, Homo Sapiens
auguguguggcuucccuaccgccuaacugugcucugcuccagaaacggcaucugaauguuccagca

SEQ ID NO: 241177 - RNA, 66 nt, Homo Sapiens
cagcagagccuucuagggucaaguggagguuucagccuccagaagacugucacuuuaguuaugcua

SEQ ID NO: 241178 - RNA, 66 nt, Homo Sapiens
uuaccacaaaagcaaaauuuuuugcauuuaugauuucuccagaaaucaguauuuacaguauugagc

SEQ ID NO: 241179 - RNA, 66 nt, Homo Sapiens
accuggccgccagccccuucggaaucacugugaggucuccagaaggcacagcguuggucucuguuu

SEQ ID NO: 241180 - RNA, 66 nt, Homo Sapiens
cagcaguguuggaggggccuaguaagcuggaggcugcuccagaacucucuugucccucacugcccc

SEQ ID NO: 241181 - RNA, 66 nt, Homo Sapiens
accccagugccuuuugacaaguuccaaugcauuuggcuccagaaaguuuauuccuacuggagcuua

SEQ ID NO: 241182 - RNA, 66 nt, Homo Sapiens
acggguaucuccgcgugguggcacaguaaagcuggccuccagaaacguggggacccucuuccucua

SEQ ID NO: 241183 - RNA, 66 nt, Homo Sapiens
cuuguaaauaaaauaaauccaccagccgccauccuucuccagaauucauuauuucaccaagccaau

SEQ ID NO: 241184 - RNA, 56 nt, Homo Sapiens; identical to SEQ ID NO: 240675

SEQ ID NO: 241185 - RNA, 66 nt, Homo Sapiens
ccaaguauucguguaaauuaaaaguaacuaaaguagcuccagaaugggcagggcuuugaucauuca

SEQ ID NO: 241186 - RNA, 66 nt, Homo Sapiens
uagagcccaucaauauuuuuguucuacugcccgugucuccagaaugauuucaagcugaaaauaaua

SEQ ID NO: 241187 - RNA, 66 nt, Homo Sapiens
ggggagcagaguccgagcuuacuugccucuccccaucuccagaagaaaguaugacaacacauacac

SEQ ID NO: 241188 - RNA, 66 nt, Homo Sapiens
gacaauguccccuauucaggucuugugguucucuaacuccagaaagccagagcacagaccccagag

SEQ ID NO: 241189 - RNA, 66 nt, Homo Sapiens
uucauguuuaugaguauuaguguuuuaaauuucauacuccagaacuuaauuuauauccaaaauuug

SEQ ID NO: 241190 - RNA, 66 nt, Homo Sapiens
aaggcauuaaagaaaauagcugagauuuuagccuuucuccagaacuauguguuaaugucaauauga

SEQ ID NO: 241191 - RNA, 66 nt, Homo Sapiens
cugcuugcccccagagagccgugguucagguggggucuccagaaggcgcuguggucaccugaggau

SEQ ID NO: 241192 - RNA, 66 nt, Homo Sapiens
auacuggaagccaccucuggcuucuuggaagacccccuccagaagccaugacccuuaagugccacc

SEQ ID NO: 241193 - RNA, 66 nt, Homo Sapiens
auggcagagcagacaggccgugaaccagcaucaagucuccagaaacaauacaguaagagauagugu

SEQ ID NO: 241194 - RNA, 66 nt, Homo Sapiens
caccaaggaaaaagcagagauccucaaccugcuguccuccagaaaguggaacugacccuuccuuca

SEQ ID NO: 241195 - RNA, 66 nt, Homo Sapiens
gcuagacuaagaauuaggugaucuugaugacuccugcuccagaauccaaaucagcuuauauuuuuu

SEQ ID NO: 241196 - RNA, 66 nt, Homo Sapiens
gacuguccuauaaguuguacuucacccuccacaguacuccagaaagacuuacacuggaagcuuuga

SEQ ID NO: 241197 - RNA, 66 nt, Homo Sapiens
auuccagauuuguuuccuuuuggccuccugcaaagucuccagaagaaaauuugccaaucuuuccua

SEQ ID NO: 241198 - RNA, 66 nt, Homo Sapiens
cgaagauguuuacuacaaaagcaugccaaaccuaggcuccagaaaccacguccaucagcugcauac

SEQ ID NO: 241199 - RNA, 66 nt, Homo Sapiens
gauacuagcauugcacauauagucugcuuucuguuccuccagaauuugaguccuguuaauguagua

SEQ ID NO: 241200 - RNA, 66 nt, Homo Sapiens
uuucauucuucaacagugccuugcauguaacaagcacuccagaaauguuuguugaaugaaugaaug

SEQ ID NO: 241201 - RNA, 66 nt, Homo Sapiens
cucauggcuggagagcugaucagccaggcacagaaucuccagaacaaccuagagagugaaugcuaa

SEQ ID NO: 241202 - RNA, 66 nt, Homo Sapiens
caaaucuccuggcaccuugaucuuggauuuuacagccuccagaacugugagaaaauaaauuucugu

SEQ ID NO: 241203 - RNA, 66 nt, Homo Sapiens
uuuuaaugguacuuaguauuuugaucaaacuuuagucuccagaacuaaacaagucccuaaguuucc

SEQ ID NO: 241204 - RNA, 66 nt, Homo Sapiens
uuacaggaaguacuggagaaaauggacguguuaugacuccagaauuucccaaagcagugcaugcug

SEQ ID NO: 241205 - RNA, 66 nt, Homo Sapiens
uuuaauguuaccuuuuggcuugagaaugucuuucagcuccagaauuauuguuacucauauuuuaau

SEQ ID NO: 241206 - RNA, 52 nt, Homo Sapiens; identical to SEQ ID NO: 240697

SEQ ID NO: 241207 - RNA, 66 nt, Homo Sapiens
uugugaccacuauuguggguuguugggugcugguagcuccagaauuuuguauaguaauuuuguugu

SEQ ID NO: 241208 - RNA, 66 nt, Homo Sapiens
uaggguuaugugugucauucuagagcuucacagcuacuccagaaaaccuccaaccucacagccucg

SEQ ID NO: 241209 - RNA, 66 nt, Homo Sapiens
uguaacuguguuguuaugugauguccaugugcuagucuccagaacugcccauccaaagauguccag

SEQ ID NO: 241210 - RNA, 66 nt, Homo Sapiens
uuuuucugucagugaaaauacuaucuugauuguacucuccagaaaaauguuauuucuaauaauaca

SEQ ID NO: 241211 - RNA, 66 nt, Homo Sapiens
uugggauuaucgucuucuaauuacaucucauucaaucuccagaagagagucaaaagcuucagugag

SEQ ID NO: 241212 - RNA, 66 nt, Homo Sapiens
gacguaacuuagcauggaucuucaucuuauacugagcuccagaaaggacccagcucauggaauuuu

SEQ ID NO: 241213 - RNA, 66 nt, Homo Sapiens
ucuuuuauuuuccugucuucuuucuccugugguuugcuccagaauuaagguuuguuuuccauccau

SEQ ID NO: 241214 - RNA, 66 nt, Homo Sapiens
auucucccuuuugacacaguuguuucagaaagagcucuccagaagccaauauugagauguaauuca

SEQ ID NO: 241215 - RNA, 66 nt, Homo Sapiens
aguagaagaaaaaaaaucuuucagauaagagguguucuccagaauggaggaacuacuuggcaugua

SEQ ID NO: 241216 - RNA, 66 nt, Homo Sapiens
cugacuuaacuguaugugcaacagcaaugaaauuaacuccagaagccuuccaccugcgucacccag

SEQ ID NO: 241217 - RNA, 66 nt, Homo Sapiens
acuucaagcugcucaucuguuaguaagugauguucacuccagaacacauucaugaugagaacuuuc

SEQ ID NO: 241218 - RNA, 66 nt, Homo Sapiens
aguagaagaaaaaaaaucuuucagauaagagguguucuccagaauggaagaacgacuuggcaugua

SEQ ID NO: 241219 - RNA, 66 nt, Homo Sapiens
cccucacacugcugugcagccaucaccaccauucaucuccagaauuuguucucagucccaaacuga

SEQ ID NO: 241220 - RNA, 66 nt, Homo Sapiens
ccuucuauucauaaauguucuauacaguggacagcccuccagaaugguacuucagugccuagugua

SEQ ID NO: 241221 - RNA, 66 nt, Homo Sapiens
gcaaaauaaggaagagggcugagcugagcuucgguucuccagaauguaagaaaacaaaaucuaaaa

SEQ ID NO: 241222 - RNA, 66 nt, Homo Sapiens
ugccgaccaccagcaccauccucuccucccagcagccuccagaaccaugcccaggucuccugccuc

SEQ ID NO: 241223 - RNA, 66 nt, Homo Sapiens
cucugaccucaucaugguucuaguucucauacagaacuccagaauuuuuaaagaacucuauaauug

SEQ ID NO: 241224 - RNA, 66 nt, Homo Sapiens
auuuuacugaaucugucuacccuucauucaugagaacuccagaaugaguguugaccacugaagcau

SEQ ID NO: 241225 - RNA, 66 nt, Homo Sapiens
uucccacacuaagguaaguucagacuagauugaacacuccagaauuuuuuacuacagacuguuuuu

SEQ ID NO: 241226 - RNA, 66 nt, Homo Sapiens
ugcauccccauggagagacagcauugcuccccagcccuccagaaaccuugagcagauccagggauc

SEQ ID NO: 241227 - RNA, 66 nt, Homo Sapiens
gggcauugccgggguaggguggugucuucaccacagcuccagaaggcacuggugggauguggaguc

SEQ ID NO: 241228 - RNA, 66 nt, Homo Sapiens
aaggaaagaaucaaauuucuugcccggucacuggcacuccagaagacagcgugccggaaccggcag

SEQ ID NO: 241229 - RNA, 66 nt, Homo Sapiens
gcaacuuucauagucccaaagauaggcagagaacaucuccagaaaugugugugugugugugugugu

SEQ ID NO: 241230 - RNA, 66 nt, Homo Sapiens
ccccauuccccucugagcauagacucauggcguucccuccagaacuacagaagagccacagucucc

SEQ ID NO: 241231 - RNA, 66 nt, Homo Sapiens
gugcuuguggagggccugacaccuagucagacgaaacuccagaacacucgaaaagccagaggguuc

SEQ ID NO: 241232 - RNA, 66 nt, Homo Sapiens
ucugaaacacauucuugaagguuaauaaacagaaaucuccagaacccccauaauuuucuucaauga

SEQ ID NO: 241233 - RNA, 66 nt, Homo Sapiens
uagacuucagacccuuaaugguaauaccugguaauucuccagaagaacacuauauuacagaaugau

SEQ ID NO: 241234 - RNA, 66 nt, Homo Sapiens
aauaaucaucuguguggcaucuuaucaguugacucucuccagaauaguauuaauuguaaagccaag

SEQ ID NO: 241235 - RNA, 66 nt, Homo Sapiens
caguguggugcuguggaagggcccuggcuggaaagacuccagaaucgcacuguugcagcuuccucu

SEQ ID NO: 241236 - RNA, 66 nt, Homo Sapiens
gaagagaaugauggauauucggaaguguggguuugucuccagaacaccccucugugaggagcugug

SEQ ID NO: 241237 - RNA, 66 nt, Homo Sapiens
agcacuagggucccaggagagaagcugaggauagagcuccagaaaccuagucccugaggguggagg

SEQ ID NO: 241238 - RNA, 66 nt, Homo Sapiens
gggaggggggaaagagaccagccuuggucccuaagccuccagaaacgucuucuuaauccccaccuu

SEQ ID NO: 241239 - RNA, 66 nt, Homo Sapiens
ggggcauauuucugugcuguggaugacauggccuuacuccagaaucccaggcccuccacugugacu

SEQ ID NO: 241240 - RNA, 66 nt, Homo Sapiens
gaagugcuggcaaccacuaagaauucaaacuggggccuccagaacucacuggggccuacagcuuug

SEQ ID NO: 241241 - RNA, 66 nt, Homo Sapiens
ccuucagccuuaaauacaaaaauaaaacugaaacugcuccagaaagcagcuuucuccaaaaauguc

SEQ ID NO: 241242 - RNA, 66 nt, Homo Sapiens
ggugaagcccaaaagcucuuaaggagaauuguauuucuccagaagcugcagcaagagguacagcuc

SEQ ID NO: 241243 - RNA, 66 nt, Homo Sapiens
agaauuauucaauuucaugaauaacucuuguuugcacuccagaaaacaacauacauguuuaaauac

SEQ ID NO: 241244 - RNA, 66 nt, Homo Sapiens
aaaaucuuuuagaauuuuuuuggagguguuuguuuucuccagaauaaagguauuacuuuagaauag

SEQ ID NO: 241245 - RNA, 66 nt, Homo Sapiens
cuaguggcuguguagcauccucagugcaaaacccagcuccagaauuuucaccugguaacgaauuuc

SEQ ID NO: 241246 - RNA, 66 nt, Homo Sapiens
acuaaaaugcagcuguuguuagacaacuguugaaaacuccagaaauacaucacccaagguggcagu

SEQ ID NO: 241247 - RNA, 66 nt, Homo Sapiens
aaaacccaggccuugacauuguuauucaaauggccccuccagaaaguuuaaugauuuccauuugua

SEQ ID NO: 241248 - RNA, 66 nt, Homo Sapiens
agcgugaaaccuuggcacaggacugaggauccucuccuccagaaaagcccccucgaggaaauaaau

SEQ ID NO: 241249 - RNA, 66 nt, Homo Sapiens
gggaggugucuacugaaaagggaaccugcuucuuuacuccagaacgcuguucuuuaaagaccaaga

SEQ ID NO: 241250 - RNA, 55 nt, Homo Sapiens; identical to SEQ ID NO: 240741

SEQ ID NO: 241251 - RNA, 66 nt, Homo Sapiens
gcucagggccuuccccacagcucuugccacuccuagcuccagaaggggucaaauacuugacuccca

SEQ ID NO: 241252 - RNA, 66 nt, Homo Sapiens
uaagacaggccacaggagggggcaggcccaguccuccuccagaaaagguuuaagaugcuaggauga

SEQ ID NO: 241253 - RNA, 66 nt, Homo Sapiens
uucugggauaacauuuggagcuccccuucucccugccuccagaaugcucagacucugauuagcugc

SEQ ID NO: 241254 - RNA, 66 nt, Homo Sapiens
auuaaccaccccucucuagugaaauuccacagcugccuccagaaacaggagagggggagcaaacag

SEQ ID NO: 241255 - RNA, 66 nt, Homo Sapiens
accccgacggggggccuuaucucccugggaggcaggcuccagaagccccgccagcuccucagccug

SEQ ID NO: 241256 - RNA, 66 nt, Homo Sapiens
cucugaccccauuuguuuuucugcccugccacaugacuccagaaguucagugcuacaggaguacau

SEQ ID NO: 241257 - RNA, 66 nt, Homo Sapiens
ccuuuggaaauggugaaggaccuguuccugcaaggucuccagaacccucuuggcuaaggugcuguu

SEQ ID NO: 241258 - RNA, 66 nt, Homo Sapiens
uucuauuaccuuuaaaaaagcacagaggauagcaagcuccagaaggucugucucaaauaauuauuu

SEQ ID NO: 241259 - RNA, 66 nt, Homo Sapiens
guaaugguggcagaacccacacugcgcagcaggcaccuccagaaaguuagagcgagagcagagcaa

SEQ ID NO: 241260 - RNA, 66 nt, Homo Sapiens
ggaguuuucugugagaauaaucauauugaggggcaacuccagaaguggcuuuuacuuccgguuucu

SEQ ID NO: 241261 - RNA, 66 nt, Homo Sapiens
auuaauaaaacaaaacaaaagggguagggacugggacuccagaaccuuacuaaagcaaaauuucca

SEQ ID NO: 241262 - RNA, 66 nt, Homo Sapiens
aacuugauucaucgcugcaaaguauuccccaauggacuccagaagaagccuucuagcugaaaaacg

SEQ ID NO: 241263 - RNA, 66 nt, Homo Sapiens
ccuagaaacaucucaucauuuaaaagagcauaucuucuccagaagucauccagggcaaggacagac

SEQ ID NO: 241264 - RNA, 66 nt, Homo Sapiens
agaaacuguuucuccaggcgcugcugcugagauggacuccagaagaaugaaugugggagaaaaucg

SEQ ID NO: 241265 - RNA, 66 nt, Homo Sapiens
uaguacgcuuuauuuuuagaaaauauuugaaaaacacuccagaauccauaaguggcaaauauuuua

SEQ ID NO: 241266 - RNA, 66 nt, Homo Sapiens
auagaagcucagccuggccucaggcacggcucauuccuccagaauucuuccccguguggcccaccc

SEQ ID NO: 241267 - RNA, 66 nt, Homo Sapiens
gcagagccaccauuuuuuauaauuucuaauaaccaacuccagaacuaggagcugaucaacucuuug

SEQ ID NO: 241268 - RNA, 66 nt, Homo Sapiens
ggagauguuggcaccuuugaauucuacauccuguuucuccagaaugagaauuuguguacaaagaua

SEQ ID NO: 241269 - RNA, 66 nt, Homo Sapiens
aguauaccuuauaacacugagccacuucuccccacccuccagaagggguccacguugaauucugaa

SEQ ID NO: 241270 - RNA, 66 nt, Homo Sapiens
aagcauugcauugugggaaucacaaagcaaauaguacuccagaaagacaaauaucagaagcuuccu

SEQ ID NO: 241271 - RNA, 66 nt, Homo Sapiens
guuuuuagacuguuagacaaaagugcucacgugcagcuccagaauauggaaacagagcaaaagaac

SEQ ID NO: 241272 - RNA, 66 nt, Homo Sapiens
gccccgccuuccccaaagcagaggggcugucugugucuccagaaaggggacaucgggggggagggg

SEQ ID NO: 241273 - RNA, 66 nt, Homo Sapiens
ucugaguuugggcugcaagugcucacagcucuuguucuccagaaacuggagaauugcccucaggag

SEQ ID NO: 241274 - RNA, 66 nt, Homo Sapiens
auauuucuacccaugcaacggaagaaaaacccauuacuccagaagaguauaucuaaguaacuaaaa

SEQ ID NO: 241275 - RNA, 66 nt, Homo Sapiens
uucccuugaugaagaaguugauaugccuuuucccaacuccagaaagugacaagcucacagaccuuu

SEQ ID NO: 241276 - RNA, 66 nt, Homo Sapiens
cauuugugucgguuaaaaauucgaaggcuuaugggucuccagaaacucugccagccagccucagug

SEQ ID NO: 241277 - RNA, 66 nt, Homo Sapiens
gccucccaaauaacuauuuucuuaucugcaguauuccuccagaagagcuaaccagggcagggcugg

SEQ ID NO: 241278 - RNA, 66 nt, Homo Sapiens
cugcccuuccaacgcaucacccgccucaaacugcugcuccagaacauucugaagagaacacagccu

SEQ ID NO: 241279 - RNA, 66 nt, Homo Sapiens
uugggcuaagguauaaaucaacacacugcuuccuuccuccagaaggucuuacugugaaggaaaaaa

SEQ ID NO: 241280 - RNA, 66 nt, Homo Sapiens
uuaggcuuuuguauuuuuuacucuagucaguuuugucuccagaaccacaacuuggcuacacauaga

SEQ ID NO: 241281 - RNA, 66 nt, Homo Sapiens
gcagaucccucagcaggaacucugcaguauuuguaccuccagaaugaguccugcggugauauucua

SEQ ID NO: 241282 - RNA, 66 nt, Homo Sapiens
cacuuugagauacuuaaagauguaguaaaaagauuucuccagaaaauggaauaucaaguauaauga

SEQ ID NO: 241283 - RNA, 66 nt, Homo Sapiens
cuucuggcugauuguuccgauuugugcuuccucuuucuccagaagcggguaguucuguucuguggg

SEQ ID NO: 241284 - RNA, 66 nt, Homo Sapiens
augaacugcaguggagaugagagcuuuuggacagcucuccagaagcgccucaaaccagcccaaccc

SEQ ID NO: 241285 - RNA, 66 nt, Homo Sapiens
ucuggacggagcugcuggcacaggcagcagucucugcuccagaauccaagauucaucugugaccuc

SEQ ID NO: 241286 - RNA, 66 nt, Homo Sapiens
uacuauccaucuugaugagaaauguauaguuugacucuccagaaugauguuucuuuucuauagaga

SEQ ID NO: 241287 - RNA, 66 nt, Homo Sapiens
gugagaaauacauaccugcuacccuuggacuucagccuccagaacuaaggcccucaccagaaccca

SEQ ID NO: 241288 - RNA, 66 nt, Homo Sapiens
ccuucagcucuugccuugccggacuggacccuccuucuccagaaggcuggaucaggguggggacaa

SEQ ID NO: 241289 - RNA, 66 nt, Homo Sapiens
augcuugugagaaucauuaaaaauaguguucuuuuucuccagaaaagucaauauaaauucuacaga

SEQ ID NO: 241290 - RNA, 66 nt, Homo Sapiens
gaccucuccaaccaccacacuccccgccguacaguucuccagaaucccaggcgaugacaagucuga

SEQ ID NO: 241291 - RNA, 66 nt, Homo Sapiens
ggcucccaggggccggccuccucugccugguaaugacuccagaacaacaacugggaagaaacuuga

SEQ ID NO: 241292 - RNA, 66 nt, Homo Sapiens
uagaaggaagcauggcccugacuucagaauuccagacuccagaacuggaagaauaaaugucuguug

SEQ ID NO: 241293 - RNA, 66 nt, Homo Sapiens
uccugcauugaauugaauaugaauuucucuaacucucuccagaaaauggauggagauaacuugucu

SEQ ID NO: 241294 - RNA, 66 nt, Homo Sapiens
augugagauucuuuagccacuuuggggagccugucucuccagaagccuuucuuaguggugcccaca

SEQ ID NO: 241295 - RNA, 66 nt, Homo Sapiens
ccuuaaaaugcacggcuaaacuauucagaguuaacacuccagaauuguuaaauuacaaguacuaug

SEQ ID NO: 241296 - RNA, 66 nt, Homo Sapiens
cacugagcgccugcagaucccgcaggcuucguuugccuccagaaccuucccgucugauuguuccuc

SEQ ID NO: 241297 - RNA, 66 nt, Homo Sapiens
uuaaccuuucuaaaaguuuucaucgccuugguaaagcuccagaaauggacaaugcuagugacugca

SEQ ID NO: 241298 - RNA, 66 nt, Homo Sapiens
cauauugcccggugaugaaacuuccucacuucaugccuccagaaagaacaucggcuucucagaugg

SEQ ID NO: 241299 - RNA, 66 nt, Homo Sapiens
gaugcagagagcuguggggcuggguagcuuggcugccuccagaagaccccucugggccaaagccca

SEQ ID NO: 241300 - RNA, 66 nt, Homo Sapiens
augaaaagcaauacaacuuuaggagagagggcacaucuccagaaaagugauagggauccugguggg

SEQ ID NO: 241301 - RNA, 66 nt, Homo Sapiens
gaaggggguggggauuuucugcuuuagauacgaaaucuccagaaugacuucauccucgccucucag

SEQ ID NO: 241302 - RNA, 66 nt, Homo Sapiens
ugacgacugggccaugugacgcugugacacucuacccuccagaaccgagucccaugggauuccccg

SEQ ID NO: 241303 - RNA, 66 nt, Homo Sapiens
ugcucuccacuugcuuuagggcucaaaugucaccuucuccagaagcuuauuuuucuugaagaggca

SEQ ID NO: 241304 - RNA, 66 nt, Homo Sapiens
uagcaauuuccgccuggugaucgcaucagcgccggccuccagaacuagauccagcaggccccaguc

SEQ ID NO: 241305 - RNA, 66 nt, Homo Sapiens
uuuuaaggcuacauuuuggaucauuuaucugagucucuccagaagugagaggagaggagggggagg

SEQ ID NO: 241306 - RNA, 66 nt, Homo Sapiens
aagcacuuagcgugcuguuccagugucacaaaauaacuccagaaaggaagcuuuucuuuggcgauu

SEQ ID NO: 241307 - RNA, 66 nt, Homo Sapiens
uucacuuuaaacuuuuauuaccacaguugcugccuccuccagaauuuuugaauuuuaauaaaaggc

SEQ ID NO: 241308 - RNA, 66 nt, Homo Sapiens
caacauugcgagaguagcuauuuugaaagaauaauucuccagaaguuaacaucuaauaucuaguau

SEQ ID NO: 241309 - RNA, 66 nt, Homo Sapiens
acaaaaucaccagcaccuugaucuuugacuucuaaucuccagaauagugagaaauaaauuucuguu

SEQ ID NO: 241310 - RNA, 66 nt, Homo Sapiens
guguucuuugccaccagccugucacuccaguggcagcuccagaaacggaggcuguugcuuuuaucc

SEQ ID NO: 241311 - RNA, 66 nt, Homo Sapiens
cacuacugcuucugucccugcuggcagccucugucccuccagaacggcuaaccagagcacacuguc

SEQ ID NO: 241312 - RNA, 57 nt, Homo Sapiens; identical to SEQ ID NO: 240803

SEQ ID NO: 241313 - RNA, 66 nt, Homo Sapiens
uuuuaauccuugcuuugguuuggaacugccuucgggcuccagaacuuaaauugcuugguccguggc

SEQ ID NO: 241314 - RNA, 66 nt, Homo Sapiens
ggggugggcugggccgcuggagccuccgccugcuuccuccagaagacacgaaucaugacucacgau

SEQ ID NO: 241315 - RNA, 66 nt, Homo Sapiens
aaucaguguuaguccucuguguucuucuccauguuucuccagaauuucccugcuaagcaguuuaua

SEQ ID NO: 241316 - RNA, 66 nt, Homo Sapiens
cugcucucagcaauugcaguguuccccuggaucauacuccagaauugcucagugguguggggaaac

SEQ ID NO: 241317 - RNA, 63 nt, Homo Sapiens; identical to SEQ ID NO: 240808

SEQ ID NO: 241318 - RNA, 66 nt, Homo Sapiens
ucccaacucgucugccguccccgccccaauuccaagcuccagaaacgacuucuuggaccuccuccc

SEQ ID NO: 241319 - RNA, 66 nt, Homo Sapiens
ugcaagagcuucuuagcaguuccacaucacagcucccuccagaagcuccccaccgauuucagcgug

SEQ ID NO: 241320 - RNA, 66 nt, Homo Sapiens
cccacccaagaaaauaauagcuuucagcuccccaugcuccagaauaacagcaguuuccuugcaaca

SEQ ID NO: 241321 - RNA, 66 nt, Homo Sapiens
auucuauagugugccagagcugguuuggauuuguaacuccagaaacggaugcucuaauuggcuggu

SEQ ID NO: 241322 - RNA, 53 nt, Homo Sapiens; identical to SEQ ID NO: 240813

SEQ ID NO: 241323 - RNA, 66 nt, Homo Sapiens
accccggcccccugcccguuuacaaguucuuggucccuccagaaccauguaguuguucguugguua

SEQ ID NO: 241324 - RNA, 66 nt, Homo Sapiens
uguagucugucuucaacuauuuuauccaaaauaaaccuccagaagaaaguaguuuucauuuacuua

SEQ ID NO: 241325 - RNA, 66 nt, Homo Sapiens
uaggagaccuaucgucuuggaacuugccauucuuuccuccagaacaaaauguuaacuuucuaacac

SEQ ID NO: 241326 - RNA, 66 nt, Homo Sapiens
cgcacagacagguuuucacauaaaugcagcccauuucuccagaacccauuugaggggugggggggu

SEQ ID NO: 241327 - RNA, 63 nt, Homo Sapiens; identical to SEQ ID NO: 240818

SEQ ID NO: 241328 - RNA, 66 nt, Homo Sapiens
uuaaggcugcuugguacugaguauacuuaaauauaacuccagaauccagggacuugguguuaaaac

SEQ ID NO: 241329 - RNA, 66 nt, Homo Sapiens
auuacgccucaacauauacuugugcucuuccuuugccuccagaagaaguuuuuccuugauugugcu

SEQ ID NO: 241330 - RNA, 66 nt, Homo Sapiens
agacugccuccaccacaggcauccugcaaaugcagacuccagaauccccagcaucagcgggaacca

SEQ ID NO: 241331 - RNA, 66 nt, Homo Sapiens
gugagaaauaaauguguuuuucuuggaccucccagccuccagaacucaugucugcuggcaccuuga

SEQ ID NO: 241332 - RNA, 66 nt, Homo Sapiens
auuuuguuugcuuugacccucagggcuacacugaaccuccagaaucgucauacaacauacuuaaug

SEQ ID NO: 241333 - RNA, 66 nt, Homo Sapiens
gccguagcaguuugacgauagggaauauaaauuucgcuccagaaagcauucuuucacauggcuacu

SEQ ID NO: 241334 - RNA, 66 nt, Homo Sapiens
gcacaggaacgaaauaccucuuucaaaagaugaaaacuccagaaacgggcucuuaugagucauuuu

SEQ ID NO: 241335 - RNA, 66 nt, Homo Sapiens
aguccguuauuugggaaagugugaauauuagguuuccuccagaaauuguuauugguaaucuuuucu

SEQ ID NO: 241336 - RNA, 66 nt, Homo Sapiens
aagaagcccuuuacauuuccccuguccacaaggcaacuccagaagauggccuggguugucucaaau

SEQ ID NO: 241337 - RNA, 66 nt, Homo Sapiens
guaucuggucagguugacccguuuaagaaugcauuccuccagaagaacaaaguugcaggcacaaca

SEQ ID NO: 241338 - RNA, 52 nt, Homo Sapiens; identical to SEQ ID NO: 240829

SEQ ID NO: 241339 - RNA, 66 nt, Homo Sapiens
gccauucucccaaacuaaugcuaucccaguuuagggcuccagaaaacauuaugaggcucugauuuc

SEQ ID NO: 241340 - RNA, 66 nt, Homo Sapiens
ccccacccaggccaggcaugugcccugagccagggucuccagaaagccccuuucacaggcagccag

SEQ ID NO: 241341 - RNA, 66 nt, Homo Sapiens
ucagguaugccucaccaauuucacgcauuuguauaucuccagaaauauuugcauaugaugccagcc

SEQ ID NO: 241342 - RNA, 66 nt, Homo Sapiens
aaauuccuaaagcuuuuaggugaccuuagagcaagacuccagaaugguguucugugguuucuuagg

SEQ ID NO: 241343 - RNA, 66 nt, Homo Sapiens
caauaaaguguaauauuucugaggguagauuagcugcuccagaauucuugucauuggucaauaggg

SEQ ID NO: 241344 - RNA, 66 nt, Homo Sapiens
ccagccggcuucccccaaggcauuucagaggggacccuccagaagcuuguguuuuucaauuguuga

SEQ ID NO: 241345 - RNA, 66 nt, Homo Sapiens
gguggaggugguguucuauaccuaaaggaugaccugcuccagaaacagcaccagcacagcauguau

SEQ ID NO: 241346 - RNA, 66 nt, Homo Sapiens
caauucacacaugacuaccuuugagcuaaugacugucuccagaaaauaacugugccccaagaagug

SEQ ID NO: 241347 - RNA, 66 nt, Homo Sapiens
uaaauaugccagguagacaccagcccaaguacccuccuccagaagucugugacuaccuugucacua

SEQ ID NO: 241348 - RNA, 66 nt, Homo Sapiens
acacugaaaauguuuuguuagcuuuuccuucuuucucuccagaagaaacauggauagaugauagcu

SEQ ID NO: 241349 - RNA, 66 nt, Homo Sapiens
ugccugcucuaauuucuuuugcccauauaugaguaucuccagaaugucuacaaauaguuuuuguag

SEQ ID NO: 241350 - RNA, 66 nt, Homo Sapiens
gagguuugaggccaccaaaagaucaacagacaaaugcuccagaaaucuaugcugacugugacacaa

SEQ ID NO: 241351 - RNA, 66 nt, Homo Sapiens
aggccaucucgggcacaggcccaccccgccccaccccuccagaacacggcucacgcuuaccucaac

SEQ ID NO: 241352 - RNA, 66 nt, Homo Sapiens
uuccuauaaaguuaaacauacacuuuuacuuuaggacuccagaauuccacuucuaguuauuuauuc

SEQ ID NO: 241353 - RNA, 66 nt, Homo Sapiens
augaccagaauucuucuguaauucugcccaugacuccuccagaauuuuaguagauacagggugggu

SEQ ID NO: 241354 - RNA, 66 nt, Homo Sapiens
uuuguuuuauccaugaggaagauuuuuaacaaaagccuccagaagauuuccccucaguuuccauug

SEQ ID NO: 241355 - RNA, 66 nt, Homo Sapiens
aaaaagauauggugaaggcagaacugcucacaccagcuccagaagcacguccucugacuucacugc

SEQ ID NO: 241356 - RNA, 66 nt, Homo Sapiens
cuggagcagcccaccuagagcccagucuaaugagaacuccagaaagcuggagcagcccgccuagaa

SEQ ID NO: 241357 - RNA, 66 nt, Homo Sapiens
guguguuucccugaugcggggccuucagccuccucacuccagaaacucagcucuccucugggcccu

SEQ ID NO: 241358 - RNA, 66 nt, Homo Sapiens
ggacagccacggccaagugggcugcagccacagcuccuccagaaagggacuaagucacagggaucu

SEQ ID NO: 241359 - RNA, 66 nt, Homo Sapiens
ucaccagagagcuuucagcuaguuaggcauggggagcuccagaaggccaaaaggcagaugacgggg

SEQ ID NO: 241360 - RNA, 66 nt, Homo Sapiens
ccaggagucgacaguuuuggggggaauucagccacacuccagaaaguuuuuugggggcgggggggu

SEQ ID NO: 241361 - RNA, 66 nt, Homo Sapiens
agugcaauucagaaggcagcgaagaauuaacuucuccuccagaacagaggacucccugacaaaagu

SEQ ID NO: 241362 - RNA, 66 nt, Homo Sapiens
aagaaucucaaccuggagggcugacccccuuccuaccuccagaauaacccuucccaccugagcaug

SEQ ID NO: 241363 - RNA, 66 nt, Homo Sapiens
ccgccuguccuuccagcaugcuccagacaaaaggaucuccagaaaggaaagccagcagcuguggua

SEQ ID NO: 241364 - RNA, 66 nt, Homo Sapiens
uggaaauccuaguuuccucuaauaacuucaguccugcuccagaauuaauccaagcucccugcccca

SEQ ID NO: 241365 - RNA, 66 nt, Homo Sapiens
ucugcccaggaggcaggggacagacacacuagugcucuccagaauccuacagaguuccuucucacc

SEQ ID NO: 241366 - RNA, 66 nt, Homo Sapiens
ugcuccuuuacccucuugguggccucugccuggggccuccagaagcgccagucacugcugcaaggu

SEQ ID NO: 241367 - RNA, 66 nt, Homo Sapiens
gcagaaagcgggugcuguagugcuccucccaacaaacuccagaacaccugccggaagggagccccc

SEQ ID NO: 241368 - RNA, 66 nt, Homo Sapiens
cugcuguggacugcaucaggggauugcgucuggggccuccagaacuuggaagaccaagacaccugg

SEQ ID NO: 241369 - RNA, 66 nt, Homo Sapiens
ccagccagaagccugauuggauggugcuuaaugaaucuccagaaugguguggccuggaguauuuau

SEQ ID NO: 241370 - RNA, 66 nt, Homo Sapiens
gaaagaccuuacuucauuucauaguagaauuuauuacuccagaacaauuuucagaauaauuauugc

SEQ ID NO: 241371 - RNA, 66 nt, Homo Sapiens
cucuccucuucaucucagcauucuccaucacuuccccuccagaaaaacggauggaaggaagcccuc

SEQ ID NO: 241372 - RNA, 66 nt, Homo Sapiens
uccccaaggagcuucagggcaguccuucuggcacugcuccagaauuccuccuucuuggugugucug

SEQ ID NO: 241373 - RNA, 66 nt, Homo Sapiens
acccuagauacuguguuaugugcaacuguagaaacccuccagaaauuuccacugcuguucuucacu

SEQ ID NO: 241374 - RNA, 50 nt, Homo Sapiens; identical to SEQ ID NO: 240865

SEQ ID NO: 241375 - RNA, 66 nt, Homo Sapiens
cccaccacacagacucugggccuccccgcaaaauggcuccagaauuagaguaauuaugagauggug

SEQ ID NO: 241376 - RNA, 66 nt, Homo Sapiens
aucaaauggcaacauggaauauuguccuccaugccccuccagaaggaccuaggagaguaggugagc

SEQ ID NO: 241377 - RNA, 66 nt, Homo Sapiens
aacaaggcgucgaggaauuggaaagauuugcacacccuccagaaaggagagacgcaaucuccccuc

SEQ ID NO: 241378 - RNA, 66 nt, Homo Sapiens
uauaaugcuuauuaugaguuuaagaagcaguucuuccuccagaaagaagggggcgauagcaugcag

SEQ ID NO: 241379 - RNA, 66 nt, Homo Sapiens
gagccgcagcccuggggccaguaggaagcggacccgcuccagaaguccccacgagaagaagaagaa

SEQ ID NO: 241380 - RNA, 66 nt, Homo Sapiens
agggacuguguugacugacgagccgagggguggccgcuccagaagggugcccagucaggccgcacc

SEQ ID NO: 241381 - RNA, 66 nt, Homo Sapiens
uagaccuuugcuuaugcaaaaccucugaaggguuggcuccagaacuacccaucauucauucucaag

SEQ ID NO: 241382 - RNA, 66 nt, Homo Sapiens
ccucgucugggaauucgagagcagagguucucugcccuccagaagcaucagcagauacaugucagu

SEQ ID NO: 241383 - RNA, 66 nt, Homo Sapiens
uguucaauaaaaugcuuuuauuuugguucuaacuaccuccagaaugcaccccaaucccaaauuuug

SEQ ID NO: 241384 - RNA, 66 nt, Homo Sapiens
uagaagccugucucuguaccaacccagacucucccacuccagaaugccaccaccaccgacucuccc

SEQ ID NO: 241385 - RNA, 66 nt, Homo Sapiens
auuggggucacauaugucccugaccaggagugucaucuccagaauucccauggacagagaagaaaa

SEQ ID NO: 241386 - RNA, 66 nt, Homo Sapiens
cuuuuuuccuuuuuacaaacaccauugcuuuccauucuccagaacucagucuucccaacuucuuac

SEQ ID NO: 241387 - RNA, 66 nt, Homo Sapiens
gacuggucaugaagcucaugucugaacuccugcacucuccagaaguagcaaaaggggcugggacac

SEQ ID NO: 241388 - RNA, 66 nt, Homo Sapiens
cuauccacuguauuuccacaauaaagguggcuucugcuccagaacuuuuacucucuauuauugggc

SEQ ID NO: 241389 - RNA, 66 nt, Homo Sapiens
gucuaaaugcugaaaaaacauguaccauuugcauggcuccagaaauagcacgugucucagacugca

SEQ ID NO: 241390 - RNA, 66 nt, Homo Sapiens
cauccugucaaucacucuguacauuucugccauguacuccagaacuucucugggagacuucucugu

SEQ ID NO: 241391 - RNA, 66 nt, Homo Sapiens
gccucggccucagcuccguuuaaaugugcuggugcccuccagaaaaucaagugccuucugugaguu

SEQ ID NO: 241392 - RNA, 66 nt, Homo Sapiens
caagggauguaucagggaugaucagcugaugagaggcuccagaaggauuucuagaucgcuucaagc

SEQ ID NO: 241393 - RNA, 66 nt, Homo Sapiens
auguuuaagcuagcuuuaccuaagccacuucucagccuccagaauacucucucugggguugugagu

SEQ ID NO: 241394 - RNA, 66 nt, Homo Sapiens
aguguaaacugcaguuuuccugugguuaaaaaugaucuccagaauaugcuacaggggcacauuuuc

SEQ ID NO: 241395 - RNA, 66 nt, Homo Sapiens
caauaccaaccugaaaguucaggagacuucugucuucuccagaagguaaaauguagcugcgucaua

SEQ ID NO: 241396 - RNA, 66 nt, Homo Sapiens
uuggaacaccuggcaugugaauguugguaaaauccucuccagaaucagaaagcugauagcuccucc

SEQ ID NO: 241397 - RNA, 66 nt, Homo Sapiens
cagcaagaacacuuggaaugcuuacagaauuauguccuccagaaacuguagcagugguuacccaga

SEQ ID NO: 241398 - RNA, 66 nt, Homo Sapiens
agacauuggcauucaaauguuucagcuccagugucucuccagaauaaagugugaucauuguugaac

SEQ ID NO: 241399 - RNA, 66 nt, Homo Sapiens
ucaaagaagggaagaaacucaggccagcugcagguccuccagaaaagaauggagccugucucagga

SEQ ID NO: 241400 - RNA, 66 nt, Homo Sapiens
ucaauaguuauccccaggccuggcacgucaaagaggcuccagaaauguuugcugagugagugauga

SEQ ID NO: 241401 - RNA, 66 nt, Homo Sapiens
ugccgguacugaagaugcuccuucuuccucccccugcuccagaaggaaguagcaaacuguacauuc

SEQ ID NO: 241402 - RNA, 66 nt, Homo Sapiens
uccugcagacauccuacucgugaaguuacuugcuaacuccagaaaucagauacucucuuugccaga

SEQ ID NO: 241403 - RNA, 66 nt, Homo Sapiens
aucccgauucccgggaucugaaguguuagccagcagcuccagaaaaucugcccuggcucugcacau

SEQ ID NO: 241404 - RNA, 66 nt, Homo Sapiens
acucuuuuugcauaaauaccaaaaguguguucuuaacuccagaaccuuugagaaauagagaaauau

SEQ ID NO: 241405 - RNA, 66 nt, Homo Sapiens
caugcucgcuucccuuggcaccaugcauguaguccacuccagaaauccaguuuacugaacuccaga

SEQ ID NO: 241406 - RNA, 64 nt, Homo Sapiens
uaucccaguaaaagauaugauauuuuccauagauaccuccagaauuuuuuucagcaaauggaau

SEQ ID NO: 241407 - RNA, 66 nt, Homo Sapiens
aagaggaacgguguuauggacugaauguucauguuccuccagaauucauaugcugaagccucuguc

SEQ ID NO: 241408 - RNA, 66 nt, Homo Sapiens
ugcgucugcuggcaccuugaucuugaacuucccagccuccagaacugugagaaagaaaucucuaug

SEQ ID NO: 241409 - RNA, 66 nt, Homo Sapiens
ccagugggaccuuguaaaaugcucccugucagagcucuccagaauaugcuuguuggagauccuuca

SEQ ID NO: 241410 - RNA, 66 nt, Homo Sapiens
cuaacggugagggcugacucugaacugucucucagucuccagaaaguguucaagccuguuguguuc

SEQ ID NO: 241411 - RNA, 66 nt, Homo Sapiens
ugaaaaggaauuagagggucagaaacacccagguuccuccagaaagcuccuuggagcccaacaacu

SEQ ID NO: 241412 - RNA, 66 nt, Homo Sapiens
auacguauguuuaaaaaccccuuacucaagauuccccuccagaaaauguagaaagaugugagauaa

SEQ ID NO: 241413 - RNA, 66 nt, Homo Sapiens
ccuaaaauacaauuuugaggagggauucuccauggacuccagaaacuauguuuuaugauauggguu

SEQ ID NO: 241414 - RNA, 66 nt, Homo Sapiens
aaaccaaaauaccaugggaugaaaaacagcuuuaaucuccagaagaugcugcugcauuuaucccaa

SEQ ID NO: 241415 - RNA, 66 nt, Homo Sapiens
gaaaacaaaucaaauaaauaaguauuuacaauaucacuccagaaaaaaugagugacaaaucuuuaa

SEQ ID NO: 241416 - RNA, 66 nt, Homo Sapiens
aaugagccuccaccaccaagccaaaaauuucagugacuccagaagauccaagcuucgaaagauauc

SEQ ID NO: 241417 - RNA, 66 nt, Homo Sapiens
ugagaugagccagccgagccguuugaaaaccuagcucuccagaacacuugaccuaaucagcuuaca

SEQ ID NO: 241418 - RNA, 66 nt, Homo Sapiens
acugcggcacgcgcuucgggugucccccugcucccacuccagaagacccuccucuacccaaagcuc

SEQ ID NO: 241419 - RNA, 66 nt, Homo Sapiens
gaacucaagcugguuuuaagcaauggcgccugcucccuccagaaugacuugaccucaucucccgag

SEQ ID NO: 241420 - RNA, 66 nt, Homo Sapiens
augggaacaucugggugugcgauuacaucuaaggaccuccagaagccuggcccucuuucucccagu

SEQ ID NO: 241421 - RNA, 66 nt, Homo Sapiens
gcuccccacccccccaaagaccccaguccuuuccuacuccagaaauccuccgcaccccgccccaug

SEQ ID NO: 241422 - RNA, 66 nt, Homo Sapiens
ggaaccuuccaaggugucugguugcccugccucuggcuccagaacagaaagggagccucacgcugg

SEQ ID NO: 241423 - RNA, 66 nt, Homo Sapiens
ucccaccaacuccuauuucccuaccaaccaaggagccuccagaaggaaaggaggaagaaauguuuu

SEQ ID NO: 241424 - RNA, 66 nt, Homo Sapiens
ggaccucaaccccagggauucccaggaagcagaacucuccagaagaaggguuuugaucauuccagc

SEQ ID NO: 241425 - RNA, 66 nt, Homo Sapiens
acugcccugccucaacaggguccauugccuccucgccuccagaacuuggagcagggaagugggcac

SEQ ID NO: 241426 - RNA, 66 nt, Homo Sapiens
ccuggaaagauauagcauagugguucucagcacagucuccagaacagaagcaucuguaguaccugg

SEQ ID NO: 241427 - RNA, 66 nt, Homo Sapiens
cggagacauugaccccucccuccaugugguaaaccacuccagaauggccaccaggcuucccagagu

SEQ ID NO: 241428 - RNA, 66 nt, Homo Sapiens
aacuuguguuacaucuauaaagagcaaaauaacacacuccagaacuuggcaguuguagcauuaguu

SEQ ID NO: 241429 - RNA, 66 nt, Homo Sapiens
uggagcucauguuugugauccucuaucuggacagcucuccagaauccuguguugccccuguucugc

SEQ ID NO: 241430 - RNA, 66 nt, Homo Sapiens
ugagaaugugccaugcaugaagcaaaggauuccaggcuccagaaaaaaugaaugaacucaccuuga

SEQ ID NO: 241431 - RNA, 66 nt, Homo Sapiens
agaagcugggcaggacaaguaggacaucccuggagccuccagaagggacuggccucugcccacacc

SEQ ID NO: 241432 - RNA, 66 nt, Homo Sapiens
aaguaugauuuguguucaauaagccugaccaagaggcuccagaauagcagagggagugugcgaauc

SEQ ID NO: 241433 - RNA, 66 nt, Homo Sapiens
cugaugguaucaauggauuucuuugauauugccacccuccagaaucggggaagaagacacagaagc

SEQ ID NO: 241434 - RNA, 64 nt, Homo Sapiens; identical to SEQ ID NO: 240925

SEQ ID NO: 241435 - RNA, 66 nt, Homo Sapiens
acagcccuucuccccaaggggccgucccuccccugccuccagaaucaggaccuggcagcuuuucuu

SEQ ID NO: 241436 - RNA, 66 nt, Homo Sapiens
uggguucguccccagugagaucugucaggggagaggcuccagaaccuaagugccggugacaagcug

SEQ ID NO: 241437 - RNA, 66 nt, Homo Sapiens
caaggcuccaggcccgugugagcugccggccacugucuccagaacgcgcacacggcgucaaaacca

SEQ ID NO: 241438 - RNA, 66 nt, Homo Sapiens
uguucugcugagacugagcaccuuacagauauuuuucuccagaagauggugcuggguaauaaaauc

SEQ ID NO: 241439 - RNA, 66 nt, Homo Sapiens
cccauccccuuuccuccccaccuuccccagacucagcuccagaauaccuucuucgcugcuagagaa

SEQ ID NO: 241440 - RNA, 66 nt, Homo Sapiens
ccuauuauucgcuccaagaaagaugcuaagucugagcuccagaagagacugugcuggguguggcuu

SEQ ID NO: 241441 - RNA, 66 nt, Homo Sapiens
gcgaggugccgccuuggccgggcccccacgugucuucuccagaaugugucugucuuugccuggugu

SEQ ID NO: 241442 - RNA, 66 nt, Homo Sapiens
ucagcgacacacacacacuuauggcaccagccuggacuccagaaaaaggguguccagguauugugu

SEQ ID NO: 241443 - RNA, 66 nt, Homo Sapiens
cagagcuggagcucgaucaugccugcgugacaaagccuccagaaaaauccuugaaagacaggacau

SEQ ID NO: 241444 - RNA, 66 nt, Homo Sapiens
acuugcggccacagcacuagagucacccccccaggccuccagaaccuuacuggcacuguggcacug

SEQ ID NO: 241445 - RNA, 66 nt, Homo Sapiens
aaaugaucuguacuaucuagugucuaaaacacuauucuccagaaaaaucaaucauuuucuagcccu

SEQ ID NO: 241446 - RNA, 66 nt, Homo Sapiens
uggacaaugaauguaguuaacugguuccugcucacacuccagaauuaaauucuauugaaaaaggaa

SEQ ID NO: 241447 - RNA, 66 nt, Homo Sapiens
cuuugcagaucacagugcuggaagcaggaacccaggcuccagaagguguugccaggggcccagaug

SEQ ID NO: 241448 - RNA, 66 nt, Homo Sapiens
gucaaagaugaacaucggaauaacaaacauuguccucuccagaaaguccuuucuuucuccauacug

SEQ ID NO: 241449 - RNA, 66 nt, Homo Sapiens
agucucaggauuuagaaagucuguaagccauccaugcuccagaaagcaccgaucuguuguaguugc

SEQ ID NO: 241450 - RNA, 66 nt, Homo Sapiens
gagcguggaggcgugugcaggcuuggaagaagaacucuccagaacauggaacuuaacccucuuuug

SEQ ID NO: 241451 - RNA, 66 nt, Homo Sapiens
aaacugaggccagagggaggagagaauugcucauggcuccagaacugguggcaaguuucucuggac

SEQ ID NO: 241452 - RNA, 66 nt, Homo Sapiens
uguggggagaguggggaaucggguaaacacugggaacuccagaagugcuucuggauacagccuuuu

SEQ ID NO: 241453 - RNA, 66 nt, Homo Sapiens
gccccucacccuucuuccccugcccgccuacccucccuccagaauagcucccccuucaccccuccu

SEQ ID NO: 241454 - RNA, 66 nt, Homo Sapiens
agcugcuucuccccccauccccaugaccccuucucucuccagaaacggaggguaacuggggggcca

SEQ ID NO: 241455 - RNA, 66 nt, Homo Sapiens
ucagcucaauugcugugcaguacgaucaaucacagucuccagaagagugccuucuucauccuuccu

SEQ ID NO: 241456 - RNA, 66 nt, Homo Sapiens
ugacaaggcaccagcaggacugugcagcucacaccacuccagaaccgcagcaagggggaccgaugc

SEQ ID NO: 241457 - RNA, 66 nt, Homo Sapiens
cccgcgccccacauaccugcucucuuuugguccuggcuccagaaaaucccuccuggucgugccccg

SEQ ID NO: 241458 - RNA, 66 nt, Homo Sapiens
acuuuaugaaaugguacacugcuuggcagauuuuaacuccagaagcaaguguggacacuuuugaca

SEQ ID NO: 241459 - RNA, 66 nt, Homo Sapiens
gaugccaucuuccugaauguaugagguuuauggagccuccagaacaggcuuguuccaaguuuguca

SEQ ID NO: 241460 - RNA, 66 nt, Homo Sapiens
uuuccaucccaaaggcagucaauagaauggagggagcuccagaaacgcauguuccugccccacagg

SEQ ID NO: 241461 - RNA, 66 nt, Homo Sapiens
agccccucggaggcagaggacccacacaacagugcccuccagaagcccugcaaaccucacaggguc

SEQ ID NO: 241462 - RNA, 66 nt, Homo Sapiens
uuauccacuguggaugaugauagaccaucaucgaaacuccagaaauagaacucaugguuuuaaaua

SEQ ID NO: 241463 - RNA, 66 nt, Homo Sapiens
uggaaccauuucucccgcagcccacccccacccagccuccagaagcuaucccacacccacccccac

SEQ ID NO: 241464 - RNA, 66 nt, Homo Sapiens
uagcuucaccccaaucccagagagugcaagccccugcuccagaagaggaaaagcagcucuccccuc

SEQ ID NO: 241465 - RNA, 66 nt, Homo Sapiens
ugccagcuucucucuccagguggagugagucaccugcuccagaagaggggagauggggaggagaua

SEQ ID NO: 241466 - RNA, 66 nt, Homo Sapiens
gccaagagaacccaaaccaaaccugccucagccccacuccagaauagauucugcccuucacuuagc

SEQ ID NO: 241467 - RNA, 66 nt, Homo Sapiens
gcaggagaauaaauuuguguaucuugagcuccuggccuccagaauuacuugagcccauugaaacug

SEQ ID NO: 241468 - RNA, 66 nt, Homo Sapiens
cuguucuuuaaagaccaagaggaaccugcuucuuuacuccagaacugggaggugucuacugaaaag

SEQ ID NO: 241469 - RNA, 66 nt, Homo Sapiens
agguacucagcuuucugggagccaguauuuccccuucuccagaagcuaggaaggaaaaugaagaga

SEQ ID NO: 241470 - RNA, 66 nt, Homo Sapiens
cggaaucccccgcugcagggacacccacgcccuucucuccagaagccgggcaggcagaauccggcc

SEQ ID NO: 241471 - RNA, 66 nt, Homo Sapiens
gucgagggagaggaggggguuggggaggacccaccucuccagaauggcgacuguccccauccgccu

SEQ ID NO: 241472 - RNA, 66 nt, Homo Sapiens
aggcaucuaaguuagagcuggcaccagaacugagaccuccagaaaucuauuccaguauuuuuucca

SEQ ID NO: 241473 - RNA, 66 nt, Homo Sapiens
cccaguuucugucaucuuaauugucacuagaauguucuccagaaacuuucuguccugcuuugccuu

SEQ ID NO: 241474 - RNA, 66 nt, Homo Sapiens
uggcuuagaggagcuccaaaccauaucuuagaguaucuccagaaacuucauucucagaaaauccaa

SEQ ID NO: 241475 - RNA, 57 nt, Homo Sapiens; identical to SEQ ID NO: 240966

SEQ ID NO: 241476 - RNA, 66 nt, Homo Sapiens
aauagcagcugacaacuuucuccaguuguggcagcucuccagaagucuggugauacuccaacaccg

SEQ ID NO: 241477 - RNA, 66 nt, Homo Sapiens
ucagcaagggcucagcugggaucugcgcccggccugcuccagaacgcagcccacucgccaccggug

SEQ ID NO: 241478 - RNA, 66 nt, Homo Sapiens
aggggguuugcuggggaacuggcgccaucgccgggacuccagaaccgcagaagccuccccagcuca

SEQ ID NO: 241479 - RNA, 66 nt, Homo Sapiens
cugcccugcccucuccucacaggucuguugcagggacuccagaaaccauucugggagccguggaug

SEQ ID NO: 241480 - RNA, 66 nt, Homo Sapiens
ucugguucaugaugcauaaagcgcuaggcccuagaacuccagaaacagcacagcuggggcggggac

SEQ ID NO: 241481 - RNA, 66 nt, Homo Sapiens
gggccacagccacaccucaccgcccaguccagcugucuccagaaggggacaggcaguccgcggucu

SEQ ID NO: 241482 - RNA, 66 nt, Homo Sapiens
acuuuggccaccaguucuucggccagcaccucugcccuccagaaccugcagccuggaggggugagg

SEQ ID NO: 241483 - RNA, 66 nt, Homo Sapiens
ccccagcccggagcccagcccccugccccggcccugcuccagaacccagcccagaucggaggacaa

SEQ ID NO: 241484 - RNA, 66 nt, Homo Sapiens
cucuagaacccaauccaauuuggagccccagcccaacuccagaacccaacccuucucuagaaucca

SEQ ID NO: 241485 - RNA, 66 nt, Homo Sapiens
ccccggcugggucugcguccuuuccugugccuuucccuccagaaugcggccucagaccuagaagcu

SEQ ID NO: 241486 - RNA, 64 nt, Homo Sapiens; identical to SEQ ID NO: 240977

SEQ ID NO: 241487 - RNA, 66 nt, Homo Sapiens
uuaauuuucucggaggugauaggcuuccacacaggucuccagaagcccugcauugaauauccaucc

SEQ ID NO: 241488 - RNA, 66 nt, Homo Sapiens
uacuguuccagcaucuucccuggauggcuggaggaacuccagaaaauauccaucuucuuuuugugg

SEQ ID NO: 241489 - RNA, 66 nt, Homo Sapiens
aagccagcuccacugcccaggcccccaagagggcagcuccagaagcugcccagggcuccgggaccc

SEQ ID NO: 241490 - RNA, 66 nt, Homo Sapiens
ccucccuuaggggcugaggaagcugcccucgaaacccuccagaagacaucuguccugcagaggccc

SEQ ID NO: 241491 - RNA, 66 nt, Homo Sapiens
auauccuuauccaaaucaauaaagagagaauccucccuccagaaggguuucuaaaaacagcccuca

SEQ ID NO: 241492 - RNA, 66 nt, Homo Sapiens
gagucuaggacagauuuuacguggagaguugaacuacuccagaaacuaaagaguaauguuucuaga

SEQ ID NO: 241493 - RNA, 66 nt, Homo Sapiens
gcugugagaccuccuggaacacuggcaucucugagccuccagaagggguucugggccuaguugucc

SEQ ID NO: 241494 - RNA, 66 nt, Homo Sapiens
aggccccgccuggcacucagccuugccagagauuggcuccagaauuuuugccaggcuuacagaaca

SEQ ID NO: 241495 - RNA, 66 nt, Homo Sapiens
ggagagagggucucucuccuagcugcuacccaggaccuccagaaggagcccuuggaccucugggag

SEQ ID NO: 241496 - RNA, 66 nt, Homo Sapiens
ucauacuaagugcuuaguaaauguuagauaaguauucuccagaauugauguaaauuauuuuuaaac

SEQ ID NO: 241497 - RNA, 66 nt, Homo Sapiens
aauguuauauaaauuccacauuuuuaugcaacuaaucuccagaacauuuuuccucuuaccaagaag

SEQ ID NO: 241498 - RNA, 66 nt, Homo Sapiens
uugcaagucuaggagaguguccaggcguccuuucagcuccagaauggcuggaguggcacaggugac

SEQ ID NO: 241499 - RNA, 66 nt, Homo Sapiens
cuugccugcuagggaccucggccaggagccucuccccuccagaagaacacgcugggcuucacggcu

SEQ ID NO: 241500 - RNA, 66 nt, Homo Sapiens
ucaggcucucagugacccuuaauacauggcucugcccuccagaacuccuagagugaggcucugucc

SEQ ID NO: 241501 - RNA, 66 nt, Homo Sapiens
gugaggcaauaaauuucucuauauugcacuuccaggcuccagaacuccaacccugucuccaccuug

SEQ ID NO: 241502 - RNA, 66 nt, Homo Sapiens
ucucuccucaaaggaaagaacuguuccuccccgggacuccagaauuacuauggucacagggccguc

SEQ ID NO: 241503 - RNA, 66 nt, Homo Sapiens
ugcaggcgccucugguucucugggcaggcgagaccccuccagaaucggaucucgggcugccagcga

SEQ ID NO: 241504 - RNA, 66 nt, Homo Sapiens
accgugagaaccaggcauucgguggaaaccauugcccuccagaacaauagcggacgggggucccga

SEQ ID NO: 241505 - RNA, 66 nt, Homo Sapiens
gcugggauuacaaaugugagaucuaccugccucagccuccagaaguuuaaacuucuaggcucaagc

SEQ ID NO: 241506 - RNA, 66 nt, Homo Sapiens
gagccagucaugcuaaaugcggugacagccuggugacuccagaauguuuagucaaacucucauuua

SEQ ID NO: 241507 - RNA, 66 nt, Homo Sapiens
ugccagguucuccccuugagaucaguuuuuccaagacuccagaaggagggccgggugucuuuaggg

SEQ ID NO: 241508 - RNA, 66 nt, Homo Sapiens
ggggcucugggagggauguuugguccuccauuucaacuccagaaguugaagguaacugagagcaga

SEQ ID NO: 241509 - RNA, 66 nt, Homo Sapiens
ugcauaaucagcgcccuggaccgugccuuucucuggcuccagaauagcacuccagaauccacaaag

SEQ ID NO: 241510 - RNA, 66 nt, Homo Sapiens
cacaaagccgugccuuucucuuuccaaguuccugcacuccagaaucuccacccccuccagcuccag

SEQ ID NO: 241511 - RNA, 66 nt, Homo Sapiens
agaagccagcuccuggaguuggaggcacagggugcucuccagaacgagcacaggaaaccaggcaga

SEQ ID NO: 241512 - RNA, 66 nt, Homo Sapiens
accaccccauauuaugauuauuugugucagaaaauacuccagaacaugggagaauuagagaauuua

SEQ ID NO: 241513 - RNA, 66 nt, Homo Sapiens
cacaggagcugcccccaguggaaggagacucagagacuccagaaggcccagaucucauacucaaca

SEQ ID NO: 241514 - RNA, 66 nt, Homo Sapiens
uuuccucaacacuugagggcccagaaagucugaucucuccagaaugaucagcccagaggaaugcug

SEQ ID NO: 241515 - RNA, 65 nt, Homo Sapiens
guuguaaauuaggaggcucaacaauaaaacauuaugcuccagaaauuaugugagaugugcuauau

SEQ ID NO: 241516 - RNA, 66 nt, Homo Sapiens
caaaucuguaagcaccuugaucuuggacuucucagccuccagaauugugagaaauaaauuucuguu

SEQ ID NO: 241517 - RNA, 66 nt, Homo Sapiens
ucggagacaagcauggugcugcugcuucugcugcuucuccagaaaaucccugggacaccuuuguuc

SEQ ID NO: 241518 - RNA, 66 nt, Homo Sapiens
gcucuuugcaggcguccaauccuagaaaccaauggucuccagaacucucacacaaguguuuuucug

SEQ ID NO: 241519 - RNA, 66 nt, Homo Sapiens
cacugacuggcauccugcuuuccagugccugccagccuccagaagagccaggugccugacuaguac

SEQ ID NO: 241520 - RNA, 66 nt, Homo Sapiens
ugcguuguuaguuuugaagaguggaggagcuaggggcuccagaaagaaucuuacacauguguugaa

SEQ ID NO: 241521 - RNA, 66 nt, Homo Sapiens
uccuuucaugugaaguuuuucaauauuguggaaucacuccagaagacaucuuaucccuugaauuuu

SEQ ID NO: 241522 - RNA, 66 nt, Homo Sapiens
agcagcuagaaagagaaaaaggcauuggguaagggacuccagaagccuggcccaacauacgcacug

SEQ ID NO: 241523 - RNA, 66 nt, Homo Sapiens
ucauuccagauccagagaucgacucaacggggacaacuccagaaggaccuucuggccccaacccuu

SEQ ID NO: 241524 - RNA, 66 nt, Homo Sapiens
uugucuuacccuccgguguguucugggucugugccucuccagaaucgcuccugugugccccuggcu

SEQ ID NO: 241525 - RNA, 66 nt, Homo Sapiens
agguccagccuaggcccccugccauucugggaagggcuccagaagauuugguggggggaccccaaa

SEQ ID NO: 241526 - RNA, 66 nt, Homo Sapiens
gccagaagugcaauuaaccuugauacuguugacauccuccagaaugagcacaagucuugcuaaaug

SEQ ID NO: 241527 - RNA, 66 nt, Homo Sapiens
cugggaaaauaaaguccucuuguugaacuucccagccuccagaacuugcaccuacugauguuuuga

SEQ ID NO: 241528 - RNA, 66 nt, Homo Sapiens
cucuggcuagaggccagcccucccaguccaaauguccuccagaagcggacuggcuagaguccucac

SEQ ID NO: 241529 - RNA, 66 nt, Homo Sapiens
uucuagcucuggggucuggcuaccccucuccucugucuccagaagcguuuggaaacauuuaauuua

SEQ ID NO: 241530 - RNA, 66 nt, Homo Sapiens
gcugggauuacaggcguacaauucuccugccucagccuccagaauaccaucuccuggauucaaaca

SEQ ID NO: 241531 - RNA, 66 nt, Homo Sapiens
cccuugaagggccuuugggacaucuccacucuccuucuccagaaccaggauaccaugggaaggagc

SEQ ID NO: 241532 - RNA, 66 nt, Homo Sapiens
aacaagaaagccaucucuucuugcugcuugaaucugcuccagaauuagcaaguguucaguaaauau

SEQ ID NO: 241533 - RNA, 66 nt, Homo Sapiens
caugaugaacugugaucugccugucuuagccgcagucuccagaacccccaucuccuaccccacauc

SEQ ID NO: 241534 - RNA, 63 nt, Homo Sapiens; identical to SEQ ID NO: 241025

SEQ ID NO: 241535 - RNA, 66 nt, Homo Sapiens
auuucuauaacagaagugacauguguacugauuuuucuccagaaauauggaugcuguuguauucag

SEQ ID NO: 241536 - RNA, 66 nt, Homo Sapiens
auuccuaggccuuuucaugcuucauuucuuccacuucuccagaaaauggaagcuaugaagcaacau

SEQ ID NO: 241537 - RNA, 66 nt, Homo Sapiens
cucuuccuccacacaggucgccgugagucaagcugccuccagaaccucagagcuucccuggugggc

SEQ ID NO: 241538 - RNA, 66 nt, Homo Sapiens
ggcugaccgggcuguucuguagacucaggaccguggcuccagaacuccugugccaggcgggaggga

SEQ ID NO: 241539 - RNA, 66 nt, Homo Sapiens
ggguccggccggagaggccucccgcggacgccgucucuccagaacuccgcuuccaagagggagccu

SEQ ID NO: 241540 - RNA, 66 nt, Homo Sapiens
cugcuauccugggagaucuaccugaaggagaacuaccuccagaaccgacaguuccagcaaaagcag

SEQ ID NO: 241541 - RNA, 66 nt, Homo Sapiens
aggcgcaucccacucuaugcgaaccacaagacccuccuccagaaggcagccgcugaguucggggcu

SEQ ID NO: 241542 - RNA, 66 nt, Homo Sapiens
ggggggugcagggggcugugggcauccagcgucauccuccagaaccucacaucugaacugggggca

SEQ ID NO: 241543 - RNA, 66 nt, Homo Sapiens
gauaacaaaaucaaauaguaucuugguagagacacgcuccagaaggacuagauugcuuugugaagc

SEQ ID NO: 241544 - RNA, 66 nt, Homo Sapiens
gugagucaguaccuguuguuaauucaaacuuuuggccuccagaacuaggaagcacagcccugcuug

SEQ ID NO: 241545 - RNA, 66 nt, Homo Sapiens
cugacuuaagagaguaagauguguugggacagccaucuccagaaacuguagacaggcuggauucca

SEQ ID NO: 241546 - RNA, 66 nt, Homo Sapiens
gcuggaaaggaugcugccagaucagcugcugacugucuccagaaggcaugcugguucccggaauga

SEQ ID NO: 241547 - RNA, 66 nt, Homo Sapiens
gauguggaaacaaagcaggaccagcaggcacagcaccuccagaacagugccccggaugaccagagg

SEQ ID NO: 241548 - RNA, 66 nt, Homo Sapiens
ugucugccuucuggcugacaauccuggaaaucuguucuccagaauccaggccaaaaaguucacagu

SEQ ID NO: 241549 - RNA, 66 nt, Homo Sapiens
cauccauagggagcuggcuggggguuuccgugggagcuccagaacuuuccccagcugagugaagag

SEQ ID NO: 241550 - RNA, 66 nt, Homo Sapiens
ccaauaggacaauuugcugaggucugagaggacucccuccagaaaaucccugaucucuuaaaauuu

SEQ ID NO: 241551 - RNA, 66 nt, Homo Sapiens
caagcugcagccuacugaggaggcagaggccaccuccuccagaaagcccucggccugggccgccgc

SEQ ID NO: 241552 - RNA, 66 nt, Homo Sapiens
aaaacugccuuucuuccccucaagucaacuuuugugcuccagaaaauuuucuauucuguaagucug

SEQ ID NO: 241553 - RNA, 66 nt, Homo Sapiens
gggaagauccugcggcuggggccgucugccuacacgcuccagaagggccagcgcagagcugggaug

SEQ ID NO: 241554 - RNA, 66 nt, Homo Sapiens
cucccgugacugcugccucaucgauaccccauuuagcuccagaaagcaaagaaaacucgaguaaca

SEQ ID NO: 241555 - RNA, 66 nt, Homo Sapiens
caggggcuauagcgauggggcuuugaacucccuacucuccagaaucgaucaccgaggcucccguga

SEQ ID NO: 241556 - RNA, 66 nt, Homo Sapiens
gcagcuccacagggcagggcggacuggcacacuggccuccagaagggggucuccucugcagcucag

SEQ ID NO: 241557 - RNA, 66 nt, Homo Sapiens
cccugcccugcgagugugucucaccuguacccacaccuccagaauggcugugccucccauuucccc

SEQ ID NO: 241558 - RNA, 66 nt, Homo Sapiens
uguuaaacuggcuuacuauagacuucguaaaaauggcuccagaagaguaacaaacugaaaucuuug

SEQ ID NO: 241559 - RNA, 66 nt, Homo Sapiens
aauucugucuggggacgaaggguuggacgggaugaccuccagaagucccuucaauuucuaguaccu

SEQ ID NO: 241560 - RNA, 66 nt, Homo Sapiens
gccuuagccuccagguccagacuacuacucuauguucuccagaagggugcuaagucaccuacugaa

SEQ ID NO: 241561 - RNA, 66 nt, Homo Sapiens
ucugccuaugaggcaucuggccccugguagccagcucuccagaauuacuuguagguaauuccucuc

SEQ ID NO: 241562 - RNA, 60 nt, Homo Sapiens; identical to SEQ ID NO: 241053

SEQ ID NO: 241563 - RNA, 66 nt, Homo Sapiens
aggcaaggccagagacuucaagucuaucugaaaagucuccagaagucuaaccccagauaaauagcc

SEQ ID NO: 241564 - RNA, 66 nt, Homo Sapiens
cauccauaacauaguaaagaucagggacauugccagcuccagaaaaaggcuauuuuccaacugaag

SEQ ID NO: 241565 - RNA, 66 nt, Homo Sapiens
auaguauuauagagucuuuuauuaugaguggaaauucuccagaaagucuauaaagaaucauuagaa

SEQ ID NO: 241566 - RNA, 66 nt, Homo Sapiens
auuuuaagaaaauaacaaaggacuugcaucagcugccuccagaacaaagguuuuuuuaaaaaagag

SEQ ID NO: 241567 - RNA, 66 nt, Homo Sapiens
uaagucccagugucugcuguccuccacaauaaaauucuccagaaaagagcugcucuccuguauuau

SEQ ID NO: 241568 - RNA, 66 nt, Homo Sapiens
uuuaaggggucuguuucucagugugacaccaguuugcuccagaaagaaggagaaggguaguuugag

SEQ ID NO: 241569 - RNA, 66 nt, Homo Sapiens
ucgagcagcacccaccuccacgagaauucugagauccuccagaaaggguucaguccuagcaagaag

SEQ ID NO: 241570 - RNA, 66 nt, Homo Sapiens
cuuccuccaaggacagaagggaagagagggugaguccuccagaacucaggaagggaagggggguca

SEQ ID NO: 241571 - RNA, 66 nt, Homo Sapiens
agaaaaaggucaagauuucuaucacuuccccgucuucuccagaacuugugucuccagaggaguacg

SEQ ID NO: 241572 - RNA, 67 nt, Homo Sapiens
cuucucggccccgccaccugcccagcgugcccuggcucuccagaaccuucuaucccacagucaggcc

SEQ ID NO: 241573 - RNA, 67 nt, Homo Sapiens
aaugagaaagucuuaagcaaaauacucccaggucucacuccagaacauaaaaauggugugugaucaa

SEQ ID NO: 241574 - RNA, 67 nt, Homo Sapiens
uggaaaacccaguguccaucuuuccacccucccugaucuccagaaccuucgacugacccccuugucu

SEQ ID NO: 241575 - RNA, 67 nt, Homo Sapiens
cuaggaccugcacgggacuuguggaugggccuggacucuccagaaacuacuugggcagagcaaagga

SEQ ID NO: 241576 - RNA, 67 nt, Homo Sapiens
gggacaacagaccaggaggggcccccaccugauggaccuccagaaaaacggaucacagccacuaugg

SEQ ID NO: 241577 - RNA, 67 nt, Homo Sapiens
gggauggggagggagugggccuggaucugggaccucccuccagaauuuccuccagaugggggcagug

SEQ ID NO: 241578 - RNA, 67 nt, Homo Sapiens
aggccuuccuggugcccaccaggcacuacggcuuccucuccagaauguggcuuugccugagcacaga

SEQ ID NO: 241579 - RNA, 67 nt, Homo Sapiens
aaauauugaauaacuagaacacaagccacuguuucagcuccagaaaaaagaaagggcuuuaacguuu

SEQ ID NO: 241580 - RNA, 67 nt, Homo Sapiens
ggucacagggauuccuccuuucccccccaaauauuaacuccagaaacuaggccugacuggggacacc

SEQ ID NO: 241581 - RNA, 67 nt, Homo Sapiens
acacagcacacaauuucaagccauuuucagaucagaacuccagaaguguugacaagaugccuauucg

SEQ ID NO: 241582 - RNA, 67 nt, Homo Sapiens
uggagaggauccuucaguucuggccauuccagggacccuccagaaacacaguguuucaagagacccu

SEQ ID NO: 241583 - RNA, 67 nt, Homo Sapiens
ugugggguccccaucaucccagcugcucccaaauaaacuccagaagaggaaucugugggccugugag

SEQ ID NO: 241584 - RNA, 67 nt, Homo Sapiens
aacaaaaucaccuauucacugcuuaugcagucggaagcuccagaagaacaaagagcccaauuaccag

SEQ ID NO: 241585 - RNA, 67 nt, Homo Sapiens
accgacucugucguugccuugaucuugaacuuccagccuccagaacuaugagaaauaaaauucuguu

SEQ ID NO: 241586 - RNA, 67 nt, Homo Sapiens
uuacaguugcaguauuucaaagucccuauccaggucacuccagaaaaggguauugaaacguugaaau

SEQ ID NO: 241587 - RNA, 67 nt, Homo Sapiens
ugacugcugcauuuaggccaggucuccaauugcuuuccuccagaaaguguguucccgucuagugagg

SEQ ID NO: 241588 - RNA, 67 nt, Homo Sapiens
cacacccaaacuccuggccuucugugguuucccuuugcuccagaaacacagaugugucuaaagacuu

SEQ ID NO: 241589 - RNA, 67 nt, Homo Sapiens
cugagaaacguacacuaucauugcuaaacuaacaguccuccagaaauuuaauaagauguuuuugauu

SEQ ID NO: 241590 - RNA, 67 nt, Homo Sapiens
auguuuaagugaccuccuucaucacauccugcaguaucuccagaagcagcacuaggguuugaguuuc

SEQ ID NO: 241591 - RNA, 67 nt, Homo Sapiens
cggcccacguguauuguccgggcucagaaugggaggacuccagaagaugagagaaaccucuuuaucc

SEQ ID NO: 241592 - RNA, 67 nt, Homo Sapiens
ucuuuuagccuuaccaccuuuuaaaaaauuuguuauucuccagaaacaguaaauaggugaguagggg

SEQ ID NO: 241593 - RNA, 67 nt, Homo Sapiens
ucaacucagucagugauuuuuugaugcuucucuuauccuccagaauagagaccuaaggacacgugga

SEQ ID NO: 241594 - RNA, 67 nt, Homo Sapiens
aaaccccuguccccagucagagauaacauccaacuaacuccagaagcggaagaggauauauuuaaca

SEQ ID NO: 241595 - RNA, 67 nt, Homo Sapiens
cucuggccuugguggccccacugauucuacaccaucucuccagaacuugagggauggagcgggucuc

SEQ ID NO: 241596 - RNA, 67 nt, Homo Sapiens
gccaugccagcugggcucgugacacuggccccucgcacuccagaaaagagucuccccccggggagag

SEQ ID NO: 241597 - RNA, 67 nt, Homo Sapiens
ugcuguugccauagccccauaagaaaagacccugagacuccagaaucugcccuguaacuuaucuaga

SEQ ID NO: 241598 - RNA, 67 nt, Homo Sapiens
uacucccucaguaaagcauugguucccucacagguuucuccagaaaguuggccuauccaguuuuccu

SEQ ID NO: 241599 - RNA, 67 nt, Homo Sapiens
caggugcuggcgcccguucucggccguguccugacaccuccagaacgaggagcuuuugccacugacu

SEQ ID NO: 241600 - RNA, 67 nt, Homo Sapiens
gugcaggaugugcauuagcaauaaguuuauuauaauucuccagaaaugaggccugcuucacuugcag

SEQ ID NO: 241601 - RNA, 67 nt, Homo Sapiens
auauggcugggccaacucugcccaggggauucagagucuccagaaaguucuguugcccugagagugu

SEQ ID NO: 241602 - RNA, 67 nt, Homo Sapiens
acccuuccucaucugugccucuaacucccuccucacacuccagaauuggcugaacagugcucugccu

SEQ ID NO: 241603 - RNA, 67 nt, Homo Sapiens
ugcugccuuuuuaaguuuugggaaggacuggccguggcuccagaaugccucaggggaagcugcuagg

SEQ ID NO: 241604 - RNA, 67 nt, Homo Sapiens
accucaacaaugucaguggccucuuauuaacucccaucuccagaagccuggcgcacuuuccugaagc

SEQ ID NO: 241605 - RNA, 67 nt, Homo Sapiens
cagugacucuugaacauggaucugugcucccucugcccuccagaacuacuguuggaaucagcaggcc

SEQ ID NO: 241606 - RNA, 67 nt, Homo Sapiens
cacccucuccccugcagucucccuccccacaccuggacuccagaauugagccuccaugagucaagcc

SEQ ID NO: 241607 - RNA, 67 nt, Homo Sapiens
cucccacccuggggccaacuaggaaggaacaugaucccuccagaaguuugaggacggggggugggga

SEQ ID NO: 241608 - RNA, 67 nt, Homo Sapiens
acugggaucacaggugucagaauucuccugccuuugccuccagaagcuugaaguccuggcuucaggc

SEQ ID NO: 241609 - RNA, 67 nt, Homo Sapiens
agcacagcucauggagggugcuuuccuggacugcucucuccagaaaccacugcauuuuccuacaccc

SEQ ID NO: 241610 - RNA, 67 nt, Homo Sapiens
cccacccugacagcccaacacuuucaaagagaaaccccuccagaacugcugcuuuccuagauccaca

SEQ ID NO: 241611 - RNA, 67 nt, Homo Sapiens
auccccaaucacccuaaucuuuuguugaacauuccaacuccagaauguuuuaccuaacaacaucacu

SEQ ID NO: 241612 - RNA, 67 nt, Homo Sapiens
cagacaugauuucaacauggauuuacacuuuaacuuucuccagaacugcaugucagucuuuguaauu

SEQ ID NO: 241613 - RNA, 67 nt, Homo Sapiens
ccaucacuguucuuuaaagcagaaagaaaggaaagaacuccagaaucaucuguaucuuuggagaagg

SEQ ID NO: 241614 - RNA, 67 nt, Homo Sapiens
cucuacaauagaaaaaaaagaucaugaauuuuaucuacuccagaaguuauguauuuuuuuaagcaac

SEQ ID NO: 241615 - RNA, 67 nt, Homo Sapiens
gugcaugcagaucagcuguucuuccugaaucacuggacuccagaaaugagcaauggagagaagaccu

SEQ ID NO: 241616 - RNA, 67 nt, Homo Sapiens
cagaggugacaaaugugaggcuccaggacucacugcccuccagaaaacaguauuaccaccagacuga

SEQ ID NO: 241617 - RNA, 67 nt, Homo Sapiens
agcaguugucccccaaauacccaucucauucucgccccuccagaagauaaagagcugcuggugaacu

SEQ ID NO: 241618 - RNA, 67 nt, Homo Sapiens
cauaacccuucucuccacaccccuuuucuccccacuccuccagaaggguuccuuuucccuaaucauu

SEQ ID NO: 241619 - RNA, 67 nt, Homo Sapiens
ugccagagugcacuggggggcccaccugccucucuggcuccagaagcugcucuucucauaguguaca

SEQ ID NO: 241620 - RNA, 63 nt, Homo Sapiens; identical to SEQ ID NO: 240602

SEQ ID NO: 241621 - RNA, 67 nt, Homo Sapiens
aacuugggagaugauggugccaagaagcagagucauucuccagaaggcaucaaaauagaagaccuug

SEQ ID NO: 241622 - RNA, 67 nt, Homo Sapiens
guggagggcuguucgcccuuacaauuaucucuagaaucuccagaaagucaaggaauuguacugugcu

SEQ ID NO: 241623 - RNA, 55 nt, Homo Sapiens; identical to SEQ ID NO: 240605

SEQ ID NO: 241624 - RNA, 67 nt, Homo Sapiens
gcauuuuauguaguucuaaaaugcugaacaccaaaaucuccagaaaucaguguuaucuucauaugau

SEQ ID NO: 241625 - RNA, 67 nt, Homo Sapiens
acccucccaggcaucccauaaaucuguaaauuuuugucuccagaaaaguuuauguucucaugcccuc

SEQ ID NO: 241626 - RNA, 67 nt, Homo Sapiens
uaaucaaagaauuuucuguacuauuuggcaggauguacuccagaauaaggucagggaggacugggca

SEQ ID NO: 241627 - RNA, 67 nt, Homo Sapiens
gccucuggacucaccuugagccugguacccaggcccacuccagaaugaccaaaaggaguacccaggg

SEQ ID NO: 241628 - RNA, 67 nt, Homo Sapiens
guaaccaagugggaaaauaaagcucagaggguacaagcuccagaacauccccccaaccccaucucag

SEQ ID NO: 241629 - RNA, 67 nt, Homo Sapiens
cuaaaauuuaauuucuuuuugccagagaggggcugcucuccagaaagacaaagaaguguuugauggu

SEQ ID NO: 241630 - RNA, 67 nt, Homo Sapiens
ggccauucagcaagacaacagggaccggccaggccaccuccagaaacaccgaggggcucaggaaaac

SEQ ID NO: 241631 - RNA, 67 nt, Homo Sapiens
cacaaagagaagagggcuuguuaugaucaugaauagacuccagaaucuagccaagucuauaauauaa

SEQ ID NO: 241632 - RNA, 67 nt, Homo Sapiens
cagagccuucccuacccugacgccucccagucaucaucuccagaacucccagcggggcucccugagc

SEQ ID NO: 241633 - RNA, 67 nt, Homo Sapiens
gagaauauuagauuucugacuugcaaauauguuuguacuccagaagaauuagaggaaaagcagauac

SEQ ID NO: 241634 - RNA, 67 nt, Homo Sapiens
aagugcugggauuacaagugugagccaccacaccuggcuccagaaauuuuauuuuauuuuuuugagg

SEQ ID NO: 241635 - RNA, 67 nt, Homo Sapiens
ccacacuauguguguuguuuccauagcucuucacuuccuccagaagccuccuuacauuaaaaagccu

SEQ ID NO: 241636 - RNA, 67 nt, Homo Sapiens
ugauuguaguaauuucuauuugcacugugccuuucaacuccagaaacauucugaagauguacuugga

SEQ ID NO: 241637 - RNA, 67 nt, Homo Sapiens
aaccuuaaucuagauaauaaaagcuuuuuggggcaaccuccagaacugugaaaaauaaauuuguuau

SEQ ID NO: 241638 - RNA, 67 nt, Homo Sapiens
gagacgcuaaccgcccuucugcguuccauaaagguggcuccagaaagggcauccucuaccccaagcc

SEQ ID NO: 241639 - RNA, 67 nt, Homo Sapiens
ugagcaucauacuggaaagcaaacaccuuuccuccagcuccagaauuccuugucucugaaugacucu

SEQ ID NO: 241640 - RNA, 67 nt, Homo Sapiens
cucugccuccucuucaacugaccagccuccaugcugccuccagaauggucuuucuaaugugugaauc

SEQ ID NO: 241641 - RNA, 67 nt, Homo Sapiens
aaugaaaccugacaaagagacuguaauauuguaguugcuccagaaugucaagggcagcuuacggaga

SEQ ID NO: 241642 - RNA, 67 nt, Homo Sapiens
cgggaguguggucagucugccugcugcugugcgguagcuccagaaccaccucguuccugguuuuguu

SEQ ID NO: 241643 - RNA, 67 nt, Homo Sapiens
ugaguuuguaagaacaaucauaaaaggacuuguuagucuccagaacaucugcuaaaaugcaaguaua

SEQ ID NO: 241644 - RNA, 67 nt, Homo Sapiens
gaacaugaguuuaugggaaugccuuuucccucuggcacuccagaacaaaccucuauauguugcugaa

SEQ ID NO: 241645 - RNA, 67 nt, Homo Sapiens
ugguaaauaccauauaugauccucgaaaugauaauaucuccagaauauuguuuucacccaaauuuga

SEQ ID NO: 241646 - RNA, 67 nt, Homo Sapiens
cuguaccuauuuuugaggaccuugaaaaucuuaaucucuccagaagggauacugcauugguucuucu

SEQ ID NO: 241647 - RNA, 67 nt, Homo Sapiens
uauauuugccuauauucucccuacaagaauauuuuugcuccagaaagacauguucuuuucucaaauu

SEQ ID NO: 241648 - RNA, 67 nt, Homo Sapiens
ggaccauuugguuacccucgggauggccauccacugucuccagaaagagaccacuuagagggucucu

SEQ ID NO: 241649 - RNA, 67 nt, Homo Sapiens
gguuuuaaaccuucaggaacaccaguuaggaaaauagcuccagaaaauauagauauauuuuauuuuu

SEQ ID NO: 241650 - RNA, 67 nt, Homo Sapiens
gacggauauaaaggaagaauauuuccuuuauguguuucuccagaauggugccuguuucucucugugu

SEQ ID NO: 241651 - RNA, 67 nt, Homo Sapiens
acacagaagccacaccauuugcaccauccacgccuugcuccagaaggccuggccgccuucucccugg

SEQ ID NO: 241652 - RNA, 67 nt, Homo Sapiens
gaagguagccagugccugaggucccccugucagcugccuccagaaggcccagucagaucucaggcuu

SEQ ID NO: 241653 - RNA, 67 nt, Homo Sapiens
ugugccagacuuacagaaaagccuugccagagauuggcuccagaauuuagaccucgccuagcacucu

SEQ ID NO: 241654 - RNA, 67 nt, Homo Sapiens
cuagcccagcagguuaaucuagggcuaacaccuggaucuccagaaacaauauaauugugaaggaguc

SEQ ID NO: 241655 - RNA, 67 nt, Homo Sapiens
cuggugguggacacagcuuuuucuaauaaacagggaucuccagaacaugccagcuccacucucuggu

SEQ ID NO: 241656 - RNA, 67 nt, Homo Sapiens
cuaauauccuaaaauacagaacauuacagcuugaccucuccagaacauagcccaaugagggcgaaug

SEQ ID NO: 241657 - RNA, 57 nt, Homo Sapiens; identical to SEQ ID NO: 240639

SEQ ID NO: 241658 - RNA, 67 nt, Homo Sapiens
gaaagcuuggaaacuuacccuccagcaauaaguuguucuccagaaaaaaucuucacuuucaauuaua

SEQ ID NO: 241659 - RNA, 67 nt, Homo Sapiens
aucauuugaaacaucuuuugugcuuaccauggaagugcuccagaagauaccuugcuuucaaaaggac

SEQ ID NO: 241660 - RNA, 67 nt, Homo Sapiens
gcaaccacauugaauucuugcccaaaaugguaacugucuccagaacaguggguuuuaguauauauag

SEQ ID NO: 241661 - RNA, 67 nt, Homo Sapiens
cuacuacaauggccaaguacguaacugcccacaggcucuccagaaaaauccauagccaucuacaaua

SEQ ID NO: 241662 - RNA, 67 nt, Homo Sapiens
uuguucgguuauguucauguccucuccauugcuacaucuccagaauauaaacagagagugaacagca

SEQ ID NO: 241663 - RNA, 67 nt, Homo Sapiens
agagcauguucugcauguauucuggaucccccauccccuccagaauagggaggaaauaaagcccugu

SEQ ID NO: 241664 - RNA, 67 nt, Homo Sapiens
caaauguuagacuacacauuacagaucaguuaauuaacuccagaaagagacauaugcagugguucuu

SEQ ID NO: 241665 - RNA, 67 nt, Homo Sapiens
ccuguucugaugggggagggcggucuucccacuuccucuccagaacuccagaaagagcagugugcuu

SEQ ID NO: 241666 - RNA, 67 nt, Homo Sapiens
gaugggggagggcggucuucccacuuccucuccagaacuccagaaagagcagugugcuuaugcuuca

SEQ ID NO: 241667 - RNA, 67 nt, Homo Sapiens
ucagaaaacuucucuucugagccucuuuaacagcuuucuccagaaccagugucugaaccacccugga

SEQ ID NO: 241668 - RNA, 67 nt, Homo Sapiens
ucauuaguaauaaggagaggguugggggugggcagggcuccagaaagucagcagugugccugggcac

SEQ ID NO: 241669 - RNA, 67 nt, Homo Sapiens
aaauaaauguguauauuuaauguuuuauuguuagcuucuccagaaaauugaugcaaauucugguaau

SEQ ID NO: 241670 - RNA, 67 nt, Homo Sapiens
ugaagcugcucucaggcacccccuucuucauugcucucuccagaaaggguugcuagccuuaacuuca

SEQ ID NO: 241671 - RNA, 67 nt, Homo Sapiens
augguuauguuucugccuucggcgagagaacagcaagcuccagaaaguggcugcgccuucagccccg

SEQ ID NO: 241672 - RNA, 67 nt, Homo Sapiens
ggggagcacaguagugcgggccugggcccugcuccaccuccagaaguggcuggauguacccugccug

SEQ ID NO: 241673 - RNA, 67 nt, Homo Sapiens
ccauccugcgacccucacuggccuggccuugugggggcuccagaaaagaggcuaggagaggccagag

SEQ ID NO: 241674 - RNA, 67 nt, Homo Sapiens
ccuucaaggcacagcccuuguugggagggagaacccucuccagaaacccugccaccauggugucuug

SEQ ID NO: 241675 - RNA, 67 nt, Homo Sapiens
gacucugagcugccccuggcuuccuuuaaggaggcugcuccagaaggaaccuggguggggagggcga

SEQ ID NO: 241676 - RNA, 67 nt, Homo Sapiens
ccacucuguaccccaaagagaguucucaugaaauauucuccagaauguauucauuaucaagaaaaug

SEQ ID NO: 241677 - RNA, 67 nt, Homo Sapiens
ggugauucucuugaugccaccuucagauccuuuuauucuccagaauaauucuuaacagugguucaaa

SEQ ID NO: 241678 - RNA, 67 nt, Homo Sapiens
cuucugagcccgucucccggacagguugaggaagcugcuccagaagcgccucggaaggggagcucuc

SEQ ID NO: 241679 - RNA, 67 nt, Homo Sapiens
gucagaaaauucuggaacuugaaaaaguaguaagggccuccagaauugacuuagcccuaguaauaaa

SEQ ID NO: 241680 - RNA, 67 nt, Homo Sapiens
auuuuuaaauuuuuuaauuaccuguuguaggguguuccuccagaagcaaagagcaaaauuuuacugu

SEQ ID NO: 241681 - RNA, 67 nt, Homo Sapiens
cugcaaacuucagucuggacuucuuuuugccagagaacuccagaaaccagucaggcucucagucagc

SEQ ID NO: 241682 - RNA, 67 nt, Homo Sapiens
uuuaguguagaugaaaaugucccccuucacccacucccuccagaacaugacauagcuucccuucccu

SEQ ID NO: 241683 - RNA, 67 nt, Homo Sapiens
cguggccuuccagaacagucaaacagacucccacugucuccagaagucugcagaaaaacacaaacaa

SEQ ID NO: 241684 - RNA, 67 nt, Homo Sapiens
ucagcagaucugagccaccgcuccuguuccugugccacuccagaaccagacccagugucauuugcuc

SEQ ID NO: 241685 - RNA, 67 nt, Homo Sapiens
auguguguggcuucccuaccagccuaacugugcucugcuccagaaacuggcaucugaauguuccagc

SEQ ID NO: 241686 - RNA, 67 nt, Homo Sapiens
cagcagagccuucuagggucaaaguggagguuucagccuccagaagaacugucacuuuaguuaugcu

SEQ ID NO: 241687 - RNA, 67 nt, Homo Sapiens
uuaccacaaaagcaaaauuucuuugcauuuaugauuucuccagaaauacaguauuuacaguauugag

SEQ ID NO: 241688 - RNA, 67 nt, Homo Sapiens
accuggccgccagccccuucuggaaucacugugaggucuccagaaggacacagcguuggucucuguu

SEQ ID NO: 241689 - RNA, 67 nt, Homo Sapiens
cagcaguguuggaggggccucaguaagcuggaggcugcuccagaacugcucuugucccucacugccc

SEQ ID NO: 241690 - RNA, 67 nt, Homo Sapiens
accccagugccuuuugacaaaguuccaaugcauuuggcuccagaaagguuuauuccuacuggagcuu

SEQ ID NO: 241691 - RNA, 67 nt, Homo Sapiens
acggguaucuccgcguggugagcacaguaaagcuggccuccagaaacuguggggacccucuuccucu

SEQ ID NO: 241692 - RNA, 67 nt, Homo Sapiens
cuuguaaauaaaauaaauccuaccagccgccauccuucuccagaauuucauuauuucaccaagccaa

SEQ ID NO: 241693 - RNA, 56 nt, Homo Sapiens; identical to SEQ ID NO: 240675

SEQ ID NO: 241694 - RNA, 67 nt, Homo Sapiens
ccaaguauucguguaaauuaaaaaguaacuaaaguagcuccagaauggggcagggcuuugaucauuc

SEQ ID NO: 241695 - RNA, 67 nt, Homo Sapiens
uagagcccaucaauauuuuuaguucuacugcccgugucuccagaauguauuucaagcugaaaauaau

SEQ ID NO: 241696 - RNA, 67 nt, Homo Sapiens
ggggagcagaguccgagcuucacuugccucuccccaucuccagaagauaaguaugacaacacauaca

SEQ ID NO: 241697 - RNA, 67 nt, Homo Sapiens
gacaauguccccuauucagggucuugugguucucuaacuccagaaaggccagagcacagaccccaga

SEQ ID NO: 241698 - RNA, 67 nt, Homo Sapiens
uucauguuuaugaguauuagguguuuuaaauuucauacuccagaacuauaauuuauauccaaaauuu

SEQ ID NO: 241699 - RNA, 67 nt, Homo Sapiens
aaggcauuaaagaaaauagcaugagauuuuagccuuucuccagaacuaauguguuaaugucaauaug

SEQ ID NO: 241700 - RNA, 67 nt, Homo Sapiens
cugcuugcccccagagagccugugguucagguggggucuccagaagggcgcuguggucaccugagga

SEQ ID NO: 241701 - RNA, 67 nt, Homo Sapiens
auacuggaagccaccucuggccuucuuggaagacccccuccagaagcucaugacccuuaagugccac

SEQ ID NO: 241702 - RNA, 67 nt, Homo Sapiens
auggcagagcagacaggccguugaaccagcaucaagucuccagaaaccaauacaguaagagauagug

SEQ ID NO: 241703 - RNA, 67 nt, Homo Sapiens
caccaaggaaaaagcagagaauccucaaccugcuguccuccagaaagcuggaacugacccuuccuuc

SEQ ID NO: 241704 - RNA, 67 nt, Homo Sapiens
gcuagacuaagaauuagguguaucuugaugacuccugcuccagaaucacaaaucagcuuauauuuuu

SEQ ID NO: 241705 - RNA, 67 nt, Homo Sapiens
gacuguccuauaaguuguacauucacccuccacaguacuccagaaagaacuuacacuggaagcuuug

SEQ ID NO: 241706 - RNA, 67 nt, Homo Sapiens
aauuccagauuuguuuccuuuuggccuccugcaaagucuccagaagaaaauuugccaaucuuuccua

SEQ ID NO: 241707 - RNA, 67 nt, Homo Sapiens
ccgaagauguuuacuacaaaagcaugccaaaccuaggcuccagaaaccacguccaucagcugcauac

SEQ ID NO: 241708 - RNA, 67 nt, Homo Sapiens
agauacuagcauugcacauauagucugcuuucuguuccuccagaauuugaguccuguuaauguagua

SEQ ID NO: 241709 - RNA, 67 nt, Homo Sapiens
cuuucauucuucaacagugccuugcauguaacaagcacuccagaaauguuuguugaaugaaugaaug

SEQ ID NO: 241710 - RNA, 67 nt, Homo Sapiens
ucucauggcuggagagcugaucagccaggcacagaaucuccagaacaaccuagagagugaaugcuaa

SEQ ID NO: 241711 - RNA, 67 nt, Homo Sapiens
ccaaaucuccuggcaccuugaucuuggauuuuacagccuccagaacugugagaaaauaaauuucugu

SEQ ID NO: 241712 - RNA, 67 nt, Homo Sapiens
uuuuuaaugguacuuaguauuuugaucaaacuuuagucuccagaacuaaacaagucccuaaguuucc

SEQ ID NO: 241713 - RNA, 67 nt, Homo Sapiens
auuacaggaaguacuggagaaaauggacguguuaugacuccagaauuucccaaagcagugcaugcug

SEQ ID NO: 241714 - RNA, 67 nt, Homo Sapiens
guuuaauguuaccuuuuggcuugagaaugucuuucagcuccagaauuauuguuacucauauuuuaau

SEQ ID NO: 241715 - RNA, 52 nt, Homo Sapiens; identical to SEQ ID NO: 240697

SEQ ID NO: 241716 - RNA, 67 nt, Homo Sapiens
uugugaccacuauuguggguuuguugggugcugguagcuccagaauucuuguauaguaauuuuguug

SEQ ID NO: 241717 - RNA, 67 nt, Homo Sapiens
uaggguuaugugugucauucguagagcuucacagcuacuccagaaaagccuccaaccucacagccuc

SEQ ID NO: 241718 - RNA, 67 nt, Homo Sapiens
uguaacuguguuguuauguggauguccaugugcuagucuccagaacuggcccauccaaagaugucca

SEQ ID NO: 241719 - RNA, 67 nt, Homo Sapiens
uuuuucugucagugaaaauaacuaucuugauuguacucuccagaaaaaauguuauuucuaauaauac

SEQ ID NO: 241720 - RNA, 67 nt, Homo Sapiens
uugggauuaucgucuucuaaguuacaucucauucaaucuccagaagacgagucaaaagcuucaguga

SEQ ID NO: 241721 - RNA, 67 nt, Homo Sapiens
gacguaacuuagcauggaucuuucaucuuauacugagcuccagaaagugacccagcucauggaauuu

SEQ ID NO: 241722 - RNA, 67 nt, Homo Sapiens
aucuuuuauuuuccugucuucuuucuccugugguuugcuccagaauuaagguuuguuuuccauccau

SEQ ID NO: 241723 - RNA, 67 nt, Homo Sapiens
cauucucccuuuugacacaguuguuucagaaagagcucuccagaagccaauauugagauguaauuca

SEQ ID NO: 241724 - RNA, 67 nt, Homo Sapiens
uaguagaagaaaaaaaaucuuucagauaagagguguucuccagaauggaggaacuacuuggcaugua

SEQ ID NO: 241725 - RNA, 67 nt, Homo Sapiens
ccugacuuaacuguaugugcaacagcaaugaaauuaacuccagaagccuuccaccugcgucacccag

SEQ ID NO: 241726 - RNA, 67 nt, Homo Sapiens
aacuucaagcugcucaucuguuaguaagugauguucacuccagaacacauucaugaugagaacuuuc

SEQ ID NO: 241727 - RNA, 67 nt, Homo Sapiens
uaguagaagaaaaaaaaucuuucagauaagagguguucuccagaauggaagaacgacuuggcaugua

SEQ ID NO: 241728 - RNA, 67 nt, Homo Sapiens
gcccucacacugcugugcagccaucaccaccauucaucuccagaauuuguucucagucccaaacuga

SEQ ID NO: 241729 - RNA, 67 nt, Homo Sapiens
accuucuauucauaaauguucuauacaguggacagcccuccagaaugguacuucagugccuagugua

SEQ ID NO: 241730 - RNA, 67 nt, Homo Sapiens
agcaaaauaaggaagagggcugagcugagcuucgguucuccagaauguaagaaaacaaaaucuaaaa

SEQ ID NO: 241731 - RNA, 67 nt, Homo Sapiens
cugccgaccaccagcaccauccucuccucccagcagccuccagaaccaugcccaggucuccugccuc

SEQ ID NO: 241732 - RNA, 67 nt, Homo Sapiens
ccucugaccucaucaugguucuaguucucauacagaacuccagaauuuuuaaagaacucuauaauug

SEQ ID NO: 241733 - RNA, 67 nt, Homo Sapiens
aauuuuacugaaucugucuacccuucauucaugagaacuccagaaugaguguugaccacugaagcau

SEQ ID NO: 241734 - RNA, 67 nt, Homo Sapiens
uuucccacacuaagguaaguucagacuagauugaacacuccagaauuuuuuacuacagacuguuuuu

SEQ ID NO: 241735 - RNA, 67 nt, Homo Sapiens
augcauccccauggagagacagcauugcuccccagcccuccagaaaccuugagcagauccagggauc

SEQ ID NO: 241736 - RNA, 67 nt, Homo Sapiens
ugggcauugccgggguaggguggugucuucaccacagcuccagaaggcacuggugggauguggaguc

SEQ ID NO: 241737 - RNA, 67 nt, Homo Sapiens
aaaggaaagaaucaaauuucuugcccggucacuggcacuccagaagacagcgugccggaaccggcag

SEQ ID NO: 241738 - RNA, 67 nt, Homo Sapiens
ugcaacuuucauagucccaaagauaggcagagaacaucuccagaaaugugugugugugugugugugu

SEQ ID NO: 241739 - RNA, 67 nt, Homo Sapiens
ccccauuccccucugagcaucagacucauggcguucccuccagaacucacagaagagccacagucuc

SEQ ID NO: 241740 - RNA, 67 nt, Homo Sapiens
gugcuuguggagggccugaccaccuagucagacgaaacuccagaacaccucgaaaagccagaggguu

SEQ ID NO: 241741 - RNA, 67 nt, Homo Sapiens
ucugaaacacauucuugaagaguuaauaaacagaaaucuccagaaccacccauaauuuucuucaaug

SEQ ID NO: 241742 - RNA, 67 nt, Homo Sapiens
uagacuucagacccuuaauguguaauaccugguaauucuccagaagacacacuauauuacagaauga

SEQ ID NO: 241743 - RNA, 67 nt, Homo Sapiens
aauaaucaucuguguggcaugcuuaucaguugacucucuccagaauauguauuaauuguaaagccaa

SEQ ID NO: 241744 - RNA, 67 nt, Homo Sapiens
caguguggugcuguggaaggugcccuggcuggaaagacuccagaaucggcacuguugcagcuuccuc

SEQ ID NO: 241745 - RNA, 67 nt, Homo Sapiens
gaagagaaugauggauauucgggaaguguggguuugucuccagaacaaccccucugugaggagcugu

SEQ ID NO: 241746 - RNA, 67 nt, Homo Sapiens
agcacuagggucccaggagaggaagcugaggauagagcuccagaaacccuagucccugaggguggag

SEQ ID NO: 241747 - RNA, 67 nt, Homo Sapiens
ugggaggggggaaagagaccagccuuggucccuaagccuccagaaacgucuucuuaauccccaccuu

SEQ ID NO: 241748 - RNA, 67 nt, Homo Sapiens
uggggcauauuucugugcuguggaugacauggccuuacuccagaaucccaggcccuccacugugacu

SEQ ID NO: 241749 - RNA, 67 nt, Homo Sapiens
ugaagugcuggcaaccacuaagaauucaaacuggggccuccagaacucacuggggccuacagcuuug

SEQ ID NO: 241750 - RNA, 67 nt, Homo Sapiens
uccuucagccuuaaauacaaaaauaaaacugaaacugcuccagaaagcagcuuucuccaaaaauguc

SEQ ID NO: 241751 - RNA, 67 nt, Homo Sapiens
aggugaagcccaaaagcucuuaaggagaauuguauuucuccagaagcugcagcaagagguacagcuc

SEQ ID NO: 241752 - RNA, 67 nt, Homo Sapiens
aagaauuauucaauuucaugaauaacucuuguuugcacuccagaaaacaacauacauguuuaaauac

SEQ ID NO: 241753 - RNA, 67 nt, Homo Sapiens
caaaaucuuuuagaauuuuuuuggagguguuuguuuucuccagaauaaagguauuacuuuagaauag

SEQ ID NO: 241754 - RNA, 67 nt, Homo Sapiens
gcuaguggcuguguagcauccucagugcaaaacccagcuccagaauuuucaccugguaacgaauuuc

SEQ ID NO: 241755 - RNA, 67 nt, Homo Sapiens
uacuaaaaugcagcuguuguuagacaacuguugaaaacuccagaaauacaucacccaagguggcagu

SEQ ID NO: 241756 - RNA, 67 nt, Homo Sapiens
aaaaacccaggccuugacauuguuauucaaauggccccuccagaaaguuuaaugauuuccauuugua

SEQ ID NO: 241757 - RNA, 67 nt, Homo Sapiens
cagcgugaaaccuuggcacaggacugaggauccucuccuccagaaaagcccccucgaggaaauaaau

SEQ ID NO: 241758 - RNA, 67 nt, Homo Sapiens
cgggaggugucuacugaaaagggaaccugcuucuuuacuccagaacgcuguucuuuaaagaccaaga

SEQ ID NO: 241759 - RNA, 55 nt, Homo Sapiens; identical to SEQ ID NO: 240741

SEQ ID NO: 241760 - RNA, 67 nt, Homo Sapiens
gcucagggccuuccccacagacucuugccacuccuagcuccagaagguggucaaauacuugacuccc

SEQ ID NO: 241761 - RNA, 67 nt, Homo Sapiens
uaagacaggccacaggagggaggcaggcccaguccuccuccagaaaaggguuuaagaugcuaggaug

SEQ ID NO: 241762 - RNA, 67 nt, Homo Sapiens
uucugggauaacauuuggagccuccccuucucccugccuccagaaugucucagacucugauuagcug

SEQ ID NO: 241763 - RNA, 67 nt, Homo Sapiens
auuaaccaccccucucuaguggaaauuccacagcugccuccagaaaccaggagagggggagcaaaca

SEQ ID NO: 241764 - RNA, 67 nt, Homo Sapiens
accccgacggggggccuuaugcucccugggaggcaggcuccagaagcucccgccagcuccucagccu

SEQ ID NO: 241765 - RNA, 67 nt, Homo Sapiens
cucugaccccauuuguuuuuucugcccugccacaugacuccagaaguaucagugcuacaggaguaca

SEQ ID NO: 241766 - RNA, 67 nt, Homo Sapiens
ccuuuggaaauggugaaggauccuguuccugcaaggucuccagaaccccucuuggcuaaggugcugu

SEQ ID NO: 241767 - RNA, 67 nt, Homo Sapiens
uucuauuaccuuuaaaaaagucacagaggauagcaagcuccagaaggcucugucucaaauaauuauu

SEQ ID NO: 241768 - RNA, 67 nt, Homo Sapiens
guaaugguggcagaacccacaacugcgcagcaggcaccuccagaaagcuuagagcgagagcagagca

SEQ ID NO: 241769 - RNA, 67 nt, Homo Sapiens
ggaguuuucugugagaauaauucauauugaggggcaacuccagaaguaggcuuuuacuuccgguuuc

SEQ ID NO: 241770 - RNA, 67 nt, Homo Sapiens
auuaauaaaacaaaacaaaaagggguagggacugggacuccagaaccauuacuaaagcaaaauuucc

SEQ ID NO: 241771 - RNA, 67 nt, Homo Sapiens
aacuugauucaucgcugcaagaguauuccccaauggacuccagaagauagccuucuagcugaaaaac

SEQ ID NO: 241772 - RNA, 67 nt, Homo Sapiens
ccuagaaacaucucaucauucuaaaagagcauaucuucuccagaaguccauccagggcaaggacaga

SEQ ID NO: 241773 - RNA, 67 nt, Homo Sapiens
agaaacuguuucuccaggcggcugcugcugagauggacuccagaagaaaugaaugugggagaaaauc

SEQ ID NO: 241774 - RNA, 67 nt, Homo Sapiens
uaguacgcuuuauuuuuagaaaaauauuugaaaaacacuccagaaucccauaaguggcaaauauuuu

SEQ ID NO: 241775 - RNA, 67 nt, Homo Sapiens
auagaagcucagccuggccuccaggcacggcucauuccuccagaauuucuuccccguguggcccacc

SEQ ID NO: 241776 - RNA, 67 nt, Homo Sapiens
agcagagccaccauuuuuuauaauuucuaauaaccaacuccagaacuaggagcugaucaacucuuug

SEQ ID NO: 241777 - RNA, 67 nt, Homo Sapiens
gggagauguuggcaccuuugaauucuacauccuguuucuccagaaugagaauuuguguacaaagaua

SEQ ID NO: 241778 - RNA, 67 nt, Homo Sapiens
caguauaccuuauaacacugagccacuucuccccacccuccagaagggguccacguugaauucugaa

SEQ ID NO: 241779 - RNA, 67 nt, Homo Sapiens
gaagcauugcauugugggaaucacaaagcaaauaguacuccagaaagacaaauaucagaagcuuccu

SEQ ID NO: 241780 - RNA, 67 nt, Homo Sapiens
uguuuuuagacuguuagacaaaagugcucacgugcagcuccagaauauggaaacagagcaaaagaac

SEQ ID NO: 241781 - RNA, 67 nt, Homo Sapiens
agccccgccuuccccaaagcagaggggcugucugugucuccagaaaggggacaucgggggggagggg

SEQ ID NO: 241782 - RNA, 67 nt, Homo Sapiens
cucugaguuugggcugcaagugcucacagcucuuguucuccagaaacuggagaauugcccucaggag

SEQ ID NO: 241783 - RNA, 67 nt, Homo Sapiens
gauauuucuacccaugcaacggaagaaaaacccauuacuccagaagaguauaucuaaguaacuaaaa

SEQ ID NO: 241784 - RNA, 67 nt, Homo Sapiens
guucccuugaugaagaaguugauaugccuuuucccaacuccagaaagugacaagcucacagaccuuu

SEQ ID NO: 241785 - RNA, 67 nt, Homo Sapiens
gcauuugugucgguuaaaaauucgaaggcuuaugggucuccagaaacucugccagccagccucagug

SEQ ID NO: 241786 - RNA, 67 nt, Homo Sapiens
agccucccaaauaacuauuuucuuaucugcaguauuccuccagaagagcuaaccagggcagggcugg

SEQ ID NO: 241787 - RNA, 67 nt, Homo Sapiens
ucugcccuuccaacgcaucacccgccucaaacugcugcuccagaacauucugaagagaacacagccu

SEQ ID NO: 241788 - RNA, 67 nt, Homo Sapiens
cuugggcuaagguauaaaucaacacacugcuuccuuccuccagaaggucuuacugugaaggaaaaaa

SEQ ID NO: 241789 - RNA, 67 nt, Homo Sapiens
uuaggcuuuuguauuuuuuaacucuagucaguuuugucuccagaacccacaacuuggcuacacauag

SEQ ID NO: 241790 - RNA, 67 nt, Homo Sapiens
gcagaucccucagcaggaacaucugcaguauuuguaccuccagaauguaguccugcggugauauucu

SEQ ID NO: 241791 - RNA, 67 nt, Homo Sapiens
cacuuugagauacuuaaagaauguaguaaaaagauuucuccagaaaaauggaauaucaaguauaaug

SEQ ID NO: 241792 - RNA, 67 nt, Homo Sapiens
cuucuggcugauuguuccgaguuugugcuuccucuuucuccagaagcgggguaguucuguucugugg

SEQ ID NO: 241793 - RNA, 67 nt, Homo Sapiens
augaacugcaguggagaugacgagcuuuuggacagcucuccagaagcggccucaaaccagcccaacc

SEQ ID NO: 241794 - RNA, 67 nt, Homo Sapiens
ucuggacggagcugcuggcaccaggcagcagucucugcuccagaaucccaagauucaucugugaccu

SEQ ID NO: 241795 - RNA, 67 nt, Homo Sapiens
uacuauccaucuugaugagaaaauguauaguuugacucuccagaaugcauguuucuuuucuauagag

SEQ ID NO: 241796 - RNA, 67 nt, Homo Sapiens
gugagaaauacauaccugcuaacccuuggacuucagccuccagaacugaaggcccucaccagaaccc

SEQ ID NO: 241797 - RNA, 67 nt, Homo Sapiens
ccuucagcucuugccuugccaggacuggacccuccuucuccagaaggccuggaucaggguggggaca

SEQ ID NO: 241798 - RNA, 67 nt, Homo Sapiens
augcuugugagaaucauuaaaaaauaguguucuuuuucuccagaaaaagucaauauaaauucuacag

SEQ ID NO: 241799 - RNA, 67 nt, Homo Sapiens
cgaccucuccaaccaccacacuccccgccguacaguucuccagaaucccaggcgaugacaagucuga

SEQ ID NO: 241800 - RNA, 67 nt, Homo Sapiens
gggcucccaggggccggccuccucugccugguaaugacuccagaacaacaacugggaagaaacuuga

SEQ ID NO: 241801 - RNA, 67 nt, Homo Sapiens
uuagaaggaagcauggcccugacuucagaauuccagacuccagaacuggaagaauaaaugucuguug

SEQ ID NO: 241802 - RNA, 67 nt, Homo Sapiens
auccugcauugaauugaauaugaauuucucuaacucucuccagaaaauggauggagauaacuugucu

SEQ ID NO: 241803 - RNA, 67 nt, Homo Sapiens
aaugugagauucuuuagccacuuuggggagccugucucuccagaagccuuucuuaguggugcccaca

SEQ ID NO: 241804 - RNA, 67 nt, Homo Sapiens
accuuaaaaugcacggcuaaacuauucagaguuaacacuccagaauuguuaaauuacaaguacuaug

SEQ ID NO: 241805 - RNA, 67 nt, Homo Sapiens
gcacugagcgccugcagaucccgcaggcuucguuugccuccagaaccuucccgucugauuguuccuc

SEQ ID NO: 241806 - RNA, 67 nt, Homo Sapiens
auuaaccuuucuaaaaguuuucaucgccuugguaaagcuccagaaauggacaaugcuagugacugca

SEQ ID NO: 241807 - RNA, 67 nt, Homo Sapiens
cauauugcccggugaugaaagcuuccucacuucaugccuccagaaagcaacaucggcuucucagaug

SEQ ID NO: 241808 - RNA, 67 nt, Homo Sapiens
gaugcagagagcuguggggcauggguagcuuggcugccuccagaagagccccucugggccaaagccc

SEQ ID NO: 241809 - RNA, 67 nt, Homo Sapiens
augaaaagcaauacaacuuugaggagagagggcacaucuccagaaaaagugauagggauccuggugg

SEQ ID NO: 241810 - RNA, 67 nt, Homo Sapiens
gaaggggguggggauuuucuggcuuuagauacgaaaucuccagaauguacuucauccucgccucuca

SEQ ID NO: 241811 - RNA, 67 nt, Homo Sapiens
ugacgacugggccaugugacggcugugacacucuacccuccagaaccugagucccaugggauucccc

SEQ ID NO: 241812 - RNA, 67 nt, Homo Sapiens
ugcucuccacuugcuuuaggagcucaaaugucaccuucuccagaagcguuauuuuucuugaagaggc

SEQ ID NO: 241813 - RNA, 67 nt, Homo Sapiens
uagcaauuuccgccuggugacucgcaucagcgccggccuccagaacucagauccagcaggccccagu

SEQ ID NO: 241814 - RNA, 67 nt, Homo Sapiens
uuuuaaggcuacauuuuggagucauuuaucugagucucuccagaaguggagaggagaggagggggag

SEQ ID NO: 241815 - RNA, 67 nt, Homo Sapiens
aagcacuuagcgugcuguucucagugucacaaaauaacuccagaaagggaagcuuuucuuuggcgau

SEQ ID NO: 241816 - RNA, 67 nt, Homo Sapiens
auucacuuuaaacuuuuauuaccacaguugcugccuccuccagaauuuuugaauuuuaauaaaaggc

SEQ ID NO: 241817 - RNA, 67 nt, Homo Sapiens
ccaacauugcgagaguagcuauuuugaaagaauaauucuccagaaguuaacaucuaauaucuaguau

SEQ ID NO: 241818 - RNA, 67 nt, Homo Sapiens
aacaaaaucaccagcaccuugaucuuugacuucuaaucuccagaauagugagaaauaaauuucuguu

SEQ ID NO: 241819 - RNA, 67 nt, Homo Sapiens
cguguucuuugccaccagccugucacuccaguggcagcuccagaaacggaggcuguugcuuuuaucc

SEQ ID NO: 241820 - RNA, 67 nt, Homo Sapiens
ccacuacugcuucugucccugcuggcagccucugucccuccagaacggcuaaccagagcacacuguc

SEQ ID NO: 241821 - RNA, 57 nt, Homo Sapiens; identical to SEQ ID NO: 240803

SEQ ID NO: 241822 - RNA, 67 nt, Homo Sapiens
guuuuaauccuugcuuugguuuggaacugccuucgggcuccagaacuuaaauugcuugguccguggc

SEQ ID NO: 241823 - RNA, 67 nt, Homo Sapiens
cggggugggcugggccgcuggagccuccgccugcuuccuccagaagacacgaaucaugacucacgau

SEQ ID NO: 241824 - RNA, 67 nt, Homo Sapiens
aaucaguguuaguccucuguaguucuucuccauguuucuccagaauucucccugcuaagcaguuuau

SEQ ID NO: 241825 - RNA, 67 nt, Homo Sapiens
cugcucucagcaauugcagucguuccccuggaucauacuccagaauuagcucagugguguggggaaa

SEQ ID NO: 241826 - RNA, 63 nt, Homo Sapiens; identical to SEQ ID NO: 240808

SEQ ID NO: 241827 - RNA, 67 nt, Homo Sapiens
ucccaacucgucugccgucccccgccccaauuccaagcuccagaaacugacuucuuggaccuccucc

SEQ ID NO: 241828 - RNA, 67 nt, Homo Sapiens
ugcaagagcuucuuagcaguguccacaucacagcucccuccagaagccuccccaccgauuucagcgu

SEQ ID NO: 241829 - RNA, 67 nt, Homo Sapiens
cccacccaagaaaauaauagacuuucagcuccccaugcuccagaauacacagcaguuuccuugcaac

SEQ ID NO: 241830 - RNA, 67 nt, Homo Sapiens
auucuauagugugccagagcuugguuuggauuuguaacuccagaaacgggaugcucuaauuggcugg

SEQ ID NO: 241831 - RNA, 53 nt, Homo Sapiens; identical to SEQ ID NO: 240813

SEQ ID NO: 241832 - RNA, 67 nt, Homo Sapiens
accccggcccccugcccguuauacaaguucuuggucccuccagaaccuauguaguuguucguugguu

SEQ ID NO: 241833 - RNA, 67 nt, Homo Sapiens
uuguagucugucuucaacuauuuuauccaaaauaaaccuccagaagaaaguaguuuucauuuacuua

SEQ ID NO: 241834 - RNA, 67 nt, Homo Sapiens
auaggagaccuaucgucuuggaacuugccauucuuuccuccagaacaaaauguuaacuuucuaacac

SEQ ID NO: 241835 - RNA, 67 nt, Homo Sapiens
acgcacagacagguuuucacauaaaugcagcccauuucuccagaacccauuugaggggugggggggu

SEQ ID NO: 241836 - RNA, 63 nt, Homo Sapiens; identical to SEQ ID NO: 240818

SEQ ID NO: 241837 - RNA, 67 nt, Homo Sapiens
cuuaaggcugcuugguacugaguauacuuaaauauaacuccagaauccagggacuugguguuaaaac

SEQ ID NO: 241838 - RNA, 67 nt, Homo Sapiens
cauuacgccucaacauauacuugugcucuuccuuugccuccagaagaaguuuuuccuugauugugcu

SEQ ID NO: 241839 - RNA, 67 nt, Homo Sapiens
gagacugccuccaccacaggcauccugcaaaugcagacuccagaauccccagcaucagcgggaacca

SEQ ID NO: 241840 - RNA, 67 nt, Homo Sapiens
gugagaaauaaauguguuuuaucuuggaccucccagccuccagaacuccaugucugcuggcaccuug

SEQ ID NO: 241841 - RNA, 67 nt, Homo Sapiens
auuuuguuugcuuugacccugcagggcuacacugaaccuccagaaucagucauacaacauacuuaau

SEQ ID NO: 241842 - RNA, 67 nt, Homo Sapiens
gccguagcaguuugacgauaugggaauauaaauuucgcuccagaaagacauucuuucacauggcuac

SEQ ID NO: 241843 - RNA, 67 nt, Homo Sapiens
gcacaggaacgaaauaccucuuuucaaaagaugaaaacuccagaaacagggcucuuaugagucauuu

SEQ ID NO: 241844 - RNA, 67 nt, Homo Sapiens
aguccguuauuugggaaaguugugaauauuagguuuccuccagaaauuuguuauugguaaucuuuuc

SEQ ID NO: 241845 - RNA, 67 nt, Homo Sapiens
aagaagcccuuuacauuuccuccuguccacaaggcaacuccagaagacuggccuggguugucucaaa

SEQ ID NO: 241846 - RNA, 67 nt, Homo Sapiens
guaucuggucagguugacccaguuuaagaaugcauuccuccagaagaaacaaaguugcaggcacaac

SEQ ID NO: 241847 - RNA, 52 nt, Homo Sapiens; identical to SEQ ID NO: 240829

SEQ ID NO: 241848 - RNA, 67 nt, Homo Sapiens
gccauucucccaaacuaaugccuaucccaguuuagggcuccagaaaaacauuaugaggcucugauuu

SEQ ID NO: 241849 - RNA, 67 nt, Homo Sapiens
ccccacccaggccaggcauggugcccugagccagggucuccagaaagcccccuuucacaggcagcca

SEQ ID NO: 241850 - RNA, 67 nt, Homo Sapiens
ucagguaugccucaccaauucucacgcauuuguauaucuccagaaaucauuugcauaugaugccagc

SEQ ID NO: 241851 - RNA, 67 nt, Homo Sapiens
aaauuccuaaagcuuuuagggugaccuuagagcaagacuccagaauguguguucugugguuucuuag

SEQ ID NO: 241852 - RNA, 67 nt, Homo Sapiens
caauaaaguguaauauuucuggaggguagauuagcugcuccagaauuucuugucauuggucaauagg

SEQ ID NO: 241853 - RNA, 67 nt, Homo Sapiens
ccagccggcuucccccaaggacauuucagaggggacccuccagaagcguuguguuuuucaauuguug

SEQ ID NO: 241854 - RNA, 67 nt, Homo Sapiens
ggguggaggugguguucuauaccuaaaggaugaccugcuccagaaacagcaccagcacagcauguau

SEQ ID NO: 241855 - RNA, 67 nt, Homo Sapiens
ucaauucacacaugacuaccuuugagcuaaugacugucuccagaaaauaacugugccccaagaagug

SEQ ID NO: 241856 - RNA, 67 nt, Homo Sapiens
cuaaauaugccagguagacaccagcccaaguacccuccuccagaagucugugacuaccuugucacua

SEQ ID NO: 241857 - RNA, 67 nt, Homo Sapiens
aacacugaaaauguuuuguuagcuuuuccuucuuucucuccagaagaaacauggauagaugauagcu

SEQ ID NO: 241858 - RNA, 67 nt, Homo Sapiens
augccugcucuaauuucuuuugcccauauaugaguaucuccagaaugucuacaaauaguuuuuguag

SEQ ID NO: 241859 - RNA, 67 nt, Homo Sapiens
ugagguuugaggccaccaaaagaucaacagacaaaugcuccagaaaucuaugcugacugugacacaa

SEQ ID NO: 241860 - RNA, 67 nt, Homo Sapiens
gaggccaucucgggcacaggcccaccccgccccaccccuccagaacacggcucacgcuuaccucaac

SEQ ID NO: 241861 - RNA, 67 nt, Homo Sapiens
uuuccuauaaaguuaaacauacacuuuuacuuuaggacuccagaauuccacuucuaguuauuuauuc

SEQ ID NO: 241862 - RNA, 67 nt, Homo Sapiens
uaugaccagaauucuucuguaauucugcccaugacuccuccagaauuuuaguagauacagggugggu

SEQ ID NO: 241863 - RNA, 67 nt, Homo Sapiens
auuuguuuuauccaugaggaagauuuuuaacaaaagccuccagaagauuuccccucaguuuccauug

SEQ ID NO: 241864 - RNA, 67 nt, Homo Sapiens
gaaaaagauauggugaaggcagaacugcucacaccagcuccagaagcacguccucugacuucacugc

SEQ ID NO: 241865 - RNA, 67 nt, Homo Sapiens
cuggagcagcccaccuagagacccagucuaaugagaacuccagaaaggcuggagcagcccgccuaga

SEQ ID NO: 241866 - RNA, 67 nt, Homo Sapiens
guguguuucccugaugcgggugccuucagccuccucacuccagaaaccucagcucuccucugggccc

SEQ ID NO: 241867 - RNA, 67 nt, Homo Sapiens
ggacagccacggccaaguggugcugcagccacagcuccuccagaaaggggacuaagucacagggauc

SEQ ID NO: 241868 - RNA, 67 nt, Homo Sapiens
ucaccagagagcuuucagcugaguuaggcauggggagcuccagaaggcccaaaaggcagaugacggg

SEQ ID NO: 241869 - RNA, 67 nt, Homo Sapiens
ccaggagucgacaguuuugguggggaauucagccacacuccagaaagcuuuuuugggggcggggggg

SEQ ID NO: 241870 - RNA, 67 nt, Homo Sapiens
agugcaauucagaaggcagcugaagaauuaacuucuccuccagaacaagaggacucccugacaaaag

SEQ ID NO: 241871 - RNA, 67 nt, Homo Sapiens
aagaaucucaaccuggaggggcugacccccuuccuaccuccagaauagacccuucccaccugagcau

SEQ ID NO: 241872 - RNA, 67 nt, Homo Sapiens
ccgccuguccuuccagcaugacuccagacaaaaggaucuccagaaagggaaagccagcagcuguggu

SEQ ID NO: 241873 - RNA, 67 nt, Homo Sapiens
uggaaauccuaguuuccucuaaauaacuucaguccugcuccagaauugaauccaagcucccugcccc

SEQ ID NO: 241874 - RNA, 67 nt, Homo Sapiens
ucugcccaggaggcaggggaccagacacacuagugcucuccagaaucgcuacagaguuccuucucac

SEQ ID NO: 241875 - RNA, 67 nt, Homo Sapiens
ugcuccuuuacccucuugguuggccucugccuggggccuccagaagccgccagucacugcugcaagg

SEQ ID NO: 241876 - RNA, 67 nt, Homo Sapiens
gcagaaagcgggugcuguagcugcuccucccaacaaacuccagaacacccugccggaagggagcccc

SEQ ID NO: 241877 - RNA, 67 nt, Homo Sapiens
cugcuguggacugcaucagggggauugcgucuggggccuccagaacuguggaagaccaagacaccug

SEQ ID NO: 241878 - RNA, 67 nt, Homo Sapiens
ccagccagaagccugauugguauggugcuuaaugaaucuccagaaugaguguggccuggaguauuua

SEQ ID NO: 241879 - RNA, 67 nt, Homo Sapiens
gaaagaccuuacuucauuuccauaguagaauuuauuacuccagaacacauuuucagaauaauuauug

SEQ ID NO: 241880 - RNA, 67 nt, Homo Sapiens
acucuccucuucaucucagcauucuccaucacuuccccuccagaaaaacggauggaaggaagcccuc

SEQ ID NO: 241881 - RNA, 67 nt, Homo Sapiens
uuccccaaggagcuucagggcaguccuucuggcacugcuccagaauuccuccuucuuggugugucug

SEQ ID NO: 241882 - RNA, 67 nt, Homo Sapiens
uacccuagauacuguguuaugugcaacuguagaaacccuccagaaauuuccacugcuguucuucacu

SEQ ID NO: 241883 - RNA, 50 nt, Homo Sapiens; identical to SEQ ID NO: 240865

SEQ ID NO: 241884 - RNA, 67 nt, Homo Sapiens
ucccaccacacagacucugggccuccccgcaaaauggcuccagaauuagaguaauuaugagauggug

SEQ ID NO: 241885 - RNA, 67 nt, Homo Sapiens
caucaaauggcaacauggaauauuguccuccaugccccuccagaaggaccuaggagaguaggugagc

SEQ ID NO: 241886 - RNA, 67 nt, Homo Sapiens
aaacaaggcgucgaggaauuggaaagauuugcacacccuccagaaaggagagacgcaaucuccccuc

SEQ ID NO: 241887 - RNA, 67 nt, Homo Sapiens
guauaaugcuuauuaugaguuuaagaagcaguucuuccuccagaaagaagggggcgauagcaugcag

SEQ ID NO: 241888 - RNA, 67 nt, Homo Sapiens
ugagccgcagcccuggggccaguaggaagcggacccgcuccagaaguccccacgagaagaagaagaa

SEQ ID NO: 241889 - RNA, 67 nt, Homo Sapiens
gagggacuguguugacugacgagccgagggguggccgcuccagaagggugcccagucaggccgcacc

SEQ ID NO: 241890 - RNA, 67 nt, Homo Sapiens
uagaccuuugcuuaugcaaagaccucugaaggguuggcuccagaacuuacccaucauucauucucaa

SEQ ID NO: 241891 - RNA, 67 nt, Homo Sapiens
ccucgucugggaauucgagaugcagagguucucugcccuccagaagcgaucagcagauacaugucag

SEQ ID NO: 241892 - RNA, 67 nt, Homo Sapiens
uguucaauaaaaugcuuuuaguuuugguucuaacuaccuccagaaugccaccccaaucccaaauuuu

SEQ ID NO: 241893 - RNA, 67 nt, Homo Sapiens
uagaagccugucucuguacccaacccagacucucccacuccagaaugcccaccaccaccgacucucc

SEQ ID NO: 241894 - RNA, 67 nt, Homo Sapiens
auuggggucacauaugucccaugaccaggagugucaucuccagaauuucccauggacagagaagaaa

SEQ ID NO: 241895 - RNA, 67 nt, Homo Sapiens
cuuuuuuccuuuuuacaaaccaccauugcuuuccauucuccagaacuucagucuucccaacuucuua

SEQ ID NO: 241896 - RNA, 67 nt, Homo Sapiens
gacuggucaugaagcucaugcucugaacuccugcacucuccagaagugagcaaaaggggcugggaca

SEQ ID NO: 241897 - RNA, 67 nt, Homo Sapiens
cuauccacuguauuuccacacauaaagguggcuucugcuccagaacuauuuacucucuauuauuggg

SEQ ID NO: 241898 - RNA, 67 nt, Homo Sapiens
gucuaaaugcugaaaaaacaauguaccauuugcauggcuccagaaauaagcacgugucucagacugc

SEQ ID NO: 241899 - RNA, 67 nt, Homo Sapiens
cauccugucaaucacucuguuacauuucugccauguacuccagaacuuucucugggagacuucucug

SEQ ID NO: 241900 - RNA, 67 nt, Homo Sapiens
gccucggccucagcuccguuuuaaaugugcuggugcccuccagaaaacucaagugccuucugugagu

SEQ ID NO: 241901 - RNA, 67 nt, Homo Sapiens
ccaagggauguaucagggaugaucagcugaugagaggcuccagaaggauuucuagaucgcuucaagc

SEQ ID NO: 241902 - RNA, 67 nt, Homo Sapiens
gauguuuaagcuagcuuuaccuaagccacuucucagccuccagaauacucucucugggguugugagu

SEQ ID NO: 241903 - RNA, 67 nt, Homo Sapiens
aguguaaacugcaguuuucccugugguuaaaaaugaucuccagaauaaugcuacaggggcacauuuu

SEQ ID NO: 241904 - RNA, 67 nt, Homo Sapiens
caauaccaaccugaaaguucaaggagacuucugucuucuccagaaggguaaaauguagcugcgucau

SEQ ID NO: 241905 - RNA, 67 nt, Homo Sapiens
uuggaacaccuggcaugugacauguugguaaaauccucuccagaaucaagaaagcugauagcuccuc

SEQ ID NO: 241906 - RNA, 67 nt, Homo Sapiens
cagcaagaacacuuggaaugacuuacagaauuauguccuccagaaacuuguagcagugguuacccag

SEQ ID NO: 241907 - RNA, 67 nt, Homo Sapiens
agacauuggcauucaaaugucuucagcuccagugucucuccagaauauaagugugaucauuguugaa

SEQ ID NO: 241908 - RNA, 67 nt, Homo Sapiens
ucaaagaagggaagaaacucaaggccagcugcagguccuccagaaaaggaauggagccugucucagg

SEQ ID NO: 241909 - RNA, 67 nt, Homo Sapiens
uucaauaguuauccccaggccuggcacgucaaagaggcuccagaaauguuugcugagugagugauga

SEQ ID NO: 241910 - RNA, 67 nt, Homo Sapiens
ugccgguacugaagaugcucccuucuuccucccccugcuccagaagggaaguagcaaacuguacauu

SEQ ID NO: 241911 - RNA, 67 nt, Homo Sapiens
uccugcagacauccuacucgaugaaguuacuugcuaacuccagaaauucagauacucucuuugccag

SEQ ID NO: 241912 - RNA, 67 nt, Homo Sapiens
aucccgauucccgggaucuguaaguguuagccagcagcuccagaaaauucugcccuggcucugcaca

SEQ ID NO: 241913 - RNA, 67 nt, Homo Sapiens
acucuuuuugcauaaauaccuaaaaguguguucuuaacuccagaacccuuugagaaauagagaaaua

SEQ ID NO: 241914 - RNA, 67 nt, Homo Sapiens
caugcucgcuucccuuggcaaccaugcauguaguccacuccagaaauuccaguuuacugaacuccag

SEQ ID NO: 241915 - RNA, 65 nt, Homo Sapiens
cuaucccaguaaaagauaugauauuuuccauagauaccuccagaauuuuuuucagcaaauggaau

SEQ ID NO: 241916 - RNA, 67 nt, Homo Sapiens
caagaggaacgguguuauggacugaauguucauguuccuccagaauucauaugcugaagccucuguc

SEQ ID NO: 241917 - RNA, 67 nt, Homo Sapiens
cugcgucugcuggcaccuugaucuugaacuucccagccuccagaacugugagaaagaaaucucuaug

SEQ ID NO: 241918 - RNA, 67 nt, Homo Sapiens
uccagugggaccuuguaaaaugcucccugucagagcucuccagaauaugcuuguuggagauccuuca

SEQ ID NO: 241919 - RNA, 67 nt, Homo Sapiens
gcuaacggugagggcugacucugaacugucucucagucuccagaaaguguucaagccuguuguguuc

SEQ ID NO: 241920 - RNA, 67 nt, Homo Sapiens
uugaaaaggaauuagagggucagaaacacccagguuccuccagaaagcuccuuggagcccaacaacu

SEQ ID NO: 241921 - RNA, 67 nt, Homo Sapiens
auacguauguuuaaaaacccacuuacucaagauuccccuccagaaaaauguagaaagaugugagaua

SEQ ID NO: 241922 - RNA, 67 nt, Homo Sapiens
ccuaaaauacaauuuugagguagggauucuccauggacuccagaaacuuauguuuuaugauaugggu

SEQ ID NO: 241923 - RNA, 67 nt, Homo Sapiens
aaaccaaaauaccaugggauagaaaaacagcuuuaaucuccagaagauugcugcugcauuuauccca

SEQ ID NO: 241924 - RNA, 67 nt, Homo Sapiens
gaaaacaaaucaaauaaauaaaguauuuacaauaucacuccagaaaagaaugagugacaaaucuuua

SEQ ID NO: 241925 - RNA, 67 nt, Homo Sapiens
aaugagccuccaccaccaagcccaaaaauuucagugacuccagaagaauccaagcuucgaaagauau

SEQ ID NO: 241926 - RNA, 67 nt, Homo Sapiens
ugagaugagccagccgagccaguuugaaaaccuagcucuccagaacaucuugaccuaaucagcuuac

SEQ ID NO: 241927 - RNA, 67 nt, Homo Sapiens
acugcggcacgcgcuucgggcugucccccugcucccacuccagaagaacccuccucuacccaaagcu

SEQ ID NO: 241928 - RNA, 67 nt, Homo Sapiens
gaacucaagcugguuuuaaggcaauggcgccugcucccuccagaaugcacuugaccucaucucccga

SEQ ID NO: 241929 - RNA, 67 nt, Homo Sapiens
augggaacaucugggugugcugauuacaucuaaggaccuccagaagcucuggcccucuuucucccag

SEQ ID NO: 241930 - RNA, 67 nt, Homo Sapiens
gcuccccacccccccaaagagccccaguccuuuccuacuccagaaaucccuccgcaccccgccccau

SEQ ID NO: 241931 - RNA, 67 nt, Homo Sapiens
gggaaccuuccaaggugucugguugcccugccucuggcuccagaacagaaagggagccucacgcugg

SEQ ID NO: 241932 - RNA, 67 nt, Homo Sapiens
uucccaccaacuccuauuucccuaccaaccaaggagccuccagaaggaaaggaggaagaaauguuuu

SEQ ID NO: 241933 - RNA, 67 nt, Homo Sapiens
aggaccucaaccccagggauucccaggaagcagaacucuccagaagaaggguuuugaucauuccagc

SEQ ID NO: 241934 - RNA, 67 nt, Homo Sapiens
cacugcccugccucaacaggguccauugccuccucgccuccagaacuuggagcagggaagugggcac

SEQ ID NO: 241935 - RNA, 67 nt, Homo Sapiens
cccuggaaagauauagcauagugguucucagcacagucuccagaacagaagcaucuguaguaccugg

SEQ ID NO: 241936 - RNA, 67 nt, Homo Sapiens
acggagacauugaccccucccuccaugugguaaaccacuccagaauggccaccaggcuucccagagu

SEQ ID NO: 241937 - RNA, 67 nt, Homo Sapiens
uaacuuguguuacaucuauaaagagcaaaauaacacacuccagaacuuggcaguuguagcauuaguu

SEQ ID NO: 241938 - RNA, 67 nt, Homo Sapiens
guggagcucauguuugugauccucuaucuggacagcucuccagaauccuguguugccccuguucugc

SEQ ID NO: 241939 - RNA, 67 nt, Homo Sapiens
augagaaugugccaugcaugaagcaaaggauuccaggcuccagaaaaaaugaaugaacucaccuuga

SEQ ID NO: 241940 - RNA, 67 nt, Homo Sapiens
gagaagcugggcaggacaaguaggacaucccuggagccuccagaagggacuggccucugcccacacc

SEQ ID NO: 241941 - RNA, 67 nt, Homo Sapiens
aaguaugauuuguguucaaucaagccugaccaagaggcuccagaauaugcagagggagugugcgaau

SEQ ID NO: 241942 - RNA, 67 nt, Homo Sapiens
cugaugguaucaauggauuuccuuugauauugccacccuccagaaucuggggaagaagacacagaag

SEQ ID NO: 241943 - RNA, 64 nt, Homo Sapiens; identical to SEQ ID NO: 240925

SEQ ID NO: 241944 - RNA, 67 nt, Homo Sapiens
acagcccuucuccccaagggugccgucccuccccugccuccagaaucuaggaccuggcagcuuuucu

SEQ ID NO: 241945 - RNA, 67 nt, Homo Sapiens
uggguucguccccagugagagucugucaggggagaggcuccagaaccauaagugccggugacaagcu

SEQ ID NO: 241946 - RNA, 67 nt, Homo Sapiens
caaggcuccaggcccgugugaagcugccggccacugucuccagaacgacgcacacggcgucaaaacc

SEQ ID NO: 241947 - RNA, 67 nt, Homo Sapiens
guguucugcugagacugagcaccuuacagauauuuuucuccagaagauggugcuggguaauaaaauc

SEQ ID NO: 241948 - RNA, 67 nt, Homo Sapiens
ccccauccccuuuccuccccaccuuccccagacucagcuccagaauaccuucuucgcugcuagagaa

SEQ ID NO: 241949 - RNA, 67 nt, Homo Sapiens
uccuauuauucgcuccaagaaagaugcuaagucugagcuccagaagagacugugcuggguguggcuu

SEQ ID NO: 241950 - RNA, 67 nt, Homo Sapiens
ggcgaggugccgccuuggccgggcccccacgugucuucuccagaaugugucugucuuugccuggugu

SEQ ID NO: 241951 - RNA, 67 nt, Homo Sapiens
aucagcgacacacacacacuuauggcaccagccuggacuccagaaaaaggguguccagguauugugu

SEQ ID NO: 241952 - RNA, 67 nt, Homo Sapiens
gcagagcuggagcucgaucaugccugcgugacaaagccuccagaaaaauccuugaaagacaggacau

SEQ ID NO: 241953 - RNA, 67 nt, Homo Sapiens
gacuugcggccacagcacuagagucacccccccaggccuccagaaccuuacuggcacuguggcacug

SEQ ID NO: 241954 - RNA, 67 nt, Homo Sapiens
uaaaugaucuguacuaucuagugucuaaaacacuauucuccagaaaaaucaaucauuuucuagcccu

SEQ ID NO: 241955 - RNA, 67 nt, Homo Sapiens
uuggacaaugaauguaguuaacugguuccugcucacacuccagaauuaaauucuauugaaaaaggaa

SEQ ID NO: 241956 - RNA, 67 nt, Homo Sapiens
gcuuugcagaucacagugcuggaagcaggaacccaggcuccagaagguguugccaggggcccagaug

SEQ ID NO: 241957 - RNA, 67 nt, Homo Sapiens
agucaaagaugaacaucggaauaacaaacauuguccucuccagaaaguccuuucuuucuccauacug

SEQ ID NO: 241958 - RNA, 67 nt, Homo Sapiens
cagucucaggauuuagaaagucuguaagccauccaugcuccagaaagcaccgaucuguuguaguugc

SEQ ID NO: 241959 - RNA, 67 nt, Homo Sapiens
agagcguggaggcgugugcaggcuuggaagaagaacucuccagaacauggaacuuaacccucuuuug

SEQ ID NO: 241960 - RNA, 67 nt, Homo Sapiens
gaaacugaggccagagggaggagagaauugcucauggcuccagaacugguggcaaguuucucuggac

SEQ ID NO: 241961 - RNA, 67 nt, Homo Sapiens
uguggggagaguggggaaucuggguaaacacugggaacuccagaaguagcuucuggauacagccuuu

SEQ ID NO: 241962 - RNA, 67 nt, Homo Sapiens
gccccucacccuucuuccccuugcccgccuacccucccuccagaauaagcucccccuucaccccucc

SEQ ID NO: 241963 - RNA, 67 nt, Homo Sapiens
agcugcuucuccccccauccaccaugaccccuucucucuccagaaacuggaggguaacuggggggcc

SEQ ID NO: 241964 - RNA, 67 nt, Homo Sapiens
ucagcucaauugcugugcaguuacgaucaaucacagucuccagaagaagugccuucuucauccuucc

SEQ ID NO: 241965 - RNA, 67 nt, Homo Sapiens
ugacaaggcaccagcaggaccugugcagcucacaccacuccagaaccagcagcaagggggaccgaug

SEQ ID NO: 241966 - RNA, 67 nt, Homo Sapiens
cccgcgccccacauaccugcgucucuuuugguccuggcuccagaaaagucccuccuggucgugcccc

SEQ ID NO: 241967 - RNA, 67 nt, Homo Sapiens
acuuuaugaaaugguacacuagcuuggcagauuuuaacuccagaagcaaaguguggacacuuuugac

SEQ ID NO: 241968 - RNA, 67 nt, Homo Sapiens
gaugccaucuuccugaauguaaugagguuuauggagccuccagaacaaggcuuguuccaaguuuguc

SEQ ID NO: 241969 - RNA, 67 nt, Homo Sapiens
uuuccaucccaaaggcagucgaauagaauggagggagcuccagaaacggcauguuccugccccacag

SEQ ID NO: 241970 - RNA, 67 nt, Homo Sapiens
agccccucggaggcagaggaccccacacaacagugcccuccagaagcuccugcaaaccucacagggu

SEQ ID NO: 241971 - RNA, 67 nt, Homo Sapiens
uuauccacuguggaugaugaauagaccaucaucgaaacuccagaaauaagaacucaugguuuuaaau

SEQ ID NO: 241972 - RNA, 67 nt, Homo Sapiens
uggaaccauuucucccgcagccccacccccacccagccuccagaagccuaucccacacccaccccca

SEQ ID NO: 241973 - RNA, 67 nt, Homo Sapiens
uagcuucaccccaaucccagcagagugcaagccccugcuccagaagagggaaaagcagcucuccccu

SEQ ID NO: 241974 - RNA, 67 nt, Homo Sapiens
ugccagcuucucucuccaggauggagugagucaccugcuccagaagaaggggagauggggaggagau

SEQ ID NO: 241975 - RNA, 67 nt, Homo Sapiens
gccaagagaacccaaaccaacaccugccucagccccacuccagaauaggauucugcccuucacuuag

SEQ ID NO: 241976 - RNA, 67 nt, Homo Sapiens
gcaggagaauaaauuugugugaucuugagcuccuggccuccagaauugacuugagcccauugaaacu

SEQ ID NO: 241977 - RNA, 67 nt, Homo Sapiens
cuguucuuuaaagaccaagagggaaccugcuucuuuacuccagaacucgggaggugucuacugaaaa

SEQ ID NO: 241978 - RNA, 67 nt, Homo Sapiens
agguacucagcuuucugggaagccaguauuuccccuucuccagaagcauaggaaggaaaaugaagag

SEQ ID NO: 241979 - RNA, 67 nt, Homo Sapiens
gcggaaucccccgcugcagggacacccacgcccuucucuccagaagccgggcaggcagaauccggcc

SEQ ID NO: 241980 - RNA, 67 nt, Homo Sapiens
ugucgagggagaggaggggguuggggaggacccaccucuccagaauggcgacuguccccauccgccu

SEQ ID NO: 241981 - RNA, 67 nt, Homo Sapiens
aaggcaucuaaguuagagcuggcaccagaacugagaccuccagaaaucuauuccaguauuuuuucca

SEQ ID NO: 241982 - RNA, 67 nt, Homo Sapiens
cccaguuucugucaucuuaauuugucacuagaauguucuccagaaacuuuucuguccugcuuugccu

SEQ ID NO: 241983 - RNA, 67 nt, Homo Sapiens
uggcuuagaggagcuccaaaaccauaucuuagaguaucuccagaaacuuucauucucagaaaaucca

SEQ ID NO: 241984 - RNA, 57 nt, Homo Sapiens; identical to SEQ ID NO: 240966

SEQ ID NO: 241985 - RNA, 67 nt, Homo Sapiens
aauagcagcugacaacuuucguccaguuguggcagcucuccagaaguacuggugauacuccaacacc

SEQ ID NO: 241986 - RNA, 67 nt, Homo Sapiens
cucagcaagggcucagcugggaucugcgcccggccugcuccagaacgcagcccacucgccaccggug

SEQ ID NO: 241987 - RNA, 67 nt, Homo Sapiens
gaggggguuugcuggggaacuggcgccaucgccgggacuccagaaccgcagaagccuccccagcuca

SEQ ID NO: 241988 - RNA, 67 nt, Homo Sapiens
ccugcccugcccucuccucacaggucuguugcagggacuccagaaaccauucugggagccguggaug

SEQ ID NO: 241989 - RNA, 67 nt, Homo Sapiens
uucugguucaugaugcauaaagcgcuaggcccuagaacuccagaaacagcacagcuggggcggggac

SEQ ID NO: 241990 - RNA, 67 nt, Homo Sapiens
ggggccacagccacaccucaccgcccaguccagcugucuccagaaggggacaggcaguccgcggucu

SEQ ID NO: 241991 - RNA, 67 nt, Homo Sapiens
cacuuuggccaccaguucuucggccagcaccucugcccuccagaaccugcagccuggaggggugagg

SEQ ID NO: 241992 - RNA, 67 nt, Homo Sapiens
gccccagcccggagcccagcccccugccccggcccugcuccagaacccagcccagaucggaggacaa

SEQ ID NO: 241993 - RNA, 67 nt, Homo Sapiens
ucucuagaacccaauccaauuuggagccccagcccaacuccagaacccaacccuucucuagaaucca

SEQ ID NO: 241994 - RNA, 67 nt, Homo Sapiens
accccggcugggucugcguccuuuccugugccuuucccuccagaaugcggccucagaccuagaagcu

SEQ ID NO: 241995 - RNA, 64 nt, Homo Sapiens; identical to SEQ ID NO: 240977

SEQ ID NO: 241996 - RNA, 67 nt, Homo Sapiens
uuuaauuuucucggaggugauaggcuuccacacaggucuccagaagcccugcauugaauauccaucc

SEQ ID NO: 241997 - RNA, 67 nt, Homo Sapiens
guacuguuccagcaucuucccuggauggcuggaggaacuccagaaaauauccaucuucuuuuugugg

SEQ ID NO: 241998 - RNA, 67 nt, Homo Sapiens
caagccagcuccacugcccaggcccccaagagggcagcuccagaagcugcccagggcuccgggaccc

SEQ ID NO: 241999 - RNA, 67 nt, Homo Sapiens
uccucccuuaggggcugaggaagcugcccucgaaacccuccagaagacaucuguccugcagaggccc

SEQ ID NO: 242000 - RNA, 67 nt, Homo Sapiens
aauauccuuauccaaaucaauaaagagagaauccucccuccagaaggguuucuaaaaacagcccuca

SEQ ID NO: 242001 - RNA, 67 nt, Homo Sapiens
ugagucuaggacagauuuuacguggagaguugaacuacuccagaaacuaaagaguaauguuucuaga

SEQ ID NO: 242002 - RNA, 67 nt, Homo Sapiens
ugcugugagaccuccuggaacacuggcaucucugagccuccagaagggguucugggccuaguugucc

SEQ ID NO: 242003 - RNA, 67 nt, Homo Sapiens
uaggccccgccuggcacucagccuugccagagauuggcuccagaauuuuugccaggcuuacagaaca

SEQ ID NO: 242004 - RNA, 67 nt, Homo Sapiens
gggagagagggucucucuccuagcugcuacccaggaccuccagaaggagcccuuggaccucugggag

SEQ ID NO: 242005 - RNA, 67 nt, Homo Sapiens
cucauacuaagugcuuaguaaauguuagauaaguauucuccagaauugauguaaauuauuuuuaaac

SEQ ID NO: 242006 - RNA, 67 nt, Homo Sapiens
uaauguuauauaaauuccacauuuuuaugcaacuaaucuccagaacauuuuuccucuuaccaagaag

SEQ ID NO: 242007 - RNA, 67 nt, Homo Sapiens
uugcaagucuaggagagugucccaggcguccuuucagcuccagaaugagcuggaguggcacagguga

SEQ ID NO: 242008 - RNA, 67 nt, Homo Sapiens
cuugccugcuagggaccucgugccaggagccucuccccuccagaagacacacgcugggcuucacggc

SEQ ID NO: 242009 - RNA, 67 nt, Homo Sapiens
ucaggcucucagugacccuucaauacauggcucugcccuccagaacuuccuagagugaggcucuguc

SEQ ID NO: 242010 - RNA, 67 nt, Homo Sapiens
gugaggcaauaaauuucucugauauugcacuuccaggcuccagaacuaccaacccugucuccaccuu

SEQ ID NO: 242011 - RNA, 67 nt, Homo Sapiens
ucucuccucaaaggaaagaaccuguuccuccccgggacuccagaauugacuauggucacagggccgu

SEQ ID NO: 242012 - RNA, 67 nt, Homo Sapiens
ugcaggcgccucugguucucaugggcaggcgagaccccuccagaaucaggaucucgggcugccagcg

SEQ ID NO: 242013 - RNA, 67 nt, Homo Sapiens
accgugagaaccaggcauucagguggaaaccauugcccuccagaacacauagcggacgggggucccg

SEQ ID NO: 242014 - RNA, 67 nt, Homo Sapiens
gcugggauuacaaaugugagcaucuaccugccucagccuccagaagucuuaaacuucuaggcucaag

SEQ ID NO: 242015 - RNA, 67 nt, Homo Sapiens
gagccagucaugcuaaaugcaggugacagccuggugacuccagaaugguuuagucaaacucucauuu

SEQ ID NO: 242016 - RNA, 67 nt, Homo Sapiens
ugccagguucuccccuugaggaucaguuuuuccaagacuccagaaggcagggccgggugucuuuagg

SEQ ID NO: 242017 - RNA, 67 nt, Homo Sapiens
ggggcucugggagggauguuaugguccuccauuucaacuccagaaguuugaagguaacugagagcag

SEQ ID NO: 242018 - RNA, 67 nt, Homo Sapiens
ugcauaaucagcgcccuggagccgugccuuucucuggcuccagaauaugcacuccagaauccacaaa

SEQ ID NO: 242019 - RNA, 67 nt, Homo Sapiens
cacaaagccgugccuuucucguuuccaaguuccugcacuccagaauccuccacccccuccagcucca

SEQ ID NO: 242020 - RNA, 67 nt, Homo Sapiens
agaagccagcuccuggaguuaggaggcacagggugcucuccagaacgaagcacaggaaaccaggcag

SEQ ID NO: 242021 - RNA, 67 nt, Homo Sapiens
accaccccauauuaugauuaauuugugucagaaaauacuccagaacagugggagaauuagagaauuu

SEQ ID NO: 242022 - RNA, 67 nt, Homo Sapiens
cacaggagcugcccccagugagaaggagacucagagacuccagaaggacccagaucucauacucaac

SEQ ID NO: 242023 - RNA, 67 nt, Homo Sapiens
auuuccucaacacuugagggcccagaaagucugaucucuccagaaugaucagcccagaggaaugcug

SEQ ID NO: 242024 - RNA, 66 nt, Homo Sapiens
uguuguaaauuaggaggcucaacaauaaaacauuaugcuccagaaauuaugugagaugugcuauau

SEQ ID NO: 242025 - RNA, 67 nt, Homo Sapiens
acaaaucuguaagcaccuugaucuuggacuucucagccuccagaauugugagaaauaaauuucuguu

SEQ ID NO: 242026 - RNA, 67 nt, Homo Sapiens
aucggagacaagcauggugcugcugcuucugcugcuucuccagaaaaucccugggacaccuuuguuc

SEQ ID NO: 242027 - RNA, 67 nt, Homo Sapiens
agcucuuugcaggcguccaauccuagaaaccaauggucuccagaacucucacacaaguguuuuucug

SEQ ID NO: 242028 - RNA, 67 nt, Homo Sapiens
acacugacuggcauccugcuuuccagugccugccagccuccagaagagccaggugccugacuaguac

SEQ ID NO: 242029 - RNA, 67 nt, Homo Sapiens
cugcguuguuaguuuugaagaguggaggagcuaggggcuccagaaagaaucuuacacauguguugaa

SEQ ID NO: 242030 - RNA, 67 nt, Homo Sapiens
uccuuucaugugaaguuuuuucaauauuguggaaucacuccagaagaacaucuuaucccuugaauuu

SEQ ID NO: 242031 - RNA, 67 nt, Homo Sapiens
agcagcuagaaagagaaaaagggcauuggguaagggacuccagaagcucuggcccaacauacgcacu

SEQ ID NO: 242032 - RNA, 67 nt, Homo Sapiens
ucauuccagauccagagaucugacucaacggggacaacuccagaagguaccuucuggccccaacccu

SEQ ID NO: 242033 - RNA, 67 nt, Homo Sapiens
uugucuuacccuccgguguguuucugggucugugccucuccagaaucggcuccugugugccccuggc

SEQ ID NO: 242034 - RNA, 67 nt, Homo Sapiens
agguccagccuaggcccccuagccauucugggaagggcuccagaagacuuugguggggggaccccaa

SEQ ID NO: 242035 - RNA, 67 nt, Homo Sapiens
gccagaagugcaauuaaccugugauacuguugacauccuccagaaugcagcacaagucuugcuaaau

SEQ ID NO: 242036 - RNA, 67 nt, Homo Sapiens
cugggaaaauaaaguccucuauguugaacuucccagccuccagaacucugcaccuacugauguuuug

SEQ ID NO: 242037 - RNA, 67 nt, Homo Sapiens
cucuggcuagaggccagccccucccaguccaaauguccuccagaagcuggacuggcuagaguccuca

SEQ ID NO: 242038 - RNA, 67 nt, Homo Sapiens
uucuagcucuggggucuggcauaccccucuccucugucuccagaagcuguuuggaaacauuuaauuu

SEQ ID NO: 242039 - RNA, 67 nt, Homo Sapiens
gcugggauuacaggcguacaaauucuccugccucagccuccagaauauccaucuccuggauucaaac

SEQ ID NO: 242040 - RNA, 67 nt, Homo Sapiens
cccuugaagggccuuugggaccaucuccacucuccuucuccagaacccaggauaccaugggaaggag

SEQ ID NO: 242041 - RNA, 67 nt, Homo Sapiens
aacaagaaagccaucucuucuuugcugcuugaaucugcuccagaauuuagcaaguguucaguaaaua

SEQ ID NO: 242042 - RNA, 67 nt, Homo Sapiens
caugaugaacugugaucugcccugucuuagccgcagucuccagaaccccccaucuccuaccccacau

SEQ ID NO: 242043 - RNA, 63 nt, Homo Sapiens; identical to SEQ ID NO: 241025

SEQ ID NO: 242044 - RNA, 67 nt, Homo Sapiens
gauuucuauaacagaagugacauguguacugauuuuucuccagaaauauggaugcuguuguauucag

SEQ ID NO: 242045 - RNA, 67 nt, Homo Sapiens
gauuccuaggccuuuucaugcuucauuucuuccacuucuccagaaaauggaagcuaugaagcaacau

SEQ ID NO: 242046 - RNA, 67 nt, Homo Sapiens
ccucuuccuccacacaggucgccgugagucaagcugccuccagaaccucagagcuucccuggugggc

SEQ ID NO: 242047 - RNA, 67 nt, Homo Sapiens
aggcugaccgggcuguucuguagacucaggaccguggcuccagaacuccugugccaggcgggaggga

SEQ ID NO: 242048 - RNA, 67 nt, Homo Sapiens
uggguccggccggagaggccucccgcggacgccgucucuccagaacuccgcuuccaagagggagccu

SEQ ID NO: 242049 - RNA, 67 nt, Homo Sapiens
ccugcuauccugggagaucuaccugaaggagaacuaccuccagaaccgacaguuccagcaaaagcag

SEQ ID NO: 242050 - RNA, 67 nt, Homo Sapiens
caggcgcaucccacucuaugcgaaccacaagacccuccuccagaaggcagccgcugaguucggggcu

SEQ ID NO: 242051 - RNA, 67 nt, Homo Sapiens
uggggggugcagggggcugugggcauccagcgucauccuccagaaccucacaucugaacugggggca

SEQ ID NO: 242052 - RNA, 67 nt, Homo Sapiens
gauaacaaaaucaaauaguacucuugguagagacacgcuccagaagggacuagauugcuuugugaag

SEQ ID NO: 242053 - RNA, 67 nt, Homo Sapiens
gugagucaguaccuguuguugaauucaaacuuuuggccuccagaacugaggaagcacagcccugcuu

SEQ ID NO: 242054 - RNA, 67 nt, Homo Sapiens
cugacuuaagagaguaagauaguguugggacagccaucuccagaaaccuguagacaggcuggauucc

SEQ ID NO: 242055 - RNA, 67 nt, Homo Sapiens
gcuggaaaggaugcugccagaaucagcugcugacugucuccagaaggccaugcugguucccggaaug

SEQ ID NO: 242056 - RNA, 67 nt, Homo Sapiens
ugauguggaaacaaagcaggaccagcaggcacagcaccuccagaacagugccccggaugaccagagg

SEQ ID NO: 242057 - RNA, 67 nt, Homo Sapiens
cugucugccuucuggcugacaauccuggaaaucuguucuccagaauccaggccaaaaaguucacagu

SEQ ID NO: 242058 - RNA, 67 nt, Homo Sapiens
ccauccauagggagcuggcuggggguuuccgugggagcuccagaacuuuccccagcugagugaagag

SEQ ID NO: 242059 - RNA, 67 nt, Homo Sapiens
accaauaggacaauuugcugaggucugagaggacucccuccagaaaaucccugaucucuuaaaauuu

SEQ ID NO: 242060 - RNA, 67 nt, Homo Sapiens
ccaagcugcagccuacugaggaggcagaggccaccuccuccagaaagcccucggccugggccgccgc

SEQ ID NO: 242061 - RNA, 67 nt, Homo Sapiens
aaaaacugccuuucuuccccucaagucaacuuuugugcuccagaaaauuuucuauucuguaagucug

SEQ ID NO: 242062 - RNA, 67 nt, Homo Sapiens
cgggaagauccugcggcuggggccgucugccuacacgcuccagaagggccagcgcagagcugggaug

SEQ ID NO: 242063 - RNA, 67 nt, Homo Sapiens
ucucccgugacugcugccucaucgauaccccauuuagcuccagaaagcaaagaaaacucgaguaaca

SEQ ID NO: 242064 - RNA, 67 nt, Homo Sapiens
caggggcuauagcgauggggacuuugaacucccuacucuccagaaucugaucaccgaggcucccgug

SEQ ID NO: 242065 - RNA, 67 nt, Homo Sapiens
gcagcuccacagggcagggcgggacuggcacacuggccuccagaaggggggucuccucugcagcuca

SEQ ID NO: 242066 - RNA, 67 nt, Homo Sapiens
cccugcccugcgaguguguccucaccuguacccacaccuccagaaugggcugugccucccauuuccc

SEQ ID NO: 242067 - RNA, 67 nt, Homo Sapiens
auguuaaacuggcuuacuauagacuucguaaaaauggcuccagaagaguaacaaacugaaaucuuug

SEQ ID NO: 242068 - RNA, 67 nt, Homo Sapiens
aaauucugucuggggacgaaggguuggacgggaugaccuccagaagucccuucaauuucuaguaccu

SEQ ID NO: 242069 - RNA, 67 nt, Homo Sapiens
ggccuuagccuccagguccagacuacuacucuauguucuccagaagggugcuaagucaccuacugaa

SEQ ID NO: 242070 - RNA, 67 nt, Homo Sapiens
uucugccuaugaggcaucuggccccugguagccagcucuccagaauuacuuguagguaauuccucuc

SEQ ID NO: 242071 - RNA, 60 nt, Homo Sapiens; identical to SEQ ID NO: 241053

SEQ ID NO: 242072 - RNA, 67 nt, Homo Sapiens
caggcaaggccagagacuucaagucuaucugaaaagucuccagaagucuaaccccagauaaauagcc

SEQ ID NO: 242073 - RNA, 67 nt, Homo Sapiens
cauccauaacauaguaaagagucagggacauugccagcuccagaaaaaaggcuauuuuccaacugaa

SEQ ID NO: 242074 - RNA, 67 nt, Homo Sapiens
auaguauuauagagucuuuuaauuaugaguggaaauucuccagaaaguucuauaaagaaucauuaga

SEQ ID NO: 242075 - RNA, 67 nt, Homo Sapiens
auuuuaagaaaauaacaaagggacuugcaucagcugccuccagaacagaagguuuuuuuaaaaaaga

SEQ ID NO: 242076 - RNA, 67 nt, Homo Sapiens
uaagucccagugucugcuguuccuccacaauaaaauucuccagaaaaggagcugcucuccuguauua

SEQ ID NO: 242077 - RNA, 67 nt, Homo Sapiens
uuuaaggggucuguuucucaggugugacaccaguuugcuccagaaagaaaggagaaggguaguuuga

SEQ ID NO: 242078 - RNA, 67 nt, Homo Sapiens
ucgagcagcacccaccuccagcgagaauucugagauccuccagaaagugguucaguccuagcaagaa

SEQ ID NO: 242079 - RNA, 67 nt, Homo Sapiens
cuuccuccaaggacagaaggagaagagagggugaguccuccagaacuccaggaagggaagggggguc

SEQ ID NO: 242080 - RNA, 67 nt, Homo Sapiens
aagaaaaaggucaagauuucuaucacuuccccgucuucuccagaacuugugucuccagaggaguacg

SEQ ID NO: 242081 - RNA, 65 nt, Homo Sapiens
ugguuuccuuuucuccucucucugcaucugcgcuuuccagauaagcccaaagacagcaacuucuc

SEQ ID NO: 242082 - RNA, 65 nt, Homo Sapiens
gggugggcaccaggucaacccuucuccuccugcuguccagauacagggaagacucaggaugaggg

SEQ ID NO: 242083 - RNA, 65 nt, Homo Sapiens
uuuuuaaaaaaccaaguagugucuuccuaccuaucuccagauacaugucaaaaaaagaaaggugu

SEQ ID NO: 242084 - RNA, 65 nt, Homo Sapiens
ggcauaccuuuuuagcuucuguuuguggaguugucuccagauaagaggagaugugccuucccaau

SEQ ID NO: 242085 - RNA, 65 nt, Homo Sapiens
agguagugccaaugacaggacauuugacaugagucuccagauagaugucguggacuccagcucua

SEQ ID NO: 242086 - RNA, 65 nt, Homo Sapiens
gcuaaaguuuguuuuuccagggcugcugauccuuuuccagauagcuccagaguaugaugacccca

SEQ ID NO: 242087 - RNA, 65 nt, Homo Sapiens
ggccuucuugucuucaaccuggccuguccagcccuuccagauauggccaaacccauggccuggau

SEQ ID NO: 242088 - RNA, 65 nt, Homo Sapiens
ggguucagauuugaaauugugguggaaaauugcauuccagauacccagaugauaugccaauuuca

SEQ ID NO: 242089 - RNA, 65 nt, Homo Sapiens
cacagaaagauaucugcuucuaaauguuaguuggauccagauauaggcaugcaacagacauugga

SEQ ID NO: 242090 - RNA, 65 nt, Homo Sapiens
uucgauuccacuguaaguccucauuuguguagcuuuccagauauuuagccacuauucacagcuuc

SEQ ID NO: 242091 - RNA, 65 nt, Homo Sapiens
gggccugcuugggcccucugucagaaaccagaggguccagauaggucugugaggcuucaguggcc

SEQ ID NO: 242092 - RNA, 65 nt, Homo Sapiens
cagagacaaugauaaauaaaugugccuuucguuguuccagauauguauuuauuuagcaacugcua

SEQ ID NO: 242093 - RNA, 65 nt, Homo Sapiens
gauucccucuuuccuuugaguuuccaggccaaccauccagauagauggcauuagucauuauuuag

SEQ ID NO: 242094 - RNA, 65 nt, Homo Sapiens
gaaacaagccuagauaugcuggcaugaucccauuuuccagauaaggaaagugagcgaggcaggca

SEQ ID NO: 242095 - RNA, 65 nt, Homo Sapiens
cuuuccugucauguguuagacuguugccuucaagauccagauaaagaaaugugcaugcagaucag

SEQ ID NO: 242096 - RNA, 65 nt, Homo Sapiens
uuuuaagacuuauuuagcuuacaacacuuagagccuccagauaacuagaguacuuugguuugaaa

SEQ ID NO: 242097 - RNA, 65 nt, Homo Sapiens
gcuucugagaacuauaaauacuucuacauuaaguuuccagauaaggacaagaagccuaacagcaa

SEQ ID NO: 242098 - RNA, 65 nt, Homo Sapiens
ugguuuuugccuauacuucaggacugaaauaauaauccagauaauaagauuagcuauuauuugua

SEQ ID NO: 242099 - RNA, 65 nt, Homo Sapiens
augguacuuaggagugagugucaaagugggaaagcuccagauaacuuuguuuaccucuuuucauc

SEQ ID NO: 242100 - RNA, 65 nt, Homo Sapiens
cuggauuuaacaaaaccaauccccuaucuacuuaauccagauagcuaaaaacuauaaaaacccau

SEQ ID NO: 242101 - RNA, 65 nt, Homo Sapiens
aaagacuuuguaaaacaugaguugugcauccccaauccagauaauagaccugggguuaagugugg

SEQ ID NO: 242102 - RNA, 65 nt, Homo Sapiens
uugcacugaagagaaucuaguaaaauugcugugacuccagauacuagauugcacuagcuugucuc

SEQ ID NO: 242103 - RNA, 65 nt, Homo Sapiens
guucauuugacagagucaguauuuuuugccaaauauccagauaaccaguuuucacaucugagaca

SEQ ID NO: 242104 - RNA, 65 nt, Homo Sapiens
uguguagagauauagcagcugaagcaggacuucauuccagauagcugugugcauuuaugucaugc

SEQ ID NO: 242105 - RNA, 65 nt, Homo Sapiens
ccuacgggggcagcacacuuagauauuccuggacauccagauagcucacaugugcugaccacacu

SEQ ID NO: 242106 - RNA, 65 nt, Homo Sapiens
gacuuugagccaagggaaagaaugaguacuaucuuuccagauaucuuaaggguaaaagcuuauuc

SEQ ID NO: 242107 - RNA, 65 nt, Homo Sapiens
uauacagaugcuucucaacuuaugauggguuuagguccagauaagcccacugugaguugaaaaua

SEQ ID NO: 242108 - RNA, 65 nt, Homo Sapiens
uggaaaacauacuacuauaauuuauuauuauaucuuccagauaauguuauucauuuagaacaaau

SEQ ID NO: 242109 - RNA, 65 nt, Homo Sapiens
agcagauuaaccccaggcagaccgauaaaaagaccuccagauaggcagacagacagauggaccac

SEQ ID NO: 242110 - RNA, 65 nt, Homo Sapiens
ggaagggccugcccaguugcacucaggugacauccuccagauaguguagcugaggaggcaccuac

SEQ ID NO: 242111 - RNA, 65 nt, Homo Sapiens
cuuuuggaaaaaaauagagcuuuucugcauccuacuccagauacacugaaucggaaucccuaggg

SEQ ID NO: 242112 - RNA, 65 nt, Homo Sapiens
guacuuuaguuggcuuccgaguuccagacuauauguccagauauuaauugacugucuuguaagcc

SEQ ID NO: 242113 - RNA, 65 nt, Homo Sapiens
uuuuguuuuguuuuguuuuguuuugcauuuuuaacuccagauauccuaaagcucaauuguuuggu

SEQ ID NO: 242114 - RNA, 65 nt, Homo Sapiens
acuuagcaguaaauuauagcucaugugcauuauuuuccagauaacuuagcuuaugaguagcuuau

SEQ ID NO: 242115 - RNA, 65 nt, Homo Sapiens
acauucuauaguuaccaaaaauuuaguuuugcuuuuccagauauuaaguuugagcaccugauuau

SEQ ID NO: 242116 - RNA, 65 nt, Homo Sapiens
aacacuaacaaacucucccugacaugaaggaaauuuccagauaaccaaucuaguugguuuuauuc

SEQ ID NO: 242117 - RNA, 65 nt, Homo Sapiens
guauaaccugcauaacuuuugaguugaaugauuauuccagauacuaggcacugucagagaaucug

SEQ ID NO: 242118 - RNA, 65 nt, Homo Sapiens
cuagggugagggugacagagugcaguggcaaaggauccagauagcggggucugcuccuguggcgg

SEQ ID NO: 242119 - RNA, 65 nt, Homo Sapiens
uaagcuauuuuuuccuaagguuaaaaguuaaaacauccagauauauguggugaaacaaaauaucu

SEQ ID NO: 242120 - RNA, 65 nt, Homo Sapiens
cagccacgaccccaaagguguuaacaagacagcacuccagauaggucagccacucaucuuaaucc

SEQ ID NO: 242121 - RNA, 65 nt, Homo Sapiens
cccaaaguaucaggacgagacacaagugaaaaacauccagauacaauucucugaagaguggguuu

SEQ ID NO: 242122 - RNA, 65 nt, Homo Sapiens
uggggaugccgggcuccagguccuuccgcugcggcuccagauagacuccaccagaaagggggagc

SEQ ID NO: 242123 - RNA, 65 nt, Homo Sapiens
gauaauaugcaaaugaacauuuuccuuuaugucucuccagauaauguuuauugucugagguaaau

SEQ ID NO: 242124 - RNA, 65 nt, Homo Sapiens
ccaugucagauaggacaacacugcuggguuuuacauccagauaguaauaaacaccauuucaucau

SEQ ID NO: 242125 - RNA, 65 nt, Homo Sapiens
cuucccccugaguaugcaugugccuguucagagucuccagauaccuuuuuuauaaaaagaagucu

SEQ ID NO: 242126 - RNA, 65 nt, Homo Sapiens
gacccaauagagagggcaagcugagcaucuguauuuccagauaaaaguuguuauugauguauaaa

SEQ ID NO: 242127 - RNA, 65 nt, Homo Sapiens
cgaugacagucauccuaaugauaauaaaaccugcauccagauaaucacggagcucugugguugcu

SEQ ID NO: 242128 - RNA, 65 nt, Homo Sapiens
auuuguagaagugggcccucaugacugagguagcuuccagauaggccagaguagaguguagagug

SEQ ID NO: 242129 - RNA, 65 nt, Homo Sapiens
uauagaauugucucucaacucugcuuuucuccaguuccagauaacguccuuaagaccaucuguuc

SEQ ID NO: 242130 - RNA, 65 nt, Homo Sapiens
uuuacaguauaucuuaagauaauauuuaaaauaguuccagauaaaaacaauauauguaaauuaua

SEQ ID NO: 242131 - RNA, 65 nt, Homo Sapiens
uaacccuucacuuacuagaccagaaaagaacuuauuccagauaagcuuugaauaucaauucuuac

SEQ ID NO: 242132 - RNA, 65 nt, Homo Sapiens
aaaagaagaaguaaaacuauaaagaaauaaauguauccagauaggaagaagcauuugggaaagaa

SEQ ID NO: 242133 - RNA, 65 nt, Homo Sapiens
cugcauuugcaauggaauaaaaauuuaaagacugcuccagauagcuuuuuaaacaaugugaucuc

SEQ ID NO: 242134 - RNA, 65 nt, Homo Sapiens
cuacgaugaggacgggaacugggagucccgccacuuccagauagacaaagaugaccagucaauca

SEQ ID NO: 242135 - RNA, 65 nt, Homo Sapiens
aacugcugauguugcucuagauucauuacuccuccuccagauaccuuuuucacuguccucccacc

SEQ ID NO: 242136 - RNA, 65 nt, Homo Sapiens
agaagaugauuccuucuaguucgaggaggaucagauccagauaagcuucggaaacccccaaggug

SEQ ID NO: 242137 - RNA, 65 nt, Homo Sapiens
gcguguuccuggugaagcaguuucacaucagucucuccagauagcacuacgauguauuccgcuuc

SEQ ID NO: 242138 - RNA, 65 nt, Homo Sapiens
gugaucuugcugaagacuacaggcagccaaaugguuccagauacuucagcuuuguguaucuucgu

SEQ ID NO: 242139 - RNA, 65 nt, Homo Sapiens
cacauuaagcuauaguagaaggaauuggacacuucuccagauauuuggcuucaaaggaguaccuu

SEQ ID NO: 242140 - RNA, 65 nt, Homo Sapiens
uauuuguuauucauuuugcaaauucagaaaguugguccagauauaugucacagaacuuuucacuu

SEQ ID NO: 242141 - RNA, 65 nt, Homo Sapiens
ucauucauaauuuuguuuucaccugguuuaaagaauccagauauuuuacugcaaaaguucagaug

SEQ ID NO: 242142 - RNA, 62 nt, Homo Sapiens
aagguaaauuuaagagguaagacucuaggggcuccagauaaucauguccaaaaggaaaauaa

SEQ ID NO: 242143 - RNA, 65 nt, Homo Sapiens
aaaacaaucccuaagccuuaucaaauuaggcaaauuccagauaguuugugcaagaacuuugaagg

SEQ ID NO: 242144 - RNA, 65 nt, Homo Sapiens
auuuaauuccauauaauaacccuaaacauuuuaauuccagauauuaauaauauagucauuagcca

SEQ ID NO: 242145 - RNA, 65 nt, Homo Sapiens
uggauaaacuuucuuaacaacgcuuuuuauugcuauccagauauaucuuacaguuuccuaggaaa

SEQ ID NO: 242146 - RNA, 65 nt, Homo Sapiens
caugcaugcacccagauuuugaaugaaacucaccguccagauaacgguuuauaguacagccuaga

SEQ ID NO: 242147 - RNA, 65 nt, Homo Sapiens
gagaugacuaaggucauugaaauauauucagacuauccagauacauuuucagugggcaauuuugu

SEQ ID NO: 242148 - RNA, 65 nt, Homo Sapiens
aagugaggaaugaggugugaggcucccugaguguguccagauaccccuagcagauugcuucccag

SEQ ID NO: 242149 - RNA, 65 nt, Homo Sapiens
acauggaucucaaugccaauccuccauucuuccucuccagauauuuuugggagugacaaacauuc

SEQ ID NO: 242150 - RNA, 65 nt, Homo Sapiens
cugacucggugugcggccacuucggcacugcuuaauccagauauucuuguuaacuaagcauugug

SEQ ID NO: 242151 - RNA, 65 nt, Homo Sapiens
aaaugcucgucauacaguaaacucuggaugauucuuccagauaauguccuugcuuuacaaaccaa

SEQ ID NO: 242152 - RNA, 65 nt, Homo Sapiens
ucacauuuugaaaggucaaaucagcaugaauccaguccagauauuuacuucaaacagaacugcag

SEQ ID NO: 242153 - RNA, 65 nt, Homo Sapiens
cagaguugcucuucaccaguuuuuguuucacucuuuccagauaagucuuuauuauuuacuuugca

SEQ ID NO: 242154 - RNA, 65 nt, Homo Sapiens
uaauuguaagcugaugcugaaacugugaguauucuuccagauaucuaugcauugccaguauaaua

SEQ ID NO: 242155 - RNA, 65 nt, Homo Sapiens
ccugaacacuguguauuuauuauuuaagauggcuauccagauaauggucaugcggaacacucugu

SEQ ID NO: 242156 - RNA, 65 nt, Homo Sapiens
ugagaagcaggaaauuuauaauagguagccaaaaauccagauauuacaccaaagacggaagccaa

SEQ ID NO: 242157 - RNA, 65 nt, Homo Sapiens
auuacauuugaaauuguuauguauugaaguucaaauccagauaguaagaauuuuacuuaggaaaa

SEQ ID NO: 242158 - RNA, 65 nt, Homo Sapiens
aguguauccaaacaucuaauuaauuuccuucagucuccagauaggcaugcaguguacauuucaga

SEQ ID NO: 242159 - RNA, 65 nt, Homo Sapiens
gugagaaaauagccaugucaauuccccaacccaccuccagauaaugucuggaucagauccgcgcu

SEQ ID NO: 242160 - RNA, 65 nt, Homo Sapiens
ugggugaacuuauuguucuuaucuaguaugguuacuccagauaaggaaagaauuguauuucuuua

SEQ ID NO: 242161 - RNA, 65 nt, Homo Sapiens
cagcuguaacacagcugagacuuaaaaguugugauuccagauaacugaaguaguuuguauaacuu

SEQ ID NO: 242162 - RNA, 65 nt, Homo Sapiens
aacaaaauacucccucucuguuugcugugugggcuuccagauaucaugucuccaaauacgccuuc

SEQ ID NO: 242163 - RNA, 65 nt, Homo Sapiens
uagauuugugcacccauuggcaaaacaggaaaguuuccagauagguauuguaucauugagaaugc

SEQ ID NO: 242164 - RNA, 65 nt, Homo Sapiens
ucucucucucuuuauuuucaguuuuuuugcuguuauccagauaauuaauaaaaaccaaccacgca

SEQ ID NO: 242165 - RNA, 65 nt, Homo Sapiens
ugauuuuuauucaagaaagcuuuaaaaguuuuauauccagauauacaaccacaauaaagcaaaau

SEQ ID NO: 242166 - RNA, 65 nt, Homo Sapiens
ggcaaauagccacugguaaagggaggaaaugaauuuccagauacuuauuaccaaguagguaaggu

SEQ ID NO: 242167 - RNA, 65 nt, Homo Sapiens
ccggccacuacccagcccaucucugccugugcuuauccagauaagaagaccaaaaucccgcuggg

SEQ ID NO: 242168 - RNA, 65 nt, Homo Sapiens
uuuucuuggauuugugucaguuggaugauauccccuccagauaguaucaauaaaauguuaaaauu

SEQ ID NO: 242169 - RNA, 60 nt, Homo Sapiens
agagccacggaaaaucauaguaugauucaauccagauauggguuaaauuccucauuuuac

SEQ ID NO: 242170 - RNA, 65 nt, Homo Sapiens
uggaaauagaucucauuuuuagguuuucucuucguuccagauaccaaauaaaugggacagagaau

SEQ ID NO: 242171 - RNA, 65 nt, Homo Sapiens
aaugagacuuagaagacagacuuaccaaagugcguuccagauaaaucaaauauaggcugaaaucu

SEQ ID NO: 242172 - RNA, 65 nt, Homo Sapiens
aaccauaucccagccauugcuuaugauucccauacuccagauacagcccauaagacaagugauua

SEQ ID NO: 242173 - RNA, 65 nt, Homo Sapiens
auuuucuacagauuuugaaaauuuuccuuugggguuccagauaauaacuuuuuaaaaauuaauug

SEQ ID NO: 242174 - RNA, 65 nt, Homo Sapiens
cagauuauuucauuugguaagaacucuugggaaucuccagauaauuuucuuucaucaucuucauu

SEQ ID NO: 242175 - RNA, 65 nt, Homo Sapiens
cuaaucaaauaaauuagaauuauuuauaaaguuuuuccagauaaauacugcccucuuacauaaug

SEQ ID NO: 242176 - RNA, 65 nt, Homo Sapiens
uuaccaguaacggaacaguauuaugaaccuuuacauccagauaggaacaaaaaaagcauuguaac

SEQ ID NO: 242177 - RNA, 65 nt, Homo Sapiens
cucauguugaguuugugcuguggugucaccagaauuccagauaaacacacagccuuucccauacc

SEQ ID NO: 242178 - RNA, 65 nt, Homo Sapiens
gaugccagguuuauagcaauuugcaacuuuaauuuuccagauaaucuggagguuagcauuugaua

SEQ ID NO: 242179 - RNA, 65 nt, Homo Sapiens
uuugguuuaauuuucuaugugcuuuuaggugugaauccagauaugcggucuuaauuccuuuggaa

SEQ ID NO: 242180 - RNA, 65 nt, Homo Sapiens
uguacuuaguuguugaaagggugaugaaacugauauccagauacuugagauccugguaauugguc

SEQ ID NO: 242181 - RNA, 65 nt, Homo Sapiens
caugucugaaauucuauugcuuggagagaauccccuccagauaagagauuuugagugaaaaacau

SEQ ID NO: 242182 - RNA, 65 nt, Homo Sapiens
guaauuugugccauuagucuuucuauguuucugcauccagauagagugcaguucaugagggaggg

SEQ ID NO: 242183 - RNA, 65 nt, Homo Sapiens
ugagaauauagauagucguacaacaacccaggggauccagauacaugagaccagggcagcguuca

SEQ ID NO: 242184 - RNA, 65 nt, Homo Sapiens
uugacgcagaauaaauuuuuaaugcagcuucauuuuccagauacccucauguauaaugugcccca

SEQ ID NO: 242185 - RNA, 65 nt, Homo Sapiens
ugauuucucaucgacagggugaaaaaggcuuuuuuuccagauauagcuacuuuggcagcagaacu

SEQ ID NO: 242186 - RNA, 65 nt, Homo Sapiens
cacaaagcccccagacagaagcugcgccccaccuuuccagauacccccccuugauccccaaagaa

SEQ ID NO: 242187 - RNA, 65 nt, Homo Sapiens
aauuuuaagaguacucaucgcuaaauaauauaauuuccagauaguaucuagguaauuggcagauu

SEQ ID NO: 242188 - RNA, 65 nt, Homo Sapiens
augucuuaaauauaaagcugugauuauaucaaaaauccagauaaaucaucaaauauaucagauua

SEQ ID NO: 242189 - RNA, 65 nt, Homo Sapiens
ugguggaucaaaaaugccacccaucaguauauuuguccagauaauaggacauaugagaaaacuga

SEQ ID NO: 242190 - RNA, 65 nt, Homo Sapiens
cacauaaaugcuccuuguggaauaacuaucucacuuccagauaucuuuucuuuuccugggaaugg

SEQ ID NO: 242191 - RNA, 65 nt, Homo Sapiens
uauuaauguugauaugaguauuggaaauuaauaaauccagauacaugguaacuaaaauuuucuuu

SEQ ID NO: 242192 - RNA, 65 nt, Homo Sapiens
gcagauuuuggucaucuuucacuuuaacuuguguuuccagauaagucauaagggauauagacagu

SEQ ID NO: 242193 - RNA, 65 nt, Homo Sapiens
auugucaacuucccuuauucugggccuauauagaauccagauacccuccaggugagggugaggac

SEQ ID NO: 242194 - RNA, 65 nt, Homo Sapiens
ugacagaguuaugaauaugaauauuguggagucuguccagauaccggguggaagacugguuuuga

SEQ ID NO: 242195 - RNA, 65 nt, Homo Sapiens
uaaauguuuauaacauaguuuaauuuuauauuuauuccagauaguauuuaauuuagugcuuuuua

SEQ ID NO: 242196 - RNA, 65 nt, Homo Sapiens
gcuuucacucguggugaauauuucagaccuaaagauccagauaguaucucuguucauaugugaau

SEQ ID NO: 242197 - RNA, 65 nt, Homo Sapiens
agccuccgcaggaugccggacaauggugaagaaacuccagauaucaaggaauugggaaauccugg

SEQ ID NO: 242198 - RNA, 65 nt, Homo Sapiens
guuggaaggaaugaagaagcuuuuuuaguaauagguccagauaugagugcuaaaaauaaagauga

SEQ ID NO: 242199 - RNA, 65 nt, Homo Sapiens
ugguauuuauuuuucuccaucucccaccuccuucauccagauaacuuauacauucccaagaaagu

SEQ ID NO: 242200 - RNA, 65 nt, Homo Sapiens
uacaaaagaugugaaagcacuuucaucuuacaaauuccagauaucaggaaaaagagaauuuuucu

SEQ ID NO: 242201 - RNA, 65 nt, Homo Sapiens
aaaugaccuugacuuuucuguugaguucuccugucuccagauaccguaacagugcuuuugguucc

SEQ ID NO: 242202 - RNA, 65 nt, Homo Sapiens
ugggguggcaccccagcauuccuggcuuucugggguccagauaggcuggcaagagcuguuuuugc

SEQ ID NO: 242203 - RNA, 65 nt, Homo Sapiens
ugauuucagauggauacuaacaguuugaggggagguccagauauuuccaaggcauaaauucuugc

SEQ ID NO: 242204 - RNA, 65 nt, Homo Sapiens
caaccuuucuguagccuaaaacgaauggucuuugcuccagauaacucucuuuccuugagcuguug

SEQ ID NO: 242205 - RNA, 65 nt, Homo Sapiens
gggcaaugacuuuccuagacaauaacccgagggacuccagauacauaccccgaaggucuaggaaa

SEQ ID NO: 242206 - RNA, 65 nt, Homo Sapiens
aaaaccaauuguaccgacaucacguagacaaaaacuccagauaaauccauugauuggguauuuuc

SEQ ID NO: 242207 - RNA, 65 nt, Homo Sapiens
auguauauucuucuauagaguguggaauuccuguuuccagauaacuaaggaagcuaaaacaccaa

SEQ ID NO: 242208 - RNA, 65 nt, Homo Sapiens
accguuuugcuaaaagauaccuucacaaugaagcuuccagauagcaaacaaaaaaacgaaagcau

SEQ ID NO: 242209 - RNA, 65 nt, Homo Sapiens
acucaggaugccaaguggcccucagauuacacuucuccagauagcugaaugagucugcuuucacu

SEQ ID NO: 242210 - RNA, 65 nt, Homo Sapiens
aguaccacuagcaccuauuccccacccagcgugucuccagauauugucaaauaucccaucgggug

SEQ ID NO: 242211 - RNA, 65 nt, Homo Sapiens
uaaugcagucagcuaagagccaacaaaaccccauauccagauaguuagcugugagccagcacuca

SEQ ID NO: 242212 - RNA, 65 nt, Homo Sapiens
cauucuuacuuuguuagcauacgcugaccuuaguguccagauaugucacuauuacucauuuuucu

SEQ ID NO: 242213 - RNA, 65 nt, Homo Sapiens
uuuauuuuaaccaguuauuuuuauuauugagucuguccagauaaguuauuuauaaugggcauuac

SEQ ID NO: 242214 - RNA, 65 nt, Homo Sapiens
agggcaugaaaacuuagagagaaguggggaaguguuccagauagcgcuagaggacuucuggcagg

SEQ ID NO: 242215 - RNA, 65 nt, Homo Sapiens
uggguucuagcaauuuccccgugcugauaggucaguccagauaggccguaggaggggcagagauu

SEQ ID NO: 242216 - RNA, 65 nt, Homo Sapiens
aaaggaccaacuuggguuccaguggccuagcaauauccagauaagaugaugaaucauaagucuuc

SEQ ID NO: 242217 - RNA, 65 nt, Homo Sapiens
aagaggauugagcuuugugucaccugccugcgcucuccagauaugaccccugcacccacccccca

SEQ ID NO: 242218 - RNA, 50 nt, Homo Sapiens
gcaccccccgugaggacuaauccagauacaucccaccagccucuccaagg

SEQ ID NO: 242219 - RNA, 65 nt, Homo Sapiens
uuccuuugcuaaauucaggcugcaggcuccuuccauccagauaacuccauccugucgaguaggcu

SEQ ID NO: 242220 - RNA, 65 nt, Homo Sapiens
ugaacaaacauauaaaauguaaacaaucccuacaauccagauaaaacagagaagacugugauucu

SEQ ID NO: 242221 - RNA, 65 nt, Homo Sapiens
uaaaagaaaguccaaagagcuccuauauagacuacuccagauaacuucgcuucuuugauacuugu

SEQ ID NO: 242222 - RNA, 65 nt, Homo Sapiens
acagcuugaagagguagcuagguguuuaaaguuccuccagauacuuuuaccugagugaugcuucc

SEQ ID NO: 242223 - RNA, 65 nt, Homo Sapiens
cuucuacuguguagaauacuuugacuuaauuuucuuccagauacagggggauaccugccuguuuu

SEQ ID NO: 242224 - RNA, 65 nt, Homo Sapiens
ccaacauuuucuuuucuguuaagguuguuuuaguuuccagauagggcuaauuacaaaauguuaag

SEQ ID NO: 242225 - RNA, 65 nt, Homo Sapiens
uauaagcaaaagagauugguaaagugccacaguauuccagauaacuuuucaguugcggccuuucu

SEQ ID NO: 242226 - RNA, 65 nt, Homo Sapiens
gauauaccugauauauuccaccaggauauccucccuccagauauacuugguucucuccaccaggu

SEQ ID NO: 242227 - RNA, 65 nt, Homo Sapiens
aucaacuguuuauaucaauuauucacauucuugguuccagauaaaggacaucuagguuccaauuc

SEQ ID NO: 242228 - RNA, 65 nt, Homo Sapiens
uccccacaaaaggaggcaaauuuguucagcuauuuuccagauaucuuguuucgccacauguagag

SEQ ID NO: 242229 - RNA, 65 nt, Homo Sapiens
aaauguguguucagaacuuugagugcauuuauuccuccagauaauguucugaugauaagcauuug

SEQ ID NO: 242230 - RNA, 65 nt, Homo Sapiens
uuccuuuuacugaaccuugaucuauaaucaagaauuccagauacagacagaagaguguuuucaug

SEQ ID NO: 242231 - RNA, 65 nt, Homo Sapiens
ucugaaagcccuggaucucuuugcaccaaaaaugguccagauagacucuuuuuaaggaucuuggc

SEQ ID NO: 242232 - RNA, 65 nt, Homo Sapiens
aacuuacuuucugcaauguuuucuuagaaauuguguccagauagcuuucacuaauuuuaaauuaa

SEQ ID NO: 242233 - RNA, 65 nt, Homo Sapiens
gaagucaggagcauuaaaucccaaaccaaaucaacuccagauauaucagugucaaaagcccaaga

SEQ ID NO: 242234 - RNA, 65 nt, Homo Sapiens
cagaucuugugguauaaaaaauaaccuuguaguucuccagauacuaagcuuguauaugauuaugg

SEQ ID NO: 242235 - RNA, 65 nt, Homo Sapiens
gaaauagugacaagugaagauaacaagaauguaacuccagauagaagugcuuuuuuuuuuuugac

SEQ ID NO: 242236 - RNA, 65 nt, Homo Sapiens
uuauagaguaacauaggccuuguuuuaaaaagcacuccagauaauuuucagaauuacuuuuuaau

SEQ ID NO: 242237 - RNA, 65 nt, Homo Sapiens
ugauuuuugauguuauuguuuaaaugguucuaauuuccagauaaaugcaaauuuguacaaacauu

SEQ ID NO: 242238 - RNA, 65 nt, Homo Sapiens
uguauuuuaaaugugaccuuuaaacaacccuuguuuccagauaagggcuuuucuugagcccauuu

SEQ ID NO: 242239 - RNA, 65 nt, Homo Sapiens
acaugucaccauuaauucucugguuuuggaaaauuuccagauaagaaguuuacuuuuuccucuuc

SEQ ID NO: 242240 - RNA, 65 nt, Homo Sapiens
auucuauuuauggaaaaaaguuuaugcaacagauguccagauauguguaagcuuuggaaacacaa

SEQ ID NO: 242241 - RNA, 65 nt, Homo Sapiens
guuuuaggugagcugagcuauuuuaucauugcacauccagauacuaauucauaagagucagugca

SEQ ID NO: 242242 - RNA, 65 nt, Homo Sapiens
uaaaaucauuucucucuauuguuuuaaguggcagguccagauauguccugcauucuguacauaaa

SEQ ID NO: 242243 - RNA, 65 nt, Homo Sapiens
uuucuuuauuuuauauuguaaggaauuuaauuauuuccagauaaaccaaccacugauuacuuuuc

SEQ ID NO: 242244 - RNA, 65 nt, Homo Sapiens
ugccucguccgaggcagacaagcuguggcccugcauccagauacccuugaagguccucugccucc

SEQ ID NO: 242245 - RNA, 65 nt, Homo Sapiens
uaugauguggauccuacguauuuuuuaaaaaacucuccagauaauuuugaugucacgagucacua

SEQ ID NO: 242246 - RNA, 65 nt, Homo Sapiens
ggacuuacugcuauacuuguuccuuggccccuguauccagauauugauuugguuuuuucauuguu

SEQ ID NO: 242247 - RNA, 65 nt, Homo Sapiens
cacuuaaaaacugcagagaaaacugaaaguuauguuccagauaacuuuccguuguuuaccaaauu

SEQ ID NO: 242248 - RNA, 65 nt, Homo Sapiens
aaaauuagccaggcaugguggugcaugccuguaacuccagauacuugggaugcugaggcaggaga

SEQ ID NO: 242249 - RNA, 65 nt, Homo Sapiens
caaggcauucaaguguacagugaaaagucucccuuuccagauauucaagucaccuccuuaaaggu

SEQ ID NO: 242250 - RNA, 65 nt, Homo Sapiens
aaugaaggcucuggcccuaaccccucagcacugucuccagauaggaacaugcacaaagcaguuaa

SEQ ID NO: 242251 - RNA, 65 nt, Homo Sapiens
cucaccaggcacuggcagggaggguaagggcuggcuccagauaccccucccccacagauuccuag

SEQ ID NO: 242252 - RNA, 65 nt, Homo Sapiens
acacuuuuauaaaaaucagauuuuucaguggucucuccagauauuaacaagaauuguuguguaac

SEQ ID NO: 242253 - RNA, 65 nt, Homo Sapiens
uaaauuuauuuuuuucauuucugucaugaaaucauuccagauaccucuuuucuucuuuccaaaug

SEQ ID NO: 242254 - RNA, 65 nt, Homo Sapiens
accugaggagcucuguccugcucccuguggagggcuccagauagcucagaaaugaccagccaaug

SEQ ID NO: 242255 - RNA, 65 nt, Homo Sapiens
agccccgccggccaaucccuaguucuuccccagccuccagauaagccugaaggagcugggaagua

SEQ ID NO: 242256 - RNA, 65 nt, Homo Sapiens
accuccuugucuuaaguucuccuaagauuaaacauuccagauaguccuaggucugugcuguaaau

SEQ ID NO: 242257 - RNA, 65 nt, Homo Sapiens
ccaccugggaccaaauaagaauugaauugugcuuguccagauaugaacaaauauguagugaguau

SEQ ID NO: 242258 - RNA, 65 nt, Homo Sapiens
gaccagggcuggcccugauccaccuaccugcuaacuccagauauuauuuuuaaguuggagaccua

SEQ ID NO: 242259 - RNA, 65 nt, Homo Sapiens
uuugaaaaggaaauaaacuuugaugaauuagauaauccagauacaucauuguaaacucuuacucu

SEQ ID NO: 242260 - RNA, 65 nt, Homo Sapiens
aguuguugcuuaauuuauuguuuuuuaauaacuaauccagauaaaaaguuguggggcuucagggu

SEQ ID NO: 242261 - RNA, 65 nt, Homo Sapiens
aacaaauauguagugaguauauucaauugugcuuguccagauaugccaccugggaccaaauaaga

SEQ ID NO: 242262 - RNA, 65 nt, Homo Sapiens
uucauuucaccuguaaacuguugugguaggccaguuccagauaguaucaguccagguucagaaac

SEQ ID NO: 242263 - RNA, 65 nt, Homo Sapiens
cccaccuaagugaaauggccauagugaaaaagguguccagauaaaguaugugucuucuucuccag

SEQ ID NO: 242264 - RNA, 65 nt, Homo Sapiens
gaaaaagguguccagauaaaguaugugucuucuucuccagauaguacagcagcccugaacaacca

SEQ ID NO: 242265 - RNA, 65 nt, Homo Sapiens; identical to SEQ ID NO: 242261

SEQ ID NO: 242266 - RNA, 65 nt, Homo Sapiens
aacagggcccaggccuggaggagucucccuccgacuccagauaugagucccaaagcggccgaugg

SEQ ID NO: 242267 - RNA, 65 nt, Homo Sapiens
uggacgcauugugggcuuuagggacagaugaguuuuccagauagugucagcuuauuugaagauua

SEQ ID NO: 242268 - RNA, 65 nt, Homo Sapiens
aaaguuuugcuggauccuaaaguauugaggauuuuuccagauaaauuuguacucaaggaaagaac

SEQ ID NO: 242269 - RNA, 65 nt, Homo Sapiens
ucaaucuagaaaagccuuguugagcagccuccuuauccagauagauccaaagcucaugucucuuc

SEQ ID NO: 242270 - RNA, 65 nt, Homo Sapiens
aacacuaauagauauucaauaacggaguaaacuguuccagauaaagcaagaauaguugcaagaag

SEQ ID NO: 242271 - RNA, 65 nt, Homo Sapiens
uccgauguggagaggguguuggcaaaugcccaaccuccagauacccgguggaccccguggcguua

SEQ ID NO: 242272 - RNA, 65 nt, Homo Sapiens
ggaccugggccggcccaugggagccugggguucuguccagauaggaccagggggucucacuuugg

SEQ ID NO: 242273 - RNA, 65 nt, Homo Sapiens
gacagaugcauacaugcauguaaccaccaccccauuccagauauagaauguuucuaucucucugg

SEQ ID NO: 242274 - RNA, 65 nt, Homo Sapiens
uucuuuuguggauucgucauuucccaugcccugguuccagauacauuuugaaaaccuuccaucuu

SEQ ID NO: 242275 - RNA, 65 nt, Homo Sapiens
gggauuucuaagaccgacuguaugagcucgccucuuccagauagcuggcagagggcagggcaagg

SEQ ID NO: 242276 - RNA, 65 nt, Homo Sapiens
ugaauccaguggagcugggccaaguacgacaggaguccagauaaagguguaggggcugcacggcc

SEQ ID NO: 242277 - RNA, 65 nt, Homo Sapiens
ccaagaagagugaaugugucccauccaaaggugcauccagauaugucuguguuacuauggcuuca

SEQ ID NO: 242278 - RNA, 65 nt, Homo Sapiens
ggaaagcaggauuugagagaacauacaccuugccuuccagauaugugguuuuugugauucaccca

SEQ ID NO: 242279 - RNA, 65 nt, Homo Sapiens
uccccagugcuccacauuaaucagaguuguaggucuccagauaugaaaucacuugucucuguucc

SEQ ID NO: 242280 - RNA, 65 nt, Homo Sapiens
ugaaagaacccacacuggaguuacucuugcagguuuccagauacaaaaaugugggaaaacauaca

SEQ ID NO: 242281 - RNA, 65 nt, Homo Sapiens
auucaggaccugugugaaaacacuugugucugcauuccagauaacccaagcaguguagcucagag

SEQ ID NO: 242282 - RNA, 65 nt, Homo Sapiens
agugaggaagcuguacaugacugaaaguuaaaaaguccagauaggcuauuuauuuccuuaaacuu

SEQ ID NO: 242283 - RNA, 65 nt, Homo Sapiens
uaccauuucuguugcucuucaaucuguuauguuuuuccagauauuaaaaaacucaugagaagagu

SEQ ID NO: 242284 - RNA, 65 nt, Homo Sapiens
uaaggugaagaaucuuuuuaaugggguucuggaaauccagauaacgcagggcccuuauggacagg

SEQ ID NO: 242285 - RNA, 65 nt, Homo Sapiens
ugauucuaagacauguuaggcugucucguugucuguccagauaaucccagugaauccucaauuuu

SEQ ID NO: 242286 - RNA, 65 nt, Homo Sapiens
auauaaugaacucguaauguuuacugucacaauuuuccagauauuaagaucaagaauacugccca

SEQ ID NO: 242287 - RNA, 65 nt, Homo Sapiens
ggauagccagcauccucucaucuucauuuaggaucuccagauacugccaccaggacucaccuccc

SEQ ID NO: 242288 - RNA, 65 nt, Homo Sapiens
auuucuccuaguauuucuuuacauuucuguuccuguccagauaccaaaaucccucgcaguugugg

SEQ ID NO: 242289 - RNA, 65 nt, Homo Sapiens
ugcuuuaaagcuacuuuugugugugcuaaaaauuuuccagauacuugcaggaccauuuuaaaccu

SEQ ID NO: 242290 - RNA, 65 nt, Homo Sapiens
ccaccgagggacuagcuuggccuuugcgcuuugauuccagauaguaagaugaguggaaguguuua

SEQ ID NO: 242291 - RNA, 65 nt, Homo Sapiens
cacugccuuuuccucaagggccuucaguuggauccuccagauagcuggguaacaacagaagaaaa

SEQ ID NO: 242292 - RNA, 65 nt, Homo Sapiens
gcagaggagaaacaccucacaaauuaccauuuacuuccagauagacacagcugauguaaaauucu

SEQ ID NO: 242293 - RNA, 65 nt, Homo Sapiens
ugcccagaggcaacccuugccagucuguuuaucccuccagauacagucucugauaguaaacuuuu

SEQ ID NO: 242294 - RNA, 65 nt, Homo Sapiens
cagagcucaaaacaaggcgagcuugaguucugcacuccagauaugugccaaaacuaguaaaacuu

SEQ ID NO: 242295 - RNA, 65 nt, Homo Sapiens
gugguaccagaggccagaauggugggaaagacagauccagauaaugcugggaaguguggcuacac

SEQ ID NO: 242296 - RNA, 65 nt, Homo Sapiens
cacacuuguguauauauguaauguagagcuacagauccagauacauguagcuguauauaaagcgc

SEQ ID NO: 242297 - RNA, 65 nt, Homo Sapiens
uuugcagauuguuuugcuaccaggcggcagugaaguccagauaguaugaacaaguaaccacaucu

SEQ ID NO: 242298 - RNA, 65 nt, Homo Sapiens
gaauccaccuuuuagguaugagaaauguguucagguccagauaugguuucuccuauaauuuuucc

SEQ ID NO: 242299 - RNA, 65 nt, Homo Sapiens
ucaagguagaaauacugauauguaucaucaccuuuuccagauacaaacuugccuuauuuucuagu

SEQ ID NO: 242300 - RNA, 65 nt, Homo Sapiens
cuugcuuagguagagaaggagcacuaaauagcuacuccagauauaaaagcuguacauuuguggga

SEQ ID NO: 242301 - RNA, 65 nt, Homo Sapiens
guuuaaaaggacacuaaaaacuggaguuauagauauccagauagaaacaguaguuaucuuugggu

SEQ ID NO: 242302 - RNA, 65 nt, Homo Sapiens
cuaagacacggcagcaagacaucccugcauauuguuccagauaaaaaugaaagcugcucacaccc

SEQ ID NO: 242303 - RNA, 65 nt, Homo Sapiens
gccagcuaccccuugagggaacaaccaaaaaugucuccagauauugcacccucccccaaguugag

SEQ ID NO: 242304 - RNA, 65 nt, Homo Sapiens
aagcauguggauauguuuaguuaccgauuucaaaguccagauaccguugccauugcugcuaaagg

SEQ ID NO: 242305 - RNA, 65 nt, Homo Sapiens
ggaaacaguaugcaugaagagaaguagaaggaauuuccagauauuguaggaauuagccaguugag

SEQ ID NO: 242306 - RNA, 65 nt, Homo Sapiens
uugucaugaacauugacagauguaaucuguauaguuccagauaauccacgggaauacuacugcca

SEQ ID NO: 242307 - RNA, 65 nt, Homo Sapiens
augacuguucaucuuuuucuuucagaauauuacauuccagauaauucugcuauacuugacuugcc

SEQ ID NO: 242308 - RNA, 60 nt, Homo Sapiens; identical to SEQ ID NO: 37632

SEQ ID NO: 242309 - RNA, 60 nt, Homo Sapiens; identical to SEQ ID NO: 37633

SEQ ID NO: 242310 - RNA, 60 nt, Homo Sapiens; identical to SEQ ID NO: 37634

SEQ ID NO: 242311 - RNA, 60 nt, Homo Sapiens; identical to SEQ ID NO: 37635

SEQ ID NO: 242312 - RNA, 60 nt, Homo Sapiens; identical to SEQ ID NO: 37636

SEQ ID NO: 242313 - RNA, 60 nt, Homo Sapiens; identical to SEQ ID NO: 37637

SEQ ID NO: 242314 - RNA, 60 nt, Homo Sapiens; identical to SEQ ID NO: 37638

SEQ ID NO: 242315 - RNA, 60 nt, Homo Sapiens; identical to SEQ ID NO: 37639

SEQ ID NO: 242316 - RNA, 60 nt, Homo Sapiens; identical to SEQ ID NO: 37640

SEQ ID NO: 242317 - RNA, 60 nt, Homo Sapiens; identical to SEQ ID NO: 37641

SEQ ID NO: 242318 - RNA, 60 nt, Homo Sapiens; identical to SEQ ID NO: 37642

SEQ ID NO: 242319 - RNA, 60 nt, Homo Sapiens; identical to SEQ ID NO: 37643

SEQ ID NO: 242320 - RNA, 60 nt, Homo Sapiens; identical to SEQ ID NO: 37644

SEQ ID NO: 242321 - RNA, 60 nt, Homo Sapiens; identical to SEQ ID NO: 37645

SEQ ID NO: 242322 - RNA, 60 nt, Homo Sapiens; identical to SEQ ID NO: 37646

SEQ ID NO: 242323 - RNA, 60 nt, Homo Sapiens; identical to SEQ ID NO: 37647

SEQ ID NO: 242324 - RNA, 60 nt, Homo Sapiens; identical to SEQ ID NO: 37648

SEQ ID NO: 242325 - RNA, 60 nt, Homo Sapiens; identical to SEQ ID NO: 37649

SEQ ID NO: 242326 - RNA, 60 nt, Homo Sapiens; identical to SEQ ID NO: 37650

SEQ ID NO: 242327 - RNA, 60 nt, Homo Sapiens; identical to SEQ ID NO: 37651

SEQ ID NO: 242328 - RNA, 60 nt, Homo Sapiens; identical to SEQ ID NO: 37652

SEQ ID NO: 242329 - RNA, 60 nt, Homo Sapiens; identical to SEQ ID NO: 37653

SEQ ID NO: 242330 - RNA, 60 nt, Homo Sapiens; identical to SEQ ID NO: 37654

SEQ ID NO: 242331 - RNA, 60 nt, Homo Sapiens; identical to SEQ ID NO: 37655

SEQ ID NO: 242332 - RNA, 60 nt, Homo Sapiens; identical to SEQ ID NO: 37656

SEQ ID NO: 242333 - RNA, 60 nt, Homo Sapiens; identical to SEQ ID NO: 37657

SEQ ID NO: 242334 - RNA, 60 nt, Homo Sapiens; identical to SEQ ID NO: 37658

SEQ ID NO: 242335 - RNA, 60 nt, Homo Sapiens; identical to SEQ ID NO: 37659

SEQ ID NO: 242336 - RNA, 60 nt, Homo Sapiens; identical to SEQ ID NO: 37660

SEQ ID NO: 242337 - RNA, 60 nt, Homo Sapiens; identical to SEQ ID NO: 37661

SEQ ID NO: 242338 - RNA, 60 nt, Homo Sapiens; identical to SEQ ID NO: 37662

SEQ ID NO: 242339 - RNA, 60 nt, Homo Sapiens; identical to SEQ ID NO: 37663

SEQ ID NO: 242340 - RNA, 60 nt, Homo Sapiens; identical to SEQ ID NO: 37664

SEQ ID NO: 242341 - RNA, 60 nt, Homo Sapiens; identical to SEQ ID NO: 37665

SEQ ID NO: 242342 - RNA, 60 nt, Homo Sapiens; identical to SEQ ID NO: 37666

SEQ ID NO: 242343 - RNA, 60 nt, Homo Sapiens; identical to SEQ ID NO: 37667

SEQ ID NO: 242344 - RNA, 60 nt, Homo Sapiens; identical to SEQ ID NO: 37668

SEQ ID NO: 242345 - RNA, 60 nt, Homo Sapiens; identical to SEQ ID NO: 37669

SEQ ID NO: 242346 - RNA, 60 nt, Homo Sapiens; identical to SEQ ID NO: 37670

SEQ ID NO: 242347 - RNA, 60 nt, Homo Sapiens; identical to SEQ ID NO: 37671

SEQ ID NO: 242348 - RNA, 60 nt, Homo Sapiens; identical to SEQ ID NO: 37672

SEQ ID NO: 242349 - RNA, 50 nt, Homo Sapiens; identical to SEQ ID NO: 37673

SEQ ID NO: 242350 - RNA, 60 nt, Homo Sapiens; identical to SEQ ID NO: 37674

SEQ ID NO: 242351 - RNA, 60 nt, Homo Sapiens; identical to SEQ ID NO: 37675

SEQ ID NO: 242352 - RNA, 60 nt, Homo Sapiens; identical to SEQ ID NO: 37676

SEQ ID NO: 242353 - RNA, 60 nt, Homo Sapiens; identical to SEQ ID NO: 37677

SEQ ID NO: 242354 - RNA, 60 nt, Homo Sapiens; identical to SEQ ID NO: 37678

SEQ ID NO: 242355 - RNA, 60 nt, Homo Sapiens; identical to SEQ ID NO: 37679

SEQ ID NO: 242356 - RNA, 60 nt, Homo Sapiens; identical to SEQ ID NO: 37680

SEQ ID NO: 242357 - RNA, 60 nt, Homo Sapiens; identical to SEQ ID NO: 37681

SEQ ID NO: 242358 - RNA, 60 nt, Homo Sapiens; identical to SEQ ID NO: 37682

SEQ ID NO: 242359 - RNA, 60 nt, Homo Sapiens; identical to SEQ ID NO: 37683

SEQ ID NO: 242360 - RNA, 60 nt, Homo Sapiens; identical to SEQ ID NO: 37684

SEQ ID NO: 242361 - RNA, 60 nt, Homo Sapiens; identical to SEQ ID NO: 37685

SEQ ID NO: 242362 - RNA, 60 nt, Homo Sapiens; identical to SEQ ID NO: 37686

SEQ ID NO: 242363 - RNA, 60 nt, Homo Sapiens; identical to SEQ ID NO: 37687

SEQ ID NO: 242364 - RNA, 60 nt, Homo Sapiens; identical to SEQ ID NO: 37688

SEQ ID NO: 242365 - RNA, 60 nt, Homo Sapiens; identical to SEQ ID NO: 37689

SEQ ID NO: 242366 - RNA, 60 nt, Homo Sapiens; identical to SEQ ID NO: 37690

SEQ ID NO: 242367 - RNA, 60 nt, Homo Sapiens; identical to SEQ ID NO: 37691

SEQ ID NO: 242368 - RNA, 60 nt, Homo Sapiens; identical to SEQ ID NO: 37692

SEQ ID NO: 242369 - RNA, 60 nt, Homo Sapiens; identical to SEQ ID NO: 37693

SEQ ID NO: 242370 - RNA, 60 nt, Homo Sapiens; identical to SEQ ID NO: 37694

SEQ ID NO: 242371 - RNA, 60 nt, Homo Sapiens; identical to SEQ ID NO: 37695

SEQ ID NO: 242372 - RNA, 60 nt, Homo Sapiens; identical to SEQ ID NO: 37696

SEQ ID NO: 242373 - RNA, 60 nt, Homo Sapiens; identical to SEQ ID NO: 37697

SEQ ID NO: 242374 - RNA, 60 nt, Homo Sapiens; identical to SEQ ID NO: 37698

SEQ ID NO: 242375 - RNA, 60 nt, Homo Sapiens; identical to SEQ ID NO: 37699

SEQ ID NO: 242376 - RNA, 60 nt, Homo Sapiens; identical to SEQ ID NO: 37700

SEQ ID NO: 242377 - RNA, 60 nt, Homo Sapiens; identical to SEQ ID NO: 37701

SEQ ID NO: 242378 - RNA, 60 nt, Homo Sapiens; identical to SEQ ID NO: 37702

SEQ ID NO: 242379 - RNA, 60 nt, Homo Sapiens; identical to SEQ ID NO: 37703

SEQ ID NO: 242380 - RNA, 60 nt, Homo Sapiens; identical to SEQ ID NO: 37704

SEQ ID NO: 242381 - RNA, 60 nt, Homo Sapiens; identical to SEQ ID NO: 37705

SEQ ID NO: 242382 - RNA, 60 nt, Homo Sapiens; identical to SEQ ID NO: 37706

SEQ ID NO: 242383 - RNA, 60 nt, Homo Sapiens; identical to SEQ ID NO: 37707

SEQ ID NO: 242384 - RNA, 60 nt, Homo Sapiens; identical to SEQ ID NO: 37708

SEQ ID NO: 242385 - RNA, 60 nt, Homo Sapiens; identical to SEQ ID NO: 37709

SEQ ID NO: 242386 - RNA, 60 nt, Homo Sapiens; identical to SEQ ID NO: 37710

SEQ ID NO: 242387 - RNA, 60 nt, Homo Sapiens; identical to SEQ ID NO: 37711

SEQ ID NO: 242388 - RNA, 60 nt, Homo Sapiens; identical to SEQ ID NO: 37712

SEQ ID NO: 242389 - RNA, 60 nt, Homo Sapiens; identical to SEQ ID NO: 37713

SEQ ID NO: 242390 - RNA, 60 nt, Homo Sapiens; identical to SEQ ID NO: 37714

SEQ ID NO: 242391 - RNA, 60 nt, Homo Sapiens; identical to SEQ ID NO: 37715

SEQ ID NO: 242392 - RNA, 60 nt, Homo Sapiens; identical to SEQ ID NO: 37716

SEQ ID NO: 242393 - RNA, 60 nt, Homo Sapiens; identical to SEQ ID NO: 37717

SEQ ID NO: 242394 - RNA, 60 nt, Homo Sapiens; identical to SEQ ID NO: 37718

SEQ ID NO: 242395 - RNA, 60 nt, Homo Sapiens; identical to SEQ ID NO: 37719

SEQ ID NO: 242396 - RNA, 60 nt, Homo Sapiens; identical to SEQ ID NO: 37720

SEQ ID NO: 242397 - RNA, 60 nt, Homo Sapiens; identical to SEQ ID NO: 37721

SEQ ID NO: 242398 - RNA, 60 nt, Homo Sapiens; identical to SEQ ID NO: 37722

SEQ ID NO: 242399 - RNA, 60 nt, Homo Sapiens; identical to SEQ ID NO: 37723

SEQ ID NO: 242400 - RNA, 60 nt, Homo Sapiens; identical to SEQ ID NO: 37724

SEQ ID NO: 242401 - RNA, 60 nt, Homo Sapiens; identical to SEQ ID NO: 37725

SEQ ID NO: 242402 - RNA, 60 nt, Homo Sapiens; identical to SEQ ID NO: 37726

SEQ ID NO: 242403 - RNA, 60 nt, Homo Sapiens; identical to SEQ ID NO: 37727

SEQ ID NO: 242404 - RNA, 60 nt, Homo Sapiens; identical to SEQ ID NO: 37728

SEQ ID NO: 242405 - RNA, 60 nt, Homo Sapiens; identical to SEQ ID NO: 37729

SEQ ID NO: 242406 - RNA, 60 nt, Homo Sapiens; identical to SEQ ID NO: 37730

SEQ ID NO: 242407 - RNA, 60 nt, Homo Sapiens; identical to SEQ ID NO: 37731

SEQ ID NO: 242408 - RNA, 60 nt, Homo Sapiens; identical to SEQ ID NO: 37732

SEQ ID NO: 242409 - RNA, 60 nt, Homo Sapiens; identical to SEQ ID NO: 37733

SEQ ID NO: 242410 - RNA, 60 nt, Homo Sapiens; identical to SEQ ID NO: 37734

SEQ ID NO: 242411 - RNA, 60 nt, Homo Sapiens; identical to SEQ ID NO: 37735

SEQ ID NO: 242412 - RNA, 60 nt, Homo Sapiens; identical to SEQ ID NO: 37736

SEQ ID NO: 242413 - RNA, 60 nt, Homo Sapiens; identical to SEQ ID NO: 37737

SEQ ID NO: 242414 - RNA, 60 nt, Homo Sapiens; identical to SEQ ID NO: 37738

SEQ ID NO: 242415 - RNA, 60 nt, Homo Sapiens; identical to SEQ ID NO: 37739

SEQ ID NO: 242416 - RNA, 60 nt, Homo Sapiens; identical to SEQ ID NO: 37740

SEQ ID NO: 242417 - RNA, 60 nt, Homo Sapiens; identical to SEQ ID NO: 37741

SEQ ID NO: 242418 - RNA, 60 nt, Homo Sapiens; identical to SEQ ID NO: 37742

SEQ ID NO: 242419 - RNA, 60 nt, Homo Sapiens; identical to SEQ ID NO: 37743

SEQ ID NO: 242420 - RNA, 60 nt, Homo Sapiens; identical to SEQ ID NO: 37744

SEQ ID NO: 242421 - RNA, 60 nt, Homo Sapiens; identical to SEQ ID NO: 37745

SEQ ID NO: 242422 - RNA, 60 nt, Homo Sapiens; identical to SEQ ID NO: 37746

SEQ ID NO: 242423 - RNA, 60 nt, Homo Sapiens; identical to SEQ ID NO: 37747

SEQ ID NO: 242424 - RNA, 60 nt, Homo Sapiens; identical to SEQ ID NO: 37748

SEQ ID NO: 242425 - RNA, 60 nt, Homo Sapiens; identical to SEQ ID NO: 37749

SEQ ID NO: 242426 - RNA, 60 nt, Homo Sapiens; identical to SEQ ID NO: 37750

SEQ ID NO: 242427 - RNA, 60 nt, Homo Sapiens; identical to SEQ ID NO: 37751

SEQ ID NO: 242428 - RNA, 60 nt, Homo Sapiens; identical to SEQ ID NO: 37752

SEQ ID NO: 242429 - RNA, 51 nt, Homo Sapiens; identical to SEQ ID NO: 37753

SEQ ID NO: 242430 - RNA, 60 nt, Homo Sapiens; identical to SEQ ID NO: 37754

SEQ ID NO: 242431 - RNA, 60 nt, Homo Sapiens; identical to SEQ ID NO: 37755

SEQ ID NO: 242432 - RNA, 60 nt, Homo Sapiens; identical to SEQ ID NO: 37756

SEQ ID NO: 242433 - RNA, 60 nt, Homo Sapiens; identical to SEQ ID NO: 37757

SEQ ID NO: 242434 - RNA, 60 nt, Homo Sapiens; identical to SEQ ID NO: 37758

SEQ ID NO: 242435 - RNA, 60 nt, Homo Sapiens; identical to SEQ ID NO: 37759

SEQ ID NO: 242436 - RNA, 60 nt, Homo Sapiens; identical to SEQ ID NO: 37760

SEQ ID NO: 242437 - RNA, 60 nt, Homo Sapiens; identical to SEQ ID NO: 37761

SEQ ID NO: 242438 - RNA, 60 nt, Homo Sapiens; identical to SEQ ID NO: 37762

SEQ ID NO: 242439 - RNA, 60 nt, Homo Sapiens; identical to SEQ ID NO: 37763

SEQ ID NO: 242440 - RNA, 60 nt, Homo Sapiens; identical to SEQ ID NO: 37764

SEQ ID NO: 242441 - RNA, 60 nt, Homo Sapiens; identical to SEQ ID NO: 37765

SEQ ID NO: 242442 - RNA, 54 nt, Homo Sapiens; identical to SEQ ID NO: 37766

SEQ ID NO: 242443 - RNA, 60 nt, Homo Sapiens; identical to SEQ ID NO: 37767

SEQ ID NO: 242444 - RNA, 60 nt, Homo Sapiens; identical to SEQ ID NO: 37768

SEQ ID NO: 242445 - RNA, 60 nt, Homo Sapiens; identical to SEQ ID NO: 37769

SEQ ID NO: 242446 - RNA, 60 nt, Homo Sapiens; identical to SEQ ID NO: 37770

SEQ ID NO: 242447 - RNA, 60 nt, Homo Sapiens; identical to SEQ ID NO: 37771

SEQ ID NO: 242448 - RNA, 60 nt, Homo Sapiens; identical to SEQ ID NO: 37772

SEQ ID NO: 242449 - RNA, 60 nt, Homo Sapiens; identical to SEQ ID NO: 37773

SEQ ID NO: 242450 - RNA, 60 nt, Homo Sapiens; identical to SEQ ID NO: 37774

SEQ ID NO: 242451 - RNA, 60 nt, Homo Sapiens; identical to SEQ ID NO: 37775

SEQ ID NO: 242452 - RNA, 60 nt, Homo Sapiens; identical to SEQ ID NO: 37776

SEQ ID NO: 242453 - RNA, 60 nt, Homo Sapiens; identical to SEQ ID NO: 37777

SEQ ID NO: 242454 - RNA, 60 nt, Homo Sapiens; identical to SEQ ID NO: 37778

SEQ ID NO: 242455 - RNA, 60 nt, Homo Sapiens; identical to SEQ ID NO: 37779

SEQ ID NO: 242456 - RNA, 60 nt, Homo Sapiens; identical to SEQ ID NO: 37780

SEQ ID NO: 242457 - RNA, 60 nt, Homo Sapiens; identical to SEQ ID NO: 37781

SEQ ID NO: 242458 - RNA, 60 nt, Homo Sapiens; identical to SEQ ID NO: 37782

SEQ ID NO: 242459 - RNA, 60 nt, Homo Sapiens; identical to SEQ ID NO: 37783

SEQ ID NO: 242460 - RNA, 60 nt, Homo Sapiens; identical to SEQ ID NO: 37784

SEQ ID NO: 242461 - RNA, 60 nt, Homo Sapiens; identical to SEQ ID NO: 37785

SEQ ID NO: 242462 - RNA, 60 nt, Homo Sapiens; identical to SEQ ID NO: 37786

SEQ ID NO: 242463 - RNA, 60 nt, Homo Sapiens; identical to SEQ ID NO: 37787

SEQ ID NO: 242464 - RNA, 60 nt, Homo Sapiens; identical to SEQ ID NO: 37788

SEQ ID NO: 242465 - RNA, 60 nt, Homo Sapiens; identical to SEQ ID NO: 37789

SEQ ID NO: 242466 - RNA, 60 nt, Homo Sapiens; identical to SEQ ID NO: 37790

SEQ ID NO: 242467 - RNA, 60 nt, Homo Sapiens; identical to SEQ ID NO: 37791

SEQ ID NO: 242468 - RNA, 60 nt, Homo Sapiens; identical to SEQ ID NO: 37792

SEQ ID NO: 242469 - RNA, 60 nt, Homo Sapiens; identical to SEQ ID NO: 37793

SEQ ID NO: 242470 - RNA, 60 nt, Homo Sapiens; identical to SEQ ID NO: 37794

SEQ ID NO: 242471 - RNA, 60 nt, Homo Sapiens; identical to SEQ ID NO: 37795

SEQ ID NO: 242472 - RNA, 60 nt, Homo Sapiens; identical to SEQ ID NO: 37796

SEQ ID NO: 242473 - RNA, 60 nt, Homo Sapiens; identical to SEQ ID NO: 37797

SEQ ID NO: 242474 - RNA, 60 nt, Homo Sapiens; identical to SEQ ID NO: 37798

SEQ ID NO: 242475 - RNA, 60 nt, Homo Sapiens; identical to SEQ ID NO: 37799

SEQ ID NO: 242476 - RNA, 60 nt, Homo Sapiens; identical to SEQ ID NO: 37800

SEQ ID NO: 242477 - RNA, 60 nt, Homo Sapiens; identical to SEQ ID NO: 37801

SEQ ID NO: 242478 - RNA, 60 nt, Homo Sapiens; identical to SEQ ID NO: 37802

SEQ ID NO: 242479 - RNA, 60 nt, Homo Sapiens; identical to SEQ ID NO: 37803

SEQ ID NO: 242480 - RNA, 60 nt, Homo Sapiens; identical to SEQ ID NO: 37804

SEQ ID NO: 242481 - RNA, 60 nt, Homo Sapiens; identical to SEQ ID NO: 37805

SEQ ID NO: 242482 - RNA, 60 nt, Homo Sapiens; identical to SEQ ID NO: 37806

SEQ ID NO: 242483 - RNA, 60 nt, Homo Sapiens; identical to SEQ ID NO: 37807

SEQ ID NO: 242484 - RNA, 60 nt, Homo Sapiens; identical to SEQ ID NO: 37808

SEQ ID NO: 242485 - RNA, 60 nt, Homo Sapiens; identical to SEQ ID NO: 37809

SEQ ID NO: 242486 - RNA, 60 nt, Homo Sapiens; identical to SEQ ID NO: 37810

SEQ ID NO: 242487 - RNA, 60 nt, Homo Sapiens; identical to SEQ ID NO: 37811

SEQ ID NO: 242488 - RNA, 60 nt, Homo Sapiens; identical to SEQ ID NO: 37812

SEQ ID NO: 242489 - RNA, 60 nt, Homo Sapiens; identical to SEQ ID NO: 37813

SEQ ID NO: 242490 - RNA, 60 nt, Homo Sapiens; identical to SEQ ID NO: 37814

SEQ ID NO: 242491 - RNA, 60 nt, Homo Sapiens; identical to SEQ ID NO: 37815

SEQ ID NO: 242492 - RNA, 60 nt, Homo Sapiens; identical to SEQ ID NO: 37816

SEQ ID NO: 242493 - RNA, 60 nt, Homo Sapiens; identical to SEQ ID NO: 37817

SEQ ID NO: 242494 - RNA, 60 nt, Homo Sapiens; identical to SEQ ID NO: 37818

SEQ ID NO: 242495 - RNA, 60 nt, Homo Sapiens; identical to SEQ ID NO: 37819

SEQ ID NO: 242496 - RNA, 60 nt, Homo Sapiens; identical to SEQ ID NO: 37820

SEQ ID NO: 242497 - RNA, 60 nt, Homo Sapiens; identical to SEQ ID NO: 37821

SEQ ID NO: 242498 - RNA, 60 nt, Homo Sapiens; identical to SEQ ID NO: 37822

SEQ ID NO: 242499 - RNA, 60 nt, Homo Sapiens; identical to SEQ ID NO: 37823

SEQ ID NO: 242500 - RNA, 60 nt, Homo Sapiens; identical to SEQ ID NO: 37824

SEQ ID NO: 242501 - RNA, 60 nt, Homo Sapiens; identical to SEQ ID NO: 37825

SEQ ID NO: 242502 - RNA, 60 nt, Homo Sapiens; identical to SEQ ID NO: 37826

SEQ ID NO: 242503 - RNA, 60 nt, Homo Sapiens; identical to SEQ ID NO: 37827

SEQ ID NO: 242504 - RNA, 60 nt, Homo Sapiens; identical to SEQ ID NO: 37828

SEQ ID NO: 242505 - RNA, 60 nt, Homo Sapiens; identical to SEQ ID NO: 37829

SEQ ID NO: 242506 - RNA, 60 nt, Homo Sapiens; identical to SEQ ID NO: 37830

SEQ ID NO: 242507 - RNA, 60 nt, Homo Sapiens; identical to SEQ ID NO: 37831

SEQ ID NO: 242508 - RNA, 60 nt, Homo Sapiens; identical to SEQ ID NO: 37832

SEQ ID NO: 242509 - RNA, 60 nt, Homo Sapiens; identical to SEQ ID NO: 37833

SEQ ID NO: 242510 - RNA, 60 nt, Homo Sapiens; identical to SEQ ID NO: 37834

SEQ ID NO: 242511 - RNA, 60 nt, Homo Sapiens; identical to SEQ ID NO: 37835

SEQ ID NO: 242512 - RNA, 60 nt, Homo Sapiens; identical to SEQ ID NO: 37836

SEQ ID NO: 242513 - RNA, 60 nt, Homo Sapiens; identical to SEQ ID NO: 37837

SEQ ID NO: 242514 - RNA, 60 nt, Homo Sapiens; identical to SEQ ID NO: 37838

SEQ ID NO: 242515 - RNA, 60 nt, Homo Sapiens; identical to SEQ ID NO: 37839

SEQ ID NO: 242516 - RNA, 60 nt, Homo Sapiens; identical to SEQ ID NO: 37840

SEQ ID NO: 242517 - RNA, 60 nt, Homo Sapiens; identical to SEQ ID NO: 37841

SEQ ID NO: 242518 - RNA, 60 nt, Homo Sapiens; identical to SEQ ID NO: 37842

SEQ ID NO: 242519 - RNA, 60 nt, Homo Sapiens; identical to SEQ ID NO: 37843

SEQ ID NO: 242520 - RNA, 60 nt, Homo Sapiens; identical to SEQ ID NO: 37844

SEQ ID NO: 242521 - RNA, 60 nt, Homo Sapiens; identical to SEQ ID NO: 37845

SEQ ID NO: 242522 - RNA, 60 nt, Homo Sapiens; identical to SEQ ID NO: 37846

SEQ ID NO: 242523 - RNA, 60 nt, Homo Sapiens; identical to SEQ ID NO: 37847

SEQ ID NO: 242524 - RNA, 60 nt, Homo Sapiens; identical to SEQ ID NO: 37848

SEQ ID NO: 242525 - RNA, 60 nt, Homo Sapiens; identical to SEQ ID NO: 37849

SEQ ID NO: 242526 - RNA, 60 nt, Homo Sapiens; identical to SEQ ID NO: 37850

SEQ ID NO: 242527 - RNA, 60 nt, Homo Sapiens; identical to SEQ ID NO: 37851

SEQ ID NO: 242528 - RNA, 60 nt, Homo Sapiens; identical to SEQ ID NO: 37852

SEQ ID NO: 242529 - RNA, 60 nt, Homo Sapiens; identical to SEQ ID NO: 37853

SEQ ID NO: 242530 - RNA, 60 nt, Homo Sapiens; identical to SEQ ID NO: 37854

SEQ ID NO: 242531 - RNA, 60 nt, Homo Sapiens; identical to SEQ ID NO: 37855

SEQ ID NO: 242532 - RNA, 60 nt, Homo Sapiens; identical to SEQ ID NO: 37856

SEQ ID NO: 242533 - RNA, 60 nt, Homo Sapiens; identical to SEQ ID NO: 37857

SEQ ID NO: 242534 - RNA, 60 nt, Homo Sapiens; identical to SEQ ID NO: 37858

SEQ ID NO: 242535 - RNA, 60 nt, Homo Sapiens; identical to SEQ ID NO: 37859

SEQ ID NO: 242536 - RNA, 60 nt, Homo Sapiens; identical to SEQ ID NO: 37860

SEQ ID NO: 242537 - RNA, 60 nt, Homo Sapiens; identical to SEQ ID NO: 37861

SEQ ID NO: 242538 - RNA, 60 nt, Homo Sapiens; identical to SEQ ID NO: 37862

SEQ ID NO: 242539 - RNA, 60 nt, Homo Sapiens; identical to SEQ ID NO: 37863

SEQ ID NO: 242540 - RNA, 60 nt, Homo Sapiens; identical to SEQ ID NO: 37864

SEQ ID NO: 242541 - RNA, 60 nt, Homo Sapiens; identical to SEQ ID NO: 37865

SEQ ID NO: 242542 - RNA, 60 nt, Homo Sapiens; identical to SEQ ID NO: 37866

SEQ ID NO: 242543 - RNA, 60 nt, Homo Sapiens; identical to SEQ ID NO: 37867

SEQ ID NO: 242544 - RNA, 60 nt, Homo Sapiens; identical to SEQ ID NO: 37868

SEQ ID NO: 242545 - RNA, 60 nt, Homo Sapiens; identical to SEQ ID NO: 37869

SEQ ID NO: 242546 - RNA, 60 nt, Homo Sapiens; identical to SEQ ID NO: 37870

SEQ ID NO: 242547 - RNA, 60 nt, Homo Sapiens; identical to SEQ ID NO: 37871

SEQ ID NO: 242548 - RNA, 60 nt, Homo Sapiens; identical to SEQ ID NO: 37872

SEQ ID NO: 242549 - RNA, 60 nt, Homo Sapiens; identical to SEQ ID NO: 37873

SEQ ID NO: 242550 - RNA, 60 nt, Homo Sapiens; identical to SEQ ID NO: 37874

SEQ ID NO: 242551 - RNA, 60 nt, Homo Sapiens; identical to SEQ ID NO: 37875

SEQ ID NO: 242552 - RNA, 60 nt, Homo Sapiens; identical to SEQ ID NO: 37876

SEQ ID NO: 242553 - RNA, 60 nt, Homo Sapiens; identical to SEQ ID NO: 37877

SEQ ID NO: 242554 - RNA, 60 nt, Homo Sapiens; identical to SEQ ID NO: 37878

SEQ ID NO: 242555 - RNA, 60 nt, Homo Sapiens; identical to SEQ ID NO: 37879

SEQ ID NO: 242556 - RNA, 60 nt, Homo Sapiens; identical to SEQ ID NO: 37880

SEQ ID NO: 242557 - RNA, 60 nt, Homo Sapiens; identical to SEQ ID NO: 37881

SEQ ID NO: 242558 - RNA, 60 nt, Homo Sapiens; identical to SEQ ID NO: 37882

SEQ ID NO: 242559 - RNA, 60 nt, Homo Sapiens; identical to SEQ ID NO: 37883

SEQ ID NO: 242560 - RNA, 60 nt, Homo Sapiens; identical to SEQ ID NO: 37884

SEQ ID NO: 242561 - RNA, 60 nt, Homo Sapiens; identical to SEQ ID NO: 37885

SEQ ID NO: 242562 - RNA, 60 nt, Homo Sapiens; identical to SEQ ID NO: 37886

SEQ ID NO: 242563 - RNA, 60 nt, Homo Sapiens; identical to SEQ ID NO: 37887

SEQ ID NO: 242564 - RNA, 60 nt, Homo Sapiens; identical to SEQ ID NO: 37888

SEQ ID NO: 242565 - RNA, 60 nt, Homo Sapiens; identical to SEQ ID NO: 37889

SEQ ID NO: 242566 - RNA, 60 nt, Homo Sapiens; identical to SEQ ID NO: 37890

SEQ ID NO: 242567 - RNA, 60 nt, Homo Sapiens; identical to SEQ ID NO: 37891

SEQ ID NO: 242568 - RNA, 60 nt, Homo Sapiens; identical to SEQ ID NO: 37892

SEQ ID NO: 242569 - RNA, 60 nt, Homo Sapiens; identical to SEQ ID NO: 37893

SEQ ID NO: 242570 - RNA, 60 nt, Homo Sapiens; identical to SEQ ID NO: 37894

SEQ ID NO: 242571 - RNA, 60 nt, Homo Sapiens; identical to SEQ ID NO: 37895

SEQ ID NO: 242572 - RNA, 60 nt, Homo Sapiens; identical to SEQ ID NO: 37896

SEQ ID NO: 242573 - RNA, 60 nt, Homo Sapiens; identical to SEQ ID NO: 37897

SEQ ID NO: 242574 - RNA, 60 nt, Homo Sapiens; identical to SEQ ID NO: 37898

SEQ ID NO: 242575 - RNA, 60 nt, Homo Sapiens; identical to SEQ ID NO: 37899

SEQ ID NO: 242576 - RNA, 60 nt, Homo Sapiens; identical to SEQ ID NO: 37900

SEQ ID NO: 242577 - RNA, 60 nt, Homo Sapiens; identical to SEQ ID NO: 37901

SEQ ID NO: 242578 - RNA, 60 nt, Homo Sapiens; identical to SEQ ID NO: 37902

SEQ ID NO: 242579 - RNA, 60 nt, Homo Sapiens; identical to SEQ ID NO: 37903

SEQ ID NO: 242580 - RNA, 60 nt, Homo Sapiens; identical to SEQ ID NO: 37904

SEQ ID NO: 242581 - RNA, 60 nt, Homo Sapiens; identical to SEQ ID NO: 37905

SEQ ID NO: 242582 - RNA, 60 nt, Homo Sapiens; identical to SEQ ID NO: 37906

SEQ ID NO: 242583 - RNA, 60 nt, Homo Sapiens; identical to SEQ ID NO: 37907

SEQ ID NO: 242584 - RNA, 60 nt, Homo Sapiens; identical to SEQ ID NO: 37908

SEQ ID NO: 242585 - RNA, 60 nt, Homo Sapiens; identical to SEQ ID NO: 37909

SEQ ID NO: 242586 - RNA, 60 nt, Homo Sapiens; identical to SEQ ID NO: 37910

SEQ ID NO: 242587 - RNA, 60 nt, Homo Sapiens; identical to SEQ ID NO: 37911

SEQ ID NO: 242588 - RNA, 60 nt, Homo Sapiens; identical to SEQ ID NO: 37912

SEQ ID NO: 242589 - RNA, 60 nt, Homo Sapiens; identical to SEQ ID NO: 37913

SEQ ID NO: 242590 - RNA, 60 nt, Homo Sapiens; identical to SEQ ID NO: 37914

SEQ ID NO: 242591 - RNA, 60 nt, Homo Sapiens; identical to SEQ ID NO: 37915

SEQ ID NO: 242592 - RNA, 60 nt, Homo Sapiens; identical to SEQ ID NO: 37916

SEQ ID NO: 242593 - RNA, 60 nt, Homo Sapiens; identical to SEQ ID NO: 37917

SEQ ID NO: 242594 - RNA, 60 nt, Homo Sapiens; identical to SEQ ID NO: 37918

SEQ ID NO: 242595 - RNA, 60 nt, Homo Sapiens; identical to SEQ ID NO: 37919

SEQ ID NO: 242596 - RNA, 60 nt, Homo Sapiens; identical to SEQ ID NO: 37920

SEQ ID NO: 242597 - RNA, 60 nt, Homo Sapiens; identical to SEQ ID NO: 37921

SEQ ID NO: 242598 - RNA, 60 nt, Homo Sapiens; identical to SEQ ID NO: 37922

SEQ ID NO: 242599 - RNA, 60 nt, Homo Sapiens; identical to SEQ ID NO: 37923

SEQ ID NO: 242600 - RNA, 60 nt, Homo Sapiens; identical to SEQ ID NO: 37924

SEQ ID NO: 242601 - RNA, 60 nt, Homo Sapiens; identical to SEQ ID NO: 37925

SEQ ID NO: 242602 - RNA, 60 nt, Homo Sapiens; identical to SEQ ID NO: 37926

SEQ ID NO: 242603 - RNA, 60 nt, Homo Sapiens; identical to SEQ ID NO: 37927

SEQ ID NO: 242604 - RNA, 60 nt, Homo Sapiens; identical to SEQ ID NO: 37928

SEQ ID NO: 242605 - RNA, 60 nt, Homo Sapiens; identical to SEQ ID NO: 37929

SEQ ID NO: 242606 - RNA, 60 nt, Homo Sapiens; identical to SEQ ID NO: 37930

SEQ ID NO: 242607 - RNA, 60 nt, Homo Sapiens; identical to SEQ ID NO: 37931

SEQ ID NO: 242608 - RNA, 60 nt, Homo Sapiens; identical to SEQ ID NO: 37932

SEQ ID NO: 242609 - RNA, 60 nt, Homo Sapiens; identical to SEQ ID NO: 37933

SEQ ID NO: 242610 - RNA, 60 nt, Homo Sapiens; identical to SEQ ID NO: 37934

SEQ ID NO: 242611 - RNA, 60 nt, Homo Sapiens; identical to SEQ ID NO: 37935

SEQ ID NO: 242612 - RNA, 60 nt, Homo Sapiens; identical to SEQ ID NO: 37936

SEQ ID NO: 242613 - RNA, 60 nt, Homo Sapiens; identical to SEQ ID NO: 37937

SEQ ID NO: 242614 - RNA, 60 nt, Homo Sapiens; identical to SEQ ID NO: 37938

SEQ ID NO: 242615 - RNA, 60 nt, Homo Sapiens; identical to SEQ ID NO: 37939

SEQ ID NO: 242616 - RNA, 60 nt, Homo Sapiens; identical to SEQ ID NO: 37940

SEQ ID NO: 242617 - RNA, 60 nt, Homo Sapiens; identical to SEQ ID NO: 37941

SEQ ID NO: 242618 - RNA, 60 nt, Homo Sapiens; identical to SEQ ID NO: 37942

SEQ ID NO: 242619 - RNA, 60 nt, Homo Sapiens; identical to SEQ ID NO: 37943

SEQ ID NO: 242620 - RNA, 60 nt, Homo Sapiens; identical to SEQ ID NO: 37944

SEQ ID NO: 242621 - RNA, 60 nt, Homo Sapiens; identical to SEQ ID NO: 37945

SEQ ID NO: 242622 - RNA, 60 nt, Homo Sapiens; identical to SEQ ID NO: 37946

SEQ ID NO: 242623 - RNA, 60 nt, Homo Sapiens; identical to SEQ ID NO: 37947

SEQ ID NO: 242624 - RNA, 60 nt, Homo Sapiens; identical to SEQ ID NO: 37948

SEQ ID NO: 242625 - RNA, 60 nt, Homo Sapiens; identical to SEQ ID NO: 37949

SEQ ID NO: 242626 - RNA, 60 nt, Homo Sapiens; identical to SEQ ID NO: 37950

SEQ ID NO: 242627 - RNA, 60 nt, Homo Sapiens; identical to SEQ ID NO: 37951

SEQ ID NO: 242628 - RNA, 60 nt, Homo Sapiens; identical to SEQ ID NO: 37952

SEQ ID NO: 242629 - RNA, 60 nt, Homo Sapiens; identical to SEQ ID NO: 37953

SEQ ID NO: 242630 - RNA, 60 nt, Homo Sapiens; identical to SEQ ID NO: 37954

SEQ ID NO: 242631 - RNA, 60 nt, Homo Sapiens; identical to SEQ ID NO: 37955

SEQ ID NO: 242632 - RNA, 60 nt, Homo Sapiens; identical to SEQ ID NO: 37956

SEQ ID NO: 242633 - RNA, 60 nt, Homo Sapiens; identical to SEQ ID NO: 37957

SEQ ID NO: 242634 - RNA, 60 nt, Homo Sapiens; identical to SEQ ID NO: 37958

SEQ ID NO: 242635 - RNA, 60 nt, Homo Sapiens; identical to SEQ ID NO: 37959

SEQ ID NO: 242636 - RNA, 60 nt, Homo Sapiens; identical to SEQ ID NO: 37960

SEQ ID NO: 242637 - RNA, 54 nt, Homo Sapiens; identical to SEQ ID NO: 37961

SEQ ID NO: 242638 - RNA, 60 nt, Homo Sapiens; identical to SEQ ID NO: 37962

SEQ ID NO: 242639 - RNA, 60 nt, Homo Sapiens; identical to SEQ ID NO: 37963

SEQ ID NO: 242640 - RNA, 60 nt, Homo Sapiens; identical to SEQ ID NO: 37964

SEQ ID NO: 242641 - RNA, 60 nt, Homo Sapiens; identical to SEQ ID NO: 37965

SEQ ID NO: 242642 - RNA, 60 nt, Homo Sapiens; identical to SEQ ID NO: 37966

SEQ ID NO: 242643 - RNA, 60 nt, Homo Sapiens; identical to SEQ ID NO: 37967

SEQ ID NO: 242644 - RNA, 60 nt, Homo Sapiens; identical to SEQ ID NO: 37968

SEQ ID NO: 242645 - RNA, 60 nt, Homo Sapiens; identical to SEQ ID NO: 37969

SEQ ID NO: 242646 - RNA, 60 nt, Homo Sapiens; identical to SEQ ID NO: 37970

SEQ ID NO: 242647 - RNA, 60 nt, Homo Sapiens; identical to SEQ ID NO: 37971

SEQ ID NO: 242648 - RNA, 60 nt, Homo Sapiens; identical to SEQ ID NO: 37972

SEQ ID NO: 242649 - RNA, 60 nt, Homo Sapiens; identical to SEQ ID NO: 37973

SEQ ID NO: 242650 - RNA, 60 nt, Homo Sapiens; identical to SEQ ID NO: 37974

SEQ ID NO: 242651 - RNA, 60 nt, Homo Sapiens; identical to SEQ ID NO: 37975

SEQ ID NO: 242652 - RNA, 60 nt, Homo Sapiens; identical to SEQ ID NO: 37976

SEQ ID NO: 242653 - RNA, 60 nt, Homo Sapiens; identical to SEQ ID NO: 37977

SEQ ID NO: 242654 - RNA, 60 nt, Homo Sapiens; identical to SEQ ID NO: 37978

SEQ ID NO: 242655 - RNA, 60 nt, Homo Sapiens; identical to SEQ ID NO: 37979

SEQ ID NO: 242656 - RNA, 60 nt, Homo Sapiens; identical to SEQ ID NO: 37980

SEQ ID NO: 242657 - RNA, 60 nt, Homo Sapiens; identical to SEQ ID NO: 37981

SEQ ID NO: 242658 - RNA, 60 nt, Homo Sapiens; identical to SEQ ID NO: 37982

SEQ ID NO: 242659 - RNA, 60 nt, Homo Sapiens; identical to SEQ ID NO: 37983

SEQ ID NO: 242660 - RNA, 60 nt, Homo Sapiens; identical to SEQ ID NO: 37984

SEQ ID NO: 242661 - RNA, 60 nt, Homo Sapiens; identical to SEQ ID NO: 37985

SEQ ID NO: 242662 - RNA, 60 nt, Homo Sapiens; identical to SEQ ID NO: 37986

SEQ ID NO: 242663 - RNA, 60 nt, Homo Sapiens; identical to SEQ ID NO: 37987

SEQ ID NO: 242664 - RNA, 60 nt, Homo Sapiens; identical to SEQ ID NO: 37988

SEQ ID NO: 242665 - RNA, 60 nt, Homo Sapiens; identical to SEQ ID NO: 37989

SEQ ID NO: 242666 - RNA, 60 nt, Homo Sapiens; identical to SEQ ID NO: 37990

SEQ ID NO: 242667 - RNA, 60 nt, Homo Sapiens; identical to SEQ ID NO: 37991

SEQ ID NO: 242668 - RNA, 60 nt, Homo Sapiens; identical to SEQ ID NO: 37992

SEQ ID NO: 242669 - RNA, 60 nt, Homo Sapiens; identical to SEQ ID NO: 37993

SEQ ID NO: 242670 - RNA, 60 nt, Homo Sapiens; identical to SEQ ID NO: 37994

SEQ ID NO: 242671 - RNA, 52 nt, Homo Sapiens; identical to SEQ ID NO: 37995

SEQ ID NO: 242672 - RNA, 60 nt, Homo Sapiens; identical to SEQ ID NO: 37996

SEQ ID NO: 242673 - RNA, 60 nt, Homo Sapiens; identical to SEQ ID NO: 37997

SEQ ID NO: 242674 - RNA, 60 nt, Homo Sapiens; identical to SEQ ID NO: 37998

SEQ ID NO: 242675 - RNA, 60 nt, Homo Sapiens; identical to SEQ ID NO: 37999

SEQ ID NO: 242676 - RNA, 60 nt, Homo Sapiens; identical to SEQ ID NO: 38000

SEQ ID NO: 242677 - RNA, 60 nt, Homo Sapiens; identical to SEQ ID NO: 38001

SEQ ID NO: 242678 - RNA, 60 nt, Homo Sapiens; identical to SEQ ID NO: 38002

SEQ ID NO: 242679 - RNA, 60 nt, Homo Sapiens; identical to SEQ ID NO: 38003

SEQ ID NO: 242680 - RNA, 60 nt, Homo Sapiens; identical to SEQ ID NO: 38004

SEQ ID NO: 242681 - RNA, 60 nt, Homo Sapiens; identical to SEQ ID NO: 38005

SEQ ID NO: 242682 - RNA, 60 nt, Homo Sapiens; identical to SEQ ID NO: 38006

SEQ ID NO: 242683 - RNA, 60 nt, Homo Sapiens; identical to SEQ ID NO: 38007

SEQ ID NO: 242684 - RNA, 60 nt, Homo Sapiens; identical to SEQ ID NO: 38008

SEQ ID NO: 242685 - RNA, 60 nt, Homo Sapiens; identical to SEQ ID NO: 38009

SEQ ID NO: 242686 - RNA, 60 nt, Homo Sapiens; identical to SEQ ID NO: 38010

SEQ ID NO: 242687 - RNA, 60 nt, Homo Sapiens; identical to SEQ ID NO: 38011

SEQ ID NO: 242688 - RNA, 60 nt, Homo Sapiens; identical to SEQ ID NO: 38012

SEQ ID NO: 242689 - RNA, 60 nt, Homo Sapiens; identical to SEQ ID NO: 38013

SEQ ID NO: 242690 - RNA, 60 nt, Homo Sapiens; identical to SEQ ID NO: 38014

SEQ ID NO: 242691 - RNA, 60 nt, Homo Sapiens; identical to SEQ ID NO: 38015

SEQ ID NO: 242692 - RNA, 60 nt, Homo Sapiens; identical to SEQ ID NO: 38016

SEQ ID NO: 242693 - RNA, 60 nt, Homo Sapiens; identical to SEQ ID NO: 38017

SEQ ID NO: 242694 - RNA, 60 nt, Homo Sapiens; identical to SEQ ID NO: 38018

SEQ ID NO: 242695 - RNA, 60 nt, Homo Sapiens; identical to SEQ ID NO: 38019

SEQ ID NO: 242696 - RNA, 60 nt, Homo Sapiens; identical to SEQ ID NO: 38020

SEQ ID NO: 242697 - RNA, 60 nt, Homo Sapiens; identical to SEQ ID NO: 38021

SEQ ID NO: 242698 - RNA, 60 nt, Homo Sapiens; identical to SEQ ID NO: 38022

SEQ ID NO: 242699 - RNA, 60 nt, Homo Sapiens; identical to SEQ ID NO: 38023

SEQ ID NO: 242700 - RNA, 60 nt, Homo Sapiens; identical to SEQ ID NO: 38024

SEQ ID NO: 242701 - RNA, 60 nt, Homo Sapiens; identical to SEQ ID NO: 38025

SEQ ID NO: 242702 - RNA, 60 nt, Homo Sapiens; identical to SEQ ID NO: 38026

SEQ ID NO: 242703 - RNA, 60 nt, Homo Sapiens; identical to SEQ ID NO: 38027

SEQ ID NO: 242704 - RNA, 60 nt, Homo Sapiens; identical to SEQ ID NO: 38028

SEQ ID NO: 242705 - RNA, 60 nt, Homo Sapiens; identical to SEQ ID NO: 38029

SEQ ID NO: 242706 - RNA, 60 nt, Homo Sapiens; identical to SEQ ID NO: 38030

SEQ ID NO: 242707 - RNA, 60 nt, Homo Sapiens; identical to SEQ ID NO: 38031

SEQ ID NO: 242708 - RNA, 60 nt, Homo Sapiens; identical to SEQ ID NO: 38032

SEQ ID NO: 242709 - RNA, 60 nt, Homo Sapiens; identical to SEQ ID NO: 38033

SEQ ID NO: 242710 - RNA, 60 nt, Homo Sapiens; identical to SEQ ID NO: 38034

SEQ ID NO: 242711 - RNA, 60 nt, Homo Sapiens; identical to SEQ ID NO: 38035

SEQ ID NO: 242712 - RNA, 60 nt, Homo Sapiens; identical to SEQ ID NO: 38036

SEQ ID NO: 242713 - RNA, 60 nt, Homo Sapiens; identical to SEQ ID NO: 38037

SEQ ID NO: 242714 - RNA, 60 nt, Homo Sapiens; identical to SEQ ID NO: 38038

SEQ ID NO: 242715 - RNA, 60 nt, Homo Sapiens; identical to SEQ ID NO: 38039

SEQ ID NO: 242716 - RNA, 60 nt, Homo Sapiens; identical to SEQ ID NO: 38040

SEQ ID NO: 242717 - RNA, 60 nt, Homo Sapiens; identical to SEQ ID NO: 38041

SEQ ID NO: 242718 - RNA, 60 nt, Homo Sapiens; identical to SEQ ID NO: 38042

SEQ ID NO: 242719 - RNA, 60 nt, Homo Sapiens; identical to SEQ ID NO: 38043

SEQ ID NO: 242720 - RNA, 60 nt, Homo Sapiens; identical to SEQ ID NO: 38044

SEQ ID NO: 242721 - RNA, 60 nt, Homo Sapiens; identical to SEQ ID NO: 38045

SEQ ID NO: 242722 - RNA, 60 nt, Homo Sapiens; identical to SEQ ID NO: 38046

SEQ ID NO: 242723 - RNA, 60 nt, Homo Sapiens; identical to SEQ ID NO: 38047

SEQ ID NO: 242724 - RNA, 60 nt, Homo Sapiens; identical to SEQ ID NO: 38048

SEQ ID NO: 242725 - RNA, 60 nt, Homo Sapiens; identical to SEQ ID NO: 38049

SEQ ID NO: 242726 - RNA, 60 nt, Homo Sapiens; identical to SEQ ID NO: 38050

SEQ ID NO: 242727 - RNA, 60 nt, Homo Sapiens; identical to SEQ ID NO: 38051

SEQ ID NO: 242728 - RNA, 60 nt, Homo Sapiens; identical to SEQ ID NO: 38052

SEQ ID NO: 242729 - RNA, 60 nt, Homo Sapiens; identical to SEQ ID NO: 38053

SEQ ID NO: 242730 - RNA, 60 nt, Homo Sapiens; identical to SEQ ID NO: 38054

SEQ ID NO: 242731 - RNA, 60 nt, Homo Sapiens; identical to SEQ ID NO: 38055

SEQ ID NO: 242732 - RNA, 60 nt, Homo Sapiens; identical to SEQ ID NO: 38056

SEQ ID NO: 242733 - RNA, 60 nt, Homo Sapiens; identical to SEQ ID NO: 38057

SEQ ID NO: 242734 - RNA, 60 nt, Homo Sapiens; identical to SEQ ID NO: 38058

SEQ ID NO: 242735 - RNA, 60 nt, Homo Sapiens; identical to SEQ ID NO: 38059

SEQ ID NO: 242736 - RNA, 60 nt, Homo Sapiens; identical to SEQ ID NO: 38060

SEQ ID NO: 242737 - RNA, 60 nt, Homo Sapiens; identical to SEQ ID NO: 38061

SEQ ID NO: 242738 - RNA, 60 nt, Homo Sapiens; identical to SEQ ID NO: 38062

SEQ ID NO: 242739 - RNA, 60 nt, Homo Sapiens; identical to SEQ ID NO: 38063

SEQ ID NO: 242740 - RNA, 60 nt, Homo Sapiens; identical to SEQ ID NO: 38064

SEQ ID NO: 242741 - RNA, 60 nt, Homo Sapiens; identical to SEQ ID NO: 38065

SEQ ID NO: 242742 - RNA, 60 nt, Homo Sapiens; identical to SEQ ID NO: 38066

SEQ ID NO: 242743 - RNA, 60 nt, Homo Sapiens; identical to SEQ ID NO: 38067

SEQ ID NO: 242744 - RNA, 60 nt, Homo Sapiens; identical to SEQ ID NO: 38068

SEQ ID NO: 242745 - RNA, 60 nt, Homo Sapiens; identical to SEQ ID NO: 38069

SEQ ID NO: 242746 - RNA, 60 nt, Homo Sapiens; identical to SEQ ID NO: 38070

SEQ ID NO: 242747 - RNA, 60 nt, Homo Sapiens; identical to SEQ ID NO: 38071

SEQ ID NO: 242748 - RNA, 60 nt, Homo Sapiens; identical to SEQ ID NO: 38072

SEQ ID NO: 242749 - RNA, 60 nt, Homo Sapiens; identical to SEQ ID NO: 38073

SEQ ID NO: 242750 - RNA, 60 nt, Homo Sapiens; identical to SEQ ID NO: 38074

SEQ ID NO: 242751 - RNA, 60 nt, Homo Sapiens; identical to SEQ ID NO: 38075

SEQ ID NO: 242752 - RNA, 60 nt, Homo Sapiens; identical to SEQ ID NO: 38076

SEQ ID NO: 242753 - RNA, 60 nt, Homo Sapiens; identical to SEQ ID NO: 38077

SEQ ID NO: 242754 - RNA, 60 nt, Homo Sapiens; identical to SEQ ID NO: 38078

SEQ ID NO: 242755 - RNA, 60 nt, Homo Sapiens; identical to SEQ ID NO: 38079

SEQ ID NO: 242756 - RNA, 60 nt, Homo Sapiens; identical to SEQ ID NO: 38080

SEQ ID NO: 242757 - RNA, 60 nt, Homo Sapiens; identical to SEQ ID NO: 38081

SEQ ID NO: 242758 - RNA, 60 nt, Homo Sapiens; identical to SEQ ID NO: 38082

SEQ ID NO: 242759 - RNA, 60 nt, Homo Sapiens; identical to SEQ ID NO: 38083

SEQ ID NO: 242760 - RNA, 60 nt, Homo Sapiens; identical to SEQ ID NO: 38084

SEQ ID NO: 242761 - RNA, 60 nt, Homo Sapiens; identical to SEQ ID NO: 38085

SEQ ID NO: 242762 - RNA, 60 nt, Homo Sapiens; identical to SEQ ID NO: 38086

SEQ ID NO: 242763 - RNA, 60 nt, Homo Sapiens; identical to SEQ ID NO: 38087

SEQ ID NO: 242764 - RNA, 60 nt, Homo Sapiens; identical to SEQ ID NO: 38088

SEQ ID NO: 242765 - RNA, 60 nt, Homo Sapiens; identical to SEQ ID NO: 38089

SEQ ID NO: 242766 - RNA, 60 nt, Homo Sapiens; identical to SEQ ID NO: 38090

SEQ ID NO: 242767 - RNA, 60 nt, Homo Sapiens; identical to SEQ ID NO: 38091

SEQ ID NO: 242768 - RNA, 60 nt, Homo Sapiens; identical to SEQ ID NO: 38092

SEQ ID NO: 242769 - RNA, 60 nt, Homo Sapiens; identical to SEQ ID NO: 38093

SEQ ID NO: 242770 - RNA, 60 nt, Homo Sapiens; identical to SEQ ID NO: 38094

SEQ ID NO: 242771 - RNA, 60 nt, Homo Sapiens; identical to SEQ ID NO: 38095

SEQ ID NO: 242772 - RNA, 60 nt, Homo Sapiens; identical to SEQ ID NO: 38096

SEQ ID NO: 242773 - RNA, 60 nt, Homo Sapiens; identical to SEQ ID NO: 38097

SEQ ID NO: 242774 - RNA, 60 nt, Homo Sapiens; identical to SEQ ID NO: 38098

SEQ ID NO: 242775 - RNA, 60 nt, Homo Sapiens; identical to SEQ ID NO: 38099

SEQ ID NO: 242776 - RNA, 60 nt, Homo Sapiens; identical to SEQ ID NO: 38100

SEQ ID NO: 242777 - RNA, 60 nt, Homo Sapiens; identical to SEQ ID NO: 38101

SEQ ID NO: 242778 - RNA, 60 nt, Homo Sapiens; identical to SEQ ID NO: 38102

SEQ ID NO: 242779 - RNA, 60 nt, Homo Sapiens; identical to SEQ ID NO: 38103

SEQ ID NO: 242780 - RNA, 60 nt, Homo Sapiens; identical to SEQ ID NO: 38104

SEQ ID NO: 242781 - RNA, 60 nt, Homo Sapiens; identical to SEQ ID NO: 38105

SEQ ID NO: 242782 - RNA, 60 nt, Homo Sapiens; identical to SEQ ID NO: 38106

SEQ ID NO: 242783 - RNA, 60 nt, Homo Sapiens; identical to SEQ ID NO: 38107

SEQ ID NO: 242784 - RNA, 60 nt, Homo Sapiens; identical to SEQ ID NO: 38108

SEQ ID NO: 242785 - RNA, 60 nt, Homo Sapiens; identical to SEQ ID NO: 38109

SEQ ID NO: 242786 - RNA, 60 nt, Homo Sapiens; identical to SEQ ID NO: 38110

SEQ ID NO: 242787 - RNA, 60 nt, Homo Sapiens; identical to SEQ ID NO: 38111

SEQ ID NO: 242788 - RNA, 60 nt, Homo Sapiens; identical to SEQ ID NO: 38112

SEQ ID NO: 242789 - RNA, 60 nt, Homo Sapiens; identical to SEQ ID NO: 38113

SEQ ID NO: 242790 - RNA, 60 nt, Homo Sapiens; identical to SEQ ID NO: 38114

SEQ ID NO: 242791 - RNA, 60 nt, Homo Sapiens; identical to SEQ ID NO: 38115

SEQ ID NO: 242792 - RNA, 60 nt, Homo Sapiens; identical to SEQ ID NO: 38116

SEQ ID NO: 242793 - RNA, 60 nt, Homo Sapiens; identical to SEQ ID NO: 38117

SEQ ID NO: 242794 - RNA, 60 nt, Homo Sapiens; identical to SEQ ID NO: 38118

SEQ ID NO: 242795 - RNA, 60 nt, Homo Sapiens; identical to SEQ ID NO: 38119

SEQ ID NO: 242796 - RNA, 60 nt, Homo Sapiens; identical to SEQ ID NO: 38120

SEQ ID NO: 242797 - RNA, 60 nt, Homo Sapiens; identical to SEQ ID NO: 38121

SEQ ID NO: 242798 - RNA, 60 nt, Homo Sapiens; identical to SEQ ID NO: 38122

SEQ ID NO: 242799 - RNA, 60 nt, Homo Sapiens; identical to SEQ ID NO: 38123

SEQ ID NO: 242800 - RNA, 60 nt, Homo Sapiens; identical to SEQ ID NO: 38124

SEQ ID NO: 242801 - RNA, 60 nt, Homo Sapiens; identical to SEQ ID NO: 38125

SEQ ID NO: 242802 - RNA, 60 nt, Homo Sapiens; identical to SEQ ID NO: 38126

SEQ ID NO: 242803 - RNA, 60 nt, Homo Sapiens; identical to SEQ ID NO: 38127

SEQ ID NO: 242804 - RNA, 60 nt, Homo Sapiens; identical to SEQ ID NO: 38128

SEQ ID NO: 242805 - RNA, 60 nt, Homo Sapiens; identical to SEQ ID NO: 38129

SEQ ID NO: 242806 - RNA, 60 nt, Homo Sapiens; identical to SEQ ID NO: 38130

SEQ ID NO: 242807 - RNA, 60 nt, Homo Sapiens; identical to SEQ ID NO: 38131

SEQ ID NO: 242808 - RNA, 60 nt, Homo Sapiens; identical to SEQ ID NO: 38132

SEQ ID NO: 242809 - RNA, 60 nt, Homo Sapiens; identical to SEQ ID NO: 38133

SEQ ID NO: 242810 - RNA, 60 nt, Homo Sapiens; identical to SEQ ID NO: 38134

SEQ ID NO: 242811 - RNA, 60 nt, Homo Sapiens; identical to SEQ ID NO: 38135

SEQ ID NO: 242812 - RNA, 60 nt, Homo Sapiens; identical to SEQ ID NO: 38136

SEQ ID NO: 242813 - RNA, 60 nt, Homo Sapiens; identical to SEQ ID NO: 38137

SEQ ID NO: 242814 - RNA, 60 nt, Homo Sapiens; identical to SEQ ID NO: 38138

SEQ ID NO: 242815 - RNA, 60 nt, Homo Sapiens; identical to SEQ ID NO: 38139

SEQ ID NO: 242816 - RNA, 64 nt, Homo Sapiens
gugcuugcuacucaccugcucacaauaaaaagcagucuuagagaaauugugaaacuugucacca

SEQ ID NO: 242817 - RNA, 64 nt, Homo Sapiens
ccacaggagaagagguaaagaaggaggagauggugucuuagaugggaaauugagaaaagggccc

SEQ ID NO: 242818 - RNA, 61 nt, Homo Sapiens
ugggccucucuuuucucagguuuguauuuuccacuucuaacgugaaucuucuuugacagac

SEQ ID NO: 242819 - RNA, 61 nt, Homo Sapiens
agggccaaaaagagaaaagaggaagcuaaaacacuucuacuuugcccauuucuaucacugu

SEQ ID NO: 242820 - RNA, 61 nt, Homo Sapiens
ugguuuuuugaucaguguagcuuuuaaaaagcacuucuacuugaagccuucguuuucaaga

SEQ ID NO: 242821 - RNA, 61 nt, Homo Sapiens
uuacaggugagggaaccaagcuggcucuuaucacuucuagucgguucauuuaaccugguga

SEQ ID NO: 242822 - RNA, 61 nt, Homo Sapiens
aauaguaugauaaaugcacauuuaaauauugcacuucuauauguguuuuauuuugaaaaua

SEQ ID NO: 242823 - RNA, 61 nt, Homo Sapiens
aucaugcacugaauucaaaauuugacucaagcacuucuagauaaauggugacucuaguaga

SEQ ID NO: 242824 - RNA, 61 nt, Homo Sapiens
gucuuuucucaucaguagaaucuauuuuggucacuucuagucaaugaaaaauguaaacuuu

SEQ ID NO: 242825 - RNA, 61 nt, Homo Sapiens
uugaaugaaaaaugcuuauguauugacagaacacuucuagaaugauacccaaacuccugga

SEQ ID NO: 242826 - RNA, 64 nt, Homo Sapiens; identical to SEQ ID NO: 91262

SEQ ID NO: 242827 - RNA, 64 nt, Homo Sapiens; identical to SEQ ID NO: 91263

SEQ ID NO: 242828 - RNA, 64 nt, Homo Sapiens; identical to SEQ ID NO: 91264

SEQ ID NO: 242829 - RNA, 64 nt, Homo Sapiens; identical to SEQ ID NO: 91265

SEQ ID NO: 242830 - RNA, 64 nt, Homo Sapiens; identical to SEQ ID NO: 91266

SEQ ID NO: 242831 - RNA, 64 nt, Homo Sapiens; identical to SEQ ID NO: 91267

SEQ ID NO: 242832 - RNA, 64 nt, Homo Sapiens; identical to SEQ ID NO: 91268

SEQ ID NO: 242833 - RNA, 64 nt, Homo Sapiens; identical to SEQ ID NO: 91269

SEQ ID NO: 242834 - RNA, 64 nt, Homo Sapiens; identical to SEQ ID NO: 91270

SEQ ID NO: 242835 - RNA, 64 nt, Homo Sapiens; identical to SEQ ID NO: 91271

SEQ ID NO: 242836 - RNA, 64 nt, Homo Sapiens; identical to SEQ ID NO: 91272

SEQ ID NO: 242837 - RNA, 64 nt, Homo Sapiens; identical to SEQ ID NO: 91273

SEQ ID NO: 242838 - RNA, 64 nt, Homo Sapiens; identical to SEQ ID NO: 91274

SEQ ID NO: 242839 - RNA, 64 nt, Homo Sapiens; identical to SEQ ID NO: 91275

SEQ ID NO: 242840 - RNA, 64 nt, Homo Sapiens; identical to SEQ ID NO: 91276

SEQ ID NO: 242841 - RNA, 64 nt, Homo Sapiens; identical to SEQ ID NO: 91277

SEQ ID NO: 242842 - RNA, 64 nt, Homo Sapiens; identical to SEQ ID NO: 91278

SEQ ID NO: 242843 - RNA, 64 nt, Homo Sapiens; identical to SEQ ID NO: 91279

SEQ ID NO: 242844 - RNA, 64 nt, Homo Sapiens; identical to SEQ ID NO: 91280

SEQ ID NO: 242845 - RNA, 64 nt, Homo Sapiens; identical to SEQ ID NO: 91281

SEQ ID NO: 242846 - RNA, 64 nt, Homo Sapiens; identical to SEQ ID NO: 91282

SEQ ID NO: 242847 - RNA, 64 nt, Homo Sapiens; identical to SEQ ID NO: 91283

SEQ ID NO: 242848 - RNA, 64 nt, Homo Sapiens; identical to SEQ ID NO: 91284

SEQ ID NO: 242849 - RNA, 64 nt, Homo Sapiens; identical to SEQ ID NO: 91285

SEQ ID NO: 242850 - RNA, 64 nt, Homo Sapiens; identical to SEQ ID NO: 91286

SEQ ID NO: 242851 - RNA, 64 nt, Homo Sapiens; identical to SEQ ID NO: 91287

SEQ ID NO: 242852 - RNA, 64 nt, Homo Sapiens; identical to SEQ ID NO: 91288

SEQ ID NO: 242853 - RNA, 64 nt, Homo Sapiens; identical to SEQ ID NO: 91289

SEQ ID NO: 242854 - RNA, 64 nt, Homo Sapiens; identical to SEQ ID NO: 91290

SEQ ID NO: 242855 - RNA, 64 nt, Homo Sapiens; identical to SEQ ID NO: 91291

SEQ ID NO: 242856 - RNA, 64 nt, Homo Sapiens; identical to SEQ ID NO: 91292

SEQ ID NO: 242857 - RNA, 64 nt, Homo Sapiens; identical to SEQ ID NO: 91293

SEQ ID NO: 242858 - RNA, 64 nt, Homo Sapiens; identical to SEQ ID NO: 91294

SEQ ID NO: 242859 - RNA, 64 nt, Homo Sapiens; identical to SEQ ID NO: 91295

SEQ ID NO: 242860 - RNA, 64 nt, Homo Sapiens; identical to SEQ ID NO: 91296

SEQ ID NO: 242861 - RNA, 64 nt, Homo Sapiens; identical to SEQ ID NO: 91297

SEQ ID NO: 242862 - RNA, 64 nt, Homo Sapiens; identical to SEQ ID NO: 91298

SEQ ID NO: 242863 - RNA, 64 nt, Homo Sapiens; identical to SEQ ID NO: 91299

SEQ ID NO: 242864 - RNA, 64 nt, Homo Sapiens; identical to SEQ ID NO: 91300

SEQ ID NO: 242865 - RNA, 64 nt, Homo Sapiens; identical to SEQ ID NO: 91301

SEQ ID NO: 242866 - RNA, 64 nt, Homo Sapiens; identical to SEQ ID NO: 91302

SEQ ID NO: 242867 - RNA, 64 nt, Homo Sapiens; identical to SEQ ID NO: 91303

SEQ ID NO: 242868 - RNA, 64 nt, Homo Sapiens; identical to SEQ ID NO: 91304

SEQ ID NO: 242869 - RNA, 64 nt, Homo Sapiens; identical to SEQ ID NO: 91305

SEQ ID NO: 242870 - RNA, 64 nt, Homo Sapiens; identical to SEQ ID NO: 91306

SEQ ID NO: 242871 - RNA, 64 nt, Homo Sapiens; identical to SEQ ID NO: 91307

SEQ ID NO: 242872 - RNA, 64 nt, Homo Sapiens; identical to SEQ ID NO: 91308

SEQ ID NO: 242873 - RNA, 64 nt, Homo Sapiens; identical to SEQ ID NO: 91309

SEQ ID NO: 242874 - RNA, 64 nt, Homo Sapiens; identical to SEQ ID NO: 91310

SEQ ID NO: 242875 - RNA, 64 nt, Homo Sapiens; identical to SEQ ID NO: 91311

SEQ ID NO: 242876 - RNA, 64 nt, Homo Sapiens; identical to SEQ ID NO: 91312

SEQ ID NO: 242877 - RNA, 64 nt, Homo Sapiens; identical to SEQ ID NO: 91313

SEQ ID NO: 242878 - RNA, 64 nt, Homo Sapiens; identical to SEQ ID NO: 91314

SEQ ID NO: 242879 - RNA, 64 nt, Homo Sapiens; identical to SEQ ID NO: 91315

SEQ ID NO: 242880 - RNA, 64 nt, Homo Sapiens; identical to SEQ ID NO: 91316

SEQ ID NO: 242881 - RNA, 64 nt, Homo Sapiens; identical to SEQ ID NO: 91317

SEQ ID NO: 242882 - RNA, 64 nt, Homo Sapiens; identical to SEQ ID NO: 91318

SEQ ID NO: 242883 - RNA, 64 nt, Homo Sapiens; identical to SEQ ID NO: 91319

SEQ ID NO: 242884 - RNA, 64 nt, Homo Sapiens; identical to SEQ ID NO: 91320

SEQ ID NO: 242885 - RNA, 64 nt, Homo Sapiens; identical to SEQ ID NO: 91321

SEQ ID NO: 242886 - RNA, 64 nt, Homo Sapiens; identical to SEQ ID NO: 91322

SEQ ID NO: 242887 - RNA, 64 nt, Homo Sapiens; identical to SEQ ID NO: 91323

SEQ ID NO: 242888 - RNA, 64 nt, Homo Sapiens; identical to SEQ ID NO: 91324

SEQ ID NO: 242889 - RNA, 64 nt, Homo Sapiens; identical to SEQ ID NO: 91325

SEQ ID NO: 242890 - RNA, 64 nt, Homo Sapiens; identical to SEQ ID NO: 91326

SEQ ID NO: 242891 - RNA, 64 nt, Homo Sapiens; identical to SEQ ID NO: 91327

SEQ ID NO: 242892 - RNA, 64 nt, Homo Sapiens; identical to SEQ ID NO: 91328

SEQ ID NO: 242893 - RNA, 64 nt, Homo Sapiens; identical to SEQ ID NO: 91329

SEQ ID NO: 242894 - RNA, 64 nt, Homo Sapiens; identical to SEQ ID NO: 91330

SEQ ID NO: 242895 - RNA, 64 nt, Homo Sapiens; identical to SEQ ID NO: 91331

SEQ ID NO: 242896 - RNA, 64 nt, Homo Sapiens; identical to SEQ ID NO: 91332

SEQ ID NO: 242897 - RNA, 64 nt, Homo Sapiens; identical to SEQ ID NO: 91333

SEQ ID NO: 242898 - RNA, 64 nt, Homo Sapiens; identical to SEQ ID NO: 91334

SEQ ID NO: 242899 - RNA, 64 nt, Homo Sapiens; identical to SEQ ID NO: 91335

SEQ ID NO: 242900 - RNA, 64 nt, Homo Sapiens; identical to SEQ ID NO: 91336

SEQ ID NO: 242901 - RNA, 64 nt, Homo Sapiens; identical to SEQ ID NO: 91337

SEQ ID NO: 242902 - RNA, 64 nt, Homo Sapiens; identical to SEQ ID NO: 91338

SEQ ID NO: 242903 - RNA, 64 nt, Homo Sapiens; identical to SEQ ID NO: 91339

SEQ ID NO: 242904 - RNA, 64 nt, Homo Sapiens; identical to SEQ ID NO: 91340

SEQ ID NO: 242905 - RNA, 64 nt, Homo Sapiens; identical to SEQ ID NO: 91341

SEQ ID NO: 242906 - RNA, 64 nt, Homo Sapiens; identical to SEQ ID NO: 91342

SEQ ID NO: 242907 - RNA, 64 nt, Homo Sapiens; identical to SEQ ID NO: 91343

SEQ ID NO: 242908 - RNA, 64 nt, Homo Sapiens; identical to SEQ ID NO: 91344

SEQ ID NO: 242909 - RNA, 64 nt, Homo Sapiens; identical to SEQ ID NO: 91345

SEQ ID NO: 242910 - RNA, 64 nt, Homo Sapiens; identical to SEQ ID NO: 91346

SEQ ID NO: 242911 - RNA, 64 nt, Homo Sapiens; identical to SEQ ID NO: 91347

SEQ ID NO: 242912 - RNA, 64 nt, Homo Sapiens; identical to SEQ ID NO: 91348

SEQ ID NO: 242913 - RNA, 64 nt, Homo Sapiens; identical to SEQ ID NO: 91349

SEQ ID NO: 242914 - RNA, 64 nt, Homo Sapiens; identical to SEQ ID NO: 91350

SEQ ID NO: 242915 - RNA, 64 nt, Homo Sapiens; identical to SEQ ID NO: 91351

SEQ ID NO: 242916 - RNA, 64 nt, Homo Sapiens; identical to SEQ ID NO: 91352

SEQ ID NO: 242917 - RNA, 64 nt, Homo Sapiens; identical to SEQ ID NO: 91353

SEQ ID NO: 242918 - RNA, 54 nt, Homo Sapiens; identical to SEQ ID NO: 91354

SEQ ID NO: 242919 - RNA, 64 nt, Homo Sapiens; identical to SEQ ID NO: 91355

SEQ ID NO: 242920 - RNA, 64 nt, Homo Sapiens; identical to SEQ ID NO: 91356

SEQ ID NO: 242921 - RNA, 64 nt, Homo Sapiens; identical to SEQ ID NO: 91357

SEQ ID NO: 242922 - RNA, 64 nt, Homo Sapiens; identical to SEQ ID NO: 91358

SEQ ID NO: 242923 - RNA, 64 nt, Homo Sapiens; identical to SEQ ID NO: 91359

SEQ ID NO: 242924 - RNA, 64 nt, Homo Sapiens; identical to SEQ ID NO: 91360

SEQ ID NO: 242925 - RNA, 64 nt, Homo Sapiens; identical to SEQ ID NO: 91361

SEQ ID NO: 242926 - RNA, 64 nt, Homo Sapiens; identical to SEQ ID NO: 91362

SEQ ID NO: 242927 - RNA, 64 nt, Homo Sapiens; identical to SEQ ID NO: 91363

SEQ ID NO: 242928 - RNA, 64 nt, Homo Sapiens; identical to SEQ ID NO: 91364

SEQ ID NO: 242929 - RNA, 64 nt, Homo Sapiens; identical to SEQ ID NO: 91365

SEQ ID NO: 242930 - RNA, 64 nt, Homo Sapiens; identical to SEQ ID NO: 91366

SEQ ID NO: 242931 - RNA, 64 nt, Homo Sapiens; identical to SEQ ID NO: 91367

SEQ ID NO: 242932 - RNA, 64 nt, Homo Sapiens; identical to SEQ ID NO: 91368

SEQ ID NO: 242933 - RNA, 64 nt, Homo Sapiens; identical to SEQ ID NO: 91369

SEQ ID NO: 242934 - RNA, 64 nt, Homo Sapiens; identical to SEQ ID NO: 91370

SEQ ID NO: 242935 - RNA, 64 nt, Homo Sapiens; identical to SEQ ID NO: 91371

SEQ ID NO: 242936 - RNA, 64 nt, Homo Sapiens; identical to SEQ ID NO: 91372

SEQ ID NO: 242937 - RNA, 64 nt, Homo Sapiens; identical to SEQ ID NO: 91373

SEQ ID NO: 242938 - RNA, 64 nt, Homo Sapiens; identical to SEQ ID NO: 91374

SEQ ID NO: 242939 - RNA, 64 nt, Homo Sapiens; identical to SEQ ID NO: 91375

SEQ ID NO: 242940 - RNA, 64 nt, Homo Sapiens; identical to SEQ ID NO: 91376

SEQ ID NO: 242941 - RNA, 64 nt, Homo Sapiens; identical to SEQ ID NO: 91377

SEQ ID NO: 242942 - RNA, 64 nt, Homo Sapiens; identical to SEQ ID NO: 91378

SEQ ID NO: 242943 - RNA, 64 nt, Homo Sapiens; identical to SEQ ID NO: 91379

SEQ ID NO: 242944 - RNA, 64 nt, Homo Sapiens; identical to SEQ ID NO: 91380

SEQ ID NO: 242945 - RNA, 64 nt, Homo Sapiens
gagggcccugggcugggugcggcacagccccaggcuggcaaaggggggccgaccccuuucccca

SEQ ID NO: 242946 - RNA, 64 nt, Homo Sapiens
guccuggcucgggucagaagcucugcggugccuccuggcaaaggauccacaugcguguugugug

SEQ ID NO: 242947 - RNA, 64 nt, Homo Sapiens
gaauagcugggacuacaggcacaugccaccaggacuggcaaacuguuuuauuuuuagguagagg

SEQ ID NO: 242948 - RNA, 64 nt, Homo Sapiens
uauaaccuaagaaauaccaauguggacauagggccuggcaaagauuucaugaagaagacacuaa

SEQ ID NO: 242949 - RNA, 64 nt, Homo Sapiens
ucuagggaaacuuggccagaggaaguuaauuuggcuggcaaaauuaaucaaauaguuaacauca

SEQ ID NO: 242950 - RNA, 64 nt, Homo Sapiens
aaggucaugagaugaguuccaacguguggcacugcuggcaaaugaguuuuguggugcuguaggu

SEQ ID NO: 242951 - RNA, 64 nt, Homo Sapiens
agcaaagaaggccagcaacauuggcacaugccaccuggcaaaggacccuugaguaagugaaggu

SEQ ID NO: 242952 - RNA, 64 nt, Homo Sapiens
ccuucccauuucuucccacuuucaucuaccuuuucuggcaaaaaggagccuuuugcucucugug

SEQ ID NO: 242953 - RNA, 64 nt, Homo Sapiens
acuguugguccaauuuucacacacgugagaaucccuggcaaagggagcagaacugaaccggcuu

SEQ ID NO: 242954 - RNA, 64 nt, Homo Sapiens
ggccccaguggcuguucuggaagaaacagaucuccuggcaaaggccccagcaucucccucacug

SEQ ID NO: 242955 - RNA, 64 nt, Homo Sapiens
acaguuguacagguuguacacugcaggagagugccuggcaaaaagaucaaauggggcugggacu

SEQ ID NO: 242956 - RNA, 64 nt, Homo Sapiens
gaguagcugggaccauaggcucacaacaccacaccuggcaaauuugauuuuuuuuuuuuuucca

SEQ ID NO: 242957 - RNA, 64 nt, Homo Sapiens; identical to SEQ ID NO: 178992

SEQ ID NO: 242958 - RNA, 64 nt, Homo Sapiens; identical to SEQ ID NO: 178993

SEQ ID NO: 242959 - RNA, 64 nt, Homo Sapiens; identical to SEQ ID NO: 178994

SEQ ID NO: 242960 - RNA, 64 nt, Homo Sapiens; identical to SEQ ID NO: 178995

SEQ ID NO: 242961 - RNA, 64 nt, Homo Sapiens; identical to SEQ ID NO: 178996

SEQ ID NO: 242962 - RNA, 64 nt, Homo Sapiens; identical to SEQ ID NO: 178997

SEQ ID NO: 242963 - RNA, 64 nt, Homo Sapiens; identical to SEQ ID NO: 178998

SEQ ID NO: 242964 - RNA, 64 nt, Homo Sapiens; identical to SEQ ID NO: 178999

SEQ ID NO: 242965 - RNA, 64 nt, Homo Sapiens; identical to SEQ ID NO: 179000

SEQ ID NO: 242966 - RNA, 64 nt, Homo Sapiens; identical to SEQ ID NO: 179001

SEQ ID NO: 242967 - RNA, 64 nt, Homo Sapiens; identical to SEQ ID NO: 179002

SEQ ID NO: 242968 - RNA, 64 nt, Homo Sapiens; identical to SEQ ID NO: 179003

SEQ ID NO: 242969 - RNA, 64 nt, Homo Sapiens; identical to SEQ ID NO: 179004

SEQ ID NO: 242970 - RNA, 64 nt, Homo Sapiens; identical to SEQ ID NO: 179005

SEQ ID NO: 242971 - RNA, 64 nt, Homo Sapiens; identical to SEQ ID NO: 179006

SEQ ID NO: 242972 - RNA, 64 nt, Homo Sapiens; identical to SEQ ID NO: 179007

SEQ ID NO: 242973 - RNA, 64 nt, Homo Sapiens; identical to SEQ ID NO: 179008

SEQ ID NO: 242974 - RNA, 64 nt, Homo Sapiens
acuuugaaccacaaauaaguacucuuguaagaaaaacacugaaucucauaguaaauacaagcau

SEQ ID NO: 242975 - RNA, 64 nt, Homo Sapiens
aauagaguaaaauaucugcuaauggaauaguauaaacacugaucauuaaacauuggcaaaagga

SEQ ID NO: 242976 - RNA, 64 nt, Homo Sapiens
aaauuaauuuuaauuguguaucaagugaaaaagaaacacugagguuuuaagcugcuguauauag

SEQ ID NO: 242977 - RNA, 64 nt, Homo Sapiens
uuugaaacaccccguguuguccaguauaccuuauaacacugagccacuucuccccacccuccag

SEQ ID NO: 242978 - RNA, 64 nt, Homo Sapiens
acuuuguagugaugacuaccucuuauagguaaccaacacugaaagaucuucugucuaguacuug

SEQ ID NO: 242979 - RNA, 64 nt, Homo Sapiens
cacucuuuucuuaacacgugucacuuugcaguggaacacugagucacaaauaaaucauuugguu

SEQ ID NO: 242980 - RNA, 64 nt, Homo Sapiens
ucccuuaacaagaguuuuauaccaauuauuagucaacacugauaaaaggcuuuuuuagggcuuu

SEQ ID NO: 242981 - RNA, 64 nt, Homo Sapiens
gcuauuguuguacaugagaaauucagcauuaaagaacacugaagcgguaaggucacuguggaag

SEQ ID NO: 242982 - RNA, 64 nt, Homo Sapiens
auguuccagcguuuucuacucugaauaguucuaaaacacugagcauuuucucauuuguugcauu

SEQ ID NO: 242983 - RNA, 64 nt, Homo Sapiens
guguuauaaaucagaauuuuacgacaguuugcagaacacugauuugaaagcuuccuaugcaaaa

SEQ ID NO: 242984 - RNA, 64 nt, Homo Sapiens
uaauuagcaacaagguggcaauuauuuucagaaaaacacugacugugucauuuaaaaagaaaua

SEQ ID NO: 242985 - RNA, 64 nt, Homo Sapiens
gugcauucggcugcaaauaacagaaaacccagcaaacacugaagggcuggauaagaacccugag

SEQ ID NO: 242986 - RNA, 64 nt, Homo Sapiens; identical to SEQ ID NO: 108616

SEQ ID NO: 242987 - RNA, 64 nt, Homo Sapiens; identical to SEQ ID NO: 108617

SEQ ID NO: 242988 - RNA, 64 nt, Homo Sapiens; identical to SEQ ID NO: 108618

SEQ ID NO: 242989 - RNA, 64 nt, Homo Sapiens; identical to SEQ ID NO: 108619

SEQ ID NO: 242990 - RNA, 64 nt, Homo Sapiens; identical to SEQ ID NO: 108620

SEQ ID NO: 242991 - RNA, 64 nt, Homo Sapiens; identical to SEQ ID NO: 108621

SEQ ID NO: 242992 - RNA, 64 nt, Homo Sapiens; identical to SEQ ID NO: 108622

SEQ ID NO: 242993 - RNA, 64 nt, Homo Sapiens; identical to SEQ ID NO: 108623

SEQ ID NO: 242994 - RNA, 61 nt, Homo Sapiens; identical to SEQ ID NO: 108624

SEQ ID NO: 242995 - RNA, 64 nt, Homo Sapiens; identical to SEQ ID NO: 108625

SEQ ID NO: 242996 - RNA, 64 nt, Homo Sapiens; identical to SEQ ID NO: 108626

SEQ ID NO: 242997 - RNA, 64 nt, Homo Sapiens; identical to SEQ ID NO: 108627

SEQ ID NO: 242998 - RNA, 64 nt, Homo Sapiens; identical to SEQ ID NO: 108628

SEQ ID NO: 242999 - RNA, 64 nt, Homo Sapiens; identical to SEQ ID NO: 108629

SEQ ID NO: 243000 - RNA, 64 nt, Homo Sapiens; identical to SEQ ID NO: 108630

SEQ ID NO: 243001 - RNA, 64 nt, Homo Sapiens; identical to SEQ ID NO: 108631

SEQ ID NO: 243002 - RNA, 64 nt, Homo Sapiens; identical to SEQ ID NO: 108632

SEQ ID NO: 243003 - RNA, 64 nt, Homo Sapiens; identical to SEQ ID NO: 108633

SEQ ID NO: 243004 - RNA, 64 nt, Homo Sapiens; identical to SEQ ID NO: 108634

SEQ ID NO: 243005 - RNA, 64 nt, Homo Sapiens; identical to SEQ ID NO: 108635

SEQ ID NO: 243006 - RNA, 64 nt, Homo Sapiens; identical to SEQ ID NO: 108636

SEQ ID NO: 243007 - RNA, 64 nt, Homo Sapiens; identical to SEQ ID NO: 108637

SEQ ID NO: 243008 - RNA, 64 nt, Homo Sapiens; identical to SEQ ID NO: 108638

SEQ ID NO: 243009 - RNA, 64 nt, Homo Sapiens; identical to SEQ ID NO: 108639

SEQ ID NO: 243010 - RNA, 64 nt, Homo Sapiens; identical to SEQ ID NO: 108640

SEQ ID NO: 243011 - RNA, 64 nt, Homo Sapiens; identical to SEQ ID NO: 108641

SEQ ID NO: 243012 - RNA, 64 nt, Homo Sapiens; identical to SEQ ID NO: 108642

SEQ ID NO: 243013 - RNA, 64 nt, Homo Sapiens; identical to SEQ ID NO: 108643

SEQ ID NO: 243014 - RNA, 64 nt, Homo Sapiens; identical to SEQ ID NO: 108644

SEQ ID NO: 243015 - RNA, 64 nt, Homo Sapiens; identical to SEQ ID NO: 108645

SEQ ID NO: 243016 - RNA, 64 nt, Homo Sapiens; identical to SEQ ID NO: 108646

SEQ ID NO: 243017 - RNA, 64 nt, Homo Sapiens; identical to SEQ ID NO: 108647

SEQ ID NO: 243018 - RNA, 64 nt, Homo Sapiens; identical to SEQ ID NO: 108648

SEQ ID NO: 243019 - RNA, 64 nt, Homo Sapiens; identical to SEQ ID NO: 108649

SEQ ID NO: 243020 - RNA, 64 nt, Homo Sapiens; identical to SEQ ID NO: 108650

SEQ ID NO: 243021 - RNA, 64 nt, Homo Sapiens; identical to SEQ ID NO: 108651

SEQ ID NO: 243022 - RNA, 64 nt, Homo Sapiens; identical to SEQ ID NO: 108652

SEQ ID NO: 243023 - RNA, 64 nt, Homo Sapiens; identical to SEQ ID NO: 108653

SEQ ID NO: 243024 - RNA, 64 nt, Homo Sapiens; identical to SEQ ID NO: 108654

SEQ ID NO: 243025 - RNA, 64 nt, Homo Sapiens; identical to SEQ ID NO: 108655

SEQ ID NO: 243026 - RNA, 64 nt, Homo Sapiens; identical to SEQ ID NO: 108656

SEQ ID NO: 243027 - RNA, 64 nt, Homo Sapiens; identical to SEQ ID NO: 108657

SEQ ID NO: 243028 - RNA, 64 nt, Homo Sapiens; identical to SEQ ID NO: 108658

SEQ ID NO: 243029 - RNA, 64 nt, Homo Sapiens; identical to SEQ ID NO: 108659

SEQ ID NO: 243030 - RNA, 64 nt, Homo Sapiens; identical to SEQ ID NO: 108660

SEQ ID NO: 243031 - RNA, 64 nt, Homo Sapiens; identical to SEQ ID NO: 108661

SEQ ID NO: 243032 - RNA, 64 nt, Homo Sapiens; identical to SEQ ID NO: 108662

SEQ ID NO: 243033 - RNA, 64 nt, Homo Sapiens; identical to SEQ ID NO: 108663

SEQ ID NO: 243034 - RNA, 64 nt, Homo Sapiens; identical to SEQ ID NO: 108664

SEQ ID NO: 243035 - RNA, 64 nt, Homo Sapiens; identical to SEQ ID NO: 108665

SEQ ID NO: 243036 - RNA, 64 nt, Homo Sapiens; identical to SEQ ID NO: 108666

SEQ ID NO: 243037 - RNA, 64 nt, Homo Sapiens; identical to SEQ ID NO: 108667

SEQ ID NO: 243038 - RNA, 64 nt, Homo Sapiens; identical to SEQ ID NO: 108668

SEQ ID NO: 243039 - RNA, 64 nt, Homo Sapiens; identical to SEQ ID NO: 108669

SEQ ID NO: 243040 - RNA, 64 nt, Homo Sapiens; identical to SEQ ID NO: 108670

SEQ ID NO: 243041 - RNA, 64 nt, Homo Sapiens; identical to SEQ ID NO: 108671

SEQ ID NO: 243042 - RNA, 64 nt, Homo Sapiens; identical to SEQ ID NO: 108672

SEQ ID NO: 243043 - RNA, 64 nt, Homo Sapiens; identical to SEQ ID NO: 108673

SEQ ID NO: 243044 - RNA, 64 nt, Homo Sapiens; identical to SEQ ID NO: 108674

SEQ ID NO: 243045 - RNA, 64 nt, Homo Sapiens; identical to SEQ ID NO: 108675

SEQ ID NO: 243046 - RNA, 64 nt, Homo Sapiens; identical to SEQ ID NO: 108676

SEQ ID NO: 243047 - RNA, 64 nt, Homo Sapiens; identical to SEQ ID NO: 108677

SEQ ID NO: 243048 - RNA, 64 nt, Homo Sapiens; identical to SEQ ID NO: 108678

SEQ ID NO: 243049 - RNA, 64 nt, Homo Sapiens; identical to SEQ ID NO: 108679

SEQ ID NO: 243050 - RNA, 64 nt, Homo Sapiens; identical to SEQ ID NO: 108680

SEQ ID NO: 243051 - RNA, 64 nt, Homo Sapiens; identical to SEQ ID NO: 108681

SEQ ID NO: 243052 - RNA, 64 nt, Homo Sapiens; identical to SEQ ID NO: 108682

SEQ ID NO: 243053 - RNA, 64 nt, Homo Sapiens; identical to SEQ ID NO: 108683

SEQ ID NO: 243054 - RNA, 64 nt, Homo Sapiens; identical to SEQ ID NO: 108684

SEQ ID NO: 243055 - RNA, 64 nt, Homo Sapiens; identical to SEQ ID NO: 108685

SEQ ID NO: 243056 - RNA, 64 nt, Homo Sapiens; identical to SEQ ID NO: 108686

SEQ ID NO: 243057 - RNA, 64 nt, Homo Sapiens; identical to SEQ ID NO: 108687

SEQ ID NO: 243058 - RNA, 64 nt, Homo Sapiens; identical to SEQ ID NO: 108688

SEQ ID NO: 243059 - RNA, 64 nt, Homo Sapiens; identical to SEQ ID NO: 108689

SEQ ID NO: 243060 - RNA, 64 nt, Homo Sapiens; identical to SEQ ID NO: 108690

SEQ ID NO: 243061 - RNA, 64 nt, Homo Sapiens; identical to SEQ ID NO: 108691

SEQ ID NO: 243062 - RNA, 64 nt, Homo Sapiens; identical to SEQ ID NO: 108692

SEQ ID NO: 243063 - RNA, 64 nt, Homo Sapiens; identical to SEQ ID NO: 108693

SEQ ID NO: 243064 - RNA, 64 nt, Homo Sapiens; identical to SEQ ID NO: 108694

SEQ ID NO: 243065 - RNA, 64 nt, Homo Sapiens; identical to SEQ ID NO: 108695

SEQ ID NO: 243066 - RNA, 64 nt, Homo Sapiens; identical to SEQ ID NO: 108696

SEQ ID NO: 243067 - RNA, 64 nt, Homo Sapiens; identical to SEQ ID NO: 108697

SEQ ID NO: 243068 - RNA, 64 nt, Homo Sapiens; identical to SEQ ID NO: 108698

SEQ ID NO: 243069 - RNA, 64 nt, Homo Sapiens; identical to SEQ ID NO: 108699

SEQ ID NO: 243070 - RNA, 64 nt, Homo Sapiens; identical to SEQ ID NO: 108700

SEQ ID NO: 243071 - RNA, 64 nt, Homo Sapiens; identical to SEQ ID NO: 108701

SEQ ID NO: 243072 - RNA, 64 nt, Homo Sapiens; identical to SEQ ID NO: 108702

SEQ ID NO: 243073 - RNA, 64 nt, Homo Sapiens; identical to SEQ ID NO: 108703

SEQ ID NO: 243074 - RNA, 64 nt, Homo Sapiens; identical to SEQ ID NO: 108704

SEQ ID NO: 243075 - RNA, 64 nt, Homo Sapiens; identical to SEQ ID NO: 108705

SEQ ID NO: 243076 - RNA, 64 nt, Homo Sapiens; identical to SEQ ID NO: 108706

SEQ ID NO: 243077 - RNA, 64 nt, Homo Sapiens; identical to SEQ ID NO: 108707

SEQ ID NO: 243078 - RNA, 64 nt, Homo Sapiens; identical to SEQ ID NO: 108708

SEQ ID NO: 243079 - RNA, 64 nt, Homo Sapiens; identical to SEQ ID NO: 108709

SEQ ID NO: 243080 - RNA, 64 nt, Homo Sapiens; identical to SEQ ID NO: 108710

SEQ ID NO: 243081 - RNA, 64 nt, Homo Sapiens; identical to SEQ ID NO: 108711

SEQ ID NO: 243082 - RNA, 64 nt, Homo Sapiens; identical to SEQ ID NO: 108712

SEQ ID NO: 243083 - RNA, 64 nt, Homo Sapiens; identical to SEQ ID NO: 108713

SEQ ID NO: 243084 - RNA, 64 nt, Homo Sapiens; identical to SEQ ID NO: 108714

SEQ ID NO: 243085 - RNA, 64 nt, Homo Sapiens; identical to SEQ ID NO: 108715

SEQ ID NO: 243086 - RNA, 64 nt, Homo Sapiens; identical to SEQ ID NO: 108716

SEQ ID NO: 243087 - RNA, 64 nt, Homo Sapiens; identical to SEQ ID NO: 108717

SEQ ID NO: 243088 - RNA, 64 nt, Homo Sapiens; identical to SEQ ID NO: 108718

SEQ ID NO: 243089 - RNA, 64 nt, Homo Sapiens; identical to SEQ ID NO: 108719

SEQ ID NO: 243090 - RNA, 64 nt, Homo Sapiens; identical to SEQ ID NO: 108720

SEQ ID NO: 243091 - RNA, 64 nt, Homo Sapiens; identical to SEQ ID NO: 108721

SEQ ID NO: 243092 - RNA, 64 nt, Homo Sapiens; identical to SEQ ID NO: 108722

SEQ ID NO: 243093 - RNA, 64 nt, Homo Sapiens; identical to SEQ ID NO: 108723

SEQ ID NO: 243094 - RNA, 64 nt, Homo Sapiens; identical to SEQ ID NO: 108724

SEQ ID NO: 243095 - RNA, 64 nt, Homo Sapiens; identical to SEQ ID NO: 108725

SEQ ID NO: 243096 - RNA, 64 nt, Homo Sapiens; identical to SEQ ID NO: 108726

SEQ ID NO: 243097 - RNA, 64 nt, Homo Sapiens; identical to SEQ ID NO: 108727

SEQ ID NO: 243098 - RNA, 64 nt, Homo Sapiens; identical to SEQ ID NO: 108728

SEQ ID NO: 243099 - RNA, 64 nt, Homo Sapiens; identical to SEQ ID NO: 108729

SEQ ID NO: 243100 - RNA, 64 nt, Homo Sapiens; identical to SEQ ID NO: 108730

SEQ ID NO: 243101 - RNA, 64 nt, Homo Sapiens; identical to SEQ ID NO: 108731

SEQ ID NO: 243102 - RNA, 64 nt, Homo Sapiens; identical to SEQ ID NO: 108732

SEQ ID NO: 243103 - RNA, 64 nt, Homo Sapiens; identical to SEQ ID NO: 108733

SEQ ID NO: 243104 - RNA, 64 nt, Homo Sapiens; identical to SEQ ID NO: 108734

SEQ ID NO: 243105 - RNA, 64 nt, Homo Sapiens; identical to SEQ ID NO: 108735

SEQ ID NO: 243106 - RNA, 64 nt, Homo Sapiens; identical to SEQ ID NO: 108736

SEQ ID NO: 243107 - RNA, 64 nt, Homo Sapiens; identical to SEQ ID NO: 108737

SEQ ID NO: 243108 - RNA, 64 nt, Homo Sapiens; identical to SEQ ID NO: 108738

SEQ ID NO: 243109 - RNA, 64 nt, Homo Sapiens; identical to SEQ ID NO: 108739

SEQ ID NO: 243110 - RNA, 64 nt, Homo Sapiens; identical to SEQ ID NO: 108740

SEQ ID NO: 243111 - RNA, 64 nt, Homo Sapiens; identical to SEQ ID NO: 108741

SEQ ID NO: 243112 - RNA, 64 nt, Homo Sapiens; identical to SEQ ID NO: 108742

SEQ ID NO: 243113 - RNA, 64 nt, Homo Sapiens; identical to SEQ ID NO: 108743

SEQ ID NO: 243114 - RNA, 64 nt, Homo Sapiens; identical to SEQ ID NO: 108744

SEQ ID NO: 243115 - RNA, 64 nt, Homo Sapiens; identical to SEQ ID NO: 108745

SEQ ID NO: 243116 - RNA, 64 nt, Homo Sapiens; identical to SEQ ID NO: 108746

SEQ ID NO: 243117 - RNA, 64 nt, Homo Sapiens; identical to SEQ ID NO: 108747

SEQ ID NO: 243118 - RNA, 64 nt, Homo Sapiens; identical to SEQ ID NO: 108748

SEQ ID NO: 243119 - RNA, 64 nt, Homo Sapiens; identical to SEQ ID NO: 108749

SEQ ID NO: 243120 - RNA, 64 nt, Homo Sapiens; identical to SEQ ID NO: 108750

SEQ ID NO: 243121 - RNA, 64 nt, Homo Sapiens; identical to SEQ ID NO: 108751

SEQ ID NO: 243122 - RNA, 64 nt, Homo Sapiens; identical to SEQ ID NO: 108752

SEQ ID NO: 243123 - RNA, 64 nt, Homo Sapiens; identical to SEQ ID NO: 108753

SEQ ID NO: 243124 - RNA, 64 nt, Homo Sapiens; identical to SEQ ID NO: 108754

SEQ ID NO: 243125 - RNA, 64 nt, Homo Sapiens; identical to SEQ ID NO: 108755

SEQ ID NO: 243126 - RNA, 64 nt, Homo Sapiens; identical to SEQ ID NO: 108756

SEQ ID NO: 243127 - RNA, 64 nt, Homo Sapiens; identical to SEQ ID NO: 108757

SEQ ID NO: 243128 - RNA, 64 nt, Homo Sapiens; identical to SEQ ID NO: 108758

SEQ ID NO: 243129 - RNA, 64 nt, Homo Sapiens; identical to SEQ ID NO: 108759

SEQ ID NO: 243130 - RNA, 64 nt, Homo Sapiens; identical to SEQ ID NO: 108760

SEQ ID NO: 243131 - RNA, 64 nt, Homo Sapiens; identical to SEQ ID NO: 108761

SEQ ID NO: 243132 - RNA, 64 nt, Homo Sapiens; identical to SEQ ID NO: 108762

SEQ ID NO: 243133 - RNA, 64 nt, Homo Sapiens; identical to SEQ ID NO: 108763

SEQ ID NO: 243134 - RNA, 64 nt, Homo Sapiens; identical to SEQ ID NO: 108764

SEQ ID NO: 243135 - RNA, 64 nt, Homo Sapiens; identical to SEQ ID NO: 108765

SEQ ID NO: 243136 - RNA, 64 nt, Homo Sapiens
agacaccugugacauccucccucuuauuagcuccccgcuccacacuaccaccaaucccgaucgg

SEQ ID NO: 243137 - RNA, 64 nt, Homo Sapiens
agacaccugugaucuggaaacucuuauuagcuccccgcuccacaccaccaccaaucccgaucgg

SEQ ID NO: 243138 - RNA, 64 nt, Homo Sapiens
agacaccugugcuuuggaaacucuuauuagcuccccgcuccacaccacgaccaaucccgaucgg

SEQ ID NO: 243139 - RNA, 64 nt, Homo Sapiens
cuaaugcuccacucggcgccccacuccaucggccccgcuccaucggcacuaaugccccacucgg

SEQ ID NO: 243140 - RNA, 64 nt, Homo Sapiens
gucacuaacguccggcuccaucggcacuaccaccccgcuccaucaucacuauguccagcuccgu

SEQ ID NO: 243141 - RNA, 64 nt, Homo Sapiens
ggcacuggugccccauuccaucggcacuaacgccccgcuccaccggcaccagugccucgcucca

SEQ ID NO: 243142 - RNA, 64 nt, Homo Sapiens; identical to SEQ ID NO: 161048

SEQ ID NO: 243143 - RNA, 64 nt, Homo Sapiens; identical to SEQ ID NO: 161049

SEQ ID NO: 243144 - RNA, 64 nt, Homo Sapiens; identical to SEQ ID NO: 161050

SEQ ID NO: 243145 - RNA, 64 nt, Homo Sapiens; identical to SEQ ID NO: 161051

SEQ ID NO: 243146 - RNA, 64 nt, Homo Sapiens; identical to SEQ ID NO: 161052

SEQ ID NO: 243147 - RNA, 64 nt, Homo Sapiens; identical to SEQ ID NO: 161053

SEQ ID NO: 243148 - RNA, 64 nt, Homo Sapiens; identical to SEQ ID NO: 161054

SEQ ID NO: 243149 - RNA, 64 nt, Homo Sapiens; identical to SEQ ID NO: 161055

SEQ ID NO: 243150 - RNA, 64 nt, Homo Sapiens; identical to SEQ ID NO: 161056

SEQ ID NO: 243151 - RNA, 64 nt, Homo Sapiens; identical to SEQ ID NO: 161057

SEQ ID NO: 243152 - RNA, 64 nt, Homo Sapiens; identical to SEQ ID NO: 161058

SEQ ID NO: 243153 - RNA, 64 nt, Homo Sapiens; identical to SEQ ID NO: 161059

SEQ ID NO: 243154 - RNA, 64 nt, Homo Sapiens; identical to SEQ ID NO: 161060

SEQ ID NO: 243155 - RNA, 64 nt, Homo Sapiens; identical to SEQ ID NO: 161061

SEQ ID NO: 243156 - RNA, 64 nt, Homo Sapiens; identical to SEQ ID NO: 161062

SEQ ID NO: 243157 - RNA, 64 nt, Homo Sapiens; identical to SEQ ID NO: 161063

SEQ ID NO: 243158 - RNA, 64 nt, Homo Sapiens; identical to SEQ ID NO: 161064

SEQ ID NO: 243159 - RNA, 64 nt, Homo Sapiens; identical to SEQ ID NO: 161065

SEQ ID NO: 243160 - RNA, 64 nt, Homo Sapiens; identical to SEQ ID NO: 161066

SEQ ID NO: 243161 - RNA, 64 nt, Homo Sapiens; identical to SEQ ID NO: 161067

SEQ ID NO: 243162 - RNA, 64 nt, Homo Sapiens; identical to SEQ ID NO: 161068

SEQ ID NO: 243163 - RNA, 64 nt, Homo Sapiens; identical to SEQ ID NO: 161069

SEQ ID NO: 243164 - RNA, 64 nt, Homo Sapiens; identical to SEQ ID NO: 161070

SEQ ID NO: 243165 - RNA, 64 nt, Homo Sapiens; identical to SEQ ID NO: 161071

SEQ ID NO: 243166 - RNA, 64 nt, Homo Sapiens; identical to SEQ ID NO: 161072

SEQ ID NO: 243167 - RNA, 64 nt, Homo Sapiens; identical to SEQ ID NO: 161073

SEQ ID NO: 243168 - RNA, 64 nt, Homo Sapiens; identical to SEQ ID NO: 161074

SEQ ID NO: 243169 - RNA, 64 nt, Homo Sapiens; identical to SEQ ID NO: 161075

SEQ ID NO: 243170 - RNA, 64 nt, Homo Sapiens; identical to SEQ ID NO: 161076

SEQ ID NO: 243171 - RNA, 62 nt, Homo Sapiens; identical to SEQ ID NO: 161077

SEQ ID NO: 243172 - RNA, 64 nt, Homo Sapiens; identical to SEQ ID NO: 161078

SEQ ID NO: 243173 - RNA, 64 nt, Homo Sapiens; identical to SEQ ID NO: 161079

SEQ ID NO: 243174 - RNA, 64 nt, Homo Sapiens; identical to SEQ ID NO: 161080

SEQ ID NO: 243175 - RNA, 64 nt, Homo Sapiens; identical to SEQ ID NO: 161081

SEQ ID NO: 243176 - RNA, 64 nt, Homo Sapiens; identical to SEQ ID NO: 161082

SEQ ID NO: 243177 - RNA, 64 nt, Homo Sapiens; identical to SEQ ID NO: 161083

SEQ ID NO: 243178 - RNA, 64 nt, Homo Sapiens; identical to SEQ ID NO: 161084

SEQ ID NO: 243179 - RNA, 64 nt, Homo Sapiens; identical to SEQ ID NO: 161085

SEQ ID NO: 243180 - RNA, 64 nt, Homo Sapiens; identical to SEQ ID NO: 161086

SEQ ID NO: 243181 - RNA, 64 nt, Homo Sapiens; identical to SEQ ID NO: 161087

SEQ ID NO: 243182 - RNA, 64 nt, Homo Sapiens; identical to SEQ ID NO: 161088

SEQ ID NO: 243183 - RNA, 64 nt, Homo Sapiens; identical to SEQ ID NO: 161089

SEQ ID NO: 243184 - RNA, 64 nt, Homo Sapiens; identical to SEQ ID NO: 161090

SEQ ID NO: 243185 - RNA, 64 nt, Homo Sapiens; identical to SEQ ID NO: 161091

SEQ ID NO: 243186 - RNA, 64 nt, Homo Sapiens; identical to SEQ ID NO: 161092

SEQ ID NO: 243187 - RNA, 64 nt, Homo Sapiens; identical to SEQ ID NO: 161093

SEQ ID NO: 243188 - RNA, 64 nt, Homo Sapiens; identical to SEQ ID NO: 161094

SEQ ID NO: 243189 - RNA, 64 nt, Homo Sapiens; identical to SEQ ID NO: 161095

SEQ ID NO: 243190 - RNA, 64 nt, Homo Sapiens; identical to SEQ ID NO: 161096

SEQ ID NO: 243191 - RNA, 63 nt, Homo Sapiens
ucuagucacuucuguuggccugaacaguacuuuuccauaaaguuuuguuuguagauuuaaugu

SEQ ID NO: 243192 - RNA, 63 nt, Homo Sapiens
uuuguuuguagauuuaauguugacauucccucuuccauaaaccaugauaaaaauacauaaauu

SEQ ID NO: 243193 - RNA, 63 nt, Homo Sapiens
guuacacaaaauauaaaccuuucauuucaguuuuccauaaacuuuagucagaaaaaauaauuu

SEQ ID NO: 243194 - RNA, 63 nt, Homo Sapiens
uaucagaagacucacuuuucaacacaaaauuuuuccauaaacuagucucaaaccuugaugaaa

SEQ ID NO: 243195 - RNA, 63 nt, Homo Sapiens
accaauaucacugauucagguuuuaaucuacuuuccauaaauuaugaauaaggauucaggggu

SEQ ID NO: 243196 - RNA, 63 nt, Homo Sapiens
ucaaaguuacauucauuuuaauuuugguacauauccauaaauucuccauaaaaguaggaccaa

SEQ ID NO: 243197 - RNA, 63 nt, Homo Sapiens
uucauuuuaauuuugguacauauccauaaauucuccauaaaaguaggaccaacuuacauuacc

SEQ ID NO: 243198 - RNA, 63 nt, Homo Sapiens
uucauccgugacacaugaguaccuacugaggacuccauaaacagaacgggauacagagauaaa

SEQ ID NO: 243199 - RNA, 63 nt, Homo Sapiens
accacauguucugucugagccucaguuuuccuauccauaaaaugaagguagccaggccugccu

SEQ ID NO: 243200 - RNA, 64 nt, Homo Sapiens; identical to SEQ ID NO: 63016

SEQ ID NO: 243201 - RNA, 64 nt, Homo Sapiens; identical to SEQ ID NO: 63017

SEQ ID NO: 243202 - RNA, 64 nt, Homo Sapiens; identical to SEQ ID NO: 63018

SEQ ID NO: 243203 - RNA, 64 nt, Homo Sapiens; identical to SEQ ID NO: 63019

SEQ ID NO: 243204 - RNA, 64 nt, Homo Sapiens; identical to SEQ ID NO: 63020

SEQ ID NO: 243205 - RNA, 64 nt, Homo Sapiens; identical to SEQ ID NO: 63021

SEQ ID NO: 243206 - RNA, 64 nt, Homo Sapiens; identical to SEQ ID NO: 63022

SEQ ID NO: 243207 - RNA, 64 nt, Homo Sapiens; identical to SEQ ID NO: 63023

SEQ ID NO: 243208 - RNA, 64 nt, Homo Sapiens; identical to SEQ ID NO: 63024

SEQ ID NO: 243209 - RNA, 64 nt, Homo Sapiens; identical to SEQ ID NO: 63025

SEQ ID NO: 243210 - RNA, 56 nt, Homo Sapiens; identical to SEQ ID NO: 63026

SEQ ID NO: 243211 - RNA, 64 nt, Homo Sapiens; identical to SEQ ID NO: 63027

SEQ ID NO: 243212 - RNA, 64 nt, Homo Sapiens; identical to SEQ ID NO: 63028

SEQ ID NO: 243213 - RNA, 64 nt, Homo Sapiens; identical to SEQ ID NO: 63029

SEQ ID NO: 243214 - RNA, 64 nt, Homo Sapiens; identical to SEQ ID NO: 63030

SEQ ID NO: 243215 - RNA, 64 nt, Homo Sapiens; identical to SEQ ID NO: 63031

SEQ ID NO: 243216 - RNA, 64 nt, Homo Sapiens; identical to SEQ ID NO: 63032

SEQ ID NO: 243217 - RNA, 64 nt, Homo Sapiens; identical to SEQ ID NO: 63033

SEQ ID NO: 243218 - RNA, 64 nt, Homo Sapiens; identical to SEQ ID NO: 63034

SEQ ID NO: 243219 - RNA, 64 nt, Homo Sapiens; identical to SEQ ID NO: 63035

SEQ ID NO: 243220 - RNA, 64 nt, Homo Sapiens; identical to SEQ ID NO: 63036

SEQ ID NO: 243221 - RNA, 64 nt, Homo Sapiens; identical to SEQ ID NO: 63037

SEQ ID NO: 243222 - RNA, 64 nt, Homo Sapiens; identical to SEQ ID NO: 63038

SEQ ID NO: 243223 - RNA, 64 nt, Homo Sapiens; identical to SEQ ID NO: 63039

SEQ ID NO: 243224 - RNA, 64 nt, Homo Sapiens; identical to SEQ ID NO: 63040

SEQ ID NO: 243225 - RNA, 64 nt, Homo Sapiens; identical to SEQ ID NO: 63041

SEQ ID NO: 243226 - RNA, 64 nt, Homo Sapiens; identical to SEQ ID NO: 63042

SEQ ID NO: 243227 - RNA, 64 nt, Homo Sapiens; identical to SEQ ID NO: 63043

SEQ ID NO: 243228 - RNA, 64 nt, Homo Sapiens; identical to SEQ ID NO: 63044

SEQ ID NO: 243229 - RNA, 64 nt, Homo Sapiens; identical to SEQ ID NO: 63045

SEQ ID NO: 243230 - RNA, 64 nt, Homo Sapiens; identical to SEQ ID NO: 63046

SEQ ID NO: 243231 - RNA, 64 nt, Homo Sapiens; identical to SEQ ID NO: 63047

SEQ ID NO: 243232 - RNA, 64 nt, Homo Sapiens; identical to SEQ ID NO: 63048

SEQ ID NO: 243233 - RNA, 64 nt, Homo Sapiens; identical to SEQ ID NO: 63049

SEQ ID NO: 243234 - RNA, 64 nt, Homo Sapiens; identical to SEQ ID NO: 63050

SEQ ID NO: 243235 - RNA, 64 nt, Homo Sapiens; identical to SEQ ID NO: 63051

SEQ ID NO: 243236 - RNA, 64 nt, Homo Sapiens; identical to SEQ ID NO: 63052

SEQ ID NO: 243237 - RNA, 64 nt, Homo Sapiens; identical to SEQ ID NO: 63053

SEQ ID NO: 243238 - RNA, 64 nt, Homo Sapiens; identical to SEQ ID NO: 63054

SEQ ID NO: 243239 - RNA, 64 nt, Homo Sapiens; identical to SEQ ID NO: 63055

SEQ ID NO: 243240 - RNA, 64 nt, Homo Sapiens; identical to SEQ ID NO: 63056

SEQ ID NO: 243241 - RNA, 64 nt, Homo Sapiens; identical to SEQ ID NO: 63057

SEQ ID NO: 243242 - RNA, 64 nt, Homo Sapiens; identical to SEQ ID NO: 63058

SEQ ID NO: 243243 - RNA, 64 nt, Homo Sapiens; identical to SEQ ID NO: 63059

SEQ ID NO: 243244 - RNA, 64 nt, Homo Sapiens; identical to SEQ ID NO: 63060

SEQ ID NO: 243245 - RNA, 64 nt, Homo Sapiens; identical to SEQ ID NO: 63061

SEQ ID NO: 243246 - RNA, 64 nt, Homo Sapiens; identical to SEQ ID NO: 63062

SEQ ID NO: 243247 - RNA, 64 nt, Homo Sapiens; identical to SEQ ID NO: 63063

SEQ ID NO: 243248 - RNA, 64 nt, Homo Sapiens; identical to SEQ ID NO: 63064

SEQ ID NO: 243249 - RNA, 64 nt, Homo Sapiens; identical to SEQ ID NO: 63065

SEQ ID NO: 243250 - RNA, 64 nt, Homo Sapiens; identical to SEQ ID NO: 63066

SEQ ID NO: 243251 - RNA, 64 nt, Homo Sapiens; identical to SEQ ID NO: 63067

SEQ ID NO: 243252 - RNA, 64 nt, Homo Sapiens; identical to SEQ ID NO: 63068

SEQ ID NO: 243253 - RNA, 64 nt, Homo Sapiens; identical to SEQ ID NO: 63069

SEQ ID NO: 243254 - RNA, 64 nt, Homo Sapiens; identical to SEQ ID NO: 63070

SEQ ID NO: 243255 - RNA, 64 nt, Homo Sapiens; identical to SEQ ID NO: 63071

SEQ ID NO: 243256 - RNA, 64 nt, Homo Sapiens
guccccacccacagaagcagaccuucagcucaggccccggcauugccaucagcagccucagcgu

SEQ ID NO: 243257 - RNA, 64 nt, Homo Sapiens
gcuggaggacgcagcguccagggccagcgagcucccccggcagcagguccccaagccaugucag

SEQ ID NO: 243258 - RNA, 64 nt, Homo Sapiens
agcuuaucccaggccagaggcugcaugccacuguccccggcagcgccaaccccugcuuggcugu

SEQ ID NO: 243259 - RNA, 64 nt, Homo Sapiens
gcagacccggccucggucagcugggaggggcccgccccggcacaaagcacccaugggaauaaag

SEQ ID NO: 243260 - RNA, 64 nt, Homo Sapiens
ccccgccaggcccaggguggccccggcagcaagaccccggcacucccccaccaggacugggccu

SEQ ID NO: 243261 - RNA, 64 nt, Homo Sapiens
aagaccccggcacuccccgcccaggacugggccuccccggcagcccagcccugagccuccccca

SEQ ID NO: 243262 - RNA, 64 nt, Homo Sapiens
ugagaaaacauuuauaaacaaaagaaacauuuauaaacuaaagaaaaacuaaaagaaugacaga

SEQ ID NO: 243263 - RNA, 64 nt, Homo Sapiens
uuauaaacaaaagaaacauuuauaaacuaaagaaaaacuaaaagaaugacagaacaaucaucuu

SEQ ID NO: 243264 - RNA, 64 nt, Homo Sapiens
aacuaugacuaagaaauuaaagaagaaaaccagcaaacuaaaacuucugggcagcaaaaauaua

SEQ ID NO: 243265 - RNA, 64 nt, Homo Sapiens
aauaguuuuaacuagcuuaguuuucugguuuccaaaacuaaaauagauuaaauccuacaaauuu

SEQ ID NO: 243266 - RNA, 64 nt, Homo Sapiens
agccguuagacacacaggaaaaauccagaaggguaaacuaaacuaaagcuacaauuaauauggg

SEQ ID NO: 243267 - RNA, 64 nt, Homo Sapiens
uuagacacacaggaaaaauccagaaggguaaacuaaacuaaagcuacaauuaauaugggaauuu

SEQ ID NO: 243268 - RNA, 64 nt, Homo Sapiens
uguuguacaacugaccgaaauguuacuuguggagaaacuaaaaauuuuaaaguaaaaauuauga

SEQ ID NO: 243269 - RNA, 64 nt, Homo Sapiens
gacauuaaaauuaagauuuguggaaaaguauuugaaacuaaauuauuggaauauacuaggcagc

SEQ ID NO: 243270 - RNA, 64 nt, Homo Sapiens
caaaguggguugcaaucauuccuaacacaggcugaaacuaaacaaucuugcuccuagaguuuau

SEQ ID NO: 243271 - RNA, 64 nt, Homo Sapiens
aaauaugugaaaguucauuguggucauggugagaaaacuaaaacuacaugaguuucauguuaga

SEQ ID NO: 243272 - RNA, 64 nt, Homo Sapiens
cucuucuugggguccugauaaauacuacauugagaaacuaaaccuuagaaaaugacaaguagag

SEQ ID NO: 243273 - RNA, 64 nt, Homo Sapiens
gaacaugcuauucugucagcauguucagugcugaaaacuaaaauacauuuauguugacccacuu

SEQ ID NO: 243274 - RNA, 64 nt, Homo Sapiens
gugcuuuauauuuagauugguuuuucauugccaaaaacuaaaugaaaaccaauguuuugcaguu

SEQ ID NO: 243275 - RNA, 64 nt, Homo Sapiens
aaaaaaaacuuugccagccaggagcauuuuuuaaaaacuaaaaaauugaacacaaucucauuga

SEQ ID NO: 243276 - RNA, 64 nt, Homo Sapiens
gucuuaauggcugugugacauuaaggaggcgaucaaacuaaaauucuuagagggacugaaaggu

SEQ ID NO: 243277 - RNA, 64 nt, Homo Sapiens
acuaaauuuguuuuauaaugcauuccauaugauaaaacuaaaggucauaccaggacaauagggu

SEQ ID NO: 243278 - RNA, 64 nt, Homo Sapiens
uggaugagcauaaaccuagucuuaguuuaaaggcaaacuaaaguugaggggaaauaauuaauca

SEQ ID NO: 243279 - RNA, 64 nt, Homo Sapiens
ugauguguucauuccaguuauucacuuacagaugaaacuaaaacaaauaaaggcaagcuauuau

SEQ ID NO: 243280 - RNA, 64 nt, Homo Sapiens
uuuaagugcuuauuuuuauaacccaaccccuggaaaacuaaauuuugcaggcaugagccacugc

SEQ ID NO: 243281 - RNA, 64 nt, Homo Sapiens
uuuuuuuucucuugagacggaaacucauacuggaaaacuaaauuauauaauugcgaauaucaga

SEQ ID NO: 243282 - RNA, 64 nt, Homo Sapiens
aaaaauccagugucacauggaaaauauucaaacaaaacuaaaacaauaaguaagaacuauuuuu

SEQ ID NO: 243283 - RNA, 64 nt, Homo Sapiens
gacuccuuucacuaacugcuaaaaugcugguauuaaacuaaaugaguagucuuacuuguuuuuu

SEQ ID NO: 243284 - RNA, 64 nt, Homo Sapiens
aaaccuugcauuaaaauaauaaaucuguaauaaaaaacuaaauuuaugucaauuauaccucaau

SEQ ID NO: 243285 - RNA, 64 nt, Homo Sapiens
cuuucucugcuauuaacuggcuuaugagcuaccaaaacuaaauuacauggcauacgguuacuga

SEQ ID NO: 243286 - RNA, 64 nt, Homo Sapiens
uuggcauacguuaucagcaaggcuuuacugagagaaacuaaauauguuagaauauuuuuaagua

SEQ ID NO: 243287 - RNA, 64 nt, Homo Sapiens
auaguggaaaaauaaaaaaauaaguaaacagaaaaaacuaaaguuguauuuucccacaaauaua

SEQ ID NO: 243288 - RNA, 64 nt, Homo Sapiens
ucuaauaggaaaacaugauacuuucaaugugccaaaacuaaaccuuaguauacaacuaaaaauc

SEQ ID NO: 243289 - RNA, 64 nt, Homo Sapiens
agguacuaugaauguaauucauaauuuaaaaggaaaacuaaaaacuauuuugauuugggaaaau

SEQ ID NO: 243290 - RNA, 64 nt, Homo Sapiens
uuauauucagcuacucuugucauuucucguugaaaaacuaaaaucugacuagguuaguuuacuc

SEQ ID NO: 243291 - RNA, 64 nt, Homo Sapiens
aagaauaauuuuaacagacauguauacuccauagaaacuaaacuaaaauaguuuaaaaauauuc

SEQ ID NO: 243292 - RNA, 64 nt, Homo Sapiens
uaauuuuaacagacauguauacuccauagaaacuaaacuaaaauaguuuaaaaauauucccuuu

SEQ ID NO: 243293 - RNA, 64 nt, Homo Sapiens
guguaucuuguauuuucccuaaaagcagaaggaaaaacuaaaaaggagugauugugguucuugg

SEQ ID NO: 243294 - RNA, 64 nt, Homo Sapiens
gagaaugcuucuuacaggaacauuuuuaaauauaaaacuaaagaauuaucugauccaguccuca

SEQ ID NO: 243295 - RNA, 64 nt, Homo Sapiens
gaacuuauuagaaacgauuccggauggcauuggaaaacuaaagaaacugucaaucuugaaggug

SEQ ID NO: 243296 - RNA, 64 nt, Homo Sapiens
guuauuuuaacagacccugccuaaaagcauuggaaaacuaaagaaguugagcaacuugaaugca

SEQ ID NO: 243297 - RNA, 64 nt, Homo Sapiens
uaguugucacacuaaaauuucuguguaagaaaacaaacuaaaugcauaauggugaauguucaau

SEQ ID NO: 243298 - RNA, 64 nt, Homo Sapiens
cauugucaaaauuaauaugagucuaaaacuucaaaaacuaaaauuggccuuuuuaaguauugca

SEQ ID NO: 243299 - RNA, 64 nt, Homo Sapiens
uuugguaacugaagcaauagaugguguaacuuguaaacuaaauaaguaguuaaugaugauaaca

SEQ ID NO: 243300 - RNA, 64 nt, Homo Sapiens
uguuuuaauauuucugaauuucaugguaaauauaaaacuaaauagaaaaauuggagacuuauaa

SEQ ID NO: 243301 - RNA, 64 nt, Homo Sapiens
uaguaaagaggguuuuuaaacaaacuuauucuugaaacuaaauauauucaaauaagauuauuua

SEQ ID NO: 243302 - RNA, 64 nt, Homo Sapiens
uuuaaacaaaaaugggauaaaaaucaaaaagaaaaaacuaaacaaaaauaaaugauuuaaaauc

SEQ ID NO: 243303 - RNA, 64 nt, Homo Sapiens
uagaaaauaagauauacaagagaaauuucccaugaaacuaaaaauaaaugcaauuuauuauuuc

SEQ ID NO: 243304 - RNA, 64 nt, Homo Sapiens
cuuaaauaaaacagaaaacuuuucuucagaauuaaaacuaaaauaaaacaaggaaauguaccuc

SEQ ID NO: 243305 - RNA, 64 nt, Homo Sapiens
caaggaaauguaccucuuucauaaccugacgcuaaaacuaaaaaaagaaaacagaaaccugguu

SEQ ID NO: 243306 - RNA, 64 nt, Homo Sapiens
auaaaguagauauugguuuaugucuuagauaauaaaacuaaauccuuguuauuucuuuguaaaa

SEQ ID NO: 243307 - RNA, 64 nt, Homo Sapiens
aaauuaaaacugcuuacacccugaagauuggcaaaaacuaaaauaaaaaacacuuuucuaagga

SEQ ID NO: 243308 - RNA, 64 nt, Homo Sapiens
aaauguuauuguggaucccaccugauauuaagggaaacuaaagaggaaucuuuccuaaugacaa

SEQ ID NO: 243309 - RNA, 64 nt, Homo Sapiens
ugcacugcuuugggauuuaauacuaucacugaacaaacuaaaggugauggcucgugggaugucc

SEQ ID NO: 243310 - RNA, 64 nt, Homo Sapiens
caaaaaguaaaaauuaguuccagucaaaauaauaaaacuaaaaauuauugcauauuuucauaau

SEQ ID NO: 243311 - RNA, 64 nt, Homo Sapiens
cccuuguuauuuguaucuucaagcucguauuuguaaacuaaaacgaaucagagaauacuuggcc

SEQ ID NO: 243312 - RNA, 64 nt, Homo Sapiens
uagaaauuuuuuagauucacgagguauuuaccauaaacuaaauuguaccuauuuuagguauuuu

SEQ ID NO: 243313 - RNA, 64 nt, Homo Sapiens
auaaauuuaaaaugugacccuugacaaaaaagaaaaacuaaaaaauuauuucaucaaucauuug

SEQ ID NO: 243314 - RNA, 64 nt, Homo Sapiens
aaaucagcccucgaguuauucaaugauaacugacaaacuaaauuauuucccuagaaaggaagau

SEQ ID NO: 243315 - RNA, 64 nt, Homo Sapiens
aucccuagaugauguaugcuugcaguccuauauaaaacuaaauuugcuaucuguguagaaaaua

SEQ ID NO: 243316 - RNA, 64 nt, Homo Sapiens
uuguucuaugucuuuguuggcugguguauuuuauaaacuaaagcugccuauguuucuuuuuaaa

SEQ ID NO: 243317 - RNA, 64 nt, Homo Sapiens
auauucugucuggguuuuuaaugucuguggaaaaaaacuaaacaagucucugucucaguuaaga

SEQ ID NO: 243318 - RNA, 64 nt, Homo Sapiens
aaaaaaaaaugauagugcaucagauucuuccuguaaacuaaauacuuucugcaaccuguacuua

SEQ ID NO: 243319 - RNA, 64 nt, Homo Sapiens
guugggugaauucuaccaaaaaaaaauggaaaagaaacuaaaauuacugggccaacuugagagg

SEQ ID NO: 243320 - RNA, 64 nt, Homo Sapiens
caauagcaccaagucuucaucaauuaaaaguuccaaacuaaagcaauugccaagaauauguuaa

SEQ ID NO: 243321 - RNA, 64 nt, Homo Sapiens
cucuggaaaauggauuugcucugauucuuccuuaaaacuaaaaucaucucgguggccugccugg

SEQ ID NO: 243322 - RNA, 64 nt, Homo Sapiens
augcaaaacuuuugcuauucgacucaaagggggaaaacuaaagaguuuucucuuucaguuaguu

SEQ ID NO: 243323 - RNA, 64 nt, Homo Sapiens
aaauaaaagugaaccauauuuaucugguuauauaaaacuaaaaauggggguguuuauauaaaac

SEQ ID NO: 243324 - RNA, 64 nt, Homo Sapiens
guuauauaaaacuaaaaauggggguguuuauauaaaacuaaaaacuaagaaugauguaaccuuu

SEQ ID NO: 243325 - RNA, 64 nt, Homo Sapiens
ccucaaaaaugcuaaaagaaagaugacuacuagaaaacuaaaagcaaaacaaaucauuuuaaca

SEQ ID NO: 243326 - RNA, 64 nt, Homo Sapiens
ugguaaaauauuuguauauauagaaaauaaucuaaaacuaaaaucuaaaucagagugcugagua

SEQ ID NO: 243327 - RNA, 64 nt, Homo Sapiens
cugguacauggaggcuauuuuaauccuucuaacuaaacuaaaauagauuaaaggaauuaaacua

SEQ ID NO: 243328 - RNA, 64 nt, Homo Sapiens
ccuucuaacuaaacuaaaauagauuaaaggaauuaaacuaaaauacaaguaaagcuagacaaag

SEQ ID NO: 243329 - RNA, 64 nt, Homo Sapiens
ggcaggggaagugaaaggaauuguuuuuaauagaaaacuaaagguauagaugcuaugguucaga

SEQ ID NO: 243330 - RNA, 64 nt, Homo Sapiens
aauuaauuauucaauuagguucuuccuaggaugaaaacuaaaucggauugaaaugauuuguuuc

SEQ ID NO: 243331 - RNA, 64 nt, Homo Sapiens
ccuagaaaacguuuucccagagcugccuauucagaaacuaaagcccucacugucauuauucuuu

SEQ ID NO: 243332 - RNA, 64 nt, Homo Sapiens
acucuggauguuugguauuuuuuuacauuaaaacaaacuaaagcaaaauuuagaagaaagaacu

SEQ ID NO: 243333 - RNA, 64 nt, Homo Sapiens
acuucuuggcugguccagggacugcagaaaccaaagcugcuauuguugaggaauaauucagugg

SEQ ID NO: 243334 - RNA, 64 nt, Homo Sapiens
guugcccuuuuguccuugcucccuggcuagggaaagcugcuaguggucagccuguuuugccuuu

SEQ ID NO: 243335 - RNA, 64 nt, Homo Sapiens
uacagucaguacacagcugacuuauguagauuuaagcugcuaauaugcuacuuaaccaucuauu

SEQ ID NO: 243336 - RNA, 64 nt, Homo Sapiens
ccucaaagcaaaaaaaaaaaaaaaaaaaccaguuagcugcuauauaaacacuauaccaagcacu

SEQ ID NO: 243337 - RNA, 64 nt, Homo Sapiens
auguccuccuugguggacguuucuguuuacucagagcugcuagagaccauccugcccauccgag

SEQ ID NO: 243338 - RNA, 64 nt, Homo Sapiens
cacaaguggcauuauuuauguugugcugcuguccagcugcuaagaucccuucaucugcacaagc

SEQ ID NO: 243339 - RNA, 64 nt, Homo Sapiens
agcuucacgcagguuuggccuaaugguggccuguagcugcuaagacagaguuaauggcaaccaa

SEQ ID NO: 243340 - RNA, 64 nt, Homo Sapiens
auuguauuucaguggcaaugaauuguggauuuuaagcugcuauuuguuguucgguugugugacu

SEQ ID NO: 243341 - RNA, 64 nt, Homo Sapiens
uguuugugucucugagauugacuucaagauaauaagcugcuaauuguaaacaaaacaguuaccc

SEQ ID NO: 243342 - RNA, 64 nt, Homo Sapiens
ugaauuuuuuccauuugaggaauuuuaugaauaaagcugcuauaagcaugaaauuacaagucuu

SEQ ID NO: 243343 - RNA, 64 nt, Homo Sapiens
gagucgucuggcaucucccacacaagacccaaguagcugcuaccuucuuuggccccuugcugga

SEQ ID NO: 243344 - RNA, 64 nt, Homo Sapiens
aggauuugacucgggccuuagaacuuugcauagcagcugcuacuagcucuuugagauaauacau

SEQ ID NO: 243345 - RNA, 64 nt, Homo Sapiens; identical to SEQ ID NO: 206360

SEQ ID NO: 243346 - RNA, 64 nt, Homo Sapiens; identical to SEQ ID NO: 206361

SEQ ID NO: 243347 - RNA, 64 nt, Homo Sapiens; identical to SEQ ID NO: 206362

SEQ ID NO: 243348 - RNA, 64 nt, Homo Sapiens; identical to SEQ ID NO: 206363

SEQ ID NO: 243349 - RNA, 64 nt, Homo Sapiens; identical to SEQ ID NO: 206364

SEQ ID NO: 243350 - RNA, 64 nt, Homo Sapiens; identical to SEQ ID NO: 206365

SEQ ID NO: 243351 - RNA, 64 nt, Homo Sapiens; identical to SEQ ID NO: 206366

SEQ ID NO: 243352 - RNA, 64 nt, Homo Sapiens; identical to SEQ ID NO: 206367

SEQ ID NO: 243353 - RNA, 64 nt, Homo Sapiens; identical to SEQ ID NO: 206368

SEQ ID NO: 243354 - RNA, 64 nt, Homo Sapiens; identical to SEQ ID NO: 206369

SEQ ID NO: 243355 - RNA, 64 nt, Homo Sapiens; identical to SEQ ID NO: 206370

SEQ ID NO: 243356 - RNA, 64 nt, Homo Sapiens; identical to SEQ ID NO: 206371

SEQ ID NO: 243357 - RNA, 64 nt, Homo Sapiens; identical to SEQ ID NO: 206372

SEQ ID NO: 243358 - RNA, 62 nt, Homo Sapiens
ugugugguuguagcaaggacucagccucauguagcacgaauaggggugugguucauggcgug

SEQ ID NO: 243359 - RNA, 62 nt, Homo Sapiens
aaugucgagagggggugaagccaaggcgaagaagcacgaacggcucgccccuaucgcuccag

SEQ ID NO: 243360 - RNA, 62 nt, Homo Sapiens
ggccccuuauuaccauguauggaaagugguuuagcacgaagaucugaagaacauagugucca

SEQ ID NO: 243361 - RNA, 62 nt, Homo Sapiens
ugcccuuguuggaagccccaggguggacacucagcacgaaggucucucccuuaacugcugcc

SEQ ID NO: 243362 - RNA, 62 nt, Homo Sapiens
ugcuaaugcacugaugagucuaguuucauuauagcacgaagcuaugagaauaacuucaguca

SEQ ID NO: 243363 - RNA, 62 nt, Homo Sapiens
aucucuaacccgggucugcgugccacauuuguagcacgaaggacucuaaauaaacaaggugu

SEQ ID NO: 243364 - RNA, 62 nt, Homo Sapiens
agacuguuucuuggggucagccaccauaccaaagcacgaaccgcugcuaugcacacuggagu

SEQ ID NO: 243365 - RNA, 62 nt, Homo Sapiens
guuauuuuuuaauuauuauuagaugaaggcaaagcacgaaaucuucuugaagccgagccuca

SEQ ID NO: 243366 - RNA, 62 nt, Homo Sapiens
gaagaugggcccaauuucuuaagugaugagagagcacgaaauuccauaaccaguacaggccu

SEQ ID NO: 243367 - RNA, 62 nt, Homo Sapiens
auuuuaaaaaucaguguaccuaggcagugcacagcacgaaauaaguggcccuugcagcuucc

SEQ ID NO: 243368 - RNA, 62 nt, Homo Sapiens
uagaagugaaugacaauaaagucugucagccaagcacgaaccaagacuggcacuauuuuucu

SEQ ID NO: 243369 - RNA, 62 nt, Homo Sapiens
augauuugcuuuuuaugccuguucugaauggcagcacgaagcaggccuguuacuuguauguc

SEQ ID NO: 243370 - RNA, 62 nt, Homo Sapiens
cagaauuguguaugccuugccuaucacgguacagcacgaagccaggcuccuuucuccaccaa

SEQ ID NO: 243371 - RNA, 62 nt, Homo Sapiens
uguuaccaguaggaggaggaagaacaggacauagcacgaaucacgaagcaacaaauauguca

SEQ ID NO: 243372 - RNA, 62 nt, Homo Sapiens
gguaacaguuguuucauaaauagcacuguuaaagcacgaauuaugauaacuugacuguauuu

SEQ ID NO: 243373 - RNA, 62 nt, Homo Sapiens
aguuaggcuguacaucagaccacaugagaagaagcacgaagcacaagaaagcuguggcucaa

SEQ ID NO: 243374 - RNA, 62 nt, Homo Sapiens
uuuaugguauuugguacaacuggcugauacuaagcacgaauagauauugauguuauggagug

SEQ ID NO: 243375 - RNA, 62 nt, Homo Sapiens
ucucuguugcugcugcugaacucagcuguuguagcacgaaagcagccagguaauuacuagau

SEQ ID NO: 243376 - RNA, 62 nt, Homo Sapiens
cugcuugucugcuuuggcggcacugcgggaccagcacgaaaggaguggguuuguggagucgc

SEQ ID NO: 243377 - RNA, 62 nt, Homo Sapiens
ucccuagcugcaggaagccccuauuuuuuccaagcacgaagccaccagucucccccagggag

SEQ ID NO: 243378 - RNA, 62 nt, Homo Sapiens
gcccgucagagaagugcacacugaaagccagcagcacgaacuaagugugcggagacaggcgg

SEQ ID NO: 243379 - RNA, 62 nt, Homo Sapiens
gccuggcaggcuguuagcagcccugaugacgcagcacgaaggacuuuucagcagcaaaacug

SEQ ID NO: 243380 - RNA, 62 nt, Homo Sapiens
cacaucccagccccagaguccugggggggcccagcacgaaguuccugcaugaacagcuucac

SEQ ID NO: 243381 - RNA, 62 nt, Homo Sapiens
aauugcuguacuucauuaagugaauguguuguagcacgaauaacgaaaaaaaagguagaucu

SEQ ID NO: 243382 - RNA, 62 nt, Homo Sapiens
acucaaaaaguaagcaaaccacauaggcugaaagcacgaauuugucauauuucacucucaaa

SEQ ID NO: 243383 - RNA, 62 nt, Homo Sapiens
auucuauuaaagaaaaucauuuuuauccacuuagcacgaauguuucuuuuguaauuuguaac

SEQ ID NO: 243384 - RNA, 62 nt, Homo Sapiens
uaggguuaacccuuucaggcaguagccaccuuagcacgaacagcagcccagcagugaucagc

SEQ ID NO: 243385 - RNA, 62 nt, Homo Sapiens
gggaguuauucuccccuagagaucgacuuggcagcacgaaggauucuuuucucuuucaugcu

SEQ ID NO: 243386 - RNA, 62 nt, Homo Sapiens
gccaaaacugcagucacugaaugaccaagagcagcacgaaggacuuggaaccuauccuugua

SEQ ID NO: 243387 - RNA, 62 nt, Homo Sapiens
aaaagacauguagaauuuguugucuucugcuaagcacgaaaaguuaagauaucugcuuacau

SEQ ID NO: 243388 - RNA, 62 nt, Homo Sapiens
ccacgaacguagaguuugacugccuaagggacagcacgaaugacucacauguuucagacagg

SEQ ID NO: 243389 - RNA, 62 nt, Homo Sapiens
cagucccagcaggcagaaugcccaaaaccaggagcacgaaggccugucauccauggggccau

SEQ ID NO: 243390 - RNA, 62 nt, Homo Sapiens
agaccaagcgaagggcagccgcagguuuggcgagcacgaacuugagcagacacaaaacggug

SEQ ID NO: 243391 - RNA, 62 nt, Homo Sapiens
aacagcagcagggaugucuaugccuuguuccgagcacgaagacuucccuccacagaccccua

SEQ ID NO: 243392 - RNA, 62 nt, Homo Sapiens
gaugcuggugguuaaggguagcaaaucucuaaagcacgaagcccucacaaaucuuugccauu

SEQ ID NO: 243393 - RNA, 62 nt, Homo Sapiens
ucacauuuuccccuacacuuugucauuaaaacagcacgaaaacucacaugauuugguucuug

SEQ ID NO: 243394 - RNA, 62 nt, Homo Sapiens
aauucccacuggugagaaaccaguuucuuuugagcacgaaagucuaaagcccuuaauuguuc

SEQ ID NO: 243395 - RNA, 62 nt, Homo Sapiens
gcccuuguggcaauguuaacaccacuugcugaagcacgaagaggggaaaggacaagucaggg

SEQ ID NO: 243396 - RNA, 62 nt, Homo Sapiens
acugaaaguuucaguuuuuauuuuuuucagaaagcacgaaaaauuauuuauaauagucugga

SEQ ID NO: 243397 - RNA, 62 nt, Homo Sapiens
guuaggcugcaucccacucaaaauacaggaaaagcacgaaucaugauucugcuuucuguuag

SEQ ID NO: 243398 - RNA, 62 nt, Homo Sapiens
uuucuuuucucucuuuguuguuuaagguauuaagcacgaauuauuacaugagacuggcagau

SEQ ID NO: 243399 - RNA, 62 nt, Homo Sapiens
cuugagccugccccagcccccuguugaaacucagcacgaaugguagcugcucgccacacagg

SEQ ID NO: 243400 - RNA, 62 nt, Homo Sapiens
ccuuggcccaagaccccuuugauucucuaaggagcacgaaagggggaaugccccucccagga

SEQ ID NO: 243401 - RNA, 62 nt, Homo Sapiens
uucccucugggguacuuguugucauuguuuaaagcacgaauguucacaguauuauguguaaa

SEQ ID NO: 243402 - RNA, 64 nt, Homo Sapiens
gaaucguaaccaaaacuacaaccguaaaaaaaggagcagguaauaaaacaggagcagguaacga

SEQ ID NO: 243403 - RNA, 64 nt, Homo Sapiens
gaaccguaaaaaaaggagcaagggccaaaacaggagcagguaacggagauacugacuguaccug

SEQ ID NO: 243404 - RNA, 64 nt, Homo Sapiens
uaauuuuuuuauuuguacugaaaaacuaaucauaacuguuaauucucagccaucuuugaagcuu

SEQ ID NO: 243405 - RNA, 64 nt, Homo Sapiens
gguuuuggugguuaacuuuuacacaguucugaguacuguuaauaucuggaaaguaucuugagau

SEQ ID NO: 243406 - RNA, 64 nt, Homo Sapiens
caguaaguuaacccuacauguuauaaagauggcgacuguuaacaaaggcuguaacagauuaagu

SEQ ID NO: 243407 - RNA, 64 nt, Homo Sapiens
uuuacaguaggaaacgccaguaaacaacuuuuauacuguuaaaaggcuuuuuuccccuuccuaa

SEQ ID NO: 243408 - RNA, 64 nt, Homo Sapiens
uauccaaucugaaguauugcacaucugaacugggacuguuaacacugaugccaauacagugugg

SEQ ID NO: 243409 - RNA, 64 nt, Homo Sapiens
auaaagggaaccgagauuuaauuuggagaucaucacuguuaaaacgauaccagacauuugucac

SEQ ID NO: 243410 - RNA, 64 nt, Homo Sapiens
aauuguauugaauucuuuuuuuguaguuuuauguacuguuaaagucugccauuuucuuuugcaa

SEQ ID NO: 243411 - RNA, 64 nt, Homo Sapiens
ucuuucccgggacauuuuuuauacauuauuagaaacuguuaaggcucaaugcauugucaguaga

SEQ ID NO: 243412 - RNA, 64 nt, Homo Sapiens
aauuguacugaauucuuuuuuuuuaguuuuauguacuguuaaagaguuucauuuucuuuugcaa

SEQ ID NO: 243413 - RNA, 64 nt, Homo Sapiens
uuuuaacagacaacuucauuuuucagagagaacuacuguuaacaaaacucucaacaaucccuuc

SEQ ID NO: 243414 - RNA, 64 nt, Homo Sapiens
ccuaauuaaauaugcuuuaguuaaguucucccuuacuguuaaaauuuuuaagggcuguguuaua

SEQ ID NO: 243415 - RNA, 64 nt, Homo Sapiens
ucuauuuguauucuuauaccaggcaucacuagccacuguuaauacaguuuaagaaaaccuuaug

SEQ ID NO: 243416 - RNA, 64 nt, Homo Sapiens
ugugcaugguuuuggacccccacaguucuucuggacuguuaaauugcuagccagguaaagauua

SEQ ID NO: 243417 - RNA, 64 nt, Homo Sapiens
uguuuuaagacuuccacacaccaaggcuacaaugacuguuaaccuggaggaagucucugguaug

SEQ ID NO: 243418 - RNA, 64 nt, Homo Sapiens
auaaauuaagcauaaaauauguaaccaggaaaagacuguuaacauuacauuuaugcaaauuaaa

SEQ ID NO: 243419 - RNA, 64 nt, Homo Sapiens
uuuuuaaaaaagaagcaauggcuuuuuucauacuacuguuaacugacagcuggcuuugugggug

SEQ ID NO: 243420 - RNA, 64 nt, Homo Sapiens
cuugccguaucaggagacugucaugggaguguuaacuguuaacuguuagcuuuucacuuaugaa

SEQ ID NO: 243421 - RNA, 64 nt, Homo Sapiens
uaaaaauucgucuaucgaauuagggcugaaaauuacuguuaaagaguguugcaguaugucuggu

SEQ ID NO: 243422 - RNA, 64 nt, Homo Sapiens
aaaugucuuucacagacuuaagggacuauguacuacuguuaauaucucuaagaacaaaacacau

SEQ ID NO: 243423 - RNA, 64 nt, Homo Sapiens
aauccuuuugcugcuuaucugauguugguuugauacuguuaacacaccaaaaagaauauggaau

SEQ ID NO: 243424 - RNA, 64 nt, Homo Sapiens
uugggguugaacuuuuuuuuaccucaggcuaauuacuguuaauuuguagagccacauuuacaau

SEQ ID NO: 243425 - RNA, 64 nt, Homo Sapiens
gaaauaccuuuuuuuuuuuuuaugaaaauuaacaacuguuaaaguguagcucuuggaguacagc

SEQ ID NO: 243426 - RNA, 64 nt, Homo Sapiens
cucuuuuauuuuacuguuuucuuuuuagaaacccacuguuaaaauuuaaaaaggugcuuuaaaa

SEQ ID NO: 243427 - RNA, 64 nt, Homo Sapiens
cauuuuggcccuuacgaaauacgucuuuuucagaacuguuaaaguuuugauguacaucgagcug

SEQ ID NO: 243428 - RNA, 64 nt, Homo Sapiens
ugaaaauuaaauauuacugaagauuucgacuuccacuguuaaauguacaagauacaugaaauau

SEQ ID NO: 243429 - RNA, 64 nt, Homo Sapiens
accaguuuaccaauacaugaguaacugaaguguaacuguuaaaugcuuguauacuaguuuuucu

SEQ ID NO: 243430 - RNA, 64 nt, Homo Sapiens
ucuaaagguguaguuuccacuguaacuguugaguacuguuaaguacuguuaaucuuuuacauau

SEQ ID NO: 243431 - RNA, 64 nt, Homo Sapiens
uaguuuccacuguaacuguugaguacuguuaaguacuguuaaucuuuuacauauuugcacuugg

SEQ ID NO: 243432 - RNA, 64 nt, Homo Sapiens
acaauuuuaugacuauuuaucacuuguaugguagacuguuaaaguucauuuuauuugcagagua

SEQ ID NO: 243433 - RNA, 64 nt, Homo Sapiens
agaaagcugaguaucaacuuguaaaggucugaacacuguuaagggacuuucuugaauugcuuuc

SEQ ID NO: 243434 - RNA, 64 nt, Homo Sapiens
gugucacgggucagcgugcgcugcugagcccuguacuguuaacagugcaaagcuagugaguagc

SEQ ID NO: 243435 - RNA, 64 nt, Homo Sapiens
ucagcugcugucccaaaguaacaaaacaauaccuacuguuaaguaggaagucaaucugugugcu

SEQ ID NO: 243436 - RNA, 64 nt, Homo Sapiens
uaugugauuuucccccuauugcuuggcaucauggacuguuaauggaaacuuuuacucuucagga

SEQ ID NO: 243437 - RNA, 64 nt, Homo Sapiens
cacaauguucacagacaucuagaggcucugagccacuguuaacgccaugcagagcugugaaucu

SEQ ID NO: 243438 - RNA, 64 nt, Homo Sapiens
uaaauaccugauuucuugucaucgagauucuuguacuguuaaaugaauauugccuuuuacugcu

SEQ ID NO: 243439 - RNA, 64 nt, Homo Sapiens
acuugguuccaugaaaaguaugcuuuguguuuuaacuguuaaaauaauuuaaaaauuaauuauu

SEQ ID NO: 243440 - RNA, 64 nt, Homo Sapiens
ugagugugguggugugaccuucaggcugcacagaggcaaggacccagauguggcagcaugggcg

SEQ ID NO: 243441 - RNA, 64 nt, Homo Sapiens
ccuuccuucacuaaagcucccuuuuuuuucuguuggcaaggacagguuacagaauaggaagagu

SEQ ID NO: 243442 - RNA, 64 nt, Homo Sapiens
cagcugacaggcaccucuccaggccccguagaugggcaaggacuugauaaccaggguuuuaggc

SEQ ID NO: 243443 - RNA, 64 nt, Homo Sapiens
cccgagccuguguccuccccaccucgcccacccuggcaaggacagcugcggccaaggacgaaag

SEQ ID NO: 243444 - RNA, 64 nt, Homo Sapiens
cuuuuuaucauuaggaaacaaucuuuccaagcaaggcaaggagaaggcaaggagacuuucucuc

SEQ ID NO: 243445 - RNA, 64 nt, Homo Sapiens
cuuucucucaucuuuccaagaucuguccaaacaaggcaaggagaagaggaggaucucaucucuc

SEQ ID NO: 243446 - RNA, 64 nt, Homo Sapiens
ggcccuucauggggggccagggguggcugcugugggcaaggacccuaugaggcugcugacaagu

SEQ ID NO: 243447 - RNA, 64 nt, Homo Sapiens
ugaccgaguucggcaauaagcugugaacgagcagggcaaggaggcuacuacccagccaugaagg

SEQ ID NO: 243448 - RNA, 64 nt, Homo Sapiens
guuauagcuauaccuucaggucuuuuguuacuuaggcaaggaaaaccacaugucugaccugguu

SEQ ID NO: 243449 - RNA, 64 nt, Homo Sapiens
caaaaauaagccaggcgugguggcgggaggcugaggcaaggagaaucacuugaauacaagaggc

SEQ ID NO: 243450 - RNA, 64 nt, Homo Sapiens
aggacagaggcggugggacagccuggccacagagggcaaggacugugccggagucccuggggga

SEQ ID NO: 243451 - RNA, 64 nt, Homo Sapiens
gggcacuguccgccagggcugggcaggcucagguggcaaggacggagcuguccccuagugaggg

SEQ ID NO: 243452 - RNA, 64 nt, Homo Sapiens
gagggccuggaccagcaggucuguccaacuugguggcaaggacagguucuuggaauuggcaggc

SEQ ID NO: 243453 - RNA, 64 nt, Homo Sapiens
cacgccaaauaccacacgcgaggcagguaaauggggcaaggacuacuacucauagcagcuccug

SEQ ID NO: 243454 - RNA, 64 nt, Homo Sapiens
ugauccugugaaguaaggaugugggggaagaccuggcaaggacacagaugaaacacaaacaaua

SEQ ID NO: 243455 - RNA, 64 nt, Homo Sapiens
ucaauucaacacucccuucccaugacccaggcugggcaaggaggccacgugauguggagggcac

SEQ ID NO: 243456 - RNA, 64 nt, Homo Sapiens
agaagugaggaugagacccacccugcucugcccaggcaaggaacccccuuccccaugaacccug

SEQ ID NO: 243457 - RNA, 64 nt, Homo Sapiens
aggagucagaugaggcccugcaccccuguaaucaggcaaggagggaggagaugugaucaggccc

SEQ ID NO: 243458 - RNA, 64 nt, Homo Sapiens
ucaacccacaaguagcuacgacugcaagcaccugccaccauaaagggcugcauuuugccaccau

SEQ ID NO: 243459 - RNA, 64 nt, Homo Sapiens
gcaagcaccugccaccauaaagggcugcauuuugccaccauaaagggcugcauuuuuuuaaaaa

SEQ ID NO: 243460 - RNA, 64 nt, Homo Sapiens
caagcagcugggacuacaccaccacagguaugcaccaccauaccuggcugauuuuuaaaauuuu

SEQ ID NO: 243461 - RNA, 64 nt, Homo Sapiens
cuguguauguaugcauguuugucuuuccuaggacccaccauaccugagugaggcgugugugugu

SEQ ID NO: 243462 - RNA, 64 nt, Homo Sapiens
ucugauucccaccccacauauucuggggccucccccaccauagcacucggggagccuucucugu

SEQ ID NO: 243463 - RNA, 64 nt, Homo Sapiens; identical to SEQ ID NO: 156945

SEQ ID NO: 243464 - RNA, 64 nt, Homo Sapiens; identical to SEQ ID NO: 156946

SEQ ID NO: 243465 - RNA, 64 nt, Homo Sapiens; identical to SEQ ID NO: 156947

SEQ ID NO: 243466 - RNA, 64 nt, Homo Sapiens; identical to SEQ ID NO: 156948

SEQ ID NO: 243467 - RNA, 64 nt, Homo Sapiens; identical to SEQ ID NO: 156949

SEQ ID NO: 243468 - RNA, 64 nt, Homo Sapiens; identical to SEQ ID NO: 156950

SEQ ID NO: 243469 - RNA, 64 nt, Homo Sapiens; identical to SEQ ID NO: 156951

SEQ ID NO: 243470 - RNA, 64 nt, Homo Sapiens; identical to SEQ ID NO: 156952

SEQ ID NO: 243471 - RNA, 64 nt, Homo Sapiens; identical to SEQ ID NO: 156953

SEQ ID NO: 243472 - RNA, 64 nt, Homo Sapiens; identical to SEQ ID NO: 156954

SEQ ID NO: 243473 - RNA, 64 nt, Homo Sapiens; identical to SEQ ID NO: 156955

SEQ ID NO: 243474 - RNA, 64 nt, Homo Sapiens; identical to SEQ ID NO: 156956

SEQ ID NO: 243475 - RNA, 64 nt, Homo Sapiens; identical to SEQ ID NO: 156957

SEQ ID NO: 243476 - RNA, 64 nt, Homo Sapiens; identical to SEQ ID NO: 156958

SEQ ID NO: 243477 - RNA, 64 nt, Homo Sapiens; identical to SEQ ID NO: 156959

SEQ ID NO: 243478 - RNA, 64 nt, Homo Sapiens; identical to SEQ ID NO: 156960

SEQ ID NO: 243479 - RNA, 64 nt, Homo Sapiens; identical to SEQ ID NO: 156961

SEQ ID NO: 243480 - RNA, 64 nt, Homo Sapiens; identical to SEQ ID NO: 156962

SEQ ID NO: 243481 - RNA, 64 nt, Homo Sapiens; identical to SEQ ID NO: 156963

SEQ ID NO: 243482 - RNA, 64 nt, Homo Sapiens; identical to SEQ ID NO: 156964

SEQ ID NO: 243483 - RNA, 64 nt, Homo Sapiens; identical to SEQ ID NO: 156965

SEQ ID NO: 243484 - RNA, 64 nt, Homo Sapiens; identical to SEQ ID NO: 156966

SEQ ID NO: 243485 - RNA, 64 nt, Homo Sapiens; identical to SEQ ID NO: 156967

SEQ ID NO: 243486 - RNA, 64 nt, Homo Sapiens; identical to SEQ ID NO: 156968

SEQ ID NO: 243487 - RNA, 64 nt, Homo Sapiens; identical to SEQ ID NO: 156969

SEQ ID NO: 243488 - RNA, 64 nt, Homo Sapiens; identical to SEQ ID NO: 156970

SEQ ID NO: 243489 - RNA, 64 nt, Homo Sapiens; identical to SEQ ID NO: 156971

SEQ ID NO: 243490 - RNA, 64 nt, Homo Sapiens; identical to SEQ ID NO: 156972

SEQ ID NO: 243491 - RNA, 64 nt, Homo Sapiens; identical to SEQ ID NO: 156973

SEQ ID NO: 243492 - RNA, 64 nt, Homo Sapiens; identical to SEQ ID NO: 156974

SEQ ID NO: 243493 - RNA, 64 nt, Homo Sapiens; identical to SEQ ID NO: 156975

SEQ ID NO: 243494 - RNA, 64 nt, Homo Sapiens; identical to SEQ ID NO: 156976

SEQ ID NO: 243495 - RNA, 64 nt, Homo Sapiens; identical to SEQ ID NO: 156977

SEQ ID NO: 243496 - RNA, 64 nt, Homo Sapiens; identical to SEQ ID NO: 156978

SEQ ID NO: 243497 - RNA, 64 nt, Homo Sapiens; identical to SEQ ID NO: 156979

SEQ ID NO: 243498 - RNA, 64 nt, Homo Sapiens; identical to SEQ ID NO: 156980

SEQ ID NO: 243499 - RNA, 64 nt, Homo Sapiens; identical to SEQ ID NO: 156981

SEQ ID NO: 243500 - RNA, 64 nt, Homo Sapiens; identical to SEQ ID NO: 156982

SEQ ID NO: 243501 - RNA, 64 nt, Homo Sapiens; identical to SEQ ID NO: 156983

SEQ ID NO: 243502 - RNA, 64 nt, Homo Sapiens; identical to SEQ ID NO: 156984

SEQ ID NO: 243503 - RNA, 64 nt, Homo Sapiens; identical to SEQ ID NO: 156985

SEQ ID NO: 243504 - RNA, 64 nt, Homo Sapiens; identical to SEQ ID NO: 156986

SEQ ID NO: 243505 - RNA, 64 nt, Homo Sapiens; identical to SEQ ID NO: 156987

SEQ ID NO: 243506 - RNA, 64 nt, Homo Sapiens; identical to SEQ ID NO: 156988

SEQ ID NO: 243507 - RNA, 64 nt, Homo Sapiens; identical to SEQ ID NO: 156989

SEQ ID NO: 243508 - RNA, 64 nt, Homo Sapiens; identical to SEQ ID NO: 156990

SEQ ID NO: 243509 - RNA, 64 nt, Homo Sapiens
auugauaugaagccugacugauuuuuuuuuuccuuacagugagacauuuaagcacacauuuuau

SEQ ID NO: 243510 - RNA, 64 nt, Homo Sapiens
guuauggucgauuucuauucuugaaagaaucaacuacagugaauccuuugcauuugaagccuua

SEQ ID NO: 243511 - RNA, 64 nt, Homo Sapiens
guuauaauucuguuuauaauuuccuuucagcauuuacagugaaaagugagaauuuuaaaauuua

SEQ ID NO: 243512 - RNA, 64 nt, Homo Sapiens
ccaucuuucuuuaucaucuggugugggcgcacucuacagugacuucagucugcucagaacgaau

SEQ ID NO: 243513 - RNA, 64 nt, Homo Sapiens
aaauucggaaagugaucagagcacuuauucaaaauacagugauagaaguucagaaagcucacca

SEQ ID NO: 243514 - RNA, 64 nt, Homo Sapiens
gucuccaucaucuagaucucauucacgaaauaaauacagugaucauucacaguguaguagauca

SEQ ID NO: 243515 - RNA, 64 nt, Homo Sapiens
aauccagugaagaggaccuuucagguaaacaugauacagugacuguuucaucagaucuugauca

SEQ ID NO: 243516 - RNA, 64 nt, Homo Sapiens
gaacaaaagaggauuaguagguacuaaugaaauuuacagugauaaacauuuuacagauuuuaug

SEQ ID NO: 243517 - RNA, 64 nt, Homo Sapiens
ccaugaagacaguccaguaggucagggguuugcuuacagugaugagaggacauaccacugccau

SEQ ID NO: 243518 - RNA, 64 nt, Homo Sapiens
ucaucugauguuagagauuucauuuuauccggauuacagugacccaggcaugauuacaguaucu

SEQ ID NO: 243519 - RNA, 64 nt, Homo Sapiens
uagcuaaccucuguuucaagaccacguuucuggauacagugaaaaaugaugggucagaauuucu

SEQ ID NO: 243520 - RNA, 64 nt, Homo Sapiens
cauuuugcuuacacuguugcuucuguuaaagacuuacagugaucuucuggaguagauugguaua

SEQ ID NO: 243521 - RNA, 64 nt, Homo Sapiens
uaacuuaagauaucccugugugcauuuuuaacccuacagugaaauguuaagggauuuuaaauug

SEQ ID NO: 243522 - RNA, 64 nt, Homo Sapiens
cugauuuccauccuguauuucuuuucaucccaauuacagugaguagcauucuucuuagaguugc

SEQ ID NO: 243523 - RNA, 51 nt, Homo Sapiens
uaaguagauagcaaaauacucuacagugauguuggcacauuucuuuucuga

SEQ ID NO: 243524 - RNA, 64 nt, Homo Sapiens
uuuuugacuaaauaauccccaccucccuugaucauacagugaggcuacagugacugaggggaga

SEQ ID NO: 243525 - RNA, 64 nt, Homo Sapiens
auaauccccaccucccuugaucauacagugaggcuacagugacugaggggagaauccccuccug

SEQ ID NO: 243526 - RNA, 64 nt, Homo Sapiens
uggucucccaggugccagacccaaaagcuuuuccuacagugauacccuuuauuuuuacuucccc

SEQ ID NO: 243527 - RNA, 64 nt, Homo Sapiens
gcaggaggcuugcuugaggcaaggaguucaaggcuacagugagcuaugauugugccacuguacu

SEQ ID NO: 243528 - RNA, 64 nt, Homo Sapiens
gcagaagaaucauuugaacccaggaggcagagguuacagugagccgagaucgugcuacugcauu

SEQ ID NO: 243529 - RNA, 64 nt, Homo Sapiens
ucaccuguucagagguuuauagccaaagcacucugcacaccaaauucuucucucuaaacagcaa

SEQ ID NO: 243530 - RNA, 64 nt, Homo Sapiens
cugggcaacacagcaagacugagaucuugccacugcacaccagcggcagagguugcagugagcu

SEQ ID NO: 243531 - RNA, 64 nt, Homo Sapiens
uaaccccaaagccaucaugggagacauccagauggcacaccagaacuuaaugcuggaucccaug

SEQ ID NO: 243532 - RNA, 64 nt, Homo Sapiens
gcgcaacccugcugacuguuucaguuaauaugcugcacaccacacacuuguuuagugaaccaaa

SEQ ID NO: 243533 - RNA, 64 nt, Homo Sapiens
guuggauuuucuaugacagcacaggggacagguggcacaccaugagaggucugcccaggguggg

SEQ ID NO: 243534 - RNA, 64 nt, Homo Sapiens
uaagaaaaagguaagaacugucucaaaaacgaaagcacaccacccaagacacaguacccaguca

SEQ ID NO: 243535 - RNA, 64 nt, Homo Sapiens
cucuugucuauauuuaccuuaacucuguaugcuagcacaccaaaucauuugucaccauuuuuaa

SEQ ID NO: 243536 - RNA, 64 nt, Homo Sapiens
auguuucccucagugcccuucaaaccauucuuuugcacaccacauccaugaacgccucuaguag

SEQ ID NO: 243537 - RNA, 64 nt, Homo Sapiens
cucugcaguaaaaacaaaggacaacccagccaagcagaggaagaagcugccgaaggggacagac

SEQ ID NO: 243538 - RNA, 64 nt, Homo Sapiens
acguuuuuuuuaaucugugccaaaaauguguuuucagaggaaaucuuauuuucauauucagacu

SEQ ID NO: 243539 - RNA, 64 nt, Homo Sapiens
uaucucaucagccaucuuguccugugcauccuaacagaggaaggauccaugauucugcuuuggu

SEQ ID NO: 243540 - RNA, 64 nt, Homo Sapiens
augauucugcuuugguccaauugcuuccucucugcagaggaacaacccuaaaaccagaccacuc

SEQ ID NO: 243541 - RNA, 64 nt, Homo Sapiens
ggcggguagacaagggaugccugggcugacugggcagaggaaccucuagcucugacugucacuc

SEQ ID NO: 243542 - RNA, 64 nt, Homo Sapiens
cccccucaccccacccggggcucacucagccuggcagaggaagaaggaaggcagacaucuccgc

SEQ ID NO: 243543 - RNA, 64 nt, Homo Sapiens
uuugcaggcuggugggcuuucaaauugguacuuccagaggaaagccaagcugcuucuguuguga

SEQ ID NO: 243544 - RNA, 64 nt, Homo Sapiens
cagccaagagccugaggcugaagggaaaaguacacagaggaagauauuuuacaaaccaggucag

SEQ ID NO: 243545 - RNA, 64 nt, Homo Sapiens
cuuccaccuuucuguucaaggcuguuugucuacccagaggaaggaggcacugcugaauggcuau

SEQ ID NO: 243546 - RNA, 64 nt, Homo Sapiens
gaauguuugacucccuuaaucucuuccccagcuacagaggaaucuuuucucugccuggucucag

SEQ ID NO: 243547 - RNA, 64 nt, Homo Sapiens
ugagaggcguccauuuccagauguuaagaguggccagaggaaagacaauuagaagaucugacug

SEQ ID NO: 243548 - RNA, 64 nt, Homo Sapiens
aaguuuauggauuuaaaauaagaggggcugcagacagaggaagaccugaaaaggcagaaaagga

SEQ ID NO: 243549 - RNA, 64 nt, Homo Sapiens
gggacuuuguuaaaauucacuugaauuucaagcucagaggaaacuuugucucaugcccugacau

SEQ ID NO: 243550 - RNA, 64 nt, Homo Sapiens
auuucauuccuacucuucaggagacacugcugaacagaggaaugauucuguuccuugugugcuu

SEQ ID NO: 243551 - RNA, 64 nt, Homo Sapiens
gcugacuuucuagcuuugcagaggaucaaaacaacagaggaaauuuggcuuuggguuguauaag

SEQ ID NO: 243552 - RNA, 64 nt, Homo Sapiens
ccucagcaaaggccugagccggaggagcagacggcagaggaaaugugguggucaacgggaggga

SEQ ID NO: 243553 - RNA, 64 nt, Homo Sapiens
ccacaaaagaaaagacuuguaauauuuuuauauacagaggaaaucuguaacagguauuuuguuu

SEQ ID NO: 243554 - RNA, 64 nt, Homo Sapiens
aacagguauuuuguuucuuuuaaagcaagcaacacagaggaauuuauaccucaaacuaucuggc

SEQ ID NO: 243555 - RNA, 64 nt, Homo Sapiens
agcaaauaaagccgcuuccugucauuaagcaucucagaggaagcagcccucccucgauggccuc

SEQ ID NO: 243556 - RNA, 64 nt, Homo Sapiens
cagccuuccugcugccaccaucucugcuucuccccagaggaacuuagggauuucaccccuggcu

SEQ ID NO: 243557 - RNA, 64 nt, Homo Sapiens
uuugaucacaggagcaaucacaggaaaauguauccagaggaauugauugucagccaccucccuc

SEQ ID NO: 243558 - RNA, 64 nt, Homo Sapiens
ccuuagcaugugacuccugaagggaaggcaaaggcagaggaauuuggcugcuucuacggccaug

SEQ ID NO: 243559 - RNA, 64 nt, Homo Sapiens
ccuccugagggaggggcagggaagaucugggggacagaggaaggggucagaggaagccagcagg

SEQ ID NO: 243560 - RNA, 64 nt, Homo Sapiens
cagcagggaagaucugggggugggcuaggguggucagaggaagcggagcuuggagaacucacug

SEQ ID NO: 243561 - RNA, 64 nt, Homo Sapiens
gggaggaaagagcuuccagggggcgaacgcagcacagaggaagaggccugcuccacuugucugg

SEQ ID NO: 243562 - RNA, 64 nt, Homo Sapiens
ugcuccacuugucugggaaccugggcaggaggcacagaggaagccaaggccuggagcugcaggu

SEQ ID NO: 243563 - RNA, 64 nt, Homo Sapiens
gaugagacuguguaaaugagagaaagacuugauucagaggaaaaaaauguguucucucuggacu

SEQ ID NO: 243564 - RNA, 64 nt, Homo Sapiens
gaauugacagauaagaagcaaaugguuucuuguacagaggaauuuuguuuuaauguagaaaguu

SEQ ID NO: 243565 - RNA, 64 nt, Homo Sapiens
auccagugugacagagugcaggcugcagcuggaucagaggaaaaagagugaacuucuuauggga

SEQ ID NO: 243566 - RNA, 64 nt, Homo Sapiens
aucuugccaggauaccuacccacguuuacuauuucagaggaaauuagacaguaacuucuaaggu

SEQ ID NO: 243567 - RNA, 64 nt, Homo Sapiens
gucucaagaaccagaaauaaugaaaauagccagccagaggaaauucacaaaggcuuaaaggaag

SEQ ID NO: 243568 - RNA, 64 nt, Homo Sapiens
gucacaaaggcuuaaaggaacuuaaagcugacaucagaggaagagauuuuucaacagaacaaga

SEQ ID NO: 243569 - RNA, 64 nt, Homo Sapiens
ccuguccugcuggaacuggacccaggcuuccuuucagaggaagggacuaguguggccucacugc

SEQ ID NO: 243570 - RNA, 64 nt, Homo Sapiens
gaaaaacaaguauuaaaggcuuguuuagugaauacagaggaaaggccuuacaaaaaaaaaaaaa

SEQ ID NO: 243571 - RNA, 64 nt, Homo Sapiens
uaagguggaauuugcaggucagcccaggaauuggcagaggaaguaggugucugauaacccuuug

SEQ ID NO: 243572 - RNA, 64 nt, Homo Sapiens
aaaauaaacagcucuggagucuuguuccugacuccagaggaacgagagcauuccaggaaagaga

SEQ ID NO: 243573 - RNA, 64 nt, Homo Sapiens
ggacaucucacggcugcggcgcaagcuggaaaagcagaggaagguggaggucuacgcagaugcc

SEQ ID NO: 243574 - RNA, 64 nt, Homo Sapiens
cuucgagugcgugcggggccgcuaugaggcccgccagaggaagugccccaagugcaacgcggcc

SEQ ID NO: 243575 - RNA, 64 nt, Homo Sapiens
gguccgggggcugggggcuguauggcagucagaccagaggaagccuuccuggggccacagggcc

SEQ ID NO: 243576 - RNA, 64 nt, Homo Sapiens
agaagcccccgaguccuuucagaguccacaggcccagaggaagcccugagggccgggaagccga

SEQ ID NO: 243577 - RNA, 64 nt, Homo Sapiens
cuggagccaagagaagcccuucugcagagggucccagaggaacggggguccagcacaggcugua

SEQ ID NO: 243578 - RNA, 64 nt, Homo Sapiens
ugcagugauuccacgguuagccaagucgggaucucagaggaaauucaaucccuguccugguugu

SEQ ID NO: 243579 - RNA, 64 nt, Homo Sapiens
cucugcugauguucgguccugacauuuuugggagcagaggaaaaggaacaguucuagggaguga

SEQ ID NO: 243580 - RNA, 64 nt, Homo Sapiens
gcaauuuagcaggagguccuucaugaaacuggagcagaggaauuuugagaaauccuccuuggua

SEQ ID NO: 243581 - RNA, 64 nt, Homo Sapiens
gugucucccuccaaggccccugcaggagaacagacagaggaaauugggcuuuuuaccaccacug

SEQ ID NO: 243582 - RNA, 64 nt, Homo Sapiens
ccugcagaaaguuccaucaggcuccgagcucagacagaggaagcauccugcccggaaugccagu

SEQ ID NO: 243583 - RNA, 64 nt, Homo Sapiens
auaugaggaaaaauaucuugagcuaagaaaguagcagaggaaauuucacaugcaaagccacagu

SEQ ID NO: 243584 - RNA, 64 nt, Homo Sapiens
gugagcaguuuauguaacuggaaugaaaagggcucagaggaauggcagggauggcaagagaucc

SEQ ID NO: 243585 - RNA, 64 nt, Homo Sapiens
ccugaaaugaagucaguagaaauggcaugggauaagagcagagcucacacuuuuacaguugcag

SEQ ID NO: 243586 - RNA, 64 nt, Homo Sapiens
aacuuaacuuuaauuuccuguguaguuuacacccagagcagauacucauaaaguauaaaguaaa

SEQ ID NO: 243587 - RNA, 64 nt, Homo Sapiens
gaggaagacccccaagcauaugguugugacuccaagagcagaguucguugguuuuuuggagucu

SEQ ID NO: 243588 - RNA, 64 nt, Homo Sapiens
agggaagagcccaagcauaguggucaugacuccaagagcagagcuuuguuggcuuuuagagugu

SEQ ID NO: 243589 - RNA, 64 nt, Homo Sapiens
acacacuggcucaagcagcaggcuagggaagcagagagcagagcagggaugagaaggauggcgg

SEQ ID NO: 243590 - RNA, 64 nt, Homo Sapiens
augcagugauggaagaagcaaaccagggaagcagagagcagagcaggaaacuuuuagguggugg

SEQ ID NO: 243591 - RNA, 64 nt, Homo Sapiens
uccuggccagcguuugaagcgggcuugggaaucuagagcagagcuugucuaggucugaaaucaa

SEQ ID NO: 243592 - RNA, 64 nt, Homo Sapiens
gcguaacagcagccuaugccucagccugcuggaaagagcagacaugcuagacuaccccucuuca

SEQ ID NO: 243593 - RNA, 64 nt, Homo Sapiens
ugaaacagucucacauacccaacugcucaucaacagagcagagcugauggcaugagugagggcu

SEQ ID NO: 243594 - RNA, 64 nt, Homo Sapiens
uggaacccuaggaacaaggagccuuuguuccaacagagcagagaaggagguucucuauguucag

SEQ ID NO: 243595 - RNA, 64 nt, Homo Sapiens
guagauuuaaaaacaagugccguacguuaagagaagagcagaucaugcuauugugacauuugca

SEQ ID NO: 243596 - RNA, 64 nt, Homo Sapiens
ccaucuucaguuugaaugacucccaggaaggccuagagcagacccuuuagaaaucagcccaagg

SEQ ID NO: 243597 - RNA, 64 nt, Homo Sapiens
ggcaauggugauaauggauuaauuccucaaaggaagagcagaacaccugaaaaucagcaauuuc

SEQ ID NO: 243598 - RNA, 64 nt, Homo Sapiens
ggcaauggugaugauggauuaauuccuccaaggaagagcagaacaccugaaagccagcaauuuc

SEQ ID NO: 243599 - RNA, 64 nt, Homo Sapiens
agucguucuuaagccaucaccaguggguguacucagagcagaggggccaggacuucugccagcc

SEQ ID NO: 243600 - RNA, 64 nt, Homo Sapiens
cucuguccaggacagcagguaaaaaggaauccccagagcagacgcaaugguaggagccugcaca

SEQ ID NO: 243601 - RNA, 64 nt, Homo Sapiens
cugggcggcauccacagccagagaggcagaggcaagagcagagccaggcugugcccgagggacc

SEQ ID NO: 243602 - RNA, 64 nt, Homo Sapiens
auuugggcucagcacauuuugugggacccauguuagagcagaaacagagcagacugauaggucc

SEQ ID NO: 243603 - RNA, 64 nt, Homo Sapiens
gauagguccgugggacccaucaggucagcaccccagagcagacuagacccugcucaggacccag

SEQ ID NO: 243604 - RNA, 64 nt, Homo Sapiens
ggccguuaaguuucacagacuccagaaacauggcagagcagacauguugaaccagcaucaaguc

SEQ ID NO: 243605 - RNA, 64 nt, Homo Sapiens
aagacucugucucaaaaaaagcacuccagccuggagagcagagcugagccgagauugcaccacu

SEQ ID NO: 243606 - RNA, 64 nt, Homo Sapiens
gccaaucagucaaugauaaucugaacaaauuuuaagagcagauuuuagauuaauaauguuuuau

SEQ ID NO: 243607 - RNA, 64 nt, Homo Sapiens
uucaggcaagugcaagugguucaggggccagcgcagagcagagugcugaguaaagaugucagaa

SEQ ID NO: 243608 - RNA, 64 nt, Homo Sapiens
caacccacaaugaucaggucaaucaaaaucccuaagagcagaacuccuaccccaaaagaagccu

SEQ ID NO: 243609 - RNA, 64 nt, Homo Sapiens
acuauagaccaaaguuugcuuaagguuugacccuagagcagaggugggcaaacuaugaccugga

SEQ ID NO: 243610 - RNA, 64 nt, Homo Sapiens
aggccaccucauccguaaggacccugcuucuccaagagcagaccuggcccugucgacuauugcc

SEQ ID NO: 243611 - RNA, 57 nt, Homo Sapiens
ccugggccaaggaacaccccagggcccagagcagagcugugggugggugagguauga

SEQ ID NO: 243612 - RNA, 64 nt, Homo Sapiens
caggguucucaggcaggcaguucugcuucagcuuagagcagaacccauaaaauacucaaguacu

SEQ ID NO: 243613 - RNA, 64 nt, Homo Sapiens
uuauuuugaaaguuggaaggagaagggagggaagagagcagaagggaagaagguguaagucaag

SEQ ID NO: 243614 - RNA, 64 nt, Homo Sapiens
gaugcugaugaacaucgaacauaucuacuucauuagagcagaggcuauuuuucugcauucuugu

SEQ ID NO: 243615 - RNA, 64 nt, Homo Sapiens
auaauucugagcaggaaauuuauaagaaauugaaagagcagaagaauuacagcccugucacaug

SEQ ID NO: 243616 - RNA, 64 nt, Homo Sapiens
gcugguuucugggaagggaacguuuauuuaguaaagagcagaacacccuugcguuuuguuggga

SEQ ID NO: 243617 - RNA, 64 nt, Homo Sapiens
gugagcaggcggagacuccaagcugggcugagccagagcagaaggcgagggauucccagccgga

SEQ ID NO: 243618 - RNA, 64 nt, Homo Sapiens
ugaugucccggugcuuccuggucgcacacgcagcagagcagaccccucccaggggagaguagaa

SEQ ID NO: 243619 - RNA, 64 nt, Homo Sapiens
cuagggcagagccaaugcugcucaugggacacccagagcagaagaggggccagcggccaccaag

SEQ ID NO: 243620 - RNA, 64 nt, Homo Sapiens
gguagagacaucuucaaggcaugaaauagcuuaaagagcagaguagaaacggaagaggcuuugc

SEQ ID NO: 243621 - RNA, 64 nt, Homo Sapiens
ugcacugucgguguuaagagaaauuacucucacaagagcagaggccugaagauucuuucuucug

SEQ ID NO: 243622 - RNA, 64 nt, Homo Sapiens
gagcaccacucacuucugcagggagcaaggguccagagcagauauggaccccucugcacaggcc

SEQ ID NO: 243623 - RNA, 64 nt, Homo Sapiens
cucucuguagggcuuccccaccucucggugggacagagcagaggaaggcaggggauuuaggauc

SEQ ID NO: 243624 - RNA, 64 nt, Homo Sapiens
ugcugccaagggcagaaaauggggagguuagcucagagcagaguagucucuagagaaaggaaga

SEQ ID NO: 243625 - RNA, 64 nt, Homo Sapiens
ggacuaugcucugaggcuauacucugugcccaugagagcagagacuggaagggcaagaccaggu

SEQ ID NO: 243626 - RNA, 64 nt, Homo Sapiens
cagcccagaccucugacacaucaagcccucgucuagagcagacccgaugcaggggauggugugg

SEQ ID NO: 243627 - RNA, 64 nt, Homo Sapiens
ucgauuuuuuuuggaagaggucagcucuugcuucagagcagauuggagucuaaccugcgucauu

SEQ ID NO: 243628 - RNA, 64 nt, Homo Sapiens
cugugcggugacuccgaagcggagcacagagcagagagcagacuggaggggacugugggacuga

SEQ ID NO: 243629 - RNA, 64 nt, Homo Sapiens
gcagacucugugcggugacuggacugaggagcacagagcagagagugacuuggaggggacugug

SEQ ID NO: 243630 - RNA, 64 nt, Homo Sapiens
cggaaggccgcuuccuuucucaggagaggcugcuagagcagaagaggagagguugcuggagcug

SEQ ID NO: 243631 - RNA, 64 nt, Homo Sapiens
cggaaggccgcuuccuuucucaggagagccugcuagagcagaagaggagaggcuacuggagcug

SEQ ID NO: 243632 - RNA, 64 nt, Homo Sapiens
gaacgcugcauagaccauggaggccuuugcgcagagagcagagaggaugacuugcggccaccaa

SEQ ID NO: 243633 - RNA, 64 nt, Homo Sapiens
uccucuguaacaucugaggugaccaagaggcagaagagcagagcagucgggggccguguccugg

SEQ ID NO: 243634 - RNA, 59 nt, Homo Sapiens
uucguguucauuccccuugaggaggaagcagagcagagugcgagauccugacccaagag

SEQ ID NO: 243635 - RNA, 64 nt, Homo Sapiens
gacccaagagcaccauaacauagcuccgaaagggagagcagagauggcagcugaaacucacucu

SEQ ID NO: 243636 - RNA, 64 nt, Homo Sapiens
cacacugucucccuggagggcaccucacguuuuuagagcagaacuuuugacauauuucaguuuc

SEQ ID NO: 243637 - RNA, 64 nt, Homo Sapiens
ucuaaccucauucaggaaaagccacagggauuuuagagcagacaugcaugggacuaguucaucu

SEQ ID NO: 243638 - RNA, 64 nt, Homo Sapiens
uccuuacuucucuaccugccucaagaaggggcucagagcagagacuugugaauuccuuaguaac

SEQ ID NO: 243639 - RNA, 64 nt, Homo Sapiens
auggacacacacccaagccacaagaaaucccaagagagcagaagcgaauuuuuaaaagauuuau

SEQ ID NO: 243640 - RNA, 64 nt, Homo Sapiens
cucaggcugccccucuccuuccccggcucgcaggagagcagagcagagaacuguggggaacgcu

SEQ ID NO: 243641 - RNA, 64 nt, Homo Sapiens
gcugccccucuccuuccccggcucgcaggagagcagagcagagaacuguggggaacgcugugcu

SEQ ID NO: 243642 - RNA, 64 nt, Homo Sapiens
ucugaauuccccguuuuguuccauauugguauagagagcagaagaguagcuaggcagaugcaga

SEQ ID NO: 243643 - RNA, 64 nt, Homo Sapiens
cuucucucaaaauggauccgauaaauauuugaauagagcagauuguagaaugucgugcugucac

SEQ ID NO: 243644 - RNA, 64 nt, Homo Sapiens
gacuagugagucuguaccauaaguauuaaucaccuccacucauauuaaagugaucauuaagaau

SEQ ID NO: 243645 - RNA, 64 nt, Homo Sapiens
uggaagggguaucagagaccauguaguucaacuuuccacucaaaguaagauuuaugaauuauuu

SEQ ID NO: 243646 - RNA, 64 nt, Homo Sapiens
aaauuggauuauuaggaauacaucuugacccuuuuccacucaauagaccagggaaagggguuac

SEQ ID NO: 243647 - RNA, 64 nt, Homo Sapiens
uucccuuccccaaaccaugugcuuauuagaugguuccacucaggaagcaaggaagcuaaaacuc

SEQ ID NO: 243648 - RNA, 64 nt, Homo Sapiens
ucuaagggacauuaucuuccuucagguuuuuaccuccacucauccuuagagcccacugacugcu

SEQ ID NO: 243649 - RNA, 64 nt, Homo Sapiens
caagcuagagccgcaggcacccucucacucaauuuccacucagaacccuauaaacaccaguggg

SEQ ID NO: 243650 - RNA, 64 nt, Homo Sapiens
uaaaaggugagcucagcucaaaaaaaaaaaaaaauccacucauaagagcaagacuccauuucaa

SEQ ID NO: 243651 - RNA, 64 nt, Homo Sapiens
ccgggcgugguggcacgcgcuuuaacacuaaaauuccacucaugaacccagagucaggaagaga

SEQ ID NO: 243652 - RNA, 64 nt, Homo Sapiens
cuugccuccucucccuggguguggggcugcggaguccacucaucgucgacauguucagugccug

SEQ ID NO: 243653 - RNA, 64 nt, Homo Sapiens
uguuucuccgguucucccugcguguguccguuccuccacucaucugggggagccgcccggugcc

SEQ ID NO: 243654 - RNA, 64 nt, Homo Sapiens
agcuaccaccugucaccagagccuacugcugcucuccacucaacuggccucugcugccaggcca

SEQ ID NO: 243655 - RNA, 64 nt, Homo Sapiens
auguacacgcuaaggaaaaacuagcacccuucuguccacucagcaauaagagggaucucuuccc

SEQ ID NO: 243656 - RNA, 64 nt, Homo Sapiens
aggagugacagaggcagaagggcacugagaugcauccacucagcgccgcugcccuggugggcau

SEQ ID NO: 243657 - RNA, 64 nt, Homo Sapiens
caccugcccuccaccaggagauuauaaauuacaauccacucaucguguuucugccauauauuuu

SEQ ID NO: 243658 - RNA, 64 nt, Homo Sapiens; identical to SEQ ID NO: 43914

SEQ ID NO: 243659 - RNA, 64 nt, Homo Sapiens; identical to SEQ ID NO: 43915

SEQ ID NO: 243660 - RNA, 64 nt, Homo Sapiens; identical to SEQ ID NO: 43916

SEQ ID NO: 243661 - RNA, 64 nt, Homo Sapiens; identical to SEQ ID NO: 43917

SEQ ID NO: 243662 - RNA, 64 nt, Homo Sapiens; identical to SEQ ID NO: 43918

SEQ ID NO: 243663 - RNA, 64 nt, Homo Sapiens; identical to SEQ ID NO: 43919

SEQ ID NO: 243664 - RNA, 64 nt, Homo Sapiens; identical to SEQ ID NO: 43920

SEQ ID NO: 243665 - RNA, 64 nt, Homo Sapiens; identical to SEQ ID NO: 43921

SEQ ID NO: 243666 - RNA, 64 nt, Homo Sapiens; identical to SEQ ID NO: 43922

SEQ ID NO: 243667 - RNA, 64 nt, Homo Sapiens; identical to SEQ ID NO: 43923

SEQ ID NO: 243668 - RNA, 64 nt, Homo Sapiens; identical to SEQ ID NO: 43924

SEQ ID NO: 243669 - RNA, 64 nt, Homo Sapiens; identical to SEQ ID NO: 43925

SEQ ID NO: 243670 - RNA, 64 nt, Homo Sapiens; identical to SEQ ID NO: 43926

SEQ ID NO: 243671 - RNA, 64 nt, Homo Sapiens; identical to SEQ ID NO: 43927

SEQ ID NO: 243672 - RNA, 64 nt, Homo Sapiens; identical to SEQ ID NO: 43928

SEQ ID NO: 243673 - RNA, 64 nt, Homo Sapiens; identical to SEQ ID NO: 43929

SEQ ID NO: 243674 - RNA, 64 nt, Homo Sapiens; identical to SEQ ID NO: 43930

SEQ ID NO: 243675 - RNA, 64 nt, Homo Sapiens; identical to SEQ ID NO: 43931

SEQ ID NO: 243676 - RNA, 64 nt, Homo Sapiens; identical to SEQ ID NO: 43932

SEQ ID NO: 243677 - RNA, 64 nt, Homo Sapiens; identical to SEQ ID NO: 43933

SEQ ID NO: 243678 - RNA, 64 nt, Homo Sapiens; identical to SEQ ID NO: 43934

SEQ ID NO: 243679 - RNA, 64 nt, Homo Sapiens; identical to SEQ ID NO: 43935

SEQ ID NO: 243680 - RNA, 64 nt, Homo Sapiens; identical to SEQ ID NO: 43936

SEQ ID NO: 243681 - RNA, 64 nt, Homo Sapiens; identical to SEQ ID NO: 43937

SEQ ID NO: 243682 - RNA, 64 nt, Homo Sapiens; identical to SEQ ID NO: 43938

SEQ ID NO: 243683 - RNA, 64 nt, Homo Sapiens; identical to SEQ ID NO: 43939

SEQ ID NO: 243684 - RNA, 64 nt, Homo Sapiens; identical to SEQ ID NO: 43940

SEQ ID NO: 243685 - RNA, 64 nt, Homo Sapiens; identical to SEQ ID NO: 43941

SEQ ID NO: 243686 - RNA, 64 nt, Homo Sapiens; identical to SEQ ID NO: 43942

SEQ ID NO: 243687 - RNA, 64 nt, Homo Sapiens; identical to SEQ ID NO: 43943

SEQ ID NO: 243688 - RNA, 64 nt, Homo Sapiens; identical to SEQ ID NO: 43944

SEQ ID NO: 243689 - RNA, 64 nt, Homo Sapiens; identical to SEQ ID NO: 43945

SEQ ID NO: 243690 - RNA, 64 nt, Homo Sapiens; identical to SEQ ID NO: 43946

SEQ ID NO: 243691 - RNA, 64 nt, Homo Sapiens; identical to SEQ ID NO: 43947

SEQ ID NO: 243692 - RNA, 64 nt, Homo Sapiens; identical to SEQ ID NO: 43948

SEQ ID NO: 243693 - RNA, 64 nt, Homo Sapiens; identical to SEQ ID NO: 189763

SEQ ID NO: 243694 - RNA, 64 nt, Homo Sapiens; identical to SEQ ID NO: 189764

SEQ ID NO: 243695 - RNA, 64 nt, Homo Sapiens; identical to SEQ ID NO: 189765

SEQ ID NO: 243696 - RNA, 64 nt, Homo Sapiens; identical to SEQ ID NO: 189766

SEQ ID NO: 243697 - RNA, 64 nt, Homo Sapiens; identical to SEQ ID NO: 189767

SEQ ID NO: 243698 - RNA, 64 nt, Homo Sapiens; identical to SEQ ID NO: 189768

SEQ ID NO: 243699 - RNA, 64 nt, Homo Sapiens; identical to SEQ ID NO: 189769

SEQ ID NO: 243700 - RNA, 64 nt, Homo Sapiens; identical to SEQ ID NO: 189770

SEQ ID NO: 243701 - RNA, 64 nt, Homo Sapiens; identical to SEQ ID NO: 189771

SEQ ID NO: 243702 - RNA, 64 nt, Homo Sapiens; identical to SEQ ID NO: 189772

SEQ ID NO: 243703 - RNA, 64 nt, Homo Sapiens; identical to SEQ ID NO: 189773

SEQ ID NO: 243704 - RNA, 64 nt, Homo Sapiens; identical to SEQ ID NO: 189774

SEQ ID NO: 243705 - RNA, 64 nt, Homo Sapiens; identical to SEQ ID NO: 189775

SEQ ID NO: 243706 - RNA, 64 nt, Homo Sapiens; identical to SEQ ID NO: 189776

SEQ ID NO: 243707 - RNA, 64 nt, Homo Sapiens; identical to SEQ ID NO: 189777

SEQ ID NO: 243708 - RNA, 64 nt, Homo Sapiens; identical to SEQ ID NO: 189778

SEQ ID NO: 243709 - RNA, 64 nt, Homo Sapiens; identical to SEQ ID NO: 189779

SEQ ID NO: 243710 - RNA, 64 nt, Homo Sapiens; identical to SEQ ID NO: 189780

SEQ ID NO: 243711 - RNA, 64 nt, Homo Sapiens; identical to SEQ ID NO: 189781

SEQ ID NO: 243712 - RNA, 64 nt, Homo Sapiens; identical to SEQ ID NO: 189782

SEQ ID NO: 243713 - RNA, 64 nt, Homo Sapiens; identical to SEQ ID NO: 189783

SEQ ID NO: 243714 - RNA, 64 nt, Homo Sapiens
guguuuucccguagccaccaaccgcuaaaaugcacgccaucaucgagcgcacggccagcuucgu

SEQ ID NO: 243715 - RNA, 64 nt, Homo Sapiens
gacucuucuccugcagugcacuugcccccguggccgccaucauccccccgccccccgacgucca

SEQ ID NO: 243716 - RNA, 64 nt, Homo Sapiens; identical to SEQ ID NO: 100251

SEQ ID NO: 243717 - RNA, 64 nt, Homo Sapiens; identical to SEQ ID NO: 100252

SEQ ID NO: 243718 - RNA, 64 nt, Homo Sapiens; identical to SEQ ID NO: 100253

SEQ ID NO: 243719 - RNA, 64 nt, Homo Sapiens; identical to SEQ ID NO: 100254

SEQ ID NO: 243720 - RNA, 64 nt, Homo Sapiens; identical to SEQ ID NO: 100255

SEQ ID NO: 243721 - RNA, 64 nt, Homo Sapiens; identical to SEQ ID NO: 100256

SEQ ID NO: 243722 - RNA, 64 nt, Homo Sapiens; identical to SEQ ID NO: 100257

SEQ ID NO: 243723 - RNA, 64 nt, Homo Sapiens; identical to SEQ ID NO: 100258

SEQ ID NO: 243724 - RNA, 64 nt, Homo Sapiens; identical to SEQ ID NO: 100259

SEQ ID NO: 243725 - RNA, 64 nt, Homo Sapiens; identical to SEQ ID NO: 100260

SEQ ID NO: 243726 - RNA, 64 nt, Homo Sapiens; identical to SEQ ID NO: 100261

SEQ ID NO: 243727 - RNA, 64 nt, Homo Sapiens; identical to SEQ ID NO: 100262

SEQ ID NO: 243728 - RNA, 64 nt, Homo Sapiens; identical to SEQ ID NO: 100263

SEQ ID NO: 243729 - RNA, 64 nt, Homo Sapiens; identical to SEQ ID NO: 100264

SEQ ID NO: 243730 - RNA, 64 nt, Homo Sapiens; identical to SEQ ID NO: 100265

SEQ ID NO: 243731 - RNA, 64 nt, Homo Sapiens; identical to SEQ ID NO: 100266

SEQ ID NO: 243732 - RNA, 64 nt, Homo Sapiens; identical to SEQ ID NO: 100267

SEQ ID NO: 243733 - RNA, 64 nt, Homo Sapiens; identical to SEQ ID NO: 100268

SEQ ID NO: 243734 - RNA, 64 nt, Homo Sapiens; identical to SEQ ID NO: 100269

SEQ ID NO: 243735 - RNA, 64 nt, Homo Sapiens; identical to SEQ ID NO: 100270

SEQ ID NO: 243736 - RNA, 64 nt, Homo Sapiens; identical to SEQ ID NO: 100271

SEQ ID NO: 243737 - RNA, 64 nt, Homo Sapiens; identical to SEQ ID NO: 100272

SEQ ID NO: 243738 - RNA, 64 nt, Homo Sapiens; identical to SEQ ID NO: 100273

SEQ ID NO: 243739 - RNA, 64 nt, Homo Sapiens; identical to SEQ ID NO: 100274

SEQ ID NO: 243740 - RNA, 64 nt, Homo Sapiens; identical to SEQ ID NO: 100275

SEQ ID NO: 243741 - RNA, 64 nt, Homo Sapiens; identical to SEQ ID NO: 100276

SEQ ID NO: 243742 - RNA, 64 nt, Homo Sapiens; identical to SEQ ID NO: 100277

SEQ ID NO: 243743 - RNA, 64 nt, Homo Sapiens; identical to SEQ ID NO: 100278

SEQ ID NO: 243744 - RNA, 64 nt, Homo Sapiens; identical to SEQ ID NO: 100279

SEQ ID NO: 243745 - RNA, 64 nt, Homo Sapiens; identical to SEQ ID NO: 100280

SEQ ID NO: 243746 - RNA, 64 nt, Homo Sapiens; identical to SEQ ID NO: 100281

SEQ ID NO: 243747 - RNA, 64 nt, Homo Sapiens; identical to SEQ ID NO: 100282

SEQ ID NO: 243748 - RNA, 64 nt, Homo Sapiens; identical to SEQ ID NO: 100283

SEQ ID NO: 243749 - RNA, 64 nt, Homo Sapiens; identical to SEQ ID NO: 100284

SEQ ID NO: 243750 - RNA, 64 nt, Homo Sapiens; identical to SEQ ID NO: 100285

SEQ ID NO: 243751 - RNA, 64 nt, Homo Sapiens; identical to SEQ ID NO: 100286

SEQ ID NO: 243752 - RNA, 64 nt, Homo Sapiens; identical to SEQ ID NO: 100287

SEQ ID NO: 243753 - RNA, 64 nt, Homo Sapiens; identical to SEQ ID NO: 100288

SEQ ID NO: 243754 - RNA, 64 nt, Homo Sapiens; identical to SEQ ID NO: 100289

SEQ ID NO: 243755 - RNA, 64 nt, Homo Sapiens; identical to SEQ ID NO: 100290

SEQ ID NO: 243756 - RNA, 64 nt, Homo Sapiens; identical to SEQ ID NO: 100291

SEQ ID NO: 243757 - RNA, 64 nt, Homo Sapiens; identical to SEQ ID NO: 100292

SEQ ID NO: 243758 - RNA, 64 nt, Homo Sapiens; identical to SEQ ID NO: 100293

SEQ ID NO: 243759 - RNA, 64 nt, Homo Sapiens; identical to SEQ ID NO: 100294

SEQ ID NO: 243760 - RNA, 64 nt, Homo Sapiens; identical to SEQ ID NO: 100295

SEQ ID NO: 243761 - RNA, 64 nt, Homo Sapiens; identical to SEQ ID NO: 100296

SEQ ID NO: 243762 - RNA, 64 nt, Homo Sapiens; identical to SEQ ID NO: 100297

SEQ ID NO: 243763 - RNA, 64 nt, Homo Sapiens; identical to SEQ ID NO: 100298

SEQ ID NO: 243764 - RNA, 64 nt, Homo Sapiens; identical to SEQ ID NO: 100299

SEQ ID NO: 243765 - RNA, 64 nt, Homo Sapiens; identical to SEQ ID NO: 100300

SEQ ID NO: 243766 - RNA, 64 nt, Homo Sapiens; identical to SEQ ID NO: 100301

SEQ ID NO: 243767 - RNA, 64 nt, Homo Sapiens; identical to SEQ ID NO: 100302

SEQ ID NO: 243768 - RNA, 64 nt, Homo Sapiens; identical to SEQ ID NO: 100303

SEQ ID NO: 243769 - RNA, 64 nt, Homo Sapiens
uuaccucaaguugcuuggcagcacaacuaucuuugcaaaaaaaaguaaagaaaaaguaaaugau

SEQ ID NO: 243770 - RNA, 64 nt, Homo Sapiens
ugaauaaucaaagugauuuuucagaauuaugugugcaaaaaauuaaugugcauucauauauucu

SEQ ID NO: 243771 - RNA, 64 nt, Homo Sapiens
aaaaaaaaaaaaaucucagaaaaaauagaaaauugcaaaaaaaaguugaugagcuuaaaaaaau

SEQ ID NO: 243772 - RNA, 64 nt, Homo Sapiens
gaagugagucagagcccauucaaaaccuaucuuggcaaaaaaaguuuagaaaaaaacaacaaag

SEQ ID NO: 243773 - RNA, 64 nt, Homo Sapiens
ucaaauuuuuuucagcagugacaaauacaaacaagcaaaaaacccucauuugaaguuggcaaaa

SEQ ID NO: 243774 - RNA, 64 nt, Homo Sapiens
aaauuacauuaugcccuugaaugcuaaguaaggggcaaaaaaaauaaugggcugcugucauuuu

SEQ ID NO: 243775 - RNA, 64 nt, Homo Sapiens
gcaucgauccccagccuggucaacugggaaauaagcaaaaaacuguguuuucgagcaggacuaa

SEQ ID NO: 243776 - RNA, 64 nt, Homo Sapiens
acaguguugaaauuggaaaggucuuccuguaguggcaaaaaagaguguuauaacaccaucugga

SEQ ID NO: 243777 - RNA, 64 nt, Homo Sapiens
uuugaugggauuuuaaauucauuuaugcuuaagagcaaaaaaguauauguaugcuauuuguugu

SEQ ID NO: 243778 - RNA, 64 nt, Homo Sapiens
auuguagcuuuaaaauaacauugcaacugauuuugcaaaaaaaagccuggcuuguuuugucucu

SEQ ID NO: 243779 - RNA, 64 nt, Homo Sapiens
gcacaauaauuuaacugaaaaaccuagaaauuaagcaaaaaauacaugauaaacacgcaaaaaa

SEQ ID NO: 243780 - RNA, 64 nt, Homo Sapiens
ccuagaaauuaagcaaaaaagacaugauaaacacgcaaaaaaaacugcccacuuuaccuacgga

SEQ ID NO: 243781 - RNA, 64 nt, Homo Sapiens
gcacaucaacugcgaaguuauagcacuuuuaauagcaaaaaaagagacauuuuagcauguuaaa

SEQ ID NO: 243782 - RNA, 64 nt, Homo Sapiens
ccacaugaauaaagcaauaauaccacagugccuugcaaaaaacaauuccaaguuuucuagucca

SEQ ID NO: 243783 - RNA, 64 nt, Homo Sapiens
augauauguacuauagugauucuguuuuugaggugcaaaaaacauacauauauaccaguuggua

SEQ ID NO: 243784 - RNA, 64 nt, Homo Sapiens
aggagaugcuuauagaugauaguuguacauaugugcaaaaaaaaauccacuugcaaugguaaga

SEQ ID NO: 243785 - RNA, 64 nt, Homo Sapiens
aaugauauuuuaggaauaacggacuuuuaaagaagcaaaaaaaaagacugaauuuccuugcuua

SEQ ID NO: 243786 - RNA, 64 nt, Homo Sapiens
ucauguuuaauuuguauuuguaaaaaaacaaaaagcaaaaaaauucccaaaacccagauaacaa

SEQ ID NO: 243787 - RNA, 64 nt, Homo Sapiens
agcccaaagauuacauguugguguucaaaguguagcaaaaaaugauguauauuuauaaaucuau

SEQ ID NO: 243788 - RNA, 64 nt, Homo Sapiens
gccaagccauguaaaagaucuacuuuuucuaagggcaaaaaaaaaaaaaaaaaaaaaagaacac

SEQ ID NO: 243789 - RNA, 64 nt, Homo Sapiens
auuaccuggucauuuugugaucacaagagucuaugcaaaaaaaaaaauuucuuuaccccagauu

SEQ ID NO: 243790 - RNA, 64 nt, Homo Sapiens
uacuacagaucuggauggcuauucagauaacauggcaaaaaaugauagcagaagaucauuaaaa

SEQ ID NO: 243791 - RNA, 64 nt, Homo Sapiens
acauuuggacagauccugucauuguuuaagcugagcaaaaaaccacacaaaaguuguguaagag

SEQ ID NO: 243792 - RNA, 64 nt, Homo Sapiens
uccugacauaguaaaguuugcuuucauaacugcagcaaaaaaggucaacuugccaagucacugc

SEQ ID NO: 243793 - RNA, 64 nt, Homo Sapiens
cuauuaaccuauauaaccauaugaauuuugaaaagcaaaaaauaaguaauagacaucaccagca

SEQ ID NO: 243794 - RNA, 64 nt, Homo Sapiens
caaaaauuagcuggguaugggaaacacugucucugcaaaaaauaaccagccuggacaacauagu

SEQ ID NO: 243795 - RNA, 64 nt, Homo Sapiens
gacuuggauauaugguugaagaaucaaaacaaaagcaaaaaaaaaaagcaaaaaaagaaaagag

SEQ ID NO: 243796 - RNA, 64 nt, Homo Sapiens
gguugaagaaucaaaacaaaagcaaaaaaaaaaagcaaaaaaagaaaagagaaaaaaagaaaaa

SEQ ID NO: 243797 - RNA, 64 nt, Homo Sapiens
auuuuuucaaagaaaaauuuauuaaugggccaaugcaaaaaaucuucauuauuuaucuauguuu

SEQ ID NO: 243798 - RNA, 64 nt, Homo Sapiens
aaccuuugcuuuuuuuuuuucaacaaaagacaaagcaaaaaauacaauucucaugcuaaaaaua

SEQ ID NO: 243799 - RNA, 64 nt, Homo Sapiens
aaaagucaaaccaaacuuccaccccccgccccccgcaaaaaagucuagucaauucugaaccacc

SEQ ID NO: 243800 - RNA, 64 nt, Homo Sapiens
auucacgcuuggugugaauauuuaacuuuugcuggcaaaaaaaagaaagagguuucuuugaugu

SEQ ID NO: 243801 - RNA, 64 nt, Homo Sapiens
ugaaaugugaacugaacaggagaaaaaaagaaaagcaaaaaacuccuguaacccuugagauuaa

SEQ ID NO: 243802 - RNA, 64 nt, Homo Sapiens
uuucaggcuaaugauuaccucuuauucucuacaugcaaaaaauuaaauauuuuguguucaaaua

SEQ ID NO: 243803 - RNA, 64 nt, Homo Sapiens
gagauggaacuucaggucuuaagugcaaaucaaagcaaaaaacaaacaaaacuuacauggaaaa

SEQ ID NO: 243804 - RNA, 64 nt, Homo Sapiens
uccuaggcaacagagcgagacucugucuccccccgcaaaaaaaaaaaagaaagaaagaaagaga

SEQ ID NO: 243805 - RNA, 64 nt, Homo Sapiens
guacacauaacauggguuauuuaguuuaacucuggcaaaaaaaaaaaaaaaaauuuuguauguu

SEQ ID NO: 243806 - RNA, 64 nt, Homo Sapiens
uaacucaaaguguuucuuaagggugaguuggcaugcaaaaaauuacauugauuacaguguguuu

SEQ ID NO: 243807 - RNA, 64 nt, Homo Sapiens
cugucguuaaaacugaggaucuugcaauauuuuugcaaaaaaauaccuacaaaaauaaacugaa

SEQ ID NO: 243808 - RNA, 64 nt, Homo Sapiens
acuaagauguacgggucuuggaaaaagcaaaacugcaaaaaaguuucacagcuaugacaaaacc

SEQ ID NO: 243809 - RNA, 64 nt, Homo Sapiens
aaacuuuucauguagcguaucacauaacuuuuuugcaaaaaauauaaaaagaaauaaacuucaa

SEQ ID NO: 243810 - RNA, 64 nt, Homo Sapiens
ugaaugaaaauauguggacugucauuuuguugcagcaaaaaaguguuaauaaaaugcucuauuu

SEQ ID NO: 243811 - RNA, 64 nt, Homo Sapiens
ucuuauggcggaguuuuuuguuuuaaaaaaaaaugcaaaaaaaucgauguaagugucgauguuu

SEQ ID NO: 243812 - RNA, 64 nt, Homo Sapiens
ggugggugggaugaaacauguuaggucugggagggcaaaaaagacaauuaauuugcuucuguuu

SEQ ID NO: 243813 - RNA, 64 nt, Homo Sapiens
uauauauauaccuauauuuauucucccugccaaggcaaaaaauauugcaaaaaaugauaugagu

SEQ ID NO: 243814 - RNA, 64 nt, Homo Sapiens
auaugaguuucucccugccauuauuuuuaugauugcaaaaaaugauguuuuuauuuuauuuugc

SEQ ID NO: 243815 - RNA, 64 nt, Homo Sapiens
aauucuuuugaauuguuacaucaugcuggaaccugcaaaaaauacuuuuucuaaugaggagaga

SEQ ID NO: 243816 - RNA, 64 nt, Homo Sapiens
aguuaauagauuuuuucagacuugucaagccugugcaaaaaaauuaaaauggaugccuugaaua

SEQ ID NO: 243817 - RNA, 64 nt, Homo Sapiens
uuuucaaaauagaaaaguuauuagugguuuaucagcaaaaaaguccaauuuuaauuuaguaaau

SEQ ID NO: 243818 - RNA, 64 nt, Homo Sapiens
accccagcuauugucuguuguguucagcugagaugcaaaaaagaaauuaagcaaaaaagaaaaa

SEQ ID NO: 243819 - RNA, 64 nt, Homo Sapiens
guuguguucagcugagaugcaaaaaagaaauuaagcaaaaaagaaaaagaugaagacuuuucau

SEQ ID NO: 243820 - RNA, 64 nt, Homo Sapiens
uaaauucuauugaaaaaggaaaaucagcaauucagcaaaaaauaaauaaaaaauaaaaauguaa

SEQ ID NO: 243821 - RNA, 64 nt, Homo Sapiens
ugugaccgaccccuuggccaaaaaaaaacaaaaagcaaaaaacaaaaaccuacccuguucuggu

SEQ ID NO: 243822 - RNA, 64 nt, Homo Sapiens
ucuaugacagagcaaugcuuuuaaugaauuuaaggcaaaaaagguggagagggagaugugugag

SEQ ID NO: 243823 - RNA, 64 nt, Homo Sapiens
aauaaacguggauuuuaaaaaaucaaucaauggugcaaaaaaaaacuuaaagcaaaauaguauu

SEQ ID NO: 243824 - RNA, 64 nt, Homo Sapiens
guaauggcaaaguuugccaaucaguuuggauucugcaaaaaaggucaaggaaccagggaugaaa

SEQ ID NO: 243825 - RNA, 64 nt, Homo Sapiens
aaaauaacucuccugaacauacagcuauaauuuugcaaaaaaggcuuguauuuuacagaugcaa

SEQ ID NO: 243826 - RNA, 55 nt, Homo Sapiens; identical to SEQ ID NO: 113265

SEQ ID NO: 243827 - RNA, 64 nt, Homo Sapiens; identical to SEQ ID NO: 113266

SEQ ID NO: 243828 - RNA, 64 nt, Homo Sapiens; identical to SEQ ID NO: 113267

SEQ ID NO: 243829 - RNA, 64 nt, Homo Sapiens; identical to SEQ ID NO: 113268

SEQ ID NO: 243830 - RNA, 64 nt, Homo Sapiens; identical to SEQ ID NO: 113269

SEQ ID NO: 243831 - RNA, 64 nt, Homo Sapiens; identical to SEQ ID NO: 113270

SEQ ID NO: 243832 - RNA, 64 nt, Homo Sapiens; identical to SEQ ID NO: 113271

SEQ ID NO: 243833 - RNA, 64 nt, Homo Sapiens; identical to SEQ ID NO: 113272

SEQ ID NO: 243834 - RNA, 64 nt, Homo Sapiens; identical to SEQ ID NO: 113273

SEQ ID NO: 243835 - RNA, 64 nt, Homo Sapiens; identical to SEQ ID NO: 113274

SEQ ID NO: 243836 - RNA, 64 nt, Homo Sapiens; identical to SEQ ID NO: 113275

SEQ ID NO: 243837 - RNA, 64 nt, Homo Sapiens; identical to SEQ ID NO: 113276

SEQ ID NO: 243838 - RNA, 64 nt, Homo Sapiens; identical to SEQ ID NO: 113277

SEQ ID NO: 243839 - RNA, 64 nt, Homo Sapiens; identical to SEQ ID NO: 113278

SEQ ID NO: 243840 - RNA, 64 nt, Homo Sapiens
uucuauauaaacuguaguaucuucaugaagacccaaggcucaaauuuacuguccuuaaaaacaa

SEQ ID NO: 243841 - RNA, 64 nt, Homo Sapiens
aauuucuuuuaucacuaucucaacugaggaagaaaaggcucaccacaaguggugugaaggcuuu

SEQ ID NO: 243842 - RNA, 64 nt, Homo Sapiens
ucuuuugcccaggauggaguacaguggcauggucaaggcucacugcagcuucaaucuucugggc

SEQ ID NO: 243843 - RNA, 64 nt, Homo Sapiens
ucaucucuuuuaaauagaauccucuuccaccaucaaggcucaacauuuuguaagcauccaaaaa

SEQ ID NO: 243844 - RNA, 64 nt, Homo Sapiens
guuaccuguacgcuguauuaaaauagaaccaggaaaggcucaggauuucagacauuucaucagc

SEQ ID NO: 243845 - RNA, 64 nt, Homo Sapiens
uagaugagaguucuuuggggcuuauuuucuggguaaggcucaucuuuaaaaacuggcuucagag

SEQ ID NO: 243846 - RNA, 64 nt, Homo Sapiens
caucaaagauuuucaguuaaaguagcauuauguaaaggcucaaaacauuacccuaacaaaguaa

SEQ ID NO: 243847 - RNA, 64 nt, Homo Sapiens
ucccucugacucuagugcacugaugaucucugauaaggcucagcugcuuuauaguucucuggcu

SEQ ID NO: 243848 - RNA, 64 nt, Homo Sapiens
ggcuccuugcagcagggcugggccugcgagacccaaggcucacugcagcgcgcuccugaccccu

SEQ ID NO: 243849 - RNA, 64 nt, Homo Sapiens
aggccaguguugugggcuuccugcugggacugagaaggcucacgaagggcauccgcaauguugg

SEQ ID NO: 243850 - RNA, 64 nt, Homo Sapiens
aauaacacuucguaagcaacgaguucaccuaaguaaggcucagauccuaguuuuaaaaaccauu

SEQ ID NO: 243851 - RNA, 64 nt, Homo Sapiens
gagccuggagcauuguguguggugaaguaaaauaaaggcucaaaacgugacggcaacccggcaa

SEQ ID NO: 243852 - RNA, 64 nt, Homo Sapiens
aggaauggugcguggcuuccuauuuuuuugauucaaggcucagagaaugcugcuuucugcuuag

SEQ ID NO: 243853 - RNA, 64 nt, Homo Sapiens
uuucugcccggcuacaucagggugugacucuagcaaggcucaucuuggagcaaucagaacuuca

SEQ ID NO: 243854 - RNA, 64 nt, Homo Sapiens
ucaccccuguucagaugaauuuccagaaagagcuaaggcucauaagguucccuuuuaaguauua

SEQ ID NO: 243855 - RNA, 64 nt, Homo Sapiens
aagcuagaggaaguaugugauauacacauggacuaaggcucaggugacacuauggcuagauuaa

SEQ ID NO: 243856 - RNA, 64 nt, Homo Sapiens
ucuccccggccuugacuuuugggcugcaagacugagccuaaauggaggugggaacuggaggagu

SEQ ID NO: 243857 - RNA, 64 nt, Homo Sapiens
caacugcaggacaagccuccaugcagagcccauuagccuaaaagugaggguauacccaaagcug

SEQ ID NO: 243858 - RNA, 64 nt, Homo Sapiens
uguccagcuuccaaagccuagacaaccuuucuguagccuaaaacgaauggucuuugcuccagau

SEQ ID NO: 243859 - RNA, 64 nt, Homo Sapiens
uuuuuugaggagaagggggucucuguuaacaucuagccuaaaguauacaacugccuggggggca

SEQ ID NO: 243860 - RNA, 64 nt, Homo Sapiens
gcauuuaguuacaaccugaaggaauaaaaugauuuguggaaaugcuuaaaauagaccuaacuga

SEQ ID NO: 243861 - RNA, 64 nt, Homo Sapiens
acagucucaucuugccgcgccuggcuuaccuaucuguggaaagcuaggcuucccaggcugggcu

SEQ ID NO: 243862 - RNA, 64 nt, Homo Sapiens
ggagagcuacgugguggccguggcagaggccauuuguggaaagucauggagguucuucccaagc

SEQ ID NO: 243863 - RNA, 64 nt, Homo Sapiens
ggggcacacacagaugauucagcccuggggaugauguggaaauaugagccccuugcccaccuga

SEQ ID NO: 243864 - RNA, 64 nt, Homo Sapiens
aucagaguaaggcucucccccagugggcagugcauguggaaagugauggaguuaaacuugaugc

SEQ ID NO: 243865 - RNA, 64 nt, Homo Sapiens
cagaggaaaaaugauccagugaaagccucauuuguguggaaagucugugguugcaaaacccacg

SEQ ID NO: 243866 - RNA, 64 nt, Homo Sapiens
aacucaccuggcaucuuacagagcuuaagaaauuuguggaaaauaaauuuuuuuuuccaguaau

SEQ ID NO: 243867 - RNA, 64 nt, Homo Sapiens
uaugauccaacuagaaaugacaugccaucaguuguguggaaauggugguggcuuugaugguucu

SEQ ID NO: 243868 - RNA, 64 nt, Homo Sapiens
ucauuuaaaauaaucugauuucagacaaaugcuguguggaaacaucuauccuauagaucauccu

SEQ ID NO: 243869 - RNA, 64 nt, Homo Sapiens
gaaaacguagccuucauuuuaugauuuuuucauauguggaaaucuauuacauguaauacaaaac

SEQ ID NO: 243870 - RNA, 64 nt, Homo Sapiens
auuagaaacuacagaguuugauuagaaacuucuauguggaaaauguugguacuauguggaaaau

SEQ ID NO: 243871 - RNA, 64 nt, Homo Sapiens
auuagaaacuucuauguggaagcuguugguacuauguggaaaaucuuucauaucuuggauuugc

SEQ ID NO: 243872 - RNA, 64 nt, Homo Sapiens
uucuuucgaguuuguuuuugguuuuguugaacuuuguggaaacaaaguaacuuauuucugcacu

SEQ ID NO: 243873 - RNA, 64 nt, Homo Sapiens
aaacuaguuaaauuuacuauugaaauguucguuuuguggaaaagccguuacuuaaaaagaaguc

SEQ ID NO: 243874 - RNA, 64 nt, Homo Sapiens
ucaaucugaagauacaugucuuucuccagggacauguggaaaaaaaaaagauguuauacaacca

SEQ ID NO: 243875 - RNA, 64 nt, Homo Sapiens
uaacaagaaacuacugaauucucuguuugucuguuguggaaauaaaaccuucuggggaugaauc

SEQ ID NO: 243876 - RNA, 64 nt, Homo Sapiens
gaaaaaucugaauuccuguccugaccuucugugauguggaaacccuaggcucugagacacacuc

SEQ ID NO: 243877 - RNA, 64 nt, Homo Sapiens
ugcauauaguuacaguaguguauaaauuaaauauuguggaaaaacagucuuguauuuuucugua

SEQ ID NO: 243878 - RNA, 64 nt, Homo Sapiens
ucauggggaggucagugugcaauaaaguagguacuguggaaaauauacuuuguggaaaguguua

SEQ ID NO: 243879 - RNA, 64 nt, Homo Sapiens
guuaaauaaaguagguacugaggacaggauacuuuguggaaagucauucuacaaaaagccuaga

SEQ ID NO: 243880 - RNA, 64 nt, Homo Sapiens
gucauguagcugacacucaaauaugcaggugaauuguggaaaauaugauuuuuuacaacaccag

SEQ ID NO: 243881 - RNA, 64 nt, Homo Sapiens
aacacagggcaauagaaacaguucagcucucugcuguggaaaguugugccuuagaagcgugaca

SEQ ID NO: 243882 - RNA, 64 nt, Homo Sapiens
cuggacuuggcucagugcuaacucugcugcaguuuguggaaauguugcuugguaguguuuuaug

SEQ ID NO: 243883 - RNA, 64 nt, Homo Sapiens
uaaaauauauucaaauguauauugagaaguaauauguggaaaauguggcuguuuuaauuuuuaa

SEQ ID NO: 243884 - RNA, 64 nt, Homo Sapiens
uggaaugaaaugcaauucauugagcuuuaugaucuguggaaauucuaggauucagcuaaauuuc

SEQ ID NO: 243885 - RNA, 64 nt, Homo Sapiens
agccagagugacaagugacauuuaaaaaccauguuguggaaaaaugaagcucauauuguaucuu

SEQ ID NO: 243886 - RNA, 64 nt, Homo Sapiens
ugguugaaauaucuugguauccaggauaaggguauguggaaaaacaggcuuuaggcaaguggaa

SEQ ID NO: 243887 - RNA, 64 nt, Homo Sapiens
agaggagacuggccccacuucuaugggucugagcuguggaaaagggagagcagagaggaacuga

SEQ ID NO: 243888 - RNA, 64 nt, Homo Sapiens
uuguuagcacacaggacacuuccuuguugucuuuuguggaaagggcaaguaccacuaauagggu

SEQ ID NO: 243889 - RNA, 64 nt, Homo Sapiens
cuacccaaagucauaaauauauucuuuacugccuuguggaaauuuuauaguuuugccuuucaca

SEQ ID NO: 243890 - RNA, 51 nt, Homo Sapiens
accuuaacccaccuaaguaaauguggaaacauccgauauaaaucucauagu

SEQ ID NO: 243891 - RNA, 64 nt, Homo Sapiens
cucuacaaauucccucuugguguaaaauucaagauguggaaauucuaacuuuuuugaaauuuaa

SEQ ID NO: 243892 - RNA, 64 nt, Homo Sapiens
gggacucuuggaaucaggagacaaagcuaccacauguggaaagguacuauguguccaugucauu

SEQ ID NO: 243893 - RNA, 64 nt, Homo Sapiens
cuaaagcucccugagaacaguuggcauucagcaauguggaaauuaauuccaugacuuguggaau

SEQ ID NO: 243894 - RNA, 64 nt, Homo Sapiens
ccaugacuuguggaauuuggagugaagagagauguguggaaauuuagacagaagaagucagaga

SEQ ID NO: 243895 - RNA, 64 nt, Homo Sapiens
ucauuucagagaaaagcccuauacguguagugaauguggaaaagacuucagauugaauucacau

SEQ ID NO: 243896 - RNA, 64 nt, Homo Sapiens
ucacacaggagagaaagcacaugaauguaaugaauguggaaaagcuuucagucaaaccucaugc

SEQ ID NO: 243897 - RNA, 64 nt, Homo Sapiens
uuucagauuaaaugauaguaagacaaagaaagguuguggaaaugaaaaaugucaaugucauaga

SEQ ID NO: 243898 - RNA, 64 nt, Homo Sapiens
gaauagaauugguauaaauugcaagaaagaaccauguggaaaugcaaauaugaaaugagggaag

SEQ ID NO: 243899 - RNA, 64 nt, Homo Sapiens
ucauauaagacagaaacccuauggguguaaugaauguggaaaaucauucugugugaagucaaga

SEQ ID NO: 243900 - RNA, 64 nt, Homo Sapiens
guugaguugcaggauaucuagcaauuuaagaaaauguggaaaaaauauuuuuauugagaaauag

SEQ ID NO: 243901 - RNA, 64 nt, Homo Sapiens
gucuuagguuggcauucaggucacaugaaagguguguggaaaguggccagcauucugccugcag

SEQ ID NO: 243902 - RNA, 63 nt, Homo Sapiens
agggcauggcauauuguuggugcauaauaaauauuguggaaauaauuucugugugagaagcug

SEQ ID NO: 243903 - RNA, 64 nt, Homo Sapiens
agcagguaaaaugaauucuuucacauaacuagcuuguggaaaccuauuguuuguaaaacauggu

SEQ ID NO: 243904 - RNA, 64 nt, Homo Sapiens
cucuauuauccaauuaacuuguuucuacuugaauuguggaaaagaauuauccaguuucuucugu

SEQ ID NO: 243905 - RNA, 64 nt, Homo Sapiens
aaagaugauaaaaaauaauuuuaaugguucuuaauguggaaauucacaacauacucaacuuuug

SEQ ID NO: 243906 - RNA, 64 nt, Homo Sapiens
gccaaguauuauuuugcuacuuaccguguuauucuguggaaagaaaaaccuguaaaguguuuaa

SEQ ID NO: 243907 - RNA, 64 nt, Homo Sapiens
gagaaagcucgaggugaaguuuuaaaaaaaaaguuguggaaaggaaaguuccaaagaggugguu

SEQ ID NO: 243908 - RNA, 64 nt, Homo Sapiens
aauaacaucuugaguuauuuuuaauucagggggauguggaaagguuugcaauugucaaguguuu

SEQ ID NO: 243909 - RNA, 64 nt, Homo Sapiens
accugccccacaugaaaaggacaccaaagaaagcuguggaaagguuuuuucuuuuaaugaagaa

SEQ ID NO: 243910 - RNA, 64 nt, Homo Sapiens
cgagcagaaaacuccggcggugggguuugacaacuguggaaaggauauaccaagugacugugug

SEQ ID NO: 243911 - RNA, 64 nt, Homo Sapiens
cacacacacacacaaacaauccaguguuuugucauguggaaaaucaaaacaaguuagaaagcau

SEQ ID NO: 243912 - RNA, 64 nt, Homo Sapiens
gagguucuguuauuaaagaaacaaugugaaauaauguggaaauuaauacugauaaagacuauca

SEQ ID NO: 243913 - RNA, 64 nt, Homo Sapiens
gcauggccuauuaaguuggcuggagaguguuuuauguggaaauauuuucaagauaauguuccuu

SEQ ID NO: 243914 - RNA, 64 nt, Homo Sapiens
aauaaggaaugauuugaauguaauuuugugaauguguggaaaauauaaagcagggauuuagccu

SEQ ID NO: 243915 - RNA, 64 nt, Homo Sapiens
aaaacugugccuggacccucccucuuggugggucuguggaaacauaagcgguuuuuuuaauggg

SEQ ID NO: 243916 - RNA, 64 nt, Homo Sapiens
uccuaggaaacgguucaugugucacuuuucaggauguggaaacacugagccauacacccuccau

SEQ ID NO: 243917 - RNA, 64 nt, Homo Sapiens
aagauucaggcccugagaggugcaucauuuaucuuguggaaaaguuuccuguguguguggccuu

SEQ ID NO: 243918 - RNA, 64 nt, Homo Sapiens
gguguucauuuuuuuugggguguguguguguauguguggaaaaugccacaggaaacaaacuuua

SEQ ID NO: 243919 - RNA, 64 nt, Homo Sapiens
aaacuauauaaacuuagaaucaggcacuggguauuguggaaauaaguaaagucacccaaagagu

SEQ ID NO: 243920 - RNA, 64 nt, Homo Sapiens
aaagaaugcgaaaagauccugcauggaacuaaaauguggaaagaauucguuuuuguucuaagau

SEQ ID NO: 243921 - RNA, 64 nt, Homo Sapiens
uacauaauggagagaaacccaauagugugguaaguguggaaaagccuuuagaucauaugaaucc

SEQ ID NO: 243922 - RNA, 64 nt, Homo Sapiens
ccugcaaacuccuacaggagaaaaguuguaugaauguggaaacuuuagaaauugaaggaauuuu

SEQ ID NO: 243923 - RNA, 64 nt, Homo Sapiens
ucauacagcugagaaacccuaugaauguaaggaauguggaaaagccuucagcaggaaagaaaau

SEQ ID NO: 243924 - RNA, 64 nt, Homo Sapiens
ucauacgggugagaaacccuaugcauguacaguauguggaaaagccuuuagucagaaaucaaac

SEQ ID NO: 243925 - RNA, 64 nt, Homo Sapiens
uuauacuggagagacuucacaauuauaauaaauguguggaaaagucuucaaaaaaauuucacac

SEQ ID NO: 243926 - RNA, 64 nt, Homo Sapiens
cacugcuggugggaauguaaauuaauucagccauuguggaaagcacugcagcgauuucucaaag

SEQ ID NO: 243927 - RNA, 64 nt, Homo Sapiens
ucacacaggagaaaggccuuaugaaugcguugaguguggaaaaucauuucgccgaagcucuuca

SEQ ID NO: 243928 - RNA, 64 nt, Homo Sapiens
ucacacuggagaaaggccauaugaaugcauugauuguggaaaaucauuucgccacaguucuucg

SEQ ID NO: 243929 - RNA, 64 nt, Homo Sapiens
gaugcgugggcguucccugaucuugguuuugucauguggaaaguuuuuuugauguuggggguuc

SEQ ID NO: 243930 - RNA, 64 nt, Homo Sapiens
uggcuuauucuucuaaagcccucaagggggaugcuguggaaaccggagaaauggaaacauauca

SEQ ID NO: 243931 - RNA, 64 nt, Homo Sapiens
ccuucaguuuccuuacaggcaugaauguaaagaauguggaaaacucauacuggagagaaacccu

SEQ ID NO: 243932 - RNA, 64 nt, Homo Sapiens
cauuuagauacuacuacucauugaguguaaaaaauguggaaaagucacacuggagauaaacccu

SEQ ID NO: 243933 - RNA, 64 nt, Homo Sapiens
ccuacauaucuucuguagguaugaauguaaacaauguggaaaaaucacacuguacagaaacgcu

SEQ ID NO: 243934 - RNA, 64 nt, Homo Sapiens
cauuccgauaccaccaaucuuuaaguguaaagaauguggaaaagucacacuggagauaaacccu

SEQ ID NO: 243935 - RNA, 64 nt, Homo Sapiens
ucuugagccaucauucauccgggaaagcaguguauguggaaaaguccuucuggaggaaagcuuu

SEQ ID NO: 243936 - RNA, 64 nt, Homo Sapiens
uauuaaauuccuuuaaauguugauaucugccauuuguggaaacaacguaaauucuacuuaagug

SEQ ID NO: 243937 - RNA, 64 nt, Homo Sapiens
uugagagugguucaguugucuuuaauguuugucauguggaaauggaaguagccucuuuuuguuc

SEQ ID NO: 243938 - RNA, 64 nt, Homo Sapiens
uuguacuuuauuacgaguaaaguguaaugaguacuguggaaaccaaauuugaauacugcaaauu

SEQ ID NO: 243939 - RNA, 64 nt, Homo Sapiens
aaucuccaaauuguaguuuuuuucugauuuuuuguguggaaaaauggggcagaguguugccaau

SEQ ID NO: 243940 - RNA, 64 nt, Homo Sapiens
gggcagaguguugccaauuucuaaauuguugccauguggaaaugguggagagcucauggccugu

SEQ ID NO: 243941 - RNA, 64 nt, Homo Sapiens
uggaaggaaauugaucagaucuguaauucacaacuguggaaaccuacacaaauggggcugaugc

SEQ ID NO: 243942 - RNA, 64 nt, Homo Sapiens
uggacaguguucucaaagcaacuuucugaagccguguggaaaacugacucugugugggucccgu

SEQ ID NO: 243943 - RNA, 64 nt, Homo Sapiens
agaaaugcaagguaauuuugaucggguguucugauguggaaaaaauacaauuuauagaaauagu

SEQ ID NO: 243944 - RNA, 64 nt, Homo Sapiens
gugauucuuccuaaacuaaccuacuaccuaccauuguggaaaagaagaugauguagauguugcc

SEQ ID NO: 243945 - RNA, 64 nt, Homo Sapiens
ugaugauguguuaggauugcuacugaugcugucauguggaaacuauuuaaaggcacuauuauaa

SEQ ID NO: 243946 - RNA, 64 nt, Homo Sapiens
aaugcaaguaagacuuucugaaaacacuugaugauguggaaaugcugcaggauuaaauaacuug

SEQ ID NO: 243947 - RNA, 64 nt, Homo Sapiens
cacuuuugcagcucuuuggaauccugaacccauguguggaaaagccugaacugugcuguuggaa

SEQ ID NO: 243948 - RNA, 64 nt, Homo Sapiens
aggggaaaccugcugcuacaucaugagauagcccuguggaaagguccacaugagugaacuuuga

SEQ ID NO: 243949 - RNA, 64 nt, Homo Sapiens
cagaaucaaaaucaaaguucacaauucauucugcacgcagaagugcuuccacucuugcuccucu

SEQ ID NO: 243950 - RNA, 59 nt, Homo Sapiens
gacguacaacuucugaaagagaauggaaaacgcagaagauagagaagcaucagguguga

SEQ ID NO: 243951 - RNA, 64 nt, Homo Sapiens
gcauuuuuuuuucugaggugggaguaugucacucacagcaaacuuggaaagaaggcuaugacuc

SEQ ID NO: 243952 - RNA, 64 nt, Homo Sapiens
uccucuauuucuguuucaacucucgucuaauccaacagcaaauccccuugaugcuaccuuugaa

SEQ ID NO: 243953 - RNA, 53 nt, Homo Sapiens
ucucucguuuucuuuuaggacauacagcaaaugcugcucaucagcgucaaaau

SEQ ID NO: 243954 - RNA, 64 nt, Homo Sapiens
caaaugggaucuaauuaaacuaaagagcuucugcacagcaaaagaaacuaccaucagagugaac

SEQ ID NO: 243955 - RNA, 64 nt, Homo Sapiens
ucuuugcacccucaaugcaugauugguauucucaacagcaaaggggugaaaaaucuagagacag

SEQ ID NO: 243956 - RNA, 64 nt, Homo Sapiens
agaccaagaacaaugaguauuagaaaaaaaggagacagcaaaggugguuugagguagucaccug

SEQ ID NO: 243957 - RNA, 64 nt, Homo Sapiens
gggcaacagaggccaaagaaacgaagcaagacaaacagcaaacaggcauuuuggucaggucauu

SEQ ID NO: 243958 - RNA, 64 nt, Homo Sapiens
aaaauacuuuucaggccuuuuuaaaaaauucauuacagcaaacagcuggggaaggacaugcagu

SEQ ID NO: 243959 - RNA, 64 nt, Homo Sapiens
acaccauccuagcgaggcaccagcacaccuaaucacagcaaagcccagauccccccaucaguug

SEQ ID NO: 243960 - RNA, 64 nt, Homo Sapiens
uuuuucauuaccuguagcuuugggcagauuugcaacagcaaauuaauguguaaaauuggauuau

SEQ ID NO: 243961 - RNA, 64 nt, Homo Sapiens
guuuuaaacugugagccguccaagucagaagaagacagcaaaaaaagcaacuuuuccaacauac

SEQ ID NO: 243962 - RNA, 64 nt, Homo Sapiens
uuuuucauuuuuuauuuugaaaaauugcaaaucuacagcaaaaguaaaacaguagagugaacac

SEQ ID NO: 243963 - RNA, 64 nt, Homo Sapiens
cucaaaguaucuuuuagacuuuuaaggacaauuuacagcaaaugaaauuuaugaugcugugaca

SEQ ID NO: 243964 - RNA, 64 nt, Homo Sapiens
cuuggauuuuaugcaguagguucuccaacuguucacagcaaaugcuagguucuuccugacugcu

SEQ ID NO: 243965 - RNA, 64 nt, Homo Sapiens
caaacaaacgcaagaagagagggguggaacuugcacagcaaaaaggaucaauuucuuuuucaua

SEQ ID NO: 243966 - RNA, 64 nt, Homo Sapiens
aaugugaggaagcuccuccaaaauucuuuucucuacagcaaauuaccaggaaggaauggaaaaa

SEQ ID NO: 243967 - RNA, 64 nt, Homo Sapiens
auugaauaaccauugacaaaauucuuuuuaauuuacagcaaaauaccauuugaugugagaaaca

SEQ ID NO: 243968 - RNA, 64 nt, Homo Sapiens
cuucaaugucuaagaaaacuuuuauuaccacaaaacagcaaaauauuguaugaucguaacauua

SEQ ID NO: 243969 - RNA, 64 nt, Homo Sapiens
aaaacaccagaaauauuuuuuggauuguggcugaacagcaaaucccaagcugcacuauugggaa

SEQ ID NO: 243970 - RNA, 64 nt, Homo Sapiens
uugaugccucugcaagauacugugaggagaauugacagcaaaaguucaccaccuacucuuauuu

SEQ ID NO: 243971 - RNA, 64 nt, Homo Sapiens
ugacuuuucuucauauuuugcaaagagaaauuucacagcaaaaauucauguuuugucagcuuuc

SEQ ID NO: 243972 - RNA, 64 nt, Homo Sapiens
cgggucccaaguucucuccuauuuccccaucaaaauccccaaggauucacagaaccguggucac

SEQ ID NO: 243973 - RNA, 64 nt, Homo Sapiens
auugaggcacacuccuuggcgcauagcugucugaauccccaauuacaaaaaauaaaucaagaag

SEQ ID NO: 243974 - RNA, 64 nt, Homo Sapiens
uacuuuuaguuuuuuuguuuagagauacaaccuaauccccaacccuacuuugcagcucgcccaa

SEQ ID NO: 243975 - RNA, 64 nt, Homo Sapiens
caccuuugucaucagcuuuuaacucuacuuuuacauccccaaacgcacccccucccuuucccuu

SEQ ID NO: 243976 - RNA, 64 nt, Homo Sapiens
ccaauaaucccccacuccucuuccuuucccauccauccccaacugagcauuggcugaagcccag

SEQ ID NO: 243977 - RNA, 64 nt, Homo Sapiens
ccuucaggccugagaucagaaccagguacgaaggauccccaagcucucugggccuuggcuuggg

SEQ ID NO: 243978 - RNA, 64 nt, Homo Sapiens
aggacacuaagaggaggcaggaggagcaacucaaauccccaagaacacaagaagacccauccug

SEQ ID NO: 243979 - RNA, 64 nt, Homo Sapiens
ugccuaugaacagaccaucccccacuccuuggguauccccaaccccagacccccaucacuugau

SEQ ID NO: 243980 - RNA, 64 nt, Homo Sapiens
auccuccaccccacaucccaccacauccaccuccauccccaacccauccucauccccaacuaca

SEQ ID NO: 243981 - RNA, 64 nt, Homo Sapiens
ccaccacauccaccuccauccccaacccauccucauccccaacuacagccccaaacccagcccc

SEQ ID NO: 243982 - RNA, 64 nt, Homo Sapiens
agccccaaacccagccccagacuaauccacagccauccccaacucauccucauccccaacugca

SEQ ID NO: 243983 - RNA, 64 nt, Homo Sapiens
cagacuaauccacagccauccccaacucauccucauccccaacugcagccccaaacccaaccca

SEQ ID NO: 243984 - RNA, 64 nt, Homo Sapiens
uccccaacugcagccccaaacccaacccagggccauccccaaacccauccccaagccaaacuca

SEQ ID NO: 243985 - RNA, 64 nt, Homo Sapiens
gccccaaacccaacccagggccauccccaaacccauccccaagccaaacucaacaccauccccu

SEQ ID NO: 243986 - RNA, 64 nt, Homo Sapiens
cccuaaucaccucuccugccccuagcucagccucauccccaacuccaugccugucuccaauccc

SEQ ID NO: 243987 - RNA, 64 nt, Homo Sapiens
ccaccgucccgaagccaacuucacccauguccccauccccaaucuuguccccauuccugacucc

SEQ ID NO: 243988 - RNA, 64 nt, Homo Sapiens
ucauuccagaucuauuuuucaaaaaaaccaccaaauccccaaaugaugcaaaaaacaaaaacaa

SEQ ID NO: 243989 - RNA, 64 nt, Homo Sapiens
ccagauccccaugccucgagacgcuggauccuagauccccaaccagauccaguguccuagugaa

SEQ ID NO: 243990 - RNA, 64 nt, Homo Sapiens
guauaaaccucaguaaaaauagugaagacaugcaucauggaaugagaaaaugagaaaggaauga

SEQ ID NO: 243991 - RNA, 64 nt, Homo Sapiens
aggcauguuaauucaauauaaaugaccuuugauuucauggaauauuaaaguugguuuaaagucc

SEQ ID NO: 243992 - RNA, 64 nt, Homo Sapiens
caaacagaugaagcaccacuggaauaguuuuugcucauggaacuuauggaagaguuacuucuac

SEQ ID NO: 243993 - RNA, 64 nt, Homo Sapiens
cuggagaguuucuguggauagugcuuccuugagaucauggaauuccuuccugcucuaacgucca

SEQ ID NO: 243994 - RNA, 64 nt, Homo Sapiens
gggugggcuaugaaagccggcaccugccuccucaucauggaaggugguggcuguuccucccugu

SEQ ID NO: 243995 - RNA, 64 nt, Homo Sapiens
gaaugcugucaccagaaaauauuagaagguaaugucauggaauaaaugccagcuaacuucuuug

SEQ ID NO: 243996 - RNA, 64 nt, Homo Sapiens
uggacauacaccaccaggucgguuuugaguuacuucauggaacuaguguguccauucuggcagu

SEQ ID NO: 243997 - RNA, 64 nt, Homo Sapiens
gagagcagcauaaauguugacaugggacauuugcucauggaauuggagcucgugggacagucac

SEQ ID NO: 243998 - RNA, 64 nt, Homo Sapiens
ugcucauggaauuggagcucgugggacagucaccucauggaauuggagcucguggaacaguuac

SEQ ID NO: 243999 - RNA, 64 nt, Homo Sapiens
uguagcaugccaguaauuuuuaaagcagcagcacucauggaaauaagucuucugucauaaucua

SEQ ID NO: 244000 - RNA, 64 nt, Homo Sapiens
auacaacuuguggguaacucgcuuuuagcuuguuucauggaacugcuuuguaauuuaaauugga

SEQ ID NO: 244001 - RNA, 64 nt, Homo Sapiens
gaaaaguauuuuaaccuaccuguagagauccucgucauggaaaggugccaaacuguuuugaaug

SEQ ID NO: 244002 - RNA, 64 nt, Homo Sapiens
uuggagugccauguauaaguugggcuauuagaguucauggaacauagaacaaccaugaaugagu

SEQ ID NO: 244003 - RNA, 64 nt, Homo Sapiens
ugguggaaggaaaauagacuccuuuuccugacucucauggaagaagguugggugcucacagaac

SEQ ID NO: 244004 - RNA, 64 nt, Homo Sapiens
aucagacugggaaccacagaggcgcugauguagcucauggaagguuccuucauggaaagguguu

SEQ ID NO: 244005 - RNA, 64 nt, Homo Sapiens
guguuggcgcugauguagcucaacaucacuuccuucauggaaaggugaggcuaaacugcgaccc

SEQ ID NO: 244006 - RNA, 64 nt, Homo Sapiens
aaauggcuuucugccuccauacugucucauaaguucauggaaugcucacauugaacuaaaaucc

SEQ ID NO: 244007 - RNA, 64 nt, Homo Sapiens
ugguauggaagaagguaugguguuagaauuuccaucauggaaggagaugcuucaaaaauugucc

SEQ ID NO: 244008 - RNA, 64 nt, Homo Sapiens
ucuggaaaggacagggaaguuuuaaaagaagagcucauggaacccuauaagugcccaguacaug

SEQ ID NO: 244009 - RNA, 64 nt, Homo Sapiens
caacucuugccccuccuccuaucaggugcacucuucauggaaaguccucuggagcugccuucuc

SEQ ID NO: 244010 - RNA, 64 nt, Homo Sapiens
uagguuuaugccuucuguggccagagucuuggacucauggaaauagaaugaauagaggggcauu

SEQ ID NO: 244011 - RNA, 64 nt, Homo Sapiens
cugaauuaaaagcccacuguggagaugcugugguucauggaaucucuuccaguguaauucagaa

SEQ ID NO: 244012 - RNA, 64 nt, Homo Sapiens; identical to SEQ ID NO: 209384

SEQ ID NO: 244013 - RNA, 64 nt, Homo Sapiens; identical to SEQ ID NO: 209385

SEQ ID NO: 244014 - RNA, 64 nt, Homo Sapiens; identical to SEQ ID NO: 209386

SEQ ID NO: 244015 - RNA, 64 nt, Homo Sapiens; identical to SEQ ID NO: 209387

SEQ ID NO: 244016 - RNA, 64 nt, Homo Sapiens; identical to SEQ ID NO: 209388

SEQ ID NO: 244017 - RNA, 64 nt, Homo Sapiens; identical to SEQ ID NO: 209389

SEQ ID NO: 244018 - RNA, 64 nt, Homo Sapiens; identical to SEQ ID NO: 209390

SEQ ID NO: 244019 - RNA, 64 nt, Homo Sapiens; identical to SEQ ID NO: 209391

SEQ ID NO: 244020 - RNA, 64 nt, Homo Sapiens; identical to SEQ ID NO: 209392

SEQ ID NO: 244021 - RNA, 64 nt, Homo Sapiens; identical to SEQ ID NO: 209393

SEQ ID NO: 244022 - RNA, 64 nt, Homo Sapiens; identical to SEQ ID NO: 209394

SEQ ID NO: 244023 - RNA, 64 nt, Homo Sapiens; identical to SEQ ID NO: 209395

SEQ ID NO: 244024 - RNA, 61 nt, Homo Sapiens; identical to SEQ ID NO: 209396

SEQ ID NO: 244025 - RNA, 64 nt, Homo Sapiens; identical to SEQ ID NO: 209397

SEQ ID NO: 244026 - RNA, 64 nt, Homo Sapiens; identical to SEQ ID NO: 209398

SEQ ID NO: 244027 - RNA, 64 nt, Homo Sapiens; identical to SEQ ID NO: 209399

SEQ ID NO: 244028 - RNA, 64 nt, Homo Sapiens; identical to SEQ ID NO: 209400

SEQ ID NO: 244029 - RNA, 64 nt, Homo Sapiens; identical to SEQ ID NO: 209401

SEQ ID NO: 244030 - RNA, 64 nt, Homo Sapiens; identical to SEQ ID NO: 209402

SEQ ID NO: 244031 - RNA, 64 nt, Homo Sapiens; identical to SEQ ID NO: 209403

SEQ ID NO: 244032 - RNA, 64 nt, Homo Sapiens; identical to SEQ ID NO: 209404

SEQ ID NO: 244033 - RNA, 64 nt, Homo Sapiens; identical to SEQ ID NO: 209405

SEQ ID NO: 244034 - RNA, 64 nt, Homo Sapiens; identical to SEQ ID NO: 209406

SEQ ID NO: 244035 - RNA, 64 nt, Homo Sapiens; identical to SEQ ID NO: 209407

SEQ ID NO: 244036 - RNA, 64 nt, Homo Sapiens
cauaccuucaugugguucaguuuccacugaacaaaaccuacacauuccucucucuaccagucua

SEQ ID NO: 244037 - RNA, 64 nt, Homo Sapiens
cguaccuucaugugauucacaagucacugaacaaaaccuacacaagcuggcugagacacugaag

SEQ ID NO: 244038 - RNA, 64 nt, Homo Sapiens
uggcccaauuuccuaacaagccggaugcuugagaaaccuacauuuggacaaugagaggcugcuc

SEQ ID NO: 244039 - RNA, 64 nt, Homo Sapiens
uuccuuggcuccugcuuucuuuuuagacuauaucaaccuacaacuuuagucgggaagagggaca

SEQ ID NO: 244040 - RNA, 64 nt, Homo Sapiens
aggaauaggauaaugauauauaggaucaugauauuccuucuauccaugugccaaauggguguaa

SEQ ID NO: 244041 - RNA, 64 nt, Homo Sapiens
uggcaaugaagucaguagauaggaaaccaguuauuccuucuaccuuuaaaaauuuugagaacuu

SEQ ID NO: 244042 - RNA, 64 nt, Homo Sapiens
gagucauuuaucccaaacuggguuuuuucucucauccuucuaccucccuccuuugaaugagggu

SEQ ID NO: 244043 - RNA, 64 nt, Homo Sapiens
uggguugucugaagucagaaacauauuuacaaaguccuucuacccacuaucaaaaaugaacuga

SEQ ID NO: 244044 - RNA, 64 nt, Homo Sapiens
uaaaucguaaaaaauguacauuugcccuuucucuuccuucuaaacaugugucucucccacaggu

SEQ ID NO: 244045 - RNA, 64 nt, Homo Sapiens
aacaacacuuagacuggggucuaacguugacaaauccuucuagaauuugccucuuugggacuga

SEQ ID NO: 244046 - RNA, 64 nt, Homo Sapiens
guuccuuccuccacugcgcuuacuccucugacccuccuucuauuuucccuacccugcaacuucu

SEQ ID NO: 244047 - RNA, 64 nt, Homo Sapiens
cugugaaauuuacaaaucaaaaucuuaaucauuauccuucuaagaggauacaaauuuagugcuc

SEQ ID NO: 244048 - RNA, 64 nt, Homo Sapiens
ugguuuuccccaccccacacauucucaaccauaguccuucuaacaauaccaauagcuaggaccc

SEQ ID NO: 244049 - RNA, 64 nt, Homo Sapiens
uucacguuaacauauagacacuguuggaagcaguuccuucuaaaaggguagcccuggacuuaau

SEQ ID NO: 244050 - RNA, 64 nt, Homo Sapiens
gccaccuguccccuuaaacauuucugucuucuguuccuucuagguucugcaggaggagcaggug

SEQ ID NO: 244051 - RNA, 64 nt, Homo Sapiens
ccuuccaaggaggggagagagcaacauggacauuuccuucuaguuuuuuuguuccccgugaaaa

SEQ ID NO: 244052 - RNA, 64 nt, Homo Sapiens
ccacuaaccaaaauaccuccccuacaaauacgaauccuucuauccuucaaaauuuuuagugcuc

SEQ ID NO: 244053 - RNA, 64 nt, Homo Sapiens
aauacuuauuauauuucugggaaauagaacuugcuccuucuauucauucuucaaucagauagug

SEQ ID NO: 244054 - RNA, 64 nt, Homo Sapiens
aagaacuugacucggcacuguuucucguguaauauccuucuaaugcuuagcaacaacaacaaaa

SEQ ID NO: 244055 - RNA, 64 nt, Homo Sapiens
gcucuccucucuaaccucacugggcuauaaauguuccuucuaacucuguaaugaaaguucagug

SEQ ID NO: 244056 - RNA, 64 nt, Homo Sapiens
ccucaaccuggggaacuguauuuuuaaaugaagagcuauuuauauauauuauuuuuuuuuaaga

SEQ ID NO: 244057 - RNA, 64 nt, Homo Sapiens
ggauuucuaaacugcucaauuuugacucaaaggugcuauuuaccaaacacucucccuacccauu

SEQ ID NO: 244058 - RNA, 64 nt, Homo Sapiens
uguuuaccagagcaucuucuuaucuuuccacagagcuauuuacauccuggacuauauaacuuaa

SEQ ID NO: 244059 - RNA, 64 nt, Homo Sapiens
cagcauuauggcuaaaauauaugucuaacccagugcuauuuaggugaaaaugcuaauugauaaa

SEQ ID NO: 244060 - RNA, 64 nt, Homo Sapiens
auuugaggacucucuuagaaugagugauucaccugcuauuuaaaugaauuauuuagauuuuuga

SEQ ID NO: 244061 - RNA, 64 nt, Homo Sapiens
aaaacuuagcaaacuuuugaaucuuucuuuuauugcuauuuacacauacauacacacauacaaa

SEQ ID NO: 244062 - RNA, 64 nt, Homo Sapiens
gauggagcagcacuuagugcaacugaaaauaggagcuauuuauaggcaguuuaaugugguacca

SEQ ID NO: 244063 - RNA, 64 nt, Homo Sapiens
accuguggcaaaaugaacgcugaccauauucaucgcuauuuaaacagcagguuagaccggcuuu

SEQ ID NO: 244064 - RNA, 64 nt, Homo Sapiens
uucagaugcuucugggagacacccaaagggugaagcuauuuaucuguaguaaacuauuuaucug

SEQ ID NO: 244065 - RNA, 64 nt, Homo Sapiens
cuuaaacacaccagugucuguucuugaugcaguugcuauuuaggaugaguuaagugccugggga

SEQ ID NO: 244066 - RNA, 64 nt, Homo Sapiens
uuugauuaaauuuagguagcacuuuuuuuguagugcuauuuaauguaauuggugccaauaaacu

SEQ ID NO: 244067 - RNA, 64 nt, Homo Sapiens
caauuuuuuucuaacgugaaacugaauuuauggugcuauuuaaacuugaggugugccuuguaua

SEQ ID NO: 244068 - RNA, 64 nt, Homo Sapiens
cauuuuaaauuaaguaguuuuaaucagcuuaaaagcuauuuaacccauuuuaauaagcuugcag

SEQ ID NO: 244069 - RNA, 64 nt, Homo Sapiens
uuggcaaguaacucuacuaacagauguugguauagcuauuuaaagacuacuucguaaguaguau

SEQ ID NO: 244070 - RNA, 64 nt, Homo Sapiens; identical to SEQ ID NO: 137832

SEQ ID NO: 244071 - RNA, 64 nt, Homo Sapiens; identical to SEQ ID NO: 137833

SEQ ID NO: 244072 - RNA, 64 nt, Homo Sapiens; identical to SEQ ID NO: 137834

SEQ ID NO: 244073 - RNA, 64 nt, Homo Sapiens; identical to SEQ ID NO: 137835

SEQ ID NO: 244074 - RNA, 64 nt, Homo Sapiens; identical to SEQ ID NO: 137836

SEQ ID NO: 244075 - RNA, 64 nt, Homo Sapiens; identical to SEQ ID NO: 137837

SEQ ID NO: 244076 - RNA, 64 nt, Homo Sapiens; identical to SEQ ID NO: 137838

SEQ ID NO: 244077 - RNA, 64 nt, Homo Sapiens; identical to SEQ ID NO: 137839

SEQ ID NO: 244078 - RNA, 64 nt, Homo Sapiens; identical to SEQ ID NO: 137840

SEQ ID NO: 244079 - RNA, 64 nt, Homo Sapiens; identical to SEQ ID NO: 137841

SEQ ID NO: 244080 - RNA, 64 nt, Homo Sapiens; identical to SEQ ID NO: 137842

SEQ ID NO: 244081 - RNA, 64 nt, Homo Sapiens; identical to SEQ ID NO: 137843

SEQ ID NO: 244082 - RNA, 64 nt, Homo Sapiens; identical to SEQ ID NO: 137844

SEQ ID NO: 244083 - RNA, 64 nt, Homo Sapiens; identical to SEQ ID NO: 137845

SEQ ID NO: 244084 - RNA, 64 nt, Homo Sapiens; identical to SEQ ID NO: 137846

SEQ ID NO: 244085 - RNA, 64 nt, Homo Sapiens; identical to SEQ ID NO: 137847

SEQ ID NO: 244086 - RNA, 64 nt, Homo Sapiens; identical to SEQ ID NO: 137848

SEQ ID NO: 244087 - RNA, 64 nt, Homo Sapiens; identical to SEQ ID NO: 137849

SEQ ID NO: 244088 - RNA, 64 nt, Homo Sapiens; identical to SEQ ID NO: 137850

SEQ ID NO: 244089 - RNA, 64 nt, Homo Sapiens; identical to SEQ ID NO: 137851

SEQ ID NO: 244090 - RNA, 64 nt, Homo Sapiens; identical to SEQ ID NO: 137852

SEQ ID NO: 244091 - RNA, 64 nt, Homo Sapiens; identical to SEQ ID NO: 137853

SEQ ID NO: 244092 - RNA, 64 nt, Homo Sapiens; identical to SEQ ID NO: 137854

SEQ ID NO: 244093 - RNA, 64 nt, Homo Sapiens; identical to SEQ ID NO: 137855

SEQ ID NO: 244094 - RNA, 64 nt, Homo Sapiens; identical to SEQ ID NO: 137856

SEQ ID NO: 244095 - RNA, 64 nt, Homo Sapiens; identical to SEQ ID NO: 137857

SEQ ID NO: 244096 - RNA, 64 nt, Homo Sapiens; identical to SEQ ID NO: 137858

SEQ ID NO: 244097 - RNA, 64 nt, Homo Sapiens; identical to SEQ ID NO: 137859

SEQ ID NO: 244098 - RNA, 64 nt, Homo Sapiens; identical to SEQ ID NO: 137860

SEQ ID NO: 244099 - RNA, 64 nt, Homo Sapiens; identical to SEQ ID NO: 137861

SEQ ID NO: 244100 - RNA, 64 nt, Homo Sapiens; identical to SEQ ID NO: 137862

SEQ ID NO: 244101 - RNA, 64 nt, Homo Sapiens; identical to SEQ ID NO: 137863

SEQ ID NO: 244102 - RNA, 64 nt, Homo Sapiens; identical to SEQ ID NO: 137864

SEQ ID NO: 244103 - RNA, 64 nt, Homo Sapiens; identical to SEQ ID NO: 137865

SEQ ID NO: 244104 - RNA, 64 nt, Homo Sapiens; identical to SEQ ID NO: 137866

SEQ ID NO: 244105 - RNA, 64 nt, Homo Sapiens; identical to SEQ ID NO: 137867

SEQ ID NO: 244106 - RNA, 64 nt, Homo Sapiens; identical to SEQ ID NO: 137868

SEQ ID NO: 244107 - RNA, 64 nt, Homo Sapiens; identical to SEQ ID NO: 137869

SEQ ID NO: 244108 - RNA, 64 nt, Homo Sapiens; identical to SEQ ID NO: 137870

SEQ ID NO: 244109 - RNA, 64 nt, Homo Sapiens; identical to SEQ ID NO: 137871

SEQ ID NO: 244110 - RNA, 64 nt, Homo Sapiens; identical to SEQ ID NO: 137872

SEQ ID NO: 244111 - RNA, 64 nt, Homo Sapiens; identical to SEQ ID NO: 137873

SEQ ID NO: 244112 - RNA, 64 nt, Homo Sapiens; identical to SEQ ID NO: 137874

SEQ ID NO: 244113 - RNA, 64 nt, Homo Sapiens; identical to SEQ ID NO: 137875

SEQ ID NO: 244114 - RNA, 64 nt, Homo Sapiens; identical to SEQ ID NO: 137876

SEQ ID NO: 244115 - RNA, 64 nt, Homo Sapiens; identical to SEQ ID NO: 137877

SEQ ID NO: 244116 - RNA, 64 nt, Homo Sapiens; identical to SEQ ID NO: 137878

SEQ ID NO: 244117 - RNA, 64 nt, Homo Sapiens; identical to SEQ ID NO: 137879

SEQ ID NO: 244118 - RNA, 64 nt, Homo Sapiens; identical to SEQ ID NO: 137880

SEQ ID NO: 244119 - RNA, 64 nt, Homo Sapiens; identical to SEQ ID NO: 137881

SEQ ID NO: 244120 - RNA, 64 nt, Homo Sapiens; identical to SEQ ID NO: 137882

SEQ ID NO: 244121 - RNA, 64 nt, Homo Sapiens; identical to SEQ ID NO: 137883

SEQ ID NO: 244122 - RNA, 64 nt, Homo Sapiens; identical to SEQ ID NO: 137884

SEQ ID NO: 244123 - RNA, 64 nt, Homo Sapiens; identical to SEQ ID NO: 137885

SEQ ID NO: 244124 - RNA, 64 nt, Homo Sapiens; identical to SEQ ID NO: 137886

SEQ ID NO: 244125 - RNA, 64 nt, Homo Sapiens; identical to SEQ ID NO: 137887

SEQ ID NO: 244126 - RNA, 64 nt, Homo Sapiens; identical to SEQ ID NO: 137888

SEQ ID NO: 244127 - RNA, 64 nt, Homo Sapiens; identical to SEQ ID NO: 137889

SEQ ID NO: 244128 - RNA, 64 nt, Homo Sapiens; identical to SEQ ID NO: 137890

SEQ ID NO: 244129 - RNA, 64 nt, Homo Sapiens; identical to SEQ ID NO: 137891

SEQ ID NO: 244130 - RNA, 64 nt, Homo Sapiens; identical to SEQ ID NO: 137892

SEQ ID NO: 244131 - RNA, 64 nt, Homo Sapiens; identical to SEQ ID NO: 137893

SEQ ID NO: 244132 - RNA, 64 nt, Homo Sapiens; identical to SEQ ID NO: 137894

SEQ ID NO: 244133 - RNA, 64 nt, Homo Sapiens; identical to SEQ ID NO: 137895

SEQ ID NO: 244134 - RNA, 64 nt, Homo Sapiens; identical to SEQ ID NO: 137896

SEQ ID NO: 244135 - RNA, 64 nt, Homo Sapiens
gaaagcuauuuccaucuaguaucagggugagagcauccuugaucuggcugccuguuagagaaau

SEQ ID NO: 244136 - RNA, 64 nt, Homo Sapiens
ugucucuugagaagagagaggcaugugugccggcauccuugauggguucaaagagaaagguugg

SEQ ID NO: 244137 - RNA, 64 nt, Homo Sapiens
uaguauugguggaaaccauugaacuucaguaacuauccuugacugagggcuugaguucaucgau

SEQ ID NO: 244138 - RNA, 64 nt, Homo Sapiens
uaaugacucaaauuuucaaaaaaaaaaaaaaaaaauccuugaacgcacagugagacuccaccuc

SEQ ID NO: 244139 - RNA, 64 nt, Homo Sapiens
ggguucauaaauugaggccagagacucauuguauauccuugaucaauuuucuaauuaaaggaaa

SEQ ID NO: 244140 - RNA, 64 nt, Homo Sapiens
guaacaagagucuauuugccuugaaaaaacaauuauccuugaacuuccuccagcuaugcaggga

SEQ ID NO: 244141 - RNA, 64 nt, Homo Sapiens
aaugaagauauuuuaccaugaagagauugcacuuauccuugagaacagucuaaauauaaaugaa

SEQ ID NO: 244142 - RNA, 64 nt, Homo Sapiens
aaugaagauauuuuaccaugaagagauugcacuuauccuugagaacagucuaaugauacuuuuu

SEQ ID NO: 244143 - RNA, 64 nt, Homo Sapiens
auccccaagugacauguggcuucagaaguagagucugaaagagcagugggaugggagcugguga

SEQ ID NO: 244144 - RNA, 64 nt, Homo Sapiens
cacugaauauccccuuggcagcagagaaaacccacugaaagaucguagaguggcacaugcuuac

SEQ ID NO: 244145 - RNA, 64 nt, Homo Sapiens
caucuagugcauuuaaaaauaaucgacucuaaaacugaaagaaaccuuaucacauuuuccccag

SEQ ID NO: 244146 - RNA, 64 nt, Homo Sapiens
gagagaugaauuuauaaaguaggaaaaaaagaaucugaaagauacaaagugauuauaaaagaau

SEQ ID NO: 244147 - RNA, 64 nt, Homo Sapiens
cuaaucuauuugccaaacuugcucaugguauuuccugaaagaugcugaugaguagauaagugga

SEQ ID NO: 244148 - RNA, 64 nt, Homo Sapiens
acauccugagcagugccagccuuaaugguagcaacugaaagaagcgaaaaggauaugcaguaug

SEQ ID NO: 244149 - RNA, 64 nt, Homo Sapiens
uuugccgauggaauaacagauuugccggcaaucacugaaagagugcaaauaucggguccuugug

SEQ ID NO: 244150 - RNA, 64 nt, Homo Sapiens
cccuauccauacuauaguuucucuaaaacuuuaucugaaagagucauuuuaaaauaacuauuaa

SEQ ID NO: 244151 - RNA, 64 nt, Homo Sapiens
ugaauucuuguaagcggaauguaaaacggaaauacugaaagacuuuugccuaaaguggcauuau

SEQ ID NO: 244152 - RNA, 64 nt, Homo Sapiens
uuugccuaaaguggcauuauguaaaacggaaauacugaaagacuugaauucuuguaagcggaau

SEQ ID NO: 244153 - RNA, 64 nt, Homo Sapiens
cauuuuaaaauaacuauuaacucuaaaacuuuaucugaaagagucccuauccauacuauaguuu

SEQ ID NO: 244154 - RNA, 64 nt, Homo Sapiens
gcaaacaucggguccuuguguuugccggcaaucacugaaagaguuuugccgauggaauaacaga

SEQ ID NO: 244155 - RNA, 64 nt, Homo Sapiens
uuugcuuaaaguggcauuauguguaacggaaauacugaaagacuugaguucuuguuaacagaau

SEQ ID NO: 244156 - RNA, 64 nt, Homo Sapiens
gcagauauuggguccuuguauuugccggcauucacugaaagagguuugccaauggaauaacaga

SEQ ID NO: 244157 - RNA, 64 nt, Homo Sapiens
agagaccauguuauuccugacaugaaagauuaaucugaaagaucuaauuaccauuaaauucaca

SEQ ID NO: 244158 - RNA, 64 nt, Homo Sapiens
uguaucucugugcuugaacuaacuagauggggcucugaaagauuaggucacauauuucaaacac

SEQ ID NO: 244159 - RNA, 64 nt, Homo Sapiens
acagcccgccagcugauuggaugucuaggaaugacugaaagaaaccaaaacagccuguccacug

SEQ ID NO: 244160 - RNA, 64 nt, Homo Sapiens
gugucccuuauagucccuucccccacagcucuugcugaaagaguuugccuuguuuuguuuuguu

SEQ ID NO: 244161 - RNA, 64 nt, Homo Sapiens
aaauugaugagucagguugcagcccucaugugaacugaaagaaguugcucgcuucuguguugac

SEQ ID NO: 244162 - RNA, 64 nt, Homo Sapiens
ccugcuggaagucaguacaaugcgucaaaaguugcugaaagaugcugugccuaugggguucuag

SEQ ID NO: 244163 - RNA, 64 nt, Homo Sapiens
uggacagggaaggccucugacauuuauccaagaccugaaagaugggcaaaagacgggaagcaag

SEQ ID NO: 244164 - RNA, 64 nt, Homo Sapiens
cuccgcggcaggaggagccggugcucuggaagaccugaaagaagcccagguggccacagggcua

SEQ ID NO: 244165 - RNA, 64 nt, Homo Sapiens
aaugggaaaugagaacauucacauucaaugucaccugaaagagacuagaggaaaacuuugagga

SEQ ID NO: 244166 - RNA, 64 nt, Homo Sapiens
uguagagaguagcaguauuuaaggguuuugcaaacugaaagaucgaucucauguuaaguggaga

SEQ ID NO: 244167 - RNA, 64 nt, Homo Sapiens
ugaagcaaacccacacccuagguugggggauguacugaaagagaaaguucccuaggaggggguu

SEQ ID NO: 244168 - RNA, 64 nt, Homo Sapiens
aaaaauaccccuaaauaaaaauuuugcagaaagccugaaagaaauuguuguuuuuaaaaaauuc

SEQ ID NO: 244169 - RNA, 64 nt, Homo Sapiens
aguguaagggcucacacauuuacuguacucagaucugaaagacaauguugcuucuugauuuuuu

SEQ ID NO: 244170 - RNA, 64 nt, Homo Sapiens
agaacuucuacaaaacuucuauaccacacagaagcugaaagagacucuggggcacuaaauucag

SEQ ID NO: 244171 - RNA, 64 nt, Homo Sapiens
guggcuguugccccuuuuugauauggagggaacacugaaagacaguuuccuucuggaguuccaa

SEQ ID NO: 244172 - RNA, 58 nt, Homo Sapiens
gccccaagaagaagcugugaccugcccacuggcacacagcuggcacuggcacacaccu

SEQ ID NO: 244173 - RNA, 64 nt, Homo Sapiens
aagcugugaccugcccacuggcacacagcuggcacuggcacacaccugucccaugcccacccug

SEQ ID NO: 244174 - RNA, 64 nt, Homo Sapiens
gcccucccugcacagggcaaagccagucugggcucuggcacacagaguucauguuugcgcccuc

SEQ ID NO: 244175 - RNA, 64 nt, Homo Sapiens
uccgccucccuuggauggggucaagaggccaggccuggcacauuuuggaguguccuggcuacca

SEQ ID NO: 244176 - RNA, 64 nt, Homo Sapiens
ucccuuuaacugguauaugaaguccuuuuauagccuggcacaaguuuuauuauugaguuguaag

SEQ ID NO: 244177 - RNA, 64 nt, Homo Sapiens
agaucgagcggcugcagaugaggagacggaggugcuggcacauggaagaugaagcagcucacag

SEQ ID NO: 244178 - RNA, 64 nt, Homo Sapiens
cacacacacucacgcaugagcaaacguguacagacuggcacaugccuccacaugcgaacaccca

SEQ ID NO: 244179 - RNA, 64 nt, Homo Sapiens
augcgaacacccacuuacacacacgccacucacacuggcacacaugcugucuacccgugcacag

SEQ ID NO: 244180 - RNA, 64 nt, Homo Sapiens
ucccugguaccaguaggcaccuggcugagccuggcuggcacagaaaccucuacuaaaaagaagg

SEQ ID NO: 244181 - RNA, 64 nt, Homo Sapiens
agaguugcugggagcugaaaaaucacauccuggccuggcacaucagaaaggaaugggggccucu

SEQ ID NO: 244182 - RNA, 64 nt, Homo Sapiens
ucugaggccaccaaccucgucccucauccacccucuggcacaacagcucugggggaggcacagg

SEQ ID NO: 244183 - RNA, 64 nt, Homo Sapiens
cgggagccuucuacgcagagugaccaccaccacacuggcacagggauggagggagagguugugc

SEQ ID NO: 244184 - RNA, 64 nt, Homo Sapiens
cucacugaagagagaaagcagaagguucuagauccuggcacagacugcaucccauguucccaug

SEQ ID NO: 244185 - RNA, 64 nt, Homo Sapiens
cuggcccagaggcuccugaagaugcugggcgguccuggcacagggaggagcagcucuguaaauc

SEQ ID NO: 244186 - RNA, 64 nt, Homo Sapiens
cccuggagccucagaaaucuuccugggcccugggcuggcacagcauugccccucugccuugccc

SEQ ID NO: 244187 - RNA, 64 nt, Homo Sapiens
gccccucugccuugcccuccgcagucuccccuuccuggcacauuagaaguuucgucuaaugggg

SEQ ID NO: 244188 - RNA, 64 nt, Homo Sapiens
cacguugaucugaacuuuaaaucaaucagugcugcuggcacaaugaaagguggaacugcacuuc

SEQ ID NO: 244189 - RNA, 64 nt, Homo Sapiens
auuguugagaugucuuaggacaucuaaggcaaaacuggcacauuuguucugcagacuauugcag

SEQ ID NO: 244190 - RNA, 64 nt, Homo Sapiens
ggagggccccuguacuaccuccugggccaagaaacuggcacagccccacacugucagugccaag

SEQ ID NO: 244191 - RNA, 64 nt, Homo Sapiens
agccacuucuuaccaggcaacgggcacagccacccuggcacacccucugccuggccgugcugaa

SEQ ID NO: 244192 - RNA, 64 nt, Homo Sapiens
cgccuggaaugcaggacuguagguacccccaccccuggcacagcugugguggggggugcggagg

SEQ ID NO: 244193 - RNA, 64 nt, Homo Sapiens
ugcgauggcaccccaugcucuggagggcaggggucuggcacagguaccugcuugcggcuuucag

SEQ ID NO: 244194 - RNA, 64 nt, Homo Sapiens
cagccuuagagcucuuguguucagaagaaucuuccuggcacaauguuggagcagcaggccucug

SEQ ID NO: 244195 - RNA, 64 nt, Homo Sapiens
gucucugccaguuacuugggcuucaacagccaagcuggcacaaaagacagcuggcggaggcugc

SEQ ID NO: 244196 - RNA, 64 nt, Homo Sapiens
caaucauaaaugaaugaucauugugauaugaaaacagcuauagaacacugaacuugaacuucca

SEQ ID NO: 244197 - RNA, 64 nt, Homo Sapiens
caaucauaaaugaaugaucacugugguaugaaaacagcuauagaacagcaacucaauucuacca

SEQ ID NO: 244198 - RNA, 64 nt, Homo Sapiens
auugaauucugccucuuuuugaaaaaaauguauucacauacaaaucuucacauggacacauguu

SEQ ID NO: 244199 - RNA, 64 nt, Homo Sapiens
uaaggucccgaagguggaacaugcuucauggucacacauacaggcacaaaaacagcauuaugug

SEQ ID NO: 244200 - RNA, 64 nt, Homo Sapiens
uucauacacaauucauacaccauacgugcacacacacauacauauacagacagaccuaccuaua

SEQ ID NO: 244201 - RNA, 64 nt, Homo Sapiens
cagaccuaccuauacauacguacacauacacacccacauacagaguguggcagccaugaaaagu

SEQ ID NO: 244202 - RNA, 64 nt, Homo Sapiens
cccacauacagacagaccuagccaugaaaaguuacacauacacaggagaugcuaguguguggca

SEQ ID NO: 244203 - RNA, 64 nt, Homo Sapiens
auuuugacugcauacaaacuaugucucugacaugcacauacacugcuuuauaaugaaaaugagg

SEQ ID NO: 244204 - RNA, 64 nt, Homo Sapiens
guguuaccccucuacacguccacaccacucaccacacauacauacacaugcacacacacacaca

SEQ ID NO: 244205 - RNA, 64 nt, Homo Sapiens
uguguauguauacacacauauacauauauauauacacauacauacacauacauacauacauaca

SEQ ID NO: 244206 - RNA, 64 nt, Homo Sapiens
uacacacauauacauauauauauacacauacauacacauacauacauacauacauauauaucug

SEQ ID NO: 244207 - RNA, 64 nt, Homo Sapiens
aaaaaacggauagaacaggauuuucuaggaguuacacauacauuuuauccugucauaccucgag

SEQ ID NO: 244208 - RNA, 64 nt, Homo Sapiens
aaaugagcucaaguacaugaauguuaguuguuaucacauacagcaaauuccuuuuuuuuucuuu

SEQ ID NO: 244209 - RNA, 64 nt, Homo Sapiens
auguucuucuaaaacauauacauauauacauacacacauacacauauucuucaggucucuaagc

SEQ ID NO: 244210 - RNA, 64 nt, Homo Sapiens
uaugcacacacgcauacacacaugcacgcacacacacauacacacaugcacgcacgcacgcaug

SEQ ID NO: 244211 - RNA, 64 nt, Homo Sapiens
cacuauuuucacacacacacaauacucacauucccacauacauuuuauaaucuuuucucccuga

SEQ ID NO: 244212 - RNA, 64 nt, Homo Sapiens
agaagacagggaaugcaaucuccuuuuuaugaagcacauacaaauaauauaaacuuauuuacuu

SEQ ID NO: 244213 - RNA, 64 nt, Homo Sapiens
aagccuccugccccaaagcuugugggcacaugggcacauacagacucacauacagacacacaca

SEQ ID NO: 244214 - RNA, 64 nt, Homo Sapiens
ccaaagcuugugggcacaugggcacauacagacucacauacagacacacacauauauguacaga

SEQ ID NO: 244215 - RNA, 64 nt, Homo Sapiens
uuuuuaaagguauucauggugacucaggaauacacacauacacacacacacacacacacacaca

SEQ ID NO: 244216 - RNA, 64 nt, Homo Sapiens
cacauacacacacacacacacacacacacacacacacauacacacauauaauuugaaagaggug

SEQ ID NO: 244217 - RNA, 64 nt, Homo Sapiens
aacuaauuauuucucuggaucauacaaguacacucacauacauaaaucaacagaaucacucaca

SEQ ID NO: 244218 - RNA, 64 nt, Homo Sapiens
uacacucacauacauaaacuaacagaaucacucacacauacaaguugccucuaaugcagaaauc

SEQ ID NO: 244219 - RNA, 64 nt, Homo Sapiens
caucuucacuuaaaguuguuauauaaauuacaaacacauacacaagaauccauaauggacuaga

SEQ ID NO: 244220 - RNA, 64 nt, Homo Sapiens
cauuacacacacacacagaauacaccuguaugugcacauacacauauaaaauguuugccaugua

SEQ ID NO: 244221 - RNA, 64 nt, Homo Sapiens
uaauuuuuuuuuuuuuugaguauauauacauacacacauacauacauauauauauauauauaca

SEQ ID NO: 244222 - RNA, 64 nt, Homo Sapiens
cauacauauauauauauauacacacacacacacacacauacauacauauauacacacacacaca

SEQ ID NO: 244223 - RNA, 64 nt, Homo Sapiens
gcaaacuuuugaaucuuucuuuuauugcuauuuacacauacauacacacauacaaaaccuuuaa

SEQ ID NO: 244224 - RNA, 64 nt, Homo Sapiens
aucuuucuuuuauugcuauuuacacauacauacacacauacaaaaccuuuaaauuuugggaucu

SEQ ID NO: 244225 - RNA, 64 nt, Homo Sapiens
agugacugugccauaggaaagcagccccuccucacacauacaugugcacaugcacacacaugca

SEQ ID NO: 244226 - RNA, 64 nt, Homo Sapiens
ugcacaugcacacacaugcaugcacacacaugcacacauacacgcacaugcacacauacacaug

SEQ ID NO: 244227 - RNA, 64 nt, Homo Sapiens
caugcacacacaugcacacauacacgcacaugcacacauacacaugcaugcacacauacacagg

SEQ ID NO: 244228 - RNA, 64 nt, Homo Sapiens
cauacacgcacaugcacacauacacaugcaugcacacauacacaggcauacaugcaugcacaca

SEQ ID NO: 244229 - RNA, 64 nt, Homo Sapiens
caugcacacacacaugcacgcacacacacaugcacacauacacgugcacacauacacaggcaca

SEQ ID NO: 244230 - RNA, 64 nt, Homo Sapiens
ugcacgcacacacacaugcacacauacacgugcacacauacacaggcacacaugcaugcacaca

SEQ ID NO: 244231 - RNA, 64 nt, Homo Sapiens
cacgugcacacauacacaggcacacaugcaugcacacauacacaugcacacacacaugcacaca

SEQ ID NO: 244232 - RNA, 64 nt, Homo Sapiens
cauauccaugcacacaaacacauauauacacaugcacauacacagauuuuucugcuggccaggu

SEQ ID NO: 244233 - RNA, 64 nt, Homo Sapiens
ugcagaacuguuuuuuuuuuuuuuuuaucuuaaacacauacacaccuccaguuuuugcucuuuu

SEQ ID NO: 244234 - RNA, 64 nt, Homo Sapiens
aaacccuccauguucauuuccagacuuggucaggcacauacauaguaaauuauaaucaaucaug

SEQ ID NO: 244235 - RNA, 64 nt, Homo Sapiens
caugaugugagcaaacacaccacacacacagacacacauacacccacacauacacaccccugaa

SEQ ID NO: 244236 - RNA, 64 nt, Homo Sapiens
ccccugaacacacacacagaacacacaacacacacacauacacacacccugaaaacacacacag

SEQ ID NO: 244237 - RNA, 64 nt, Homo Sapiens
cguucucuuuccccagcgcaaccgaaauaaaugacacauacaaaugugauuuuuuuccuccuuu

SEQ ID NO: 244238 - RNA, 64 nt, Homo Sapiens
ugcagauuuuguacaaaaaaaaaaaagacacacacacauacaugauaaugauucccagcccagg

SEQ ID NO: 244239 - RNA, 64 nt, Homo Sapiens
auccugcaccaccucacuguuccccaugcgcacacacauacacacaccccaaaacacauacauu

SEQ ID NO: 244240 - RNA, 64 nt, Homo Sapiens
uccccaugcgcacacacauacacacaccccaaaacacauacauugaaagugccucaucugaaua

SEQ ID NO: 244241 - RNA, 64 nt, Homo Sapiens
aggggaaaauguguguguacuauggacagucauacacauacaucaaaccaauaccuggugaauc

SEQ ID NO: 244242 - RNA, 64 nt, Homo Sapiens
cacacacacacacucugacucacacacucacacucacauacacaaacuuuuaauguacaucaca

SEQ ID NO: 244243 - RNA, 64 nt, Homo Sapiens
cacacagagucuuuauugcagacacacauacacacacauacacaaggauuacaggcgugagaca

SEQ ID NO: 244244 - RNA, 64 nt, Homo Sapiens
cacauacacacacacagagugcgugagacagacacacauacacaaaugagugcuaggauuacag

SEQ ID NO: 244245 - RNA, 64 nt, Homo Sapiens
cacacacacacguuaucccacccauaaaugcauacacauacaugugaauucccagcuccccauc

SEQ ID NO: 244246 - RNA, 64 nt, Homo Sapiens
caucuuggcacccugauuaucccaucuucacagacacauacaccccuugcagauguagcccuug

SEQ ID NO: 244247 - RNA, 64 nt, Homo Sapiens
gguggccagcuuggaggauggacauuucuggauacacauacacauacaaaacagaaaacauuuu

SEQ ID NO: 244248 - RNA, 64 nt, Homo Sapiens
cagcuuggaggauggacauuucuggauacacauacacauacaaaacagaaaacauuuuuuaaaa

SEQ ID NO: 244249 - RNA, 64 nt, Homo Sapiens
cccuuacccccauccacucugccacacauacauacacauacacagcaguguccagauccccaga

SEQ ID NO: 244250 - RNA, 64 nt, Homo Sapiens
cacauacacacccuuaccccgauccccagagccacacauacauagugagggagggcagugucca

SEQ ID NO: 244251 - RNA, 64 nt, Homo Sapiens
cccucuccuucuccaucucacccucccucucucacacauacacacacaaacacauacacacaac

SEQ ID NO: 244252 - RNA, 64 nt, Homo Sapiens
cucacccucccucucucacacauacacacacaaacacauacacacaacacuaagugccuagacu

SEQ ID NO: 244253 - RNA, 64 nt, Homo Sapiens
ccauauacauauggaguaugcacacacacacauacacauacaauuauauauauauauacacaca

SEQ ID NO: 244254 - RNA, 64 nt, Homo Sapiens
uacaauccauauacauauggcacacacacacacacacauacacaugcaaauauauauauauaua

SEQ ID NO: 244255 - RNA, 64 nt, Homo Sapiens
agugcacagaccacacacagucacacacaguauacacauacacacacaugcacacacguguagc

SEQ ID NO: 244256 - RNA, 64 nt, Homo Sapiens
uccgcauacaggcguacacacacacacacgugcucacauacaugcaucccuacgugcccacugg

SEQ ID NO: 244257 - RNA, 64 nt, Homo Sapiens
gagucuuugcuaugcaccauuuaaaaucuggcuucacauacacacagacacuuguuaccauauu

SEQ ID NO: 244258 - RNA, 64 nt, Homo Sapiens
ccucaaucuagaaagaacuucauauacauagacacacauacacaaacacacaggcacauacacu

SEQ ID NO: 244259 - RNA, 64 nt, Homo Sapiens
cauauacauagacacacauaugaaaacacacaggcacauacacuccauccugcacacaucuccc

SEQ ID NO: 244260 - RNA, 64 nt, Homo Sapiens
ugagaaauuuuauaaauguguauuucuguguauucacauacauauauauauacacacauauaua

SEQ ID NO: 244261 - RNA, 64 nt, Homo Sapiens
uacauauauauauacacacauauauauguacauacacauacauacauauuaccauacugaaggg

SEQ ID NO: 244262 - RNA, 64 nt, Homo Sapiens
cacacagacacacacacacgcaaacacauacacacacauacacaaaauucugcccacacacaca

SEQ ID NO: 244263 - RNA, 64 nt, Homo Sapiens
cacauacacacacacagacacacacacacacaaacacauacacaaaauuaaaagaaauucugcc

SEQ ID NO: 244264 - RNA, 63 nt, Homo Sapiens
guuuauuacuuggcaauaccgauuuagaguugaauggcaaaauuaaaacuaaugcuaauaagg

SEQ ID NO: 244265 - RNA, 63 nt, Homo Sapiens
uaauguaaauaaguuacuauaagaaguuuucuuauggcaaaaauugagagcugacuguugcuu

SEQ ID NO: 244266 - RNA, 63 nt, Homo Sapiens
uguaagcgugucauuuaaguuuuaauuuuagaaauggcaaauugaugucuugaaacccgugca

SEQ ID NO: 244267 - RNA, 63 nt, Homo Sapiens
aaaugcagauuucccaguuauuggguaacaaaaauggcaaaagcacuuugcgcauuguguaag

SEQ ID NO: 244268 - RNA, 63 nt, Homo Sapiens
agugguuaaagagguaaucacagucugagcaacauggcaaaacccugugucuacaaaaaauaa

SEQ ID NO: 244269 - RNA, 63 nt, Homo Sapiens
aucaaaagcugguucuuugaaaagaucuacaaaauggcaaacauuuagcuagauugaccaccc

SEQ ID NO: 244270 - RNA, 63 nt, Homo Sapiens
caaaacauaauuuugugcaaugauaauauuuaaauggcaaaaaucuuucagaauaggauucug

SEQ ID NO: 244271 - RNA, 63 nt, Homo Sapiens
gccaucauuuacuuuuaaacuuaucuuuuuaguauggcaaacuccuauaauuuuagacauucu

SEQ ID NO: 244272 - RNA, 63 nt, Homo Sapiens
uaugcuauuccuggaaaaauagacacaagaaagauggcaaauuauucuaaaccccuuuuccau

SEQ ID NO: 244273 - RNA, 63 nt, Homo Sapiens
agauagauguaguuccuuccgcccagggauacaauggcaaacaguauaacacauucugcuaag

SEQ ID NO: 244274 - RNA, 63 nt, Homo Sapiens
cccaucucuacuaaaaauaccagccuggccaacauggcaaaauugaggccaggaguucaagac

SEQ ID NO: 244275 - RNA, 63 nt, Homo Sapiens
ccacuauuacuuuugcaccauuuuuaauuuuuaauggcaaaagacuaaucgugguuuuugcca

SEQ ID NO: 244276 - RNA, 63 nt, Homo Sapiens
ucucucagaaauuuauguguuggaugguaccuuauggcaaaaaggaugugguuuacaguaagg

SEQ ID NO: 244277 - RNA, 63 nt, Homo Sapiens
uaacaccccacugucaacauaauaauaauaauaauggcaaacugacuuagacucccacauagu

SEQ ID NO: 244278 - RNA, 63 nt, Homo Sapiens
aaagacuguaggagagccaaaaagacaagggaaauggcaaacaaaagagcuguguuuugguuc

SEQ ID NO: 244279 - RNA, 63 nt, Homo Sapiens
aguaaggauggggaccuucuaggacccgugggaauggcaaaacaucuuucucaaaggaagcuu

SEQ ID NO: 244280 - RNA, 63 nt, Homo Sapiens
gcuugcagauauuuuuaaauuuucuuuauugauauggcaaauucagacuugaaucuguagaca

SEQ ID NO: 244281 - RNA, 63 nt, Homo Sapiens
ggagacccagagucacuugccccaauucuacacauggcaaaauccuagaggguagaaaguuuu

SEQ ID NO: 244282 - RNA, 63 nt, Homo Sapiens
caaaauagcuccuacaauuuagggguuuucuuuauggcaaagcacaaacucaacacuaccauc

SEQ ID NO: 244283 - RNA, 63 nt, Homo Sapiens
uuuuaauauuucuguuuucauauauagccaugcauggcaaauaaguaaaacuauguauaauag

SEQ ID NO: 244284 - RNA, 63 nt, Homo Sapiens
uucacaggcuuucacagcaaggguaccuauuucauggcaaaauaggcaguuuuaaaagaauaa

SEQ ID NO: 244285 - RNA, 63 nt, Homo Sapiens
ugagcccaggaguuugagaccagccugggcaacauggcaaaaccccaucucuacaaaaaauac

SEQ ID NO: 244286 - RNA, 63 nt, Homo Sapiens
ugugucuguugugccuugcccggcgccucacggauggcaaagcucuccucacccaugggacug

SEQ ID NO: 244287 - RNA, 63 nt, Homo Sapiens
cuaaaaccagugggaaaacugucugauuucuggauggcaaaggcuuucuaaacucaaaaguga

SEQ ID NO: 244288 - RNA, 63 nt, Homo Sapiens
uggacuugauucuacugguauaguuauccacaaauggcaaaaccaugcuuuuguaucuuguca

SEQ ID NO: 244289 - RNA, 63 nt, Homo Sapiens
caugcuuuuguaucuugucagccagggcuauuuauggcaaacagugugagcgguuugcuguua

SEQ ID NO: 244290 - RNA, 55 nt, Homo Sapiens
gagaaaaauuacaaauaugaaaauuauggcaaagcuuuaaucaauuuacaagucu

SEQ ID NO: 244291 - RNA, 63 nt, Homo Sapiens
auacuggugagaaauucuaaaaaugugaagacuauggcaaagucuuuaaaugguugucacacu

SEQ ID NO: 244292 - RNA, 63 nt, Homo Sapiens
auacuguacaaaaaccccacaagugugaaaaacauggcaaagccuuuaagaagcccucaauuc

SEQ ID NO: 244293 - RNA, 63 nt, Homo Sapiens
auacuggagaaaacgccuacaugugugaacaauauggcaaaacuuaaugcucacacuuuauug

SEQ ID NO: 244294 - RNA, 63 nt, Homo Sapiens
ugagcccaggaguuugaaaccagccuggguaacauggcaaaauccugucuuuacaaaaaauac

SEQ ID NO: 244295 - RNA, 63 nt, Homo Sapiens
ugaagucagaaguuugagaccagccuggcaaacauggcaaaacugucucuauuaaaaauacag

SEQ ID NO: 244296 - RNA, 63 nt, Homo Sapiens
ugccugcuguaugcuauuuuaggagccuguagcauggcaaauccuggccuuccccagccugca

SEQ ID NO: 244297 - RNA, 63 nt, Homo Sapiens
aaugugaaaaggcauugggaauccauaugugcaauggcaaagaaaggaaacucaggcaaaggg

SEQ ID NO: 244298 - RNA, 63 nt, Homo Sapiens
ggaacgcaaagggccgaggagcaucugguuuucauggcaaagcucuacuccagagcuccuuua

SEQ ID NO: 244299 - RNA, 63 nt, Homo Sapiens
cugcuaauuaagugcaauaaauuuuucuagaaaauggcaaagaugacuuccagguggauauug

SEQ ID NO: 244300 - RNA, 63 nt, Homo Sapiens
ucauuaacacaaaauuucauagacaaacaaaacauggcaaauugccaccuucgugguuguaaa

SEQ ID NO: 244301 - RNA, 63 nt, Homo Sapiens
gcuuugagauauaauauugaggaaggccuaagaauggcaaaucuucucauauccaucgugaua

SEQ ID NO: 244302 - RNA, 64 nt, Homo Sapiens; identical to SEQ ID NO: 47378

SEQ ID NO: 244303 - RNA, 64 nt, Homo Sapiens; identical to SEQ ID NO: 47379

SEQ ID NO: 244304 - RNA, 64 nt, Homo Sapiens; identical to SEQ ID NO: 47380

SEQ ID NO: 244305 - RNA, 64 nt, Homo Sapiens; identical to SEQ ID NO: 47381

SEQ ID NO: 244306 - RNA, 64 nt, Homo Sapiens; identical to SEQ ID NO: 47382

SEQ ID NO: 244307 - RNA, 64 nt, Homo Sapiens; identical to SEQ ID NO: 47383

SEQ ID NO: 244308 - RNA, 64 nt, Homo Sapiens; identical to SEQ ID NO: 47384

SEQ ID NO: 244309 - RNA, 64 nt, Homo Sapiens; identical to SEQ ID NO: 47385

SEQ ID NO: 244310 - RNA, 64 nt, Homo Sapiens; identical to SEQ ID NO: 47386

SEQ ID NO: 244311 - RNA, 64 nt, Homo Sapiens; identical to SEQ ID NO: 47387

SEQ ID NO: 244312 - RNA, 64 nt, Homo Sapiens; identical to SEQ ID NO: 47388

SEQ ID NO: 244313 - RNA, 64 nt, Homo Sapiens; identical to SEQ ID NO: 47389

SEQ ID NO: 244314 - RNA, 64 nt, Homo Sapiens; identical to SEQ ID NO: 47390

SEQ ID NO: 244315 - RNA, 64 nt, Homo Sapiens; identical to SEQ ID NO: 47391

SEQ ID NO: 244316 - RNA, 64 nt, Homo Sapiens; identical to SEQ ID NO: 47392

SEQ ID NO: 244317 - RNA, 64 nt, Homo Sapiens; identical to SEQ ID NO: 47393

SEQ ID NO: 244318 - RNA, 64 nt, Homo Sapiens; identical to SEQ ID NO: 47394

SEQ ID NO: 244319 - RNA, 64 nt, Homo Sapiens; identical to SEQ ID NO: 47395

SEQ ID NO: 244320 - RNA, 64 nt, Homo Sapiens; identical to SEQ ID NO: 47396

SEQ ID NO: 244321 - RNA, 64 nt, Homo Sapiens; identical to SEQ ID NO: 47397

SEQ ID NO: 244322 - RNA, 64 nt, Homo Sapiens; identical to SEQ ID NO: 47398

SEQ ID NO: 244323 - RNA, 64 nt, Homo Sapiens; identical to SEQ ID NO: 47399

SEQ ID NO: 244324 - RNA, 64 nt, Homo Sapiens; identical to SEQ ID NO: 47400

SEQ ID NO: 244325 - RNA, 64 nt, Homo Sapiens; identical to SEQ ID NO: 47401

SEQ ID NO: 244326 - RNA, 64 nt, Homo Sapiens; identical to SEQ ID NO: 47402

SEQ ID NO: 244327 - RNA, 64 nt, Homo Sapiens; identical to SEQ ID NO: 47403

SEQ ID NO: 244328 - RNA, 64 nt, Homo Sapiens; identical to SEQ ID NO: 47404

SEQ ID NO: 244329 - RNA, 64 nt, Homo Sapiens; identical to SEQ ID NO: 47405

SEQ ID NO: 244330 - RNA, 64 nt, Homo Sapiens; identical to SEQ ID NO: 47406

SEQ ID NO: 244331 - RNA, 64 nt, Homo Sapiens; identical to SEQ ID NO: 47407

SEQ ID NO: 244332 - RNA, 64 nt, Homo Sapiens; identical to SEQ ID NO: 47408

SEQ ID NO: 244333 - RNA, 64 nt, Homo Sapiens; identical to SEQ ID NO: 47409

SEQ ID NO: 244334 - RNA, 64 nt, Homo Sapiens; identical to SEQ ID NO: 47410

SEQ ID NO: 244335 - RNA, 64 nt, Homo Sapiens; identical to SEQ ID NO: 47411

SEQ ID NO: 244336 - RNA, 64 nt, Homo Sapiens; identical to SEQ ID NO: 47412

SEQ ID NO: 244337 - RNA, 64 nt, Homo Sapiens; identical to SEQ ID NO: 47413

SEQ ID NO: 244338 - RNA, 64 nt, Homo Sapiens; identical to SEQ ID NO: 47414

SEQ ID NO: 244339 - RNA, 64 nt, Homo Sapiens; identical to SEQ ID NO: 47415

SEQ ID NO: 244340 - RNA, 64 nt, Homo Sapiens; identical to SEQ ID NO: 47416

SEQ ID NO: 244341 - RNA, 64 nt, Homo Sapiens; identical to SEQ ID NO: 47417

SEQ ID NO: 244342 - RNA, 64 nt, Homo Sapiens; identical to SEQ ID NO: 47418

SEQ ID NO: 244343 - RNA, 64 nt, Homo Sapiens; identical to SEQ ID NO: 47419

SEQ ID NO: 244344 - RNA, 64 nt, Homo Sapiens; identical to SEQ ID NO: 47420

SEQ ID NO: 244345 - RNA, 64 nt, Homo Sapiens; identical to SEQ ID NO: 47421

SEQ ID NO: 244346 - RNA, 64 nt, Homo Sapiens; identical to SEQ ID NO: 47422

SEQ ID NO: 244347 - RNA, 64 nt, Homo Sapiens; identical to SEQ ID NO: 47423

SEQ ID NO: 244348 - RNA, 64 nt, Homo Sapiens; identical to SEQ ID NO: 47424

SEQ ID NO: 244349 - RNA, 64 nt, Homo Sapiens; identical to SEQ ID NO: 47425

SEQ ID NO: 244350 - RNA, 64 nt, Homo Sapiens; identical to SEQ ID NO: 47426

SEQ ID NO: 244351 - RNA, 64 nt, Homo Sapiens; identical to SEQ ID NO: 47427

SEQ ID NO: 244352 - RNA, 64 nt, Homo Sapiens; identical to SEQ ID NO: 47428

SEQ ID NO: 244353 - RNA, 64 nt, Homo Sapiens; identical to SEQ ID NO: 47429

SEQ ID NO: 244354 - RNA, 64 nt, Homo Sapiens; identical to SEQ ID NO: 47430

SEQ ID NO: 244355 - RNA, 64 nt, Homo Sapiens; identical to SEQ ID NO: 47431

SEQ ID NO: 244356 - RNA, 64 nt, Homo Sapiens; identical to SEQ ID NO: 47432

SEQ ID NO: 244357 - RNA, 64 nt, Homo Sapiens; identical to SEQ ID NO: 47433

SEQ ID NO: 244358 - RNA, 64 nt, Homo Sapiens; identical to SEQ ID NO: 47434

SEQ ID NO: 244359 - RNA, 64 nt, Homo Sapiens; identical to SEQ ID NO: 47435

SEQ ID NO: 244360 - RNA, 64 nt, Homo Sapiens; identical to SEQ ID NO: 47436

SEQ ID NO: 244361 - RNA, 64 nt, Homo Sapiens; identical to SEQ ID NO: 47437

SEQ ID NO: 244362 - RNA, 64 nt, Homo Sapiens; identical to SEQ ID NO: 47438

SEQ ID NO: 244363 - RNA, 64 nt, Homo Sapiens; identical to SEQ ID NO: 47439

SEQ ID NO: 244364 - RNA, 64 nt, Homo Sapiens; identical to SEQ ID NO: 47440

SEQ ID NO: 244365 - RNA, 64 nt, Homo Sapiens; identical to SEQ ID NO: 47441

SEQ ID NO: 244366 - RNA, 64 nt, Homo Sapiens; identical to SEQ ID NO: 47442

SEQ ID NO: 244367 - RNA, 64 nt, Homo Sapiens; identical to SEQ ID NO: 47443

SEQ ID NO: 244368 - RNA, 64 nt, Homo Sapiens; identical to SEQ ID NO: 47444

SEQ ID NO: 244369 - RNA, 64 nt, Homo Sapiens; identical to SEQ ID NO: 47445

SEQ ID NO: 244370 - RNA, 63 nt, Homo Sapiens; identical to SEQ ID NO: 47446

SEQ ID NO: 244371 - RNA, 64 nt, Homo Sapiens; identical to SEQ ID NO: 47447

SEQ ID NO: 244372 - RNA, 64 nt, Homo Sapiens; identical to SEQ ID NO: 47448

SEQ ID NO: 244373 - RNA, 64 nt, Homo Sapiens; identical to SEQ ID NO: 47449

SEQ ID NO: 244374 - RNA, 64 nt, Homo Sapiens; identical to SEQ ID NO: 47450

SEQ ID NO: 244375 - RNA, 64 nt, Homo Sapiens; identical to SEQ ID NO: 47451

SEQ ID NO: 244376 - RNA, 64 nt, Homo Sapiens; identical to SEQ ID NO: 47452

SEQ ID NO: 244377 - RNA, 64 nt, Homo Sapiens; identical to SEQ ID NO: 47453

SEQ ID NO: 244378 - RNA, 64 nt, Homo Sapiens; identical to SEQ ID NO: 47454

SEQ ID NO: 244379 - RNA, 64 nt, Homo Sapiens; identical to SEQ ID NO: 47455

SEQ ID NO: 244380 - RNA, 64 nt, Homo Sapiens; identical to SEQ ID NO: 47456

SEQ ID NO: 244381 - RNA, 64 nt, Homo Sapiens; identical to SEQ ID NO: 47457

SEQ ID NO: 244382 - RNA, 64 nt, Homo Sapiens; identical to SEQ ID NO: 47458

SEQ ID NO: 244383 - RNA, 64 nt, Homo Sapiens; identical to SEQ ID NO: 47459

SEQ ID NO: 244384 - RNA, 64 nt, Homo Sapiens; identical to SEQ ID NO: 47460

SEQ ID NO: 244385 - RNA, 64 nt, Homo Sapiens; identical to SEQ ID NO: 47461

SEQ ID NO: 244386 - RNA, 64 nt, Homo Sapiens; identical to SEQ ID NO: 47462

SEQ ID NO: 244387 - RNA, 64 nt, Homo Sapiens; identical to SEQ ID NO: 47463

SEQ ID NO: 244388 - RNA, 64 nt, Homo Sapiens; identical to SEQ ID NO: 47464

SEQ ID NO: 244389 - RNA, 64 nt, Homo Sapiens; identical to SEQ ID NO: 47465

SEQ ID NO: 244390 - RNA, 64 nt, Homo Sapiens; identical to SEQ ID NO: 47466

SEQ ID NO: 244391 - RNA, 64 nt, Homo Sapiens; identical to SEQ ID NO: 47467

SEQ ID NO: 244392 - RNA, 64 nt, Homo Sapiens; identical to SEQ ID NO: 47468

SEQ ID NO: 244393 - RNA, 64 nt, Homo Sapiens; identical to SEQ ID NO: 47469

SEQ ID NO: 244394 - RNA, 64 nt, Homo Sapiens; identical to SEQ ID NO: 47470

SEQ ID NO: 244395 - RNA, 64 nt, Homo Sapiens; identical to SEQ ID NO: 47471

SEQ ID NO: 244396 - RNA, 64 nt, Homo Sapiens; identical to SEQ ID NO: 47472

SEQ ID NO: 244397 - RNA, 64 nt, Homo Sapiens; identical to SEQ ID NO: 47473

SEQ ID NO: 244398 - RNA, 64 nt, Homo Sapiens; identical to SEQ ID NO: 47474

SEQ ID NO: 244399 - RNA, 64 nt, Homo Sapiens; identical to SEQ ID NO: 47475

SEQ ID NO: 244400 - RNA, 64 nt, Homo Sapiens; identical to SEQ ID NO: 47476

SEQ ID NO: 244401 - RNA, 64 nt, Homo Sapiens; identical to SEQ ID NO: 47477

SEQ ID NO: 244402 - RNA, 64 nt, Homo Sapiens; identical to SEQ ID NO: 47478

SEQ ID NO: 244403 - RNA, 64 nt, Homo Sapiens; identical to SEQ ID NO: 47479

SEQ ID NO: 244404 - RNA, 64 nt, Homo Sapiens; identical to SEQ ID NO: 47480

SEQ ID NO: 244405 - RNA, 64 nt, Homo Sapiens; identical to SEQ ID NO: 47481

SEQ ID NO: 244406 - RNA, 64 nt, Homo Sapiens; identical to SEQ ID NO: 47482

SEQ ID NO: 244407 - RNA, 64 nt, Homo Sapiens; identical to SEQ ID NO: 47483

SEQ ID NO: 244408 - RNA, 64 nt, Homo Sapiens; identical to SEQ ID NO: 47484

SEQ ID NO: 244409 - RNA, 64 nt, Homo Sapiens; identical to SEQ ID NO: 47485

SEQ ID NO: 244410 - RNA, 64 nt, Homo Sapiens; identical to SEQ ID NO: 47486

SEQ ID NO: 244411 - RNA, 64 nt, Homo Sapiens; identical to SEQ ID NO: 47487

SEQ ID NO: 244412 - RNA, 64 nt, Homo Sapiens; identical to SEQ ID NO: 47488

SEQ ID NO: 244413 - RNA, 64 nt, Homo Sapiens; identical to SEQ ID NO: 47489

SEQ ID NO: 244414 - RNA, 64 nt, Homo Sapiens; identical to SEQ ID NO: 47490

SEQ ID NO: 244415 - RNA, 64 nt, Homo Sapiens; identical to SEQ ID NO: 47491

SEQ ID NO: 244416 - RNA, 64 nt, Homo Sapiens; identical to SEQ ID NO: 47492

SEQ ID NO: 244417 - RNA, 64 nt, Homo Sapiens; identical to SEQ ID NO: 47493

SEQ ID NO: 244418 - RNA, 64 nt, Homo Sapiens; identical to SEQ ID NO: 47494

SEQ ID NO: 244419 - RNA, 64 nt, Homo Sapiens; identical to SEQ ID NO: 47495

SEQ ID NO: 244420 - RNA, 64 nt, Homo Sapiens; identical to SEQ ID NO: 47496

SEQ ID NO: 244421 - RNA, 64 nt, Homo Sapiens; identical to SEQ ID NO: 47497

SEQ ID NO: 244422 - RNA, 64 nt, Homo Sapiens; identical to SEQ ID NO: 47498

SEQ ID NO: 244423 - RNA, 64 nt, Homo Sapiens; identical to SEQ ID NO: 47499

SEQ ID NO: 244424 - RNA, 64 nt, Homo Sapiens; identical to SEQ ID NO: 47500

SEQ ID NO: 244425 - RNA, 64 nt, Homo Sapiens; identical to SEQ ID NO: 47501

SEQ ID NO: 244426 - RNA, 64 nt, Homo Sapiens; identical to SEQ ID NO: 47502

SEQ ID NO: 244427 - RNA, 64 nt, Homo Sapiens; identical to SEQ ID NO: 47503

SEQ ID NO: 244428 - RNA, 64 nt, Homo Sapiens; identical to SEQ ID NO: 47504

SEQ ID NO: 244429 - RNA, 64 nt, Homo Sapiens; identical to SEQ ID NO: 47505

SEQ ID NO: 244430 - RNA, 64 nt, Homo Sapiens; identical to SEQ ID NO: 47506

SEQ ID NO: 244431 - RNA, 64 nt, Homo Sapiens; identical to SEQ ID NO: 47507

SEQ ID NO: 244432 - RNA, 64 nt, Homo Sapiens; identical to SEQ ID NO: 47508

SEQ ID NO: 244433 - RNA, 64 nt, Homo Sapiens; identical to SEQ ID NO: 47509

SEQ ID NO: 244434 - RNA, 64 nt, Homo Sapiens; identical to SEQ ID NO: 47510

SEQ ID NO: 244435 - RNA, 64 nt, Homo Sapiens; identical to SEQ ID NO: 47511

SEQ ID NO: 244436 - RNA, 64 nt, Homo Sapiens; identical to SEQ ID NO: 47512

SEQ ID NO: 244437 - RNA, 64 nt, Homo Sapiens; identical to SEQ ID NO: 47513

SEQ ID NO: 244438 - RNA, 64 nt, Homo Sapiens; identical to SEQ ID NO: 47514

SEQ ID NO: 244439 - RNA, 64 nt, Homo Sapiens; identical to SEQ ID NO: 47515

SEQ ID NO: 244440 - RNA, 64 nt, Homo Sapiens; identical to SEQ ID NO: 47516

SEQ ID NO: 244441 - RNA, 64 nt, Homo Sapiens; identical to SEQ ID NO: 47517

SEQ ID NO: 244442 - RNA, 64 nt, Homo Sapiens; identical to SEQ ID NO: 47518

SEQ ID NO: 244443 - RNA, 64 nt, Homo Sapiens; identical to SEQ ID NO: 47519

SEQ ID NO: 244444 - RNA, 64 nt, Homo Sapiens; identical to SEQ ID NO: 47520

SEQ ID NO: 244445 - RNA, 64 nt, Homo Sapiens; identical to SEQ ID NO: 47521

SEQ ID NO: 244446 - RNA, 64 nt, Homo Sapiens; identical to SEQ ID NO: 47522

SEQ ID NO: 244447 - RNA, 64 nt, Homo Sapiens; identical to SEQ ID NO: 47523

SEQ ID NO: 244448 - RNA, 64 nt, Homo Sapiens; identical to SEQ ID NO: 47524

SEQ ID NO: 244449 - RNA, 64 nt, Homo Sapiens; identical to SEQ ID NO: 47525

SEQ ID NO: 244450 - RNA, 64 nt, Homo Sapiens; identical to SEQ ID NO: 47526

SEQ ID NO: 244451 - RNA, 64 nt, Homo Sapiens; identical to SEQ ID NO: 47527

SEQ ID NO: 244452 - RNA, 64 nt, Homo Sapiens; identical to SEQ ID NO: 47528

SEQ ID NO: 244453 - RNA, 64 nt, Homo Sapiens; identical to SEQ ID NO: 47529

SEQ ID NO: 244454 - RNA, 64 nt, Homo Sapiens; identical to SEQ ID NO: 47530

SEQ ID NO: 244455 - RNA, 64 nt, Homo Sapiens; identical to SEQ ID NO: 47531

SEQ ID NO: 244456 - RNA, 64 nt, Homo Sapiens; identical to SEQ ID NO: 47532

SEQ ID NO: 244457 - RNA, 64 nt, Homo Sapiens; identical to SEQ ID NO: 47533

SEQ ID NO: 244458 - RNA, 64 nt, Homo Sapiens; identical to SEQ ID NO: 47534

SEQ ID NO: 244459 - RNA, 64 nt, Homo Sapiens; identical to SEQ ID NO: 47535

SEQ ID NO: 244460 - RNA, 64 nt, Homo Sapiens; identical to SEQ ID NO: 47536

SEQ ID NO: 244461 - RNA, 64 nt, Homo Sapiens; identical to SEQ ID NO: 47537

SEQ ID NO: 244462 - RNA, 64 nt, Homo Sapiens; identical to SEQ ID NO: 47538

SEQ ID NO: 244463 - RNA, 64 nt, Homo Sapiens; identical to SEQ ID NO: 47539

SEQ ID NO: 244464 - RNA, 64 nt, Homo Sapiens; identical to SEQ ID NO: 47540

SEQ ID NO: 244465 - RNA, 64 nt, Homo Sapiens; identical to SEQ ID NO: 47541

SEQ ID NO: 244466 - RNA, 64 nt, Homo Sapiens; identical to SEQ ID NO: 47542

SEQ ID NO: 244467 - RNA, 64 nt, Homo Sapiens; identical to SEQ ID NO: 47543

SEQ ID NO: 244468 - RNA, 64 nt, Homo Sapiens; identical to SEQ ID NO: 47544

SEQ ID NO: 244469 - RNA, 64 nt, Homo Sapiens; identical to SEQ ID NO: 47545

SEQ ID NO: 244470 - RNA, 64 nt, Homo Sapiens; identical to SEQ ID NO: 47546

SEQ ID NO: 244471 - RNA, 64 nt, Homo Sapiens; identical to SEQ ID NO: 47547

SEQ ID NO: 244472 - RNA, 64 nt, Homo Sapiens; identical to SEQ ID NO: 47548

SEQ ID NO: 244473 - RNA, 64 nt, Homo Sapiens; identical to SEQ ID NO: 47549

SEQ ID NO: 244474 - RNA, 64 nt, Homo Sapiens; identical to SEQ ID NO: 47550

SEQ ID NO: 244475 - RNA, 64 nt, Homo Sapiens; identical to SEQ ID NO: 47551

SEQ ID NO: 244476 - RNA, 64 nt, Homo Sapiens; identical to SEQ ID NO: 47552

SEQ ID NO: 244477 - RNA, 64 nt, Homo Sapiens; identical to SEQ ID NO: 47553

SEQ ID NO: 244478 - RNA, 64 nt, Homo Sapiens; identical to SEQ ID NO: 47554

SEQ ID NO: 244479 - RNA, 64 nt, Homo Sapiens; identical to SEQ ID NO: 47555

SEQ ID NO: 244480 - RNA, 64 nt, Homo Sapiens; identical to SEQ ID NO: 47556

SEQ ID NO: 244481 - RNA, 64 nt, Homo Sapiens; identical to SEQ ID NO: 47557

SEQ ID NO: 244482 - RNA, 64 nt, Homo Sapiens; identical to SEQ ID NO: 47558

SEQ ID NO: 244483 - RNA, 64 nt, Homo Sapiens; identical to SEQ ID NO: 47559

SEQ ID NO: 244484 - RNA, 64 nt, Homo Sapiens; identical to SEQ ID NO: 47560

SEQ ID NO: 244485 - RNA, 64 nt, Homo Sapiens; identical to SEQ ID NO: 47561

SEQ ID NO: 244486 - RNA, 64 nt, Homo Sapiens; identical to SEQ ID NO: 47562

SEQ ID NO: 244487 - RNA, 64 nt, Homo Sapiens; identical to SEQ ID NO: 47563

SEQ ID NO: 244488 - RNA, 64 nt, Homo Sapiens; identical to SEQ ID NO: 47564

SEQ ID NO: 244489 - RNA, 64 nt, Homo Sapiens; identical to SEQ ID NO: 47565

SEQ ID NO: 244490 - RNA, 64 nt, Homo Sapiens; identical to SEQ ID NO: 47566

SEQ ID NO: 244491 - RNA, 64 nt, Homo Sapiens; identical to SEQ ID NO: 47567

SEQ ID NO: 244492 - RNA, 64 nt, Homo Sapiens; identical to SEQ ID NO: 47568

SEQ ID NO: 244493 - RNA, 64 nt, Homo Sapiens; identical to SEQ ID NO: 47569

SEQ ID NO: 244494 - RNA, 64 nt, Homo Sapiens; identical to SEQ ID NO: 47570

SEQ ID NO: 244495 - RNA, 64 nt, Homo Sapiens; identical to SEQ ID NO: 47571

SEQ ID NO: 244496 - RNA, 64 nt, Homo Sapiens; identical to SEQ ID NO: 47572

SEQ ID NO: 244497 - RNA, 64 nt, Homo Sapiens; identical to SEQ ID NO: 47573

SEQ ID NO: 244498 - RNA, 64 nt, Homo Sapiens; identical to SEQ ID NO: 47574

SEQ ID NO: 244499 - RNA, 64 nt, Homo Sapiens; identical to SEQ ID NO: 47575

SEQ ID NO: 244500 - RNA, 64 nt, Homo Sapiens; identical to SEQ ID NO: 47576

SEQ ID NO: 244501 - RNA, 64 nt, Homo Sapiens; identical to SEQ ID NO: 47577

SEQ ID NO: 244502 - RNA, 64 nt, Homo Sapiens; identical to SEQ ID NO: 47578

SEQ ID NO: 244503 - RNA, 64 nt, Homo Sapiens; identical to SEQ ID NO: 47579

SEQ ID NO: 244504 - RNA, 64 nt, Homo Sapiens; identical to SEQ ID NO: 47580

SEQ ID NO: 244505 - RNA, 64 nt, Homo Sapiens; identical to SEQ ID NO: 47581

SEQ ID NO: 244506 - RNA, 64 nt, Homo Sapiens; identical to SEQ ID NO: 47582

SEQ ID NO: 244507 - RNA, 64 nt, Homo Sapiens; identical to SEQ ID NO: 47583

SEQ ID NO: 244508 - RNA, 64 nt, Homo Sapiens; identical to SEQ ID NO: 47584

SEQ ID NO: 244509 - RNA, 64 nt, Homo Sapiens; identical to SEQ ID NO: 47585

SEQ ID NO: 244510 - RNA, 64 nt, Homo Sapiens; identical to SEQ ID NO: 47586

SEQ ID NO: 244511 - RNA, 64 nt, Homo Sapiens; identical to SEQ ID NO: 47587

SEQ ID NO: 244512 - RNA, 64 nt, Homo Sapiens; identical to SEQ ID NO: 47588

SEQ ID NO: 244513 - RNA, 64 nt, Homo Sapiens; identical to SEQ ID NO: 47589

SEQ ID NO: 244514 - RNA, 64 nt, Homo Sapiens; identical to SEQ ID NO: 47590

SEQ ID NO: 244515 - RNA, 64 nt, Homo Sapiens; identical to SEQ ID NO: 47591

SEQ ID NO: 244516 - RNA, 64 nt, Homo Sapiens; identical to SEQ ID NO: 47592

SEQ ID NO: 244517 - RNA, 64 nt, Homo Sapiens; identical to SEQ ID NO: 47593

SEQ ID NO: 244518 - RNA, 64 nt, Homo Sapiens; identical to SEQ ID NO: 47594

SEQ ID NO: 244519 - RNA, 64 nt, Homo Sapiens; identical to SEQ ID NO: 47595

SEQ ID NO: 244520 - RNA, 64 nt, Homo Sapiens; identical to SEQ ID NO: 47596

SEQ ID NO: 244521 - RNA, 64 nt, Homo Sapiens; identical to SEQ ID NO: 47597

SEQ ID NO: 244522 - RNA, 64 nt, Homo Sapiens; identical to SEQ ID NO: 47598

SEQ ID NO: 244523 - RNA, 64 nt, Homo Sapiens; identical to SEQ ID NO: 47599

SEQ ID NO: 244524 - RNA, 64 nt, Homo Sapiens; identical to SEQ ID NO: 47600

SEQ ID NO: 244525 - RNA, 64 nt, Homo Sapiens; identical to SEQ ID NO: 47601

SEQ ID NO: 244526 - RNA, 64 nt, Homo Sapiens; identical to SEQ ID NO: 47602

SEQ ID NO: 244527 - RNA, 53 nt, Homo Sapiens
gcccuguuugcuuuuuauaaaccaaacucuaucugaaaucccaacaaaaaaaa

SEQ ID NO: 244528 - RNA, 64 nt, Homo Sapiens
acgcauguuauggugcuaauguacuuucacuuuuaaacucuagaucagaauuguugacuugcau

SEQ ID NO: 244529 - RNA, 64 nt, Homo Sapiens
gucauauuagaaacauguuacauaucuuuggccaaaacucuauuuuguauuagcuuaaugucua

SEQ ID NO: 244530 - RNA, 64 nt, Homo Sapiens
cuagagcaaaaaucaaauaguuuuaagacauccaaaacucuauguuguuuacaaagaguuuagu

SEQ ID NO: 244531 - RNA, 64 nt, Homo Sapiens
acaucaucaggacugcauugcucaggcauuuucuaaacucuaaauuuacgagcuguacaaaaaa

SEQ ID NO: 244532 - RNA, 64 nt, Homo Sapiens
guuuccuguauaauauaugaauguuucugagaagaaacucuaaauaguugaaaggcuaaccugc

SEQ ID NO: 244533 - RNA, 64 nt, Homo Sapiens
uaaaugcuuucuagugaaaaauuauaaucuacuuaaacucuaaucagaaaaaaaauucucaaaa

SEQ ID NO: 244534 - RNA, 64 nt, Homo Sapiens
aauaaucaugcuuuuuuccuaugguuacagcauuaaacucuauuuuaaguuguuuuugaacuuu

SEQ ID NO: 244535 - RNA, 64 nt, Homo Sapiens
ccuuucgauaucuaaaaggacucacaguggagaaaaacucuaugaguguaagcaaugugggaaa

SEQ ID NO: 244536 - RNA, 64 nt, Homo Sapiens
acuucaaaugcauggaagcacucacacuuggcagaaacucuaugaauguaagcaguaugggaaa

SEQ ID NO: 244537 - RNA, 64 nt, Homo Sapiens
aauguaaaccauguggugaaaaagaaaaagaaauaaacucuaugaucucaaaaaaaauaaaaaa

SEQ ID NO: 244538 - RNA, 64 nt, Homo Sapiens
gcuugggcacgguggcucauaucacauuggaaauaaacucuauguaccugagaaaauuaaacaa

SEQ ID NO: 244539 - RNA, 64 nt, Homo Sapiens
aaugcaagcagugugggaaaacacuggagagaagaaacucuauggcaaagucaugaaagaacuc

SEQ ID NO: 244540 - RNA, 64 nt, Homo Sapiens
auaacauuuugugcauaauugaguacuggauggaaaacucuacacacuguuuugcaucaagcug

SEQ ID NO: 244541 - RNA, 64 nt, Homo Sapiens
cuccccuuauggucuaccagauuaacaaugaaggaaacucuaaacccuuacucaaaaucagaua

SEQ ID NO: 244542 - RNA, 64 nt, Homo Sapiens
accaggugugagaggugugguagcagauugcaaugcucugcaccucuuccuugcaagugagcaa

SEQ ID NO: 244543 - RNA, 64 nt, Homo Sapiens
gucaugcuguagagccaggauuccuagacccagggcucugcacucucaaggcuggccccaugug

SEQ ID NO: 244544 - RNA, 64 nt, Homo Sapiens
gagcagcagagcuagagccaccggucauccuggggcucugcacauccagugcccuggguucuuc

SEQ ID NO: 244545 - RNA, 64 nt, Homo Sapiens
cuguggccuggcugcgggauggugaagcucuggagcucugcaucaccggcaacuacagcagccg

SEQ ID NO: 244546 - RNA, 64 nt, Homo Sapiens
uggauggaguuuucuuuuguccaugugaaucacagcucugcaccuuauucaucuccuggaauuu

SEQ ID NO: 244547 - RNA, 64 nt, Homo Sapiens
uuauucaucuccuggaauuucucuaaaaaucccggcucugcacaaagacacuugagaaagaauc

SEQ ID NO: 244548 - RNA, 64 nt, Homo Sapiens
caugcugacuguccugauugcucacagccuaggugcucugcagguaaggccuuggccccauccu

SEQ ID NO: 244549 - RNA, 64 nt, Homo Sapiens
aacaagaacaaacaacaucaaagaggaucuuccagcucugcaaaauuccaggcccaugagggga

SEQ ID NO: 244550 - RNA, 64 nt, Homo Sapiens
gccaggaugacggcuuucauugccaggggcgggggcucugcauauggacagggucucugcugac

SEQ ID NO: 244551 - RNA, 64 nt, Homo Sapiens
guguuuaugccuuugcgggucaugugaauucuuagcucugcaaguugcccccaacuuggcucgg

SEQ ID NO: 244552 - RNA, 64 nt, Homo Sapiens
aaaacccuaaugguuucuuguugcucuggaggcugcucugcaugacucuuccucucagagaaug

SEQ ID NO: 244553 - RNA, 64 nt, Homo Sapiens
aacaaccaggcuccccugcaggaacaugaggcuggcucugcagcguuuagaaaggauguuuagg

SEQ ID NO: 244554 - RNA, 64 nt, Homo Sapiens
cuccccucagcagucugagugcaaccccguuggugcucugcaggagcugguggugcagaaaggc

SEQ ID NO: 244555 - RNA, 64 nt, Homo Sapiens
gaacuguccacccagccggccacugugugucauggcucugcaaccaccagggaggcagcccgug

SEQ ID NO: 244556 - RNA, 64 nt, Homo Sapiens
ugggaggggcaccguccggacuuacaggagggcagcucugcagugcagcuggcucgggagccgg

SEQ ID NO: 244557 - RNA, 64 nt, Homo Sapiens
cgguucuccgggcccuggucccagcccacccucggcucugcagccaauuacuugaccugcagcc

SEQ ID NO: 244558 - RNA, 64 nt, Homo Sapiens
aaauggcugagauuuggugaucuccccacagcuggcucugcaaguuaccucuuucuccuugggc

SEQ ID NO: 244559 - RNA, 64 nt, Homo Sapiens
auuuguuuaugcaguacggccugacauugcuuuugcucugcaacagcagagucgagucauugca

SEQ ID NO: 244560 - RNA, 64 nt, Homo Sapiens
ugcgaauagagaggaagcuggaaaaguuccuggggcucugcagccaggaaggggaaccagggca

SEQ ID NO: 244561 - RNA, 64 nt, Homo Sapiens
gcggaagacaccuggggcgggcagauccauagcugcucugcagggcagcauuccaguccccuuu

SEQ ID NO: 244562 - RNA, 64 nt, Homo Sapiens
auuccaguccccuuugcagaaaauggagcccggggcucugcagcuucauccugccagaguuucc

SEQ ID NO: 244563 - RNA, 64 nt, Homo Sapiens
guccucccaacugaaaacaaugccagaaaaaugugcucugcaguaugggcaucuuggcucuccc

SEQ ID NO: 244564 - RNA, 64 nt, Homo Sapiens
uuuaucauauaguuuuuuuccaugauaauggccggcucugcaaaaguguaucguuacaguaaga

SEQ ID NO: 244565 - RNA, 64 nt, Homo Sapiens
cgccucaacuccuggucuccugagcucugcaaucgcucugcagugcuggucuucaucacgucua

SEQ ID NO: 244566 - RNA, 64 nt, Homo Sapiens
cgcucugcagucgccucaaccaucacgucuaugagcucugcaauugcagugcccagcuggucuu

SEQ ID NO: 244567 - RNA, 64 nt, Homo Sapiens
aauucuccaucaaauauacagcauaaguaaaacugcucugcacuguuuaauccauuuccaaggg

SEQ ID NO: 244568 - RNA, 64 nt, Homo Sapiens
caugggcauugcaagugccaccgugcggggccuggcucugcacacccaggaaaagucugcagac

SEQ ID NO: 244569 - RNA, 64 nt, Homo Sapiens
auccccuuagaauuucaucuuucucgaugagcaggcucugcacccacucuuuuuuugccccccg

SEQ ID NO: 244570 - RNA, 64 nt, Homo Sapiens
aggaaaaagaagcuugaauuuuaagacugaggcugcucugcagauucuaguuuggcuuucagag

SEQ ID NO: 244571 - RNA, 59 nt, Homo Sapiens
uggcuacagcauggggugcccuauaggcacaagcccagcugaagaacagaauggagggc

SEQ ID NO: 244572 - RNA, 59 nt, Homo Sapiens
ugacugcagaagaccaagaaccuguuccccaagcccagagauguccaccugggcuggac

SEQ ID NO: 244573 - RNA, 59 nt, Homo Sapiens
ggggaggaugacaagccgcugcccaccuccaagcccaggaaacaguacaagauggcuaa

SEQ ID NO: 244574 - RNA, 59 nt, Homo Sapiens
gguggcuccagaaagggcauccucuaccccaagcccaaagccugcugggugucccccau

SEQ ID NO: 244575 - RNA, 59 nt, Homo Sapiens
aggugucaggauagucacagccacauccccaagcccaccugccccuuucaggccuacag

SEQ ID NO: 244576 - RNA, 59 nt, Homo Sapiens
cuugguuucugugagaauagugccccacccaagcccaaacucagcugacccggccucuc

SEQ ID NO: 244577 - RNA, 59 nt, Homo Sapiens
cccagggcgcuuagggagaaaucgaccagcaagcccagcccuccccgcaagcugguccc

SEQ ID NO: 244578 - RNA, 59 nt, Homo Sapiens
cccuugucagcuuagggggaaccucaagacaagcccacgguaaccagggcacaucaccc

SEQ ID NO: 244579 - RNA, 59 nt, Homo Sapiens
cuaaagacaccuuccuuuccacuggcugucaagcccacagggcaccagugccacccagg

SEQ ID NO: 244580 - RNA, 59 nt, Homo Sapiens
aggccuugccuucugagagcccccguggccaagcccaggucacagaucuucccccgacc

SEQ ID NO: 244581 - RNA, 59 nt, Homo Sapiens
cucagugcagggacgucaccccugccaggcaagcccagggcacagaugccaggauggcu

SEQ ID NO: 244582 - RNA, 59 nt, Homo Sapiens
ucucagugcgaggcuucaccccugccaggcaagcccagggcauagaugcugagacagcc

SEQ ID NO: 244583 - RNA, 59 nt, Homo Sapiens
cucagugcagggacgucaccccugccaggcaagcccagggcacagaggccgggacggcc

SEQ ID NO: 244584 - RNA, 59 nt, Homo Sapiens
ucucagugugaggcuucacccaugcuaggcaagcccagggcacagaugccgggauggcc

SEQ ID NO: 244585 - RNA, 59 nt, Homo Sapiens
cucagugcgggaacgucaccccugccaggcaagcccagggcacagaugcugcgauggcc

SEQ ID NO: 244586 - RNA, 59 nt, Homo Sapiens
gccaagcagaagcuccuggagauugccaccaagcccacguacccggugagccugggggc

SEQ ID NO: 244587 - RNA, 59 nt, Homo Sapiens
gcagcaagcacaauaccauuaaaaagccucaagcccaaggcagaagaccuaucugcauu

SEQ ID NO: 244588 - RNA, 59 nt, Homo Sapiens
cugagggagagggggccgggagggguugucaagcccacccgggaaacugagcccuggag

SEQ ID NO: 244589 - RNA, 59 nt, Homo Sapiens
gcagguagaccuguggggauggcucgguccaagcccaacacugcccgcuccagagagcc

SEQ ID NO: 244590 - RNA, 59 nt, Homo Sapiens
gacaccuggagcccccaggaaugcggccacaagcccagggacagaggcagacuggagug

SEQ ID NO: 244591 - RNA, 59 nt, Homo Sapiens
gaugccuggaguccccaggaaugcugccccaagcccaggcagaggcagagacugaagug

SEQ ID NO: 244592 - RNA, 64 nt, Homo Sapiens
agucucccaaagagccauuucaacagagaagggaaaugacaaaggggcagcuggccagauaagc

SEQ ID NO: 244593 - RNA, 64 nt, Homo Sapiens
ggcagagauaaucgugucuuaaaaguuguuuuuaaaugacaauaaaacaagccagaaugucuuu

SEQ ID NO: 244594 - RNA, 64 nt, Homo Sapiens
gcuuguugaacgguccacuuucuuugaugaguggaaugacaagcaaugucugaugccuuuuugu

SEQ ID NO: 244595 - RNA, 64 nt, Homo Sapiens
accauuuauggaugacaacaauuuuuuuuuuguaaaugacaagaaauucuuaugcagccuuuua

SEQ ID NO: 244596 - RNA, 64 nt, Homo Sapiens
aaguggaaaccguguaaauaguggcauugucuguaaugacaaaucauauacuaagauguucacu

SEQ ID NO: 244597 - RNA, 64 nt, Homo Sapiens
gagacaaaaagcacuaguauggcacccacaaauaaaugacaaguaauucuacaacuuuuccuaa

SEQ ID NO: 244598 - RNA, 64 nt, Homo Sapiens
guaaaaaaaaaaaaaaaaaagggcagccuucuuaaaugacaaauaaugaauuaugaauaccgca

SEQ ID NO: 244599 - RNA, 64 nt, Homo Sapiens
auaaacaguucaagugaagcauguugcaauguugaaugacaaaaaaagaauccauuugaagaca

SEQ ID NO: 244600 - RNA, 64 nt, Homo Sapiens
uaaauauauugauagaccugucauuguauugauuaaugacaaaacccuuuagauaauuaucuuc

SEQ ID NO: 244601 - RNA, 64 nt, Homo Sapiens
gaggaaaguugauuugaagugaggauuagaagugaaugacaauaaagucugucagccaagcacg

SEQ ID NO: 244602 - RNA, 64 nt, Homo Sapiens
agaauuccacugcccaaaggagucuuccugaaugaaugacaaucaggaccaaaaacagaaauac

SEQ ID NO: 244603 - RNA, 64 nt, Homo Sapiens
auucuacaguaggaaacugaacugugacuacugaaaugacaagaaaaaaccuagaacaaguuua

SEQ ID NO: 244604 - RNA, 64 nt, Homo Sapiens
auuuguaagaaacauuuaaauuuucauugaaauaaaugacaagucauacugccacuuaaaaaaa

SEQ ID NO: 244605 - RNA, 64 nt, Homo Sapiens
ccuccuugguuuaccuccaucauuaaaaaacaacaaugacaacgacaacaaaaaacaaaacuaa

SEQ ID NO: 244606 - RNA, 64 nt, Homo Sapiens
uauuguauguguguuguaaucuaaaaaaaaaaagaaugacaaacagcuucuuuaagacaagucu

SEQ ID NO: 244607 - RNA, 64 nt, Homo Sapiens
aguuuucuuugaaaguauuggaaaacuaaaauuaaaugacaaggacuuugaauuagaauuuugc

SEQ ID NO: 244608 - RNA, 64 nt, Homo Sapiens
ugaaccauauguaaguaaucauugguuccaggauaaugacaaauuagggcucaaacuacucucu

SEQ ID NO: 244609 - RNA, 64 nt, Homo Sapiens
ucaguuuggagacagaaaaaacagcaguuucaaaaaugacaaaguuccauugagaggaauguuu

SEQ ID NO: 244610 - RNA, 64 nt, Homo Sapiens
cacugcuauuagacaauugaugaccugagaccuuaaugacaaauuuagauuuuaaauguauuau

SEQ ID NO: 244611 - RNA, 64 nt, Homo Sapiens
auguguagcuguguucaauuuugaguagagcaaaaaugacaaagauaaacuuuuucagaaagaa

SEQ ID NO: 244612 - RNA, 64 nt, Homo Sapiens
acaaauaacaaugaauguuugauacacaaguauaaaugacaagugcuuaccguuuugucuauaa

SEQ ID NO: 244613 - RNA, 64 nt, Homo Sapiens
ugguugaagcugguaaucaaacaaaguguaaugaaaugacaagcgaaugucucuugacuaauug

SEQ ID NO: 244614 - RNA, 64 nt, Homo Sapiens
gaccaaaagacccaccacuguauuuugaccaaauaaugacaacuucuuuagaaauuugaauggc

SEQ ID NO: 244615 - RNA, 64 nt, Homo Sapiens
cccgaugacuauucaaaucagcaucuagaggcugaaugacaaugccaaacacuccaccucugau

SEQ ID NO: 244616 - RNA, 64 nt, Homo Sapiens
aauaucugcaguuauccaggugaaacagaauggaaaugacaagaaguguauuguucugcagugu

SEQ ID NO: 244617 - RNA, 54 nt, Homo Sapiens
uauucucggcugcaaaaaucggaaaaugacaaagaccacucccuuaaagacuga

SEQ ID NO: 244618 - RNA, 64 nt, Homo Sapiens
aauguuauguugagguuaugccucuacuggcuuuaaugacaaauuugccuaaagauaucuggga

SEQ ID NO: 244619 - RNA, 64 nt, Homo Sapiens
uauucuuucauaaaacuaugucugaauuucauguaaugacaacaaauggaaaauugugguuaau

SEQ ID NO: 244620 - RNA, 64 nt, Homo Sapiens
aaaaauucuuuuugauuauuuauauugaacugucaaugacaaauaauuaauguuuuacuuaauu

SEQ ID NO: 244621 - RNA, 64 nt, Homo Sapiens
auauuuuaacuuuggugggguuuugauuuccuggaaugacaauugagugugcuauucuaaaaga

SEQ ID NO: 244622 - RNA, 64 nt, Homo Sapiens
gaagcauuugacucguuguacuucagagaccauaaaugacaagguuuugacauuuuugaagaga

SEQ ID NO: 244623 - RNA, 64 nt, Homo Sapiens
uaucugagccuucaguuagucauuuggucaaaccaaugacaaaaccgccuuccacaaaaguuga

SEQ ID NO: 244624 - RNA, 64 nt, Homo Sapiens
caugguuaauauauauacuugcuaauggaaaggagagacaaaagcaccaaaauaauaaaaggca

SEQ ID NO: 244625 - RNA, 64 nt, Homo Sapiens
cuuaacaaagaaauaacaguauaaauggaaucuugagacaaaacuaauucagugcuauccaguu

SEQ ID NO: 244626 - RNA, 64 nt, Homo Sapiens
agcauguauauaagagcacguuguaaacuugaaagagacaaaggcacaaauguggcuguugauu

SEQ ID NO: 244627 - RNA, 64 nt, Homo Sapiens
ccuagacuaggacuccagugcccuccucucccaagagacaaaggccauugcauugaaggaggug

SEQ ID NO: 244628 - RNA, 64 nt, Homo Sapiens
gugagacucuuuaaaaaaagaaauuaaaagaguugagacaaacguuuccuacauucuuuuccau

SEQ ID NO: 244629 - RNA, 64 nt, Homo Sapiens
cagcaccguuccgacagggaccagugaaagaaaagagacaaaguuagaacgugcuggggagcgg

SEQ ID NO: 244630 - RNA, 64 nt, Homo Sapiens
ggaucaccugagguuaggaguucgagaccagccuggccaacaugguaaaaccccaucucuacua

SEQ ID NO: 244631 - RNA, 64 nt, Homo Sapiens
ucugccaauuuuuuaaaaaaguaaguaccacucaggccaacaagccaacgacaaagccaaacuc

SEQ ID NO: 244632 - RNA, 64 nt, Homo Sapiens
gugaaaccccaucucuacaguucgagaccacccuggccaacaugagaucaccugaggucaggag

SEQ ID NO: 244633 - RNA, 64 nt, Homo Sapiens
gugaaaccuggccucuacuauuugagaccagccuggccaacaugggaucaccugagguuagaag

SEQ ID NO: 244634 - RNA, 64 nt, Homo Sapiens
acggaucacgaggucaggagaucaagaccauccuggccaacauggugaaaccccaucucuacug

SEQ ID NO: 244635 - RNA, 64 nt, Homo Sapiens
ggaucucuugaggucgggaguuugagaccagccuggccaacauggugaaacccugucuuuacua

SEQ ID NO: 244636 - RNA, 64 nt, Homo Sapiens
ggaccacaugaggucaggaguuugagaucagccuggccaacauggugaaaccccaucucuacua

SEQ ID NO: 244637 - RNA, 64 nt, Homo Sapiens
gcggaucaugaggucaagagaucaagaucauccuggccaacauggugaaacccugucucuacua

SEQ ID NO: 244638 - RNA, 64 nt, Homo Sapiens
agaucacuugaggucagaaguuugagaccagccaggccaacauggugaaacuucaucucuacua

SEQ ID NO: 244639 - RNA, 64 nt, Homo Sapiens
guggaucacaaggucaagagaucgagaccauccuggccaacauggugaaacccugucucuauua

SEQ ID NO: 244640 - RNA, 64 nt, Homo Sapiens
uaggaugcuacuugcugcaaacaagcccuacuuuggccaacauccugcuuauuucucaaaaaag

SEQ ID NO: 244641 - RNA, 64 nt, Homo Sapiens
gaucaccugaggucaggaguuuugagaccagccuggccaacaugguaaaaucccgucucuacua

SEQ ID NO: 244642 - RNA, 64 nt, Homo Sapiens
gugaaacccugucucuacuauuggagaccagccuggccaacaugggaugacuugaggccaggag

SEQ ID NO: 244643 - RNA, 64 nt, Homo Sapiens
cuuucuccuugguggaaacuggaguccuaccucgggccaacacuuuggcuuucccacagaggca

SEQ ID NO: 244644 - RNA, 64 nt, Homo Sapiens
gugaaaccccgucucuacuaaucgagaccauccuggccaacauggcggaucacaagguccagag

SEQ ID NO: 244645 - RNA, 64 nt, Homo Sapiens
gcaaaaucccaucucuacuauucaagaccagccuggccaacaugggaucacuugaggccaggag

SEQ ID NO: 244646 - RNA, 64 nt, Homo Sapiens
gcacuuugggaggccaggaguucgagaccagccuggccaacauggugaaacccggucucuacua

SEQ ID NO: 244647 - RNA, 64 nt, Homo Sapiens
ggaucaccugaggucaggaguuugagaccagccuggccaacauggcaaaaccccgucucuacaa

SEQ ID NO: 244648 - RNA, 64 nt, Homo Sapiens
gugaaaccccaucucuacuacucgagaccagccuggccaacacgggaucacuugaggucaggag

SEQ ID NO: 244649 - RNA, 64 nt, Homo Sapiens
gugaaaccccaucucuacuacucaagaccagccuggccaacaugggaucacuugaggucaggag

SEQ ID NO: 244650 - RNA, 64 nt, Homo Sapiens
gugaaaccccgucucuauuauuugagaccagccuggccaacauaggaucacucaaggucaggca

SEQ ID NO: 244651 - RNA, 64 nt, Homo Sapiens
gcaaaaccccgucucuacuauugcagaccagccuggccaacaugagaucaccugaggcuaggag

SEQ ID NO: 244652 - RNA, 64 nt, Homo Sapiens
ggaucagcugaggucaggaguuggagaccagcguggccaacauggugaaaccccgucucuacua

SEQ ID NO: 244653 - RNA, 64 nt, Homo Sapiens
gcggaucacgaggucaggagaucgagaccauccuggccaacacggugaaaccucgucuccacua

SEQ ID NO: 244654 - RNA, 64 nt, Homo Sapiens
gugaaaccccaucucuacuauucaagaccagccuggccaacaugcgaucacuugaggucaggag

SEQ ID NO: 244655 - RNA, 64 nt, Homo Sapiens
augagaccuccgucucuacuuucaagaccagccuggccaacaugggaucacuugaggccaggag

SEQ ID NO: 244656 - RNA, 64 nt, Homo Sapiens
agcaccgcagcgggagccagcagggggcagcagaggccaacagggagcucgcaggccgggcccc

SEQ ID NO: 244657 - RNA, 64 nt, Homo Sapiens
gcggaucacaaggucaggaguucgagaccagccuggccaacacggugaaaccccgacucuacua

SEQ ID NO: 244658 - RNA, 64 nt, Homo Sapiens
gugaaaccccaucucuacuauuugagaccacccuggccaacaugagguggguggaucacuggag

SEQ ID NO: 244659 - RNA, 64 nt, Homo Sapiens
gugaaaccccaucucuacuauucgagaccagccuggccaacauagcggaucacgaggucaggag

SEQ ID NO: 244660 - RNA, 64 nt, Homo Sapiens
gugaaaccccaucucuacuauucaagaccagccuggccaacaugagaucacuugaggucaggag

SEQ ID NO: 244661 - RNA, 64 nt, Homo Sapiens
gcaaaaccucaucucuacuauugagaacuggccuggccaacauagaucacuugagguuaggagu

SEQ ID NO: 244662 - RNA, 64 nt, Homo Sapiens
gugaaaccccgucucuacuauucgagaccauccuggccaacauggcagaucacgaggucaggag

SEQ ID NO: 244663 - RNA, 64 nt, Homo Sapiens
gcaaaaccccgucucuacuauuagagaccagccuggccaacaagggauugcuugaggccaggag

SEQ ID NO: 244664 - RNA, 63 nt, Homo Sapiens
aaacugucugucuaauggucacagagcacuguagcacuuaacagauugccauggacaccaguu

SEQ ID NO: 244665 - RNA, 63 nt, Homo Sapiens
uucuuuagugggggaggguaagaaaagcaguuugcacuuaaaaagaaaaaaaaaaaacgggug

SEQ ID NO: 244666 - RNA, 63 nt, Homo Sapiens
guuuacaaagcccuuucacgccuuguguggucagcacuuaacuauaaucaguauaauaauuug

SEQ ID NO: 244667 - RNA, 63 nt, Homo Sapiens
uucagcuugucucauccccaagagugacugagagcacuuaacacaccuguggccccuaaaccc

SEQ ID NO: 244668 - RNA, 63 nt, Homo Sapiens
gagcagagaugcagccagugccaaauucauugagcacuuaaaguuuuucuuuccucccuuacc

SEQ ID NO: 244669 - RNA, 63 nt, Homo Sapiens
ggaggagggcgcagggugggagaaguuuugaaugcacuuaaccugacuaggaguguuaggggc

SEQ ID NO: 244670 - RNA, 63 nt, Homo Sapiens
uguaaauugaauaauuuauccagauagcaguuagcacuuaaucguuuuaaauuaauuuuuuag

SEQ ID NO: 244671 - RNA, 63 nt, Homo Sapiens
aauaaagguacuuuacagcaaacugucgcugaagcacuuaagaaaucaauuaguaauggcgga

SEQ ID NO: 244672 - RNA, 63 nt, Homo Sapiens
gcacuuuuuuaugaagaaaaacaagcugacuuggcacuuaaguuauuuaaaaauuguuucuug

SEQ ID NO: 244673 - RNA, 63 nt, Homo Sapiens
gcuguugagggccacuuuuugcuaaagcacuuugcacuuaaugugcaggugacagcaggacuu

SEQ ID NO: 244674 - RNA, 63 nt, Homo Sapiens
caauuuucaaauguacucaagcugucuagucaugcacuuaaagauaugcaaucacucguuuau

SEQ ID NO: 244675 - RNA, 63 nt, Homo Sapiens
uucaguaguagucuugacuuucuugauagaacugcacuuaauugcgugcaguucauuucuagu

SEQ ID NO: 244676 - RNA, 63 nt, Homo Sapiens
uuucuuaauuauuauaaaaauauuaagacaauagcacuuaaauuccucaacaguguuuucaga

SEQ ID NO: 244677 - RNA, 63 nt, Homo Sapiens
uuuuucauuuuaaaaaguccauaccuuauauaugcacuuaauuuguuggggcuuuacauacuu

SEQ ID NO: 244678 - RNA, 63 nt, Homo Sapiens
ucaaaguaguucaacaugcaacuaucuauauuugcacuuaaaagcaagugacaaucagaggug

SEQ ID NO: 244679 - RNA, 63 nt, Homo Sapiens
uuuuuuuuuuuuuuuuaguguccaagaguaguugcacuuaacuuugacuccccuuauucccuc

SEQ ID NO: 244680 - RNA, 63 nt, Homo Sapiens
gcagguaguguuuaguuaucuacugcauuaugagcacuuaaaguacugcuagcuguagaacuc

SEQ ID NO: 244681 - RNA, 63 nt, Homo Sapiens
acuuucuauuuuuagccuauauuuggaaagaaagcacuuaacauuuuaggaauucuuuuuaaa

SEQ ID NO: 244682 - RNA, 63 nt, Homo Sapiens
aaaagauacagugauauagcauauguaccaguggcacuuaaccuuuuguuuuuuuucaucuua

SEQ ID NO: 244683 - RNA, 63 nt, Homo Sapiens
auggaacccaaacagaagagugucuauuucugugcacuuaacagguuucaguacaaaugcugc

SEQ ID NO: 244684 - RNA, 64 nt, Homo Sapiens
uaagacauaugcauuuauggcuugcauaugucaucccauauaacggcaaagucaaugaguacaa

SEQ ID NO: 244685 - RNA, 64 nt, Homo Sapiens
uugaaaugcaaacuuaaacauuuuuaagaaaacacccauauauaaaauauuucaaccuuucaua

SEQ ID NO: 244686 - RNA, 64 nt, Homo Sapiens
agauauaacaugcucaugauaaaaaagaauugaaauaguugaaaaggguguucagugaaaagua

SEQ ID NO: 244687 - RNA, 64 nt, Homo Sapiens
gguuaaugcuuuguuagauagcuucauccagucaauaguugaaaaguuuucacauaauccagua

SEQ ID NO: 244688 - RNA, 64 nt, Homo Sapiens
auauaaauuuauauuacaguugaaagcaauguaaauaguugaaacaugucuuaaugaauguugu

SEQ ID NO: 244689 - RNA, 64 nt, Homo Sapiens
aacacuuuaggaguuuuguacacuuaaccugcugauaguugaaggucuuuuugcaaguaugaau

SEQ ID NO: 244690 - RNA, 64 nt, Homo Sapiens
cuaggaaaaaauaauguuaacaggcuuuaauugcauaguugaguugucuuacauuuuccaaaag

SEQ ID NO: 244691 - RNA, 64 nt, Homo Sapiens
auuauucaccuaagaauagagugacuuacuaaaaauaguugaaagacuuuucauuuagccccag

SEQ ID NO: 244692 - RNA, 64 nt, Homo Sapiens
uguaacaguuggugauuuuaauccuauacugguuauaguugauacacauauuuguagcuagaau

SEQ ID NO: 244693 - RNA, 64 nt, Homo Sapiens
aagauuucccuaaaaauuccuugcuuucacaaauauaguugaacuuuuaaaaaauaacauauuc

SEQ ID NO: 244694 - RNA, 64 nt, Homo Sapiens
acgucgcuuccugggauuccagcacgaugccuccauaguugaaagacuacacaaaaagccacaa

SEQ ID NO: 244695 - RNA, 64 nt, Homo Sapiens
guuuccagcuaguccuagaguucuauauuucuacauaguugaauuauuuuaucaugcuguugcu

SEQ ID NO: 244696 - RNA, 64 nt, Homo Sapiens
aagccucggccucccugagcucugaccccagccucacccgaaaggccagccuggggcucuccgg

SEQ ID NO: 244697 - RNA, 64 nt, Homo Sapiens
cuaaaugaaauaacuuucuucucuuccccuuccccacccgaauucuuuucugaaguugcuggca

SEQ ID NO: 244698 - RNA, 64 nt, Homo Sapiens
ggguccucugggauuaguuaugcagauauuaaaucacccgaagacacuaacuuacagaagacac

SEQ ID NO: 244699 - RNA, 64 nt, Homo Sapiens
gccaaauuccaggaggacaauucaccgugcccagcacccgaaguaaggacaauguuaucuggga

SEQ ID NO: 244700 - RNA, 64 nt, Homo Sapiens
gcuucugcaccaacucaccucucugguaugaauucacccgaagcagccgagucacacccggugg

SEQ ID NO: 244701 - RNA, 64 nt, Homo Sapiens
cuggcccucugggcccaacgcaggaggcccucagcacccgaacacaucuuccuccuccccaccc

SEQ ID NO: 244702 - RNA, 64 nt, Homo Sapiens
cauacauauauguucacuuagcauuugaacaugacacccgaacaauuuauacauaaaccuaaaa

SEQ ID NO: 244703 - RNA, 64 nt, Homo Sapiens
caauauaggggaaaaaacucgcuccgccuccccccacccgaagcguauccagaccuugaaaguc

SEQ ID NO: 244704 - RNA, 64 nt, Homo Sapiens
ucuuaucuaaucaugaaacuuccgguggagaucccacccgaacggcugaugauuuagagugcug

SEQ ID NO: 244705 - RNA, 64 nt, Homo Sapiens
uuuaagauacaccaaauuucuacuaucuaaucaucacccgaagauuguauacccacgcuucagc

SEQ ID NO: 244706 - RNA, 64 nt, Homo Sapiens
uuguagaaauauucaaacuacuaaaggaaaagcccacccgaaucgaguggauagcuguuuucac

SEQ ID NO: 244707 - RNA, 64 nt, Homo Sapiens
aaauuaaaggaaagggaaagaaauagaucuggugcacccgaacauuaggagaaaaugaaaaaua

SEQ ID NO: 244708 - RNA, 64 nt, Homo Sapiens
uccuuuuuacuugugugguuauguguggggcuggcacccgaaaugugugacauucagcuucuaa

SEQ ID NO: 244709 - RNA, 64 nt, Homo Sapiens
uugcuguggcucagucacauguccucuuaauuggcacccgaauguuuacaagaaaaugaaaagc

SEQ ID NO: 244710 - RNA, 64 nt, Homo Sapiens
cgggcccagccccaggcugcagcccauucgcaggcacccgaaagaacuuccccaguaugguggu

SEQ ID NO: 244711 - RNA, 64 nt, Homo Sapiens
auuauuagaccccggggcagucaggugcuccggacacccgaaggcaauaaaacaggagccgugg

SEQ ID NO: 244712 - RNA, 64 nt, Homo Sapiens
agugguggcugccaucccucggggcccaggcccucacccgaagggcugccucacucuguggugu

SEQ ID NO: 244713 - RNA, 64 nt, Homo Sapiens
gaaggagccgugaggagaggagugaggcaacaggcacccgaagucccucguccuucccucugug

SEQ ID NO: 244714 - RNA, 64 nt, Homo Sapiens
ugggagggaggacugguaccaagguggcgaugaacacccgaaggagaggugccagcaauugcug

SEQ ID NO: 244715 - RNA, 64 nt, Homo Sapiens
gucccucagggugcagggaggggcaucccugaggcacccgaaugucagugccccugggagggaa

SEQ ID NO: 244716 - RNA, 64 nt, Homo Sapiens
gaggacaacccugaggugugguuaguccgcagcucacccgaacaggccucugcugccgggccac

SEQ ID NO: 244717 - RNA, 64 nt, Homo Sapiens
aggcguccaucuguguccucagccucucccuccacacccgaagcacacccccgugcucugcacc

SEQ ID NO: 244718 - RNA, 64 nt, Homo Sapiens
gcgccccugcugucuuccccaccgcagucaccaccacccgaaaugccacguggucacugugcac

SEQ ID NO: 244719 - RNA, 64 nt, Homo Sapiens
agcugccuggccagcccacccuccugcaaccucucacccgaacaccagugaucaggacuggagc

SEQ ID NO: 244720 - RNA, 64 nt, Homo Sapiens
uggacacuggcuccgcccuguuggcuccagcccccacccgaaagggcagcuccuggacagccuc

SEQ ID NO: 244721 - RNA, 64 nt, Homo Sapiens
ucuagcauuguuugcaagagugaaagaguggaaacacccgaaguguccaucaguaagggacagg

SEQ ID NO: 244722 - RNA, 64 nt, Homo Sapiens
aauucaccguguguacugagugcaguuuuuuucacacccgaaagucuuuacuggcuuucauagc

SEQ ID NO: 244723 - RNA, 64 nt, Homo Sapiens
ucgcucccauguuuccacccggcacccugauccucacccgaaucuccuuuuuuuuuuucuuuug

SEQ ID NO: 244724 - RNA, 64 nt, Homo Sapiens
gagcucuggacccucagagccacuggcuucccgccacccgaagggccuggccgccagggagcgc

SEQ ID NO: 244725 - RNA, 64 nt, Homo Sapiens
cgaugguugagggauugucacgggaggaacaugacacccgaagggacucuaggugcccucggag

SEQ ID NO: 244726 - RNA, 64 nt, Homo Sapiens
cuacuggauugccuuaaauucuucucuuacaccccacccgaaaguauucagcuggcauuuagag

SEQ ID NO: 244727 - RNA, 64 nt, Homo Sapiens
uggccaugcccuagacccuccccaaggaugaccacacccgaaguccugucacugagcacaguca

SEQ ID NO: 244728 - RNA, 64 nt, Homo Sapiens
gggucucagccccugccuuccccagucucugggucacccgaauuuucccaccccugcuucuccc

SEQ ID NO: 244729 - RNA, 64 nt, Homo Sapiens
ucuagugcuccauccaccccucucuccacagacgcacccgaauuucuguccguucccaaagauc

SEQ ID NO: 244730 - RNA, 64 nt, Homo Sapiens
cugacuauagcaaccagcuggacccggccucuggcacccgaaacuuccacccccgacggcuccu

SEQ ID NO: 244731 - RNA, 64 nt, Homo Sapiens
guccaucagaaacaggagcugacaaccugcugggcacccgaagaccaagcccccugccagcuca

SEQ ID NO: 244732 - RNA, 64 nt, Homo Sapiens
acccuccacgcucguccucugcuggggcugcccccacccgaaagccggggccucggggcacaca

SEQ ID NO: 244733 - RNA, 64 nt, Homo Sapiens
cgguuaguggcaauuccuugcagagaaauagaagcacccgaagacccaggggucccugcuggau

SEQ ID NO: 244734 - RNA, 64 nt, Homo Sapiens
uuuguguggcccauggauuugaaagaagcugcugcacccgaaacugccagugugcggugacaac

SEQ ID NO: 244735 - RNA, 64 nt, Homo Sapiens
augcauauggacaccacaccugugaucuuugccccacccgaauaucugaaagucuagugagagc

SEQ ID NO: 244736 - RNA, 64 nt, Homo Sapiens
guagaaagaucucaggguuaucaggagcgagccacacccgaaugaaguucauuuccaaggggaa

SEQ ID NO: 244737 - RNA, 64 nt, Homo Sapiens
uucuuuauauagauaguauuuuauauuuuauucucacccgaaguauucacacaaucuuuuuaaa

SEQ ID NO: 244738 - RNA, 59 nt, Homo Sapiens
auuuuugggcccuagaaaugcucaaagggugcuccuaggauuaucagagccuaucuuuc

SEQ ID NO: 244739 - RNA, 59 nt, Homo Sapiens
cucccuagaucuuuagcuucuacucccacugcuccuaccacuccagcaacgccagauaa

SEQ ID NO: 244740 - RNA, 59 nt, Homo Sapiens
ccagaucguucugccacuugcacugugcuugcuccuaagcaaaagggaaaaggagcgcg

SEQ ID NO: 244741 - RNA, 59 nt, Homo Sapiens
ggauguuauucuuccuucccaacucacugugcuccuaaaggcagcaaccauucaucuuu

SEQ ID NO: 244742 - RNA, 59 nt, Homo Sapiens
uuuugauuaggagaauauuuuuuucaaacugcuccuagcaaggaaguacauuuuuaaau

SEQ ID NO: 244743 - RNA, 59 nt, Homo Sapiens
uuuuuuuaauccuuggagcaauuuuaucaugcuccuauaaaggagcuuuggcuccugau

SEQ ID NO: 244744 - RNA, 59 nt, Homo Sapiens
guugaauuuugaugaacaaauuuuugacuugcuccuaauuauuacaaauauuuugcuag

SEQ ID NO: 244745 - RNA, 59 nt, Homo Sapiens
ggcaauguguggcaguccuaaugaauuuaugcuccuacccaguuuuccuaagugauugu

SEQ ID NO: 244746 - RNA, 59 nt, Homo Sapiens
ccuggguucuggacgugagugguggguccugcuccuaucucuccaaaccccauacccuu

SEQ ID NO: 244747 - RNA, 59 nt, Homo Sapiens
cugacuuucuagccauuaauaaagagaacugcuccuagcaccucagccucuaaccauca

SEQ ID NO: 244748 - RNA, 64 nt, Homo Sapiens
cccgucucuccuguaggcuugcuuuagugagaccacagaccagguggaccuaauugggcauugg

SEQ ID NO: 244749 - RNA, 64 nt, Homo Sapiens
gugauuuuucuuuucccuuguuuuuucagagaccacagaccacaaucccacuuacucuuuuuuu

SEQ ID NO: 244750 - RNA, 64 nt, Homo Sapiens
aguacacuaggugcaaaccagaacucuugguggaacagaccagccacugcagcagacagaccag

SEQ ID NO: 244751 - RNA, 64 nt, Homo Sapiens
aacucuugguggaacagaccagccacugcagcagacagaccaggaacacaaugagacugacauu

SEQ ID NO: 244752 - RNA, 64 nt, Homo Sapiens
uacaggauuacuugagaguuaucagggcugccuaacagaccaggagaucuggggguugcaccag

SEQ ID NO: 244753 - RNA, 64 nt, Homo Sapiens
agaaccggagguagagcaaugaucagaugggugcacagaccagugccaaucugaacauuguuaa

SEQ ID NO: 244754 - RNA, 64 nt, Homo Sapiens
uagccacuuaauggagacacaauggagagguaagacagaccacaaacuaguucuuauaguguac

SEQ ID NO: 244755 - RNA, 64 nt, Homo Sapiens
acaauuucaaagagaacccacauuugugagauuuacagaccaaggugugguggaggagguagaa

SEQ ID NO: 244756 - RNA, 64 nt, Homo Sapiens
cuggcauuacaguuggccucugugguuuaugcgaacagaccaacauucauuaaaaaaaauguau

SEQ ID NO: 244757 - RNA, 64 nt, Homo Sapiens
uuaauuggcuuuguguccuaauuaccuguaacugacagaccaaauuauguuuuauuacuuucca

SEQ ID NO: 244758 - RNA, 64 nt, Homo Sapiens
augcucuuccuggaacugcccacgucugcacagaacagaccaccagacgccagggcugauuggu

SEQ ID NO: 244759 - RNA, 64 nt, Homo Sapiens
ucugcccaugcuagggggugggggagcucccaggacagaccagccuuguuucucauguaaugca

SEQ ID NO: 244760 - RNA, 64 nt, Homo Sapiens
uucccaggccuggggaccggccaacugucaccaaacagaccaucuguccucugacgucccuuuc

SEQ ID NO: 244761 - RNA, 64 nt, Homo Sapiens
ugcccccguggucgccuggugagaccacuuggaaacagaccaacgaagacuggccacgccuccu

SEQ ID NO: 244762 - RNA, 64 nt, Homo Sapiens
cagcacacacaagugcacagaugcacacaggugcacagaccacagugcauaggccacacagcac

SEQ ID NO: 244763 - RNA, 64 nt, Homo Sapiens
cacagcacuaacacaugcacacauacacaagugcacagaccacaguagcucacacacaguauac

SEQ ID NO: 244764 - RNA, 64 nt, Homo Sapiens
uagcacacaugugcacugacuugcacacaugcacacagaccacaacaggcguacacaugcacgc

SEQ ID NO: 244765 - RNA, 57 nt, Homo Sapiens
caucuguggauauggagcgggcaggggcugucucauucaucagugaaaucccugagg

SEQ ID NO: 244766 - RNA, 57 nt, Homo Sapiens
auuaguuauguuugccugucucucucgcugucucaugcacaugccugggucggcauu

SEQ ID NO: 244767 - RNA, 57 nt, Homo Sapiens
cuccagccuggacaacagagcaagacucugucucaaaaaaaaaauaaaaaauaaaaa

SEQ ID NO: 244768 - RNA, 57 nt, Homo Sapiens
cacuccagcuugagcaacacagugauacugucucaauaaauaaauaaauagaagaaa

SEQ ID NO: 244769 - RNA, 57 nt, Homo Sapiens
agcaaaacaaacagcaauaaugagacccugucucaaacuccagccugggugacagag

SEQ ID NO: 244770 - RNA, 57 nt, Homo Sapiens
aaaaaaaaaaaagaaaagaaccagacucugucucaaacuccagccugggugacagag

SEQ ID NO: 244771 - RNA, 57 nt, Homo Sapiens
ugugugaaucuucugacacaucuuaggcugucucacucuucuguauaguaaccauuu

SEQ ID NO: 244772 - RNA, 57 nt, Homo Sapiens
aaaacaaaacaaaaaaacaccgagacucugucucaaacuccagccugggugacagag

SEQ ID NO: 244773 - RNA, 57 nt, Homo Sapiens
aagaggagaccuggggcuguggaggagcugucucagcaaacaugggguuggagugga

SEQ ID NO: 244774 - RNA, 57 nt, Homo Sapiens
ccacuagccccacuuaaacuacuacuacugucucagagaacaguguuuccuaaugua

SEQ ID NO: 244775 - RNA, 57 nt, Homo Sapiens
ucauaaaguagaaaaauucaaaggaagcugucucaauuugagaauaccagcugggca

SEQ ID NO: 244776 - RNA, 57 nt, Homo Sapiens
aaaauaaaaaaauucagauucgagacacugucucaaaacuccagccugaugacagac

SEQ ID NO: 244777 - RNA, 57 nt, Homo Sapiens
aaaaugcagacuggccaggccaaaacccugucucaaauuccagccuggaugacagag

SEQ ID NO: 244778 - RNA, 57 nt, Homo Sapiens
ggucuuuacuuacuugucuguaucuuucugucucacucgaaaggcacagucucaaug

SEQ ID NO: 244779 - RNA, 57 nt, Homo Sapiens
cucuagccugggcaaccaagagugaaacugucucaaaaaacaacuuuuaucaauguc

SEQ ID NO: 244780 - RNA, 57 nt, Homo Sapiens
cucuagucugggugacagagcgagacucugucucaaaaaaaaaaaaauaaagccggg

SEQ ID NO: 244781 - RNA, 57 nt, Homo Sapiens
gcuccagccugagcaacaagagcgaaacugucucaaaaaaaagaagaaaauaaauaa

SEQ ID NO: 244782 - RNA, 57 nt, Homo Sapiens
aacuauuuggccaugugcucucauacccugucucaguaaucugccugugcugcucuu

SEQ ID NO: 244783 - RNA, 57 nt, Homo Sapiens
uguccucaucuccuucuugcaauuccucugucucauuugcuccggacucuucuagga

SEQ ID NO: 244784 - RNA, 57 nt, Homo Sapiens
aaaaaaaaaagaaaaaagaacgaaccucugucucaaacuccagccggggugacagag

SEQ ID NO: 244785 - RNA, 57 nt, Homo Sapiens
aaaaaaaaaacaaaaacaaauaagacucugucucaaacuccagcuugggcaacagag

SEQ ID NO: 244786 - RNA, 57 nt, Homo Sapiens
aaagaaaaaaaagaaaaaaacgaaacucugucucaaauccagccugggcaacaaaag

SEQ ID NO: 244787 - RNA, 57 nt, Homo Sapiens
aaaaaaaaaaagaggugggucgaaacucugucucaaauccagccugggcaacaagag

SEQ ID NO: 244788 - RNA, 57 nt, Homo Sapiens
cucugcccuucacagguagauaccacucugucucaguuuaccgaccugaauguuuac

SEQ ID NO: 244789 - RNA, 57 nt, Homo Sapiens
ugucuaaacccugugucccugagggaucugucucacuggcaucuuguugagggccuu

SEQ ID NO: 244790 - RNA, 57 nt, Homo Sapiens
cuccagucugggcaacagagugagacccugucucaauaauaauaauaauaauaauga

SEQ ID NO: 244791 - RNA, 57 nt, Homo Sapiens
gauacagaugacagugacgaaugccuucugucucaugauugacagggaaaaggaagg

SEQ ID NO: 244792 - RNA, 57 nt, Homo Sapiens
uaguaccuaccuuaguuuauacugucucugucucaucguuguuugguuuugguuuuc

SEQ ID NO: 244793 - RNA, 57 nt, Homo Sapiens
aaaaaaaaaacaaauuaacccaagacccugucucaaacuccaaccuaggugacagag

SEQ ID NO: 244794 - RNA, 57 nt, Homo Sapiens
ucaagcuugggcaacgagagcaaaacucugucucaaaaaaaaaauuagccagaugug

SEQ ID NO: 244795 - RNA, 57 nt, Homo Sapiens
cuccagccuaggugacagagugagacccugucucaaaaauaaauaauaaauaaauaa

SEQ ID NO: 244796 - RNA, 57 nt, Homo Sapiens
uccugggagaggcagacgaguccaguccugucucaucgagagggugggagauucucc

SEQ ID NO: 244797 - RNA, 57 nt, Homo Sapiens
gagaggggagacagaggcagcacaaaacugucucaauccucugccauguccagaggg

SEQ ID NO: 244798 - RNA, 57 nt, Homo Sapiens
cuccagccugggcaacagagcaaaacucugucucaaaaaaaaaaaaaaaaaggcaaa

SEQ ID NO: 244799 - RNA, 57 nt, Homo Sapiens
acagggccacauuugcaugagacauggcugucucacaggucacagagccauuacaac

SEQ ID NO: 244800 - RNA, 57 nt, Homo Sapiens
gucugcccuuuggcccaaaauuuaugucugucucauguguaaaagacauucauccca

SEQ ID NO: 244801 - RNA, 57 nt, Homo Sapiens
ggcauaggauaacaguuacagacauuucugucucaaaaaggagagaauggaaauugg

SEQ ID NO: 244802 - RNA, 57 nt, Homo Sapiens
ugcccccagcaaauaaacacaccucugcugucucagacagcaucuucucuguguacc

SEQ ID NO: 244803 - RNA, 57 nt, Homo Sapiens
gggccccucucccuucuguuguguccucugucucacaccacucaccgaccugaguca

SEQ ID NO: 244804 - RNA, 64 nt, Homo Sapiens; identical to SEQ ID NO: 163552

SEQ ID NO: 244805 - RNA, 64 nt, Homo Sapiens; identical to SEQ ID NO: 163553

SEQ ID NO: 244806 - RNA, 64 nt, Homo Sapiens; identical to SEQ ID NO: 163554

SEQ ID NO: 244807 - RNA, 64 nt, Homo Sapiens; identical to SEQ ID NO: 163555

SEQ ID NO: 244808 - RNA, 64 nt, Homo Sapiens; identical to SEQ ID NO: 163556

SEQ ID NO: 244809 - RNA, 64 nt, Homo Sapiens; identical to SEQ ID NO: 163557

SEQ ID NO: 244810 - RNA, 64 nt, Homo Sapiens; identical to SEQ ID NO: 163558

SEQ ID NO: 244811 - RNA, 64 nt, Homo Sapiens; identical to SEQ ID NO: 163559

SEQ ID NO: 244812 - RNA, 64 nt, Homo Sapiens; identical to SEQ ID NO: 163560

SEQ ID NO: 244813 - RNA, 64 nt, Homo Sapiens; identical to SEQ ID NO: 163561

SEQ ID NO: 244814 - RNA, 64 nt, Homo Sapiens; identical to SEQ ID NO: 163562

SEQ ID NO: 244815 - RNA, 64 nt, Homo Sapiens; identical to SEQ ID NO: 163563

SEQ ID NO: 244816 - RNA, 64 nt, Homo Sapiens; identical to SEQ ID NO: 163564

SEQ ID NO: 244817 - RNA, 64 nt, Homo Sapiens; identical to SEQ ID NO: 163565

SEQ ID NO: 244818 - RNA, 64 nt, Homo Sapiens; identical to SEQ ID NO: 163566

SEQ ID NO: 244819 - RNA, 64 nt, Homo Sapiens; identical to SEQ ID NO: 163567

SEQ ID NO: 244820 - RNA, 64 nt, Homo Sapiens; identical to SEQ ID NO: 163568

SEQ ID NO: 244821 - RNA, 64 nt, Homo Sapiens; identical to SEQ ID NO: 163569

SEQ ID NO: 244822 - RNA, 64 nt, Homo Sapiens; identical to SEQ ID NO: 163570

SEQ ID NO: 244823 - RNA, 64 nt, Homo Sapiens; identical to SEQ ID NO: 163571

SEQ ID NO: 244824 - RNA, 64 nt, Homo Sapiens; identical to SEQ ID NO: 163572

SEQ ID NO: 244825 - RNA, 64 nt, Homo Sapiens; identical to SEQ ID NO: 163573

SEQ ID NO: 244826 - RNA, 64 nt, Homo Sapiens; identical to SEQ ID NO: 163574

SEQ ID NO: 244827 - RNA, 64 nt, Homo Sapiens; identical to SEQ ID NO: 163575

SEQ ID NO: 244828 - RNA, 64 nt, Homo Sapiens; identical to SEQ ID NO: 163576

SEQ ID NO: 244829 - RNA, 64 nt, Homo Sapiens; identical to SEQ ID NO: 163577

SEQ ID NO: 244830 - RNA, 64 nt, Homo Sapiens; identical to SEQ ID NO: 113285

SEQ ID NO: 244831 - RNA, 64 nt, Homo Sapiens; identical to SEQ ID NO: 113286

SEQ ID NO: 244832 - RNA, 64 nt, Homo Sapiens; identical to SEQ ID NO: 113287

SEQ ID NO: 244833 - RNA, 64 nt, Homo Sapiens; identical to SEQ ID NO: 113288

SEQ ID NO: 244834 - RNA, 64 nt, Homo Sapiens; identical to SEQ ID NO: 113289

SEQ ID NO: 244835 - RNA, 64 nt, Homo Sapiens; identical to SEQ ID NO: 113290

SEQ ID NO: 244836 - RNA, 64 nt, Homo Sapiens; identical to SEQ ID NO: 113291

SEQ ID NO: 244837 - RNA, 64 nt, Homo Sapiens; identical to SEQ ID NO: 113292

SEQ ID NO: 244838 - RNA, 64 nt, Homo Sapiens; identical to SEQ ID NO: 113293

SEQ ID NO: 244839 - RNA, 64 nt, Homo Sapiens; identical to SEQ ID NO: 113294

SEQ ID NO: 244840 - RNA, 64 nt, Homo Sapiens; identical to SEQ ID NO: 113295

SEQ ID NO: 244841 - RNA, 64 nt, Homo Sapiens; identical to SEQ ID NO: 113296

SEQ ID NO: 244842 - RNA, 64 nt, Homo Sapiens; identical to SEQ ID NO: 113297

SEQ ID NO: 244843 - RNA, 64 nt, Homo Sapiens; identical to SEQ ID NO: 113298

SEQ ID NO: 244844 - RNA, 64 nt, Homo Sapiens; identical to SEQ ID NO: 113299

SEQ ID NO: 244845 - RNA, 64 nt, Homo Sapiens; identical to SEQ ID NO: 113300

SEQ ID NO: 244846 - RNA, 64 nt, Homo Sapiens; identical to SEQ ID NO: 113301

SEQ ID NO: 244847 - RNA, 64 nt, Homo Sapiens; identical to SEQ ID NO: 113302

SEQ ID NO: 244848 - RNA, 64 nt, Homo Sapiens; identical to SEQ ID NO: 113303

SEQ ID NO: 244849 - RNA, 64 nt, Homo Sapiens; identical to SEQ ID NO: 113304

SEQ ID NO: 244850 - RNA, 64 nt, Homo Sapiens; identical to SEQ ID NO: 113305

SEQ ID NO: 244851 - RNA, 64 nt, Homo Sapiens; identical to SEQ ID NO: 113306

SEQ ID NO: 244852 - RNA, 64 nt, Homo Sapiens; identical to SEQ ID NO: 113307

SEQ ID NO: 244853 - RNA, 64 nt, Homo Sapiens; identical to SEQ ID NO: 113308

SEQ ID NO: 244854 - RNA, 64 nt, Homo Sapiens; identical to SEQ ID NO: 113309

SEQ ID NO: 244855 - RNA, 64 nt, Homo Sapiens; identical to SEQ ID NO: 113310

SEQ ID NO: 244856 - RNA, 64 nt, Homo Sapiens; identical to SEQ ID NO: 113311

SEQ ID NO: 244857 - RNA, 64 nt, Homo Sapiens; identical to SEQ ID NO: 113312

SEQ ID NO: 244858 - RNA, 64 nt, Homo Sapiens; identical to SEQ ID NO: 113313

SEQ ID NO: 244859 - RNA, 64 nt, Homo Sapiens; identical to SEQ ID NO: 113314

SEQ ID NO: 244860 - RNA, 64 nt, Homo Sapiens; identical to SEQ ID NO: 113315

SEQ ID NO: 244861 - RNA, 64 nt, Homo Sapiens; identical to SEQ ID NO: 113316

SEQ ID NO: 244862 - RNA, 64 nt, Homo Sapiens; identical to SEQ ID NO: 113317

SEQ ID NO: 244863 - RNA, 64 nt, Homo Sapiens; identical to SEQ ID NO: 113318

SEQ ID NO: 244864 - RNA, 64 nt, Homo Sapiens; identical to SEQ ID NO: 113319

SEQ ID NO: 244865 - RNA, 64 nt, Homo Sapiens; identical to SEQ ID NO: 113320

SEQ ID NO: 244866 - RNA, 64 nt, Homo Sapiens; identical to SEQ ID NO: 113321

SEQ ID NO: 244867 - RNA, 64 nt, Homo Sapiens; identical to SEQ ID NO: 113322

SEQ ID NO: 244868 - RNA, 64 nt, Homo Sapiens; identical to SEQ ID NO: 113323

SEQ ID NO: 244869 - RNA, 64 nt, Homo Sapiens; identical to SEQ ID NO: 113324

SEQ ID NO: 244870 - RNA, 64 nt, Homo Sapiens; identical to SEQ ID NO: 89734

SEQ ID NO: 244871 - RNA, 64 nt, Homo Sapiens; identical to SEQ ID NO: 89735

SEQ ID NO: 244872 - RNA, 64 nt, Homo Sapiens
caauccgguaacauaagauugaaauuuuuuuacuuugucuuaauuuguuucuaauuuuuuuuuu

SEQ ID NO: 244873 - RNA, 64 nt, Homo Sapiens
cagaugugaauacuucacaaagcuguaaagaccauugucuuaaauacuacaacaacuuaacacc

SEQ ID NO: 244874 - RNA, 64 nt, Homo Sapiens
ggauucaagaaauggaaggaucugaaucuucucauugucuuauaauacacucugauccccucag

SEQ ID NO: 244875 - RNA, 64 nt, Homo Sapiens
ucuugaccuguuucugagugaggaagguuuauucuugucuuaugaauaugacacuuagagaaaa

SEQ ID NO: 244876 - RNA, 64 nt, Homo Sapiens
uucagauacaaauaacugaacucaguuuaugucauugucuuaacaaauuagcaguauuugaaag

SEQ ID NO: 244877 - RNA, 64 nt, Homo Sapiens
uucagauuucucuacauaaagcuuucaguuaguuuugucuuacuaucagaggcagcuuaaagau

SEQ ID NO: 244878 - RNA, 64 nt, Homo Sapiens
gccaacccaacugacuucugcuagguagaggcauuugucuuagagagagagagagcgcgggaga

SEQ ID NO: 244879 - RNA, 64 nt, Homo Sapiens
agguucucagcaaguguacaguauuuaccuuccuuugucuuacauuggcuuuuuaaauuuucca

SEQ ID NO: 244880 - RNA, 64 nt, Homo Sapiens
uugaauuauagcaucuucaccuagaagaucucaauugucuuagucacagaguagguuuaucugg

SEQ ID NO: 244881 - RNA, 64 nt, Homo Sapiens
cuuagcuugcuuccugucuccuugauaucuacacuugucuuagaucacaugcccugcuucagcu

SEQ ID NO: 244882 - RNA, 64 nt, Homo Sapiens
uuucucagauuauaauauuacagaggcagaguauuugucuuauaucauuugcacuuugacagag

SEQ ID NO: 244883 - RNA, 64 nt, Homo Sapiens
uuaaacccugucuccaugacuuucacuuauuuuauugucuuauucuucuuugucagcaauguga

SEQ ID NO: 244884 - RNA, 64 nt, Homo Sapiens
uagcuuaggucugagagucaaacaauguuaaggauugucuuaaaguuccuuagccagcaaaaca

SEQ ID NO: 244885 - RNA, 64 nt, Homo Sapiens
caacaaaagucugugggcugccaguuuauuacuuuugucuuaaaacaugaucauuguucucuca

SEQ ID NO: 244886 - RNA, 64 nt, Homo Sapiens
cacaacuaguggcugcccaauugcugcugaccaguugucuuagaaauggucaauuggauucaac

SEQ ID NO: 244887 - RNA, 64 nt, Homo Sapiens
guuugugaccugaauuuacaggaaguguuucaacuugucuuaugcaucuuaucuggcauguccu

SEQ ID NO: 244888 - RNA, 64 nt, Homo Sapiens
gguaaccaacacugaaaacucuucugucuaguacuugucuuauaauauuucuguguaacuugau

SEQ ID NO: 244889 - RNA, 64 nt, Homo Sapiens
acuagggaucaguaagauuucaauuucuuggcaauugucuuacuuuggguaguaccugcuagga

SEQ ID NO: 244890 - RNA, 64 nt, Homo Sapiens
cauaacuauugaaugcuuucuauguggagagugcuugucuuaauuuucuguugcuauaauagaa

SEQ ID NO: 244891 - RNA, 64 nt, Homo Sapiens
uucaaccaaagcacucuaaaauuuagaguauaaauugucuuauauuucaaauuagaaaaguuca

SEQ ID NO: 244892 - RNA, 64 nt, Homo Sapiens
aagucuuguuuacuacuguuuaggguuugaaaacuugucuuagaaugcgaaucuguguuaagaa

SEQ ID NO: 244893 - RNA, 64 nt, Homo Sapiens
uuccuuuuggaauauggcuguaagaagcagcauuuugucuuauuaacacauguauaaagguauc

SEQ ID NO: 244894 - RNA, 64 nt, Homo Sapiens
auuguugacaauucuguaaaccgguuagucaauuuugucuuaaugggaagaugcgguaaugaaa

SEQ ID NO: 244895 - RNA, 64 nt, Homo Sapiens
ucaaaccccuuccagucaaguuuuucuuccgagcuugucuuauccagaaacugcugccuggcuu

SEQ ID NO: 244896 - RNA, 64 nt, Homo Sapiens
guuaaccauuucuuaguuucuguaaauucaugacuugucuuacugaacuacagccugguuugua

SEQ ID NO: 244897 - RNA, 64 nt, Homo Sapiens
uuaccucuuaggggaaguuaugcccccucaacuauugucuuauuauaaugaaucuuuccuuuuu

SEQ ID NO: 244898 - RNA, 64 nt, Homo Sapiens
cuaaguauaugugagaaaucagaauuggcauaauuugucuuaguugauauucaaggcuuuaaaa

SEQ ID NO: 244899 - RNA, 64 nt, Homo Sapiens
accaugugugcuaauauacuuuuuuuguuauagauugucuuaaugguaggucaaguaauaaaaa

SEQ ID NO: 244900 - RNA, 64 nt, Homo Sapiens
caaagcuagauuguaaauaggcauucaagaaguauugucuuaaauuuacgaugaauuucuugug

SEQ ID NO: 244901 - RNA, 64 nt, Homo Sapiens
uguuguucugaaaaucaacaaccuuagaaggauuuugucuuagaaaauuuccuuggcuuuaguu

SEQ ID NO: 244902 - RNA, 64 nt, Homo Sapiens
acagaagagcccuagcaauuguugggauguguaauugucuuauucacuguaggacaccagagag

SEQ ID NO: 244903 - RNA, 64 nt, Homo Sapiens
uaguaugagaucggaaaauaguucuuaguccuguuugucuuaauuuuuauugguuuccaagguc

SEQ ID NO: 244904 - RNA, 64 nt, Homo Sapiens
ggguuuugauagucauguuaucucaguaagugucuugucuuagaaauauguguguauaggcugg

SEQ ID NO: 244905 - RNA, 64 nt, Homo Sapiens
aacaugagauuuuaacacaacaaugaaauuugccuugucuuauuccacuaguuuauuccuuuaa

SEQ ID NO: 244906 - RNA, 64 nt, Homo Sapiens
cuuuuuguugguagggagaaaaaacgcuauugcuuugucuuacagagcgaaugucugccaacua

SEQ ID NO: 244907 - RNA, 64 nt, Homo Sapiens
acaaaaauuagccgggugugguggcgcgcgccuguugucuuagcuacucaggaggcugaggcag

SEQ ID NO: 244908 - RNA, 64 nt, Homo Sapiens
ggaacaaacuuguacauuuuauuucacuuguguuuugucuuaaacccuacugcuggaaacaauu

SEQ ID NO: 244909 - RNA, 64 nt, Homo Sapiens
cagucguagagucucaccaucuccaaggauuggucuugagaacacuguucagugacggccaugc

SEQ ID NO: 244910 - RNA, 64 nt, Homo Sapiens
gucgcucuuccugcggguucuuggcgagacacagcuugagaacagaagggcgucgggggaaccu

SEQ ID NO: 244911 - RNA, 64 nt, Homo Sapiens
uucuggggagcuuugaccuuggagcuuuguacagcuugagaaaacauuagaacaaauuuuauua

SEQ ID NO: 244912 - RNA, 64 nt, Homo Sapiens
cuuauaaaaacaauauauaagucucauaugcugucuugagaauccaagagaaucacaugcagcu

SEQ ID NO: 244913 - RNA, 64 nt, Homo Sapiens
gucgguuguuccuaauggcauauuuuacaagagacuugagaaauaauucacuugaugcucuuuu

SEQ ID NO: 244914 - RNA, 64 nt, Homo Sapiens
cuugugcccaaagcuugaagaagagaaagagaaacuugagaaggagagugagacccugucucca

SEQ ID NO: 244915 - RNA, 64 nt, Homo Sapiens
uagcagggacagggaaaaauaaauacauagaauacuugagaauuaaguucuaaaaaaaaguaaa

SEQ ID NO: 244916 - RNA, 64 nt, Homo Sapiens
aauuuuuuuaaaaaaucuucauaaguuucaccaccuugagaaauccuguuccucuauuccaagu

SEQ ID NO: 244917 - RNA, 64 nt, Homo Sapiens
gaggccuuuacaauuacccagucuucauggaauccuugagaagaaaucagcauuuuggaucuag

SEQ ID NO: 244918 - RNA, 64 nt, Homo Sapiens
gcagucaaguuccaaggaacacagugacggacaacuugagaaaaagagaaauaaucguaagaga

SEQ ID NO: 244919 - RNA, 64 nt, Homo Sapiens
uaaaaccuaaaugacuuuugacauacaaacucuucuugagaauguuuguuguaaaugguuucaa

SEQ ID NO: 244920 - RNA, 64 nt, Homo Sapiens
gcucuaucauauucugaaacaagaauuagaaugacuugagaacgggcaaauaacaaagcaaacc

SEQ ID NO: 244921 - RNA, 64 nt, Homo Sapiens
uuugcaugcagaggagguaagaagucugacaauccuugagaaucgugguucugcuguuacguuu

SEQ ID NO: 244922 - RNA, 64 nt, Homo Sapiens
ucacuacugcauuuauaggauaaagaccugacagcuugagaaggauuaaaucccaaauccuauu

SEQ ID NO: 244923 - RNA, 64 nt, Homo Sapiens
agcuuucaugcuuauuccuuucagugccaguuuccuugagaagcuuaguguauucaucaaaucu

SEQ ID NO: 244924 - RNA, 64 nt, Homo Sapiens
gaauguaacgauauaacauucuuggcgaaaauaucuugagaauaaaacacauucauagagauuu

SEQ ID NO: 244925 - RNA, 64 nt, Homo Sapiens
gaagauauuuuaccaugaagagauugcacuuauccuugagaacagucuaaauauaaaugaagau

SEQ ID NO: 244926 - RNA, 64 nt, Homo Sapiens
gaagauauuuuaccaugaagagauugcacuuauccuugagaacagucuaaugauacuuuuuuua

SEQ ID NO: 244927 - RNA, 64 nt, Homo Sapiens
cuaacuacucaauaaaagcgugggugugagccagcuugagaacacuaggccccagcugaccgca

SEQ ID NO: 244928 - RNA, 64 nt, Homo Sapiens
ccgaaagggccccugaccugaacucagguggaggcuugagaagggggagacuggcauugacgag

SEQ ID NO: 244929 - RNA, 64 nt, Homo Sapiens
aaagauaauacauacacauguacuuuuaaaacaccuugagaaaaaaaagcacugauaaacagaa

SEQ ID NO: 244930 - RNA, 64 nt, Homo Sapiens
auaccuacagagguucauaccaacucacuguacacuugagaauauggaagauuucaagaaagga

SEQ ID NO: 244931 - RNA, 64 nt, Homo Sapiens
uauuuuauagucuaaaucacgagggguugaauuccuugagaauuuuaagaaaaaguauugacug

SEQ ID NO: 244932 - RNA, 64 nt, Homo Sapiens
ugcuaaaauuuugccucuguucaacuccaagagucuugagaaacauuucccuucucaaaucugc

SEQ ID NO: 244933 - RNA, 64 nt, Homo Sapiens
guacauuguucuggaauuucaauuugcagcagagcuugagaaaauaacacugauguuuguguua

SEQ ID NO: 244934 - RNA, 64 nt, Homo Sapiens
uucacccuuucacuuaaaggauacuuuuauuucucuugagaaccuagaucuuaccaaucucagc

SEQ ID NO: 244935 - RNA, 64 nt, Homo Sapiens
gauggagauaauuuauuuuuaccuucacugugaccuugagaagauucuucccauucuccauuug

SEQ ID NO: 244936 - RNA, 64 nt, Homo Sapiens
gaggugguaucuucacguagaacauugguauucgcuugagaaaaaaagaauaguugaaccuauu

SEQ ID NO: 244937 - RNA, 64 nt, Homo Sapiens
cuccucacacacagacucauauuacugguaggaacuugagaacuuuauuuccaaguuguucaaa

SEQ ID NO: 244938 - RNA, 64 nt, Homo Sapiens
uuacauccacauuccuacacuguuaaggagaccugugucaaaacguaggcaucacugccucagc

SEQ ID NO: 244939 - RNA, 64 nt, Homo Sapiens
cccuuucauccucaagagcuguguuguugugggugugucaaaucgcugcgaagcauggacccca

SEQ ID NO: 244940 - RNA, 64 nt, Homo Sapiens
ggagagccuucagacugcaacgcuggccugauacgugucaaaggagagagggauagaggaggau

SEQ ID NO: 244941 - RNA, 64 nt, Homo Sapiens
caugaugcuggugacucaaacgugccuacucauggugucaaauuggcauaauccucuugggaag

SEQ ID NO: 244942 - RNA, 64 nt, Homo Sapiens
ggccugcucagaggaguaggagcugaaagauggugccuuccacccucuugggcugugugcccau

SEQ ID NO: 244943 - RNA, 64 nt, Homo Sapiens
ccaugggcccagccccugcccugggaaccaggcagccuuccagaccucaggggcugaggcagac

SEQ ID NO: 244944 - RNA, 64 nt, Homo Sapiens
cugcuuagccuuugucaaccacuaagccagcucagccuuccaagggcugccacuggggcaccga

SEQ ID NO: 244945 - RNA, 64 nt, Homo Sapiens
ccugccacuuuguccgucucacagauuuuucagggccuuccaugccuuucucccuccacaggaa

SEQ ID NO: 244946 - RNA, 64 nt, Homo Sapiens
ggagaggcugugguggcugucucugucccucacugccuuccaggagcaauuugcacauguaaca

SEQ ID NO: 244947 - RNA, 64 nt, Homo Sapiens
uguccccacuaaaacaaaacaaaaaacuuuuaaugccuuccacauuaauuagauuuucuugcag

SEQ ID NO: 244948 - RNA, 64 nt, Homo Sapiens
ucagucuuaggcagauuugaacuacaugugaauggccuuccacucugggaacccuguggucugc

SEQ ID NO: 244949 - RNA, 64 nt, Homo Sapiens
caauaauggaagagcucacuccauauucuuacaggccuuccaguuuaccuauccuugaggucau

SEQ ID NO: 244950 - RNA, 64 nt, Homo Sapiens
ucuuacggagcuucuccucagaagugguaccaucgccuuccaaagucagcacucuacacucuug

SEQ ID NO: 244951 - RNA, 64 nt, Homo Sapiens
gucacuuuacauccucagguauuguaaccacugggccuuccaacuuugcuggcaagcucuggua

SEQ ID NO: 244952 - RNA, 64 nt, Homo Sapiens
uucaagcgauucuccugacuucaccgcaaccuccgccuuccaggugcaauggcgugaucgcugc

SEQ ID NO: 244953 - RNA, 64 nt, Homo Sapiens
ugcaagugauucuccugccuucacugcaaccuccgccuuccagucugaguacaguggugcaauc

SEQ ID NO: 244954 - RNA, 64 nt, Homo Sapiens
ugaucuuugcccucugggucuuagccaguuuccagccuuccagaacacaagccauucuaaauac

SEQ ID NO: 244955 - RNA, 64 nt, Homo Sapiens
agugcugggauuacaggcguauccaccugccucagccuuccaaacaaacucgugugcccaagca

SEQ ID NO: 244956 - RNA, 64 nt, Homo Sapiens
cauggugauggaugguuuggcagcagguggcgcugccuuccaccgugagccauaauaugauggg

SEQ ID NO: 244957 - RNA, 64 nt, Homo Sapiens
uuaaucuaacuugagccucaacagcuucuagguagccuuccaacuaaacuggguaccucacugc

SEQ ID NO: 244958 - RNA, 64 nt, Homo Sapiens
cccugugcauaggcagcccugcacuguccccacagccuuccacaccccaccacgucugugcccu

SEQ ID NO: 244959 - RNA, 64 nt, Homo Sapiens
gugcugggauuacaggcgugauccacccgccucggccuuccaaacgaacuccugaccucaggug

SEQ ID NO: 244960 - RNA, 64 nt, Homo Sapiens
uuuguggauuaaaccuuuuugacauuuuuuaaaagccuuccagugauacaguuuugaguaaaaa

SEQ ID NO: 244961 - RNA, 64 nt, Homo Sapiens
gaauauguggcuaucaccuugagcacugacaguggccuuccaggcuaguugccuuccaaacgca

SEQ ID NO: 244962 - RNA, 64 nt, Homo Sapiens
ccuugagcacugacaguggccuuccaggcuaguugccuuccaaacgcagguagccgaccugcag

SEQ ID NO: 244963 - RNA, 64 nt, Homo Sapiens
ccccaggaaguuggccuuccuuugcuuuccuuuggccuuccagaugaauugcagcccccuccag

SEQ ID NO: 244964 - RNA, 64 nt, Homo Sapiens
ccaagaaacugcuucuugaacagcagaugcccuugccuuccaguauugggccacgaggaacaaa

SEQ ID NO: 244965 - RNA, 64 nt, Homo Sapiens
ggggcacccggagggcugccgauggagcugcucugccuuccagcgcaccucucacccacccaga

SEQ ID NO: 244966 - RNA, 64 nt, Homo Sapiens
ccucccuugcacccauccugccuccugcccuuccgccuuccacucacucuuguggcucuauccu

SEQ ID NO: 244967 - RNA, 64 nt, Homo Sapiens
gcagaaaccagggcaaaaggacacugcuccuguggccuuccacacucuucccaucgucuugugu

SEQ ID NO: 244968 - RNA, 64 nt, Homo Sapiens
aggcuccugagaguuauuuccacuaaguaguauugccuuccauucuuauuccagggccuuuucc

SEQ ID NO: 244969 - RNA, 62 nt, Homo Sapiens
cccucuggcucaggaggguugggucccugggaggccggcagccaggccacagaauccacacg

SEQ ID NO: 244970 - RNA, 62 nt, Homo Sapiens
auccacacguggaccauugugggucccugggaggccggcagccaggccacggaauccacacg

SEQ ID NO: 244971 - RNA, 64 nt, Homo Sapiens
uuacuuucuuuggaguaaauucuggugugacuaaaauuuucaggguugauggguuaccuuaaaa

SEQ ID NO: 244972 - RNA, 64 nt, Homo Sapiens
augcuuagauugcaguuuguuuugcauuugcuauaauuuucaaaauuauuuuugaagcaagaca

SEQ ID NO: 244973 - RNA, 64 nt, Homo Sapiens
ucaaaaaagaaacaggaguaccuaucccuaucugaauuuucaaguuccccauuggaugaccaga

SEQ ID NO: 244974 - RNA, 64 nt, Homo Sapiens
auagaauuccaaagaaucagaauaguuucaaaauaauuuucagugauaaaagaguguuguaauu

SEQ ID NO: 244975 - RNA, 64 nt, Homo Sapiens
auuaagcuguuccuguucaggucauucagcagcaaauuuucagcgagucuaauagucuuugcca

SEQ ID NO: 244976 - RNA, 64 nt, Homo Sapiens
agucuaauagucuuugccaggcauuugugcuagaaauuuucaagaagaacguuuuuuccucagu

SEQ ID NO: 244977 - RNA, 64 nt, Homo Sapiens
uauuucuguuccccugaacuuacacauauacauaaauuuucagcuguguauauauauauauaca

SEQ ID NO: 244978 - RNA, 64 nt, Homo Sapiens
guuuuuuuggucuuaacgcucccugugaaaauaaaauuuucaauauguucuuuuuaugcaaauc

SEQ ID NO: 244979 - RNA, 64 nt, Homo Sapiens
uguuuuucuuuaaauccuuucaguaagagaauagaauuuucauuaaguacauuuauguuuuauu

SEQ ID NO: 244980 - RNA, 64 nt, Homo Sapiens
ccuuaaucugaaaacagaaggcauuuuaaugggaaauuuucaacaaguaaggaugugagaauuu

SEQ ID NO: 244981 - RNA, 64 nt, Homo Sapiens
uguuuuuuuuuuuuuuuuuuaguuacaguuguaaaauuuucagcaacauuugcagccauuacag

SEQ ID NO: 244982 - RNA, 64 nt, Homo Sapiens
uuucugcuauuuuuaccguauacuuccuuuuuagaauuuucaguaauucucaugcuuuuaggug

SEQ ID NO: 244983 - RNA, 64 nt, Homo Sapiens
ucaagacaccaaauuccaaacuucuaaauguuggaauuuucaaaaauuguguuuagauuuuaug

SEQ ID NO: 244984 - RNA, 64 nt, Homo Sapiens
cacggaucaauagacuguacuuauuuuccaauaaaauuuucaaacuuuguacuguuauccugag

SEQ ID NO: 244985 - RNA, 61 nt, Homo Sapiens
acugccacaaaucagauuaauuugggauuuaaauuuucaccuguuaagguggaaaauggac

SEQ ID NO: 244986 - RNA, 64 nt, Homo Sapiens
guuccaacaccugccuccacuucuccccucaagaaauuuucaacgccaggaaucaugaagagac

SEQ ID NO: 244987 - RNA, 64 nt, Homo Sapiens
gaauuuugucuuccccuaauuuaaauuggcuugaaauuuucagaaaagguacauuuaaaauaug

SEQ ID NO: 244988 - RNA, 64 nt, Homo Sapiens
aaaauuuggaaacagaguaaagcucaucccuaggaauuuucauuccuucaaauacauaguggau

SEQ ID NO: 244989 - RNA, 64 nt, Homo Sapiens
cugccuaaacaauauugaaguauccauagggcacaauuuucagacauuuuaguaucuguauaua

SEQ ID NO: 244990 - RNA, 64 nt, Homo Sapiens
cuaaaaauaaauuuuaguuugcuaaaaauuuacaaauuuucauuuugcaguuccagagcugcuu

SEQ ID NO: 244991 - RNA, 64 nt, Homo Sapiens
ucugacuagccacaaguauguuacccagauguagaauuuucaucacuaaacaguaaguucauua

SEQ ID NO: 244992 - RNA, 64 nt, Homo Sapiens
gaaaaauaaaacgcaguucaaauuucaugguuuuaauuuucaacucagaagcacucaaaaaugc

SEQ ID NO: 244993 - RNA, 64 nt, Homo Sapiens
aaagaaugauccaaaaauacuaaggaaaaagaacaauuuucaauuuucagaaaugaauuaucug

SEQ ID NO: 244994 - RNA, 64 nt, Homo Sapiens
gauccaaaaauacuaaggaaaaagaacaauuuucaauuuucagaaaugaauuaucuguacauau

SEQ ID NO: 244995 - RNA, 64 nt, Homo Sapiens
auuuccaucaguugacauagauauuauucacuaaaauuuucagcagacucaaaauagagaggag

SEQ ID NO: 244996 - RNA, 64 nt, Homo Sapiens
auuccagaaauauuuguuuuuuuaagagaaaguaaauuuucacauuagauuucuauucaaagua

SEQ ID NO: 244997 - RNA, 64 nt, Homo Sapiens
uuuuuacggaguuuacaguacagaaauaggcuuuaauuuucaagugaauuuuuugccaaacuua

SEQ ID NO: 244998 - RNA, 64 nt, Homo Sapiens
uuuauuccaaaacuaguggguuuucucuacuggaaauuuucaauaaaccugucauuauugcuua

SEQ ID NO: 244999 - RNA, 64 nt, Homo Sapiens
uguacucaaagucucuaggccaugcacuuaaagcaauuuucaaaacucguuuaugcugucuagu

SEQ ID NO: 245000 - RNA, 64 nt, Homo Sapiens
aguagucuugacuuuuuaagauagaacugcacuuaauuuucagucaguucauuucuaguucuug

SEQ ID NO: 245001 - RNA, 64 nt, Homo Sapiens
guuaaauuugguauucguggcgaaucagcaaugaaauuuucauaaagguuccagaggugacauu

SEQ ID NO: 245002 - RNA, 64 nt, Homo Sapiens
auaaugaguuccagugacuccaauuucagaaugcaauuuucauuauauaccugccuaaguugua

SEQ ID NO: 245003 - RNA, 64 nt, Homo Sapiens
gucgcuuuuauucggauugacgaaaaucaaccauaauuuucaagggaucuucauggguugugac

SEQ ID NO: 245004 - RNA, 64 nt, Homo Sapiens
gaaguuuucauuuuuucuaaauccuccccuacaaaauuuucagauuggaaauuacucuuguauu

SEQ ID NO: 245005 - RNA, 64 nt, Homo Sapiens
aaaugcauaagcaagacugagcagcauuauaauuaauuuucaggguuuugaggcugaacauaau

SEQ ID NO: 245006 - RNA, 64 nt, Homo Sapiens
uauuuuuaaaauuuaaaguauaauuaguuuuuauaauuuucaucagauuuuuguuauauuuuuu

SEQ ID NO: 245007 - RNA, 64 nt, Homo Sapiens
ugaaacaaaauaagcagugggaacuaaugacucaaauuuucaaaaaaaaaaaaaaaaaauccuu

SEQ ID NO: 245008 - RNA, 64 nt, Homo Sapiens
ugaagauagucuguugaagaggcugucaucaucaaauuuucaagaggcgugagccaccacuccc

SEQ ID NO: 245009 - RNA, 64 nt, Homo Sapiens
agaaaacaugucaacuuuaaguaaaagaagaaucaauuuucagcaauaaguuuuuaggagguuu

SEQ ID NO: 245010 - RNA, 64 nt, Homo Sapiens
uuaagguagaaaauaaguuucugugacuuaggugaauuuucaauuccuuauuuaaacauaagug

SEQ ID NO: 245011 - RNA, 64 nt, Homo Sapiens
uaaguguaacuaagcacuugaauuguccuauuauaauuuucagaauaugaaugugacaugcacc

SEQ ID NO: 245012 - RNA, 64 nt, Homo Sapiens
aauccaguauauuccaaacagaaaauauaaauuuaauuuucagguagaauagucuauuccuugu

SEQ ID NO: 245013 - RNA, 64 nt, Homo Sapiens
uuuuuaaaaaauaaugcauguuucuuuaauaauuaauuuucaucuucuauaagaugccauguga

SEQ ID NO: 245014 - RNA, 64 nt, Homo Sapiens
uuugcauagaaaaucaaauucagggaccacaaagaauuuucagugggaaugucuagucugaggg

SEQ ID NO: 245015 - RNA, 64 nt, Homo Sapiens
uuccuagaauccccuucuccaaacgauuagucuaaauuuucagagagaaauagauaaaacacgc

SEQ ID NO: 245016 - RNA, 64 nt, Homo Sapiens
aaaacccauaaaggagugauuuagaacagucauuaauuuucaacucaaugaaauaugugaagcc

SEQ ID NO: 245017 - RNA, 64 nt, Homo Sapiens
agguuugaaugaucauguuuaaaacagugaauuaaauuuucacucacuuugccaaaaccuauuu

SEQ ID NO: 245018 - RNA, 64 nt, Homo Sapiens
aggcaaauagguaauguggaagaugauaacucaaaauuuucaguuauaugauuaucagguuguu

SEQ ID NO: 245019 - RNA, 64 nt, Homo Sapiens
uuuaaauaaucaguuuaucuguugucaaaacguuaauuuucagugcgaugucagacacucuuga

SEQ ID NO: 245020 - RNA, 64 nt, Homo Sapiens
guuuucccagccuauaaaaaucaugagcuuuguuaauuuucaauagcuguugucaaacaaucag

SEQ ID NO: 245021 - RNA, 64 nt, Homo Sapiens
ucuugcuuuguccuuucuauacugccauucuaaaaauuuucagcuguuggcuguuuuuuuuguu

SEQ ID NO: 245022 - RNA, 64 nt, Homo Sapiens
uaccagaccauuuuaaucaacuuuauugagauucaauuuucauauaguaaaacgccuauuuaag

SEQ ID NO: 245023 - RNA, 64 nt, Homo Sapiens
uguacaccucuuugccuguuaauuuuggagucuuaauuuucaugcuucagggcaccaguguuaa

SEQ ID NO: 245024 - RNA, 64 nt, Homo Sapiens
uuugucuaauaacaguggcucuuuuagaucuuaaaauuuucauucaaaucccauuuucaaauua

SEQ ID NO: 245025 - RNA, 64 nt, Homo Sapiens
aagccaguauaaaauagaaauuuuguauaauacaaauuuucauuaacaguauaaaaauuucugc

SEQ ID NO: 245026 - RNA, 64 nt, Homo Sapiens
gcaauguaaacaaaauaaaaaaaaguaugauguaaauuuucaguuuuaugaaaagaaacuuugu

SEQ ID NO: 245027 - RNA, 64 nt, Homo Sapiens
uaacaauggauuagaaaaauauuuugacacuuuuaauuuucauugagucuucaaauuuagcauu

SEQ ID NO: 245028 - RNA, 64 nt, Homo Sapiens
uuugguuuuuguuccucagagagaguuugaaagaaauuuucagauguucuguucccuauagagg

SEQ ID NO: 245029 - RNA, 64 nt, Homo Sapiens
uccaaauucucaucacauguauuauuugauacuaaauuuucaauuauuacuucaaaauaagagu

SEQ ID NO: 245030 - RNA, 64 nt, Homo Sapiens
aaaauguaauuaaagucuauaccaaaguugaaugaauuuucaacacauaagugcuuuuacaagc

SEQ ID NO: 245031 - RNA, 64 nt, Homo Sapiens
uugcuauaaagauguaucaauucaguuuacucagaauuuucaauauuuugucguuaagcauacu

SEQ ID NO: 245032 - RNA, 64 nt, Homo Sapiens
auuacuguuguaauuauugaacaauaauuuuuucaauuuucacugaaauguuaaaauuuuuuuc

SEQ ID NO: 245033 - RNA, 64 nt, Homo Sapiens
uuuaaacaguaaccaaaucuagauguuuauuuaaaauuuucacuucuaauuuaugguaaauuuc

SEQ ID NO: 245034 - RNA, 64 nt, Homo Sapiens
ugucagucaaguuuugcauuaaauguuuuuguaaaauuuucaaaaauccuucaaaaauaaguua

SEQ ID NO: 245035 - RNA, 64 nt, Homo Sapiens
uacaaucuuugcucucucugcaucaauagagggaaauuuucagcgagguacaccuuaugaaucg

SEQ ID NO: 245036 - RNA, 64 nt, Homo Sapiens
gauuagccguguaacuccugcuaacaaagaucauaauuuucaauaaacugaauuuucuuuuaag

SEQ ID NO: 245037 - RNA, 64 nt, Homo Sapiens
uugaaugucuuuguauuaaaaucaacgguccugaaauuuucaucacacacauugaaagcuucug

SEQ ID NO: 245038 - RNA, 64 nt, Homo Sapiens
ucuguaauaccaagaagagggagcugaaaaggaaaauuuucagauuaauaaagaagacgccaau

SEQ ID NO: 245039 - RNA, 64 nt, Homo Sapiens
cacauguaaucaugucugcugcuguugcuacccaaauuuucauuucuccacauuuuggguacuu

SEQ ID NO: 245040 - RNA, 64 nt, Homo Sapiens
uuuaauguaauccccaagauaaugugggaacucaaauuuucauucuccaugucaaaaaaaaaag

SEQ ID NO: 245041 - RNA, 64 nt, Homo Sapiens
uuaaaauacagguuauaacaggaauuaaugaaaaaauuuucaagcucauuaauuuagguggcua

SEQ ID NO: 245042 - RNA, 64 nt, Homo Sapiens
aacuuugagacuaauuuguaaaaaaucacuuauuaauuuucaagagguaugguuaaguagugag

SEQ ID NO: 245043 - RNA, 64 nt, Homo Sapiens
auuaauugauguuuuaaaaaguuguuaaauuguaaauuuucaaacuuguuauugauaggaucau

SEQ ID NO: 245044 - RNA, 64 nt, Homo Sapiens
ucacuguuggugccuaaucauaaaauugacauuuaauuuucaaaguucuugucuuguuaccauu

SEQ ID NO: 245045 - RNA, 64 nt, Homo Sapiens
aguuucagaagcaacaggacacuguucuugacuaaauuuucaagaucugaauguuuuuauguug

SEQ ID NO: 245046 - RNA, 64 nt, Homo Sapiens
uuuggcaaugacucaaagucuuugaauucuguuuaauuuucacuuaagaauaguagauguggcc

SEQ ID NO: 245047 - RNA, 64 nt, Homo Sapiens
uugcacugaggauauucagaacuuccaaauaaauaauuuucauugucuguaauaauagacugua

SEQ ID NO: 245048 - RNA, 64 nt, Homo Sapiens
ugcugguuggcugucgccagguggcuguacauugaauuuucaagucccuguggcggcaucagga

SEQ ID NO: 245049 - RNA, 64 nt, Homo Sapiens
cacuugauuaacacaacacuugagcaacugacuuaauuuucaagucuucuaagcugagggcacu

SEQ ID NO: 245050 - RNA, 64 nt, Homo Sapiens
aaaauggaaaagcaauguguuuuuccacuggauuaauuuucaccggaacaauugcgaauucucu

SEQ ID NO: 245051 - RNA, 64 nt, Homo Sapiens
caguuuaaugcaaguaagucagguuucacaagaaaauuuucaaguuuugaagggaauuugaggu

SEQ ID NO: 245052 - RNA, 64 nt, Homo Sapiens
augauaauguuuuugguuaugauuuuauaaugguaauuuucauggauuuguuuaggaauuauuu

SEQ ID NO: 245053 - RNA, 64 nt, Homo Sapiens
acuuauguauacacuuuuucgaauauuuuucuguaauuuucagcaacauuuuugcuuauucauu

SEQ ID NO: 245054 - RNA, 64 nt, Homo Sapiens
uuuuuaguagagaugggguucaccacacccggcuaauuuucauacugggacuauaggcacgugc

SEQ ID NO: 245055 - RNA, 64 nt, Homo Sapiens
gcgggugggauaagauuauagagaacuucugaagaauuuucaagguuuuguccuguaggacaug

SEQ ID NO: 245056 - RNA, 64 nt, Homo Sapiens
ugaguuuaguggcuuaaccacucuucucaugcccaauuuucauugucuuucauguguggaguua

SEQ ID NO: 245057 - RNA, 64 nt, Homo Sapiens
caucuucucagcagcugaagagaaaacauacuugaauuuucauuagugaacacucagguuggca

SEQ ID NO: 245058 - RNA, 64 nt, Homo Sapiens
aaguuaaaaaaaaagacauauuuuuuuaaauaaaaauuuucaaaaaaaagucuguguuuuugug

SEQ ID NO: 245059 - RNA, 64 nt, Homo Sapiens
uguauaauauguuuacagauuugacugauauuguaauuuucaaacaccuguaaacuguaucacu

SEQ ID NO: 245060 - RNA, 64 nt, Homo Sapiens
auuagugauuuuuuuuucugugggguuuuuucacaauuuucaacguagacaacugcuuaauggu

SEQ ID NO: 245061 - RNA, 64 nt, Homo Sapiens
guuuuuagugaacuuaaggacaucauaugccggaaauuuucacacucugcguuugauauucaaa

SEQ ID NO: 245062 - RNA, 64 nt, Homo Sapiens
gucaaauucagugaauuuugucacaaaauucuccaauuuucaguuaaaaauugagguauaauuu

SEQ ID NO: 245063 - RNA, 64 nt, Homo Sapiens
aaauucuccaauuuucagugaaaaauugagguauaauuuucacauuauuauguauugacuuuuu

SEQ ID NO: 245064 - RNA, 64 nt, Homo Sapiens
uucuuucucacauaguugcuuguauuagaccuagaauuuucauuuaccugaaacuuguuuaaca

SEQ ID NO: 245065 - RNA, 64 nt, Homo Sapiens
uaugccuagauaauggggaauugcauuaucauaaaauuuucauacuuuuuaacuuuauacucag

SEQ ID NO: 245066 - RNA, 64 nt, Homo Sapiens
uacaaaugugaaaaauguggcaaagcuuuuaaccaauuuucaaaccuuacuaaacauaagauaa

SEQ ID NO: 245067 - RNA, 64 nt, Homo Sapiens
gcugucuugcaaauguaauaaauuugggaaaacaaauuuucaaaaacuacagcuuagaaaacac

SEQ ID NO: 245068 - RNA, 64 nt, Homo Sapiens
aacaagcugcauaucagcugaugaaugcaugagaaauuuucaaggcuuucacaguggucuuaag

SEQ ID NO: 245069 - RNA, 64 nt, Homo Sapiens
caauaaauauuuauucaguguuaaugucguccagaauuuucaucagaaauggauagcuuuaaca

SEQ ID NO: 245070 - RNA, 64 nt, Homo Sapiens
aaaugacauggaaagcaaaacuuucuuuuuuaaaaauuuucauuuauuuaauggaaacuugccc

SEQ ID NO: 245071 - RNA, 64 nt, Homo Sapiens
auguuucuauauuauuuagaauauuuguuguugcaauuuucacauaagaaaauuuaacaguugu

SEQ ID NO: 245072 - RNA, 64 nt, Homo Sapiens
acaaugucaugugaugauagggagggaaugauauaauuuucauguaauagucacaguuuuccag

SEQ ID NO: 245073 - RNA, 64 nt, Homo Sapiens
cucauuaggaaguuaaauguuagucuuuguaagcaauuuucauuagaauaaugggaagugacuc

SEQ ID NO: 245074 - RNA, 64 nt, Homo Sapiens
acuguacguucuacacucuguccuacucccacagaauuuucaagcccuuaagaguuuaguuaaa

SEQ ID NO: 245075 - RNA, 64 nt, Homo Sapiens
gguuuacuauguuuaaauaaguuaauacuuuaaaaauuuucagguuuuuuuaguauggugaaua

SEQ ID NO: 245076 - RNA, 64 nt, Homo Sapiens
acagaaaucucucacccaguucagguguauagggaauuuucauuuucauuauuucaaggaauag

SEQ ID NO: 245077 - RNA, 64 nt, Homo Sapiens
caaaacguauuuaucuggccauugcacuucggauaauuuucauuuuuaauuccucuugguguca

SEQ ID NO: 245078 - RNA, 64 nt, Homo Sapiens
gaaacuuaacauuaugagccuuuucugcucaaaaaauuuucaaagauuaaaacuauuauacaua

SEQ ID NO: 245079 - RNA, 64 nt, Homo Sapiens
cuaggauuacaggugccugccaccacacccggcuaauuuucauauuuuucaguagagacggggu

SEQ ID NO: 245080 - RNA, 64 nt, Homo Sapiens
aauuuuuuauuuuuugguauuggccauaagcaacaauuuucagauuugcacaaaaagauaccuu

SEQ ID NO: 245081 - RNA, 64 nt, Homo Sapiens
ugccucugauguauuuugugaguuuguuucuuugaauuuucauuuuacaguuacuuuuccuugc

SEQ ID NO: 245082 - RNA, 64 nt, Homo Sapiens
uuuguguaucccacagauucaaucuucaggugagaauuuucauugucaaaacccacugguuaga

SEQ ID NO: 245083 - RNA, 64 nt, Homo Sapiens
uaaaaauguguuuuguugaguuuccaaauggaugaauuuucauuuggacauuacaucacuaaau

SEQ ID NO: 245084 - RNA, 64 nt, Homo Sapiens
aauacugauauucacuuuauuccaauauucuaggaauuuucagcuguuuucauuuaaaguuuua

SEQ ID NO: 245085 - RNA, 64 nt, Homo Sapiens
aauacuaauauucucauuuuuccaguauucuaggaauuuucagcucauguuauuuaaaguuuua

SEQ ID NO: 245086 - RNA, 64 nt, Homo Sapiens
aucccaguaccuaguuauaucuaaccuaucaaaggcaagauaucauuuauuggacuucuugaaa

SEQ ID NO: 245087 - RNA, 64 nt, Homo Sapiens
uaaauuuggggauccuagagugaucuuaaauauggcaagauacagcucauuuagaauaaaaucu

SEQ ID NO: 245088 - RNA, 64 nt, Homo Sapiens
uuagcaaauuggaaauaauauauucauuuguauggcaagauaaaugcagucaucuuaauacuag

SEQ ID NO: 245089 - RNA, 64 nt, Homo Sapiens
ccauauuagguaaaauauuguucaaaguugcgaaagagcacaaauagauuugagcauuugaaga

SEQ ID NO: 245090 - RNA, 64 nt, Homo Sapiens
caucuuuuagauuugagcauuagcgcauaauaacagagcacaagaaacaauguuuucuuucugg

SEQ ID NO: 245091 - RNA, 64 nt, Homo Sapiens
caauuccuacuggugaaauuacuuacuuguauugagagcacacgaacaauugaaggaguggcaa

SEQ ID NO: 245092 - RNA, 56 nt, Homo Sapiens; identical to SEQ ID NO: 238493

SEQ ID NO: 245093 - RNA, 64 nt, Homo Sapiens
gccuggauuuccgcaccugccugucuccucucccagagcacaguauuugggagacuuugacuau

SEQ ID NO: 245094 - RNA, 64 nt, Homo Sapiens
aagugcccucuccuugaccuugagaugaaggucaagagcacagggaccaggccuugguuaggcu

SEQ ID NO: 245095 - RNA, 64 nt, Homo Sapiens
ccgugcacaacuuugacaucuggucuugcuccauagagcacaacucaagauagaccaugagaca

SEQ ID NO: 245096 - RNA, 64 nt, Homo Sapiens
gccauggugccgccuuccugaauuggcaguggucagagcacaccugaacccuauccugggcugg

SEQ ID NO: 245097 - RNA, 64 nt, Homo Sapiens
ucauagggggguguccccccagagacaaagcugcagagcacauuccaugccagacgcucuggcc

SEQ ID NO: 245098 - RNA, 64 nt, Homo Sapiens
ugcccacacacggcgcaggcugcccgccuccuggagagcacacuucagcugaaacaguaaagcc

SEQ ID NO: 245099 - RNA, 64 nt, Homo Sapiens
aagccacccugccugcugggggacaucaccagccagagcacagguucucagagcagggcgauug

SEQ ID NO: 245100 - RNA, 64 nt, Homo Sapiens
agaaaaacuaaauuauugaacuacuaaaaaaaaaagagcacaaaauugacaacuguuccugcuu

SEQ ID NO: 245101 - RNA, 64 nt, Homo Sapiens
cuucuguaaggagaaaggcauuuuucucccuuuaagagcacauuugacaauuuuuuguauuugc

SEQ ID NO: 245102 - RNA, 64 nt, Homo Sapiens
ucuagcccucagcaagacaggaacaccauucuucagagcacacgcauguggucuucugaaaaug

SEQ ID NO: 245103 - RNA, 64 nt, Homo Sapiens; identical to SEQ ID NO: 227857

SEQ ID NO: 245104 - RNA, 64 nt, Homo Sapiens; identical to SEQ ID NO: 227858

SEQ ID NO: 245105 - RNA, 57 nt, Homo Sapiens; identical to SEQ ID NO: 227859

SEQ ID NO: 245106 - RNA, 64 nt, Homo Sapiens; identical to SEQ ID NO: 227860

SEQ ID NO: 245107 - RNA, 64 nt, Homo Sapiens; identical to SEQ ID NO: 227861

SEQ ID NO: 245108 - RNA, 64 nt, Homo Sapiens; identical to SEQ ID NO: 227862

SEQ ID NO: 245109 - RNA, 64 nt, Homo Sapiens; identical to SEQ ID NO: 227863

SEQ ID NO: 245110 - RNA, 64 nt, Homo Sapiens; identical to SEQ ID NO: 227864

SEQ ID NO: 245111 - RNA, 64 nt, Homo Sapiens; identical to SEQ ID NO: 227865

SEQ ID NO: 245112 - RNA, 64 nt, Homo Sapiens; identical to SEQ ID NO: 227866

SEQ ID NO: 245113 - RNA, 64 nt, Homo Sapiens; identical to SEQ ID NO: 227867

SEQ ID NO: 245114 - RNA, 64 nt, Homo Sapiens; identical to SEQ ID NO: 227868

SEQ ID NO: 245115 - RNA, 64 nt, Homo Sapiens; identical to SEQ ID NO: 227869

SEQ ID NO: 245116 - RNA, 64 nt, Homo Sapiens; identical to SEQ ID NO: 227870

SEQ ID NO: 245117 - RNA, 64 nt, Homo Sapiens; identical to SEQ ID NO: 227871

SEQ ID NO: 245118 - RNA, 64 nt, Homo Sapiens
uauuacucacaugggugcaaucuuuagccccagggaggucaauaaugucuuuuaaagccagaag

SEQ ID NO: 245119 - RNA, 64 nt, Homo Sapiens
cccagcuacuugggaggcugaggugggagccugggaggucaaggcugcagugagccaugaucau

SEQ ID NO: 245120 - RNA, 64 nt, Homo Sapiens
gccgcuggaagauuguauuccagaugcuagcuuagaggucaaguacagucuccucaugagacau

SEQ ID NO: 245121 - RNA, 64 nt, Homo Sapiens
aaaugcccguauuaggaggauuacuugagcccaggaggucaaagcugaggugagccaugauuac

SEQ ID NO: 245122 - RNA, 64 nt, Homo Sapiens
ugaagacggaaaccggaaacugcucaggacauuugaggucaaaucagcagaauaacaaaaacuu

SEQ ID NO: 245123 - RNA, 64 nt, Homo Sapiens
uucagccaucaugguaggcauuacggucuucuuugaggucaaaauucuugagcacugauauaaa

SEQ ID NO: 245124 - RNA, 64 nt, Homo Sapiens
uuccaaaagugcccgaggcauccccaaggcuccugaggucaagccaagggaccugaagugaagc

SEQ ID NO: 245125 - RNA, 64 nt, Homo Sapiens
ugcccaagggaccugaaguggagugucagggcccgaggucaagggaugcccucccuuggcaucg

SEQ ID NO: 245126 - RNA, 64 nt, Homo Sapiens; identical to SEQ ID NO: 239110

SEQ ID NO: 245127 - RNA, 64 nt, Homo Sapiens; identical to SEQ ID NO: 239111

SEQ ID NO: 245128 - RNA, 64 nt, Homo Sapiens; identical to SEQ ID NO: 239112

SEQ ID NO: 245129 - RNA, 64 nt, Homo Sapiens; identical to SEQ ID NO: 239113

SEQ ID NO: 245130 - RNA, 64 nt, Homo Sapiens; identical to SEQ ID NO: 239114

SEQ ID NO: 245131 - RNA, 64 nt, Homo Sapiens; identical to SEQ ID NO: 239115

SEQ ID NO: 245132 - RNA, 64 nt, Homo Sapiens; identical to SEQ ID NO: 239116

SEQ ID NO: 245133 - RNA, 64 nt, Homo Sapiens; identical to SEQ ID NO: 239117

SEQ ID NO: 245134 - RNA, 64 nt, Homo Sapiens; identical to SEQ ID NO: 239118

SEQ ID NO: 245135 - RNA, 64 nt, Homo Sapiens; identical to SEQ ID NO: 239119

SEQ ID NO: 245136 - RNA, 54 nt, Homo Sapiens; identical to SEQ ID NO: 239120

SEQ ID NO: 245137 - RNA, 64 nt, Homo Sapiens; identical to SEQ ID NO: 239121

SEQ ID NO: 245138 - RNA, 64 nt, Homo Sapiens; identical to SEQ ID NO: 239122

SEQ ID NO: 245139 - RNA, 64 nt, Homo Sapiens; identical to SEQ ID NO: 239123

SEQ ID NO: 245140 - RNA, 64 nt, Homo Sapiens; identical to SEQ ID NO: 239124

SEQ ID NO: 245141 - RNA, 64 nt, Homo Sapiens; identical to SEQ ID NO: 239125

SEQ ID NO: 245142 - RNA, 64 nt, Homo Sapiens; identical to SEQ ID NO: 239126

SEQ ID NO: 245143 - RNA, 64 nt, Homo Sapiens; identical to SEQ ID NO: 239127

SEQ ID NO: 245144 - RNA, 64 nt, Homo Sapiens; identical to SEQ ID NO: 239128

SEQ ID NO: 245145 - RNA, 64 nt, Homo Sapiens; identical to SEQ ID NO: 239129

SEQ ID NO: 245146 - RNA, 64 nt, Homo Sapiens; identical to SEQ ID NO: 239130

SEQ ID NO: 245147 - RNA, 64 nt, Homo Sapiens; identical to SEQ ID NO: 239131

SEQ ID NO: 245148 - RNA, 64 nt, Homo Sapiens; identical to SEQ ID NO: 239132

SEQ ID NO: 245149 - RNA, 64 nt, Homo Sapiens; identical to SEQ ID NO: 239133

SEQ ID NO: 245150 - RNA, 64 nt, Homo Sapiens; identical to SEQ ID NO: 239134

SEQ ID NO: 245151 - RNA, 64 nt, Homo Sapiens; identical to SEQ ID NO: 239135

SEQ ID NO: 245152 - RNA, 64 nt, Homo Sapiens; identical to SEQ ID NO: 239136

SEQ ID NO: 245153 - RNA, 64 nt, Homo Sapiens; identical to SEQ ID NO: 239137

SEQ ID NO: 245154 - RNA, 64 nt, Homo Sapiens; identical to SEQ ID NO: 239138

SEQ ID NO: 245155 - RNA, 64 nt, Homo Sapiens; identical to SEQ ID NO: 239139

SEQ ID NO: 245156 - RNA, 64 nt, Homo Sapiens; identical to SEQ ID NO: 239140

SEQ ID NO: 245157 - RNA, 64 nt, Homo Sapiens; identical to SEQ ID NO: 239141

SEQ ID NO: 245158 - RNA, 64 nt, Homo Sapiens; identical to SEQ ID NO: 239142

SEQ ID NO: 245159 - RNA, 64 nt, Homo Sapiens; identical to SEQ ID NO: 239143

SEQ ID NO: 245160 - RNA, 64 nt, Homo Sapiens; identical to SEQ ID NO: 239144

SEQ ID NO: 245161 - RNA, 64 nt, Homo Sapiens; identical to SEQ ID NO: 239145

SEQ ID NO: 245162 - RNA, 64 nt, Homo Sapiens; identical to SEQ ID NO: 239146

SEQ ID NO: 245163 - RNA, 64 nt, Homo Sapiens; identical to SEQ ID NO: 239147

SEQ ID NO: 245164 - RNA, 64 nt, Homo Sapiens; identical to SEQ ID NO: 239148

SEQ ID NO: 245165 - RNA, 64 nt, Homo Sapiens; identical to SEQ ID NO: 239149

SEQ ID NO: 245166 - RNA, 64 nt, Homo Sapiens; identical to SEQ ID NO: 239150

SEQ ID NO: 245167 - RNA, 64 nt, Homo Sapiens; identical to SEQ ID NO: 239151

SEQ ID NO: 245168 - RNA, 64 nt, Homo Sapiens
gucuuugacuaggaaccggacucuuaauuuccucaggacagacuagcuggcacauuaucccuac

SEQ ID NO: 245169 - RNA, 64 nt, Homo Sapiens
uuuacuauuuaugauguauuuaaguguuuuauuaaggacagaguucuguuaggggugggaggga

SEQ ID NO: 245170 - RNA, 64 nt, Homo Sapiens
agaaccuauaggaaacuacuuggagcaaacucaaaggacagauuagggaucgagauugggucag

SEQ ID NO: 245171 - RNA, 64 nt, Homo Sapiens
gccuauaucgcaaauuuucuaagccacguccuauaggacagaggagacuggccccacuucuaug

SEQ ID NO: 245172 - RNA, 64 nt, Homo Sapiens
aaaaaucaaccuaucaaagcuuuuauauuauauaaggacagaccuaaaagugucuguagguacg

SEQ ID NO: 245173 - RNA, 55 nt, Homo Sapiens
agaugacucguucccauagagauagaggacagagacauuacagcuaauuucuuga

SEQ ID NO: 245174 - RNA, 64 nt, Homo Sapiens
aaaaggacggaguggggggacagagacucagaugaggacagagugguuuccaauguguucaaua

SEQ ID NO: 245175 - RNA, 64 nt, Homo Sapiens
aggagcagaaaugcaaggggcugcaugaccuaccaggacagaacuuuccccaauuacaggguga

SEQ ID NO: 245176 - RNA, 64 nt, Homo Sapiens
cucuggcaggaguaaauuagagcccucauauucaaggacagaaggauuuacuauaggugaagau

SEQ ID NO: 245177 - RNA, 64 nt, Homo Sapiens
cucucccccacucccuugccagccauagccagaaaggacagaauagcaugcuugugcagaaaga

SEQ ID NO: 245178 - RNA, 64 nt, Homo Sapiens
gcacaugaacagcuugccagcuguggacaggaugaggacagaggugccccaggcucucgcugcc

SEQ ID NO: 245179 - RNA, 64 nt, Homo Sapiens
cagcggcuccaacuccuuucagagaaaaugagaaaggacagagcucauuuggagcucuuggguc

SEQ ID NO: 245180 - RNA, 64 nt, Homo Sapiens
uccuuucccaguuguuacccccagaaugacacaaaggacagaauagaauugcuacucgaaggug

SEQ ID NO: 245181 - RNA, 64 nt, Homo Sapiens
caagauuaaaaccuggauccaaaucacaugguucaggacagaaaaagaugaagugacuuccuca

SEQ ID NO: 245182 - RNA, 64 nt, Homo Sapiens
ugccugcuuguggagaccaguucuggaggggcugaggacagaugugucugacgcggccaccucu

SEQ ID NO: 245183 - RNA, 64 nt, Homo Sapiens
gaugucgcacacgccgagacgcuucggacagaacaggacagaugcagugacucagaaugaacug

SEQ ID NO: 245184 - RNA, 64 nt, Homo Sapiens
aauuacuccaugaugaaucuaaagggauuuuugaaggacagaacguguauugagcuuauuguug

SEQ ID NO: 245185 - RNA, 64 nt, Homo Sapiens
acuaaaaaauugcugcuggaaacagccucccaaaaggacagagauagagacgagcaguggagga

SEQ ID NO: 245186 - RNA, 64 nt, Homo Sapiens
acaagccacacucagaggccaacaacucuaacccaggacagaccaugguauguuccgugauauu

SEQ ID NO: 245187 - RNA, 64 nt, Homo Sapiens
uuaggugacaccugguuauggcaucuuggccuacaggacagauucugccugggcgcugcgugua

SEQ ID NO: 245188 - RNA, 64 nt, Homo Sapiens
ucgcccauuauucaggcugcugcagcaagauauuaggacagauuaaggagugaguuaggacaga

SEQ ID NO: 245189 - RNA, 62 nt, Homo Sapiens
cagcaagauauuaggacagaaaggagugaguuaggacagaugccucugcugaggcccuguaa

SEQ ID NO: 245190 - RNA, 64 nt, Homo Sapiens
ggugggaagagaggacaucuguccagucucaaucaggacagaccaccgugcgacacccaggagg

SEQ ID NO: 245191 - RNA, 64 nt, Homo Sapiens
guucaccuuaaguaacacacaaaucgggaacaggaggacagaaccguuggcauuaucaggauuc

SEQ ID NO: 245192 - RNA, 64 nt, Homo Sapiens
uugcugcuuccucggcccagggagaaagcaugucaggacagagcuguuggauuggcuuugauag

SEQ ID NO: 245193 - RNA, 64 nt, Homo Sapiens
cucuuagcaucuccucuaguauuuuccauguaucaggacagaggugucuuauguagggaggggg

SEQ ID NO: 245194 - RNA, 64 nt, Homo Sapiens
aauagauuuaacccuucacauuuuuuucuaccagaggacagauuucaguuauuauuucuucauu

SEQ ID NO: 245195 - RNA, 64 nt, Homo Sapiens
ccauuccgaaaucaagaaacugaagaaacaaagaaggacagaggugucugggaaaaagugcacg

SEQ ID NO: 245196 - RNA, 64 nt, Homo Sapiens
acggcaaucuacaaaacuacaaguuucaugugguaggacagagagagaacagaaggccgaaucc

SEQ ID NO: 245197 - RNA, 64 nt, Homo Sapiens
acagaaggccgaauccaaguaaguuucauguaguaggacagagacuuuagugaaggcugaaucc

SEQ ID NO: 245198 - RNA, 64 nt, Homo Sapiens
ggagguggcccuaucccuaggcaguggugcuaggaggacagaaggcuauaugggcguggcagag

SEQ ID NO: 245199 - RNA, 64 nt, Homo Sapiens
ccccgccuugugagccaggaagcagcgucucaucaggacagaagguaggaugaagacauggggu

SEQ ID NO: 245200 - RNA, 64 nt, Homo Sapiens
aaaacuuggguaacacuuccaaauaugggaggaaaggacagauguguuuacaagggaggauuuu

SEQ ID NO: 245201 - RNA, 64 nt, Homo Sapiens
ucuacauuuaucaauaaaauguaaauuaucugaaaggacagaauauaagauuuaaccauguuug

SEQ ID NO: 245202 - RNA, 64 nt, Homo Sapiens
uguuaggcucacaguuacaguuuauuacaguaaaaggacagagauuaagaucagcaaagggagg

SEQ ID NO: 245203 - RNA, 64 nt, Homo Sapiens
caaagcuugagcugcucugcaagagaaaauaagcaggacagaggauuugcucuggacagagaug

SEQ ID NO: 245204 - RNA, 64 nt, Homo Sapiens
aucugaacuugguuuucccgucagaagaaucagcaggacagaucguagugccuuauuccauugu

SEQ ID NO: 245205 - RNA, 64 nt, Homo Sapiens
ccaccaccagggcacucacucgcagcuauagcccaggacagaaaaacugugcuuuggacaggug

SEQ ID NO: 245206 - RNA, 64 nt, Homo Sapiens
cuagggaacgaggcagccuauuggagaugcggacaggacagacacguugagaagcugcagggag

SEQ ID NO: 245207 - RNA, 64 nt, Homo Sapiens
gaagggaugggguauccccauggaugcugggaugaggacagaggaagaccugauggggucuccu

SEQ ID NO: 245208 - RNA, 64 nt, Homo Sapiens
ccugcacacaaacuggggcuauagagauucuccaaggacagauggcaguggagcuagaccugag

SEQ ID NO: 245209 - RNA, 64 nt, Homo Sapiens
ccuugcucacaaaguuacaggguaggcaccugucaggacagaacagcagcagcgcuacagccca

SEQ ID NO: 245210 - RNA, 64 nt, Homo Sapiens
uaccaagcguuacaaaaucaauaauuuauuuuaaaggacagaaugaauuauuuauucaugggag

SEQ ID NO: 245211 - RNA, 64 nt, Homo Sapiens
aggaaaugcuuugggaugagaaucuguugaagaaaggacagaaggcacaggaaagagaaaaaga

SEQ ID NO: 245212 - RNA, 64 nt, Homo Sapiens; identical to SEQ ID NO: 92348

SEQ ID NO: 245213 - RNA, 64 nt, Homo Sapiens; identical to SEQ ID NO: 92349

SEQ ID NO: 245214 - RNA, 64 nt, Homo Sapiens; identical to SEQ ID NO: 92350

SEQ ID NO: 245215 - RNA, 64 nt, Homo Sapiens; identical to SEQ ID NO: 92351

SEQ ID NO: 245216 - RNA, 64 nt, Homo Sapiens; identical to SEQ ID NO: 92352

SEQ ID NO: 245217 - RNA, 64 nt, Homo Sapiens; identical to SEQ ID NO: 92353

SEQ ID NO: 245218 - RNA, 64 nt, Homo Sapiens; identical to SEQ ID NO: 92354

SEQ ID NO: 245219 - RNA, 64 nt, Homo Sapiens; identical to SEQ ID NO: 92355

SEQ ID NO: 245220 - RNA, 64 nt, Homo Sapiens; identical to SEQ ID NO: 92356

SEQ ID NO: 245221 - RNA, 64 nt, Homo Sapiens; identical to SEQ ID NO: 92357

SEQ ID NO: 245222 - RNA, 64 nt, Homo Sapiens; identical to SEQ ID NO: 92358

SEQ ID NO: 245223 - RNA, 64 nt, Homo Sapiens; identical to SEQ ID NO: 92359

SEQ ID NO: 245224 - RNA, 64 nt, Homo Sapiens; identical to SEQ ID NO: 92360

SEQ ID NO: 245225 - RNA, 64 nt, Homo Sapiens; identical to SEQ ID NO: 92361

SEQ ID NO: 245226 - RNA, 64 nt, Homo Sapiens; identical to SEQ ID NO: 92362

SEQ ID NO: 245227 - RNA, 64 nt, Homo Sapiens; identical to SEQ ID NO: 92363

SEQ ID NO: 245228 - RNA, 64 nt, Homo Sapiens; identical to SEQ ID NO: 92364

SEQ ID NO: 245229 - RNA, 64 nt, Homo Sapiens; identical to SEQ ID NO: 92365

SEQ ID NO: 245230 - RNA, 64 nt, Homo Sapiens; identical to SEQ ID NO: 92366

SEQ ID NO: 245231 - RNA, 64 nt, Homo Sapiens; identical to SEQ ID NO: 92367

SEQ ID NO: 245232 - RNA, 64 nt, Homo Sapiens; identical to SEQ ID NO: 92368

SEQ ID NO: 245233 - RNA, 64 nt, Homo Sapiens; identical to SEQ ID NO: 92369

SEQ ID NO: 245234 - RNA, 64 nt, Homo Sapiens; identical to SEQ ID NO: 92370

SEQ ID NO: 245235 - RNA, 64 nt, Homo Sapiens; identical to SEQ ID NO: 92371

SEQ ID NO: 245236 - RNA, 64 nt, Homo Sapiens; identical to SEQ ID NO: 92372

SEQ ID NO: 245237 - RNA, 64 nt, Homo Sapiens; identical to SEQ ID NO: 92373

SEQ ID NO: 245238 - RNA, 64 nt, Homo Sapiens; identical to SEQ ID NO: 92374

SEQ ID NO: 245239 - RNA, 64 nt, Homo Sapiens; identical to SEQ ID NO: 92375

SEQ ID NO: 245240 - RNA, 64 nt, Homo Sapiens; identical to SEQ ID NO: 92376

SEQ ID NO: 245241 - RNA, 64 nt, Homo Sapiens; identical to SEQ ID NO: 92377

SEQ ID NO: 245242 - RNA, 64 nt, Homo Sapiens; identical to SEQ ID NO: 92378

SEQ ID NO: 245243 - RNA, 64 nt, Homo Sapiens; identical to SEQ ID NO: 92379

SEQ ID NO: 245244 - RNA, 64 nt, Homo Sapiens; identical to SEQ ID NO: 92354

SEQ ID NO: 245245 - RNA, 64 nt, Homo Sapiens; identical to SEQ ID NO: 92355

SEQ ID NO: 245246 - RNA, 64 nt, Homo Sapiens; identical to SEQ ID NO: 92382

SEQ ID NO: 245247 - RNA, 64 nt, Homo Sapiens; identical to SEQ ID NO: 92383

SEQ ID NO: 245248 - RNA, 64 nt, Homo Sapiens; identical to SEQ ID NO: 92384

SEQ ID NO: 245249 - RNA, 64 nt, Homo Sapiens; identical to SEQ ID NO: 92385

SEQ ID NO: 245250 - RNA, 64 nt, Homo Sapiens; identical to SEQ ID NO: 92386

SEQ ID NO: 245251 - RNA, 64 nt, Homo Sapiens; identical to SEQ ID NO: 92387

SEQ ID NO: 245252 - RNA, 64 nt, Homo Sapiens; identical to SEQ ID NO: 92388

SEQ ID NO: 245253 - RNA, 64 nt, Homo Sapiens; identical to SEQ ID NO: 92389

SEQ ID NO: 245254 - RNA, 64 nt, Homo Sapiens; identical to SEQ ID NO: 92390

SEQ ID NO: 245255 - RNA, 64 nt, Homo Sapiens; identical to SEQ ID NO: 92391

SEQ ID NO: 245256 - RNA, 64 nt, Homo Sapiens; identical to SEQ ID NO: 92392

SEQ ID NO: 245257 - RNA, 64 nt, Homo Sapiens; identical to SEQ ID NO: 92393

SEQ ID NO: 245258 - RNA, 64 nt, Homo Sapiens; identical to SEQ ID NO: 92394

SEQ ID NO: 245259 - RNA, 64 nt, Homo Sapiens; identical to SEQ ID NO: 92395

SEQ ID NO: 245260 - RNA, 64 nt, Homo Sapiens; identical to SEQ ID NO: 92396

SEQ ID NO: 245261 - RNA, 64 nt, Homo Sapiens; identical to SEQ ID NO: 92397

SEQ ID NO: 245262 - RNA, 64 nt, Homo Sapiens; identical to SEQ ID NO: 92398

SEQ ID NO: 245263 - RNA, 64 nt, Homo Sapiens; identical to SEQ ID NO: 92399

SEQ ID NO: 245264 - RNA, 64 nt, Homo Sapiens; identical to SEQ ID NO: 92400

SEQ ID NO: 245265 - RNA, 64 nt, Homo Sapiens; identical to SEQ ID NO: 92401

SEQ ID NO: 245266 - RNA, 64 nt, Homo Sapiens; identical to SEQ ID NO: 92402

SEQ ID NO: 245267 - RNA, 64 nt, Homo Sapiens; identical to SEQ ID NO: 92403

SEQ ID NO: 245268 - RNA, 64 nt, Homo Sapiens; identical to SEQ ID NO: 92404

SEQ ID NO: 245269 - RNA, 64 nt, Homo Sapiens; identical to SEQ ID NO: 92405

SEQ ID NO: 245270 - RNA, 64 nt, Homo Sapiens; identical to SEQ ID NO: 92406

SEQ ID NO: 245271 - RNA, 64 nt, Homo Sapiens; identical to SEQ ID NO: 92407

SEQ ID NO: 245272 - RNA, 64 nt, Homo Sapiens; identical to SEQ ID NO: 92408

SEQ ID NO: 245273 - RNA, 64 nt, Homo Sapiens; identical to SEQ ID NO: 92409

SEQ ID NO: 245274 - RNA, 64 nt, Homo Sapiens; identical to SEQ ID NO: 92410

SEQ ID NO: 245275 - RNA, 64 nt, Homo Sapiens; identical to SEQ ID NO: 92411

SEQ ID NO: 245276 - RNA, 64 nt, Homo Sapiens; identical to SEQ ID NO: 92412

SEQ ID NO: 245277 - RNA, 64 nt, Homo Sapiens; identical to SEQ ID NO: 92413

SEQ ID NO: 245278 - RNA, 64 nt, Homo Sapiens; identical to SEQ ID NO: 92414

SEQ ID NO: 245279 - RNA, 64 nt, Homo Sapiens; identical to SEQ ID NO: 92415

SEQ ID NO: 245280 - RNA, 64 nt, Homo Sapiens; identical to SEQ ID NO: 92416

SEQ ID NO: 245281 - RNA, 64 nt, Homo Sapiens; identical to SEQ ID NO: 92417

SEQ ID NO: 245282 - RNA, 64 nt, Homo Sapiens; identical to SEQ ID NO: 92418

SEQ ID NO: 245283 - RNA, 64 nt, Homo Sapiens; identical to SEQ ID NO: 92419

SEQ ID NO: 245284 - RNA, 64 nt, Homo Sapiens; identical to SEQ ID NO: 92420

SEQ ID NO: 245285 - RNA, 64 nt, Homo Sapiens; identical to SEQ ID NO: 92421

SEQ ID NO: 245286 - RNA, 64 nt, Homo Sapiens; identical to SEQ ID NO: 92422

SEQ ID NO: 245287 - RNA, 64 nt, Homo Sapiens; identical to SEQ ID NO: 92423

SEQ ID NO: 245288 - RNA, 64 nt, Homo Sapiens; identical to SEQ ID NO: 92424

SEQ ID NO: 245289 - RNA, 64 nt, Homo Sapiens; identical to SEQ ID NO: 92425

SEQ ID NO: 245290 - RNA, 64 nt, Homo Sapiens; identical to SEQ ID NO: 92426

SEQ ID NO: 245291 - RNA, 64 nt, Homo Sapiens
gggaacaugggaguggcugcggggacgugaucuaaguuaggaguaaggucucuuucagguccca

SEQ ID NO: 245292 - RNA, 64 nt, Homo Sapiens
guuuccuauagcaaagggcuaaaaaaaucauaauaguuaggauauuuaaucuaaacuuuuuuua

SEQ ID NO: 245293 - RNA, 64 nt, Homo Sapiens
cuggguucaaacccucuucccccguggauuuuguaguuaggaacucaggagagcagcaguuaaa

SEQ ID NO: 245294 - RNA, 64 nt, Homo Sapiens
cgaacaccagucaugccuacccagggagcaggggaguuaggaauucaguugguuccaaaugaaa

SEQ ID NO: 245295 - RNA, 64 nt, Homo Sapiens
caggcccugaucugcgcuguggcugucccuggacgugcugcagcccuccugucccuucccccca

SEQ ID NO: 245296 - RNA, 64 nt, Homo Sapiens
cccgcuggggcggccggggcgggagagaaagguggugcugcagugguggcccuggggggccauu

SEQ ID NO: 245297 - RNA, 64 nt, Homo Sapiens
ugagccugaggccuuccagaaagcaggagcagcugugcugcaccccaugugggugaccaggucc

SEQ ID NO: 245298 - RNA, 64 nt, Homo Sapiens
uaugcccguguaaaguaugugaaucgcaaggccugugcugcaugcgacagcguccgggguggug

SEQ ID NO: 245299 - RNA, 64 nt, Homo Sapiens
guuaguuacauauguauacaugugccaugcuggugugcugcacccauuaacucgucauuuauca

SEQ ID NO: 245300 - RNA, 64 nt, Homo Sapiens
uuggguugguuccaagucuuugcuauugugaauagugcugcaauaaacauacgugugcaugugu

SEQ ID NO: 245301 - RNA, 64 nt, Homo Sapiens
gagccugcaggcuuuggaaguggcccugucacccgugcugcacgggauucacagccccagcccc

SEQ ID NO: 245302 - RNA, 64 nt, Homo Sapiens
cuucccgaguugucugccucuccucaaaugcugugugcugcaauuguccaggcgaugacaaugg

SEQ ID NO: 245303 - RNA, 64 nt, Homo Sapiens
uguggggagcccggaaacaccacccggcccacgcgugcugcagaagauguggggagucuggaaa

SEQ ID NO: 245304 - RNA, 64 nt, Homo Sapiens
uguggggagucuggaaacaccacccggcccacgcgugcugcagaagauguggggagccuggaaa

SEQ ID NO: 245305 - RNA, 64 nt, Homo Sapiens
uguggggagccuggaaacaccacccggcccacgcgugcugcagaagauguggggagccuggaaa

SEQ ID NO: 245306 - RNA, 64 nt, Homo Sapiens
uguggggagccuggaaacaccacccggcccacgcgugcugcagaugacguggggagccuggaaa

SEQ ID NO: 245307 - RNA, 64 nt, Homo Sapiens
gccuggggggugugauuugugugcgugcuugcaugugcugcagguguaagagagugggagcagg

SEQ ID NO: 245308 - RNA, 64 nt, Homo Sapiens
accagagacucugaaacuauagaauaaagccucugugcugcacaacaaaggggcaggcucugcu

SEQ ID NO: 245309 - RNA, 64 nt, Homo Sapiens
cccaccgcccagcuucucccgggcccaccagccugugcugcauaaccgcccagcuucucccuga

SEQ ID NO: 245310 - RNA, 64 nt, Homo Sapiens
cccaccgcccagcuucucccgggcccaccagccugugcugcauaagccccugcccugccucuga

SEQ ID NO: 245311 - RNA, 64 nt, Homo Sapiens
aucaggccagagugucucaaacuggacaagaaaugugcugcauugccgaguucuuauuuucacc

SEQ ID NO: 245312 - RNA, 64 nt, Homo Sapiens
ccuaggcccucuccuguugcucugucauccuaaugugcugcauccaccucauggaccaagaugg

SEQ ID NO: 245313 - RNA, 64 nt, Homo Sapiens
gcuucagcccagagggcccuucaccucuggagcugugcugcacuuggggucugccccucccuuc

SEQ ID NO: 245314 - RNA, 64 nt, Homo Sapiens
gucuugaacaaggcagaagucacagcugaagugggugcugcaacucucucaggcaugccccauu

SEQ ID NO: 245315 - RNA, 64 nt, Homo Sapiens
ggaaagggccugaggccucagcaaggcagaccuggugcugcaaauguuuccuccugggaugcgu

SEQ ID NO: 245316 - RNA, 64 nt, Homo Sapiens
ccgcagcagcauacaggccugggucuccccaccagugcugcacccccuguguguggggugguga

SEQ ID NO: 245317 - RNA, 64 nt, Homo Sapiens
aguccucagggagggagugaccucgacccuggcugugcugcaagcugacuccagccuugguacu

SEQ ID NO: 245318 - RNA, 64 nt, Homo Sapiens
cagaccugccccaagggugaugcagaggccacaggugcugcacgcuccagcgcccacucuagac

SEQ ID NO: 245319 - RNA, 64 nt, Homo Sapiens
agggagagcugggcagaagcucccugcagugccagugcugcagccccgccguggcugggaaggu

SEQ ID NO: 245320 - RNA, 64 nt, Homo Sapiens
ucugugcuggccacgugcccagcgccuggugcgcgugcugcagacuuuagggccaccauggcgc

SEQ ID NO: 245321 - RNA, 64 nt, Homo Sapiens
aggaauccgccgaggcagggaaacagacugugggaaggaucagagaggauggaaggauggagaa

SEQ ID NO: 245322 - RNA, 64 nt, Homo Sapiens
aaaccugaagccagcaggaagaauuccagaauguaaggaucaucuacagaggagacugacagag

SEQ ID NO: 245323 - RNA, 64 nt, Homo Sapiens
cuuuccuguccuggcuccauggcgucaugagcugaaggaucaugaguugucuggaagccugggu

SEQ ID NO: 245324 - RNA, 64 nt, Homo Sapiens
auuuccauuccguguuacaacagugcccaugggcaaggaucauggguuccucuuucuuucagcu

SEQ ID NO: 245325 - RNA, 64 nt, Homo Sapiens
aauuuaggguaugaucucgguguggcaacugcaaaaggaucaggauguacuaaaagccacagua

SEQ ID NO: 245326 - RNA, 64 nt, Homo Sapiens
uuacuuaacucgcagccuguguguggcaugcuccaaggaucaucccaccgcucuggagaggaca

SEQ ID NO: 245327 - RNA, 64 nt, Homo Sapiens
uaauaauuuuauaaguauuuucucuguuaugguugcgcauaaauauauauagggugguccccag

SEQ ID NO: 245328 - RNA, 64 nt, Homo Sapiens
guccaccucuucuccccugcccaccagcugcucagcgcauaagaccuucccgacaggcucugcg

SEQ ID NO: 245329 - RNA, 64 nt, Homo Sapiens
acaaaggcucuuuucagagcgaccgaguugaaaagcgcauaaaaccaccacaagacuaaguaaa

SEQ ID NO: 245330 - RNA, 64 nt, Homo Sapiens
acagagcacaagcaucuuuuuuuucuuucugguagcgcauaauaucaaauuggauaaaacaaug

SEQ ID NO: 245331 - RNA, 64 nt, Homo Sapiens
cuaauuuacaaaaucacucucauuuaguuuacacgcgcauaagaugggguuaaguugggcagcc

SEQ ID NO: 245332 - RNA, 64 nt, Homo Sapiens
aaguggaauuucaggaaggcuugugugaaccguugcgcauaaauaaacccuuucuaccgggcug

SEQ ID NO: 245333 - RNA, 64 nt, Homo Sapiens
cugccccuuauacauaggaauaugcugcauaauugcgcauaacuuccaucucccuuacuggcuu

SEQ ID NO: 245334 - RNA, 64 nt, Homo Sapiens
augacauaaucugcuuagcaauuguuugucuguugcgcauaauagucucaauacuuagaaaauu

SEQ ID NO: 245335 - RNA, 64 nt, Homo Sapiens
gcugaucuagcuagggcuuugucuuuucaucuuugcgcauaacuuaccuguuaccaguauaggu

SEQ ID NO: 245336 - RNA, 64 nt, Homo Sapiens
gacuggaagggguuuuuguauaacuaaaaccucagcgcauaaaggagauuuaaaaggagcacau

SEQ ID NO: 245337 - RNA, 64 nt, Homo Sapiens
gagaguugguaucucaacccagagcaucgacaaggcgcauaauggaaacagaaacagccuguag

SEQ ID NO: 245338 - RNA, 64 nt, Homo Sapiens
gaaugguggacuuucacaaauucuggaguuguuugcgcauaaagggaacauuuuugcagcuugu

SEQ ID NO: 245339 - RNA, 64 nt, Homo Sapiens
gaaguccuggaguauuguuugggucucggaaugggcgcauaaccugcgcugaccaguuuagggg

SEQ ID NO: 245340 - RNA, 64 nt, Homo Sapiens
aguggggacacuuuaacuacaguuuacaccucgggcgcauaaaguuuuucuucucuuucucucu

SEQ ID NO: 245341 - RNA, 64 nt, Homo Sapiens
acacucugcguuauuggcugguuuagccagcccugcgcauaaauuccggacucguagccagccu

SEQ ID NO: 245342 - RNA, 64 nt, Homo Sapiens
gaccaguggggauuuguaagacuuagaugagauagcgcauaauaaggggaagacuuuaaaguau

SEQ ID NO: 245343 - RNA, 64 nt, Homo Sapiens
uaaaagcagcccgugugcauuuuuuuuaaaaccugcgcauaagagaauauuuaaaugaaacaua

SEQ ID NO: 245344 - RNA, 64 nt, Homo Sapiens
uuucauagguuauguuguguucauuuaguagguggcgcauaaucugugguuuucucucuuuuug

SEQ ID NO: 245345 - RNA, 64 nt, Homo Sapiens
cccagccccugcuacuggcuggacccucugcccugggcaggaggucaggggauucuguuuuggu

SEQ ID NO: 245346 - RNA, 64 nt, Homo Sapiens
uguggagagacacauaagccuuacuguccucugggggcaggagccgagccuuuuuguugcuccg

SEQ ID NO: 245347 - RNA, 64 nt, Homo Sapiens
cccaucaggcaguguuaccuguuagcucccuguggggcaggagugccaggaccagccuguaccu

SEQ ID NO: 245348 - RNA, 64 nt, Homo Sapiens
cagccuguaccuugcuguggggcuacaggauggugggcaggaucucaagccagcccccuccagc

SEQ ID NO: 245349 - RNA, 64 nt, Homo Sapiens
ccaagacccauucugcacagucccuccaggguuugggcaggagauggccaaucaugcgcccacc

SEQ ID NO: 245350 - RNA, 64 nt, Homo Sapiens
augggauuugggaaaggugaagcugugacuggaggggcaggagaugguccaaguguccauccag

SEQ ID NO: 245351 - RNA, 64 nt, Homo Sapiens
ugagagguggggaguacuggggcugggcggaggugggcaggaugucuaggacaucuguccagga

SEQ ID NO: 245352 - RNA, 64 nt, Homo Sapiens
cagcacgcugcuggcagagaucauuguacagauggggcaggaccacccucgagcgggguucccc

SEQ ID NO: 245353 - RNA, 64 nt, Homo Sapiens
cuggccaggagcccaaggucagccggggaggauagggcaggaguagcacugggaaagaagggag

SEQ ID NO: 245354 - RNA, 64 nt, Homo Sapiens
aaagucuuuggaaauagauuaaggauuaccccaagggcaggaaacccaucugcacagcggcagc

SEQ ID NO: 245355 - RNA, 64 nt, Homo Sapiens
uaggcuccccugagcacaguagccguuccccagggggcaggaagccgagagccccgccuccagc

SEQ ID NO: 245356 - RNA, 64 nt, Homo Sapiens
ccaccugcuacacucuugccgguaggaaugaccagggcaggaugccuggugcuccucucugcuu

SEQ ID NO: 245357 - RNA, 64 nt, Homo Sapiens
ccucacagaagagauacuugaguccugcugcacagggcaggagggcacuuucaaucccucaccu

SEQ ID NO: 245358 - RNA, 64 nt, Homo Sapiens
ggguuugguugccaaaagagguguggggaggugggggcaggauguguuuaagauucggcaguuu

SEQ ID NO: 245359 - RNA, 64 nt, Homo Sapiens
agcaaagcuguccuaggccaagggcuccuauaaggggcaggaagcaccaggaagaugaacugug

SEQ ID NO: 245360 - RNA, 64 nt, Homo Sapiens
caaaaccuggaacuuucaugccaaaccuggggcagggcaggaaacagaggaaauggcugcaaca

SEQ ID NO: 245361 - RNA, 64 nt, Homo Sapiens
cuguucuggcuguuauguaaaggagugcagggaggggcaggaaaggagacaaggaggccaguau

SEQ ID NO: 245362 - RNA, 64 nt, Homo Sapiens
caagucaucagagccgcucaggugacuggaggccgggcaggaagaggaaggggcauccacugcg

SEQ ID NO: 245363 - RNA, 64 nt, Homo Sapiens
gacccugaggaggccuugcccuggcgggacaggugggcaggacuacaaugcaaagacaugcugg

SEQ ID NO: 245364 - RNA, 64 nt, Homo Sapiens
gugccugauuucggggagucggaucucagcaguggggcaggaggagcuaggucuggcccguugg

SEQ ID NO: 245365 - RNA, 64 nt, Homo Sapiens
ggccugcugaggucacacagcccacguggaggcugggcaggaaggaggcauaggcuaggacagg

SEQ ID NO: 245366 - RNA, 64 nt, Homo Sapiens
aagggaggaagccaggggcgagacugaacacugagggcaggagccugugcccaggacgguucug

SEQ ID NO: 245367 - RNA, 64 nt, Homo Sapiens
caccuguaauuggggagagggagugugccccucggggcaggagggaagggcaucuggggaaggg

SEQ ID NO: 245368 - RNA, 64 nt, Homo Sapiens
ccccucggggcaggagggaagggcaucuggggaagggcaggagggaagagcuguccaugcagcc

SEQ ID NO: 245369 - RNA, 64 nt, Homo Sapiens
uggugaaagaaaaggugcauuucaagaacuuggggggcaggaggaaagcacaauguuucuuagc

SEQ ID NO: 245370 - RNA, 64 nt, Homo Sapiens
agaacuaagaacauauugagcuggagcuucuugagggcaggagaguauuggaaaaggaauccag

SEQ ID NO: 245371 - RNA, 64 nt, Homo Sapiens
agccucaaauccaggacccugccaggcacaggcagggcaggaccagcccacgcugacuacaggg

SEQ ID NO: 245372 - RNA, 64 nt, Homo Sapiens
cuggcucccucacucucaggaaaugcugacccaugggcaggagacuguggagacugcuccugag

SEQ ID NO: 245373 - RNA, 64 nt, Homo Sapiens
ggccucuuugacaagguaggagcugugcuuggaggggcaggaaaagaacugagcaugucgcagg

SEQ ID NO: 245374 - RNA, 64 nt, Homo Sapiens
caacuggaaugauucuagaaccaaaauaaaguuggggcaggaagagggggcuuccagggagccc

SEQ ID NO: 245375 - RNA, 64 nt, Homo Sapiens
cagccaggcccugcagggcuggucagggugucuggggcaggaggaggccaacucacugaacuag

SEQ ID NO: 245376 - RNA, 64 nt, Homo Sapiens
gucacauggggaaccuccccucaucgggccucuggggcaggaagcuugucacuggaagaucuua

SEQ ID NO: 245377 - RNA, 64 nt, Homo Sapiens
cgggaggccuucagggugggggggaaggggacaugggcaggaagcaccgagggaguugggcccu

SEQ ID NO: 245378 - RNA, 64 nt, Homo Sapiens
cagaaguuucucagcuccuuugacagacauucaagggcaggagggagccccaaagcauaaccag

SEQ ID NO: 245379 - RNA, 64 nt, Homo Sapiens
cugggcacuuacuccccguuccucaagggguuuggggcaggagcccaacaccuguuucucuuuu

SEQ ID NO: 245380 - RNA, 64 nt, Homo Sapiens
ugcucuucauccacuuggagaggcugccagcagcgggcaggagcgguggaggccccugggccug

SEQ ID NO: 245381 - RNA, 64 nt, Homo Sapiens
uggcccgagcucuccucagauggcuggagguugggggcaggaucagagucaccgagggcccaug

SEQ ID NO: 245382 - RNA, 64 nt, Homo Sapiens
ugagggcagggggccccgcuacagagcucuuuuggggcaggaggaauggcccucccgggucaug

SEQ ID NO: 245383 - RNA, 64 nt, Homo Sapiens
gcugucccagucugcccauccagguggagugggugggcaggaugggguaggggacacagcuggg

SEQ ID NO: 245384 - RNA, 64 nt, Homo Sapiens
uggggcugaggcccaaaggcagaacagccagagggggcaggaggggaccaaaaaggaaaaugag

SEQ ID NO: 245385 - RNA, 64 nt, Homo Sapiens
cacgcugucccggccugcucaccaucucagugaggggcaggagcuggggcucgcuuaggcuggg

SEQ ID NO: 245386 - RNA, 51 nt, Homo Sapiens
ccaccagcuggucccucugaugggcaggacccagcuucccacuugccacuc

SEQ ID NO: 245387 - RNA, 64 nt, Homo Sapiens
ccugcuguacucugggggcagggagaggcuagaggggcaggacagacagcguuguccaaucagg

SEQ ID NO: 245388 - RNA, 64 nt, Homo Sapiens
aacagaggcaucuccgcacccaagacugugcaacgggcaggaacguggucacagagcugcuucc

SEQ ID NO: 245389 - RNA, 64 nt, Homo Sapiens
cuaugcaucagcugugcccucuguggacuguaacgggcaggacaguuggguguggccugggcuc

SEQ ID NO: 245390 - RNA, 64 nt, Homo Sapiens
uagagguuuuguucguacucuuaacagggagugggggcaggaagaguccuguacuaugcagguu

SEQ ID NO: 245391 - RNA, 64 nt, Homo Sapiens
uagacacauccuccuaccguccccaaugcccccugggcaggaggcaguggagaaccaagcccca

SEQ ID NO: 245392 - RNA, 64 nt, Homo Sapiens
cguucucucuugcccagggugggccugguccugagggcaggacaggggguuuggagaugugggc

SEQ ID NO: 245393 - RNA, 57 nt, Homo Sapiens
ucuucaccaggauccgguaaaccugccgggcaggaccgugccacaccagcuguccag

SEQ ID NO: 245394 - RNA, 64 nt, Homo Sapiens
gagaggcaaagggcacagccaugcaaaggcccuggggcaggacggcaccugguaugcgggagga

SEQ ID NO: 245395 - RNA, 64 nt, Homo Sapiens
caaggccgggcccagccagaggaggggcagggcagggcaggagguuucuggauguuuguugggu

SEQ ID NO: 245396 - RNA, 64 nt, Homo Sapiens
gagagccugcugcaugggguaccucaggcaggaagggcaggaagggagccccagggucuucccu

SEQ ID NO: 245397 - RNA, 64 nt, Homo Sapiens
gcccuaccugauuggugcaaggguuuguggcugggggcaggaggggaggcuggcagguauggaa

SEQ ID NO: 245398 - RNA, 64 nt, Homo Sapiens
ggaacucgguucuccaacagcuguguuagugggugggcaggacuagugcuugccugagguccca

SEQ ID NO: 245399 - RNA, 64 nt, Homo Sapiens
agcuguagcccaucugagaggccccccaaaagaugggcaggacaucuuucuuugaagccuaaug

SEQ ID NO: 245400 - RNA, 64 nt, Homo Sapiens
gaggcaggggccccagaagccuucaccaggggaugggcaggaaauccuaucagaggcgauuuuc

SEQ ID NO: 245401 - RNA, 64 nt, Homo Sapiens
cggggugguccagugcugagcaacagucccaagggggcaggagagcgccaggcuccucggagcc

SEQ ID NO: 245402 - RNA, 64 nt, Homo Sapiens
ccccaggggaccagccaggccuggaaugcccccugggcaggacccugggcaggaccagaggccc

SEQ ID NO: 245403 - RNA, 64 nt, Homo Sapiens
agccaggccuggaaugcccccugggcaggacccugggcaggaccagaggcccacauggaugcca

SEQ ID NO: 245404 - RNA, 64 nt, Homo Sapiens
aaggguugagguuacuugggggggcgggaggaaggggcaggagggguuuugaccaaaagugagu

SEQ ID NO: 245405 - RNA, 64 nt, Homo Sapiens
gggacaggaucaccugcccgggguaccacccccagggcaggauggagaguugcucugggaguug

SEQ ID NO: 245406 - RNA, 64 nt, Homo Sapiens
cacguuaacagcgugucaacaaugauuuuuguguauccaguaugacagucucaauuuuguauuu

SEQ ID NO: 245407 - RNA, 64 nt, Homo Sapiens
gaaaauaggguccuugaaacguaggaaguaggaaauccaguaggucugcaacugaauacuugaa

SEQ ID NO: 245408 - RNA, 64 nt, Homo Sapiens
uuuuccuaauuaauguagcuuucggaugacauaaauccaguaucucugcuuaugacauaaaucc

SEQ ID NO: 245409 - RNA, 64 nt, Homo Sapiens
ugacauaaauccaguaucucugcuuaugacauaaauccaguaccucugcuuuucuuuugcugug

SEQ ID NO: 245410 - RNA, 64 nt, Homo Sapiens
uuguagaagauggaggucaucugcugggaaguuaauccaguacaaucggugaugcgcucaccuu

SEQ ID NO: 245411 - RNA, 64 nt, Homo Sapiens
gaucaaggccucagagggagugaggaaguuggauauccaguaauucuuucuuuuugaaggcagc

SEQ ID NO: 245412 - RNA, 64 nt, Homo Sapiens
gcacagcucugcguugcucccgugcugccugcgccagccccaggcugcugaggagcagaggcca

SEQ ID NO: 245413 - RNA, 64 nt, Homo Sapiens
cgucccuuccccacccccaucccauccccacccccagccccagcccaguccuccuaggagcagg

SEQ ID NO: 245414 - RNA, 64 nt, Homo Sapiens
ccgcagccucgcagcuccguggggcccuccgccccagccccagccagccaggcccugguggaaa

SEQ ID NO: 245415 - RNA, 64 nt, Homo Sapiens
ugcaccccaucccgacccugucuccgccaccucgcagccccauuaaagcgcucucaucugggcu

SEQ ID NO: 245416 - RNA, 64 nt, Homo Sapiens
cuucuguccaccuggccuccucucgccuggccgccagccccagccccagccccagccccaggcc

SEQ ID NO: 245417 - RNA, 64 nt, Homo Sapiens
uccaccuggccuccucucgccuggccgccagccccagccccagccccagccccaggcccagcug

SEQ ID NO: 245418 - RNA, 64 nt, Homo Sapiens
uggccuccucucgccuggccgccagccccagccccagccccagccccaggcccagcugccuuug

SEQ ID NO: 245419 - RNA, 64 nt, Homo Sapiens
ccucucgccuggccgccagccccagccccagccccagccccaggcccagcugccuuuggcuuug

SEQ ID NO: 245420 - RNA, 64 nt, Homo Sapiens
gggcccggcccuggacccgucaggugccuguccccagccccaaccccacucaugccccgucguc

SEQ ID NO: 245421 - RNA, 64 nt, Homo Sapiens
cagggaagcaggaaccccaccgugugcccccugccagccccagagggaguggcgagcccagcug

SEQ ID NO: 245422 - RNA, 64 nt, Homo Sapiens
cccccucucccuccugcaauaauucggggagucucagccccauccaggugccgcggccagcucu

SEQ ID NO: 245423 - RNA, 64 nt, Homo Sapiens
gucaacccuccuucccgacccccucccccuagcccagccccagucacugucagggucgggccag

SEQ ID NO: 245424 - RNA, 64 nt, Homo Sapiens
gggggcaagcuuuggugcgcccccugcugaggagcagccccaggaggggaccagaggggaugcu

SEQ ID NO: 245425 - RNA, 50 nt, Homo Sapiens
ccucccaggagcuccagugacagccccaucccaggaugggugucugggga

SEQ ID NO: 245426 - RNA, 64 nt, Homo Sapiens
gggagagggccaacaacugucccuccuugagcaccagccccacccaagcaagcagacauuuauc

SEQ ID NO: 245427 - RNA, 64 nt, Homo Sapiens
aaaggcagguggggucaccugaugagcuaagauccagccccagaauccuggaggagcaggaggu

SEQ ID NO: 245428 - RNA, 64 nt, Homo Sapiens
acaguccccugauccccuaccucugccugcccuccagccccaucaccagcuucuugcucaggga

SEQ ID NO: 245429 - RNA, 64 nt, Homo Sapiens
gcgggggccaugggggugaugaaugacccuccaacagccccacauggguuguuucuguuucuuu

SEQ ID NO: 245430 - RNA, 64 nt, Homo Sapiens
cuucgccaguuucuugguugggacacuccucuggcagccccagcaccaccacaaccccuugcag

SEQ ID NO: 245431 - RNA, 64 nt, Homo Sapiens
ugccacccacccccuaccauugagccaccaugcccagccccaaagccucuuaauugcucuaaca

SEQ ID NO: 245432 - RNA, 64 nt, Homo Sapiens
gagugcugggauuacacacgugagucaccaugcccagccccaaagccauuucuugaagaauuuc

SEQ ID NO: 245433 - RNA, 64 nt, Homo Sapiens
ugcugccugcagucagcucggccuccccgaccugcagccccagacucugcucucccagcacuga

SEQ ID NO: 245434 - RNA, 64 nt, Homo Sapiens
agugcucaucccagcguaugcugccucuuuagggcagccccaagggccagccagccuguacucu

SEQ ID NO: 245435 - RNA, 64 nt, Homo Sapiens
gagagaaacaaaaugggucagauagcuuuggccacagccccaggcagccuuuggggccuaugac

SEQ ID NO: 245436 - RNA, 64 nt, Homo Sapiens
gccccaugggaggcggcgcuugcagugagaacagcagccccacguggcggguugcuucagccag

SEQ ID NO: 245437 - RNA, 64 nt, Homo Sapiens
aggcuuguguuaaggcaaugauauugugagaaaacagccccaucagaagacacuuuauucguuu

SEQ ID NO: 245438 - RNA, 64 nt, Homo Sapiens
agcagccccccuaaaaaaaugccaggaaacuucccagccccaccuucugagguaaauaauuucu

SEQ ID NO: 245439 - RNA, 64 nt, Homo Sapiens
guaaagaagggucagauuaauugguaggcagaggcagccccacuagccauuuugcaccaaggac

SEQ ID NO: 245440 - RNA, 64 nt, Homo Sapiens
caauggccuuuugugcuugugaucaugcuccauccagccccaccucugcauacuuuaaggacca

SEQ ID NO: 245441 - RNA, 53 nt, Homo Sapiens
ccaggaggacgacugugucuccccagccccaagccccuuggggacccugguaa

SEQ ID NO: 245442 - RNA, 64 nt, Homo Sapiens
uccagcccugaggacagcuccagcgccucagccccagccccagccaccaccucccucccagccc

SEQ ID NO: 245443 - RNA, 64 nt, Homo Sapiens
cccagcuccagcccugaggacagccccagcgccucagccccagcucuuaucaccaccucccucc

SEQ ID NO: 245444 - RNA, 64 nt, Homo Sapiens
gccucagccccagccccagccaccaccucccucccagccccagccuuucugcagugguucuuau

SEQ ID NO: 245445 - RNA, 64 nt, Homo Sapiens
ucucccuugacccaccccagugagugccaaagggcagccccaacaugugcaccccugcauuucc

SEQ ID NO: 245446 - RNA, 64 nt, Homo Sapiens
uugagggcagccugcuguacuggccaugcugggccagccccaccuggagcucaguaaaaacugc

SEQ ID NO: 245447 - RNA, 64 nt, Homo Sapiens
ugugcuccccaccacccccauggcagucccuccgcagccccagucccuggccacgcccaaggga

SEQ ID NO: 245448 - RNA, 64 nt, Homo Sapiens
cagaggccccugggcagcccagccaggggagccacagccccaaggauggucuugcucugggaau

SEQ ID NO: 245449 - RNA, 64 nt, Homo Sapiens
acaggggugggugauuuagggacagccagggucccagccccaaugucagcaggauagggagagc

SEQ ID NO: 245450 - RNA, 64 nt, Homo Sapiens
gcaggccuggcccagcucccaguucccccugcaccagccccaccccuagagucccuucuauagg

SEQ ID NO: 245451 - RNA, 64 nt, Homo Sapiens
acagacccaaacuggggcugcccacggguucugccagccccagcuggggcagggaagcuucaug

SEQ ID NO: 245452 - RNA, 64 nt, Homo Sapiens
gaugaagcaagacauguggggccaaccagaagcccagccccaagggaggguguggggaugccuu

SEQ ID NO: 245453 - RNA, 64 nt, Homo Sapiens
gggcaagaccaaaguguggccucagccccagccccagccccagucaccugccaguuuccccagc

SEQ ID NO: 245454 - RNA, 64 nt, Homo Sapiens
cccagugggcaagaccaaagcccagccucagccccagccccagcuccuaccaccugccaguuuc

SEQ ID NO: 245455 - RNA, 64 nt, Homo Sapiens
cccagccccagugggcaagaaguuuccccagccucagccccagcucucccuccuaccaccugcc

SEQ ID NO: 245456 - RNA, 64 nt, Homo Sapiens
cucucagcaucugcugcccugccaggccgaggcucagccccagaggcccugcccucaccccacu

SEQ ID NO: 245457 - RNA, 64 nt, Homo Sapiens
acugccaccuuuacaccuacacuggcccccagcccagccccagucucagaguguggugcuagaa

SEQ ID NO: 245458 - RNA, 64 nt, Homo Sapiens
agaggaauuuggggccuaggcacugggcuugccacagccccaggcuggccaagggaggugccaa

SEQ ID NO: 245459 - RNA, 64 nt, Homo Sapiens
augagggggugcccuccggccaccuguacuguaucagccccaagcagguggugaguugggguau

SEQ ID NO: 245460 - RNA, 64 nt, Homo Sapiens
ugccucaccagcccugaggcuccgccccagcccucagccccaggccccagcuggagaaaaaaca

SEQ ID NO: 245461 - RNA, 64 nt, Homo Sapiens
gucacccugagaccugguagcccuagcugccuugcagccccaaaccccaggacccuaucagccc

SEQ ID NO: 245462 - RNA, 64 nt, Homo Sapiens
cccggcugcacuggccucuaggacucacagcagccagccccagcuaggaacgggcaggacuugg

SEQ ID NO: 245463 - RNA, 64 nt, Homo Sapiens
cugccucccugugcaguccagcccugccuugcugcagccccagcccagauggcacucagcgcuc

SEQ ID NO: 245464 - RNA, 64 nt, Homo Sapiens
cagagagggccuuuccuggcugaucagagcuuaccagccccaccccaccaugguagccuuaggg

SEQ ID NO: 245465 - RNA, 64 nt, Homo Sapiens
gcauauauauauauguggcucuagccucaggcuccagccccagugggguacuguacaguuaacu

SEQ ID NO: 245466 - RNA, 64 nt, Homo Sapiens
uggacauuaagggacagcuaacuguggccagacucagccccauguccuuggccaggcccaagga

SEQ ID NO: 245467 - RNA, 64 nt, Homo Sapiens
cucuugauauaccucgagcuuccccugugcuccccagccccaggaccacuggccccuuggccug

SEQ ID NO: 245468 - RNA, 64 nt, Homo Sapiens
ucugagccuugacgcaggccucuccccacucauccagccccagaacacacacagauggcagacg

SEQ ID NO: 245469 - RNA, 64 nt, Homo Sapiens
cacagcauucccuaacauggugcuggagcuccagcagccccaacucaacagacgaccagaggag

SEQ ID NO: 245470 - RNA, 64 nt, Homo Sapiens
gccucugccagauggcuuugcccaggccccaacacagccccauggcccagcagugccucuggag

SEQ ID NO: 245471 - RNA, 64 nt, Homo Sapiens
gugcucaggaggcagcaucucugacacggcagaucagccccauacuuccaucgugcccugaggc

SEQ ID NO: 245472 - RNA, 64 nt, Homo Sapiens
gcccaagucuuccaggcaauaccuggcucaggcccagccccaauccauccccuuacuuucugcc

SEQ ID NO: 245473 - RNA, 64 nt, Homo Sapiens
ugugcggagcuccccugcugguuggggcucagcgcagccccagggaggugcuuccugcaccuca

SEQ ID NO: 245474 - RNA, 64 nt, Homo Sapiens
cccacugaggccccuacugaggccagccccgagccagccccagacccagccccgguggcugaag

SEQ ID NO: 245475 - RNA, 64 nt, Homo Sapiens
cguguagccccgggcugacccagugugugcucagcagccccaccccacccugccccuuguccuc

SEQ ID NO: 245476 - RNA, 64 nt, Homo Sapiens
gagaccuuuucugccuggagagaaacuuucagaccagccccacacaccacagccaggagaggcc

SEQ ID NO: 245477 - RNA, 64 nt, Homo Sapiens
cagggccaggggagagagaagaggaucagcagugcagccccaggaugccucgcagguacccugc

SEQ ID NO: 245478 - RNA, 64 nt, Homo Sapiens
gggacaagauaaacggagcugguggcgggagggacagccccagagcagacccuuccuauggcgg

SEQ ID NO: 245479 - RNA, 64 nt, Homo Sapiens
uaagugcugugacuucagcuaaugaucuuuucuucagccccacccccuccccacuagcucgauc

SEQ ID NO: 245480 - RNA, 64 nt, Homo Sapiens
ucccucuguauucccagagugggaucggggcuuucagccccacccugaugccugcccuccagga

SEQ ID NO: 245481 - RNA, 64 nt, Homo Sapiens
gccuuguggcuagaguacagugggguagacccuccagccccaauagcccuaguacccagcuggc

SEQ ID NO: 245482 - RNA, 64 nt, Homo Sapiens
ggauguggcccagagaaggaggcugggggaucaccagccccaaggucccgaagggcaggucaga

SEQ ID NO: 245483 - RNA, 64 nt, Homo Sapiens
uguguugggagcagaggaguccuacuccuugccucagccccacacgguuccuuagcugccgugu

SEQ ID NO: 245484 - RNA, 64 nt, Homo Sapiens
ucuuggccccacccucuaccccauuccuuccugucagccccagucugucuuggcacuggccagg

SEQ ID NO: 245485 - RNA, 64 nt, Homo Sapiens
uggguuuacagaaugaggcccuggcuccccaccacagccccagcugccucagagcaggcacagc

SEQ ID NO: 245486 - RNA, 64 nt, Homo Sapiens
gcugccucagagcaggcacagcacaaggcaggcccagccccaugggccgucacaaaggcuugau

SEQ ID NO: 245487 - RNA, 64 nt, Homo Sapiens
cugugaggcccuucuucagguuggggugugaggacagccccaucuucaucugcccugcacucac

SEQ ID NO: 245488 - RNA, 64 nt, Homo Sapiens
uuccagcugccucuuucacacccacuacagaccucagccccaguuuucuccuccucacuaggcu

SEQ ID NO: 245489 - RNA, 64 nt, Homo Sapiens
aaggggaccugggagaugauggcucauuuccacccagccccaggauuuccagagcgcacaucca

SEQ ID NO: 245490 - RNA, 64 nt, Homo Sapiens
ugcaggcccucagcccgggcugugccagcccucccagccccaggcccaucugagggaccaagac

SEQ ID NO: 245491 - RNA, 64 nt, Homo Sapiens
gugccagcggcuucccagcaccugggaggggcugcagccccagcuggacuccagccugucccuc

SEQ ID NO: 245492 - RNA, 64 nt, Homo Sapiens
agucccugcuccucuuagaauaguggcuaccucucagccccaauuccccugccuaguggggugg

SEQ ID NO: 245493 - RNA, 64 nt, Homo Sapiens
gggggaauuugucauggggagagguaugaaaauacagccccaaauuaguggcggcugaucugua

SEQ ID NO: 245494 - RNA, 64 nt, Homo Sapiens
ucacagaugucaccacagcccugcccuucaugcccagccccaugggacacccgguggucuuucc

SEQ ID NO: 245495 - RNA, 64 nt, Homo Sapiens
gggcuugcccuggggcacugagacaguuguuuggcagccccagcccagccaggggcucauccuu

SEQ ID NO: 245496 - RNA, 64 nt, Homo Sapiens
gagccuucucugaaagcaucuuugccucccugaacagccccacccuuguagagcaaaacucuuc

SEQ ID NO: 245497 - RNA, 64 nt, Homo Sapiens
gggugaggggacagacucugcucucacuggcuggcagccccaggagccuguucccuugccucuc

SEQ ID NO: 245498 - RNA, 64 nt, Homo Sapiens
gcccuaacgggggugcggcaguuuuucggugggacagccccaggagagcgggccucuucccuca

SEQ ID NO: 245499 - RNA, 64 nt, Homo Sapiens
gcacccaggcuccauggggacagggaggaugccacagccccacagagagcaguggccgcaagcg

SEQ ID NO: 245500 - RNA, 64 nt, Homo Sapiens
acauccuggaagaggaggggaggagucacugugccagccccacccuaacccggccccuuccccc

SEQ ID NO: 245501 - RNA, 64 nt, Homo Sapiens
caaagacacuagugcaccccaccugcggugccuucagccccaacucccugcuccacccgacccc

SEQ ID NO: 245502 - RNA, 64 nt, Homo Sapiens
uggcccuuucuccagcaagcgcugaccuuguccccagccccaccgcacagcuggggaagaucuu

SEQ ID NO: 245503 - RNA, 64 nt, Homo Sapiens
acaaauggaacucccgagggccccucugucuaaccagccccagcaugcacagcuuccugaguca

SEQ ID NO: 245504 - RNA, 64 nt, Homo Sapiens
gcugcucauuuacauuagugugugugcauucguucagccccaugguggugaauucuguuucuuu

SEQ ID NO: 245505 - RNA, 64 nt, Homo Sapiens
cauuccccuuugcuaaagcaucucacucccagggcagccccagcacccuggcauugcgggaggu

SEQ ID NO: 245506 - RNA, 64 nt, Homo Sapiens
cagggauaagaacagaggaggcagcagcauugcacagccccaggcacaguggcaguuaggaugg

SEQ ID NO: 245507 - RNA, 64 nt, Homo Sapiens
aaagaggcuuacgaaaaacuuugccucugaugcucagccccacccccaaauagcacacaagcuu

SEQ ID NO: 245508 - RNA, 64 nt, Homo Sapiens
cucaguugugaucaggcaggcugugcucucaggacagccccauuuuagggaugaggagacuuca

SEQ ID NO: 245509 - RNA, 64 nt, Homo Sapiens
cuggcugggaguuagggagcccuggguuggaauccagccccaccucuuuuaugccacagguuug

SEQ ID NO: 245510 - RNA, 64 nt, Homo Sapiens
gccccagggcuggcccguuuuccucacggaggcccagccccaaagccgcugaccgacugaccuc

SEQ ID NO: 245511 - RNA, 64 nt, Homo Sapiens
ccccacaaagccuucuggacuccuuacccugacacagccccagauuccuccaccaaggcagcuu

SEQ ID NO: 245512 - RNA, 64 nt, Homo Sapiens
uugggaagucuccccgcuggggagccggcucugccagccccagaaacagccugcccucccugcc

SEQ ID NO: 245513 - RNA, 64 nt, Homo Sapiens
uuccccgggagaagcuuuccggccucucugccuccagccccaccccucuccccagaccacaggg

SEQ ID NO: 245514 - RNA, 64 nt, Homo Sapiens
gccuccaauaucacccugugagccucgcacagcucagccccaacacagaggugagaccaggaau

SEQ ID NO: 245515 - RNA, 64 nt, Homo Sapiens
ucaaugcccagcagcagcucuggaaggcagugcucagccccaucaccacugucccguggaugcc

SEQ ID NO: 245516 - RNA, 64 nt, Homo Sapiens
aaguggcccugucacccgugcugcacgggauucacagccccagccccauggccccucuccacac

SEQ ID NO: 245517 - RNA, 64 nt, Homo Sapiens
cccugucacccgugcugcacgggauucacagccccagccccauggccccucuccacaccucaaa

SEQ ID NO: 245518 - RNA, 64 nt, Homo Sapiens
cugcaggaaugccaagcaccuggccagagcagcccagccccaauaugcuuaggaggagacagag

SEQ ID NO: 245519 - RNA, 64 nt, Homo Sapiens
cuuggaagaguuaaaugcuguucagugaagauuucagccccaggccuuugcugcaagugacccu

SEQ ID NO: 245520 - RNA, 64 nt, Homo Sapiens
gcgcuuagggagaaaugaccucgaccagcaagcccagccccaggcuccccgcaagcugguccca

SEQ ID NO: 245521 - RNA, 64 nt, Homo Sapiens
gcccugagagaugguguugcuggcagaaagcccccagccccacaaaaaaucagcuuuaaggagc

SEQ ID NO: 245522 - RNA, 64 nt, Homo Sapiens
aaugcagaaucccacuacccgcccccacaucucucagccccacuacuauaauggggcuggaggg

SEQ ID NO: 245523 - RNA, 64 nt, Homo Sapiens
caccuuccuuccucuucccuuuaguccauacuaccagccccaccgccccagguccugcagcacc

SEQ ID NO: 245524 - RNA, 64 nt, Homo Sapiens
gccaaagaaaggagaggcaggugcuccuguaccccagccccacucagcacugacaguccccagc

SEQ ID NO: 245525 - RNA, 64 nt, Homo Sapiens
ccagcugccaaacagcagccugccgggcagggagcagccccaggccagagaggccucccggucc

SEQ ID NO: 245526 - RNA, 64 nt, Homo Sapiens
ccugcugccacagcccucccccggccccagauagcagccccagggaggaugcugccuccaagag

SEQ ID NO: 245527 - RNA, 64 nt, Homo Sapiens
gaguuuccuaugguuuacaaagagggccccagcccagccccaccacagaucccagagauagggg

SEQ ID NO: 245528 - RNA, 64 nt, Homo Sapiens
gcaccucuacuggcaucagucuuugguuaccccccagccccaguaggaggagagcaggcagagc

SEQ ID NO: 245529 - RNA, 64 nt, Homo Sapiens
augguggcuuucccuaccugacacagccauggcccagccccaaggccaggcugucuacccuaug

SEQ ID NO: 245530 - RNA, 64 nt, Homo Sapiens
ugggcggccucugggcuugggcaccagcucaugccagccccagagggucaggguuggaggccug

SEQ ID NO: 245531 - RNA, 64 nt, Homo Sapiens
aguccauggugucaugccaagacaguaucagacacagccccagaagggggcauuaugggcccug

SEQ ID NO: 245532 - RNA, 64 nt, Homo Sapiens
cacgaccccaagcccgcggaugggcgcccguccccagccccacgucccugaccacaaggccaac

SEQ ID NO: 245533 - RNA, 64 nt, Homo Sapiens
gcuuugacaaccaggcguucaagcuccggagccccagccccaaggcucaagugcugcuguggca

SEQ ID NO: 245534 - RNA, 64 nt, Homo Sapiens
accuuccuucugcuggugaagccaggaguguccccagccccaugacucgggcaaccucaccgug

SEQ ID NO: 245535 - RNA, 64 nt, Homo Sapiens
ccucagacucgcuucccaucuguagggagaaaagcagccccagggcccaagcccuggggacagg

SEQ ID NO: 245536 - RNA, 64 nt, Homo Sapiens
gacaaagggacacacagcccaaccagccugaguucagccccacgccugggagcccccucccugc

SEQ ID NO: 245537 - RNA, 64 nt, Homo Sapiens
cacuggggagccuuucggauucaagugucgcucacagccccauuucuccgcccuccuuugugua

SEQ ID NO: 245538 - RNA, 64 nt, Homo Sapiens
cgcaagccaggcugggccugcucacugaccagcccagccccaucgagcccguacuguggggauc

SEQ ID NO: 245539 - RNA, 64 nt, Homo Sapiens
cuccagggccacggcggaguggcgagcugggagccagccccagggccuccagggagggcuggac

SEQ ID NO: 245540 - RNA, 64 nt, Homo Sapiens
uggggcgcucagccuggcccaucucgggcacagacagccccaccucugaaaggggccugggggc

SEQ ID NO: 245541 - RNA, 64 nt, Homo Sapiens
uuggcugcugagccaggagcccacuucuccaucgcagccccaccagcaccgucccugcccagcc

SEQ ID NO: 245542 - RNA, 64 nt, Homo Sapiens
ucuccaucgcagccccaccugcaccgucccugcccagccccacuugaccccagugcugcucuaa

SEQ ID NO: 245543 - RNA, 64 nt, Homo Sapiens
ggagauaguggaagagucaggacagguuggucuccagccccacuucccaaauaugccucagccc

SEQ ID NO: 245544 - RNA, 64 nt, Homo Sapiens
gguuggucuccagccccacuucccaaauaugccucagccccacuagcuggcaccaacuuaauuc

SEQ ID NO: 245545 - RNA, 64 nt, Homo Sapiens
ccuccccacccuuccuacucgugcuguuccuucccagccccauccuugggaagggagacgaggu

SEQ ID NO: 245546 - RNA, 64 nt, Homo Sapiens
uggaaggagucccugcucuguguagcugccaggccagccccauccugggggaggaggcaaucgc

SEQ ID NO: 245547 - RNA, 64 nt, Homo Sapiens
gagcuucccugcuauaaacacacccucacaccaccagccccagggccuggcauccaggcaggga

SEQ ID NO: 245548 - RNA, 64 nt, Homo Sapiens
agguccacuccugguuccugauuucauaauccuccagccccagcaucugagcucccugcuuccu

SEQ ID NO: 245549 - RNA, 64 nt, Homo Sapiens
gucacuguccagcccccaccacgaagucacaucccagccccagauucaccugggggggcccagc

SEQ ID NO: 245550 - RNA, 64 nt, Homo Sapiens
agcuggauucucaggcuggggagaaggucaagggcagccccagccacccccuguuugagguucu

SEQ ID NO: 245551 - RNA, 64 nt, Homo Sapiens
cacccagcaaucaagccagagccaucuucccgcucagccccagagcauacuccaaacuuucgca

SEQ ID NO: 245552 - RNA, 64 nt, Homo Sapiens
ccacccucggcucugcagccaauuacuugaccugcagccccagccucacugcagccaaaggugc

SEQ ID NO: 245553 - RNA, 64 nt, Homo Sapiens
uagaaccuuuuguaaaaguugguggcagcagaggcagccccaggccgggcugcaucucucugug

SEQ ID NO: 245554 - RNA, 64 nt, Homo Sapiens
ucacgagggcagugcaagggagaaccugccagcccagccccaccacagggagagugcgucagca

SEQ ID NO: 245555 - RNA, 64 nt, Homo Sapiens
guuagauuuuaugcuugggccuucccuccaccgccagccccagagccagagcccccucccucac

SEQ ID NO: 245556 - RNA, 64 nt, Homo Sapiens
uccuugggcgccaggguccccguccgccucccugcagccccauccgaacgccuggaacgcucuc

SEQ ID NO: 245557 - RNA, 64 nt, Homo Sapiens
uggugcugcucagccuucucccacaacccgcggccagccccacgcucuccaggcgugcucaugc

SEQ ID NO: 245558 - RNA, 64 nt, Homo Sapiens
gccucuccaggcgugcucauccagagcuugucaccagccccaugcagaccuuggggucuucugg

SEQ ID NO: 245559 - RNA, 64 nt, Homo Sapiens
cuuucacacuggugaagucuguguacccauacugcagccccaucccauggggccccugaagacc

SEQ ID NO: 245560 - RNA, 64 nt, Homo Sapiens
ggaaggaggaagggagacugggcccacugauuuccagccccaccaugugugcuguuuucagaug

SEQ ID NO: 245561 - RNA, 64 nt, Homo Sapiens
gcacagcagaucaugcggcugguuuuccccacgacagccccacgaacaagaagaggcuggggag

SEQ ID NO: 245562 - RNA, 64 nt, Homo Sapiens
gacugggggcgauucuguguagaggcagcagccucagccccagggccuuggcccagaaggagcc

SEQ ID NO: 245563 - RNA, 64 nt, Homo Sapiens
acagccacggccaggccagagggagugacagaggcagccccauucugccugcccaggccccugc

SEQ ID NO: 245564 - RNA, 64 nt, Homo Sapiens
ggcagugggagcugccuguucagcuccagcucaccagccccagugcccacaggaucagucugau

SEQ ID NO: 245565 - RNA, 64 nt, Homo Sapiens
ccagggacagaggggguggccucccaacucaccccagccccaaaacucuccucugcugcuggcu

SEQ ID NO: 245566 - RNA, 64 nt, Homo Sapiens
gcuggcugguuagagguucccuuugacgccaucccagccccaaugaacaauuauuuauuaaaug

SEQ ID NO: 245567 - RNA, 64 nt, Homo Sapiens
cagucaccccggccaccugcggugcuaucucccccagccccauccucuguacagagcccacgcc

SEQ ID NO: 245568 - RNA, 64 nt, Homo Sapiens
cacaccaaccugugagccccgugagccccacucccagccccacuggccccacucacuccauccu

SEQ ID NO: 245569 - RNA, 64 nt, Homo Sapiens
cccaccauccugugagccccgugagccccacucccagccccacuagccccacucccaccauccu

SEQ ID NO: 245570 - RNA, 64 nt, Homo Sapiens
cccaccauccugugagccccgugagccccacuuccagccccacuagccccacucccaccauccu

SEQ ID NO: 245571 - RNA, 64 nt, Homo Sapiens
cccaccauccugugagccccgugagucccacucccagccccacuagccccauucacuccauccu

SEQ ID NO: 245572 - RNA, 64 nt, Homo Sapiens
cacuccauccugugagucccuguaagacuaugcccagccccauucggccccacucacuccaucu

SEQ ID NO: 245573 - RNA, 64 nt, Homo Sapiens
cccaccauccugugagcccagugagucccacucccagccccacuagccccacucacuccauccu

SEQ ID NO: 245574 - RNA, 64 nt, Homo Sapiens
cacuccauccugugagucccuguaagacugugcccagccccacucggccccacucccaccaucu

SEQ ID NO: 245575 - RNA, 64 nt, Homo Sapiens
ccucccuggucuugaaagaaccccugcccucuuccagccccacccauuuugaacccugcucuau

SEQ ID NO: 245576 - RNA, 64 nt, Homo Sapiens
cagcucaacccaguccugcuaggggcuuggggcacagccccaguauugugugaaccaaagcguc

SEQ ID NO: 245577 - RNA, 64 nt, Homo Sapiens
agcgaaaacugccaggaugaaugaggaaaaaacccagccccacaaacgagacacacgcuggcgg

SEQ ID NO: 245578 - RNA, 64 nt, Homo Sapiens
ggcccuggagaccuccaggcuuuccugcccugggcagccccaccucacagccagagucaaugcc

SEQ ID NO: 245579 - RNA, 50 nt, Homo Sapiens
cccuucuccaggaagaguaacagccccaggagguauugaaggacaggaga

SEQ ID NO: 245580 - RNA, 64 nt, Homo Sapiens
gcaggacuaagguggcuuucccacuccuggcccacagccccagagagccugucugugcauccug

SEQ ID NO: 245581 - RNA, 64 nt, Homo Sapiens
guugaggauaagcccacuuuccugucauuaguggcagccccagauccagaccuaggccuccugg

SEQ ID NO: 245582 - RNA, 64 nt, Homo Sapiens
gggccagguguugacaccuuaaagcuggcgcccccagccccacucuuggcugugcuggccaggu

SEQ ID NO: 245583 - RNA, 64 nt, Homo Sapiens
uucugucucucugagggaaucagaguccagcauccagccccagcuggaacagcugaagucacaa

SEQ ID NO: 245584 - RNA, 64 nt, Homo Sapiens
gaacaggaaagggucacguggucccauguugcaacagccccaacaucacgcaugucauucacug

SEQ ID NO: 245585 - RNA, 64 nt, Homo Sapiens
acacacaagcucucagccacaggcagcuucuccacagccccagcuucgcacaggcuccuggagg

SEQ ID NO: 245586 - RNA, 64 nt, Homo Sapiens
cucgcugaggcaacgugagacucagggagccccacagccccaaggggcaccuucgcgucucagc

SEQ ID NO: 245587 - RNA, 64 nt, Homo Sapiens
cucaccaccgcaucccaccucaaagccggcugcccagccccagcgucuuuugugccaccuugua

SEQ ID NO: 245588 - RNA, 64 nt, Homo Sapiens
ccucugcugaccugcugacccugcagccccagcccagccccacuuggcccugggagaaucgcuc

SEQ ID NO: 245589 - RNA, 64 nt, Homo Sapiens
ccagccccacuccucugcuggagaaucgcuccugcagccccagcacuggcucuccuggcccugg

SEQ ID NO: 245590 - RNA, 64 nt, Homo Sapiens
accaucguucugaauucugaccucccagcacccccagccccacgaaagccaaccaugcccagcc

SEQ ID NO: 245591 - RNA, 64 nt, Homo Sapiens
cuggaaggaccagguucuuugcagcucgagccaccagccccagcagacugaagccccagugugc

SEQ ID NO: 245592 - RNA, 64 nt, Homo Sapiens
aaccggcuaaaggacccugcgcuccgcgucuucccagccccagauguacacacaguguuucauu

SEQ ID NO: 245593 - RNA, 64 nt, Homo Sapiens
uuguacacacaguguuucaucugccuccucuccccagccccaccagggcccaggaccagaaucg

SEQ ID NO: 245594 - RNA, 64 nt, Homo Sapiens
ugccaucagauucaagcccaggccacauggccaccagccccagcgcuccaaggcuugccccaga

SEQ ID NO: 245595 - RNA, 64 nt, Homo Sapiens
gaugucccuccccucaugagcgugcaacagggagcagccccagccagccccaccgccgccgucu

SEQ ID NO: 245596 - RNA, 64 nt, Homo Sapiens
cccucaugagcgugcaacagggagcagccccagccagccccaccgccgccgucugcguggaugg

SEQ ID NO: 245597 - RNA, 64 nt, Homo Sapiens
aguuucuuguuuuggugccugaccgaaccaacgacagccccaaucuucccgucuuuaugagaga

SEQ ID NO: 245598 - RNA, 64 nt, Homo Sapiens
uuccuucuccuuugaggggggagagagaacagugcagccccauuuccgguccugcuaccucacc

SEQ ID NO: 245599 - RNA, 64 nt, Homo Sapiens
gacugagacgcaugagugccuucuggggugagagcagccccaggguuuaaguugggcguccuag

SEQ ID NO: 245600 - RNA, 64 nt, Homo Sapiens
cuaaugagggcuuugcagggauuguuuucauucucagccccagcugugggagugcggguggggg

SEQ ID NO: 245601 - RNA, 64 nt, Homo Sapiens
gaggguuggguggauggagcucagaaggaaaccccagccccaccacggaugacaccaucccucc

SEQ ID NO: 245602 - RNA, 64 nt, Homo Sapiens
accuccauccccaacccauccucauccccaacuacagccccaaacccagccccagacuaaucca

SEQ ID NO: 245603 - RNA, 64 nt, Homo Sapiens
aacccauccucauccccaacuacagccccaaacccagccccagacuaauccacagccaucccca

SEQ ID NO: 245604 - RNA, 64 nt, Homo Sapiens
acagccauccccaacucauccucauccccaacugcagccccaaacccaacccagggccaucccc

SEQ ID NO: 245605 - RNA, 64 nt, Homo Sapiens
agcccuggccacauccccauccucccccaaccuccagccccaacacccaucaucccccugagcu

SEQ ID NO: 245606 - RNA, 64 nt, Homo Sapiens
ggugggugguggcuuauaacuguaagggagauggcagccccaggguacagccagcaggcauuga

SEQ ID NO: 245607 - RNA, 64 nt, Homo Sapiens
aaccaggagagggcuggagggagggagauggucucagccccacagaguuuggaguccucagugu

SEQ ID NO: 245608 - RNA, 64 nt, Homo Sapiens
cuccuuucccguccacuuguugggcccaaaggcccagccccacacaggcccaggguggggugga

SEQ ID NO: 245609 - RNA, 64 nt, Homo Sapiens
gacgacgcgagggccccacgagagacagcacaggcagccccacgagagagagaaggggcccaag

SEQ ID NO: 245610 - RNA, 64 nt, Homo Sapiens
accugcagggcugaaguucacucaucgaccgacucagccccaaccgggagccaggcagaaaaac

SEQ ID NO: 245611 - RNA, 64 nt, Homo Sapiens
aaaugucaggcacuucccucuaacuggcaugcaacagccccaccugccugagagcccugaggug

SEQ ID NO: 245612 - RNA, 64 nt, Homo Sapiens
ucccccagccucugccacccuccaccuccucggucagccccagccccagguugauaaaucuauu

SEQ ID NO: 245613 - RNA, 64 nt, Homo Sapiens
agccucugccacccuccaccuccucggucagccccagccccagguugauaaaucuauugauuga

SEQ ID NO: 245614 - RNA, 64 nt, Homo Sapiens
aauucccuccugagugccccacuucuggccacaucagccccacaggacuuugaugaagaccauu

SEQ ID NO: 245615 - RNA, 64 nt, Homo Sapiens
ugugacuaacuaugcaauaauccacccccaggugcagccccagggccugcggaggcgguggcag

SEQ ID NO: 245616 - RNA, 64 nt, Homo Sapiens
aggagcagccagcugggaugucuccccaccaagacagccccagagacccacugccccaucuccc

SEQ ID NO: 245617 - RNA, 64 nt, Homo Sapiens
acccuucccacuuggcacccuaagguucccaagccagccccaacgguguuggaagggcagcggg

SEQ ID NO: 245618 - RNA, 64 nt, Homo Sapiens
ugcucauccacaggguuuucucacugcuaugaaccagccccacagccccaggccccugucaccu

SEQ ID NO: 245619 - RNA, 64 nt, Homo Sapiens
cacaggguuuucucacugcuaugaaccagccccacagccccaggccccugucaccuggcuaugc

SEQ ID NO: 245620 - RNA, 64 nt, Homo Sapiens
uggagggccgggugguggcucugaggaugguccccagccccacccuguccccacccuggccugu

SEQ ID NO: 245621 - RNA, 64 nt, Homo Sapiens
ccccuguacuaccuccugggccaagaaacuggcacagccccacacugucagugccaagaggcug

SEQ ID NO: 245622 - RNA, 64 nt, Homo Sapiens
ugaccacgugggggucagucgggggcaaggggcucagccccacuggacucugggcugcagaggc

SEQ ID NO: 245623 - RNA, 64 nt, Homo Sapiens
gccaggguccccuuggugaaggcagggggugggccagccccagggcuugaagugaaggaacaga

SEQ ID NO: 245624 - RNA, 64 nt, Homo Sapiens
ucagucuccaggacauuccuuuccaugccuggcccagccccaccuguagcgguuugaauguugg

SEQ ID NO: 245625 - RNA, 64 nt, Homo Sapiens
ugagugcucuccggggaugcccccgagcaugguccagccccauuggggacagagccucagggag

SEQ ID NO: 245626 - RNA, 64 nt, Homo Sapiens
ccugcccucggccugguccaugugagcagcugcccagccccaggugggcacccccauugguucg

SEQ ID NO: 245627 - RNA, 64 nt, Homo Sapiens
gaggaccgacuccaggaguccccuuucccugucccagccccaucuguggguugcacuuacaaac

SEQ ID NO: 245628 - RNA, 64 nt, Homo Sapiens
ccuauuaaggagguccaaggggugagucccaacccagccccagaauauauuuguuuuugcaccu

SEQ ID NO: 245629 - RNA, 64 nt, Homo Sapiens
agcucaccucugguagccauagcagccccugcuucagccccaccgcaccccuccagggggccug

SEQ ID NO: 245630 - RNA, 64 nt, Homo Sapiens
ugagucuguuguguggaugugcgugugugguccccagccccagacuggauuggaaaagugcaug

SEQ ID NO: 245631 - RNA, 64 nt, Homo Sapiens
acuggggcuucaggccagaggagccaccuacauccagccccaaaagccuugaaccuaggaccaa

SEQ ID NO: 245632 - RNA, 64 nt, Homo Sapiens
cuaagauaucccucacaccccccuacccccacgccagccccaaaaaacaggacaucugugaccg

SEQ ID NO: 245633 - RNA, 64 nt, Homo Sapiens
uugucaccugcuucucugccccugggacagggagcagccccaaacccgaagcaugaacagugca

SEQ ID NO: 245634 - RNA, 64 nt, Homo Sapiens
cuguuuugagcccugaggagccugcugccaguaccagccccacccucugccugcccuuuguccu

SEQ ID NO: 245635 - RNA, 64 nt, Homo Sapiens
ccaaaacuggcaaggacgcugucuggccccacaccagccccaauucccacccgugguggcucaa

SEQ ID NO: 245636 - RNA, 64 nt, Homo Sapiens
accugagcugguuuagcgcagcaugugccugcaccagccccaacugucugucuucuucuacacg

SEQ ID NO: 245637 - RNA, 64 nt, Homo Sapiens
gccuacccgacucgguuucugguggauauucaaccagccccacccacaccuguccauacccgag

SEQ ID NO: 245638 - RNA, 64 nt, Homo Sapiens; identical to SEQ ID NO: 51593

SEQ ID NO: 245639 - RNA, 64 nt, Homo Sapiens; identical to SEQ ID NO: 51594

SEQ ID NO: 245640 - RNA, 64 nt, Homo Sapiens; identical to SEQ ID NO: 166002

SEQ ID NO: 245641 - RNA, 64 nt, Homo Sapiens; identical to SEQ ID NO: 166003

SEQ ID NO: 245642 - RNA, 64 nt, Homo Sapiens; identical to SEQ ID NO: 166004

SEQ ID NO: 245643 - RNA, 64 nt, Homo Sapiens; identical to SEQ ID NO: 166005

SEQ ID NO: 245644 - RNA, 64 nt, Homo Sapiens; identical to SEQ ID NO: 166006

SEQ ID NO: 245645 - RNA, 64 nt, Homo Sapiens; identical to SEQ ID NO: 166007

SEQ ID NO: 245646 - RNA, 64 nt, Homo Sapiens; identical to SEQ ID NO: 166008

SEQ ID NO: 245647 - RNA, 64 nt, Homo Sapiens; identical to SEQ ID NO: 166009

SEQ ID NO: 245648 - RNA, 64 nt, Homo Sapiens; identical to SEQ ID NO: 166010

SEQ ID NO: 245649 - RNA, 60 nt, Homo Sapiens; identical to SEQ ID NO: 166011

SEQ ID NO: 245650 - RNA, 64 nt, Homo Sapiens; identical to SEQ ID NO: 166012

SEQ ID NO: 245651 - RNA, 63 nt, Homo Sapiens; identical to SEQ ID NO: 91030

SEQ ID NO: 245652 - RNA, 63 nt, Homo Sapiens; identical to SEQ ID NO: 91031

SEQ ID NO: 245653 - RNA, 63 nt, Homo Sapiens; identical to SEQ ID NO: 91032

SEQ ID NO: 245654 - RNA, 63 nt, Homo Sapiens; identical to SEQ ID NO: 91033

SEQ ID NO: 245655 - RNA, 63 nt, Homo Sapiens; identical to SEQ ID NO: 91034

SEQ ID NO: 245656 - RNA, 63 nt, Homo Sapiens; identical to SEQ ID NO: 91035

SEQ ID NO: 245657 - RNA, 63 nt, Homo Sapiens; identical to SEQ ID NO: 91036

SEQ ID NO: 245658 - RNA, 63 nt, Homo Sapiens; identical to SEQ ID NO: 91037

SEQ ID NO: 245659 - RNA, 63 nt, Homo Sapiens; identical to SEQ ID NO: 91038

SEQ ID NO: 245660 - RNA, 63 nt, Homo Sapiens; identical to SEQ ID NO: 91039

SEQ ID NO: 245661 - RNA, 63 nt, Homo Sapiens; identical to SEQ ID NO: 91040

SEQ ID NO: 245662 - RNA, 63 nt, Homo Sapiens; identical to SEQ ID NO: 91041

SEQ ID NO: 245663 - RNA, 63 nt, Homo Sapiens; identical to SEQ ID NO: 91042

SEQ ID NO: 245664 - RNA, 63 nt, Homo Sapiens; identical to SEQ ID NO: 91043

SEQ ID NO: 245665 - RNA, 63 nt, Homo Sapiens; identical to SEQ ID NO: 91044

SEQ ID NO: 245666 - RNA, 63 nt, Homo Sapiens; identical to SEQ ID NO: 91045

SEQ ID NO: 245667 - RNA, 63 nt, Homo Sapiens; identical to SEQ ID NO: 91046

SEQ ID NO: 245668 - RNA, 63 nt, Homo Sapiens; identical to SEQ ID NO: 91047

SEQ ID NO: 245669 - RNA, 63 nt, Homo Sapiens; identical to SEQ ID NO: 91048

SEQ ID NO: 245670 - RNA, 63 nt, Homo Sapiens; identical to SEQ ID NO: 91049

SEQ ID NO: 245671 - RNA, 63 nt, Homo Sapiens; identical to SEQ ID NO: 91050

SEQ ID NO: 245672 - RNA, 63 nt, Homo Sapiens; identical to SEQ ID NO: 91051

SEQ ID NO: 245673 - RNA, 63 nt, Homo Sapiens; identical to SEQ ID NO: 91052

SEQ ID NO: 245674 - RNA, 63 nt, Homo Sapiens; identical to SEQ ID NO: 91053

SEQ ID NO: 245675 - RNA, 63 nt, Homo Sapiens; identical to SEQ ID NO: 91054

SEQ ID NO: 245676 - RNA, 63 nt, Homo Sapiens; identical to SEQ ID NO: 91055

SEQ ID NO: 245677 - RNA, 63 nt, Homo Sapiens; identical to SEQ ID NO: 91056

SEQ ID NO: 245678 - RNA, 63 nt, Homo Sapiens; identical to SEQ ID NO: 91057

SEQ ID NO: 245679 - RNA, 63 nt, Homo Sapiens; identical to SEQ ID NO: 91058

SEQ ID NO: 245680 - RNA, 63 nt, Homo Sapiens; identical to SEQ ID NO: 91059

SEQ ID NO: 245681 - RNA, 63 nt, Homo Sapiens; identical to SEQ ID NO: 91060

SEQ ID NO: 245682 - RNA, 63 nt, Homo Sapiens; identical to SEQ ID NO: 91061

SEQ ID NO: 245683 - RNA, 63 nt, Homo Sapiens; identical to SEQ ID NO: 91062

SEQ ID NO: 245684 - RNA, 63 nt, Homo Sapiens; identical to SEQ ID NO: 91063

SEQ ID NO: 245685 - RNA, 63 nt, Homo Sapiens; identical to SEQ ID NO: 91064

SEQ ID NO: 245686 - RNA, 63 nt, Homo Sapiens; identical to SEQ ID NO: 91065

SEQ ID NO: 245687 - RNA, 63 nt, Homo Sapiens; identical to SEQ ID NO: 91066

SEQ ID NO: 245688 - RNA, 63 nt, Homo Sapiens; identical to SEQ ID NO: 91067

SEQ ID NO: 245689 - RNA, 63 nt, Homo Sapiens; identical to SEQ ID NO: 91068

SEQ ID NO: 245690 - RNA, 63 nt, Homo Sapiens; identical to SEQ ID NO: 91069

SEQ ID NO: 245691 - RNA, 63 nt, Homo Sapiens; identical to SEQ ID NO: 91070

SEQ ID NO: 245692 - RNA, 63 nt, Homo Sapiens; identical to SEQ ID NO: 91071

SEQ ID NO: 245693 - RNA, 63 nt, Homo Sapiens; identical to SEQ ID NO: 91072

SEQ ID NO: 245694 - RNA, 63 nt, Homo Sapiens; identical to SEQ ID NO: 91073

SEQ ID NO: 245695 - RNA, 63 nt, Homo Sapiens; identical to SEQ ID NO: 91074

SEQ ID NO: 245696 - RNA, 63 nt, Homo Sapiens; identical to SEQ ID NO: 91075

SEQ ID NO: 245697 - RNA, 63 nt, Homo Sapiens; identical to SEQ ID NO: 91076

SEQ ID NO: 245698 - RNA, 63 nt, Homo Sapiens; identical to SEQ ID NO: 91077

SEQ ID NO: 245699 - RNA, 63 nt, Homo Sapiens; identical to SEQ ID NO: 91078

SEQ ID NO: 245700 - RNA, 63 nt, Homo Sapiens; identical to SEQ ID NO: 91079

SEQ ID NO: 245701 - RNA, 63 nt, Homo Sapiens; identical to SEQ ID NO: 91080

SEQ ID NO: 245702 - RNA, 63 nt, Homo Sapiens; identical to SEQ ID NO: 91081

SEQ ID NO: 245703 - RNA, 63 nt, Homo Sapiens; identical to SEQ ID NO: 91082

SEQ ID NO: 245704 - RNA, 63 nt, Homo Sapiens; identical to SEQ ID NO: 91083

SEQ ID NO: 245705 - RNA, 63 nt, Homo Sapiens; identical to SEQ ID NO: 91084

SEQ ID NO: 245706 - RNA, 63 nt, Homo Sapiens; identical to SEQ ID NO: 91085

SEQ ID NO: 245707 - RNA, 63 nt, Homo Sapiens; identical to SEQ ID NO: 91086

SEQ ID NO: 245708 - RNA, 63 nt, Homo Sapiens; identical to SEQ ID NO: 91087

SEQ ID NO: 245709 - RNA, 63 nt, Homo Sapiens; identical to SEQ ID NO: 91088

SEQ ID NO: 245710 - RNA, 63 nt, Homo Sapiens; identical to SEQ ID NO: 91089

SEQ ID NO: 245711 - RNA, 63 nt, Homo Sapiens; identical to SEQ ID NO: 91090

SEQ ID NO: 245712 - RNA, 63 nt, Homo Sapiens; identical to SEQ ID NO: 91091

SEQ ID NO: 245713 - RNA, 63 nt, Homo Sapiens; identical to SEQ ID NO: 91092

SEQ ID NO: 245714 - RNA, 63 nt, Homo Sapiens; identical to SEQ ID NO: 91093

SEQ ID NO: 245715 - RNA, 63 nt, Homo Sapiens; identical to SEQ ID NO: 91094

SEQ ID NO: 245716 - RNA, 63 nt, Homo Sapiens; identical to SEQ ID NO: 91095

SEQ ID NO: 245717 - RNA, 63 nt, Homo Sapiens; identical to SEQ ID NO: 91096

SEQ ID NO: 245718 - RNA, 63 nt, Homo Sapiens; identical to SEQ ID NO: 91097

SEQ ID NO: 245719 - RNA, 63 nt, Homo Sapiens; identical to SEQ ID NO: 91098

SEQ ID NO: 245720 - RNA, 63 nt, Homo Sapiens; identical to SEQ ID NO: 91099

SEQ ID NO: 245721 - RNA, 63 nt, Homo Sapiens; identical to SEQ ID NO: 91100

SEQ ID NO: 245722 - RNA, 63 nt, Homo Sapiens; identical to SEQ ID NO: 91101

SEQ ID NO: 245723 - RNA, 63 nt, Homo Sapiens; identical to SEQ ID NO: 91102

SEQ ID NO: 245724 - RNA, 63 nt, Homo Sapiens; identical to SEQ ID NO: 91103

SEQ ID NO: 245725 - RNA, 63 nt, Homo Sapiens; identical to SEQ ID NO: 91104

SEQ ID NO: 245726 - RNA, 63 nt, Homo Sapiens; identical to SEQ ID NO: 91105

SEQ ID NO: 245727 - RNA, 63 nt, Homo Sapiens; identical to SEQ ID NO: 91106

SEQ ID NO: 245728 - RNA, 63 nt, Homo Sapiens; identical to SEQ ID NO: 91107

SEQ ID NO: 245729 - RNA, 63 nt, Homo Sapiens; identical to SEQ ID NO: 91108

SEQ ID NO: 245730 - RNA, 63 nt, Homo Sapiens; identical to SEQ ID NO: 91109

SEQ ID NO: 245731 - RNA, 63 nt, Homo Sapiens; identical to SEQ ID NO: 91110

SEQ ID NO: 245732 - RNA, 63 nt, Homo Sapiens; identical to SEQ ID NO: 91111

SEQ ID NO: 245733 - RNA, 63 nt, Homo Sapiens; identical to SEQ ID NO: 91112

SEQ ID NO: 245734 - RNA, 63 nt, Homo Sapiens; identical to SEQ ID NO: 91113

SEQ ID NO: 245735 - RNA, 63 nt, Homo Sapiens; identical to SEQ ID NO: 91114

SEQ ID NO: 245736 - RNA, 63 nt, Homo Sapiens; identical to SEQ ID NO: 91115

SEQ ID NO: 245737 - RNA, 63 nt, Homo Sapiens; identical to SEQ ID NO: 91116

SEQ ID NO: 245738 - RNA, 63 nt, Homo Sapiens; identical to SEQ ID NO: 91117

SEQ ID NO: 245739 - RNA, 63 nt, Homo Sapiens; identical to SEQ ID NO: 91118

SEQ ID NO: 245740 - RNA, 63 nt, Homo Sapiens; identical to SEQ ID NO: 91119

SEQ ID NO: 245741 - RNA, 63 nt, Homo Sapiens; identical to SEQ ID NO: 91120

SEQ ID NO: 245742 - RNA, 63 nt, Homo Sapiens; identical to SEQ ID NO: 91121

SEQ ID NO: 245743 - RNA, 63 nt, Homo Sapiens; identical to SEQ ID NO: 91122

SEQ ID NO: 245744 - RNA, 63 nt, Homo Sapiens; identical to SEQ ID NO: 91123

SEQ ID NO: 245745 - RNA, 63 nt, Homo Sapiens; identical to SEQ ID NO: 91124

SEQ ID NO: 245746 - RNA, 63 nt, Homo Sapiens; identical to SEQ ID NO: 91125

SEQ ID NO: 245747 - RNA, 63 nt, Homo Sapiens; identical to SEQ ID NO: 91126

SEQ ID NO: 245748 - RNA, 63 nt, Homo Sapiens; identical to SEQ ID NO: 91127

SEQ ID NO: 245749 - RNA, 63 nt, Homo Sapiens; identical to SEQ ID NO: 91128

SEQ ID NO: 245750 - RNA, 63 nt, Homo Sapiens; identical to SEQ ID NO: 91129

SEQ ID NO: 245751 - RNA, 63 nt, Homo Sapiens; identical to SEQ ID NO: 91130

SEQ ID NO: 245752 - RNA, 63 nt, Homo Sapiens; identical to SEQ ID NO: 91131

SEQ ID NO: 245753 - RNA, 63 nt, Homo Sapiens; identical to SEQ ID NO: 91132

SEQ ID NO: 245754 - RNA, 63 nt, Homo Sapiens; identical to SEQ ID NO: 91133

SEQ ID NO: 245755 - RNA, 63 nt, Homo Sapiens; identical to SEQ ID NO: 91134

SEQ ID NO: 245756 - RNA, 64 nt, Homo Sapiens
aacggaugcauggaaggcgcugcgccccucguggagagccuauaucauagcucugggaauggaa

SEQ ID NO: 245757 - RNA, 64 nt, Homo Sapiens
aauggacgugcagucagggagcuucccccuguagagagccuaugagaaugagccaacagcacuu

SEQ ID NO: 245758 - RNA, 64 nt, Homo Sapiens
agcuacuucucuacccuugacauccagcuucgcgagagccuagagccagaugccuaugcguugu

SEQ ID NO: 245759 - RNA, 64 nt, Homo Sapiens
gcuacaaugccuuuuacgccaagaauaaauguccagagccuaacugcagggugaaaaagucccu

SEQ ID NO: 245760 - RNA, 64 nt, Homo Sapiens
cucccaggauuccaauuuuaauuggagagcuaaguaaguaaaguuuuauaacuguuagguuucu

SEQ ID NO: 245761 - RNA, 64 nt, Homo Sapiens
ccuuauacuuucuauuuuaaguauaucuguuucuuaaguaaacaacuuagauauuuuccacacc

SEQ ID NO: 245762 - RNA, 64 nt, Homo Sapiens
auaaauuugacagauagcuauuuacauagccuucuaaguaaaggcaaugaauucuccauuuccu

SEQ ID NO: 245763 - RNA, 64 nt, Homo Sapiens
aaaauacagaaacaguuuauguauaggauagcuauaaguaaauacugaaacacauuaugccucu

SEQ ID NO: 245764 - RNA, 64 nt, Homo Sapiens
gggugacaaaaugagacauugucucuaaaauacauaaguaaauuuaaaaaaaaaagaauaauaa

SEQ ID NO: 245765 - RNA, 64 nt, Homo Sapiens
auugaaaaacuaguaagcaaauaaaugauaaacauaaguaaauuuaaacuguuguuuguauaaa

SEQ ID NO: 245766 - RNA, 64 nt, Homo Sapiens
augguaggaaaacagacuuugcucuguacagaaguaaguaaaaguaggaauaguuuccauggau

SEQ ID NO: 245767 - RNA, 64 nt, Homo Sapiens
gauuuuaaguuaaagaauauggaauauaguaaaauaaguaaauuucuuuuggaauauuuuuagu

SEQ ID NO: 245768 - RNA, 64 nt, Homo Sapiens
uaugugucaucuaacagaaaugacuccuuugaaauaaguaaaucuuuggcuuuuuguucuguug

SEQ ID NO: 245769 - RNA, 64 nt, Homo Sapiens
gcacauugccaagaauuacugucaagagaaaugauaaguaaaagucauuuaugaaaauaaagau

SEQ ID NO: 245770 - RNA, 64 nt, Homo Sapiens
auugagagauuuuucuuaguaaauagauuauuguuaaguaaauaguuauuaaaaauauaucuca

SEQ ID NO: 245771 - RNA, 64 nt, Homo Sapiens
gcuuuacaaauaaacauacacaugcucaguuuuuuaaguaaaccuguaaaauacccaggaaggc

SEQ ID NO: 245772 - RNA, 64 nt, Homo Sapiens
uuaagugugaaacuaaacauagaaaaucuguaaguaaguaaaccuuuuguucaauguaaauuga

SEQ ID NO: 245773 - RNA, 64 nt, Homo Sapiens
uaacauuacuuggaggguugauaacauuaauaccuaaguaaacaugauacauaccuaaguaaac

SEQ ID NO: 245774 - RNA, 64 nt, Homo Sapiens
uaacauuaauaccuaaguaacucugauacauaccuaaguaaacaucugcuuuggaaauuauugc

SEQ ID NO: 245775 - RNA, 64 nt, Homo Sapiens
agcggagagaacacagaguggaaucagcccccuguaaguaaaaggguagagaaagagaugugug

SEQ ID NO: 245776 - RNA, 64 nt, Homo Sapiens
uuggcaaguguagaggcugccucugugugugguuuaaguaaacuggaaaugagacauugacgug

SEQ ID NO: 245777 - RNA, 64 nt, Homo Sapiens
uuuuuauaaaaaccagaaaauuuaaaaguuuauuuaaguaaauaucugcucuauuuagauuuau

SEQ ID NO: 245778 - RNA, 64 nt, Homo Sapiens
uugguaacucuaauggggauguuuagauucacuguaaguaaacuguuaaaggucugaagcagcu

SEQ ID NO: 245779 - RNA, 64 nt, Homo Sapiens
auuuuuaauuuuuauguuauguuuugcuuuguuuuaaguaaacaaaaauuuuucuuucuuuacu

SEQ ID NO: 245780 - RNA, 64 nt, Homo Sapiens
gucgacggugaauguucuggugguuguugccuguuaaguaaacuuuaguguguaaguugaguuu

SEQ ID NO: 245781 - RNA, 64 nt, Homo Sapiens
aaaucccuauucuuggaaaaaaguauacuuugauuaaguaaaaauagacagucaaucagauaag

SEQ ID NO: 245782 - RNA, 64 nt, Homo Sapiens
uggauaauuuauagacagauaauuuauagacaguuaaguaaaaaggauaauuuauagacaguua

SEQ ID NO: 245783 - RNA, 64 nt, Homo Sapiens
uacaaacauuauuuccaccagaguccggacuguguaaguaaaaguaucaguguuuuagaaacau

SEQ ID NO: 245784 - RNA, 64 nt, Homo Sapiens
guaagacugaaugucuacguaaucuuacauauaauaaguaaaaauuuuaagcaaggauguucaa

SEQ ID NO: 245785 - RNA, 64 nt, Homo Sapiens
accaaccaacccugaggaacauuaaguaaauaaauaaguaaauaugcucuaaaaaaugaagugu

SEQ ID NO: 245786 - RNA, 64 nt, Homo Sapiens
aauaaguaaauaaccaaccaaaaaugaaguguauuaaguaaauauaacccuaaagcugcucuaa

SEQ ID NO: 245787 - RNA, 64 nt, Homo Sapiens
ucucaguuucuugguaucugguggaagguuucacuaaguaaaacuauuugacuuuucauaagua

SEQ ID NO: 245788 - RNA, 64 nt, Homo Sapiens
ucugaguuucuugguaucugguggaagguuucacuaaguaaagauauuugacuuuucauaagua

SEQ ID NO: 245789 - RNA, 64 nt, Homo Sapiens
cucucauaacuuguauacauaacacuuaucuucuuaaguaaauguauuuauaacugaagaguau

SEQ ID NO: 245790 - RNA, 64 nt, Homo Sapiens
uaagcucauuagugacagaccaugaauggaaaccuaaguaaaacccuuguauuuaaaaggguuu

SEQ ID NO: 245791 - RNA, 64 nt, Homo Sapiens
guuggaugcacugaacaauuagaaagguguggaguaaguaaaguguuuauuaugagcauuuugc

SEQ ID NO: 245792 - RNA, 64 nt, Homo Sapiens
gggacugggugcaguggcucuugaauuugauauuuaaguaaaauauaaguagaacacugaagau

SEQ ID NO: 245793 - RNA, 64 nt, Homo Sapiens
uagagguuaaaaaggaggagcuagauucauauccuaaguaaagagaaaugccuagugucuauuu

SEQ ID NO: 245794 - RNA, 64 nt, Homo Sapiens
acuuuaucaauguauaauuaacaauuaucuuguuuaaguaaauuuagaauacauuuaaguauug

SEQ ID NO: 245795 - RNA, 64 nt, Homo Sapiens
cauuauugaaaagcaaaucuguucacugaauaaauaaguaaauauugguagauauucaggaaau

SEQ ID NO: 245796 - RNA, 64 nt, Homo Sapiens
uucuuuaagucagaagcccauuuguuauuguaccuaaguaaauuacuaugauuccaauuacuac

SEQ ID NO: 245797 - RNA, 64 nt, Homo Sapiens
aacuaaauuuacccuuuacugaagcugguaauuuuaaguaaagcugguaauuuuuaccaaaacu

SEQ ID NO: 245798 - RNA, 64 nt, Homo Sapiens
cauaagagucagugcauuuucuuaaauaauuauuuaaguaaauuaggcuuuugcaggaauuuaa

SEQ ID NO: 245799 - RNA, 64 nt, Homo Sapiens
agauaaauugacaagacuaaucaguauuuuauuauaaguaaaagauuuuucuucuuuccuuaaa

SEQ ID NO: 245800 - RNA, 64 nt, Homo Sapiens
uuuguucuaacaggacaguagaacacuugcaagguaaguaaaaccaaauguauuagcauuauuc

SEQ ID NO: 245801 - RNA, 64 nt, Homo Sapiens
auaacacauuuauguucucguuuuucuacagauauaaguaaauuuauauauaaaaauaccaaaa

SEQ ID NO: 245802 - RNA, 64 nt, Homo Sapiens
ggaacucuacauuuuguaucuuuuaaagcuccuauaaguaaaauaacuauuggcuuuauuaaaa

SEQ ID NO: 245803 - RNA, 64 nt, Homo Sapiens
uauuuauugagucaauuuguuuuuauaguugacauaaguaaauuuaguuauuuuucuuuucacu

SEQ ID NO: 245804 - RNA, 64 nt, Homo Sapiens
aaaauuaguauauuuuacuacuuaauuucauuuauaaguaaauuuauucugcauuaugagaaaa

SEQ ID NO: 245805 - RNA, 64 nt, Homo Sapiens
ucauuuuaaaugcucaaagaguugcccuauauaugcauguuauccauuauaaaugcacucagca

SEQ ID NO: 245806 - RNA, 64 nt, Homo Sapiens
cauauguuccacuuauugcuuuguuagucaaaaugcauguuauguagaaaauggucaauggcaa

SEQ ID NO: 245807 - RNA, 64 nt, Homo Sapiens
uagggcuggcucuaggaagauguugcccuugugggcauguuauauguguaugaacugugauaac

SEQ ID NO: 245808 - RNA, 64 nt, Homo Sapiens
auuaaaugguugguuauuuuuugagccacuguaagcauguuacuuacauuugucacauucagcu

SEQ ID NO: 245809 - RNA, 64 nt, Homo Sapiens
ggauaauuggggacuucugcucaacauggcaguggcauguuaggcauguuagggcuugaggugg

SEQ ID NO: 245810 - RNA, 64 nt, Homo Sapiens
gggacuucugcucaacauggcaguggcauguuaggcauguuagggcuugagguggggcauucac

SEQ ID NO: 245811 - RNA, 64 nt, Homo Sapiens
aaaauuuuuaugucuuaaucuaacucuauaguaggcauguuauguuguucuuauuacccugauu

SEQ ID NO: 245812 - RNA, 64 nt, Homo Sapiens
uucucacaacaaaccuauuguagaggugaguaaggcauguuacuacagaggaaaguuugagagu

SEQ ID NO: 245813 - RNA, 64 nt, Homo Sapiens; identical to SEQ ID NO: 143712

SEQ ID NO: 245814 - RNA, 64 nt, Homo Sapiens; identical to SEQ ID NO: 143713

SEQ ID NO: 245815 - RNA, 64 nt, Homo Sapiens; identical to SEQ ID NO: 143714

SEQ ID NO: 245816 - RNA, 64 nt, Homo Sapiens; identical to SEQ ID NO: 143715

SEQ ID NO: 245817 - RNA, 64 nt, Homo Sapiens; identical to SEQ ID NO: 143716

SEQ ID NO: 245818 - RNA, 64 nt, Homo Sapiens; identical to SEQ ID NO: 143717

SEQ ID NO: 245819 - RNA, 64 nt, Homo Sapiens; identical to SEQ ID NO: 143718

SEQ ID NO: 245820 - RNA, 64 nt, Homo Sapiens; identical to SEQ ID NO: 143719

SEQ ID NO: 245821 - RNA, 64 nt, Homo Sapiens; identical to SEQ ID NO: 143720

SEQ ID NO: 245822 - RNA, 64 nt, Homo Sapiens; identical to SEQ ID NO: 143721

SEQ ID NO: 245823 - RNA, 64 nt, Homo Sapiens; identical to SEQ ID NO: 143722

SEQ ID NO: 245824 - RNA, 64 nt, Homo Sapiens; identical to SEQ ID NO: 143723

SEQ ID NO: 245825 - RNA, 64 nt, Homo Sapiens; identical to SEQ ID NO: 143724

SEQ ID NO: 245826 - RNA, 64 nt, Homo Sapiens; identical to SEQ ID NO: 143725

SEQ ID NO: 245827 - RNA, 64 nt, Homo Sapiens; identical to SEQ ID NO: 143726

SEQ ID NO: 245828 - RNA, 64 nt, Homo Sapiens; identical to SEQ ID NO: 143727

SEQ ID NO: 245829 - RNA, 64 nt, Homo Sapiens; identical to SEQ ID NO: 143728

SEQ ID NO: 245830 - RNA, 64 nt, Homo Sapiens; identical to SEQ ID NO: 143729

SEQ ID NO: 245831 - RNA, 64 nt, Homo Sapiens; identical to SEQ ID NO: 143730

SEQ ID NO: 245832 - RNA, 64 nt, Homo Sapiens; identical to SEQ ID NO: 143731

SEQ ID NO: 245833 - RNA, 64 nt, Homo Sapiens; identical to SEQ ID NO: 143732

SEQ ID NO: 245834 - RNA, 64 nt, Homo Sapiens; identical to SEQ ID NO: 143733

SEQ ID NO: 245835 - RNA, 64 nt, Homo Sapiens; identical to SEQ ID NO: 143734

SEQ ID NO: 245836 - RNA, 64 nt, Homo Sapiens; identical to SEQ ID NO: 143735

SEQ ID NO: 245837 - RNA, 64 nt, Homo Sapiens; identical to SEQ ID NO: 143736

SEQ ID NO: 245838 - RNA, 64 nt, Homo Sapiens; identical to SEQ ID NO: 143737

SEQ ID NO: 245839 - RNA, 64 nt, Homo Sapiens; identical to SEQ ID NO: 143738

SEQ ID NO: 245840 - RNA, 64 nt, Homo Sapiens; identical to SEQ ID NO: 143739

SEQ ID NO: 245841 - RNA, 64 nt, Homo Sapiens; identical to SEQ ID NO: 143740

SEQ ID NO: 245842 - RNA, 64 nt, Homo Sapiens; identical to SEQ ID NO: 143741

SEQ ID NO: 245843 - RNA, 64 nt, Homo Sapiens; identical to SEQ ID NO: 143742

SEQ ID NO: 245844 - RNA, 64 nt, Homo Sapiens; identical to SEQ ID NO: 143743

SEQ ID NO: 245845 - RNA, 64 nt, Homo Sapiens; identical to SEQ ID NO: 143744

SEQ ID NO: 245846 - RNA, 64 nt, Homo Sapiens; identical to SEQ ID NO: 143745

SEQ ID NO: 245847 - RNA, 64 nt, Homo Sapiens; identical to SEQ ID NO: 143746

SEQ ID NO: 245848 - RNA, 64 nt, Homo Sapiens; identical to SEQ ID NO: 143747

SEQ ID NO: 245849 - RNA, 64 nt, Homo Sapiens; identical to SEQ ID NO: 143748

SEQ ID NO: 245850 - RNA, 64 nt, Homo Sapiens; identical to SEQ ID NO: 143749

SEQ ID NO: 245851 - RNA, 64 nt, Homo Sapiens; identical to SEQ ID NO: 143750

SEQ ID NO: 245852 - RNA, 64 nt, Homo Sapiens; identical to SEQ ID NO: 143751

SEQ ID NO: 245853 - RNA, 64 nt, Homo Sapiens; identical to SEQ ID NO: 143752

SEQ ID NO: 245854 - RNA, 64 nt, Homo Sapiens; identical to SEQ ID NO: 143753

SEQ ID NO: 245855 - RNA, 64 nt, Homo Sapiens; identical to SEQ ID NO: 143754

SEQ ID NO: 245856 - RNA, 64 nt, Homo Sapiens; identical to SEQ ID NO: 143755

SEQ ID NO: 245857 - RNA, 64 nt, Homo Sapiens; identical to SEQ ID NO: 143756

SEQ ID NO: 245858 - RNA, 64 nt, Homo Sapiens; identical to SEQ ID NO: 143757

SEQ ID NO: 245859 - RNA, 64 nt, Homo Sapiens; identical to SEQ ID NO: 143758

SEQ ID NO: 245860 - RNA, 64 nt, Homo Sapiens; identical to SEQ ID NO: 143759

SEQ ID NO: 245861 - RNA, 64 nt, Homo Sapiens; identical to SEQ ID NO: 143760

SEQ ID NO: 245862 - RNA, 64 nt, Homo Sapiens; identical to SEQ ID NO: 143761

SEQ ID NO: 245863 - RNA, 64 nt, Homo Sapiens; identical to SEQ ID NO: 143762

SEQ ID NO: 245864 - RNA, 64 nt, Homo Sapiens; identical to SEQ ID NO: 143763

SEQ ID NO: 245865 - RNA, 64 nt, Homo Sapiens; identical to SEQ ID NO: 143764

SEQ ID NO: 245866 - RNA, 64 nt, Homo Sapiens; identical to SEQ ID NO: 143765

SEQ ID NO: 245867 - RNA, 64 nt, Homo Sapiens; identical to SEQ ID NO: 143766

SEQ ID NO: 245868 - RNA, 64 nt, Homo Sapiens; identical to SEQ ID NO: 143767

SEQ ID NO: 245869 - RNA, 64 nt, Homo Sapiens; identical to SEQ ID NO: 143768

SEQ ID NO: 245870 - RNA, 64 nt, Homo Sapiens; identical to SEQ ID NO: 143769

SEQ ID NO: 245871 - RNA, 64 nt, Homo Sapiens; identical to SEQ ID NO: 143770

SEQ ID NO: 245872 - RNA, 64 nt, Homo Sapiens; identical to SEQ ID NO: 143771

SEQ ID NO: 245873 - RNA, 64 nt, Homo Sapiens; identical to SEQ ID NO: 143772

SEQ ID NO: 245874 - RNA, 64 nt, Homo Sapiens; identical to SEQ ID NO: 143773

SEQ ID NO: 245875 - RNA, 64 nt, Homo Sapiens; identical to SEQ ID NO: 143774

SEQ ID NO: 245876 - RNA, 64 nt, Homo Sapiens; identical to SEQ ID NO: 143775

SEQ ID NO: 245877 - RNA, 64 nt, Homo Sapiens; identical to SEQ ID NO: 143776

SEQ ID NO: 245878 - RNA, 64 nt, Homo Sapiens; identical to SEQ ID NO: 143777

SEQ ID NO: 245879 - RNA, 64 nt, Homo Sapiens; identical to SEQ ID NO: 143778

SEQ ID NO: 245880 - RNA, 64 nt, Homo Sapiens; identical to SEQ ID NO: 143779

SEQ ID NO: 245881 - RNA, 64 nt, Homo Sapiens; identical to SEQ ID NO: 143780

SEQ ID NO: 245882 - RNA, 64 nt, Homo Sapiens; identical to SEQ ID NO: 143781

SEQ ID NO: 245883 - RNA, 64 nt, Homo Sapiens; identical to SEQ ID NO: 143782

SEQ ID NO: 245884 - RNA, 64 nt, Homo Sapiens; identical to SEQ ID NO: 143783

SEQ ID NO: 245885 - RNA, 64 nt, Homo Sapiens; identical to SEQ ID NO: 143784

SEQ ID NO: 245886 - RNA, 64 nt, Homo Sapiens; identical to SEQ ID NO: 143785

SEQ ID NO: 245887 - RNA, 64 nt, Homo Sapiens; identical to SEQ ID NO: 143786

SEQ ID NO: 245888 - RNA, 64 nt, Homo Sapiens; identical to SEQ ID NO: 143787

SEQ ID NO: 245889 - RNA, 64 nt, Homo Sapiens; identical to SEQ ID NO: 143788

SEQ ID NO: 245890 - RNA, 64 nt, Homo Sapiens; identical to SEQ ID NO: 143789

SEQ ID NO: 245891 - RNA, 57 nt, Homo Sapiens; identical to SEQ ID NO: 143790

SEQ ID NO: 245892 - RNA, 64 nt, Homo Sapiens; identical to SEQ ID NO: 143791

SEQ ID NO: 245893 - RNA, 64 nt, Homo Sapiens; identical to SEQ ID NO: 143792

SEQ ID NO: 245894 - RNA, 64 nt, Homo Sapiens; identical to SEQ ID NO: 143793

SEQ ID NO: 245895 - RNA, 64 nt, Homo Sapiens; identical to SEQ ID NO: 143794

SEQ ID NO: 245896 - RNA, 64 nt, Homo Sapiens; identical to SEQ ID NO: 143795

SEQ ID NO: 245897 - RNA, 64 nt, Homo Sapiens; identical to SEQ ID NO: 143796

SEQ ID NO: 245898 - RNA, 64 nt, Homo Sapiens; identical to SEQ ID NO: 143797

SEQ ID NO: 245899 - RNA, 64 nt, Homo Sapiens; identical to SEQ ID NO: 143798

SEQ ID NO: 245900 - RNA, 64 nt, Homo Sapiens; identical to SEQ ID NO: 143799

SEQ ID NO: 245901 - RNA, 64 nt, Homo Sapiens; identical to SEQ ID NO: 143800

SEQ ID NO: 245902 - RNA, 64 nt, Homo Sapiens; identical to SEQ ID NO: 143801

SEQ ID NO: 245903 - RNA, 64 nt, Homo Sapiens; identical to SEQ ID NO: 143802

SEQ ID NO: 245904 - RNA, 64 nt, Homo Sapiens; identical to SEQ ID NO: 143803

SEQ ID NO: 245905 - RNA, 64 nt, Homo Sapiens; identical to SEQ ID NO: 143804

SEQ ID NO: 245906 - RNA, 64 nt, Homo Sapiens; identical to SEQ ID NO: 143805

SEQ ID NO: 245907 - RNA, 64 nt, Homo Sapiens; identical to SEQ ID NO: 143806

SEQ ID NO: 245908 - RNA, 64 nt, Homo Sapiens; identical to SEQ ID NO: 143807

SEQ ID NO: 245909 - RNA, 64 nt, Homo Sapiens; identical to SEQ ID NO: 143808

SEQ ID NO: 245910 - RNA, 64 nt, Homo Sapiens; identical to SEQ ID NO: 143809

SEQ ID NO: 245911 - RNA, 64 nt, Homo Sapiens; identical to SEQ ID NO: 143810

SEQ ID NO: 245912 - RNA, 64 nt, Homo Sapiens; identical to SEQ ID NO: 143811

SEQ ID NO: 245913 - RNA, 64 nt, Homo Sapiens; identical to SEQ ID NO: 143812

SEQ ID NO: 245914 - RNA, 64 nt, Homo Sapiens
aguuuauaugucgccuuuuucuguucaaauuugcauggccuauuaaguuggcuggagaguguuu

SEQ ID NO: 245915 - RNA, 64 nt, Homo Sapiens
gaaaaucuaaugucuggauuaucuuccuuuucucauggccuaagaaauaaggaucaauaaggaa

SEQ ID NO: 245916 - RNA, 64 nt, Homo Sapiens
guuuuaagaaaguuuaaaaaaaaaaaaaaaaaaaaucucagacuaaauagaaaauugcaaaaaa

SEQ ID NO: 245917 - RNA, 64 nt, Homo Sapiens
ugaccuccucucccaaccacucuccuggaaauguaucucagaaaccuucucucaaacuuguauu

SEQ ID NO: 245918 - RNA, 64 nt, Homo Sapiens
ugcuuaccugcaugaugccuccuggaccagccuuaucucagaccuuguuauuggguuucaugcc

SEQ ID NO: 245919 - RNA, 64 nt, Homo Sapiens
caaggcaccucaggucucuuguuugcuugaaaguaucucagaccgacaucaaguggaagaacuu

SEQ ID NO: 245920 - RNA, 64 nt, Homo Sapiens
acucaguacagauagcaauucaucaagucuucugaucucagauaugugaauuuuaaaugaccug

SEQ ID NO: 245921 - RNA, 64 nt, Homo Sapiens
aaaccaagcuuaauuauacuuaaugugguugcagaucucagaugaaaauuuuucugacacccuu

SEQ ID NO: 245922 - RNA, 64 nt, Homo Sapiens
agaauugacugggacuaauaucacaggaucaaucaucucagaaucuuacuugaugcauuauuua

SEQ ID NO: 245923 - RNA, 64 nt, Homo Sapiens
cuuucuacgccauucaggaaggcagcacaaauuuaucucagaaagguuccuguguauugcaagg

SEQ ID NO: 245924 - RNA, 64 nt, Homo Sapiens
aauaauccuagggcagacuaaauucagacgacccaucucagaaugguggaucaaagcagcaagu

SEQ ID NO: 245925 - RNA, 64 nt, Homo Sapiens
gaggacuaaagggcaaaauucuagagagugguaaaucucagaaagcacaagcauaaaaugcagc

SEQ ID NO: 245926 - RNA, 64 nt, Homo Sapiens
gguucguuguggaugcucugcaucuuccacucggaucucagauuucagccagcuccggggcucu

SEQ ID NO: 245927 - RNA, 64 nt, Homo Sapiens
accuuagucagcuuugcugaaggaguaagaacauaucucagaccaacuuuuaaaguuugaguuu

SEQ ID NO: 245928 - RNA, 64 nt, Homo Sapiens
ggaauaaguucauccucauggaucagaaucagagaucucagaggggucaacaccagagaucuca

SEQ ID NO: 245929 - RNA, 64 nt, Homo Sapiens
agaaucagagaucucagaggggucaacaccagagaucucagaucauccugucuggaauacacca

SEQ ID NO: 245930 - RNA, 64 nt, Homo Sapiens
uggauacuugcaggaagcugguggauguugcagaaucucagagcgcaaggcucagagagcaaaa

SEQ ID NO: 245931 - RNA, 64 nt, Homo Sapiens
cucaccuguguaggucuguuucagaaccagaucaaucucagaaucacugcauuccugaccgagg

SEQ ID NO: 245932 - RNA, 64 nt, Homo Sapiens
aaacaaugaccugauucugucuuuaaaaaaaaaaaucucagaauucuuuuuuuguuuguguuuu

SEQ ID NO: 245933 - RNA, 64 nt, Homo Sapiens
gauuacaggcgugagccaccuugccuggccaaaaaucucagaauucuuuaagacuguuuuaauu

SEQ ID NO: 245934 - RNA, 64 nt, Homo Sapiens
uuugggaggcugaggcagguggcucacuccuguaaucucagaacaaaagaagccugggcacugu

SEQ ID NO: 245935 - RNA, 64 nt, Homo Sapiens
cuguucuacuggagaaguucacacuaaguuccuuaucucagauguuguaaauacuuuuuaaaaa

SEQ ID NO: 245936 - RNA, 64 nt, Homo Sapiens
uccucgucuauaacaagagcauguauggcacgacaucucagacucuaccucuaugaggacagca

SEQ ID NO: 245937 - RNA, 64 nt, Homo Sapiens; identical to SEQ ID NO: 81841

SEQ ID NO: 245938 - RNA, 64 nt, Homo Sapiens; identical to SEQ ID NO: 81842

SEQ ID NO: 245939 - RNA, 64 nt, Homo Sapiens; identical to SEQ ID NO: 81843

SEQ ID NO: 245940 - RNA, 64 nt, Homo Sapiens; identical to SEQ ID NO: 81844

SEQ ID NO: 245941 - RNA, 64 nt, Homo Sapiens; identical to SEQ ID NO: 81845

SEQ ID NO: 245942 - RNA, 64 nt, Homo Sapiens; identical to SEQ ID NO: 81846

SEQ ID NO: 245943 - RNA, 64 nt, Homo Sapiens; identical to SEQ ID NO: 81847

SEQ ID NO: 245944 - RNA, 64 nt, Homo Sapiens; identical to SEQ ID NO: 81848

SEQ ID NO: 245945 - RNA, 64 nt, Homo Sapiens; identical to SEQ ID NO: 81849

SEQ ID NO: 245946 - RNA, 64 nt, Homo Sapiens; identical to SEQ ID NO: 81850

SEQ ID NO: 245947 - RNA, 64 nt, Homo Sapiens; identical to SEQ ID NO: 81851

SEQ ID NO: 245948 - RNA, 61 nt, Homo Sapiens; identical to SEQ ID NO: 81852

SEQ ID NO: 245949 - RNA, 64 nt, Homo Sapiens; identical to SEQ ID NO: 81853

SEQ ID NO: 245950 - RNA, 51 nt, Homo Sapiens; identical to SEQ ID NO: 81854

SEQ ID NO: 245951 - RNA, 64 nt, Homo Sapiens; identical to SEQ ID NO: 81855

SEQ ID NO: 245952 - RNA, 64 nt, Homo Sapiens; identical to SEQ ID NO: 81856

SEQ ID NO: 245953 - RNA, 64 nt, Homo Sapiens; identical to SEQ ID NO: 81857

SEQ ID NO: 245954 - RNA, 64 nt, Homo Sapiens; identical to SEQ ID NO: 81858

SEQ ID NO: 245955 - RNA, 64 nt, Homo Sapiens; identical to SEQ ID NO: 81859

SEQ ID NO: 245956 - RNA, 64 nt, Homo Sapiens; identical to SEQ ID NO: 81860

SEQ ID NO: 245957 - RNA, 64 nt, Homo Sapiens; identical to SEQ ID NO: 81861

SEQ ID NO: 245958 - RNA, 64 nt, Homo Sapiens; identical to SEQ ID NO: 81862

SEQ ID NO: 245959 - RNA, 64 nt, Homo Sapiens; identical to SEQ ID NO: 81863

SEQ ID NO: 245960 - RNA, 64 nt, Homo Sapiens; identical to SEQ ID NO: 81864

SEQ ID NO: 245961 - RNA, 64 nt, Homo Sapiens; identical to SEQ ID NO: 81865

SEQ ID NO: 245962 - RNA, 64 nt, Homo Sapiens; identical to SEQ ID NO: 81866

SEQ ID NO: 245963 - RNA, 64 nt, Homo Sapiens; identical to SEQ ID NO: 81867

SEQ ID NO: 245964 - RNA, 64 nt, Homo Sapiens; identical to SEQ ID NO: 81868

SEQ ID NO: 245965 - RNA, 64 nt, Homo Sapiens; identical to SEQ ID NO: 81869

SEQ ID NO: 245966 - RNA, 64 nt, Homo Sapiens; identical to SEQ ID NO: 81870

SEQ ID NO: 245967 - RNA, 64 nt, Homo Sapiens; identical to SEQ ID NO: 81871

SEQ ID NO: 245968 - RNA, 64 nt, Homo Sapiens; identical to SEQ ID NO: 81872

SEQ ID NO: 245969 - RNA, 64 nt, Homo Sapiens; identical to SEQ ID NO: 81873

SEQ ID NO: 245970 - RNA, 64 nt, Homo Sapiens; identical to SEQ ID NO: 81874

SEQ ID NO: 245971 - RNA, 64 nt, Homo Sapiens; identical to SEQ ID NO: 81875

SEQ ID NO: 245972 - RNA, 64 nt, Homo Sapiens; identical to SEQ ID NO: 81876

SEQ ID NO: 245973 - RNA, 64 nt, Homo Sapiens; identical to SEQ ID NO: 81877

SEQ ID NO: 245974 - RNA, 64 nt, Homo Sapiens; identical to SEQ ID NO: 81878

SEQ ID NO: 245975 - RNA, 64 nt, Homo Sapiens; identical to SEQ ID NO: 81879

SEQ ID NO: 245976 - RNA, 64 nt, Homo Sapiens; identical to SEQ ID NO: 81880

SEQ ID NO: 245977 - RNA, 64 nt, Homo Sapiens; identical to SEQ ID NO: 81881

SEQ ID NO: 245978 - RNA, 64 nt, Homo Sapiens; identical to SEQ ID NO: 81882

SEQ ID NO: 245979 - RNA, 64 nt, Homo Sapiens; identical to SEQ ID NO: 81883

SEQ ID NO: 245980 - RNA, 64 nt, Homo Sapiens; identical to SEQ ID NO: 81884

SEQ ID NO: 245981 - RNA, 64 nt, Homo Sapiens; identical to SEQ ID NO: 81885

SEQ ID NO: 245982 - RNA, 64 nt, Homo Sapiens; identical to SEQ ID NO: 81886

SEQ ID NO: 245983 - RNA, 64 nt, Homo Sapiens; identical to SEQ ID NO: 81887

SEQ ID NO: 245984 - RNA, 64 nt, Homo Sapiens; identical to SEQ ID NO: 81888

SEQ ID NO: 245985 - RNA, 64 nt, Homo Sapiens; identical to SEQ ID NO: 81889

SEQ ID NO: 245986 - RNA, 64 nt, Homo Sapiens; identical to SEQ ID NO: 81890

SEQ ID NO: 245987 - RNA, 64 nt, Homo Sapiens; identical to SEQ ID NO: 81891

SEQ ID NO: 245988 - RNA, 64 nt, Homo Sapiens; identical to SEQ ID NO: 81892

SEQ ID NO: 245989 - RNA, 64 nt, Homo Sapiens; identical to SEQ ID NO: 81893

SEQ ID NO: 245990 - RNA, 64 nt, Homo Sapiens; identical to SEQ ID NO: 81894

SEQ ID NO: 245991 - RNA, 64 nt, Homo Sapiens; identical to SEQ ID NO: 81895

SEQ ID NO: 245992 - RNA, 64 nt, Homo Sapiens; identical to SEQ ID NO: 81896

SEQ ID NO: 245993 - RNA, 64 nt, Homo Sapiens; identical to SEQ ID NO: 81897

SEQ ID NO: 245994 - RNA, 64 nt, Homo Sapiens; identical to SEQ ID NO: 81898

SEQ ID NO: 245995 - RNA, 64 nt, Homo Sapiens; identical to SEQ ID NO: 81899

SEQ ID NO: 245996 - RNA, 64 nt, Homo Sapiens; identical to SEQ ID NO: 81900

SEQ ID NO: 245997 - RNA, 64 nt, Homo Sapiens; identical to SEQ ID NO: 81901

SEQ ID NO: 245998 - RNA, 64 nt, Homo Sapiens; identical to SEQ ID NO: 81902

SEQ ID NO: 245999 - RNA, 64 nt, Homo Sapiens; identical to SEQ ID NO: 81903

SEQ ID NO: 246000 - RNA, 64 nt, Homo Sapiens; identical to SEQ ID NO: 81904

SEQ ID NO: 246001 - RNA, 64 nt, Homo Sapiens; identical to SEQ ID NO: 81905

SEQ ID NO: 246002 - RNA, 64 nt, Homo Sapiens; identical to SEQ ID NO: 81906

SEQ ID NO: 246003 - RNA, 64 nt, Homo Sapiens; identical to SEQ ID NO: 81907

SEQ ID NO: 246004 - RNA, 64 nt, Homo Sapiens; identical to SEQ ID NO: 81908

SEQ ID NO: 246005 - RNA, 64 nt, Homo Sapiens; identical to SEQ ID NO: 81909

SEQ ID NO: 246006 - RNA, 64 nt, Homo Sapiens; identical to SEQ ID NO: 81910

SEQ ID NO: 246007 - RNA, 64 nt, Homo Sapiens; identical to SEQ ID NO: 81911

SEQ ID NO: 246008 - RNA, 64 nt, Homo Sapiens; identical to SEQ ID NO: 81912

SEQ ID NO: 246009 - RNA, 64 nt, Homo Sapiens; identical to SEQ ID NO: 81913

SEQ ID NO: 246010 - RNA, 64 nt, Homo Sapiens; identical to SEQ ID NO: 81914

SEQ ID NO: 246011 - RNA, 64 nt, Homo Sapiens; identical to SEQ ID NO: 81915

SEQ ID NO: 246012 - RNA, 64 nt, Homo Sapiens; identical to SEQ ID NO: 81916

SEQ ID NO: 246013 - RNA, 64 nt, Homo Sapiens; identical to SEQ ID NO: 81917

SEQ ID NO: 246014 - RNA, 64 nt, Homo Sapiens; identical to SEQ ID NO: 81918

SEQ ID NO: 246015 - RNA, 64 nt, Homo Sapiens; identical to SEQ ID NO: 81919

SEQ ID NO: 246016 - RNA, 64 nt, Homo Sapiens; identical to SEQ ID NO: 81920

SEQ ID NO: 246017 - RNA, 64 nt, Homo Sapiens; identical to SEQ ID NO: 81921

SEQ ID NO: 246018 - RNA, 64 nt, Homo Sapiens; identical to SEQ ID NO: 81922

SEQ ID NO: 246019 - RNA, 64 nt, Homo Sapiens; identical to SEQ ID NO: 81923

SEQ ID NO: 246020 - RNA, 64 nt, Homo Sapiens; identical to SEQ ID NO: 81924

SEQ ID NO: 246021 - RNA, 64 nt, Homo Sapiens; identical to SEQ ID NO: 81925

SEQ ID NO: 246022 - RNA, 64 nt, Homo Sapiens; identical to SEQ ID NO: 81926

SEQ ID NO: 246023 - RNA, 64 nt, Homo Sapiens; identical to SEQ ID NO: 81927

SEQ ID NO: 246024 - RNA, 64 nt, Homo Sapiens; identical to SEQ ID NO: 81928

SEQ ID NO: 246025 - RNA, 64 nt, Homo Sapiens; identical to SEQ ID NO: 81929

SEQ ID NO: 246026 - RNA, 64 nt, Homo Sapiens; identical to SEQ ID NO: 81930

SEQ ID NO: 246027 - RNA, 64 nt, Homo Sapiens; identical to SEQ ID NO: 81931

SEQ ID NO: 246028 - RNA, 64 nt, Homo Sapiens; identical to SEQ ID NO: 81932

SEQ ID NO: 246029 - RNA, 64 nt, Homo Sapiens; identical to SEQ ID NO: 81933

SEQ ID NO: 246030 - RNA, 64 nt, Homo Sapiens; identical to SEQ ID NO: 81934

SEQ ID NO: 246031 - RNA, 64 nt, Homo Sapiens; identical to SEQ ID NO: 81935

SEQ ID NO: 246032 - RNA, 64 nt, Homo Sapiens; identical to SEQ ID NO: 81936

SEQ ID NO: 246033 - RNA, 64 nt, Homo Sapiens; identical to SEQ ID NO: 81937

SEQ ID NO: 246034 - RNA, 64 nt, Homo Sapiens; identical to SEQ ID NO: 81938

SEQ ID NO: 246035 - RNA, 64 nt, Homo Sapiens; identical to SEQ ID NO: 81939

SEQ ID NO: 246036 - RNA, 64 nt, Homo Sapiens; identical to SEQ ID NO: 81940

SEQ ID NO: 246037 - RNA, 64 nt, Homo Sapiens; identical to SEQ ID NO: 81941

SEQ ID NO: 246038 - RNA, 64 nt, Homo Sapiens; identical to SEQ ID NO: 81942

SEQ ID NO: 246039 - RNA, 64 nt, Homo Sapiens; identical to SEQ ID NO: 81943

SEQ ID NO: 246040 - RNA, 64 nt, Homo Sapiens; identical to SEQ ID NO: 81944

SEQ ID NO: 246041 - RNA, 64 nt, Homo Sapiens
cacaaugaaguccaggguuggcucugugccucauagggaauaaaaggggcuuguuuauuaucuu

SEQ ID NO: 246042 - RNA, 64 nt, Homo Sapiens
cccaguccaggcccagcaaauucugaugagaaauagggaauacuuacacaguagauugcagccc

SEQ ID NO: 246043 - RNA, 64 nt, Homo Sapiens
ugaauguuguugggugguagaaaaugauagaacaagggaauaaccgcgaaugcucugugcagcu

SEQ ID NO: 246044 - RNA, 64 nt, Homo Sapiens
auuuuucccagcaaaauaaaucauauggcgagucagggaauaaaaagucaaaagaaacaaauag

SEQ ID NO: 246045 - RNA, 64 nt, Homo Sapiens
uugcuaaaauaaaacuuaggauacuauauguaauagggaauaccguuuauucauuuucugcaau

SEQ ID NO: 246046 - RNA, 64 nt, Homo Sapiens
uuuuguaaucuaucauuuuaugucuguuuaaugaagggaauaggaccagagaauuggguuguca

SEQ ID NO: 246047 - RNA, 64 nt, Homo Sapiens
cugagcaaagguaugaaacagggaucuggcugagagggaauaauauagguguucucaggaggua

SEQ ID NO: 246048 - RNA, 64 nt, Homo Sapiens
accagagggagaggacccucgccucaauacugccagggaauaaaaagaugggucccugugccag

SEQ ID NO: 246049 - RNA, 64 nt, Homo Sapiens
uauguccuugaagcuggcaggggauucccaguccagggaauaucccuacaugauuuuugucauu

SEQ ID NO: 246050 - RNA, 64 nt, Homo Sapiens
gaggucaaacaugggccuucggcauuggguuucuagggaauauggcucaguagggccugccccu

SEQ ID NO: 246051 - RNA, 64 nt, Homo Sapiens
aauuuuaaaaauuaagagauuuuuuuuauuuuuaagggaauaaaauaucuucuauucaaaaucu

SEQ ID NO: 246052 - RNA, 64 nt, Homo Sapiens
gaucuuuuuuuuaaagacaggaagacagaaccagagggaauaaguaguguucuccaucucuagu

SEQ ID NO: 246053 - RNA, 64 nt, Homo Sapiens
cugugucccaccuguuuacuaacaccauaacaguagggaauaaauucucgugaagggcaaaugu

SEQ ID NO: 246054 - RNA, 64 nt, Homo Sapiens
uaucuuguaaaauguaccugcaucuucaugguccagggaauaugaauuccauuuuaugaaaagg

SEQ ID NO: 246055 - RNA, 64 nt, Homo Sapiens
uugagaaacccaaaguacuagacuaucaccuccaagggaauagcaugucuuaaaaggcauuuuu

SEQ ID NO: 246056 - RNA, 64 nt, Homo Sapiens
uucaggagcuauguaagcugcucaggcuuacaaaagggaauagucagcuggagaaagcacucac

SEQ ID NO: 246057 - RNA, 64 nt, Homo Sapiens
aaacaaaacuuucugcuaacaaaauacauacaguaucugccaguauauucuguaaaaccuucua

SEQ ID NO: 246058 - RNA, 64 nt, Homo Sapiens
gaagcaaggagucuaaggcccuagcgauuugggcaucugccacauugguucauauucagaaagu

SEQ ID NO: 246059 - RNA, 64 nt, Homo Sapiens
guuauccugaaacuuucuaugcucaguggaaaguaucugccagccacagcaugaggccugugaa

SEQ ID NO: 246060 - RNA, 64 nt, Homo Sapiens
guugggcuuugggaagauguuauuuaugaccaauaucugccaguaacgcuguuuaucucacuug

SEQ ID NO: 246061 - RNA, 64 nt, Homo Sapiens
uuaggcuuaccagcauauaaggaaaaauggcccaaucugccaguacaucucaaauacaaccaca

SEQ ID NO: 246062 - RNA, 64 nt, Homo Sapiens
aacaacccuccccucacccccugccucugacuacaucugccacccugucugccauuggucuccu

SEQ ID NO: 246063 - RNA, 64 nt, Homo Sapiens
gguuauuuuuuucuaaggagauguucagaacuucaucugccacuuauuauauuuaaaaaaaacu

SEQ ID NO: 246064 - RNA, 64 nt, Homo Sapiens
acguuuguugaacaaaacugcacaccucacugucaucugccaggucacaugccacaaccacggu

SEQ ID NO: 246065 - RNA, 64 nt, Homo Sapiens
aaacugguacucaagauguuauuggauguuuacuaucugccagguucaggaaaaaucccuugug

SEQ ID NO: 246066 - RNA, 64 nt, Homo Sapiens
uuuacacaguauuuacuuggucuuagcuggaaaaaucugccaacgaaaauuuguuuuuucuuga

SEQ ID NO: 246067 - RNA, 64 nt, Homo Sapiens
cagacugaaaggccagguuguagucccagcucuuaucugccaucuuggacaaagcuuuucccau

SEQ ID NO: 246068 - RNA, 64 nt, Homo Sapiens
agcaaccccccauuucuguuugggaauucauaugaucugccagagccucuccagggguggaaua

SEQ ID NO: 246069 - RNA, 64 nt, Homo Sapiens
ccacgcaaguuggggagaaaacccccaaggaugaaucugccaauguaagucagggacucuucuu

SEQ ID NO: 246070 - RNA, 64 nt, Homo Sapiens
uuuagcuucuugaaaaugggccccugcagaauaaaucugccaguuuuuauaaaugcuaagaucu

SEQ ID NO: 246071 - RNA, 64 nt, Homo Sapiens
uuuuuagcgaacuuaacaggaagacauacgaaacaucugccaacuuguuggccaaaauccuuua

SEQ ID NO: 246072 - RNA, 64 nt, Homo Sapiens
gggugucugaugugggguggaggcagaacaggauaucugccaaagucgggaggccucgguagcc

SEQ ID NO: 246073 - RNA, 64 nt, Homo Sapiens
ggaaagauacccagagacccaaauaucugccaucaucugccauaaauaggacagcaggaaccua

SEQ ID NO: 246074 - RNA, 64 nt, Homo Sapiens
aucugccauaggaaagauaccaggaaccuaaaauaucugccaucgcuucaagguaauaggacag

SEQ ID NO: 246075 - RNA, 64 nt, Homo Sapiens; identical to SEQ ID NO: 81713

SEQ ID NO: 246076 - RNA, 64 nt, Homo Sapiens; identical to SEQ ID NO: 81714

SEQ ID NO: 246077 - RNA, 64 nt, Homo Sapiens; identical to SEQ ID NO: 81715

SEQ ID NO: 246078 - RNA, 64 nt, Homo Sapiens; identical to SEQ ID NO: 81716

SEQ ID NO: 246079 - RNA, 64 nt, Homo Sapiens; identical to SEQ ID NO: 81717

SEQ ID NO: 246080 - RNA, 64 nt, Homo Sapiens; identical to SEQ ID NO: 81718

SEQ ID NO: 246081 - RNA, 64 nt, Homo Sapiens; identical to SEQ ID NO: 52505

SEQ ID NO: 246082 - RNA, 64 nt, Homo Sapiens; identical to SEQ ID NO: 52506

SEQ ID NO: 246083 - RNA, 64 nt, Homo Sapiens; identical to SEQ ID NO: 52507

SEQ ID NO: 246084 - RNA, 64 nt, Homo Sapiens; identical to SEQ ID NO: 52508

SEQ ID NO: 246085 - RNA, 64 nt, Homo Sapiens; identical to SEQ ID NO: 52509

SEQ ID NO: 246086 - RNA, 64 nt, Homo Sapiens; identical to SEQ ID NO: 52510

SEQ ID NO: 246087 - RNA, 64 nt, Homo Sapiens; identical to SEQ ID NO: 52511

SEQ ID NO: 246088 - RNA, 64 nt, Homo Sapiens; identical to SEQ ID NO: 52512

SEQ ID NO: 246089 - RNA, 64 nt, Homo Sapiens; identical to SEQ ID NO: 52513

SEQ ID NO: 246090 - RNA, 64 nt, Homo Sapiens; identical to SEQ ID NO: 52514

SEQ ID NO: 246091 - RNA, 64 nt, Homo Sapiens; identical to SEQ ID NO: 52515

SEQ ID NO: 246092 - RNA, 64 nt, Homo Sapiens; identical to SEQ ID NO: 52516

SEQ ID NO: 246093 - RNA, 64 nt, Homo Sapiens; identical to SEQ ID NO: 52517

SEQ ID NO: 246094 - RNA, 64 nt, Homo Sapiens; identical to SEQ ID NO: 52518

SEQ ID NO: 246095 - RNA, 64 nt, Homo Sapiens; identical to SEQ ID NO: 52519

SEQ ID NO: 246096 - RNA, 64 nt, Homo Sapiens; identical to SEQ ID NO: 52520

SEQ ID NO: 246097 - RNA, 64 nt, Homo Sapiens; identical to SEQ ID NO: 52521

SEQ ID NO: 246098 - RNA, 64 nt, Homo Sapiens; identical to SEQ ID NO: 52522

SEQ ID NO: 246099 - RNA, 64 nt, Homo Sapiens; identical to SEQ ID NO: 52523

SEQ ID NO: 246100 - RNA, 64 nt, Homo Sapiens; identical to SEQ ID NO: 52524

SEQ ID NO: 246101 - RNA, 64 nt, Homo Sapiens; identical to SEQ ID NO: 52525

SEQ ID NO: 246102 - RNA, 64 nt, Homo Sapiens; identical to SEQ ID NO: 52526

SEQ ID NO: 246103 - RNA, 64 nt, Homo Sapiens; identical to SEQ ID NO: 52527

SEQ ID NO: 246104 - RNA, 64 nt, Homo Sapiens; identical to SEQ ID NO: 52528

SEQ ID NO: 246105 - RNA, 64 nt, Homo Sapiens; identical to SEQ ID NO: 52529

SEQ ID NO: 246106 - RNA, 64 nt, Homo Sapiens; identical to SEQ ID NO: 52530

SEQ ID NO: 246107 - RNA, 64 nt, Homo Sapiens; identical to SEQ ID NO: 52531

SEQ ID NO: 246108 - RNA, 64 nt, Homo Sapiens; identical to SEQ ID NO: 52532

SEQ ID NO: 246109 - RNA, 64 nt, Homo Sapiens; identical to SEQ ID NO: 52533

SEQ ID NO: 246110 - RNA, 64 nt, Homo Sapiens; identical to SEQ ID NO: 52534

SEQ ID NO: 246111 - RNA, 64 nt, Homo Sapiens; identical to SEQ ID NO: 52535

SEQ ID NO: 246112 - RNA, 64 nt, Homo Sapiens; identical to SEQ ID NO: 52536

SEQ ID NO: 246113 - RNA, 64 nt, Homo Sapiens; identical to SEQ ID NO: 52537

SEQ ID NO: 246114 - RNA, 64 nt, Homo Sapiens; identical to SEQ ID NO: 52538

SEQ ID NO: 246115 - RNA, 64 nt, Homo Sapiens; identical to SEQ ID NO: 52539

SEQ ID NO: 246116 - RNA, 64 nt, Homo Sapiens; identical to SEQ ID NO: 52540

SEQ ID NO: 246117 - RNA, 64 nt, Homo Sapiens; identical to SEQ ID NO: 52541

SEQ ID NO: 246118 - RNA, 64 nt, Homo Sapiens; identical to SEQ ID NO: 52542

SEQ ID NO: 246119 - RNA, 64 nt, Homo Sapiens; identical to SEQ ID NO: 52543

SEQ ID NO: 246120 - RNA, 64 nt, Homo Sapiens; identical to SEQ ID NO: 52544

SEQ ID NO: 246121 - RNA, 64 nt, Homo Sapiens; identical to SEQ ID NO: 52545

SEQ ID NO: 246122 - RNA, 64 nt, Homo Sapiens; identical to SEQ ID NO: 52546

SEQ ID NO: 246123 - RNA, 64 nt, Homo Sapiens; identical to SEQ ID NO: 52547

SEQ ID NO: 246124 - RNA, 64 nt, Homo Sapiens; identical to SEQ ID NO: 52548

SEQ ID NO: 246125 - RNA, 64 nt, Homo Sapiens; identical to SEQ ID NO: 52549

SEQ ID NO: 246126 - RNA, 64 nt, Homo Sapiens; identical to SEQ ID NO: 52550

SEQ ID NO: 246127 - RNA, 64 nt, Homo Sapiens; identical to SEQ ID NO: 52551

SEQ ID NO: 246128 - RNA, 64 nt, Homo Sapiens; identical to SEQ ID NO: 52552

SEQ ID NO: 246129 - RNA, 64 nt, Homo Sapiens; identical to SEQ ID NO: 52553

SEQ ID NO: 246130 - RNA, 64 nt, Homo Sapiens; identical to SEQ ID NO: 52554

SEQ ID NO: 246131 - RNA, 64 nt, Homo Sapiens; identical to SEQ ID NO: 52555

SEQ ID NO: 246132 - RNA, 64 nt, Homo Sapiens; identical to SEQ ID NO: 52556

SEQ ID NO: 246133 - RNA, 64 nt, Homo Sapiens; identical to SEQ ID NO: 52557

SEQ ID NO: 246134 - RNA, 64 nt, Homo Sapiens; identical to SEQ ID NO: 52558

SEQ ID NO: 246135 - RNA, 64 nt, Homo Sapiens; identical to SEQ ID NO: 52559

SEQ ID NO: 246136 - RNA, 64 nt, Homo Sapiens; identical to SEQ ID NO: 52560

SEQ ID NO: 246137 - RNA, 64 nt, Homo Sapiens; identical to SEQ ID NO: 52561

SEQ ID NO: 246138 - RNA, 64 nt, Homo Sapiens; identical to SEQ ID NO: 52562

SEQ ID NO: 246139 - RNA, 64 nt, Homo Sapiens; identical to SEQ ID NO: 52563

SEQ ID NO: 246140 - RNA, 64 nt, Homo Sapiens; identical to SEQ ID NO: 52564

SEQ ID NO: 246141 - RNA, 64 nt, Homo Sapiens; identical to SEQ ID NO: 52565

SEQ ID NO: 246142 - RNA, 64 nt, Homo Sapiens; identical to SEQ ID NO: 52566

SEQ ID NO: 246143 - RNA, 64 nt, Homo Sapiens; identical to SEQ ID NO: 52567

SEQ ID NO: 246144 - RNA, 64 nt, Homo Sapiens; identical to SEQ ID NO: 52568

SEQ ID NO: 246145 - RNA, 64 nt, Homo Sapiens; identical to SEQ ID NO: 52569

SEQ ID NO: 246146 - RNA, 64 nt, Homo Sapiens; identical to SEQ ID NO: 52570

SEQ ID NO: 246147 - RNA, 64 nt, Homo Sapiens; identical to SEQ ID NO: 52571

SEQ ID NO: 246148 - RNA, 64 nt, Homo Sapiens; identical to SEQ ID NO: 52572

SEQ ID NO: 246149 - RNA, 64 nt, Homo Sapiens; identical to SEQ ID NO: 52573

SEQ ID NO: 246150 - RNA, 64 nt, Homo Sapiens; identical to SEQ ID NO: 52574

SEQ ID NO: 246151 - RNA, 64 nt, Homo Sapiens; identical to SEQ ID NO: 52575

SEQ ID NO: 246152 - RNA, 64 nt, Homo Sapiens; identical to SEQ ID NO: 52576

SEQ ID NO: 246153 - RNA, 64 nt, Homo Sapiens; identical to SEQ ID NO: 52577

SEQ ID NO: 246154 - RNA, 64 nt, Homo Sapiens; identical to SEQ ID NO: 52578

SEQ ID NO: 246155 - RNA, 64 nt, Homo Sapiens; identical to SEQ ID NO: 52579

SEQ ID NO: 246156 - RNA, 64 nt, Homo Sapiens; identical to SEQ ID NO: 52580

SEQ ID NO: 246157 - RNA, 64 nt, Homo Sapiens; identical to SEQ ID NO: 52581

SEQ ID NO: 246158 - RNA, 64 nt, Homo Sapiens; identical to SEQ ID NO: 52582

SEQ ID NO: 246159 - RNA, 64 nt, Homo Sapiens; identical to SEQ ID NO: 52583

SEQ ID NO: 246160 - RNA, 64 nt, Homo Sapiens; identical to SEQ ID NO: 52584

SEQ ID NO: 246161 - RNA, 64 nt, Homo Sapiens; identical to SEQ ID NO: 52585

SEQ ID NO: 246162 - RNA, 64 nt, Homo Sapiens; identical to SEQ ID NO: 52586

SEQ ID NO: 246163 - RNA, 64 nt, Homo Sapiens; identical to SEQ ID NO: 52587

SEQ ID NO: 246164 - RNA, 64 nt, Homo Sapiens; identical to SEQ ID NO: 52588

SEQ ID NO: 246165 - RNA, 64 nt, Homo Sapiens; identical to SEQ ID NO: 52589

SEQ ID NO: 246166 - RNA, 64 nt, Homo Sapiens; identical to SEQ ID NO: 52590

SEQ ID NO: 246167 - RNA, 64 nt, Homo Sapiens; identical to SEQ ID NO: 52591

SEQ ID NO: 246168 - RNA, 64 nt, Homo Sapiens; identical to SEQ ID NO: 52592

SEQ ID NO: 246169 - RNA, 64 nt, Homo Sapiens; identical to SEQ ID NO: 52593

SEQ ID NO: 246170 - RNA, 64 nt, Homo Sapiens; identical to SEQ ID NO: 52594

SEQ ID NO: 246171 - RNA, 64 nt, Homo Sapiens; identical to SEQ ID NO: 52595

SEQ ID NO: 246172 - RNA, 64 nt, Homo Sapiens; identical to SEQ ID NO: 52596

SEQ ID NO: 246173 - RNA, 64 nt, Homo Sapiens; identical to SEQ ID NO: 52597

SEQ ID NO: 246174 - RNA, 64 nt, Homo Sapiens; identical to SEQ ID NO: 52598

SEQ ID NO: 246175 - RNA, 64 nt, Homo Sapiens; identical to SEQ ID NO: 52599

SEQ ID NO: 246176 - RNA, 64 nt, Homo Sapiens; identical to SEQ ID NO: 52600

SEQ ID NO: 246177 - RNA, 64 nt, Homo Sapiens; identical to SEQ ID NO: 52601

SEQ ID NO: 246178 - RNA, 64 nt, Homo Sapiens; identical to SEQ ID NO: 52602

SEQ ID NO: 246179 - RNA, 64 nt, Homo Sapiens; identical to SEQ ID NO: 52603

SEQ ID NO: 246180 - RNA, 64 nt, Homo Sapiens; identical to SEQ ID NO: 52604

SEQ ID NO: 246181 - RNA, 64 nt, Homo Sapiens; identical to SEQ ID NO: 52605

SEQ ID NO: 246182 - RNA, 64 nt, Homo Sapiens; identical to SEQ ID NO: 52606

SEQ ID NO: 246183 - RNA, 64 nt, Homo Sapiens; identical to SEQ ID NO: 52607

SEQ ID NO: 246184 - RNA, 64 nt, Homo Sapiens; identical to SEQ ID NO: 52608

SEQ ID NO: 246185 - RNA, 64 nt, Homo Sapiens; identical to SEQ ID NO: 52609

SEQ ID NO: 246186 - RNA, 64 nt, Homo Sapiens; identical to SEQ ID NO: 52610

SEQ ID NO: 246187 - RNA, 64 nt, Homo Sapiens; identical to SEQ ID NO: 52611

SEQ ID NO: 246188 - RNA, 64 nt, Homo Sapiens; identical to SEQ ID NO: 52612

SEQ ID NO: 246189 - RNA, 64 nt, Homo Sapiens; identical to SEQ ID NO: 52613

SEQ ID NO: 246190 - RNA, 64 nt, Homo Sapiens; identical to SEQ ID NO: 52614

SEQ ID NO: 246191 - RNA, 64 nt, Homo Sapiens; identical to SEQ ID NO: 52615

SEQ ID NO: 246192 - RNA, 64 nt, Homo Sapiens; identical to SEQ ID NO: 52616

SEQ ID NO: 246193 - RNA, 64 nt, Homo Sapiens; identical to SEQ ID NO: 52617

SEQ ID NO: 246194 - RNA, 64 nt, Homo Sapiens; identical to SEQ ID NO: 52618

SEQ ID NO: 246195 - RNA, 64 nt, Homo Sapiens; identical to SEQ ID NO: 52619

SEQ ID NO: 246196 - RNA, 64 nt, Homo Sapiens; identical to SEQ ID NO: 52620

SEQ ID NO: 246197 - RNA, 64 nt, Homo Sapiens; identical to SEQ ID NO: 52621

SEQ ID NO: 246198 - RNA, 64 nt, Homo Sapiens; identical to SEQ ID NO: 52622

SEQ ID NO: 246199 - RNA, 64 nt, Homo Sapiens; identical to SEQ ID NO: 52623

SEQ ID NO: 246200 - RNA, 64 nt, Homo Sapiens; identical to SEQ ID NO: 52624

SEQ ID NO: 246201 - RNA, 64 nt, Homo Sapiens; identical to SEQ ID NO: 52625

SEQ ID NO: 246202 - RNA, 64 nt, Homo Sapiens; identical to SEQ ID NO: 52626

SEQ ID NO: 246203 - RNA, 64 nt, Homo Sapiens; identical to SEQ ID NO: 52627

SEQ ID NO: 246204 - RNA, 64 nt, Homo Sapiens; identical to SEQ ID NO: 52628

SEQ ID NO: 246205 - RNA, 64 nt, Homo Sapiens; identical to SEQ ID NO: 52629

SEQ ID NO: 246206 - RNA, 64 nt, Homo Sapiens; identical to SEQ ID NO: 52630

SEQ ID NO: 246207 - RNA, 64 nt, Homo Sapiens; identical to SEQ ID NO: 52631

SEQ ID NO: 246208 - RNA, 64 nt, Homo Sapiens; identical to SEQ ID NO: 52632

SEQ ID NO: 246209 - RNA, 64 nt, Homo Sapiens; identical to SEQ ID NO: 52633

SEQ ID NO: 246210 - RNA, 64 nt, Homo Sapiens; identical to SEQ ID NO: 52634

SEQ ID NO: 246211 - RNA, 64 nt, Homo Sapiens; identical to SEQ ID NO: 52635

SEQ ID NO: 246212 - RNA, 64 nt, Homo Sapiens; identical to SEQ ID NO: 52636

SEQ ID NO: 246213 - RNA, 64 nt, Homo Sapiens; identical to SEQ ID NO: 52637

SEQ ID NO: 246214 - RNA, 64 nt, Homo Sapiens; identical to SEQ ID NO: 52638

SEQ ID NO: 246215 - RNA, 64 nt, Homo Sapiens; identical to SEQ ID NO: 52639

SEQ ID NO: 246216 - RNA, 64 nt, Homo Sapiens; identical to SEQ ID NO: 52640

SEQ ID NO: 246217 - RNA, 64 nt, Homo Sapiens
cacgcagccagggcuucacacccuucaggcugcacccgggcaggccucagaacggugaggggcc

SEQ ID NO: 246218 - RNA, 64 nt, Homo Sapiens
caaaagugcuucauuuuucgugcccgccccgcgccccgggcaggccagucauguguuaaguugc

SEQ ID NO: 246219 - RNA, 64 nt, Homo Sapiens
uccaggcugcacgcggcggacugggcaggccgggcccgggcacuggugggugacagucauacuu

SEQ ID NO: 246220 - RNA, 64 nt, Homo Sapiens
gugacagucauacuucguggagcccagcgagcaucccgggcaagcacuaccaggcugugggucu

SEQ ID NO: 246221 - RNA, 64 nt, Homo Sapiens
ccagcuuagaacagcccuuggugagguggucaugcccgggcaaaggcccugcuuccuggaaagg

SEQ ID NO: 246222 - RNA, 64 nt, Homo Sapiens
uccacauuggccucugcagcugggugaccagagccccgggcacggccccagcuccguggggcuc

SEQ ID NO: 246223 - RNA, 64 nt, Homo Sapiens
gcccagugggauugagggggacugucccccccaucccgggcaggcacacccgcucugucuuccc

SEQ ID NO: 246224 - RNA, 64 nt, Homo Sapiens
ggggcggcgggugggcccgcccucccagccccgccccgggcaggccgaccuucggucccuccgc

SEQ ID NO: 246225 - RNA, 64 nt, Homo Sapiens
uucugguuuaggcacacgucacgggugcgggagacccgggcacgggagacccgggccgccuuca

SEQ ID NO: 246226 - RNA, 64 nt, Homo Sapiens
gcacccagcacagccugcccagcccagcccugcccccgggcacugcacagccugucugggggcc

SEQ ID NO: 246227 - RNA, 60 nt, Homo Sapiens
cgcugguguccacagugugaggacgcugaccccgggcagccgcugcucugaagagcuucc

SEQ ID NO: 246228 - RNA, 64 nt, Homo Sapiens
gaggaagccggccgcuccugugagggaggccgggcccgggcaccugagggcuucucccucugga

SEQ ID NO: 246229 - RNA, 64 nt, Homo Sapiens
cagggcaggcgcauccagcaugucaguguccugccccgggcagcucucccucccgggcacgcuc

SEQ ID NO: 246230 - RNA, 64 nt, Homo Sapiens
gcaugucaguguccugccccgggcagcucucccucccgggcacgcucccucuggccugguggau

SEQ ID NO: 246231 - RNA, 64 nt, Homo Sapiens
accguaccccugcccccagcaaacauuaaggguacccgggcacaacugacucccccaucagcuc

SEQ ID NO: 246232 - RNA, 64 nt, Homo Sapiens
ucugggcccaggcaccucugccagccacugcccucccgggcagacagccccugccaggccaagc

SEQ ID NO: 246233 - RNA, 64 nt, Homo Sapiens
gucaugcccagcuuggaguggccgcugcccacgucccgggcacuccagcuuggagugccacaug

SEQ ID NO: 246234 - RNA, 64 nt, Homo Sapiens
gucaugcccagcuuggaguggccgcugcccacgucccgggcacuccagcuuggagugccacgug

SEQ ID NO: 246235 - RNA, 64 nt, Homo Sapiens
gacacagguaacugagccccaacaccacucggaucccgggcaagaccagauggagaggauguuc

SEQ ID NO: 246236 - RNA, 64 nt, Homo Sapiens
ucucagcauggccaucuucuccagaccccgcagacccgggcacuuccaauagguguggccccua

SEQ ID NO: 246237 - RNA, 64 nt, Homo Sapiens; identical to SEQ ID NO: 172497

SEQ ID NO: 246238 - RNA, 64 nt, Homo Sapiens; identical to SEQ ID NO: 172498

SEQ ID NO: 246239 - RNA, 64 nt, Homo Sapiens
cccaucuggagagaagcuuccagaccagcccuucacacaccacagccaggaggggccuuuccca

SEQ ID NO: 246240 - RNA, 64 nt, Homo Sapiens
cuuucccgccuggaaacuuccggacaagccucucacacaccacagccaggagaggccuuuccca

SEQ ID NO: 246241 - RNA, 64 nt, Homo Sapiens
uuucugccuggagagaaacuuucagaccagccccacacaccacagccaggagaggccguuccug

SEQ ID NO: 246242 - RNA, 64 nt, Homo Sapiens
uauaauauauacacacagauacaaguguacacacacacaccacacaccacacacaccccacugg

SEQ ID NO: 246243 - RNA, 64 nt, Homo Sapiens
uauacacacagauacaaguguacacacacacaccacacaccacacacaccccacuggcagucuu

SEQ ID NO: 246244 - RNA, 64 nt, Homo Sapiens
acauacacagacacacacaguccccgccacagagacacaccauuacacaaucacacgcagcccc

SEQ ID NO: 246245 - RNA, 64 nt, Homo Sapiens
acacacacauacacagaaaguuccggccacagaaacacaccauuacgcaaucgcagauacgccc

SEQ ID NO: 246246 - RNA, 64 nt, Homo Sapiens
acauacacagacacgcaaucuccccgccacagagacacaccauuacaaaaucacacacacaccc

SEQ ID NO: 246247 - RNA, 64 nt, Homo Sapiens
caucucaccacaccacagcacaccucaccacacaacacaccacaccccacaccgcacugcaccg

SEQ ID NO: 246248 - RNA, 64 nt, Homo Sapiens
acacgcaaaagaugacgcccagcacagcagcaggacacaccaugugccaggaaaugaccucagc

SEQ ID NO: 246249 - RNA, 64 nt, Homo Sapiens
uacaccacacacacacguucuacacaccacacacacacaccacauccuugaggauagacagaua

SEQ ID NO: 246250 - RNA, 64 nt, Homo Sapiens
cacacacaccacauacaccaggauagacagauauacacaccacaugagaucaggcaguccuuga

SEQ ID NO: 246251 - RNA, 64 nt, Homo Sapiens
acuccaagucucugugagcagugacuugaaccaaacacaccaggaauaauccauucuuuggggc

SEQ ID NO: 246252 - RNA, 64 nt, Homo Sapiens
gcuucuggggcuggcaaaaaccuucucugaacccacacaccaaguucguaguugguaggugccc

SEQ ID NO: 246253 - RNA, 64 nt, Homo Sapiens
ccuaggucagcgugcagagcagugaugcuggaggacacaccauggggugaagccaucccaaggc

SEQ ID NO: 246254 - RNA, 64 nt, Homo Sapiens
uccauguggcuuuaugugaggggacugaaugcagacacaccauagcccccuucuacuacuuucc

SEQ ID NO: 246255 - RNA, 64 nt, Homo Sapiens
guuuaauuuccgauuuuuuccucugcauuuacacacacaccacacacgcacacacacacaccaa

SEQ ID NO: 246256 - RNA, 64 nt, Homo Sapiens
ucugcauuuacacacacaccacacacgcacacacacacaccaaguaccaguauaagcaucuccc

SEQ ID NO: 246257 - RNA, 64 nt, Homo Sapiens
gaguguuuaauuucagacuucuuccucugcauuuacacaccacacaacacacacacacacacac

SEQ ID NO: 246258 - RNA, 64 nt, Homo Sapiens
auuuacacaccacacaacacacacacacacacacacacaccaaguaccauuauaagcaucuccc

SEQ ID NO: 246259 - RNA, 64 nt, Homo Sapiens
uaccaguauaagcaucucccacacacgcacacacacacaccaagucugcauuuacacacacacc

SEQ ID NO: 246260 - RNA, 64 nt, Homo Sapiens
cacgcacacacacacaccaacucugcauuuacacacacaccacaguuuaauuuccgauuuuuuc

SEQ ID NO: 246261 - RNA, 64 nt, Homo Sapiens
uaccaguauaagcaucucccacacacacacacagacacaccaagacaaacacacacacacagac

SEQ ID NO: 246262 - RNA, 64 nt, Homo Sapiens
cacacaaacacacacacacauccccucugcauuuacacaccagagaguguuuaauuuccgauuu

SEQ ID NO: 246263 - RNA, 64 nt, Homo Sapiens
uuuacagagaugacacaguaucaaaauauucucauauacccagaaauaaugaauauuguugagu

SEQ ID NO: 246264 - RNA, 64 nt, Homo Sapiens
guguggcaaucagccccuacuuucaucucucugauauacccaauuuaaugauaaucauuuuauu

SEQ ID NO: 246265 - RNA, 64 nt, Homo Sapiens
uuaggaauuauuuuguuguuacguuuuggugaguuauacccauuuuauuuauuuagaaaaauag

SEQ ID NO: 246266 - RNA, 64 nt, Homo Sapiens
ccucaucaaaccaaaggcacagauuuguguacaauauacccauugaauguauauccugagaaaa

SEQ ID NO: 246267 - RNA, 64 nt, Homo Sapiens
uccaucucuaaguaaaaaaauacaacaguagaaauauacccaugauaauauacccaauauaccc

SEQ ID NO: 246268 - RNA, 64 nt, Homo Sapiens
aaaaaauacaacaguagaaauauacccaugauaauauacccaauauacccuuguuaaagaagca

SEQ ID NO: 246269 - RNA, 64 nt, Homo Sapiens
uggcggguagacaagggaugccugggcugacugggcagaggaaccucuagcucugacugucacu

SEQ ID NO: 246270 - RNA, 64 nt, Homo Sapiens
acccccucaccccacccggggcucacucagccuggcagaggaagaaggaaggcagacaucuccg

SEQ ID NO: 246271 - RNA, 64 nt, Homo Sapiens
ucagggcugggcagguccuggggaggcugagacugcagaggagccaccugggcugggagaaggu

SEQ ID NO: 246272 - RNA, 64 nt, Homo Sapiens
gcgccccugggguggguuuagcaggcugcagcaggcagaggagaguaccccccugagagcaugu

SEQ ID NO: 246273 - RNA, 64 nt, Homo Sapiens
aucagaaaugagcccuucagucauucuuuguccagcagaggagaccucugagguuccaacucag

SEQ ID NO: 246274 - RNA, 64 nt, Homo Sapiens
uccucagcaaaggccugagcaggaggagcagacggcagaggaaaggugguggucaacgggaggg

SEQ ID NO: 246275 - RNA, 64 nt, Homo Sapiens
gugagcccccgccgcccccccagcccacagggaagcagaggaagacacugaggagcucugaacc

SEQ ID NO: 246276 - RNA, 64 nt, Homo Sapiens
acaaggcagcagaaagcgcgcucccagggcuggagcagaggaccugucaggggagccgcguucc

SEQ ID NO: 246277 - RNA, 51 nt, Homo Sapiens
ucccucuccucaccaucuaaggcagaggaugggaugugguggggcagggau

SEQ ID NO: 246278 - RNA, 64 nt, Homo Sapiens
acucagugggccuuggggccuagcccagcucugagcagaggacuguggcauucacuguccuuga

SEQ ID NO: 246279 - RNA, 64 nt, Homo Sapiens
agaggaggaaaggauggggggucagcuggucaaggcagaggagggcggugcugucugcugggag

SEQ ID NO: 246280 - RNA, 56 nt, Homo Sapiens
gguggucaggaugggcugggaagggggcagaggagggggagguggaggccacguag

SEQ ID NO: 246281 - RNA, 64 nt, Homo Sapiens
gugccuuggcaggagccaggacaaggcccuccuggcagaggagcaccuaggcagggcccagccc

SEQ ID NO: 246282 - RNA, 64 nt, Homo Sapiens
cugucugcauggccacugggcauguguguugggagcagaggaguccuacuccuugccucagccc

SEQ ID NO: 246283 - RNA, 64 nt, Homo Sapiens
ccaugguggcaugggucagcagagcauggagcaggcagaggaagccuaucuguggggcugggua

SEQ ID NO: 246284 - RNA, 64 nt, Homo Sapiens
cuuuguauuuauuggcuucagccuuuguuacaaggcagaggaagccagggcccuaugccaaccu

SEQ ID NO: 246285 - RNA, 64 nt, Homo Sapiens
gauagcugcuccccaucccacgcaagugaagccagcagaggaguuugccagcuagaggccgcca

SEQ ID NO: 246286 - RNA, 64 nt, Homo Sapiens
cccuccaaacacugguucccaugcccuucagauagcagaggacaggggggcaccccccccaugg

SEQ ID NO: 246287 - RNA, 64 nt, Homo Sapiens
acauucaggucucagggcagccagcgagagcacagcagaggacgccugguucaggaccucuacc

SEQ ID NO: 246288 - RNA, 64 nt, Homo Sapiens
gucuggcaggggcugcucaguuaggcagaggagugcagaggagguccagggcuugggccgugac

SEQ ID NO: 246289 - RNA, 64 nt, Homo Sapiens
gcagaggagggucuggcagggggccgugacuuaggcagaggagucuccuacguguccagggcuu

SEQ ID NO: 246290 - RNA, 64 nt, Homo Sapiens
aggguuuccagaguugcuagaaaugacuagagaggcagaggagaugaagaucacuuugucuugg

SEQ ID NO: 246291 - RNA, 64 nt, Homo Sapiens
gagaagcucuggggagccagcuccuaugcacagagcagaggaggcccaccccagccaggugucc

SEQ ID NO: 246292 - RNA, 64 nt, Homo Sapiens
aaugggggcucauugugagggaggugcagaggcagcagaggauuggcauaaaacugaaaaggag

SEQ ID NO: 246293 - RNA, 64 nt, Homo Sapiens
auaagguggaauuugcaggucagcccaggaauuggcagaggaaguaggugucugauaacccuuu

SEQ ID NO: 246294 - RNA, 64 nt, Homo Sapiens
acucugcugauguucgguccagacauuuuugggagcagaggaaagggaacaguucuagggagug

SEQ ID NO: 246295 - RNA, 64 nt, Homo Sapiens
ugcaauuuagcaggagguccaucaugaaacuggagcagaggaaucuugagaaauccuccuuggu

SEQ ID NO: 246296 - RNA, 64 nt, Homo Sapiens
aggagucaagggagcagggcauuuuccugccuuggcagaggaggccauccaugaccagaggauu

SEQ ID NO: 246297 - RNA, 64 nt, Homo Sapiens
guggcucuguuuccccaaggagccagaagugggggcagaggagguuugagcaggggagugaggc

SEQ ID NO: 246298 - RNA, 64 nt, Homo Sapiens
gacuccaaccgggguagccgcgaggaaggcgcuggcagaggacagaaauguccagucaccuccg

SEQ ID NO: 246299 - RNA, 64 nt, Homo Sapiens
cacaucuacucaacuauccgaauauguccauuucgcagaggaggaaagugaggcccagggagug

SEQ ID NO: 246300 - RNA, 64 nt, Homo Sapiens
aacauuccugcaaacagguuuuucucagcuucaggcagaggagacaacauggaagaagauuccc

SEQ ID NO: 246301 - RNA, 64 nt, Homo Sapiens
aauaugaggaaaaauaucuugagcuaagaaaguagcagaggaaauuucacaugcaaagccacag

SEQ ID NO: 246302 - RNA, 64 nt, Homo Sapiens; identical to SEQ ID NO: 196485

SEQ ID NO: 246303 - RNA, 64 nt, Homo Sapiens; identical to SEQ ID NO: 196486

SEQ ID NO: 246304 - RNA, 64 nt, Homo Sapiens; identical to SEQ ID NO: 196487

SEQ ID NO: 246305 - RNA, 64 nt, Homo Sapiens; identical to SEQ ID NO: 196488

SEQ ID NO: 246306 - RNA, 64 nt, Homo Sapiens; identical to SEQ ID NO: 196489

SEQ ID NO: 246307 - RNA, 64 nt, Homo Sapiens; identical to SEQ ID NO: 196490

SEQ ID NO: 246308 - RNA, 64 nt, Homo Sapiens; identical to SEQ ID NO: 196491

SEQ ID NO: 246309 - RNA, 64 nt, Homo Sapiens; identical to SEQ ID NO: 196492

SEQ ID NO: 246310 - RNA, 64 nt, Homo Sapiens; identical to SEQ ID NO: 196493

SEQ ID NO: 246311 - RNA, 64 nt, Homo Sapiens; identical to SEQ ID NO: 196494

SEQ ID NO: 246312 - RNA, 64 nt, Homo Sapiens; identical to SEQ ID NO: 196495

SEQ ID NO: 246313 - RNA, 64 nt, Homo Sapiens; identical to SEQ ID NO: 196496

SEQ ID NO: 246314 - RNA, 64 nt, Homo Sapiens; identical to SEQ ID NO: 196497

SEQ ID NO: 246315 - RNA, 64 nt, Homo Sapiens; identical to SEQ ID NO: 196498

SEQ ID NO: 246316 - RNA, 64 nt, Homo Sapiens; identical to SEQ ID NO: 196499

SEQ ID NO: 246317 - RNA, 64 nt, Homo Sapiens; identical to SEQ ID NO: 196500

SEQ ID NO: 246318 - RNA, 64 nt, Homo Sapiens; identical to SEQ ID NO: 196501

SEQ ID NO: 246319 - RNA, 64 nt, Homo Sapiens; identical to SEQ ID NO: 196502

SEQ ID NO: 246320 - RNA, 64 nt, Homo Sapiens; identical to SEQ ID NO: 196503

SEQ ID NO: 246321 - RNA, 64 nt, Homo Sapiens; identical to SEQ ID NO: 196504

SEQ ID NO: 246322 - RNA, 64 nt, Homo Sapiens; identical to SEQ ID NO: 196505

SEQ ID NO: 246323 - RNA, 64 nt, Homo Sapiens; identical to SEQ ID NO: 196506

SEQ ID NO: 246324 - RNA, 64 nt, Homo Sapiens; identical to SEQ ID NO: 196507

SEQ ID NO: 246325 - RNA, 64 nt, Homo Sapiens; identical to SEQ ID NO: 196508

SEQ ID NO: 246326 - RNA, 64 nt, Homo Sapiens; identical to SEQ ID NO: 196509

SEQ ID NO: 246327 - RNA, 64 nt, Homo Sapiens; identical to SEQ ID NO: 196510

SEQ ID NO: 246328 - RNA, 64 nt, Homo Sapiens; identical to SEQ ID NO: 196511

SEQ ID NO: 246329 - RNA, 64 nt, Homo Sapiens; identical to SEQ ID NO: 196512

SEQ ID NO: 246330 - RNA, 64 nt, Homo Sapiens; identical to SEQ ID NO: 196513

SEQ ID NO: 246331 - RNA, 64 nt, Homo Sapiens; identical to SEQ ID NO: 196514

SEQ ID NO: 246332 - RNA, 64 nt, Homo Sapiens; identical to SEQ ID NO: 196515

SEQ ID NO: 246333 - RNA, 64 nt, Homo Sapiens; identical to SEQ ID NO: 196516

SEQ ID NO: 246334 - RNA, 64 nt, Homo Sapiens; identical to SEQ ID NO: 196517

SEQ ID NO: 246335 - RNA, 64 nt, Homo Sapiens; identical to SEQ ID NO: 196518

SEQ ID NO: 246336 - RNA, 64 nt, Homo Sapiens; identical to SEQ ID NO: 196519

SEQ ID NO: 246337 - RNA, 64 nt, Homo Sapiens; identical to SEQ ID NO: 196520

SEQ ID NO: 246338 - RNA, 64 nt, Homo Sapiens; identical to SEQ ID NO: 196521

SEQ ID NO: 246339 - RNA, 64 nt, Homo Sapiens; identical to SEQ ID NO: 196522

SEQ ID NO: 246340 - RNA, 64 nt, Homo Sapiens; identical to SEQ ID NO: 196523

SEQ ID NO: 246341 - RNA, 64 nt, Homo Sapiens; identical to SEQ ID NO: 196524

SEQ ID NO: 246342 - RNA, 64 nt, Homo Sapiens; identical to SEQ ID NO: 196525

SEQ ID NO: 246343 - RNA, 64 nt, Homo Sapiens; identical to SEQ ID NO: 196526

SEQ ID NO: 246344 - RNA, 64 nt, Homo Sapiens; identical to SEQ ID NO: 196527

SEQ ID NO: 246345 - RNA, 64 nt, Homo Sapiens; identical to SEQ ID NO: 196528

SEQ ID NO: 246346 - RNA, 64 nt, Homo Sapiens; identical to SEQ ID NO: 196529

SEQ ID NO: 246347 - RNA, 64 nt, Homo Sapiens; identical to SEQ ID NO: 196530

SEQ ID NO: 246348 - RNA, 64 nt, Homo Sapiens; identical to SEQ ID NO: 196531

SEQ ID NO: 246349 - RNA, 64 nt, Homo Sapiens; identical to SEQ ID NO: 196532

SEQ ID NO: 246350 - RNA, 64 nt, Homo Sapiens; identical to SEQ ID NO: 196533

SEQ ID NO: 246351 - RNA, 64 nt, Homo Sapiens; identical to SEQ ID NO: 196534

SEQ ID NO: 246352 - RNA, 64 nt, Homo Sapiens; identical to SEQ ID NO: 196535

SEQ ID NO: 246353 - RNA, 64 nt, Homo Sapiens; identical to SEQ ID NO: 196536

SEQ ID NO: 246354 - RNA, 64 nt, Homo Sapiens; identical to SEQ ID NO: 196537

SEQ ID NO: 246355 - RNA, 64 nt, Homo Sapiens; identical to SEQ ID NO: 196538

SEQ ID NO: 246356 - RNA, 64 nt, Homo Sapiens; identical to SEQ ID NO: 196539

SEQ ID NO: 246357 - RNA, 64 nt, Homo Sapiens; identical to SEQ ID NO: 196540

SEQ ID NO: 246358 - RNA, 64 nt, Homo Sapiens; identical to SEQ ID NO: 196541

SEQ ID NO: 246359 - RNA, 64 nt, Homo Sapiens; identical to SEQ ID NO: 196542

SEQ ID NO: 246360 - RNA, 64 nt, Homo Sapiens; identical to SEQ ID NO: 196543

SEQ ID NO: 246361 - RNA, 64 nt, Homo Sapiens; identical to SEQ ID NO: 196544

SEQ ID NO: 246362 - RNA, 64 nt, Homo Sapiens; identical to SEQ ID NO: 196545

SEQ ID NO: 246363 - RNA, 64 nt, Homo Sapiens; identical to SEQ ID NO: 196546

SEQ ID NO: 246364 - RNA, 64 nt, Homo Sapiens; identical to SEQ ID NO: 196547

SEQ ID NO: 246365 - RNA, 64 nt, Homo Sapiens; identical to SEQ ID NO: 196548

SEQ ID NO: 246366 - RNA, 64 nt, Homo Sapiens; identical to SEQ ID NO: 196549

SEQ ID NO: 246367 - RNA, 64 nt, Homo Sapiens; identical to SEQ ID NO: 196550

SEQ ID NO: 246368 - RNA, 64 nt, Homo Sapiens; identical to SEQ ID NO: 196551

SEQ ID NO: 246369 - RNA, 64 nt, Homo Sapiens; identical to SEQ ID NO: 196551

SEQ ID NO: 246370 - RNA, 64 nt, Homo Sapiens; identical to SEQ ID NO: 196553

SEQ ID NO: 246371 - RNA, 64 nt, Homo Sapiens; identical to SEQ ID NO: 196554

SEQ ID NO: 246372 - RNA, 64 nt, Homo Sapiens; identical to SEQ ID NO: 196555

SEQ ID NO: 246373 - RNA, 64 nt, Homo Sapiens; identical to SEQ ID NO: 196556

SEQ ID NO: 246374 - RNA, 64 nt, Homo Sapiens; identical to SEQ ID NO: 196557

SEQ ID NO: 246375 - RNA, 64 nt, Homo Sapiens; identical to SEQ ID NO: 196558

SEQ ID NO: 246376 - RNA, 64 nt, Homo Sapiens; identical to SEQ ID NO: 196559

SEQ ID NO: 246377 - RNA, 64 nt, Homo Sapiens; identical to SEQ ID NO: 196560

SEQ ID NO: 246378 - RNA, 64 nt, Homo Sapiens; identical to SEQ ID NO: 196561

SEQ ID NO: 246379 - RNA, 64 nt, Homo Sapiens; identical to SEQ ID NO: 196562

SEQ ID NO: 246380 - RNA, 64 nt, Homo Sapiens; identical to SEQ ID NO: 196563

SEQ ID NO: 246381 - RNA, 64 nt, Homo Sapiens; identical to SEQ ID NO: 196564

SEQ ID NO: 246382 - RNA, 64 nt, Homo Sapiens; identical to SEQ ID NO: 196565

SEQ ID NO: 246383 - RNA, 64 nt, Homo Sapiens; identical to SEQ ID NO: 196566

SEQ ID NO: 246384 - RNA, 64 nt, Homo Sapiens; identical to SEQ ID NO: 196567

SEQ ID NO: 246385 - RNA, 64 nt, Homo Sapiens; identical to SEQ ID NO: 196568

SEQ ID NO: 246386 - RNA, 64 nt, Homo Sapiens; identical to SEQ ID NO: 196569

SEQ ID NO: 246387 - RNA, 64 nt, Homo Sapiens; identical to SEQ ID NO: 196570

SEQ ID NO: 246388 - RNA, 64 nt, Homo Sapiens; identical to SEQ ID NO: 196571

SEQ ID NO: 246389 - RNA, 64 nt, Homo Sapiens; identical to SEQ ID NO: 196572

SEQ ID NO: 246390 - RNA, 60 nt, Homo Sapiens
gucuauaauugcagauguuauuguaugaauguaccauaauauauuugagcagucccugcu

SEQ ID NO: 246391 - RNA, 60 nt, Homo Sapiens
uucugaaguccaaaaaauuaucauuacaguguaccauauuaagccaugugaauaaguagu

SEQ ID NO: 246392 - RNA, 60 nt, Homo Sapiens
ucuugaauuauuuugcagacuagugagucuguaccauaaguauuaaucaccuccacucau

SEQ ID NO: 246393 - RNA, 60 nt, Homo Sapiens
ggggggaaaggugguauuuucccuccauguguaccauagacucugucuucaacucuuuga

SEQ ID NO: 246394 - RNA, 60 nt, Homo Sapiens
uaauaaagcaggguacagaucaaauuuacaguaccauaacguuaaauuugcaaugagaag

SEQ ID NO: 246395 - RNA, 60 nt, Homo Sapiens
aaauccaaacucucaauuacaaaucggaauguaccauaauguaccuuauguauuaaauag

SEQ ID NO: 246396 - RNA, 60 nt, Homo Sapiens
ccaguuuuaaagaacuggcaucuguaccuaguaccauauucuuuccuaccccuuuagccu

SEQ ID NO: 246397 - RNA, 60 nt, Homo Sapiens
cugauguaaaaaucaugcuguaauguuaugguaccauauaacuaaauggaacccaaauau

SEQ ID NO: 246398 - RNA, 60 nt, Homo Sapiens
gugugcuccagcaaauguccuuugugauguguaccauacuaaagcaaucaauuguauauu

SEQ ID NO: 246399 - RNA, 60 nt, Homo Sapiens
aauuucucuauccugcucugaggcuaauugguaccauauuuucccuuugugucuugugac

SEQ ID NO: 246400 - RNA, 60 nt, Homo Sapiens
uuccuugguaucugaaaaaaauaccaaauaguaccauacaugaguuauuucuaaguuuga

SEQ ID NO: 246401 - RNA, 60 nt, Homo Sapiens
cugugaauuuugaaguuaaacuaaauuuugguaccauaccaacuggaauuuaggcuuuaa

SEQ ID NO: 246402 - RNA, 60 nt, Homo Sapiens
gcuuuuuuccccuuccuaaauguuuuaauuguaccauaguguuuugcucacugaagaagc

SEQ ID NO: 246403 - RNA, 60 nt, Homo Sapiens
aucuagacuuaauauauuguguguaugcauguaccauaacggguauaaaacagccugaaa

SEQ ID NO: 246404 - RNA, 60 nt, Homo Sapiens
aacuggaauuuaggcuuuaacuaaauuuugguaccauacccugugaauuuugaaguuaaa

SEQ ID NO: 246405 - RNA, 60 nt, Homo Sapiens
gcaaaacuuuuaaacuacagguuuuacacuguaccauauauggaauuuauaauucaguau

SEQ ID NO: 246406 - RNA, 60 nt, Homo Sapiens
agugacgcaaaucugcaugaacagcuaauuguaccauaguguucauugauacaaucauag

SEQ ID NO: 246407 - RNA, 60 nt, Homo Sapiens
cauaaagccacaacuccuacaugauguuauguaccauaugaucuguuuuguaucuuaaau

SEQ ID NO: 246408 - RNA, 60 nt, Homo Sapiens
gaggccuaagaauuuccuaagccaugucuuguaccauagugccacauugaugacuuguuu

SEQ ID NO: 246409 - RNA, 58 nt, Homo Sapiens
aacuugaauaccaacucuucagagaagcagguaccauaucuuacuucucuucccauua

SEQ ID NO: 246410 - RNA, 60 nt, Homo Sapiens
augauaccagaugaaaagaaggagaaguguguaccauauguuuugagcagaggacccucc

SEQ ID NO: 246411 - RNA, 60 nt, Homo Sapiens
aaucccuuaagccucucaaaacacuaaaauguaccauacacacuagauguuaucaaucaa

SEQ ID NO: 246412 - RNA, 60 nt, Homo Sapiens
uaaguugaacugcucugcauugguauugaaguaccauauuucaaacaauguagcauaaag

SEQ ID NO: 246413 - RNA, 60 nt, Homo Sapiens
gaucaaaagcuuuguaaccaaccucacuugguaccauauaccuuagucuuggucaucaga

SEQ ID NO: 246414 - RNA, 60 nt, Homo Sapiens
gugugaugacuuuuuuuuaaaugagguucaguaccauaauguuuauuuacuggaagauaa

SEQ ID NO: 246415 - RNA, 60 nt, Homo Sapiens
auguauuauuaaauguuagauaaauggguaguaccauacuacaaauauuuaaaugcaaaa

SEQ ID NO: 246416 - RNA, 60 nt, Homo Sapiens
accugaacaccagaauuagaauuaaacauuguaccauacaauuucauuaucuuaucagaa

SEQ ID NO: 246417 - RNA, 60 nt, Homo Sapiens
gagacugagaaugacucaagggacgucauaguaccauaguuuuaaggaccaaggugugcc

SEQ ID NO: 246418 - RNA, 60 nt, Homo Sapiens
gugaaaugcugggaacaauguuuuuguuugguaccauaguuuucaaaaaagaaaaugugu

SEQ ID NO: 246419 - RNA, 60 nt, Homo Sapiens
ucugguagcuaaauauauauuuuauuaggaguaccauaauauaugcuauuuauuaaguau

SEQ ID NO: 246420 - RNA, 60 nt, Homo Sapiens
cguuuauuuaacauauauuuugcaaaauuuguaccauaacuguggcucaccugaaggcuu

SEQ ID NO: 246421 - RNA, 60 nt, Homo Sapiens
gggaacaaucuguuucugauagguacaauuguaccauaaacucagguauaaagccaauua

SEQ ID NO: 246422 - RNA, 60 nt, Homo Sapiens
gcucuuaaaaaucuugguuuucuuauuuuuguaccauauuaguccaaauugucugucugc

SEQ ID NO: 246423 - RNA, 60 nt, Homo Sapiens
ccuuauguuaugccacagaauuuaguaaaaguaccauaaauuuggucauuauaagugacu

SEQ ID NO: 246424 - RNA, 60 nt, Homo Sapiens
ccuagacuagacaugcgaaaguuugccuuuguaccauauaaagggggagggaaauagcua

SEQ ID NO: 246425 - RNA, 60 nt, Homo Sapiens
aagucuacuuuugaagaggaaaacaggaacguaccauauauuuugcuaaggguaaaauau

SEQ ID NO: 246426 - RNA, 60 nt, Homo Sapiens
agagagggaaagaauguugcaccugcucuaguaccauaggucaagaggcuucuggaucac

SEQ ID NO: 246427 - RNA, 60 nt, Homo Sapiens
uugcuaauaccaacuauuucaauaaguguuguaccauauguagcauuaaauauaaaauac

SEQ ID NO: 246428 - RNA, 60 nt, Homo Sapiens
cagcauuugauuuccauggguucccuugcuguaccauauuggagagaaaagcuggaccuu

SEQ ID NO: 246429 - RNA, 60 nt, Homo Sapiens
uuuauaagucaguggucugaaucuauaugaguaccauauuuuccuucuuuauaaugcuaa

SEQ ID NO: 246430 - RNA, 60 nt, Homo Sapiens
aauacccagcacaauacuuguauauuuuuaguaccauacagaaguaaaaucccaggaacu

SEQ ID NO: 246431 - RNA, 60 nt, Homo Sapiens
aaauucaaaauacuuuuuaaggauggcacaguaccauauaacuggaguaauaaaacauga

SEQ ID NO: 246432 - RNA, 60 nt, Homo Sapiens
cccauuccaguguuacuuucugugaaugcaguaccauauucucauuuucaaugacauuuc

SEQ ID NO: 246433 - RNA, 60 nt, Homo Sapiens
uacagaaccugucaucuguagcucaguucaguaccauaaccuaguuuuggcugacaggaa

SEQ ID NO: 246434 - RNA, 60 nt, Homo Sapiens
gccuuucuuugcauggcuuguagauauaguguaccauacuaugccaagcguaugauacua

SEQ ID NO: 246435 - RNA, 60 nt, Homo Sapiens
uguaacuaucaacuuuuaaaaaauuguuacguaccauauuuuguacugaaauaaaguaga

SEQ ID NO: 246436 - RNA, 60 nt, Homo Sapiens
uuuuguaaauuauuuauguuuauuuagaauguaccauauugggagugacgaugaugugag

SEQ ID NO: 246437 - RNA, 60 nt, Homo Sapiens
auuuauuuauuguaauaccucacagacguuguaccauauccaugcacauuuaguugccug

SEQ ID NO: 246438 - RNA, 60 nt, Homo Sapiens
uuuaaaucuugaccuuaagauugauuucaaguaccauacuguaguacagauaaguggcuc

SEQ ID NO: 246439 - RNA, 60 nt, Homo Sapiens
guauuguaagugaaauguaauuauuucuguguaccauauggaguaacuaaggucauuguu

SEQ ID NO: 246440 - RNA, 60 nt, Homo Sapiens
cacgacaguggcaccaccugauuucaugauguaccauaugcaguaacccauguuugaggu

SEQ ID NO: 246441 - RNA, 60 nt, Homo Sapiens
aauuugggguucuaaauauauuggagcauaguaccauagauauaaacaucacacuuuaau

SEQ ID NO: 246442 - RNA, 60 nt, Homo Sapiens
auucuacuguaacuacccauuuuuuucccuguaccauacauccucccccuaugcauuggu

SEQ ID NO: 246443 - RNA, 60 nt, Homo Sapiens
caaagugauuauugauauaguggugcauauguaccauauucugacaaucugucuuaaaau

SEQ ID NO: 246444 - RNA, 60 nt, Homo Sapiens
ccccacuuccagugacugcucuuauuuuguguaccauaagccaacaaccgcugacuccag

SEQ ID NO: 246445 - RNA, 60 nt, Homo Sapiens
gaaggaacuuuaaaagcaacaagcaauuauguaccauauauacacuguagcaaauauuuu

SEQ ID NO: 246446 - RNA, 60 nt, Homo Sapiens
uaguuaaauggaauguugguaugguacagaguaccauauugcuaagaaaacugucuuaua

SEQ ID NO: 246447 - RNA, 60 nt, Homo Sapiens
cugucguaccaucuagaacuauacuguccaguaccauagccucuagccguauguagcuau

SEQ ID NO: 246448 - RNA, 60 nt, Homo Sapiens
agacuuuuggaagaggauauauauagcauaguaccauaccacuuauaaaguggaaacucu

SEQ ID NO: 246449 - RNA, 60 nt, Homo Sapiens
cuaaaaugaaauaagaacucguugcacuauguaccauacuucgaaccucuacauugugaa

SEQ ID NO: 246450 - RNA, 60 nt, Homo Sapiens
gcugcucuuaugccauuuguacaguauucuguaccauagccaaaaaaaauuuaaaaaaau

SEQ ID NO: 246451 - RNA, 60 nt, Homo Sapiens
uuguuuuguuuuguucugaagagaagagugguaccauauguugcaggaagucaaacugga

SEQ ID NO: 246452 - RNA, 60 nt, Homo Sapiens
cugagucacaacauguuuuagagcauccaaguaccauauaauccaacuaucaugguaagg

SEQ ID NO: 246453 - RNA, 60 nt, Homo Sapiens
accuuuuagaaaaagauucuuguugcaaaaguaccauaggcaguguguguguaaggucau

SEQ ID NO: 246454 - RNA, 60 nt, Homo Sapiens
uuucaauuguagaaacaacugguauguacaguaccauaauuuaauuacauuuuacuuuaa

SEQ ID NO: 246455 - RNA, 60 nt, Homo Sapiens
gaguuauugguaugacccugauuauaucuaguaccauacuaauuguagcuaacaauccua

SEQ ID NO: 246456 - RNA, 60 nt, Homo Sapiens
gcaggacgucaguuuuggugguaugaagcuguaccauaauguauuugagaugaacucuga

SEQ ID NO: 246457 - RNA, 60 nt, Homo Sapiens
aguucauuuaaacugcaccuuccauaucaaguaccauauggagaagaaaaaaagcuucuu

SEQ ID NO: 246458 - RNA, 60 nt, Homo Sapiens
uguuuaaucgccaaaaacacacuggccaguguaccauaauauguuaccagaagaguuauu

SEQ ID NO: 246459 - RNA, 60 nt, Homo Sapiens
acauguaaaauuaaaaaaacuauuagaacuguaccauaauuauguugaagguagaaguga

SEQ ID NO: 246460 - RNA, 60 nt, Homo Sapiens
uugaaaaacaguugauuugggggcacuuagguaccauaugccccauucccaaagggcaca

SEQ ID NO: 246461 - RNA, 60 nt, Homo Sapiens
cuauaacuugccaaaguagaagaaauaguaguaccauaugccaaagugauagagaugaau

SEQ ID NO: 246462 - RNA, 60 nt, Homo Sapiens
uguuuucucuuuucuaaaagacaaauuaugguaccauaagcugccaaagauccccuccug

SEQ ID NO: 246463 - RNA, 60 nt, Homo Sapiens
ucaagauugcauuuucuuaaugaagcccuaguaccauaauugacucuuuacugcucugcc

SEQ ID NO: 246464 - RNA, 60 nt, Homo Sapiens
caguuuccagaugggccacaucuccccaaaguaccauagcuugucguccuguccuuccua

SEQ ID NO: 246465 - RNA, 60 nt, Homo Sapiens
aauuuucugugaugauguauauuuaaauuaguaccauaucgcuacauaaaacauuucagg

SEQ ID NO: 246466 - RNA, 60 nt, Homo Sapiens
auuuuccuuuaauuucucuggaguaauacuguaccauacuggucuuugcuuuuaguaaua

SEQ ID NO: 246467 - RNA, 60 nt, Homo Sapiens
gcuugccccaucuauuuaugucuccgcuuuguaccauaaccgaacccacggaaagacgcu

SEQ ID NO: 246468 - RNA, 60 nt, Homo Sapiens
cuauuuauucccuaauguaccugaacacuaguaccauagaacugaaccaccaucuguauc

SEQ ID NO: 246469 - RNA, 60 nt, Homo Sapiens
gggacauuucauauuuauaaugugcugaagguaccauauuuuaaauguuauuuaaugcag

SEQ ID NO: 246470 - RNA, 60 nt, Homo Sapiens
ugacuugcgaaaaagcuuuugcccuguuguguaccauaacauuuaaaagaauggaaaaug

SEQ ID NO: 246471 - RNA, 60 nt, Homo Sapiens
gaagccggcucuucaaagacaauggaaacuguaccauacacauuggaaggcucccuaaca

SEQ ID NO: 246472 - RNA, 60 nt, Homo Sapiens
accccuuccuuuuuggugauuuacaccacuguaccauacugacccaggcugggggcaggu

SEQ ID NO: 246473 - RNA, 60 nt, Homo Sapiens
agcaaagacaaaauaauguuaaacaauucuguaccauaacauuuucuguaaugauacuga

SEQ ID NO: 246474 - RNA, 60 nt, Homo Sapiens
uagaccaagucagaaagaucucucucgagcguaccauaaaccugcagagagaagucucga

SEQ ID NO: 246475 - RNA, 60 nt, Homo Sapiens
cuuagagacaaaccuuaaaaccucccuccaguaccauaaucaaauugauugucuuucccc

SEQ ID NO: 246476 - RNA, 60 nt, Homo Sapiens
uaucaccuauucaaaaaaaauuugaauuuuguaccauauguguaucuccuuuuguauuuu

SEQ ID NO: 246477 - RNA, 60 nt, Homo Sapiens
aaaucaucuauuccuugggaaagguauuuuguaccauaugggacugaaaucauuucucug

SEQ ID NO: 246478 - RNA, 60 nt, Homo Sapiens
gcuaaauaaaacuguggcacuguuuguuauguaccauaauuuucauaauugagacagaac

SEQ ID NO: 246479 - RNA, 60 nt, Homo Sapiens
acuguggcuucagauuuaguagcuucuuguguaccauaguugugcuagcauaacugcucu

SEQ ID NO: 246480 - RNA, 60 nt, Homo Sapiens
cagaaugccugccuuuccugguuauuuuuuguaccauauuguaaauuauauuauuuauuc

SEQ ID NO: 246481 - RNA, 60 nt, Homo Sapiens
uaccgcugcauaguauuccauugugugaguguaccauaauguauuuaaccagucuucuuu

SEQ ID NO: 246482 - RNA, 60 nt, Homo Sapiens
aaauugguuggagaauuuagguuuuuauuaguaccauaguaccauuuauacaaauuagaa

SEQ ID NO: 246483 - RNA, 60 nt, Homo Sapiens
auacuguaaauuuacauacguugucuagaaguaccauaggguuuaaaaaccugggcuggc

SEQ ID NO: 246484 - RNA, 60 nt, Homo Sapiens
uacauugugagcucugguuauuuuucucuuguaccauagaaaaauguauaaaaauuauca

SEQ ID NO: 246485 - RNA, 60 nt, Homo Sapiens
ugaaacauucuggccauagcguaguuuaauguaccauauguucucauauuuaauuaucau

SEQ ID NO: 246486 - RNA, 60 nt, Homo Sapiens
ugcugggccagucccacacauccuggguguguaccauaccuguccugccucuggccugug

SEQ ID NO: 246487 - RNA, 60 nt, Homo Sapiens
ucaucaauacauccaccaaaaauauauaauguaccauauauauuaauagucaacaaauac

SEQ ID NO: 246488 - RNA, 60 nt, Homo Sapiens
aaaaaaaaauaccauaagaagaaucagaauguaccauaagaaaucagaugcaaagcacgu

SEQ ID NO: 246489 - RNA, 60 nt, Homo Sapiens
auacauaaccuugaauaaugaggaucaacuguaccauauuuaauaaagcacaaaacccac

SEQ ID NO: 246490 - RNA, 60 nt, Homo Sapiens
acuuguauuaucaaacuguuacauuguauuguaccauaaauuaauguauauuauucagaa

SEQ ID NO: 246491 - RNA, 60 nt, Homo Sapiens
agucucuguuccugcuguauuauacaaacuguaccauaguccugggaaaaggguggacuc

SEQ ID NO: 246492 - RNA, 60 nt, Homo Sapiens
cucugagugccuucuucccaaaagccagcaguaccauaccugcugucagcaaguguguaa

SEQ ID NO: 246493 - RNA, 60 nt, Homo Sapiens
uuuuaaaucacaagucuaauaauuauuaaaguaccauacggaauaacugucuacuguuua

SEQ ID NO: 246494 - RNA, 60 nt, Homo Sapiens
auuguuucuccgugugucuuuaaccacccaguaccauacuuuuuucuugaucuggaucua

SEQ ID NO: 246495 - RNA, 60 nt, Homo Sapiens
aaaaauaagccaacucugacuccuggcaauguaccauacagcuuauucugagacagacau

SEQ ID NO: 246496 - RNA, 60 nt, Homo Sapiens
auuguacuugccucuuuagccugggaggaaguaccauagcggagggaaggaggaugaguc

SEQ ID NO: 246497 - RNA, 60 nt, Homo Sapiens
cugccucggcucccuguggcgcccacacagguaccauaaguccccagcaccuccagguug

SEQ ID NO: 246498 - RNA, 60 nt, Homo Sapiens
gucaacugaauucacacacacacaaauauaguaccauagaaaaaguuuguuuucucgaaa

SEQ ID NO: 246499 - RNA, 60 nt, Homo Sapiens
acagaacugcuaaauacuguauguacaaaaguaccauagaaauuaguaauaaaacccagc

SEQ ID NO: 246500 - RNA, 60 nt, Homo Sapiens
gagguguaacacuugucaagguggucacuuguaccauauaagugucacucuguaguuacu

SEQ ID NO: 246501 - RNA, 60 nt, Homo Sapiens
uaacuuggcuaguugauuguuuguuuagauguaccauaauauuaggguuaguauuaaacu

SEQ ID NO: 246502 - RNA, 60 nt, Homo Sapiens
ucaccuuuuuauuauugacauuaaguaaugguaccauauauuuuuuaaaauacauauuga

SEQ ID NO: 246503 - RNA, 60 nt, Homo Sapiens
uguuucuuuguugccaguguuaccuuugcuguaccauagacuuaaaauuccucuauuguu

SEQ ID NO: 246504 - RNA, 60 nt, Homo Sapiens
caaauauccucuugggcccaaaugaacauuguaccauagucuucuggaaagcaaacaugc

SEQ ID NO: 246505 - RNA, 60 nt, Homo Sapiens
agaaaguugccuucagaagguaccaguucuguaccauaugccucccaucccccaggcugg

SEQ ID NO: 246506 - RNA, 60 nt, Homo Sapiens
caccuaaaagaugagagaauagauaaguaaguaccauacacagucagugggcaagaggaa

SEQ ID NO: 246507 - RNA, 60 nt, Homo Sapiens
acuuaaaggugauuuggauguuucaaguauguaccauaggcagugaguuucugcugucuu

SEQ ID NO: 246508 - RNA, 64 nt, Homo Sapiens
cucagaacccuuggagucauucuuuugccauaccaagggccagacuugcacagaauugcaaaug

SEQ ID NO: 246509 - RNA, 64 nt, Homo Sapiens
ugguaugcagcccauguauaucuuucaguugaauaagggccaguaacuuauuguucuuuucuau

SEQ ID NO: 246510 - RNA, 64 nt, Homo Sapiens
aggccgugggggcugcugaaggcucuuuccccgcaagggccagguguugacaccuuaaagcugg

SEQ ID NO: 246511 - RNA, 64 nt, Homo Sapiens
cugagucagccagauccucccccuacuucuccccaagggccaagaacugcucagggacauuaaa

SEQ ID NO: 246512 - RNA, 64 nt, Homo Sapiens
caccaagagccaauggaguagaccccuggcugguaagggccaagucccaccgguugcuucuggg

SEQ ID NO: 246513 - RNA, 64 nt, Homo Sapiens
cucacagacuggagacaaugcagaugccagagcaaagggccaggaagggucaaaacauuuuauu

SEQ ID NO: 246514 - RNA, 64 nt, Homo Sapiens
aggaagcaggcagggcuuaguucuauuaccuggaaagggccauagcauguggucaguuuccauu

SEQ ID NO: 246515 - RNA, 64 nt, Homo Sapiens
agccaagggcccuggccacgugcccugccccaugaagggccaccggucccaguucuguguagcu

SEQ ID NO: 246516 - RNA, 64 nt, Homo Sapiens
gccccucuuggcugccaagcccaaguccagcgugaagggccacaggccagaggguccaggcauc

SEQ ID NO: 246517 - RNA, 64 nt, Homo Sapiens
ggguccaggcaucccaagucccuucccgugugagaagggccagaccauucagggagaaaccucu

SEQ ID NO: 246518 - RNA, 64 nt, Homo Sapiens
uguuacugcagcaucugggcugccagccacagggaagggccaagccccauguagccccagucau

SEQ ID NO: 246519 - RNA, 64 nt, Homo Sapiens
cuguguccugaggugcauuuccuguuguacacacaagggccaggcuccauucucccucccuuuc

SEQ ID NO: 246520 - RNA, 64 nt, Homo Sapiens
cacaugccaucuucccugcgagcaaggcuucaggaagggccagccuguuagccagugguggagg

SEQ ID NO: 246521 - RNA, 64 nt, Homo Sapiens
aggugcaggguuaauacucucucuggagugguugaagggccacacaucggucucugaggugaca

SEQ ID NO: 246522 - RNA, 64 nt, Homo Sapiens
ccugcggcuggggccgucugccuacacgcuccagaagggccagcgcagagcugggauggccacu

SEQ ID NO: 246523 - RNA, 64 nt, Homo Sapiens
auggcugggcggcuggugagcaguccaggugcccaagggccagcuugcugcugcccaaagcaga

SEQ ID NO: 246524 - RNA, 64 nt, Homo Sapiens
gccacuggggcuugggggcgacccuggcuguacgaagggccaggcaguauagacagacagaugg

SEQ ID NO: 246525 - RNA, 64 nt, Homo Sapiens
augagcccaagauauccuucgagagaggcucccaaagggccacccacccagcaucagcccuggg

SEQ ID NO: 246526 - RNA, 64 nt, Homo Sapiens
cuuggaaguacucuugagaauuccaaaaucagccuucuggcagaaguaagcuaguguuucacau

SEQ ID NO: 246527 - RNA, 64 nt, Homo Sapiens
acauagauucaaauuacaguuauacccaagaagauucuggcaaacauuuaccaacuucugugaa

SEQ ID NO: 246528 - RNA, 64 nt, Homo Sapiens
uggaguggguguuguucaaguaucugugguuugguucuggcauuuuguucccaccauccccuuc

SEQ ID NO: 246529 - RNA, 64 nt, Homo Sapiens
uacagcuauuacugaauuauagaaacugguuuauuucuggcagaaagcugcagugccaccugag

SEQ ID NO: 246530 - RNA, 64 nt, Homo Sapiens
aagaucuuuguuuuuuguuuucauuaaagagccauucuggcacuuuaaugauaaaaucccauug

SEQ ID NO: 246531 - RNA, 64 nt, Homo Sapiens
cugcugggaauauccgugccaggaaaagaaaaauuucuggcaaauauuuugucacugcuguaaa

SEQ ID NO: 246532 - RNA, 64 nt, Homo Sapiens
agggggcagcccuugggagcuuguggguugaaacuucuggcaaaucucucugugacuggugauu

SEQ ID NO: 246533 - RNA, 64 nt, Homo Sapiens
uuguuguaauuauuccauuaaauugcaagagcauuucuggcauguuuacuaaauaauggccuga

SEQ ID NO: 246534 - RNA, 64 nt, Homo Sapiens
aucuggggacaaaggucaagccaguaaagaauacuucuggcagcacuuugggaggccaaggcgg

SEQ ID NO: 246535 - RNA, 64 nt, Homo Sapiens
gacucugucucaaaaaaaaaaaaaaaaaaaauacuucuggcagagucuuuuaucuuccuauuaa

SEQ ID NO: 246536 - RNA, 64 nt, Homo Sapiens
cuaucuuucauucuccacuccuaaucccucuccuuucuggcauccuggccucucgugguccuca

SEQ ID NO: 246537 - RNA, 64 nt, Homo Sapiens
agccaagcugaccuuggacccuguccagcacagcuucuggcacaggaugcuuggugaauguacc

SEQ ID NO: 246538 - RNA, 59 nt, Homo Sapiens
gcggcggcucccagcucugagggggcccauucuggcagcggcgccugcggccugaccac

SEQ ID NO: 246539 - RNA, 64 nt, Homo Sapiens
uuaaaccucucugccucuggaggagggugggguauucuggcaggaugaaucgcaggauggcgcg

SEQ ID NO: 246540 - RNA, 64 nt, Homo Sapiens
gaaauuguguuuuccccauuuauggugcucuguauucuggcauuaugcagcagccucccagaag

SEQ ID NO: 246541 - RNA, 64 nt, Homo Sapiens
gcugcccuuggcccugcaagcacaucaugacccuuucuggcagccucuuggugcucuggguagu

SEQ ID NO: 246542 - RNA, 64 nt, Homo Sapiens; identical to SEQ ID NO: 111305

SEQ ID NO: 246543 - RNA, 64 nt, Homo Sapiens; identical to SEQ ID NO: 111306

SEQ ID NO: 246544 - RNA, 64 nt, Homo Sapiens; identical to SEQ ID NO: 111307

SEQ ID NO: 246545 - RNA, 64 nt, Homo Sapiens; identical to SEQ ID NO: 111308

SEQ ID NO: 246546 - RNA, 64 nt, Homo Sapiens; identical to SEQ ID NO: 111309

SEQ ID NO: 246547 - RNA, 64 nt, Homo Sapiens; identical to SEQ ID NO: 111310

SEQ ID NO: 246548 - RNA, 64 nt, Homo Sapiens; identical to SEQ ID NO: 111311

SEQ ID NO: 246549 - RNA, 64 nt, Homo Sapiens; identical to SEQ ID NO: 111312

SEQ ID NO: 246550 - RNA, 64 nt, Homo Sapiens; identical to SEQ ID NO: 111313

SEQ ID NO: 246551 - RNA, 64 nt, Homo Sapiens; identical to SEQ ID NO: 111314

SEQ ID NO: 246552 - RNA, 64 nt, Homo Sapiens; identical to SEQ ID NO: 111315

SEQ ID NO: 246553 - RNA, 64 nt, Homo Sapiens; identical to SEQ ID NO: 111316

SEQ ID NO: 246554 - RNA, 64 nt, Homo Sapiens; identical to SEQ ID NO: 111317

SEQ ID NO: 246555 - RNA, 64 nt, Homo Sapiens; identical to SEQ ID NO: 111318

SEQ ID NO: 246556 - RNA, 64 nt, Homo Sapiens; identical to SEQ ID NO: 111319

SEQ ID NO: 246557 - RNA, 64 nt, Homo Sapiens; identical to SEQ ID NO: 111320

SEQ ID NO: 246558 - RNA, 64 nt, Homo Sapiens; identical to SEQ ID NO: 111321

SEQ ID NO: 246559 - RNA, 64 nt, Homo Sapiens; identical to SEQ ID NO: 111322

SEQ ID NO: 246560 - RNA, 64 nt, Homo Sapiens; identical to SEQ ID NO: 111323

SEQ ID NO: 246561 - RNA, 64 nt, Homo Sapiens; identical to SEQ ID NO: 111324

SEQ ID NO: 246562 - RNA, 64 nt, Homo Sapiens; identical to SEQ ID NO: 111325

SEQ ID NO: 246563 - RNA, 64 nt, Homo Sapiens; identical to SEQ ID NO: 111326

SEQ ID NO: 246564 - RNA, 64 nt, Homo Sapiens; identical to SEQ ID NO: 111327

SEQ ID NO: 246565 - RNA, 64 nt, Homo Sapiens; identical to SEQ ID NO: 111328

SEQ ID NO: 246566 - RNA, 64 nt, Homo Sapiens; identical to SEQ ID NO: 111329

SEQ ID NO: 246567 - RNA, 64 nt, Homo Sapiens; identical to SEQ ID NO: 111330

SEQ ID NO: 246568 - RNA, 64 nt, Homo Sapiens; identical to SEQ ID NO: 111331

SEQ ID NO: 246569 - RNA, 64 nt, Homo Sapiens; identical to SEQ ID NO: 111332

SEQ ID NO: 246570 - RNA, 64 nt, Homo Sapiens; identical to SEQ ID NO: 111333

SEQ ID NO: 246571 - RNA, 64 nt, Homo Sapiens; identical to SEQ ID NO: 111334

SEQ ID NO: 246572 - RNA, 57 nt, Homo Sapiens; identical to SEQ ID NO: 111335

SEQ ID NO: 246573 - RNA, 64 nt, Homo Sapiens; identical to SEQ ID NO: 111336

SEQ ID NO: 246574 - RNA, 64 nt, Homo Sapiens; identical to SEQ ID NO: 111337

SEQ ID NO: 246575 - RNA, 64 nt, Homo Sapiens; identical to SEQ ID NO: 111338

SEQ ID NO: 246576 - RNA, 64 nt, Homo Sapiens; identical to SEQ ID NO: 111339

SEQ ID NO: 246577 - RNA, 64 nt, Homo Sapiens; identical to SEQ ID NO: 111340

SEQ ID NO: 246578 - RNA, 64 nt, Homo Sapiens; identical to SEQ ID NO: 111341

SEQ ID NO: 246579 - RNA, 64 nt, Homo Sapiens; identical to SEQ ID NO: 111342

SEQ ID NO: 246580 - RNA, 64 nt, Homo Sapiens; identical to SEQ ID NO: 111343

SEQ ID NO: 246581 - RNA, 64 nt, Homo Sapiens; identical to SEQ ID NO: 111344

SEQ ID NO: 246582 - RNA, 64 nt, Homo Sapiens; identical to SEQ ID NO: 111345

SEQ ID NO: 246583 - RNA, 64 nt, Homo Sapiens; identical to SEQ ID NO: 111346

SEQ ID NO: 246584 - RNA, 57 nt, Homo Sapiens; identical to SEQ ID NO: 111347

SEQ ID NO: 246585 - RNA, 64 nt, Homo Sapiens; identical to SEQ ID NO: 111348

SEQ ID NO: 246586 - RNA, 64 nt, Homo Sapiens; identical to SEQ ID NO: 111349

SEQ ID NO: 246587 - RNA, 64 nt, Homo Sapiens; identical to SEQ ID NO: 111350

SEQ ID NO: 246588 - RNA, 64 nt, Homo Sapiens
uuucuaagugagcuuagcaaaacucuuuuaaauggugcccaacugccacccuggucuguucucc

SEQ ID NO: 246589 - RNA, 64 nt, Homo Sapiens
agccacccuggucuguucucagcaccauccagcugugcccaagaaaaucccaggccuggcuucc

SEQ ID NO: 246590 - RNA, 64 nt, Homo Sapiens
acuuggggcagcugaagcucacggugacucagcagugcccaacugaccaaucucccgcagcucu

SEQ ID NO: 246591 - RNA, 64 nt, Homo Sapiens
ccagaggauucaggauaggacaaaggcccuggcugugcccaaaagggucuaccucagguggggu

SEQ ID NO: 246592 - RNA, 64 nt, Homo Sapiens
auguacuuguauugauuauguaguucaguaagaugugcccaagucauuucagaaagaaagaccc

SEQ ID NO: 246593 - RNA, 64 nt, Homo Sapiens
caguucuagagcaaucuacagcuguuuaugugaggugcccaacacccauucaucucaagugcuu

SEQ ID NO: 246594 - RNA, 64 nt, Homo Sapiens; identical to SEQ ID NO: 161498

SEQ ID NO: 246595 - RNA, 64 nt, Homo Sapiens; identical to SEQ ID NO: 161499

SEQ ID NO: 246596 - RNA, 64 nt, Homo Sapiens; identical to SEQ ID NO: 161500

SEQ ID NO: 246597 - RNA, 64 nt, Homo Sapiens; identical to SEQ ID NO: 161501

SEQ ID NO: 246598 - RNA, 64 nt, Homo Sapiens; identical to SEQ ID NO: 161502

SEQ ID NO: 246599 - RNA, 64 nt, Homo Sapiens; identical to SEQ ID NO: 161503

SEQ ID NO: 246600 - RNA, 64 nt, Homo Sapiens; identical to SEQ ID NO: 161504

SEQ ID NO: 246601 - RNA, 64 nt, Homo Sapiens; identical to SEQ ID NO: 161505

SEQ ID NO: 246602 - RNA, 64 nt, Homo Sapiens; identical to SEQ ID NO: 161506

SEQ ID NO: 246603 - RNA, 64 nt, Homo Sapiens; identical to SEQ ID NO: 161507

SEQ ID NO: 246604 - RNA, 64 nt, Homo Sapiens; identical to SEQ ID NO: 161508

SEQ ID NO: 246605 - RNA, 64 nt, Homo Sapiens; identical to SEQ ID NO: 161509

SEQ ID NO: 246606 - RNA, 64 nt, Homo Sapiens; identical to SEQ ID NO: 161510

SEQ ID NO: 246607 - RNA, 64 nt, Homo Sapiens; identical to SEQ ID NO: 161511

SEQ ID NO: 246608 - RNA, 64 nt, Homo Sapiens; identical to SEQ ID NO: 161512

SEQ ID NO: 246609 - RNA, 64 nt, Homo Sapiens; identical to SEQ ID NO: 161513

SEQ ID NO: 246610 - RNA, 64 nt, Homo Sapiens; identical to SEQ ID NO: 161514

SEQ ID NO: 246611 - RNA, 64 nt, Homo Sapiens; identical to SEQ ID NO: 161515

SEQ ID NO: 246612 - RNA, 64 nt, Homo Sapiens; identical to SEQ ID NO: 161516

SEQ ID NO: 246613 - RNA, 64 nt, Homo Sapiens; identical to SEQ ID NO: 161517

SEQ ID NO: 246614 - RNA, 64 nt, Homo Sapiens; identical to SEQ ID NO: 161518

SEQ ID NO: 246615 - RNA, 64 nt, Homo Sapiens; identical to SEQ ID NO: 161519

SEQ ID NO: 246616 - RNA, 64 nt, Homo Sapiens; identical to SEQ ID NO: 161520

SEQ ID NO: 246617 - RNA, 64 nt, Homo Sapiens; identical to SEQ ID NO: 161521

SEQ ID NO: 246618 - RNA, 64 nt, Homo Sapiens; identical to SEQ ID NO: 161522

SEQ ID NO: 246619 - RNA, 64 nt, Homo Sapiens; identical to SEQ ID NO: 161523

SEQ ID NO: 246620 - RNA, 64 nt, Homo Sapiens; identical to SEQ ID NO: 161524

SEQ ID NO: 246621 - RNA, 64 nt, Homo Sapiens; identical to SEQ ID NO: 161525

SEQ ID NO: 246622 - RNA, 64 nt, Homo Sapiens; identical to SEQ ID NO: 161526

SEQ ID NO: 246623 - RNA, 64 nt, Homo Sapiens; identical to SEQ ID NO: 161527

SEQ ID NO: 246624 - RNA, 64 nt, Homo Sapiens; identical to SEQ ID NO: 161528

SEQ ID NO: 246625 - RNA, 64 nt, Homo Sapiens; identical to SEQ ID NO: 161529

SEQ ID NO: 246626 - RNA, 64 nt, Homo Sapiens; identical to SEQ ID NO: 161530

SEQ ID NO: 246627 - RNA, 64 nt, Homo Sapiens; identical to SEQ ID NO: 161531

SEQ ID NO: 246628 - RNA, 64 nt, Homo Sapiens; identical to SEQ ID NO: 161532

SEQ ID NO: 246629 - RNA, 64 nt, Homo Sapiens; identical to SEQ ID NO: 161533

SEQ ID NO: 246630 - RNA, 59 nt, Homo Sapiens
cuuagguuagugcccagugcugguuucccccgguggagcauggaaaggggauaucagau

SEQ ID NO: 246631 - RNA, 59 nt, Homo Sapiens
cugaccacccugcuugagcccgcugggguccgguggagagugcuuugcuuaugggugcu

SEQ ID NO: 246632 - RNA, 64 nt, Homo Sapiens; identical to SEQ ID NO: 196000

SEQ ID NO: 246633 - RNA, 64 nt, Homo Sapiens; identical to SEQ ID NO: 196001

SEQ ID NO: 246634 - RNA, 64 nt, Homo Sapiens; identical to SEQ ID NO: 196002

SEQ ID NO: 246635 - RNA, 64 nt, Homo Sapiens; identical to SEQ ID NO: 196003

SEQ ID NO: 246636 - RNA, 64 nt, Homo Sapiens; identical to SEQ ID NO: 196004

SEQ ID NO: 246637 - RNA, 64 nt, Homo Sapiens; identical to SEQ ID NO: 196005

SEQ ID NO: 246638 - RNA, 64 nt, Homo Sapiens; identical to SEQ ID NO: 196006

SEQ ID NO: 246639 - RNA, 64 nt, Homo Sapiens; identical to SEQ ID NO: 196007

SEQ ID NO: 246640 - RNA, 64 nt, Homo Sapiens; identical to SEQ ID NO: 196008

SEQ ID NO: 246641 - RNA, 64 nt, Homo Sapiens; identical to SEQ ID NO: 196009

SEQ ID NO: 246642 - RNA, 64 nt, Homo Sapiens; identical to SEQ ID NO: 196010

SEQ ID NO: 246643 - RNA, 64 nt, Homo Sapiens; identical to SEQ ID NO: 196011

SEQ ID NO: 246644 - RNA, 64 nt, Homo Sapiens; identical to SEQ ID NO: 196012

SEQ ID NO: 246645 - RNA, 64 nt, Homo Sapiens; identical to SEQ ID NO: 196013

SEQ ID NO: 246646 - RNA, 64 nt, Homo Sapiens; identical to SEQ ID NO: 196014

SEQ ID NO: 246647 - RNA, 64 nt, Homo Sapiens; identical to SEQ ID NO: 196015

SEQ ID NO: 246648 - RNA, 64 nt, Homo Sapiens; identical to SEQ ID NO: 196016

SEQ ID NO: 246649 - RNA, 64 nt, Homo Sapiens; identical to SEQ ID NO: 196017

SEQ ID NO: 246650 - RNA, 64 nt, Homo Sapiens; identical to SEQ ID NO: 196018

SEQ ID NO: 246651 - RNA, 64 nt, Homo Sapiens; identical to SEQ ID NO: 196019

SEQ ID NO: 246652 - RNA, 64 nt, Homo Sapiens; identical to SEQ ID NO: 196020

SEQ ID NO: 246653 - RNA, 64 nt, Homo Sapiens; identical to SEQ ID NO: 196021

SEQ ID NO: 246654 - RNA, 64 nt, Homo Sapiens; identical to SEQ ID NO: 196022

SEQ ID NO: 246655 - RNA, 64 nt, Homo Sapiens; identical to SEQ ID NO: 196023

SEQ ID NO: 246656 - RNA, 64 nt, Homo Sapiens; identical to SEQ ID NO: 196024

SEQ ID NO: 246657 - RNA, 64 nt, Homo Sapiens; identical to SEQ ID NO: 196025

SEQ ID NO: 246658 - RNA, 64 nt, Homo Sapiens; identical to SEQ ID NO: 196026

SEQ ID NO: 246659 - RNA, 64 nt, Homo Sapiens; identical to SEQ ID NO: 196027

SEQ ID NO: 246660 - RNA, 64 nt, Homo Sapiens; identical to SEQ ID NO: 196028

SEQ ID NO: 246661 - RNA, 64 nt, Homo Sapiens; identical to SEQ ID NO: 196029

SEQ ID NO: 246662 - RNA, 64 nt, Homo Sapiens; identical to SEQ ID NO: 196030

SEQ ID NO: 246663 - RNA, 64 nt, Homo Sapiens; identical to SEQ ID NO: 196031

SEQ ID NO: 246664 - RNA, 64 nt, Homo Sapiens
uuucuucguuuuuugaucagaagcccagcccgcacgcgcucaucuccggaggcgggcgugagac

SEQ ID NO: 246665 - RNA, 64 nt, Homo Sapiens
ccugaccacaugcacguuccguagccgcugcucacgcgcucacucuggcaccugugcuaguuac

SEQ ID NO: 246666 - RNA, 64 nt, Homo Sapiens
ucucccuuccuuugagggaagcucagcuuucuuacgcgcucaucguuggacgggcugccaugca

SEQ ID NO: 246667 - RNA, 64 nt, Homo Sapiens
aggcggguccgggucgcaggaccaucccggccggcgcgcucaucccacccgcccaccgcagggu

SEQ ID NO: 246668 - RNA, 64 nt, Homo Sapiens
cggacggcgccgacucuuuucccaggagggaacccgcgcucaggugaggcgggcgggucccgag

SEQ ID NO: 246669 - RNA, 64 nt, Homo Sapiens
caaccgguccacuccugccuacucaaacucccaccgcgcucacacuacaacaaugucuuccaca

SEQ ID NO: 246670 - RNA, 64 nt, Homo Sapiens
gguaaagaaaaguugccgaagaugagacugcccacgcgcucagacaugauaugcggcuaugccu

SEQ ID NO: 246671 - RNA, 64 nt, Homo Sapiens
aggucaagaccagccugggcguggguggauugcccgcgcucagguagcacuuugcgaggccgag

SEQ ID NO: 246672 - RNA, 64 nt, Homo Sapiens
cgcacucgcagcugcuggacuugggccccaucgacgcgcucaacuucuucugugagcagcugcg

SEQ ID NO: 246673 - RNA, 64 nt, Homo Sapiens
ggggugugcgcugccccggcaccugcuugcccuccgcgcucaucuggggccgcagcaugccuau

SEQ ID NO: 246674 - RNA, 64 nt, Homo Sapiens
gaaucaugggcacggagggccgcccgccacgccccgcgcucaacugcucccguggaagauuaaa

SEQ ID NO: 246675 - RNA, 64 nt, Homo Sapiens
gccggggagcccgccagguggagcgagcggccggcgcgcucauccagccucagccccggaagcc

SEQ ID NO: 246676 - RNA, 64 nt, Homo Sapiens
cugauguguuuacaugguaccccuaccaccaccacgcgcucagcacucuuaugcccccaaccug

SEQ ID NO: 246677 - RNA, 64 nt, Homo Sapiens
cgagaggcgaagcccacuuuuguauaccggccggcgcgcucacuuuccuccgcguugcuuccgg

SEQ ID NO: 246678 - RNA, 57 nt, Homo Sapiens
agcuggaggacauggcuuaggucaaggcgcgcucagaugccggagccccaagacucu

SEQ ID NO: 246679 - RNA, 64 nt, Homo Sapiens
gggauuugaaccggucugucuucacugagguccucgcgcucagaaaaggaccuugugagacgga

SEQ ID NO: 246680 - RNA, 64 nt, Homo Sapiens
gcgugccgcucugcccgcuccgccuaggcuccuccgcgcucaccacucaguacggcgccgccuu

SEQ ID NO: 246681 - RNA, 64 nt, Homo Sapiens
gcacgggugguccccguuccaccccaagagaacucgcgcucaguaaacgggaacaugcccccug

SEQ ID NO: 246682 - RNA, 64 nt, Homo Sapiens
gguggccaggggggauuuccgaaucuccaucaggcgcgcucauaguuguccccauugucuaccc

SEQ ID NO: 246683 - RNA, 64 nt, Homo Sapiens
aauacuuggcccgccggcuucccgcugcccccaucgcgcucacgcaauaaccggcccggccccc

SEQ ID NO: 246684 - RNA, 64 nt, Homo Sapiens
acgccaacuugacccucaccagcauuaucaggagcgcgcucagcaaguugguaguuuccucccc

SEQ ID NO: 246685 - RNA, 64 nt, Homo Sapiens
ccaccagggugcgagaugccuucacagccaugcacgcgcucaagggccucggcucuuuacucca

SEQ ID NO: 246686 - RNA, 64 nt, Homo Sapiens
cacgcggccgccccgggagccacgcugugcugcgcgcgcucauggggggccgccggcgcucaac

SEQ ID NO: 246687 - RNA, 64 nt, Homo Sapiens; identical to SEQ ID NO: 153638

SEQ ID NO: 246688 - RNA, 64 nt, Homo Sapiens; identical to SEQ ID NO: 153639

SEQ ID NO: 246689 - RNA, 64 nt, Homo Sapiens; identical to SEQ ID NO: 153640

SEQ ID NO: 246690 - RNA, 64 nt, Homo Sapiens; identical to SEQ ID NO: 153641

SEQ ID NO: 246691 - RNA, 64 nt, Homo Sapiens; identical to SEQ ID NO: 153642

SEQ ID NO: 246692 - RNA, 64 nt, Homo Sapiens; identical to SEQ ID NO: 153643

SEQ ID NO: 246693 - RNA, 64 nt, Homo Sapiens; identical to SEQ ID NO: 153644

SEQ ID NO: 246694 - RNA, 64 nt, Homo Sapiens; identical to SEQ ID NO: 153645

SEQ ID NO: 246695 - RNA, 64 nt, Homo Sapiens; identical to SEQ ID NO: 153646

SEQ ID NO: 246696 - RNA, 64 nt, Homo Sapiens; identical to SEQ ID NO: 153647

SEQ ID NO: 246697 - RNA, 64 nt, Homo Sapiens; identical to SEQ ID NO: 153648

SEQ ID NO: 246698 - RNA, 64 nt, Homo Sapiens; identical to SEQ ID NO: 153649

SEQ ID NO: 246699 - RNA, 64 nt, Homo Sapiens; identical to SEQ ID NO: 153650

SEQ ID NO: 246700 - RNA, 64 nt, Homo Sapiens; identical to SEQ ID NO: 153651

SEQ ID NO: 246701 - RNA, 64 nt, Homo Sapiens; identical to SEQ ID NO: 153652

SEQ ID NO: 246702 - RNA, 64 nt, Homo Sapiens; identical to SEQ ID NO: 153653

SEQ ID NO: 246703 - RNA, 64 nt, Homo Sapiens; identical to SEQ ID NO: 153654

SEQ ID NO: 246704 - RNA, 64 nt, Homo Sapiens; identical to SEQ ID NO: 153655

SEQ ID NO: 246705 - RNA, 64 nt, Homo Sapiens; identical to SEQ ID NO: 153656

SEQ ID NO: 246706 - RNA, 64 nt, Homo Sapiens; identical to SEQ ID NO: 153657

SEQ ID NO: 246707 - RNA, 64 nt, Homo Sapiens; identical to SEQ ID NO: 153658

SEQ ID NO: 246708 - RNA, 64 nt, Homo Sapiens; identical to SEQ ID NO: 153659

SEQ ID NO: 246709 - RNA, 64 nt, Homo Sapiens; identical to SEQ ID NO: 153660

SEQ ID NO: 246710 - RNA, 64 nt, Homo Sapiens; identical to SEQ ID NO: 153661

SEQ ID NO: 246711 - RNA, 64 nt, Homo Sapiens; identical to SEQ ID NO: 153662

SEQ ID NO: 246712 - RNA, 64 nt, Homo Sapiens; identical to SEQ ID NO: 153663

SEQ ID NO: 246713 - RNA, 64 nt, Homo Sapiens; identical to SEQ ID NO: 153664

SEQ ID NO: 246714 - RNA, 64 nt, Homo Sapiens; identical to SEQ ID NO: 153665

SEQ ID NO: 246715 - RNA, 64 nt, Homo Sapiens; identical to SEQ ID NO: 153666

SEQ ID NO: 246716 - RNA, 64 nt, Homo Sapiens; identical to SEQ ID NO: 153667

SEQ ID NO: 246717 - RNA, 64 nt, Homo Sapiens; identical to SEQ ID NO: 153668

SEQ ID NO: 246718 - RNA, 64 nt, Homo Sapiens; identical to SEQ ID NO: 153669

SEQ ID NO: 246719 - RNA, 64 nt, Homo Sapiens; identical to SEQ ID NO: 153670

SEQ ID NO: 246720 - RNA, 64 nt, Homo Sapiens; identical to SEQ ID NO: 153671

SEQ ID NO: 246721 - RNA, 64 nt, Homo Sapiens; identical to SEQ ID NO: 153672

SEQ ID NO: 246722 - RNA, 64 nt, Homo Sapiens; identical to SEQ ID NO: 153673

SEQ ID NO: 246723 - RNA, 64 nt, Homo Sapiens
auaagagagauuggacaaacgcuucagcaauggaauuuagcauuagaagagaucauuucuggag

SEQ ID NO: 246724 - RNA, 64 nt, Homo Sapiens
uuuuugccaccuuggugaacuguuuccuagcaguauuuagcaccugacagggaucaguggcauu

SEQ ID NO: 246725 - RNA, 64 nt, Homo Sapiens
uaauuugggaccuaugucuaauuguucauuacucauuuagcagacacaccuucugaauagaaau

SEQ ID NO: 246726 - RNA, 64 nt, Homo Sapiens
agcuaaaucucaaagccuugaauuuuaaaaaaugauuuagcacaauaaaaugccucagagcuac

SEQ ID NO: 246727 - RNA, 64 nt, Homo Sapiens
uaugcuaaaauauguacuuauuuauuacauugugauuuagcaguagcaaucuuuaauaaaccuu

SEQ ID NO: 246728 - RNA, 64 nt, Homo Sapiens
auugugauugaaaaauugccuaugccugaauaacauuuagcagugaacaguggguaagaaacuu

SEQ ID NO: 246729 - RNA, 64 nt, Homo Sapiens
uuccuauaaacuaaaauaacauuacaguuuccgaauuuagcaugggacauagucaguguuugaa

SEQ ID NO: 246730 - RNA, 64 nt, Homo Sapiens
cugcagaaugcaaaauaaaacuugcagugaaugaauuuagcauuuuaugagagugcuguuggaa

SEQ ID NO: 246731 - RNA, 64 nt, Homo Sapiens
ggcaagauuuucugaugcuuuugauuuucucucaauuuagcauuugcuuuugguuuuuuucucu

SEQ ID NO: 246732 - RNA, 64 nt, Homo Sapiens
cucaauuuagcauuugcuuuugguuuuuuucucuauuuagcauucuguuaaggcacaaaaacua

SEQ ID NO: 246733 - RNA, 64 nt, Homo Sapiens
uuaacuaaauacaaauauauaauaugugaaauaaauuuagcaguggcugaugucucuuucuugg

SEQ ID NO: 246734 - RNA, 64 nt, Homo Sapiens
aaauuaaaguaaccaguccucaaaccugcuuuucauuuagcagcuacaguaacaugaauaaagc

SEQ ID NO: 246735 - RNA, 64 nt, Homo Sapiens
auuuaaaauaagcacaccaaucuucacuuaauccauuuagcacucauuaggggaaccauuguug

SEQ ID NO: 246736 - RNA, 64 nt, Homo Sapiens
guuugugacaguaaccauuuccuccuauaucauuauuuagcaccuaggugacuugagaguggaa

SEQ ID NO: 246737 - RNA, 64 nt, Homo Sapiens
uauuuaagaccuaguaagugaguacuguguauguauuuagcaaaaauuuccuggggcuauugug

SEQ ID NO: 246738 - RNA, 64 nt, Homo Sapiens
agaugugcauuauuaugagacuuugagaguagucauuuagcagugaacaugaaaaagaaaacaa

SEQ ID NO: 246739 - RNA, 64 nt, Homo Sapiens
cccuugcuagaagcccguguacaggggaucauuuauuuagcauuuaaaucagaguuuacaaugc

SEQ ID NO: 246740 - RNA, 64 nt, Homo Sapiens
aagcucuagcaacaugaucucagcuaaucuuaacauuuagcagacacugauuccaacucuuugc

SEQ ID NO: 246741 - RNA, 64 nt, Homo Sapiens
agacaucuuaugaaaacuguauucauggaauuugauuuagcaugcucaguugccaguucccauu

SEQ ID NO: 246742 - RNA, 64 nt, Homo Sapiens
ugaauagugacacucgguaaggauuuucagugccauuuagcaaaacgucuuuagucuaugcaac

SEQ ID NO: 246743 - RNA, 64 nt, Homo Sapiens
uaugaacagaaaguacuguguagcccaggaguuuauuuagcaagauaaauagugguaauuucuu

SEQ ID NO: 246744 - RNA, 64 nt, Homo Sapiens
aucuguucaguuuaccaagguucagaaauacguaauuuagcaggaaacuauaaauaccagugcu

SEQ ID NO: 246745 - RNA, 64 nt, Homo Sapiens
uucuuaauuaugguaccucugucuauaggacuuaauuuagcaguccauuuuugaguaaaacuug

SEQ ID NO: 246746 - RNA, 64 nt, Homo Sapiens
ccgaaaugaaaauggcugaagaaacacagcaugcauuuagcaugaguucugcacauacagaugg

SEQ ID NO: 246747 - RNA, 64 nt, Homo Sapiens
gagguuauuaagacaaaguuuuuacuuaggauggauuuagcauugucuaaggaugugauuuaaa

SEQ ID NO: 246748 - RNA, 64 nt, Homo Sapiens
ugaauaguaaguuucaucacuaaagcuugaaaacauuuagcauuggaauugauauauaccuuau

SEQ ID NO: 246749 - RNA, 64 nt, Homo Sapiens
uugguugucuuucaauauaugacuagugguuaacauuuagcaccucuucagacauuccuaacuu

SEQ ID NO: 246750 - RNA, 64 nt, Homo Sapiens
uaggcuuuaaugaccuuacaauacuuagaaguugauuuagcaauuuuguagcagaguauuuagu

SEQ ID NO: 246751 - RNA, 64 nt, Homo Sapiens
gaaguggaauaauaucuuuuugaugauuaauuucauuuagcaggcaccucuugaaagucaaagg

SEQ ID NO: 246752 - RNA, 64 nt, Homo Sapiens; identical to SEQ ID NO: 166002

SEQ ID NO: 246753 - RNA, 64 nt, Homo Sapiens; identical to SEQ ID NO: 166003

SEQ ID NO: 246754 - RNA, 64 nt, Homo Sapiens; identical to SEQ ID NO: 166004

SEQ ID NO: 246755 - RNA, 64 nt, Homo Sapiens; identical to SEQ ID NO: 166005

SEQ ID NO: 246756 - RNA, 64 nt, Homo Sapiens; identical to SEQ ID NO: 166006

SEQ ID NO: 246757 - RNA, 64 nt, Homo Sapiens; identical to SEQ ID NO: 166007

SEQ ID NO: 246758 - RNA, 64 nt, Homo Sapiens; identical to SEQ ID NO: 166008

SEQ ID NO: 246759 - RNA, 64 nt, Homo Sapiens; identical to SEQ ID NO: 166009

SEQ ID NO: 246760 - RNA, 64 nt, Homo Sapiens; identical to SEQ ID NO: 166010

SEQ ID NO: 246761 - RNA, 60 nt, Homo Sapiens; identical to SEQ ID NO: 166011

SEQ ID NO: 246762 - RNA, 64 nt, Homo Sapiens; identical to SEQ ID NO: 166012

SEQ ID NO: 246763 - RNA, 64 nt, Homo Sapiens; identical to SEQ ID NO: 116857

SEQ ID NO: 246764 - RNA, 64 nt, Homo Sapiens; identical to SEQ ID NO: 116858

SEQ ID NO: 246765 - RNA, 64 nt, Homo Sapiens; identical to SEQ ID NO: 116859

SEQ ID NO: 246766 - RNA, 64 nt, Homo Sapiens; identical to SEQ ID NO: 116860

SEQ ID NO: 246767 - RNA, 64 nt, Homo Sapiens; identical to SEQ ID NO: 116861

SEQ ID NO: 246768 - RNA, 64 nt, Homo Sapiens; identical to SEQ ID NO: 116862

SEQ ID NO: 246769 - RNA, 64 nt, Homo Sapiens; identical to SEQ ID NO: 116863

SEQ ID NO: 246770 - RNA, 64 nt, Homo Sapiens; identical to SEQ ID NO: 116864

SEQ ID NO: 246771 - RNA, 64 nt, Homo Sapiens; identical to SEQ ID NO: 116865

SEQ ID NO: 246772 - RNA, 64 nt, Homo Sapiens; identical to SEQ ID NO: 116866

SEQ ID NO: 246773 - RNA, 64 nt, Homo Sapiens; identical to SEQ ID NO: 116867

SEQ ID NO: 246774 - RNA, 64 nt, Homo Sapiens; identical to SEQ ID NO: 116868

SEQ ID NO: 246775 - RNA, 64 nt, Homo Sapiens; identical to SEQ ID NO: 116869

SEQ ID NO: 246776 - RNA, 64 nt, Homo Sapiens; identical to SEQ ID NO: 116870

SEQ ID NO: 246777 - RNA, 64 nt, Homo Sapiens; identical to SEQ ID NO: 116871

SEQ ID NO: 246778 - RNA, 64 nt, Homo Sapiens; identical to SEQ ID NO: 116872

SEQ ID NO: 246779 - RNA, 64 nt, Homo Sapiens; identical to SEQ ID NO: 116873

SEQ ID NO: 246780 - RNA, 64 nt, Homo Sapiens; identical to SEQ ID NO: 116874

SEQ ID NO: 246781 - RNA, 64 nt, Homo Sapiens; identical to SEQ ID NO: 116875

SEQ ID NO: 246782 - RNA, 64 nt, Homo Sapiens; identical to SEQ ID NO: 116876

SEQ ID NO: 246783 - RNA, 64 nt, Homo Sapiens; identical to SEQ ID NO: 116877

SEQ ID NO: 246784 - RNA, 64 nt, Homo Sapiens; identical to SEQ ID NO: 116878

SEQ ID NO: 246785 - RNA, 64 nt, Homo Sapiens; identical to SEQ ID NO: 116879

SEQ ID NO: 246786 - RNA, 64 nt, Homo Sapiens; identical to SEQ ID NO: 116880

SEQ ID NO: 246787 - RNA, 64 nt, Homo Sapiens; identical to SEQ ID NO: 116881

SEQ ID NO: 246788 - RNA, 64 nt, Homo Sapiens; identical to SEQ ID NO: 116882

SEQ ID NO: 246789 - RNA, 64 nt, Homo Sapiens; identical to SEQ ID NO: 116883

SEQ ID NO: 246790 - RNA, 64 nt, Homo Sapiens; identical to SEQ ID NO: 116884

SEQ ID NO: 246791 - RNA, 64 nt, Homo Sapiens; identical to SEQ ID NO: 116885

SEQ ID NO: 246792 - RNA, 64 nt, Homo Sapiens; identical to SEQ ID NO: 116886

SEQ ID NO: 246793 - RNA, 64 nt, Homo Sapiens; identical to SEQ ID NO: 116887

SEQ ID NO: 246794 - RNA, 64 nt, Homo Sapiens; identical to SEQ ID NO: 116888

SEQ ID NO: 246795 - RNA, 64 nt, Homo Sapiens; identical to SEQ ID NO: 116889

SEQ ID NO: 246796 - RNA, 64 nt, Homo Sapiens; identical to SEQ ID NO: 116890

SEQ ID NO: 246797 - RNA, 64 nt, Homo Sapiens; identical to SEQ ID NO: 116891

SEQ ID NO: 246798 - RNA, 64 nt, Homo Sapiens; identical to SEQ ID NO: 116892

SEQ ID NO: 246799 - RNA, 64 nt, Homo Sapiens; identical to SEQ ID NO: 116893

SEQ ID NO: 246800 - RNA, 64 nt, Homo Sapiens; identical to SEQ ID NO: 116894

SEQ ID NO: 246801 - RNA, 64 nt, Homo Sapiens; identical to SEQ ID NO: 116895

SEQ ID NO: 246802 - RNA, 64 nt, Homo Sapiens; identical to SEQ ID NO: 116896

SEQ ID NO: 246803 - RNA, 64 nt, Homo Sapiens; identical to SEQ ID NO: 116897

SEQ ID NO: 246804 - RNA, 64 nt, Homo Sapiens; identical to SEQ ID NO: 116898

SEQ ID NO: 246805 - RNA, 64 nt, Homo Sapiens; identical to SEQ ID NO: 116899

SEQ ID NO: 246806 - RNA, 64 nt, Homo Sapiens; identical to SEQ ID NO: 116900

SEQ ID NO: 246807 - RNA, 64 nt, Homo Sapiens; identical to SEQ ID NO: 116901

SEQ ID NO: 246808 - RNA, 64 nt, Homo Sapiens; identical to SEQ ID NO: 116902

SEQ ID NO: 246809 - RNA, 64 nt, Homo Sapiens; identical to SEQ ID NO: 116903

SEQ ID NO: 246810 - RNA, 64 nt, Homo Sapiens; identical to SEQ ID NO: 116904

SEQ ID NO: 246811 - RNA, 64 nt, Homo Sapiens; identical to SEQ ID NO: 116905

SEQ ID NO: 246812 - RNA, 64 nt, Homo Sapiens; identical to SEQ ID NO: 116906

SEQ ID NO: 246813 - RNA, 64 nt, Homo Sapiens; identical to SEQ ID NO: 116907

SEQ ID NO: 246814 - RNA, 64 nt, Homo Sapiens; identical to SEQ ID NO: 116908

SEQ ID NO: 246815 - RNA, 64 nt, Homo Sapiens; identical to SEQ ID NO: 116909

SEQ ID NO: 246816 - RNA, 64 nt, Homo Sapiens; identical to SEQ ID NO: 116910

SEQ ID NO: 246817 - RNA, 64 nt, Homo Sapiens; identical to SEQ ID NO: 116911

SEQ ID NO: 246818 - RNA, 64 nt, Homo Sapiens; identical to SEQ ID NO: 116912

SEQ ID NO: 246819 - RNA, 64 nt, Homo Sapiens; identical to SEQ ID NO: 116913

SEQ ID NO: 246820 - RNA, 64 nt, Homo Sapiens; identical to SEQ ID NO: 116914

SEQ ID NO: 246821 - RNA, 64 nt, Homo Sapiens; identical to SEQ ID NO: 116915

SEQ ID NO: 246822 - RNA, 64 nt, Homo Sapiens; identical to SEQ ID NO: 116916

SEQ ID NO: 246823 - RNA, 64 nt, Homo Sapiens
ggggcugcccacagccuuuucaggggcucgcuuggcgggugacggggccgcagccaggccuucu

SEQ ID NO: 246824 - RNA, 64 nt, Homo Sapiens
cuuuccccacagcucucacgucucccuucucccugcgggugacaaagaagcccaaggaccaccu

SEQ ID NO: 246825 - RNA, 64 nt, Homo Sapiens
guccucauguuggugaaguguugggggauggagggcgggugagcagucgggggacaaaaagucu

SEQ ID NO: 246826 - RNA, 64 nt, Homo Sapiens
ccgggcuccguggcugucccaccggggcggccucgcgggugacucgcgccgccccccacgcacc

SEQ ID NO: 246827 - RNA, 64 nt, Homo Sapiens
aggaggcaugagguacaaugcaccucugggaaaagcgggugagcgugaagggcccaugugugcu

SEQ ID NO: 246828 - RNA, 64 nt, Homo Sapiens
ucaccugaggucaugaguucuuugggaggcugaggcgggugaaacacgccuguaaucccagcac

SEQ ID NO: 246829 - RNA, 64 nt, Homo Sapiens
gacuguucccugaugauuuggcccucagccacaagcgggugacuguaguucucauccuccgcau

SEQ ID NO: 246830 - RNA, 50 nt, Homo Sapiens
ccccagcggauguuggccacgcgggugaugauccaggggccauagacuaa

SEQ ID NO: 246831 - RNA, 64 nt, Homo Sapiens
uguaggguucugggucccuggcaagucuaggugggcgggugacagggaaagcaugggcauuuuu

SEQ ID NO: 246832 - RNA, 64 nt, Homo Sapiens
uuccuccacaagguccccccaccgcucagugucagcgggugacguguguucuuuugaguccuug

SEQ ID NO: 246833 - RNA, 64 nt, Homo Sapiens
gagcaagacugcgucucaagccagugcacuccaggcgggugacaugcagugagccaaggucaua

SEQ ID NO: 246834 - RNA, 64 nt, Homo Sapiens
cuucuauuuauugugggaaggaaaacaggguggggcgggugagugaaaagguggaaaucccugg

SEQ ID NO: 246835 - RNA, 64 nt, Homo Sapiens
cgccaggagggagagagaggcaccccucugggaugcgggugagggaagguuggcugaaguuccu

SEQ ID NO: 246836 - RNA, 64 nt, Homo Sapiens
gagguggacaagaguggggccuaugggaaucggggcgggugaugcccucggagaucugcugggg

SEQ ID NO: 246837 - RNA, 64 nt, Homo Sapiens
ucggggucagugucccacccuucacuucccgagggcgggugaguggagagcagagccaggagcu

SEQ ID NO: 246838 - RNA, 64 nt, Homo Sapiens
caaugagauacguuacagaaccuauguucagguugcgggugagcugcccucuccaaauccagcc

SEQ ID NO: 246839 - RNA, 64 nt, Homo Sapiens
cgcuccauccuacucccacuaacuacaccucagggcgggugagguuccgacacugaucccagag

SEQ ID NO: 246840 - RNA, 64 nt, Homo Sapiens
ggcucccuguuaccagaaagccaaauuuuauaaugcgggugaaagaaaaauauagauuaaaauu

SEQ ID NO: 246841 - RNA, 64 nt, Homo Sapiens
gcuccgggaucagcaacccugcgcccacccuccggcgggugacaacgccucaccagccccccgc

SEQ ID NO: 246842 - RNA, 64 nt, Homo Sapiens
ggaggccgggcaggaagcaaaaggggcauccacugcgggugacucugaggugagcaaaagcagg

SEQ ID NO: 246843 - RNA, 64 nt, Homo Sapiens
auuuagcuuuugcuguguguggagugccaucaccgcgggugaugauaguuaugagauuaagacu

SEQ ID NO: 246844 - RNA, 64 nt, Homo Sapiens
acugucuaguuuaaauuauggcuguuaaggccgggcgggugacucaggcagguaaucccagaac

SEQ ID NO: 246845 - RNA, 64 nt, Homo Sapiens
ucuccuuugggaucguccugugcgagaucaucgggcgggugaacgcagacccugacuaccugcc

SEQ ID NO: 246846 - RNA, 64 nt, Homo Sapiens
gggggccagcccaggagggccccagagcucacccgcgggugaccccggguccugagcccgaacu

SEQ ID NO: 246847 - RNA, 64 nt, Homo Sapiens
ugguggccccugguggagcugagggaagggaagcgcgggugaggcugcacagcccugauuuaca

SEQ ID NO: 246848 - RNA, 64 nt, Homo Sapiens
caaguuacggugguacugccacucugcagguggagcgggugacucugggggaccauuaagaccu

SEQ ID NO: 246849 - RNA, 64 nt, Homo Sapiens
gccagccccuggggcccagcguugagagccaguggcgggugaugggcagagggagaauccaagg

SEQ ID NO: 246850 - RNA, 64 nt, Homo Sapiens
cacuugauugaggucaggaguuugggaggcugaggcgggugaaucacgccuguaaucccagcac

SEQ ID NO: 246851 - RNA, 64 nt, Homo Sapiens
gcuccgucuucugaauucaucauggcccagggaggcgggugaaauuacuaagaagagcugccau

SEQ ID NO: 246852 - RNA, 64 nt, Homo Sapiens
ggauggggagggacgucccugggaucuggacccugcgggugaaggaguugcgcaucagcaccug

SEQ ID NO: 246853 - RNA, 64 nt, Homo Sapiens
ugagugauucucagccaaguccagacagugcucggcgggugaggaagggucugccccgagcuuu

SEQ ID NO: 246854 - RNA, 64 nt, Homo Sapiens
uuuguaacauuuccucuuuguggccagaaagcuggcgggugacacaaccuggcauucugcuuac

SEQ ID NO: 246855 - RNA, 64 nt, Homo Sapiens
cccagcauauuucuagguuacagaggggguuucugcgggugaccucugcuuacccauuagcgag

SEQ ID NO: 246856 - RNA, 64 nt, Homo Sapiens
uucccaucuccugcuuguggccauucggccaggugcgggugaugguggagucuucgcuucagag

SEQ ID NO: 246857 - RNA, 64 nt, Homo Sapiens
uugcuuuuguuuuuguuucaguuguaucuugugggcgggugauuggguaguggaugggguuucu

SEQ ID NO: 246858 - RNA, 64 nt, Homo Sapiens
cgguccccugguggcaggaggggcucccccuguugcgggugaggcggcugcucucauauuuuca

SEQ ID NO: 246859 - RNA, 64 nt, Homo Sapiens
ucugagagggggauucuggggcaaguaguuucuugcgggugaguguucucagagaaacuuacca

SEQ ID NO: 246860 - RNA, 64 nt, Homo Sapiens
agggguaugcuccaugcuuugagucaccaaugaagcgggugagggaagaugagagggggaggug

SEQ ID NO: 246861 - RNA, 64 nt, Homo Sapiens
cuaaaacgggggaagugagaggaaagaggcgggggcgggugaggagacuggccccaggccccag

SEQ ID NO: 246862 - RNA, 64 nt, Homo Sapiens
aacccccacaacccccuccacaaagagaccaggggcgggugaugagaccugggguuuagaaccc

SEQ ID NO: 246863 - RNA, 64 nt, Homo Sapiens
acuaauaguuuguugaucugauaagcaagagugggcgggugagaaaaaccgaauuggguuuagu

SEQ ID NO: 246864 - RNA, 64 nt, Homo Sapiens
gaaggugaauauaaucaaugccaauguaaugccagcgggugagauggccgauggagguuucaaa

SEQ ID NO: 246865 - RNA, 64 nt, Homo Sapiens
gguuagaggcagauggcacaggggcguguggcgggcgggugaggcugcuuugcacaccuguguu

SEQ ID NO: 246866 - RNA, 64 nt, Homo Sapiens
gggagaggcugcguaacuggcgaugcugcucucugcgggugacacguggcuucugagcggccac

SEQ ID NO: 246867 - RNA, 64 nt, Homo Sapiens
guggagaagggcuuuaaggaggccaauuugcugcgcgggugaccugugaaaggucacagucauu

SEQ ID NO: 246868 - RNA, 64 nt, Homo Sapiens
uucguugcacugcuagacacccucccagggagcugcgggugaugccacacgugaagcucgcggu

SEQ ID NO: 246869 - RNA, 64 nt, Homo Sapiens
cacaagaagggucacugccacaacagcacagucagcgggugaauuacaggugccugcugccugc

SEQ ID NO: 246870 - RNA, 64 nt, Homo Sapiens
gccguccccaccgcggcggcacgggggcauuccugcgggugagaagagggcacgggcgaucccg

SEQ ID NO: 246871 - RNA, 64 nt, Homo Sapiens
ggagagagccgcuggaaugguguggacccaucccgcgggugaccggugccuguucuccccugac

SEQ ID NO: 246872 - RNA, 64 nt, Homo Sapiens
cuuacuguggaaaacuccugccagaacucuucaagcgggugaaaaaccucaugacaguauugag

SEQ ID NO: 246873 - RNA, 64 nt, Homo Sapiens
gagauccucgauuacuggggauccucaaucuggagcgggugaccggcucucccagauggccacc

SEQ ID NO: 246874 - RNA, 64 nt, Homo Sapiens
acguccuuuucuaagcaacacuccgcuuagagcugcgggugaggaggcugagcugagaaagggc

SEQ ID NO: 246875 - RNA, 64 nt, Homo Sapiens
ggucagagagacggacacaaugugcagggcccgggcgggugaagcgaggcugcuucuguuuaua

SEQ ID NO: 246876 - RNA, 64 nt, Homo Sapiens
ucggcuuucgcugcacccaggaacacccugcggagcgggugagauggcccccugcuggcaggcu

SEQ ID NO: 246877 - RNA, 52 nt, Homo Sapiens
cagauggccauggcuauugugagcgggugaccgcccagggggucgguucuga

SEQ ID NO: 246878 - RNA, 64 nt, Homo Sapiens
ggaguguugcucccaguccauuuccugaaucuuugcgggugaaguuccuuguccuuggggugcu

SEQ ID NO: 246879 - RNA, 64 nt, Homo Sapiens
cauccauuggguauguaugcuuauguaugggugagcgggugacaagauuguucuguaaggaaug

SEQ ID NO: 246880 - RNA, 64 nt, Homo Sapiens
agcgaguggccucgaaggcuacgggacgaggguggcgggugaccaagugcaggcgcgacggguc

SEQ ID NO: 246881 - RNA, 64 nt, Homo Sapiens
cuugggcuuucucuggaggggaagguggaugcuggcgggugacuugcagugggcgccuggcagu

SEQ ID NO: 246882 - RNA, 64 nt, Homo Sapiens
ucaacccaagcucuggggauggguggggaggggggcgggugacgcccaccuucgggcaguccug

SEQ ID NO: 246883 - RNA, 64 nt, Homo Sapiens
uggcggcgguggcgacauggcggagcccuccgaggcgggugacgcgcccccugaugaugggccu

SEQ ID NO: 246884 - RNA, 64 nt, Homo Sapiens
uccucccucaggagauuggggguugggggaggcagcgggugauggcucugaagcugaacccagg

SEQ ID NO: 246885 - RNA, 64 nt, Homo Sapiens
gccucacagacccucucaggccucugacgagugagcgggugaagugccacugggucaccgcagg

SEQ ID NO: 246886 - RNA, 64 nt, Homo Sapiens
aggcagggcuucggggacgcggggcgcuucucgggcgggugaucccuaacagggcggcuuccca

SEQ ID NO: 246887 - RNA, 64 nt, Homo Sapiens
aagcugggaggucaggugggguggaugauauaaugcgggugagaguaaugaggcuuggggcugg

SEQ ID NO: 246888 - RNA, 64 nt, Homo Sapiens
aguggacggucaugaaggagcggggguguggcaggcgggugacguccaggagagggagcgcccc

SEQ ID NO: 246889 - RNA, 64 nt, Homo Sapiens
gaaggggaaccccggggugcccacaggccgcccugcgggugaacaaagcagccacgaggugcaa

SEQ ID NO: 246890 - RNA, 64 nt, Homo Sapiens
ugcccuccgucagguggaccgaggauagaugcaggcgggugagccuucauauuuuaagugcauu

SEQ ID NO: 246891 - RNA, 64 nt, Homo Sapiens
gugucacuaaagaaagugagggccacugucuccggcgggugaggcugcagcccaguuucacaug

SEQ ID NO: 246892 - RNA, 64 nt, Homo Sapiens
gucgcccagaccaggugccagcucagggcuuccugcgggugacugcccagggugaugguggcca

SEQ ID NO: 246893 - RNA, 64 nt, Homo Sapiens
gccagacccucgcggagauggugcagaaggcggagcgggugagcggccgugcguccagcccggg

SEQ ID NO: 246894 - RNA, 64 nt, Homo Sapiens
aaccuccaaugggugggggacagugagcuucggccuggccgaggugggugggugggcucucaga

SEQ ID NO: 246895 - RNA, 64 nt, Homo Sapiens
ccgaucucuauuaaaggacucccucuuggugggccuggccgagucccuccuuugugcucccagg

SEQ ID NO: 246896 - RNA, 64 nt, Homo Sapiens
cuccgacugucugugcuuucugggucugucuacacuggccgagugucuacacuggccgagucuc

SEQ ID NO: 246897 - RNA, 64 nt, Homo Sapiens
cucugggucugucuacacuguggcucugucuacacuggccgagucgucgccgggcugcccagcc

SEQ ID NO: 246898 - RNA, 57 nt, Homo Sapiens
acgagugggaggucaucugaaggagcccuggccgagucacgcggaggggcccggcgu

SEQ ID NO: 246899 - RNA, 64 nt, Homo Sapiens
ugagucagugcaauaaacuagacuuuuuccaaaccuggccgaguguggugccugagcugugaga

SEQ ID NO: 246900 - RNA, 54 nt, Homo Sapiens
ccgagcugaccccacucugagagccuggccgagcuggcagcauggagcccucgg

SEQ ID NO: 246901 - RNA, 64 nt, Homo Sapiens
ugggcagcuagagugucucagcccggugcugggccuggccgaggggcggaggcacagcugcuuc

SEQ ID NO: 246902 - RNA, 64 nt, Homo Sapiens; identical to SEQ ID NO: 246823

SEQ ID NO: 246903 - RNA, 64 nt, Homo Sapiens; identical to SEQ ID NO: 246824

SEQ ID NO: 246904 - RNA, 64 nt, Homo Sapiens; identical to SEQ ID NO: 246825

SEQ ID NO: 246905 - RNA, 64 nt, Homo Sapiens; identical to SEQ ID NO: 246826

SEQ ID NO: 246906 - RNA, 64 nt, Homo Sapiens; identical to SEQ ID NO: 246827

SEQ ID NO: 246907 - RNA, 64 nt, Homo Sapiens; identical to SEQ ID NO: 246828

SEQ ID NO: 246908 - RNA, 64 nt, Homo Sapiens; identical to SEQ ID NO: 246829

SEQ ID NO: 246909 - RNA, 50 nt, Homo Sapiens; identical to SEQ ID NO: 246830

SEQ ID NO: 246910 - RNA, 64 nt, Homo Sapiens; identical to SEQ ID NO: 246831

SEQ ID NO: 246911 - RNA, 64 nt, Homo Sapiens; identical to SEQ ID NO: 246832

SEQ ID NO: 246912 - RNA, 64 nt, Homo Sapiens; identical to SEQ ID NO: 246833

SEQ ID NO: 246913 - RNA, 64 nt, Homo Sapiens; identical to SEQ ID NO: 246834

SEQ ID NO: 246914 - RNA, 64 nt, Homo Sapiens; identical to SEQ ID NO: 246835

SEQ ID NO: 246915 - RNA, 64 nt, Homo Sapiens; identical to SEQ ID NO: 246836

SEQ ID NO: 246916 - RNA, 64 nt, Homo Sapiens; identical to SEQ ID NO: 246837

SEQ ID NO: 246917 - RNA, 64 nt, Homo Sapiens; identical to SEQ ID NO: 246838

SEQ ID NO: 246918 - RNA, 64 nt, Homo Sapiens; identical to SEQ ID NO: 246839

SEQ ID NO: 246919 - RNA, 64 nt, Homo Sapiens; identical to SEQ ID NO: 246840

SEQ ID NO: 246920 - RNA, 64 nt, Homo Sapiens; identical to SEQ ID NO: 246841

SEQ ID NO: 246921 - RNA, 64 nt, Homo Sapiens; identical to SEQ ID NO: 246842

SEQ ID NO: 246922 - RNA, 64 nt, Homo Sapiens; identical to SEQ ID NO: 246843

SEQ ID NO: 246923 - RNA, 64 nt, Homo Sapiens; identical to SEQ ID NO: 246844

SEQ ID NO: 246924 - RNA, 64 nt, Homo Sapiens; identical to SEQ ID NO: 246845

SEQ ID NO: 246925 - RNA, 64 nt, Homo Sapiens; identical to SEQ ID NO: 246846

SEQ ID NO: 246926 - RNA, 64 nt, Homo Sapiens; identical to SEQ ID NO: 246847

SEQ ID NO: 246927 - RNA, 64 nt, Homo Sapiens; identical to SEQ ID NO: 246848

SEQ ID NO: 246928 - RNA, 64 nt, Homo Sapiens; identical to SEQ ID NO: 246849

SEQ ID NO: 246929 - RNA, 64 nt, Homo Sapiens; identical to SEQ ID NO: 246850

SEQ ID NO: 246930 - RNA, 64 nt, Homo Sapiens; identical to SEQ ID NO: 246851

SEQ ID NO: 246931 - RNA, 64 nt, Homo Sapiens; identical to SEQ ID NO: 246852

SEQ ID NO: 246932 - RNA, 64 nt, Homo Sapiens; identical to SEQ ID NO: 246853

SEQ ID NO: 246933 - RNA, 64 nt, Homo Sapiens; identical to SEQ ID NO: 246854

SEQ ID NO: 246934 - RNA, 64 nt, Homo Sapiens; identical to SEQ ID NO: 246855

SEQ ID NO: 246935 - RNA, 64 nt, Homo Sapiens; identical to SEQ ID NO: 246856

SEQ ID NO: 246936 - RNA, 64 nt, Homo Sapiens; identical to SEQ ID NO: 246857

SEQ ID NO: 246937 - RNA, 64 nt, Homo Sapiens; identical to SEQ ID NO: 246858

SEQ ID NO: 246938 - RNA, 64 nt, Homo Sapiens; identical to SEQ ID NO: 246859

SEQ ID NO: 246939 - RNA, 64 nt, Homo Sapiens; identical to SEQ ID NO: 246860

SEQ ID NO: 246940 - RNA, 64 nt, Homo Sapiens; identical to SEQ ID NO: 246861

SEQ ID NO: 246941 - RNA, 64 nt, Homo Sapiens; identical to SEQ ID NO: 246862

SEQ ID NO: 246942 - RNA, 64 nt, Homo Sapiens; identical to SEQ ID NO: 246863

SEQ ID NO: 246943 - RNA, 64 nt, Homo Sapiens; identical to SEQ ID NO: 246864

SEQ ID NO: 246944 - RNA, 64 nt, Homo Sapiens; identical to SEQ ID NO: 246865

SEQ ID NO: 246945 - RNA, 64 nt, Homo Sapiens; identical to SEQ ID NO: 246866

SEQ ID NO: 246946 - RNA, 64 nt, Homo Sapiens; identical to SEQ ID NO: 246867

SEQ ID NO: 246947 - RNA, 64 nt, Homo Sapiens; identical to SEQ ID NO: 246868

SEQ ID NO: 246948 - RNA, 64 nt, Homo Sapiens; identical to SEQ ID NO: 246869

SEQ ID NO: 246949 - RNA, 64 nt, Homo Sapiens; identical to SEQ ID NO: 246870

SEQ ID NO: 246950 - RNA, 64 nt, Homo Sapiens; identical to SEQ ID NO: 246871

SEQ ID NO: 246951 - RNA, 64 nt, Homo Sapiens; identical to SEQ ID NO: 246872

SEQ ID NO: 246952 - RNA, 64 nt, Homo Sapiens; identical to SEQ ID NO: 246873

SEQ ID NO: 246953 - RNA, 64 nt, Homo Sapiens; identical to SEQ ID NO: 246874

SEQ ID NO: 246954 - RNA, 64 nt, Homo Sapiens; identical to SEQ ID NO: 246875

SEQ ID NO: 246955 - RNA, 64 nt, Homo Sapiens; identical to SEQ ID NO: 246876

SEQ ID NO: 246956 - RNA, 52 nt, Homo Sapiens; identical to SEQ ID NO: 246877

SEQ ID NO: 246957 - RNA, 64 nt, Homo Sapiens; identical to SEQ ID NO: 246878

SEQ ID NO: 246958 - RNA, 64 nt, Homo Sapiens; identical to SEQ ID NO: 246879

SEQ ID NO: 246959 - RNA, 64 nt, Homo Sapiens; identical to SEQ ID NO: 246880

SEQ ID NO: 246960 - RNA, 64 nt, Homo Sapiens; identical to SEQ ID NO: 246881

SEQ ID NO: 246961 - RNA, 64 nt, Homo Sapiens; identical to SEQ ID NO: 246882

SEQ ID NO: 246962 - RNA, 64 nt, Homo Sapiens; identical to SEQ ID NO: 246883

SEQ ID NO: 246963 - RNA, 64 nt, Homo Sapiens; identical to SEQ ID NO: 246884

SEQ ID NO: 246964 - RNA, 64 nt, Homo Sapiens; identical to SEQ ID NO: 246885

SEQ ID NO: 246965 - RNA, 64 nt, Homo Sapiens; identical to SEQ ID NO: 246886

SEQ ID NO: 246966 - RNA, 64 nt, Homo Sapiens; identical to SEQ ID NO: 246887

SEQ ID NO: 246967 - RNA, 64 nt, Homo Sapiens; identical to SEQ ID NO: 246888

SEQ ID NO: 246968 - RNA, 64 nt, Homo Sapiens; identical to SEQ ID NO: 246889

SEQ ID NO: 246969 - RNA, 64 nt, Homo Sapiens; identical to SEQ ID NO: 246890

SEQ ID NO: 246970 - RNA, 64 nt, Homo Sapiens; identical to SEQ ID NO: 246891

SEQ ID NO: 246971 - RNA, 64 nt, Homo Sapiens; identical to SEQ ID NO: 246892

SEQ ID NO: 246972 - RNA, 64 nt, Homo Sapiens; identical to SEQ ID NO: 246893

SEQ ID NO: 246973 - RNA, 64 nt, Homo Sapiens; identical to SEQ ID NO: 246894

SEQ ID NO: 246974 - RNA, 64 nt, Homo Sapiens; identical to SEQ ID NO: 246895

SEQ ID NO: 246975 - RNA, 64 nt, Homo Sapiens; identical to SEQ ID NO: 246896

SEQ ID NO: 246976 - RNA, 64 nt, Homo Sapiens; identical to SEQ ID NO: 246897

SEQ ID NO: 246977 - RNA, 57 nt, Homo Sapiens; identical to SEQ ID NO: 246898

SEQ ID NO: 246978 - RNA, 64 nt, Homo Sapiens; identical to SEQ ID NO: 246899

SEQ ID NO: 246979 - RNA, 54 nt, Homo Sapiens; identical to SEQ ID NO: 246900

SEQ ID NO: 246980 - RNA, 64 nt, Homo Sapiens; identical to SEQ ID NO: 246901

SEQ ID NO: 246981 - RNA, 64 nt, Homo Sapiens
cugcguggcuccaugaaaagccuggguguugcuuccgggccagugagugcucuuaaauguugaa

SEQ ID NO: 246982 - RNA, 64 nt, Homo Sapiens
ucgugggggacaagucucgccccucccgcccagcccgggccaccgcaugcucccugcggcccug

SEQ ID NO: 246983 - RNA, 52 nt, Homo Sapiens
cccggaucacgacgcucugagcccgggccacgcaggggcucugagcccgggc

SEQ ID NO: 246984 - RNA, 64 nt, Homo Sapiens
cgcucugagcccgggccacgcaggggcucugagcccgggccacgcaggggcccugagccaaaag

SEQ ID NO: 246985 - RNA, 64 nt, Homo Sapiens
ccuuaggaauaaucacuucaacuccugauuggucccgggccaagcugaauagcccuuaugaauc

SEQ ID NO: 246986 - RNA, 64 nt, Homo Sapiens
ccuuaugaaucaucacuucgguuccugauuggucccgggccaaggucccagaccaagcugaauc

SEQ ID NO: 246987 - RNA, 64 nt, Homo Sapiens
uuaaugcuuauuaaucucucacaagcaucuuugucuugcaaauccuaagggaaaagcaaguccc

SEQ ID NO: 246988 - RNA, 64 nt, Homo Sapiens
aguuuucuuugacaaaaauguguacuguguaagccuugcaaacaaaaaacaacaaaaaagaagc

SEQ ID NO: 246989 - RNA, 64 nt, Homo Sapiens
aacuagaggcuggcuucacugcaugacacagguucuugcaaagaccacacuuguggggacuuag

SEQ ID NO: 246990 - RNA, 64 nt, Homo Sapiens
gaauucauaacacuuggcacuauucaaucaccaacuugcaaacaacuuugcucugauuaacuag

SEQ ID NO: 246991 - RNA, 64 nt, Homo Sapiens
ugccaggcugucuucugucccuaaucuggacuugcuugcaaaggccuugggguuggccguuccu

SEQ ID NO: 246992 - RNA, 64 nt, Homo Sapiens
guuuuuucuuccgaauaguuauguggcucuagcacuugcaaauuccccuucuaccaggcugcaa

SEQ ID NO: 246993 - RNA, 64 nt, Homo Sapiens
aaaagaaagugagggguuuucagaccuguaaggacuugcaaaacugccccagaguugcugugga

SEQ ID NO: 246994 - RNA, 64 nt, Homo Sapiens
guuuucaaucuaaaaagaaguauuggcaguuucacuugcaaaauuacacagcuggucccuguga

SEQ ID NO: 246995 - RNA, 64 nt, Homo Sapiens
cuucuauucugaucugcaaauagcuuaaaugucucuugcaaaacaaaguaagauaccaccagua

SEQ ID NO: 246996 - RNA, 64 nt, Homo Sapiens
ccugcuugacagacucacucggccucacuucauccuugcaaagagaauccuguacuucauccuu

SEQ ID NO: 246997 - RNA, 64 nt, Homo Sapiens
cuucauccuugcaaagagaauccuguacuucauccuugcaaagagaauccuguacuucacucag

SEQ ID NO: 246998 - RNA, 64 nt, Homo Sapiens
cuuucuagauagauuuuauuuauuuuguuucuuuaaucugcacauuguaacaguuauuucagga

SEQ ID NO: 246999 - RNA, 64 nt, Homo Sapiens
gugugaagggauuagaugggugggccuguuucccaaucugcaaaaugagcucagagaagcuccg

SEQ ID NO: 247000 - RNA, 64 nt, Homo Sapiens
gggucucagugaaugaacgugccccauuuacaggaaucugcacucaccuguggccucugagacc

SEQ ID NO: 247001 - RNA, 64 nt, Homo Sapiens
gucucugaagagaacucucuggcuuaguccugagaaucugcaaauuugauucauuccugagaau

SEQ ID NO: 247002 - RNA, 64 nt, Homo Sapiens
caugccaauucagcauaaaaaagaauaaaauugaaaucugcauuaauguuuuugucucaagaac

SEQ ID NO: 247003 - RNA, 64 nt, Homo Sapiens
ugcacauuaaugcaaauuaacacugaaauauuaaaaucugcaaaauaauguaugaugagguuaa

SEQ ID NO: 247004 - RNA, 64 nt, Homo Sapiens
uccuaucuacaugagcccucuuagagaccucagaaaucugcagaaaguucccugugucugucua

SEQ ID NO: 247005 - RNA, 64 nt, Homo Sapiens
uaaagucuguuggcugugacgucauuauaccuaaaaucugcaucauaccugcaagccaacaguu

SEQ ID NO: 247006 - RNA, 64 nt, Homo Sapiens
gaaauaaucagcagaaacggaauggaaugccaagaaucugcauugagaauaacuaaacauuguu

SEQ ID NO: 247007 - RNA, 64 nt, Homo Sapiens
caaccguaucauuauuuguuugaggaaaaaaagaaaucugcauuuuaauucauguuggucaaag

SEQ ID NO: 247008 - RNA, 64 nt, Homo Sapiens
uuacaacucggggacaaaugaugacaaaaccuuuaaucugcacccccucugauuuccuucugcu

SEQ ID NO: 247009 - RNA, 64 nt, Homo Sapiens
caugccaggccucagggaucguucucuguagcucaaucugcaaacacuugcgacaccucaaggu

SEQ ID NO: 247010 - RNA, 64 nt, Homo Sapiens
aguugcuuuuguacccuuuaggcaaacagaaagaaaucugcaugaggaucucuguuuuuccugg

SEQ ID NO: 247011 - RNA, 64 nt, Homo Sapiens
aauuaagagagcugauuagaacauccauuuuagaaaucugcacacaacaucauaaccagcuuuu

SEQ ID NO: 247012 - RNA, 64 nt, Homo Sapiens
ucuuacuacuauaacaacucuaaaccugguuuaaaugaaacaucuaauuuugcuguaaggcuua

SEQ ID NO: 247013 - RNA, 64 nt, Homo Sapiens
ggaagaauguucaaguugaauccuaaugccgugaaugaaacacagucuguguagggaaugagca

SEQ ID NO: 247014 - RNA, 64 nt, Homo Sapiens
uugcaauuacugguuggggggugcauuuuaaaagaugaaacaugcagcuucccuacauuacaca

SEQ ID NO: 247015 - RNA, 64 nt, Homo Sapiens
cucagaaauccuucaaacaugauuaauuaugaagaugaaacacuagagucauauaagaaauaaa

SEQ ID NO: 247016 - RNA, 64 nt, Homo Sapiens
uagcuguugacguuugcucaaugccaagggguuaaugaaacaaagagaaaauccccaacuaugc

SEQ ID NO: 247017 - RNA, 64 nt, Homo Sapiens
uugagccagagagcaucuuuacuuaaagggucuuaugaaacaaugcauaugcacagucaagguc

SEQ ID NO: 247018 - RNA, 64 nt, Homo Sapiens
auuccugucuaugcauuuugugagguacaaacugaugaaacagugagugauagagaauuucugc

SEQ ID NO: 247019 - RNA, 64 nt, Homo Sapiens
uguuuaaccauuaagaaaugcuguauucuuaaauaugaaacaguuaaucuaaagucuuauuauu

SEQ ID NO: 247020 - RNA, 64 nt, Homo Sapiens
ggcaagauuuucagaaaaaugaguaaaauaauuaaugaaacauauuuagagcacuuaauggucu

SEQ ID NO: 247021 - RNA, 64 nt, Homo Sapiens
ugcugcuuuuagggacaauuaaaacugggaaacuaugaaacauggaacauuuuauccuaccuga

SEQ ID NO: 247022 - RNA, 64 nt, Homo Sapiens
cacugggcagcugcagguuuuuccuucucaauaaaugaaacaaaaucugcuaauuuuuucccuc

SEQ ID NO: 247023 - RNA, 64 nt, Homo Sapiens
gugaagagaagcuguccgugaaaucauccuugacaugaaacaggagugaguaaccucgauauua

SEQ ID NO: 247024 - RNA, 64 nt, Homo Sapiens
aaauguucauuuauacugguugcauuuuaagaucaugaaacaauuccaguuacauuguaaaaag

SEQ ID NO: 247025 - RNA, 64 nt, Homo Sapiens
aacaaguuagaggcauaagcuuaagagcauuuccaugaaacaacacaugcagcauuccaggaac

SEQ ID NO: 247026 - RNA, 64 nt, Homo Sapiens
ugacauaaugguaaccagucuggcuuugccagcaaugaaacagcaugaugagagagaagguaag

SEQ ID NO: 247027 - RNA, 64 nt, Homo Sapiens
auaagcaguggaucuugcauacucaaauuuucaaaugaaacaaaaaaaaauccuugaacuaaug

SEQ ID NO: 247028 - RNA, 64 nt, Homo Sapiens
gggaaagggcauggcugugucuuuugcacccaauaugaaacaucuucucccaacacugcuuuaa

SEQ ID NO: 247029 - RNA, 64 nt, Homo Sapiens
uuuuuuuggcccugggcccaacaguuuguacuucaugaaacauauuguacauuuuacauaguuu

SEQ ID NO: 247030 - RNA, 64 nt, Homo Sapiens
uuauauuuguacaaucgaguauuuuagaaauuacaugaaacaugaaacaguuuuugcaauuuuu

SEQ ID NO: 247031 - RNA, 64 nt, Homo Sapiens
uguacaaucgaguauuuuagaaauuacaugaaacaugaaacaguuuuugcaauuuuuuuuaaac

SEQ ID NO: 247032 - RNA, 64 nt, Homo Sapiens
acuuaauuuggaaauuuuauuguccuauugcaaaaugaaacaaaauuaaaaguggccucgagua

SEQ ID NO: 247033 - RNA, 64 nt, Homo Sapiens
cccacugucuguggcccauugucauuguuuccucaugaaacauugcagaguuugaauccucagu

SEQ ID NO: 247034 - RNA, 64 nt, Homo Sapiens
aaaacaauuacuaaugaggugacauuagaaaaaaaugaaacaacaggugagcugguagagggga

SEQ ID NO: 247035 - RNA, 64 nt, Homo Sapiens
agagacagugaaaguuuuaaucacuggugagacaaugaaacaacgcguggaaaucucagauucu

SEQ ID NO: 247036 - RNA, 64 nt, Homo Sapiens
ucagaaauuauuuugauaagugucuauguuucauaugaaacauuauauccucuuuuuauugcuu

SEQ ID NO: 247037 - RNA, 64 nt, Homo Sapiens
ugaaaguucuugcuauaauguuguaaacgguaacaugaaacaaaugugugugugugcauuaaag

SEQ ID NO: 247038 - RNA, 64 nt, Homo Sapiens
cuaaugcauuagagaaaaaaaucugagcaaagguaugaaacagcgaucuggcugagagggaaua

SEQ ID NO: 247039 - RNA, 64 nt, Homo Sapiens
aaaaagaaaaugaaaaguaucaggaauuguccuuaugaaacaagucauaagacagaacauuugg

SEQ ID NO: 247040 - RNA, 64 nt, Homo Sapiens
cagcauugacauuuuauuuuaauuuuuaaguucuaugaaacagccaauagaauaaugagaauug

SEQ ID NO: 247041 - RNA, 64 nt, Homo Sapiens
acuauaauuguggggggaacucucagagggagaaaugaaacauuguugguuuuucuuaauacau

SEQ ID NO: 247042 - RNA, 64 nt, Homo Sapiens
uuugaggaacaccucucaucauaacuacauuuaaaugaaacaacuguauuaauauuuuaaauau

SEQ ID NO: 247043 - RNA, 64 nt, Homo Sapiens
agauuauuguuaauuguauucacccuaauaaucuaugaaacacuaggucuuacuucuucuaucu

SEQ ID NO: 247044 - RNA, 64 nt, Homo Sapiens
agucacucuucuaauugaauauuuuuauauuuuuaugaaacaaaagagcauuucuucagguuuc

SEQ ID NO: 247045 - RNA, 64 nt, Homo Sapiens
cauauuuuaaggaaggagcuaaaaauggaaauucaugaaacauaaaugguaucaagaacuuuau

SEQ ID NO: 247046 - RNA, 64 nt, Homo Sapiens
cauauuuaaaaauaucucaagguuucuguucauuaugaaacaucaauauguuuucuaccauuug

SEQ ID NO: 247047 - RNA, 64 nt, Homo Sapiens
guauauuuaacuuauaaaguuaauaaauaguuaaaugaaacaaaguuuauaggugaccuuuagu

SEQ ID NO: 247048 - RNA, 64 nt, Homo Sapiens
auccugacaaguuuggaaaaauaaaagucuagaaaugaaacacauccucaucaucccuuugaga

SEQ ID NO: 247049 - RNA, 64 nt, Homo Sapiens
uuaaauguccuucagccuccuuuguaaugaguacaugaaacacgcucugguagcuggggaauga

SEQ ID NO: 247050 - RNA, 64 nt, Homo Sapiens
gcuggggucauuuaugaaaaauacaguuugucacaugaaacauuugcaaaauuguuuuugguug

SEQ ID NO: 247051 - RNA, 64 nt, Homo Sapiens
uaaggaugugggggaagaccuggcaaggacacagaugaaacacaaacaauaguaauucucaggc

SEQ ID NO: 247052 - RNA, 64 nt, Homo Sapiens
aaguggcagggagauacaauaaauguuucuauauaugaaacauaugguaauaugucauuucuau

SEQ ID NO: 247053 - RNA, 64 nt, Homo Sapiens
caccaccauauugccauuaggggaaaaauuagugaugaaacagcgugacguccuggugacuugg

SEQ ID NO: 247054 - RNA, 64 nt, Homo Sapiens
caauuauggaaauaguacuaaaggcuugccgcacaugaaacauuauuuuaauugguuuaaaguc

SEQ ID NO: 247055 - RNA, 64 nt, Homo Sapiens
acucuuaaguuuuguuuagcaauguguuucugguaugaaacaaacuacugugucacuguccagg

SEQ ID NO: 247056 - RNA, 64 nt, Homo Sapiens
augugagcagagacgcauaacauccaauucugagaugaaacagucuaaaauaggaguaaagcau

SEQ ID NO: 247057 - RNA, 64 nt, Homo Sapiens
uauaauugacauauugaaaaaguauaugaacauaaugaaacaccucauuuauuugauaauucac

SEQ ID NO: 247058 - RNA, 64 nt, Homo Sapiens
uucagagaggggaagugauuuuuuuuaagacaggaugaaacagguccucuuccucucccauuuc

SEQ ID NO: 247059 - RNA, 64 nt, Homo Sapiens
gugagugcucgucacuggguaaagauaauuaaaaaugaaacaaauaaucgguacaguuauucuu

SEQ ID NO: 247060 - RNA, 64 nt, Homo Sapiens
auguaguuaguuugauacuccuuagaauaaaaaaaugaaacaguaacaacuuuuauguaaaaaa

SEQ ID NO: 247061 - RNA, 64 nt, Homo Sapiens
uauuguuuuuuaaggaucuccucucacagugguaaugaaacauuaacuguaacagaaauuuaca

SEQ ID NO: 247062 - RNA, 64 nt, Homo Sapiens
ucaguccuccucauucaccaugugagcggggcuuuagccggaagagccuuaugucugcagagag

SEQ ID NO: 247063 - RNA, 64 nt, Homo Sapiens
ucagaccuccucagucaccagugugggagggcuuuagccggaagaagcccuacgucugcagaga

SEQ ID NO: 247064 - RNA, 64 nt, Homo Sapiens
ggaaaggcauguguuucuugcuggugacucauugccuucacaccacuggguuugccagaaacag

SEQ ID NO: 247065 - RNA, 64 nt, Homo Sapiens
aggagguagcaggagaggaccagguccccaagucccuucacaggguccccacccccacuggcuu

SEQ ID NO: 247066 - RNA, 64 nt, Homo Sapiens
uaguucaauuuauugcaauuuaauuacaauacuaccuucacaacauuuucauguguuuuaaaua

SEQ ID NO: 247067 - RNA, 64 nt, Homo Sapiens
cacugugaaugaacuuuguauuauuuuuuuaaaaccuucacauuacguguagauauuauugcaa

SEQ ID NO: 247068 - RNA, 64 nt, Homo Sapiens
guaauuuaauguguuuuauaucauuuuuaaaauuccuucacacuauuuaaugaggauacacugu

SEQ ID NO: 247069 - RNA, 64 nt, Homo Sapiens
gagcugauggucucuacagguacugaggcucaagccuucacaguuuuuuuccucaaauuuuacc

SEQ ID NO: 247070 - RNA, 64 nt, Homo Sapiens
ccuuucccaucuggagagaagcuuccagaccagcccuucacacaccacagccaggaggggccuu

SEQ ID NO: 247071 - RNA, 64 nt, Homo Sapiens
ccguuccugccuggagagaagcuuccagaccagcccuucacaccacagccaggagaggccuuuc

SEQ ID NO: 247072 - RNA, 64 nt, Homo Sapiens
cucacagaggcaucaugcaaugcgaaaggaaaggccuucacaccggccuucacaccuucacagg

SEQ ID NO: 247073 - RNA, 64 nt, Homo Sapiens
ugcgaaaggaaaggccuucagauaggccuucacaccuucacagguagaaucauuaauggcccaa

SEQ ID NO: 247074 - RNA, 64 nt, Homo Sapiens
uucacaggugcgaaaggaaauggcccaagauaggccuucacaccgaaaaauauagaaucauuaa

SEQ ID NO: 247075 - RNA, 64 nt, Homo Sapiens
guaacucagaugaugccuccaacccuguggcugcccuucacacuuacaggccuaaccccagcag

SEQ ID NO: 247076 - RNA, 64 nt, Homo Sapiens
cucugccucucucagccgcaucacccuguugcuuccuucacagcaugucucaccaucugcaacc

SEQ ID NO: 247077 - RNA, 64 nt, Homo Sapiens
ggucguaugaguaaggggauccccuucacaccccccuucacaggcauaugcacaagcccaccaa

SEQ ID NO: 247078 - RNA, 64 nt, Homo Sapiens
ccccuucacaggggucguaucaagcccaccaaccccuucacaccuucacauucccucauaugca

SEQ ID NO: 247079 - RNA, 64 nt, Homo Sapiens
gagaaggguuuuucuuuuuugaccuuucuucucucaacaggaaccugccugaggacacccuucu

SEQ ID NO: 247080 - RNA, 64 nt, Homo Sapiens
gcauuuuucuuuugguacccaugugagacaugaacaacaggagggagggaaagagcccaggugg

SEQ ID NO: 247081 - RNA, 64 nt, Homo Sapiens
gaauggaagagaggagaggggaagaaaugaguaccaacaggaaguaaauguuuauuaaaaguua

SEQ ID NO: 247082 - RNA, 64 nt, Homo Sapiens
aauagaaaugaagcagugaggaaauuacucccugcaacaggaggggaagugagacaaaggagaa

SEQ ID NO: 247083 - RNA, 64 nt, Homo Sapiens
auugucucccauccuagucuguccuggucccuggcaacaggaaccugggcagcuuauccugccc

SEQ ID NO: 247084 - RNA, 64 nt, Homo Sapiens
uguggaccccagccgagcgcggcaagcgcuguuccaacaggagauggcccgccuugcccgagaa

SEQ ID NO: 247085 - RNA, 64 nt, Homo Sapiens
augcauuugcucaauucucauggagucuccuuuccaacaggauggagcuacuagaaaagcugag

SEQ ID NO: 247086 - RNA, 64 nt, Homo Sapiens
ugagcccagagcauggcacaaggcuugccagagccaacaggaagcaccuggaggacaugcacca

SEQ ID NO: 247087 - RNA, 55 nt, Homo Sapiens
augaacaagagggaaaguaguccuccaacaggaugaagcagauuaacagaagagu

SEQ ID NO: 247088 - RNA, 64 nt, Homo Sapiens
auuuagaacuuuguguguucuuaaagugugcuuccaacaggaaggucagugauaaauuuucaaa

SEQ ID NO: 247089 - RNA, 64 nt, Homo Sapiens
caacagggaaaaaaucucauaacauugacaucugcaacaggaggauggguacucugaacucauu

SEQ ID NO: 247090 - RNA, 64 nt, Homo Sapiens
cacauuguuaauuuauaaauuuuccccaauuucacaacaggauuuuaaauugagguggacauua

SEQ ID NO: 247091 - RNA, 64 nt, Homo Sapiens
uaacacaggccucuuguuccacaggacuuaacaucaacaggacuguguuuaccuggugcucuca

SEQ ID NO: 247092 - RNA, 64 nt, Homo Sapiens
uaacaucaacaggacuuaacuuaccuggugcucucaacaggacuagagaaggggugcagagugu

SEQ ID NO: 247093 - RNA, 64 nt, Homo Sapiens
ccucgccaagugggaaugccuacuccagucuugccaacaggacuccaggguucgguaggugggg

SEQ ID NO: 247094 - RNA, 64 nt, Homo Sapiens
caguaaggcuccaucaggacugggucagugauggcaacaggauggccaaggauggcucuagaac

SEQ ID NO: 247095 - RNA, 64 nt, Homo Sapiens; identical to SEQ ID NO: 51559

SEQ ID NO: 247096 - RNA, 64 nt, Homo Sapiens; identical to SEQ ID NO: 51560

SEQ ID NO: 247097 - RNA, 64 nt, Homo Sapiens; identical to SEQ ID NO: 51561

SEQ ID NO: 247098 - RNA, 64 nt, Homo Sapiens; identical to SEQ ID NO: 51562

SEQ ID NO: 247099 - RNA, 64 nt, Homo Sapiens; identical to SEQ ID NO: 51563

SEQ ID NO: 247100 - RNA, 64 nt, Homo Sapiens; identical to SEQ ID NO: 51564

SEQ ID NO: 247101 - RNA, 64 nt, Homo Sapiens; identical to SEQ ID NO: 51565

SEQ ID NO: 247102 - RNA, 64 nt, Homo Sapiens; identical to SEQ ID NO: 51566

SEQ ID NO: 247103 - RNA, 64 nt, Homo Sapiens; identical to SEQ ID NO: 51567

SEQ ID NO: 247104 - RNA, 64 nt, Homo Sapiens; identical to SEQ ID NO: 51568

SEQ ID NO: 247105 - RNA, 64 nt, Homo Sapiens; identical to SEQ ID NO: 51569

SEQ ID NO: 247106 - RNA, 64 nt, Homo Sapiens; identical to SEQ ID NO: 51570

SEQ ID NO: 247107 - RNA, 64 nt, Homo Sapiens; identical to SEQ ID NO: 51571

SEQ ID NO: 247108 - RNA, 64 nt, Homo Sapiens; identical to SEQ ID NO: 51572

SEQ ID NO: 247109 - RNA, 64 nt, Homo Sapiens; identical to SEQ ID NO: 51573

SEQ ID NO: 247110 - RNA, 64 nt, Homo Sapiens; identical to SEQ ID NO: 51574

SEQ ID NO: 247111 - RNA, 64 nt, Homo Sapiens; identical to SEQ ID NO: 51575

SEQ ID NO: 247112 - RNA, 64 nt, Homo Sapiens; identical to SEQ ID NO: 51576

SEQ ID NO: 247113 - RNA, 64 nt, Homo Sapiens; identical to SEQ ID NO: 51577

SEQ ID NO: 247114 - RNA, 64 nt, Homo Sapiens; identical to SEQ ID NO: 51578

SEQ ID NO: 247115 - RNA, 64 nt, Homo Sapiens; identical to SEQ ID NO: 92469

SEQ ID NO: 247116 - RNA, 64 nt, Homo Sapiens; identical to SEQ ID NO: 92470

SEQ ID NO: 247117 - RNA, 64 nt, Homo Sapiens; identical to SEQ ID NO: 92471

SEQ ID NO: 247118 - RNA, 64 nt, Homo Sapiens; identical to SEQ ID NO: 92472

SEQ ID NO: 247119 - RNA, 64 nt, Homo Sapiens; identical to SEQ ID NO: 92473

SEQ ID NO: 247120 - RNA, 64 nt, Homo Sapiens; identical to SEQ ID NO: 92474

SEQ ID NO: 247121 - RNA, 63 nt, Homo Sapiens; identical to SEQ ID NO: 92475

SEQ ID NO: 247122 - RNA, 64 nt, Homo Sapiens; identical to SEQ ID NO: 92476

SEQ ID NO: 247123 - RNA, 64 nt, Homo Sapiens; identical to SEQ ID NO: 92477

SEQ ID NO: 247124 - RNA, 64 nt, Homo Sapiens; identical to SEQ ID NO: 92478

SEQ ID NO: 247125 - RNA, 64 nt, Homo Sapiens; identical to SEQ ID NO: 92479

SEQ ID NO: 247126 - RNA, 64 nt, Homo Sapiens; identical to SEQ ID NO: 92480

SEQ ID NO: 247127 - RNA, 64 nt, Homo Sapiens; identical to SEQ ID NO: 92481

SEQ ID NO: 247128 - RNA, 64 nt, Homo Sapiens; identical to SEQ ID NO: 92482

SEQ ID NO: 247129 - RNA, 64 nt, Homo Sapiens; identical to SEQ ID NO: 92483

SEQ ID NO: 247130 - RNA, 64 nt, Homo Sapiens; identical to SEQ ID NO: 92484

SEQ ID NO: 247131 - RNA, 64 nt, Homo Sapiens; identical to SEQ ID NO: 92485

SEQ ID NO: 247132 - RNA, 64 nt, Homo Sapiens; identical to SEQ ID NO: 92486

SEQ ID NO: 247133 - RNA, 64 nt, Homo Sapiens; identical to SEQ ID NO: 92487

SEQ ID NO: 247134 - RNA, 64 nt, Homo Sapiens; identical to SEQ ID NO: 92488

SEQ ID NO: 247135 - RNA, 64 nt, Homo Sapiens; identical to SEQ ID NO: 92489

SEQ ID NO: 247136 - RNA, 64 nt, Homo Sapiens; identical to SEQ ID NO: 92490

SEQ ID NO: 247137 - RNA, 64 nt, Homo Sapiens; identical to SEQ ID NO: 92491

SEQ ID NO: 247138 - RNA, 64 nt, Homo Sapiens; identical to SEQ ID NO: 92492

SEQ ID NO: 247139 - RNA, 64 nt, Homo Sapiens; identical to SEQ ID NO: 92493

SEQ ID NO: 247140 - RNA, 64 nt, Homo Sapiens; identical to SEQ ID NO: 92494

SEQ ID NO: 247141 - RNA, 64 nt, Homo Sapiens; identical to SEQ ID NO: 92495

SEQ ID NO: 247142 - RNA, 64 nt, Homo Sapiens; identical to SEQ ID NO: 92496

SEQ ID NO: 247143 - RNA, 64 nt, Homo Sapiens; identical to SEQ ID NO: 92497

SEQ ID NO: 247144 - RNA, 64 nt, Homo Sapiens; identical to SEQ ID NO: 92498

SEQ ID NO: 247145 - RNA, 64 nt, Homo Sapiens; identical to SEQ ID NO: 92499

SEQ ID NO: 247146 - RNA, 64 nt, Homo Sapiens; identical to SEQ ID NO: 92500

SEQ ID NO: 247147 - RNA, 64 nt, Homo Sapiens; identical to SEQ ID NO: 92501

SEQ ID NO: 247148 - RNA, 64 nt, Homo Sapiens; identical to SEQ ID NO: 92502

SEQ ID NO: 247149 - RNA, 64 nt, Homo Sapiens; identical to SEQ ID NO: 92503

SEQ ID NO: 247150 - RNA, 64 nt, Homo Sapiens; identical to SEQ ID NO: 92504

SEQ ID NO: 247151 - RNA, 64 nt, Homo Sapiens; identical to SEQ ID NO: 92505

SEQ ID NO: 247152 - RNA, 64 nt, Homo Sapiens; identical to SEQ ID NO: 92506

SEQ ID NO: 247153 - RNA, 64 nt, Homo Sapiens; identical to SEQ ID NO: 92507

SEQ ID NO: 247154 - RNA, 64 nt, Homo Sapiens; identical to SEQ ID NO: 92508

SEQ ID NO: 247155 - RNA, 64 nt, Homo Sapiens; identical to SEQ ID NO: 92509

SEQ ID NO: 247156 - RNA, 64 nt, Homo Sapiens; identical to SEQ ID NO: 92510

SEQ ID NO: 247157 - RNA, 64 nt, Homo Sapiens; identical to SEQ ID NO: 92511

SEQ ID NO: 247158 - RNA, 64 nt, Homo Sapiens; identical to SEQ ID NO: 92512

SEQ ID NO: 247159 - RNA, 64 nt, Homo Sapiens; identical to SEQ ID NO: 92513

SEQ ID NO: 247160 - RNA, 64 nt, Homo Sapiens; identical to SEQ ID NO: 92514

SEQ ID NO: 247161 - RNA, 64 nt, Homo Sapiens; identical to SEQ ID NO: 92515

SEQ ID NO: 247162 - RNA, 64 nt, Homo Sapiens; identical to SEQ ID NO: 92516

SEQ ID NO: 247163 - RNA, 64 nt, Homo Sapiens; identical to SEQ ID NO: 92517

SEQ ID NO: 247164 - RNA, 64 nt, Homo Sapiens; identical to SEQ ID NO: 92518

SEQ ID NO: 247165 - RNA, 63 nt, Homo Sapiens
guucugaaauauggaauguaauuggacugucuggaaagcuaaagaauuuguaaacaaaacaaa

SEQ ID NO: 247166 - RNA, 63 nt, Homo Sapiens
agcaaauuuaugaaacuaaauaugccuguugaugaaagcuaaaaucaugguagguuaagaaaa

SEQ ID NO: 247167 - RNA, 63 nt, Homo Sapiens
uuaaaaacaagacaucuccagguaggaaaaaaugaaagcuauuucaugcaaacauuaucuaau

SEQ ID NO: 247168 - RNA, 63 nt, Homo Sapiens
uggcagugauuggucuguuuguggagaauguaugaaagcuauuaauauucuagaauagauuaa

SEQ ID NO: 247169 - RNA, 63 nt, Homo Sapiens
gugauccuaaauaugacaguuuggaaaucaguagaaagcuaaauaaaugaaucgcaaguuaac

SEQ ID NO: 247170 - RNA, 63 nt, Homo Sapiens
ugaaucgcaaguuaacuuggaagagcuauuuuagaaagcuaaaauaaccaguaaggaaauauu

SEQ ID NO: 247171 - RNA, 63 nt, Homo Sapiens
cgucaguggggcaagaaaucuggagugagugaagaaagcuaaguugugaacaagaguguuuuu

SEQ ID NO: 247172 - RNA, 63 nt, Homo Sapiens
aaaauuggaagagacuucaaagacugucaaguggaaagcuaucauuuccuaaauuaaggaacu

SEQ ID NO: 247173 - RNA, 63 nt, Homo Sapiens
uucagccuucaaacuacuacugaucaacuaaaggaaagcuaauaagguauuucuuuuaaacaa

SEQ ID NO: 247174 - RNA, 63 nt, Homo Sapiens
guauuccgucugcacaggcaaccaaggccaguagaaagcuauggcugcaaaacccuggggugg

SEQ ID NO: 247175 - RNA, 64 nt, Homo Sapiens
cccggagguaagguucagaaagucccccuggggacuccuccaucuucggcagcucuggcucaaa

SEQ ID NO: 247176 - RNA, 64 nt, Homo Sapiens
ggggauucaagguaaauaggcuuuacaggcuccccuccuccaaacacacacagaaugggcuggu

SEQ ID NO: 247177 - RNA, 64 nt, Homo Sapiens
cguggcagguuuacgucaauagucccucucucugcuccuccauucgcaagugucuuccugggcc

SEQ ID NO: 247178 - RNA, 64 nt, Homo Sapiens
caccccugccacucuguggucggugcccugcuuccuccuccacuccuggccgccuucuccagcg

SEQ ID NO: 247179 - RNA, 64 nt, Homo Sapiens
ugccacggaugggccacggacuuguguuccugugcuccuccacucuugaguucagggcggccuc

SEQ ID NO: 247180 - RNA, 64 nt, Homo Sapiens
ugcuggcaggggcuggcaccaguccgaggccagccuccuccagcgccccaccugcucaagucua

SEQ ID NO: 247181 - RNA, 64 nt, Homo Sapiens
ugccagagcgccucagcacaggagugcaaucagccuccuccagcguccagacaguccuguuugu

SEQ ID NO: 247182 - RNA, 64 nt, Homo Sapiens
ccuggccgugcccgcucaggugugugugcggccgcuccuccaggcagggagccuagcgccuggc

SEQ ID NO: 247183 - RNA, 64 nt, Homo Sapiens
uaaaccccuucgacucuucucccugucagcugcccuccuccaccugacuuaacaacuccaggag

SEQ ID NO: 247184 - RNA, 64 nt, Homo Sapiens
cagagggucuggaccauccauccuggcuccaccacuccuccagcccucauggcugaaggcccag

SEQ ID NO: 247185 - RNA, 64 nt, Homo Sapiens
agagcuggauguuuugcgugcuuacccagaaccacuccuccaggcagcagaggaccgguugcag

SEQ ID NO: 247186 - RNA, 64 nt, Homo Sapiens
caugcucuugucccucacuggagauccugaccagcuccuccagucggugccaggggaccccccg

SEQ ID NO: 247187 - RNA, 64 nt, Homo Sapiens
cacacccccuugguacccauucccauuucacaaacuccuccaaaccccaaaccccaaacggaaa

SEQ ID NO: 247188 - RNA, 64 nt, Homo Sapiens
cccaaaccccaaacggaaaucucugggacaauggcuccuccagagggccccucagagccaggug

SEQ ID NO: 247189 - RNA, 64 nt, Homo Sapiens
cuccuagccccgaggugcuggugacuggcagcuucuccuccagagaggggagaguaugaggagg

SEQ ID NO: 247190 - RNA, 64 nt, Homo Sapiens
aaccuccacaucuccaaaaagagcuccucccacccuccuccaggaagcaugucuggccgccucu

SEQ ID NO: 247191 - RNA, 64 nt, Homo Sapiens
ccaggccuccacccccacccccguuugcugggggcuccuccagccgcccccaugggaagaggcc

SEQ ID NO: 247192 - RNA, 64 nt, Homo Sapiens
gucuguugguggccaagaccuucucucuccaccccuccuccauccacccugaggacccuggggc

SEQ ID NO: 247193 - RNA, 64 nt, Homo Sapiens
caccccuccguuccgcuagccacccccugcuacucuccuccacacuguuucaacuugacccucc

SEQ ID NO: 247194 - RNA, 64 nt, Homo Sapiens
ugcgguccacacaucaguaagucgccacucaugucuccuccacacacccggccugcugcuugcu

SEQ ID NO: 247195 - RNA, 64 nt, Homo Sapiens
uugcauuucaguuucuuuccuggcuuguccaacucuccuccagguuucccaugaguggaaaaug

SEQ ID NO: 247196 - RNA, 64 nt, Homo Sapiens
agguacaguccucauuguggucacuugaugaaaacuccuccaaauugguauccagggcucaugu

SEQ ID NO: 247197 - RNA, 64 nt, Homo Sapiens
uucagagcuagcagguucaguggcucuuggcccccuccuccaucuagaggcugccuacauuccu

SEQ ID NO: 247198 - RNA, 64 nt, Homo Sapiens
uccaaacuuagugaaauggcuucuuggcuugccucuccuccaaucugccuuccuggccucuuga

SEQ ID NO: 247199 - RNA, 64 nt, Homo Sapiens
cgccugggagcacaaaggccaccguggggcugcccuccuccaugcauguuggggagacuccagc

SEQ ID NO: 247200 - RNA, 64 nt, Homo Sapiens
ccaggaaccccagaaggagacgcuguuggggagacuccuccagauggaaaacagccagcuuugg

SEQ ID NO: 247201 - RNA, 64 nt, Homo Sapiens
cacuccaguccacacucccccaucucauccaugccuccuccauguucagaucaccucugcgcca

SEQ ID NO: 247202 - RNA, 61 nt, Homo Sapiens
acuacuacacccgcagcuagcauccccacuccuccuccagcccacccaaccgccuuggguc

SEQ ID NO: 247203 - RNA, 64 nt, Homo Sapiens
caagcccacuggccagcucuggcucagggcccaccuccuccagcgaguaccccagccacuccuc

SEQ ID NO: 247204 - RNA, 64 nt, Homo Sapiens
agaauguucucacaccauuucacuuccucuuccucuccuccagcauucuccucugagcagccuu

SEQ ID NO: 247205 - RNA, 64 nt, Homo Sapiens
ugucuuaagaaccagcccacaacagccucucuuucuccuccacauacugcagccucccuccaug

SEQ ID NO: 247206 - RNA, 64 nt, Homo Sapiens
gccgacaagugauggccuccugggagagccccgccuccuccaccccugccucuccuccaccccu

SEQ ID NO: 247207 - RNA, 64 nt, Homo Sapiens
uccugggagagccccgccuccuccaccccugccucuccuccaccccugccuccccuccaccccu

SEQ ID NO: 247208 - RNA, 64 nt, Homo Sapiens
cuccuccaccccugccuccccuccaccccugccucuccuccacccgcccaggagagccccaccu

SEQ ID NO: 247209 - RNA, 64 nt, Homo Sapiens
cugccucuccuccacccgcccaggagagccccaccuccuccaccccugccucuccuccaccccu

SEQ ID NO: 247210 - RNA, 64 nt, Homo Sapiens
gcccaggagagccccaccuccuccaccccugccucuccuccaccccugccuccccuccaccugc

SEQ ID NO: 247211 - RNA, 64 nt, Homo Sapiens
gcuaagaaagagggaugguguguccacuuuagcccuccuccaauaauugcaaaugccaggcauc

SEQ ID NO: 247212 - RNA, 64 nt, Homo Sapiens
cuuggcguauaauaauuuucggaggauccuuuuucuccuccaaccucccugguucuucuuacag

SEQ ID NO: 247213 - RNA, 64 nt, Homo Sapiens
auggccagguucuugugguguccagugcgcgucucuccuccaucacacucucccggcuugcgca

SEQ ID NO: 247214 - RNA, 64 nt, Homo Sapiens
acugggccaagccccaaccugccucccagccaggcuccuccaggccucugguuuagcggagccc

SEQ ID NO: 247215 - RNA, 64 nt, Homo Sapiens
ggaagucuaggagcugggagcaccaccuaggccacuccuccaaaaguuacucagcccugggccc

SEQ ID NO: 247216 - RNA, 64 nt, Homo Sapiens
gccacgugccaggcccggggccuggguggggcugcuccuccagguaggacagccuguggcggug

SEQ ID NO: 247217 - RNA, 64 nt, Homo Sapiens
gagccccauauuuugggaaaucuguuucacccuacuccuccagucaccauacagaucuguuuau

SEQ ID NO: 247218 - RNA, 64 nt, Homo Sapiens
uugguaaaauccucuccagaaagaaagcugauagcuccuccaugugcugucaaggaagaaaggu

SEQ ID NO: 247219 - RNA, 64 nt, Homo Sapiens
aagcugccguagaaagccaugcgcuacugcuuaccuccuccacucccccugccugcccccagca

SEQ ID NO: 247220 - RNA, 64 nt, Homo Sapiens
gagucacaucuuagcacuuccgcucucaggccuccuccuccaucacagaugucuggaugcuuuu

SEQ ID NO: 247221 - RNA, 64 nt, Homo Sapiens
uaggauuaaagugcuucugcccuuccacgaacuccuccuccauuuccuuuuugggauuugucac

SEQ ID NO: 247222 - RNA, 64 nt, Homo Sapiens
uugauguaugacaugucacccuucccaacuuggucuccuccaacaugcugucuucauguggagc

SEQ ID NO: 247223 - RNA, 64 nt, Homo Sapiens
ccugucucaucuccugggaggagggugggagauucuccuccagucugagggagggggaagaaga

SEQ ID NO: 247224 - RNA, 64 nt, Homo Sapiens
guucuggcuuagcagcugcacaccagugcuccagcuccuccaaauucagauuccugggaacaga

SEQ ID NO: 247225 - RNA, 64 nt, Homo Sapiens
gucuggggugaggaauguggggagcuugggcauccuccuccagccuccuccagcccccaggcag

SEQ ID NO: 247226 - RNA, 64 nt, Homo Sapiens
aggaauguggggagcuugggcauccuccuccagccuccuccagcccccaggcagugccuuaccu

SEQ ID NO: 247227 - RNA, 64 nt, Homo Sapiens
gccucgggccugggauuugaggagggcccuagaccuccuccacucuccauccccuuucccuucc

SEQ ID NO: 247228 - RNA, 64 nt, Homo Sapiens
agcccuuccuuccacccuggcaccaaaauaauuucuccuccauccguaccuugccuagccucuc

SEQ ID NO: 247229 - RNA, 64 nt, Homo Sapiens
aaaaauuacacgucgucagccacucagcccuucucuccuccagcccggggacccccgcgggccc

SEQ ID NO: 247230 - RNA, 64 nt, Homo Sapiens
uuguuugggucuuuugcuguuggaaugggaacuccuccuccauuugagcaacuugggaacaauu

SEQ ID NO: 247231 - RNA, 64 nt, Homo Sapiens
agcccuccccagauccccuuggggagccucugcccuccuccagcccggauggcucuccuccauu

SEQ ID NO: 247232 - RNA, 64 nt, Homo Sapiens
ggggagccucugcccuccuccagcccggauggcucuccuccauuuugguuuguuuccucuuguu

SEQ ID NO: 247233 - RNA, 64 nt, Homo Sapiens
uggccucuuccucuccuccuucccucccaucguccuccuccaccugcgccucccuugucugaac

SEQ ID NO: 247234 - RNA, 64 nt, Homo Sapiens
cucuucucucuccugcggcccagccucccucucccuccuccauuccucucucccugcccuuuuc

SEQ ID NO: 247235 - RNA, 64 nt, Homo Sapiens
ggucgauuccucgggacccacagucucaccacgucuccuccagaggacggcagaggguacaggu

SEQ ID NO: 247236 - RNA, 64 nt, Homo Sapiens
ccucgcccugcacauuccccaccuccacauuccccuccuccaagaucucagcuccuuaacauau

SEQ ID NO: 247237 - RNA, 64 nt, Homo Sapiens
uccugcuggcuccucgggggagcaccgcccccggcuccuccaggggguggggaagguuguuguc

SEQ ID NO: 247238 - RNA, 64 nt, Homo Sapiens
ugggaacaugcacccggagcgcuggcgccccguucuccuccaguuuuucuguagguuuagugug

SEQ ID NO: 247239 - RNA, 64 nt, Homo Sapiens
agagaaggacagucguggcagccgccuccuccgccuccuccacguggagcccaucccgauggaa

SEQ ID NO: 247240 - RNA, 64 nt, Homo Sapiens
uacgaagaacuggccagggcuccacagaaagugccuccuccacugagcaagaagcagcaugguc

SEQ ID NO: 247241 - RNA, 64 nt, Homo Sapiens
uuguggacucaggcacuggggccugucaccaaggcuccuccaacaugcgggaggaggcuuagca

SEQ ID NO: 247242 - RNA, 64 nt, Homo Sapiens
caagauguggcuccugccacacccacagggcagccuccuccaaaucccuccuggaggggccuac

SEQ ID NO: 247243 - RNA, 64 nt, Homo Sapiens
cuuuuaaaaaauuuaaaaacaaacagccacaccccuccuccaguccuucuccucaguucuugug

SEQ ID NO: 247244 - RNA, 64 nt, Homo Sapiens
ccagucuggggucgccugggccccugcugacccccuccuccagagcagccagcccagcccggga

SEQ ID NO: 247245 - RNA, 64 nt, Homo Sapiens
ggccacaccggccggacacgugguagaugcccaccuccuccaugccucggcgcucgaucuccuc

SEQ ID NO: 247246 - RNA, 64 nt, Homo Sapiens
agaugcccaccuccuccaugccucggcgcucgaucuccuccacgcacuggcgcacgauguaggg

SEQ ID NO: 247247 - RNA, 64 nt, Homo Sapiens
ucaccaucucccagacccucuucccuuugcccuucuccuccaauacauaaaggacacagacaag

SEQ ID NO: 247248 - RNA, 64 nt, Homo Sapiens
aauugggggaaauagaaggaacuaguaacugagacuccuccagccuccucccuauuggaauccc

SEQ ID NO: 247249 - RNA, 64 nt, Homo Sapiens
ucccaugccucuauguuaccgcuaguccuguguccuccuccacuccgggaggagaagguggugg

SEQ ID NO: 247250 - RNA, 64 nt, Homo Sapiens
cuauaagcagucaucuugggggggaccuguuugccuccuccacugugaccaucugguacauuga

SEQ ID NO: 247251 - RNA, 64 nt, Homo Sapiens
uugggggacccccgccaaagacugagcccccugucuccuccaucauuugguuuccucuuggcuu

SEQ ID NO: 247252 - RNA, 64 nt, Homo Sapiens
ucuuggcuuuggggauacuucuaaauuuugggagcuccuccaucuccaauggcugggauuugug

SEQ ID NO: 247253 - RNA, 64 nt, Homo Sapiens
ccacauaaaagugcucuccugccugggcagcaacaaccaagaacaaagccccgggacuguuuuc

SEQ ID NO: 247254 - RNA, 64 nt, Homo Sapiens
guauuaaaaagcugcguugguaaguuuuucauggaaccaagauuugacaaaggcaucucuuauc

SEQ ID NO: 247255 - RNA, 64 nt, Homo Sapiens
gaauguucacauugcuuuaccaguuuggcacuggaaccaagagcacaugucguggcuggcuaca

SEQ ID NO: 247256 - RNA, 64 nt, Homo Sapiens
aagugauuuagauaucuaucuaucuagauuucugaaccaagauauauuuauaguucacuuuugg

SEQ ID NO: 247257 - RNA, 64 nt, Homo Sapiens
aucccuggcucagaggauagcgguuuccaucauaaaccaagaugaugaguucagccuuuauccc

SEQ ID NO: 247258 - RNA, 64 nt, Homo Sapiens
uucccugggucagaggauagcgguuuccaucauaaaccaagaugaugaguucagccuuuauccc

SEQ ID NO: 247259 - RNA, 64 nt, Homo Sapiens
uggucagccugucugacauccagguugugcuauuaaccaagaaggaaacagauacuuggaggcu

SEQ ID NO: 247260 - RNA, 64 nt, Homo Sapiens
aauugcuugaacccgggagguggagguugcagugaaccaagaucgcggcgcugcacucuagccu

SEQ ID NO: 247261 - RNA, 64 nt, Homo Sapiens
uugaauguaauaagaugaauaaucgucauuguucaaccaagauucaucauucagaaaacuuuau

SEQ ID NO: 247262 - RNA, 64 nt, Homo Sapiens
aagaagccaagcaaaaaucaugguauaaagaggaaaccaagaaaauggaggggucuggggacca

SEQ ID NO: 247263 - RNA, 64 nt, Homo Sapiens
cacagguuuucuugucuugacaagaugcuugaaaaaccaagaggauaugaaaaucugucucugg

SEQ ID NO: 247264 - RNA, 64 nt, Homo Sapiens
auuuacuucuuauaaauugaagucuuaaaugugaaaccaagaaauguaaucaagcaguaaaaac

SEQ ID NO: 247265 - RNA, 64 nt, Homo Sapiens
cugacaggagggagaagaaaaaacaaaacacuugaaccaagaaacucaaauguaauccuacgau

SEQ ID NO: 247266 - RNA, 64 nt, Homo Sapiens
ucccccaaauaaacauugcuuuauuucuaauaauaaccaagacuuuucaagcuucuagaucuca

SEQ ID NO: 247267 - RNA, 64 nt, Homo Sapiens
aggaagagguugcuggagcagcuugagucgccugaaccaagagcccaugugcaagaaaaugagg

SEQ ID NO: 247268 - RNA, 58 nt, Homo Sapiens; identical to SEQ ID NO: 199452

SEQ ID NO: 247269 - RNA, 64 nt, Homo Sapiens
augagaaagcucaugggcaagaaacucuaugaauaaccaagauggagccgggugcaguugccaa

SEQ ID NO: 247270 - RNA, 64 nt, Homo Sapiens
cuugugagagauugagacacucuaaauaaauaauaaccaagaugggaaauuucccugccagacc

SEQ ID NO: 247271 - RNA, 64 nt, Homo Sapiens
gcugccuuuccccagggaauccucuccagaucuuaaccaagagccccuugcaaacuucuucgac

SEQ ID NO: 247272 - RNA, 64 nt, Homo Sapiens
gagauauuuccuccaggaaucguguuucaauuguaaccaagaaauuuccauuugugcuucauga

SEQ ID NO: 247273 - RNA, 55 nt, Homo Sapiens; identical to SEQ ID NO: 199457

SEQ ID NO: 247274 - RNA, 64 nt, Homo Sapiens
acuauagguuuaaaccaagacaaaugaagacugaaaccaagaauauuguucuuaugcuggaaau

SEQ ID NO: 247275 - RNA, 64 nt, Homo Sapiens; identical to SEQ ID NO: 49704

SEQ ID NO: 247276 - RNA, 64 nt, Homo Sapiens; identical to SEQ ID NO: 49705

SEQ ID NO: 247277 - RNA, 64 nt, Homo Sapiens; identical to SEQ ID NO: 49706

SEQ ID NO: 247278 - RNA, 64 nt, Homo Sapiens; identical to SEQ ID NO: 49707

SEQ ID NO: 247279 - RNA, 64 nt, Homo Sapiens; identical to SEQ ID NO: 49708

SEQ ID NO: 247280 - RNA, 64 nt, Homo Sapiens; identical to SEQ ID NO: 49709

SEQ ID NO: 247281 - RNA, 64 nt, Homo Sapiens; identical to SEQ ID NO: 49710

SEQ ID NO: 247282 - RNA, 64 nt, Homo Sapiens; identical to SEQ ID NO: 49711

SEQ ID NO: 247283 - RNA, 64 nt, Homo Sapiens; identical to SEQ ID NO: 49712

SEQ ID NO: 247284 - RNA, 64 nt, Homo Sapiens; identical to SEQ ID NO: 49713

SEQ ID NO: 247285 - RNA, 64 nt, Homo Sapiens; identical to SEQ ID NO: 49714

SEQ ID NO: 247286 - RNA, 64 nt, Homo Sapiens; identical to SEQ ID NO: 49715

SEQ ID NO: 247287 - RNA, 64 nt, Homo Sapiens; identical to SEQ ID NO: 49716

SEQ ID NO: 247288 - RNA, 64 nt, Homo Sapiens; identical to SEQ ID NO: 49717

SEQ ID NO: 247289 - RNA, 64 nt, Homo Sapiens; identical to SEQ ID NO: 49718

SEQ ID NO: 247290 - RNA, 64 nt, Homo Sapiens; identical to SEQ ID NO: 49719

SEQ ID NO: 247291 - RNA, 64 nt, Homo Sapiens; identical to SEQ ID NO: 49720

SEQ ID NO: 247292 - RNA, 64 nt, Homo Sapiens; identical to SEQ ID NO: 49721

SEQ ID NO: 247293 - RNA, 64 nt, Homo Sapiens; identical to SEQ ID NO: 49722

SEQ ID NO: 247294 - RNA, 64 nt, Homo Sapiens; identical to SEQ ID NO: 49723

SEQ ID NO: 247295 - RNA, 64 nt, Homo Sapiens; identical to SEQ ID NO: 49724

SEQ ID NO: 247296 - RNA, 64 nt, Homo Sapiens; identical to SEQ ID NO: 49725

SEQ ID NO: 247297 - RNA, 64 nt, Homo Sapiens; identical to SEQ ID NO: 49726

SEQ ID NO: 247298 - RNA, 64 nt, Homo Sapiens; identical to SEQ ID NO: 49727

SEQ ID NO: 247299 - RNA, 64 nt, Homo Sapiens; identical to SEQ ID NO: 49728

SEQ ID NO: 247300 - RNA, 64 nt, Homo Sapiens; identical to SEQ ID NO: 49729

SEQ ID NO: 247301 - RNA, 64 nt, Homo Sapiens; identical to SEQ ID NO: 49730

SEQ ID NO: 247302 - RNA, 64 nt, Homo Sapiens; identical to SEQ ID NO: 49731

SEQ ID NO: 247303 - RNA, 64 nt, Homo Sapiens; identical to SEQ ID NO: 49732

SEQ ID NO: 247304 - RNA, 64 nt, Homo Sapiens; identical to SEQ ID NO: 49733

SEQ ID NO: 247305 - RNA, 64 nt, Homo Sapiens; identical to SEQ ID NO: 49734

SEQ ID NO: 247306 - RNA, 64 nt, Homo Sapiens; identical to SEQ ID NO: 49735

SEQ ID NO: 247307 - RNA, 64 nt, Homo Sapiens; identical to SEQ ID NO: 49736

SEQ ID NO: 247308 - RNA, 64 nt, Homo Sapiens; identical to SEQ ID NO: 49737

SEQ ID NO: 247309 - RNA, 64 nt, Homo Sapiens; identical to SEQ ID NO: 49738

SEQ ID NO: 247310 - RNA, 64 nt, Homo Sapiens; identical to SEQ ID NO: 49739

SEQ ID NO: 247311 - RNA, 64 nt, Homo Sapiens; identical to SEQ ID NO: 49740

SEQ ID NO: 247312 - RNA, 64 nt, Homo Sapiens; identical to SEQ ID NO: 49741

SEQ ID NO: 247313 - RNA, 64 nt, Homo Sapiens; identical to SEQ ID NO: 49742

SEQ ID NO: 247314 - RNA, 64 nt, Homo Sapiens; identical to SEQ ID NO: 49743

SEQ ID NO: 247315 - RNA, 64 nt, Homo Sapiens; identical to SEQ ID NO: 49744

SEQ ID NO: 247316 - RNA, 64 nt, Homo Sapiens; identical to SEQ ID NO: 49745

SEQ ID NO: 247317 - RNA, 64 nt, Homo Sapiens; identical to SEQ ID NO: 49746

SEQ ID NO: 247318 - RNA, 64 nt, Homo Sapiens; identical to SEQ ID NO: 49747

SEQ ID NO: 247319 - RNA, 64 nt, Homo Sapiens; identical to SEQ ID NO: 49748

SEQ ID NO: 247320 - RNA, 64 nt, Homo Sapiens; identical to SEQ ID NO: 49749

SEQ ID NO: 247321 - RNA, 64 nt, Homo Sapiens; identical to SEQ ID NO: 49750

SEQ ID NO: 247322 - RNA, 64 nt, Homo Sapiens; identical to SEQ ID NO: 49751

SEQ ID NO: 247323 - RNA, 64 nt, Homo Sapiens; identical to SEQ ID NO: 49752

SEQ ID NO: 247324 - RNA, 64 nt, Homo Sapiens; identical to SEQ ID NO: 49753

SEQ ID NO: 247325 - RNA, 64 nt, Homo Sapiens; identical to SEQ ID NO: 49754

SEQ ID NO: 247326 - RNA, 64 nt, Homo Sapiens; identical to SEQ ID NO: 49755

SEQ ID NO: 247327 - RNA, 64 nt, Homo Sapiens; identical to SEQ ID NO: 49756

SEQ ID NO: 247328 - RNA, 64 nt, Homo Sapiens; identical to SEQ ID NO: 49757

SEQ ID NO: 247329 - RNA, 64 nt, Homo Sapiens; identical to SEQ ID NO: 49758

SEQ ID NO: 247330 - RNA, 64 nt, Homo Sapiens; identical to SEQ ID NO: 49759

SEQ ID NO: 247331 - RNA, 64 nt, Homo Sapiens; identical to SEQ ID NO: 49760

SEQ ID NO: 247332 - RNA, 64 nt, Homo Sapiens; identical to SEQ ID NO: 49761

SEQ ID NO: 247333 - RNA, 64 nt, Homo Sapiens; identical to SEQ ID NO: 49762

SEQ ID NO: 247334 - RNA, 64 nt, Homo Sapiens; identical to SEQ ID NO: 49763

SEQ ID NO: 247335 - RNA, 64 nt, Homo Sapiens; identical to SEQ ID NO: 49764

SEQ ID NO: 247336 - RNA, 64 nt, Homo Sapiens; identical to SEQ ID NO: 49765

SEQ ID NO: 247337 - RNA, 64 nt, Homo Sapiens; identical to SEQ ID NO: 49766

SEQ ID NO: 247338 - RNA, 64 nt, Homo Sapiens; identical to SEQ ID NO: 49767

SEQ ID NO: 247339 - RNA, 64 nt, Homo Sapiens; identical to SEQ ID NO: 49768

SEQ ID NO: 247340 - RNA, 64 nt, Homo Sapiens; identical to SEQ ID NO: 49769

SEQ ID NO: 247341 - RNA, 64 nt, Homo Sapiens; identical to SEQ ID NO: 49770

SEQ ID NO: 247342 - RNA, 64 nt, Homo Sapiens; identical to SEQ ID NO: 49771

SEQ ID NO: 247343 - RNA, 64 nt, Homo Sapiens; identical to SEQ ID NO: 49772

SEQ ID NO: 247344 - RNA, 64 nt, Homo Sapiens; identical to SEQ ID NO: 49773

SEQ ID NO: 247345 - RNA, 64 nt, Homo Sapiens; identical to SEQ ID NO: 49774

SEQ ID NO: 247346 - RNA, 64 nt, Homo Sapiens; identical to SEQ ID NO: 49775

SEQ ID NO: 247347 - RNA, 64 nt, Homo Sapiens; identical to SEQ ID NO: 49776

SEQ ID NO: 247348 - RNA, 64 nt, Homo Sapiens; identical to SEQ ID NO: 49777

SEQ ID NO: 247349 - RNA, 64 nt, Homo Sapiens; identical to SEQ ID NO: 49778

SEQ ID NO: 247350 - RNA, 64 nt, Homo Sapiens; identical to SEQ ID NO: 49779

SEQ ID NO: 247351 - RNA, 64 nt, Homo Sapiens; identical to SEQ ID NO: 49780

SEQ ID NO: 247352 - RNA, 64 nt, Homo Sapiens; identical to SEQ ID NO: 49781

SEQ ID NO: 247353 - RNA, 64 nt, Homo Sapiens; identical to SEQ ID NO: 49782

SEQ ID NO: 247354 - RNA, 64 nt, Homo Sapiens; identical to SEQ ID NO: 49783

SEQ ID NO: 247355 - RNA, 64 nt, Homo Sapiens; identical to SEQ ID NO: 49784

SEQ ID NO: 247356 - RNA, 64 nt, Homo Sapiens; identical to SEQ ID NO: 49785

SEQ ID NO: 247357 - RNA, 64 nt, Homo Sapiens; identical to SEQ ID NO: 49786

SEQ ID NO: 247358 - RNA, 64 nt, Homo Sapiens; identical to SEQ ID NO: 49787

SEQ ID NO: 247359 - RNA, 64 nt, Homo Sapiens; identical to SEQ ID NO: 49788

SEQ ID NO: 247360 - RNA, 64 nt, Homo Sapiens; identical to SEQ ID NO: 49789

SEQ ID NO: 247361 - RNA, 64 nt, Homo Sapiens; identical to SEQ ID NO: 49790

SEQ ID NO: 247362 - RNA, 64 nt, Homo Sapiens; identical to SEQ ID NO: 49791

SEQ ID NO: 247363 - RNA, 64 nt, Homo Sapiens; identical to SEQ ID NO: 49792

SEQ ID NO: 247364 - RNA, 64 nt, Homo Sapiens; identical to SEQ ID NO: 49793

SEQ ID NO: 247365 - RNA, 64 nt, Homo Sapiens; identical to SEQ ID NO: 49794

SEQ ID NO: 247366 - RNA, 64 nt, Homo Sapiens; identical to SEQ ID NO: 49795

SEQ ID NO: 247367 - RNA, 64 nt, Homo Sapiens; identical to SEQ ID NO: 49796

SEQ ID NO: 247368 - RNA, 64 nt, Homo Sapiens; identical to SEQ ID NO: 49797

SEQ ID NO: 247369 - RNA, 64 nt, Homo Sapiens; identical to SEQ ID NO: 49798

SEQ ID NO: 247370 - RNA, 64 nt, Homo Sapiens; identical to SEQ ID NO: 49799

SEQ ID NO: 247371 - RNA, 64 nt, Homo Sapiens; identical to SEQ ID NO: 49800

SEQ ID NO: 247372 - RNA, 64 nt, Homo Sapiens; identical to SEQ ID NO: 49801

SEQ ID NO: 247373 - RNA, 64 nt, Homo Sapiens; identical to SEQ ID NO: 49802

SEQ ID NO: 247374 - RNA, 64 nt, Homo Sapiens; identical to SEQ ID NO: 49803

SEQ ID NO: 247375 - RNA, 64 nt, Homo Sapiens; identical to SEQ ID NO: 49804

SEQ ID NO: 247376 - RNA, 64 nt, Homo Sapiens; identical to SEQ ID NO: 49805

SEQ ID NO: 247377 - RNA, 64 nt, Homo Sapiens; identical to SEQ ID NO: 49806

SEQ ID NO: 247378 - RNA, 64 nt, Homo Sapiens; identical to SEQ ID NO: 49807

SEQ ID NO: 247379 - RNA, 64 nt, Homo Sapiens; identical to SEQ ID NO: 49808

SEQ ID NO: 247380 - RNA, 64 nt, Homo Sapiens; identical to SEQ ID NO: 49809

SEQ ID NO: 247381 - RNA, 64 nt, Homo Sapiens; identical to SEQ ID NO: 49810

SEQ ID NO: 247382 - RNA, 64 nt, Homo Sapiens; identical to SEQ ID NO: 49811

SEQ ID NO: 247383 - RNA, 64 nt, Homo Sapiens; identical to SEQ ID NO: 49812

SEQ ID NO: 247384 - RNA, 64 nt, Homo Sapiens; identical to SEQ ID NO: 49813

SEQ ID NO: 247385 - RNA, 64 nt, Homo Sapiens; identical to SEQ ID NO: 49814

SEQ ID NO: 247386 - RNA, 64 nt, Homo Sapiens; identical to SEQ ID NO: 49815

SEQ ID NO: 247387 - RNA, 64 nt, Homo Sapiens; identical to SEQ ID NO: 49816

SEQ ID NO: 247388 - RNA, 64 nt, Homo Sapiens; identical to SEQ ID NO: 49817

SEQ ID NO: 247389 - RNA, 64 nt, Homo Sapiens; identical to SEQ ID NO: 49818

SEQ ID NO: 247390 - RNA, 64 nt, Homo Sapiens; identical to SEQ ID NO: 49819

SEQ ID NO: 247391 - RNA, 64 nt, Homo Sapiens; identical to SEQ ID NO: 49820

SEQ ID NO: 247392 - RNA, 64 nt, Homo Sapiens; identical to SEQ ID NO: 49821

SEQ ID NO: 247393 - RNA, 64 nt, Homo Sapiens; identical to SEQ ID NO: 49822

SEQ ID NO: 247394 - RNA, 64 nt, Homo Sapiens; identical to SEQ ID NO: 49823

SEQ ID NO: 247395 - RNA, 64 nt, Homo Sapiens; identical to SEQ ID NO: 49824

SEQ ID NO: 247396 - RNA, 64 nt, Homo Sapiens; identical to SEQ ID NO: 49825

SEQ ID NO: 247397 - RNA, 64 nt, Homo Sapiens; identical to SEQ ID NO: 49826

SEQ ID NO: 247398 - RNA, 64 nt, Homo Sapiens; identical to SEQ ID NO: 49827

SEQ ID NO: 247399 - RNA, 64 nt, Homo Sapiens; identical to SEQ ID NO: 49828

SEQ ID NO: 247400 - RNA, 64 nt, Homo Sapiens; identical to SEQ ID NO: 49829

SEQ ID NO: 247401 - RNA, 64 nt, Homo Sapiens; identical to SEQ ID NO: 49830

SEQ ID NO: 247402 - RNA, 64 nt, Homo Sapiens; identical to SEQ ID NO: 49831

SEQ ID NO: 247403 - RNA, 64 nt, Homo Sapiens; identical to SEQ ID NO: 49832

SEQ ID NO: 247404 - RNA, 64 nt, Homo Sapiens; identical to SEQ ID NO: 49833

SEQ ID NO: 247405 - RNA, 64 nt, Homo Sapiens; identical to SEQ ID NO: 49834

SEQ ID NO: 247406 - RNA, 64 nt, Homo Sapiens; identical to SEQ ID NO: 49835

SEQ ID NO: 247407 - RNA, 64 nt, Homo Sapiens; identical to SEQ ID NO: 49836

SEQ ID NO: 247408 - RNA, 64 nt, Homo Sapiens; identical to SEQ ID NO: 49837

SEQ ID NO: 247409 - RNA, 64 nt, Homo Sapiens; identical to SEQ ID NO: 49838

SEQ ID NO: 247410 - RNA, 64 nt, Homo Sapiens; identical to SEQ ID NO: 49839

SEQ ID NO: 247411 - RNA, 64 nt, Homo Sapiens; identical to SEQ ID NO: 49840

SEQ ID NO: 247412 - RNA, 64 nt, Homo Sapiens; identical to SEQ ID NO: 49841

SEQ ID NO: 247413 - RNA, 64 nt, Homo Sapiens; identical to SEQ ID NO: 49842

SEQ ID NO: 247414 - RNA, 64 nt, Homo Sapiens; identical to SEQ ID NO: 49843

SEQ ID NO: 247415 - RNA, 64 nt, Homo Sapiens; identical to SEQ ID NO: 49844

SEQ ID NO: 247416 - RNA, 64 nt, Homo Sapiens; identical to SEQ ID NO: 49845

SEQ ID NO: 247417 - RNA, 64 nt, Homo Sapiens; identical to SEQ ID NO: 49846

SEQ ID NO: 247418 - RNA, 64 nt, Homo Sapiens; identical to SEQ ID NO: 49847

SEQ ID NO: 247419 - RNA, 64 nt, Homo Sapiens; identical to SEQ ID NO: 49848

SEQ ID NO: 247420 - RNA, 64 nt, Homo Sapiens; identical to SEQ ID NO: 49849

SEQ ID NO: 247421 - RNA, 64 nt, Homo Sapiens; identical to SEQ ID NO: 49850

SEQ ID NO: 247422 - RNA, 64 nt, Homo Sapiens; identical to SEQ ID NO: 49851

SEQ ID NO: 247423 - RNA, 64 nt, Homo Sapiens; identical to SEQ ID NO: 49852

SEQ ID NO: 247424 - RNA, 64 nt, Homo Sapiens; identical to SEQ ID NO: 49853

SEQ ID NO: 247425 - RNA, 64 nt, Homo Sapiens; identical to SEQ ID NO: 49854

SEQ ID NO: 247426 - RNA, 64 nt, Homo Sapiens; identical to SEQ ID NO: 49855

SEQ ID NO: 247427 - RNA, 64 nt, Homo Sapiens; identical to SEQ ID NO: 49856

SEQ ID NO: 247428 - RNA, 64 nt, Homo Sapiens; identical to SEQ ID NO: 49857

SEQ ID NO: 247429 - RNA, 64 nt, Homo Sapiens; identical to SEQ ID NO: 49858

SEQ ID NO: 247430 - RNA, 64 nt, Homo Sapiens; identical to SEQ ID NO: 49859

SEQ ID NO: 247431 - RNA, 64 nt, Homo Sapiens; identical to SEQ ID NO: 49860

SEQ ID NO: 247432 - RNA, 64 nt, Homo Sapiens; identical to SEQ ID NO: 49861

SEQ ID NO: 247433 - RNA, 64 nt, Homo Sapiens; identical to SEQ ID NO: 49862

SEQ ID NO: 247434 - RNA, 64 nt, Homo Sapiens; identical to SEQ ID NO: 49863

SEQ ID NO: 247435 - RNA, 64 nt, Homo Sapiens; identical to SEQ ID NO: 49864

SEQ ID NO: 247436 - RNA, 64 nt, Homo Sapiens; identical to SEQ ID NO: 49865

SEQ ID NO: 247437 - RNA, 64 nt, Homo Sapiens; identical to SEQ ID NO: 49866

SEQ ID NO: 247438 - RNA, 64 nt, Homo Sapiens; identical to SEQ ID NO: 49867

SEQ ID NO: 247439 - RNA, 64 nt, Homo Sapiens; identical to SEQ ID NO: 49868

SEQ ID NO: 247440 - RNA, 64 nt, Homo Sapiens; identical to SEQ ID NO: 49869

SEQ ID NO: 247441 - RNA, 64 nt, Homo Sapiens; identical to SEQ ID NO: 49870

SEQ ID NO: 247442 - RNA, 64 nt, Homo Sapiens; identical to SEQ ID NO: 49871

SEQ ID NO: 247443 - RNA, 64 nt, Homo Sapiens; identical to SEQ ID NO: 49872

SEQ ID NO: 247444 - RNA, 64 nt, Homo Sapiens; identical to SEQ ID NO: 49873

SEQ ID NO: 247445 - RNA, 64 nt, Homo Sapiens; identical to SEQ ID NO: 49874

SEQ ID NO: 247446 - RNA, 64 nt, Homo Sapiens; identical to SEQ ID NO: 49875

SEQ ID NO: 247447 - RNA, 64 nt, Homo Sapiens; identical to SEQ ID NO: 49876

SEQ ID NO: 247448 - RNA, 64 nt, Homo Sapiens; identical to SEQ ID NO: 49877

SEQ ID NO: 247449 - RNA, 64 nt, Homo Sapiens; identical to SEQ ID NO: 49878

SEQ ID NO: 247450 - RNA, 64 nt, Homo Sapiens; identical to SEQ ID NO: 49879

SEQ ID NO: 247451 - RNA, 64 nt, Homo Sapiens; identical to SEQ ID NO: 49880

SEQ ID NO: 247452 - RNA, 64 nt, Homo Sapiens; identical to SEQ ID NO: 49881

SEQ ID NO: 247453 - RNA, 64 nt, Homo Sapiens; identical to SEQ ID NO: 49882

SEQ ID NO: 247454 - RNA, 64 nt, Homo Sapiens; identical to SEQ ID NO: 49883

SEQ ID NO: 247455 - RNA, 64 nt, Homo Sapiens; identical to SEQ ID NO: 49884

SEQ ID NO: 247456 - RNA, 64 nt, Homo Sapiens; identical to SEQ ID NO: 49885

SEQ ID NO: 247457 - RNA, 64 nt, Homo Sapiens; identical to SEQ ID NO: 49886

SEQ ID NO: 247458 - RNA, 64 nt, Homo Sapiens; identical to SEQ ID NO: 49887

SEQ ID NO: 247459 - RNA, 64 nt, Homo Sapiens; identical to SEQ ID NO: 49888

SEQ ID NO: 247460 - RNA, 64 nt, Homo Sapiens; identical to SEQ ID NO: 49889

SEQ ID NO: 247461 - RNA, 64 nt, Homo Sapiens; identical to SEQ ID NO: 49890

SEQ ID NO: 247462 - RNA, 64 nt, Homo Sapiens; identical to SEQ ID NO: 49891

SEQ ID NO: 247463 - RNA, 64 nt, Homo Sapiens; identical to SEQ ID NO: 49892

SEQ ID NO: 247464 - RNA, 64 nt, Homo Sapiens; identical to SEQ ID NO: 49893

SEQ ID NO: 247465 - RNA, 64 nt, Homo Sapiens
ucaggcucagcaugaauuuuucaguucugcugucacuuggaaguuuugugcagacauaccauuu

SEQ ID NO: 247466 - RNA, 64 nt, Homo Sapiens
cuaacauucuguaagagguucaaguuacacuaagacuuggaacacaagcagcucacuacgauau

SEQ ID NO: 247467 - RNA, 64 nt, Homo Sapiens
aaugcauuaaucucauguuuuuaauguguuaauuacuuggaauaggacaaguuuaacuuuauuu

SEQ ID NO: 247468 - RNA, 64 nt, Homo Sapiens
auuguucaucucuuaggcuuugcugaaauggaaaacuuggaagagggaaaaacaccagaaagcu

SEQ ID NO: 247469 - RNA, 64 nt, Homo Sapiens
guuucaagacuugauacugcagaugggucuccgcacuuggaaagaccauaguuauuuacuugaa

SEQ ID NO: 247470 - RNA, 64 nt, Homo Sapiens
agaaagaaacacucaacaauggguuccuuuuucaacuuggaaaaugguucaagagacacugcuu

SEQ ID NO: 247471 - RNA, 64 nt, Homo Sapiens
aaaguuaucuugguacaacaccguguguauauacacuuggaagcuuaaaaagguguuuugucug

SEQ ID NO: 247472 - RNA, 64 nt, Homo Sapiens
uauugcucauaacuuaccaagaggcuaauacuaaacuuggaaaauuguuuaaguauguuuuauc

SEQ ID NO: 247473 - RNA, 64 nt, Homo Sapiens
agcugaaagcuguaauauguuuucaauaacauucacuuggaaucuuucauuugggggcuaugug

SEQ ID NO: 247474 - RNA, 64 nt, Homo Sapiens
uccguuugucuacacuguccauuucuuuugguggacuuggaaucacucagaacugaaggcaauu

SEQ ID NO: 247475 - RNA, 64 nt, Homo Sapiens
gguguaccugaaagugagggggagaauggaaccaacuuggaaaacacucugcaggauauuaucc

SEQ ID NO: 247476 - RNA, 64 nt, Homo Sapiens
caggauuaagaaacucacucaaaaccgcucaacuacuuggaaacugaacaaccugcuccugaau

SEQ ID NO: 247477 - RNA, 64 nt, Homo Sapiens
cggccugucacccugcuuucccugccucuacuugacuuggaauuggcugaagacuacacaggaa

SEQ ID NO: 247478 - RNA, 64 nt, Homo Sapiens
uacacaggaaugcaucguucccacuccccaucccacuuggaaaacuccaaggggguguggcuuc

SEQ ID NO: 247479 - RNA, 64 nt, Homo Sapiens
ucuccuuuuaguguuuauauuucagagaacagacacuuggaauuauggcgagugauugcuuucc

SEQ ID NO: 247480 - RNA, 64 nt, Homo Sapiens
aagaacucuacuuuagccuaauuuauguccccaaacuuggaaacggaugcuuuuaaaguuuuau

SEQ ID NO: 247481 - RNA, 64 nt, Homo Sapiens
agugguuauucagggucugagcagcaguaaaagucacccuaaaucaaggggcuuuucagaaggu

SEQ ID NO: 247482 - RNA, 64 nt, Homo Sapiens
ccuuuuuaaagccauggaacaaaaccugauacaucacccuaacagagcauuaaguuguaacuga

SEQ ID NO: 247483 - RNA, 64 nt, Homo Sapiens
guuugacuuguauaacaucacugucaaacuuugucacccuaacuucguauuuuuugauacgcac

SEQ ID NO: 247484 - RNA, 64 nt, Homo Sapiens
agcucugucugcucaaugccauugugcagagaagcacccuaaugcauaagcuuuuuaaugcugu

SEQ ID NO: 247485 - RNA, 64 nt, Homo Sapiens
aguucucccugaguugauugauaggcuuaauggucacccuaaaaacacccacauaugcuuuucg

SEQ ID NO: 247486 - RNA, 64 nt, Homo Sapiens
augcauucaucauaauaauuccagacauuuucaucacccuaaaaggaaacccugaaacccauua

SEQ ID NO: 247487 - RNA, 64 nt, Homo Sapiens
guuagcccuuggccaaaucuucucuuccaagccccacccuaaggcuaauauugcaggaggggcc

SEQ ID NO: 247488 - RNA, 64 nt, Homo Sapiens
gccacugaguuguguagggagucuccucuccugucacccuaagagacucuucccaaguuagcuu

SEQ ID NO: 247489 - RNA, 64 nt, Homo Sapiens
uauacuacuuuguuaggauuucauuucuaauuaaccuuacuaauagaucucgguuugccaaaau

SEQ ID NO: 247490 - RNA, 64 nt, Homo Sapiens
aagaacguuuuuuccucaguauuugagaauagacccuuacuagguuaauagggaauauaucucu

SEQ ID NO: 247491 - RNA, 64 nt, Homo Sapiens
aagaauguggcaaaggccuuuacugcuccuauucccuuacuaaagaauguggcaaagcuuuuca

SEQ ID NO: 247492 - RNA, 64 nt, Homo Sapiens
aagaauguggcaaagauuucuauugauucucauaccuuacuaaauauaagauaauucauauugg

SEQ ID NO: 247493 - RNA, 64 nt, Homo Sapiens
aagaauguggcaaaggcuuuaauuaguucucaucccuuacuaaacauaagagaauucauaccau

SEQ ID NO: 247494 - RNA, 64 nt, Homo Sapiens
aggaaugucucaaagcuuuuuacugauucuuauaccuuacuaaacauaaaauaauucauaaagg

SEQ ID NO: 247495 - RNA, 64 nt, Homo Sapiens
aaaaauguggcaaaccuuuuaaccaauccucaacccuuacuacacauuagauaauucaugcugg

SEQ ID NO: 247496 - RNA, 64 nt, Homo Sapiens
aaaaauguggcaaagcuuuuaaccaauuuucaaaccuuacuaaacauaagauaacucauacugg

SEQ ID NO: 247497 - RNA, 64 nt, Homo Sapiens
cauucauguaauucauacugagcuguuccucaauccuuacuaaaaagaauguggcaagccuuuu

SEQ ID NO: 247498 - RNA, 64 nt, Homo Sapiens
cauaaaagaauucauacuggaacuguuccucacaccuuacuacuaagaaugugauaaagacuuc

SEQ ID NO: 247499 - RNA, 64 nt, Homo Sapiens; identical to SEQ ID NO: 48305

SEQ ID NO: 247500 - RNA, 64 nt, Homo Sapiens; identical to SEQ ID NO: 48306

SEQ ID NO: 247501 - RNA, 64 nt, Homo Sapiens; identical to SEQ ID NO: 48307

SEQ ID NO: 247502 - RNA, 64 nt, Homo Sapiens; identical to SEQ ID NO: 48308

SEQ ID NO: 247503 - RNA, 64 nt, Homo Sapiens; identical to SEQ ID NO: 48309

SEQ ID NO: 247504 - RNA, 64 nt, Homo Sapiens; identical to SEQ ID NO: 48310

SEQ ID NO: 247505 - RNA, 64 nt, Homo Sapiens; identical to SEQ ID NO: 48311

SEQ ID NO: 247506 - RNA, 64 nt, Homo Sapiens; identical to SEQ ID NO: 48312

SEQ ID NO: 247507 - RNA, 64 nt, Homo Sapiens; identical to SEQ ID NO: 48313

SEQ ID NO: 247508 - RNA, 64 nt, Homo Sapiens; identical to SEQ ID NO: 48314

SEQ ID NO: 247509 - RNA, 64 nt, Homo Sapiens; identical to SEQ ID NO: 48315

SEQ ID NO: 247510 - RNA, 64 nt, Homo Sapiens; identical to SEQ ID NO: 48316

SEQ ID NO: 247511 - RNA, 64 nt, Homo Sapiens; identical to SEQ ID NO: 48317

SEQ ID NO: 247512 - RNA, 64 nt, Homo Sapiens; identical to SEQ ID NO: 48318

SEQ ID NO: 247513 - RNA, 64 nt, Homo Sapiens; identical to SEQ ID NO: 48319

SEQ ID NO: 247514 - RNA, 64 nt, Homo Sapiens; identical to SEQ ID NO: 48320

SEQ ID NO: 247515 - RNA, 64 nt, Homo Sapiens; identical to SEQ ID NO: 48321

SEQ ID NO: 247516 - RNA, 64 nt, Homo Sapiens; identical to SEQ ID NO: 48322

SEQ ID NO: 247517 - RNA, 64 nt, Homo Sapiens; identical to SEQ ID NO: 48323

SEQ ID NO: 247518 - RNA, 64 nt, Homo Sapiens; identical to SEQ ID NO: 48324

SEQ ID NO: 247519 - RNA, 64 nt, Homo Sapiens; identical to SEQ ID NO: 48325

SEQ ID NO: 247520 - RNA, 64 nt, Homo Sapiens; identical to SEQ ID NO: 48326

SEQ ID NO: 247521 - RNA, 64 nt, Homo Sapiens; identical to SEQ ID NO: 48327

SEQ ID NO: 247522 - RNA, 64 nt, Homo Sapiens; identical to SEQ ID NO: 48328

SEQ ID NO: 247523 - RNA, 64 nt, Homo Sapiens; identical to SEQ ID NO: 48329

SEQ ID NO: 247524 - RNA, 51 nt, Homo Sapiens; identical to SEQ ID NO: 48330

SEQ ID NO: 247525 - RNA, 64 nt, Homo Sapiens; identical to SEQ ID NO: 48331

SEQ ID NO: 247526 - RNA, 64 nt, Homo Sapiens; identical to SEQ ID NO: 48332

SEQ ID NO: 247527 - RNA, 64 nt, Homo Sapiens; identical to SEQ ID NO: 48333

SEQ ID NO: 247528 - RNA, 64 nt, Homo Sapiens; identical to SEQ ID NO: 48334

SEQ ID NO: 247529 - RNA, 64 nt, Homo Sapiens; identical to SEQ ID NO: 48335

SEQ ID NO: 247530 - RNA, 64 nt, Homo Sapiens; identical to SEQ ID NO: 48336

SEQ ID NO: 247531 - RNA, 64 nt, Homo Sapiens; identical to SEQ ID NO: 48337

SEQ ID NO: 247532 - RNA, 64 nt, Homo Sapiens; identical to SEQ ID NO: 48338

SEQ ID NO: 247533 - RNA, 64 nt, Homo Sapiens; identical to SEQ ID NO: 48339

SEQ ID NO: 247534 - RNA, 64 nt, Homo Sapiens; identical to SEQ ID NO: 48340

SEQ ID NO: 247535 - RNA, 64 nt, Homo Sapiens; identical to SEQ ID NO: 48341

SEQ ID NO: 247536 - RNA, 64 nt, Homo Sapiens; identical to SEQ ID NO: 48342

SEQ ID NO: 247537 - RNA, 64 nt, Homo Sapiens; identical to SEQ ID NO: 48343

SEQ ID NO: 247538 - RNA, 64 nt, Homo Sapiens; identical to SEQ ID NO: 48344

SEQ ID NO: 247539 - RNA, 64 nt, Homo Sapiens; identical to SEQ ID NO: 48345

SEQ ID NO: 247540 - RNA, 64 nt, Homo Sapiens; identical to SEQ ID NO: 48346

SEQ ID NO: 247541 - RNA, 64 nt, Homo Sapiens; identical to SEQ ID NO: 48347

SEQ ID NO: 247542 - RNA, 64 nt, Homo Sapiens; identical to SEQ ID NO: 48348

SEQ ID NO: 247543 - RNA, 64 nt, Homo Sapiens; identical to SEQ ID NO: 48349

SEQ ID NO: 247544 - RNA, 64 nt, Homo Sapiens; identical to SEQ ID NO: 71557

SEQ ID NO: 247545 - RNA, 64 nt, Homo Sapiens; identical to SEQ ID NO: 71558

SEQ ID NO: 247546 - RNA, 64 nt, Homo Sapiens; identical to SEQ ID NO: 71559

SEQ ID NO: 247547 - RNA, 64 nt, Homo Sapiens; identical to SEQ ID NO: 71560

SEQ ID NO: 247548 - RNA, 64 nt, Homo Sapiens; identical to SEQ ID NO: 71561

SEQ ID NO: 247549 - RNA, 64 nt, Homo Sapiens; identical to SEQ ID NO: 71562

SEQ ID NO: 247550 - RNA, 64 nt, Homo Sapiens; identical to SEQ ID NO: 71563

SEQ ID NO: 247551 - RNA, 64 nt, Homo Sapiens; identical to SEQ ID NO: 71564

SEQ ID NO: 247552 - RNA, 64 nt, Homo Sapiens; identical to SEQ ID NO: 71565

SEQ ID NO: 247553 - RNA, 64 nt, Homo Sapiens; identical to SEQ ID NO: 71566

SEQ ID NO: 247554 - RNA, 64 nt, Homo Sapiens; identical to SEQ ID NO: 71567

SEQ ID NO: 247555 - RNA, 64 nt, Homo Sapiens; identical to SEQ ID NO: 71568

SEQ ID NO: 247556 - RNA, 64 nt, Homo Sapiens; identical to SEQ ID NO: 71569

SEQ ID NO: 247557 - RNA, 64 nt, Homo Sapiens; identical to SEQ ID NO: 71570

SEQ ID NO: 247558 - RNA, 64 nt, Homo Sapiens; identical to SEQ ID NO: 71571

SEQ ID NO: 247559 - RNA, 64 nt, Homo Sapiens; identical to SEQ ID NO: 71572

SEQ ID NO: 247560 - RNA, 64 nt, Homo Sapiens; identical to SEQ ID NO: 71573

SEQ ID NO: 247561 - RNA, 64 nt, Homo Sapiens; identical to SEQ ID NO: 71574

SEQ ID NO: 247562 - RNA, 64 nt, Homo Sapiens; identical to SEQ ID NO: 71575

SEQ ID NO: 247563 - RNA, 64 nt, Homo Sapiens; identical to SEQ ID NO: 71576

SEQ ID NO: 247564 - RNA, 64 nt, Homo Sapiens; identical to SEQ ID NO: 71577

SEQ ID NO: 247565 - RNA, 64 nt, Homo Sapiens; identical to SEQ ID NO: 71578

SEQ ID NO: 247566 - RNA, 64 nt, Homo Sapiens; identical to SEQ ID NO: 71579

SEQ ID NO: 247567 - RNA, 64 nt, Homo Sapiens; identical to SEQ ID NO: 71580

SEQ ID NO: 247568 - RNA, 64 nt, Homo Sapiens; identical to SEQ ID NO: 71581

SEQ ID NO: 247569 - RNA, 64 nt, Homo Sapiens; identical to SEQ ID NO: 71582

SEQ ID NO: 247570 - RNA, 64 nt, Homo Sapiens; identical to SEQ ID NO: 71583

SEQ ID NO: 247571 - RNA, 64 nt, Homo Sapiens; identical to SEQ ID NO: 71579

SEQ ID NO: 247572 - RNA, 64 nt, Homo Sapiens; identical to SEQ ID NO: 71585

SEQ ID NO: 247573 - RNA, 64 nt, Homo Sapiens; identical to SEQ ID NO: 71581

SEQ ID NO: 247574 - RNA, 64 nt, Homo Sapiens
uauuuaacagcugagcaaaaacauugagucgcucucaaaggacacgaggcccuuggcagggaau

SEQ ID NO: 247575 - RNA, 64 nt, Homo Sapiens
uaacaagguaugcugccucuguaaauucauguauucaaaggaaaagacaccuugccuauaauua

SEQ ID NO: 247576 - RNA, 64 nt, Homo Sapiens
auguaacauggaaaacaguaacuaaagauuaaauucaaaggacuuucagaaguuaagguuaagu

SEQ ID NO: 247577 - RNA, 64 nt, Homo Sapiens
aaacuuagagaagaccaagggacaguauuuuuuaucaaaggaauacuauuuuuucacacuacgu

SEQ ID NO: 247578 - RNA, 64 nt, Homo Sapiens
auauucaauuuggcuuuuugcagugagaccuuuuucaaaggaacuauacaaauuuguuacaugu

SEQ ID NO: 247579 - RNA, 64 nt, Homo Sapiens
uucuauaucguaggacucaguguauuuuguaauaucaaaggaaugaguucugauaaaauauuuu

SEQ ID NO: 247580 - RNA, 64 nt, Homo Sapiens
aagugggccacggaagaacgcaaggagccuuuguucaaaggaagcaguuucccgccacuggguc

SEQ ID NO: 247581 - RNA, 64 nt, Homo Sapiens
acacugaccuuucccaucccaauugucucaggguucaaaggaagagcaggccucaagagccccu

SEQ ID NO: 247582 - RNA, 64 nt, Homo Sapiens
gugauauaauccauuuauauauuuauaucacaacucaaaggacuaaaggacugugauauaaucc

SEQ ID NO: 247583 - RNA, 64 nt, Homo Sapiens
gugauauaauccauuuauauauuuacaucacagcucaaaggacugacagcauaccauuaaauac

SEQ ID NO: 247584 - RNA, 64 nt, Homo Sapiens
ugacggagcaucguggcacgagcauacaggaggaucaaaggaggcuuccuguucucuccagccc

SEQ ID NO: 247585 - RNA, 64 nt, Homo Sapiens
ugccacgcaggacagacuggggcuucucugacccucaaaggagacccagcuugccucccucccu

SEQ ID NO: 247586 - RNA, 64 nt, Homo Sapiens
aacaauaaagggauaaaccagugacacguuuugaucaaaggagacuuccucuugguucccagcu

SEQ ID NO: 247587 - RNA, 64 nt, Homo Sapiens
gagguugcuaaagaacauccacaggaugaauggaucaaaggagugggaccaccccuuaccccgg

SEQ ID NO: 247588 - RNA, 64 nt, Homo Sapiens
aauaacugccuguuuuccuaaaucaaacccauccucaaaggaugaagacucaccaccauccagg

SEQ ID NO: 247589 - RNA, 64 nt, Homo Sapiens
gaagaaacucuaaauaguugaaaggcuaaccugcucaaaggauaccaaauaaugguuuaacugg

SEQ ID NO: 247590 - RNA, 64 nt, Homo Sapiens
caagcaggauggauggaugguagggcuuggcuggucaaaggagaggaauguacguaaaacaaaa

SEQ ID NO: 247591 - RNA, 64 nt, Homo Sapiens
gaaaacagggcaugcgcuugcagaauuucucuccucaaaggaaaccuguuccuccccgggacuc

SEQ ID NO: 247592 - RNA, 64 nt, Homo Sapiens
ucugcaucaucuugaggugggcccaggugucagcucaaaggaucuggggguaaggggaugacau

SEQ ID NO: 247593 - RNA, 64 nt, Homo Sapiens
agaauagcuuuauccugcacaguggccugguuguucaaaggauaggaaagaaaaaaaaagccuu

SEQ ID NO: 247594 - RNA, 64 nt, Homo Sapiens
uaaguuaaaugugggugucaaccaguggaaaagaucaaaggaccuuuugcagccuagcuugcca

SEQ ID NO: 247595 - RNA, 64 nt, Homo Sapiens
aacuaccuaauuuucaagcauggaucuccauauuucaaaggaaaguuuuaaaaauguuuuuaaa

SEQ ID NO: 247596 - RNA, 64 nt, Homo Sapiens
guaucagcugugggcuaauuuacugaaaauguuuucaaaggaagacuuaaaacgugugcauucu

SEQ ID NO: 247597 - RNA, 64 nt, Homo Sapiens
caauggcuccaagccuugcccauguggguagagaucaaaggagggggaagcagcaggaaaugug

SEQ ID NO: 247598 - RNA, 64 nt, Homo Sapiens
cccaggacccaggacccugcggcccugaccaauaaacccucagagggcacaugacaucugccug

SEQ ID NO: 247599 - RNA, 64 nt, Homo Sapiens
gccagcaggccccaaguggcgcgggggguggguaaacccucacucggcacuggagcaagcuggg

SEQ ID NO: 247600 - RNA, 64 nt, Homo Sapiens
agcuccucacuuuuuagcccuucugcaagagaaaaacccucauggguccacauggugagaaguu

SEQ ID NO: 247601 - RNA, 64 nt, Homo Sapiens
cccuggaaaggaguugagggacaucagaugcuggaacccucacugaaaguccagaaugucuaag

SEQ ID NO: 247602 - RNA, 64 nt, Homo Sapiens
cccacagccgcaaggcacugcggcagggaaucggaacccucagaucuaagagcugagagacagc

SEQ ID NO: 247603 - RNA, 64 nt, Homo Sapiens
caggaaucugccaugaguccgcucugacuccaccaacccucauccuccucuuuggggaucacca

SEQ ID NO: 247604 - RNA, 64 nt, Homo Sapiens
gggacauuaccaccaaccccacagaaauacgaaaaacccucaaagauuacuauaaacaccugua

SEQ ID NO: 247605 - RNA, 64 nt, Homo Sapiens
uuuuuaauaaaauucaacaucccuucauuuuaaaaacccucaacaaauuacacauugagggaac

SEQ ID NO: 247606 - RNA, 64 nt, Homo Sapiens
auaggggacaguggugugccugaccacuuauuacaacccucagaccacucuccauucuguguga

SEQ ID NO: 247607 - RNA, 64 nt, Homo Sapiens
caguauuucuaucaagaaagaguuggucauauccaacccucauuuucucauucgaaucuaccac

SEQ ID NO: 247608 - RNA, 64 nt, Homo Sapiens
guaaaaaaaucuuccuugucccugggcucuggccaacccucagaaacccucacaauaaaccaga

SEQ ID NO: 247609 - RNA, 64 nt, Homo Sapiens
cuuccuugucccugggcucuggccaacccucagaaacccucacaauaaaccagaccagaaggau

SEQ ID NO: 247610 - RNA, 64 nt, Homo Sapiens
uccuuuuuugaauugagaaacucuacuuuagccuaacccucaugcccaaacuuggaaacaagaa

SEQ ID NO: 247611 - RNA, 64 nt, Homo Sapiens
ucaaaaaauggacuggcaaugcagaaccugcuguaacccucaguugccuugugggcuacucagu

SEQ ID NO: 247612 - RNA, 64 nt, Homo Sapiens
uccucaccuugcugcuccccugcccuaaguccccaacccucaacuugaaaccccauucccuuaa

SEQ ID NO: 247613 - RNA, 64 nt, Homo Sapiens
aucacuccaucccucuccuaccccucccucccccaacccucaauguauaaauugcuucuugaug

SEQ ID NO: 247614 - RNA, 64 nt, Homo Sapiens; identical to SEQ ID NO: 24583

SEQ ID NO: 247615 - RNA, 64 nt, Homo Sapiens; identical to SEQ ID NO: 24584

SEQ ID NO: 247616 - RNA, 64 nt, Homo Sapiens; identical to SEQ ID NO: 24585

SEQ ID NO: 247617 - RNA, 64 nt, Homo Sapiens; identical to SEQ ID NO: 24586

SEQ ID NO: 247618 - RNA, 64 nt, Homo Sapiens; identical to SEQ ID NO: 24587

SEQ ID NO: 247619 - RNA, 64 nt, Homo Sapiens; identical to SEQ ID NO: 24588

SEQ ID NO: 247620 - RNA, 63 nt, Homo Sapiens
ggcagcaggcggugggaugcuuguagcuccucacagcaggauuccugcccacuguuuuuucuc

SEQ ID NO: 247621 - RNA, 63 nt, Homo Sapiens
ggacacaauaugcccuuccgguucuauucaaaccagcaggaucugucggugcuuagagauggc

SEQ ID NO: 247622 - RNA, 63 nt, Homo Sapiens
gcucacccauucauucacccaacuuccuucauucagcaggagguccuauuacccucuccagcu

SEQ ID NO: 247623 - RNA, 63 nt, Homo Sapiens
cucugcugcauccaacaugggagcagagacuggcagcaggaggggggaacauggugagaagug

SEQ ID NO: 247624 - RNA, 63 nt, Homo Sapiens
agacagucgugccauucacaaagucagaaaauacagcaggaagagacagcuuuuagaggggca

SEQ ID NO: 247625 - RNA, 63 nt, Homo Sapiens
aaagugauggaaugacuucugcaacuguagucccagcaggaacugugaagaccagcugcccug

SEQ ID NO: 247626 - RNA, 63 nt, Homo Sapiens
acugagguuggguaggugugggguuccagaggacagcaggacacucucgcauacuuugccaaa

SEQ ID NO: 247627 - RNA, 63 nt, Homo Sapiens
agcccccagacucugugcacuucagaccagcagcagcaggagggcucccgagggccuuaugag

SEQ ID NO: 247628 - RNA, 63 nt, Homo Sapiens
gggcgcugccuggggccugggucaagggccagucagcaggaggcugccggaacaacagcggcu

SEQ ID NO: 247629 - RNA, 63 nt, Homo Sapiens
ggguucuuggagagucggccagacggcggggggcagcaggaacuuugccucauaccccaccaa

SEQ ID NO: 247630 - RNA, 63 nt, Homo Sapiens
gaauaagcaaauccaugaacaugaguuuugucucagcaggauaucacaugugugugcacacuc

SEQ ID NO: 247631 - RNA, 63 nt, Homo Sapiens
acuuagggauaaggaagaauaauugggacuccccagcaggaauuagaaagauaauauuucucc

SEQ ID NO: 247632 - RNA, 63 nt, Homo Sapiens
gaccugggggcccuugggugccagagugagacacagcaggacccuuccccaaauacuaggcuc

SEQ ID NO: 247633 - RNA, 63 nt, Homo Sapiens
aauacuaggcucagagcaaccuccagccuucuccagcaggaucugcucccuguguccuuggac

SEQ ID NO: 247634 - RNA, 63 nt, Homo Sapiens
caucccuuuuuuuccccaaggcacuuuaaaaaucagcaggacaacccugaggcaaacuggaag

SEQ ID NO: 247635 - RNA, 63 nt, Homo Sapiens
agaaacaugauuuguucauuucugagucacaaacagcaggauaccucacagguaagccauacc

SEQ ID NO: 247636 - RNA, 63 nt, Homo Sapiens
aagacaacccguuggagcccucagggugggggacagcaggaucccucagccucugcaaggcac

SEQ ID NO: 247637 - RNA, 63 nt, Homo Sapiens
uggcccuucugccugggcaggccggcuguggagcagcaggaccguacugcagcuuccuccaca

SEQ ID NO: 247638 - RNA, 63 nt, Homo Sapiens
ggauguagagaggcguuagugggcagguggccacagcaggacugaggacaggcccccauuauc

SEQ ID NO: 247639 - RNA, 63 nt, Homo Sapiens
cccagccaggaccaccucguccucguggcggggcagcaggagcgguagaaagggguccgaugu

SEQ ID NO: 247640 - RNA, 63 nt, Homo Sapiens
cccaucugcuggcaucaguaccugguguugggacagcaggauaggguucuaaaggugguuuuc

SEQ ID NO: 247641 - RNA, 63 nt, Homo Sapiens
ggcccccaggaaucccuuccucccauguccuggcagcaggaccccaggcuacauauggaaggu

SEQ ID NO: 247642 - RNA, 63 nt, Homo Sapiens
gagugucuuuguguaucaccuuuguguguuccucagcaggaaucaugugcuggucucugugug

SEQ ID NO: 247643 - RNA, 63 nt, Homo Sapiens
cacuggccuggcaccaccuguggguucuccugacagcaggaacagaaauguugaaaagcuccu

SEQ ID NO: 247644 - RNA, 63 nt, Homo Sapiens
ucuuuugucauguauaacugagacacacaaacacagcaggagaaaucuaaaccguugugccuu

SEQ ID NO: 247645 - RNA, 63 nt, Homo Sapiens
cuaguaugauuaguauagcuuucuccagcauggcagcaggaaguaacuacagggccucuuuua

SEQ ID NO: 247646 - RNA, 63 nt, Homo Sapiens
cuccgaagagaguucuggaugucuggcucaaagcagcaggacugugggaaagagccuaacauc

SEQ ID NO: 247647 - RNA, 63 nt, Homo Sapiens
cauguucccaaggccccacuuucaagaaucagacagcaggaagccauagaugcuggcuggguu

SEQ ID NO: 247648 - RNA, 63 nt, Homo Sapiens
uugcuaacaaagcacuuuuggacaaugcuaucccagcaggaaaaaaaaggauaauauaacugu

SEQ ID NO: 247649 - RNA, 63 nt, Homo Sapiens
gaguauuugaucccuagauaagaacaugcaaaucagcaggaacuggucauacaggguaagcac

SEQ ID NO: 247650 - RNA, 63 nt, Homo Sapiens
ggguggccuucucaggacuccuggguggcacagcagcaggaccuugucaugggacugaugcug

SEQ ID NO: 247651 - RNA, 63 nt, Homo Sapiens
ccaacagcaagggugacuccuggcaggugggggcagcaggagggcagagggcagagcucuggc

SEQ ID NO: 247652 - RNA, 63 nt, Homo Sapiens
ggcugucguguauauagcuguuuuguccacggccagcaggaugugggcacaggagcucccagc

SEQ ID NO: 247653 - RNA, 63 nt, Homo Sapiens
gaagggcgcagcguccccucggggcagucugggcagcaggaagagccggcgccggacccggua

SEQ ID NO: 247654 - RNA, 63 nt, Homo Sapiens
ucucggaaaugagaaagcuggaauccugguccccagcaggagagccuaguccucccccagccc

SEQ ID NO: 247655 - RNA, 63 nt, Homo Sapiens
ugcagcugccagauccacucacucugcugccuccagcaggacccaaggccacuuucaacucuu

SEQ ID NO: 247656 - RNA, 63 nt, Homo Sapiens
agggaugagagaaaggaggugguauggaagacucagcaggaacaagguaggcuucaaagagcc

SEQ ID NO: 247657 - RNA, 63 nt, Homo Sapiens
agugagggccccugcugggcccagccaccaggacagcaggaaccagggccuacuccucuuaug

SEQ ID NO: 247658 - RNA, 63 nt, Homo Sapiens
ugucugcuccuacuccucacaucuggaggauuccagcaggagggguuuuggaggggaccugcu

SEQ ID NO: 247659 - RNA, 63 nt, Homo Sapiens
uccaaauccagccauagauggcugcugggugugcagcaggagaaggaggauggucagccuugg

SEQ ID NO: 247660 - RNA, 63 nt, Homo Sapiens
gaggugaagagggcggagagagagaggaagggacagcaggagugcacugucuauauugcacug

SEQ ID NO: 247661 - RNA, 63 nt, Homo Sapiens
gccucacugccccucuugcagagccaccucaaucagcaggacagaagccaguagagagaccag

SEQ ID NO: 247662 - RNA, 63 nt, Homo Sapiens
ucuggggagcuuccaagagcacccaccaagacacagcaggacaggccaggggagggcaucugg

SEQ ID NO: 247663 - RNA, 63 nt, Homo Sapiens
cagaccacuugacucucuguaaaauggaccaaucagcaggauguggguggggcgagacaagag

SEQ ID NO: 247664 - RNA, 63 nt, Homo Sapiens
gagacggucuugccucucagggggaagcagcugcagcaggaggugugcccagcaguggcugcu

SEQ ID NO: 247665 - RNA, 63 nt, Homo Sapiens
agguuuuccucuguuggccuggcuguguugucacagcaggaaucuuaggcugcgugggacaag

SEQ ID NO: 247666 - RNA, 63 nt, Homo Sapiens
gugaaguaguaaacugggggggaagagcagcagcagcaggaugcacagucucuauggugcuga

SEQ ID NO: 247667 - RNA, 63 nt, Homo Sapiens
aggcccuggguugccgugcucccugcccaccuucagcaggaugcucauuccuuaccccccagc

SEQ ID NO: 247668 - RNA, 63 nt, Homo Sapiens
cucccaggaggggugguagccguucccaccucgcagcaggacccccagugcagaggcucacag

SEQ ID NO: 247669 - RNA, 63 nt, Homo Sapiens
uggguugagggggucugaccaggaggccaccuacagcaggaagugaggcugccauguuuccuu

SEQ ID NO: 247670 - RNA, 63 nt, Homo Sapiens
aagggagccagccuccagugauaccucucguuccagcaggacccugguuggcguccacaagca

SEQ ID NO: 247671 - RNA, 63 nt, Homo Sapiens
aggcauuccagucugccccacagguggugggaacagcaggaaauuuuucgagcuauagggcau

SEQ ID NO: 247672 - RNA, 63 nt, Homo Sapiens
aauugugaagcccacagaugcgcacgcaaugaccagcaggaaccggaagcccugggucacccc

SEQ ID NO: 247673 - RNA, 63 nt, Homo Sapiens
uugcucccuccccucucuuagagacugugccuucagcaggacucuuaauaucugcugcaacuu

SEQ ID NO: 247674 - RNA, 63 nt, Homo Sapiens
cggcccaugcagaggugguagaaaggcuggacucagcaggaacaccaaaucccggaccaggca

SEQ ID NO: 247675 - RNA, 63 nt, Homo Sapiens
accucgcagggcucagcagcacccggugaacagcagcaggaggagccgcuagagcagcugcuc

SEQ ID NO: 247676 - RNA, 63 nt, Homo Sapiens
aauucugcaucccuaauucugcucccacugccucagcaggagcacgcuuucagcuugagggga

SEQ ID NO: 247677 - RNA, 63 nt, Homo Sapiens
uuguaguuguaugcuugauucuuggaaguggagcagcaggacucuaagaauuauuaaguuuga

SEQ ID NO: 247678 - RNA, 63 nt, Homo Sapiens
cuaaaauaucugccaucauccaagguaauaggacagcaggaacuuaaugcugcuuuugagcuu

SEQ ID NO: 247679 - RNA, 63 nt, Homo Sapiens
ugugcauguggguagagaucuaccuuugggaagcagcaggaaaucagugacaccaucuuggaa

SEQ ID NO: 247680 - RNA, 64 nt, Homo Sapiens
ccaaauccagaggaagcaaggaggagggaggugggguagggaggaguguaggaugccuuguuuc

SEQ ID NO: 247681 - RNA, 64 nt, Homo Sapiens
aacuguguaccugauuuguucucugaccuggcuagguagggagggggugguuaucgccccaaga

SEQ ID NO: 247682 - RNA, 64 nt, Homo Sapiens
ucuccauaccuucucaauuugugugggggaacaggguagggaaaccaugggggcagcugugccu

SEQ ID NO: 247683 - RNA, 64 nt, Homo Sapiens
cccaugggggcagcugugccuaugcaccacuccagguagggauacuggguucaaauuccaguuc

SEQ ID NO: 247684 - RNA, 64 nt, Homo Sapiens
guuggauaccuguauucuugacaguuagaauauugguagggacuuuguuaaaauucacuugaau

SEQ ID NO: 247685 - RNA, 64 nt, Homo Sapiens
agaggcagggcugagguggucuacgaauguggcagguagggaaggggagaugucugucucuuga

SEQ ID NO: 247686 - RNA, 64 nt, Homo Sapiens
ugccuguguggucuguuuacaugugggugucccugguagggaagucagucuauuccugucauag

SEQ ID NO: 247687 - RNA, 64 nt, Homo Sapiens
gcuuagcagaaugugugugugguuguuuggaugugguagggagucugaguggcucuauggaugu

SEQ ID NO: 247688 - RNA, 64 nt, Homo Sapiens
uggcugagagggaauaaucuagguguucucaggagguagggaucugagcuuuaaaaagaugaau

SEQ ID NO: 247689 - RNA, 64 nt, Homo Sapiens
acuuagggauguuuccugugacuugcacuacuaggguagggagguugccagaaacuuaccauua

SEQ ID NO: 247690 - RNA, 64 nt, Homo Sapiens
gcagguuuaaaauaaaaagaugacaagaguauuugguagggaaacuagguggauuuucucuuca

SEQ ID NO: 247691 - RNA, 64 nt, Homo Sapiens
gggcaugaucaaaggggccagcgggguugggggugguagggauauugaagaagugggggcugga

SEQ ID NO: 247692 - RNA, 64 nt, Homo Sapiens
guggugcccagaauaaaauauaccucaugccuaggguagggacauccuuuccagcucaaacgug

SEQ ID NO: 247693 - RNA, 64 nt, Homo Sapiens
cuaggguagggacauccuuuccagcucaaacguggguagggaugugggagaauaagaauguggg

SEQ ID NO: 247694 - RNA, 64 nt, Homo Sapiens
gaagcuagacccaaucuccuguaagggagggagggguagggacacauagcagcagaggacuggu

SEQ ID NO: 247695 - RNA, 64 nt, Homo Sapiens
ugucuaauccaagucccaggucuuugccuuucuggguagggagcggaagcaagugugggauggg

SEQ ID NO: 247696 - RNA, 64 nt, Homo Sapiens
uccaccuagagcaccaggaaacagcuuguacccugguagggaaaugguguugcugaaaggggag

SEQ ID NO: 247697 - RNA, 64 nt, Homo Sapiens
aaaaguugagauuuagcucauggauauauuuuuugguagggaaacauuagggucuccuuuucuu

SEQ ID NO: 247698 - RNA, 64 nt, Homo Sapiens; identical to SEQ ID NO: 189847

SEQ ID NO: 247699 - RNA, 64 nt, Homo Sapiens; identical to SEQ ID NO: 189848

SEQ ID NO: 247700 - RNA, 64 nt, Homo Sapiens; identical to SEQ ID NO: 189849

SEQ ID NO: 247701 - RNA, 64 nt, Homo Sapiens; identical to SEQ ID NO: 189850

SEQ ID NO: 247702 - RNA, 64 nt, Homo Sapiens; identical to SEQ ID NO: 189851

SEQ ID NO: 247703 - RNA, 64 nt, Homo Sapiens; identical to SEQ ID NO: 189852

SEQ ID NO: 247704 - RNA, 64 nt, Homo Sapiens; identical to SEQ ID NO: 189853

SEQ ID NO: 247705 - RNA, 64 nt, Homo Sapiens; identical to SEQ ID NO: 189854

SEQ ID NO: 247706 - RNA, 64 nt, Homo Sapiens; identical to SEQ ID NO: 189855

SEQ ID NO: 247707 - RNA, 64 nt, Homo Sapiens; identical to SEQ ID NO: 189856

SEQ ID NO: 247708 - RNA, 64 nt, Homo Sapiens; identical to SEQ ID NO: 189857

SEQ ID NO: 247709 - RNA, 64 nt, Homo Sapiens; identical to SEQ ID NO: 189858

SEQ ID NO: 247710 - RNA, 64 nt, Homo Sapiens; identical to SEQ ID NO: 189859

SEQ ID NO: 247711 - RNA, 64 nt, Homo Sapiens; identical to SEQ ID NO: 189860

SEQ ID NO: 247712 - RNA, 64 nt, Homo Sapiens; identical to SEQ ID NO: 189861

SEQ ID NO: 247713 - RNA, 64 nt, Homo Sapiens; identical to SEQ ID NO: 189862

SEQ ID NO: 247714 - RNA, 64 nt, Homo Sapiens; identical to SEQ ID NO: 189863

SEQ ID NO: 247715 - RNA, 64 nt, Homo Sapiens; identical to SEQ ID NO: 189864

SEQ ID NO: 247716 - RNA, 64 nt, Homo Sapiens; identical to SEQ ID NO: 189865

SEQ ID NO: 247717 - RNA, 64 nt, Homo Sapiens; identical to SEQ ID NO: 189866

SEQ ID NO: 247718 - RNA, 64 nt, Homo Sapiens; identical to SEQ ID NO: 189867

SEQ ID NO: 247719 - RNA, 64 nt, Homo Sapiens; identical to SEQ ID NO: 189868

SEQ ID NO: 247720 - RNA, 64 nt, Homo Sapiens
ccucauagcucagaucuccuuucaaaguaguggcuuucuggaugguaauuccaucuuaaggugu

SEQ ID NO: 247721 - RNA, 64 nt, Homo Sapiens
ucuguucucuaauagaagccuuucuuuuccauuguuucuggauauuuguauuauccaaaugugc

SEQ ID NO: 247722 - RNA, 64 nt, Homo Sapiens
uucuuuaagagcuaacaagagaagagaguccaguuuucuggaaauaugucuuuaaguauuuuag

SEQ ID NO: 247723 - RNA, 64 nt, Homo Sapiens
uaaaacaucacaaaaaaaauugcaguacauaaaauuucuggacuauguuaguuacuugaucugg

SEQ ID NO: 247724 - RNA, 64 nt, Homo Sapiens
uucacugcuguuaacaguaaugugucccuuucauuuucuggaucaagccuucucagcggugggu

SEQ ID NO: 247725 - RNA, 64 nt, Homo Sapiens
caaacaguuccucuuauuuugucuuuugcaccaguuucuggaggcccuugucauuucaaaaagg

SEQ ID NO: 247726 - RNA, 64 nt, Homo Sapiens
aaaaugagugaaauuuaaacccccaguauguccuuuucuggauugggcacaucuggaugccuuc

SEQ ID NO: 247727 - RNA, 64 nt, Homo Sapiens
ccgagacuuggccauaaagaggcaagauaaacacuuucuggaacaaacauuaccuaaauaggcu

SEQ ID NO: 247728 - RNA, 64 nt, Homo Sapiens
agcuuacaucuuccucagccguugaauguauuuuuuucuggacaguaaccuucuccuuuacuau

SEQ ID NO: 247729 - RNA, 64 nt, Homo Sapiens
auucuguguuaucaaggaauaacaucacagaaucuuucuggaugacauuuucaauagaggauac

SEQ ID NO: 247730 - RNA, 64 nt, Homo Sapiens
uuaguaacucaguaagaacaugccugcgacucccuuucuggauggaaccugggcuguggcucuc

SEQ ID NO: 247731 - RNA, 64 nt, Homo Sapiens
uggugcugugauggugucuacuguuagaauagcuuuucuggagguggguggcaacuccacgcgg

SEQ ID NO: 247732 - RNA, 64 nt, Homo Sapiens
ccccuacuaaacucuuaagccuccccuuccagucuuucuggacagcuauuaagcacuugcagcc

SEQ ID NO: 247733 - RNA, 64 nt, Homo Sapiens
auccgcuguuugagcccaacacuuuaauuuauucuuucuggacacuggagucacuaacuggcgu

SEQ ID NO: 247734 - RNA, 64 nt, Homo Sapiens
accaugccuaggacucaccccauuuauccaggucuuucuggaucuguuuaaucaauaagcccua

SEQ ID NO: 247735 - RNA, 64 nt, Homo Sapiens
auuccugucccaagccacccaaauucucagaucuuuucuggaacaaggcagaauauaaaauaaa

SEQ ID NO: 247736 - RNA, 64 nt, Homo Sapiens
aagagaaauuugagaggaaaaguggaagaaguguuuucuggagcagaagauuccacuucuuugg

SEQ ID NO: 247737 - RNA, 64 nt, Homo Sapiens
cuaauauucuucacauuaaacuauggacucuaauuuucuggauaaaauauccugccuuauggaa

SEQ ID NO: 247738 - RNA, 64 nt, Homo Sapiens
uuugguuuccaggaauuuuuuucaaauggggcuguuucuggaaaaaugaaaaauucuauuggac

SEQ ID NO: 247739 - RNA, 64 nt, Homo Sapiens
agaaguaauacuuuauucucuaauguuaauagcuuuucuggaucucuuaguagggggaaaguag

SEQ ID NO: 247740 - RNA, 64 nt, Homo Sapiens
guuuguauaagaauaacaaucugcuagucugucauuucuggagugauacuuuuuuuuuugagac

SEQ ID NO: 247741 - RNA, 64 nt, Homo Sapiens
uaaaucuuuggcagaggcaggaguaaggaagccauuucuggaguccuugcuacuaauuuggaaa

SEQ ID NO: 247742 - RNA, 64 nt, Homo Sapiens
uuuaaguagaaccuaggguuucuaauugacuugauuucuggaaaugaaaacccgcgcuuuuauu

SEQ ID NO: 247743 - RNA, 64 nt, Homo Sapiens
cugauuuuuguugauaacacaaaaaacacuauguuuucuggagagcuguguaagcugucuuguu

SEQ ID NO: 247744 - RNA, 64 nt, Homo Sapiens
ucaaaaaugggaaagcaaaaaggaauuaaaaguguuucuggaagcagaacuagaauacuuuuua

SEQ ID NO: 247745 - RNA, 64 nt, Homo Sapiens
gagccugugaaacugaacaggguacauaugcauuuuucuggagaugaaauuguacaugcaaauu

SEQ ID NO: 247746 - RNA, 64 nt, Homo Sapiens
gccaacgggauggccuuggguacaucacucagccuuucuggacccaauuuuuccccagugaaag

SEQ ID NO: 247747 - RNA, 64 nt, Homo Sapiens
aauuuuuccccagugaaagccaaguuggacugaauuucuggaguucucaucagugcacauucca

SEQ ID NO: 247748 - RNA, 64 nt, Homo Sapiens
ugaggggcuuuguuugggccacugccagcagcuguuucuggaaauggcuguaggugguguugag

SEQ ID NO: 247749 - RNA, 64 nt, Homo Sapiens
gaggcuggcaaggaguucguggcugcaaaagaaguuucuggagcaagagagagcucgcucuugg

SEQ ID NO: 247750 - RNA, 64 nt, Homo Sapiens
aagaauuccucucugcccagaugguagguugauauuucuggacucuagccaagaaaaagcuaau

SEQ ID NO: 247751 - RNA, 64 nt, Homo Sapiens
gaaaggaagaagccugagauuugauccuugacaauuucuggaaagcacuggucagucacacugu

SEQ ID NO: 247752 - RNA, 64 nt, Homo Sapiens
aaucuuauaucuuaucuaugcuauuuaggacuacuuucuggagcuuggcagauuuuccucugac

SEQ ID NO: 247753 - RNA, 64 nt, Homo Sapiens
gaauuauugggucuuucauaaauaacaugagugguuucuggagacauuuaagauugucagcaaa

SEQ ID NO: 247754 - RNA, 64 nt, Homo Sapiens
uacauauuuuucuaaguuuccccccuaguuucacuuucuggaaagugaacaguuuuuuaaaucc

SEQ ID NO: 247755 - RNA, 64 nt, Homo Sapiens
augauaaggguauucaauaauugggugcccuaaauuucuggaugagaaaauuuucaauucuggc

SEQ ID NO: 247756 - RNA, 64 nt, Homo Sapiens
acaaaauguuuagauucuguagguguuaaaagccuuucuggaaguauugcauucugccguguuu

SEQ ID NO: 247757 - RNA, 64 nt, Homo Sapiens
cauacugcaauaggcucucucauuugggacugcauuucuggaaauauacaauauagaguaugca

SEQ ID NO: 247758 - RNA, 64 nt, Homo Sapiens
agugggaauuaaggcuacuguucuguauuuuucuuuucuggaacacaguaagauguguggguuu

SEQ ID NO: 247759 - RNA, 64 nt, Homo Sapiens
gugugugcaucaaugauguuagcauaccucugcauuucuggaaucaccccuaccccguggcagc

SEQ ID NO: 247760 - RNA, 64 nt, Homo Sapiens
aaaccugucccccaccugugagaaaggccuacgguuucuggagcccucuuuagggggccagaca

SEQ ID NO: 247761 - RNA, 64 nt, Homo Sapiens
ugacucaacauguuacugaccagcaacuugucuuuuucuggacugaagccugcaggaguuaaaa

SEQ ID NO: 247762 - RNA, 64 nt, Homo Sapiens
aacuguguggacugugaugccacacagaguggucuuucuggagagguuauaggucacuccuggg

SEQ ID NO: 247763 - RNA, 64 nt, Homo Sapiens
uucaaucuacucaugauguguuaugcauaaaacauuucuggaacauggauuuguguucaccuua

SEQ ID NO: 247764 - RNA, 64 nt, Homo Sapiens
uaaauccuauuuucuauggaagacugguaccugguuucuggaagaggggucugugacuuggagc

SEQ ID NO: 247765 - RNA, 64 nt, Homo Sapiens
ucuuguuugugggguaucuugcccaaaauguuauuuucuggagcguagcaagaaguuucuguga

SEQ ID NO: 247766 - RNA, 64 nt, Homo Sapiens
agggugggggcggggugggagguuuuuuuuuuuuuuucuggaguauuacuuuuuuuccguugcg

SEQ ID NO: 247767 - RNA, 64 nt, Homo Sapiens
auaaaggauuauuugcucaggggaaccauggggcuuucuggaguuguggugaggccaccaggcu

SEQ ID NO: 247768 - RNA, 64 nt, Homo Sapiens
gaagcuugucacuggaagaucuuaagguauauauuuucuggacacucaaacacaucauaaugga

SEQ ID NO: 247769 - RNA, 64 nt, Homo Sapiens
cacccaggaaacccuugguccagagaggacaggcuuucuggaggaaucaggcccugggacagcc

SEQ ID NO: 247770 - RNA, 64 nt, Homo Sapiens
cuguagauuuauucugcccacaacuuggggguccuuucuggaucucggcuucuccagcuguaaa

SEQ ID NO: 247771 - RNA, 64 nt, Homo Sapiens
aaggagaaugccugugcaggccguccucagagccuuucuggaacuuuccugagaggcaggucuu

SEQ ID NO: 247772 - RNA, 64 nt, Homo Sapiens
gccaggugggaaaugcuuucaaugaaauacccaguuucuggaggccuagcugauuguugugguc

SEQ ID NO: 247773 - RNA, 64 nt, Homo Sapiens
aauguaguaaucuucuagacaaucuuauuuuguauuucuggaagguuucaaacauuucuggaca

SEQ ID NO: 247774 - RNA, 64 nt, Homo Sapiens
aaucuuauuuuguauuucugauguguuucaaacauuucuggacaccauuacaacuuuugugagg

SEQ ID NO: 247775 - RNA, 64 nt, Homo Sapiens
uaggucauuaaguagcacacagucugaaugcccuuuucuggaguggccaguuccuaucagacug

SEQ ID NO: 247776 - RNA, 64 nt, Homo Sapiens
cuccccagguccugggaguggcuaccgcagguaguuucuggagagcacguuuucuucauugaua

SEQ ID NO: 247777 - RNA, 64 nt, Homo Sapiens
cugaccaccccccugacccccgccauuacuuucuuuucuggagugccaugcuggcgaggauccg

SEQ ID NO: 247778 - RNA, 64 nt, Homo Sapiens
cucaccugcuugccaagguacgucuggguaguaguuucuggaaaugacugcagacugugccaaa

SEQ ID NO: 247779 - RNA, 64 nt, Homo Sapiens
cuguggccugauggagcagcucauggaugcucucuuucuggaagcccaagaggcucuucagaga

SEQ ID NO: 247780 - RNA, 64 nt, Homo Sapiens
ggccacaggagguugcggagugacugagggagauuuucuggaagagcaauaucccaaguucuug

SEQ ID NO: 247781 - RNA, 64 nt, Homo Sapiens
uaaguaguugccuaaauuuacuggaaggaaauauuuucuggacuaagagccuuaaccuuuugua

SEQ ID NO: 247782 - RNA, 64 nt, Homo Sapiens
uauuguagcuaacccaacaccgaacaaucuuucauuucuggauauguauucaaagcuuacuaga

SEQ ID NO: 247783 - RNA, 64 nt, Homo Sapiens
ugugcagguauaaacacaccggucugggaucuguuuucuggaagucugcaggugggcugcugag

SEQ ID NO: 247784 - RNA, 64 nt, Homo Sapiens
gauucuagagggagacuuguaguccccuucuguguuucuggaguuccagagcaagcauucacca

SEQ ID NO: 247785 - RNA, 64 nt, Homo Sapiens
ugucugaauauucuagaacuagagaagggggacguuucuggaacauucuaguugggagaguugg

SEQ ID NO: 247786 - RNA, 64 nt, Homo Sapiens
uaguuuucacuuuuaguuggggaauuuuucucuuuuucuggagaucacaagaucuguuagaaau

SEQ ID NO: 247787 - RNA, 64 nt, Homo Sapiens
uacuugcuucauguauggaugugaggaagggagcuuucuggaaggggucuguaggcaucacauu

SEQ ID NO: 247788 - RNA, 64 nt, Homo Sapiens
augagagaauacuguaauaauaucaaaagcacuuuuucuggaaacacauuuauggcuuuuauaa

SEQ ID NO: 247789 - RNA, 64 nt, Homo Sapiens
uuauauugucauagugguuuuuauuccugcuuuguuucuggaaaggaaauccugaauuacuuaa

SEQ ID NO: 247790 - RNA, 64 nt, Homo Sapiens
agcaagccuacucugacuucugacuuguuuuuguuuucuggauuuuuagcuguagguauucagc

SEQ ID NO: 247791 - RNA, 64 nt, Homo Sapiens
gggggguauacauuagacauaucagagcaguguauuucuggaucauuuuuuaaaugaccucuuc

SEQ ID NO: 247792 - RNA, 64 nt, Homo Sapiens
cucaggauuaucuggaagacuggaagauguggauuuucuggaaguccggaagacauggauuguc

SEQ ID NO: 247793 - RNA, 64 nt, Homo Sapiens
acauggauuagcuggaagauggaagacacagauuuuucuggaagcuggaagacuuggauuuggu

SEQ ID NO: 247794 - RNA, 53 nt, Homo Sapiens
aacuagauuuacuggaagacauuuuucuggaagugauugacuggaagaucuag

SEQ ID NO: 247795 - RNA, 64 nt, Homo Sapiens
cagccuccugaguagcugggauuacaggcguccgcuaccacaacuggcuaauuuuuacauuuuu

SEQ ID NO: 247796 - RNA, 64 nt, Homo Sapiens
ggaagagaaaagguaccugaggaugcagaaguaccuaccacaugggaaccguuuguccacacuc

SEQ ID NO: 247797 - RNA, 64 nt, Homo Sapiens; identical to SEQ ID NO: 60375

SEQ ID NO: 247798 - RNA, 64 nt, Homo Sapiens; identical to SEQ ID NO: 60376

SEQ ID NO: 247799 - RNA, 64 nt, Homo Sapiens; identical to SEQ ID NO: 60377

SEQ ID NO: 247800 - RNA, 64 nt, Homo Sapiens; identical to SEQ ID NO: 60378

SEQ ID NO: 247801 - RNA, 64 nt, Homo Sapiens; identical to SEQ ID NO: 60379

SEQ ID NO: 247802 - RNA, 64 nt, Homo Sapiens; identical to SEQ ID NO: 60380

SEQ ID NO: 247803 - RNA, 64 nt, Homo Sapiens; identical to SEQ ID NO: 60381

SEQ ID NO: 247804 - RNA, 64 nt, Homo Sapiens; identical to SEQ ID NO: 60382

SEQ ID NO: 247805 - RNA, 64 nt, Homo Sapiens; identical to SEQ ID NO: 60383

SEQ ID NO: 247806 - RNA, 64 nt, Homo Sapiens; identical to SEQ ID NO: 60384

SEQ ID NO: 247807 - RNA, 64 nt, Homo Sapiens; identical to SEQ ID NO: 60385

SEQ ID NO: 247808 - RNA, 64 nt, Homo Sapiens; identical to SEQ ID NO: 60386

SEQ ID NO: 247809 - RNA, 64 nt, Homo Sapiens; identical to SEQ ID NO: 60387

SEQ ID NO: 247810 - RNA, 64 nt, Homo Sapiens; identical to SEQ ID NO: 60388

SEQ ID NO: 247811 - RNA, 64 nt, Homo Sapiens; identical to SEQ ID NO: 60389

SEQ ID NO: 247812 - RNA, 64 nt, Homo Sapiens; identical to SEQ ID NO: 60390

SEQ ID NO: 247813 - RNA, 64 nt, Homo Sapiens; identical to SEQ ID NO: 60391

SEQ ID NO: 247814 - RNA, 64 nt, Homo Sapiens; identical to SEQ ID NO: 60392

SEQ ID NO: 247815 - RNA, 64 nt, Homo Sapiens; identical to SEQ ID NO: 60393

SEQ ID NO: 247816 - RNA, 64 nt, Homo Sapiens; identical to SEQ ID NO: 60394

SEQ ID NO: 247817 - RNA, 64 nt, Homo Sapiens; identical to SEQ ID NO: 60395

SEQ ID NO: 247818 - RNA, 64 nt, Homo Sapiens; identical to SEQ ID NO: 60396

SEQ ID NO: 247819 - RNA, 64 nt, Homo Sapiens; identical to SEQ ID NO: 60397

SEQ ID NO: 247820 - RNA, 63 nt, Homo Sapiens
ugagaccagccuggccaaauggugaaaccccaucucuacgaaaaauacaaaauuuagccgggc

SEQ ID NO: 247821 - RNA, 63 nt, Homo Sapiens
ugauggacgcggucccagcggccgggcccgcagcucuacgacgucgccagccaugaugcugca

SEQ ID NO: 247822 - RNA, 63 nt, Homo Sapiens
gccauuugcucauugucuuuacacaaccgaauucucuacgaugauaaguagcauugcugaaac

SEQ ID NO: 247823 - RNA, 63 nt, Homo Sapiens
ccauccaguccuucgagaagagacccagcaguccucuacgaggacuugcccugacgaguauga

SEQ ID NO: 247824 - RNA, 63 nt, Homo Sapiens
ccacggguucccacgcugcugugacugcccugccucuacgacaaaagccaacgggucuucagu

SEQ ID NO: 247825 - RNA, 63 nt, Homo Sapiens
cugguagagaggacgaauguuccacaccauggucucuacgaaaaagaaauaguuagucaccuu

SEQ ID NO: 247826 - RNA, 63 nt, Homo Sapiens
acauuaaguauuaaugaggggaaaggaaaugagcucuacgaggauuucacccugcaugggaga

SEQ ID NO: 247827 - RNA, 63 nt, Homo Sapiens
guagagcaaaacuauagguuuugguuccacaaucucuacgacuaaucaccuacucaaugccug

SEQ ID NO: 247828 - RNA, 63 nt, Homo Sapiens
gugagacugggaacuugauggaagcagaaccagcucuacgagacucguuucccuuuuccucua

SEQ ID NO: 247829 - RNA, 63 nt, Homo Sapiens
agguugcagaaaugggaagaggccuucaucccucucuacgauauguuuccuaacgccauugga

SEQ ID NO: 247830 - RNA, 62 nt, Homo Sapiens
agaucacaguuuuuuauucuaaugcagaacguacucuacgauaguguugccugcagaaauaa

SEQ ID NO: 247831 - RNA, 63 nt, Homo Sapiens
cgagaccacccuggccaacaugcgaaaccccaucucuacgaaaaauagaaauauuagccgggc

SEQ ID NO: 247832 - RNA, 63 nt, Homo Sapiens
uaaaauggaacaaauaauaucuccuuaagauugcucuacgaauuaauugacacauuaugugug

SEQ ID NO: 247833 - RNA, 63 nt, Homo Sapiens
gugcacuguuguaaagcugaaaaaccguuaagccucuacgauuuuuaaguaaguuggggacca

SEQ ID NO: 247834 - RNA, 63 nt, Homo Sapiens
aguuugcagccgaguagggacuccuccccuguccucuacgaaggaaaagauugcuauugucgu

SEQ ID NO: 247835 - RNA, 63 nt, Homo Sapiens
uucgaaaccggggcccagguugcaccugggauucucuacgaaauucaguaggagagaagaucc

SEQ ID NO: 247836 - RNA, 63 nt, Homo Sapiens
ccagagagacuguaguucccauaauuugaauaacucuacgagauuaagccuuauccagcagcc

SEQ ID NO: 247837 - RNA, 63 nt, Homo Sapiens
ugacaagcugccccugcccuucgaaacagaggacucuacgaaacaaauguguaccuggacccc

SEQ ID NO: 247838 - RNA, 63 nt, Homo Sapiens
guuugagaccagccugacauggugaaaccccaucucuacgaaaaauacaaaaauuagcugggc

SEQ ID NO: 247839 - RNA, 63 nt, Homo Sapiens
ucuuugggcggcaggugcgguccccacggccggcucuacgaggaagaguucuggcucuuuugu

SEQ ID NO: 247840 - RNA, 63 nt, Homo Sapiens
ccugcucacucugggguuggggguccagcugcccucuacgaucaggugcaggggcugcccagg

SEQ ID NO: 247841 - RNA, 63 nt, Homo Sapiens
cgaccucucuauguaagcacugucacaguguuccucuacgaccguuuauuuuguuucugucua

SEQ ID NO: 247842 - RNA, 63 nt, Homo Sapiens
uguugcuggggcuccaccuuuucucaccuggggcucuacgagaauuugguguuggaggugggu

SEQ ID NO: 247843 - RNA, 63 nt, Homo Sapiens
gugauaacuguaugggcuaucaauauccauucacucuacgaguugugcagaaagaugggaacu

SEQ ID NO: 247844 - RNA, 63 nt, Homo Sapiens
cuugaccaaagcugcuguguggcagcucggccucucuacgaccccaucuugguggcugcacac

SEQ ID NO: 247845 - RNA, 63 nt, Homo Sapiens
agcaagugccugcccccuccaaacccacucuugcucuacgaggggaagggagggucagggaag

SEQ ID NO: 247846 - RNA, 63 nt, Homo Sapiens
aggcagaguacguuuuucccacgacagccacugcucuacgaaauucaaccagguguugaaggc

SEQ ID NO: 247847 - RNA, 63 nt, Homo Sapiens
auuaaaaguuagcccgguguagugagacccugacucuacgaaagagaucaaccugggcaagag

SEQ ID NO: 247848 - RNA, 63 nt, Homo Sapiens
auucuuugggccuccuggaccuaagccaagacccucuacgaaccacucuguuaauaagaaacc

SEQ ID NO: 247849 - RNA, 63 nt, Homo Sapiens
uacacaggaagcgggauucgcagccugggaucgcucuacgaaucugugacuuuuuuugcugag

SEQ ID NO: 247850 - RNA, 63 nt, Homo Sapiens
augaggucugcugccaggugugaacaagcaugucucuacgaaugaacgaaacauuggggaucu

SEQ ID NO: 247851 - RNA, 63 nt, Homo Sapiens
gccaacugaggcauauuuccuagaucauuuugccucuacgauguuuuuucuugguccaccuuu

SEQ ID NO: 247852 - RNA, 63 nt, Homo Sapiens
gguccucaucuccaucuggcccucugaucuggccucuacgagauucagagaagagaacccuca

SEQ ID NO: 247853 - RNA, 64 nt, Homo Sapiens; identical to SEQ ID NO: 125388

SEQ ID NO: 247854 - RNA, 64 nt, Homo Sapiens; identical to SEQ ID NO: 125389

SEQ ID NO: 247855 - RNA, 64 nt, Homo Sapiens; identical to SEQ ID NO: 125390

SEQ ID NO: 247856 - RNA, 64 nt, Homo Sapiens; identical to SEQ ID NO: 125391

SEQ ID NO: 247857 - RNA, 64 nt, Homo Sapiens; identical to SEQ ID NO: 125392

SEQ ID NO: 247858 - RNA, 64 nt, Homo Sapiens; identical to SEQ ID NO: 125393

SEQ ID NO: 247859 - RNA, 64 nt, Homo Sapiens; identical to SEQ ID NO: 125394

SEQ ID NO: 247860 - RNA, 64 nt, Homo Sapiens; identical to SEQ ID NO: 125395

SEQ ID NO: 247861 - RNA, 64 nt, Homo Sapiens; identical to SEQ ID NO: 125396

SEQ ID NO: 247862 - RNA, 64 nt, Homo Sapiens; identical to SEQ ID NO: 125397

SEQ ID NO: 247863 - RNA, 64 nt, Homo Sapiens; identical to SEQ ID NO: 125398

SEQ ID NO: 247864 - RNA, 64 nt, Homo Sapiens; identical to SEQ ID NO: 125399

SEQ ID NO: 247865 - RNA, 64 nt, Homo Sapiens; identical to SEQ ID NO: 125400

SEQ ID NO: 247866 - RNA, 64 nt, Homo Sapiens; identical to SEQ ID NO: 125401

SEQ ID NO: 247867 - RNA, 62 nt, Homo Sapiens
gguuucagggggacccaaaugggcccaccuccgauucacagagcugcguccugcacccuccu

SEQ ID NO: 247868 - RNA, 62 nt, Homo Sapiens
gguuguguaucucuauaauguacucauacuuagauucacaauugccuccaaacauuuuucug

SEQ ID NO: 247869 - RNA, 62 nt, Homo Sapiens
aauucagcauguuggucagagacacggucacugauucacacccagucccugccacagaccgu

SEQ ID NO: 247870 - RNA, 62 nt, Homo Sapiens
cgucucagacacgcacagugggccugcugcaugauucacacccagucccugccacagaccgu

SEQ ID NO: 247871 - RNA, 62 nt, Homo Sapiens; identical to SEQ ID NO: 247870

SEQ ID NO: 247872 - RNA, 62 nt, Homo Sapiens
ugaguuaaauuagacaacugauccucaauacugauucacaauauuggggcaauuaccuuuug

SEQ ID NO: 247873 - RNA, 62 nt, Homo Sapiens
ccaugugggauggagcagaacaagaaaaggaugauucacaucggguggguaguguaaauaca

SEQ ID NO: 247874 - RNA, 62 nt, Homo Sapiens
ugcaucuuaacugcucuuuaguauugaagagggauucacauccagagaaccaucccuauuuu

SEQ ID NO: 247875 - RNA, 62 nt, Homo Sapiens
guauuugaaaaauguauauauuguucaaacgggauucacagagccuguuuugucuuuuguug

SEQ ID NO: 247876 - RNA, 62 nt, Homo Sapiens
aauuaacucuuccucucuucuagaaagaaugagauucacaauuaguuaagauucacaaucuu

SEQ ID NO: 247877 - RNA, 62 nt, Homo Sapiens
cuuuagaaagaaugagauucggucuuaguuaagauucacaauuuauuuuccgucaggugcca

SEQ ID NO: 247878 - RNA, 64 nt, Homo Sapiens
gaugggcauuuguugccauuguuuuacucaauugguccccuacuucaauagaagcagaguauuc

SEQ ID NO: 247879 - RNA, 64 nt, Homo Sapiens
gauagccacuauucacagcuaaaagaaaguaaaaguccccuaguccuaugucaaaaaagaaaua

SEQ ID NO: 247880 - RNA, 64 nt, Homo Sapiens
ccucuuccucuccucuguggcuuuuccuguuauuguccccuaaugauaggauauucccugcugc

SEQ ID NO: 247881 - RNA, 64 nt, Homo Sapiens
uugggauuuccuucucccuuucccugcccacccuguccccuacaauuugugcuucugaguugag

SEQ ID NO: 247882 - RNA, 64 nt, Homo Sapiens
gauuugaaagaaguuucauuuacuucacagcuagcauguucacaauggaaagaauaaaagcaug

SEQ ID NO: 247883 - RNA, 64 nt, Homo Sapiens
aauaucaaaucuuuugaugcaaccagguguagggcauguucaugguauaaauacauaacuuccu

SEQ ID NO: 247884 - RNA, 64 nt, Homo Sapiens
aaggcauggaggcagggccacccaggggcaucaucauguucaacaaaaaccaucaccucccauu

SEQ ID NO: 247885 - RNA, 64 nt, Homo Sapiens
uaccugcugauggaauccagaaacugacauuugucauguucacuuuauguauaauggacagagg

SEQ ID NO: 247886 - RNA, 64 nt, Homo Sapiens
gagccugccuuuccuaucuucacaccugccaccucauguucacaccuaucuuucucaccuuuuu

SEQ ID NO: 247887 - RNA, 64 nt, Homo Sapiens
acaucuguuuucacaccuucaucccugucuuccucauguucacacuugucuuccccauguucau

SEQ ID NO: 247888 - RNA, 64 nt, Homo Sapiens
ucccugucuuccucauguucacacuugucuuccccauguucauagcugccuuucuuaccauuuu

SEQ ID NO: 247889 - RNA, 64 nt, Homo Sapiens
cgccugaagcuuaaccaagagugagaggauaugucauguucacacucaaugcaauucguagugg

SEQ ID NO: 247890 - RNA, 64 nt, Homo Sapiens
ccacauuuucaauccuccuucacugucuuccuaccauguucagcccagacuccugccacaugga

SEQ ID NO: 247891 - RNA, 64 nt, Homo Sapiens
ugagacacaggcaucaacacucucaaaugauucacauguucagccaaaguugagaaccaucgag

SEQ ID NO: 247892 - RNA, 64 nt, Homo Sapiens
ugauucauaacaaggaaaauaaaucaccuuaaaacauguucauuagcuaccguuaaaugaggac

SEQ ID NO: 247893 - RNA, 64 nt, Homo Sapiens
uauguuaaaguaguaugauaugaacuguuuuccucauguucaguauaaaucacuuaucaaaaug

SEQ ID NO: 247894 - RNA, 64 nt, Homo Sapiens
aaaugaucucuguuugaaccucuuaaagaucagccauguucagguuugggugaggaaauuguuc

SEQ ID NO: 247895 - RNA, 64 nt, Homo Sapiens
uuuacuucauuuuccuuuaauaacuuaaucucuucauguucaguuuuuacuucacucuuuauuc

SEQ ID NO: 247896 - RNA, 64 nt, Homo Sapiens
agaugagaugucugacuugcuuucacuuauuaaacauguucaccaugggaugaugucuguaaca

SEQ ID NO: 247897 - RNA, 64 nt, Homo Sapiens
cacaugugcucucgggugccccguaugcuuucuucauguucagucauguguacacacgcuuuuc

SEQ ID NO: 247898 - RNA, 64 nt, Homo Sapiens
aagauuugguggguccacaccugggcuacgguuccauguucaccuccugggccugggcuuuagu

SEQ ID NO: 247899 - RNA, 64 nt, Homo Sapiens
uucuguuuaaauuuguacuguggcuuauguuacacauguucauguucaccucucauucaccugu

SEQ ID NO: 247900 - RNA, 64 nt, Homo Sapiens
uuaaauuuguacuguggcuuauguuacacauguucauguucaccucucauucaccuguuuuaua

SEQ ID NO: 247901 - RNA, 64 nt, Homo Sapiens
cagcucugagauuagcaaaagccagggacagcuacauguucagguuuuuuuuuuuuuuuuuuuu

SEQ ID NO: 247902 - RNA, 64 nt, Homo Sapiens
ucuuuucagauucacguucucuaacaaagagucucauguucaagaucaauaugucuaauaagug

SEQ ID NO: 247903 - RNA, 64 nt, Homo Sapiens
uuuuaccguccccagccccccucccacauggucacauguucacuugcuuuuccuuccaucuguu

SEQ ID NO: 247904 - RNA, 64 nt, Homo Sapiens
auuuaacagaaugauugauuuuucuuucaaucagcauguucaccaaaaauagaaaaguucuucu

SEQ ID NO: 247905 - RNA, 64 nt, Homo Sapiens
ucauauaucugcugaaauuccccaucuuuucaugcauguucauguuuuccccuuuacccuuugu

SEQ ID NO: 247906 - RNA, 64 nt, Homo Sapiens
uagugaauagaaugaggcagagguaaugggaugucauguucaagauugguuacaaaaagacugu

SEQ ID NO: 247907 - RNA, 64 nt, Homo Sapiens
cugacccuauuugaauuaauccugugcuaguuuucauguucacaaggcagguuagcuagcccac

SEQ ID NO: 247908 - RNA, 64 nt, Homo Sapiens
cuuggguuuagggguguuuuugucccaguuaucacauguucacaaagauagaaagcauucagga

SEQ ID NO: 247909 - RNA, 64 nt, Homo Sapiens
acgcaccucccagaggaccggugggaauuguucauagugccaaaguccuacuacugcguuuuca

SEQ ID NO: 247910 - RNA, 64 nt, Homo Sapiens
uguuuuauuaauuuggggaaagggguguuagcauuagugccaugauaucuacuggauuuuaagu

SEQ ID NO: 247911 - RNA, 64 nt, Homo Sapiens
aaaauaagaucgaugguaucuuguaaaaugaggguagugccacuucuuaguauuuuugaaagcu

SEQ ID NO: 247912 - RNA, 64 nt, Homo Sapiens
uccucuucauuuguucuuuaugagaaaacccggguagugccagcaccuggauacaguauuuaca

SEQ ID NO: 247913 - RNA, 64 nt, Homo Sapiens; identical to SEQ ID NO: 99488

SEQ ID NO: 247914 - RNA, 64 nt, Homo Sapiens; identical to SEQ ID NO: 99489

SEQ ID NO: 247915 - RNA, 64 nt, Homo Sapiens; identical to SEQ ID NO: 99490

SEQ ID NO: 247916 - RNA, 64 nt, Homo Sapiens; identical to SEQ ID NO: 99491

SEQ ID NO: 247917 - RNA, 64 nt, Homo Sapiens; identical to SEQ ID NO: 99492

SEQ ID NO: 247918 - RNA, 64 nt, Homo Sapiens; identical to SEQ ID NO: 99493

SEQ ID NO: 247919 - RNA, 64 nt, Homo Sapiens; identical to SEQ ID NO: 99494

SEQ ID NO: 247920 - RNA, 64 nt, Homo Sapiens; identical to SEQ ID NO: 99495

SEQ ID NO: 247921 - RNA, 64 nt, Homo Sapiens
guguggauuuuucucugaaugauauacauaacaccaaucagaccaguagaaaaaucuguugccu

SEQ ID NO: 247922 - RNA, 64 nt, Homo Sapiens
agaaaaaucuguugccugaucagaugaaaagcaacaaucagaguuagcaaucugccacaacugc

SEQ ID NO: 247923 - RNA, 64 nt, Homo Sapiens
uggccaaggggugggccugugaaucaauccugggcaaucagacacccucuccuuaaaaacuggc

SEQ ID NO: 247924 - RNA, 64 nt, Homo Sapiens
aauggccuggagggacuuuuaaucagugaagaugcaaucagacaaguguuuuggaaagagcacc

SEQ ID NO: 247925 - RNA, 64 nt, Homo Sapiens
aaggacaaggacaugagacaacuuaagauagccacaaucagaaacaaucagaccuucucccuga

SEQ ID NO: 247926 - RNA, 64 nt, Homo Sapiens
uucucccugaacuuaagauaaaggacacaagaaucaaucagaccaguuucugggguuaagcacu

SEQ ID NO: 247927 - RNA, 64 nt, Homo Sapiens
auagacagguacacuaaagguacacauuucccaucaaucagaaaucuagcggcuaaguaccucc

SEQ ID NO: 247928 - RNA, 64 nt, Homo Sapiens
acacaaucuuaaccacucggcccucauucugcagcaaucagaaugaucgaauuuaauuuccuuu

SEQ ID NO: 247929 - RNA, 61 nt, Homo Sapiens
ccacuaagaaggccugucuacacugcaggggaaccucaagaacuuuucauugcacuucuaa

SEQ ID NO: 247930 - RNA, 61 nt, Homo Sapiens
auaucacugacucuugaaaucacuaacagugaaccucaaauuugguuaugauguuaacaga

SEQ ID NO: 247931 - RNA, 61 nt, Homo Sapiens
caaaaggaagagccuuuuaaaaacauuugccaaccucaagaauaaauacugaaagucuuga

SEQ ID NO: 247932 - RNA, 61 nt, Homo Sapiens
uuuuuuaacgucagccagauauuuagaaaauaaccucaaaaguguuuauauggucagugag

SEQ ID NO: 247933 - RNA, 61 nt, Homo Sapiens
ccacuggaaaguaaacaaaaccaucccucccaaccucaaagcuaggccacacucuauuuca

SEQ ID NO: 247934 - RNA, 61 nt, Homo Sapiens
aaaccauaaagcuuggagugcacaaaacuguaaccucaaggugaaauacacuaagagcagc

SEQ ID NO: 247935 - RNA, 61 nt, Homo Sapiens
guauuaaauagcauuggggacuuaacguccuaaccucaauuaguacacagucugauaagga

SEQ ID NO: 247936 - RNA, 64 nt, Homo Sapiens
gguccucagcccauuucagacugcagaugccgcccacucccaccccacuccuaggcugccuugg

SEQ ID NO: 247937 - RNA, 64 nt, Homo Sapiens
ucacuaaggggguucccgaggcccagggccaaggcacucccaccgccuaccuuagcacaggguc

SEQ ID NO: 247938 - RNA, 64 nt, Homo Sapiens
uuucaggcuccugccugccccaggcccccugccccacucccaucucuucuucccugccaccccu

SEQ ID NO: 247939 - RNA, 64 nt, Homo Sapiens
ucuggagcugcaggcaggagguggcacuggcucccacucccaccccugcccaggcuggcaucua

SEQ ID NO: 247940 - RNA, 64 nt, Homo Sapiens
agaacuuggcagccuugaaguuccuggaggaggacacucccaucucgucgggggcugggagaug

SEQ ID NO: 247941 - RNA, 64 nt, Homo Sapiens
agaaccuggcagccccaaaaacauuccuggaggacacucccaucugcccgcugggggccugaag

SEQ ID NO: 247942 - RNA, 64 nt, Homo Sapiens
cacagacauacuuuuguagaagaagaauaaguaacacucccaaauuuugguugaacagagggac

SEQ ID NO: 247943 - RNA, 64 nt, Homo Sapiens
ucuuucuaggacuucacuuuccuccuccaccccacacucccaccuuuucuuuuguuccccuguc

SEQ ID NO: 247944 - RNA, 64 nt, Homo Sapiens
cuucccccagagaaguggcuuggagggaacuucccacucccauugccugcuuuccccauuccag

SEQ ID NO: 247945 - RNA, 64 nt, Homo Sapiens
ucuuggguuggaugcuaugggaauuacaacccaucacucccaaugccucccuuuccuggaggag

SEQ ID NO: 247946 - RNA, 64 nt, Homo Sapiens
gcauuucuucuugaauccauugcagauugacuuccacucccacuccuucacuaaaagggcucuu

SEQ ID NO: 247947 - RNA, 64 nt, Homo Sapiens
uuccuaugugauuuggccuuucgaugucaaucaucacucccagccauugauuuuggugacccac

SEQ ID NO: 247948 - RNA, 64 nt, Homo Sapiens
cccuggccucugccauaauugacccggguucccccacucccauugcguccugccccuucaccuu

SEQ ID NO: 247949 - RNA, 64 nt, Homo Sapiens
cuuucagcguccugccccuugccccguucagcuucacucccaccacguggguuaagcucuuccu

SEQ ID NO: 247950 - RNA, 64 nt, Homo Sapiens
uuuuauuuuguuuucucguucucccuccccaccccacucccagccuuaucuauccccccucacu

SEQ ID NO: 247951 - RNA, 64 nt, Homo Sapiens
ccuuaucuauccccccucacuguccccuuuucuccacucccagccccauuuccuuuuuuucugg

SEQ ID NO: 247952 - RNA, 64 nt, Homo Sapiens
caggaaacccuggugaaggugcaacugagccacccacucccaaaaaucauuccaaggccaaacu

SEQ ID NO: 247953 - RNA, 64 nt, Homo Sapiens
cuuaaaaccacagauugcaauuaauauugcaucucacucccaccaaaagucugggcugccuucc

SEQ ID NO: 247954 - RNA, 64 nt, Homo Sapiens
accaaaaauaacuuuaggaaccaccauauuauaucacucccaauagcacugaccuggugaucaa

SEQ ID NO: 247955 - RNA, 64 nt, Homo Sapiens
ucccucaaaucaguccuuauccucuuucuaucuucacucccaucaucaucuauuuucacacuau

SEQ ID NO: 247956 - RNA, 64 nt, Homo Sapiens
cucccaacuauucuugcuuuucccagacagcucccacucccaugucucugcucauuuagucccg

SEQ ID NO: 247957 - RNA, 64 nt, Homo Sapiens
gcauccugacaucuguucauuuaggcuucaguuccacucccaggaacuuugccugucccacgag

SEQ ID NO: 247958 - RNA, 64 nt, Homo Sapiens
ccgcaagagggacagagcccgggagagacucgcucacucccauguuggguuugagacagacacc

SEQ ID NO: 247959 - RNA, 64 nt, Homo Sapiens
cacaaguagccucugggaucugccaacacacguccacucccaagccacuagcccacuccccagu

SEQ ID NO: 247960 - RNA, 64 nt, Homo Sapiens
acacccgcacacagccagcagcuaucccugcagccacucccagcgcaggaaggagcaguccccu

SEQ ID NO: 247961 - RNA, 64 nt, Homo Sapiens
ugcuggaggagaggggagauuccagugcugcccacacucccagcguccaugucccaggccccac

SEQ ID NO: 247962 - RNA, 64 nt, Homo Sapiens
auccugugaaccccacuccacccacgcccggccccacucccacccacucacaccauccuaugag

SEQ ID NO: 247963 - RNA, 64 nt, Homo Sapiens
auccugugagccccacuccuaccacgccuggccccacucccacccacucacucuauccugugag

SEQ ID NO: 247964 - RNA, 64 nt, Homo Sapiens
cccacucacaccaaccugugcauccugugagccccacucccagcacucccggccccacucacuc

SEQ ID NO: 247965 - RNA, 64 nt, Homo Sapiens
auccugugagccccacuccccccacucccagccccacucccaccacucccaccauccugugagc

SEQ ID NO: 247966 - RNA, 64 nt, Homo Sapiens
cccacucccaccauccugugcauccugugagccccacucccagcacuuccagccccacucccac

SEQ ID NO: 247967 - RNA, 64 nt, Homo Sapiens
auccugugagccccacuccccccacuuccagccccacucccaccacucccaccauccugugagc

SEQ ID NO: 247968 - RNA, 64 nt, Homo Sapiens
auccugugagccccacuucccccacucccagccccacucccaccauucacuccauccugugagu

SEQ ID NO: 247969 - RNA, 64 nt, Homo Sapiens
cccacucccaccauccugugcauccugugagucccacucccagcaugcccagccccauucacuc

SEQ ID NO: 247970 - RNA, 64 nt, Homo Sapiens
auccugugagcccaugcccgcccacucccagccccacucccaccacucacuccauccugugagu

SEQ ID NO: 247971 - RNA, 64 nt, Homo Sapiens
cccacucccaccauccugugcauccugugagucccacucccagcgugcccagccccacucacuc

SEQ ID NO: 247972 - RNA, 64 nt, Homo Sapiens
aucuuguaagacugugcccaaccacgcccggccccacucccacccucucacaccauccugugag

SEQ ID NO: 247973 - RNA, 64 nt, Homo Sapiens
cucccugcuccacgucugcgccgccgccggaguccacucccagugcuugcaagauuccaaguuc

SEQ ID NO: 247974 - RNA, 64 nt, Homo Sapiens
ccacaccgagggcgaccccgucacagccucaagucacucccaagcccccuccuugucugugcau

SEQ ID NO: 247975 - RNA, 64 nt, Homo Sapiens
accaugcacgcucccagcgugcuguguccuucgccacucccacgcgcccguuccucuuccgucg

SEQ ID NO: 247976 - RNA, 64 nt, Homo Sapiens
gggggccgggcugagggugggggugcgagguggucacucccaucgugccccuggccgucccucc

SEQ ID NO: 247977 - RNA, 64 nt, Homo Sapiens
cccagcuccagcugcccucagggaucucaucacccacucccagcccuacugucuucaguccaug

SEQ ID NO: 247978 - RNA, 64 nt, Homo Sapiens
cacaguuccuacugucuucaacacccccacaccccacucccacacuggccauucacacacacac

SEQ ID NO: 247979 - RNA, 60 nt, Homo Sapiens
auuaacacuuuugcugagggagaaaaagaaaacauacauuaugaagccuuuccaaaauua

SEQ ID NO: 247980 - RNA, 60 nt, Homo Sapiens
aaaucuuacuaugaaaucaagagguuuaagaacauacacugggcagauguugauuccgug

SEQ ID NO: 247981 - RNA, 60 nt, Homo Sapiens
gugaaaacacugcccugccuguauuguuggaacauacauucacccaugauucuaugcacu

SEQ ID NO: 247982 - RNA, 60 nt, Homo Sapiens
cacacauauguacacacacacaugugcccgaacauacacaaaccugugacuguugaauaa

SEQ ID NO: 247983 - RNA, 60 nt, Homo Sapiens
gcaaguuuaaauauuugagcuuuacaaauaaacauacacaugcucaguuuuuuaaguaaa

SEQ ID NO: 247984 - RNA, 60 nt, Homo Sapiens
aaggcuuauguguauuuuccauauauguaaaacauacacauguaaaauauauguggccau

SEQ ID NO: 247985 - RNA, 60 nt, Homo Sapiens
aaugcacgcacacgcacagagacaugccagaacauacaaggacaugcugccugaacauac

SEQ ID NO: 247986 - RNA, 60 nt, Homo Sapiens
augccagaacauacaaggacaugcugccugaacauacacacgcacacccaugcgcagaug

SEQ ID NO: 247987 - RNA, 60 nt, Homo Sapiens
gucaaacuuuacaucagggauuuugaacacaacauacacuuucuuguuuagaacuguuga

SEQ ID NO: 247988 - RNA, 60 nt, Homo Sapiens
uucacauuacacaguuccagaauagaacaaaacauacauauguggaucaucuccuaggaa

SEQ ID NO: 247989 - RNA, 60 nt, Homo Sapiens
cuauguuuugaacaaaaacacuggcagauuaacauacaacauccagaagaugccaaugua

SEQ ID NO: 247990 - RNA, 60 nt, Homo Sapiens
cacucaaauuccacaagcuauuaaaaaaaaaacauacagaacuccccuccaaacaaacaa

SEQ ID NO: 247991 - RNA, 60 nt, Homo Sapiens
cauauauauaauauauuuuuuguaacuaugaacauacacaguuuuccagaaauagauuuu

SEQ ID NO: 247992 - RNA, 60 nt, Homo Sapiens
aaagggagagagaauuucuuuauauacacaaacauacaugaauaugcauaucuauaugca

SEQ ID NO: 247993 - RNA, 60 nt, Homo Sapiens
gagaagcauggggaaaauauuugcacucuaaacauacagagauagagguggggcuugugg

SEQ ID NO: 247994 - RNA, 60 nt, Homo Sapiens
uagaauugucacucagcauaaugagcauuuaacauacaaaggcaauguacuguuuugugu

SEQ ID NO: 247995 - RNA, 60 nt, Homo Sapiens
gccagagauacucuaggcauguaaagcacaaacauacauauaaaaucugcgggcuucaaa

SEQ ID NO: 247996 - RNA, 60 nt, Homo Sapiens
cacugcauccuguaaggucugcaggccagaaacauacauauauauuuauauacaguuaca

SEQ ID NO: 247997 - RNA, 60 nt, Homo Sapiens
agacaugagauuccaguuguauaccuuugaaacauacaagacuucucucuuuuaaaucag

SEQ ID NO: 247998 - RNA, 60 nt, Homo Sapiens
gaaguggcuauggaaugguggguuguguccaacauacacgacacucgugugaccccacag

SEQ ID NO: 247999 - RNA, 60 nt, Homo Sapiens
caagcccacccggcccgucgauuugguguuaacauacaccauuuuuuucuuuuuucuccu

SEQ ID NO: 248000 - RNA, 60 nt, Homo Sapiens
ccugucacauugagaucauaaccccucuacaacauacagcaggauucagcacuacagcau

SEQ ID NO: 248001 - RNA, 60 nt, Homo Sapiens
gagccuaaacagcaguuaagaaacauuuucaacauacauugaacaaaguacacuugauaa

SEQ ID NO: 248002 - RNA, 64 nt, Homo Sapiens; identical to SEQ ID NO: 244942

SEQ ID NO: 248003 - RNA, 64 nt, Homo Sapiens; identical to SEQ ID NO: 244943

SEQ ID NO: 248004 - RNA, 64 nt, Homo Sapiens; identical to SEQ ID NO: 244944

SEQ ID NO: 248005 - RNA, 64 nt, Homo Sapiens; identical to SEQ ID NO: 244945

SEQ ID NO: 248006 - RNA, 64 nt, Homo Sapiens; identical to SEQ ID NO: 244946

SEQ ID NO: 248007 - RNA, 64 nt, Homo Sapiens; identical to SEQ ID NO: 244947

SEQ ID NO: 248008 - RNA, 64 nt, Homo Sapiens; identical to SEQ ID NO: 244948

SEQ ID NO: 248009 - RNA, 64 nt, Homo Sapiens; identical to SEQ ID NO: 244949

SEQ ID NO: 248010 - RNA, 64 nt, Homo Sapiens; identical to SEQ ID NO: 244950

SEQ ID NO: 248011 - RNA, 64 nt, Homo Sapiens; identical to SEQ ID NO: 244951

SEQ ID NO: 248012 - RNA, 64 nt, Homo Sapiens; identical to SEQ ID NO: 244952

SEQ ID NO: 248013 - RNA, 64 nt, Homo Sapiens; identical to SEQ ID NO: 244953

SEQ ID NO: 248014 - RNA, 64 nt, Homo Sapiens; identical to SEQ ID NO: 244954

SEQ ID NO: 248015 - RNA, 64 nt, Homo Sapiens; identical to SEQ ID NO: 244955

SEQ ID NO: 248016 - RNA, 64 nt, Homo Sapiens; identical to SEQ ID NO: 244956

SEQ ID NO: 248017 - RNA, 64 nt, Homo Sapiens; identical to SEQ ID NO: 244957

SEQ ID NO: 248018 - RNA, 64 nt, Homo Sapiens; identical to SEQ ID NO: 244958

SEQ ID NO: 248019 - RNA, 64 nt, Homo Sapiens; identical to SEQ ID NO: 244959

SEQ ID NO: 248020 - RNA, 64 nt, Homo Sapiens; identical to SEQ ID NO: 244960

SEQ ID NO: 248021 - RNA, 64 nt, Homo Sapiens; identical to SEQ ID NO: 244961

SEQ ID NO: 248022 - RNA, 64 nt, Homo Sapiens; identical to SEQ ID NO: 244962

SEQ ID NO: 248023 - RNA, 64 nt, Homo Sapiens; identical to SEQ ID NO: 244963

SEQ ID NO: 248024 - RNA, 64 nt, Homo Sapiens; identical to SEQ ID NO: 244964

SEQ ID NO: 248025 - RNA, 64 nt, Homo Sapiens; identical to SEQ ID NO: 244965

SEQ ID NO: 248026 - RNA, 64 nt, Homo Sapiens; identical to SEQ ID NO: 244966

SEQ ID NO: 248027 - RNA, 64 nt, Homo Sapiens; identical to SEQ ID NO: 244967

SEQ ID NO: 248028 - RNA, 64 nt, Homo Sapiens; identical to SEQ ID NO: 244968

SEQ ID NO: 248029 - RNA, 64 nt, Homo Sapiens
uuaauauuugauuaaauaaugcagucagcuaagagccaacaaaaccccauauccagauaguuag

SEQ ID NO: 248030 - RNA, 64 nt, Homo Sapiens
caaggaugucaacuugacauccuucccuuagcaugccaacaagccauuagacugauucuuccac

SEQ ID NO: 248031 - RNA, 64 nt, Homo Sapiens
aaugacucauacugugaugauuuuccagaugucugccaacaagaagcugcuuguaagucacagg

SEQ ID NO: 248032 - RNA, 64 nt, Homo Sapiens
cuauucuugaaagagcaaagcaaccuagcaugaugccaacaagagcacauauuacucuuuuuag

SEQ ID NO: 248033 - RNA, 64 nt, Homo Sapiens
ccuuuuuguaggagguaggauauuuuauauucugccgcaggauagaacccacgcaaggauuuuc

SEQ ID NO: 248034 - RNA, 64 nt, Homo Sapiens
cccauucucagagaauguguccaagcuggccggcccgcaggagcuucuccggaaggcucuggcc

SEQ ID NO: 248035 - RNA, 64 nt, Homo Sapiens
gugugugaauguguauguauguucugaggcagcuccgcaggacucuuauuuauuaauagauuaa

SEQ ID NO: 248036 - RNA, 64 nt, Homo Sapiens
gaagaccugaaggggcuggcccuccuuuugccuuccgcaggacucucagucagaggcccccguc

SEQ ID NO: 248037 - RNA, 64 nt, Homo Sapiens
ggggcaguauugggggacugugcuagcuuuacccccgcaggacauacacaggagccuuugaucu

SEQ ID NO: 248038 - RNA, 64 nt, Homo Sapiens
cgggugggaaugaccccuaggcaaggggaugagaccgcaggaggaaauggcggggaggaggcau

SEQ ID NO: 248039 - RNA, 64 nt, Homo Sapiens
gaugggcagaauggcccuaguggccauuguguccccgcaggagagaaccaagccagggaugggc

SEQ ID NO: 248040 - RNA, 64 nt, Homo Sapiens
gagacugggggcagcccucagauggcacccagagccgcaggacggacugagcucaaaggaacag

SEQ ID NO: 248041 - RNA, 64 nt, Homo Sapiens
guuuggaauccggaauaaauaaauacuguuuaggccgcaggagacugaauguuuccaauagacu

SEQ ID NO: 248042 - RNA, 64 nt, Homo Sapiens
uugacuccuguggcuucuggaccccuccucugccccgcaggaggaaguuccacggcagguggug

SEQ ID NO: 248043 - RNA, 64 nt, Homo Sapiens
ugggcucuuggaauccugggccccuucacucccaccgcaggauuucaguagccagcaucugccu

SEQ ID NO: 248044 - RNA, 64 nt, Homo Sapiens
ccucagucauaccaguuguacagcacgccagccaccgcaggauacugugagcaggccccaugcc

SEQ ID NO: 248045 - RNA, 64 nt, Homo Sapiens
gacuaggacuugccacacacugccaauucauaauccgcaggaucuguagaagacauuuugggaa

SEQ ID NO: 248046 - RNA, 64 nt, Homo Sapiens
acuauuccauuagccuguggucugcaggguaggcccgcaggaaaugaggaauggccgagcugga

SEQ ID NO: 248047 - RNA, 64 nt, Homo Sapiens
gagugucccuggccccuuccugccaugggcaggcccgcaggaagagccgguagggguggaaagg

SEQ ID NO: 248048 - RNA, 64 nt, Homo Sapiens
gcagaauaaauccuugggagaaagggaggcccagccgcaggaaguccauguagaauaaaugaag

SEQ ID NO: 248049 - RNA, 64 nt, Homo Sapiens
gcuaaggggucaggccagauggggcaggaaggcuccgcaggaccggaccccuagaccacccugc

SEQ ID NO: 248050 - RNA, 64 nt, Homo Sapiens
acccuuaucugcggccggugaagaagcccaagauccgcaggaagaagugaguuggaggcugggg

SEQ ID NO: 248051 - RNA, 64 nt, Homo Sapiens
cuuuucacguuuucuuuacacacacguugacgggccgcaggagggaggcggggaggaggaacgg

SEQ ID NO: 248052 - RNA, 64 nt, Homo Sapiens
ugggcccccucacgccugccacuccagggagcacccgcaggagcuggccgucaccucagacauc

SEQ ID NO: 248053 - RNA, 64 nt, Homo Sapiens
gccucuauuaccucuacuguaggggcuggcgcucccgcaggacggacgcaguucucggacgccg

SEQ ID NO: 248054 - RNA, 64 nt, Homo Sapiens
guccacagacacacucacgcccgccaccugcuccccgcaggaugugucugugugugggaauugg

SEQ ID NO: 248055 - RNA, 64 nt, Homo Sapiens
cuaagccugcaguaggaucucagccacaagggccccgcaggauggagcugggucaaggaccagg

SEQ ID NO: 248056 - RNA, 64 nt, Homo Sapiens
aaaaugaagaaaaucaacaaaucugguuccagaaccgcaggaugucaccgagaggcaggucaag

SEQ ID NO: 248057 - RNA, 64 nt, Homo Sapiens
ugagagggaauagcucacccgcuggaagugacuuccgcaggaauagggaugccauguagcccca

SEQ ID NO: 248058 - RNA, 64 nt, Homo Sapiens
caguuuggguuuugaaagguacccugggcccucaccgcaggaaggccuguccucuccguggagg

SEQ ID NO: 248059 - RNA, 64 nt, Homo Sapiens
auugcugcugaccuuacgccuguauauuaagccuccgcaggaugccggacaauggugaagaaac

SEQ ID NO: 248060 - RNA, 64 nt, Homo Sapiens
cacaggugaguacagugaugugcaccaccaccuuccgcaggauggcagccccacucacagcugc

SEQ ID NO: 248061 - RNA, 64 nt, Homo Sapiens
ucggccaggugcugaucggucugcccuugcagcgccgcaggaacugaugccguuggggcggagg

SEQ ID NO: 248062 - RNA, 64 nt, Homo Sapiens
gcauacaacccugcauccagcacguagccaugggccgcaggaguccaggcagcccacagugcug

SEQ ID NO: 248063 - RNA, 64 nt, Homo Sapiens
acucgcagccccaucggacgcucucccgggaccgccgcaggaccaguuuccauagacugcggac

SEQ ID NO: 248064 - RNA, 64 nt, Homo Sapiens
cacacauacaacacagaucauuucccaguuagauccgcaggaaguagguugguggggguggaug

SEQ ID NO: 248065 - RNA, 64 nt, Homo Sapiens
ccuuugaaacugugaagccucgccccgcggccugccgcaggauauguuuugguaaauguagacu

SEQ ID NO: 248066 - RNA, 64 nt, Homo Sapiens
gaaauucugacauaugcgguauaguaccagccuuccgcaggaaguguuccgugcaugcagugga

SEQ ID NO: 248067 - RNA, 64 nt, Homo Sapiens
cuugaucaauggggaagccuugcauucccaguuuccgcaggagcacuccgcauccuugucccuc

SEQ ID NO: 248068 - RNA, 64 nt, Homo Sapiens
gcaggccgcaagugggguugcugccucugugcugccgcaggaggugccuggaggccauuugugc

SEQ ID NO: 248069 - RNA, 64 nt, Homo Sapiens
uuggucagaaucaauccuuuggugaaaguaagaaccgcaggaguugaguuuugguuugguccug

SEQ ID NO: 248070 - RNA, 64 nt, Homo Sapiens
gaugggaaaucugccuaugucauaccgugacagcccgcaggaucaggugacuucuagcagagac

SEQ ID NO: 248071 - RNA, 64 nt, Homo Sapiens
gcccugcccccgugaggaugucacucagauggaaccgcaggaagcugcuccgugcuuguuugcu

SEQ ID NO: 248072 - RNA, 64 nt, Homo Sapiens
ccccuguauguucagggcuggugcccauguggggccgcaggaauaggggugcugugagaaggcu

SEQ ID NO: 248073 - RNA, 64 nt, Homo Sapiens
ggagaggcacauucccuuggacugagggagucccccgcaggauuuucucauauagcccucaguc

SEQ ID NO: 248074 - RNA, 53 nt, Homo Sapiens
agcagccacgccuggaccgcggcccgcaggaagaauccuacacccugguguag

SEQ ID NO: 248075 - RNA, 64 nt, Homo Sapiens
ggccuggcuuccugguaaggaguuucagccgccuccgcaggaacccccaaagugcagauuccgg

SEQ ID NO: 248076 - RNA, 64 nt, Homo Sapiens
guaccuagucagaugguagacgagcugucugcugccgcaggagcaccucuauacaggacuuaga

SEQ ID NO: 248077 - RNA, 64 nt, Homo Sapiens
ugcauggcugagagccaggcuuccuuccuggucuccgcaggaggcuguggcagcuguggcaucc

SEQ ID NO: 248078 - RNA, 64 nt, Homo Sapiens
ggcucagcucgguacccggggcccagggcaagcuccgcaggacuuccccggagggcugcggcgu

SEQ ID NO: 248079 - RNA, 64 nt, Homo Sapiens
augcaaccacagugcauguugcagauaccggcggccgcaggaggggcagcauccaguagaggac

SEQ ID NO: 248080 - RNA, 64 nt, Homo Sapiens
cuuugcucugcacgaguuacagagugacaugccaccgcaggaucaagacccuccugaggaguga

SEQ ID NO: 248081 - RNA, 64 nt, Homo Sapiens
ccuggaggaauagagaguaaguugcaaggugugaccgcaggaauggcagaugagugggagacug

SEQ ID NO: 248082 - RNA, 64 nt, Homo Sapiens
ccuggaggaacagagaguaaguugcaaggugugaccgcaggaauggcagaugagugggagacug

SEQ ID NO: 248083 - RNA, 64 nt, Homo Sapiens
ccuuuaguuuccugacaccuguguccugagugagccgcaggaguucuuagcuccucagcgagca

SEQ ID NO: 248084 - RNA, 64 nt, Homo Sapiens
gugggggcagcgggcuucucgaguccaggggugaccgcaggaugcaguggccaggauccaauac

SEQ ID NO: 248085 - RNA, 64 nt, Homo Sapiens
gcagauucggaccacuaggcgggcaucgcauggaccgcaggagguguguucacagaccucagca

SEQ ID NO: 248086 - RNA, 64 nt, Homo Sapiens
uuccucgggacacggcugcucugcuuuguggacaccgcaggaagugccggaggacagccagcgg

SEQ ID NO: 248087 - RNA, 64 nt, Homo Sapiens
gagcaguccccugcuaucccacuccaccugcccgccgcaggaagaaugacgaagcugcucagca

SEQ ID NO: 248088 - RNA, 64 nt, Homo Sapiens
gcuccugccgccucuucccuaccuccuccacuagccgcaggaagggccuccagcacccacaacu

SEQ ID NO: 248089 - RNA, 64 nt, Homo Sapiens
cgucccacagcguggcucucggcugcgcccaguuccgcaggagcucccaggccaagcacacaca

SEQ ID NO: 248090 - RNA, 64 nt, Homo Sapiens
ucggggucugcaccccaggcacagcggugucaccccgcaggaccgcgggccugccccaaccccc

SEQ ID NO: 248091 - RNA, 64 nt, Homo Sapiens
ccggagggacggcagccccggucgcgcgcuggccccgcaggaccuuccuuuuccaggaagagcc

SEQ ID NO: 248092 - RNA, 64 nt, Homo Sapiens
guggggguggggguggggguggggguggaagcagccgcaggagcaagggccccucccacauaca

SEQ ID NO: 248093 - RNA, 64 nt, Homo Sapiens
aaauggccacugaguaggccccagaggucgcacuccgcaggaggacugaggccaugugccauuc

SEQ ID NO: 248094 - RNA, 64 nt, Homo Sapiens
gcugcacucagggauacgcccuaggaagugaaucccgcaggacaaccuaggaaaucucggugca

SEQ ID NO: 248095 - RNA, 64 nt, Homo Sapiens
ccuccugagcucggggggcuagaacaagaagaccccgcaggaucggcagcagccagggaccccc

SEQ ID NO: 248096 - RNA, 63 nt, Homo Sapiens
caggcgagggccgcacggcucaccgcgggacggccgcaggacguuguauuguugccggcauga

SEQ ID NO: 248097 - RNA, 64 nt, Homo Sapiens
ccaaccugucccacccccgugcccccuccuuaccccgcaggacgggccuacaggggggucuccc

SEQ ID NO: 248098 - RNA, 64 nt, Homo Sapiens
gaggacgcagagugcaggcuguggccucggcaucccgcaggaggucccuagaacaugccguuuc

SEQ ID NO: 248099 - RNA, 64 nt, Homo Sapiens
ccuccaugaccugcgcucucagcugaccaucaucccgcaggaccccauccuguucucggggacc

SEQ ID NO: 248100 - RNA, 64 nt, Homo Sapiens
ggccgccuggcagaaucuagcaccguccgaauccccgcaggacccauggagcuaugaccacacc

SEQ ID NO: 248101 - RNA, 64 nt, Homo Sapiens
ccgccugauuucgcucgggcuucgggugacuucgccgcaggaccuacccagcucgcucacuucg

SEQ ID NO: 248102 - RNA, 64 nt, Homo Sapiens
ucgugguacucuugccuuagggagcucccuggcaccgcaggaccaggcagguaggcugcagcca

SEQ ID NO: 248103 - RNA, 64 nt, Homo Sapiens
uggcgcccucucgcuccugcaguaggaaccucccccgcaggagcuugcacaggguggggcgcgc

SEQ ID NO: 248104 - RNA, 64 nt, Homo Sapiens
aacagguccgacucaguaugcuuagacucaaaacccgcaggagaccucccaggccccuugugga

SEQ ID NO: 248105 - RNA, 64 nt, Homo Sapiens
ugaaagaugaccuugugacagccucuuuaaggagccgcaggacagugcaggccaugugagcccu

SEQ ID NO: 248106 - RNA, 64 nt, Homo Sapiens
gcacaugugccuugcaugaagguucccugcagacccgcaggagagccgcggggcucucugggcc

SEQ ID NO: 248107 - RNA, 64 nt, Homo Sapiens
ugggcugggccucgugcgccgguggugcccgugcccgcaggaaccuccuggucugugaagagcc

SEQ ID NO: 248108 - RNA, 64 nt, Homo Sapiens
cauuauucaagagaccaccugacaugcaucuccuccgcaggaauacauucguccucucuuagag

SEQ ID NO: 248109 - RNA, 64 nt, Homo Sapiens
aaaggaaugcagugcucaaaaccuacccaaauucccgcaggauucuaccaaacccuuccccagg

SEQ ID NO: 248110 - RNA, 64 nt, Homo Sapiens
cccuguaaggccugugagcgugaagcuggggugaccgcaggagagggccagcagccgcgaaccu

SEQ ID NO: 248111 - RNA, 64 nt, Homo Sapiens
ggacgggagcuccacugugaaucggcggcacgcgccgcaggaggcugggacugguccaguuugu

SEQ ID NO: 248112 - RNA, 64 nt, Homo Sapiens
agacgcaacguuuccaacucucgggacgccaaggccgcaggacuggagggccaggccccgccac

SEQ ID NO: 248113 - RNA, 64 nt, Homo Sapiens
gccgcuguggucuggcccccucccuguccaggccccgcaggaggcagaugcagucccaggcauc

SEQ ID NO: 248114 - RNA, 64 nt, Homo Sapiens
cugagacgguuuggggguggcccccuacccggggccgcaggacgaagcacaaccagcucgcccu

SEQ ID NO: 248115 - RNA, 64 nt, Homo Sapiens
ucagagcaucgcugggccugaccuacuuccccgcccgcaggagcagcucacguggccuuuaaaa

SEQ ID NO: 248116 - RNA, 64 nt, Homo Sapiens
augcguugccugcagugcaguggccccccgugagccgcaggaggaucagaagcccugggguucc

SEQ ID NO: 248117 - RNA, 64 nt, Homo Sapiens
ccugcccccagcccccgcagaacggugucucugcccgcaggacgcaaagccaaagccgaaugag

SEQ ID NO: 248118 - RNA, 64 nt, Homo Sapiens
aacccagaugccugaggccuggcuggggcugcccccgcaggacacuguggccaugccacggagg

SEQ ID NO: 248119 - RNA, 64 nt, Homo Sapiens
ccgaguaggggugggggugggauggcaggaggagccgcaggaggaaggagguugugcagggucu

SEQ ID NO: 248120 - RNA, 64 nt, Homo Sapiens
cgugccuuggacuugguauugaacacuguccugaccgcaggacggguaagugaguucacaccua

SEQ ID NO: 248121 - RNA, 64 nt, Homo Sapiens
gagccuggagagagaaguugggucuccccacagaccgcaggacuugagccagauccauggcaau

SEQ ID NO: 248122 - RNA, 64 nt, Homo Sapiens
gcacaacucugccaggggugggagagcaucaggcccgcaggacuugcuugucuggccaugaucu

SEQ ID NO: 248123 - RNA, 64 nt, Homo Sapiens
gggaugcccguuggacuuugugggaaagcccaggccgcaggagugugucccccaccccaucagc

SEQ ID NO: 248124 - RNA, 64 nt, Homo Sapiens
ccucugaggcagggccugaaccgguccuggacucccgcaggacuggccauccguggaggagggg

SEQ ID NO: 248125 - RNA, 64 nt, Homo Sapiens
guuagaguguacucugaaaccaacucgucucuggccgcaggagucuauauguuuucguaaucuu

SEQ ID NO: 248126 - RNA, 64 nt, Homo Sapiens
aguggcugaguuacuugcugcccugugcuccuccccgcaggacauggcucccccuccaccugcu

SEQ ID NO: 248127 - RNA, 64 nt, Homo Sapiens
guggguggagcagguggacuuguuuucuuuggucccgcaggagguuuuuguuuugcccucuggg

SEQ ID NO: 248128 - RNA, 64 nt, Homo Sapiens
agauucuuucaguucuuuggauucuaaauacaugccacaucaaaccuuugaguagauccauuuc

SEQ ID NO: 248129 - RNA, 64 nt, Homo Sapiens
uguauuuucaugaaaauaccauuuaguaagaauaccacaucaaauaagaaauaaugcuacaauu

SEQ ID NO: 248130 - RNA, 64 nt, Homo Sapiens
aaaaaaagccagugccuauucaucacaaaaaaagccacaucacauacaauaguguggaaagcca

SEQ ID NO: 248131 - RNA, 64 nt, Homo Sapiens
aaaaaagccacaucacaaaaaauaguguggaaagccacaucacaaugggauucuggacuucuac

SEQ ID NO: 248132 - RNA, 64 nt, Homo Sapiens
cuuuucacuguguuuaauuugggaaaauccagauccacaucauuguagagucugaggguuagaa

SEQ ID NO: 248133 - RNA, 64 nt, Homo Sapiens
cauuuacugagugucugucagggaucauucacauccacaucauccucccggccccuccccgugu

SEQ ID NO: 248134 - RNA, 64 nt, Homo Sapiens
agaaaucuaacucccugaaaauugucagcuugguccacaucaccaaaauucauugucucuagag

SEQ ID NO: 248135 - RNA, 64 nt, Homo Sapiens
aagaaggaaucauauuccuuuauaucaucuucgaccacaucagaagugauugauccuuaccuug

SEQ ID NO: 248136 - RNA, 64 nt, Homo Sapiens
gaaaucugccuagaggauauauguaaggaagauuccacaucaugaguacuugccuuuuaacuuu

SEQ ID NO: 248137 - RNA, 64 nt, Homo Sapiens
cuucugucaaauuauaugguuauuuuuuauauuaccacaucagcauuauauuaaaaguguuuuu

SEQ ID NO: 248138 - RNA, 64 nt, Homo Sapiens
uccaggaauggugcuuuaugugagauaccccacuccacaucaacauuccagggaugagccaaac

SEQ ID NO: 248139 - RNA, 64 nt, Homo Sapiens
aacucaaggguuuuccagguguagcuaacaguugccacaucacacagaccucgaguuucuggua

SEQ ID NO: 248140 - RNA, 64 nt, Homo Sapiens
gggcgccauccagguuuaacccugcaagcuguuuccacaucagaacucccuucaaacacaaaga

SEQ ID NO: 248141 - RNA, 64 nt, Homo Sapiens
aauauuuccauucaaaaugugguucacagacccgccacaucagcaccauccgagagcuuauuag

SEQ ID NO: 248142 - RNA, 64 nt, Homo Sapiens
auaggguggcuggcagagggggccaucagauggacgaucugaacgcccaggucuggacuuuuuu

SEQ ID NO: 248143 - RNA, 64 nt, Homo Sapiens
gaaagcaugcuagaguaugacaccaccagcucuucgaucugauuugaccucagaggcagaggaa

SEQ ID NO: 248144 - RNA, 64 nt, Homo Sapiens
auuagaccuauguguuugcacccaucuuuguuggcgaucugagugcaguguggcaagugcacac

SEQ ID NO: 248145 - RNA, 64 nt, Homo Sapiens
uaucugcauuauaauaauagaauguaaauuauuccgaucugacauuucuaugauauaauuugua

SEQ ID NO: 248146 - RNA, 64 nt, Homo Sapiens
agacauuucccaaaggaagaaacaaaugaaaaagcgaucugaacgcaaaaaaaaaaaucugauu

SEQ ID NO: 248147 - RNA, 64 nt, Homo Sapiens
ugcuguuuagcuugacuguuuuccucaagaacaucgaucugaaggauucauaaggagcuuaucu

SEQ ID NO: 248148 - RNA, 64 nt, Homo Sapiens
ucuaauauacuaagccuuacagcuaucuuagaugcgaucugacuccugugugacuguggagcac

SEQ ID NO: 248149 - RNA, 64 nt, Homo Sapiens
aauugguuuuugaaucccagucccucagaggcagcgaucugaugcuccccagccaaucuguaca

SEQ ID NO: 248150 - RNA, 64 nt, Homo Sapiens
aucauucaguuauuaaauuguuugcaguauaacacgaucugauaauucaugguguaagaacagu

SEQ ID NO: 248151 - RNA, 64 nt, Homo Sapiens
ccucagcgacaguguagcgucauguuagaggagacgaucugacccaccaguuuguacaucacgu

SEQ ID NO: 248152 - RNA, 64 nt, Homo Sapiens
cugccggggccccagcccacacgcugcuguaccucgaucugaauacgcuccaagaguauuauua

SEQ ID NO: 248153 - RNA, 64 nt, Homo Sapiens
ugaaagucauuaacaaagccgccagcuucaaaagcgaucugacagcagcagagacugaggcaua

SEQ ID NO: 248154 - RNA, 64 nt, Homo Sapiens
ccagaagauucuugugagaaacgaaaaucucgugcgaucugauuugugguguucucacaccuua

SEQ ID NO: 248155 - RNA, 64 nt, Homo Sapiens
uaauaaaaggcugugucaugcugaccuggucucacgaucugaaaugaugagcguaacgacccuu

SEQ ID NO: 248156 - RNA, 64 nt, Homo Sapiens
cccuguugacuaaucuugccaaccuuuuucuucccgaucugaacaaaccugucuugacauucaa

SEQ ID NO: 248157 - RNA, 64 nt, Homo Sapiens
cccacugucuccccauccuuccaccuacuuguggcgaucugaguacucuacucuugcucaagaa

SEQ ID NO: 248158 - RNA, 64 nt, Homo Sapiens
ccgcccagccagaugucccgcccucuauuaaagccgaucugacucccgggagccuccucaggcu

SEQ ID NO: 248159 - RNA, 64 nt, Homo Sapiens
gauccauuuuuagggaagggauuuuggcucaaaacgaucugaccaccucugcccuguccaccag

SEQ ID NO: 248160 - RNA, 64 nt, Homo Sapiens
guuuuccuuuaaccuggacuucaacugcauuaaccgaucugagaucacauucucaagcaaaaau

SEQ ID NO: 248161 - RNA, 64 nt, Homo Sapiens
ugacuuuguguacaucugugaugauaauuaucagcgaucugagguacucagcauggaaaucaac

SEQ ID NO: 248162 - RNA, 64 nt, Homo Sapiens
aggguaacaguaucugaaauuucacaguccuauccgaucugaaaacacacauacacaaaugcac

SEQ ID NO: 248163 - RNA, 64 nt, Homo Sapiens
gugcaaagcuguaaucucauagaaggaaggacccuccugucagucugguuguauguguaggcua

SEQ ID NO: 248164 - RNA, 64 nt, Homo Sapiens
guucugaguucgagcuggagauugaagagcagguuccugucaauggagaaaggggaggugaaag

SEQ ID NO: 248165 - RNA, 64 nt, Homo Sapiens
acccugagaagaacuacggagaaaucaaauaaaauccugucauauuuuuuucacccugccuuuc

SEQ ID NO: 248166 - RNA, 64 nt, Homo Sapiens
ccccgacagauuaaaugcguguuggggauugguuuccugucauagcugcugcugcugccaugcg

SEQ ID NO: 248167 - RNA, 64 nt, Homo Sapiens
caccgagugccugcagaagacagggacaaguguuuccugucagcaugcagagguacucccuggu

SEQ ID NO: 248168 - RNA, 64 nt, Homo Sapiens
gccuugcaggaggcaagggagaucagagaggccuuccugucacucuagaccugaaaguguuccu

SEQ ID NO: 248169 - RNA, 64 nt, Homo Sapiens
cccucuggcuaaaacucaagcaaauaaagccgcuuccugucauuaagcaucucagaggaagcag

SEQ ID NO: 248170 - RNA, 64 nt, Homo Sapiens
gaucacccaugauucuguuucacuguuugcuuucuccugucaugguuaagagaaaugugcaauu

SEQ ID NO: 248171 - RNA, 64 nt, Homo Sapiens
uccacggcuggauaccugugugucuccauaaaaguccugucaccaaggacguuaaaggcauuuu

SEQ ID NO: 248172 - RNA, 64 nt, Homo Sapiens
ucggccucuacuuuguccccucaccuccacccccuccugucaccggccuugugacauucacuca

SEQ ID NO: 248173 - RNA, 64 nt, Homo Sapiens
auugguuuucacucauuugaacaugcuuuauggcuccugucaaagguguaauuuaauuggugca

SEQ ID NO: 248174 - RNA, 64 nt, Homo Sapiens
ccuaccagccaaucccagucgcuucaucauuaaguccugucaucagccauuaaagcagcucccu

SEQ ID NO: 248175 - RNA, 64 nt, Homo Sapiens
ugggcuguaaucauuuguaggaaggccgcgugcuuccugucacaugcacacgauccggagagcc

SEQ ID NO: 248176 - RNA, 64 nt, Homo Sapiens
ugugacugucaguuugcugguuagcuguaagguuuccugucaggguccagggcaccucccccca

SEQ ID NO: 248177 - RNA, 64 nt, Homo Sapiens
uucuuuuguauuaggcuguggauugggaauuuucuccugucaacccugucauuuaucagcaaaa

SEQ ID NO: 248178 - RNA, 64 nt, Homo Sapiens
uaucagcaaaagauugggaacaacaaugauacaguccugucauucacaccugagacagacauuu

SEQ ID NO: 248179 - RNA, 64 nt, Homo Sapiens
uccucagucauuucugcaaagccaaggggcagccuccugucaagguagcuagaggccugggaaa

SEQ ID NO: 248180 - RNA, 64 nt, Homo Sapiens
gacacacacacacacacguacaugcacacauuuuuccugucagguuaacuuauuuguagguucu

SEQ ID NO: 248181 - RNA, 64 nt, Homo Sapiens
cuuuuucuccucucugagccuuugucuauuguguuccugucacccacccuuucaucaucuuuuu

SEQ ID NO: 248182 - RNA, 64 nt, Homo Sapiens
guaggaaggggcccuagaaagggccuaguuacuauccugucaguucuaacaguaguggaacagg

SEQ ID NO: 248183 - RNA, 64 nt, Homo Sapiens
aaaggcaauaaugauagaaauuauuucuuagguacagcaauaguugauaggaugugaggguguu

SEQ ID NO: 248184 - RNA, 64 nt, Homo Sapiens
cuguacccccggacaguuaaaucagaaccucagacagcaauaugccuugagaugccuugaacca

SEQ ID NO: 248185 - RNA, 64 nt, Homo Sapiens
aaaccuuggaaauacgacagggugugguagaauucagcaauaugagaaaaccagccccuaaaau

SEQ ID NO: 248186 - RNA, 64 nt, Homo Sapiens
cauacuguuaaugucaaauaucaaaaauguuuuccagcaauaucaaguuauggcaauggcaaaa

SEQ ID NO: 248187 - RNA, 64 nt, Homo Sapiens
gucgacgagaccuagaaccgccccggcuuucucccagcaauagguccccuccccuccagggugc

SEQ ID NO: 248188 - RNA, 64 nt, Homo Sapiens
gggaggggggcccggucccacgggccccuccucacagcaauaggcggguggaggggccggaggg

SEQ ID NO: 248189 - RNA, 64 nt, Homo Sapiens
gccccccagggaagucuucggccaggucggcucucagcaauacggggcggcggggccuccccca

SEQ ID NO: 248190 - RNA, 64 nt, Homo Sapiens
guuauuuauucaagagaaggaaaaacaaugaucacagcaauacuuguaugcauguucauugcaa

SEQ ID NO: 248191 - RNA, 64 nt, Homo Sapiens
gugguauccauuacacaauagacuacuuacuacucagcaauaaaaaugaaguaacuuucaauaa

SEQ ID NO: 248192 - RNA, 64 nt, Homo Sapiens
ucucaccuucuuuaccucaggagccaggagcagacagcaauacuucguccacaccugggaucgc

SEQ ID NO: 248193 - RNA, 64 nt, Homo Sapiens
cugcaggggccacgaguuugcagaugcuguacuucagcaauaaccuugccuuugcuaagacccc

SEQ ID NO: 248194 - RNA, 64 nt, Homo Sapiens
gauauucacuuuauuuuuuuauucuaggaauuuucagcaauacucauuuaaaguuuuauccaau

SEQ ID NO: 248195 - RNA, 64 nt, Homo Sapiens
aauauucucauuuuuaaacaauucuaggaauuuucagcaauacuuauuuaaaguuuuauccagu

SEQ ID NO: 248196 - RNA, 61 nt, Homo Sapiens
ccaucugaagcuguagccaccagggaugcagcuagcugaggaguuugggguguuggguugg

SEQ ID NO: 248197 - RNA, 61 nt, Homo Sapiens
cugggguggaacuagguccugagggcacagccuagcugagugcaaagaaauauaggaugcu

SEQ ID NO: 248198 - RNA, 61 nt, Homo Sapiens
uuuauuuuacuugagaccuuacaucuuuguucuagcugacaguaaaucucuggguuucugu

SEQ ID NO: 248199 - RNA, 61 nt, Homo Sapiens
agagacacucacaggcuaugaggguacaccccuagcugaauguucuguguuguuuccuuag

SEQ ID NO: 248200 - RNA, 61 nt, Homo Sapiens
cuaccagcagacucuggaggccugugccuugcuagcugaccuggagaugcugccugguggg

SEQ ID NO: 248201 - RNA, 61 nt, Homo Sapiens
cuuccugccccagacagacuucaucauugugcuagcugauggacaggugucugagaugggc

SEQ ID NO: 248202 - RNA, 61 nt, Homo Sapiens
ugcggagaacccaggugggauccugaaggcacuagcugacagacgggccccucaauccugu

SEQ ID NO: 248203 - RNA, 61 nt, Homo Sapiens
ggagagacaauagcuuugaggagcucacaaucuagcugaggagacaagacacauccaaugc

SEQ ID NO: 248204 - RNA, 64 nt, Homo Sapiens
uguuaagagacauacccucuaaaaaagaacuuuagcaugguauugaaggaauuagaaaugaauu

SEQ ID NO: 248205 - RNA, 64 nt, Homo Sapiens
auacauuaaaagaaguaaccaacugaacgacaaagcaugguauuugaauuuuaaauuaaagcaa

SEQ ID NO: 248206 - RNA, 64 nt, Homo Sapiens
acauagugauaggguagcgagggcaaagucaccugcaugguagcgaggaaaccaaggcucagag

SEQ ID NO: 248207 - RNA, 64 nt, Homo Sapiens
ugccacaauguaugugcacggcacuggcgcauuggcaugguagaaaagaugugcuccugucucu

SEQ ID NO: 248208 - RNA, 64 nt, Homo Sapiens
uguuaggcagaauauuuuggauuuggaggcauuugcaugguagucuuugaacaguaaaaugaug

SEQ ID NO: 248209 - RNA, 64 nt, Homo Sapiens
aacauguccaucuuuuuagugauaauaaaagaaagcaugguauuaaacuaucauagaaguagac

SEQ ID NO: 248210 - RNA, 62 nt, Homo Sapiens
gaagacuuuauuguuguuauauuuauuuuuaugaaacagagggauagggggaggguuggaaa

SEQ ID NO: 248211 - RNA, 62 nt, Homo Sapiens
gagcucuugggcccagccagcuguacuuuggggaaacagaugcucaauggccuagaagcugc

SEQ ID NO: 248212 - RNA, 62 nt, Homo Sapiens
uaauauauauauagaaagauucuaagaagaaagaaacagagaugacauauaugaaagguuua

SEQ ID NO: 248213 - RNA, 62 nt, Homo Sapiens
acagaaggccaagagccagccuugaaaaaucugaaacagagaaaaaacaagaaccacaaaaa

SEQ ID NO: 248214 - RNA, 62 nt, Homo Sapiens
uaauggaucagacuuugccagauuugguuagggaaacagaaauuuagaauggugcauuauuu

SEQ ID NO: 248215 - RNA, 62 nt, Homo Sapiens
agaguaaauagcccuucagcaugcucauucaugaaacagaagaggcuguacaagugaagaca

SEQ ID NO: 248216 - RNA, 62 nt, Homo Sapiens
cuuuaauugaaauacucugaauuccccucauggaaacagagagcauugagagcacuuucuuu

SEQ ID NO: 248217 - RNA, 62 nt, Homo Sapiens
caaguggccgugcuaccuuuuuagagaauaaagaaacagacuuuugaguuuauaugcaaugc

SEQ ID NO: 248218 - RNA, 62 nt, Homo Sapiens
uucauggccaaaguagaccuuaaauggaagaagaaacagaacguuuuaauuuggguauaggu

SEQ ID NO: 248219 - RNA, 62 nt, Homo Sapiens
uuauucacuguguuuuugauaugaaauacuuugaaacagaagaugccacacuuugcaccuua

SEQ ID NO: 248220 - RNA, 62 nt, Homo Sapiens
aggucucuuugcagauauauaaggcaggugaggaaacagaaaccaaaaaaugguagacauga

SEQ ID NO: 248221 - RNA, 62 nt, Homo Sapiens
gaagucauuugcugagucugaaaauagagguggaaacagaagggagaugaaauaaacaaggc

SEQ ID NO: 248222 - RNA, 62 nt, Homo Sapiens
uuuccaauugcucuuuugucaugacgaaacaagaaacagagaaucacgucgccuuccuaugu

SEQ ID NO: 248223 - RNA, 62 nt, Homo Sapiens
caaaacugaggcaccugauggguguggauggggaaacagaggucccucacucaaccugcuga

SEQ ID NO: 248224 - RNA, 62 nt, Homo Sapiens
aacacacacacaaaagcaaaccaguccaaaaugaaacagaccuggcuaugcauuaccuaaaa

SEQ ID NO: 248225 - RNA, 62 nt, Homo Sapiens
aaaagguaagguguugugucacugugcuccacgaaacagaagcgcauggcuguucugcugca

SEQ ID NO: 248226 - RNA, 62 nt, Homo Sapiens
cugccauugccgagaguccuguuauugagguagaaacagaaaagaaagacguucuugauuuu

SEQ ID NO: 248227 - RNA, 62 nt, Homo Sapiens
cugaugauuuggguucuuuuccauaguccaaagaaacagaucagcucuucagguaucauguu

SEQ ID NO: 248228 - RNA, 55 nt, Homo Sapiens
gcaaggagcagaagacauagacguugaaacagaaacagaaggaugaaggacaguu

SEQ ID NO: 248229 - RNA, 61 nt, Homo Sapiens
gcaaggagcagaagacauagacguugaaacagaaacagaaggaugaaggacaguuuuuucc

SEQ ID NO: 248230 - RNA, 62 nt, Homo Sapiens
uccuaaggggauugacucucaccccugccuuagaaacagaauugcaugugauggugccugag

SEQ ID NO: 248231 - RNA, 62 nt, Homo Sapiens
uggaaaacugccugacuuaucuuuuuaaacuggaaacagaauaaguagugccacugcagugu

SEQ ID NO: 248232 - RNA, 62 nt, Homo Sapiens
gcagaagcaaagagcagacacacauacagccugaaacagaccuggacagacagacacagccu

SEQ ID NO: 248233 - RNA, 62 nt, Homo Sapiens
cugaaacagaccuggacagacagacacagccugaaacagacccggacagacagacacagccu

SEQ ID NO: 248234 - RNA, 62 nt, Homo Sapiens
cugaaacagacccggacagacagacacagccugaaacagacccagacaaacagacagacaga

SEQ ID NO: 248235 - RNA, 62 nt, Homo Sapiens
gacccagacaaacagacagacagacacagccugaaacagacccagacagacagacagacagc

SEQ ID NO: 248236 - RNA, 62 nt, Homo Sapiens
gaaacagacccagacagacagacagacagccugaaacagacccagacacagccugaaacaga

SEQ ID NO: 248237 - RNA, 62 nt, Homo Sapiens
cagacagccugaaacagacccagacacagccugaaacagauccggacagacagacagaaaca

SEQ ID NO: 248238 - RNA, 62 nt, Homo Sapiens
aacagauccggacagacagacagaaacagccugaaacagacccagacagacagacagacaca

SEQ ID NO: 248239 - RNA, 62 nt, Homo Sapiens
aacagacccagacagacagacagacacagccugaaacagacccggacagacagacagacaca

SEQ ID NO: 248240 - RNA, 62 nt, Homo Sapiens
aacagacccggacagacagacagacacagccugaaacagacccggacagacagacagacaca

SEQ ID NO: 248241 - RNA, 62 nt, Homo Sapiens; identical to SEQ ID NO: 248240

SEQ ID NO: 248242 - RNA, 62 nt, Homo Sapiens
aacagacccggacagacagacagacacagccugaaacagaccuagacagacagacacagauu

SEQ ID NO: 248243 - RNA, 62 nt, Homo Sapiens
cugaaacagaccuagacagacagacacagauugaaacagacccagacaaacagacagacaca

SEQ ID NO: 248244 - RNA, 62 nt, Homo Sapiens
aacagacccagacaaacagacagacacagccugaaacagacccagacacagccugaaacaga

SEQ ID NO: 248245 - RNA, 62 nt, Homo Sapiens
gacacagccugaaacagacccagacacagccugaaacagacccggacagacagacagacaca

SEQ ID NO: 248246 - RNA, 62 nt, Homo Sapiens
aacagacccggacagacagacagacacagccugaaacagacccagacagacagacagacaca

SEQ ID NO: 248247 - RNA, 62 nt, Homo Sapiens
aacagacccagacagacagacagacacagccugaaacagacccagacagacagaccgacgca

SEQ ID NO: 248248 - RNA, 62 nt, Homo Sapiens
aacagaccuggacagacaggcagacguagucugaaacagaccugaacagacagacagacgca

SEQ ID NO: 248249 - RNA, 62 nt, Homo Sapiens
ccugcuuuagagacacaggaugauucagaccggaaacagaccucguggguguaagaggaagc

SEQ ID NO: 248250 - RNA, 62 nt, Homo Sapiens
gaauacgggauugcacuuacucuuucaucacggaaacagaccccccgagagaagccccaacg

SEQ ID NO: 248251 - RNA, 62 nt, Homo Sapiens
cuucucucugccauggcccuuggccauuaaaagaaacagagauuucagccaugggguugagu

SEQ ID NO: 248252 - RNA, 62 nt, Homo Sapiens
caguaccuggacuccaugaaagaguaugugaggaaacagauacgacaucuugaauugcuggu

SEQ ID NO: 248253 - RNA, 62 nt, Homo Sapiens
auauuaauuuuauuaagcaaggguucgccagagaaacagaaccaauaggauauauaagccca

SEQ ID NO: 248254 - RNA, 62 nt, Homo Sapiens
acaguauuauuacauucaguauuacaauggcagaaacagacagaaaggguggaguaauuugu

SEQ ID NO: 248255 - RNA, 62 nt, Homo Sapiens
aguauuuguaucuucaguucauuccacuuuaggaaacagagcugccaauugaaacagaagaa

SEQ ID NO: 248256 - RNA, 62 nt, Homo Sapiens
ucauuccacuuuaggaaacagagcugccaauugaaacagaagaagaaaaaaaaaaaaagcag

SEQ ID NO: 248257 - RNA, 62 nt, Homo Sapiens
uuuuauuucaccuuuaguuuugggaaaagcgagaaacagaugaucuauaggaugugaguggg

SEQ ID NO: 248258 - RNA, 62 nt, Homo Sapiens
aaaaaaaaagauguuaaaacagugaaauuacagaaacagaacauagccacccuguuucauca

SEQ ID NO: 248259 - RNA, 64 nt, Homo Sapiens
uuggggggacccagcaaggacucagagagucagacagugccacuuggccacuugggguaaagcc

SEQ ID NO: 248260 - RNA, 64 nt, Homo Sapiens
ucagacagugccacuuggccacuugggguaaagccagugccagcaauaacaguuuaucaugcuc

SEQ ID NO: 248261 - RNA, 64 nt, Homo Sapiens
cccacagccuugggcccuagguaccccagcugaucagugccaggagagaccagagccucuggag

SEQ ID NO: 248262 - RNA, 64 nt, Homo Sapiens
cacacccccuccucugagcucugaauaugggacccagugccaggagcuggaagacaagguguuu

SEQ ID NO: 248263 - RNA, 64 nt, Homo Sapiens
aaaccuuucccaagccuuccuggcccacaguggccagugccauaggcagugcuguggacaguag

SEQ ID NO: 248264 - RNA, 64 nt, Homo Sapiens
uccagcaauacaugugcagggguugcugcuuucccagugccaggagaacccccgcuccgaguca

SEQ ID NO: 248265 - RNA, 64 nt, Homo Sapiens
caucuggcauguguuucuuggauaggggccagugcagugccauccuacagguggcuggagcagc

SEQ ID NO: 248266 - RNA, 64 nt, Homo Sapiens
ggcacccaguccagaaggagcaauggcaccugggcagugccagggcuuaaagcccgcugcuccu

SEQ ID NO: 248267 - RNA, 64 nt, Homo Sapiens
ugcuaccacuucccaauaaauauauuuagugggucagugccaagcuggggcaguuuuaguucuu

SEQ ID NO: 248268 - RNA, 64 nt, Homo Sapiens
caguaucuccuggcguucuagcaucagccuugcccagugccacaggucucugaggcucuuugug

SEQ ID NO: 248269 - RNA, 64 nt, Homo Sapiens
uuuguuaggaaaacccaugggccgccgccacacucagugccauggggaagcgggcgucuccccc

SEQ ID NO: 248270 - RNA, 64 nt, Homo Sapiens
ccccagggucuaacgguuaaggggacccacauaccagugccaagggggaugucaaguggugaug

SEQ ID NO: 248271 - RNA, 64 nt, Homo Sapiens
cagugauuccuuggugacagguugagggcagcuccagugccagcaauaggguggcacagaagcu

SEQ ID NO: 248272 - RNA, 64 nt, Homo Sapiens
uguggagcuggacuacggcggcaguauggaauuccagugccaggccagugaccucauucccgag

SEQ ID NO: 248273 - RNA, 64 nt, Homo Sapiens
cuucaccaccguauucucagucacuuccacuaaacagugccaguguuuuaagguucugucacac

SEQ ID NO: 248274 - RNA, 64 nt, Homo Sapiens
agguuuguggcaggccuguguugagcaagacuaucagugccauuuuuuuucaacagcaugugcu

SEQ ID NO: 248275 - RNA, 64 nt, Homo Sapiens
gugacccaagaggcaggguuagcaggccuuacagcagugccacgaggccuggccauagggcaag

SEQ ID NO: 248276 - RNA, 64 nt, Homo Sapiens
acucagaagucuggcaggugauuagcuaauccuucagugccagcuuugccacucagguugcaaa

SEQ ID NO: 248277 - RNA, 64 nt, Homo Sapiens
accaauuaauucuugccagggcacugcugagaagcagugccauuuaauuucucaggauauuuuu

SEQ ID NO: 248278 - RNA, 64 nt, Homo Sapiens
uaauuaaaagauacacugucggaaagugaaauuucagugccaauagcuacuagaaugcagcuaa

SEQ ID NO: 248279 - RNA, 64 nt, Homo Sapiens
auaaaccuguacccagcugucccccuuucaccuccagugccacaaccggugcuggccacaccag

SEQ ID NO: 248280 - RNA, 64 nt, Homo Sapiens
aggucauccgguggguggcccucccgugugucaccagugccacagggcagcaacaacggcaaga

SEQ ID NO: 248281 - RNA, 64 nt, Homo Sapiens
cauauaauacuaaucuaaacaguacuagaaauuacagugccaagagccaccaggaggcccagcc

SEQ ID NO: 248282 - RNA, 64 nt, Homo Sapiens
ggagguagagcaaugaucagaugggugcacagaccagugccaaucugaacauuguuaauggccu

SEQ ID NO: 248283 - RNA, 64 nt, Homo Sapiens
auguuggugccauuuucagcaauuacggcuuugacagugccaccucuuugaugccaaaucagca

SEQ ID NO: 248284 - RNA, 64 nt, Homo Sapiens
gccccucaccacauacccuuugccuuuuagaacucagugccauccugggugcccagggcagagc

SEQ ID NO: 248285 - RNA, 64 nt, Homo Sapiens
gccuagcccuguggcuuccaccagucuccuccugcagugccacgugguggcauuucucgccuca

SEQ ID NO: 248286 - RNA, 64 nt, Homo Sapiens
uuuaaagcauucuuucuagguuauuuuggggggacagugccaaguccaucuuugcccagucaau

SEQ ID NO: 248287 - RNA, 64 nt, Homo Sapiens
gcauguuuaucauauauccuuaaguggacacauacagugccauguugaugugccucucaguuuu

SEQ ID NO: 248288 - RNA, 64 nt, Homo Sapiens
caugcccuuccccugggcuaggauccccguaccacagugccagcggagggccuguccacacccu

SEQ ID NO: 248289 - RNA, 64 nt, Homo Sapiens
cucugaucugaggaccccguggccagggcuggggcagugccagacaggugccaaagagcaggcc

SEQ ID NO: 248290 - RNA, 64 nt, Homo Sapiens
cagucuuuaugcaaaugaaagagauggagcaaaccagugccauccaaaacagccacaauaauca

SEQ ID NO: 248291 - RNA, 54 nt, Homo Sapiens
uggacccaagagaagacugccaggcagugccaguugggccucccaauagacuaa

SEQ ID NO: 248292 - RNA, 64 nt, Homo Sapiens
cacuccuugggccccuaggaaggacacauuugggcagugccaccuguugauguuuccugcccaa

SEQ ID NO: 248293 - RNA, 64 nt, Homo Sapiens
caauccgggcaggacccucgguuccuuuugcccucagugccagccuccccugacaaucuggaag

SEQ ID NO: 248294 - RNA, 64 nt, Homo Sapiens
gauuuccauuucagccaguggguagcugauaagccagugccagcauccagcaugagcagauguc

SEQ ID NO: 248295 - RNA, 64 nt, Homo Sapiens
cagcguuacugcucuccuucccuucaugauaagccagugccagcauccagcgugagcagacguc

SEQ ID NO: 248296 - RNA, 64 nt, Homo Sapiens
ccuccuggcugcaggcacccccagccagaacacgcagugccagccgugccccccaggcaccuuc

SEQ ID NO: 248297 - RNA, 64 nt, Homo Sapiens
aggcaccuucucagccagcagcuccagcucagagcagugccagccccaccgcaacugcacggcc

SEQ ID NO: 248298 - RNA, 64 nt, Homo Sapiens
agggcagaggugcuaccugguccuggcuccuuaucagugccauguaugccccaccugcccugcu

SEQ ID NO: 248299 - RNA, 64 nt, Homo Sapiens
cagggcagaggagagcagcuccuuacuccugguucagugccacgggaggcuagaacagagaagc

SEQ ID NO: 248300 - RNA, 64 nt, Homo Sapiens; identical to SEQ ID NO: 175237

SEQ ID NO: 248301 - RNA, 64 nt, Homo Sapiens; identical to SEQ ID NO: 175238

SEQ ID NO: 248302 - RNA, 64 nt, Homo Sapiens; identical to SEQ ID NO: 175239

SEQ ID NO: 248303 - RNA, 64 nt, Homo Sapiens; identical to SEQ ID NO: 175240

SEQ ID NO: 248304 - RNA, 64 nt, Homo Sapiens; identical to SEQ ID NO: 175241

SEQ ID NO: 248305 - RNA, 64 nt, Homo Sapiens; identical to SEQ ID NO: 175242

SEQ ID NO: 248306 - RNA, 64 nt, Homo Sapiens; identical to SEQ ID NO: 175243

SEQ ID NO: 248307 - RNA, 64 nt, Homo Sapiens; identical to SEQ ID NO: 175244

SEQ ID NO: 248308 - RNA, 64 nt, Homo Sapiens; identical to SEQ ID NO: 175245

SEQ ID NO: 248309 - RNA, 64 nt, Homo Sapiens; identical to SEQ ID NO: 175246

SEQ ID NO: 248310 - RNA, 64 nt, Homo Sapiens; identical to SEQ ID NO: 175247

SEQ ID NO: 248311 - RNA, 64 nt, Homo Sapiens; identical to SEQ ID NO: 175248

SEQ ID NO: 248312 - RNA, 64 nt, Homo Sapiens; identical to SEQ ID NO: 175249

SEQ ID NO: 248313 - RNA, 64 nt, Homo Sapiens; identical to SEQ ID NO: 175250

SEQ ID NO: 248314 - RNA, 64 nt, Homo Sapiens; identical to SEQ ID NO: 175251

SEQ ID NO: 248315 - RNA, 64 nt, Homo Sapiens; identical to SEQ ID NO: 175252

SEQ ID NO: 248316 - RNA, 64 nt, Homo Sapiens; identical to SEQ ID NO: 175253

SEQ ID NO: 248317 - RNA, 64 nt, Homo Sapiens; identical to SEQ ID NO: 175254

SEQ ID NO: 248318 - RNA, 64 nt, Homo Sapiens; identical to SEQ ID NO: 175255

SEQ ID NO: 248319 - RNA, 64 nt, Homo Sapiens; identical to SEQ ID NO: 175256

SEQ ID NO: 248320 - RNA, 64 nt, Homo Sapiens; identical to SEQ ID NO: 175257

SEQ ID NO: 248321 - RNA, 64 nt, Homo Sapiens; identical to SEQ ID NO: 175258

SEQ ID NO: 248322 - RNA, 64 nt, Homo Sapiens; identical to SEQ ID NO: 175259

SEQ ID NO: 248323 - RNA, 64 nt, Homo Sapiens; identical to SEQ ID NO: 175260

SEQ ID NO: 248324 - RNA, 64 nt, Homo Sapiens; identical to SEQ ID NO: 175261

SEQ ID NO: 248325 - RNA, 64 nt, Homo Sapiens; identical to SEQ ID NO: 175262

SEQ ID NO: 248326 - RNA, 64 nt, Homo Sapiens; identical to SEQ ID NO: 175263

SEQ ID NO: 248327 - RNA, 64 nt, Homo Sapiens; identical to SEQ ID NO: 175264

SEQ ID NO: 248328 - RNA, 64 nt, Homo Sapiens; identical to SEQ ID NO: 175265

SEQ ID NO: 248329 - RNA, 64 nt, Homo Sapiens; identical to SEQ ID NO: 175266

SEQ ID NO: 248330 - RNA, 64 nt, Homo Sapiens; identical to SEQ ID NO: 175267

SEQ ID NO: 248331 - RNA, 64 nt, Homo Sapiens; identical to SEQ ID NO: 175268

SEQ ID NO: 248332 - RNA, 64 nt, Homo Sapiens; identical to SEQ ID NO: 175269

SEQ ID NO: 248333 - RNA, 64 nt, Homo Sapiens; identical to SEQ ID NO: 175270

SEQ ID NO: 248334 - RNA, 64 nt, Homo Sapiens; identical to SEQ ID NO: 175271

SEQ ID NO: 248335 - RNA, 64 nt, Homo Sapiens; identical to SEQ ID NO: 175272

SEQ ID NO: 248336 - RNA, 64 nt, Homo Sapiens; identical to SEQ ID NO: 175273

SEQ ID NO: 248337 - RNA, 64 nt, Homo Sapiens; identical to SEQ ID NO: 175274

SEQ ID NO: 248338 - RNA, 64 nt, Homo Sapiens; identical to SEQ ID NO: 175275

SEQ ID NO: 248339 - RNA, 64 nt, Homo Sapiens; identical to SEQ ID NO: 175276

SEQ ID NO: 248340 - RNA, 64 nt, Homo Sapiens; identical to SEQ ID NO: 175277

SEQ ID NO: 248341 - RNA, 64 nt, Homo Sapiens; identical to SEQ ID NO: 175278

SEQ ID NO: 248342 - RNA, 64 nt, Homo Sapiens; identical to SEQ ID NO: 130466

SEQ ID NO: 248343 - RNA, 64 nt, Homo Sapiens; identical to SEQ ID NO: 130467

SEQ ID NO: 248344 - RNA, 64 nt, Homo Sapiens; identical to SEQ ID NO: 130468

SEQ ID NO: 248345 - RNA, 64 nt, Homo Sapiens; identical to SEQ ID NO: 130469

SEQ ID NO: 248346 - RNA, 64 nt, Homo Sapiens; identical to SEQ ID NO: 130470

SEQ ID NO: 248347 - RNA, 64 nt, Homo Sapiens; identical to SEQ ID NO: 130471

SEQ ID NO: 248348 - RNA, 64 nt, Homo Sapiens; identical to SEQ ID NO: 130472

SEQ ID NO: 248349 - RNA, 64 nt, Homo Sapiens; identical to SEQ ID NO: 130473

SEQ ID NO: 248350 - RNA, 64 nt, Homo Sapiens; identical to SEQ ID NO: 130474

SEQ ID NO: 248351 - RNA, 64 nt, Homo Sapiens; identical to SEQ ID NO: 130475

SEQ ID NO: 248352 - RNA, 64 nt, Homo Sapiens; identical to SEQ ID NO: 130476

SEQ ID NO: 248353 - RNA, 64 nt, Homo Sapiens; identical to SEQ ID NO: 130477

SEQ ID NO: 248354 - RNA, 64 nt, Homo Sapiens; identical to SEQ ID NO: 130478

SEQ ID NO: 248355 - RNA, 64 nt, Homo Sapiens; identical to SEQ ID NO: 130479

SEQ ID NO: 248356 - RNA, 64 nt, Homo Sapiens; identical to SEQ ID NO: 130480

SEQ ID NO: 248357 - RNA, 64 nt, Homo Sapiens; identical to SEQ ID NO: 130481

SEQ ID NO: 248358 - RNA, 64 nt, Homo Sapiens; identical to SEQ ID NO: 130482

SEQ ID NO: 248359 - RNA, 64 nt, Homo Sapiens; identical to SEQ ID NO: 130483

SEQ ID NO: 248360 - RNA, 64 nt, Homo Sapiens; identical to SEQ ID NO: 130484

SEQ ID NO: 248361 - RNA, 64 nt, Homo Sapiens; identical to SEQ ID NO: 130485

SEQ ID NO: 248362 - RNA, 64 nt, Homo Sapiens; identical to SEQ ID NO: 130486

SEQ ID NO: 248363 - RNA, 64 nt, Homo Sapiens; identical to SEQ ID NO: 130487

SEQ ID NO: 248364 - RNA, 64 nt, Homo Sapiens; identical to SEQ ID NO: 130488

SEQ ID NO: 248365 - RNA, 64 nt, Homo Sapiens; identical to SEQ ID NO: 130489

SEQ ID NO: 248366 - RNA, 64 nt, Homo Sapiens; identical to SEQ ID NO: 130490

SEQ ID NO: 248367 - RNA, 64 nt, Homo Sapiens; identical to SEQ ID NO: 130491

SEQ ID NO: 248368 - RNA, 64 nt, Homo Sapiens
uaacaaauucuuaggucaauaugugaaugcuuuuagaagcuaagcuguggcucaacucauccgg

SEQ ID NO: 248369 - RNA, 64 nt, Homo Sapiens
uucaaaaauugauuguggugccucaggugaaaugagaagcuaucaguaacagcuacucucaucg

SEQ ID NO: 248370 - RNA, 64 nt, Homo Sapiens
guaaaguuccuuuccuggugauaaaaaaguaaucagaagcuaaaauaauaaaguaaaaauaaaa

SEQ ID NO: 248371 - RNA, 64 nt, Homo Sapiens
cugggugcaguggcucaugccugaggucauaaucagaagcuaagucaguaucuauuccaagaua

SEQ ID NO: 248372 - RNA, 64 nt, Homo Sapiens
cguguuuauuuucccuuaaacacuaaacugcgagagaagcuaaacuacagccuggacuuaccac

SEQ ID NO: 248373 - RNA, 64 nt, Homo Sapiens
gccuggacuuaccaccacuaacauaggagcgcaaagaagcuacagcccgcugcaguuucuuggg

SEQ ID NO: 248374 - RNA, 64 nt, Homo Sapiens
ucuaacucagaaugggauuaaaaauuuuagaagcagaagcuaauauauaaaugaaguuugggau

SEQ ID NO: 248375 - RNA, 64 nt, Homo Sapiens
ggauaauagagaaguccauuuaaaaauuauuuuuagaagcuaaagaaaguaauuaugcuuccug

SEQ ID NO: 248376 - RNA, 64 nt, Homo Sapiens
aaaaaaaaaaaaaaaaaagagagagugugugauuagaagcuaaauaggaaaguuuugagcuuca

SEQ ID NO: 248377 - RNA, 64 nt, Homo Sapiens
agacuccguuuccaaaaaaauaagagagaauagaagaagcuacugcaugauguuaguuaccaag

SEQ ID NO: 248378 - RNA, 64 nt, Homo Sapiens; identical to SEQ ID NO: 167088

SEQ ID NO: 248379 - RNA, 64 nt, Homo Sapiens; identical to SEQ ID NO: 167089

SEQ ID NO: 248380 - RNA, 64 nt, Homo Sapiens; identical to SEQ ID NO: 167090

SEQ ID NO: 248381 - RNA, 64 nt, Homo Sapiens; identical to SEQ ID NO: 167091

SEQ ID NO: 248382 - RNA, 64 nt, Homo Sapiens; identical to SEQ ID NO: 167092

SEQ ID NO: 248383 - RNA, 64 nt, Homo Sapiens; identical to SEQ ID NO: 167093

SEQ ID NO: 248384 - RNA, 64 nt, Homo Sapiens; identical to SEQ ID NO: 167094

SEQ ID NO: 248385 - RNA, 64 nt, Homo Sapiens; identical to SEQ ID NO: 167095

SEQ ID NO: 248386 - RNA, 64 nt, Homo Sapiens; identical to SEQ ID NO: 167096

SEQ ID NO: 248387 - RNA, 64 nt, Homo Sapiens; identical to SEQ ID NO: 167097

SEQ ID NO: 248388 - RNA, 64 nt, Homo Sapiens; identical to SEQ ID NO: 167098

SEQ ID NO: 248389 - RNA, 64 nt, Homo Sapiens; identical to SEQ ID NO: 167099

SEQ ID NO: 248390 - RNA, 64 nt, Homo Sapiens; identical to SEQ ID NO: 167100

SEQ ID NO: 248391 - RNA, 64 nt, Homo Sapiens; identical to SEQ ID NO: 167101

SEQ ID NO: 248392 - RNA, 64 nt, Homo Sapiens; identical to SEQ ID NO: 167102

SEQ ID NO: 248393 - RNA, 64 nt, Homo Sapiens; identical to SEQ ID NO: 167103

SEQ ID NO: 248394 - RNA, 64 nt, Homo Sapiens; identical to SEQ ID NO: 167104

SEQ ID NO: 248395 - RNA, 64 nt, Homo Sapiens; identical to SEQ ID NO: 167105

SEQ ID NO: 248396 - RNA, 64 nt, Homo Sapiens; identical to SEQ ID NO: 167106

SEQ ID NO: 248397 - RNA, 64 nt, Homo Sapiens; identical to SEQ ID NO: 167107

SEQ ID NO: 248398 - RNA, 64 nt, Homo Sapiens; identical to SEQ ID NO: 167108

SEQ ID NO: 248399 - RNA, 64 nt, Homo Sapiens; identical to SEQ ID NO: 167109

SEQ ID NO: 248400 - RNA, 64 nt, Homo Sapiens; identical to SEQ ID NO: 167110

SEQ ID NO: 248401 - RNA, 64 nt, Homo Sapiens; identical to SEQ ID NO: 167111

SEQ ID NO: 248402 - RNA, 64 nt, Homo Sapiens; identical to SEQ ID NO: 167112

SEQ ID NO: 248403 - RNA, 64 nt, Homo Sapiens; identical to SEQ ID NO: 167113

SEQ ID NO: 248404 - RNA, 64 nt, Homo Sapiens; identical to SEQ ID NO: 167114

SEQ ID NO: 248405 - RNA, 64 nt, Homo Sapiens; identical to SEQ ID NO: 167115

SEQ ID NO: 248406 - RNA, 64 nt, Homo Sapiens; identical to SEQ ID NO: 167116

SEQ ID NO: 248407 - RNA, 64 nt, Homo Sapiens; identical to SEQ ID NO: 167117

SEQ ID NO: 248408 - RNA, 64 nt, Homo Sapiens; identical to SEQ ID NO: 167118

SEQ ID NO: 248409 - RNA, 64 nt, Homo Sapiens; identical to SEQ ID NO: 167119

SEQ ID NO: 248410 - RNA, 64 nt, Homo Sapiens; identical to SEQ ID NO: 167120

SEQ ID NO: 248411 - RNA, 64 nt, Homo Sapiens; identical to SEQ ID NO: 167121

SEQ ID NO: 248412 - RNA, 64 nt, Homo Sapiens; identical to SEQ ID NO: 167122

SEQ ID NO: 248413 - RNA, 64 nt, Homo Sapiens; identical to SEQ ID NO: 167123

SEQ ID NO: 248414 - RNA, 64 nt, Homo Sapiens; identical to SEQ ID NO: 167124

SEQ ID NO: 248415 - RNA, 64 nt, Homo Sapiens; identical to SEQ ID NO: 167125

SEQ ID NO: 248416 - RNA, 64 nt, Homo Sapiens; identical to SEQ ID NO: 167126

SEQ ID NO: 248417 - RNA, 64 nt, Homo Sapiens; identical to SEQ ID NO: 167127

SEQ ID NO: 248418 - RNA, 64 nt, Homo Sapiens; identical to SEQ ID NO: 167128

SEQ ID NO: 248419 - RNA, 64 nt, Homo Sapiens; identical to SEQ ID NO: 167129

SEQ ID NO: 248420 - RNA, 64 nt, Homo Sapiens; identical to SEQ ID NO: 167130

SEQ ID NO: 248421 - RNA, 64 nt, Homo Sapiens; identical to SEQ ID NO: 167131

SEQ ID NO: 248422 - RNA, 64 nt, Homo Sapiens; identical to SEQ ID NO: 167132

SEQ ID NO: 248423 - RNA, 64 nt, Homo Sapiens; identical to SEQ ID NO: 167133

SEQ ID NO: 248424 - RNA, 64 nt, Homo Sapiens; identical to SEQ ID NO: 167134

SEQ ID NO: 248425 - RNA, 64 nt, Homo Sapiens; identical to SEQ ID NO: 167135

SEQ ID NO: 248426 - RNA, 64 nt, Homo Sapiens; identical to SEQ ID NO: 167136

SEQ ID NO: 248427 - RNA, 64 nt, Homo Sapiens; identical to SEQ ID NO: 167137

SEQ ID NO: 248428 - RNA, 64 nt, Homo Sapiens; identical to SEQ ID NO: 167138

SEQ ID NO: 248429 - RNA, 64 nt, Homo Sapiens; identical to SEQ ID NO: 167139

SEQ ID NO: 248430 - RNA, 64 nt, Homo Sapiens; identical to SEQ ID NO: 167140

SEQ ID NO: 248431 - RNA, 64 nt, Homo Sapiens; identical to SEQ ID NO: 167141

SEQ ID NO: 248432 - RNA, 64 nt, Homo Sapiens; identical to SEQ ID NO: 167142

SEQ ID NO: 248433 - RNA, 64 nt, Homo Sapiens; identical to SEQ ID NO: 167143

SEQ ID NO: 248434 - RNA, 64 nt, Homo Sapiens; identical to SEQ ID NO: 167144

SEQ ID NO: 248435 - RNA, 64 nt, Homo Sapiens; identical to SEQ ID NO: 167145

SEQ ID NO: 248436 - RNA, 64 nt, Homo Sapiens; identical to SEQ ID NO: 167146

SEQ ID NO: 248437 - RNA, 64 nt, Homo Sapiens; identical to SEQ ID NO: 167147

SEQ ID NO: 248438 - RNA, 64 nt, Homo Sapiens; identical to SEQ ID NO: 167148

SEQ ID NO: 248439 - RNA, 64 nt, Homo Sapiens; identical to SEQ ID NO: 167149

SEQ ID NO: 248440 - RNA, 64 nt, Homo Sapiens; identical to SEQ ID NO: 167150

SEQ ID NO: 248441 - RNA, 64 nt, Homo Sapiens; identical to SEQ ID NO: 167151

SEQ ID NO: 248442 - RNA, 64 nt, Homo Sapiens; identical to SEQ ID NO: 167152

SEQ ID NO: 248443 - RNA, 64 nt, Homo Sapiens; identical to SEQ ID NO: 167153

SEQ ID NO: 248444 - RNA, 64 nt, Homo Sapiens; identical to SEQ ID NO: 167154

SEQ ID NO: 248445 - RNA, 64 nt, Homo Sapiens; identical to SEQ ID NO: 167155

SEQ ID NO: 248446 - RNA, 64 nt, Homo Sapiens; identical to SEQ ID NO: 167156

SEQ ID NO: 248447 - RNA, 64 nt, Homo Sapiens; identical to SEQ ID NO: 167157

SEQ ID NO: 248448 - RNA, 64 nt, Homo Sapiens; identical to SEQ ID NO: 167158

SEQ ID NO: 248449 - RNA, 64 nt, Homo Sapiens; identical to SEQ ID NO: 167159

SEQ ID NO: 248450 - RNA, 64 nt, Homo Sapiens; identical to SEQ ID NO: 167160

SEQ ID NO: 248451 - RNA, 64 nt, Homo Sapiens; identical to SEQ ID NO: 167161

SEQ ID NO: 248452 - RNA, 64 nt, Homo Sapiens; identical to SEQ ID NO: 167162

SEQ ID NO: 248453 - RNA, 64 nt, Homo Sapiens; identical to SEQ ID NO: 167163

SEQ ID NO: 248454 - RNA, 64 nt, Homo Sapiens; identical to SEQ ID NO: 167164

SEQ ID NO: 248455 - RNA, 64 nt, Homo Sapiens; identical to SEQ ID NO: 167165

SEQ ID NO: 248456 - RNA, 64 nt, Homo Sapiens; identical to SEQ ID NO: 167166

SEQ ID NO: 248457 - RNA, 64 nt, Homo Sapiens; identical to SEQ ID NO: 167167

SEQ ID NO: 248458 - RNA, 64 nt, Homo Sapiens; identical to SEQ ID NO: 167168

SEQ ID NO: 248459 - RNA, 64 nt, Homo Sapiens; identical to SEQ ID NO: 159137

SEQ ID NO: 248460 - RNA, 64 nt, Homo Sapiens; identical to SEQ ID NO: 159138

SEQ ID NO: 248461 - RNA, 64 nt, Homo Sapiens; identical to SEQ ID NO: 159139

SEQ ID NO: 248462 - RNA, 64 nt, Homo Sapiens; identical to SEQ ID NO: 159140

SEQ ID NO: 248463 - RNA, 64 nt, Homo Sapiens; identical to SEQ ID NO: 159141

SEQ ID NO: 248464 - RNA, 64 nt, Homo Sapiens; identical to SEQ ID NO: 159142

SEQ ID NO: 248465 - RNA, 64 nt, Homo Sapiens; identical to SEQ ID NO: 159143

SEQ ID NO: 248466 - RNA, 64 nt, Homo Sapiens; identical to SEQ ID NO: 159144

SEQ ID NO: 248467 - RNA, 64 nt, Homo Sapiens; identical to SEQ ID NO: 159145

SEQ ID NO: 248468 - RNA, 64 nt, Homo Sapiens; identical to SEQ ID NO: 159146

SEQ ID NO: 248469 - RNA, 64 nt, Homo Sapiens; identical to SEQ ID NO: 159147

SEQ ID NO: 248470 - RNA, 64 nt, Homo Sapiens; identical to SEQ ID NO: 159148

SEQ ID NO: 248471 - RNA, 64 nt, Homo Sapiens; identical to SEQ ID NO: 159149

SEQ ID NO: 248472 - RNA, 64 nt, Homo Sapiens; identical to SEQ ID NO: 159150

SEQ ID NO: 248473 - RNA, 64 nt, Homo Sapiens; identical to SEQ ID NO: 159151

SEQ ID NO: 248474 - RNA, 64 nt, Homo Sapiens; identical to SEQ ID NO: 159152

SEQ ID NO: 248475 - RNA, 64 nt, Homo Sapiens; identical to SEQ ID NO: 159153

SEQ ID NO: 248476 - RNA, 64 nt, Homo Sapiens; identical to SEQ ID NO: 159154

SEQ ID NO: 248477 - RNA, 64 nt, Homo Sapiens; identical to SEQ ID NO: 159155

SEQ ID NO: 248478 - RNA, 64 nt, Homo Sapiens; identical to SEQ ID NO: 159156

SEQ ID NO: 248479 - RNA, 64 nt, Homo Sapiens; identical to SEQ ID NO: 159157

SEQ ID NO: 248480 - RNA, 64 nt, Homo Sapiens; identical to SEQ ID NO: 159158

SEQ ID NO: 248481 - RNA, 64 nt, Homo Sapiens; identical to SEQ ID NO: 159159

SEQ ID NO: 248482 - RNA, 64 nt, Homo Sapiens; identical to SEQ ID NO: 159160

SEQ ID NO: 248483 - RNA, 64 nt, Homo Sapiens; identical to SEQ ID NO: 159161

SEQ ID NO: 248484 - RNA, 64 nt, Homo Sapiens; identical to SEQ ID NO: 159162

SEQ ID NO: 248485 - RNA, 60 nt, Homo Sapiens
ucucauaucagagucaucauuuuucuuccuguggaauaaaaugccuuguggacuucccaa

SEQ ID NO: 248486 - RNA, 60 nt, Homo Sapiens
uaaucuuauuuuguuugggaguaacaaaucguggaauauuuuuaaggaaaacuguuguau

SEQ ID NO: 248487 - RNA, 60 nt, Homo Sapiens
uguaauauaggauccuggaaaugagaccugguggaauauuauuuucaacuguagucuuuc

SEQ ID NO: 248488 - RNA, 60 nt, Homo Sapiens
cuucucuugccaccucaggggcuuggauauguggaauagugaacuggggccaugucaguu

SEQ ID NO: 248489 - RNA, 60 nt, Homo Sapiens
aaaaacugcugacuguuuucucuugagaggguggaauauccaauauucgcugugucagca

SEQ ID NO: 248490 - RNA, 60 nt, Homo Sapiens
aucuagauuuaaauauauuugucaaugaauguggaauagaaaaucuaaacaugacaauaa

SEQ ID NO: 248491 - RNA, 60 nt, Homo Sapiens
guuauacuuuuaaugguaguauguuuuuagguggaauaaauuaauaugugauugguuuca

SEQ ID NO: 248492 - RNA, 60 nt, Homo Sapiens
ucccacgcuacccccugccuugggagguguguggaauaaauuauuuuuguuaaggcaagc

SEQ ID NO: 248493 - RNA, 60 nt, Homo Sapiens
auaauuuuuuuaacuuuuuaaggaacagauguggaauacacuggcccauauuucaaccuu

SEQ ID NO: 248494 - RNA, 60 nt, Homo Sapiens
cugugcugggguuugaacuaaaagccauauguggaauauugacauguguaagaagcacuu

SEQ ID NO: 248495 - RNA, 60 nt, Homo Sapiens
uauuuuauuucugauguuuuauuugcacuuguggaauauguuaccauuaaucagaaacau

SEQ ID NO: 248496 - RNA, 60 nt, Homo Sapiens
gggcagguccaaggccugcaccuucaagaaguggaauaaauguggccuuugcuucuguuu

SEQ ID NO: 248497 - RNA, 60 nt, Homo Sapiens
aauugaaccaaugacuacuuaggauggguuguggaauaaguuuugauguggaauugcaca

SEQ ID NO: 248498 - RNA, 60 nt, Homo Sapiens
caaucuaaaagcagugccacacccuccaaaguggaauagaaagaaguucaugaguaaggg

SEQ ID NO: 248499 - RNA, 60 nt, Homo Sapiens
aucuucgaaacugggcagagaaaaaauaaaguggaauauuaaguaaaaguugggcacuaa

SEQ ID NO: 248500 - RNA, 60 nt, Homo Sapiens
uuuuaucacaucucuuauuugauaaagaugguggaauagguaggacaugcuguggaugaa

SEQ ID NO: 248501 - RNA, 60 nt, Homo Sapiens
uugauuuggccaauguguaaaccaggguggguggaauaaguggguuuuuucucccccuuc

SEQ ID NO: 248502 - RNA, 60 nt, Homo Sapiens
aacuauauguauuuuaacuuuuuaugcuguguggaauacuuaaacuuugauuugucaaau

SEQ ID NO: 248503 - RNA, 60 nt, Homo Sapiens
gugaggaaaaaaaaaauuaaccacagguauguggaauacggguaacauuaccuuccccag

SEQ ID NO: 248504 - RNA, 60 nt, Homo Sapiens
ugacauuuuuccuguuuuaacgaauggggaguggaauauuccuugggggaugguuugggc

SEQ ID NO: 248505 - RNA, 60 nt, Homo Sapiens
ugucucaaaaauccuuaugcuaauauuucaguggaauagaugguuuguagacuuccuuua

SEQ ID NO: 248506 - RNA, 60 nt, Homo Sapiens
agcuaacuaauucugucauuaauacuuuuuguggaauacuaaauuuuuugaaaauagagc

SEQ ID NO: 248507 - RNA, 60 nt, Homo Sapiens
uaugucuaacuuuuuacgugacuuuuuccuguggaauaauauuuauagucaaguguuuac

SEQ ID NO: 248508 - RNA, 60 nt, Homo Sapiens
uuguuagaaugaggguuaaaaaaauacugaguggaauaaccauuugugcuacuuuguuag

SEQ ID NO: 248509 - RNA, 60 nt, Homo Sapiens
gguaaggcuugaguaaaacuccugaaauggguggaauagcggugucuuacucccuggaag

SEQ ID NO: 248510 - RNA, 60 nt, Homo Sapiens
cuuuugcuucaauaaaucugcucccacucuguggaauauagagcagcuugcuuuagccug

SEQ ID NO: 248511 - RNA, 60 nt, Homo Sapiens
aagauggcugacuuugcucuaaggauucauguggaauauacaaauaagaccauaaaggga

SEQ ID NO: 248512 - RNA, 60 nt, Homo Sapiens
aaggucguuuuuuucauuccaacucaaaggguggaauauccucccaguugucccgauugu

SEQ ID NO: 248513 - RNA, 60 nt, Homo Sapiens
uccuucguccuaacauaacaaguuuauauuguggaauaaauagcuuguaucaaauguuac

SEQ ID NO: 248514 - RNA, 60 nt, Homo Sapiens
uuaauuaauauagcauggcauucuuuucuuguggaauauuuuauuuucagguuuuguauu

SEQ ID NO: 248515 - RNA, 60 nt, Homo Sapiens
cauauguggggugaaaccguccccuauaauguggaauauggaugaccggaaacuagaaag

SEQ ID NO: 248516 - RNA, 60 nt, Homo Sapiens
gcauaauuguaauaaauuauugguugcuguguggaauaugguuccauuuaacauuccaac

SEQ ID NO: 248517 - RNA, 60 nt, Homo Sapiens
agcauuuaccuuuauuuaaaugaugguaagguggaauauugaauaaaauuagguuuugug

SEQ ID NO: 248518 - RNA, 60 nt, Homo Sapiens
augauuuugcuagaaauagaaggcccagugguggaauauuagagggaaggaaacugacaa

SEQ ID NO: 248519 - RNA, 60 nt, Homo Sapiens
augggaaggggaaggggagucuuacuauauguggaauaaacuugcucaguguugccacag

SEQ ID NO: 248520 - RNA, 60 nt, Homo Sapiens
uuuaaaauuccuucugauuaaaaaaauauaguggaauacaauugucugccguuuccccuu

SEQ ID NO: 248521 - RNA, 60 nt, Homo Sapiens
ucugaaagucauucacugaauuuuacacauguggaauaaacagugucuuuucuaaggcaa

SEQ ID NO: 248522 - RNA, 60 nt, Homo Sapiens
gaugguagcugcacagcuugcaucaaugguguggaauaacccaagucagcaacaauuuau

SEQ ID NO: 248523 - RNA, 60 nt, Homo Sapiens
uaugauuuggcuagaaagauucuuaaauauguggaauaugauuauucuuagcuggaauau

SEQ ID NO: 248524 - RNA, 60 nt, Homo Sapiens
augucgauauuugcauaggagucauuuucaguggaauaacauuuuuaaugugugguuuua

SEQ ID NO: 248525 - RNA, 60 nt, Homo Sapiens
ccaugccccuugggugccuggggcagagggguggaauacguuggggugccccacgauagc

SEQ ID NO: 248526 - RNA, 60 nt, Homo Sapiens
uacaugaaugaaaaauuuuauauuuugacuguggaauaaauauagcuuuaaauuuugauu

SEQ ID NO: 248527 - RNA, 60 nt, Homo Sapiens
aaaccuguauauuuuacuuuugaggcacugguggaauaaaauaucuuuuuccuaucuauc

SEQ ID NO: 248528 - RNA, 60 nt, Homo Sapiens
uauaaaugagauucuaacuacauaaacagaguggaauaaauuucaaauuaguuaccaaau

SEQ ID NO: 248529 - RNA, 60 nt, Homo Sapiens
cauuauuggcaaaauugcucaaaaaacaguguggaauagauuuccuacuuuuccacuacu

SEQ ID NO: 248530 - RNA, 60 nt, Homo Sapiens
gugcucagggucaccauagcucaccuagaaguggaauaauugagucaugaggaaacugaa

SEQ ID NO: 248531 - RNA, 60 nt, Homo Sapiens
ccaauaccuuuaacuacagaguacagauguguggaauacgagcgaucauacucaagaaua

SEQ ID NO: 248532 - RNA, 60 nt, Homo Sapiens
agcaggugaagacuucauaguucucagccuguggaauaauaccauuucuuucagaaguaa

SEQ ID NO: 248533 - RNA, 60 nt, Homo Sapiens
auugugacaauuuccuacgcuuguauccauguggaauaaacuaaauuaaaguauaaucau

SEQ ID NO: 248534 - RNA, 60 nt, Homo Sapiens
uccccuuacucaugauucauaguuucauugguggaauaagcuguucacuuauaacuugcc

SEQ ID NO: 248535 - RNA, 60 nt, Homo Sapiens
gccauuggaaacaaauggaacuaaagucauguggaauaaaaauugauugaguacgguuua

SEQ ID NO: 248536 - RNA, 60 nt, Homo Sapiens
aacuuuuuaaaaauaauuuccugaaacucuguggaauauauagauuaaggaaauaggaaa

SEQ ID NO: 248537 - RNA, 60 nt, Homo Sapiens
uguuuucauagagcccuauucucucagacgguggaauauuuggaaaaauuuuaaaacaau

SEQ ID NO: 248538 - RNA, 60 nt, Homo Sapiens
ugagaaaaagaaaggauauagauuccuugaguggaauagugggcuagauuaauauaccga

SEQ ID NO: 248539 - RNA, 60 nt, Homo Sapiens
auaccuuaagcuguuaacuaacuguaaggcguggaauaggaguugcucaguggauugguu

SEQ ID NO: 248540 - RNA, 60 nt, Homo Sapiens
augauggccuaugguuuuaaaaauaguauuguggaauauauuuuuggguaauaagaaugg

SEQ ID NO: 248541 - RNA, 60 nt, Homo Sapiens
gguuuguugaaucaaacaaaaggaaauguuguggaauauuuuuccaaguaguuuugguuc

SEQ ID NO: 248542 - RNA, 60 nt, Homo Sapiens
guaauaagggggcuccaggacucccucuaaguggaauagccucccuguaacuccagcucu

SEQ ID NO: 248543 - RNA, 60 nt, Homo Sapiens
ugcgugguuuugauacuuugauggauuccaguggaauaaauucaggcugcugaaacaaga

SEQ ID NO: 248544 - RNA, 60 nt, Homo Sapiens
aucaaaaggcugccucuauuacaauccucaguggaauagauggcuaucuuucuuggcuaa

SEQ ID NO: 248545 - RNA, 60 nt, Homo Sapiens
cuuuuuccauggggcuauaguagagaguuaguggaauauagacaggacucugaaaacaca

SEQ ID NO: 248546 - RNA, 60 nt, Homo Sapiens
cgaugcuuugaaucaugcaccuuguuggcuguggaauaucuguaauagggaauaggaaac

SEQ ID NO: 248547 - RNA, 60 nt, Homo Sapiens
ccaaaaccuagaaaugcuguauacagugguguggaauacuugugguugggaaaaauaaaa

SEQ ID NO: 248548 - RNA, 60 nt, Homo Sapiens
cugacugcugguacugauggcacuuaaccaguggaauagucucgcuuuaaugguaguaaa

SEQ ID NO: 248549 - RNA, 60 nt, Homo Sapiens
uuuuauuuucauuaauucagaaaaucugucguggaauauaaaguuuucauuugugccaca

SEQ ID NO: 248550 - RNA, 60 nt, Homo Sapiens
cuucuaauaaaaggguaaccgcucucugugguggaauaccacacaucuggaaaaccuccg

SEQ ID NO: 248551 - RNA, 60 nt, Homo Sapiens
aaugugggauuagcccgcuaagggaugauaguggaauaaucaaaaccaagaccuuucugc

SEQ ID NO: 248552 - RNA, 60 nt, Homo Sapiens
agcaaaucuacaagagacccccaacauuuuguggaauagcuuguggcauggcagcaaaug

SEQ ID NO: 248553 - RNA, 60 nt, Homo Sapiens
agaugaaaugcuccugauuaaacuauugcuguggaauaaagcuguaggcagacccccuga

SEQ ID NO: 248554 - RNA, 60 nt, Homo Sapiens
ggcacagaaaaguauuagguguuuuucuuaguggaauauuagaaaugaucauauucauua

SEQ ID NO: 248555 - RNA, 60 nt, Homo Sapiens
cucuuggaugucauuugaucggaauaugcaguggaauaggugacucacugaaaugccuuu

SEQ ID NO: 248556 - RNA, 60 nt, Homo Sapiens
guuuccucaugaaaucuaaguaauuuuguuguggaauagugucacuguuacauuuccccc

SEQ ID NO: 248557 - RNA, 60 nt, Homo Sapiens
uuuaauuuauuauugaaauuguacauauuuguggaauaauguaaaauguugaauaaaaau

SEQ ID NO: 248558 - RNA, 60 nt, Homo Sapiens
ucuuuuagcccauuuuucuagacugucucuguggaauauauuugugugugugauauaugc

SEQ ID NO: 248559 - RNA, 60 nt, Homo Sapiens
ugaacaaaacaaaaaaacaaggcugccacaguggaauauuaucuuacaagaauaagaacu

SEQ ID NO: 248560 - RNA, 60 nt, Homo Sapiens
ugguuucuuuucuuacuuauguugacaugaguggaauacuucuccuuuuugcccuggauu

SEQ ID NO: 248561 - RNA, 60 nt, Homo Sapiens
gcaauagcauuguucuucucgggggauguuguggaauauggagcauauguacacagacaa

SEQ ID NO: 248562 - RNA, 60 nt, Homo Sapiens
cauuaauuuugugcauucuuugacacaaagguggaauaaauggugaaggauccaggaaua

SEQ ID NO: 248563 - RNA, 60 nt, Homo Sapiens
uggagagaucuugaaagaggucucaaacugguggaauauaccaccuccucccccagccua

SEQ ID NO: 248564 - RNA, 60 nt, Homo Sapiens
aggaaagcaauaaaugaaugauaauaaacaguggaauauacauaugaaaauacaacuuaa

SEQ ID NO: 248565 - RNA, 60 nt, Homo Sapiens
gcuucucagauaguuuugauguguuguacaguggaauaucuuagauacuuuuuggaaagu

SEQ ID NO: 248566 - RNA, 60 nt, Homo Sapiens
ggccacuccaauaggugcugaguguacagaguggaauaagacagagaccugcccucaaga

SEQ ID NO: 248567 - RNA, 60 nt, Homo Sapiens
auagucuugcuuauuuuguugcgaaggccaguggaauauaaaaaucaauggcauuaauga

SEQ ID NO: 248568 - RNA, 60 nt, Homo Sapiens
cacaagauuuagcaaaaagauaaagcuuggguggaauaucauuuuaaaauguucauguuc

SEQ ID NO: 248569 - RNA, 60 nt, Homo Sapiens
uuguguuuguccaucacuguuuuaccagcuguggaauaaguucagauauauucuaaguau

SEQ ID NO: 248570 - RNA, 60 nt, Homo Sapiens
uccuguuuuuccaucugugucauauucuauguggaauagaaaauaauaaaauucaagaag

SEQ ID NO: 248571 - RNA, 60 nt, Homo Sapiens
aaaaugggauagaucuggaacccucauccuguggaauaaguuuguaaccuggcacaguuu

SEQ ID NO: 248572 - RNA, 60 nt, Homo Sapiens
uuggcacauccacuaggaucuugacucugaguggaauacccuuucccucuuucccuggga

SEQ ID NO: 248573 - RNA, 60 nt, Homo Sapiens
ugcccuucuccgguuguguguacaguauguguggaauaaaaaagggaaacuguuuucaca

SEQ ID NO: 248574 - RNA, 60 nt, Homo Sapiens
agucaaguacuccccgggccuucugagcugguggaauauuuuauuucagacugaaaacag

SEQ ID NO: 248575 - RNA, 60 nt, Homo Sapiens
uuuauaagaaaaccaguauuugaacaaauuguggaauauaaauacaacuauuuuuaagua

SEQ ID NO: 248576 - RNA, 60 nt, Homo Sapiens
aaauugcuuuguuuuguuuaaucagauacuguggaauaaaagcaccuuuugcuuuucuca

SEQ ID NO: 248577 - RNA, 60 nt, Homo Sapiens
aauacagaggauaaagaaguuaauggcaugguggaauaaccaaaauguguaucauucuac

SEQ ID NO: 248578 - RNA, 60 nt, Homo Sapiens
gcuuggaaguuuuacagcaauaauguugcaguggaauauuauuuguaguuaaggucaucc

SEQ ID NO: 248579 - RNA, 60 nt, Homo Sapiens
uuuauuaauuuaguaguacucauuucaaaaguggaauaaauuagguggauuuuuggcugu

SEQ ID NO: 248580 - RNA, 60 nt, Homo Sapiens
cucaauuuauuucucccuuuucuaucaaauguggaauaaauauuaguggcuguauaguuu

SEQ ID NO: 248581 - RNA, 60 nt, Homo Sapiens
uggugccauuuacaacauuaaugcauuuaaguggaauauuuuuugacucuaauacuguau

SEQ ID NO: 248582 - RNA, 60 nt, Homo Sapiens
ccagucccaggaagugucaauguuuguugaguggaauauugaaaauguaggcagcaacug

SEQ ID NO: 248583 - RNA, 60 nt, Homo Sapiens
cauuuggaccaauagcccacagcugagaauguggaauaccuaaggauagcaccgcuuuug

SEQ ID NO: 248584 - RNA, 60 nt, Homo Sapiens
ucuaacacacugagggaaagauuaaaaucuguggaauaaaggaggagauuuuauuuacag

SEQ ID NO: 248585 - RNA, 60 nt, Homo Sapiens
ugaucaucuccucaccccaucucccaccuuguggaauaaauacauguuagcacuucccag

SEQ ID NO: 248586 - RNA, 60 nt, Homo Sapiens
cuagaauuuucuuggugcaaaguguaucauguggaauauccucauauuuuuaccauauuu

SEQ ID NO: 248587 - RNA, 60 nt, Homo Sapiens
caugaaggaaggacuuaaccaggcuaccaaguggaauauaauuuaucugcuauuuuuaau

SEQ ID NO: 248588 - RNA, 60 nt, Homo Sapiens
aaccugguaagauuucaggagguaaagaagguggaauaauugacggggagauagcgccug

SEQ ID NO: 248589 - RNA, 60 nt, Homo Sapiens
uggcuuaaaugauuuuuucuaacuaauaaaguggaauauauauuucuacugugugucaug

SEQ ID NO: 248590 - RNA, 60 nt, Homo Sapiens
ucuucuguauaacuaggcuguagcucuguaguggaauaugaaaaacaguugcauagagua

SEQ ID NO: 248591 - RNA, 60 nt, Homo Sapiens
auggauugugaugauuuggguaaacaugcuguggaauaaauccugaaaauaacauucccu

SEQ ID NO: 248592 - RNA, 60 nt, Homo Sapiens
agaagaagcaggaccccuacggacacagauguggaauacagaugguacauggaaacugug

SEQ ID NO: 248593 - RNA, 60 nt, Homo Sapiens
guacgaguuccacaaaauuucuggagauuuguggaauacauugagaaggaggcaggauac

SEQ ID NO: 248594 - RNA, 60 nt, Homo Sapiens
augcagagauauucaggguuuggauuagcaguggaauaaagagaugggcauuguuucccc

SEQ ID NO: 248595 - RNA, 60 nt, Homo Sapiens
auaugcuguggcuuugagaaguuaacuuuuguggaauaugaaaccaaaggaagaauuucc

SEQ ID NO: 248596 - RNA, 60 nt, Homo Sapiens
uugugauuauuugacuggaaugcuucuuaaguggaauaacuauacuccguuauccacccg

SEQ ID NO: 248597 - RNA, 60 nt, Homo Sapiens
uguggcuguggauuuuuuuaacugcuaguaguggaauacuggaaaagcuucauuucugaa

SEQ ID NO: 248598 - RNA, 60 nt, Homo Sapiens
uggagauucagcgugggugucuccaccuccguggaauaaaggcagucgaaccauggugaa

SEQ ID NO: 248599 - RNA, 60 nt, Homo Sapiens
aauagcugaaaacuaauguaaggucuaacuguggaauauacuuaaaaccagagaaucuua

SEQ ID NO: 248600 - RNA, 60 nt, Homo Sapiens
gugauauauuguguuaauuuuuagucauuuguggaauauauugcuugugcuuuauuuuuc

SEQ ID NO: 248601 - RNA, 60 nt, Homo Sapiens
ucuggagaccacaaguaccauugucugacaguggaauauauucaaugaagaaaaguauuu

SEQ ID NO: 248602 - RNA, 60 nt, Homo Sapiens
uauauguucagaguuuuuaguagaagacagguggaauaaggaauaucuaagucauagaaa

SEQ ID NO: 248603 - RNA, 60 nt, Homo Sapiens
gguguuaccagugaagggggaauuaggaugguggaauauuagacugaaugcuugugaggg

SEQ ID NO: 248604 - RNA, 60 nt, Homo Sapiens
ucagaaugucaguucuguuuauucuuuacuguggaauagcuuccuuucuuuaauuuugua

SEQ ID NO: 248605 - RNA, 60 nt, Homo Sapiens
aguuuuaugaauggacuuuuauucauguaaguggaauaaaguuaagaacacguguauuaa

SEQ ID NO: 248606 - RNA, 60 nt, Homo Sapiens
caauguguacaccuuugacuauguauaucuguggaauacuuggauaccacauauuaaacc

SEQ ID NO: 248607 - RNA, 60 nt, Homo Sapiens
uuuuauaauagacuauagugcuucuugaaaguggaauaauauuguaagaaccccauuuag

SEQ ID NO: 248608 - RNA, 60 nt, Homo Sapiens
cuauauauugacaagaguuuuuuuggggugguggaauacugguagagacuuuaggaaaug

SEQ ID NO: 248609 - RNA, 60 nt, Homo Sapiens
uauuccagcuuccugauaacacugcuuacuguggaauauucauuugacaucugucucuuu

SEQ ID NO: 248610 - RNA, 60 nt, Homo Sapiens
uaggcauagucaauuucagaauaacuaagaguggaauauaugcauauggugaaauuauaa

SEQ ID NO: 248611 - RNA, 60 nt, Homo Sapiens
gccgguugcuggcaucuuaauguucuguagguggaauauuuccaauaaacacaaggugcc

SEQ ID NO: 248612 - RNA, 60 nt, Homo Sapiens
gaaaauuaaauauaccuguuuagcuccauuguggaauacaauuuucaugaguccugcuuc

SEQ ID NO: 248613 - RNA, 60 nt, Homo Sapiens
cauuuucuuacugcagugggugcuucauguguggaauauuguuuaucuguguguagugag

SEQ ID NO: 248614 - RNA, 60 nt, Homo Sapiens
auaggccgggcguggugacuggucuccgaaguggaauaaaaucugagggacaaggggggc

SEQ ID NO: 248615 - RNA, 60 nt, Homo Sapiens
uaaguauaaagcagcaaagacagaggaaauguggaauaccuaacaguaagccagguucac

SEQ ID NO: 248616 - RNA, 60 nt, Homo Sapiens
uguucagauagaaacuucacuucuaugacuguggaauaaaaggucuuuuccaucuucagu

SEQ ID NO: 248617 - RNA, 60 nt, Homo Sapiens
uauucuaagugauuuaaugcaagaggaagaguggaauaaaguugaauuuccuucagcuuu

SEQ ID NO: 248618 - RNA, 60 nt, Homo Sapiens
gauugauauacgugauuuaaucugcaauagguggaauaaccaggggaacugguuaugaau

SEQ ID NO: 248619 - RNA, 60 nt, Homo Sapiens
aauuuugaggcuauacagccacugugcccuguggaauaaagccauauauauaaauguuuu

SEQ ID NO: 248620 - RNA, 60 nt, Homo Sapiens
uaucuuaccagacugugccuaaagaauuuuguggaauacacuuuguuugcuucaugugca

SEQ ID NO: 248621 - RNA, 60 nt, Homo Sapiens
guuuuuacccauggcauggguggaauuagaguggaauaaggauguuaacuugguucucag

SEQ ID NO: 248622 - RNA, 60 nt, Homo Sapiens
aggagggacagaaaaguaaccucuucuuaaguggaauauucuaauaagcuaccuuuugua

SEQ ID NO: 248623 - RNA, 60 nt, Homo Sapiens
accagccuuccgcaggaaggcgugcaugcaguggaauaguuggaugcaggaauuguguuc

SEQ ID NO: 248624 - RNA, 60 nt, Homo Sapiens
cuuuuuaaaaacaauuuuauaaauauauauguggaauauuuauuuucauaugaaacugau

SEQ ID NO: 248625 - RNA, 60 nt, Homo Sapiens
agcuggauuccaucagauuuaagacaaccuguggaauagaucggacguugauucuuacug

SEQ ID NO: 248626 - RNA, 60 nt, Homo Sapiens
aggagguuuuccugaugugggaaaggaaauguggaauaaauuuuggagacuggcugagau

SEQ ID NO: 248627 - RNA, 60 nt, Homo Sapiens
accccauggucuucuugacaucuugcucaaguggaauaaauugauggggcucugauuugc

SEQ ID NO: 248628 - RNA, 60 nt, Homo Sapiens
auuuccccuuuuuuucauaaaaauuugucaguggaauaaaacauuauauuuauagaauau

SEQ ID NO: 248629 - RNA, 60 nt, Homo Sapiens
cuguuuaguagaaaaauccuugccuguggaguggaauauuaaaaauuucauccagccaua

SEQ ID NO: 248630 - RNA, 60 nt, Homo Sapiens
aguuccccuggaagcagugcccagguggcuguggaauaggaacgcuauguccguguacug

SEQ ID NO: 248631 - RNA, 60 nt, Homo Sapiens
aagggcauacaucucaguggcaugagcauuguggaauauccuuuccuaggcacauucguc

SEQ ID NO: 248632 - RNA, 60 nt, Homo Sapiens
caguguaacccaagcauuuguggacaaugaguggaauacuaaaguuaaaaagucaaacuu

SEQ ID NO: 248633 - RNA, 60 nt, Homo Sapiens
aauauuugcuuuuacugguguacaguaugaguggaauauaaacuguacacauaauuauca

SEQ ID NO: 248634 - RNA, 60 nt, Homo Sapiens
ugagcuuucaggaaguugcugagaaaugggguggaauagggaacuguaauggccacugaa

SEQ ID NO: 248635 - RNA, 60 nt, Homo Sapiens
auuuguucaaaaaugauagcucucauaaauguggaauaacuuguagagaaacccaacaaa

SEQ ID NO: 248636 - RNA, 60 nt, Homo Sapiens
acauacuaaugaaguauuacggacuauuauguggaauaauguaugguacaucuaccuaaa

SEQ ID NO: 248637 - RNA, 60 nt, Homo Sapiens
guugauaacagugcuuggcaagggaauaaaguggaauaauaccugccuuucauaaucacc

SEQ ID NO: 248638 - RNA, 60 nt, Homo Sapiens
gucacaugaaaacaaaacacaaucuuucagguggaauaaacgcuaauggaagaaguuuag

SEQ ID NO: 248639 - RNA, 60 nt, Homo Sapiens
uauaaaaguaugaccuuuuuuacuauuucuguggaauaauaaacuuuugugauuuaauaa

SEQ ID NO: 248640 - RNA, 60 nt, Homo Sapiens
guuacaccuggaguuuguugguuggagaagguggaauaaaucuaagguuggaacucugaa

SEQ ID NO: 248641 - RNA, 60 nt, Homo Sapiens
gcaugaggaaaauuuuuccagaacaacaguguggaauaguucugaauuaugcuguucuac

SEQ ID NO: 248642 - RNA, 60 nt, Homo Sapiens
aaacauucugugaaugaaguagacucuucgguggaauauauuaauauauuacuguauauc

SEQ ID NO: 248643 - RNA, 60 nt, Homo Sapiens
aaaacauuuuccugcuugucuuagaagaaaguggaauaauuccacugauugugauaaugg

SEQ ID NO: 248644 - RNA, 60 nt, Homo Sapiens
ucucuuuaguauaauugaccuacuuugguaguggaauagugaauacuuacuauaauuuga

SEQ ID NO: 248645 - RNA, 60 nt, Homo Sapiens
aagcugggucuuguuauuccuuggguguugguggaauaagcaguggaauuugaacaagga

SEQ ID NO: 248646 - RNA, 60 nt, Homo Sapiens
ccuccacugccaagacagccugaguuuggaguggaauaagguggaagacaaaugucucug

SEQ ID NO: 248647 - RNA, 60 nt, Homo Sapiens
gagaguuaaccugcuggcugugagucccuuguggaauauaaggggguagugggaaaagug

SEQ ID NO: 248648 - RNA, 60 nt, Homo Sapiens
cuaucuaucuauauauauauuugauaguuuguggaauaauaucccccaguauuuuccaua

SEQ ID NO: 248649 - RNA, 60 nt, Homo Sapiens
augcagcuggaggcuacgcaaggcacuggaguggaauagaacacuggugcuaacuggccc

SEQ ID NO: 248650 - RNA, 60 nt, Homo Sapiens
aaacuuuuugaaguagaggacuuacacuugguggaauaagcucccuguuuucaugucuuc

SEQ ID NO: 248651 - RNA, 60 nt, Homo Sapiens
uaguuucugaaggcuugccaugaauuuuggguggaauaaucccuaggaacaaguuagcac

SEQ ID NO: 248652 - RNA, 60 nt, Homo Sapiens
auccuccagguuuuucaauuaucugggggaguggaauagucuggucuccucagccuccuc

SEQ ID NO: 248653 - RNA, 60 nt, Homo Sapiens
uuauuuuguuuuugaauuugccuuuuggggguggaauaucuuagauaaaaagauuaucua

SEQ ID NO: 248654 - RNA, 60 nt, Homo Sapiens
auacuggacuccucuucccauacagguucuguggaauaagcucugccuguuuuccagaca

SEQ ID NO: 248655 - RNA, 60 nt, Homo Sapiens
gggucucccuggggaaugcagcugucuacaguggaauaggucaaaaaauucgugaggaga

SEQ ID NO: 248656 - RNA, 60 nt, Homo Sapiens
aaugcuuggaaaauuaaacuuuguaaauagguggaauaugauguaauuauuugauaacuc

SEQ ID NO: 248657 - RNA, 60 nt, Homo Sapiens
agcauuccuuuaauuuuuuaauucuuuacuguggaauagcucaaaauguccauucuguuu

SEQ ID NO: 248658 - RNA, 60 nt, Homo Sapiens
guuuucaaagaucccgugaaauugaugccaguggaauacagugaguccuccucuuccucc

SEQ ID NO: 248659 - RNA, 60 nt, Homo Sapiens
gucaguagccuuaugcaccuaauucaaaagguggaauauaguucugucagggcuuuuacg

SEQ ID NO: 248660 - RNA, 60 nt, Homo Sapiens
cccagcaccuaguaugcucaguaaauguuuguggaauaagugcauaaaauguucuuaacc

SEQ ID NO: 248661 - RNA, 60 nt, Homo Sapiens
agaguaagauauuccuugaaagcccauuaaguggaauagacuuucugaaaauaagaguuc

SEQ ID NO: 248662 - RNA, 60 nt, Homo Sapiens
uucucugaaccuacaaaauaguuauacauaguggaauaaagaagguaaaccaucuguuau

SEQ ID NO: 248663 - RNA, 59 nt, Homo Sapiens
acagagaaauguuuuaacuguauuucaugguggaauaacuggauauuucuaauauuuga

SEQ ID NO: 248664 - RNA, 60 nt, Homo Sapiens
ucacuuaacucaaaaagcccagcagguuacguggaauauauagugccaguucuuaugcua

SEQ ID NO: 248665 - RNA, 60 nt, Homo Sapiens
uuaauucuuaaagcggcucuuuuaaccccgguggaauacacugagggaaaucagaaauga

SEQ ID NO: 248666 - RNA, 60 nt, Homo Sapiens
ucagagaacauccccugcuaaauggugccaguggaauaaaaaaacaacuaaauauucacu

SEQ ID NO: 248667 - RNA, 60 nt, Homo Sapiens
gaugguccaaaaauagucaacaauuuuccuguggaauaaaagcugcuuuugcagaaauca

SEQ ID NO: 248668 - RNA, 60 nt, Homo Sapiens
gaaaaagggcuugcagagaguggaaaguuaguggaauauucaugaaacuucauugcaggg

SEQ ID NO: 248669 - RNA, 60 nt, Homo Sapiens
ucagucaccagacugggugcccuccgauggguggaauaagucugcuucaugccaaggcug

SEQ ID NO: 248670 - RNA, 60 nt, Homo Sapiens
uaaugcuaauauuuccaucaaaauuugccuguggaauauauacaguucuuaauuuuaaac

SEQ ID NO: 248671 - RNA, 60 nt, Homo Sapiens
uuuuuuagcugcuaaugacauuaagaacauguggaauaaguuuuuuccaccauuaaggcu

SEQ ID NO: 248672 - RNA, 60 nt, Homo Sapiens
ccuguuuuccaggugucucuagugcuaccuguggaauaaaucagagauggcuuuggggca

SEQ ID NO: 248673 - RNA, 60 nt, Homo Sapiens
gaaaugugcaucuggucucucagaaccaugguggaauaaaacccaaacuagcugggaguu

SEQ ID NO: 248674 - RNA, 60 nt, Homo Sapiens
gaccguguaacuggacagcuccauaucccuguggaauacauguaugugagggcauguugu

SEQ ID NO: 248675 - RNA, 60 nt, Homo Sapiens
ucccugcuugcauugggucugggagagagaguggaauauuugguagggaccuugacagaa

SEQ ID NO: 248676 - RNA, 60 nt, Homo Sapiens
gguucuacugcugugggguaaacuaacucaguggaauagggcugguuacuuugggcuguc

SEQ ID NO: 248677 - RNA, 60 nt, Homo Sapiens
cuaaauacuccaucuguuuaguacuguauuguggaauauuugaguucuauuuccauacuu

SEQ ID NO: 248678 - RNA, 60 nt, Homo Sapiens
ccuugacacuaacacucuaacagagacacaguggaauagaugcuuacccuggagaugcua

SEQ ID NO: 248679 - RNA, 60 nt, Homo Sapiens
guaaaaauuuugucaaagauauauugaaagguggaauauuaugccuuuuuaagcuguuuc

SEQ ID NO: 248680 - RNA, 60 nt, Homo Sapiens
cauguauuccuaaguguuucuaucccaaaaguggaauaaguuucaggaaguacuaguagu

SEQ ID NO: 248681 - RNA, 60 nt, Homo Sapiens
cguguguagaguuuuugauuugcugcuauuguggaauauauugcagguagcaguagugug

SEQ ID NO: 248682 - RNA, 60 nt, Homo Sapiens
ggcaacauauauauagccuucccagaguauguggaauauguuuaaaaguaccaaacauaa

SEQ ID NO: 248683 - RNA, 60 nt, Homo Sapiens
auacuauuuuuacugccacugcggguggggguggaauaaaggguugcggggggagggaug

SEQ ID NO: 248684 - RNA, 50 nt, Homo Sapiens
cuauuuugaaaaauuccuauguggaauaacagggagaagaugaugacuaa

SEQ ID NO: 248685 - RNA, 60 nt, Homo Sapiens
ucaggaauuuauaauaaaauacaggcagggguggaauauaaaauuacauuuagauuaaga

SEQ ID NO: 248686 - RNA, 60 nt, Homo Sapiens
uccuuggaucgggaacccuggucuuuucuuguggaauaaaccagccuaaagcagggauca

SEQ ID NO: 248687 - RNA, 60 nt, Homo Sapiens
cuuggcaugccacccuguuucaaaggugcuguggaauaggaguguucucugucugccugg

SEQ ID NO: 248688 - RNA, 60 nt, Homo Sapiens
ucuugcuuuuccacaaagauauuauuuaaaguggaauauuuuuguaacugggauaccaau

SEQ ID NO: 248689 - RNA, 60 nt, Homo Sapiens
ugaacuaaagacaucccccaugucccaaagguggaauacaaccagaggucucaucucuga

SEQ ID NO: 248690 - RNA, 60 nt, Homo Sapiens
aucaauaaaucugaauuccgaacauguuguguggaauacucuuaaguguguuugagagua

SEQ ID NO: 248691 - RNA, 60 nt, Homo Sapiens
gcccugucccuagcaccaccucuccuguguguggaauagaggccccucgugcuaccaaca

SEQ ID NO: 248692 - RNA, 60 nt, Homo Sapiens
auucccuuuaaaaacucuuuaccaguccuuguggaauaagugaacccagguugaugacag

SEQ ID NO: 248693 - RNA, 60 nt, Homo Sapiens
uucauaugaucugccagagccucuccagggguggaauacauguccuggacuaagccaaug

SEQ ID NO: 248694 - RNA, 60 nt, Homo Sapiens
uucucccugccuugauugagcuugagugauguggaauaaauuguccgucucuucuuucuc

SEQ ID NO: 248695 - RNA, 60 nt, Homo Sapiens
agaacgggccaugaugacaauggcgguuuuguggaauagaaaaggcggaaagguggggaa

SEQ ID NO: 248696 - RNA, 60 nt, Homo Sapiens
ccuuucuggccccagccuagguggaggcaaguggaauaucuuauauugggcgauuugggg

SEQ ID NO: 248697 - RNA, 60 nt, Homo Sapiens
uguacagccaggauggcagcugcugggacuguggaauaccaaaaugguggguuaugugag

SEQ ID NO: 248698 - RNA, 60 nt, Homo Sapiens
acuggcuucagcaggcguguucacugccggguggaauagcccauucucauggcccuuugg

SEQ ID NO: 248699 - RNA, 60 nt, Homo Sapiens
cgguguguccugagaaaccagccuucccccguggaauaaagggaggcccuggccuccagu

SEQ ID NO: 248700 - RNA, 60 nt, Homo Sapiens
ggaggccuucaacugauuagguuacuguggguggaauaguccugccugugugggagggug

SEQ ID NO: 248701 - RNA, 60 nt, Homo Sapiens
ccuaaacuggugaugcucaagcauuauacuguggaauacugccuuuugacaaaaauacuc

SEQ ID NO: 248702 - RNA, 60 nt, Homo Sapiens
agaacaccaauauacccccuuuauuuuacuguggaauaugugcuggaaaaauugcaacaa

SEQ ID NO: 248703 - RNA, 60 nt, Homo Sapiens
aacuauuuaauugugugucuauauuuuggaguggaauaauuucuucauuaaaaaauguuu

SEQ ID NO: 248704 - RNA, 60 nt, Homo Sapiens
gggguuaucuguacauccugaguuccagguguggaauaugugaaaaccugacaaaaaaaa

SEQ ID NO: 248705 - RNA, 60 nt, Homo Sapiens
ucagaagguuggggggauaccagagaggugguggaauaggaccgcccccuccuuacuugu

SEQ ID NO: 248706 - RNA, 50 nt, Homo Sapiens
cagcucuaaacacaaauuagguggaauaaugacucgagcaggaaagcagu

SEQ ID NO: 248707 - RNA, 60 nt, Homo Sapiens
gugcaggccuugggccacagggaggcgccuguggaauagggggaguucaugcaccccuuu

SEQ ID NO: 248708 - RNA, 60 nt, Homo Sapiens
guaccauucugucuuuacuccguggcaucuguggaauaacccugcuaauguaacacguga

SEQ ID NO: 248709 - RNA, 60 nt, Homo Sapiens
auguuuccuucauucccaaagaauauuuuuguggaauauaagauucagaguuggcaguug

SEQ ID NO: 248710 - RNA, 60 nt, Homo Sapiens
guuaucaaggacaaugccaagaguguaagaguggaauaaagacagaauuacugaggaauu

SEQ ID NO: 248711 - RNA, 60 nt, Homo Sapiens
accugagaccacaauuuguuuaaauuuauaguggaauaugggcaauugggguaauugaug

SEQ ID NO: 248712 - RNA, 60 nt, Homo Sapiens
ccaacauaaauugccauagaauugccauagguggaauaauaggaaagaaaacuugaugug

SEQ ID NO: 248713 - RNA, 60 nt, Homo Sapiens
cugccauugggguuuuacaugauaauguauguggaauaucugcuaauguugcaaacccau

SEQ ID NO: 248714 - RNA, 60 nt, Homo Sapiens
auuguugcaaggaguaaguacugccacacuguggaauaggggggccuguuuagagucagc

SEQ ID NO: 248715 - RNA, 60 nt, Homo Sapiens
ugaauaagugugaucauuucuuuaucaauuguggaauagaaaaauuggauauaacaaauu

SEQ ID NO: 248716 - RNA, 60 nt, Homo Sapiens
uuccacauguguauauauucauguguguauguggaauauaaauauauacauauauuccac

SEQ ID NO: 248717 - RNA, 60 nt, Homo Sapiens
uuccacauguguguauguggauguguguauguggaauauauauauauacauauauuccac

SEQ ID NO: 248718 - RNA, 60 nt, Homo Sapiens
uuggucagggccucagaccagccaaccuuuguggaauaagccccagcccagccaaaccaa

SEQ ID NO: 248719 - RNA, 60 nt, Homo Sapiens
acauucuugcucaaguugaugaaucaugggguggaauaaaggcugaguuuaguuuuucac

SEQ ID NO: 248720 - RNA, 60 nt, Homo Sapiens
ucacuguguaguggauggaguuuacuguuuguggaauaaaaacggcuguuuccgugguuc

SEQ ID NO: 248721 - RNA, 60 nt, Homo Sapiens
aggaacuuuugacuggagagaaucacagauguggaauauuugucauaaauaaauaaugaa

SEQ ID NO: 248722 - RNA, 60 nt, Homo Sapiens
ucauggacaaauuuuuuuuuuuaccugcagguggaauauuucaggggauucccugaaaaa

SEQ ID NO: 248723 - RNA, 60 nt, Homo Sapiens
acaacguaacuaaaacaugguuuaagcuaaguggaauaauguuucuacaagacuuuauau

SEQ ID NO: 248724 - RNA, 60 nt, Homo Sapiens
uuggcuuauguguuugaacucucuuagcugguggaauaugucucaggggacuugauuguu

SEQ ID NO: 248725 - RNA, 60 nt, Homo Sapiens
acuuuugccauaaaaauaaauuaaaacuguguggaauaaguuugauuucuaaugucacac

SEQ ID NO: 248726 - RNA, 60 nt, Homo Sapiens
caaugucugcagugugaaggcagguucauuguggaauaguuuaacagucaggaaggcuaa

SEQ ID NO: 248727 - RNA, 60 nt, Homo Sapiens
ccugcuaggagauauaggauaaugugucagguggaauaucaauacuuuuuggggucagau

SEQ ID NO: 248728 - RNA, 60 nt, Homo Sapiens
auccgccccccaccccaguugguauuacugguggaauaaucuugugugccccgucccaag

SEQ ID NO: 248729 - RNA, 60 nt, Homo Sapiens
gucgaaguauuccuucuuuuuuauugauuaguggaauacuuaauugagguuuuugguuuu

SEQ ID NO: 248730 - RNA, 60 nt, Homo Sapiens
cggcuuuccauggagauagagaaagaaaaaguggaauacauggaaaagagcaagcaucug

SEQ ID NO: 248731 - RNA, 60 nt, Homo Sapiens
ugccagggauggggccaccacugucacacuguggaauacaagacagugaacucugucugc

SEQ ID NO: 248732 - RNA, 60 nt, Homo Sapiens
ugccugggguggccauggggauggaaggggguggaauaaaaccugucaaccuggcucaug

SEQ ID NO: 248733 - RNA, 60 nt, Homo Sapiens
gggaccugcagagggggcugucgggacagcguggaauaaacauuauuucaaggacacaua

SEQ ID NO: 248734 - RNA, 60 nt, Homo Sapiens
guggaugucugugcagagccgggaggcaguguggaauacuaguagggacuucugaaaugg

SEQ ID NO: 248735 - RNA, 60 nt, Homo Sapiens
gagcucuuuucuuaagcuguaucggacgacguggaauaaauauuuuacuuguguaaaaau

SEQ ID NO: 248736 - RNA, 60 nt, Homo Sapiens
ccuuacgggugaagcucagaaauguuacaaguggaauaagggccuggucuggaagucgac

SEQ ID NO: 248737 - RNA, 60 nt, Homo Sapiens
caaggucauguagccagugauuaaaacgagguggaauaccgaggauuaucugccccauuu

SEQ ID NO: 248738 - RNA, 60 nt, Homo Sapiens
guaauagaguaacaaguggccagaugacauguggaauaaagguuuguuuuuccaaaguaa

SEQ ID NO: 248739 - RNA, 60 nt, Homo Sapiens
gcaucuguucaaaguuguagggcuuauaaaguggaauauaagaaugaacuaaguauguuu

SEQ ID NO: 248740 - RNA, 60 nt, Homo Sapiens
aauugucuuagcuuaaaaaaagaagaaacuguggaauacuacaguaaauauuguuuucaa

SEQ ID NO: 248741 - RNA, 60 nt, Homo Sapiens
gaaacugugaaggaacucugcaguuaaauaguggaauaaaguaaaggauuguuaauguuu

SEQ ID NO: 248742 - RNA, 60 nt, Homo Sapiens
guauagauuaaaaguauacauucaaauugaguggaauaaaaaaagacuuauuaugugggg

SEQ ID NO: 248743 - RNA, 60 nt, Homo Sapiens
agaaaucgugaugaaauaauucaggcacagguggaauagauuauugucacuacaauugcu

SEQ ID NO: 248744 - RNA, 60 nt, Homo Sapiens
uagaaaaaaauaugcuuucagauuauaguaguggaauacacauuuaucuauaaauuuugu

SEQ ID NO: 248745 - RNA, 60 nt, Homo Sapiens
aucuuuugaaauaacuaaguuagcagggaaguggaauaauaggugaugauuaauuucauu

SEQ ID NO: 248746 - RNA, 60 nt, Homo Sapiens
uauucauuuagaaaugugaaaguuacagcaguggaauaagcauuuugugaauugggacau

SEQ ID NO: 248747 - RNA, 60 nt, Homo Sapiens
uauuugccuauauugugaacaauaacagcaguggaauaugcauuuugugaguugucacau

SEQ ID NO: 248748 - RNA, 60 nt, Homo Sapiens
uacuuagaaaugugaaaaauaauaacagcaguggaauaagucuauuuugugaauugggau

SEQ ID NO: 248749 - RNA, 63 nt, Homo Sapiens
ggcucuccggcaggcagcccgagaccugcacagaugaaggagcagagguucugaccgagaggc

SEQ ID NO: 248750 - RNA, 63 nt, Homo Sapiens
ccuauuuuuuauggauuuuucagcucauuucagaugaaggaacuaagucauugugaacugucu

SEQ ID NO: 248751 - RNA, 63 nt, Homo Sapiens
caucaccacacuccccccagccuucaccuggccaugaaggaccuuuugaccaacucccuguca

SEQ ID NO: 248752 - RNA, 63 nt, Homo Sapiens
aucucucucaaauguauuauuuuggugacaaaaaugaaggagcuuuguaaauuuuuuuuaaaa

SEQ ID NO: 248753 - RNA, 63 nt, Homo Sapiens
uuuucuuaucaaguuucucaaccuuuauuuuuaaugaaggaggugcugaguuuuguaucuuuu

SEQ ID NO: 248754 - RNA, 63 nt, Homo Sapiens
agagauuuuuauauuuauacaaaagauuacuaaaugaaggauugcuaaauguuuuugguucaa

SEQ ID NO: 248755 - RNA, 63 nt, Homo Sapiens
guggagcucagccccgagcuguccccguguugcaugaaggagcagcauugacugguuuacagg

SEQ ID NO: 248756 - RNA, 63 nt, Homo Sapiens; identical to SEQ ID NO: 248755

SEQ ID NO: 248757 - RNA, 63 nt, Homo Sapiens
gcuucuccaggaggccaagcagaggcuccccucaugaaggaagccauugcacugugaacacug

SEQ ID NO: 248758 - RNA, 63 nt, Homo Sapiens
cuuugugguauguuuugcuuuccuaauagggacaugaaggaaacccagcaauuugcuguuaug

SEQ ID NO: 248759 - RNA, 63 nt, Homo Sapiens
aaaagcauuuuacagggaaaaauaccucuccucaugaaggacuugaaaaguuuacaaccugcu

SEQ ID NO: 248760 - RNA, 63 nt, Homo Sapiens
gaacaaucaugaaauggaagaaggaggaagagcaugaaggaucuuauaagaaaugcaagagga

SEQ ID NO: 248761 - RNA, 63 nt, Homo Sapiens
cagaaccuccucagucucaguacucuuguuucuaugaaggaaaaguuuggcuacuaacaguag

SEQ ID NO: 248762 - RNA, 63 nt, Homo Sapiens
agaacauucucaauuaagugauaaguccaaaugaugaaggaaauguuuuaauucacaaaugga

SEQ ID NO: 248763 - RNA, 63 nt, Homo Sapiens
cugggccccucacuguggggauugaucauucucaugaaggaaucacaguuauauggcaacugc

SEQ ID NO: 248764 - RNA, 63 nt, Homo Sapiens
ucgcuaaaggaaaauacaguaagugcuugaaagaugaaggaccaaaaggccaaaaaacaguga

SEQ ID NO: 248765 - RNA, 63 nt, Homo Sapiens
uuuuguaucgggaauuucucagagcugaguaaaaugaaggaaaagcauguuauguguuuuuaa

SEQ ID NO: 248766 - RNA, 63 nt, Homo Sapiens
caaaggacuuaaaauuaccaaaugcuucuaaauaugaaggagagguuggggacacgcacccua

SEQ ID NO: 248767 - RNA, 63 nt, Homo Sapiens
aacuugagaagacauuuauaauacaaauaacugaugaaggauucauaaucacaaauauagaga

SEQ ID NO: 248768 - RNA, 63 nt, Homo Sapiens
gcgugagugccaggacgguccggcacccugaucaugaaggacaaagaagccucggcuccugca

SEQ ID NO: 248769 - RNA, 63 nt, Homo Sapiens
gugggcgcuggguucaaauuuggugucauaggaaugaaggacuauguggugacucaugugaag

SEQ ID NO: 248770 - RNA, 63 nt, Homo Sapiens
cugcacuacaaacccaaauuuuguccuagucagaugaaggaggugcacaguucucucuucucc

SEQ ID NO: 248771 - RNA, 63 nt, Homo Sapiens
uuuuuaaccuuuguuuuguuggcaggguuggaaaugaaggacuauuccccacccacaccccca

SEQ ID NO: 248772 - RNA, 63 nt, Homo Sapiens
cuucaugcccuguuccccacacuagaagugcgcaugaaggauggagaccauaaaggcuucaaa

SEQ ID NO: 248773 - RNA, 63 nt, Homo Sapiens
gaggagggagagugggggucgauaaguccuuccaugaaggacucuccuagccacagcugccau

SEQ ID NO: 248774 - RNA, 63 nt, Homo Sapiens
uauugcuaaaaugaucugggauuaccagcaguuaugaaggaaagcugacuuggauaauucauu

SEQ ID NO: 248775 - RNA, 63 nt, Homo Sapiens
gcuuaaagguguuucaauuaggaaaguuuggggaugaaggagaucuaucauagacaccauagg

SEQ ID NO: 248776 - RNA, 63 nt, Homo Sapiens
ccaagaaugagaaaaagcaacuuucuagcaugaaugaaggaugacucucuguccccagauccu

SEQ ID NO: 248777 - RNA, 63 nt, Homo Sapiens
ucaagucuggaaaugggaaaagugagauagcugaugaaggauugguccugguuucaacaugga

SEQ ID NO: 248778 - RNA, 63 nt, Homo Sapiens
auuaauuccaagauuaaaaguuaaaucuucaauaugaaggacuuaagguacgcuugcuugucu

SEQ ID NO: 248779 - RNA, 63 nt, Homo Sapiens
guaaauaaaaaugcuaaauaauuuuaaucuguuaugaaggaagaacuauauucccaucccucu

SEQ ID NO: 248780 - RNA, 63 nt, Homo Sapiens
aucucuucgugcuaguacaguaauuuugcagaaaugaaggaaaauuagaugaauagagaauau

SEQ ID NO: 248781 - RNA, 63 nt, Homo Sapiens
uauuaaaauuuuugacuuaaacaauaacacucaaugaaggaugcuuaugucuuugguaaugaa

SEQ ID NO: 248782 - RNA, 63 nt, Homo Sapiens
aacuagugugauuucuaaucgccagcccugauaaugaaggaugcagaaacauucagguuugaa

SEQ ID NO: 248783 - RNA, 63 nt, Homo Sapiens
aaugaauccugaaggaagauauuacgaacaauaaugaaggacauuuugugcuggcuuugaaca

SEQ ID NO: 248784 - RNA, 63 nt, Homo Sapiens
gaagaauucaccauuagaggucucuagaagagaaugaaggauucuugaaagcgaugaagaaug

SEQ ID NO: 248785 - RNA, 63 nt, Homo Sapiens
agggggaaaaaaggugcaaauuguugaaagaaaaugaaggaacauaaaagaaaccuuuguugu

SEQ ID NO: 248786 - RNA, 63 nt, Homo Sapiens
gagauuuugccucucuuuuaauaaaaguaucucaugaaggaaagaguagagaaagagauaaaa

SEQ ID NO: 248787 - RNA, 63 nt, Homo Sapiens
guaugcuucaaauugucuuucuauccauguaucaugaaggacauucaaauguuuaaauaaugu

SEQ ID NO: 248788 - RNA, 63 nt, Homo Sapiens
uuacaaaaauaguagaacaagcaacauaaaacaaugaaggaaaaccucacuugaaggcccagg

SEQ ID NO: 248789 - RNA, 63 nt, Homo Sapiens
acuggaacuagugagcuguguccauggugugucaugaaggauguaccccagagaguaacauga

SEQ ID NO: 248790 - RNA, 63 nt, Homo Sapiens
ugggagugcaaaaaaaacaaagccaaaaaauauaugaaggauagcuguucuucuguguucucu

SEQ ID NO: 248791 - RNA, 59 nt, Homo Sapiens
ugaucagccagccuaacugaagaugauguaugaaggaguuggaguuguugaaaccaagg

SEQ ID NO: 248792 - RNA, 63 nt, Homo Sapiens
uacuugcucuuggccuugagaucguguaacaaaaugaaggagggcucucuucuuucuuccuca

SEQ ID NO: 248793 - RNA, 63 nt, Homo Sapiens
guaagucuuugcauuuaagacauccaaucaauaaugaaggaaauuuuuuucugaauguagguu

SEQ ID NO: 248794 - RNA, 63 nt, Homo Sapiens
gacauuuuugauaaauuauguuuguacuaguugaugaaggaguuuuuuuuaaccuguuuauau

SEQ ID NO: 248795 - RNA, 63 nt, Homo Sapiens
uauaaauuguugagaaauuuuugugauuagaauaugaaggaaaaagcuuuguugguaaaagug

SEQ ID NO: 248796 - RNA, 63 nt, Homo Sapiens
ccuuuauaauuuagaaagagacugcguugagacaugaaggaucagaaggaauuuccuauuuuc

SEQ ID NO: 248797 - RNA, 63 nt, Homo Sapiens
ggaaaaaucauucaaguggcaugccaagucccuaugaaggaagggcugcuaucaaaccuaccu

SEQ ID NO: 248798 - RNA, 63 nt, Homo Sapiens
aaggcccuggggauuccacuccaguaaaguagaaugaaggauacaaaugauaaaaauuacacu

SEQ ID NO: 248799 - RNA, 63 nt, Homo Sapiens
cucaggaccccguggaauugcaucuucugcaggaugaaggagucuccgggaagccaacagugu

SEQ ID NO: 248800 - RNA, 63 nt, Homo Sapiens
uuuccagauaacaacacuaagguuuuauucgacaugaaggaaauauuaugagucaaucuaguu

SEQ ID NO: 248801 - RNA, 63 nt, Homo Sapiens
aucacccagaaugcuucugccuuauuguuggccaugaaggaaaugcaacaugggagagaaguu

SEQ ID NO: 248802 - RNA, 63 nt, Homo Sapiens
ugcucaucuaagcaaaagauaaagacguuugugaugaaggaacuguaaugcacauggcaaagc

SEQ ID NO: 248803 - RNA, 63 nt, Homo Sapiens
gaaucuuuuuuuccuaaauccuuauuuggaaggaugaaggaauguuauugaguuguacuguac

SEQ ID NO: 248804 - RNA, 63 nt, Homo Sapiens
caucucaagucagcucccuagggccacuaggggaugaaggaccccagcccuguccucauccua

SEQ ID NO: 248805 - RNA, 63 nt, Homo Sapiens
ugccaguccccgaucgcugcaaaacacagaagaaugaaggacauccccuuuacaagaaaaucg

SEQ ID NO: 248806 - RNA, 63 nt, Homo Sapiens
guuuugguuuuggucugcagcaugcgagaaaacaugaaggaggaauagggcaaguuuauguuu

SEQ ID NO: 248807 - RNA, 63 nt, Homo Sapiens
gcauccuagugaagaagcagcccuacugggaugaugaaggaugguucuaagcgggagaugacu

SEQ ID NO: 248808 - RNA, 63 nt, Homo Sapiens
aagcuuuguugguaaaaguguugugauuagaauaugaaggaaauauaaauuguugagaaauuu

SEQ ID NO: 248809 - RNA, 63 nt, Homo Sapiens
gcuuaaagcccaagcagauaaucugucacuugaaugaaggaaaagcaucccgucaaaggcaga

SEQ ID NO: 248810 - RNA, 63 nt, Homo Sapiens
guguaugaguugcauuuguaagagaaaggguccaugaaggaaauuuuuuaacauguguuaaac

SEQ ID NO: 248811 - RNA, 63 nt, Homo Sapiens
guuuuauaguaauuuaauuuaaauguuuuacagaugaaggaauuuuuaauuugaggggaaaag

SEQ ID NO: 248812 - RNA, 63 nt, Homo Sapiens
ucuuauuuucuuggaauuuuauaaagaaaaucaaugaaggauucaaauuagcaaucauuuuau

SEQ ID NO: 248813 - RNA, 63 nt, Homo Sapiens
cuacaaguguguguguauauaacuaugaaauaaaugaaggaaggcaaguaccaggaugaaaag

SEQ ID NO: 248814 - RNA, 63 nt, Homo Sapiens
gauaugcacugaaacauguguacaaguuagcacaugaaggauaagcaguuaacugaccuuuua

SEQ ID NO: 248815 - RNA, 59 nt, Homo Sapiens
aucucuucucagaaggaaagaaaccaucgaugaaggaauaugucucuuccaaccucuga

SEQ ID NO: 248816 - RNA, 63 nt, Homo Sapiens
agucauuaaaaacaguugccagugauaaucugcaugaaggaaaaagaacccugcaaauggcua

SEQ ID NO: 248817 - RNA, 63 nt, Homo Sapiens
cggaacgucagccagcucccagccacauggcgcaugaaggagagcccagucucccuccaggaa

SEQ ID NO: 248818 - RNA, 63 nt, Homo Sapiens
gugggugugaaagguuuccaaaaaaaguucagcaugaaggaugccauauauguuguugccaac

SEQ ID NO: 248819 - RNA, 63 nt, Homo Sapiens
auggggcuaggaugagagagaaugccacagaguaugaaggaagagugauagauccagaugaga

SEQ ID NO: 248820 - RNA, 63 nt, Homo Sapiens
uugggugagaugcaacuaacagccccuuccuggaugaaggagucaaagaauaaagcuugccua

SEQ ID NO: 248821 - RNA, 63 nt, Homo Sapiens
guagaggggcagguagaguuccuggagggaaggaugaaggagccuuggcuacuguacucugag

SEQ ID NO: 248822 - RNA, 63 nt, Homo Sapiens
aaugcucucagugucugccccaaguaccaccucaugaaggaugccacugcuuucugugcagaa

SEQ ID NO: 248823 - RNA, 63 nt, Homo Sapiens
aauuucuaacaaucaucaguuaggaauauuaacaugaaggauaaaccaacuuauuuguauacc

SEQ ID NO: 248824 - RNA, 63 nt, Homo Sapiens
uuuuauuggucaugagaacaaauggaugugaucaugaaggaaucagauucccuauguaaagca

SEQ ID NO: 248825 - RNA, 63 nt, Homo Sapiens
gaagauuaggaugacuaaauuaauggggaaaugaugaaggaguuugaaucucuucuuugugaa

SEQ ID NO: 248826 - RNA, 63 nt, Homo Sapiens
uuaaauacauggaaggaaguccgggagaaccauaugaaggagcaggaggagaggaagaaacuu

SEQ ID NO: 248827 - RNA, 63 nt, Homo Sapiens
caauaccaugauuccuuccauuuucaacaguagaugaaggaaaugauacugaaugagucacag

SEQ ID NO: 248828 - RNA, 63 nt, Homo Sapiens
ccaugguuuuccugaaauccucaauucaucaauaugaaggaaaugaaccacauagacuuuaug

SEQ ID NO: 248829 - RNA, 63 nt, Homo Sapiens
cuugcacacaugcacccccuucucuugucaggaaugaaggauggccaacauuagcguuggucu

SEQ ID NO: 248830 - RNA, 63 nt, Homo Sapiens
auagguagcccagagaagaagagcaccugcuucaugaaggaagagaugauucuuccggguccu

SEQ ID NO: 248831 - RNA, 63 nt, Homo Sapiens
guaaugcaauaccuccaccuccauuauggauggaugaaggauacaggugcuuugaagaggaag

SEQ ID NO: 248832 - RNA, 63 nt, Homo Sapiens
uuauuuggcauauaaaauuuuuccuuuucuuauaugaaggaccuacugaaaauugauauuauu

SEQ ID NO: 248833 - RNA, 63 nt, Homo Sapiens
cugaccugacuauccaugccgccacagauuggcaugaaggaucagagguggggacagcaagaa

SEQ ID NO: 248834 - RNA, 63 nt, Homo Sapiens
guaguuuuauucugaagguaucuaauuggauaaaugaaggagauccuucacuuugagcagugu

SEQ ID NO: 248835 - RNA, 63 nt, Homo Sapiens
agaacauugacaagcuaagauggaacacaaauaaugaaggagccuggauuugguugaccuuug

SEQ ID NO: 248836 - RNA, 63 nt, Homo Sapiens
uucccuaagcaguugggaagagcagaaaaugaaaugaaggaauauuucuguuaucuagagguu

SEQ ID NO: 248837 - RNA, 63 nt, Homo Sapiens
uaauaguugagaauugcuuuuuugaaaauuuucaugaaggaauuuugguaaugacuuugcuug

SEQ ID NO: 248838 - RNA, 63 nt, Homo Sapiens
ggacacauuuaacaaguaacauuucuagggaaaaugaaggaaguaccacaaacuggcuagaaa

SEQ ID NO: 248839 - RNA, 63 nt, Homo Sapiens
gacucagugccaugcagaagccuuuuuuuuaagaugaaggaaauauuuuauguaaagagcaac

SEQ ID NO: 248840 - RNA, 63 nt, Homo Sapiens
acuugggaugagugaaaaauuacaucauuggacaugaaggaguuucaacauccagcuucaucu

SEQ ID NO: 248841 - RNA, 63 nt, Homo Sapiens
uuucccuuucuuuaaaagaaacuuaacuguucuaugaaggagauugagggagaagagacaaac

SEQ ID NO: 248842 - RNA, 63 nt, Homo Sapiens
uuaaaauuuccagaauuuuaagcaaaaagcauuaugaaggaaggcuugguuuaauaaagacug

SEQ ID NO: 248843 - RNA, 63 nt, Homo Sapiens
uaacuucuaauggccaucuguaaaccauaaguaaugaaggacuccacugugccccacuuucug

SEQ ID NO: 248844 - RNA, 63 nt, Homo Sapiens
uauuuaugaacugugauaaagcaucaaaucuugaugaaggauuguagauuuuugcuuuuucuu

SEQ ID NO: 248845 - RNA, 63 nt, Homo Sapiens
aacaauucuucauuuaccuaguauuaugaaagaaugaaggaguucaaacaaauguguuuccca

SEQ ID NO: 248846 - RNA, 63 nt, Homo Sapiens
ggggaaacacaccuaggugcuggugaugggcuuaugaaggaagcuaagcacggcugcucacug

SEQ ID NO: 248847 - RNA, 63 nt, Homo Sapiens
gaugaaucugaacaucucuccaucuagagcccaaugaaggaagcuucaaaugagaacaugaug

SEQ ID NO: 248848 - RNA, 63 nt, Homo Sapiens
uauauguauagugaacauauugcuuaguaacaaaugaaggacaagcauacuacauaauauaau

SEQ ID NO: 248849 - RNA, 63 nt, Homo Sapiens
ggaaucagggguuuggaaggaguagggaggagaaugaaggaaaaugcaaccagcaugauuaua

SEQ ID NO: 248850 - RNA, 63 nt, Homo Sapiens
uaaacuauuucacugaaaaaaauaugucucuauaugaaggaaccaugguuguuaacauugugu

SEQ ID NO: 248851 - RNA, 63 nt, Homo Sapiens
auaucuagugguauuucacacucucuaaauaaaaugaaggacuauaaaaucagaaacuucaag

SEQ ID NO: 248852 - RNA, 63 nt, Homo Sapiens
aaaaugcacagggagucugugcuggaaggggaaaugaaggacaagggcaguauuaaccaccau

SEQ ID NO: 248853 - RNA, 63 nt, Homo Sapiens
ugaaauaagguauaaggaucguauguauaaauuaugaaggaccuugcugugcuguacauuacu

SEQ ID NO: 248854 - RNA, 63 nt, Homo Sapiens
ugucugugguuuuucaauggaauuaccuaugucaugaaggaccaaaugucuuuagguugaagg

SEQ ID NO: 248855 - RNA, 63 nt, Homo Sapiens
ccaaaauaaauauuucugcaauuuccaaaaacaaugaaggaaaguuuuauaaaccaaaacaaa

SEQ ID NO: 248856 - RNA, 63 nt, Homo Sapiens
gaucagauacaugaacauguagcuguacauaggaugaaggagacaguguagucauucauuucu

SEQ ID NO: 248857 - RNA, 63 nt, Homo Sapiens
guggccuuccccgggcgguaaagaggugaaaggaugaaggagggcuggggggggccccauuua

SEQ ID NO: 248858 - RNA, 63 nt, Homo Sapiens
auuuuaaugaaggcucuuuucagauguaaccuuaugaaggaaauaucugcuuuguguauaugc

SEQ ID NO: 248859 - RNA, 63 nt, Homo Sapiens
cuauuuuuuuaaaaucacuaacauuauauugcaaugaaggaaauaaaaaagucucuauuuaaa

SEQ ID NO: 248860 - RNA, 63 nt, Homo Sapiens
augauuuauuugaagauggagcacugcugauuuaugaaggaaaaaagaagaauuuucuaaaga

SEQ ID NO: 248861 - RNA, 63 nt, Homo Sapiens
ggagucugcuguugucagaaggcagggagggugaugaaggacugacccacauggacugggaug

SEQ ID NO: 248862 - RNA, 63 nt, Homo Sapiens
uugggauuuucaauggaauaagggaggguugccaugaaggaaccugcuggggugugagggcag

SEQ ID NO: 248863 - RNA, 63 nt, Homo Sapiens
uaaauaaacuaagauauucccugcaaauggccaaugaaggaggcauuuuucaaggagaagagc

SEQ ID NO: 248864 - RNA, 63 nt, Homo Sapiens
ggggcgagggaggggggugggcucuaacuggacaugaaggaaaaucugcugcaccuuguaaau

SEQ ID NO: 248865 - RNA, 63 nt, Homo Sapiens
auaaucuaaaucauuagggcucccccagguucaaugaaggauaaaguucugucagacuccauc

SEQ ID NO: 248866 - RNA, 63 nt, Homo Sapiens
ggggaagcuuauuucaaucauagauauauuaacaugaaggaauuaauuucuauucaauauugc

SEQ ID NO: 248867 - RNA, 63 nt, Homo Sapiens
acacaaaccagagaaugacaauacuccagcaaaaugaaggaguuagggaagcuguuggagaaa

SEQ ID NO: 248868 - RNA, 63 nt, Homo Sapiens
aaaagcugcuacuccuaguagaugugagcgugcaugaaggaaaaugugugcagagguggugug

SEQ ID NO: 248869 - RNA, 63 nt, Homo Sapiens
ucacuguaagacucauucccuuugguaggccuaaugaaggaguauuuugaugccaagaaagua

SEQ ID NO: 248870 - RNA, 63 nt, Homo Sapiens
cuuggagaagaggaagaauaguccaucagcacaaugaaggagaccuggcccugccagcuggua

SEQ ID NO: 248871 - RNA, 63 nt, Homo Sapiens
gcgcuuccgcgagcacccuggcugcccguguuaaugaaggacagacgcuucuagggggcucug

SEQ ID NO: 248872 - RNA, 63 nt, Homo Sapiens
aaacgucuggcuaugugaagucccauccagccgaugaaggagcugguuaaaaggguucuuugu

SEQ ID NO: 248873 - RNA, 63 nt, Homo Sapiens
ugaagcuggagaggaagguacuggugauucagcaugaaggaaaggacagccaugugggacccc

SEQ ID NO: 248874 - RNA, 63 nt, Homo Sapiens
gcaccaagcaccuuuuugaaaaacauugcauccaugaaggacaagugacuuggacuguaaaug

SEQ ID NO: 248875 - RNA, 63 nt, Homo Sapiens
accagacugaccacaagaacugucaucucaucaaugaaggaguaacugaucaaugaagccagc

SEQ ID NO: 248876 - RNA, 63 nt, Homo Sapiens
auaguucuggccagaccccguuccccuuccucuaugaaggaauaaguuggaccaagggaaguc

SEQ ID NO: 248877 - RNA, 63 nt, Homo Sapiens
gcaugacaacucguguguaugagaaggagggauaugaaggaagauggcuugcagaguaagucg

SEQ ID NO: 248878 - RNA, 63 nt, Homo Sapiens
aaggagggagcuacucucaggcugcaaguaaguaugaaggaggcugaucccugagauccuugg

SEQ ID NO: 248879 - RNA, 63 nt, Homo Sapiens
uguguagcuggggauggggauuccuaggggcagaugaaggacaagccccacuggagugggguu

SEQ ID NO: 248880 - RNA, 63 nt, Homo Sapiens
uucucuccuuuccucauccuaagugccuggcagaugaaggaguuuucaggagcuuuugacacu

SEQ ID NO: 248881 - RNA, 63 nt, Homo Sapiens
guuuuacuuccuuguuaacauauaaaguuauaaaugaaggacaaggaggagauggaaaaugug

SEQ ID NO: 248882 - RNA, 63 nt, Homo Sapiens
acuuaauguguguccucaucuuuuuacaaauaaaugaaggauuauaaaugaugucagcauuuu

SEQ ID NO: 248883 - RNA, 63 nt, Homo Sapiens
guagaccuguuuggggucuacuauuguuuuagaaugaaggaauuguauuauuguguguauaua

SEQ ID NO: 248884 - RNA, 63 nt, Homo Sapiens
acuuucuuugucaaucuauggacaugcccauauaugaaggagaugggugggucaaaaagggau

SEQ ID NO: 248885 - RNA, 63 nt, Homo Sapiens
ucaugugaauuuccaaguuuuaauucguucuccaugaaggauuuucauuucagugaaagucgc

SEQ ID NO: 248886 - RNA, 63 nt, Homo Sapiens
caugccugauauuucagcccauugacuugcuggaugaaggacuagaauacagcagcuguuaua

SEQ ID NO: 248887 - RNA, 63 nt, Homo Sapiens
ggcaaggaaaagccccacaagugucauuuccacaugaaggagacuuuaaagagcgaaaugagu

SEQ ID NO: 248888 - RNA, 63 nt, Homo Sapiens
guaauuccuagcaguuuauuauaaaaugucaauaugaaggacucacgucuagcagacuuuaca

SEQ ID NO: 248889 - RNA, 63 nt, Homo Sapiens
uggaguagauuauuucaaaguuuccuuuauggaaugaaggauuucuacuguuuuaagcuuuag

SEQ ID NO: 248890 - RNA, 63 nt, Homo Sapiens
augaauauuuguagagucuccuuaaaauuuuuaaugaaggauaaucaaucaaaauguuuguaa

SEQ ID NO: 248891 - RNA, 63 nt, Homo Sapiens
cgguaauggcaggaauagcagugauacucuaccaugaaggaugacaaccagaaacuuuuacuu

SEQ ID NO: 248892 - RNA, 63 nt, Homo Sapiens
aauucuauggaaauuacaaacagaaacuauacaaugaaggaaguuuugaguaaauuuaugcag

SEQ ID NO: 248893 - RNA, 63 nt, Homo Sapiens
uugauugcuuugcugcacagucaggcuguuauuaugaaggaauccucagauugcugaauccca

SEQ ID NO: 248894 - RNA, 63 nt, Homo Sapiens
uaauaaagugauagacagggcgcuacuaaaagaaugaaggaaacauucuagcccagagacugu

SEQ ID NO: 248895 - RNA, 63 nt, Homo Sapiens
caucuuuguauauuuacauguuuuuuaauuucuaugaaggaucucgaaaugagcucaaauuga

SEQ ID NO: 248896 - RNA, 63 nt, Homo Sapiens
gagacugcuucucccaaacauaacgcguuagccaugaaggagucggagcccuggguccgaaug

SEQ ID NO: 248897 - RNA, 63 nt, Homo Sapiens
ucuggugacuuugacacugaagcggaagagccaaugaaggacugcaguauuugugugcccgau

SEQ ID NO: 248898 - RNA, 63 nt, Homo Sapiens
guccaagaaagaaagcuucuugauugagguagcaugaaggaugaggcuucagcccccauuguc

SEQ ID NO: 248899 - RNA, 63 nt, Homo Sapiens
gugacacaccgugagacaggugaggugauggugaugaaggagcugauccgguucgacgaggag

SEQ ID NO: 248900 - RNA, 63 nt, Homo Sapiens
uaauuagauuauguauagggguaacuggaagccaugaaggaaggacuuaaccaggcuaccaag

SEQ ID NO: 248901 - RNA, 63 nt, Homo Sapiens
aaaaguugacucuacccccuaauuugguaggagaugaaggagaaaaggauggcauugaauuau

SEQ ID NO: 248902 - RNA, 63 nt, Homo Sapiens
gcauaaccauucauuagggaguacuuuacaagcaugaaggauauuaggguaaguggcuaauua

SEQ ID NO: 248903 - RNA, 63 nt, Homo Sapiens
aagcacuggaauguuuugugagauuauuuuuauaugaaggaauagccugaacucaaacagaug

SEQ ID NO: 248904 - RNA, 63 nt, Homo Sapiens
uuugauugacaauauauccaguccaauauaaguaugaaggauucucucuccugagauuguagc

SEQ ID NO: 248905 - RNA, 63 nt, Homo Sapiens
aacuggcuguacaauaucuaaaaagaaagugacaugaaggaagcaaucuacaacuuccuuccg

SEQ ID NO: 248906 - RNA, 63 nt, Homo Sapiens
aguugccaaacguugcaggaccgcacggagaagaugaaggagaucguaggguggaugccccug

SEQ ID NO: 248907 - RNA, 63 nt, Homo Sapiens
gcagcugcucaagcaguucaggcuacagcucagaugaaggagggacgaagaacaucaaguuua

SEQ ID NO: 248908 - RNA, 63 nt, Homo Sapiens
aagaugugcucucagaauggccgggcccaagagaugaaggaaaggagugaaagggaaguagga

SEQ ID NO: 248909 - RNA, 63 nt, Homo Sapiens
auuuuuguauuuuucucugguugggaguaugauaugaaggaucaagauccucaacucacacau

SEQ ID NO: 248910 - RNA, 63 nt, Homo Sapiens
cuuuggcaaaaagugaacacaauucaaauacgaaugaaggaagagcccucagauggaacgaaa

SEQ ID NO: 248911 - RNA, 63 nt, Homo Sapiens
agccucuauugauacuugguucccacagcucgcaugaaggaacuuauucaaugauguauauac

SEQ ID NO: 248912 - RNA, 63 nt, Homo Sapiens
ugucucaggagcuugauccaagcacuauuauggaugaaggacgugcaggacggaauauagagg

SEQ ID NO: 248913 - RNA, 63 nt, Homo Sapiens
uuaauguaaauuagaugcaagaugugaaauuaaaugaaggauagcucauuaaaauauuccucu

SEQ ID NO: 248914 - RNA, 63 nt, Homo Sapiens
caggcuuccaggccuggcuuccuugggggcuccaugaaggaugccuccccagccauccucccg

SEQ ID NO: 248915 - RNA, 63 nt, Homo Sapiens
auguggaaaaaauccuuagcccugaugaaacagaugaaggaagaaaguaaauuaaaaacaaaa

SEQ ID NO: 248916 - RNA, 63 nt, Homo Sapiens
agagagcucauuuagaagucccuuauccuucugaugaaggaugcaaagagugcaggccagguu

SEQ ID NO: 248917 - RNA, 63 nt, Homo Sapiens
uggaugucauccaaacuuuauccuccccacugcaugaaggacuaguuuaagaaaaaaaaauau

SEQ ID NO: 248918 - RNA, 63 nt, Homo Sapiens
uacagaauauucuuugcguuggcagcaaagcuuaugaaggagggucaugagaguggggagaca

SEQ ID NO: 248919 - RNA, 63 nt, Homo Sapiens
uucagucuugucuuugauauggucaccaugccaaugaaggaagagggcugcaccucccacggu

SEQ ID NO: 248920 - RNA, 63 nt, Homo Sapiens
ggaccucuccacacagguguggagagcaaggucaugaaggaggcugaggagacaaccagauca

SEQ ID NO: 248921 - RNA, 63 nt, Homo Sapiens
uuguuuucuucucuuuuugucucaagauuguauaugaaggaggcuuuucuucucagcuaacag

SEQ ID NO: 248922 - RNA, 63 nt, Homo Sapiens
uggaagcaggucugaggucagaagaaguagagaaugaaggaaaaggugaaugcuaugaaauug

SEQ ID NO: 248923 - RNA, 63 nt, Homo Sapiens
cagucaaggaaaggccacuuaaggaucugcucuaugaaggagaagaaagaggaaaaagaagua

SEQ ID NO: 248924 - RNA, 63 nt, Homo Sapiens
caugcacaagcuaaacauaauuugaaugggucuaugaaggaaaaauaaugcuuagacuuuggu

SEQ ID NO: 248925 - RNA, 63 nt, Homo Sapiens
aaaauuuugaguuaaguugcauuucuuugggcuaugaaggaguccucuuaaguuugauagaaa

SEQ ID NO: 248926 - RNA, 63 nt, Homo Sapiens
guuguagcacgaaagcagccagguaauuacuagaugaaggaaugcagguggcuguguuucaau

SEQ ID NO: 248927 - RNA, 63 nt, Homo Sapiens
guuuuguaaguuugaaucucgcugagaaguaauaugaaggagcacauggcccugcguugcaaa

SEQ ID NO: 248928 - RNA, 63 nt, Homo Sapiens
ccaagaguuuaugcuaugggcugucaugagugcaugaaggaggaggcuucugaagguugcugu

SEQ ID NO: 248929 - RNA, 63 nt, Homo Sapiens
gaagcagcagcgggccggcacuggauuuucgugaugaaggacgcagagaugauggaugagcag

SEQ ID NO: 248930 - RNA, 63 nt, Homo Sapiens
acgacguuucuuuucucauggcugcagauggagaugaaggaggcuggcacaugagaucgagcg

SEQ ID NO: 248931 - RNA, 63 nt, Homo Sapiens
gaggcuccagggugagaaggcccucgggcccuuaugaaggacucuggccccaccccgccacuu

SEQ ID NO: 248932 - RNA, 63 nt, Homo Sapiens
uacaggugugugugcacaugugcauaugccuguaugaaggagaaccccgauuggugagggcuc

SEQ ID NO: 248933 - RNA, 63 nt, Homo Sapiens
aagucugcccuuugccauacggcagcagaguggaugaaggagucaguguguucaccucaucaa

SEQ ID NO: 248934 - RNA, 63 nt, Homo Sapiens
auugacucaagggugccuggguagcucuggacaaugaaggacagugcucugaaaugccacuug

SEQ ID NO: 248935 - RNA, 63 nt, Homo Sapiens
uagauuuguguacuuguguuccauacaccagcaaugaaggagauuugugaugguguucugggu

SEQ ID NO: 248936 - RNA, 63 nt, Homo Sapiens
ccaacuagaagacagauauuuggaaacaaaaacaugaaggacuuauucucauuuucucugagu

SEQ ID NO: 248937 - RNA, 63 nt, Homo Sapiens
ggauuuggcucgcugugguuaaccucuguucucaugaaggagaucugcuguugauuccacuga

SEQ ID NO: 248938 - RNA, 63 nt, Homo Sapiens
cauacucagauaucagucugcuagaacuuuaaaaugaaggacaaauccuguuaaagaaauauu

SEQ ID NO: 248939 - RNA, 63 nt, Homo Sapiens
cuugugcccccagaugggccaaagaaagagccuaugaaggagaagcagaagcagacggcuggc

SEQ ID NO: 248940 - RNA, 63 nt, Homo Sapiens
acuugaagaauacauauacuuauauucggggauaugaaggauucaaugaaugaucucuagaaa

SEQ ID NO: 248941 - RNA, 63 nt, Homo Sapiens
ugcaggcggaacugagaccagccucucugggcgaugaaggacaauggugguagggccacuuag

SEQ ID NO: 248942 - RNA, 63 nt, Homo Sapiens
accucuuugggccucaguuuccccaucuguaaaaugaaggaguuggaccaaugcccccucccc

SEQ ID NO: 248943 - RNA, 63 nt, Homo Sapiens
cuuuuuuuaaaaaaaugugaaggauauauucccaugaaggauuucuccauauaauugauuauu

SEQ ID NO: 248944 - RNA, 63 nt, Homo Sapiens
ucauugaaaaagagaacaguagaguuugacuuuaugaaggagggaugggcuuaaguuugggcu

SEQ ID NO: 248945 - RNA, 63 nt, Homo Sapiens
cucugcagggugaagcaccaccuguccuaggucaugaaggacaggcccucagcucccugaccc

SEQ ID NO: 248946 - RNA, 63 nt, Homo Sapiens
aaugacuuuauugcaucuggguagcuguaaggcaugaaggaugccaagaaguuuaaggaauau

SEQ ID NO: 248947 - RNA, 63 nt, Homo Sapiens
guuagaaguagaugacuucaauuaaacaaauuuaugaaggacauuauucugauucauaaaagu

SEQ ID NO: 248948 - RNA, 63 nt, Homo Sapiens
cacucuauaaaaucauggcaauaauagaagauuaugaaggauuucuauggaggacauaaaugc

SEQ ID NO: 248949 - RNA, 63 nt, Homo Sapiens
auauuaagguucuccuugcccugaagcuucaggaugaaggacaggaagcugaaggagaaaagu

SEQ ID NO: 248950 - RNA, 63 nt, Homo Sapiens
uaucucaucuauggacuugccaaacagucuuuuaugaaggaaaguuacaguauuaauuuuuga

SEQ ID NO: 248951 - RNA, 63 nt, Homo Sapiens
acagccucaguagucugcccaguguccacauuaaugaaggauccauguuuguagugagagaaa

SEQ ID NO: 248952 - RNA, 63 nt, Homo Sapiens
uagaaaguuugcugaaagcaaagggcuaagcuuaugaaggaaugccuccuuuguuacacacuc

SEQ ID NO: 248953 - RNA, 63 nt, Homo Sapiens
ggguaacugggguugagggccaaaauauuuggaaugaaggacuuuggcccuauuuaaggcaga

SEQ ID NO: 248954 - RNA, 63 nt, Homo Sapiens
gcggggagcccaaggacauaacaaauuaaaagcaugaaggagagaaaaaugggggucguggcu

SEQ ID NO: 248955 - RNA, 63 nt, Homo Sapiens
auuguucucuauccuccccuucugccuuucaaaaugaaggaacaccuugaacaagucagcauc

SEQ ID NO: 248956 - RNA, 63 nt, Homo Sapiens
ggccaccuuguaagagacauaagaacugcugucaugaaggaggcaguguuaccagagcccagu

SEQ ID NO: 248957 - RNA, 63 nt, Homo Sapiens
uccaaauaacucaccuacagcauuuuuauuuaaaugaaggaaugaagucaugaaguuuuuuug

SEQ ID NO: 248958 - RNA, 63 nt, Homo Sapiens
uuggauuuacugagaacucaucuccuacaugucaugaaggaccgucauccuggugcuuguacu

SEQ ID NO: 248959 - RNA, 63 nt, Homo Sapiens
uggggucuggguuuuuagccggacaacaggcuaaugaaggauuuaguucagagaauugucuua

SEQ ID NO: 248960 - RNA, 63 nt, Homo Sapiens
uucugcaagaggcugccucccggagcaaagucuaugaaggaucaguuaagugugaggcacucc

SEQ ID NO: 248961 - RNA, 63 nt, Homo Sapiens
uguucagugcuauucucccagcuagguuuauccaugaaggacugagugaccuuuguuguauuu

SEQ ID NO: 248962 - RNA, 63 nt, Homo Sapiens
aaaagaagaagaaaagagaagaaggagaaggagaugaaggaggaggaggaggagaaggagaag

SEQ ID NO: 248963 - RNA, 63 nt, Homo Sapiens
cuugguuaauagaaucuacuaucuggaagauaaaugaaggauuuuaauaaaauuuucaauaga

SEQ ID NO: 248964 - RNA, 63 nt, Homo Sapiens
ccauuuaauaguuauaacgucguuacuuguacuaugaaggaaaauacucagugucagcuugag

SEQ ID NO: 248965 - RNA, 63 nt, Homo Sapiens
cucccgggucuccagccuccgaccccucgccccaugaaggagcuggcagguggaaauaaacaa

SEQ ID NO: 248966 - RNA, 63 nt, Homo Sapiens
aaaaaaaccuccugggacuguugcaaggaugaaaugaaggauugagggauugagggauugcug

SEQ ID NO: 248967 - RNA, 63 nt, Homo Sapiens
ccgcugggggugggggcggguguccguccggaaaugaaggaauagcccgaggaccgggcuggg

SEQ ID NO: 248968 - RNA, 63 nt, Homo Sapiens
ggaggauauuccucggaaaaacagacuuugggaaugaaggagggacucaggaucauuguuauc

SEQ ID NO: 248969 - RNA, 63 nt, Homo Sapiens
uuaaaugaagaaauuagugaaaaaauugaccuaaugaaggaaacauuugugcuuuccuauauu

SEQ ID NO: 248970 - RNA, 63 nt, Homo Sapiens
agcggggagccaggaaagaagaguuggagugagaugaaggaaggacuaugacaaauaaaaaag

SEQ ID NO: 248971 - RNA, 63 nt, Homo Sapiens
uuuuggcuuucuuuuuucccacagcaacugccaaugaaggaugaauccccuuuuuaaaaaguu

SEQ ID NO: 248972 - RNA, 63 nt, Homo Sapiens
ggacugcagccuuggccuaggaacgggcuguggaugaaggaguugaagugagacccuugggga

SEQ ID NO: 248973 - RNA, 63 nt, Homo Sapiens
uagcagcccuggguucuccuuguggggagaaauaugaaggaggugaccugugaccagguccaa

SEQ ID NO: 248974 - RNA, 63 nt, Homo Sapiens
uuucuaucauuuccauuuuagggauaauuaagaaugaaggacuguuaauauauaagaaaucug

SEQ ID NO: 248975 - RNA, 63 nt, Homo Sapiens
ugaaaguauccuggaucaaccauuucaaaaaugaugaaggaaguuggcuuuuugaaaaacaag

SEQ ID NO: 248976 - RNA, 63 nt, Homo Sapiens
gaggcugagagaagaaggaagguaaagacagggaugaaggauaggcugggacaugggggugug

SEQ ID NO: 248977 - RNA, 63 nt, Homo Sapiens
accccaucacucucuuuguugucuucagaauguaugaaggaugcgauggaugcgagugcggcg

SEQ ID NO: 248978 - RNA, 63 nt, Homo Sapiens
uugaagaugagagcuaaaccccaggauguagaaaugaaggacccaaaagaagacaaaagcccc

SEQ ID NO: 248979 - RNA, 63 nt, Homo Sapiens
agaagacgcauggcucauggcauccacuuugacaugaaggacacaaagaucagagcaggugag

SEQ ID NO: 248980 - RNA, 63 nt, Homo Sapiens
guagaaaaugcuggugggucaggaaggagaaguaugaaggaagucucaggguuuaaaacugug

SEQ ID NO: 248981 - RNA, 63 nt, Homo Sapiens
aaaggaagggaaaacugauggcagaggcagaagaugaaggacacaggacagcugcuguggggu

SEQ ID NO: 248982 - RNA, 63 nt, Homo Sapiens
cagaggggccaaagggugggacuguaugaagccaugaaggaaacuuacgaauguacaacacaa

SEQ ID NO: 248983 - RNA, 63 nt, Homo Sapiens
uugggacuaguuuauaggagucagugaaggcccaugaaggaaaauuagaaugcuacaaguaac

SEQ ID NO: 248984 - RNA, 63 nt, Homo Sapiens
ggaggaagaggcgguggcuggucccaguuugggaugaaggaaagccagaacuugaagucuuuu

SEQ ID NO: 248985 - RNA, 63 nt, Homo Sapiens
agggucagggcuggccuuccggcaggccuguggaugaaggaggugccaccucccucucucuga

SEQ ID NO: 248986 - RNA, 63 nt, Homo Sapiens
ugcuagaugucaucucuggauugcacauggaugaugaaggaacucagcauugaaaguuggggg

SEQ ID NO: 248987 - RNA, 63 nt, Homo Sapiens
uguuaacaucuuugaucaguggguguaucuguaaugaaggagguucaagaggcugugcuuucc

SEQ ID NO: 248988 - RNA, 63 nt, Homo Sapiens
guuuggacauacauaaggagagaagguacagugaugaaggagaccauaauucuguaguguuga

SEQ ID NO: 248989 - RNA, 63 nt, Homo Sapiens
auauagcacuuuuauguucauauuuuuuuuuuaaugaaggaaacguucaauaagugagucaug

SEQ ID NO: 248990 - RNA, 63 nt, Homo Sapiens
cagucaacuguggcaccuguaaccucccggaacaugaaggacuaugcucugaggcuauacucu

SEQ ID NO: 248991 - RNA, 63 nt, Homo Sapiens
uuccucagcuucuucacaggcacuccuggagauaugaaggauuacucuccauaucccuuccuc

SEQ ID NO: 248992 - RNA, 63 nt, Homo Sapiens
aacagaacagaaagguguggugcuggaacaucgaugaaggagcccuacuuacugagcuuaguu

SEQ ID NO: 248993 - RNA, 63 nt, Homo Sapiens
uucccuggccccgccggauguauaaauguaaaaaugaaggaauuacauuuuauaugugagcga

SEQ ID NO: 248994 - RNA, 63 nt, Homo Sapiens
cacccuugcuguucuucucaaucucuugcucuaaugaaggaacuguguaucucaaaaaccaua

SEQ ID NO: 248995 - RNA, 63 nt, Homo Sapiens
aauuauacuuaagaucuucaauuucuucaaaaaaugaaggaucaaaauuuuccaguucuuuuu

SEQ ID NO: 248996 - RNA, 63 nt, Homo Sapiens
gccauugucauccauuucccaguuagggcaacaaugaaggaggacccagccaagcuagaagga

SEQ ID NO: 248997 - RNA, 63 nt, Homo Sapiens
aagcccugggccacugccauuggguuagucaagaugaaggaggaggacuggcugccuccauuu

SEQ ID NO: 248998 - RNA, 63 nt, Homo Sapiens
ucucugaaagcuguccuuucagaugagggagaaaugaaggauuucacacuucagaauauuuua

SEQ ID NO: 248999 - RNA, 63 nt, Homo Sapiens
gugaggguguuagcagugugucucuuccuguugaugaaggagcguuaaagaggguccuguucc

SEQ ID NO: 249000 - RNA, 63 nt, Homo Sapiens
agaaauccaauaaaagaguuaauuuggaaugaaaugaaggaaucacauuuuuaucuagaugaa

SEQ ID NO: 249001 - RNA, 63 nt, Homo Sapiens
gugcaccuccacuccaacaguaggcugccuaugaugaaggaccuuccuaagaugcaucucgca

SEQ ID NO: 249002 - RNA, 63 nt, Homo Sapiens
ggauucuuaaauaagaccuacgucacauuauaaaugaaggagucuaugucagagccacauucc

SEQ ID NO: 249003 - RNA, 63 nt, Homo Sapiens
uugaucgugaauuuuuuuagccucauaaaaugcaugaaggacuaugauuuuaauccagaacuu

SEQ ID NO: 249004 - RNA, 63 nt, Homo Sapiens
acauuuuuauacagaaggcauggccagcauuucaugaaggauaaaaaguucugccauguuaag

SEQ ID NO: 249005 - RNA, 63 nt, Homo Sapiens
gcgggaagcuauccagaagucagaacugcacugaugaaggagagacagcuguugaucuuguug

SEQ ID NO: 249006 - RNA, 63 nt, Homo Sapiens
ucaaagcaccugaacaguuucacaaaaaagaaaaugaaggaccauaauucuggauuuucuuau

SEQ ID NO: 249007 - RNA, 63 nt, Homo Sapiens
gacccagugauaaaaacuuccuuuuagggaucaaugaaggagagaaggucuuggaaucaccuu

SEQ ID NO: 249008 - RNA, 63 nt, Homo Sapiens
gauuuuaaaaguuuuacauguaggagugugggaaugaaggaauucuggagcuuuuugacacaa

SEQ ID NO: 249009 - RNA, 63 nt, Homo Sapiens
accccaguggugggacccuggaccaggccauggaugaaggacaaagaccagggcaggucacgg

SEQ ID NO: 249010 - RNA, 63 nt, Homo Sapiens
acuaauuuauaacuuguucugauggcaguuccaaugaaggacacaccuaaaaaagaguguguu

SEQ ID NO: 249011 - RNA, 63 nt, Homo Sapiens
gugugucagauggucuuuauauauuuuuucuguaugaaggaauagccuugccuacugaagaua

SEQ ID NO: 249012 - RNA, 62 nt, Homo Sapiens
ccagaaaauccaauccuuaaaucaacugcuugaugaaggaggcaaaacaaaggcagcaggag

SEQ ID NO: 249013 - RNA, 63 nt, Homo Sapiens
ggcauaggaaaauuuucccagaaguagggagaaaugaaggaagaauuggugacccaacccuag

SEQ ID NO: 249014 - RNA, 63 nt, Homo Sapiens
uaucauuuauuuaagcagccuccaacacaaugaaugaaggaaacccccuuuccacugggcccu

SEQ ID NO: 249015 - RNA, 63 nt, Homo Sapiens
aaacuguucaagaacaaaaucagguguauaauuaugaaggagaaagagagacuaucgaucggc

SEQ ID NO: 249016 - RNA, 63 nt, Homo Sapiens
ugagguuuuguuucaccuguuuaauguuuuugaaugaaggaaacaagugaguggagaguguuu

SEQ ID NO: 249017 - RNA, 63 nt, Homo Sapiens
agcuccuauguaucagguuaggagcauuuggaaaugaaggacuaaccaugcacuccacaaagg

SEQ ID NO: 249018 - RNA, 63 nt, Homo Sapiens
guguguagcaugggggugugcacugagaaggagaugaaggaguaugcggcugggguaugaaaa

SEQ ID NO: 249019 - RNA, 63 nt, Homo Sapiens
aauacaacacauacucaagcgccagauguuaagaugaaggagguaaccucuuucuucucaugu

SEQ ID NO: 249020 - RNA, 63 nt, Homo Sapiens
ugauuaauagcaaauuggcauggcuaccugcucaugaaggacuaccgugucagcaugguugcc

SEQ ID NO: 249021 - RNA, 63 nt, Homo Sapiens
ucagaaauuuguaauaaaugcaaauacuugcuuaugaaggauuauuuuccauuuuuguuuaau

SEQ ID NO: 249022 - RNA, 63 nt, Homo Sapiens
cccauacagccugucucccaguuccaucugcacaugaaggacccacagcugugaggcgaugcu

SEQ ID NO: 249023 - RNA, 63 nt, Homo Sapiens
gagguaacuaguucaguuuguugggauggaagcaugaaggaaagggcuagagaaguaugaaau

SEQ ID NO: 249024 - RNA, 63 nt, Homo Sapiens
gauacauugagauagaauuaaggaaaaacuuuaaugaaggaauguacccauguacauauguga

SEQ ID NO: 249025 - RNA, 63 nt, Homo Sapiens
aauuuuguuuugcuugcuguuuuaacuugacagaugaaggacuuuaguugaacuucauauugu

SEQ ID NO: 249026 - RNA, 63 nt, Homo Sapiens
gucugggucuauucccacacuuacugaguacagaugaaggaaagugguagcaauuuaaucaua

SEQ ID NO: 249027 - RNA, 63 nt, Homo Sapiens
aagaucacaugaggguaguauuuaauauauuagaugaaggacaacuuuggacauaacacugac

SEQ ID NO: 249028 - RNA, 63 nt, Homo Sapiens
aaguaauugaucguuugcugccagcccagaaggaugaaggaaagaagcaccucacagcuccuu

SEQ ID NO: 249029 - RNA, 63 nt, Homo Sapiens
gcugggggcaucggcaaggccaagcugcgcagcaugaaggagcgaaagcuggagaagaagcag

SEQ ID NO: 249030 - RNA, 63 nt, Homo Sapiens
cucuuucuuacaaaacaaaaacuaaguuacugaaugaaggaacgaaauauuuauuaagggaaa

SEQ ID NO: 249031 - RNA, 63 nt, Homo Sapiens
ggaagaccucaagaaaaauuccacuucauccagaugaaggaaaugacacaggagggcugggcu

SEQ ID NO: 249032 - RNA, 63 nt, Homo Sapiens
gcuauucuuuacagcauuuaaaccuaguauuguaugaaggauaugacauacuaaaaaaaauaa

SEQ ID NO: 249033 - RNA, 63 nt, Homo Sapiens
aaagguugagagaacauuuagccuuuugaaaagaugaaggaacuacagaaggaaagagaucuu

SEQ ID NO: 249034 - RNA, 63 nt, Homo Sapiens
gcccugcguucugugcuucuggcccagggcagcaugaaggagacugcaugccuggcgagcugg

SEQ ID NO: 249035 - RNA, 63 nt, Homo Sapiens
uuccagaagagacuagagaccuuaggccaggagaugaaggaguucaguagcaaagucacaccu

SEQ ID NO: 249036 - RNA, 63 nt, Homo Sapiens
uucuacaguugauauauuuguaacugguacaagaugaaggacagcagcuuuccaucccuaguu

SEQ ID NO: 249037 - RNA, 63 nt, Homo Sapiens
uucaggggcaguggggggcuccaggcacggucaaugaaggaaacagugccuguccacccaccc

SEQ ID NO: 249038 - RNA, 63 nt, Homo Sapiens
ggggaucucagcgcagagaaguugagaggacccaugaaggaagcaaggacacggggcaggcac

SEQ ID NO: 249039 - RNA, 63 nt, Homo Sapiens
auagagccccuccccagggccccacccugccauaugaaggaccccacccccgacaccacaagg

SEQ ID NO: 249040 - RNA, 63 nt, Homo Sapiens
uggacauaaagucaaagaaugauggcagguaggaugaaggagagauacuuaggaaauccuaaa

SEQ ID NO: 249041 - RNA, 63 nt, Homo Sapiens
guuuuuaagggcuuuauuauagaagaaguauuaaugaaggacuuuccuuccucccucccuuuc

SEQ ID NO: 249042 - RNA, 63 nt, Homo Sapiens
uuuccauauguuuuauauaaauauauauauaauaugaaggacuacccuccuuuuuuuuuuuug

SEQ ID NO: 249043 - RNA, 63 nt, Homo Sapiens
uagaagcuuagcugccucaguaaaggaaacuucaugaaggaugaacugucuucugucgagaag

SEQ ID NO: 249044 - RNA, 63 nt, Homo Sapiens
aaguuuuguauuugugaccuggggacagaggccaugaaggagcuugucuggugguggggggca

SEQ ID NO: 249045 - RNA, 63 nt, Homo Sapiens
uuauguugugcucuuuauugggcacgaugacgcaugaaggagagcuggcuggcucagcuaagu

SEQ ID NO: 249046 - RNA, 63 nt, Homo Sapiens
uuguuuaauaaauggacgugguauuaaauugucaugaaggaacacuaaucguuaauaacuauu

SEQ ID NO: 249047 - RNA, 63 nt, Homo Sapiens
uggugcucuauuuguaauagguugagauuuggcaugaaggauauggaguuaaaaagagcuuuu

SEQ ID NO: 249048 - RNA, 63 nt, Homo Sapiens
cugcucugaggaacagacagagcugccgcugugaugaaggagcagcaccgagaaccaucugug

SEQ ID NO: 249049 - RNA, 63 nt, Homo Sapiens
auucucccauuuuugagccauuucuuuuuaggaaugaaggaaaacagcuucuauuggacauau

SEQ ID NO: 249050 - RNA, 63 nt, Homo Sapiens
uaccuaaggaaaaagacaguuuuucuagguaccaugaaggaagauugacccuguugguaugcc

SEQ ID NO: 249051 - RNA, 63 nt, Homo Sapiens
cuucuccugcugauagcagucagcuugaggaggaugaaggaaggcagccucagacaggaauua

SEQ ID NO: 249052 - RNA, 63 nt, Homo Sapiens
uucacugcgucauuguaacaugaagggauaaaaaugaaggagaaggaggguuugggaugggug

SEQ ID NO: 249053 - RNA, 63 nt, Homo Sapiens
caccccugcccccugguucaccagagggagcggaugaaggauggcagcaucucacaugcccca

SEQ ID NO: 249054 - RNA, 63 nt, Homo Sapiens
agucagacuggggugcaggaccuguccaccucaaugaaggagagaggagcauggggugucccg

SEQ ID NO: 249055 - RNA, 63 nt, Homo Sapiens
aaaacuguauugaaaaaauauuguuuaaugcaaaugaaggaaugcaauaaagaguaaauauac

SEQ ID NO: 249056 - RNA, 63 nt, Homo Sapiens
agguuggaggacaccgacuaauuugggaaacggaugaaggacugagaaggcccccgcucccuc

SEQ ID NO: 249057 - RNA, 63 nt, Homo Sapiens
agcuggagaaaagaagacaagaaagucuugggcaugaaggagcuuuuugcaucuagugggugg

SEQ ID NO: 249058 - RNA, 63 nt, Homo Sapiens
aggagcaugguuuggugguuaagguuuagugggaugaaggaccugucuuggugggccgggccc

SEQ ID NO: 249059 - RNA, 63 nt, Homo Sapiens
aaaagccccgggaucuguuugguagcaggagaaaugaaggaagaugaaaaagcaggcagggaa

SEQ ID NO: 249060 - RNA, 63 nt, Homo Sapiens
gguugggaaaugucccucaaaauccugggcacuaugaaggaacccccugcccccucaccuuuu

SEQ ID NO: 249061 - RNA, 63 nt, Homo Sapiens
aauuauuucccccaagguagugaaguaauuggaaugaaggaggcugaaaguauugucuaaagu

SEQ ID NO: 249062 - RNA, 63 nt, Homo Sapiens
aaacaggcaacguguucuuguaaccuuuauuucaugaaggacuucuuuuuguuucuaacuaua

SEQ ID NO: 249063 - RNA, 63 nt, Homo Sapiens
aacucuuuuauuaaacuuggaacaaccauuuaaaugaaggauuuugugagauagaauucaauu

SEQ ID NO: 249064 - RNA, 63 nt, Homo Sapiens
ggggacggggugaguggaaacuuaguuugaguaaugaaggaaucuucacagaagcaaaucaga

SEQ ID NO: 249065 - RNA, 63 nt, Homo Sapiens
acugagugacccagaaggggcuauaucaaggacaugaaggagaagugacaaguggguccagga

SEQ ID NO: 249066 - RNA, 63 nt, Homo Sapiens
uuggucauuuuggacacuuagagucaugggcaaaugaaggacuuuugagguaguuguccguuu

SEQ ID NO: 249067 - RNA, 63 nt, Homo Sapiens
ugggcccagaaucauguggccuugaacuuggacaugaaggaugugauuuucucuuuucaacuu

SEQ ID NO: 249068 - RNA, 63 nt, Homo Sapiens
cugcuagagaguuaccaugccccaugucccggcaugaaggacacagcagugccugcccguguc

SEQ ID NO: 249069 - RNA, 63 nt, Homo Sapiens
aagugggguuccuccugacccacuuguugucccaugaaggaagagccccgcuucuucccacuc

SEQ ID NO: 249070 - RNA, 63 nt, Homo Sapiens
agggaaagagggcugccauugucuguuggagccaugaaggaaguauuaacccuuucagaccca

SEQ ID NO: 249071 - RNA, 63 nt, Homo Sapiens
aaacuugcagaauugggugucaaagggccuucuaugaaggacacugcacuuugcugcgaaaag

SEQ ID NO: 249072 - RNA, 63 nt, Homo Sapiens
cugaauagacuuggccaacuccauuccacuaucaugaaggacuuagugaauuaauuauucauu

SEQ ID NO: 249073 - RNA, 63 nt, Homo Sapiens
acuauuaacuggcuuucagcaauacaaaaacagaugaaggagaaugcaggagaugcuacacaa

SEQ ID NO: 249074 - RNA, 63 nt, Homo Sapiens
caaggaaauauagggaaaaguuaaaaauuuaggaugaaggaaaaaugauuacaguuuucauuu

SEQ ID NO: 249075 - RNA, 63 nt, Homo Sapiens
agcugguaaacugaagagcacaacuauauucuuaugaaggaauuuguaccuuugggguauuau

SEQ ID NO: 249076 - RNA, 63 nt, Homo Sapiens
agaagacauagacguugaaacagaaacagaaggaugaaggacaguuuuuuccuucuuaguuau

SEQ ID NO: 249077 - RNA, 63 nt, Homo Sapiens
aacacauucuuauuaauucuucaccuguuauguaugaaggaaucauuccagugcuagaaaauu

SEQ ID NO: 249078 - RNA, 63 nt, Homo Sapiens
gugaggcuccugcuuauuuaugacagcaugguaaugaaggacagauacugaugacaguguggg

SEQ ID NO: 249079 - RNA, 63 nt, Homo Sapiens
aggaucgguggcugggucugcugacauauaacuaugaaggaagagcaugcccaagacuauguc

SEQ ID NO: 249080 - RNA, 63 nt, Homo Sapiens
ugucaauaauugacagccaaacccuugugugaaaugaaggaacacaucacuaaacaaagguua

SEQ ID NO: 249081 - RNA, 63 nt, Homo Sapiens
uaaacaggguacuguacuggaucuuacuugucuaugaaggagaaguuacacuaacccuuaauu

SEQ ID NO: 249082 - RNA, 63 nt, Homo Sapiens
agcaucgcacauguccagcaguuuucagcagaaaugaaggauacugagggcgauuucggaaau

SEQ ID NO: 249083 - RNA, 63 nt, Homo Sapiens
aaaacccagugcccugguuuuuccccacccgagaugaaggauacgcuguauuuuuugccuaau

SEQ ID NO: 249084 - RNA, 63 nt, Homo Sapiens
cuuuuuuaacuguuaaaccaaaggaaagcacaaaugaaggaaauccuguguaaagcauugaga

SEQ ID NO: 249085 - RNA, 63 nt, Homo Sapiens
gaugagggugcaugaguguauguuugcauucacaugaaggaauugcuuuucacaccagaaauu

SEQ ID NO: 249086 - RNA, 63 nt, Homo Sapiens
agacacauaauugucagauucaccaaaguugaaaugaaggaaaaaauguuaagggcagccaga

SEQ ID NO: 249087 - RNA, 63 nt, Homo Sapiens
aacaccagcuuaccuuggaguaugaaucuacccaugaaggaugagagauguuuugaaaaacua

SEQ ID NO: 249088 - RNA, 63 nt, Homo Sapiens
gagaaaugugucaucaggagaacaucauaacccaugaaggauaaaagccccaaauggugguaa

SEQ ID NO: 249089 - RNA, 63 nt, Homo Sapiens
auuagcugaggauuauuucuauccaauuuccugaugaaggacauugccuuuugagauuaaaua

SEQ ID NO: 249090 - RNA, 63 nt, Homo Sapiens
guuggauugcagagacauuuucuggagugauccaugaaggaccauuaaccugugauaccuuuc

SEQ ID NO: 249091 - RNA, 63 nt, Homo Sapiens
uccuugcaaagagaauccuguacuucacucagaaugaaggaacaaguaucucaggaugaaauc

SEQ ID NO: 249092 - RNA, 63 nt, Homo Sapiens
uuauggaaggcgugcuaggcccaugucagcaauaugaaggauguguguguuucaagaaauuca

SEQ ID NO: 249093 - RNA, 63 nt, Homo Sapiens
guaaccaagaaaccucuagguugauguguuuuuaugaaggaaacucauaguguaaacucacau

SEQ ID NO: 249094 - RNA, 63 nt, Homo Sapiens
ucugagcaucagauaauccaguauaguaaagguaugaaggacuuuuuagacaaaaccuuuaaa

SEQ ID NO: 249095 - RNA, 63 nt, Homo Sapiens
gggccuggaaaggcaacuuugauagguguguuuaugaaggaugcccaggauaaaggacauccg

SEQ ID NO: 249096 - RNA, 63 nt, Homo Sapiens
uuggucuuugucugcaggugguugccucucacaaugaaggaaguauauugggugugaguucag

SEQ ID NO: 249097 - RNA, 63 nt, Homo Sapiens
ggccaugucuguccauuugaggaauaaauauaaaugaaggaggagagaagugugcaauagucu

SEQ ID NO: 249098 - RNA, 63 nt, Homo Sapiens
gaagccuuggcaaaaugaugaucagagaauuuaaugaaggaaauagaagacuuuuaggaaaau

SEQ ID NO: 249099 - RNA, 63 nt, Homo Sapiens
aaaaaggauacagaauuguacaguauacauaacaugaaggaauuauaauuauggacacugcau

SEQ ID NO: 249100 - RNA, 63 nt, Homo Sapiens
cucuaaacuccccuuauggucagauaauuaacaaugaaggaaaauuuagcccuuacucaaaau

SEQ ID NO: 249101 - RNA, 63 nt, Homo Sapiens
agaauagggaaaagcuuucauagaagaaaccccaugaaggaaauuuacuagaaaauaucaucu

SEQ ID NO: 249102 - RNA, 63 nt, Homo Sapiens
aacacccgucugggaaggccccaaggucagcuuaugaaggaccccacuugcaccccaccccag

SEQ ID NO: 249103 - RNA, 63 nt, Homo Sapiens
agcaagcaacuugcaggcuccauggaacuuuuaaugaaggacagugucuucuuugaagaaaau

SEQ ID NO: 249104 - RNA, 63 nt, Homo Sapiens
ugugcuugaauuuaguagcuuacagcauuauuuaugaaggaaaaaauacauaaauaugaagua

SEQ ID NO: 249105 - RNA, 63 nt, Homo Sapiens
ugagcccagguaagaccucucugaagagcugucaugaaggagggagggagcacauuccuggca

SEQ ID NO: 249106 - RNA, 63 nt, Homo Sapiens
aauucuaugagcaugccaaggcucugugggaggaugaaggagugcgugccugcuacgaacgcu

SEQ ID NO: 249107 - RNA, 63 nt, Homo Sapiens
uugauacccaccaaaagaauguaucucgaaagaaugaaggaagaagaaaaaaggauccuugau

SEQ ID NO: 249108 - RNA, 63 nt, Homo Sapiens
gugacaaggacgcccgaagcacaguggacggucaugaaggagcggggguguggcaggcgggug

SEQ ID NO: 249109 - RNA, 63 nt, Homo Sapiens
ggcuccuguucaucuuguggugcugugaaaugaaugaaggagauaagcucgccaagucugugu

SEQ ID NO: 249110 - RNA, 63 nt, Homo Sapiens
uguaaagcuuugcucaaaguugcuuuguaugguaugaaggauuauugacauuauuuucucauu

SEQ ID NO: 249111 - RNA, 63 nt, Homo Sapiens
acagaguucagggggaaaauaauacugugucucaugaaggauccuacacagcaagagaacaga

SEQ ID NO: 249112 - RNA, 63 nt, Homo Sapiens
auuuucuacauaauaugacauaagucuguuggcaugaaggaccguguucauguuuuauacaug

SEQ ID NO: 249113 - RNA, 63 nt, Homo Sapiens
ucaaggaaaccuugacuuauaccuagcugucauaugaaggaaaugcaaagaaacauauauuuu

SEQ ID NO: 249114 - RNA, 63 nt, Homo Sapiens
aaauagauucuuaaaguggcuuucaacuucaagaugaaggagcuuaauaaugguuacucauuu

SEQ ID NO: 249115 - RNA, 63 nt, Homo Sapiens
ugccccuccaguucugguucaccuguaccuucuaugaaggagaauucgucaugucauucaaca

SEQ ID NO: 249116 - RNA, 63 nt, Homo Sapiens
augaauucuggucacauuccauuucucuccaacaugaaggaucaaaaaauguuuuucaaugug

SEQ ID NO: 249117 - RNA, 63 nt, Homo Sapiens
cuggggcccaagaucaucauugugaagcggaugaugaaggacgucuucuucuuccucuuccug

SEQ ID NO: 249118 - RNA, 63 nt, Homo Sapiens
gucuucaaucauauuuuagucaccuuuaauaaaaugaaggaauuauucucuaguauauagcua

SEQ ID NO: 249119 - RNA, 63 nt, Homo Sapiens
aaauuauguuuuucaguuuaaugcuggagaaaaaugaaggaaaaccaugucugaccugcaaaa

SEQ ID NO: 249120 - RNA, 63 nt, Homo Sapiens
aaaaagaggcccugauaaacaaaggugucucauaugaaggauggagacuaaugcugugcuuca

SEQ ID NO: 249121 - RNA, 63 nt, Homo Sapiens
ccaagauaaauugcaugcggcauggccccagccaugaaggaacuuaaccgcuagugccgagga

SEQ ID NO: 249122 - RNA, 63 nt, Homo Sapiens
gaaucuucgaaauauguacacagagaaaaucacaugaaggagaccugggguccccacuuguga

SEQ ID NO: 249123 - RNA, 63 nt, Homo Sapiens
accccggacgccgagacugagaagcuuaucaggaugaaggaugaggaaguauguggggcggcg

SEQ ID NO: 249124 - RNA, 63 nt, Homo Sapiens
aacuaggcccugccucugucaccucauugguccaugaaggagcagccaggggugguggaagga

SEQ ID NO: 249125 - RNA, 63 nt, Homo Sapiens
accuucagagacagucuacgccuuaacaagcacaugaaggaaacuauuuugaauguucucuuu

SEQ ID NO: 249126 - RNA, 63 nt, Homo Sapiens
ccagugggaggaaaugaaguuuagaauagcuguaugaaggaaagugguguucugguaaaauug

SEQ ID NO: 249127 - RNA, 63 nt, Homo Sapiens
ggccaagacaaucauccacaccaccuugcuaccaugaaggaaagauggcuggaucuggggcag

SEQ ID NO: 249128 - RNA, 63 nt, Homo Sapiens
ccaggaagaucauggagaccaacugaugcuggcaugaaggauuugacaagcucagagagcaug

SEQ ID NO: 249129 - RNA, 63 nt, Homo Sapiens
ggguguguguguggcguugaaaacccucaucucaugaaggacgaaugugagauugaacugaac

SEQ ID NO: 249130 - RNA, 63 nt, Homo Sapiens
gaauaaagaguuuuuacugaggccaacugucacaugaaggaaucugucuuuguaacuacucaa

SEQ ID NO: 249131 - RNA, 63 nt, Homo Sapiens
ccaguuauuuaaccuguaaaaugucaauagcaaaugaaggaugaaguauaucucuagaugcaa

SEQ ID NO: 249132 - RNA, 63 nt, Homo Sapiens
guggcggaggaacuccugccacgccacugugucaugaaggaaagugaaagggaacgaggaagu

SEQ ID NO: 249133 - RNA, 63 nt, Homo Sapiens
agaggguuugcauuuuggauuaauucaugcaaaaugaaggaggaagccuggucuaagaagaua

SEQ ID NO: 249134 - RNA, 63 nt, Homo Sapiens
uguccaugaggagaaaaaaagcaugugucaugcaugaaggaaacugaacuugagguggccucc

SEQ ID NO: 249135 - RNA, 63 nt, Homo Sapiens
guuguaauauuuuuacaggauauuccuagguaaaugaaggagccuucaguuguaaauuucaau

SEQ ID NO: 249136 - RNA, 63 nt, Homo Sapiens
auacuccccuaucuuguccuagcccaggccuccaugaaggagaaccugguggcauugccccag

SEQ ID NO: 249137 - RNA, 63 nt, Homo Sapiens
gcacugugcauguaaacagguuccuuugcucagaugaaggaaguaggggguggggcuuuccuu

SEQ ID NO: 249138 - RNA, 63 nt, Homo Sapiens
ccggccccugccccgcccccaagcucggaucacaugaaggagacagcagcacccacccaugca

SEQ ID NO: 249139 - RNA, 63 nt, Homo Sapiens
uaucugaagaaaucacuacaaauugaaggcaagaugaaggaacuucuuuuaagccucugaaau

SEQ ID NO: 249140 - RNA, 63 nt, Homo Sapiens
gggcuauccugggaccucccguagggcaagaggaugaaggaagucaguauucuuuuucaacau

SEQ ID NO: 249141 - RNA, 63 nt, Homo Sapiens
cugagccaugaagugggaaggaugaggagagguaugaaggagcccgcuagagcuggaaggcag

SEQ ID NO: 249142 - RNA, 63 nt, Homo Sapiens
uccuuuuaaugcugcuuuuggauuguugauuuaaugaaggauucuuuuaaaaucauguaucuu

SEQ ID NO: 249143 - RNA, 63 nt, Homo Sapiens
uaggggguggggcuuuccuuuuccuuugcucagaugaaggaaggcacugugcauguaaacagg

SEQ ID NO: 249144 - RNA, 63 nt, Homo Sapiens
gaaaccuuggccuggucucgucugcguggugccaugaaggaaaugcagcacugcagaaaugcc

SEQ ID NO: 249145 - RNA, 63 nt, Homo Sapiens
gaaacaucauagaaacuguccuaugguguaaucaugaaggaguuauugucccuggcuuccuua

SEQ ID NO: 249146 - RNA, 63 nt, Homo Sapiens
ggcaacauccaaaauaguuauuucauguacaagaugaaggagacaauauuaaaucugcuggag

SEQ ID NO: 249147 - RNA, 64 nt, Homo Sapiens; identical to SEQ ID NO: 80199

SEQ ID NO: 249148 - RNA, 64 nt, Homo Sapiens; identical to SEQ ID NO: 80200

SEQ ID NO: 249149 - RNA, 64 nt, Homo Sapiens; identical to SEQ ID NO: 80201

SEQ ID NO: 249150 - RNA, 64 nt, Homo Sapiens; identical to SEQ ID NO: 80202

SEQ ID NO: 249151 - RNA, 64 nt, Homo Sapiens; identical to SEQ ID NO: 80203

SEQ ID NO: 249152 - RNA, 64 nt, Homo Sapiens; identical to SEQ ID NO: 80204

SEQ ID NO: 249153 - RNA, 64 nt, Homo Sapiens; identical to SEQ ID NO: 80205

SEQ ID NO: 249154 - RNA, 64 nt, Homo Sapiens; identical to SEQ ID NO: 80206

SEQ ID NO: 249155 - RNA, 64 nt, Homo Sapiens; identical to SEQ ID NO: 80207

SEQ ID NO: 249156 - RNA, 64 nt, Homo Sapiens; identical to SEQ ID NO: 80208

SEQ ID NO: 249157 - RNA, 64 nt, Homo Sapiens; identical to SEQ ID NO: 80209

SEQ ID NO: 249158 - RNA, 64 nt, Homo Sapiens; identical to SEQ ID NO: 80210

SEQ ID NO: 249159 - RNA, 64 nt, Homo Sapiens; identical to SEQ ID NO: 80211

SEQ ID NO: 249160 - RNA, 64 nt, Homo Sapiens; identical to SEQ ID NO: 80212

SEQ ID NO: 249161 - RNA, 64 nt, Homo Sapiens; identical to SEQ ID NO: 80213

SEQ ID NO: 249162 - RNA, 64 nt, Homo Sapiens; identical to SEQ ID NO: 80214

SEQ ID NO: 249163 - RNA, 64 nt, Homo Sapiens; identical to SEQ ID NO: 80215

SEQ ID NO: 249164 - RNA, 64 nt, Homo Sapiens; identical to SEQ ID NO: 80216

SEQ ID NO: 249165 - RNA, 64 nt, Homo Sapiens; identical to SEQ ID NO: 80217

SEQ ID NO: 249166 - RNA, 64 nt, Homo Sapiens; identical to SEQ ID NO: 80218

SEQ ID NO: 249167 - RNA, 64 nt, Homo Sapiens; identical to SEQ ID NO: 80219

SEQ ID NO: 249168 - RNA, 64 nt, Homo Sapiens; identical to SEQ ID NO: 80220

SEQ ID NO: 249169 - RNA, 64 nt, Homo Sapiens; identical to SEQ ID NO: 80221

SEQ ID NO: 249170 - RNA, 64 nt, Homo Sapiens; identical to SEQ ID NO: 80222

SEQ ID NO: 249171 - RNA, 64 nt, Homo Sapiens; identical to SEQ ID NO: 80223

SEQ ID NO: 249172 - RNA, 64 nt, Homo Sapiens; identical to SEQ ID NO: 80224

SEQ ID NO: 249173 - RNA, 64 nt, Homo Sapiens; identical to SEQ ID NO: 80225

SEQ ID NO: 249174 - RNA, 64 nt, Homo Sapiens; identical to SEQ ID NO: 80226

SEQ ID NO: 249175 - RNA, 64 nt, Homo Sapiens; identical to SEQ ID NO: 80227

SEQ ID NO: 249176 - RNA, 64 nt, Homo Sapiens; identical to SEQ ID NO: 80228

SEQ ID NO: 249177 - RNA, 64 nt, Homo Sapiens; identical to SEQ ID NO: 80229

SEQ ID NO: 249178 - RNA, 64 nt, Homo Sapiens; identical to SEQ ID NO: 80230

SEQ ID NO: 249179 - RNA, 64 nt, Homo Sapiens; identical to SEQ ID NO: 80231

SEQ ID NO: 249180 - RNA, 52 nt, Homo Sapiens; identical to SEQ ID NO: 80232

SEQ ID NO: 249181 - RNA, 64 nt, Homo Sapiens; identical to SEQ ID NO: 80233

SEQ ID NO: 249182 - RNA, 64 nt, Homo Sapiens; identical to SEQ ID NO: 80234

SEQ ID NO: 249183 - RNA, 64 nt, Homo Sapiens; identical to SEQ ID NO: 80235

SEQ ID NO: 249184 - RNA, 64 nt, Homo Sapiens; identical to SEQ ID NO: 80236

SEQ ID NO: 249185 - RNA, 64 nt, Homo Sapiens; identical to SEQ ID NO: 80237

SEQ ID NO: 249186 - RNA, 64 nt, Homo Sapiens; identical to SEQ ID NO: 80238

SEQ ID NO: 249187 - RNA, 64 nt, Homo Sapiens; identical to SEQ ID NO: 80239

SEQ ID NO: 249188 - RNA, 64 nt, Homo Sapiens; identical to SEQ ID NO: 80240

SEQ ID NO: 249189 - RNA, 64 nt, Homo Sapiens; identical to SEQ ID NO: 80241

SEQ ID NO: 249190 - RNA, 64 nt, Homo Sapiens; identical to SEQ ID NO: 80242

SEQ ID NO: 249191 - RNA, 64 nt, Homo Sapiens; identical to SEQ ID NO: 80243

SEQ ID NO: 249192 - RNA, 64 nt, Homo Sapiens; identical to SEQ ID NO: 80244

SEQ ID NO: 249193 - RNA, 64 nt, Homo Sapiens; identical to SEQ ID NO: 80245

SEQ ID NO: 249194 - RNA, 64 nt, Homo Sapiens; identical to SEQ ID NO: 80246

SEQ ID NO: 249195 - RNA, 64 nt, Homo Sapiens; identical to SEQ ID NO: 80247

SEQ ID NO: 249196 - RNA, 64 nt, Homo Sapiens; identical to SEQ ID NO: 80248

SEQ ID NO: 249197 - RNA, 64 nt, Homo Sapiens; identical to SEQ ID NO: 80249

SEQ ID NO: 249198 - RNA, 64 nt, Homo Sapiens; identical to SEQ ID NO: 80250

SEQ ID NO: 249199 - RNA, 64 nt, Homo Sapiens; identical to SEQ ID NO: 80251

SEQ ID NO: 249200 - RNA, 64 nt, Homo Sapiens; identical to SEQ ID NO: 80252

SEQ ID NO: 249201 - RNA, 64 nt, Homo Sapiens; identical to SEQ ID NO: 80253

SEQ ID NO: 249202 - RNA, 64 nt, Homo Sapiens; identical to SEQ ID NO: 80254

SEQ ID NO: 249203 - RNA, 64 nt, Homo Sapiens; identical to SEQ ID NO: 80255

SEQ ID NO: 249204 - RNA, 64 nt, Homo Sapiens; identical to SEQ ID NO: 80256

SEQ ID NO: 249205 - RNA, 64 nt, Homo Sapiens; identical to SEQ ID NO: 80257

SEQ ID NO: 249206 - RNA, 64 nt, Homo Sapiens; identical to SEQ ID NO: 80258

SEQ ID NO: 249207 - RNA, 64 nt, Homo Sapiens; identical to SEQ ID NO: 80259

SEQ ID NO: 249208 - RNA, 64 nt, Homo Sapiens; identical to SEQ ID NO: 80260

SEQ ID NO: 249209 - RNA, 64 nt, Homo Sapiens; identical to SEQ ID NO: 80261

SEQ ID NO: 249210 - RNA, 64 nt, Homo Sapiens; identical to SEQ ID NO: 80262

SEQ ID NO: 249211 - RNA, 64 nt, Homo Sapiens; identical to SEQ ID NO: 80263

SEQ ID NO: 249212 - RNA, 64 nt, Homo Sapiens; identical to SEQ ID NO: 80264

SEQ ID NO: 249213 - RNA, 64 nt, Homo Sapiens; identical to SEQ ID NO: 80265

SEQ ID NO: 249214 - RNA, 64 nt, Homo Sapiens; identical to SEQ ID NO: 80266

SEQ ID NO: 249215 - RNA, 64 nt, Homo Sapiens; identical to SEQ ID NO: 80267

SEQ ID NO: 249216 - RNA, 64 nt, Homo Sapiens; identical to SEQ ID NO: 80268

SEQ ID NO: 249217 - RNA, 64 nt, Homo Sapiens; identical to SEQ ID NO: 80269

SEQ ID NO: 249218 - RNA, 64 nt, Homo Sapiens; identical to SEQ ID NO: 80270

SEQ ID NO: 249219 - RNA, 64 nt, Homo Sapiens; identical to SEQ ID NO: 80271

SEQ ID NO: 249220 - RNA, 64 nt, Homo Sapiens; identical to SEQ ID NO: 80272

SEQ ID NO: 249221 - RNA, 64 nt, Homo Sapiens; identical to SEQ ID NO: 80273

SEQ ID NO: 249222 - RNA, 64 nt, Homo Sapiens; identical to SEQ ID NO: 80274

SEQ ID NO: 249223 - RNA, 64 nt, Homo Sapiens; identical to SEQ ID NO: 80275

SEQ ID NO: 249224 - RNA, 64 nt, Homo Sapiens; identical to SEQ ID NO: 80276

SEQ ID NO: 249225 - RNA, 64 nt, Homo Sapiens; identical to SEQ ID NO: 80277

SEQ ID NO: 249226 - RNA, 64 nt, Homo Sapiens; identical to SEQ ID NO: 80278

SEQ ID NO: 249227 - RNA, 64 nt, Homo Sapiens; identical to SEQ ID NO: 80279

SEQ ID NO: 249228 - RNA, 64 nt, Homo Sapiens; identical to SEQ ID NO: 80280

SEQ ID NO: 249229 - RNA, 64 nt, Homo Sapiens; identical to SEQ ID NO: 80281

SEQ ID NO: 249230 - RNA, 64 nt, Homo Sapiens; identical to SEQ ID NO: 80282

SEQ ID NO: 249231 - RNA, 64 nt, Homo Sapiens; identical to SEQ ID NO: 80283

SEQ ID NO: 249232 - RNA, 64 nt, Homo Sapiens; identical to SEQ ID NO: 80284

SEQ ID NO: 249233 - RNA, 64 nt, Homo Sapiens; identical to SEQ ID NO: 80285

SEQ ID NO: 249234 - RNA, 64 nt, Homo Sapiens; identical to SEQ ID NO: 80286

SEQ ID NO: 249235 - RNA, 64 nt, Homo Sapiens; identical to SEQ ID NO: 80287

SEQ ID NO: 249236 - RNA, 64 nt, Homo Sapiens; identical to SEQ ID NO: 80288

SEQ ID NO: 249237 - RNA, 64 nt, Homo Sapiens; identical to SEQ ID NO: 80289

SEQ ID NO: 249238 - RNA, 64 nt, Homo Sapiens; identical to SEQ ID NO: 80290

SEQ ID NO: 249239 - RNA, 64 nt, Homo Sapiens; identical to SEQ ID NO: 80291

SEQ ID NO: 249240 - RNA, 64 nt, Homo Sapiens; identical to SEQ ID NO: 80292

SEQ ID NO: 249241 - RNA, 64 nt, Homo Sapiens; identical to SEQ ID NO: 80293

SEQ ID NO: 249242 - RNA, 64 nt, Homo Sapiens; identical to SEQ ID NO: 80294

SEQ ID NO: 249243 - RNA, 64 nt, Homo Sapiens; identical to SEQ ID NO: 80295

SEQ ID NO: 249244 - RNA, 64 nt, Homo Sapiens; identical to SEQ ID NO: 80296

SEQ ID NO: 249245 - RNA, 64 nt, Homo Sapiens; identical to SEQ ID NO: 80297

SEQ ID NO: 249246 - RNA, 64 nt, Homo Sapiens; identical to SEQ ID NO: 80298

SEQ ID NO: 249247 - RNA, 64 nt, Homo Sapiens; identical to SEQ ID NO: 80299

SEQ ID NO: 249248 - RNA, 64 nt, Homo Sapiens; identical to SEQ ID NO: 80300

SEQ ID NO: 249249 - RNA, 64 nt, Homo Sapiens; identical to SEQ ID NO: 80301

SEQ ID NO: 249250 - RNA, 64 nt, Homo Sapiens; identical to SEQ ID NO: 80302

SEQ ID NO: 249251 - RNA, 64 nt, Homo Sapiens; identical to SEQ ID NO: 80303

SEQ ID NO: 249252 - RNA, 64 nt, Homo Sapiens; identical to SEQ ID NO: 80304

SEQ ID NO: 249253 - RNA, 64 nt, Homo Sapiens; identical to SEQ ID NO: 80305

SEQ ID NO: 249254 - RNA, 64 nt, Homo Sapiens; identical to SEQ ID NO: 80306

SEQ ID NO: 249255 - RNA, 64 nt, Homo Sapiens; identical to SEQ ID NO: 80307

SEQ ID NO: 249256 - RNA, 64 nt, Homo Sapiens; identical to SEQ ID NO: 80308

SEQ ID NO: 249257 - RNA, 64 nt, Homo Sapiens; identical to SEQ ID NO: 80309

SEQ ID NO: 249258 - RNA, 64 nt, Homo Sapiens; identical to SEQ ID NO: 80310

SEQ ID NO: 249259 - RNA, 64 nt, Homo Sapiens; identical to SEQ ID NO: 80311

SEQ ID NO: 249260 - RNA, 64 nt, Homo Sapiens; identical to SEQ ID NO: 80312

SEQ ID NO: 249261 - RNA, 64 nt, Homo Sapiens; identical to SEQ ID NO: 80313

SEQ ID NO: 249262 - RNA, 64 nt, Homo Sapiens; identical to SEQ ID NO: 80314

SEQ ID NO: 249263 - RNA, 64 nt, Homo Sapiens; identical to SEQ ID NO: 80315

SEQ ID NO: 249264 - RNA, 64 nt, Homo Sapiens; identical to SEQ ID NO: 80316

SEQ ID NO: 249265 - RNA, 64 nt, Homo Sapiens; identical to SEQ ID NO: 80317

SEQ ID NO: 249266 - RNA, 64 nt, Homo Sapiens; identical to SEQ ID NO: 80318

SEQ ID NO: 249267 - RNA, 64 nt, Homo Sapiens; identical to SEQ ID NO: 80319

SEQ ID NO: 249268 - RNA, 64 nt, Homo Sapiens; identical to SEQ ID NO: 80320

SEQ ID NO: 249269 - RNA, 64 nt, Homo Sapiens; identical to SEQ ID NO: 80321

SEQ ID NO: 249270 - RNA, 64 nt, Homo Sapiens; identical to SEQ ID NO: 80322

SEQ ID NO: 249271 - RNA, 64 nt, Homo Sapiens; identical to SEQ ID NO: 80323

SEQ ID NO: 249272 - RNA, 64 nt, Homo Sapiens; identical to SEQ ID NO: 80324

SEQ ID NO: 249273 - RNA, 51 nt, Homo Sapiens; identical to SEQ ID NO: 80325

SEQ ID NO: 249274 - RNA, 64 nt, Homo Sapiens; identical to SEQ ID NO: 80326

SEQ ID NO: 249275 - RNA, 64 nt, Homo Sapiens; identical to SEQ ID NO: 80327

SEQ ID NO: 249276 - RNA, 64 nt, Homo Sapiens; identical to SEQ ID NO: 80328

SEQ ID NO: 249277 - RNA, 64 nt, Homo Sapiens; identical to SEQ ID NO: 80329

SEQ ID NO: 249278 - RNA, 64 nt, Homo Sapiens; identical to SEQ ID NO: 80330

SEQ ID NO: 249279 - RNA, 62 nt, Homo Sapiens; identical to SEQ ID NO: 80331

SEQ ID NO: 249280 - RNA, 64 nt, Homo Sapiens; identical to SEQ ID NO: 80332

SEQ ID NO: 249281 - RNA, 64 nt, Homo Sapiens; identical to SEQ ID NO: 80333

SEQ ID NO: 249282 - RNA, 64 nt, Homo Sapiens; identical to SEQ ID NO: 80334

SEQ ID NO: 249283 - RNA, 54 nt, Homo Sapiens; identical to SEQ ID NO: 80335

SEQ ID NO: 249284 - RNA, 64 nt, Homo Sapiens; identical to SEQ ID NO: 80336

SEQ ID NO: 249285 - RNA, 64 nt, Homo Sapiens; identical to SEQ ID NO: 80337

SEQ ID NO: 249286 - RNA, 64 nt, Homo Sapiens; identical to SEQ ID NO: 80338

SEQ ID NO: 249287 - RNA, 64 nt, Homo Sapiens; identical to SEQ ID NO: 80339

SEQ ID NO: 249288 - RNA, 64 nt, Homo Sapiens; identical to SEQ ID NO: 80340

SEQ ID NO: 249289 - RNA, 64 nt, Homo Sapiens; identical to SEQ ID NO: 80341

SEQ ID NO: 249290 - RNA, 64 nt, Homo Sapiens; identical to SEQ ID NO: 80342

SEQ ID NO: 249291 - RNA, 64 nt, Homo Sapiens; identical to SEQ ID NO: 80343

SEQ ID NO: 249292 - RNA, 64 nt, Homo Sapiens; identical to SEQ ID NO: 80344

SEQ ID NO: 249293 - RNA, 64 nt, Homo Sapiens; identical to SEQ ID NO: 80345

SEQ ID NO: 249294 - RNA, 64 nt, Homo Sapiens; identical to SEQ ID NO: 80346

SEQ ID NO: 249295 - RNA, 64 nt, Homo Sapiens; identical to SEQ ID NO: 80347

SEQ ID NO: 249296 - RNA, 64 nt, Homo Sapiens; identical to SEQ ID NO: 80348

SEQ ID NO: 249297 - RNA, 64 nt, Homo Sapiens; identical to SEQ ID NO: 80349

SEQ ID NO: 249298 - RNA, 64 nt, Homo Sapiens; identical to SEQ ID NO: 80350

SEQ ID NO: 249299 - RNA, 64 nt, Homo Sapiens; identical to SEQ ID NO: 80351

SEQ ID NO: 249300 - RNA, 59 nt, Homo Sapiens; identical to SEQ ID NO: 80352

SEQ ID NO: 249301 - RNA, 64 nt, Homo Sapiens; identical to SEQ ID NO: 80353

SEQ ID NO: 249302 - RNA, 64 nt, Homo Sapiens; identical to SEQ ID NO: 80354

SEQ ID NO: 249303 - RNA, 64 nt, Homo Sapiens; identical to SEQ ID NO: 80355

SEQ ID NO: 249304 - RNA, 64 nt, Homo Sapiens; identical to SEQ ID NO: 80356

SEQ ID NO: 249305 - RNA, 64 nt, Homo Sapiens; identical to SEQ ID NO: 80357

SEQ ID NO: 249306 - RNA, 64 nt, Homo Sapiens; identical to SEQ ID NO: 80358

SEQ ID NO: 249307 - RNA, 64 nt, Homo Sapiens; identical to SEQ ID NO: 80359

SEQ ID NO: 249308 - RNA, 64 nt, Homo Sapiens; identical to SEQ ID NO: 80360

SEQ ID NO: 249309 - RNA, 64 nt, Homo Sapiens; identical to SEQ ID NO: 80361

SEQ ID NO: 249310 - RNA, 64 nt, Homo Sapiens; identical to SEQ ID NO: 80362

SEQ ID NO: 249311 - RNA, 64 nt, Homo Sapiens; identical to SEQ ID NO: 80363

SEQ ID NO: 249312 - RNA, 64 nt, Homo Sapiens; identical to SEQ ID NO: 80364

SEQ ID NO: 249313 - RNA, 64 nt, Homo Sapiens; identical to SEQ ID NO: 80365

SEQ ID NO: 249314 - RNA, 64 nt, Homo Sapiens; identical to SEQ ID NO: 80366

SEQ ID NO: 249315 - RNA, 64 nt, Homo Sapiens; identical to SEQ ID NO: 80367

SEQ ID NO: 249316 - RNA, 64 nt, Homo Sapiens; identical to SEQ ID NO: 80368

SEQ ID NO: 249317 - RNA, 64 nt, Homo Sapiens; identical to SEQ ID NO: 80369

SEQ ID NO: 249318 - RNA, 64 nt, Homo Sapiens; identical to SEQ ID NO: 80370

SEQ ID NO: 249319 - RNA, 64 nt, Homo Sapiens; identical to SEQ ID NO: 80371

SEQ ID NO: 249320 - RNA, 64 nt, Homo Sapiens; identical to SEQ ID NO: 80372

SEQ ID NO: 249321 - RNA, 64 nt, Homo Sapiens; identical to SEQ ID NO: 80373

SEQ ID NO: 249322 - RNA, 64 nt, Homo Sapiens; identical to SEQ ID NO: 80374

SEQ ID NO: 249323 - RNA, 64 nt, Homo Sapiens; identical to SEQ ID NO: 80375

SEQ ID NO: 249324 - RNA, 64 nt, Homo Sapiens; identical to SEQ ID NO: 80376

SEQ ID NO: 249325 - RNA, 64 nt, Homo Sapiens; identical to SEQ ID NO: 80377

SEQ ID NO: 249326 - RNA, 64 nt, Homo Sapiens; identical to SEQ ID NO: 80378

SEQ ID NO: 249327 - RNA, 64 nt, Homo Sapiens; identical to SEQ ID NO: 80379

SEQ ID NO: 249328 - RNA, 64 nt, Homo Sapiens; identical to SEQ ID NO: 80380

SEQ ID NO: 249329 - RNA, 64 nt, Homo Sapiens; identical to SEQ ID NO: 80381

SEQ ID NO: 249330 - RNA, 64 nt, Homo Sapiens; identical to SEQ ID NO: 80382

SEQ ID NO: 249331 - RNA, 64 nt, Homo Sapiens; identical to SEQ ID NO: 80383

SEQ ID NO: 249332 - RNA, 64 nt, Homo Sapiens; identical to SEQ ID NO: 80384

SEQ ID NO: 249333 - RNA, 64 nt, Homo Sapiens; identical to SEQ ID NO: 80385

SEQ ID NO: 249334 - RNA, 64 nt, Homo Sapiens; identical to SEQ ID NO: 80386

SEQ ID NO: 249335 - RNA, 64 nt, Homo Sapiens; identical to SEQ ID NO: 80387

SEQ ID NO: 249336 - RNA, 64 nt, Homo Sapiens; identical to SEQ ID NO: 80388

SEQ ID NO: 249337 - RNA, 64 nt, Homo Sapiens; identical to SEQ ID NO: 80389

SEQ ID NO: 249338 - RNA, 64 nt, Homo Sapiens; identical to SEQ ID NO: 80390

SEQ ID NO: 249339 - RNA, 64 nt, Homo Sapiens; identical to SEQ ID NO: 80391

SEQ ID NO: 249340 - RNA, 53 nt, Homo Sapiens; identical to SEQ ID NO: 80392

SEQ ID NO: 249341 - RNA, 64 nt, Homo Sapiens; identical to SEQ ID NO: 80393

SEQ ID NO: 249342 - RNA, 64 nt, Homo Sapiens; identical to SEQ ID NO: 80394

SEQ ID NO: 249343 - RNA, 64 nt, Homo Sapiens; identical to SEQ ID NO: 80395

SEQ ID NO: 249344 - RNA, 64 nt, Homo Sapiens; identical to SEQ ID NO: 80396

SEQ ID NO: 249345 - RNA, 64 nt, Homo Sapiens; identical to SEQ ID NO: 80397

SEQ ID NO: 249346 - RNA, 64 nt, Homo Sapiens; identical to SEQ ID NO: 80398

SEQ ID NO: 249347 - RNA, 64 nt, Homo Sapiens; identical to SEQ ID NO: 80399

SEQ ID NO: 249348 - RNA, 64 nt, Homo Sapiens; identical to SEQ ID NO: 80400

SEQ ID NO: 249349 - RNA, 64 nt, Homo Sapiens; identical to SEQ ID NO: 80401

SEQ ID NO: 249350 - RNA, 64 nt, Homo Sapiens; identical to SEQ ID NO: 80402

SEQ ID NO: 249351 - RNA, 64 nt, Homo Sapiens; identical to SEQ ID NO: 80403

SEQ ID NO: 249352 - RNA, 64 nt, Homo Sapiens; identical to SEQ ID NO: 80404

SEQ ID NO: 249353 - RNA, 64 nt, Homo Sapiens; identical to SEQ ID NO: 80405

SEQ ID NO: 249354 - RNA, 64 nt, Homo Sapiens; identical to SEQ ID NO: 80406

SEQ ID NO: 249355 - RNA, 64 nt, Homo Sapiens; identical to SEQ ID NO: 80407

SEQ ID NO: 249356 - RNA, 64 nt, Homo Sapiens; identical to SEQ ID NO: 80408

SEQ ID NO: 249357 - RNA, 64 nt, Homo Sapiens; identical to SEQ ID NO: 80409

SEQ ID NO: 249358 - RNA, 64 nt, Homo Sapiens; identical to SEQ ID NO: 80410

SEQ ID NO: 249359 - RNA, 64 nt, Homo Sapiens; identical to SEQ ID NO: 80411

SEQ ID NO: 249360 - RNA, 64 nt, Homo Sapiens; identical to SEQ ID NO: 80412

SEQ ID NO: 249361 - RNA, 64 nt, Homo Sapiens; identical to SEQ ID NO: 80413

SEQ ID NO: 249362 - RNA, 64 nt, Homo Sapiens; identical to SEQ ID NO: 80414

SEQ ID NO: 249363 - RNA, 64 nt, Homo Sapiens; identical to SEQ ID NO: 80415

SEQ ID NO: 249364 - RNA, 64 nt, Homo Sapiens; identical to SEQ ID NO: 80416

SEQ ID NO: 249365 - RNA, 64 nt, Homo Sapiens; identical to SEQ ID NO: 80417

SEQ ID NO: 249366 - RNA, 64 nt, Homo Sapiens; identical to SEQ ID NO: 80418

SEQ ID NO: 249367 - RNA, 58 nt, Homo Sapiens
aguguacaauucaguggugugaguauauucauaagauuuauacuuggugucuauucau

SEQ ID NO: 249368 - RNA, 58 nt, Homo Sapiens
auucauaagauuuauacuuggugucuauucauaagacuuauauccagcauauucauaa

SEQ ID NO: 249369 - RNA, 58 nt, Homo Sapiens
aacucagauucauuucaaaacaauuuuaucauaagaguugguuuguaauuauuugaug

SEQ ID NO: 249370 - RNA, 58 nt, Homo Sapiens
uucaauaucuccuucagauuauaaauuuucauaagauacuauuuauuagaagaguugg

SEQ ID NO: 249371 - RNA, 64 nt, Homo Sapiens
acgcaugaaggcaaaagcaggucagaagcgaauacucugccauuaucucaaaaaucuuuuuuuu

SEQ ID NO: 249372 - RNA, 64 nt, Homo Sapiens
gggauuacaggcaugagccaccgcgcccggcccacucugccauugucuaagccaccucugaaag

SEQ ID NO: 249373 - RNA, 64 nt, Homo Sapiens
gcaaaagggucuggcugucccuugcuguuuucaucucugccaagccuauugugccucuggcugc

SEQ ID NO: 249374 - RNA, 64 nt, Homo Sapiens
ccuccuccugcccuccccuucacucccucccuggcucugccagucgguucccacggagccauuu

SEQ ID NO: 249375 - RNA, 64 nt, Homo Sapiens
aguggugauggugguguccggguuugucagucaucucugccaaagaucugagaauguccuucuu

SEQ ID NO: 249376 - RNA, 64 nt, Homo Sapiens
aggugucuguccccggcccauggggagguggauccucugccagcagguguuugcucucuccuug

SEQ ID NO: 249377 - RNA, 64 nt, Homo Sapiens
gggccugggcaggcagccacccgugccgaaggagcucugccagucuucaagccuccccacucca

SEQ ID NO: 249378 - RNA, 64 nt, Homo Sapiens
guuuucugagaaauguagcacuugacucucccggcucugccacugucuugucuuuuguuccacu

SEQ ID NO: 249379 - RNA, 64 nt, Homo Sapiens
guggcuuccuuccauccuaucccugugccugucccucugccacauaacugccuuuaggucccaa

SEQ ID NO: 249380 - RNA, 64 nt, Homo Sapiens
ucucucucaucucuuauuucaauaaugucugcgccucugccaccauacauguaaaauaccaaga

SEQ ID NO: 249381 - RNA, 64 nt, Homo Sapiens
gucccugugggugaaacagaacaaucgcugcccucucugccagcaggacugggugguccaaaga

SEQ ID NO: 249382 - RNA, 64 nt, Homo Sapiens
uuuuuuuuuuuuuuuuugugggggugaagucuugcucugccacccaggcuggagugcaguggca

SEQ ID NO: 249383 - RNA, 64 nt, Homo Sapiens
uacuauaggcagucuucauugccauuuucauguucucugccaauaaaaucucuuuaccuccuug

SEQ ID NO: 249384 - RNA, 64 nt, Homo Sapiens
ccauaccacccuugguacugaguuuccugaguggcucugccaauaggaaguauaagucauugac

SEQ ID NO: 249385 - RNA, 64 nt, Homo Sapiens
gcacaugccgcgggcggccaggcaacgugcgugucucugccauguggcagaagugcucuuugug

SEQ ID NO: 249386 - RNA, 64 nt, Homo Sapiens
ggggagcugaaagggagccccuccucugagcagccucugccaggccuguaugaggcuuuuccca

SEQ ID NO: 249387 - RNA, 64 nt, Homo Sapiens
uugagccugggccacuccucccuggccuucuuaccucugccaagagccuccagaugugccugca

SEQ ID NO: 249388 - RNA, 64 nt, Homo Sapiens
cuccaggaucuccucucaccugcccccauuaaagcucugccacucaugcaggcauguguggacc

SEQ ID NO: 249389 - RNA, 64 nt, Homo Sapiens
uucaauacgaaucaucuuccuauguugucucucucucugccaauguggauaaauuggaauuuuu

SEQ ID NO: 249390 - RNA, 64 nt, Homo Sapiens
cacacaggaggagagcuggacugaaccccacacacucugccaugcacaccucgacacccaaccc

SEQ ID NO: 249391 - RNA, 63 nt, Homo Sapiens
auuuggugaaaacauccuagaugucaucacaaacucugccaaauuuguggaacuaugaaaugu

SEQ ID NO: 249392 - RNA, 64 nt, Homo Sapiens
aaugaaagcuuaaaugucccugcgaacccacaaucucugccagcagaacugguuuuguucugaa

SEQ ID NO: 249393 - RNA, 64 nt, Homo Sapiens
cuuguccuggccuuccucauauggggguaagccgcucugccacagcgugcugguacacugugcc

SEQ ID NO: 249394 - RNA, 64 nt, Homo Sapiens
uugccacccuggcacugaucucccugccauggggcucugccacucuuccagagcugguccuuac

SEQ ID NO: 249395 - RNA, 64 nt, Homo Sapiens
uaacuugucauuuucaguacuuauagauuaauuucucugccaauccgcucuggacacaacccuu

SEQ ID NO: 249396 - RNA, 64 nt, Homo Sapiens
cuaggcacacaugaauuauaggaaaaccccaggacucugccacuaacuguuucacucaugguau

SEQ ID NO: 249397 - RNA, 64 nt, Homo Sapiens
aguuccauuuuagacaaugaagcugcuuaguaaucucugccaagccaucucuuaauauuaaagc

SEQ ID NO: 249398 - RNA, 64 nt, Homo Sapiens
cuucaccaacaaaacuuggccucuuuugguuccacucugccacccugccauuggaacuuggauu

SEQ ID NO: 249399 - RNA, 64 nt, Homo Sapiens
aacuuggggacuagaccaccuuauguugagggaacucugccaccugcgugcaacccacagcuaa

SEQ ID NO: 249400 - RNA, 64 nt, Homo Sapiens
cugaccacucacgauaaagcagauuuuucucugccucugccacaagguuucagaguaguguagu

SEQ ID NO: 249401 - RNA, 64 nt, Homo Sapiens
ucugggagucccaggccaucgcccuaauaaaacccucugccaggaaacggugcaggccaggcgg

SEQ ID NO: 249402 - RNA, 64 nt, Homo Sapiens
cucggccucucccuccugagaauaggcccaggggcucugccagcgggagggguggcugcuugga

SEQ ID NO: 249403 - RNA, 64 nt, Homo Sapiens
cucugacgcaaaaccacuuucuuugagggacugccucugccacagcuaggggacaucagagguu

SEQ ID NO: 249404 - RNA, 64 nt, Homo Sapiens
gcagugcuagugagcugggccccgcacacccucacucugccagguggcuccaugcuccucacug

SEQ ID NO: 249405 - RNA, 64 nt, Homo Sapiens
gggaaacacacacagagauacacaugagugugaccucugccauguuuguuuuuguccaucaagg

SEQ ID NO: 249406 - RNA, 64 nt, Homo Sapiens
cacaacaaaacguaaguuucuucccaacaacauccucugccacaugcuucucuccucaucauca

SEQ ID NO: 249407 - RNA, 64 nt, Homo Sapiens
gccuuagagcaucucugccuccaacccagcaguucucugccaaagcuuguggaggagggagagc

SEQ ID NO: 249408 - RNA, 64 nt, Homo Sapiens
auggagcaggucuuugggaagcucccacacccaccucugccacucuuaacacuaagugagaguu

SEQ ID NO: 249409 - RNA, 64 nt, Homo Sapiens
caauccuaucccuaguucccguugcuaaucccggcucugccacugcaggucgcggaucucccca

SEQ ID NO: 249410 - RNA, 64 nt, Homo Sapiens
gaguugcugguugacugagggauuucaaucccaacucugccacuccuuggugucacaagucuug

SEQ ID NO: 249411 - RNA, 64 nt, Homo Sapiens
uuggugguugguggggcaggcugcaaaauggucacucugccaucugugcacugauucacacucc

SEQ ID NO: 249412 - RNA, 64 nt, Homo Sapiens
ugcuaggggaguugggaaagggcagccaagucagcucugccaacuaaaaucaccacguguaaga

SEQ ID NO: 249413 - RNA, 64 nt, Homo Sapiens
uccuccaucaguguguucugugcugcugugccugcucugccaacgcaugugcagcaucucgucg

SEQ ID NO: 249414 - RNA, 64 nt, Homo Sapiens
ccucggccacacguggcucccccuggggggcaggcucugccagccaccuccaggacucagugau

SEQ ID NO: 249415 - RNA, 64 nt, Homo Sapiens
gcccaggcugccguccccuagagucccagguuggcucugccaguccuguccuuuaccaaagaug

SEQ ID NO: 249416 - RNA, 64 nt, Homo Sapiens
ugcauggagaggccagggcuggggacaguccgcacucugccacccuccugccccuuccacccac

SEQ ID NO: 249417 - RNA, 64 nt, Homo Sapiens
aaugagcugucccccucccacugccaccuccagccucugccagcaaaagugauguccccuuucc

SEQ ID NO: 249418 - RNA, 64 nt, Homo Sapiens
uuccaugacugcauuuguucuggacugcuucagucucugccaucguggggaaauaaacugacuu

SEQ ID NO: 249419 - RNA, 64 nt, Homo Sapiens
ucucccuggcaaggcucuuccuuuucagggauaucucugccaaccccuccccuguccucggguu

SEQ ID NO: 249420 - RNA, 64 nt, Homo Sapiens
cagucccagcucugccucugacucgcugugugcccucugccaagucaugcccauucucuaguuc

SEQ ID NO: 249421 - RNA, 64 nt, Homo Sapiens
cugagccugagguauuucaugggcuuggcucccucucugccauagguaguguuggggccgggac

SEQ ID NO: 249422 - RNA, 64 nt, Homo Sapiens
ggugagguucuuggccucaggcaggacugcacaacucugccaggaucuggagagcaucaggccc

SEQ ID NO: 249423 - RNA, 64 nt, Homo Sapiens
cuucauccuuuuauccucccccuuuccucccucccucugccaucacaggguugcuaucccccuu

SEQ ID NO: 249424 - RNA, 59 nt, Homo Sapiens
ugcucccugccagcuuccccaccuguggccucugccacguugaaaggcucuuagucuaa

SEQ ID NO: 249425 - RNA, 64 nt, Homo Sapiens
uggcagcaggcggugggaugcuuguagcuccucacagcaggauuccugcccacuguuuuuucuc

SEQ ID NO: 249426 - RNA, 64 nt, Homo Sapiens
uggacacaauaugcccuuccgguucuauucaaaccagcaggaucugucggugcuuagagauggc

SEQ ID NO: 249427 - RNA, 64 nt, Homo Sapiens
agcucacccauucauucacccaacuuccuucauucagcaggagguccuauuacccucuccagcu

SEQ ID NO: 249428 - RNA, 64 nt, Homo Sapiens
ucucugcugcauccaacaugggagcagagacuggcagcaggaggggggaacauggugagaagug

SEQ ID NO: 249429 - RNA, 64 nt, Homo Sapiens
uagacagucgugccauucacaaagucagaaaauacagcaggaagagacagcuuuuagaggggca

SEQ ID NO: 249430 - RNA, 64 nt, Homo Sapiens
aaaagugauggaaugacuucugcaacuguagucccagcaggaacugugaagaccagcugcccug

SEQ ID NO: 249431 - RNA, 64 nt, Homo Sapiens
gacugagguuggguaggugugggguuccagaggacagcaggacacucucgcauacuuugccaaa

SEQ ID NO: 249432 - RNA, 64 nt, Homo Sapiens
gagcccccagacucugugcacuucagaccagcagcagcaggagggcucccgagggccuuaugag

SEQ ID NO: 249433 - RNA, 64 nt, Homo Sapiens
cgggcgcugccuggggccugggucaagggccagucagcaggaggcugccggaacaacagcggcu

SEQ ID NO: 249434 - RNA, 64 nt, Homo Sapiens
gggguucuuggagagucggccagacggcggggggcagcaggaacuuugccucauaccccaccaa

SEQ ID NO: 249435 - RNA, 64 nt, Homo Sapiens
gaauaagcaaauccaugaaccaugaguuuugucucagcaggauauucacaugugugugcacacu

SEQ ID NO: 249436 - RNA, 64 nt, Homo Sapiens
acuuagggauaaggaagaaucaauugggacuccccagcaggaauguagaaagauaauauuucuc

SEQ ID NO: 249437 - RNA, 64 nt, Homo Sapiens
agaccugggggcccuugggugccagagugagacacagcaggacccuuccccaaauacuaggcuc

SEQ ID NO: 249438 - RNA, 64 nt, Homo Sapiens
aaauacuaggcucagagcaaccuccagccuucuccagcaggaucugcucccuguguccuuggac

SEQ ID NO: 249439 - RNA, 64 nt, Homo Sapiens
aguuagggaaaugaugcuagagcacuuuaaaaaucagcaggacaacccugaggcaaacuggaag

SEQ ID NO: 249440 - RNA, 64 nt, Homo Sapiens
cagaaacaugauuuguucauuucugagucacaaacagcaggauaccucacagguaagccauacc

SEQ ID NO: 249441 - RNA, 64 nt, Homo Sapiens
aagacaacccguuggagccccucagggugggggacagcaggaucuccucagccucugcaaggca

SEQ ID NO: 249442 - RNA, 64 nt, Homo Sapiens
uggcccuucugccugggcagagccggcuguggagcagcaggaccgguacugcagcuuccuccac

SEQ ID NO: 249443 - RNA, 64 nt, Homo Sapiens
gggauguagagaggcguuagugggcagguggccacagcaggacugaggacaggcccccauuauc

SEQ ID NO: 249444 - RNA, 64 nt, Homo Sapiens
ccccagccaggaccaccucguccucguggcggggcagcaggagcgguagaaagggguccgaugu

SEQ ID NO: 249445 - RNA, 64 nt, Homo Sapiens
gcccaucugcuggcaucaguaccugguguugggacagcaggauaggguucuaaaggugguuuuc

SEQ ID NO: 249446 - RNA, 64 nt, Homo Sapiens
aggcccccaggaaucccuuccucccauguccuggcagcaggaccccaggcuacauauggaaggu

SEQ ID NO: 249447 - RNA, 64 nt, Homo Sapiens
gagugucuuuguguaucaccguuuguguguuccucagcaggaaugcaugugcuggucucugugu

SEQ ID NO: 249448 - RNA, 64 nt, Homo Sapiens
cacuggccuggcaccaccuguuggguucuccugacagcaggaacaagaaauguugaaaagcucc

SEQ ID NO: 249449 - RNA, 64 nt, Homo Sapiens
uucuuuugucauguauaacugagacacacaaacacagcaggagaaaucuaaaccguugugccuu

SEQ ID NO: 249450 - RNA, 64 nt, Homo Sapiens
ucuaguaugauuaguauagcuuucuccagcauggcagcaggaaguaacuacagggccucuuuua

SEQ ID NO: 249451 - RNA, 64 nt, Homo Sapiens
ccuccgaagagaguucuggaugucuggcucaaagcagcaggacugugggaaagagccuaacauc

SEQ ID NO: 249452 - RNA, 64 nt, Homo Sapiens
acauguucccaaggccccacuuucaagaaucagacagcaggaagccauagaugcuggcuggguu

SEQ ID NO: 249453 - RNA, 64 nt, Homo Sapiens
auugcuaacaaagcacuuuuggacaaugcuaucccagcaggaaaaaaaaggauaauauaacugu

SEQ ID NO: 249454 - RNA, 64 nt, Homo Sapiens
ugaguauuugaucccuagauaagaacaugcaaaucagcaggaacuggucauacaggguaagcac

SEQ ID NO: 249455 - RNA, 64 nt, Homo Sapiens
gggguggccuucucaggacuccuggguggcacagcagcaggaccuugucaugggacugaugcug

SEQ ID NO: 249456 - RNA, 64 nt, Homo Sapiens
cccaacagcaagggugacuccuggcaggugggggcagcaggagggcagagggcagagcucuggc

SEQ ID NO: 249457 - RNA, 64 nt, Homo Sapiens
ggcugucguguauauagcugcuuuuguccacggccagcaggaugcugggcacaggagcucccag

SEQ ID NO: 249458 - RNA, 64 nt, Homo Sapiens
gaagggcgcagcguccccucaggggcagucugggcagcaggaagcagccggcgccggacccggu

SEQ ID NO: 249459 - RNA, 64 nt, Homo Sapiens
uucucggaaaugagaaagcuggaauccugguccccagcaggagagccuaguccucccccagccc

SEQ ID NO: 249460 - RNA, 64 nt, Homo Sapiens
augcagcugccagauccacucacucugcugccuccagcaggacccaaggccacuuucaacucuu

SEQ ID NO: 249461 - RNA, 64 nt, Homo Sapiens
aagggaugagagaaaggaggugguauggaagacucagcaggaacaagguaggcuucaaagagcc

SEQ ID NO: 249462 - RNA, 64 nt, Homo Sapiens
gagugagggccccugcugggcccagccaccaggacagcaggaaccagggccuacuccucuuaug

SEQ ID NO: 249463 - RNA, 64 nt, Homo Sapiens
cugucugcuccuacuccucacaucuggaggauuccagcaggagggguuuuggaggggaccugcu

SEQ ID NO: 249464 - RNA, 64 nt, Homo Sapiens
cuccaaauccagccauagauggcugcugggugugcagcaggagaaggaggauggucagccuugg

SEQ ID NO: 249465 - RNA, 64 nt, Homo Sapiens
gaggugaagagggcggagaggagagaggaagggacagcaggaguugcacugucuauauugcacu

SEQ ID NO: 249466 - RNA, 64 nt, Homo Sapiens
gccucacugccccucuugcaggagccaccucaaucagcaggacaagaagccaguagagagacca

SEQ ID NO: 249467 - RNA, 64 nt, Homo Sapiens
uucuggggagcuuccaagagcacccaccaagacacagcaggacaggccaggggagggcaucugg

SEQ ID NO: 249468 - RNA, 64 nt, Homo Sapiens
acagaccacuugacucucuguaaaauggaccaaucagcaggauguggguggggcgagacaagag

SEQ ID NO: 249469 - RNA, 64 nt, Homo Sapiens
gagacggucuugccucucaguggggaagcagcugcagcaggaggcugugcccagcaguggcugc

SEQ ID NO: 249470 - RNA, 64 nt, Homo Sapiens
agguuuuccucuguuggccugggcuguguugucacagcaggaauacuuaggcugcgugggacaa

SEQ ID NO: 249471 - RNA, 64 nt, Homo Sapiens
gugaaguaguaaacugggggaggaagagcagcagcagcaggauggcacagucucuauggugcug

SEQ ID NO: 249472 - RNA, 64 nt, Homo Sapiens
aggcccuggguugccgugcuccccugcccaccuucagcaggaugccucauuccuuaccccccag

SEQ ID NO: 249473 - RNA, 64 nt, Homo Sapiens
ccucccaggaggggugguagccguucccaccucgcagcaggacccccagugcagaggcucacag

SEQ ID NO: 249474 - RNA, 64 nt, Homo Sapiens
guggguugagggggucugaccaggaggccaccuacagcaggaagugaggcugccauguuuccuu

SEQ ID NO: 249475 - RNA, 64 nt, Homo Sapiens
aagggagccagccuccagugaauaccucucguuccagcaggaccccugguuggcguccacaagc

SEQ ID NO: 249476 - RNA, 64 nt, Homo Sapiens
aggcauuccagucugccccaucagguggugggaacagcaggaaaguuuuucgagcuauagggca

SEQ ID NO: 249477 - RNA, 64 nt, Homo Sapiens
gaauugugaagcccacagaugcgcacgcaaugaccagcaggaaccggaagcccugggucacccc

SEQ ID NO: 249478 - RNA, 64 nt, Homo Sapiens
uuugcucccuccccucucuuagagacugugccuucagcaggacucuuaauaucugcugcaacuu

SEQ ID NO: 249479 - RNA, 64 nt, Homo Sapiens
acggcccaugcagaggugguagaaaggcuggacucagcaggaacaccaaaucccggaccaggca

SEQ ID NO: 249480 - RNA, 64 nt, Homo Sapiens
uaccucgcagggcucagcagcacccggugaacagcagcaggaggagccgcuagagcagcugcuc

SEQ ID NO: 249481 - RNA, 64 nt, Homo Sapiens
aauucugcaucccuaauucuagcucccacugccucagcaggagccacgcuuucagcuugagggg

SEQ ID NO: 249482 - RNA, 64 nt, Homo Sapiens
uuguaguuguaugcuugauuacuuggaaguggagcagcaggacuccuaagaauuauuaaguuug

SEQ ID NO: 249483 - RNA, 64 nt, Homo Sapiens
cuaaaauaucugccaucaucucaagguaauaggacagcaggaacuuuaaugcugcuuuugagcu

SEQ ID NO: 249484 - RNA, 64 nt, Homo Sapiens
ugugcauguggguagagaucauaccuuugggaagcagcaggaaagucagugacaccaucuugga

SEQ ID NO: 249485 - RNA, 64 nt, Homo Sapiens
gggccuaagguccacuggaccagaaggcuugcacuugggccaaagcugcccaugcagcagaggg

SEQ ID NO: 249486 - RNA, 64 nt, Homo Sapiens
uucggaggagagaagaaaguccagaaggaggacuuugggccaauaauccugaccacucuugaac

SEQ ID NO: 249487 - RNA, 64 nt, Homo Sapiens
ugcgguggcucaugccuguauagaaaaucaagcuuugggccaggguagugugaacccuagaaau

SEQ ID NO: 249488 - RNA, 64 nt, Homo Sapiens
aagaaguaggggcugaagagaaaaggcagaauguuugggccaugcaucugauaaggguauuugu

SEQ ID NO: 249489 - RNA, 64 nt, Homo Sapiens
cauggccuaguaaguacacccccaaacaaguucuuugggccagggaaaguggggaggccauaga

SEQ ID NO: 249490 - RNA, 64 nt, Homo Sapiens
uccaaaauauuauacgaugggauuguaagcuauguugggccaaugaaaggaccaaucacugucc

SEQ ID NO: 249491 - RNA, 64 nt, Homo Sapiens
gaagacuagaggugauucugcccagcaucccauauugggccagccaugagccagcuucccguga

SEQ ID NO: 249492 - RNA, 64 nt, Homo Sapiens
ucucaccaggaaaguacacgggccugaggcaggauugggccacagacagccucucauugguccg

SEQ ID NO: 249493 - RNA, 64 nt, Homo Sapiens
ccccugccaccugucuuuccucuaaaggucaguuuugggccaguucuugcaacuaaagagcaga

SEQ ID NO: 249494 - RNA, 64 nt, Homo Sapiens
uuaaagaauaacagaguucuagagcuggggguucuugggccaugcuccguguguggauaaggaa

SEQ ID NO: 249495 - RNA, 64 nt, Homo Sapiens
ugugcucuugaguuuuuuauucauucaagaaaccuugggccaccgcuuuguacauagcaccgug

SEQ ID NO: 249496 - RNA, 64 nt, Homo Sapiens
ggcaggacuucucgcugcccuuccaagcccggcuuugggccaggaaaggcuuccccagguggcu

SEQ ID NO: 249497 - RNA, 64 nt, Homo Sapiens
gugguucagccccuucuccaaccccuucauaagcuugggccacugccugggacccagcagacac

SEQ ID NO: 249498 - RNA, 64 nt, Homo Sapiens
agaccuccugggugggaaagacucaaaggggugcuugggccacucaggaccccucuggcugugu

SEQ ID NO: 249499 - RNA, 64 nt, Homo Sapiens
gggcuguggucagccaagaauagaggucauauaguugggccauggggcaauuguuggcagccau

SEQ ID NO: 249500 - RNA, 64 nt, Homo Sapiens
aagcuggcccaguuguccaugacaaaagaggcuuuugggccaaaaugugagggugguggguggg

SEQ ID NO: 249501 - RNA, 64 nt, Homo Sapiens
uuuccuugcauuaaaggagaucuuccccuaaccuuugggccaauuuacuggccacuaauuucgu

SEQ ID NO: 249502 - RNA, 64 nt, Homo Sapiens
auuaauuuacauuaaaguguuuauguuaagaagauugggccaggugggguggcucaugccugua

SEQ ID NO: 249503 - RNA, 64 nt, Homo Sapiens
uuucaaacaaucgaagguaaaacaacauauuguguugggccaccuguacugaacgcugaaucgu

SEQ ID NO: 249504 - RNA, 64 nt, Homo Sapiens
ccauccguagagcgggaaccuuccugagguguccuugggccacccccaaguguugggccaucug

SEQ ID NO: 249505 - RNA, 64 nt, Homo Sapiens
ccuuccugagguguccuugggccacccccaaguguugggccaucugccaagagacagcgaccca

SEQ ID NO: 249506 - RNA, 64 nt, Homo Sapiens; identical to SEQ ID NO: 97332

SEQ ID NO: 249507 - RNA, 64 nt, Homo Sapiens; identical to SEQ ID NO: 97333

SEQ ID NO: 249508 - RNA, 64 nt, Homo Sapiens; identical to SEQ ID NO: 97334

SEQ ID NO: 249509 - RNA, 64 nt, Homo Sapiens; identical to SEQ ID NO: 97335

SEQ ID NO: 249510 - RNA, 64 nt, Homo Sapiens; identical to SEQ ID NO: 97336

SEQ ID NO: 249511 - RNA, 64 nt, Homo Sapiens; identical to SEQ ID NO: 97337

SEQ ID NO: 249512 - RNA, 64 nt, Homo Sapiens; identical to SEQ ID NO: 97338

SEQ ID NO: 249513 - RNA, 64 nt, Homo Sapiens; identical to SEQ ID NO: 97339

SEQ ID NO: 249514 - RNA, 64 nt, Homo Sapiens; identical to SEQ ID NO: 97340

SEQ ID NO: 249515 - RNA, 64 nt, Homo Sapiens; identical to SEQ ID NO: 97341

SEQ ID NO: 249516 - RNA, 64 nt, Homo Sapiens; identical to SEQ ID NO: 97342

SEQ ID NO: 249517 - RNA, 64 nt, Homo Sapiens; identical to SEQ ID NO: 97343

SEQ ID NO: 249518 - RNA, 64 nt, Homo Sapiens; identical to SEQ ID NO: 97344

SEQ ID NO: 249519 - RNA, 64 nt, Homo Sapiens; identical to SEQ ID NO: 97345

SEQ ID NO: 249520 - RNA, 64 nt, Homo Sapiens; identical to SEQ ID NO: 97346

SEQ ID NO: 249521 - RNA, 64 nt, Homo Sapiens; identical to SEQ ID NO: 97347

SEQ ID NO: 249522 - RNA, 64 nt, Homo Sapiens; identical to SEQ ID NO: 97348

SEQ ID NO: 249523 - RNA, 64 nt, Homo Sapiens; identical to SEQ ID NO: 97349

SEQ ID NO: 249524 - RNA, 64 nt, Homo Sapiens; identical to SEQ ID NO: 97350

SEQ ID NO: 249525 - RNA, 64 nt, Homo Sapiens; identical to SEQ ID NO: 97351

SEQ ID NO: 249526 - RNA, 64 nt, Homo Sapiens; identical to SEQ ID NO: 97352

SEQ ID NO: 249527 - RNA, 64 nt, Homo Sapiens; identical to SEQ ID NO: 97353

SEQ ID NO: 249528 - RNA, 64 nt, Homo Sapiens; identical to SEQ ID NO: 97354

SEQ ID NO: 249529 - RNA, 64 nt, Homo Sapiens; identical to SEQ ID NO: 97355

SEQ ID NO: 249530 - RNA, 64 nt, Homo Sapiens; identical to SEQ ID NO: 97356

SEQ ID NO: 249531 - RNA, 64 nt, Homo Sapiens; identical to SEQ ID NO: 97357

SEQ ID NO: 249532 - RNA, 64 nt, Homo Sapiens; identical to SEQ ID NO: 97358

SEQ ID NO: 249533 - RNA, 64 nt, Homo Sapiens; identical to SEQ ID NO: 97359

SEQ ID NO: 249534 - RNA, 64 nt, Homo Sapiens; identical to SEQ ID NO: 97360

SEQ ID NO: 249535 - RNA, 64 nt, Homo Sapiens; identical to SEQ ID NO: 97361

SEQ ID NO: 249536 - RNA, 64 nt, Homo Sapiens; identical to SEQ ID NO: 97362

SEQ ID NO: 249537 - RNA, 64 nt, Homo Sapiens; identical to SEQ ID NO: 97363

SEQ ID NO: 249538 - RNA, 64 nt, Homo Sapiens; identical to SEQ ID NO: 97364

SEQ ID NO: 249539 - RNA, 64 nt, Homo Sapiens; identical to SEQ ID NO: 97365

SEQ ID NO: 249540 - RNA, 64 nt, Homo Sapiens; identical to SEQ ID NO: 97366

SEQ ID NO: 249541 - RNA, 64 nt, Homo Sapiens; identical to SEQ ID NO: 97367

SEQ ID NO: 249542 - RNA, 64 nt, Homo Sapiens; identical to SEQ ID NO: 97368

SEQ ID NO: 249543 - RNA, 64 nt, Homo Sapiens; identical to SEQ ID NO: 97369

SEQ ID NO: 249544 - RNA, 64 nt, Homo Sapiens; identical to SEQ ID NO: 97370

SEQ ID NO: 249545 - RNA, 64 nt, Homo Sapiens; identical to SEQ ID NO: 97371

SEQ ID NO: 249546 - RNA, 64 nt, Homo Sapiens; identical to SEQ ID NO: 97372

SEQ ID NO: 249547 - RNA, 64 nt, Homo Sapiens; identical to SEQ ID NO: 97373

SEQ ID NO: 249548 - RNA, 64 nt, Homo Sapiens; identical to SEQ ID NO: 97374

SEQ ID NO: 249549 - RNA, 64 nt, Homo Sapiens; identical to SEQ ID NO: 97375

SEQ ID NO: 249550 - RNA, 64 nt, Homo Sapiens; identical to SEQ ID NO: 97376

SEQ ID NO: 249551 - RNA, 64 nt, Homo Sapiens; identical to SEQ ID NO: 97377

SEQ ID NO: 249552 - RNA, 64 nt, Homo Sapiens; identical to SEQ ID NO: 97378

SEQ ID NO: 249553 - RNA, 64 nt, Homo Sapiens; identical to SEQ ID NO: 97379

SEQ ID NO: 249554 - RNA, 64 nt, Homo Sapiens; identical to SEQ ID NO: 97380

SEQ ID NO: 249555 - RNA, 64 nt, Homo Sapiens; identical to SEQ ID NO: 97381

SEQ ID NO: 249556 - RNA, 64 nt, Homo Sapiens; identical to SEQ ID NO: 97382

SEQ ID NO: 249557 - RNA, 64 nt, Homo Sapiens; identical to SEQ ID NO: 97383

SEQ ID NO: 249558 - RNA, 64 nt, Homo Sapiens; identical to SEQ ID NO: 97384

SEQ ID NO: 249559 - RNA, 64 nt, Homo Sapiens; identical to SEQ ID NO: 97385

SEQ ID NO: 249560 - RNA, 64 nt, Homo Sapiens; identical to SEQ ID NO: 97386

SEQ ID NO: 249561 - RNA, 64 nt, Homo Sapiens; identical to SEQ ID NO: 97387

SEQ ID NO: 249562 - RNA, 64 nt, Homo Sapiens; identical to SEQ ID NO: 97388

SEQ ID NO: 249563 - RNA, 64 nt, Homo Sapiens; identical to SEQ ID NO: 97389

SEQ ID NO: 249564 - RNA, 64 nt, Homo Sapiens; identical to SEQ ID NO: 97390

SEQ ID NO: 249565 - RNA, 64 nt, Homo Sapiens; identical to SEQ ID NO: 97391

SEQ ID NO: 249566 - RNA, 64 nt, Homo Sapiens; identical to SEQ ID NO: 97392

SEQ ID NO: 249567 - RNA, 64 nt, Homo Sapiens; identical to SEQ ID NO: 97393

SEQ ID NO: 249568 - RNA, 64 nt, Homo Sapiens; identical to SEQ ID NO: 97394

SEQ ID NO: 249569 - RNA, 64 nt, Homo Sapiens
cauaguauggauuuuaaaaaugccacacggcagccuucccgaaagccaucugcagccaggugug

SEQ ID NO: 249570 - RNA, 64 nt, Homo Sapiens
guucuacuuuggguccgcgcgcaaaugguaaaagcuucccgacuaaagaacucaacauggcaaa

SEQ ID NO: 249571 - RNA, 64 nt, Homo Sapiens
ccuuugccugcuguugcuggaagagcuggcucauacccccaaaggacacuuucagcgacagcua

SEQ ID NO: 249572 - RNA, 64 nt, Homo Sapiens
cuguugugcccuuuaagagacauguuuccaccccacccccaaccuugucccaagugcccuggac

SEQ ID NO: 249573 - RNA, 64 nt, Homo Sapiens
auagacucggguacugugaugcagagugaggaagacccccaagcucuugguugugacuccaaga

SEQ ID NO: 249574 - RNA, 64 nt, Homo Sapiens
ucuuaucuagcaagccuguacagaacccccacucacccccaagaaacacaggcucucacaagau

SEQ ID NO: 249575 - RNA, 64 nt, Homo Sapiens
uuccccaccagcuccacaaccccaacuuuccccuacccccaacuugcccaaaauuuccccuacc

SEQ ID NO: 249576 - RNA, 64 nt, Homo Sapiens
uuccccuacccccaacuuucccaaaauuuccccuacccccaacuugggcugaugaaggcacugc

SEQ ID NO: 249577 - RNA, 64 nt, Homo Sapiens
agucgagcaaaugagcaauuauuccuuccuuucuacccccaaccacuuucaccuuuuauuuuuu

SEQ ID NO: 249578 - RNA, 64 nt, Homo Sapiens
gaaugcccuauugaggagaaacaaugauggcagaacccccaagcaugaggaaggccaauuccuu

SEQ ID NO: 249579 - RNA, 64 nt, Homo Sapiens
aaauguuggaacucugugcaggugcugccuugagacccccaagcuuccaccugucccucuccua

SEQ ID NO: 249580 - RNA, 64 nt, Homo Sapiens
ucagaacaccccgcucuggcaguaggugucccccacccccaaagaccugccugugugcuccgga

SEQ ID NO: 249581 - RNA, 64 nt, Homo Sapiens
guuuuugucuuucuucucagguguauuucuugguacccccaagauaucaggccagaaagagaug

SEQ ID NO: 249582 - RNA, 64 nt, Homo Sapiens
gaacuccugaccucaagugaucugcccacuucagacccccaaagugcugggauuccagguguga

SEQ ID NO: 249583 - RNA, 64 nt, Homo Sapiens
cugccccagccaguccagagccuaccacagcaauacccccaacacucacuccacucaaugugca

SEQ ID NO: 249584 - RNA, 64 nt, Homo Sapiens
uuuuuccccacaccucugaacucagggccuagccacccccaaacuuccaaaucccacuuuugug

SEQ ID NO: 249585 - RNA, 64 nt, Homo Sapiens
aauuugaaugccuacaauaaggacucauuguuccacccccaaccuuacuugauuuaucuucuca

SEQ ID NO: 249586 - RNA, 64 nt, Homo Sapiens
gacugacacagguggucuaauacuguuaaccaacacccccaaguuagaggugagcucagaaacc

SEQ ID NO: 249587 - RNA, 64 nt, Homo Sapiens
uuuugccuuggugcucaucuuaauggccuaaugcacccccaaacauggaaauaucaccaaaaaa

SEQ ID NO: 249588 - RNA, 64 nt, Homo Sapiens
aucaucaucuggauuuaggaauugcucuugucauacccccaaguuucuaagauuuaagauucuc

SEQ ID NO: 249589 - RNA, 64 nt, Homo Sapiens
cccugccugcuggcuacuuccuggcuuaccuucuacccccaaggauccucaccacccaaagggu

SEQ ID NO: 249590 - RNA, 64 nt, Homo Sapiens
ggcacccuccugggagcaggccuuccucccucccacccccaauguccuguugguaggagguggg

SEQ ID NO: 249591 - RNA, 64 nt, Homo Sapiens
caccccaggacgagccaucagggacagaccccccacccccaaggcugcagccacaccauguuuc

SEQ ID NO: 249592 - RNA, 64 nt, Homo Sapiens
aguccugaaacaggcuccccucaccaggacagucacccccaaacuugacccccaacauuucaau

SEQ ID NO: 249593 - RNA, 64 nt, Homo Sapiens
gcuccccucaccaggacagucacccccaaacuugacccccaacauuucaaugcacagaagggac

SEQ ID NO: 249594 - RNA, 64 nt, Homo Sapiens
cccacucuaaauuccaaagcuaucaaaaggagacacccccaaauugaaacaugcacacugcaaa

SEQ ID NO: 249595 - RNA, 64 nt, Homo Sapiens
ggucaaaugggcacaccacagcagaauggcaauaacccccaaaaagcaugcauugcucuuaacc

SEQ ID NO: 249596 - RNA, 64 nt, Homo Sapiens
uuuccggagaagauuucagagcugaggcuuugguacccccaaacccccaauauuuuuggacugg

SEQ ID NO: 249597 - RNA, 64 nt, Homo Sapiens
gaagauuucagagcugaggcuuugguacccccaaacccccaauauuuuuggacuggcagacuca

SEQ ID NO: 249598 - RNA, 64 nt, Homo Sapiens
acccugccagccacagaccuuccaggagggagccacccccaaggccaggagugucucuaagaga

SEQ ID NO: 249599 - RNA, 64 nt, Homo Sapiens
cucacacucccuugucuuuucacauaccacaaccacccccaagcaccaggagggcagacccagc

SEQ ID NO: 249600 - RNA, 64 nt, Homo Sapiens
cauggaaucccaaauccccaccguaacuccuaggacccccaaaugccccuagaagaccccaaug

SEQ ID NO: 249601 - RNA, 64 nt, Homo Sapiens
caaaagaguaacagacauucuaaacauaggucacacccccaaagccccuuaaguccucuugaaa

SEQ ID NO: 249602 - RNA, 64 nt, Homo Sapiens
acagaccccaugucacccagauacucccauaauaacccccaaauugaggccccauuauuaacag

SEQ ID NO: 249603 - RNA, 64 nt, Homo Sapiens
uaaaacguuuuuuuuuauuguacuuauuuuguuuacccccaauucaaccuguauggcgggucug

SEQ ID NO: 249604 - RNA, 64 nt, Homo Sapiens
uuucccaggccaggcacugagcauggcagucccuacccccaauuacucccccaucuugcugaca

SEQ ID NO: 249605 - RNA, 64 nt, Homo Sapiens
ccccaucccuuccccaccucuccuaucccaacucacccccaaaccgcuuggcgcuccuccuccg

SEQ ID NO: 249606 - RNA, 64 nt, Homo Sapiens
ccacgacucacuuccacaccaacuuuucuccccaacccccaaacggacccccggcccggcccgg

SEQ ID NO: 249607 - RNA, 64 nt, Homo Sapiens; identical to SEQ ID NO: 218520

SEQ ID NO: 249608 - RNA, 64 nt, Homo Sapiens; identical to SEQ ID NO: 218521

SEQ ID NO: 249609 - RNA, 64 nt, Homo Sapiens; identical to SEQ ID NO: 218522

SEQ ID NO: 249610 - RNA, 64 nt, Homo Sapiens; identical to SEQ ID NO: 218523

SEQ ID NO: 249611 - RNA, 64 nt, Homo Sapiens; identical to SEQ ID NO: 218524

SEQ ID NO: 249612 - RNA, 64 nt, Homo Sapiens; identical to SEQ ID NO: 218525

SEQ ID NO: 249613 - RNA, 64 nt, Homo Sapiens; identical to SEQ ID NO: 218526

SEQ ID NO: 249614 - RNA, 64 nt, Homo Sapiens; identical to SEQ ID NO: 218527

SEQ ID NO: 249615 - RNA, 64 nt, Homo Sapiens; identical to SEQ ID NO: 218528

SEQ ID NO: 249616 - RNA, 64 nt, Homo Sapiens; identical to SEQ ID NO: 218529

SEQ ID NO: 249617 - RNA, 64 nt, Homo Sapiens; identical to SEQ ID NO: 218530

SEQ ID NO: 249618 - RNA, 64 nt, Homo Sapiens; identical to SEQ ID NO: 218531

SEQ ID NO: 249619 - RNA, 64 nt, Homo Sapiens; identical to SEQ ID NO: 218532

SEQ ID NO: 249620 - RNA, 64 nt, Homo Sapiens; identical to SEQ ID NO: 218533

SEQ ID NO: 249621 - RNA, 64 nt, Homo Sapiens; identical to SEQ ID NO: 218534

SEQ ID NO: 249622 - RNA, 64 nt, Homo Sapiens; identical to SEQ ID NO: 218535

SEQ ID NO: 249623 - RNA, 64 nt, Homo Sapiens; identical to SEQ ID NO: 218536

SEQ ID NO: 249624 - RNA, 64 nt, Homo Sapiens; identical to SEQ ID NO: 218537

SEQ ID NO: 249625 - RNA, 64 nt, Homo Sapiens; identical to SEQ ID NO: 218538

SEQ ID NO: 249626 - RNA, 61 nt, Homo Sapiens; identical to SEQ ID NO: 218539

SEQ ID NO: 249627 - RNA, 64 nt, Homo Sapiens; identical to SEQ ID NO: 218540

SEQ ID NO: 249628 - RNA, 64 nt, Homo Sapiens; identical to SEQ ID NO: 218541

SEQ ID NO: 249629 - RNA, 64 nt, Homo Sapiens; identical to SEQ ID NO: 218542

SEQ ID NO: 249630 - RNA, 64 nt, Homo Sapiens; identical to SEQ ID NO: 218543

SEQ ID NO: 249631 - RNA, 64 nt, Homo Sapiens; identical to SEQ ID NO: 218544

SEQ ID NO: 249632 - RNA, 64 nt, Homo Sapiens; identical to SEQ ID NO: 218545

SEQ ID NO: 249633 - RNA, 64 nt, Homo Sapiens; identical to SEQ ID NO: 218546

SEQ ID NO: 249634 - RNA, 64 nt, Homo Sapiens; identical to SEQ ID NO: 218547

SEQ ID NO: 249635 - RNA, 64 nt, Homo Sapiens; identical to SEQ ID NO: 218548

SEQ ID NO: 249636 - RNA, 64 nt, Homo Sapiens; identical to SEQ ID NO: 218549

SEQ ID NO: 249637 - RNA, 64 nt, Homo Sapiens; identical to SEQ ID NO: 218550

SEQ ID NO: 249638 - RNA, 64 nt, Homo Sapiens; identical to SEQ ID NO: 218551

SEQ ID NO: 249639 - RNA, 64 nt, Homo Sapiens; identical to SEQ ID NO: 218552

SEQ ID NO: 249640 - RNA, 64 nt, Homo Sapiens; identical to SEQ ID NO: 218553

SEQ ID NO: 249641 - RNA, 63 nt, Homo Sapiens; identical to SEQ ID NO: 218554

SEQ ID NO: 249642 - RNA, 64 nt, Homo Sapiens; identical to SEQ ID NO: 218555

SEQ ID NO: 249643 - RNA, 64 nt, Homo Sapiens; identical to SEQ ID NO: 218556

SEQ ID NO: 249644 - RNA, 64 nt, Homo Sapiens; identical to SEQ ID NO: 218557

SEQ ID NO: 249645 - RNA, 64 nt, Homo Sapiens; identical to SEQ ID NO: 218558

SEQ ID NO: 249646 - RNA, 64 nt, Homo Sapiens; identical to SEQ ID NO: 218559

SEQ ID NO: 249647 - RNA, 64 nt, Homo Sapiens; identical to SEQ ID NO: 218560

SEQ ID NO: 249648 - RNA, 64 nt, Homo Sapiens; identical to SEQ ID NO: 218561

SEQ ID NO: 249649 - RNA, 64 nt, Homo Sapiens; identical to SEQ ID NO: 218562

SEQ ID NO: 249650 - RNA, 64 nt, Homo Sapiens; identical to SEQ ID NO: 218563

SEQ ID NO: 249651 - RNA, 64 nt, Homo Sapiens; identical to SEQ ID NO: 218564

SEQ ID NO: 249652 - RNA, 64 nt, Homo Sapiens; identical to SEQ ID NO: 218565

SEQ ID NO: 249653 - RNA, 64 nt, Homo Sapiens; identical to SEQ ID NO: 218566

SEQ ID NO: 249654 - RNA, 64 nt, Homo Sapiens; identical to SEQ ID NO: 218567

SEQ ID NO: 249655 - RNA, 64 nt, Homo Sapiens; identical to SEQ ID NO: 218568

SEQ ID NO: 249656 - RNA, 64 nt, Homo Sapiens; identical to SEQ ID NO: 218569

SEQ ID NO: 249657 - RNA, 64 nt, Homo Sapiens; identical to SEQ ID NO: 218570

SEQ ID NO: 249658 - RNA, 64 nt, Homo Sapiens; identical to SEQ ID NO: 218571

SEQ ID NO: 249659 - RNA, 64 nt, Homo Sapiens; identical to SEQ ID NO: 218572

SEQ ID NO: 249660 - RNA, 64 nt, Homo Sapiens; identical to SEQ ID NO: 218573

SEQ ID NO: 249661 - RNA, 64 nt, Homo Sapiens; identical to SEQ ID NO: 218574

SEQ ID NO: 249662 - RNA, 64 nt, Homo Sapiens; identical to SEQ ID NO: 218575

SEQ ID NO: 249663 - RNA, 64 nt, Homo Sapiens; identical to SEQ ID NO: 218576

SEQ ID NO: 249664 - RNA, 64 nt, Homo Sapiens; identical to SEQ ID NO: 218577

SEQ ID NO: 249665 - RNA, 64 nt, Homo Sapiens; identical to SEQ ID NO: 218578

SEQ ID NO: 249666 - RNA, 64 nt, Homo Sapiens; identical to SEQ ID NO: 218579

SEQ ID NO: 249667 - RNA, 64 nt, Homo Sapiens; identical to SEQ ID NO: 218580

SEQ ID NO: 249668 - RNA, 64 nt, Homo Sapiens; identical to SEQ ID NO: 218581

SEQ ID NO: 249669 - RNA, 64 nt, Homo Sapiens; identical to SEQ ID NO: 218582

SEQ ID NO: 249670 - RNA, 64 nt, Homo Sapiens; identical to SEQ ID NO: 218583

SEQ ID NO: 249671 - RNA, 64 nt, Homo Sapiens; identical to SEQ ID NO: 218584

SEQ ID NO: 249672 - RNA, 64 nt, Homo Sapiens; identical to SEQ ID NO: 218585

SEQ ID NO: 249673 - RNA, 64 nt, Homo Sapiens; identical to SEQ ID NO: 218586

SEQ ID NO: 249674 - RNA, 64 nt, Homo Sapiens; identical to SEQ ID NO: 218587

SEQ ID NO: 249675 - RNA, 64 nt, Homo Sapiens; identical to SEQ ID NO: 218588

SEQ ID NO: 249676 - RNA, 64 nt, Homo Sapiens; identical to SEQ ID NO: 218589

SEQ ID NO: 249677 - RNA, 64 nt, Homo Sapiens; identical to SEQ ID NO: 218590

SEQ ID NO: 249678 - RNA, 64 nt, Homo Sapiens; identical to SEQ ID NO: 218591

SEQ ID NO: 249679 - RNA, 64 nt, Homo Sapiens; identical to SEQ ID NO: 218592

SEQ ID NO: 249680 - RNA, 64 nt, Homo Sapiens; identical to SEQ ID NO: 218593

SEQ ID NO: 249681 - RNA, 64 nt, Homo Sapiens; identical to SEQ ID NO: 218594

SEQ ID NO: 249682 - RNA, 64 nt, Homo Sapiens; identical to SEQ ID NO: 218595

SEQ ID NO: 249683 - RNA, 64 nt, Homo Sapiens; identical to SEQ ID NO: 218596

SEQ ID NO: 249684 - RNA, 64 nt, Homo Sapiens; identical to SEQ ID NO: 218597

SEQ ID NO: 249685 - RNA, 64 nt, Homo Sapiens; identical to SEQ ID NO: 218598

SEQ ID NO: 249686 - RNA, 64 nt, Homo Sapiens; identical to SEQ ID NO: 218599

SEQ ID NO: 249687 - RNA, 64 nt, Homo Sapiens; identical to SEQ ID NO: 218600

SEQ ID NO: 249688 - RNA, 64 nt, Homo Sapiens; identical to SEQ ID NO: 218601

SEQ ID NO: 249689 - RNA, 64 nt, Homo Sapiens; identical to SEQ ID NO: 218602

SEQ ID NO: 249690 - RNA, 64 nt, Homo Sapiens; identical to SEQ ID NO: 218603

SEQ ID NO: 249691 - RNA, 64 nt, Homo Sapiens; identical to SEQ ID NO: 218604

SEQ ID NO: 249692 - RNA, 64 nt, Homo Sapiens; identical to SEQ ID NO: 218605

SEQ ID NO: 249693 - RNA, 64 nt, Homo Sapiens; identical to SEQ ID NO: 218606

SEQ ID NO: 249694 - RNA, 64 nt, Homo Sapiens; identical to SEQ ID NO: 218607

SEQ ID NO: 249695 - RNA, 64 nt, Homo Sapiens; identical to SEQ ID NO: 218608

SEQ ID NO: 249696 - RNA, 64 nt, Homo Sapiens; identical to SEQ ID NO: 218609

SEQ ID NO: 249697 - RNA, 64 nt, Homo Sapiens; identical to SEQ ID NO: 218610

SEQ ID NO: 249698 - RNA, 64 nt, Homo Sapiens; identical to SEQ ID NO: 218611

SEQ ID NO: 249699 - RNA, 64 nt, Homo Sapiens; identical to SEQ ID NO: 218612

SEQ ID NO: 249700 - RNA, 62 nt, Homo Sapiens; identical to SEQ ID NO: 218613

SEQ ID NO: 249701 - RNA, 64 nt, Homo Sapiens; identical to SEQ ID NO: 218614

SEQ ID NO: 249702 - RNA, 64 nt, Homo Sapiens; identical to SEQ ID NO: 218615

SEQ ID NO: 249703 - RNA, 64 nt, Homo Sapiens; identical to SEQ ID NO: 218616

SEQ ID NO: 249704 - RNA, 64 nt, Homo Sapiens; identical to SEQ ID NO: 218617

SEQ ID NO: 249705 - RNA, 64 nt, Homo Sapiens; identical to SEQ ID NO: 218618

SEQ ID NO: 249706 - RNA, 64 nt, Homo Sapiens; identical to SEQ ID NO: 218619

SEQ ID NO: 249707 - RNA, 64 nt, Homo Sapiens; identical to SEQ ID NO: 218620

SEQ ID NO: 249708 - RNA, 64 nt, Homo Sapiens; identical to SEQ ID NO: 218621

SEQ ID NO: 249709 - RNA, 64 nt, Homo Sapiens; identical to SEQ ID NO: 218622

SEQ ID NO: 249710 - RNA, 64 nt, Homo Sapiens; identical to SEQ ID NO: 218623

SEQ ID NO: 249711 - RNA, 64 nt, Homo Sapiens; identical to SEQ ID NO: 218624

SEQ ID NO: 249712 - RNA, 64 nt, Homo Sapiens; identical to SEQ ID NO: 218625

SEQ ID NO: 249713 - RNA, 64 nt, Homo Sapiens; identical to SEQ ID NO: 218626

SEQ ID NO: 249714 - RNA, 64 nt, Homo Sapiens; identical to SEQ ID NO: 218627

SEQ ID NO: 249715 - RNA, 64 nt, Homo Sapiens; identical to SEQ ID NO: 218628

SEQ ID NO: 249716 - RNA, 64 nt, Homo Sapiens; identical to SEQ ID NO: 218629

SEQ ID NO: 249717 - RNA, 64 nt, Homo Sapiens; identical to SEQ ID NO: 218630

SEQ ID NO: 249718 - RNA, 64 nt, Homo Sapiens; identical to SEQ ID NO: 218631

SEQ ID NO: 249719 - RNA, 64 nt, Homo Sapiens; identical to SEQ ID NO: 218632

SEQ ID NO: 249720 - RNA, 64 nt, Homo Sapiens; identical to SEQ ID NO: 218633

SEQ ID NO: 249721 - RNA, 64 nt, Homo Sapiens; identical to SEQ ID NO: 218634

SEQ ID NO: 249722 - RNA, 64 nt, Homo Sapiens; identical to SEQ ID NO: 218635

SEQ ID NO: 249723 - RNA, 64 nt, Homo Sapiens; identical to SEQ ID NO: 218636

SEQ ID NO: 249724 - RNA, 64 nt, Homo Sapiens; identical to SEQ ID NO: 218637

SEQ ID NO: 249725 - RNA, 64 nt, Homo Sapiens; identical to SEQ ID NO: 218638

SEQ ID NO: 249726 - RNA, 64 nt, Homo Sapiens; identical to SEQ ID NO: 218639

SEQ ID NO: 249727 - RNA, 64 nt, Homo Sapiens; identical to SEQ ID NO: 218640

SEQ ID NO: 249728 - RNA, 64 nt, Homo Sapiens; identical to SEQ ID NO: 218641

SEQ ID NO: 249729 - RNA, 64 nt, Homo Sapiens; identical to SEQ ID NO: 218642

SEQ ID NO: 249730 - RNA, 64 nt, Homo Sapiens; identical to SEQ ID NO: 218643

SEQ ID NO: 249731 - RNA, 64 nt, Homo Sapiens; identical to SEQ ID NO: 218644

SEQ ID NO: 249732 - RNA, 64 nt, Homo Sapiens; identical to SEQ ID NO: 218645

SEQ ID NO: 249733 - RNA, 64 nt, Homo Sapiens; identical to SEQ ID NO: 218646

SEQ ID NO: 249734 - RNA, 64 nt, Homo Sapiens; identical to SEQ ID NO: 218647

SEQ ID NO: 249735 - RNA, 64 nt, Homo Sapiens; identical to SEQ ID NO: 218648

SEQ ID NO: 249736 - RNA, 64 nt, Homo Sapiens; identical to SEQ ID NO: 218649

SEQ ID NO: 249737 - RNA, 64 nt, Homo Sapiens; identical to SEQ ID NO: 218650

SEQ ID NO: 249738 - RNA, 64 nt, Homo Sapiens; identical to SEQ ID NO: 218651

SEQ ID NO: 249739 - RNA, 64 nt, Homo Sapiens; identical to SEQ ID NO: 218652

SEQ ID NO: 249740 - RNA, 64 nt, Homo Sapiens; identical to SEQ ID NO: 218653

SEQ ID NO: 249741 - RNA, 64 nt, Homo Sapiens; identical to SEQ ID NO: 218654

SEQ ID NO: 249742 - RNA, 64 nt, Homo Sapiens; identical to SEQ ID NO: 218655

SEQ ID NO: 249743 - RNA, 64 nt, Homo Sapiens; identical to SEQ ID NO: 218656

SEQ ID NO: 249744 - RNA, 64 nt, Homo Sapiens; identical to SEQ ID NO: 218657

SEQ ID NO: 249745 - RNA, 64 nt, Homo Sapiens; identical to SEQ ID NO: 218658

SEQ ID NO: 249746 - RNA, 64 nt, Homo Sapiens; identical to SEQ ID NO: 218659

SEQ ID NO: 249747 - RNA, 64 nt, Homo Sapiens; identical to SEQ ID NO: 218660

SEQ ID NO: 249748 - RNA, 64 nt, Homo Sapiens; identical to SEQ ID NO: 218661

SEQ ID NO: 249749 - RNA, 61 nt, Homo Sapiens; identical to SEQ ID NO: 218662

SEQ ID NO: 249750 - RNA, 64 nt, Homo Sapiens; identical to SEQ ID NO: 218663

SEQ ID NO: 249751 - RNA, 64 nt, Homo Sapiens; identical to SEQ ID NO: 218664

SEQ ID NO: 249752 - RNA, 64 nt, Homo Sapiens; identical to SEQ ID NO: 218665

SEQ ID NO: 249753 - RNA, 64 nt, Homo Sapiens; identical to SEQ ID NO: 218666

SEQ ID NO: 249754 - RNA, 64 nt, Homo Sapiens; identical to SEQ ID NO: 218667

SEQ ID NO: 249755 - RNA, 64 nt, Homo Sapiens; identical to SEQ ID NO: 218668

SEQ ID NO: 249756 - RNA, 64 nt, Homo Sapiens; identical to SEQ ID NO: 218669

SEQ ID NO: 249757 - RNA, 64 nt, Homo Sapiens; identical to SEQ ID NO: 218670

SEQ ID NO: 249758 - RNA, 64 nt, Homo Sapiens; identical to SEQ ID NO: 218671

SEQ ID NO: 249759 - RNA, 64 nt, Homo Sapiens; identical to SEQ ID NO: 218672

SEQ ID NO: 249760 - RNA, 64 nt, Homo Sapiens; identical to SEQ ID NO: 218673

SEQ ID NO: 249761 - RNA, 64 nt, Homo Sapiens; identical to SEQ ID NO: 218674

SEQ ID NO: 249762 - RNA, 64 nt, Homo Sapiens; identical to SEQ ID NO: 218675

SEQ ID NO: 249763 - RNA, 64 nt, Homo Sapiens; identical to SEQ ID NO: 218676

SEQ ID NO: 249764 - RNA, 64 nt, Homo Sapiens; identical to SEQ ID NO: 218677

SEQ ID NO: 249765 - RNA, 64 nt, Homo Sapiens; identical to SEQ ID NO: 218678

SEQ ID NO: 249766 - RNA, 64 nt, Homo Sapiens; identical to SEQ ID NO: 218679

SEQ ID NO: 249767 - RNA, 64 nt, Homo Sapiens; identical to SEQ ID NO: 218680

SEQ ID NO: 249768 - RNA, 64 nt, Homo Sapiens; identical to SEQ ID NO: 218681

SEQ ID NO: 249769 - RNA, 64 nt, Homo Sapiens; identical to SEQ ID NO: 218682

SEQ ID NO: 249770 - RNA, 64 nt, Homo Sapiens; identical to SEQ ID NO: 218683

SEQ ID NO: 249771 - RNA, 64 nt, Homo Sapiens; identical to SEQ ID NO: 218684

SEQ ID NO: 249772 - RNA, 64 nt, Homo Sapiens; identical to SEQ ID NO: 218685

SEQ ID NO: 249773 - RNA, 59 nt, Homo Sapiens; identical to SEQ ID NO: 218686

SEQ ID NO: 249774 - RNA, 64 nt, Homo Sapiens; identical to SEQ ID NO: 218687

SEQ ID NO: 249775 - RNA, 64 nt, Homo Sapiens; identical to SEQ ID NO: 218688

SEQ ID NO: 249776 - RNA, 64 nt, Homo Sapiens; identical to SEQ ID NO: 218689

SEQ ID NO: 249777 - RNA, 64 nt, Homo Sapiens; identical to SEQ ID NO: 218690

SEQ ID NO: 249778 - RNA, 64 nt, Homo Sapiens; identical to SEQ ID NO: 218691

SEQ ID NO: 249779 - RNA, 64 nt, Homo Sapiens; identical to SEQ ID NO: 218692

SEQ ID NO: 249780 - RNA, 64 nt, Homo Sapiens; identical to SEQ ID NO: 218693

SEQ ID NO: 249781 - RNA, 64 nt, Homo Sapiens; identical to SEQ ID NO: 218694

SEQ ID NO: 249782 - RNA, 64 nt, Homo Sapiens; identical to SEQ ID NO: 218695

SEQ ID NO: 249783 - RNA, 64 nt, Homo Sapiens; identical to SEQ ID NO: 218696

SEQ ID NO: 249784 - RNA, 64 nt, Homo Sapiens; identical to SEQ ID NO: 218697

SEQ ID NO: 249785 - RNA, 64 nt, Homo Sapiens; identical to SEQ ID NO: 218698

SEQ ID NO: 249786 - RNA, 64 nt, Homo Sapiens; identical to SEQ ID NO: 218699

SEQ ID NO: 249787 - RNA, 64 nt, Homo Sapiens; identical to SEQ ID NO: 218700

SEQ ID NO: 249788 - RNA, 64 nt, Homo Sapiens; identical to SEQ ID NO: 218701

SEQ ID NO: 249789 - RNA, 64 nt, Homo Sapiens; identical to SEQ ID NO: 218702

SEQ ID NO: 249790 - RNA, 64 nt, Homo Sapiens; identical to SEQ ID NO: 218703

SEQ ID NO: 249791 - RNA, 64 nt, Homo Sapiens; identical to SEQ ID NO: 218704

SEQ ID NO: 249792 - RNA, 64 nt, Homo Sapiens; identical to SEQ ID NO: 218705

SEQ ID NO: 249793 - RNA, 64 nt, Homo Sapiens; identical to SEQ ID NO: 218706

SEQ ID NO: 249794 - RNA, 64 nt, Homo Sapiens; identical to SEQ ID NO: 218707

SEQ ID NO: 249795 - RNA, 64 nt, Homo Sapiens; identical to SEQ ID NO: 218708

SEQ ID NO: 249796 - RNA, 64 nt, Homo Sapiens; identical to SEQ ID NO: 218709

SEQ ID NO: 249797 - RNA, 64 nt, Homo Sapiens; identical to SEQ ID NO: 218710

SEQ ID NO: 249798 - RNA, 64 nt, Homo Sapiens; identical to SEQ ID NO: 218711

SEQ ID NO: 249799 - RNA, 64 nt, Homo Sapiens; identical to SEQ ID NO: 218712

SEQ ID NO: 249800 - RNA, 64 nt, Homo Sapiens; identical to SEQ ID NO: 218713

SEQ ID NO: 249801 - RNA, 64 nt, Homo Sapiens; identical to SEQ ID NO: 218714

SEQ ID NO: 249802 - RNA, 64 nt, Homo Sapiens; identical to SEQ ID NO: 218715

SEQ ID NO: 249803 - RNA, 64 nt, Homo Sapiens; identical to SEQ ID NO: 218716

SEQ ID NO: 249804 - RNA, 64 nt, Homo Sapiens; identical to SEQ ID NO: 218717

SEQ ID NO: 249805 - RNA, 64 nt, Homo Sapiens; identical to SEQ ID NO: 218718

SEQ ID NO: 249806 - RNA, 64 nt, Homo Sapiens; identical to SEQ ID NO: 218719

SEQ ID NO: 249807 - RNA, 64 nt, Homo Sapiens; identical to SEQ ID NO: 218720

SEQ ID NO: 249808 - RNA, 64 nt, Homo Sapiens; identical to SEQ ID NO: 218721

SEQ ID NO: 249809 - RNA, 64 nt, Homo Sapiens; identical to SEQ ID NO: 218722

SEQ ID NO: 249810 - RNA, 64 nt, Homo Sapiens; identical to SEQ ID NO: 218723

SEQ ID NO: 249811 - RNA, 64 nt, Homo Sapiens; identical to SEQ ID NO: 218724

SEQ ID NO: 249812 - RNA, 64 nt, Homo Sapiens; identical to SEQ ID NO: 218725

SEQ ID NO: 249813 - RNA, 64 nt, Homo Sapiens; identical to SEQ ID NO: 218726

SEQ ID NO: 249814 - RNA, 64 nt, Homo Sapiens; identical to SEQ ID NO: 218727

SEQ ID NO: 249815 - RNA, 64 nt, Homo Sapiens; identical to SEQ ID NO: 218728

SEQ ID NO: 249816 - RNA, 64 nt, Homo Sapiens; identical to SEQ ID NO: 218729

SEQ ID NO: 249817 - RNA, 64 nt, Homo Sapiens; identical to SEQ ID NO: 218730

SEQ ID NO: 249818 - RNA, 64 nt, Homo Sapiens; identical to SEQ ID NO: 218731

SEQ ID NO: 249819 - RNA, 64 nt, Homo Sapiens; identical to SEQ ID NO: 218732

SEQ ID NO: 249820 - RNA, 64 nt, Homo Sapiens; identical to SEQ ID NO: 218733

SEQ ID NO: 249821 - RNA, 64 nt, Homo Sapiens; identical to SEQ ID NO: 218734

SEQ ID NO: 249822 - RNA, 64 nt, Homo Sapiens; identical to SEQ ID NO: 218735

SEQ ID NO: 249823 - RNA, 64 nt, Homo Sapiens; identical to SEQ ID NO: 218736

SEQ ID NO: 249824 - RNA, 64 nt, Homo Sapiens; identical to SEQ ID NO: 218737

SEQ ID NO: 249825 - RNA, 64 nt, Homo Sapiens; identical to SEQ ID NO: 218738

SEQ ID NO: 249826 - RNA, 64 nt, Homo Sapiens; identical to SEQ ID NO: 218739

SEQ ID NO: 249827 - RNA, 64 nt, Homo Sapiens; identical to SEQ ID NO: 218740

SEQ ID NO: 249828 - RNA, 64 nt, Homo Sapiens; identical to SEQ ID NO: 218741

SEQ ID NO: 249829 - RNA, 64 nt, Homo Sapiens; identical to SEQ ID NO: 218742

SEQ ID NO: 249830 - RNA, 64 nt, Homo Sapiens; identical to SEQ ID NO: 218743

SEQ ID NO: 249831 - RNA, 64 nt, Homo Sapiens; identical to SEQ ID NO: 218744

SEQ ID NO: 249832 - RNA, 64 nt, Homo Sapiens; identical to SEQ ID NO: 218745

SEQ ID NO: 249833 - RNA, 64 nt, Homo Sapiens; identical to SEQ ID NO: 218746

SEQ ID NO: 249834 - RNA, 64 nt, Homo Sapiens; identical to SEQ ID NO: 218747

SEQ ID NO: 249835 - RNA, 64 nt, Homo Sapiens; identical to SEQ ID NO: 218748

SEQ ID NO: 249836 - RNA, 64 nt, Homo Sapiens; identical to SEQ ID NO: 218749

SEQ ID NO: 249837 - RNA, 64 nt, Homo Sapiens; identical to SEQ ID NO: 218750

SEQ ID NO: 249838 - RNA, 64 nt, Homo Sapiens; identical to SEQ ID NO: 218751

SEQ ID NO: 249839 - RNA, 64 nt, Homo Sapiens; identical to SEQ ID NO: 218752

SEQ ID NO: 249840 - RNA, 64 nt, Homo Sapiens; identical to SEQ ID NO: 218753

SEQ ID NO: 249841 - RNA, 64 nt, Homo Sapiens; identical to SEQ ID NO: 218754

SEQ ID NO: 249842 - RNA, 64 nt, Homo Sapiens; identical to SEQ ID NO: 218755

SEQ ID NO: 249843 - RNA, 64 nt, Homo Sapiens; identical to SEQ ID NO: 218756

SEQ ID NO: 249844 - RNA, 64 nt, Homo Sapiens; identical to SEQ ID NO: 218757

SEQ ID NO: 249845 - RNA, 64 nt, Homo Sapiens; identical to SEQ ID NO: 218758

SEQ ID NO: 249846 - RNA, 64 nt, Homo Sapiens; identical to SEQ ID NO: 218759

SEQ ID NO: 249847 - RNA, 64 nt, Homo Sapiens; identical to SEQ ID NO: 218760

SEQ ID NO: 249848 - RNA, 64 nt, Homo Sapiens; identical to SEQ ID NO: 218761

SEQ ID NO: 249849 - RNA, 64 nt, Homo Sapiens; identical to SEQ ID NO: 218762

SEQ ID NO: 249850 - RNA, 64 nt, Homo Sapiens; identical to SEQ ID NO: 218763

SEQ ID NO: 249851 - RNA, 64 nt, Homo Sapiens; identical to SEQ ID NO: 218764

SEQ ID NO: 249852 - RNA, 64 nt, Homo Sapiens; identical to SEQ ID NO: 218765

SEQ ID NO: 249853 - RNA, 64 nt, Homo Sapiens; identical to SEQ ID NO: 218766

SEQ ID NO: 249854 - RNA, 64 nt, Homo Sapiens; identical to SEQ ID NO: 218767

SEQ ID NO: 249855 - RNA, 64 nt, Homo Sapiens; identical to SEQ ID NO: 218768

SEQ ID NO: 249856 - RNA, 64 nt, Homo Sapiens; identical to SEQ ID NO: 218769

SEQ ID NO: 249857 - RNA, 64 nt, Homo Sapiens; identical to SEQ ID NO: 218770

SEQ ID NO: 249858 - RNA, 64 nt, Homo Sapiens; identical to SEQ ID NO: 218771

SEQ ID NO: 249859 - RNA, 64 nt, Homo Sapiens; identical to SEQ ID NO: 218772

SEQ ID NO: 249860 - RNA, 64 nt, Homo Sapiens; identical to SEQ ID NO: 218773

SEQ ID NO: 249861 - RNA, 64 nt, Homo Sapiens; identical to SEQ ID NO: 218774

SEQ ID NO: 249862 - RNA, 64 nt, Homo Sapiens; identical to SEQ ID NO: 218775

SEQ ID NO: 249863 - RNA, 64 nt, Homo Sapiens; identical to SEQ ID NO: 218776

SEQ ID NO: 249864 - RNA, 64 nt, Homo Sapiens; identical to SEQ ID NO: 218777

SEQ ID NO: 249865 - RNA, 64 nt, Homo Sapiens; identical to SEQ ID NO: 218778

SEQ ID NO: 249866 - RNA, 64 nt, Homo Sapiens; identical to SEQ ID NO: 218779

SEQ ID NO: 249867 - RNA, 64 nt, Homo Sapiens; identical to SEQ ID NO: 218780

SEQ ID NO: 249868 - RNA, 64 nt, Homo Sapiens; identical to SEQ ID NO: 218781

SEQ ID NO: 249869 - RNA, 64 nt, Homo Sapiens; identical to SEQ ID NO: 218782

SEQ ID NO: 249870 - RNA, 64 nt, Homo Sapiens; identical to SEQ ID NO: 218783

SEQ ID NO: 249871 - RNA, 64 nt, Homo Sapiens; identical to SEQ ID NO: 218784

SEQ ID NO: 249872 - RNA, 64 nt, Homo Sapiens; identical to SEQ ID NO: 218785

SEQ ID NO: 249873 - RNA, 64 nt, Homo Sapiens; identical to SEQ ID NO: 218786

SEQ ID NO: 249874 - RNA, 64 nt, Homo Sapiens; identical to SEQ ID NO: 218787

SEQ ID NO: 249875 - RNA, 64 nt, Homo Sapiens; identical to SEQ ID NO: 218788

SEQ ID NO: 249876 - RNA, 64 nt, Homo Sapiens; identical to SEQ ID NO: 218789

SEQ ID NO: 249877 - RNA, 64 nt, Homo Sapiens; identical to SEQ ID NO: 218790

SEQ ID NO: 249878 - RNA, 64 nt, Homo Sapiens; identical to SEQ ID NO: 218791

SEQ ID NO: 249879 - RNA, 64 nt, Homo Sapiens; identical to SEQ ID NO: 218792

SEQ ID NO: 249880 - RNA, 64 nt, Homo Sapiens; identical to SEQ ID NO: 218793

SEQ ID NO: 249881 - RNA, 64 nt, Homo Sapiens; identical to SEQ ID NO: 218794

SEQ ID NO: 249882 - RNA, 64 nt, Homo Sapiens; identical to SEQ ID NO: 218795

SEQ ID NO: 249883 - RNA, 64 nt, Homo Sapiens; identical to SEQ ID NO: 218796

SEQ ID NO: 249884 - RNA, 64 nt, Homo Sapiens; identical to SEQ ID NO: 218797

SEQ ID NO: 249885 - RNA, 64 nt, Homo Sapiens; identical to SEQ ID NO: 218798

SEQ ID NO: 249886 - RNA, 64 nt, Homo Sapiens; identical to SEQ ID NO: 218799

SEQ ID NO: 249887 - RNA, 64 nt, Homo Sapiens; identical to SEQ ID NO: 218800

SEQ ID NO: 249888 - RNA, 64 nt, Homo Sapiens; identical to SEQ ID NO: 218801

SEQ ID NO: 249889 - RNA, 64 nt, Homo Sapiens; identical to SEQ ID NO: 218802

SEQ ID NO: 249890 - RNA, 64 nt, Homo Sapiens; identical to SEQ ID NO: 218803

SEQ ID NO: 249891 - RNA, 64 nt, Homo Sapiens; identical to SEQ ID NO: 218804

SEQ ID NO: 249892 - RNA, 64 nt, Homo Sapiens; identical to SEQ ID NO: 218805

SEQ ID NO: 249893 - RNA, 64 nt, Homo Sapiens; identical to SEQ ID NO: 218806

SEQ ID NO: 249894 - RNA, 64 nt, Homo Sapiens; identical to SEQ ID NO: 218807

SEQ ID NO: 249895 - RNA, 64 nt, Homo Sapiens; identical to SEQ ID NO: 218808

SEQ ID NO: 249896 - RNA, 59 nt, Homo Sapiens; identical to SEQ ID NO: 218809

SEQ ID NO: 249897 - RNA, 64 nt, Homo Sapiens; identical to SEQ ID NO: 218810

SEQ ID NO: 249898 - RNA, 64 nt, Homo Sapiens; identical to SEQ ID NO: 218811

SEQ ID NO: 249899 - RNA, 63 nt, Homo Sapiens
agagaagauuaucaaacaaaugaaacaaguaaaggaagaaagaagguaucuggaaagaaauag

SEQ ID NO: 249900 - RNA, 63 nt, Homo Sapiens
gcaaauuaaaacgauaucaugccuacaaugguuggaagaaaaaauacuuggaaacaaagaaag

SEQ ID NO: 249901 - RNA, 63 nt, Homo Sapiens
guuucuuggccacugaauuagccaaaacacuuaggaagaaaucacuuaaauaccucuggcuua

SEQ ID NO: 249902 - RNA, 63 nt, Homo Sapiens
guuggaauguaugcuaauugaacaugcaauuggggaagaaaaaauguagaaugauuuuugcua

SEQ ID NO: 249903 - RNA, 63 nt, Homo Sapiens
aggcaugcaccaaggaauuguagagguugguggggaagaaaauggccuugcucuuguggagcu

SEQ ID NO: 249904 - RNA, 63 nt, Homo Sapiens
uuaggggcugcucugacggugucaugcagacaaggaagaaaacaauagccugcucaguagagg

SEQ ID NO: 249905 - RNA, 63 nt, Homo Sapiens
uucuucccauccuguucagcugcuggugaccugggaagaaaccugggagccaagcuugaggac

SEQ ID NO: 249906 - RNA, 63 nt, Homo Sapiens
aaggggaagaagaucaaaacgaaaagaagaaggggaagaaaagaggggaagaagaucaaagaa

SEQ ID NO: 249907 - RNA, 63 nt, Homo Sapiens
aaggggaagaagaucaaagaaagaaggggaaggggaagaaaagaauuuauugcagaaauugaa

SEQ ID NO: 249908 - RNA, 63 nt, Homo Sapiens
ggauggcaugaaagaaugacgauuguggcuggaggaagaaaaaguucccaaguggugagguga

SEQ ID NO: 249909 - RNA, 63 nt, Homo Sapiens
cagcuuguuuuuaaaacuuaguacaaacauacuggaagaaaacgauuggaggccauggccuau

SEQ ID NO: 249910 - RNA, 63 nt, Homo Sapiens
auccugcuggggauuccauugagaugcagugagggaagaaaggugcuguguggagaagguucu

SEQ ID NO: 249911 - RNA, 63 nt, Homo Sapiens
acggcuuucauuaccaaauauaagccuggggaaggaagaaaaaugggcgugggcuucuucaca

SEQ ID NO: 249912 - RNA, 63 nt, Homo Sapiens
gaaagcucuccuaauacuuacuuaaauagccauggaagaaaauuaugcuugucccuucugacu

SEQ ID NO: 249913 - RNA, 63 nt, Homo Sapiens
uuuuguguguuuaaaaaaauugaagaaaauucaggaagaaacguguuaauaaacauuguacug

SEQ ID NO: 249914 - RNA, 63 nt, Homo Sapiens
gugguuuaauuggacuuaaaauacccgagacugggaagaaaaauucacgcugcugauaaagac

SEQ ID NO: 249915 - RNA, 63 nt, Homo Sapiens
gagguuuacuuggacuuacaguacccgagacugggaagaaaaauuaaugcugcugauaaagac

SEQ ID NO: 249916 - RNA, 63 nt, Homo Sapiens
aaggugguauaccuuccaaauccugguucagauggaagaaauagcaggagagaggacccauua

SEQ ID NO: 249917 - RNA, 63 nt, Homo Sapiens
ggagagaggacccauuagcuggcagacccagggggaagaaaggagggcugugaggagauaccu

SEQ ID NO: 249918 - RNA, 63 nt, Homo Sapiens
ccauucucagugggcugcaguugcccaaccacaggaagaaagggaaggagguagagggaagaa

SEQ ID NO: 249919 - RNA, 63 nt, Homo Sapiens
cccaaccacaggaagaaagggaaggagguagagggaagaaacagaagcaguguuccauuuucu

SEQ ID NO: 249920 - RNA, 63 nt, Homo Sapiens
ugugauguauguguccaguaggcuaaagccauaggaagaaaaacuuuugguggggugggggug

SEQ ID NO: 249921 - RNA, 63 nt, Homo Sapiens
cuaaaucccuccuucacuuuuacucauuucuagggaagaaauugacuacaaauguuuagcugu

SEQ ID NO: 249922 - RNA, 63 nt, Homo Sapiens
aaaacuguuucaucauuucuaggaggaagaaaaggaagaaagagacaguugcccuuucaaagc

SEQ ID NO: 249923 - RNA, 63 nt, Homo Sapiens
gaagaaagaaaaacuguuucuuucaaagcaggaggaagaaaagaucccucaugacaguugccc

SEQ ID NO: 249924 - RNA, 63 nt, Homo Sapiens
cuuccuuguuggcugauccauagagcauuacuuggaagaaaauuucacuauuugcauugaugu

SEQ ID NO: 249925 - RNA, 63 nt, Homo Sapiens
aaacuaaguauuucuucauuguaccuuaguccaggaagaaauuaauggaauauggugugcuaa

SEQ ID NO: 249926 - RNA, 63 nt, Homo Sapiens
aaaucaacccauccauagaacacuuaauuuagaggaagaaaaacaaauauauuagucuagggc

SEQ ID NO: 249927 - RNA, 63 nt, Homo Sapiens
agaauaacugaacaaauauagaaauggcaguaaggaagaaaacgaacucacugauggagaugu

SEQ ID NO: 249928 - RNA, 63 nt, Homo Sapiens
gcugcccaagagaaaagaguguauguuuggaguggaagaaaaucgguuuugaaucucaugaac

SEQ ID NO: 249929 - RNA, 63 nt, Homo Sapiens
aagcuuagcuuccucaacuacuguuuuucagaaggaagaaagaaucaaauggaagaagaauca

SEQ ID NO: 249930 - RNA, 63 nt, Homo Sapiens
aacaaugucuaacccaacccaaggagggagaagggaagaaagaggaaagggaaggaagaaagg

SEQ ID NO: 249931 - RNA, 63 nt, Homo Sapiens
aaggagggagaagggaagaaagaggaaagggaaggaagaaaggaggaaagaagagagggagag

SEQ ID NO: 249932 - RNA, 63 nt, Homo Sapiens
gcggaggaggcuggugacaggccaaaggccaguggaagaaacacccuuucaucucagagucca

SEQ ID NO: 249933 - RNA, 63 nt, Homo Sapiens
auuucugcuuccuuuuauuuuuauaggaauagaggaagaaaugucagaugcgugcccagcucu

SEQ ID NO: 249934 - RNA, 63 nt, Homo Sapiens
cugagucuagguggagaaaauaccguugagaagggaagaaagguguugggaaaggauaagugc

SEQ ID NO: 249935 - RNA, 63 nt, Homo Sapiens
caagaaagaggaagacaaguauuuggccacacuggaagaaaggagacaggaaacagggaguuc

SEQ ID NO: 249936 - RNA, 63 nt, Homo Sapiens
ucuuaaauaacuccauucauacaaauugggaugggaagaaaauccuuuccucuugggaaagua

SEQ ID NO: 249937 - RNA, 63 nt, Homo Sapiens
aagaccacaagucugcaggaaacucuggaaucaggaagaaaagcuauguucauacucuaaauc

SEQ ID NO: 249938 - RNA, 63 nt, Homo Sapiens
cccuuuguuuacucagauuucucuuagccauaaggaagaaaaagaacucuugcaugaaaauag

SEQ ID NO: 249939 - RNA, 63 nt, Homo Sapiens
aaaagaacucuugcaugaaaauagcaugaugcaggaagaaauugccaugcuaagaauagaacu

SEQ ID NO: 249940 - RNA, 63 nt, Homo Sapiens
gaagaauuagguuugaauuguugggugggaggaggaagaaaggcaucuugagaagcaggcggg

SEQ ID NO: 249941 - RNA, 63 nt, Homo Sapiens
gaagaauuagguuugaauuguugggugggaggaggaagaaagggccacugagaagcaggcggg

SEQ ID NO: 249942 - RNA, 63 nt, Homo Sapiens
gaguuaggagaaagaagagccuucugcuucugaggaagaaaagcaucauuuuaucgagagaac

SEQ ID NO: 249943 - RNA, 63 nt, Homo Sapiens
auuucaaaaauggcuaggaauuggugaauaauuggaagaaagauaauugucacaccuggaagc

SEQ ID NO: 249944 - RNA, 63 nt, Homo Sapiens
gacugaaaagaaauucuccauuaugaggaauugggaagaaaucugguauccaagcuuaaauuu

SEQ ID NO: 249945 - RNA, 63 nt, Homo Sapiens
uguuucaugaauccauuuggcacagagacacaaggaagaaaacacuaguaaccaucuuuccac

SEQ ID NO: 249946 - RNA, 63 nt, Homo Sapiens
aucucuacuuuccuauacugccaaagaaugugaggaagaaaugggacucuuugguuauuuauu

SEQ ID NO: 249947 - RNA, 63 nt, Homo Sapiens
uaggcaagaaggacagcaguaaaugaagaccauggaagaaaagaaggaaugccaaagaucgag

SEQ ID NO: 249948 - RNA, 63 nt, Homo Sapiens
uugagagguuucuuaaucaaagccagguuaaguggaagaaacuccaaagacccagagucucag

SEQ ID NO: 249949 - RNA, 63 nt, Homo Sapiens
gucuuacacggcuguaauugggagagaugauuaggaagaaaauuuucauggugauggugcaag

SEQ ID NO: 249950 - RNA, 63 nt, Homo Sapiens
aaagcuguuuccuccuggugcaccucacccuuuggaagaaaggaggaugugucacuaaugcuc

SEQ ID NO: 249951 - RNA, 63 nt, Homo Sapiens
gaugcgguauuugcuuuugcacucuaguucugcggaagaaaaguacgcagcugccgaacucug

SEQ ID NO: 249952 - RNA, 63 nt, Homo Sapiens
acucaguugauaaaccuuaguuuuccaggaaagggaagaaaacgggcacuugcauccauugcc

SEQ ID NO: 249953 - RNA, 63 nt, Homo Sapiens
cguggucaugaauagaaaaauuauuaugggauuggaagaaacauauacagucuauaaaaauug

SEQ ID NO: 249954 - RNA, 63 nt, Homo Sapiens
aggcagcauggagagaggccuauaaaaauaaagggaagaaaggcauuuuagaaacggacagcu

SEQ ID NO: 249955 - RNA, 63 nt, Homo Sapiens
ugguggcaguuguuuguuuuaaacugaccacuuggaagaaacaccuugguuaucugugguuuu

SEQ ID NO: 249956 - RNA, 63 nt, Homo Sapiens
gaugaugauauucagacgaagcauugauguuauggaagaaagaaagaaacaaacaaaauauau

SEQ ID NO: 249957 - RNA, 63 nt, Homo Sapiens
agaaguuuuuccuugauugugcuauguuucaguggaagaaauucuuugaaguagaugugagug

SEQ ID NO: 249958 - RNA, 63 nt, Homo Sapiens
gacaaaucaacuuugaagacacaaaaguuaauuggaagaaauaaaaacugugaacgaagaaua

SEQ ID NO: 249959 - RNA, 63 nt, Homo Sapiens
uucacgcugcugauaaagacauaccugagaccaggaagaaaaagagguuuaauuggacuuaca

SEQ ID NO: 249960 - RNA, 63 nt, Homo Sapiens
uacaauugacauaggaauuacauuaaaauauuaggaagaaacaaggacaaauuuagaccuuga

SEQ ID NO: 249961 - RNA, 63 nt, Homo Sapiens
ccugccaucagaagggacaggucauuuacaaaaggaagaaauuuuuaucucaaguaauuuggu

SEQ ID NO: 249962 - RNA, 63 nt, Homo Sapiens
ucagcaggaaguaaaaauucuugagaaauucguggaagaaaugauaaguuuuuacugccagua

SEQ ID NO: 249963 - RNA, 63 nt, Homo Sapiens
accuguuacccauuaggggugauaacauuaaugggaagaaaugauggcaacuuugaaugcuag

SEQ ID NO: 249964 - RNA, 63 nt, Homo Sapiens
caucucugggauuugaaauauccagacuuguagggaagaaaacaaugacuugacgaccuuaaa

SEQ ID NO: 249965 - RNA, 63 nt, Homo Sapiens
uucagaggaggcauaagcuauggagguuggaaaggaagaaagagaagagcugaaguaaaugua

SEQ ID NO: 249966 - RNA, 63 nt, Homo Sapiens
ccuguccuuccccaacuccccagcuccaagaguggaagaaauccccaagaucaucugggucuc

SEQ ID NO: 249967 - RNA, 63 nt, Homo Sapiens
ucugcucucuucucuccccucugucccucuucaggaagaaagagcucauucugucucacaagc

SEQ ID NO: 249968 - RNA, 63 nt, Homo Sapiens
cccagcagugccugguucugagcaaacucccagggaagaaaacggcccugucuccauggccag

SEQ ID NO: 249969 - RNA, 63 nt, Homo Sapiens
uccaagcaccggggcgaaaaaccacaaaggaaaggaagaaaauuuauauauauauaauauaaa

SEQ ID NO: 249970 - RNA, 63 nt, Homo Sapiens
cucugcuuugucaugccauuaagcucacaauaaggaagaaauaacagauaaguccauuggugg

SEQ ID NO: 249971 - RNA, 63 nt, Homo Sapiens
cugauagcucauauuauaaauuucuaaauccuaggaagaaacgcuuggagugcuucugaauau

SEQ ID NO: 249972 - RNA, 63 nt, Homo Sapiens
augcgcaaaggaaagcagucaaaggagugagaaggaagaaacaaaauuuggaugucaacugag

SEQ ID NO: 249973 - RNA, 63 nt, Homo Sapiens
uauguaaaguuuaaucuauaagaagaggccuuuggaagaaaauucaggucuuuacugaauguu

SEQ ID NO: 249974 - RNA, 63 nt, Homo Sapiens
auuaaaaauugagucuuaaauuuaaaugggaagggaagaaaacaccaaauaagaaaaaaauuu

SEQ ID NO: 249975 - RNA, 63 nt, Homo Sapiens
aacgacgaagugcugagaagguuauggguaccaggaagaaacaaacagaagucuuaagauuag

SEQ ID NO: 249976 - RNA, 63 nt, Homo Sapiens
cuuugggaauaguucauagggaagggacaacauggaagaaacagcgauuuaaauuguauugaa

SEQ ID NO: 249977 - RNA, 63 nt, Homo Sapiens
aguuccuaaaacuaaaacuccauucuagucuugggaagaaaaguuucuacucagaacugggga

SEQ ID NO: 249978 - RNA, 63 nt, Homo Sapiens
caaaaugguugacauaauuaaugagaagaauuuggaagaaauugguauuuuaauacugucugu

SEQ ID NO: 249979 - RNA, 63 nt, Homo Sapiens
gacauagcaagacccugucuuaaaagaaaaaugggaagaaagacaagguaacaugaagaaaga

SEQ ID NO: 249980 - RNA, 63 nt, Homo Sapiens
ccccagguucucuuuucuuaagggugccaagaaggaagaaaagaggugggaggacuaacuucc

SEQ ID NO: 249981 - RNA, 63 nt, Homo Sapiens
ggagcuaggcagaagccuugcugccucugggaaggaagaaacagcccccacccuccugccaag

SEQ ID NO: 249982 - RNA, 63 nt, Homo Sapiens
aauuccacaacugccuuuagaaucagagcacugggaagaaauaagcuuuauucaaauuuugac

SEQ ID NO: 249983 - RNA, 63 nt, Homo Sapiens
aaaaaaauuaaaaggguagauguaaaguuagggggaagaaagauggucucgcugucgguuaac

SEQ ID NO: 249984 - RNA, 63 nt, Homo Sapiens
uguauaugcaguauugagcacuguaggcaagagggaagaaagagaaggagccaucuccaucuu

SEQ ID NO: 249985 - RNA, 63 nt, Homo Sapiens
acccacucuccucugccucaguaaguaucuggaggaagaaaacaggugaaagaagaaguaaaa

SEQ ID NO: 249986 - RNA, 63 nt, Homo Sapiens
cuguggaagggccaauggagugcaagaauuucuggaagaaaggggaagauguucaauagaaca

SEQ ID NO: 249987 - RNA, 63 nt, Homo Sapiens
cuaauucagcauguguucaucccaagauggagaggaagaaacgaaagcccuaugugaaaagau

SEQ ID NO: 249988 - RNA, 63 nt, Homo Sapiens
ugguggucccucuucccacgugcagcccuguugggaagaaaggaagaaaacaggucccuccag

SEQ ID NO: 249989 - RNA, 63 nt, Homo Sapiens
ccucuucccacgugcagcccuguugggaagaaaggaagaaaacaggucccuccaggggugcug

SEQ ID NO: 249990 - RNA, 63 nt, Homo Sapiens
gccuuauugaaaaacuaaagcaaauucuuuauaggaagaaaauaugggaauuugauuacacau

SEQ ID NO: 249991 - RNA, 63 nt, Homo Sapiens
acaggacuucuguuuacaauggaaaucugaaauggaagaaacaucuuuaaccuugugugucug

SEQ ID NO: 249992 - RNA, 63 nt, Homo Sapiens
cacaccauaacuagguaacaguuugauaacuagggaagaaagcagaacaguuaagcagccgcc

SEQ ID NO: 249993 - RNA, 63 nt, Homo Sapiens
aaaaucuguagagcagggcaaguaacauggaagggaagaaaaggugaaaaauuagaaauguuc

SEQ ID NO: 249994 - RNA, 63 nt, Homo Sapiens
ggccccaccaagaggguggaucacaccucagugggaagaaaaauaaaauuuccuucagguuuu

SEQ ID NO: 249995 - RNA, 63 nt, Homo Sapiens
gcaugcuuugauaucugguucagacuaucaucaggaagaaaaaaaaaucccacaguaccugaa

SEQ ID NO: 249996 - RNA, 63 nt, Homo Sapiens
uugaaaucuucaauuugaucaaacauggaucuuggaagaaauuaaauagcuuaagaagaagug

SEQ ID NO: 249997 - RNA, 63 nt, Homo Sapiens
gcuuaagaagaagugaaacauuuaaacagcucaggaagaaauauuuaaaucugagcaugcauc

SEQ ID NO: 249998 - RNA, 63 nt, Homo Sapiens
aaucaagaagagcaaagcaugaggaacgggcuuggaagaaaaugguuucagaugaugaagaaa

SEQ ID NO: 249999 - RNA, 63 nt, Homo Sapiens
caaggaaagaaugagucuaaaaugugaacaaaaggaagaaaauaaguccaaaagucacuuuug

SEQ ID NO: 250000 - RNA, 63 nt, Homo Sapiens
gaacuugaugcucaguauuucaagcauagaaauggaagaaaguaguuaaccacagucgggaaa

SEQ ID NO: 250001 - RNA, 63 nt, Homo Sapiens
caaaaaacaaaaaacuaaaguuauuuagaaaaaggaagaaaaauucuccaccaagcauuuggu

SEQ ID NO: 250002 - RNA, 63 nt, Homo Sapiens
gcuucuggauguccagccagaggcguggccgagggaagaaaaaaggacuggaggccgccaggc

SEQ ID NO: 250003 - RNA, 63 nt, Homo Sapiens
ccugugugcagggaaagagauagaggccuuuagggaagaaaaggucccuaucuuccagcaggu

SEQ ID NO: 250004 - RNA, 63 nt, Homo Sapiens
uguaggggagcaugguuuuuucuguaacuguagggaagaaagcuacgaggauuucuggaagcu

SEQ ID NO: 250005 - RNA, 63 nt, Homo Sapiens
uuucucacugcuaacguugguguuucuggcgugggaagaaaugcacaggcgugcauggcaugc

SEQ ID NO: 250006 - RNA, 63 nt, Homo Sapiens
cauuguaagaguucugucaugcagucugaaaagggaagaaacaggauggcuuucuguagccac

SEQ ID NO: 250007 - RNA, 63 nt, Homo Sapiens
aaaucauugaacugagggggaaaaauguaacuaggaagaaaaacccaauuuaagaaauuacau

SEQ ID NO: 250008 - RNA, 63 nt, Homo Sapiens
gucauuucugcugaaaaaacagaugauccugguggaagaaaagguugaaggcagcugcccucg

SEQ ID NO: 250009 - RNA, 63 nt, Homo Sapiens
agcaaguuguucaauuuuaaucagaaaaaucaaggaagaaaaaaaaguuuccauggaagcugu

SEQ ID NO: 250010 - RNA, 63 nt, Homo Sapiens
gguggccugggaguagauaucugaaagcuguuuggaagaaacauaaugggaaaguucauguug

SEQ ID NO: 250011 - RNA, 63 nt, Homo Sapiens
aucauggggaggucuaccuuuuuauaguuuuggggaagaaaauaaaaaucaucucacaugcau

SEQ ID NO: 250012 - RNA, 63 nt, Homo Sapiens
ggaagauuggaaucugccugggagcucacaucuggaagaaacauucaagaauuucugaggaca

SEQ ID NO: 250013 - RNA, 63 nt, Homo Sapiens
ugcuauuaaugggcuaauaauauugguguuauuggaagaaaaauaaauaaauaauuuaaauuu

SEQ ID NO: 250014 - RNA, 63 nt, Homo Sapiens
caguaacauuauccuuagguccuaaguaaaacaggaagaaaauuguccauaugucuuuaccua

SEQ ID NO: 250015 - RNA, 64 nt, Homo Sapiens
aguaauaugcuaaccugaugcacugcugaaagaaaaugugaauuuuucguaauaauugcauuuu

SEQ ID NO: 250016 - RNA, 64 nt, Homo Sapiens
ucauuccugcaaagcuugcuuuggggaguuggauaaugugaaaauuuuaaguaccuaggggaga

SEQ ID NO: 250017 - RNA, 64 nt, Homo Sapiens
acaaguuuauguaguacuuaauguacaugauaugaaugugaagcauaaaauuaaauaaaauuuu

SEQ ID NO: 250018 - RNA, 64 nt, Homo Sapiens
uaaagggaacauaauuuguuuaggcucccacauaaaugugaaucuggccaacaacuuugguuca

SEQ ID NO: 250019 - RNA, 64 nt, Homo Sapiens
uucuguuauuauacuuaaucuucuaaacuaaacuaaugugaacaguagggaagcaagggcccaa

SEQ ID NO: 250020 - RNA, 64 nt, Homo Sapiens
uagcuguauuccuaaacaaauuguuuccuaaacaaaugugaaaaugugaacagugcugaaaggu

SEQ ID NO: 250021 - RNA, 64 nt, Homo Sapiens
uuccuaaacaaauuguuuccuaaacaaaugugaaaaugugaacagugcugaaagguuuugugaa

SEQ ID NO: 250022 - RNA, 64 nt, Homo Sapiens
gaauuauaauuaguuccucauuagcauuuugcuaaaugugaaugaugauccuaggcauuugcug

SEQ ID NO: 250023 - RNA, 64 nt, Homo Sapiens
cuggguaacuagggaagauaauauuaaggaagacaaugugaaaagaaaaaugagccuggcaaga

SEQ ID NO: 250024 - RNA, 64 nt, Homo Sapiens
acuaguuuaaaaaauuauaaaugaaucuaaucaaaaugugaauaguagucaaaaggauaauuua

SEQ ID NO: 250025 - RNA, 64 nt, Homo Sapiens
aguugaauugaaugucuauaaggucuaaagguagaaugugaauauugccacagaguucauugcu

SEQ ID NO: 250026 - RNA, 64 nt, Homo Sapiens
acccauauauacaacaaaguguuuuaaacaccuaaaugugaauauuagaaacauagacucccaa

SEQ ID NO: 250027 - RNA, 64 nt, Homo Sapiens
uuaagucuucacuuucugugacagguauaauuuuaaugugaaaauugagauauaaaaguaggaa

SEQ ID NO: 250028 - RNA, 64 nt, Homo Sapiens
ggugaaaaguccaucuugcugauuugaugauugaaaugugaaagugaaguggaaggaaugaaug

SEQ ID NO: 250029 - RNA, 64 nt, Homo Sapiens
auguaggucaaaucaaauuaaagaugauuuuuuuaaugugaauaaaguuauguucugauaguuu

SEQ ID NO: 250030 - RNA, 64 nt, Homo Sapiens
cuaguucucuuaucuuugaucguauauuucucauaaugugaaauaugaugagauucacuuaggg

SEQ ID NO: 250031 - RNA, 64 nt, Homo Sapiens
uccagccauuuuuuuaguuaguaaaaauccuauuaaugugaaccagccaggaauaacaguguua

SEQ ID NO: 250032 - RNA, 64 nt, Homo Sapiens
uaauugauguuugcaaugugaaaauuaugcaauuaaugugaaaaaaacuaauagaucaccuuag

SEQ ID NO: 250033 - RNA, 64 nt, Homo Sapiens
acaauuuaguccucauuauuaaaaaggaaaagaaaaugugaaacauuguuacaugauuuuuuaa

SEQ ID NO: 250034 - RNA, 64 nt, Homo Sapiens
gugaaguggcuauccuaaacucagcacugauuaaaaugugaauagaaauugcuuuagcuucugg

SEQ ID NO: 250035 - RNA, 64 nt, Homo Sapiens
guuuuccucauguucaguuaaaaucacuuaucaaaaugugaacuaauaagccugccgccaaaau

SEQ ID NO: 250036 - RNA, 64 nt, Homo Sapiens
auacagacaggcaaacauuuuaauaauugcaaugaaugugaauuugcuaauuuaugagaaaaug

SEQ ID NO: 250037 - RNA, 64 nt, Homo Sapiens
aagaaaagagccgcuugaauuaaaaauggauaauaaugugaagggcacuuguacccgaucauaa

SEQ ID NO: 250038 - RNA, 64 nt, Homo Sapiens
caugagaaaauuuauacuguagagaaacccuggaaaugugaagaacguggcaaaguucuuuacc

SEQ ID NO: 250039 - RNA, 64 nt, Homo Sapiens
cauaagagaauucauaccggagagaaacuguacaaaugugaagaauauggcaaagccugugaau

SEQ ID NO: 250040 - RNA, 64 nt, Homo Sapiens
caagauaauucauucuggggaaaaaaaugcuacaaaugugaaaaacguggcagagccuucagac

SEQ ID NO: 250041 - RNA, 64 nt, Homo Sapiens
auaaugagaacucauacuggaggaaagucuuacaaaugugaagaauguggcagucuuuaaaucu

SEQ ID NO: 250042 - RNA, 64 nt, Homo Sapiens
auauuguaagacuuuugagaauauacuugauuaaaaugugaaagaagggauuguuaacuuauug

SEQ ID NO: 250043 - RNA, 64 nt, Homo Sapiens
guauauaauguuaauuuauugacuaguuugaaauaaugugaaguguuuuuuauaucagauuaau

SEQ ID NO: 250044 - RNA, 64 nt, Homo Sapiens
uuuucacuuuuggcgacuagaaacaauuccaguaaaugugaaucucgacaaaucgaggacugaa

SEQ ID NO: 250045 - RNA, 64 nt, Homo Sapiens
cgaacgagcgaacaacugagcccaagccggugagaaugugaaacaguuucucaaaggaaagaau

SEQ ID NO: 250046 - RNA, 64 nt, Homo Sapiens
uauauuccaggucaaaauuugccccauaguuauaaaugugaaauacaguucucucacaccaagg

SEQ ID NO: 250047 - RNA, 64 nt, Homo Sapiens
guauuguaacuauuuuaaggagaccaaugguuaaaaugugaauauuuaaauuuaaaaugcagag

SEQ ID NO: 250048 - RNA, 64 nt, Homo Sapiens
acauaagagucuuaaaagaauauaauacccauuuaaugugaaaaagggaugaaaauaaugggag

SEQ ID NO: 250049 - RNA, 64 nt, Homo Sapiens
auuuuuugucucucuccugaaugacuucuauuuuaaugugaagagaguacgcucuaugcauagu

SEQ ID NO: 250050 - RNA, 64 nt, Homo Sapiens
ugacaccacuaaagaaacgaucagacagaucuggaaugugaagcguuauagaagauaacuggcc

SEQ ID NO: 250051 - RNA, 64 nt, Homo Sapiens
cuucuugauuaaaaguuauguaauaaccaaaugcaaugugaaauauuuuacuggacucuauuuu

SEQ ID NO: 250052 - RNA, 64 nt, Homo Sapiens; identical to SEQ ID NO: 250050

SEQ ID NO: 250053 - RNA, 64 nt, Homo Sapiens; identical to SEQ ID NO: 250051

SEQ ID NO: 250054 - RNA, 64 nt, Homo Sapiens
auauuugaaguauuaauuuuuagauaaucaucuuaaugugaaagccuaggaaagauuuacacaa

SEQ ID NO: 250055 - RNA, 64 nt, Homo Sapiens
auuuggguuucaaauguuaacaauccaaaaacaaaaugugaaccguacauacucauucccaaag

SEQ ID NO: 250056 - RNA, 64 nt, Homo Sapiens
cuggauuuuaauuggcauguguucauuaggugccaaugugaaguaacuuuggucauucugcugu

SEQ ID NO: 250057 - RNA, 64 nt, Homo Sapiens
ucugucgauucaucuccaauuuuccuucucuuggaaugugaagauauuucagucuaggaaagau

SEQ ID NO: 250058 - RNA, 64 nt, Homo Sapiens
acugggugcuagacaagaagucccacagaagaaaaaugugaaaguuggugaauaaguuauaaau

SEQ ID NO: 250059 - RNA, 64 nt, Homo Sapiens
accuuuucuuuagucccaaccacuaguuuuaacaaaugugaauuauugaaaugugaagggacaa

SEQ ID NO: 250060 - RNA, 64 nt, Homo Sapiens
ccaaccacuaguuuuaacaaaugugaauuauugaaaugugaagggacaaaaagaaucauacauu

SEQ ID NO: 250061 - RNA, 64 nt, Homo Sapiens
ugagugaagcucccuucaggaugugaaugaagcuaaugugaauguguugaaugacugacccaaa

SEQ ID NO: 250062 - RNA, 64 nt, Homo Sapiens
aagcuaaugugaaugugaguaaugacugacccaaaaugugaaugcauuugacacacaguuguug

SEQ ID NO: 250063 - RNA, 64 nt, Homo Sapiens
uuaaaugaccugcaucaaguauagacacugugcuaaugugaauuaucuguauuaucaauuucuc

SEQ ID NO: 250064 - RNA, 64 nt, Homo Sapiens
cuggcccagcuugcuggaaaaugaaaaguaaauuaaugugaaacuuucauuuucuguauuauau

SEQ ID NO: 250065 - RNA, 64 nt, Homo Sapiens
cacauaggaaaauucauacuggagagaaacuacaaaugugaagaauguguuaaagccuuuaaca

SEQ ID NO: 250066 - RNA, 64 nt, Homo Sapiens
aguugagaaaauucguacuggagagaauccuacaaaugugaaaaauguggcaaauccuuuaacu

SEQ ID NO: 250067 - RNA, 64 nt, Homo Sapiens
gauaagaaaauucauacuggaaagaaacccuacaaaugugaagucuguggcaaagcuuuuaacu

SEQ ID NO: 250068 - RNA, 64 nt, Homo Sapiens
auaagacaguuuauacuuugagagaaacccugcaaaugugaauaauguggcaauacuuuaaacc

SEQ ID NO: 250069 - RNA, 64 nt, Homo Sapiens
ucuaacauaaaucauacuggugaaaaauccuagaaaugugaaaaauaucacaaagccuuuaaau

SEQ ID NO: 250070 - RNA, 64 nt, Homo Sapiens
cauaagaaaauuuacacuagagagaaagccuacaaaugugaagaauguggcaaagccuuuaacc

SEQ ID NO: 250071 - RNA, 64 nt, Homo Sapiens
cauaagauaauucauagcggagagaaaccccacaaaugugaagaauguggcagagcuuuuaacc

SEQ ID NO: 250072 - RNA, 64 nt, Homo Sapiens
cauaagauaauucacaguggagaaaaacccuacaaaugugaagaauguggcaaagcuuuuaacc

SEQ ID NO: 250073 - RNA, 64 nt, Homo Sapiens
cauaagaaaauucauaguaaagagaaacccuacaaaugugaacaguguggcaaggucuuuaaga

SEQ ID NO: 250074 - RNA, 64 nt, Homo Sapiens
cacaagaagauucauacuagagagaaacccuacaaaugugaagaauguggcauaucuuuuaacc

SEQ ID NO: 250075 - RNA, 64 nt, Homo Sapiens
cauaagaugauucacacuugaaugaaacccuacaaaugugaacgauguggcaguuguuuuaacu

SEQ ID NO: 250076 - RNA, 64 nt, Homo Sapiens
cauaagaaaauucaaacuggagagaaacucuacaaaugugaagaauguggcaaagcuuuuaacc

SEQ ID NO: 250077 - RNA, 64 nt, Homo Sapiens
acaccuaaaauucaugcaggagagaaacaccacaaaugugaaaaauuugguaaauucuuuaaca

SEQ ID NO: 250078 - RNA, 64 nt, Homo Sapiens
auccauacuagagagaagcccuacaaauguaaagaaugugaaaagucuuucagucagagcucaa

SEQ ID NO: 250079 - RNA, 64 nt, Homo Sapiens
cauaaaagaauacacacuagagaaaaaccuuacaaaugugaagcaucugauaaauccugugaag

SEQ ID NO: 250080 - RNA, 64 nt, Homo Sapiens
auucacaugggaauaaaauuccauugcugcaaugaaugugaaaaagccaucagucaaagaaacu

SEQ ID NO: 250081 - RNA, 64 nt, Homo Sapiens
cacuguuugagaaugaugcuacucugaucuaaugaaugugaacauguagauguuuuguguguau

SEQ ID NO: 250082 - RNA, 64 nt, Homo Sapiens
uacacacuuguauauacauucuugagaacacugcaaugugaaaaucacguuugcuauuuauaaa

SEQ ID NO: 250083 - RNA, 64 nt, Homo Sapiens
uagaaaacacugacuuuguuuuuauaaguuauuaaaugugaaauugaucugcaucagcuuauuu

SEQ ID NO: 250084 - RNA, 64 nt, Homo Sapiens
ugaaaacauuuguaaggcugcaacauaauauuaaaaugugaauaaauaaauguucugauaaaau

SEQ ID NO: 250085 - RNA, 64 nt, Homo Sapiens
acuuuaaugaaagguggaaaauaauuuaacuuacaaugugaaaauacaaugugaaauguacaau

SEQ ID NO: 250086 - RNA, 64 nt, Homo Sapiens
guggaaaauaauuuaacuuacaaugugaaaauacaaugugaaauguacaauaaaucauauuuau

SEQ ID NO: 250087 - RNA, 64 nt, Homo Sapiens
guauaugccacuaauaaaaugaaucuaaacauugaaugugaauggcccucagaaaaucaucuag

SEQ ID NO: 250088 - RNA, 64 nt, Homo Sapiens
ugucauauacuauugauccuuuggcacuuaaauaaaugugaaauccuccaggaauuuuccugug

SEQ ID NO: 250089 - RNA, 64 nt, Homo Sapiens
ugaaaauguguuuacuucagaacggcacuacauaaaugugaaaaguuguugaucuugaaauauc

SEQ ID NO: 250090 - RNA, 64 nt, Homo Sapiens
guugacuuuaaugaaucuuugguguggaaugaaaaaugugaacuucuuacucauagugugguuu

SEQ ID NO: 250091 - RNA, 64 nt, Homo Sapiens
gaaucaaguaauucugcuuaccuagagguccagcaaugugaaaaaacggaaaauuuacaagcaa

SEQ ID NO: 250092 - RNA, 64 nt, Homo Sapiens
acugauaggcuuuuaagcuugugauuuaaauuugaaugugaaauugaauuuacugguauacuaa

SEQ ID NO: 250093 - RNA, 64 nt, Homo Sapiens
uaauuugccagacagagaucagaauugaaccgucaaugugaaauaaagaguucuccuuguacuu

SEQ ID NO: 250094 - RNA, 64 nt, Homo Sapiens
uuauguaaacaucauaaauaguaaauaaugauucaaugugaauuuuaaaaugcaaauauugcua

SEQ ID NO: 250095 - RNA, 64 nt, Homo Sapiens
agcgagccacggcagcccccuguaucuggauuguaaugugaaucuuuaggguaauuccuccagu

SEQ ID NO: 250096 - RNA, 64 nt, Homo Sapiens
cccaaacaggauuaacugugaagacuaauuuauaaaugugaaccuaagaaaacuccaccucuga

SEQ ID NO: 250097 - RNA, 64 nt, Homo Sapiens
uauaccaaauaaaguuucuauucuauauaccaaaaaugugaagucugcauuaagaaaauaaaau

SEQ ID NO: 250098 - RNA, 64 nt, Homo Sapiens
auuuauauauugcacauucuucuguuaauuuuuuaaugugaauaauuuacugcauaugaggcuu

SEQ ID NO: 250099 - RNA, 64 nt, Homo Sapiens
cugggaacaaaccucacuugagcugugccuagacaaugugaauuccuguguugcuaacagaagu

SEQ ID NO: 250100 - RNA, 64 nt, Homo Sapiens
aacauuucuggaacauggauuuguguucaccuuaaaugugaaaauaaauccuauuuucuaugga

SEQ ID NO: 250101 - RNA, 64 nt, Homo Sapiens
aauaugauuuuuaagagauuuauguucuacuuaaaaugugaauuguacuucugagcugccuuaa

SEQ ID NO: 250102 - RNA, 64 nt, Homo Sapiens
agcugugcacuugccuuguugcugaaguuccaauaaugugaaaaccaaaguagagguuuuuuuc

SEQ ID NO: 250103 - RNA, 64 nt, Homo Sapiens
ucauguuuuuucaaaucuguggguuauuguaaucaaugugaauacaacguuacaaucauuuuua

SEQ ID NO: 250104 - RNA, 64 nt, Homo Sapiens
aaauuacauagauggguguugaugcaggggagaaaaugugaauuugaaacucucaagggaaggu

SEQ ID NO: 250105 - RNA, 64 nt, Homo Sapiens
aucauuaacaguuuguccuuaggaugcaaaugaaaaugugaauacauaccuuguuguacuguug

SEQ ID NO: 250106 - RNA, 64 nt, Homo Sapiens
uuuaaucauaagccuuaauaagauuuuucuaagaaaugugaaauagaacaauuuucaucuaauu

SEQ ID NO: 250107 - RNA, 64 nt, Homo Sapiens
ggagcuaguuuacaggcuuacugugauuuaagcaaaugugaaaagugaaaccuuaauuuuauca

SEQ ID NO: 250108 - RNA, 64 nt, Homo Sapiens
aggguuuccugaaacuggguuaauucuuuauagaaaugugaacacugaauuuauuuuaaaaaau

SEQ ID NO: 250109 - RNA, 64 nt, Homo Sapiens
accuggugucuccugcccacccuggucccagguaaaugugaauggagacagguaugagaggcug

SEQ ID NO: 250110 - RNA, 64 nt, Homo Sapiens
uggugauaacugccucguuuaaauggucacaagaaaugugaagagagagcuagggcagacaugc

SEQ ID NO: 250111 - RNA, 64 nt, Homo Sapiens
uauauuauuuggcuagaaauugcuguuuuuaauaaaugugaauuuuuuaaaaauaaagauuuuu

SEQ ID NO: 250112 - RNA, 64 nt, Homo Sapiens
gaaauuaaaacuuucuucaugguaaacaauguuuaaugugaaaaaauuucuguuagcugauugu

SEQ ID NO: 250113 - RNA, 64 nt, Homo Sapiens
cuguuaguguugacuaaagauguugacuagcugaaaugugaauuuguuaaauauuuauaugcuu

SEQ ID NO: 250114 - RNA, 64 nt, Homo Sapiens
cuuacucaacuugcuuuuuuacauauagugucugaaugugaaguuucauuuuuugaagcuuucu

SEQ ID NO: 250115 - RNA, 64 nt, Homo Sapiens
uauauucucaaguuuauuuucaucuggccuuagaaaugugaagugaaaagaauaaguauucuug

SEQ ID NO: 250116 - RNA, 64 nt, Homo Sapiens
uuccacaaaauauccaacuucgcagcugacaaaaaaugugaaauguuuuuuuggguaacaaucc

SEQ ID NO: 250117 - RNA, 64 nt, Homo Sapiens
uuuuugcuuauucauugaaucaauaguaaugauaaaugugaacauuagccagaaagcaaaaaaa

SEQ ID NO: 250118 - RNA, 64 nt, Homo Sapiens
agaauaagagcuuuuuuguuucuuggguuuuuaaaaugugaaucugcaaugaucauaaaaauua

SEQ ID NO: 250119 - RNA, 64 nt, Homo Sapiens
uaaaaugugaaucugcaaugaucauaaaaauuaaaaugugaaugucaacaauaaaaagcaagac

SEQ ID NO: 250120 - RNA, 64 nt, Homo Sapiens
auguagacugccauuauguguggucuucccauuaaaugugaacauuuuaauauguaugcauuca

SEQ ID NO: 250121 - RNA, 64 nt, Homo Sapiens
uccacuccugcuuuccuaaggaugaaacagugauaaugugaacucaaaugagguuuccugggua

SEQ ID NO: 250122 - RNA, 64 nt, Homo Sapiens
acauguugcagaagaccagaucauuuuuauacagaaugugaaauacugauacaguuauucuuuu

SEQ ID NO: 250123 - RNA, 64 nt, Homo Sapiens
aguaaaaaugaaauaacuggauuuguuugcugaaaaugugaaauuaaacccuguuugcaccucg

SEQ ID NO: 250124 - RNA, 64 nt, Homo Sapiens
aaacccuguuugcaccucgaccaguuaauauauuaaugugaaaucuauuuauuugacaaaaaau

SEQ ID NO: 250125 - RNA, 64 nt, Homo Sapiens
cauaagauaauuaaugcuggagagaaacccuacaaaugugaagaauguggcaaagauuucuauu

SEQ ID NO: 250126 - RNA, 64 nt, Homo Sapiens
cauaaaauaauucauaaaggagauaaauuauacaaaugugaagaauguggcaaagcuuuuaaca

SEQ ID NO: 250127 - RNA, 64 nt, Homo Sapiens
cauaagauaauuuauacuggagagaagcccuacaaaugugaaaaauguggcaaaccuuuuaacc

SEQ ID NO: 250128 - RNA, 64 nt, Homo Sapiens
cauuagauaauucaugcuggagagaaacccuacaaaugugaaaaauguggcaaagcuuuuaacc

SEQ ID NO: 250129 - RNA, 64 nt, Homo Sapiens
cauaagauaacucauacuggagaaaaaucuuacaaaugugaagaauguggcaaagccuuuaucc

SEQ ID NO: 250130 - RNA, 64 nt, Homo Sapiens
aacaaaauaauucauacaggagagaaacccuacaaaugugaagaaugugacaaagccuuuaacc

SEQ ID NO: 250131 - RNA, 64 nt, Homo Sapiens
cuaaacauaauucauaauggagaaaaacccuacaaaugugaagaaugugucaaagcuuuuaacu

SEQ ID NO: 250132 - RNA, 64 nt, Homo Sapiens
aacauaagggaauucauaauagagaaacccuacaaaugugaagaacguggccuggcuuuuaaca

SEQ ID NO: 250133 - RNA, 64 nt, Homo Sapiens
uuuaaagaaaaucauucugcugaaaaauccuagaaaugugaagaaugugaaaaagccuuuaaau

SEQ ID NO: 250134 - RNA, 64 nt, Homo Sapiens
aaucauucugcugaaaaauccuagaaaugugaagaaugugaaaaagccuuuaaaugauugucac

SEQ ID NO: 250135 - RNA, 64 nt, Homo Sapiens
augugacaaagccuuuaaauugagaaauccuagaaaugugaagauauaaaagaaaucauaugaa

SEQ ID NO: 250136 - RNA, 64 nt, Homo Sapiens
auguggcaagccuuuuagcuagggaaacccuacaaaugugaagacauaagggaauuuauacagg

SEQ ID NO: 250137 - RNA, 64 nt, Homo Sapiens
acguggcaaagcuuuucauuggaaaagcccuacaaaugugaaaaauaaaagaauucauacugga

SEQ ID NO: 250138 - RNA, 51 nt, Homo Sapiens
augugguaaauccuucagcuaaaugugaagaauacuggagagaaucccuaa

SEQ ID NO: 250139 - RNA, 64 nt, Homo Sapiens
aggaccagcgcaaugaaugcucucagggcguuugaaugugaauuguguauccuguuagcuccau

SEQ ID NO: 250140 - RNA, 64 nt, Homo Sapiens
uuaucuuaugagacucuguuauauguacccucgaaaugugaauguuguauucucaguaguuccg

SEQ ID NO: 250141 - RNA, 64 nt, Homo Sapiens
auaauuccuauggacacuccaacuuuuccugauuaaugugaaaaaggauggggccuggaaaggc

SEQ ID NO: 250142 - RNA, 64 nt, Homo Sapiens
ggaaaauauuuccugacuugaguguuccuuuuuaaaugugaauuuuuauuucuuuuuaauuauu

SEQ ID NO: 250143 - RNA, 64 nt, Homo Sapiens
aaaaaauggaaaaaaacauaaaaagcagaauuuuaaugugaagacauuuuuugcuauaaucauu

SEQ ID NO: 250144 - RNA, 64 nt, Homo Sapiens
aacuuaugaauaaaaggaaaaaagguauacuuacaaugugaaguuucguguccuccuuauuuaa

SEQ ID NO: 250145 - RNA, 64 nt, Homo Sapiens
gauccagaaauaagugcuguaggguuauaauuugaaugugaacuuauucuugagaaaaagauaa

SEQ ID NO: 250146 - RNA, 64 nt, Homo Sapiens
caaauaagaugguguguauguaagaaauuuguaaaaugugaagagcuaucuacacuaaguucgu

SEQ ID NO: 250147 - RNA, 64 nt, Homo Sapiens
aggggggacuaugagaucaaaauauuuuuauuauaaugugaagacauugucuuuucacucuauc

SEQ ID NO: 250148 - RNA, 64 nt, Homo Sapiens
uucagaaaugacuuggccucauuuuggauuucauaaugugaaguauucaugauuuugaacuggu

SEQ ID NO: 250149 - RNA, 64 nt, Homo Sapiens
uaccauggcaguaauggggcaaacaauaaaaugcaaugugaaaugauuugaugauuugggaaau

SEQ ID NO: 250150 - RNA, 64 nt, Homo Sapiens
ccaucuuuuaugacugcaacugcuuucuaaaaugaaugugaaugguuuuuuacaucuacguugu

SEQ ID NO: 250151 - RNA, 64 nt, Homo Sapiens
gucuucauucaauguuaaacucacuugaaacauaaaugugaaaugguuuagccuucuaauuagu

SEQ ID NO: 250152 - RNA, 64 nt, Homo Sapiens; identical to SEQ ID NO: 216924

SEQ ID NO: 250153 - RNA, 64 nt, Homo Sapiens; identical to SEQ ID NO: 216925

SEQ ID NO: 250154 - RNA, 64 nt, Homo Sapiens; identical to SEQ ID NO: 22092

SEQ ID NO: 250155 - RNA, 64 nt, Homo Sapiens; identical to SEQ ID NO: 22093

SEQ ID NO: 250156 - RNA, 64 nt, Homo Sapiens; identical to SEQ ID NO: 22094

SEQ ID NO: 250157 - RNA, 64 nt, Homo Sapiens; identical to SEQ ID NO: 22095

SEQ ID NO: 250158 - RNA, 64 nt, Homo Sapiens; identical to SEQ ID NO: 22096

SEQ ID NO: 250159 - RNA, 64 nt, Homo Sapiens; identical to SEQ ID NO: 22097

SEQ ID NO: 250160 - RNA, 64 nt, Homo Sapiens; identical to SEQ ID NO: 22098

SEQ ID NO: 250161 - RNA, 64 nt, Homo Sapiens; identical to SEQ ID NO: 22099

SEQ ID NO: 250162 - RNA, 64 nt, Homo Sapiens; identical to SEQ ID NO: 22100

SEQ ID NO: 250163 - RNA, 64 nt, Homo Sapiens; identical to SEQ ID NO: 22101

SEQ ID NO: 250164 - RNA, 64 nt, Homo Sapiens; identical to SEQ ID NO: 22102

SEQ ID NO: 250165 - RNA, 64 nt, Homo Sapiens; identical to SEQ ID NO: 22103

SEQ ID NO: 250166 - RNA, 64 nt, Homo Sapiens; identical to SEQ ID NO: 22104

SEQ ID NO: 250167 - RNA, 64 nt, Homo Sapiens; identical to SEQ ID NO: 22105

SEQ ID NO: 250168 - RNA, 64 nt, Homo Sapiens; identical to SEQ ID NO: 22106

SEQ ID NO: 250169 - RNA, 64 nt, Homo Sapiens; identical to SEQ ID NO: 22107

SEQ ID NO: 250170 - RNA, 64 nt, Homo Sapiens; identical to SEQ ID NO: 22108

SEQ ID NO: 250171 - RNA, 64 nt, Homo Sapiens; identical to SEQ ID NO: 22109

SEQ ID NO: 250172 - RNA, 64 nt, Homo Sapiens; identical to SEQ ID NO: 22110

SEQ ID NO: 250173 - RNA, 64 nt, Homo Sapiens; identical to SEQ ID NO: 22111

SEQ ID NO: 250174 - RNA, 64 nt, Homo Sapiens; identical to SEQ ID NO: 22112

SEQ ID NO: 250175 - RNA, 64 nt, Homo Sapiens; identical to SEQ ID NO: 22113

SEQ ID NO: 250176 - RNA, 64 nt, Homo Sapiens; identical to SEQ ID NO: 132737

SEQ ID NO: 250177 - RNA, 64 nt, Homo Sapiens; identical to SEQ ID NO: 132738

SEQ ID NO: 250178 - RNA, 64 nt, Homo Sapiens; identical to SEQ ID NO: 132739

SEQ ID NO: 250179 - RNA, 64 nt, Homo Sapiens; identical to SEQ ID NO: 132740

SEQ ID NO: 250180 - RNA, 64 nt, Homo Sapiens; identical to SEQ ID NO: 132741

SEQ ID NO: 250181 - RNA, 64 nt, Homo Sapiens; identical to SEQ ID NO: 132742

SEQ ID NO: 250182 - RNA, 64 nt, Homo Sapiens; identical to SEQ ID NO: 132743

SEQ ID NO: 250183 - RNA, 64 nt, Homo Sapiens; identical to SEQ ID NO: 132744

SEQ ID NO: 250184 - RNA, 64 nt, Homo Sapiens; identical to SEQ ID NO: 132745

SEQ ID NO: 250185 - RNA, 64 nt, Homo Sapiens; identical to SEQ ID NO: 132746

SEQ ID NO: 250186 - RNA, 64 nt, Homo Sapiens; identical to SEQ ID NO: 132747

SEQ ID NO: 250187 - RNA, 64 nt, Homo Sapiens; identical to SEQ ID NO: 132748

SEQ ID NO: 250188 - RNA, 64 nt, Homo Sapiens; identical to SEQ ID NO: 132749

SEQ ID NO: 250189 - RNA, 64 nt, Homo Sapiens; identical to SEQ ID NO: 132750

SEQ ID NO: 250190 - RNA, 64 nt, Homo Sapiens; identical to SEQ ID NO: 132751

SEQ ID NO: 250191 - RNA, 64 nt, Homo Sapiens; identical to SEQ ID NO: 132752

SEQ ID NO: 250192 - RNA, 64 nt, Homo Sapiens; identical to SEQ ID NO: 132753

SEQ ID NO: 250193 - RNA, 64 nt, Homo Sapiens; identical to SEQ ID NO: 132754

SEQ ID NO: 250194 - RNA, 64 nt, Homo Sapiens; identical to SEQ ID NO: 132755

SEQ ID NO: 250195 - RNA, 64 nt, Homo Sapiens; identical to SEQ ID NO: 132756

SEQ ID NO: 250196 - RNA, 64 nt, Homo Sapiens; identical to SEQ ID NO: 132757

SEQ ID NO: 250197 - RNA, 64 nt, Homo Sapiens; identical to SEQ ID NO: 132758

SEQ ID NO: 250198 - RNA, 64 nt, Homo Sapiens; identical to SEQ ID NO: 132759

SEQ ID NO: 250199 - RNA, 64 nt, Homo Sapiens; identical to SEQ ID NO: 132760

SEQ ID NO: 250200 - RNA, 64 nt, Homo Sapiens; identical to SEQ ID NO: 132761

SEQ ID NO: 250201 - RNA, 64 nt, Homo Sapiens; identical to SEQ ID NO: 132762

SEQ ID NO: 250202 - RNA, 65 nt, Homo Sapiens
guugugugucgugugggaguggggcgauuuuuuaugugccaaauacccccgucccccccaugaau

SEQ ID NO: 250203 - RNA, 65 nt, Homo Sapiens
ccuuaaguguauuccugacaguuaaauucagaaacgugccaaauggaacucaaggugccccuuca

SEQ ID NO: 250204 - RNA, 65 nt, Homo Sapiens
aaaucaaaucccccgacauacguuuuuuuuaaucugugccaaaaauguguuuucagaggaaaucu

SEQ ID NO: 250205 - RNA, 65 nt, Homo Sapiens
aauuuugccaauugcuggaccaauggcaaacauuagugccaaauguauaauacuauauguuagca

SEQ ID NO: 250206 - RNA, 65 nt, Homo Sapiens
uagaauuuauguaaacuaguaaccaguugaucucugugccaaauacauuauaucaggauuacaca

SEQ ID NO: 250207 - RNA, 65 nt, Homo Sapiens
uacauaaauauugauauauucuuuuucuacucaaagugccaaaggcuacaguuuuuaaugacuua

SEQ ID NO: 250208 - RNA, 65 nt, Homo Sapiens
guauuaacagugcaugcuuuuacuuuguaaauguggugccaaaucccuguuugccaucguuuuua

SEQ ID NO: 250209 - RNA, 65 nt, Homo Sapiens
ccucuuccuucuaagcaaaaggaaauaaacauccugugccaaagguauuggucauuuagaauguc

SEQ ID NO: 250210 - RNA, 65 nt, Homo Sapiens
ugcuaugguguugaaaacugcaguguccguuaugagugccaaaaaucugucuugaaggcagcuac

SEQ ID NO: 250211 - RNA, 65 nt, Homo Sapiens
cuauucaaucuuagggugucuauccacgucuggcugugccaaauggucuggcagcugguuuuggc

SEQ ID NO: 250212 - RNA, 65 nt, Homo Sapiens
ucucugggacccuggaauccuagguacccacaugugugccaaagccuaccccaccuggcaggugu

SEQ ID NO: 250213 - RNA, 65 nt, Homo Sapiens
caugucucacuuggaaagcuaguacuuuuaaaugggugccaaaggucaacuguaaugagauaauu

SEQ ID NO: 250214 - RNA, 59 nt, Homo Sapiens
gagagauggugcuggaguaaauaucauuagugccaaagggauucuucuccaaaacuuua

SEQ ID NO: 250215 - RNA, 65 nt, Homo Sapiens
guccuuugcggugagcuauguuuacaugacacagugugccaaagugacuuacugcgguugcguua

SEQ ID NO: 250216 - RNA, 65 nt, Homo Sapiens
aaaagguucucagguguugcgcgucuuccugaguggugccaaacacuugccucaaugccaguaac

SEQ ID NO: 250217 - RNA, 65 nt, Homo Sapiens
cuggaucuuuccacauuucagugcuauagcuccuggugccaaaguuguuggagcccuggauucug

SEQ ID NO: 250218 - RNA, 61 nt, Homo Sapiens
cuacauugagacugcuuugacaccaucaaaggugccaaaauucaaauauuuggagagcuaa

SEQ ID NO: 250219 - RNA, 65 nt, Homo Sapiens
cuuuuuaaaagguaaaaaaauuacagaaccuuguagugccaaaaauaaauugucacuucuauucu

SEQ ID NO: 250220 - RNA, 65 nt, Homo Sapiens
cagguccgaggccaaaguucggccccagaugcgcugugccaaagcgggcagccacggagugggga

SEQ ID NO: 250221 - RNA, 65 nt, Homo Sapiens
uucucuucaaaugccaccuuuacguaguggaggaugugccaaauauuuugaggcauaggguagcu

SEQ ID NO: 250222 - RNA, 65 nt, Homo Sapiens
aguuaucaaugugagacucuacauuauguaaggaagugccaaaauuaagguauuucuaaauaaac

SEQ ID NO: 250223 - RNA, 65 nt, Homo Sapiens
uagugaaacacaaacaaaggauagaaaaucccuaugugccaaaagagcuaaauggucuuagaagc

SEQ ID NO: 250224 - RNA, 65 nt, Homo Sapiens
caaucaugccuuucacggccgguuauccacucugugugccaaaacccucauuccagccaauguau

SEQ ID NO: 250225 - RNA, 65 nt, Homo Sapiens
aguuugacuacucucuguuuuaauauauauuaagugugccaaaucaaugaaaaauauaauguuga

SEQ ID NO: 250226 - RNA, 65 nt, Homo Sapiens
aacuuuagucagaaugugaguuuuuuuuauuugaagugccaaauuucaguuuuguguguuuuuuu

SEQ ID NO: 250227 - RNA, 55 nt, Homo Sapiens
aaacuuuuaaaacagcuacagccuugugccaaaaguucuuuccacagcuuuguaa

SEQ ID NO: 250228 - RNA, 65 nt, Homo Sapiens
uaaccuuacauuucuuagaaauucauuuauagauggugccaaagcugucuuuuugagagcucauc

SEQ ID NO: 250229 - RNA, 65 nt, Homo Sapiens
aauccccuuccucuuucucauccucuauuuuuaaagugccaaacagccucuccaguccugcuuac

SEQ ID NO: 250230 - RNA, 65 nt, Homo Sapiens
uuuuauaaacauaaauuuuuauuuguaacuucucugugccaaaccucaugucaacuuuccagaug

SEQ ID NO: 250231 - RNA, 65 nt, Homo Sapiens
gauuaugaaauuugugccuacaauuguuagaaaaggugccaaacagaaccuagauauuuuguguu

SEQ ID NO: 250232 - RNA, 65 nt, Homo Sapiens
ccaggaggacaagagccuuaugcccagcacccgaagugccaaauuauguuaucugggauucaccg

SEQ ID NO: 250233 - RNA, 65 nt, Homo Sapiens
aaguuuauuuucuuuuuucguuuuauaaauucagugugccaaaugaaacuuuuuuccuaaguaac

SEQ ID NO: 250234 - RNA, 65 nt, Homo Sapiens
ccauucauuaguguuauuucauuguaaacguuauugugccaaauguacuguauucaaaaggaugu

SEQ ID NO: 250235 - RNA, 65 nt, Homo Sapiens
cuugguguuugcucucccuugacccaccccagugagugccaaagggcagccccaacaugugcacc

SEQ ID NO: 250236 - RNA, 65 nt, Homo Sapiens
ucauguuucagcgcaugcgccccagccuuucccaugugccaaaccagaagcuccacugcccguag

SEQ ID NO: 250237 - RNA, 65 nt, Homo Sapiens
agaaugcaauuugaaaacuacaggcuuaggacucugugccaaaaaucucuauuuuaaaugaaaau

SEQ ID NO: 250238 - RNA, 65 nt, Homo Sapiens
uuccccauuuuucagaagcgacauuucauauauaggugccaaaagugaaucggggugcggagagu

SEQ ID NO: 250239 - RNA, 65 nt, Homo Sapiens
guauggaguuauuuauuugcuacauaauagauacugugccaaauaauuacuuuuuauuuauuuua

SEQ ID NO: 250240 - RNA, 65 nt, Homo Sapiens
gcacagggccccgcugggccuccucaccaacggcagugccaaaaucagcccccacaucaaggugg

SEQ ID NO: 250241 - RNA, 65 nt, Homo Sapiens
gaaaaaaagcuagagacccuuuuaaagggcuuaaugugccaaaaauaaagauaggucagaaguau

SEQ ID NO: 250242 - RNA, 65 nt, Homo Sapiens
cagaccacugggguuuccugugccuucuacucccagugccaaagccacccagccagcccuucagg

SEQ ID NO: 250243 - RNA, 65 nt, Homo Sapiens
ugucaguauugcauguaaauauuucuuuucaaaaagugccaaauuuuaaagcaaguguuuuguac

SEQ ID NO: 250244 - RNA, 65 nt, Homo Sapiens
ugacaugagcugcgguucuguuaaauaaaauuuaugugccaaaccugauugugucaaugugaaag

SEQ ID NO: 250245 - RNA, 65 nt, Homo Sapiens
acugccaagaaucaaggcuucuggagcugugaguggugccaaaagccaaggagccaacgagggcu

SEQ ID NO: 250246 - RNA, 65 nt, Homo Sapiens
gguccacaaccaggugugcagaagaagcaauggucgugccaaagaugcaccuccaagauaacaaa

SEQ ID NO: 250247 - RNA, 65 nt, Homo Sapiens
aaaaaucucagaaaucuuaaccaaauguauugauagugccaaaaaagaaugacuuuucagacuua

SEQ ID NO: 250248 - RNA, 65 nt, Homo Sapiens
uuuacuacuguggaaagacauuuuuuauacuguaugugccaaagcauaauuauggugggugauua

SEQ ID NO: 250249 - RNA, 65 nt, Homo Sapiens
uuuucccacuuuugcucuucacuacucuuuaacgagugccaaaucuagaagccccauucaauauc

SEQ ID NO: 250250 - RNA, 65 nt, Homo Sapiens
guaauuagaauuguuggcaugaugacauuucauuugugccaaaaauauuaaaaaugccuuuuuug

SEQ ID NO: 250251 - RNA, 65 nt, Homo Sapiens
uguacuccaggcgaggccucuggaccuguguuccugugccaaaguccugucaggcuggugggcac

SEQ ID NO: 250252 - RNA, 65 nt, Homo Sapiens
cuguguggcaucugaacuuuuauaaagguuuccuugugccaaauaagugcaaagauuuaauuuac

SEQ ID NO: 250253 - RNA, 65 nt, Homo Sapiens
augauauauaggaucaugauauuccuucuauccaugugccaaauggguguaauguuuauuuacug

SEQ ID NO: 250254 - RNA, 65 nt, Homo Sapiens
gccuugaugauuuaauauggauuuguuacagccaagugccaaaugcucucucaaauugucagcaa

SEQ ID NO: 250255 - RNA, 65 nt, Homo Sapiens
ccagggccuccuugcccagcccaguccaggcugcugugccaaaucccaaccagccacgccucagc

SEQ ID NO: 250256 - RNA, 65 nt, Homo Sapiens
guuuuguuuuucagcguuaauguaaaggggcagcagugccaaaauauaaucagagauaaagcuua

SEQ ID NO: 250257 - RNA, 65 nt, Homo Sapiens
uauuguuguuguuuuuuaaccgaguuuucccaucagugccaaaacucaacucaaucugaaaguag

SEQ ID NO: 250258 - RNA, 65 nt, Homo Sapiens
ccaagagacaggcccagagccuaaaggcaaggacagugccaaaagguucugugagcccaucgggg

SEQ ID NO: 250259 - RNA, 65 nt, Homo Sapiens
ggauauuaguguucagcagcuuauuauuuaaaggggugccaaauauagcauccuucuguuguuua

SEQ ID NO: 250260 - RNA, 65 nt, Homo Sapiens
gcaacccugauagaguaaauaaauuuuaugggcgggugccaaauacugcugugaaucuauuugua

SEQ ID NO: 250261 - RNA, 65 nt, Homo Sapiens
uuuuugauugcugcagguaaauucucuaaaagaaggugccaaagcgaugcauccuguuuugugca

SEQ ID NO: 250262 - RNA, 65 nt, Homo Sapiens
cccaccuucagggaccaccucccugcaucccugcagugccaaagcugcauuuucaccugagguuu

SEQ ID NO: 250263 - RNA, 65 nt, Homo Sapiens
aguaauuuccaaacuucuguaagauaaucugcuuugugccaaaacaguaauucuguauuucuacu

SEQ ID NO: 250264 - RNA, 65 nt, Homo Sapiens
cuggggcagggggugaagaagcugaaugucaaacagugccaaaugcugguccucccauuucuaaa

SEQ ID NO: 250265 - RNA, 65 nt, Homo Sapiens
caggccucugcugccgcccuaggccacacgcacuggugccaaaaccccagugggaugggacaggg

SEQ ID NO: 250266 - RNA, 65 nt, Homo Sapiens
cagggacccagcacugggcuauuccucuuaggagagugccaaacuaagccaggucuucucucuuc

SEQ ID NO: 250267 - RNA, 65 nt, Homo Sapiens
guuccucagauccaauuguuauguuuguuuguacugugccaaacuguccgaccaagagcgaagga

SEQ ID NO: 250268 - RNA, 65 nt, Homo Sapiens
aaaaaugugccagaaagaaagucuuacuugugauugugccaaacaagccacaucuuaccuguaaa

SEQ ID NO: 250269 - RNA, 65 nt, Homo Sapiens
uagaauuccuucuaguuuuucugugagaaacuguugugccaaaaaagguuguaaugcacaggcaa

SEQ ID NO: 250270 - RNA, 65 nt, Homo Sapiens
cauaggucugaaacugagacaacauaagcgcuuuugugccaaaccccucaaaacaagcccuuccc

SEQ ID NO: 250271 - RNA, 65 nt, Homo Sapiens
acacuaugaacuuuuugaacacuuuuuaggcaggagugccaaaggugccuaaaaauauugcagug

SEQ ID NO: 250272 - RNA, 65 nt, Homo Sapiens
ucauuuucuaacaccaugugaaauucuuaaucacggugccaaaauuaaagguuaaacuugaaaag

SEQ ID NO: 250273 - RNA, 65 nt, Homo Sapiens
agugauaagauuuaagcuuagguacaauaugcuaugugccaaaugccuuggaagagagcauuugu

SEQ ID NO: 250274 - RNA, 55 nt, Homo Sapiens
ccagcuaaaccaagagagaaacagugugccaaacaagagccguucaaaagacuaa

SEQ ID NO: 250275 - RNA, 65 nt, Homo Sapiens
aaaugagaucucauuaaaagccaaucuagaucuuugugccaaacagcuacccaucugccagauca

SEQ ID NO: 250276 - RNA, 65 nt, Homo Sapiens
uaagcuguggaaaaugacucaagagcaauaaaucagugccaaagcuucccugcgcaucugaauag

SEQ ID NO: 250277 - RNA, 65 nt, Homo Sapiens
uuuauacagaaacucuuccugugugagcuguuaaggugccaaauuggcugucauuuguauucaug

SEQ ID NO: 250278 - RNA, 65 nt, Homo Sapiens
ucagaaaucuaauaggaaaacaugauacuuucaaugugccaaaacuaaaccuuaguauacaacua

SEQ ID NO: 250279 - RNA, 65 nt, Homo Sapiens
gauuuaaucuaaucuaauaauugugccccgcaguugugccaaagugcauagucugaguaaaaucu

SEQ ID NO: 250280 - RNA, 65 nt, Homo Sapiens
ucuugaaaucucucucucucaaaaugcuuaaaguagugccaaaaauaaaaucauaccuacccuga

SEQ ID NO: 250281 - RNA, 65 nt, Homo Sapiens
uccacagcucauuucuuuguuuaagauggaaaacagugccaaacccuuacaauacagaacaacug

SEQ ID NO: 250282 - RNA, 65 nt, Homo Sapiens
uuuuugacugaaaguacuaaaagucagcuuuacuagugccaaaccuuuaaauuuucaaaagaaaa

SEQ ID NO: 250283 - RNA, 65 nt, Homo Sapiens
ggaaaucucauuuucuuucuguaauucauucaguggugccaaagcuggggguucccuacaauggc

SEQ ID NO: 250284 - RNA, 65 nt, Homo Sapiens
caauauuuaguauuaacuauauaugauuuagcacugugccaaacacauuuucaagaguacauuuu

SEQ ID NO: 250285 - RNA, 65 nt, Homo Sapiens
caagaaauauuaacauuggugacaucaguauaaaagugccaaaccugcccucuuuuaaauaaaaa

SEQ ID NO: 250286 - RNA, 65 nt, Homo Sapiens
ggccuuaccagcccuagccucuagcacuucucuaagugccaaaaacagugucauuguguguguuc

SEQ ID NO: 250287 - RNA, 65 nt, Homo Sapiens
ugccuaagaugcgccuccacugucaccuguaccaagugccaaaacagcagaggggccaguuagag

SEQ ID NO: 250288 - RNA, 65 nt, Homo Sapiens
ggcucgggcuccccagccccaucccaaacccuucagugccaaaaacaacaacaaaaugaaacgca

SEQ ID NO: 250289 - RNA, 65 nt, Homo Sapiens
uaaauagagaauauacuuccacugaugcccuuacugugccaaaacaaaaaucuuaagaaaagcaa

SEQ ID NO: 250290 - RNA, 65 nt, Homo Sapiens
gcgcugggucuggggccucuguaugcccuaggccugugccaaaguggccagagauugggcugccu

SEQ ID NO: 250291 - RNA, 65 nt, Homo Sapiens
gaacguccguccucaggagcacagccucacggacagugccaaacccugugggucuccaggggcuu

SEQ ID NO: 250292 - RNA, 65 nt, Homo Sapiens
gaguauguccgaugguaucuuaccagagccuucaagugccaaacaccauaauugcuuugccaaaa

SEQ ID NO: 250293 - RNA, 65 nt, Homo Sapiens
agauuuuguagaauauugcauugauuaccuacugugugccaaacaaauucuugcaacaugcauuc

SEQ ID NO: 250294 - RNA, 65 nt, Homo Sapiens
ccuacccagaauguccagggucagugaaauuuugggugccaaacauuaagaaacagcauucuucu

SEQ ID NO: 250295 - RNA, 65 nt, Homo Sapiens
gaaauucaguuucuugugugccgagggggugcuuggugccaaacuggguggagaggaggcagggg

SEQ ID NO: 250296 - RNA, 65 nt, Homo Sapiens
acaaacgcugcuuggauaagcucccgcacuuuccagugccaaagugugcucucacaaaccccuga

SEQ ID NO: 250297 - RNA, 65 nt, Homo Sapiens
uucagugauuucuugcuauugaccgaugcuucacugugccaaaagagaaaaaaaauguuggguuu

SEQ ID NO: 250298 - RNA, 65 nt, Homo Sapiens
gagucauuuuccccagacacuacauuuggauacaggugccaaagaacauuauuaaggaauuauuu

SEQ ID NO: 250299 - RNA, 65 nt, Homo Sapiens
gaccaaucgcaugguucuccuggcaggccugcugugugccaaaaacucccacccaaggucccuca

SEQ ID NO: 250300 - RNA, 65 nt, Homo Sapiens
cuuucucuuucccauauuccuuuucuuuuucucuugugccaaacugacagaaaccgucaccacac

SEQ ID NO: 250301 - RNA, 65 nt, Homo Sapiens
acuuagucagucaacacuuauugagcaccuacuaagugccaaacacucuccuggacucuggcaaa

SEQ ID NO: 250302 - RNA, 65 nt, Homo Sapiens
uaccucuaggcauguuucaucccaacaaucagacugugccaaagcaggggacuuuguccuuugug

SEQ ID NO: 250303 - RNA, 65 nt, Homo Sapiens
aucuuaucaauacauaagaaauuuaggaagauuaggugccaaaauacccagcacaauacuuguau

SEQ ID NO: 250304 - RNA, 65 nt, Homo Sapiens
uggacagugugacuaucuuaugucaggaccuucaugugccaaacgucagugguguuuucauaugg

SEQ ID NO: 250305 - RNA, 65 nt, Homo Sapiens
aguaacaagguuugggacaaugucuaaggguuaaagugccaaagccauuucuguacuaacuguuc

SEQ ID NO: 250306 - RNA, 65 nt, Homo Sapiens
ggaugcugcccaagaccggcugcgugauccagccugugccaaaacccgcggagaaggcugccaug

SEQ ID NO: 250307 - RNA, 65 nt, Homo Sapiens
guaugaugauaauuguauaauaauuauacaugaaagugccaaaacccuacaauuaaacacuguau

SEQ ID NO: 250308 - RNA, 65 nt, Homo Sapiens
auaacugaguaaugcauaugaaauggaacuuuugggugccaaaugggacuuuuagauuaaaaaaa

SEQ ID NO: 250309 - RNA, 65 nt, Homo Sapiens
ugugaaauuccuuuuaccuucugugcagccuuugcgugccaaacuacaaaggccuuucuuuagau

SEQ ID NO: 250310 - RNA, 65 nt, Homo Sapiens
ugguguggccaggaaagggccaacuuucuggagaggugccaaacugucugccacuugcucccugc

SEQ ID NO: 250311 - RNA, 65 nt, Homo Sapiens
uaucauaccuaauuuuuauauuuaaaaagugcuuugugccaaaaauuuugcaaaaugagcuuggg

SEQ ID NO: 250312 - RNA, 65 nt, Homo Sapiens
agaaucaauuagguggauuuagaauugagaagaacgugccaaaugguaauuuuaauuuagugaac

SEQ ID NO: 250313 - RNA, 65 nt, Homo Sapiens
cgcucacccgccacccagugcuggccgccuucuuggugccaaacccccuucccccacccagagac

SEQ ID NO: 250314 - RNA, 65 nt, Homo Sapiens
agucucacaguuugcuugucuauuuauuuuauuuagugccaaauguauuccauuuuaaaaguaag

SEQ ID NO: 250315 - RNA, 65 nt, Homo Sapiens
uuuguauucacuuucuuuaaaaaauccaaguaaaagugccaaaacuacacuucuguaaaucucuu

SEQ ID NO: 250316 - RNA, 65 nt, Homo Sapiens
caauggagacuuucugaugcaucguuuucuuugcugugccaaagcaggucagaagagggagagga

SEQ ID NO: 250317 - RNA, 65 nt, Homo Sapiens
uagcuauggcauuaaaaggccucucuucucaucuggugccaaagguuccguugcagcuuuuuaca

SEQ ID NO: 250318 - RNA, 65 nt, Homo Sapiens
cugaagggcagggguuggcaacuuuucaacauggagugccaaacugcuaacccgucuucuagugu

SEQ ID NO: 250319 - RNA, 65 nt, Homo Sapiens
cuuuccucuaguaaccaccacauggcucagcaucugugccaaacauaggcgcuccuagucugguc

SEQ ID NO: 250320 - RNA, 65 nt, Homo Sapiens
ccacucccacugccaggauuuuguauugccaucgggugccaaauaaaugcucauauuuauuacug

SEQ ID NO: 250321 - RNA, 65 nt, Homo Sapiens
gaaaccaaacgguggauaaaguauuaaguaacuaagugccaaauaaaugcuggaaaucuugaccu

SEQ ID NO: 250322 - RNA, 50 nt, Homo Sapiens
ccaucaccagcaucuguccugugccaaagaagcucaguuugccagcauaa

SEQ ID NO: 250323 - RNA, 65 nt, Homo Sapiens
uuguuuucuucauuuaaauaauggccuucaugugagugccaaauuauaauuugacaagcuuaaaa

SEQ ID NO: 250324 - RNA, 65 nt, Homo Sapiens
uuugccuuggucguuguggaaagugccucauuucugugccaaauguccuauugaugcaccaaacc

SEQ ID NO: 250325 - RNA, 65 nt, Homo Sapiens
accugggccuaucagcguguaaagaaguuagaacagugccaaagacagccagcuuuucagaggga

SEQ ID NO: 250326 - RNA, 65 nt, Homo Sapiens
gauaguggcaauaauauuuuccaugaauuuguacugugccaaaauaaaaauacaaaaaaaaagca

SEQ ID NO: 250327 - RNA, 65 nt, Homo Sapiens
gauauugccuaaugugcaccuuguuuccaccaauagugccaaaaauggaggugggacaagcaggc

SEQ ID NO: 250328 - RNA, 65 nt, Homo Sapiens
uggaaugagcucuguuagggacaguugucugguuugugccaaaccuucgaggggcgaguagggag

SEQ ID NO: 250329 - RNA, 65 nt, Homo Sapiens
agaguucaugcccaaguccccagguuggaauggcugugccaaaauccauucaaaggguuuucuuu

SEQ ID NO: 250330 - RNA, 65 nt, Homo Sapiens
caauaugcuggggaaaggggagggagggaaugaaagugccaaagaaaacauguuuuuaagaacuc

SEQ ID NO: 250331 - RNA, 65 nt, Homo Sapiens
guuuuuauuuuguaguccuuucaguuauuuuuaaugugccaaaaauuuguacauguucaauuaaa

SEQ ID NO: 250332 - RNA, 65 nt, Homo Sapiens
guacagaguacaucaacuauuuucagcccaaaaaggugccaaaugcauauaaaucuugauaaaca

SEQ ID NO: 250333 - RNA, 65 nt, Homo Sapiens
uuuugucacugcuguaaagcaaaauauuugugaaagugccaaaauaaagucugucaugccaaaag

SEQ ID NO: 250334 - RNA, 65 nt, Homo Sapiens
acaugccugggauugggaaagauaggacuaaaguugugccaaacuauaucaauaaauuccauguu

SEQ ID NO: 250335 - RNA, 65 nt, Homo Sapiens
uuuaaccuaccuguagagauccucgucauggaaaggugccaaacuguuuugaauggaaggacaag

SEQ ID NO: 250336 - RNA, 65 nt, Homo Sapiens
cgcaccucccagaggaccggugggaauuguucauagugccaaaguccuacuacugcguuuucaau

SEQ ID NO: 250337 - RNA, 65 nt, Homo Sapiens
uuuaauagauguaaugaucauauggugcgucaccugugccaaauauucuucaaugaaauuauaua

SEQ ID NO: 250338 - RNA, 65 nt, Homo Sapiens
uuuauugccuuuugagauucuccaacuugacaaaugugccaaagaucaacagacagaaaauauca

SEQ ID NO: 250339 - RNA, 65 nt, Homo Sapiens
ugagaggauaaacaauauuauuaaaaggaaaggcagugccaaauaauaacuguuuauuuaccuaa

SEQ ID NO: 250340 - RNA, 65 nt, Homo Sapiens
uaaacuacugcaguugguggauggaacuuaauguugugccaaaguggauccaauacccaaaagaa

SEQ ID NO: 250341 - RNA, 65 nt, Homo Sapiens
ccauuuaacuuuuuuacaaguugauuuuucugaaggugccaaauuuuuuaaucuuaguuucccuu

SEQ ID NO: 250342 - RNA, 65 nt, Homo Sapiens
uucaucugcaaccgcuaugcuugacccccaucuaggugccaaaugugaaucacagccccagcucc

SEQ ID NO: 250343 - RNA, 65 nt, Homo Sapiens
gcagcugacucuucccacgacaggcaccugagauggugccaaaguccauucagauccggcuugga

SEQ ID NO: 250344 - RNA, 65 nt, Homo Sapiens
uuauaaugcaucuaaaccaccuguccccaguuaaugugccaaaaugucaauuuuuaacuuaucuc

SEQ ID NO: 250345 - RNA, 65 nt, Homo Sapiens
aaaccugugcuuucauguuuaagaaaugagaaauugugccaaagauagcagaagaguagauaagu

SEQ ID NO: 250346 - RNA, 65 nt, Homo Sapiens
gcucagggacuuagcaaaaugagaagaugugaccugugccaaaacuauuuugagaauuuuaaaug

SEQ ID NO: 250347 - RNA, 65 nt, Homo Sapiens
aauuaauuaguaugguauaaucuuuaauaaauuucgugccaaaaugcaugguuuuccacuuagca

SEQ ID NO: 250348 - RNA, 65 nt, Homo Sapiens
ccugaagugacccauucuaugaauuguuaauuaaggugccaaaaaaaauuaauaauaaagcuugg

SEQ ID NO: 250349 - RNA, 65 nt, Homo Sapiens
acaagggaggcaguggcuaguggggugaacagcuggugccaaauagccccagacugggcccaggc

SEQ ID NO: 250350 - RNA, 65 nt, Homo Sapiens
aaaugaaacaagccgucuuacucuuacuuuacuucgugccaaaucugucuuccauggcauauuua

SEQ ID NO: 250351 - RNA, 65 nt, Homo Sapiens
auucggauacuaagaugcauuuggauacuaaggaugugccaaauguuauuucuacugauuuuauu

SEQ ID NO: 250352 - RNA, 65 nt, Homo Sapiens
uauguaagagaauaaaugccuugauuuugguaauugugccaaagcgagaggaggaaagcaggcau

SEQ ID NO: 250353 - RNA, 65 nt, Homo Sapiens
agcuacaauaauagagaggacagucacaauuuucugugccaaagcagcucaaacccuguaaguua

SEQ ID NO: 250354 - RNA, 65 nt, Homo Sapiens
ggggacaguguugauaauaaggaacuauuuuacaggugccaaaaacuggcuccaaacucccgaaa

SEQ ID NO: 250355 - RNA, 65 nt, Homo Sapiens
aaauaaaugaaaucucugcaaaauguaguucccaugugccaaacaacacacagauaauaggaaca

SEQ ID NO: 250356 - RNA, 65 nt, Homo Sapiens
gugguacacuuagaaaauucguuacucugguuguugugccaaauuuuccaaauuggaauuguuuu

SEQ ID NO: 250357 - RNA, 65 nt, Homo Sapiens
uauugagucuuuuaugggauuacuauaaaaugagggugccaaauagauucuguaccaaaaaggag

SEQ ID NO: 250358 - RNA, 65 nt, Homo Sapiens
ugauuuucucuaggcacagcuucaauucaugacgagugccaaacugugacuauggcuuuucauuc

SEQ ID NO: 250359 - RNA, 65 nt, Homo Sapiens
cugacccggcccgggcugcguugccgccccuaauugugccaaaggaugcccuguggucacugcgg

SEQ ID NO: 250360 - RNA, 65 nt, Homo Sapiens
agccagcugcgggcccaggaugguugaaccuggaggugccaaaaagcacagcagagacagacugg

SEQ ID NO: 250361 - RNA, 65 nt, Homo Sapiens
ucauaaauucuguaguaaaguaucaucuuggcagugugccaaaggugaaaaugaugcuuucucua

SEQ ID NO: 250362 - RNA, 65 nt, Homo Sapiens
guccaaaugacccuuuucaggaugucucaaagcuugugccaaaggucacuuuucuuuccugccuu

SEQ ID NO: 250363 - RNA, 65 nt, Homo Sapiens
uuuuuucuuuuaaagaaaaaaagugaaaauauauagugccaaauuccaaagguacuuccuuccua

SEQ ID NO: 250364 - RNA, 65 nt, Homo Sapiens
gcuaaaugcaaacacuguguauuuauuaguuaggugugccaaacuaccguucccaaauugguguu

SEQ ID NO: 250365 - RNA, 65 nt, Homo Sapiens
ccugcaucugucuguccuuccuuccauugcucccagugccaaacuugggccgcugcaccgcggcg

SEQ ID NO: 250366 - RNA, 65 nt, Homo Sapiens
uuaaguaucgaagcuuaauaaauuauuguguccuggugccaaagggggccagccagaacugaggu

SEQ ID NO: 250367 - RNA, 65 nt, Homo Sapiens
cccauuacagucuccaccuccccgucuuccucugggugccaaaugaugggaagaugagcuucauc

SEQ ID NO: 250368 - RNA, 65 nt, Homo Sapiens
cugccaguguucgcccuagaguuauuacaaagccagugccaaaacccagccaugggcucuuugca

SEQ ID NO: 250369 - RNA, 65 nt, Homo Sapiens
ucaaacauguaauaaacuuuggauaauuaaauaaugugccaaauuuaaguuguaccacaauauuc

SEQ ID NO: 250370 - RNA, 65 nt, Homo Sapiens
gaguucuuaagcgcuccccuggcaaacaaauugaagugccaaacagcacucgcugcaggguauuu

SEQ ID NO: 250371 - RNA, 65 nt, Homo Sapiens
uacuccgccuuuguccuuaagguuuuugcaggccagugccaaacacacacuaacuguccuggccu

SEQ ID NO: 250372 - RNA, 65 nt, Homo Sapiens
caaaaaagaaaaaaaguaccccauguucagccccugugccaaauuugccuagguuuuccagcuga

SEQ ID NO: 250373 - RNA, 65 nt, Homo Sapiens
agagucugagucuugcccaaacauucuuucuuuuugugccaaaugacuugcauuugcaaagagcu

SEQ ID NO: 250374 - RNA, 65 nt, Homo Sapiens
ucauuauaaccccaaaauaacaguggcagucuuaagugccaaaauuuuuucgggguuucugcaug

SEQ ID NO: 250375 - RNA, 65 nt, Homo Sapiens
gcuggugucucucuuuggagacuaccagaacuguggugccaaauuaccuuguaagagacaucauu

SEQ ID NO: 250376 - RNA, 65 nt, Homo Sapiens
caucuuuucauuuauuuugaggcacccuucccauugugccaaaaucaaguguucuuuaaauagga

SEQ ID NO: 250377 - RNA, 65 nt, Homo Sapiens
cuaccguggaaugucccugguccagguggacacaggugccaaauugaaugccgcugcaggcaagu

SEQ ID NO: 250378 - RNA, 65 nt, Homo Sapiens
agcccccccauuccugggccugugaucauucugaagugccaaagggaauaaaaaggcaaauuacu

SEQ ID NO: 250379 - RNA, 65 nt, Homo Sapiens
cuuuauuugggaaaggaaaggacaguuuguugguugugccaaacagucaggccugucagucucau

SEQ ID NO: 250380 - RNA, 65 nt, Homo Sapiens
cacagugagaccaaaaguguauaucgugccucuuagugccaaaccacuggaaugaccuccuucag

SEQ ID NO: 250381 - RNA, 65 nt, Homo Sapiens
uguagacccuuucaugccagcaguggucauauugagugccaaagagaagagcuuacuggguaguu

SEQ ID NO: 250382 - RNA, 65 nt, Homo Sapiens
uaaaaccagaauacacuaagaaguuucuaguuugugugccaaaacagaagcuucuccaagcauga

SEQ ID NO: 250383 - RNA, 65 nt, Homo Sapiens
uacauauguaaaauauuguuacuagaguuagauaugugccaaaguccauuuaucccaaauccugu

SEQ ID NO: 250384 - RNA, 65 nt, Homo Sapiens
auccgugggcuucuggggacagccauuuggcuggggugccaaacaccagaaggggagauaauagu

SEQ ID NO: 250385 - RNA, 65 nt, Homo Sapiens
uaccuggagguuugacucuaauuuuugcacugauggugccaaagggcccugagucaaaaggauag

SEQ ID NO: 250386 - RNA, 65 nt, Homo Sapiens
auuaugugcacuuugcacuaaauauaguaauggaggugccaaauauaggggaaaacaagaggcca

SEQ ID NO: 250387 - RNA, 65 nt, Homo Sapiens
ccacauuuccuguuggcacaccgggaugugucaucgugccaaauauuguuugggaaggagacaug

SEQ ID NO: 250388 - RNA, 65 nt, Homo Sapiens
uuuucguaacuuuugaaucuaguuaaacuuugaaugugccaaacuuuccaauuuuccauuuguag

SEQ ID NO: 250389 - RNA, 65 nt, Homo Sapiens
gccuagcuccuggauuuagaaagcugaaagaaggggugccaaaaugucagccuggauauucauga

SEQ ID NO: 250390 - RNA, 65 nt, Homo Sapiens
gaaaaaaaaagaguggaucacugugauauuucuuugugccaaaaaugauugaucucgggguccau

SEQ ID NO: 250391 - RNA, 65 nt, Homo Sapiens
augcccaggguccugcccucggagagugacugggugugccaaaaugauccuccaugcaggaucua

SEQ ID NO: 250392 - RNA, 65 nt, Homo Sapiens
gcccuuguguuucucuccacguaucuagcagcguugugccaaauuagguugauuguaaacccaca

SEQ ID NO: 250393 - RNA, 65 nt, Homo Sapiens
cugcuagaaaggagggccuaucaaauuguuaucaggugccaaacaagcugcucccucccccagcg

SEQ ID NO: 250394 - RNA, 65 nt, Homo Sapiens
agagaagguucugagcugucccauacucccacuuugugccaaaugacuuugcaccugcaaauggu

SEQ ID NO: 250395 - RNA, 65 nt, Homo Sapiens
uucugcuauguuuguucuucacuaugauuuacugugugccaaaggaguuuugacaggguacagag

SEQ ID NO: 250396 - RNA, 65 nt, Homo Sapiens
uuuaugugcggucuccaauuuaggacuuuuccauagugccaaagccauacauauucaguagaaca

SEQ ID NO: 250397 - RNA, 62 nt, Homo Sapiens
ugcaccaggauggugguuagcaacaguggcccgugccaaagcacuuaccaaagugaugauga

SEQ ID NO: 250398 - RNA, 65 nt, Homo Sapiens
gcugggugaucuugaacaugcugcuuagcuucucugugccaaacuuacugauauccucaucugua

SEQ ID NO: 250399 - RNA, 65 nt, Homo Sapiens
aagggcuaguugagacauugagagugagccaggcggugccaaagcccucugcaacuacaaauagc

SEQ ID NO: 250400 - RNA, 65 nt, Homo Sapiens
ugagagcccagaaaacugucuucuuugucacuugggugccaaacauuauucuggaauuuaagcua

SEQ ID NO: 250401 - RNA, 65 nt, Homo Sapiens
uguacugaaguguugaccaauacaucuuugagcaagugccaaauuuuaucuauugcacaccacac

SEQ ID NO: 250402 - RNA, 65 nt, Homo Sapiens
uguuggggaccacugcucuacaaaacuggucccuggugccaaaaauguggaaaaauugucuucca

SEQ ID NO: 250403 - RNA, 65 nt, Homo Sapiens
auaaagcaccauuuuuuucucaagagcauccuauagugccaaauaaaagguaucuucugaauguu

SEQ ID NO: 250404 - RNA, 65 nt, Homo Sapiens
cuucaucuccccaagaagcgcuuccugauccaauggugccaaaccggugcucugggaguccugug

SEQ ID NO: 250405 - RNA, 65 nt, Homo Sapiens
ccuaagugccguucgggggcagaggaguccuuuuugugccaaaucgugugguagcaaaaggaggg

SEQ ID NO: 250406 - RNA, 65 nt, Homo Sapiens
gcaggccggccagggcuggggaaguucaccugcaggugccaaagaggaugucaggucaggagcug

SEQ ID NO: 250407 - RNA, 65 nt, Homo Sapiens
uuagucccaugaucugucccggagaauguuuccaugugccaaaucccagcuuuggccauauuuca

SEQ ID NO: 250408 - RNA, 65 nt, Homo Sapiens
cuugggggaggagggacaggcuuauucagggcugagugccaaaagagaaacuggggauuuagaag

SEQ ID NO: 250409 - RNA, 65 nt, Homo Sapiens
agcccucggcugcuaugagugguuuguuuacgggagugccaaaccgcuaccccaaaccaaucaag

SEQ ID NO: 250410 - RNA, 65 nt, Homo Sapiens
gcccagagggacucuaagaagggaucacuuuccaagugccaaagacucauggggcaggaaauggg

SEQ ID NO: 250411 - RNA, 65 nt, Homo Sapiens
auauagaaauguuugaaugccuggaauuuuuuaaagugccaaaacagaagaccucagacaggaaa

SEQ ID NO: 250412 - RNA, 65 nt, Homo Sapiens
ugcuuuaaaugucacauuugaauugugauuuaccugugccaaaggccagaggcccuugaaaaugu

SEQ ID NO: 250413 - RNA, 65 nt, Homo Sapiens
uccaaacaaguuccccggugcucgguuagcccacggugccaaaacaagaauaugucagaagagug

SEQ ID NO: 250414 - RNA, 65 nt, Homo Sapiens
uacuagacauuggagaaacaauugcacaucaguaugugccaaaucgguucuucauucacguauua

SEQ ID NO: 250415 - RNA, 65 nt, Homo Sapiens
caguggggacucagugcccagagugccgccuuccugugccaaauuugcaggacgggccaggcugg

SEQ ID NO: 250416 - RNA, 65 nt, Homo Sapiens
aaaugucauccuugaucuugccuaauguaguuuaugugccaaacuuuccaggguuuuguagucac

SEQ ID NO: 250417 - RNA, 65 nt, Homo Sapiens
gcuagugccaguauuaaaacauugucauuacgagagugccaaaugacaucuucccuccacccugc

SEQ ID NO: 250418 - RNA, 65 nt, Homo Sapiens
aacuucauguaacuauagacuggaaaaaaugagccgugccaaagucucccuucuguuucuucagc

SEQ ID NO: 250419 - RNA, 65 nt, Homo Sapiens
acuuguguacuaauuucuauauguaacugaacuuggugccaaagucuaagcacagccucccgggu

SEQ ID NO: 250420 - RNA, 65 nt, Homo Sapiens
cacuacaccauauaauugcauuucauuacaaugaagugccaaacuaaggacugugccauuggaaa

SEQ ID NO: 250421 - RNA, 65 nt, Homo Sapiens
cugaaugccagaugggaugaauauuucaauaaccagugccaaauuugaggaccaucaggagcuuc

SEQ ID NO: 250422 - RNA, 65 nt, Homo Sapiens
cagggcagagcuucuaguucuauucaaguaaucaugugccaaagcaacuccugguaaauacugug

SEQ ID NO: 250423 - RNA, 65 nt, Homo Sapiens
uguucuuucucauguaucucguguuuaugugcacagugccaaaagaagacugacuggguggaggc

SEQ ID NO: 250424 - RNA, 65 nt, Homo Sapiens
guuaaauuuguaugaaccuuagaaaaguuauuaaagugccaaagaauguuucccuuuccuaaggc

SEQ ID NO: 250425 - RNA, 65 nt, Homo Sapiens
uuuauggcuccccucacugauggacaaggaggucugugccaaagaagaauccaauaagcacauau

SEQ ID NO: 250426 - RNA, 65 nt, Homo Sapiens
acuaaaaaauuuggcuuaaaccaguguucagucuggugccaaacuucgaauggaauacaaauuca

SEQ ID NO: 250427 - RNA, 65 nt, Homo Sapiens
ggcagaggaagagaggucgacuguggggucauuuggugccaaacauggaggugggcaggcucacc

SEQ ID NO: 250428 - RNA, 65 nt, Homo Sapiens
uuccagaagccaaaaagcuuccagcccccaacauggugccaaagcccugccccugccuccugcau

SEQ ID NO: 250429 - RNA, 65 nt, Homo Sapiens
ggacuuuccacucaugcucaaccugaggucaaggagugccaaauagugauaaucauuggcaugcc

SEQ ID NO: 250430 - RNA, 65 nt, Homo Sapiens
gaauguaaaaugcaaaaauugucccuucuucaaaagugccaaaagcaaacaacauaaaagacaau

SEQ ID NO: 250431 - RNA, 65 nt, Homo Sapiens
uuuguauuuuauuuggagacaagauuaaaaugucugugccaaaauuuuccuuacauugucuugac

SEQ ID NO: 250432 - RNA, 65 nt, Homo Sapiens
acaagagaaaaagcaguaaccggcuuaagccuuaagugccaaaucaguagaugccuuuuuuuuuc

SEQ ID NO: 250433 - RNA, 59 nt, Homo Sapiens
aacauaaagcugcuggaugaaaugguccagugccaaaaugagcuuaaaaucuuuguuuc

SEQ ID NO: 250434 - RNA, 65 nt, Homo Sapiens
aaugaucuuguguaagguuuugguuauggagucuugugccaaaccuacuaggccauuagcccuuc

SEQ ID NO: 250435 - RNA, 65 nt, Homo Sapiens
gagaguccuucaccguauaugaaagccagggggcagugccaaacacgcggcaccaggagauggag

SEQ ID NO: 250436 - RNA, 65 nt, Homo Sapiens
uguuaaugcuauaugacaaaaugcucugauuccuagugccaaagguucaauucaguguauauaac

SEQ ID NO: 250437 - RNA, 65 nt, Homo Sapiens
cccugagcaaaagccagagcgggcuggaggguggggugccaaagguugagcgccugcauuccugg

SEQ ID NO: 250438 - RNA, 65 nt, Homo Sapiens
auggcagcugcugaacuugaacccagagccuucaggugccaaagccauacucaggcccccaccga

SEQ ID NO: 250439 - RNA, 65 nt, Homo Sapiens
auaauaugggaugcaauaaccaacaaagcugcuaagugccaaacuguuauuuuacuauauauaaa

SEQ ID NO: 250440 - RNA, 65 nt, Homo Sapiens
caucuccucugccugugucugcgacccccauccaugugccaaagugucccuugggucacacagcu

SEQ ID NO: 250441 - RNA, 65 nt, Homo Sapiens
agaggcccucugggugaugagagggacccuggcaugugccaaagacuuuauagccaguagaggug

SEQ ID NO: 250442 - RNA, 65 nt, Homo Sapiens
caaugagagugaagcugcagauguuucaaguggcugugccaaagucccagccugucugggauauc

SEQ ID NO: 250443 - RNA, 65 nt, Homo Sapiens
cuggggcaaagcuguguuuccuccuggggcuggaagugccaaagcuuugcugggguucagcgccu

SEQ ID NO: 250444 - RNA, 65 nt, Homo Sapiens
agccuuuuccccaggccucagagcauugcucauccgugccaaacuggguagguggauuugagcgg

SEQ ID NO: 250445 - RNA, 65 nt, Homo Sapiens
agaguccucaucugcuggcauuuugugggguguuagugccaaacuugaauaggggcuggggugcu

SEQ ID NO: 250446 - RNA, 65 nt, Homo Sapiens
gaaacaugaacaugcucaaauaacucgaggcucacgugccaaagugugugugugugugugugugu

SEQ ID NO: 250447 - RNA, 65 nt, Homo Sapiens
uagagagguccggugugcacagccggccucccagugugccaaaaugaacugcucucagcugaugg

SEQ ID NO: 250448 - RNA, 65 nt, Homo Sapiens
ucccaccuggcucuguggcgagccauuugucccaagugccaaagaagcagaccauuggggcuccc

SEQ ID NO: 250449 - RNA, 65 nt, Homo Sapiens
uuguauuguggcagucugaacgcccccagaaaauugugccaaagaguuuagaaaaauaaauauac

SEQ ID NO: 250450 - RNA, 65 nt, Homo Sapiens
ggaugcucuaguugguucuguguccauuuuccucugugccaaagacagacagacagaggcugaga

SEQ ID NO: 250451 - RNA, 65 nt, Homo Sapiens
ccuucucucuuuacucccacuuuuuacguuugcaggugccaaaguaauguccacuuuucccuuuc

SEQ ID NO: 250452 - RNA, 65 nt, Homo Sapiens
cuaagaaggucgaccucaucaucugggagaucgaggugccaaagcacuuagucggucggcuaauu

SEQ ID NO: 250453 - RNA, 65 nt, Homo Sapiens
cacuccaaaaaagcaaaacagacccuaauuuuuuugugccaaaaacuguggacaugcuggcucag

SEQ ID NO: 250454 - RNA, 65 nt, Homo Sapiens
ggcucacaaauuccgauuagaccuuuauccagcuagugccaaauaauugaucagaugcugaauug

SEQ ID NO: 250455 - RNA, 65 nt, Homo Sapiens
ggaguuggggagaacugucaagaagagugaagagagugccaaagcggagaucuguucaccugggg

SEQ ID NO: 250456 - RNA, 65 nt, Homo Sapiens
gucuggguaguaguuucuggaaaugacugcagacugugccaaaugucuuuugagcuucugaccug

SEQ ID NO: 250457 - RNA, 65 nt, Homo Sapiens
gcguaccagacugcaagaccccccaguaccucaccgugccaaauaggaagagguggccuuggugu

SEQ ID NO: 250458 - RNA, 65 nt, Homo Sapiens
cgggagagcuuuucuuuaacgauaucaacucuguggugccaaaaggagacgcggccucccgccag

SEQ ID NO: 250459 - RNA, 65 nt, Homo Sapiens
aagaagcucccagggcugcugcugaagcccacugugugccaaaggagaggauuggugcaguccca

SEQ ID NO: 250460 - RNA, 65 nt, Homo Sapiens
cuggaugcccccuacuccuccugcccccaggcaccgugccaaagagggaucaugcuagucacuuc

SEQ ID NO: 250461 - RNA, 65 nt, Homo Sapiens
acuucuacagagugaacccgugggcuacagaaaccgugccaaaagaguuucuaucauccaaagua

SEQ ID NO: 250462 - RNA, 65 nt, Homo Sapiens
gccccucagcagggcagggcuggcccucacugccagugccaaaccgcccacccagugccuuuccu

SEQ ID NO: 250463 - RNA, 65 nt, Homo Sapiens
ccaaaucuccaaagagacauaaguuggcaguuuuggugccaaaccaccuucucuacuccuccagu

SEQ ID NO: 250464 - RNA, 65 nt, Homo Sapiens
auuuaauuauuacuaaaauuguauuuacaauaguggugccaaaucaaaugguaauuuaaauaaaa

SEQ ID NO: 250465 - RNA, 65 nt, Homo Sapiens
uuagguuuucuaaggacauuguuuuaaucuguaucgugccaaaguuguaucacuguuaaacuucu

SEQ ID NO: 250466 - RNA, 65 nt, Homo Sapiens
uuguaagugacagguguuaaaggcccaggugugcugugccaaagagcucagcagaggcucacgug

SEQ ID NO: 250467 - RNA, 65 nt, Homo Sapiens
gagaagacagaaagcaacaaugaaauccaucagaugugccaaaugucuaauauugaguucaacug

SEQ ID NO: 250468 - RNA, 65 nt, Homo Sapiens
ucccugccacgcgugugugugcgugugccacgugagugccaaaguccccugccccccaagccagc

SEQ ID NO: 250469 - RNA, 65 nt, Homo Sapiens
cccccguggcucccggucuccugugggccugcugugugccaaaccugagcuaccugcacccgagc

SEQ ID NO: 250470 - RNA, 65 nt, Homo Sapiens
acaagcaaucauguuugcguccccguccgucacaugugccaaaucccuggcaggcagauggcucc

SEQ ID NO: 250471 - RNA, 55 nt, Homo Sapiens
gagaaaucuuacaaguaugaauaaugugccaaagccuaagaaaacccucaauucu

SEQ ID NO: 250472 - RNA, 51 nt, Homo Sapiens
aaucuuacaaguaugaauaaugugccaaagccuaagaaaacccucaauucu

SEQ ID NO: 250473 - RNA, 65 nt, Homo Sapiens
agaaaacuucaggcugguacuccugacgaauauaggugccaaaauccucagcaaaauacuaguaa

SEQ ID NO: 250474 - RNA, 65 nt, Homo Sapiens
auggaaaagaaacaguaaacaugugccuuggauaugugccaaauguuaugauuucuaauuuucua

SEQ ID NO: 250475 - RNA, 65 nt, Homo Sapiens
ugucuuauuaaauaaaaacaucuagaaaaagucuagugccaaauugauagacuaugaaugcuauu

SEQ ID NO: 250476 - RNA, 65 nt, Homo Sapiens
aacauagacaacuguagagguaaauugugccucgugugccaaagaugugauggugcuuuuagcgc

SEQ ID NO: 250477 - RNA, 65 nt, Homo Sapiens
agacccaugcuuugcaucuuacaucaguuucuugugugccaaauacaccacauuauuauauuucc

SEQ ID NO: 250478 - RNA, 65 nt, Homo Sapiens
ccagggugaacacacagccagcuuaucccucuuaagugccaaaacuuuuuuuuaaaccauuuuuu

SEQ ID NO: 250479 - RNA, 65 nt, Homo Sapiens
aucuuguaccuuuucagagaaagggagguaucccugugccaaaggcuccaggccucuccccugca

SEQ ID NO: 250480 - RNA, 65 nt, Homo Sapiens
cagccaucccugccuuucuguugggaaaaacuguugugccaaacucuuguguggaacacagcugg

SEQ ID NO: 250481 - RNA, 65 nt, Homo Sapiens
uuguuagaacaauagaaaaauagagcaguguaugugugccaaaacucaucauuacucaaaggaga

SEQ ID NO: 250482 - RNA, 65 nt, Homo Sapiens
gaaaauauauccauaucccuauuuagcuuuauggagugccaaaggcauccuuuuuucagcccaac

SEQ ID NO: 250483 - RNA, 65 nt, Homo Sapiens
cugggcauccccagcccccugacacagagacccccgugccaaaucuuugugccaggagugggugg

SEQ ID NO: 250484 - RNA, 65 nt, Homo Sapiens
uuuuuauucucaaauguuuguuuugaguaaccguagugccaaaauuucaguucaguaauggggug

SEQ ID NO: 250485 - RNA, 65 nt, Homo Sapiens
aaguggucuuaagaaauguaagucuuaaggacaaagugccaaagacaguguauguagaagcauga

SEQ ID NO: 250486 - RNA, 65 nt, Homo Sapiens
augcuucauuuugggggcagcagcauucagcacaggugccaaaaugcacuugcuggucuuuguag

SEQ ID NO: 250487 - RNA, 65 nt, Homo Sapiens
ccggccccgagggccaaggggguccccgcccgccagugccaaagcgcccggucggaggcggaagg

SEQ ID NO: 250488 - RNA, 65 nt, Homo Sapiens
aaacaaggcgagcuugaguucugcacuccagauaugugccaaaacuaguaaaacuuaacggacuu

SEQ ID NO: 250489 - RNA, 65 nt, Homo Sapiens
cgguuuuucauuuucucaacuuuuaauagcaaaaagugccaaaguccucagagaccuaacagccu

SEQ ID NO: 250490 - RNA, 65 nt, Homo Sapiens
gccccuucccacgucccucggauuccagugcaguagugccaaaaguccugcuaccuuugucucac

SEQ ID NO: 250491 - RNA, 65 nt, Homo Sapiens
agccuacagauguuccugccggcgucuccuagguugugccaaacccggcugcuggggccaggaca

SEQ ID NO: 250492 - RNA, 65 nt, Homo Sapiens
ccacaggcaugagggaggcgcagaccuggugacaagugccaaaggcccaggagcucagggccugu

SEQ ID NO: 250493 - RNA, 65 nt, Homo Sapiens
cugugauggcugaauggaaagaaacguaaaaagcugugccaaaaaaaaagcaaaaugcugugaua

SEQ ID NO: 250494 - RNA, 65 nt, Homo Sapiens
aguggugauuguuuaaacucucacagucuuaaaccgugccaaaguccuguuaugucuugaacuuu

SEQ ID NO: 250495 - RNA, 65 nt, Homo Sapiens
agccucugagucccguggggccccggcucccaccggugccaaacccagccccugcggccgucacc

SEQ ID NO: 250496 - RNA, 65 nt, Homo Sapiens
ccagccaggagugcggacaccauguucccagcucagugccaaagaggggucaccagggggagcug

SEQ ID NO: 250497 - RNA, 65 nt, Homo Sapiens
cugaggaaauguuuucuuuccuuuguacuuacauugugccaaaggauuugguaaaaggccuacag

SEQ ID NO: 250498 - RNA, 65 nt, Homo Sapiens
ccccaugggagugggagggaccgggccacaccucagugccaaagagauguggccgggcugcagag

SEQ ID NO: 250499 - RNA, 65 nt, Homo Sapiens
auuaaagguuugccucaaaaagccaaaauaaucuugugccaaaagagacucaaauuuucugcccc

SEQ ID NO: 250500 - RNA, 65 nt, Homo Sapiens
uucaacuuaauguauauaccacgcccugauuccuagugccaaagguguuaaugcuaugugacaaa

SEQ ID NO: 250501 - RNA, 65 nt, Homo Sapiens
gcaacaccacgucuaaagcaaguucauuuacucuugugccaaaugucugagguccacaucauggc

SEQ ID NO: 250502 - RNA, 65 nt, Homo Sapiens
guauaggaacaacuguacuuagguaaaaaacuagugugccaaauguuucaaaggguauauauaaa

SEQ ID NO: 250503 - RNA, 65 nt, Homo Sapiens
auuuucaguuguacuguagauaguauuauagguuggugccaaaauggcuuuauauuaaauucuuu

SEQ ID NO: 250504 - RNA, 65 nt, Homo Sapiens
auucuccuauguuuggcugcaaaaaccaucaaguugugccaaauuuccuuuugcaaagaaagaaa

SEQ ID NO: 250505 - RNA, 65 nt, Homo Sapiens
agccaacggccccagcuucuucccccaauccaucagugccaaacuggacacccagaaacgccaca

SEQ ID NO: 250506 - RNA, 65 nt, Homo Sapiens
ggccaugcugaguuagguagauucuccagcuuucagugccaaagaauuuuuuuuacugauuuuuu

SEQ ID NO: 250507 - RNA, 65 nt, Homo Sapiens
aucaggaugcucauaacuuuguaugucugacccaagugccaaaggcagacgugcuuuauagcuaa

SEQ ID NO: 250508 - RNA, 65 nt, Homo Sapiens
uaugauguagagcuauuaagggaguauuuucacuugugccaaagaggguaagcguuuauuagccu

SEQ ID NO: 250509 - RNA, 64 nt, Homo Sapiens; identical to SEQ ID NO: 226314

SEQ ID NO: 250510 - RNA, 64 nt, Homo Sapiens; identical to SEQ ID NO: 226315

SEQ ID NO: 250511 - RNA, 64 nt, Homo Sapiens; identical to SEQ ID NO: 226316

SEQ ID NO: 250512 - RNA, 64 nt, Homo Sapiens; identical to SEQ ID NO: 226317

SEQ ID NO: 250513 - RNA, 64 nt, Homo Sapiens; identical to SEQ ID NO: 226318

SEQ ID NO: 250514 - RNA, 64 nt, Homo Sapiens; identical to SEQ ID NO: 226319

SEQ ID NO: 250515 - RNA, 64 nt, Homo Sapiens; identical to SEQ ID NO: 226320

SEQ ID NO: 250516 - RNA, 64 nt, Homo Sapiens; identical to SEQ ID NO: 226321

SEQ ID NO: 250517 - RNA, 64 nt, Homo Sapiens; identical to SEQ ID NO: 226322

SEQ ID NO: 250518 - RNA, 64 nt, Homo Sapiens; identical to SEQ ID NO: 226323

SEQ ID NO: 250519 - RNA, 64 nt, Homo Sapiens; identical to SEQ ID NO: 226324

SEQ ID NO: 250520 - RNA, 64 nt, Homo Sapiens; identical to SEQ ID NO: 226325

SEQ ID NO: 250521 - RNA, 64 nt, Homo Sapiens; identical to SEQ ID NO: 226326

SEQ ID NO: 250522 - RNA, 64 nt, Homo Sapiens; identical to SEQ ID NO: 226327

SEQ ID NO: 250523 - RNA, 64 nt, Homo Sapiens; identical to SEQ ID NO: 226328

SEQ ID NO: 250524 - RNA, 64 nt, Homo Sapiens; identical to SEQ ID NO: 226329

SEQ ID NO: 250525 - RNA, 64 nt, Homo Sapiens; identical to SEQ ID NO: 226330

SEQ ID NO: 250526 - RNA, 64 nt, Homo Sapiens; identical to SEQ ID NO: 226331

SEQ ID NO: 250527 - RNA, 64 nt, Homo Sapiens; identical to SEQ ID NO: 226332

SEQ ID NO: 250528 - RNA, 64 nt, Homo Sapiens; identical to SEQ ID NO: 226333

SEQ ID NO: 250529 - RNA, 64 nt, Homo Sapiens; identical to SEQ ID NO: 226334

SEQ ID NO: 250530 - RNA, 64 nt, Homo Sapiens; identical to SEQ ID NO: 226335

SEQ ID NO: 250531 - RNA, 64 nt, Homo Sapiens; identical to SEQ ID NO: 226336

SEQ ID NO: 250532 - RNA, 64 nt, Homo Sapiens; identical to SEQ ID NO: 226337

SEQ ID NO: 250533 - RNA, 64 nt, Homo Sapiens; identical to SEQ ID NO: 226338

SEQ ID NO: 250534 - RNA, 64 nt, Homo Sapiens; identical to SEQ ID NO: 226339

SEQ ID NO: 250535 - RNA, 64 nt, Homo Sapiens; identical to SEQ ID NO: 226340

SEQ ID NO: 250536 - RNA, 64 nt, Homo Sapiens; identical to SEQ ID NO: 226341

SEQ ID NO: 250537 - RNA, 64 nt, Homo Sapiens
ugugcagagaccaagagguggggcauuccaggcagagggaaaccuugcagauggagaauaggaa

SEQ ID NO: 250538 - RNA, 64 nt, Homo Sapiens
guuaacggugugggccacucuccuugcccagggagagggaaagaacuccugggccugccccagc

SEQ ID NO: 250539 - RNA, 64 nt, Homo Sapiens
gcagcuuccuggggcuugugcagaggccagcuaggagggaaaccaaguggggcugcacucgguc

SEQ ID NO: 250540 - RNA, 64 nt, Homo Sapiens
gagacaaguggggcugcacuagccugacaugguggagggaaaggaccuggccugacccagucgg

SEQ ID NO: 250541 - RNA, 64 nt, Homo Sapiens
caagagagccaugaggagaguggaagcacauuuggagggaaagaguuugaggugggggccucuc

SEQ ID NO: 250542 - RNA, 64 nt, Homo Sapiens
accaaaaaacuaccaaacaacccacccccagauagagggaaauaugcauguggagcccucccac

SEQ ID NO: 250543 - RNA, 64 nt, Homo Sapiens
uaucugaugacggggaaacaaaauuauucucugagagggaaaggacauuugagggaaacaucaa

SEQ ID NO: 250544 - RNA, 64 nt, Homo Sapiens
aacaaaauuauucucugagagggaaaggacauuugagggaaacaucaaauuuccccauaaauaa

SEQ ID NO: 250545 - RNA, 64 nt, Homo Sapiens
cuauauguugcugaaacacacaggccauuucauugagggaaaacauaauaucuugaagaauauu

SEQ ID NO: 250546 - RNA, 64 nt, Homo Sapiens
aaacuguuuuucaaaacgccauguccuaggggccgagggaaaugcuguuggugagaaucgaccu

SEQ ID NO: 250547 - RNA, 64 nt, Homo Sapiens
cauugugugauauucucagaggcaggggaaaauagagggaaaaauagagacuauugguauguuc

SEQ ID NO: 250548 - RNA, 64 nt, Homo Sapiens
cuggucaccacuggacgggaaggagaacagaggagagggaaagagaagcccaaccucugugauc

SEQ ID NO: 250549 - RNA, 64 nt, Homo Sapiens
uaaaagucuguaauuucaguuuuugugucggggagagggaaaaacuauuugucuguaguugcuu

SEQ ID NO: 250550 - RNA, 64 nt, Homo Sapiens
uauucuucuguaaugagaauagacuggaacaugugagggaaaaauauuuaaaaaaagauggcag

SEQ ID NO: 250551 - RNA, 64 nt, Homo Sapiens
ggccauggacgguggcucacuuuaaaagaugaaagagggaaauacuaaauguucagaaaauuau

SEQ ID NO: 250552 - RNA, 64 nt, Homo Sapiens
auccuaacaaggaaaggcaggguacccuaaggcugagggaaagauaauaaagaugaaaagagaa

SEQ ID NO: 250553 - RNA, 64 nt, Homo Sapiens
ugcauuuauuuuuauacagauucacuggggaaaggagggaaaaggaaaguauggaaguuuucca

SEQ ID NO: 250554 - RNA, 64 nt, Homo Sapiens
uggaaacgggacauacacaaguuggcuuuuuggagagggaaauuuuuguuuguuuguuuauuug

SEQ ID NO: 250555 - RNA, 64 nt, Homo Sapiens
ggccagguccuugaucaugguacccccauuaccugagggaaacuaauauucacuuuggugcuac

SEQ ID NO: 250556 - RNA, 64 nt, Homo Sapiens
uuuuuuuuucccccugaguguucagggagcuggagagggaaaucggucagucaacuuucagaaa

SEQ ID NO: 250557 - RNA, 64 nt, Homo Sapiens
guuucuaaaauuauuucagagaugugugcuccuggagggaaaaagaaauacagccucaacagau

SEQ ID NO: 250558 - RNA, 64 nt, Homo Sapiens
acuccaggcaacgacccaagcacuuauuuuuuaagagggaaaggacuuuggucauguuuacauu

SEQ ID NO: 250559 - RNA, 64 nt, Homo Sapiens
uuaaucgguggcauauacugcacauacugaaauagagggaaaucacugaauguaaagagguuuc

SEQ ID NO: 250560 - RNA, 64 nt, Homo Sapiens
uagagaugagggggcuacagcagcaucaugcaaagagggaaagaugaagggauagaagaagaga

SEQ ID NO: 250561 - RNA, 64 nt, Homo Sapiens
gaaccaagaaguagaaggaguaagagcuacaaaggagggaaaagggggaacaaaacaauuaacg

SEQ ID NO: 250562 - RNA, 64 nt, Homo Sapiens
uggauuuucacaccuugccuuaccugccagcccagagggaaauagcagccuucccaguaacuuc

SEQ ID NO: 250563 - RNA, 64 nt, Homo Sapiens
gagggagggggugucugcacgcugugggccuggagagggaaaagccuaccugggcucuggggag

SEQ ID NO: 250564 - RNA, 64 nt, Homo Sapiens
aaaauugggagggggaagaguucugccucaucuggagggaaaccuuuuggaaccaacauucaaa

SEQ ID NO: 250565 - RNA, 64 nt, Homo Sapiens
augucuugcuaaaccuguuuggugguaguggugggagggaaaccccugggggacgggggugggg

SEQ ID NO: 250566 - RNA, 64 nt, Homo Sapiens
aaaaaaaguuguuugcuuaaaaaaaauuucaugugagggaaaaaaaaaaaaccuauuccagaau

SEQ ID NO: 250567 - RNA, 64 nt, Homo Sapiens
uucuucaguuuuaacgaguaauuggauaaacccugagggaaaacggagguagauucagcaccua

SEQ ID NO: 250568 - RNA, 64 nt, Homo Sapiens
guuauacuacaaaucauguuaaauaauuuguacugagggaaacaaagguguucaauaaaaauuc

SEQ ID NO: 250569 - RNA, 64 nt, Homo Sapiens
uucagcuacaaucuuugcucgaaucgcaucaauagagggaaauuacacaagagguacaccuuau

SEQ ID NO: 250570 - RNA, 64 nt, Homo Sapiens
gacugagcuggggagggaggcaggugggugguaagagggaaacucuggagagccugcacccagg

SEQ ID NO: 250571 - RNA, 64 nt, Homo Sapiens
aaaaaggauuccaagugauggaacuccagggguggagggaaauuggcaguuccuggcaucucuu

SEQ ID NO: 250572 - RNA, 64 nt, Homo Sapiens
cccucgggccgcuccccugcgggaaagaccuacagagggaaagacuucuggauguuccuacaga

SEQ ID NO: 250573 - RNA, 64 nt, Homo Sapiens
ccuacagagggaaagacccuuggauguuccuacagagggaaagaugcuugcuuccagaaucuuc

SEQ ID NO: 250574 - RNA, 64 nt, Homo Sapiens
agcuuaugcuucuuuagauggaauaaugggaaaggagggaaaugggaaauggauggaaauggga

SEQ ID NO: 250575 - RNA, 64 nt, Homo Sapiens
ggagggaaaugggaaauggauggaaaugggaaaggagggaaaauaauagcccagugagagcuga

SEQ ID NO: 250576 - RNA, 64 nt, Homo Sapiens
ucauguauuuagaaauuuaauaugcuguucuguugagggaaaggaguugggaagauauauugau

SEQ ID NO: 250577 - RNA, 64 nt, Homo Sapiens
cuacaguggccacauuucagccaugauugcuuuugagggaaaagggauugauucagcucaccuu

SEQ ID NO: 250578 - RNA, 64 nt, Homo Sapiens
uuucuacuuuguaauugugagacauuuucuuggggagggaaaauuggaaugguucccuuuuuua

SEQ ID NO: 250579 - RNA, 64 nt, Homo Sapiens
ucauugauuuuuguguuuaaaaaaaaauaggaaagagggaaacugcagcuuucauuacagauuc

SEQ ID NO: 250580 - RNA, 64 nt, Homo Sapiens
ggcagagaaggaaagagacaggaagagaggcagagagggaaagagagggagagagagacagagg

SEQ ID NO: 250581 - RNA, 62 nt, Homo Sapiens
aggagggagagagauggagaaugggggucagggagggaaaggaggggggcccaggugcauaa

SEQ ID NO: 250582 - RNA, 64 nt, Homo Sapiens
uaaccgggagacaaauugagauuuuaaagggggagagggaaaagucuucuucuccuuccucuac

SEQ ID NO: 250583 - RNA, 64 nt, Homo Sapiens
cagacacagaugcauagggaaguccuuaucggaagagggaaauucccucacccaauaugacugg

SEQ ID NO: 250584 - RNA, 64 nt, Homo Sapiens
ccuugcugcuuucacagggugggaaacgaaauucgagggaaauuccccggaaauaugagggaaa

SEQ ID NO: 250585 - RNA, 64 nt, Homo Sapiens
gaaacgaaauucgagggaaauuccccggaaauaugagggaaaucucugcauugcaccaccagag

SEQ ID NO: 250586 - RNA, 64 nt, Homo Sapiens
guucccauccucuucuuuuagcaguaaaauagcugagggaaaagggagggaaaaggaaguuaug

SEQ ID NO: 250587 - RNA, 64 nt, Homo Sapiens
cuucuuuuagcaguaaaauagcugagggaaaagggagggaaaaggaaguuaugggaauaccugu

SEQ ID NO: 250588 - RNA, 64 nt, Homo Sapiens; identical to SEQ ID NO: 91867

SEQ ID NO: 250589 - RNA, 64 nt, Homo Sapiens; identical to SEQ ID NO: 91868

SEQ ID NO: 250590 - RNA, 64 nt, Homo Sapiens; identical to SEQ ID NO: 91869

SEQ ID NO: 250591 - RNA, 64 nt, Homo Sapiens; identical to SEQ ID NO: 91870

SEQ ID NO: 250592 - RNA, 64 nt, Homo Sapiens; identical to SEQ ID NO: 91871

SEQ ID NO: 250593 - RNA, 64 nt, Homo Sapiens; identical to SEQ ID NO: 91872

SEQ ID NO: 250594 - RNA, 64 nt, Homo Sapiens; identical to SEQ ID NO: 91873

SEQ ID NO: 250595 - RNA, 64 nt, Homo Sapiens; identical to SEQ ID NO: 91874

SEQ ID NO: 250596 - RNA, 64 nt, Homo Sapiens; identical to SEQ ID NO: 91875

SEQ ID NO: 250597 - RNA, 64 nt, Homo Sapiens; identical to SEQ ID NO: 91876

SEQ ID NO: 250598 - RNA, 64 nt, Homo Sapiens; identical to SEQ ID NO: 91877

SEQ ID NO: 250599 - RNA, 64 nt, Homo Sapiens; identical to SEQ ID NO: 91878

SEQ ID NO: 250600 - RNA, 63 nt, Homo Sapiens
aauacagugugacguguacugucaucaagggguaugcuccaugcuuugagucaccaaugaagc

SEQ ID NO: 250601 - RNA, 63 nt, Homo Sapiens
cagaaguggggagcacuuuaaugcaacccagguaugcuccaugcauauccagcugggccagcc

SEQ ID NO: 250602 - RNA, 63 nt, Homo Sapiens
gcuacccuccagacaagggcaagaguuagccagaugcuccaggcagugggaagccaauggagg

SEQ ID NO: 250603 - RNA, 63 nt, Homo Sapiens
caucggcacuggcgcccugcuccaucggcacuaaugcuccacucggcgccccacuccaucggc

SEQ ID NO: 250604 - RNA, 63 nt, Homo Sapiens
ugccccacucggcgccccacuccaucagcacuaaugcuccacuccauuggcacuaacgcccca

SEQ ID NO: 250605 - RNA, 64 nt, Homo Sapiens
gcagaaagugcccauuguucaggauucuaauagcuacaucuacuuaauaucuucauuucuaaau

SEQ ID NO: 250606 - RNA, 64 nt, Homo Sapiens
cauauuuuucaaaauagguuuuuauuguugaauguacaucuaccccagccccucaaaagaaaaa

SEQ ID NO: 250607 - RNA, 64 nt, Homo Sapiens
auuuccuggggcuauugugaauccaaaacuuaaauacaucuauacagcuaacgauuacucauug

SEQ ID NO: 250608 - RNA, 64 nt, Homo Sapiens
auugguagcauguaacagugaaagggaguccugauacaucuaauccaagaaccauaguuacuga

SEQ ID NO: 250609 - RNA, 64 nt, Homo Sapiens
uuagguccuuuaaaaaaacauauuaaucauugacuacaucuaugauaaaagugcuuauuuuggu

SEQ ID NO: 250610 - RNA, 64 nt, Homo Sapiens
auuaagacaauguuuuuaauuuaauuugccucauuacaucuaauaguucccauuugauggcaug

SEQ ID NO: 250611 - RNA, 64 nt, Homo Sapiens
ggaagaaaauaacauucuuggguugagggaaggaaugccauacacuacugucucuucagaucug

SEQ ID NO: 250612 - RNA, 64 nt, Homo Sapiens
caagcagaucuuguaucaaggcagaggugaugccaugccauacuuuuaggaagucugagaugau

SEQ ID NO: 250613 - RNA, 64 nt, Homo Sapiens
uccccaaaguguauuuuucucuaagucgagggcuaugccauaauacaaauggaaauguuaccuu

SEQ ID NO: 250614 - RNA, 64 nt, Homo Sapiens
caaggaacaaauuuccuuaggauuauaguauuacaugccauaaaauacuaugcuuuauuggucc

SEQ ID NO: 250615 - RNA, 64 nt, Homo Sapiens
cuuucaaacuauugacaguauucuuccuuucgcagccagucagucaucagugcucaauugcauu

SEQ ID NO: 250616 - RNA, 64 nt, Homo Sapiens
uggaagucagucuaccguaucaagcuucaguaaggccagucagccguagccuagagcaguguca

SEQ ID NO: 250617 - RNA, 64 nt, Homo Sapiens
cauacacuaaggccuaguugcaguaaguacgugagccagucauccuucacuucuucccaauaua

SEQ ID NO: 250618 - RNA, 64 nt, Homo Sapiens
gggcuauuuuccugaauauuuugauuaguauggugccagucacauuuuuaauagaaaugaacuu

SEQ ID NO: 250619 - RNA, 64 nt, Homo Sapiens
ugcuccguuuucaaauccagcaagguuucaaagcgccagucauucaguauuugcagaauacauu

SEQ ID NO: 250620 - RNA, 64 nt, Homo Sapiens
cacagcagaaaccuacaacuaaguacaaccaaaugccagucagggugaagagauaaagaaaaaa

SEQ ID NO: 250621 - RNA, 64 nt, Homo Sapiens
cagcccacagaggggagggagcauggggccaggugccagucaucugugaagcuagggcgccuac

SEQ ID NO: 250622 - RNA, 64 nt, Homo Sapiens
ccuggcccccucagccaucucagggugaggagcugccagucauguccagauggaaugacuccca

SEQ ID NO: 250623 - RNA, 64 nt, Homo Sapiens
gguuagggucagcagagacuguggaugggaugcagccagucaugguagaucccaggacucggca

SEQ ID NO: 250624 - RNA, 64 nt, Homo Sapiens
ggcagugggaucucgauggaucuuuccaccagcugccagucaagguuagacuuacccuccuccc

SEQ ID NO: 250625 - RNA, 64 nt, Homo Sapiens
guaaacaugcgaacacugcucacacgcgaguuuucacaguuauuucuauccacgccuaugaauc

SEQ ID NO: 250626 - RNA, 64 nt, Homo Sapiens
uaaaaugugaagaaagugugaauuuuaguuuugucacaguuaacugugucaaagagaauuaaaa

SEQ ID NO: 250627 - RNA, 64 nt, Homo Sapiens
gagaaucauguuucuuugauaugauucaaaaagucacaguuaaguauuucagaaauacagauaa

SEQ ID NO: 250628 - RNA, 64 nt, Homo Sapiens
acauacacaucagccaucaacuguuuaaauugcucacaguuauuuugaucucacauuuuuauac

SEQ ID NO: 250629 - RNA, 64 nt, Homo Sapiens; identical to SEQ ID NO: 124377

SEQ ID NO: 250630 - RNA, 64 nt, Homo Sapiens; identical to SEQ ID NO: 124378

SEQ ID NO: 250631 - RNA, 64 nt, Homo Sapiens; identical to SEQ ID NO: 124379

SEQ ID NO: 250632 - RNA, 64 nt, Homo Sapiens; identical to SEQ ID NO: 124380

SEQ ID NO: 250633 - RNA, 64 nt, Homo Sapiens; identical to SEQ ID NO: 124381

SEQ ID NO: 250634 - RNA, 64 nt, Homo Sapiens; identical to SEQ ID NO: 124382

SEQ ID NO: 250635 - RNA, 64 nt, Homo Sapiens; identical to SEQ ID NO: 124383

SEQ ID NO: 250636 - RNA, 64 nt, Homo Sapiens; identical to SEQ ID NO: 124384

SEQ ID NO: 250637 - RNA, 64 nt, Homo Sapiens
auaauuucacuugcuuugaaaguugauuuaauugacugacuaaaugaaaaugccuacccacuca

SEQ ID NO: 250638 - RNA, 64 nt, Homo Sapiens
uuaaaauuugcuagugguuugaaaauaauaauguacugacuacauguaugcuguuauugucagu

SEQ ID NO: 250639 - RNA, 64 nt, Homo Sapiens; identical to SEQ ID NO: 182371

SEQ ID NO: 250640 - RNA, 64 nt, Homo Sapiens; identical to SEQ ID NO: 182372

SEQ ID NO: 250641 - RNA, 64 nt, Homo Sapiens; identical to SEQ ID NO: 182373

SEQ ID NO: 250642 - RNA, 64 nt, Homo Sapiens; identical to SEQ ID NO: 182374

SEQ ID NO: 250643 - RNA, 64 nt, Homo Sapiens; identical to SEQ ID NO: 182375

SEQ ID NO: 250644 - RNA, 64 nt, Homo Sapiens; identical to SEQ ID NO: 182376

SEQ ID NO: 250645 - RNA, 64 nt, Homo Sapiens; identical to SEQ ID NO: 182377

SEQ ID NO: 250646 - RNA, 64 nt, Homo Sapiens; identical to SEQ ID NO: 182378

SEQ ID NO: 250647 - RNA, 64 nt, Homo Sapiens; identical to SEQ ID NO: 182379

SEQ ID NO: 250648 - RNA, 64 nt, Homo Sapiens; identical to SEQ ID NO: 182380

SEQ ID NO: 250649 - RNA, 64 nt, Homo Sapiens; identical to SEQ ID NO: 182381

SEQ ID NO: 250650 - RNA, 64 nt, Homo Sapiens; identical to SEQ ID NO: 182382

SEQ ID NO: 250651 - RNA, 64 nt, Homo Sapiens; identical to SEQ ID NO: 182383

SEQ ID NO: 250652 - RNA, 64 nt, Homo Sapiens; identical to SEQ ID NO: 182384

SEQ ID NO: 250653 - RNA, 64 nt, Homo Sapiens; identical to SEQ ID NO: 182385

SEQ ID NO: 250654 - RNA, 64 nt, Homo Sapiens; identical to SEQ ID NO: 182386

SEQ ID NO: 250655 - RNA, 64 nt, Homo Sapiens; identical to SEQ ID NO: 182387

SEQ ID NO: 250656 - RNA, 64 nt, Homo Sapiens; identical to SEQ ID NO: 182388

SEQ ID NO: 250657 - RNA, 64 nt, Homo Sapiens; identical to SEQ ID NO: 182389

SEQ ID NO: 250658 - RNA, 64 nt, Homo Sapiens; identical to SEQ ID NO: 182390

SEQ ID NO: 250659 - RNA, 64 nt, Homo Sapiens; identical to SEQ ID NO: 182391

SEQ ID NO: 250660 - RNA, 64 nt, Homo Sapiens; identical to SEQ ID NO: 182392

SEQ ID NO: 250661 - RNA, 64 nt, Homo Sapiens; identical to SEQ ID NO: 182393

SEQ ID NO: 250662 - RNA, 64 nt, Homo Sapiens; identical to SEQ ID NO: 182394

SEQ ID NO: 250663 - RNA, 64 nt, Homo Sapiens; identical to SEQ ID NO: 182395

SEQ ID NO: 250664 - RNA, 64 nt, Homo Sapiens; identical to SEQ ID NO: 182396

SEQ ID NO: 250665 - RNA, 64 nt, Homo Sapiens; identical to SEQ ID NO: 182397

SEQ ID NO: 250666 - RNA, 64 nt, Homo Sapiens; identical to SEQ ID NO: 182398

SEQ ID NO: 250667 - RNA, 64 nt, Homo Sapiens; identical to SEQ ID NO: 182399

SEQ ID NO: 250668 - RNA, 64 nt, Homo Sapiens; identical to SEQ ID NO: 182400

SEQ ID NO: 250669 - RNA, 64 nt, Homo Sapiens; identical to SEQ ID NO: 182401

SEQ ID NO: 250670 - RNA, 64 nt, Homo Sapiens; identical to SEQ ID NO: 182402

SEQ ID NO: 250671 - RNA, 64 nt, Homo Sapiens; identical to SEQ ID NO: 182403

SEQ ID NO: 250672 - RNA, 64 nt, Homo Sapiens; identical to SEQ ID NO: 182404

SEQ ID NO: 250673 - RNA, 64 nt, Homo Sapiens; identical to SEQ ID NO: 182405

SEQ ID NO: 250674 - RNA, 64 nt, Homo Sapiens; identical to SEQ ID NO: 182406

SEQ ID NO: 250675 - RNA, 64 nt, Homo Sapiens; identical to SEQ ID NO: 182407

SEQ ID NO: 250676 - RNA, 64 nt, Homo Sapiens; identical to SEQ ID NO: 182408

SEQ ID NO: 250677 - RNA, 64 nt, Homo Sapiens; identical to SEQ ID NO: 182409

SEQ ID NO: 250678 - RNA, 64 nt, Homo Sapiens; identical to SEQ ID NO: 182410

SEQ ID NO: 250679 - RNA, 64 nt, Homo Sapiens; identical to SEQ ID NO: 182411

SEQ ID NO: 250680 - RNA, 64 nt, Homo Sapiens; identical to SEQ ID NO: 182412

SEQ ID NO: 250681 - RNA, 64 nt, Homo Sapiens; identical to SEQ ID NO: 182413

SEQ ID NO: 250682 - RNA, 64 nt, Homo Sapiens; identical to SEQ ID NO: 182414

SEQ ID NO: 250683 - RNA, 64 nt, Homo Sapiens; identical to SEQ ID NO: 182415

SEQ ID NO: 250684 - RNA, 64 nt, Homo Sapiens; identical to SEQ ID NO: 182416

SEQ ID NO: 250685 - RNA, 64 nt, Homo Sapiens; identical to SEQ ID NO: 182417

SEQ ID NO: 250686 - RNA, 64 nt, Homo Sapiens; identical to SEQ ID NO: 182418

SEQ ID NO: 250687 - RNA, 64 nt, Homo Sapiens; identical to SEQ ID NO: 182419

SEQ ID NO: 250688 - RNA, 64 nt, Homo Sapiens; identical to SEQ ID NO: 182420

SEQ ID NO: 250689 - RNA, 64 nt, Homo Sapiens; identical to SEQ ID NO: 182421

SEQ ID NO: 250690 - RNA, 64 nt, Homo Sapiens; identical to SEQ ID NO: 182422

SEQ ID NO: 250691 - RNA, 64 nt, Homo Sapiens; identical to SEQ ID NO: 182423

SEQ ID NO: 250692 - RNA, 64 nt, Homo Sapiens; identical to SEQ ID NO: 182424

SEQ ID NO: 250693 - RNA, 64 nt, Homo Sapiens; identical to SEQ ID NO: 182425

SEQ ID NO: 250694 - RNA, 64 nt, Homo Sapiens; identical to SEQ ID NO: 182426

SEQ ID NO: 250695 - RNA, 64 nt, Homo Sapiens; identical to SEQ ID NO: 182427

SEQ ID NO: 250696 - RNA, 64 nt, Homo Sapiens; identical to SEQ ID NO: 182428

SEQ ID NO: 250697 - RNA, 64 nt, Homo Sapiens; identical to SEQ ID NO: 182429

SEQ ID NO: 250698 - RNA, 64 nt, Homo Sapiens
aaccaacucagcuguaacauaugcaauucuguggugggaagaggcuguguguccaaggauggug

SEQ ID NO: 250699 - RNA, 64 nt, Homo Sapiens
ggcuggcagggaagacaaaucugcuacaaguccaugggaagacccuacaaugaaauguucauug

SEQ ID NO: 250700 - RNA, 64 nt, Homo Sapiens
gcucuaggcugccuggagggaaggaacaggcccaugggaagaaggggguuuuaaaaacaugucu

SEQ ID NO: 250701 - RNA, 64 nt, Homo Sapiens
acacccguggacuuguguauauggucauaggcuuugggaagacaggacguaaaggaaaaugaga

SEQ ID NO: 250702 - RNA, 64 nt, Homo Sapiens
gaauuagacacucugccugcgggaagaaggaaggugggaagaaguaaagugagacuuggguggu

SEQ ID NO: 250703 - RNA, 64 nt, Homo Sapiens
gaaggugggaagaaggaauuugagacuuggguggugggaagaaguuuucuuuuaauaaguaaag

SEQ ID NO: 250704 - RNA, 64 nt, Homo Sapiens
aaaaguuuaggaaaucauaauguggcagagguggugggaagaagaaaguugagcuuuuuccccu

SEQ ID NO: 250705 - RNA, 64 nt, Homo Sapiens
agucauuggggggaaaauguagccacauuuuuuaugggaagacuuuguguuaaaagugaacauu

SEQ ID NO: 250706 - RNA, 64 nt, Homo Sapiens
aagugguuuaauuggacuuagacauacccgagacugggaagaaaguuuucacgcugcugauaaa

SEQ ID NO: 250707 - RNA, 64 nt, Homo Sapiens
aagagguuuacuuggacuuagacguacccgagacugggaagaaaguauuaaugcugcugauaaa

SEQ ID NO: 250708 - RNA, 64 nt, Homo Sapiens
cagcuguacagauuuucuuucucuuucuguuuacugggaagauuauacuguguuauaauauuuu

SEQ ID NO: 250709 - RNA, 64 nt, Homo Sapiens
aguacuuuuuuuuaguaugcuugacuaguuaugaugggaagagaggccuagaauuuacacuggg

SEQ ID NO: 250710 - RNA, 64 nt, Homo Sapiens
gauaacuacccaaaccaaacaaccaauacauacaugggaagagaggcccugugugcucagugcc

SEQ ID NO: 250711 - RNA, 64 nt, Homo Sapiens
aaagguuauauuuuaagcuauuugagauugcuuuugggaagaucacuagauuuauggaggaauu

SEQ ID NO: 250712 - RNA, 64 nt, Homo Sapiens
acgggaccucuuucacuacccugccccagggacaugggaagaccuccuggaaagcccccagcag

SEQ ID NO: 250713 - RNA, 64 nt, Homo Sapiens
cuuggaguuacugaggugguaccgaaucccucccugggaagauuccuggcugacagguggggag

SEQ ID NO: 250714 - RNA, 61 nt, Homo Sapiens
gcccucagagugcucuguaggagcuguagacugggaagagaggccaggcgugguggcucac

SEQ ID NO: 250715 - RNA, 64 nt, Homo Sapiens
agcuagacccugucucaaaaaaaaaaaaaaagacugggaagagagcuagagggacuaggagaua

SEQ ID NO: 250716 - RNA, 64 nt, Homo Sapiens
auuucagcugacagaguuaacacauugugggugaugggaagacgguauauaaaaucauuaacca

SEQ ID NO: 250717 - RNA, 64 nt, Homo Sapiens
gagggcaaggaggugauagagaugggcuuagcauugggaagacaaaagcaugcaaggaagacca

SEQ ID NO: 250718 - RNA, 64 nt, Homo Sapiens
uuaaaagaaacugccuugaagacccaagauuucaugggaagaagacagaaaaaauaacugauua

SEQ ID NO: 250719 - RNA, 64 nt, Homo Sapiens
gagugaugcaccuucccgcuuggcccaucuuuuaugggaagacaucuaugccuuggugccgcag

SEQ ID NO: 250720 - RNA, 64 nt, Homo Sapiens
uuuuuuuuuuuuuuuuuuuuuuucaccuuagauaugggaagagucuuuuaaaaauguuuuuuau

SEQ ID NO: 250721 - RNA, 64 nt, Homo Sapiens
ggagagggguggcgccaugggcacccuuuucaguugggaagaaagcagaaaagaaggaaagagg

SEQ ID NO: 250722 - RNA, 64 nt, Homo Sapiens
cagaugugcaagucugcuuuccauuuuagucuaaugggaagauauuaaagucuuacgacuuucc

SEQ ID NO: 250723 - RNA, 64 nt, Homo Sapiens
uauuucugauuugugggccucauaguagggguucugggaagaggcuaagaugugagcagagugc

SEQ ID NO: 250724 - RNA, 64 nt, Homo Sapiens
uuucguuucugugaucucccggcacguuuggagcugggaagaccacacugguggcagaauccua

SEQ ID NO: 250725 - RNA, 64 nt, Homo Sapiens
aaaccuccacgugacuguuuggugcaucuugaccugggaagacgccucaugggaacgaacuugg

SEQ ID NO: 250726 - RNA, 64 nt, Homo Sapiens
ggcguggagagaagagccguugcuguuuguuuuuugggaagagcuuuuaaagaaugcauguuuu

SEQ ID NO: 250727 - RNA, 64 nt, Homo Sapiens
gcucuguaagccagaaccuuugaacaucagaggaugggaagaggugauugcuguauauuaaaau

SEQ ID NO: 250728 - RNA, 64 nt, Homo Sapiens
ugaucuguaauguuacaaauaguggaacaaagagugggaagaggggaaaaggaaagagucucag

SEQ ID NO: 250729 - RNA, 64 nt, Homo Sapiens
ggauggagagaauaggaaucuucacuagaagccgugggaagaauuggaaguuacaugcuguaua

SEQ ID NO: 250730 - RNA, 64 nt, Homo Sapiens
cuuuugguagagaaggagcagaaagauguguuuuugggaagaagaagaccucuaggaggagcua

SEQ ID NO: 250731 - RNA, 64 nt, Homo Sapiens
uaucuuugcugcagagaucaaggguuaagaucuaugggaagauacuuauuuuucugagguccuu

SEQ ID NO: 250732 - RNA, 64 nt, Homo Sapiens
augcuccccgggagcagaggccacuaauggagagugggaagagccuggaaagauguggccucag

SEQ ID NO: 250733 - RNA, 64 nt, Homo Sapiens
ugagaacuugcgauacuagccugcacccacuggcugggaagaucucuuccugcucccacgcccc

SEQ ID NO: 250734 - RNA, 64 nt, Homo Sapiens
guaguccucuaaagcaaaauuggccagacuacacugggaagaagugugucauguacccacuuuu

SEQ ID NO: 250735 - RNA, 64 nt, Homo Sapiens
agcuuugcagugacagcuuguccuccuuugcucuugggaagacccuugaacuagauugcaugcu

SEQ ID NO: 250736 - RNA, 64 nt, Homo Sapiens
uaagccaucucagauucugucuaaagggguuuuuugggaagacguuuucuuuaucgcccugaga

SEQ ID NO: 250737 - RNA, 64 nt, Homo Sapiens
ggcugagguuagagagauuggccagcaaaaacugugggaagaugaacuuugucauuaugauuuc

SEQ ID NO: 250738 - RNA, 64 nt, Homo Sapiens
aacuuaccugcuaggaaugcuagauugaaugggaugggaagagccuucccucauuauugucauu

SEQ ID NO: 250739 - RNA, 64 nt, Homo Sapiens
cccuggccugggcaucacaagccagugaugcuccugggaagaccagguggcaggucgcaguugg

SEQ ID NO: 250740 - RNA, 64 nt, Homo Sapiens
ccaguauuauccacaauuauugugguaguccuuuugggaagaauacucuuugaaagcuuuguuu

SEQ ID NO: 250741 - RNA, 64 nt, Homo Sapiens
gugggggaggcgcacaguguagcaccacacccagugggaagaguccacaaaugcagguguccug

SEQ ID NO: 250742 - RNA, 64 nt, Homo Sapiens
acagucauaugcugaaucuuuuuaagugaaaagaugggaagaaaagaaaccguaaggugcuucc

SEQ ID NO: 250743 - RNA, 64 nt, Homo Sapiens
gugcaauggcacagccgcagacaccucucugcugugggaagacuucuugugccuuaaauaaaac

SEQ ID NO: 250744 - RNA, 64 nt, Homo Sapiens
cauuuauuuuuuuccauguguugcuuuuuuaauaugggaagauauuacuggcguguagauggaa

SEQ ID NO: 250745 - RNA, 64 nt, Homo Sapiens
cgggucucguuucucucugucccgaggguggcagugggaagauuguuccuagguuggacucaua

SEQ ID NO: 250746 - RNA, 64 nt, Homo Sapiens
aacuuucccuguuuguuuacguggcaauagcacaugggaagaugacacaggagucuguucugag

SEQ ID NO: 250747 - RNA, 64 nt, Homo Sapiens
ugaaaucuuuuagaaguuugaaacuauguacuccugggaagauuuccauuuaaaacuaauuuau

SEQ ID NO: 250748 - RNA, 64 nt, Homo Sapiens
agaugaaugagccccagcaguccaaggugugaugugggaagacaccgcagagcucacucaccgg

SEQ ID NO: 250749 - RNA, 64 nt, Homo Sapiens
aacuugagaccauuuacggggagaaacuugauucugggaagauagcagaguacaaaccagcugc

SEQ ID NO: 250750 - RNA, 64 nt, Homo Sapiens
cccaggucccucugagcagcccugguaacaagggugggaagaagggacagcuguucuccggccc

SEQ ID NO: 250751 - RNA, 64 nt, Homo Sapiens
ccaaagaggccacaaagaagaaaaagaaacaguuugggaagaaaaguaagugcugcaccggugc

SEQ ID NO: 250752 - RNA, 64 nt, Homo Sapiens
aacagagaugacaaaagacccuggaauacagaauugggaagaagucaauuguagaauuuggaau

SEQ ID NO: 250753 - RNA, 64 nt, Homo Sapiens
ggaggccaggccaggcccucggcuagagguggggugggaagagacaaaagguaguauguccagu

SEQ ID NO: 250754 - RNA, 64 nt, Homo Sapiens
uaugcaaagagaaaggaaaggaugaggugauguauugacucaagguucauucuugcugcaauug

SEQ ID NO: 250755 - RNA, 64 nt, Homo Sapiens
ccacaugaaggguacacauuagguaagcugggcguugacucaugcgcagucucagucacccgug

SEQ ID NO: 250756 - RNA, 64 nt, Homo Sapiens
aauuagauauuuuaccauauguauauguuuuuauuugacucaaauuucagcaaaacuuauaccu

SEQ ID NO: 250757 - RNA, 64 nt, Homo Sapiens
uggaaauugugcacuuuccuuacagccuuuaaauuugacucaaaauucucaagauuuuucuaaa

SEQ ID NO: 250758 - RNA, 64 nt, Homo Sapiens
ucagacuuuucauucacaacucuuugcaauuugcuugacucaccagcaccuccucaccugccaa

SEQ ID NO: 250759 - RNA, 64 nt, Homo Sapiens
caagcauuuugccauguuuucuacagcagggaaguugacucauccuucauccaaaucgccucac

SEQ ID NO: 250760 - RNA, 64 nt, Homo Sapiens
uggaagcuaccagagcucuauccccauccaggucuugacucauggcagcuguuucucaugaagc

SEQ ID NO: 250761 - RNA, 64 nt, Homo Sapiens
gaguccagagcuugugcuccucuugauuccugguuugacucaguuccaggccugaucuugccug

SEQ ID NO: 250762 - RNA, 64 nt, Homo Sapiens
caaccguagcaauguggucaucacgaagucuucauugacucacuggcuuggauuuuaggguuag

SEQ ID NO: 250763 - RNA, 64 nt, Homo Sapiens
uguccuuccgucucacuuuacuagagugcccaaguugacucauccuuacucacucauucccuca

SEQ ID NO: 250764 - RNA, 64 nt, Homo Sapiens
gcccauaguuuccagaccauauggugggucagauuugacucacuucuuagcuguacagaaacag

SEQ ID NO: 250765 - RNA, 64 nt, Homo Sapiens
agccgaaauuccuagaaaucucuugcagcuagaguugacucagauuaggggaaaaugaaguggc

SEQ ID NO: 250766 - RNA, 64 nt, Homo Sapiens
uugacauaccaaugaucagaaauuuuagugaaacuugacucaacuauacacaaaguucucaucc

SEQ ID NO: 250767 - RNA, 64 nt, Homo Sapiens
cuuaucugguuaauaauccgaaauguuaccgggguugacucacggaauuaaauuuuuccucuau

SEQ ID NO: 250768 - RNA, 64 nt, Homo Sapiens
aacaaacucuagaauauugauaacaaacuccagucuguugcagucaaacuccagucuguugcag

SEQ ID NO: 250769 - RNA, 64 nt, Homo Sapiens
aacaaacuccagucuguugcuaacaaacuccagucuguugcaguucuuucccugucguuugcag

SEQ ID NO: 250770 - RNA, 64 nt, Homo Sapiens
uaaauauuggggucuucugucuaaacuggggucacuguugcauggaacauuguucuuaauaguu

SEQ ID NO: 250771 - RNA, 64 nt, Homo Sapiens
uauuuguguauggaaaacacuugauauuuuaucccuguugcaucuggcugcacagagccucucc

SEQ ID NO: 250772 - RNA, 64 nt, Homo Sapiens
ccugggcuuggacuggcuagaaucuuucucuggacuguugcauguacagugccuccauccugga

SEQ ID NO: 250773 - RNA, 64 nt, Homo Sapiens
ggcucgaaucagagccgugcccaagauaucccugcuguugcaucguuugaagcugacguccugu

SEQ ID NO: 250774 - RNA, 64 nt, Homo Sapiens
uuggaucuuaccaaugcggcuauaggaaaacagccuguugcaugguaagagugauaccaucuug

SEQ ID NO: 250775 - RNA, 64 nt, Homo Sapiens
uuuuuagaauuuuuuguagggacagggccucacucuguugcacaagcuggucuugaacuccugg

SEQ ID NO: 250776 - RNA, 64 nt, Homo Sapiens
uacuuuaaaguuuauuauaacaauggcuaaauaucuguugcauguucauauuauaggcagaaca

SEQ ID NO: 250777 - RNA, 64 nt, Homo Sapiens
guuaaaaaugcugggagucuagcaaauuuuuguacuguugcauacaaauucaaauguuuaugcc

SEQ ID NO: 250778 - RNA, 64 nt, Homo Sapiens; identical to SEQ ID NO: 247079

SEQ ID NO: 250779 - RNA, 64 nt, Homo Sapiens; identical to SEQ ID NO: 247080

SEQ ID NO: 250780 - RNA, 64 nt, Homo Sapiens; identical to SEQ ID NO: 247081

SEQ ID NO: 250781 - RNA, 64 nt, Homo Sapiens; identical to SEQ ID NO: 247082

SEQ ID NO: 250782 - RNA, 64 nt, Homo Sapiens; identical to SEQ ID NO: 247083

SEQ ID NO: 250783 - RNA, 64 nt, Homo Sapiens; identical to SEQ ID NO: 247084

SEQ ID NO: 250784 - RNA, 64 nt, Homo Sapiens; identical to SEQ ID NO: 247085

SEQ ID NO: 250785 - RNA, 64 nt, Homo Sapiens; identical to SEQ ID NO: 247086

SEQ ID NO: 250786 - RNA, 55 nt, Homo Sapiens; identical to SEQ ID NO: 247087

SEQ ID NO: 250787 - RNA, 64 nt, Homo Sapiens; identical to SEQ ID NO: 247088

SEQ ID NO: 250788 - RNA, 64 nt, Homo Sapiens; identical to SEQ ID NO: 247089

SEQ ID NO: 250789 - RNA, 64 nt, Homo Sapiens; identical to SEQ ID NO: 247090

SEQ ID NO: 250790 - RNA, 64 nt, Homo Sapiens; identical to SEQ ID NO: 247091

SEQ ID NO: 250791 - RNA, 64 nt, Homo Sapiens; identical to SEQ ID NO: 247092

SEQ ID NO: 250792 - RNA, 64 nt, Homo Sapiens; identical to SEQ ID NO: 247093

SEQ ID NO: 250793 - RNA, 64 nt, Homo Sapiens; identical to SEQ ID NO: 247094

SEQ ID NO: 250794 - RNA, 64 nt, Homo Sapiens
uucuaggacauuggguguuucaagguucuguucagaucccuaugggggcccagcuggcuccacg

SEQ ID NO: 250795 - RNA, 64 nt, Homo Sapiens
uuucuacuuuacugucucccuagagauccuagaggaucccuacuguuuucuguuuuauguguuu

SEQ ID NO: 250796 - RNA, 64 nt, Homo Sapiens
uagugcccagcuguagaaucuaccuuagguagaugaucccuagacauacguugguuuugagggc

SEQ ID NO: 250797 - RNA, 64 nt, Homo Sapiens
uuugaccaaauucucagugauaaauaugugugcagaucccuagaagagaaaacgcugacuuucu

SEQ ID NO: 250798 - RNA, 64 nt, Homo Sapiens
acgugagaaugcugaauguguaaaguugcagagggaucccuaauuugaagacuuugacacagaa

SEQ ID NO: 250799 - RNA, 64 nt, Homo Sapiens
ucuuuaacaucuucuuuccuaugcccucucuguggaucccuacugcugguuucugccuucucca

SEQ ID NO: 250800 - RNA, 64 nt, Homo Sapiens
uauugcuauugcugcuaauuccaugagcugugaagaucccuaaccaacucagcuguaacauaug

SEQ ID NO: 250801 - RNA, 64 nt, Homo Sapiens
ugacuguaaaaguagcuaauuguuucuucuacaagaucccuauugacuggugggucugucuacc

SEQ ID NO: 250802 - RNA, 64 nt, Homo Sapiens
agcucauccugcccuuugaacugggaaucauuacgaucccuagcggagaagggcaggagaguac

SEQ ID NO: 250803 - RNA, 64 nt, Homo Sapiens
augccuccugaaaugcagcuguaaguggagaagagaucccuaauaagaucuuuguucuauaacu

SEQ ID NO: 250804 - RNA, 64 nt, Homo Sapiens
ccuaccccaucuauucucugagggauagggccaggaucccuauuagguauaacucaaaauccaa

SEQ ID NO: 250805 - RNA, 64 nt, Homo Sapiens
cuaaguugaaauguauuucuuuaaaaauuuguuggaucccuagacauaauuuuugucuauucau

SEQ ID NO: 250806 - RNA, 64 nt, Homo Sapiens
gagcuaugauccacaaaaacaacuuauuauugaagaucccuauuauguaaguacaguucacguu

SEQ ID NO: 250807 - RNA, 64 nt, Homo Sapiens
uauguuuuguugcagcugauuccaguuuauaauagaucccuaguaaaaagcuuugauucaacac

SEQ ID NO: 250808 - RNA, 64 nt, Homo Sapiens
accguggaggagagagaggccuucucuuccuugggaucccuaagugagcucggucgcacacuca

SEQ ID NO: 250809 - RNA, 64 nt, Homo Sapiens
uugaaucucaugccuguuaauuugaaauaaaagugaucccuauauauugguuuguauuuaauug

SEQ ID NO: 250810 - RNA, 64 nt, Homo Sapiens
gaaaacaaacaaacaaacaacuccuagcccccuugaucccuaaaugccccccauuucuguaacc

SEQ ID NO: 250811 - RNA, 64 nt, Homo Sapiens
uggaaaagacagaaaacuaaaaaggaagaaaaaagaucccuauuagauacacuucuuaaauaca

SEQ ID NO: 250812 - RNA, 64 nt, Homo Sapiens
gaagauucccaacaagaauuuggauggaaaaccugaucccuagcaagaagucugcucuguauca

SEQ ID NO: 250813 - RNA, 64 nt, Homo Sapiens
auuguauugcuaugcccucccauaaaaacacauugaucccuagcaagauuauugcauuccagau

SEQ ID NO: 250814 - RNA, 64 nt, Homo Sapiens
auuaagacucuggcagaguuauggguaggauauggaucccuacaugaauaaguccuguaaauac

SEQ ID NO: 250815 - RNA, 64 nt, Homo Sapiens
cagaaaccuaacaccauguaccagcaguggagcugaucccuacguccgugucuacuuguugcca

SEQ ID NO: 250816 - RNA, 64 nt, Homo Sapiens
auauggcagagauggggggugguggguggggugggaucccuaacguaauauucuuuaugaaagc

SEQ ID NO: 250817 - RNA, 64 nt, Homo Sapiens
ccuacaaagagccuuccuauuauuguuguuguuugaucccuaacuaaaaacuuuauuggguuuu

SEQ ID NO: 250818 - RNA, 64 nt, Homo Sapiens
agaaaugacuguuuauuucauucuuauaucuucagaucccuagcagggagauaguggaaaacug

SEQ ID NO: 250819 - RNA, 64 nt, Homo Sapiens
auggcuuuuucuccuugguaauagggccuccuuagaucccuaaggucuaagguaguaacuuucc

SEQ ID NO: 250820 - RNA, 64 nt, Homo Sapiens
ccugggccugggccugccuacccuauggggcuaugaucccuagggggaccauggagcaguggca

SEQ ID NO: 250821 - RNA, 64 nt, Homo Sapiens
cuuagcaauuuuccagucaccauguccuacuauagaucccuagaacauauuccuccaauguaac

SEQ ID NO: 250822 - RNA, 64 nt, Homo Sapiens
gagaaccauauuuauuuauaaugaagacaucuaagaucccuaugaugaaugcaggaacucucuu

SEQ ID NO: 250823 - RNA, 64 nt, Homo Sapiens
uuucauugauaguaacgcugaguuacaggaacacgaucccuaguccucccacuguuuuugcuaa

SEQ ID NO: 250824 - RNA, 64 nt, Homo Sapiens
guguuucuuuugacaccuuauugucuaugaauaugaucccuaauauaagaaaauguaaagguuu

SEQ ID NO: 250825 - RNA, 64 nt, Homo Sapiens
agcaaagaaagaaguagcuuggaacuuuugagaugaucccuaacauacuguacuacuugcuuuu

SEQ ID NO: 250826 - RNA, 64 nt, Homo Sapiens
cugaugucagagauuagguugauuugcugagcaugaucccuauuuacaaaugaccuugcucuug

SEQ ID NO: 250827 - RNA, 64 nt, Homo Sapiens
ccccauuuagguuucugaguuccugcaugccggugaucccuagcugugaccucuccccuggaac

SEQ ID NO: 250828 - RNA, 64 nt, Homo Sapiens
cucuguuccaugagccuguucuccuaugcuccuggaucccuagggcccugcccagcaccaccac

SEQ ID NO: 250829 - RNA, 64 nt, Homo Sapiens
ggcaugagaaaagcacauaaugaccaagcaccaugaucccuaggauuugacucaaauauauacu

SEQ ID NO: 250830 - RNA, 64 nt, Homo Sapiens
gacuaccuaaucugacuuuccccagagcuggauggaucccuaggaggccaucugaugauagauu

SEQ ID NO: 250831 - RNA, 64 nt, Homo Sapiens
cauagugugaauuuauauccuuguccuuggcugugaucccuauagcaaagaaugucuacugcuc

SEQ ID NO: 250832 - RNA, 64 nt, Homo Sapiens
auaucagaagaaaaugucugcuuagggacucugugaucccuaaaugguacuuacagguaccucu

SEQ ID NO: 250833 - RNA, 64 nt, Homo Sapiens
uugcugguguggauagaaaccaggcaggacaguagaucccuaugguuggaucucagcuggaagu

SEQ ID NO: 250834 - RNA, 64 nt, Homo Sapiens
guggagaugaggauggguaacaguauuggggccagaucccuaagccccccagcuguaaauaggc

SEQ ID NO: 250835 - RNA, 64 nt, Homo Sapiens
ucauucagaagcgccauaagucaguugaguauuugaucccuagauaagaacaugcaaaucagca

SEQ ID NO: 250836 - RNA, 64 nt, Homo Sapiens
ccccucaaaccugugucuggggugugggcucacagaucccuaucagccugguucgugggagggc

SEQ ID NO: 250837 - RNA, 64 nt, Homo Sapiens
ccgccgcccuccaccccugccuuucagcguuguggaucccuagagguggcccccugcccgaucc

SEQ ID NO: 250838 - RNA, 64 nt, Homo Sapiens
uccugauuuggaugcaucugccacaguggaguaugaucccuaaccauuauucuauaauucagga

SEQ ID NO: 250839 - RNA, 64 nt, Homo Sapiens
caccgaguguugagcccaagagcaauaaccucuugaucccuacuggcccugaaacugauguccu

SEQ ID NO: 250840 - RNA, 58 nt, Homo Sapiens
ugccuggcuaagacccguggcagucacagaucccuaccagaagaagaaggagugguaa

SEQ ID NO: 250841 - RNA, 64 nt, Homo Sapiens
ggacaccgggugaccccuuagggcacccaggcaagaucccuaagaggcacccaaugcccaggcc

SEQ ID NO: 250842 - RNA, 64 nt, Homo Sapiens
acgggaucccaaacuuggauguuccuggaaaggugaucccuaccgggaaacauucccauccauu

SEQ ID NO: 250843 - RNA, 64 nt, Homo Sapiens
gcauuaaagaauccuuguuggaugguagaaaucagaucccuaaccagugggagguacuuuuugg

SEQ ID NO: 250844 - RNA, 64 nt, Homo Sapiens
cuuuuguguuggaugguuuucaucaaaugauugagaucccuaaauuuguuucuaugauguugug

SEQ ID NO: 250845 - RNA, 64 nt, Homo Sapiens
accaagucaaguugguguugggugcacaugacuugaucccuaugccacagccacacaaccagag

SEQ ID NO: 250846 - RNA, 64 nt, Homo Sapiens
ucugagacuuacucaucugguuuugacuucuuaugaucccuaauuaauguucuuacacuguguu

SEQ ID NO: 250847 - RNA, 64 nt, Homo Sapiens
aggugucuuuugagagcauucaguaggacauggugaucccuauuucagccucuaagaugacugg

SEQ ID NO: 250848 - RNA, 64 nt, Homo Sapiens
ggcccugguugaaucuggcaauucuuuuugccaagaucccuagcagaagauuuagccauguccu

SEQ ID NO: 250849 - RNA, 64 nt, Homo Sapiens
ugucucuuuuggugucuauuaggagccaauaagggaucccuauugcuuuauccaacaaaaugua

SEQ ID NO: 250850 - RNA, 64 nt, Homo Sapiens
cauggaaucagggcagccaauuuucuaguuaguagaucccuagauacagguaggcuaguauuau

SEQ ID NO: 250851 - RNA, 64 nt, Homo Sapiens
auccccagccccagccagaacucuugauuagggggaucccuaaucuaaacaguugaugggguau

SEQ ID NO: 250852 - RNA, 64 nt, Homo Sapiens
gugacuggcagaguaagagacugggguauaccuugaucccuagaucaguuccauuucagguuac

SEQ ID NO: 250853 - RNA, 64 nt, Homo Sapiens
acucaaaauaacuuguuugucuagucaccaggaggaucccuauguuuuagucauuaaaaaaaau

SEQ ID NO: 250854 - RNA, 64 nt, Homo Sapiens
ugcagaucaagauuuucucaauagccuagaaaaugaucccuaucgguuaguguacuaguccauc

SEQ ID NO: 250855 - RNA, 64 nt, Homo Sapiens
auacuuaagcaugaagugacuuuuauaaugacucgaucccuagacauuuguuacagauaguuuu

SEQ ID NO: 250856 - RNA, 64 nt, Homo Sapiens
acagaauaagaacaaaugugacgaggaccuagaagaucccuaaagccuaaaaccacacucagaa

SEQ ID NO: 250857 - RNA, 64 nt, Homo Sapiens
uugcagcgaucccagagcguugauaacgugaucugaucccuaaguugagaccugucuuccugua

SEQ ID NO: 250858 - RNA, 64 nt, Homo Sapiens
gagaauuaaaggugagaaaguauaguauaauagugaucccuaugacacauacguaugcaaauau

SEQ ID NO: 250859 - RNA, 64 nt, Homo Sapiens
uuguuuucugucagucauucgaagcugcagacaggaucccuagcaauaaaaagaggaaaggcug

SEQ ID NO: 250860 - RNA, 64 nt, Homo Sapiens
ccaguggggggagaaucuucaggugagugacucugaucccuacucaugacacggaggugacucg

SEQ ID NO: 250861 - RNA, 63 nt, Homo Sapiens
aacacaaaugucuuguguuuauaaaagacauuaggaucccuaccuuuguguaauauuuauaug

SEQ ID NO: 250862 - RNA, 64 nt, Homo Sapiens
uacauguucccacagaggugucugggguaugcgugaucccuagacugaggaugggccugcccug

SEQ ID NO: 250863 - RNA, 64 nt, Homo Sapiens
gccaaccuggaauggagacuagccacuucugcaggaucccuacuuguaggccaaauuucauuuc

SEQ ID NO: 250864 - RNA, 64 nt, Homo Sapiens
ucccaggauccucucuuugggagcgaagccagaggaucccuacagcacucaagcuucauggugg

SEQ ID NO: 250865 - RNA, 64 nt, Homo Sapiens
cgggcaggacagaugggcagccucgccagcugcugaucccuacaaguggcuugguuccccaucu

SEQ ID NO: 250866 - RNA, 64 nt, Homo Sapiens
uugccaccuuucuauuguuuuuuaucucuuuugcgaucccuaaagguagaaaaguuuuuuuggu

SEQ ID NO: 250867 - RNA, 64 nt, Homo Sapiens
ccccugagagcuggacagagucccaagaacuguagaucccuagggguuacauugguuuauagca

SEQ ID NO: 250868 - RNA, 64 nt, Homo Sapiens
cccuuuguccuccccauagagcuggggugggguggaucccuauaccuggggcaggcagccccaa

SEQ ID NO: 250869 - RNA, 64 nt, Homo Sapiens
gaacgcuugugucucaggguccuccugggauggcgaucccuacuggaggugcuguuaucucgua

SEQ ID NO: 250870 - RNA, 64 nt, Homo Sapiens
uguucccuuaucuguuuucuuaggggaaagaagggaucccuaacuuuguaugucuguguaugua

SEQ ID NO: 250871 - RNA, 64 nt, Homo Sapiens
uugcagaaugucuguaggaaacccuauuuugggugaucccuaucacugguccaguccauugaag

SEQ ID NO: 250872 - RNA, 64 nt, Homo Sapiens
gaaagaggacacuucaucuugagggcucaaguuagaucccuauaccaaaacauuugacuccagu

SEQ ID NO: 250873 - RNA, 64 nt, Homo Sapiens
cucuugcuugugccuuccacaccuucucggugcagaucccuaugggggagcugccucacguucu

SEQ ID NO: 250874 - RNA, 64 nt, Homo Sapiens
guauuucauuaauguuaaaaauuuucagcguauagaucccuaugcauuuuuguuagaauuugca

SEQ ID NO: 250875 - RNA, 64 nt, Homo Sapiens
cuuuggccacgagaucccagugauccaaccacaggaucccuacuccucagccacuggagacuga

SEQ ID NO: 250876 - RNA, 64 nt, Homo Sapiens
cugacaucacuggugucccuagguuguuggguucgaucccuaaucaggugaguaacuucaaaug

SEQ ID NO: 250877 - RNA, 64 nt, Homo Sapiens
acacuguggaugaaccuugaaggaaugaagcagugaucccuacuaguauuacacagccauaaaa

SEQ ID NO: 250878 - RNA, 64 nt, Homo Sapiens
ugaggagaagcggcuugaagucacccaccaccccgaucccuaggacacuguacacuguuccuuu

SEQ ID NO: 250879 - RNA, 64 nt, Homo Sapiens
ggcuucggggacgcggggcgcuucucgggcgggugaucccuaacagggcggcuucccagggcug

SEQ ID NO: 250880 - RNA, 64 nt, Homo Sapiens
gugcccagcauguagauucuccccuccccagagggaucccuaacaacaaggcaagccaaaggcg

SEQ ID NO: 250881 - RNA, 64 nt, Homo Sapiens
ugugacuuccuucagcaaauaaguaaugauggcugaucccuauuuccuguugaucaugaugaua

SEQ ID NO: 250882 - RNA, 64 nt, Homo Sapiens
guguauguuuuuaaagcuaaaaacauuacuuuuagaucccuagaaugaaaauuuuuuucucauc

SEQ ID NO: 250883 - RNA, 64 nt, Homo Sapiens
uacccuagaaaacagcugcaaaugccagaaagaugaucccuaaaaauguugagggacuucuguu

SEQ ID NO: 250884 - RNA, 64 nt, Homo Sapiens
gcguuagucuucccaggccuuuaaggcagagggagaucccuaugcacuaagauuccugugccuu

SEQ ID NO: 250885 - RNA, 64 nt, Homo Sapiens
gggaugaggaaauaguucauagcuucgugcaggugaucccuauucugcguguauguguuugcac

SEQ ID NO: 250886 - RNA, 64 nt, Homo Sapiens
guucuggcugaagggcuaucucuggcaccucugagaucccuagguccugcccuccugguccgug

SEQ ID NO: 250887 - RNA, 64 nt, Homo Sapiens
aaaaggaaguuaugggaauaccuguggugguugugaucccuaggucuugggagcucuuggaggu

SEQ ID NO: 250888 - RNA, 64 nt, Homo Sapiens
cccuggccccacaauaaacacccucucacccgaggaucccuaccaacuuaccccggccagccag

SEQ ID NO: 250889 - RNA, 64 nt, Homo Sapiens
cugucccucucccaaucucuucccgcccugucuggaucccuaagcaguagcaguauuuuugccc

SEQ ID NO: 250890 - RNA, 64 nt, Homo Sapiens
cugccuuguaaacaaaaaugaguaacgcacggacgaucccuaaaccucagaguagcaucuucac

SEQ ID NO: 250891 - RNA, 64 nt, Homo Sapiens; identical to SEQ ID NO: 128751

SEQ ID NO: 250892 - RNA, 64 nt, Homo Sapiens; identical to SEQ ID NO: 128752

SEQ ID NO: 250893 - RNA, 64 nt, Homo Sapiens; identical to SEQ ID NO: 128753

SEQ ID NO: 250894 - RNA, 64 nt, Homo Sapiens; identical to SEQ ID NO: 128754

SEQ ID NO: 250895 - RNA, 64 nt, Homo Sapiens; identical to SEQ ID NO: 128755

SEQ ID NO: 250896 - RNA, 64 nt, Homo Sapiens; identical to SEQ ID NO: 128756

SEQ ID NO: 250897 - RNA, 64 nt, Homo Sapiens; identical to SEQ ID NO: 128757

SEQ ID NO: 250898 - RNA, 64 nt, Homo Sapiens; identical to SEQ ID NO: 128758

SEQ ID NO: 250899 - RNA, 64 nt, Homo Sapiens; identical to SEQ ID NO: 128759

SEQ ID NO: 250900 - RNA, 64 nt, Homo Sapiens; identical to SEQ ID NO: 128760

SEQ ID NO: 250901 - RNA, 64 nt, Homo Sapiens; identical to SEQ ID NO: 128761

SEQ ID NO: 250902 - RNA, 64 nt, Homo Sapiens; identical to SEQ ID NO: 128762

SEQ ID NO: 250903 - RNA, 64 nt, Homo Sapiens; identical to SEQ ID NO: 128763

SEQ ID NO: 250904 - RNA, 64 nt, Homo Sapiens; identical to SEQ ID NO: 128764

SEQ ID NO: 250905 - RNA, 64 nt, Homo Sapiens; identical to SEQ ID NO: 128765

SEQ ID NO: 250906 - RNA, 64 nt, Homo Sapiens; identical to SEQ ID NO: 128766

SEQ ID NO: 250907 - RNA, 64 nt, Homo Sapiens; identical to SEQ ID NO: 128767

SEQ ID NO: 250908 - RNA, 64 nt, Homo Sapiens; identical to SEQ ID NO: 128768

SEQ ID NO: 250909 - RNA, 64 nt, Homo Sapiens; identical to SEQ ID NO: 128769

SEQ ID NO: 250910 - RNA, 64 nt, Homo Sapiens; identical to SEQ ID NO: 128770

SEQ ID NO: 250911 - RNA, 64 nt, Homo Sapiens; identical to SEQ ID NO: 128771

SEQ ID NO: 250912 - RNA, 64 nt, Homo Sapiens; identical to SEQ ID NO: 128772

SEQ ID NO: 250913 - RNA, 64 nt, Homo Sapiens; identical to SEQ ID NO: 128773

SEQ ID NO: 250914 - RNA, 64 nt, Homo Sapiens; identical to SEQ ID NO: 128774

SEQ ID NO: 250915 - RNA, 64 nt, Homo Sapiens; identical to SEQ ID NO: 128775

SEQ ID NO: 250916 - RNA, 64 nt, Homo Sapiens; identical to SEQ ID NO: 128776

SEQ ID NO: 250917 - RNA, 64 nt, Homo Sapiens; identical to SEQ ID NO: 128777

SEQ ID NO: 250918 - RNA, 64 nt, Homo Sapiens; identical to SEQ ID NO: 128778

SEQ ID NO: 250919 - RNA, 64 nt, Homo Sapiens; identical to SEQ ID NO: 128779

SEQ ID NO: 250920 - RNA, 64 nt, Homo Sapiens; identical to SEQ ID NO: 128780

SEQ ID NO: 250921 - RNA, 64 nt, Homo Sapiens; identical to SEQ ID NO: 128781

SEQ ID NO: 250922 - RNA, 64 nt, Homo Sapiens; identical to SEQ ID NO: 128782

SEQ ID NO: 250923 - RNA, 64 nt, Homo Sapiens; identical to SEQ ID NO: 128783

SEQ ID NO: 250924 - RNA, 64 nt, Homo Sapiens; identical to SEQ ID NO: 128784

SEQ ID NO: 250925 - RNA, 64 nt, Homo Sapiens; identical to SEQ ID NO: 128785

SEQ ID NO: 250926 - RNA, 64 nt, Homo Sapiens; identical to SEQ ID NO: 128786

SEQ ID NO: 250927 - RNA, 64 nt, Homo Sapiens; identical to SEQ ID NO: 128787

SEQ ID NO: 250928 - RNA, 64 nt, Homo Sapiens; identical to SEQ ID NO: 128788

SEQ ID NO: 250929 - RNA, 64 nt, Homo Sapiens; identical to SEQ ID NO: 128789

SEQ ID NO: 250930 - RNA, 64 nt, Homo Sapiens
cgucugccuacccauucgugggagaguccccugaaggucugacagguuugggggcuguggggaa

SEQ ID NO: 250931 - RNA, 64 nt, Homo Sapiens
uggagguccuucugcuggauuuuucuugccaaugaggucugaaauuucagaagagaugggcuug

SEQ ID NO: 250932 - RNA, 64 nt, Homo Sapiens
acacacaguggagagguuaaccugaggguuuaggaggucugaacgaaggccuugcccuaagcua

SEQ ID NO: 250933 - RNA, 64 nt, Homo Sapiens
guuucaaagggagaccuauacacuucuuuuagcaaggucugaaauugcccuuauuccuccaccc

SEQ ID NO: 250934 - RNA, 64 nt, Homo Sapiens
accgaccgugcccucugcccacccgugcugagaaaggucugagcagcuccagcucaggucugag

SEQ ID NO: 250935 - RNA, 64 nt, Homo Sapiens
cccgugcugagaaaggucugguuagcuccagcucaggucugagagggugcugccucuuccucca

SEQ ID NO: 250936 - RNA, 64 nt, Homo Sapiens
agucagacauuggaauuggaagaacuauaaagugugauucgaucgucaagacaucacuuggauu

SEQ ID NO: 250937 - RNA, 64 nt, Homo Sapiens
auagucaggagaagguaacauuggaguccugguuugauucgaaggaugaagacgaagaagcaag

SEQ ID NO: 250938 - RNA, 64 nt, Homo Sapiens
caccuuggcccuucaaggucggcaagagaaaggaugauucgaggcaaaaauaacugcaaggagg

SEQ ID NO: 250939 - RNA, 64 nt, Homo Sapiens
auugaaccugaaacccaaagaaucuggaugccugugauucgagagauguguuuguuaugaagaa

SEQ ID NO: 250940 - RNA, 64 nt, Homo Sapiens
augucugccugggggugggguuggaauuaaauuuugauucgaauuauuuauuaucaugacaaug

SEQ ID NO: 250941 - RNA, 64 nt, Homo Sapiens
ugcuacugguuaaaggaccaccauuuaauuaacaugauucgaaagccuuccucggguucaaagc

SEQ ID NO: 250942 - RNA, 64 nt, Homo Sapiens
uauauccuaugauacaacucuaaguguuaucacuugauucgaaagggucagaagaccaguuuuu

SEQ ID NO: 250943 - RNA, 64 nt, Homo Sapiens
cuucaaauauuguuuaauggagacuguauuugauugauucgaguagguacaaugcaugcaucac

SEQ ID NO: 250944 - RNA, 64 nt, Homo Sapiens
gacacuguucaggaaucggacagcucugacauucugauucgaauuuaagucagaacagcagacu

SEQ ID NO: 250945 - RNA, 64 nt, Homo Sapiens
uccuccuggccugagcgcaggccccaccccguccugauucgaggcuuccccagcucagagcccc

SEQ ID NO: 250946 - RNA, 64 nt, Homo Sapiens
aucaugagaauagcacaggaaagacuggccccccugauucgaugaccucccccugggucccucc

SEQ ID NO: 250947 - RNA, 64 nt, Homo Sapiens
cuggaugcugugagcuugauggucuugucugcugugauucgacuccggguugguggccauggag

SEQ ID NO: 250948 - RNA, 64 nt, Homo Sapiens
gaauccggaauacauagggccucucccacagcccugauucgacugcaccaauucuugauuuggg

SEQ ID NO: 250949 - RNA, 64 nt, Homo Sapiens
agcauuuguuucuccccacaagaagcagagcagaugauucgagcaagcgugaaugaggaacaga

SEQ ID NO: 250950 - RNA, 64 nt, Homo Sapiens
acacauagcaaaauucaugugacggaugauaaauugauucgaaaagcuggucccccaggaucua

SEQ ID NO: 250951 - RNA, 64 nt, Homo Sapiens
cugcugauuguggggcugggagguggagggccccugauucgaaggccauuuggugaguguuuug

SEQ ID NO: 250952 - RNA, 64 nt, Homo Sapiens
ccacucauguucuuuguaacguugaagagucaucugauucgaggucucaguaaggaguguuuga

SEQ ID NO: 250953 - RNA, 64 nt, Homo Sapiens
uauauuuaaguauucaagaaccauaucuaaccagugauucgagcguacaguugggaaaauaugu

SEQ ID NO: 250954 - RNA, 64 nt, Homo Sapiens
ccuccucuuccuccuucucuacaaaagcuccgguugauucgagggaaguggugaaaauuuuuuu

SEQ ID NO: 250955 - RNA, 64 nt, Homo Sapiens
gaggcuggaggagauagccgcgugcuccggcuaaugauucgacauuucuugucuccagguacac

SEQ ID NO: 250956 - RNA, 64 nt, Homo Sapiens
ggucuuaaagaauuuuuuuagaaagaaugugcuuugauucgaaggucugugguuuaagcuuugu

SEQ ID NO: 250957 - RNA, 64 nt, Homo Sapiens
gauaugggacauuucuauaaucuauauucuaauuugauucgauuauugagucguaaguauuaau

SEQ ID NO: 250958 - RNA, 64 nt, Homo Sapiens
ugaaaaaucaacuaagauuauuugacuaaauuauugauucgauaucuaaucaauaaaauauauu

SEQ ID NO: 250959 - RNA, 64 nt, Homo Sapiens
cgcuacagucuacaguguuauggucauugucuaaugauucgaugauuaauuucccuaaagugaa

SEQ ID NO: 250960 - RNA, 64 nt, Homo Sapiens
ucucccugggaggguuuagaaccuccaccaugucugauucgaguuuccuucacagauacuuaag

SEQ ID NO: 250961 - RNA, 64 nt, Homo Sapiens
uucaaacugccaguauuuuuuuuuaucugcuuuuugcugcuaguuauguuaucuuccauucuau

SEQ ID NO: 250962 - RNA, 64 nt, Homo Sapiens
uuugacugcaagauugaaggguuguggagggaagugcugcuagaagaccauucgcgauuuagaa

SEQ ID NO: 250963 - RNA, 64 nt, Homo Sapiens
auaugagaauguuuugcguaggggcaacacagucugcugcuauauagugggggaagcgugcacu

SEQ ID NO: 250964 - RNA, 64 nt, Homo Sapiens
uuuaaacauuuuuaaucacaagcuguauuagcuuugcugcuauauagguguuauguguaaaugc

SEQ ID NO: 250965 - RNA, 64 nt, Homo Sapiens
uuaauuuuguaaaugccaaaugaaaaacguuuuuugcugcuauggucuuagccuguagacaugc

SEQ ID NO: 250966 - RNA, 64 nt, Homo Sapiens
cguuuuuugcugcuauggucuuagccuguagacaugcugcuaguaucagaggggcaguagagcu

SEQ ID NO: 250967 - RNA, 64 nt, Homo Sapiens
ccuuugggauuucaggugucccaugaucuugaugugcugcuaggcuggagcacacacuggccau

SEQ ID NO: 250968 - RNA, 64 nt, Homo Sapiens
aacaguauuuaacuugaaauucaucaugggagucugcugcuauaccaggcacaagauaaaacuc

SEQ ID NO: 250969 - RNA, 64 nt, Homo Sapiens
ucaccauguugcugugcccuucacggaauccaauugcugcuaccugugucucguaaaggucauc

SEQ ID NO: 250970 - RNA, 64 nt, Homo Sapiens
ccagaccuguggacgaggcacuuaaccuucugagugcugcuagcccccacucacuuugugugcu

SEQ ID NO: 250971 - RNA, 64 nt, Homo Sapiens
aggacggucuacucagcacaacugacugcuucagugcugcuaucagaagaugucuucuaucuuu

SEQ ID NO: 250972 - RNA, 64 nt, Homo Sapiens
caauagccauaauuuuaccagccuuucugucauaugcugcuauuacaaaguggaagcuguugaa

SEQ ID NO: 250973 - RNA, 64 nt, Homo Sapiens
ugaguuccaugcucaagagcgagccagccauugaugcugcuacauuuauuuccaaauuguuaaa

SEQ ID NO: 250974 - RNA, 64 nt, Homo Sapiens
aggauaaguacucuguugcccuuggcuaccacugugcugcuaaucugucuugcagacagagacc

SEQ ID NO: 250975 - RNA, 64 nt, Homo Sapiens
aaacuaacacucccccuccuccaccccagccugcugcugcuacugcugcccgcugcugcucugu

SEQ ID NO: 250976 - RNA, 64 nt, Homo Sapiens
aagaagagagggcugggcggggaggagcugcuacugcugcuaccgaggcugugggccucauccu

SEQ ID NO: 250977 - RNA, 64 nt, Homo Sapiens
uuauacuggaaauuaacaggacaugaaauaauugugcugcuacaucuuguucuucuuaaaugug

SEQ ID NO: 250978 - RNA, 64 nt, Homo Sapiens
auuccaacacuaaauucuuagaaaagcugacauuugcugcuaucuggauuagggugggaucuuu

SEQ ID NO: 250979 - RNA, 64 nt, Homo Sapiens
gccagcgcagacucucaggggcuuccauaucagcugcugcuagcgaugacgccccagaaaugcu

SEQ ID NO: 250980 - RNA, 64 nt, Homo Sapiens
agaguccucaaaggguuaagugaagaugguaauuugcugcuaauaagaugacacguggugauug

SEQ ID NO: 250981 - RNA, 64 nt, Homo Sapiens
uuuaagucuuauuuuuacuguuuauauauuugaaugcugcuacaacagaugaucuucaucccug

SEQ ID NO: 250982 - RNA, 64 nt, Homo Sapiens
ugugcauuaauauuuucaauuuguuuaaccacuuugcugcuaagauuuugccgucccauuccca

SEQ ID NO: 250983 - RNA, 64 nt, Homo Sapiens
ccagccaccuccagacaccagugcgugcucccgaugcugcuauggaaggugcuacuugaccuaa

SEQ ID NO: 250984 - RNA, 64 nt, Homo Sapiens
aguguacaaugccuuugaugaacuguuuuguaagugcugcuauaucuauccauuuuuuaauaaa

SEQ ID NO: 250985 - RNA, 64 nt, Homo Sapiens
uuacaacaagcccuacaauuagagauugcugaacugcugcuaaagugauuuuuuuuuuauuuga

SEQ ID NO: 250986 - RNA, 64 nt, Homo Sapiens
ccuaacauuuuguucccauuaccagaagcaaagcugcugcuaacccaacaucuggcacauagga

SEQ ID NO: 250987 - RNA, 61 nt, Homo Sapiens
aggccaaaaauggugagcgaucauuuauuucaugauucaaccugauacauuuacauagugc

SEQ ID NO: 250988 - RNA, 61 nt, Homo Sapiens
gggguggugcuagaagacagacaucuguggaaugauucacauccucucaaguuaggaggau

SEQ ID NO: 250989 - RNA, 61 nt, Homo Sapiens
guaaccaacuuggaaagcuguauuuguucccaugauucagcaaacaaugaguaccuacugu

SEQ ID NO: 250990 - RNA, 61 nt, Homo Sapiens
augaacauuuugauacaaauuucaucauuuaaugauucaccaauuucuugcauuaauuuga

SEQ ID NO: 250991 - RNA, 61 nt, Homo Sapiens
uuuuuuuccuaaccuuuugcuauuauaaauaaugauucauuuuauaaccuuuuauauaggu

SEQ ID NO: 250992 - RNA, 61 nt, Homo Sapiens
uaaguaaagcacagucccuaggacauaguaaaugauucauauauccgaacuacuguuauaa

SEQ ID NO: 250993 - RNA, 61 nt, Homo Sapiens
aaaccaggauggaugccucacauagaucaugaugauucaauccaaaggcacuuugcagugc

SEQ ID NO: 250994 - RNA, 61 nt, Homo Sapiens
guuccuuauacucuauuauauaguguuauucaugauucagcugaucuuaacaaaauucgua

SEQ ID NO: 250995 - RNA, 61 nt, Homo Sapiens
guagcugagaauucaaaaacauccuugcagaaugauucaaaagacaaaagccaggcucaac

SEQ ID NO: 250996 - RNA, 61 nt, Homo Sapiens
uguuauaucugcauaugagugauaugugaucaugauucauuuugcagauuuacauuuugcu

SEQ ID NO: 250997 - RNA, 61 nt, Homo Sapiens
acuugggcugcuggugccuugagucccacagaugauucauuaggaaaagccagauauacca

SEQ ID NO: 250998 - RNA, 61 nt, Homo Sapiens
cuuacuucuacagguuccuugagcaccaaagaugauucauaacucuguauaggugacagcu

SEQ ID NO: 250999 - RNA, 61 nt, Homo Sapiens
accaagcccugguagggaagagguaagggggaugauucaccuccauauuuccuaagcaggu

SEQ ID NO: 251000 - RNA, 61 nt, Homo Sapiens
ucaucugaagagagacuuaagaugaaagcaaaugauucagcucccuuauacccccauuaaa

SEQ ID NO: 251001 - RNA, 61 nt, Homo Sapiens
auguuauucuagaauguuuucuuuccagaugaugauucagaagcuaauuuuaaaaaacggu

SEQ ID NO: 251002 - RNA, 61 nt, Homo Sapiens
ugaggcuaaguuuuggacuaccaaggaccagaugauucacauguaggaaacagccagaagc

SEQ ID NO: 251003 - RNA, 61 nt, Homo Sapiens
ugguaauccugaaucucuuuuaaacuauuauaugauucauaaugguucucaggaauuaaua

SEQ ID NO: 251004 - RNA, 61 nt, Homo Sapiens
gcuuaucgugucugggguucaccggaaauaaaugauucacuggaacaauucuacugucaaa

SEQ ID NO: 251005 - RNA, 61 nt, Homo Sapiens
auaagaaauaaaaauugggcaauaaaauaaaaugauucaguguuucuuuucuauauuguca

SEQ ID NO: 251006 - RNA, 61 nt, Homo Sapiens
gauacaaaugggcuucucucugcuuuucucaaugauucaggugacugucaguuguaucugu

SEQ ID NO: 251007 - RNA, 61 nt, Homo Sapiens
ccgaucuuggcuuucagucuuaaaguugcagaugauucaaagacuuauuucugcucuggaa

SEQ ID NO: 251008 - RNA, 61 nt, Homo Sapiens
ugaagauacaauuuuauuugauggcugagaaaugauucauucggacuaagcuguaauuaug

SEQ ID NO: 251009 - RNA, 61 nt, Homo Sapiens
gauggggacauggaaaugagggcacacacagaugauucaugggggaugauguggaaauagg

SEQ ID NO: 251010 - RNA, 61 nt, Homo Sapiens
guuuuuuuuacuugguuuguccaaagaauaaaugauucauguuaagugucuguguagacaa

SEQ ID NO: 251011 - RNA, 61 nt, Homo Sapiens
aacuucuuaccauauaaaaaaucuuaaaccuaugauucaguauguaugauuugugccacug

SEQ ID NO: 251012 - RNA, 61 nt, Homo Sapiens
gugguaacccaaauucauaaggaguaggaugaugauucaaacucuauaccaagauaugcua

SEQ ID NO: 251013 - RNA, 61 nt, Homo Sapiens
uuauacuuucucuuaguuaaagaauguuaacaugauucacauccuaacuuucuguuauuuu

SEQ ID NO: 251014 - RNA, 61 nt, Homo Sapiens
uuggaggaagcuggggaaagguucuuagaagaugauucacccugcagggcuggaggaacag

SEQ ID NO: 251015 - RNA, 61 nt, Homo Sapiens
gaauuuaguaacagaaucaauugauuaaauaaugauucacauuuucuaaucuuuaguagau

SEQ ID NO: 251016 - RNA, 61 nt, Homo Sapiens
gucugaaguggugccccaggauaccagaaagaugauucagaccaugacccagccacaguca

SEQ ID NO: 251017 - RNA, 61 nt, Homo Sapiens
cauagaugacuggauuccuguggagagauguaugauucaaacacucagaugaccugaguug

SEQ ID NO: 251018 - RNA, 61 nt, Homo Sapiens
uaucucccaccagguuccucgaaacaacuccaugauucaguaccaugagaacaguaugggg

SEQ ID NO: 251019 - RNA, 61 nt, Homo Sapiens
ggcaugggaagaccaaaaccuucucugccugaugauucaaacuaucaauagaguaaccuca

SEQ ID NO: 251020 - RNA, 61 nt, Homo Sapiens
ugauaccuuuguugaaagaauugugaauagcaugauucauuucuagcagaggcugaguuua

SEQ ID NO: 251021 - RNA, 61 nt, Homo Sapiens
uuuaaagagauugugucuguuuaaaaucaguaugauucagagaaggaccaaauuauaugaa

SEQ ID NO: 251022 - RNA, 61 nt, Homo Sapiens
ugcaggcugucacaugacucauugaguaguaaugauucagaagaaaaagaaaaaggagacu

SEQ ID NO: 251023 - RNA, 61 nt, Homo Sapiens
uaaaacugacauaaaauuuuaugauaauaacaugauucaagaaaugugauguagauuuuug

SEQ ID NO: 251024 - RNA, 61 nt, Homo Sapiens
uuggcuucuggucuugauguauuugauaagaaugauucauuuucugauauggcuuccuaau

SEQ ID NO: 251025 - RNA, 61 nt, Homo Sapiens
agguugaauaugguaggucuuugaaaauaugaugauucaauuuucucaauuuucuuugcuu

SEQ ID NO: 251026 - RNA, 61 nt, Homo Sapiens
gucauagaggaaaagcacagauuauaccuggaugauucaggagcacauucugauuccaggu

SEQ ID NO: 251027 - RNA, 61 nt, Homo Sapiens
ugaauguauuguucuguuuguguuauuucagaugauucaaauaucaaaaggaagauucuuc
